United States Patent 7,691,997 (FUNCTIONAL AND HYPERFUNCTIONAL SIRNA) - sequence listing, part 25

SEQ ID NO: 1006975 - RNA, 19 nt, Homo sapiens
ugaaagucaucgacaagac

SEQ ID NO: 1006976 - RNA, 19 nt, Homo sapiens
gcauauguggcuaaagcaa

SEQ ID NO: 1006977 - RNA, 19 nt, Homo sapiens
ggagacgacaguggacuug

SEQ ID NO: 1006978 - RNA, 19 nt, Homo sapiens
ugggccaccuccucaauug

SEQ ID NO: 1006979 - RNA, 19 nt, Homo sapiens
gauguauguuacuucuuag

SEQ ID NO: 1006980 - RNA, 19 nt, Homo sapiens
ccaaauguuuuaggaugua

SEQ ID NO: 1006981 - RNA, 19 nt, Homo sapiens
gaauggguggcgguaauug

SEQ ID NO: 1006982 - RNA, 19 nt, Homo sapiens
gguucaaaguguugguaau

SEQ ID NO: 1006983 - RNA, 19 nt, Homo sapiens
uaagagaacuccagauuug

SEQ ID NO: 1006984 - RNA, 19 nt, Homo sapiens
ugggauagauuccaaauaa

SEQ ID NO: 1006985 - RNA, 19 nt, Homo sapiens
gaauguagcucggaggauu

SEQ ID NO: 1006986 - RNA, 19 nt, Homo sapiens
gaauggaacccuugcuaua

SEQ ID NO: 1006987 - RNA, 19 nt, Homo sapiens
gaaaggaagaucuaaauca

SEQ ID NO: 1006988 - RNA, 19 nt, Homo sapiens
gaugagagcccuccugauu

SEQ ID NO: 1006989 - RNA, 19 nt, Homo sapiens
ggaaagcgauggagaagag

SEQ ID NO: 1006990 - RNA, 19 nt, Homo sapiens
ccaaugaacuuuagagagu

SEQ ID NO: 1006991 - RNA, 19 nt, Homo sapiens
ggcagaagcuccuuuagau

SEQ ID NO: 1006992 - RNA, 19 nt, Homo sapiens
uaaguaaucuccuguccuu

SEQ ID NO: 1006993 - RNA, 19 nt, Homo sapiens
uaacuuggaucuaucaaca

SEQ ID NO: 1006994 - RNA, 19 nt, Homo sapiens
guaagaagaagaagaagaa

SEQ ID NO: 1006995 - RNA, 19 nt, Homo sapiens
ggaguaagaagaagaagaa

SEQ ID NO: 1006996 - RNA, 19 nt, Homo sapiens
gaaugaagaagcagucaaa

SEQ ID NO: 1006997 - RNA, 19 nt, Homo sapiens
ggaguuggucuacauagua

SEQ ID NO: 1006998 - RNA, 19 nt, Homo sapiens
uaagaucauucggcaguua

SEQ ID NO: 1006999 - RNA, 19 nt, Homo sapiens
gacaagaugacauagauuu

SEQ ID NO: 1007000 - RNA, 19 nt, Homo sapiens
uuagagaguucuugcauug

SEQ ID NO: 1007001 - RNA, 19 nt, Homo sapiens
gaagaaauccaggagaaug

SEQ ID NO: 1007002 - RNA, 19 nt, Homo sapiens
gggauagauuccaaauaaa

SEQ ID NO: 1007003 - RNA, 19 nt, Homo sapiens
ggugggagcugccauuaag

SEQ ID NO: 1007004 - RNA, 19 nt, Homo sapiens
cagaagcuccuuuagauug

SEQ ID NO: 1007005 - RNA, 19 nt, Homo sapiens
ggauugaauuucgaaagaa

SEQ ID NO: 1007006 - RNA, 19 nt, Homo sapiens
cuagagaguguuaagaaua

SEQ ID NO: 1007007 - RNA, 19 nt, Homo sapiens
ggaugucuuucuuuaccua

SEQ ID NO: 1007008 - RNA, 19 nt, Homo sapiens
gcagcuccauguccuucua

SEQ ID NO: 1007009 - RNA, 19 nt, Homo sapiens
uuggaucuaucaacaguua

SEQ ID NO: 1007010 - RNA, 19 nt, Homo sapiens
gcagaagcuccuuuagauu

SEQ ID NO: 1007011 - RNA, 19 nt, Homo sapiens
ugccggaugucuuucuuua

SEQ ID NO: 1007012 - RNA, 19 nt, Homo sapiens
ccagugagcucugauuucu

SEQ ID NO: 1007013 - RNA, 19 nt, Homo sapiens
gacaggaguuggucuacau

SEQ ID NO: 1007014 - RNA, 19 nt, Homo sapiens
aagaguaugugaaggaaga

SEQ ID NO: 1007015 - RNA, 19 nt, Homo sapiens
ccacuuuguuguguuguuu

SEQ ID NO: 1007016 - RNA, 19 nt, Homo sapiens
gugacaaagugaaaggaaa

SEQ ID NO: 1007017 - RNA, 19 nt, Homo sapiens
ggaauggaacccuugcuau

SEQ ID NO: 1007018 - RNA, 19 nt, Homo sapiens
gguaacgccuuguggaaag

SEQ ID NO: 1007019 - RNA, 19 nt, Homo sapiens
ggauagauuccaaauaaag

SEQ ID NO: 1007020 - RNA, 19 nt, Homo sapiens
cauuggaacuggcacuuau

SEQ ID NO: 1007021 - RNA, 19 nt, Homo sapiens
aaaggaagaucuaaaucag

SEQ ID NO: 1007022 - RNA, 19 nt, Homo sapiens
gaccaucgcugcuguugcu

SEQ ID NO: 1007023 - RNA, 19 nt, Homo sapiens
aggaagaaauccaggagaa

SEQ ID NO: 1007024 - RNA, 19 nt, Homo sapiens
aauaagagaacuccagauu

SEQ ID NO: 1007025 - RNA, 19 nt, Homo sapiens
cccaaacccuugucauuuc

SEQ ID NO: 1007026 - RNA, 19 nt, Homo sapiens
ccgacaagaugacauagau

SEQ ID NO: 1007027 - RNA, 19 nt, Homo sapiens
gagcugccauuaagaucau

SEQ ID NO: 1007028 - RNA, 19 nt, Homo sapiens
cagaaacacagccugauga

SEQ ID NO: 1007029 - RNA, 19 nt, Homo sapiens
gcauuggaacuggcacuua

SEQ ID NO: 1007030 - RNA, 19 nt, Homo sapiens
gagaguucuugcauuggaa

SEQ ID NO: 1007031 - RNA, 19 nt, Homo sapiens
ggaagccacccgggaguuu

SEQ ID NO: 1007032 - RNA, 19 nt, Homo sapiens
gaaucuagaaauaggagaa

SEQ ID NO: 1007033 - RNA, 19 nt, Homo sapiens
ugagagcccuccugauuuu

SEQ ID NO: 1007034 - RNA, 19 nt, Homo sapiens
uuacagcuguccuugaaca

SEQ ID NO: 1007035 - RNA, 19 nt, Homo sapiens
aggauugaauuucgaaaga

SEQ ID NO: 1007036 - RNA, 19 nt, Homo sapiens
uggaacccuugcuauagua

SEQ ID NO: 1007037 - RNA, 19 nt, Homo sapiens
caugguaggugaggugguu

SEQ ID NO: 1007038 - RNA, 19 nt, Homo sapiens
ccaggagaaugaagaagca

SEQ ID NO: 1007039 - RNA, 19 nt, Homo sapiens
ccagcuccgucacagguaa

SEQ ID NO: 1007040 - RNA, 19 nt, Homo sapiens
guaaucuccuguccuuugg

SEQ ID NO: 1007041 - RNA, 19 nt, Homo sapiens
uaguagugauccauuguug

SEQ ID NO: 1007042 - RNA, 19 nt, Homo sapiens
agagaguucuugcauugga

SEQ ID NO: 1007043 - RNA, 19 nt, Homo sapiens
uuacacaggccuuccuaaa

SEQ ID NO: 1007044 - RNA, 19 nt, Homo sapiens
gaggugggagcugccauua

SEQ ID NO: 1007045 - RNA, 19 nt, Homo sapiens
cagauuugccugaagaaga

SEQ ID NO: 1007046 - RNA, 19 nt, Homo sapiens
agucaagucugccggaugu

SEQ ID NO: 1007047 - RNA, 19 nt, Homo sapiens
uggcggaggcgauggauuu

SEQ ID NO: 1007048 - RNA, 19 nt, Homo sapiens
ggaagaaauccaggagaau

SEQ ID NO: 1007049 - RNA, 19 nt, Homo sapiens
gaaccacagaauaagagaa

SEQ ID NO: 1007050 - RNA, 19 nt, Homo sapiens
ggauugacuccacuuuguu

SEQ ID NO: 1007051 - RNA, 19 nt, Homo sapiens
ugaagaagaguaugugaag

SEQ ID NO: 1007052 - RNA, 19 nt, Homo sapiens
ugacuccacuuuguugugu

SEQ ID NO: 1007053 - RNA, 19 nt, Homo sapiens
ucuagagaguguuaagaau

SEQ ID NO: 1007054 - RNA, 19 nt, Homo sapiens
agugagcucugauuucuag

SEQ ID NO: 1007055 - RNA, 19 nt, Homo sapiens
ucaauguguuuaugaaagg

SEQ ID NO: 1007056 - RNA, 19 nt, Homo sapiens
agaagaguaugugaaggaa

SEQ ID NO: 1007057 - RNA, 19 nt, Homo sapiens
gaaggaccgcuaccucaag

SEQ ID NO: 1007058 - RNA, 19 nt, Homo sapiens
gauugacuccacuuuguug

SEQ ID NO: 1007059 - RNA, 19 nt, Homo sapiens
ucaggcagcauaaguaauc

SEQ ID NO: 1007060 - RNA, 19 nt, Homo sapiens
ugacaaagugaaaggaaau

SEQ ID NO: 1007061 - RNA, 19 nt, Homo sapiens
gaccaaugaacuuuagaga

SEQ ID NO: 1007062 - RNA, 19 nt, Homo sapiens
ggagcugccauuaagauca

SEQ ID NO: 1007063 - RNA, 19 nt, Homo sapiens
uaacuaugugugaugauga

SEQ ID NO: 1007064 - RNA, 19 nt, Homo sapiens
auaagagaacuccagauuu

SEQ ID NO: 1007065 - RNA, 19 nt, Homo sapiens
acauaguagugauccauug

SEQ ID NO: 1007066 - RNA, 19 nt, Homo sapiens
gaugacauagauuugcaaa

SEQ ID NO: 1007067 - RNA, 19 nt, Homo sapiens
gaggaagacucagaaacac

SEQ ID NO: 1007068 - RNA, 19 nt, Homo sapiens
ugaguauuguuugugcuaa

SEQ ID NO: 1007069 - RNA, 19 nt, Homo sapiens
gagcucugauuucuagacu

SEQ ID NO: 1007070 - RNA, 19 nt, Homo sapiens
ucgcugcuguugcucugua

SEQ ID NO: 1007071 - RNA, 19 nt, Homo sapiens
aagaaauccaggagaauga

SEQ ID NO: 1007072 - RNA, 19 nt, Homo sapiens
guuacuugguuaauguguu

SEQ ID NO: 1007073 - RNA, 19 nt, Homo sapiens
gcgcacacaacucuagaga

SEQ ID NO: 1007074 - RNA, 19 nt, Homo sapiens
ggaggcauaggccauuuca

SEQ ID NO: 1007075 - RNA, 19 nt, Homo sapiens
gcacuuauuuucugaccau

SEQ ID NO: 1007076 - RNA, 19 nt, Homo sapiens
gcaagauaaugagaaaaga

SEQ ID NO: 1007077 - RNA, 19 nt, Homo sapiens
cagagaggcauuggucaaa

SEQ ID NO: 1007078 - RNA, 19 nt, Homo sapiens
uggcagaagcuccuuuaga

SEQ ID NO: 1007079 - RNA, 19 nt, Homo sapiens
ggccauuucaggcagcaua

SEQ ID NO: 1007080 - RNA, 19 nt, Homo sapiens
auuuacagcuguccuugaa

SEQ ID NO: 1007081 - RNA, 19 nt, Homo sapiens
ccagagaggcauuggucaa

SEQ ID NO: 1007082 - RNA, 19 nt, Homo sapiens
cgacaagaugacauagauu

SEQ ID NO: 1007083 - RNA, 19 nt, Homo sapiens
gaagaaguaugaaacagaa

SEQ ID NO: 1007084 - RNA, 19 nt, Homo sapiens
gaaggagggucuuuauuau

SEQ ID NO: 1007085 - RNA, 19 nt, Homo sapiens
gaagaaagaaccuaugaaa

SEQ ID NO: 1007086 - RNA, 19 nt, Homo sapiens
ccaauccucuggcuauuua

SEQ ID NO: 1007087 - RNA, 19 nt, Homo sapiens
gcacugcuuucauuuaauu

SEQ ID NO: 1007088 - RNA, 19 nt, Homo sapiens
gaaaugggacgauucagua

SEQ ID NO: 1007089 - RNA, 19 nt, Homo sapiens
gagaauggacaaacucuua

SEQ ID NO: 1007090 - RNA, 19 nt, Homo sapiens
gaaagaaccuaugaaaucu

SEQ ID NO: 1007091 - RNA, 19 nt, Homo sapiens
gaacugauauucuucuucu

SEQ ID NO: 1007092 - RNA, 19 nt, Homo sapiens
ugagcagucuucaguauua

SEQ ID NO: 1007093 - RNA, 19 nt, Homo sapiens
gcacuggacugucaucuca

SEQ ID NO: 1007094 - RNA, 19 nt, Homo sapiens
ugaaggagggucuuuauua

SEQ ID NO: 1007095 - RNA, 19 nt, Homo sapiens
ggaagcaaauaauggaauu

SEQ ID NO: 1007096 - RNA, 19 nt, Homo sapiens
ggaagauaaugcagauauu

SEQ ID NO: 1007097 - RNA, 19 nt, Homo sapiens
cagaauugcuucauaccua

SEQ ID NO: 1007098 - RNA, 19 nt, Homo sapiens
guagaagaaugaugaaugu

SEQ ID NO: 1007099 - RNA, 19 nt, Homo sapiens
gacaauguauggcuuaguu

SEQ ID NO: 1007100 - RNA, 19 nt, Homo sapiens
caugaaaucuugguacaaa

SEQ ID NO: 1007101 - RNA, 19 nt, Homo sapiens
gaaccuggguguauuaacu

SEQ ID NO: 1007102 - RNA, 19 nt, Homo sapiens
caucaggcauaaugucuaa

SEQ ID NO: 1007103 - RNA, 19 nt, Homo sapiens
uggacaaacucuuaacuuu

SEQ ID NO: 1007104 - RNA, 19 nt, Homo sapiens
gaagacgucugcgugagaa

SEQ ID NO: 1007105 - RNA, 19 nt, Homo sapiens
gagagaaacccacugaaga

SEQ ID NO: 1007106 - RNA, 19 nt, Homo sapiens
ugaaaccguugguccauuu

SEQ ID NO: 1007107 - RNA, 19 nt, Homo sapiens
gaaggaagcaaauaaugga

SEQ ID NO: 1007108 - RNA, 19 nt, Homo sapiens
caacguagaauuacuuguu

SEQ ID NO: 1007109 - RNA, 19 nt, Homo sapiens
gaacgggaacuauuugguu

SEQ ID NO: 1007110 - RNA, 19 nt, Homo sapiens
gaaccucaccucuaguuga

SEQ ID NO: 1007111 - RNA, 19 nt, Homo sapiens
cuacggcacugcuuucauu

SEQ ID NO: 1007112 - RNA, 19 nt, Homo sapiens
guuacgcauucuuguauua

SEQ ID NO: 1007113 - RNA, 19 nt, Homo sapiens
ugaauuaggagcauaguuu

SEQ ID NO: 1007114 - RNA, 19 nt, Homo sapiens
gcaaauaauggaauuguca

SEQ ID NO: 1007115 - RNA, 19 nt, Homo sapiens
gugaauuacuugacaaugu

SEQ ID NO: 1007116 - RNA, 19 nt, Homo sapiens
agaaagaaccuaugaaauc

SEQ ID NO: 1007117 - RNA, 19 nt, Homo sapiens
guaccugcuuugucacaua

SEQ ID NO: 1007118 - RNA, 19 nt, Homo sapiens
cggcacugcuuucauuuaa

SEQ ID NO: 1007119 - RNA, 19 nt, Homo sapiens
uaagagcacauuuaucgua

SEQ ID NO: 1007120 - RNA, 19 nt, Homo sapiens
gauauaaggcauuuggauu

SEQ ID NO: 1007121 - RNA, 19 nt, Homo sapiens
aaagagugcuacaccguuu

SEQ ID NO: 1007122 - RNA, 19 nt, Homo sapiens
caagaguuguuucuacaga

SEQ ID NO: 1007123 - RNA, 19 nt, Homo sapiens
ucaaguuggugaagaaaga

SEQ ID NO: 1007124 - RNA, 19 nt, Homo sapiens
caagcuaccucuucauagu

SEQ ID NO: 1007125 - RNA, 19 nt, Homo sapiens
gaagaagaaguaugaaaca

SEQ ID NO: 1007126 - RNA, 19 nt, Homo sapiens
gaucuaguguaauggaaga

SEQ ID NO: 1007127 - RNA, 19 nt, Homo sapiens
gcaucugucuccaguguug

SEQ ID NO: 1007128 - RNA, 19 nt, Homo sapiens
gcaucuggaucaauuacaa

SEQ ID NO: 1007129 - RNA, 19 nt, Homo sapiens
aagaguugcugacuuugua

SEQ ID NO: 1007130 - RNA, 19 nt, Homo sapiens
gaagcacucuuuuacuuuu

SEQ ID NO: 1007131 - RNA, 19 nt, Homo sapiens
gagggucuuuauuauauga

SEQ ID NO: 1007132 - RNA, 19 nt, Homo sapiens
uaucguacgucacagugua

SEQ ID NO: 1007133 - RNA, 19 nt, Homo sapiens
ggaaccauuugaugugaga

SEQ ID NO: 1007134 - RNA, 19 nt, Homo sapiens
uuagggauaucuuugguuu

SEQ ID NO: 1007135 - RNA, 19 nt, Homo sapiens
ccaauuuacuugucaucuu

SEQ ID NO: 1007136 - RNA, 19 nt, Homo sapiens
gagucagaauugcuucaua

SEQ ID NO: 1007137 - RNA, 19 nt, Homo sapiens
uaaagacccuuauggaacu

SEQ ID NO: 1007138 - RNA, 19 nt, Homo sapiens
cauuuaaacgucaccauua

SEQ ID NO: 1007139 - RNA, 19 nt, Homo sapiens
gacaguaccaguaguuauu

SEQ ID NO: 1007140 - RNA, 19 nt, Homo sapiens
cuucauaccuacucuucua

SEQ ID NO: 1007141 - RNA, 19 nt, Homo sapiens
ccaguggccuuuccuuguu

SEQ ID NO: 1007142 - RNA, 19 nt, Homo sapiens
ugaaauaugaguugccuuu

SEQ ID NO: 1007143 - RNA, 19 nt, Homo sapiens
gcagaacauuggagcuaug

SEQ ID NO: 1007144 - RNA, 19 nt, Homo sapiens
gcauuuggauuaguuggaa

SEQ ID NO: 1007145 - RNA, 19 nt, Homo sapiens
uaaggcauuuggauuaguu

SEQ ID NO: 1007146 - RNA, 19 nt, Homo sapiens
gaaaggcagugggaagaca

SEQ ID NO: 1007147 - RNA, 19 nt, Homo sapiens
ggacugucaucucauucuu

SEQ ID NO: 1007148 - RNA, 19 nt, Homo sapiens
cuacuggaagugugaauua

SEQ ID NO: 1007149 - RNA, 19 nt, Homo sapiens
aggagggucuuuauuauau

SEQ ID NO: 1007150 - RNA, 19 nt, Homo sapiens
gagcagucuucaguauuaa

SEQ ID NO: 1007151 - RNA, 19 nt, Homo sapiens
uuagaacgccuuuccagua

SEQ ID NO: 1007152 - RNA, 19 nt, Homo sapiens
uaccuacucuucuaucuug

SEQ ID NO: 1007153 - RNA, 19 nt, Homo sapiens
uuacgaacauguugaguca

SEQ ID NO: 1007154 - RNA, 19 nt, Homo sapiens
gaccgcagccguagaagaa

SEQ ID NO: 1007155 - RNA, 19 nt, Homo sapiens
gaaaagccauuaugcagau

SEQ ID NO: 1007156 - RNA, 19 nt, Homo sapiens
gaagacagcagcagcuaca

SEQ ID NO: 1007157 - RNA, 19 nt, Homo sapiens
acaccuauguuugauauga

SEQ ID NO: 1007158 - RNA, 19 nt, Homo sapiens
gcauuuaccaauuuacuug

SEQ ID NO: 1007159 - RNA, 19 nt, Homo sapiens
acaauaaacaccaccuuaa

SEQ ID NO: 1007160 - RNA, 19 nt, Homo sapiens
caacagcgacuucaacuac

SEQ ID NO: 1007161 - RNA, 19 nt, Homo sapiens
aaugugaucuaguguaaug

SEQ ID NO: 1007162 - RNA, 19 nt, Homo sapiens
aaugugaucuaguguaaug

SEQ ID NO: 1007163 - RNA, 19 nt, Homo sapiens
ucaucuggcuguaagguuu

SEQ ID NO: 1007164 - RNA, 19 nt, Homo sapiens
cacaguguauggugaauau

SEQ ID NO: 1007165 - RNA, 19 nt, Homo sapiens
ugucaacccuuccauuuca

SEQ ID NO: 1007166 - RNA, 19 nt, Homo sapiens
ggaagaagaaguaugaaac

SEQ ID NO: 1007167 - RNA, 19 nt, Homo sapiens
acaauuugguucauucaga

SEQ ID NO: 1007168 - RNA, 19 nt, Homo sapiens
uaagggaagugacaauuuu

SEQ ID NO: 1007169 - RNA, 19 nt, Homo sapiens
ccuaugaaaucuguacaaa

SEQ ID NO: 1007170 - RNA, 19 nt, Homo sapiens
gaacgccuuuccaguacug

SEQ ID NO: 1007171 - RNA, 19 nt, Homo sapiens
gugucuaucuuggcauuua

SEQ ID NO: 1007172 - RNA, 19 nt, Homo sapiens
ggguucaaguguauauauu

SEQ ID NO: 1007173 - RNA, 19 nt, Homo sapiens
gguuugcccuugaacuaaa

SEQ ID NO: 1007174 - RNA, 19 nt, Homo sapiens
aaacgucaccauuacuuaa

SEQ ID NO: 1007175 - RNA, 19 nt, Homo sapiens
uaaacgucaccauuacuua

SEQ ID NO: 1007176 - RNA, 19 nt, Homo sapiens
gauauucuucuucucauug

SEQ ID NO: 1007177 - RNA, 19 nt, Homo sapiens
gaagacugccaaugaagga

SEQ ID NO: 1007178 - RNA, 19 nt, Homo sapiens
ggagcuaucuugucuaccu

SEQ ID NO: 1007179 - RNA, 19 nt, Homo sapiens
ggaauaccaagaguuguuu

SEQ ID NO: 1007180 - RNA, 19 nt, Homo sapiens
guacaacguagaauuacuu

SEQ ID NO: 1007181 - RNA, 19 nt, Homo sapiens
ucagaagcaguuaucaaua

SEQ ID NO: 1007182 - RNA, 19 nt, Homo sapiens
ggaagcauggccuugauug

SEQ ID NO: 1007183 - RNA, 19 nt, Homo sapiens
gaacaaacccuuuaaaugg

SEQ ID NO: 1007184 - RNA, 19 nt, Homo sapiens
gcacaaacauagacagaug

SEQ ID NO: 1007185 - RNA, 19 nt, Homo sapiens
gcacugacuuugacuauuc

SEQ ID NO: 1007186 - RNA, 19 nt, Homo sapiens
gaaaugcuaucagaaauuc

SEQ ID NO: 1007187 - RNA, 19 nt, Homo sapiens
gcagaugaguccucgguaa

SEQ ID NO: 1007188 - RNA, 19 nt, Homo sapiens
gaaguggccugguccaaau

SEQ ID NO: 1007189 - RNA, 19 nt, Homo sapiens
gaaacagauuuaagcaaga

SEQ ID NO: 1007190 - RNA, 19 nt, Homo sapiens
gggcgagggucucaaguuu

SEQ ID NO: 1007191 - RNA, 19 nt, Homo sapiens
gaagccagcucccugaauc

SEQ ID NO: 1007192 - RNA, 19 nt, Homo sapiens
ugacuacuccacugaauua

SEQ ID NO: 1007193 - RNA, 19 nt, Homo sapiens
ggagaacccucgugacuac

SEQ ID NO: 1007194 - RNA, 19 nt, Homo sapiens
gaaacagggcgaggacuua

SEQ ID NO: 1007195 - RNA, 19 nt, Homo sapiens
caaaguggcucugcucugu

SEQ ID NO: 1007196 - RNA, 19 nt, Homo sapiens
ggaaaugcuaucagaaauu

SEQ ID NO: 1007197 - RNA, 19 nt, Homo sapiens
gcucagugcugucgucaug

SEQ ID NO: 1007198 - RNA, 19 nt, Homo sapiens
gaaggucucucuggcucua

SEQ ID NO: 1007199 - RNA, 19 nt, Homo sapiens
gaaguaaaccugaacaaac

SEQ ID NO: 1007200 - RNA, 19 nt, Homo sapiens
gggaaaugcuaucagaaau

SEQ ID NO: 1007201 - RNA, 19 nt, Homo sapiens
ggaaguaaaccugaacaaa

SEQ ID NO: 1007202 - RNA, 19 nt, Homo sapiens
aaacacaaauacggaagua

SEQ ID NO: 1007203 - RNA, 19 nt, Homo sapiens
gaugaaguacccuauguuu

SEQ ID NO: 1007204 - RNA, 19 nt, Homo sapiens
gagaccagcucuaccuuca

SEQ ID NO: 1007205 - RNA, 19 nt, Homo sapiens
gaagggacaggcaacauga

SEQ ID NO: 1007206 - RNA, 19 nt, Homo sapiens
ggacaggcaacaugauuga

SEQ ID NO: 1007207 - RNA, 19 nt, Homo sapiens
ggaagccacaucacuauug

SEQ ID NO: 1007208 - RNA, 19 nt, Homo sapiens
gcgagggucucaaguuugu

SEQ ID NO: 1007209 - RNA, 19 nt, Homo sapiens
ugaacaaacccuuuaaaug

SEQ ID NO: 1007210 - RNA, 19 nt, Homo sapiens
gggaugaaguacccuaugu

SEQ ID NO: 1007211 - RNA, 19 nt, Homo sapiens
gcgaggacuuagcggauaa

SEQ ID NO: 1007212 - RNA, 19 nt, Homo sapiens
gaaggaaacagauuuaagc

SEQ ID NO: 1007213 - RNA, 19 nt, Homo sapiens
ggaaguggccugguccaaa

SEQ ID NO: 1007214 - RNA, 19 nt, Homo sapiens
gugcuagguuuccugagua

SEQ ID NO: 1007215 - RNA, 19 nt, Homo sapiens
gauugauggugaugucauu

SEQ ID NO: 1007216 - RNA, 19 nt, Homo sapiens
gaagccacaucacuauugg

SEQ ID NO: 1007217 - RNA, 19 nt, Homo sapiens
acacaaauacggaaguaaa

SEQ ID NO: 1007218 - RNA, 19 nt, Homo sapiens
gaacacaugcacacacaca

SEQ ID NO: 1007219 - RNA, 19 nt, Homo sapiens
acuauuccgucuccaauuu

SEQ ID NO: 1007220 - RNA, 19 nt, Homo sapiens
ccacggaggcucuuacaug

SEQ ID NO: 1007221 - RNA, 19 nt, Homo sapiens
ggacuuagcggauaaugac

SEQ ID NO: 1007222 - RNA, 19 nt, Homo sapiens
gaacugcaccaccgaccaa

SEQ ID NO: 1007223 - RNA, 19 nt, Homo sapiens
gaccagcucuaccuucaca

SEQ ID NO: 1007224 - RNA, 19 nt, Homo sapiens
cuacuccacugaauuaagu

SEQ ID NO: 1007225 - RNA, 19 nt, Homo sapiens
ccagagagccaucauccaa

SEQ ID NO: 1007226 - RNA, 19 nt, Homo sapiens
ggaagggacaggcaacaug

SEQ ID NO: 1007227 - RNA, 19 nt, Homo sapiens
ggaaggaaacagauuuaag

SEQ ID NO: 1007228 - RNA, 19 nt, Homo sapiens
ucaaguucauguauacaga

SEQ ID NO: 1007229 - RNA, 19 nt, Homo sapiens
caaagugggcuguaaugug

SEQ ID NO: 1007230 - RNA, 19 nt, Homo sapiens
cggaggcucuuacauggaa

SEQ ID NO: 1007231 - RNA, 19 nt, Homo sapiens
ugaacaacguacuauggaa

SEQ ID NO: 1007232 - RNA, 19 nt, Homo sapiens
caggaaggaaacagauuua

SEQ ID NO: 1007233 - RNA, 19 nt, Homo sapiens
gagagaccaucaaguucau

SEQ ID NO: 1007234 - RNA, 19 nt, Homo sapiens
cagacaaagugggcuguaa

SEQ ID NO: 1007235 - RNA, 19 nt, Homo sapiens
uggauaucgucgcuacuua

SEQ ID NO: 1007236 - RNA, 19 nt, Homo sapiens
ccaggaaggaaacagauuu

SEQ ID NO: 1007237 - RNA, 19 nt, Homo sapiens
guaaaccgaggacccauga

SEQ ID NO: 1007238 - RNA, 19 nt, Homo sapiens
ggcgaggacuuagcggaua

SEQ ID NO: 1007239 - RNA, 19 nt, Homo sapiens
uaucgucgcuacuuacauc

SEQ ID NO: 1007240 - RNA, 19 nt, Homo sapiens
acacacacacacacauaua

SEQ ID NO: 1007241 - RNA, 19 nt, Homo sapiens
ugguagggcugcagacauu

SEQ ID NO: 1007242 - RNA, 19 nt, Homo sapiens
gaccuuagauuuggugaac

SEQ ID NO: 1007243 - RNA, 19 nt, Homo sapiens
gcuaaggggugcccgagua

SEQ ID NO: 1007244 - RNA, 19 nt, Homo sapiens
acacacacacacacacaua

SEQ ID NO: 1007245 - RNA, 19 nt, Homo sapiens
gaccugcucucuacauugc

SEQ ID NO: 1007246 - RNA, 19 nt, Homo sapiens
caaggguccgagaucauua

SEQ ID NO: 1007247 - RNA, 19 nt, Homo sapiens
ggaccaacuuugccaagac

SEQ ID NO: 1007248 - RNA, 19 nt, Homo sapiens
gcaacuaugggcuccuuga

SEQ ID NO: 1007249 - RNA, 19 nt, Homo sapiens
ccaaaggccaacagcauug

SEQ ID NO: 1007250 - RNA, 19 nt, Homo sapiens
ucacugcauugcccgacua

SEQ ID NO: 1007251 - RNA, 19 nt, Homo sapiens
ccaaguucauucacaccaa

SEQ ID NO: 1007252 - RNA, 19 nt, Homo sapiens
gaccaucaaguucauguau

SEQ ID NO: 1007253 - RNA, 19 nt, Homo sapiens
cgagagaccaucaaguuca

SEQ ID NO: 1007254 - RNA, 19 nt, Homo sapiens
gaacuaccaaccagugaag

SEQ ID NO: 1007255 - RNA, 19 nt, Homo sapiens
ccgaccaacuccagacuug

SEQ ID NO: 1007256 - RNA, 19 nt, Homo sapiens
ccaucaaguucauguauac

SEQ ID NO: 1007257 - RNA, 19 nt, Homo sapiens
cuaaacccgucauggucua

SEQ ID NO: 1007258 - RNA, 19 nt, Homo sapiens
uauggaagccacaucacua

SEQ ID NO: 1007259 - RNA, 19 nt, Homo sapiens
aaaccgaggacccaugaaa

SEQ ID NO: 1007260 - RNA, 19 nt, Homo sapiens
gcacacacacacacacaca

SEQ ID NO: 1007261 - RNA, 19 nt, Homo sapiens
gccgcaggguucaacagua

SEQ ID NO: 1007262 - RNA, 19 nt, Homo sapiens
uauacaaccugcaugacau

SEQ ID NO: 1007263 - RNA, 19 nt, Homo sapiens
ggguuggagugcuagguuu

SEQ ID NO: 1007264 - RNA, 19 nt, Homo sapiens
gacaaagugggcuguaaug

SEQ ID NO: 1007265 - RNA, 19 nt, Homo sapiens
cagaugaguccucgguaaa

SEQ ID NO: 1007266 - RNA, 19 nt, Homo sapiens
ccaaggguccgagaucauu

SEQ ID NO: 1007267 - RNA, 19 nt, Homo sapiens
ggaugaaguacccuauguu

SEQ ID NO: 1007268 - RNA, 19 nt, Homo sapiens
ggucuuguuuuguugauuu

SEQ ID NO: 1007269 - RNA, 19 nt, Homo sapiens
acccacagcucccacauca

SEQ ID NO: 1007270 - RNA, 19 nt, Homo sapiens
caccaaggccaaccgcuuu

SEQ ID NO: 1007271 - RNA, 19 nt, Homo sapiens
ccggaacgccacacacuuu

SEQ ID NO: 1007272 - RNA, 19 nt, Homo sapiens
gacaccaaguucauucaca

SEQ ID NO: 1007273 - RNA, 19 nt, Homo sapiens
ggugaugucauuccugaug

SEQ ID NO: 1007274 - RNA, 19 nt, Homo sapiens
ccuuagauuuggugaacaa

SEQ ID NO: 1007275 - RNA, 19 nt, Homo sapiens
accaucaaguucauguaua

SEQ ID NO: 1007276 - RNA, 19 nt, Homo sapiens
gggcaacuaugggcuccuu

SEQ ID NO: 1007277 - RNA, 19 nt, Homo sapiens
cugguucacugccaacuug

SEQ ID NO: 1007278 - RNA, 19 nt, Homo sapiens
cccaacaccaucacuauga

SEQ ID NO: 1007279 - RNA, 19 nt, Homo sapiens
agagagccaucauccaaag

SEQ ID NO: 1007280 - RNA, 19 nt, Homo sapiens
auacggaaguaaaccugaa

SEQ ID NO: 1007281 - RNA, 19 nt, Homo sapiens
cuacuucuacgccuucuau

SEQ ID NO: 1007282 - RNA, 19 nt, Homo sapiens
aaacacugguggcacucuu

SEQ ID NO: 1007283 - RNA, 19 nt, Homo sapiens
ggagaugucuggcucugua

SEQ ID NO: 1007284 - RNA, 19 nt, Homo sapiens
acacggaucuguacaauug

SEQ ID NO: 1007285 - RNA, 19 nt, Homo sapiens
gagaacauaucaaagagaa

SEQ ID NO: 1007286 - RNA, 19 nt, Homo sapiens
gagaagaauuugaccuuug

SEQ ID NO: 1007287 - RNA, 19 nt, Homo sapiens
gaaagugaccagugugaaa

SEQ ID NO: 1007288 - RNA, 19 nt, Homo sapiens
gcauuuaggaguuucaaua

SEQ ID NO: 1007289 - RNA, 19 nt, Homo sapiens
gaacugguaaucuucgaua

SEQ ID NO: 1007290 - RNA, 19 nt, Homo sapiens
gagcguuucuucccauuug

SEQ ID NO: 1007291 - RNA, 19 nt, Homo sapiens
gcagugugcuggcucuuug

SEQ ID NO: 1007292 - RNA, 19 nt, Homo sapiens
gagcucagacgauggauuu

SEQ ID NO: 1007293 - RNA, 19 nt, Homo sapiens
gggaguccaauauaaauua

SEQ ID NO: 1007294 - RNA, 19 nt, Homo sapiens
gaaacgaauuuaagagaac

SEQ ID NO: 1007295 - RNA, 19 nt, Homo sapiens
agaagaauuugaccuuuga

SEQ ID NO: 1007296 - RNA, 19 nt, Homo sapiens
aaacuuaggccauggauau

SEQ ID NO: 1007297 - RNA, 19 nt, Homo sapiens
gguaguggguguuggagaa

SEQ ID NO: 1007298 - RNA, 19 nt, Homo sapiens
ggucuaagcccaccucaga

SEQ ID NO: 1007299 - RNA, 19 nt, Homo sapiens
ugaagaaagugaccagugu

SEQ ID NO: 1007300 - RNA, 19 nt, Homo sapiens
ggauggguccuucagauuu

SEQ ID NO: 1007301 - RNA, 19 nt, Homo sapiens
ggagugcaguggcuauuca

SEQ ID NO: 1007302 - RNA, 19 nt, Homo sapiens
cugguaaucuucgauaaua

SEQ ID NO: 1007303 - RNA, 19 nt, Homo sapiens
ucaguaugaucagaacuua

SEQ ID NO: 1007304 - RNA, 19 nt, Homo sapiens
ccacguggccuugugaaua

SEQ ID NO: 1007305 - RNA, 19 nt, Homo sapiens
ccaaagaugcccaauacuu

SEQ ID NO: 1007306 - RNA, 19 nt, Homo sapiens
gaagugauggcacaacaga

SEQ ID NO: 1007307 - RNA, 19 nt, Homo sapiens
aaacaaggguccauuccau

SEQ ID NO: 1007308 - RNA, 19 nt, Homo sapiens
aaaauaggcugcugcaaaa

SEQ ID NO: 1007309 - RNA, 19 nt, Homo sapiens
guacuaaaguuaccuucca

SEQ ID NO: 1007310 - RNA, 19 nt, Homo sapiens
uauuugagaucuccuguug

SEQ ID NO: 1007311 - RNA, 19 nt, Homo sapiens
ugcucaaucucacauauua

SEQ ID NO: 1007312 - RNA, 19 nt, Homo sapiens
cauccacccucgagauaaa

SEQ ID NO: 1007313 - RNA, 19 nt, Homo sapiens
gaagagcucagacgaugga

SEQ ID NO: 1007314 - RNA, 19 nt, Homo sapiens
cauccacugugcaauauga

SEQ ID NO: 1007315 - RNA, 19 nt, Homo sapiens
cuucagauuugucuaagaa

SEQ ID NO: 1007316 - RNA, 19 nt, Homo sapiens
uaacacggaucuguacaau

SEQ ID NO: 1007317 - RNA, 19 nt, Homo sapiens
ugagaagaauuugaccuuu

SEQ ID NO: 1007318 - RNA, 19 nt, Homo sapiens
cagaguaacaugcagauga

SEQ ID NO: 1007319 - RNA, 19 nt, Homo sapiens
ccaaauccuuguggaauuc

SEQ ID NO: 1007320 - RNA, 19 nt, Homo sapiens
uggaggaccuuucgaagug

SEQ ID NO: 1007321 - RNA, 19 nt, Homo sapiens
cacguggccuugugaauau

SEQ ID NO: 1007322 - RNA, 19 nt, Homo sapiens
gauagagacucgccuuuug

SEQ ID NO: 1007323 - RNA, 19 nt, Homo sapiens
gaaaccaucaugaagaaag

SEQ ID NO: 1007324 - RNA, 19 nt, Homo sapiens
ugcaaaagcugguauauug

SEQ ID NO: 1007325 - RNA, 19 nt, Homo sapiens
gaaggaccacugccugaga

SEQ ID NO: 1007326 - RNA, 19 nt, Homo sapiens
ucagauuugucuaagaaga

SEQ ID NO: 1007327 - RNA, 19 nt, Homo sapiens
gaaucgacaucuucuuggu

SEQ ID NO: 1007328 - RNA, 19 nt, Homo sapiens
aggaaaccaucaugaagaa

SEQ ID NO: 1007329 - RNA, 19 nt, Homo sapiens
gaauggaaucgacaucuuc

SEQ ID NO: 1007330 - RNA, 19 nt, Homo sapiens
caaaauaggcugcugcaaa

SEQ ID NO: 1007331 - RNA, 19 nt, Homo sapiens
gcaaauccaggugcagaaa

SEQ ID NO: 1007332 - RNA, 19 nt, Homo sapiens
gcuauggaucucugugaua

SEQ ID NO: 1007333 - RNA, 19 nt, Homo sapiens
ggaggaccuuucgaaguga

SEQ ID NO: 1007334 - RNA, 19 nt, Homo sapiens
uuucauggcuguagcuaug

SEQ ID NO: 1007335 - RNA, 19 nt, Homo sapiens
guagcugguacuaaaguua

SEQ ID NO: 1007336 - RNA, 19 nt, Homo sapiens
ccauggauauuucaaguac

SEQ ID NO: 1007337 - RNA, 19 nt, Homo sapiens
cccaaauccuuguggaauu

SEQ ID NO: 1007338 - RNA, 19 nt, Homo sapiens
cuucauugcuuucauuaca

SEQ ID NO: 1007339 - RNA, 19 nt, Homo sapiens
cagauccguuggcaucaaa

SEQ ID NO: 1007340 - RNA, 19 nt, Homo sapiens
ggccauggauauuucaagu

SEQ ID NO: 1007341 - RNA, 19 nt, Homo sapiens
acaacagacuuuggagaaa

SEQ ID NO: 1007342 - RNA, 19 nt, Homo sapiens
caggaaaccaucaugaaga

SEQ ID NO: 1007343 - RNA, 19 nt, Homo sapiens
gcaauaugacucugaaagg

SEQ ID NO: 1007344 - RNA, 19 nt, Homo sapiens
caagggaguugucuaacac

SEQ ID NO: 1007345 - RNA, 19 nt, Homo sapiens
caacagacuuuggagaaaa

SEQ ID NO: 1007346 - RNA, 19 nt, Homo sapiens
gguacuggauccuaugaag

SEQ ID NO: 1007347 - RNA, 19 nt, Homo sapiens
gacaacaagauauuugaga

SEQ ID NO: 1007348 - RNA, 19 nt, Homo sapiens
gcugcucaaucucacauau

SEQ ID NO: 1007349 - RNA, 19 nt, Homo sapiens
cagcagacuucggcuaugu

SEQ ID NO: 1007350 - RNA, 19 nt, Homo sapiens
ggucaggaaaccaucauga

SEQ ID NO: 1007351 - RNA, 19 nt, Homo sapiens
agaauggaaucgacaucuu

SEQ ID NO: 1007352 - RNA, 19 nt, Homo sapiens
gguaaucuucgauaauaug

SEQ ID NO: 1007353 - RNA, 19 nt, Homo sapiens
gcuauucacagguuuaauc

SEQ ID NO: 1007354 - RNA, 19 nt, Homo sapiens
ugaaagggguaguauggua

SEQ ID NO: 1007355 - RNA, 19 nt, Homo sapiens
ucucacauauuaccagcaa

SEQ ID NO: 1007356 - RNA, 19 nt, Homo sapiens
gcacucuguucucuggaau

SEQ ID NO: 1007357 - RNA, 19 nt, Homo sapiens
ucugaauaaugaacuggua

SEQ ID NO: 1007358 - RNA, 19 nt, Homo sapiens
uggcuuaucggcugcauuu

SEQ ID NO: 1007359 - RNA, 19 nt, Homo sapiens
acccaaagaugcccaauac

SEQ ID NO: 1007360 - RNA, 19 nt, Homo sapiens
cacaacagacuuuggagaa

SEQ ID NO: 1007361 - RNA, 19 nt, Homo sapiens
cgacaucuucuugguauug

SEQ ID NO: 1007362 - RNA, 19 nt, Homo sapiens
gauggguccuucagauuuu

SEQ ID NO: 1007363 - RNA, 19 nt, Homo sapiens
caacaagauauuugagauc

SEQ ID NO: 1007364 - RNA, 19 nt, Homo sapiens
gcagacggagcguuucuuc

SEQ ID NO: 1007365 - RNA, 19 nt, Homo sapiens
cacauucccugcacucauc

SEQ ID NO: 1007366 - RNA, 19 nt, Homo sapiens
gcaucaaacagcagacuuc

SEQ ID NO: 1007367 - RNA, 19 nt, Homo sapiens
ucacauauuaccagcaaau

SEQ ID NO: 1007368 - RNA, 19 nt, Homo sapiens
ucgcuuugcuucauacauc

SEQ ID NO: 1007369 - RNA, 19 nt, Homo sapiens
cgugucagcccuucaagaa

SEQ ID NO: 1007370 - RNA, 19 nt, Homo sapiens
gcgaucgauucuugucaug

SEQ ID NO: 1007371 - RNA, 19 nt, Homo sapiens
cgugagaaauacaaugaag

SEQ ID NO: 1007372 - RNA, 19 nt, Homo sapiens
guucaugacguccuguuug

SEQ ID NO: 1007373 - RNA, 19 nt, Homo sapiens
aaaccaucaugaagaaagu

SEQ ID NO: 1007374 - RNA, 19 nt, Homo sapiens
cucagaaucucgcguguca

SEQ ID NO: 1007375 - RNA, 19 nt, Homo sapiens
guugcuaaaugacuguuuc

SEQ ID NO: 1007376 - RNA, 19 nt, Homo sapiens
ggaccacguggccuuguga

SEQ ID NO: 1007377 - RNA, 19 nt, Homo sapiens
gcagugaccaucgaugcaa

SEQ ID NO: 1007378 - RNA, 19 nt, Homo sapiens
ugucuaacacugcggcaua

SEQ ID NO: 1007379 - RNA, 19 nt, Homo sapiens
ugaaagcucacucugauac

SEQ ID NO: 1007380 - RNA, 19 nt, Homo sapiens
ucauugcuuucauuacaga

SEQ ID NO: 1007381 - RNA, 19 nt, Homo sapiens
aagagaacauaucaaagag

SEQ ID NO: 1007382 - RNA, 19 nt, Homo sapiens
aaggaccacugccugagaa

SEQ ID NO: 1007383 - RNA, 19 nt, Homo sapiens
gcacauggcuguuucuaua

SEQ ID NO: 1007384 - RNA, 19 nt, Homo sapiens
ggagaugucuggcucugua

SEQ ID NO: 1007385 - RNA, 19 nt, Homo sapiens
agacagaucucuuuguauu

SEQ ID NO: 1007386 - RNA, 19 nt, Homo sapiens
acacggaucuguacaauug

SEQ ID NO: 1007387 - RNA, 19 nt, Homo sapiens
aaagaggccuucaguguuu

SEQ ID NO: 1007388 - RNA, 19 nt, Homo sapiens
gagaagaauuugaccuuug

SEQ ID NO: 1007389 - RNA, 19 nt, Homo sapiens
ggagugaaaugucuaauac

SEQ ID NO: 1007390 - RNA, 19 nt, Homo sapiens
gaaagaggccuucaguguu

SEQ ID NO: 1007391 - RNA, 19 nt, Homo sapiens
cgacagaagugcagguauu

SEQ ID NO: 1007392 - RNA, 19 nt, Homo sapiens
gaaagugaccagugugaaa

SEQ ID NO: 1007393 - RNA, 19 nt, Homo sapiens
gggaaacucuggcuuagga

SEQ ID NO: 1007394 - RNA, 19 nt, Homo sapiens
gcauuuaggaguuucaaua

SEQ ID NO: 1007395 - RNA, 19 nt, Homo sapiens
cagcuaacauugucugaaa

SEQ ID NO: 1007396 - RNA, 19 nt, Homo sapiens
gcuuauagguaacuugaaa

SEQ ID NO: 1007397 - RNA, 19 nt, Homo sapiens
gagugaggcugaaaguaaa

SEQ ID NO: 1007398 - RNA, 19 nt, Homo sapiens
gagcguuucuucccauuug

SEQ ID NO: 1007399 - RNA, 19 nt, Homo sapiens
gcagugugcuggcucuuug

SEQ ID NO: 1007400 - RNA, 19 nt, Homo sapiens
gagcucagacgauggauuu

SEQ ID NO: 1007401 - RNA, 19 nt, Homo sapiens
gggaguccaauauaaauua

SEQ ID NO: 1007402 - RNA, 19 nt, Homo sapiens
ggccuucaguguuuguuua

SEQ ID NO: 1007403 - RNA, 19 nt, Homo sapiens
ccacaugacaagcauauaa

SEQ ID NO: 1007404 - RNA, 19 nt, Homo sapiens
ucagauaauugaagacaga

SEQ ID NO: 1007405 - RNA, 19 nt, Homo sapiens
gaaucucucuaugaacuuu

SEQ ID NO: 1007406 - RNA, 19 nt, Homo sapiens
agaagaauuugaccuuuga

SEQ ID NO: 1007407 - RNA, 19 nt, Homo sapiens
aaacuuaggccauggauau

SEQ ID NO: 1007408 - RNA, 19 nt, Homo sapiens
ggucuaagcccaccucaga

SEQ ID NO: 1007409 - RNA, 19 nt, Homo sapiens
ugaagaaagugaccagugu

SEQ ID NO: 1007410 - RNA, 19 nt, Homo sapiens
ccaauucuguuccuucaau

SEQ ID NO: 1007411 - RNA, 19 nt, Homo sapiens
ggucuaagggucuguauug

SEQ ID NO: 1007412 - RNA, 19 nt, Homo sapiens
ggauggguccuucagauuu

SEQ ID NO: 1007413 - RNA, 19 nt, Homo sapiens
gcagaugauacaaauauga

SEQ ID NO: 1007414 - RNA, 19 nt, Homo sapiens
ccgugaaacuuuacuacua

SEQ ID NO: 1007415 - RNA, 19 nt, Homo sapiens
ucaguaugaucagaacuua

SEQ ID NO: 1007416 - RNA, 19 nt, Homo sapiens
ccacguggccuugugaaua

SEQ ID NO: 1007417 - RNA, 19 nt, Homo sapiens
ccaaagaugcccaauacuu

SEQ ID NO: 1007418 - RNA, 19 nt, Homo sapiens
gaacaggaggcgugggaaa

SEQ ID NO: 1007419 - RNA, 19 nt, Homo sapiens
gaagugauggcacaacaga

SEQ ID NO: 1007420 - RNA, 19 nt, Homo sapiens
gaagugcagguauugguuu

SEQ ID NO: 1007421 - RNA, 19 nt, Homo sapiens
gggagugaaaugucuaaua

SEQ ID NO: 1007422 - RNA, 19 nt, Homo sapiens
gucauuuacuucccucaua

SEQ ID NO: 1007423 - RNA, 19 nt, Homo sapiens
aaacaaggguccauuccau

SEQ ID NO: 1007424 - RNA, 19 nt, Homo sapiens
gcacuugggcugccaggaa

SEQ ID NO: 1007425 - RNA, 19 nt, Homo sapiens
uauuugagaucuccuguug

SEQ ID NO: 1007426 - RNA, 19 nt, Homo sapiens
ugcucaaucucacauauua

SEQ ID NO: 1007427 - RNA, 19 nt, Homo sapiens
cauccacccucgagauaaa

SEQ ID NO: 1007428 - RNA, 19 nt, Homo sapiens
gaagagcucagacgaugga

SEQ ID NO: 1007429 - RNA, 19 nt, Homo sapiens
cauccacugugcaauauga

SEQ ID NO: 1007430 - RNA, 19 nt, Homo sapiens
agagugaggcugaaaguaa

SEQ ID NO: 1007431 - RNA, 19 nt, Homo sapiens
cuucagauuugucuaagaa

SEQ ID NO: 1007432 - RNA, 19 nt, Homo sapiens
uaacacggaucuguacaau

SEQ ID NO: 1007433 - RNA, 19 nt, Homo sapiens
gaggcaaacuguuguucga

SEQ ID NO: 1007434 - RNA, 19 nt, Homo sapiens
cgugaaacuuuacuacuau

SEQ ID NO: 1007435 - RNA, 19 nt, Homo sapiens
gaacuacagacaaauugga

SEQ ID NO: 1007436 - RNA, 19 nt, Homo sapiens
ugagaagaauuugaccuuu

SEQ ID NO: 1007437 - RNA, 19 nt, Homo sapiens
ugacugcccuaaggaauga

SEQ ID NO: 1007438 - RNA, 19 nt, Homo sapiens
ggucuguauuggacuaauu

SEQ ID NO: 1007439 - RNA, 19 nt, Homo sapiens
cagaguaacaugcagauga

SEQ ID NO: 1007440 - RNA, 19 nt, Homo sapiens
uggaggaccuuucgaagug

SEQ ID NO: 1007441 - RNA, 19 nt, Homo sapiens
ccguagacgucuuuacaaa

SEQ ID NO: 1007442 - RNA, 19 nt, Homo sapiens
auagaaagccucauugaau

SEQ ID NO: 1007443 - RNA, 19 nt, Homo sapiens
cacguggccuugugaauau

SEQ ID NO: 1007444 - RNA, 19 nt, Homo sapiens
gauagagacucgccuuuug

SEQ ID NO: 1007445 - RNA, 19 nt, Homo sapiens
gaaaccaucaugaagaaag

SEQ ID NO: 1007446 - RNA, 19 nt, Homo sapiens
cugcuuagcuuccgagauc

SEQ ID NO: 1007447 - RNA, 19 nt, Homo sapiens
gaaggaccacugccugaga

SEQ ID NO: 1007448 - RNA, 19 nt, Homo sapiens
ucagauuugucuaagaaga

SEQ ID NO: 1007449 - RNA, 19 nt, Homo sapiens
gaaacucuggcuuaggaaa

SEQ ID NO: 1007450 - RNA, 19 nt, Homo sapiens
aggaaaccaucaugaagaa

SEQ ID NO: 1007451 - RNA, 19 nt, Homo sapiens
guauuggacuaauucugaa

SEQ ID NO: 1007452 - RNA, 19 nt, Homo sapiens
uaauagaaagccucauuga

SEQ ID NO: 1007453 - RNA, 19 nt, Homo sapiens
gcaaauccaggugcagaaa

SEQ ID NO: 1007454 - RNA, 19 nt, Homo sapiens
gcuauggaucucugugaua

SEQ ID NO: 1007455 - RNA, 19 nt, Homo sapiens
ggaggaccuuucgaaguga

SEQ ID NO: 1007456 - RNA, 19 nt, Homo sapiens
ccacauaggccagcuagug

SEQ ID NO: 1007457 - RNA, 19 nt, Homo sapiens
ucauuuacuucccucauau

SEQ ID NO: 1007458 - RNA, 19 nt, Homo sapiens
ggacuaauucugaacuaca

SEQ ID NO: 1007459 - RNA, 19 nt, Homo sapiens
uuucauggcuguagcuaug

SEQ ID NO: 1007460 - RNA, 19 nt, Homo sapiens
ccauggauauuucaaguac

SEQ ID NO: 1007461 - RNA, 19 nt, Homo sapiens
cuaagugacugcccuaagg

SEQ ID NO: 1007462 - RNA, 19 nt, Homo sapiens
uuacugaaucucucuauga

SEQ ID NO: 1007463 - RNA, 19 nt, Homo sapiens
gcuagcacauggcuguuuc

SEQ ID NO: 1007464 - RNA, 19 nt, Homo sapiens
cuucauugcuuucauuaca

SEQ ID NO: 1007465 - RNA, 19 nt, Homo sapiens
caggaaaccaucaugaaga

SEQ ID NO: 1007466 - RNA, 19 nt, Homo sapiens
cagauccguuggcaucaaa

SEQ ID NO: 1007467 - RNA, 19 nt, Homo sapiens
ggccauggauauuucaagu

SEQ ID NO: 1007468 - RNA, 19 nt, Homo sapiens
acaacagacuuuggagaaa

SEQ ID NO: 1007469 - RNA, 19 nt, Homo sapiens
cucaggcucuuuaaaggua

SEQ ID NO: 1007470 - RNA, 19 nt, Homo sapiens
uuuggaaggugcuaaguga

SEQ ID NO: 1007471 - RNA, 19 nt, Homo sapiens
guagacgucuuuacaaaau

SEQ ID NO: 1007472 - RNA, 19 nt, Homo sapiens
cagcuaguguucauguguu

SEQ ID NO: 1007473 - RNA, 19 nt, Homo sapiens
gguacuggauccuaugaag

SEQ ID NO: 1007474 - RNA, 19 nt, Homo sapiens
gcaauaugacucugaaagg

SEQ ID NO: 1007475 - RNA, 19 nt, Homo sapiens
caagggaguugucuaacac

SEQ ID NO: 1007476 - RNA, 19 nt, Homo sapiens
caacagacuuuggagaaaa

SEQ ID NO: 1007477 - RNA, 19 nt, Homo sapiens
gaaaguaaagccacaugac

SEQ ID NO: 1007478 - RNA, 19 nt, Homo sapiens
ggucaggaaaccaucauga

SEQ ID NO: 1007479 - RNA, 19 nt, Homo sapiens
gggcuggugcugccauuaa

SEQ ID NO: 1007480 - RNA, 19 nt, Homo sapiens
uacugaaucucucuaugaa

SEQ ID NO: 1007481 - RNA, 19 nt, Homo sapiens
gacaggugguuacugaauc

SEQ ID NO: 1007482 - RNA, 19 nt, Homo sapiens
gacaacaagauauuugaga

SEQ ID NO: 1007483 - RNA, 19 nt, Homo sapiens
gcaagaagaucacgaccuu

SEQ ID NO: 1007484 - RNA, 19 nt, Homo sapiens
caaauuggcuuaacauucu

SEQ ID NO: 1007485 - RNA, 19 nt, Homo sapiens
gaaguuauuugccuuuagu

SEQ ID NO: 1007486 - RNA, 19 nt, Homo sapiens
ggcaguaccuguaugcauu

SEQ ID NO: 1007487 - RNA, 19 nt, Homo sapiens
cuucugggcuacuuuauaa

SEQ ID NO: 1007488 - RNA, 19 nt, Homo sapiens
gaagcagacuugucagaag

SEQ ID NO: 1007489 - RNA, 19 nt, Homo sapiens
uggcuucgcuaucuuagua

SEQ ID NO: 1007490 - RNA, 19 nt, Homo sapiens
ucacugcgcugaaguccuu

SEQ ID NO: 1007491 - RNA, 19 nt, Homo sapiens
cagaagauccuguggaaga

SEQ ID NO: 1007492 - RNA, 19 nt, Homo sapiens
cugauugucucuuuguaua

SEQ ID NO: 1007493 - RNA, 19 nt, Homo sapiens
ggaugcugauugucucuuu

SEQ ID NO: 1007494 - RNA, 19 nt, Homo sapiens
gagaauggaucagaaaauu

SEQ ID NO: 1007495 - RNA, 19 nt, Homo sapiens
gucagaagauccuguggaa

SEQ ID NO: 1007496 - RNA, 19 nt, Homo sapiens
uuagugguguuucuuguuu

SEQ ID NO: 1007497 - RNA, 19 nt, Homo sapiens
ggaaguuauuugccuuuag

SEQ ID NO: 1007498 - RNA, 19 nt, Homo sapiens
ugaagcagagggccuauaa

SEQ ID NO: 1007499 - RNA, 19 nt, Homo sapiens
caaggaaacagcagcauuc

SEQ ID NO: 1007500 - RNA, 19 nt, Homo sapiens
aagcagacuugucagaaga

SEQ ID NO: 1007501 - RNA, 19 nt, Homo sapiens
ggccaaggcucacaucacu

SEQ ID NO: 1007502 - RNA, 19 nt, Homo sapiens
ucaacugguccucauauaa

SEQ ID NO: 1007503 - RNA, 19 nt, Homo sapiens
ucaccugguuuauaucaug

SEQ ID NO: 1007504 - RNA, 19 nt, Homo sapiens
caggccagcuuaugguuug

SEQ ID NO: 1007505 - RNA, 19 nt, Homo sapiens
gcaguaccuguaugcauuu

SEQ ID NO: 1007506 - RNA, 19 nt, Homo sapiens
uuacuuacaguccaaauug

SEQ ID NO: 1007507 - RNA, 19 nt, Homo sapiens
uuacuucaccugguuuaua

SEQ ID NO: 1007508 - RNA, 19 nt, Homo sapiens
ucacaucacugcgcugaag

SEQ ID NO: 1007509 - RNA, 19 nt, Homo sapiens
caacugguccucauauaac

SEQ ID NO: 1007510 - RNA, 19 nt, Homo sapiens
uacuucaccugguuuauau

SEQ ID NO: 1007511 - RNA, 19 nt, Homo sapiens
gauugucucuuuguauaca

SEQ ID NO: 1007512 - RNA, 19 nt, Homo sapiens
ccucugggaugcugauugu

SEQ ID NO: 1007513 - RNA, 19 nt, Homo sapiens
ccucuuacuucaccugguu

SEQ ID NO: 1007514 - RNA, 19 nt, Homo sapiens
gggcuacuuuauaaucaau

SEQ ID NO: 1007515 - RNA, 19 nt, Homo sapiens
uuaagcuuguuuccacuuu

SEQ ID NO: 1007516 - RNA, 19 nt, Homo sapiens
gguggcagugguugaauuu

SEQ ID NO: 1007517 - RNA, 19 nt, Homo sapiens
gaugcugauugucucuuug

SEQ ID NO: 1007518 - RNA, 19 nt, Homo sapiens
ccaaggaaacagcagcauu

SEQ ID NO: 1007519 - RNA, 19 nt, Homo sapiens
agacuuauccuccugaucu

SEQ ID NO: 1007520 - RNA, 19 nt, Homo sapiens
gcuuaugguuugccaccuu

SEQ ID NO: 1007521 - RNA, 19 nt, Homo sapiens
ucucuucauucucucauau

SEQ ID NO: 1007522 - RNA, 19 nt, Homo sapiens
gcucaauucaggaaguuau

SEQ ID NO: 1007523 - RNA, 19 nt, Homo sapiens
ggcuuaacauucuaucauc

SEQ ID NO: 1007524 - RNA, 19 nt, Homo sapiens
guccucauauaaccucauu

SEQ ID NO: 1007525 - RNA, 19 nt, Homo sapiens
gggugaagcagacuuguca

SEQ ID NO: 1007526 - RNA, 19 nt, Homo sapiens
gccuauccuucucuucauu

SEQ ID NO: 1007527 - RNA, 19 nt, Homo sapiens
aggaaguuauuugccuuua

SEQ ID NO: 1007528 - RNA, 19 nt, Homo sapiens
cuccugaucucaccagugu

SEQ ID NO: 1007529 - RNA, 19 nt, Homo sapiens
caauucaggaaguuauuug

SEQ ID NO: 1007530 - RNA, 19 nt, Homo sapiens
cagcucaauucaggaaguu

SEQ ID NO: 1007531 - RNA, 19 nt, Homo sapiens
gcugauugucucuuuguau

SEQ ID NO: 1007532 - RNA, 19 nt, Homo sapiens
cagccuauccuucucuuca

SEQ ID NO: 1007533 - RNA, 19 nt, Homo sapiens
uuuagagaauggaucagaa

SEQ ID NO: 1007534 - RNA, 19 nt, Homo sapiens
aaacagcagcauucgguau

SEQ ID NO: 1007535 - RNA, 19 nt, Homo sapiens
gcugaucauuuuggacuua

SEQ ID NO: 1007536 - RNA, 19 nt, Homo sapiens
ugaagcagacuugucagaa

SEQ ID NO: 1007537 - RNA, 19 nt, Homo sapiens
guaccuguaugcauuucag

SEQ ID NO: 1007538 - RNA, 19 nt, Homo sapiens
aaagcuggcaguaccugua

SEQ ID NO: 1007539 - RNA, 19 nt, Homo sapiens
gccguuggcuucgcuaucu

SEQ ID NO: 1007540 - RNA, 19 nt, Homo sapiens
ggacuuaagcuuguuucca

SEQ ID NO: 1007541 - RNA, 19 nt, Homo sapiens
gcagacuugucagaagauc

SEQ ID NO: 1007542 - RNA, 19 nt, Homo sapiens
caagacuuauccuccugau

SEQ ID NO: 1007543 - RNA, 19 nt, Homo sapiens
uuagagaauggaucagaaa

SEQ ID NO: 1007544 - RNA, 19 nt, Homo sapiens
uguauacacaccacaagaa

SEQ ID NO: 1007545 - RNA, 19 nt, Homo sapiens
uucaacugguccucauaua

SEQ ID NO: 1007546 - RNA, 19 nt, Homo sapiens
ggucuggaguuuuagagaa

SEQ ID NO: 1007547 - RNA, 19 nt, Homo sapiens
cugcaguggcugaucauuu

SEQ ID NO: 1007548 - RNA, 19 nt, Homo sapiens
aaauucaacugguccucau

SEQ ID NO: 1007549 - RNA, 19 nt, Homo sapiens
ugcaguggcugaucauuuu

SEQ ID NO: 1007550 - RNA, 19 nt, Homo sapiens
gcugcuuccucuuacuuca

SEQ ID NO: 1007551 - RNA, 19 nt, Homo sapiens
uggcagugguugaauuucu

SEQ ID NO: 1007552 - RNA, 19 nt, Homo sapiens
ucaccagugucuucaucug

SEQ ID NO: 1007553 - RNA, 19 nt, Homo sapiens
uccaucaccuccaagacuu

SEQ ID NO: 1007554 - RNA, 19 nt, Homo sapiens
acacaccacaagaagauga

SEQ ID NO: 1007555 - RNA, 19 nt, Homo sapiens
auacacaccacaagaagau

SEQ ID NO: 1007556 - RNA, 19 nt, Homo sapiens
ucuucauucucucauauug

SEQ ID NO: 1007557 - RNA, 19 nt, Homo sapiens
ccaucaccuccaagacuua

SEQ ID NO: 1007558 - RNA, 19 nt, Homo sapiens
guauacacaccacaagaag

SEQ ID NO: 1007559 - RNA, 19 nt, Homo sapiens
ucagcucaauucaggaagu

SEQ ID NO: 1007560 - RNA, 19 nt, Homo sapiens
guuacuuacaguccaaauu

SEQ ID NO: 1007561 - RNA, 19 nt, Homo sapiens
gugaagcagacuugucaga

SEQ ID NO: 1007562 - RNA, 19 nt, Homo sapiens
cugguggucuggaguuuua

SEQ ID NO: 1007563 - RNA, 19 nt, Homo sapiens
gccuauaaccugagucucu

SEQ ID NO: 1007564 - RNA, 19 nt, Homo sapiens
cuuccucagugucuucuau

SEQ ID NO: 1007565 - RNA, 19 nt, Homo sapiens
ccaggccagcuuaugguuu

SEQ ID NO: 1007566 - RNA, 19 nt, Homo sapiens
uaucuucuggguccuggua

SEQ ID NO: 1007567 - RNA, 19 nt, Homo sapiens
ucucaccagugucuucauc

SEQ ID NO: 1007568 - RNA, 19 nt, Homo sapiens
gaucucaccagugucuuca

SEQ ID NO: 1007569 - RNA, 19 nt, Homo sapiens
ggcagugguugaauuucuc

SEQ ID NO: 1007570 - RNA, 19 nt, Homo sapiens
caggaaguuauuugccuuu

SEQ ID NO: 1007571 - RNA, 19 nt, Homo sapiens
gcauucgguaucccuuuga

SEQ ID NO: 1007572 - RNA, 19 nt, Homo sapiens
cagcauucgguaucccuuu

SEQ ID NO: 1007573 - RNA, 19 nt, Homo sapiens
gaagauccuguggaagaca

SEQ ID NO: 1007574 - RNA, 19 nt, Homo sapiens
gggcugcuuccucuuacuu

SEQ ID NO: 1007575 - RNA, 19 nt, Homo sapiens
cuugggcugcuuccucuua

SEQ ID NO: 1007576 - RNA, 19 nt, Homo sapiens
guaugcauuucagcucaau

SEQ ID NO: 1007577 - RNA, 19 nt, Homo sapiens
cauucgguaucccuuugaa

SEQ ID NO: 1007578 - RNA, 19 nt, Homo sapiens
gagggccuauaaccugagu

SEQ ID NO: 1007579 - RNA, 19 nt, Homo sapiens
ucagugucuucuauugcaa

SEQ ID NO: 1007580 - RNA, 19 nt, Homo sapiens
ggaaagggaucuucuaguu

SEQ ID NO: 1007581 - RNA, 19 nt, Homo sapiens
gaaguuacauccugauaaa

SEQ ID NO: 1007582 - RNA, 19 nt, Homo sapiens
gaaaugagcugaagaccau

SEQ ID NO: 1007583 - RNA, 19 nt, Homo sapiens
gaauaaggaugaacuuuga

SEQ ID NO: 1007584 - RNA, 19 nt, Homo sapiens
gaaauuggcauugaaguua

SEQ ID NO: 1007585 - RNA, 19 nt, Homo sapiens
gaagaccauucacagauua

SEQ ID NO: 1007586 - RNA, 19 nt, Homo sapiens
ggagaacugugguuuguaa

SEQ ID NO: 1007587 - RNA, 19 nt, Homo sapiens
gaagacaccuauuuagaau

SEQ ID NO: 1007588 - RNA, 19 nt, Homo sapiens
gaacugugguuuguaaauu

SEQ ID NO: 1007589 - RNA, 19 nt, Homo sapiens
caucaaaucuucuuuaugg

SEQ ID NO: 1007590 - RNA, 19 nt, Homo sapiens
gagaaacagugcagcagua

SEQ ID NO: 1007591 - RNA, 19 nt, Homo sapiens
aaucagaacuugcauaaga

SEQ ID NO: 1007592 - RNA, 19 nt, Homo sapiens
uaugaaagcuggaacuauu

SEQ ID NO: 1007593 - RNA, 19 nt, Homo sapiens
caaaagaggucaaugaauu

SEQ ID NO: 1007594 - RNA, 19 nt, Homo sapiens
gaacaagaauagagucauc

SEQ ID NO: 1007595 - RNA, 19 nt, Homo sapiens
gaaauaucauggagacaga

SEQ ID NO: 1007596 - RNA, 19 nt, Homo sapiens
ucaaagauacccugagaua

SEQ ID NO: 1007597 - RNA, 19 nt, Homo sapiens
gaaagggaucuucuaguuu

SEQ ID NO: 1007598 - RNA, 19 nt, Homo sapiens
agaagggucugcaaacuuu

SEQ ID NO: 1007599 - RNA, 19 nt, Homo sapiens
aaccauggcuuguugauuu

SEQ ID NO: 1007600 - RNA, 19 nt, Homo sapiens
gaaagaagagaauuugaug

SEQ ID NO: 1007601 - RNA, 19 nt, Homo sapiens
agcaaucgcugccuuaaua

SEQ ID NO: 1007602 - RNA, 19 nt, Homo sapiens
gguauuggcuggcugauca

SEQ ID NO: 1007603 - RNA, 19 nt, Homo sapiens
gaaccagcagugaaucuua

SEQ ID NO: 1007604 - RNA, 19 nt, Homo sapiens
ggaauaaggaugaacuuug

SEQ ID NO: 1007605 - RNA, 19 nt, Homo sapiens
gacauuaacuggacugauc

SEQ ID NO: 1007606 - RNA, 19 nt, Homo sapiens
uguauaacauucaggcuua

SEQ ID NO: 1007607 - RNA, 19 nt, Homo sapiens
gagaaugggagucugguua

SEQ ID NO: 1007608 - RNA, 19 nt, Homo sapiens
ugaccuguauccuuuauuu

SEQ ID NO: 1007609 - RNA, 19 nt, Homo sapiens
gcagauaaauaccagagau

SEQ ID NO: 1007610 - RNA, 19 nt, Homo sapiens
caagaagagcagauaaaua

SEQ ID NO: 1007611 - RNA, 19 nt, Homo sapiens
gagcaucaaaucuucuuua

SEQ ID NO: 1007612 - RNA, 19 nt, Homo sapiens
gaaguaauguagacagaag

SEQ ID NO: 1007613 - RNA, 19 nt, Homo sapiens
cgacggacuuauaauguuu

SEQ ID NO: 1007614 - RNA, 19 nt, Homo sapiens
ggaugaacuuugauaaugu

SEQ ID NO: 1007615 - RNA, 19 nt, Homo sapiens
cauauuacaucaacuggaa

SEQ ID NO: 1007616 - RNA, 19 nt, Homo sapiens
uuacauauuugccuucuga

SEQ ID NO: 1007617 - RNA, 19 nt, Homo sapiens
ugaaaggagucaacagcua

SEQ ID NO: 1007618 - RNA, 19 nt, Homo sapiens
uaaagaaguggauggguua

SEQ ID NO: 1007619 - RNA, 19 nt, Homo sapiens
aaagggaucuucuaguuuc

SEQ ID NO: 1007620 - RNA, 19 nt, Homo sapiens
gaacauuaucuuagacuug

SEQ ID NO: 1007621 - RNA, 19 nt, Homo sapiens
gcaagaggaauaaggauga

SEQ ID NO: 1007622 - RNA, 19 nt, Homo sapiens
guucaaagauacccugaga

SEQ ID NO: 1007623 - RNA, 19 nt, Homo sapiens
gacaaggaaccaaagaaua

SEQ ID NO: 1007624 - RNA, 19 nt, Homo sapiens
caaaugauccugagcugaa

SEQ ID NO: 1007625 - RNA, 19 nt, Homo sapiens
gugcacaaauucuguaguu

SEQ ID NO: 1007626 - RNA, 19 nt, Homo sapiens
gaauagagucaucauguau

SEQ ID NO: 1007627 - RNA, 19 nt, Homo sapiens
ggacagauuugugaugcuu

SEQ ID NO: 1007628 - RNA, 19 nt, Homo sapiens
agaauagagucaucaugua

SEQ ID NO: 1007629 - RNA, 19 nt, Homo sapiens
gaaagagcaaagagaaauu

SEQ ID NO: 1007630 - RNA, 19 nt, Homo sapiens
cauaugaaguacucaaaga

SEQ ID NO: 1007631 - RNA, 19 nt, Homo sapiens
caucagaagacaccuauuu

SEQ ID NO: 1007632 - RNA, 19 nt, Homo sapiens
gagggacucuguaacaugu

SEQ ID NO: 1007633 - RNA, 19 nt, Homo sapiens
aaagaaccauggcuuguug

SEQ ID NO: 1007634 - RNA, 19 nt, Homo sapiens
ucacuuaaaucagaacuug

SEQ ID NO: 1007635 - RNA, 19 nt, Homo sapiens
caacgacagugguauucaa

SEQ ID NO: 1007636 - RNA, 19 nt, Homo sapiens
gaaaggagucaacagcuau

SEQ ID NO: 1007637 - RNA, 19 nt, Homo sapiens
uaacuguggugaugauaga

SEQ ID NO: 1007638 - RNA, 19 nt, Homo sapiens
cgaacuaguuacacaaaga

SEQ ID NO: 1007639 - RNA, 19 nt, Homo sapiens
ccaaagaaagugugaauuc

SEQ ID NO: 1007640 - RNA, 19 nt, Homo sapiens
ggacaaggaaccaaagaau

SEQ ID NO: 1007641 - RNA, 19 nt, Homo sapiens
caucaucgguggcuguuau

SEQ ID NO: 1007642 - RNA, 19 nt, Homo sapiens
ggaaagaagagaauuugau

SEQ ID NO: 1007643 - RNA, 19 nt, Homo sapiens
gcucagacaugccagaaag

SEQ ID NO: 1007644 - RNA, 19 nt, Homo sapiens
gaacuaguuacacaaagaa

SEQ ID NO: 1007645 - RNA, 19 nt, Homo sapiens
caaauuugagcaacaguaa

SEQ ID NO: 1007646 - RNA, 19 nt, Homo sapiens
cacaguaaguacacaaauu

SEQ ID NO: 1007647 - RNA, 19 nt, Homo sapiens
gcugugcuaucuacauaaa

SEQ ID NO: 1007648 - RNA, 19 nt, Homo sapiens
gaacuacuuucggcaaaca

SEQ ID NO: 1007649 - RNA, 19 nt, Homo sapiens
aaaguaggcuggauucagu

SEQ ID NO: 1007650 - RNA, 19 nt, Homo sapiens
gaaaucaaggcaagaggaa

SEQ ID NO: 1007651 - RNA, 19 nt, Homo sapiens
ggacaucacucugcugaac

SEQ ID NO: 1007652 - RNA, 19 nt, Homo sapiens
gaaugggagucugguuaaa

SEQ ID NO: 1007653 - RNA, 19 nt, Homo sapiens
gcucuuggcuaggaugauu

SEQ ID NO: 1007654 - RNA, 19 nt, Homo sapiens
gaaguacagugacagaacu

SEQ ID NO: 1007655 - RNA, 19 nt, Homo sapiens
gcaagcaguagagaaauaa

SEQ ID NO: 1007656 - RNA, 19 nt, Homo sapiens
aacaguaagugcacaaauu

SEQ ID NO: 1007657 - RNA, 19 nt, Homo sapiens
aaacagugcagcaguauau

SEQ ID NO: 1007658 - RNA, 19 nt, Homo sapiens
gaaacucuccgaaaucaag

SEQ ID NO: 1007659 - RNA, 19 nt, Homo sapiens
uaacuggacugaucaacgu

SEQ ID NO: 1007660 - RNA, 19 nt, Homo sapiens
caagguggccaguaugaaa

SEQ ID NO: 1007661 - RNA, 19 nt, Homo sapiens
uaaucaagguggccaguau

SEQ ID NO: 1007662 - RNA, 19 nt, Homo sapiens
uaagacaagcuuucaagaa

SEQ ID NO: 1007663 - RNA, 19 nt, Homo sapiens
gaaacagugcagcaguaua

SEQ ID NO: 1007664 - RNA, 19 nt, Homo sapiens
agacaccuauuuagaaugu

SEQ ID NO: 1007665 - RNA, 19 nt, Homo sapiens
gagcuuuacuaccagaguu

SEQ ID NO: 1007666 - RNA, 19 nt, Homo sapiens
acaaggaaccaaagaauau

SEQ ID NO: 1007667 - RNA, 19 nt, Homo sapiens
aaaggaucauucucuguuu

SEQ ID NO: 1007668 - RNA, 19 nt, Homo sapiens
gaucaacgugggcaguaua

SEQ ID NO: 1007669 - RNA, 19 nt, Homo sapiens
gcuuagauauuacaacaag

SEQ ID NO: 1007670 - RNA, 19 nt, Homo sapiens
gaacuuuggacaggaaauu

SEQ ID NO: 1007671 - RNA, 19 nt, Homo sapiens
gcuguuaacuguggugaug

SEQ ID NO: 1007672 - RNA, 19 nt, Homo sapiens
guggauggguuacuucgaa

SEQ ID NO: 1007673 - RNA, 19 nt, Homo sapiens
aaaagggacuugaggauaa

SEQ ID NO: 1007674 - RNA, 19 nt, Homo sapiens
ggagucugguuaaauaaag

SEQ ID NO: 1007675 - RNA, 19 nt, Homo sapiens
caaacccuguuaugcugua

SEQ ID NO: 1007676 - RNA, 19 nt, Homo sapiens
agaagacaccuauuuagaa

SEQ ID NO: 1007677 - RNA, 19 nt, Homo sapiens
cagaagacaccuauuuaga

SEQ ID NO: 1007678 - RNA, 19 nt, Homo sapiens
agugugaauucucauguua

SEQ ID NO: 1007679 - RNA, 19 nt, Homo sapiens
uggauggucuuguuaaugu

SEQ ID NO: 1007680 - RNA, 19 nt, Homo sapiens
gauauucccucuucauuua

SEQ ID NO: 1007681 - RNA, 19 nt, Homo sapiens
agaagaagaugaugaguua

SEQ ID NO: 1007682 - RNA, 19 nt, Homo sapiens
gagagaagacguaccauua

SEQ ID NO: 1007683 - RNA, 19 nt, Homo sapiens
guagaugacuugcaauuug

SEQ ID NO: 1007684 - RNA, 19 nt, Homo sapiens
ucacugcgguaccuuaaua

SEQ ID NO: 1007685 - RNA, 19 nt, Homo sapiens
gcgagaacccugcaaauuu

SEQ ID NO: 1007686 - RNA, 19 nt, Homo sapiens
gcaauuagugggaaucuuu

SEQ ID NO: 1007687 - RNA, 19 nt, Homo sapiens
gagaagacguaccauuaug

SEQ ID NO: 1007688 - RNA, 19 nt, Homo sapiens
auaaauaccucacaugaug

SEQ ID NO: 1007689 - RNA, 19 nt, Homo sapiens
gaacaucgucuccuauuca

SEQ ID NO: 1007690 - RNA, 19 nt, Homo sapiens
ccacuucucugacagcaaa

SEQ ID NO: 1007691 - RNA, 19 nt, Homo sapiens
gaagagaagaagaugauga

SEQ ID NO: 1007692 - RNA, 19 nt, Homo sapiens
gauguccucucucugaauu

SEQ ID NO: 1007693 - RNA, 19 nt, Homo sapiens
gaccaucucccaacaacua

SEQ ID NO: 1007694 - RNA, 19 nt, Homo sapiens
gaaaugaugacucugacaa

SEQ ID NO: 1007695 - RNA, 19 nt, Homo sapiens
acaauuguguugcuccaua

SEQ ID NO: 1007696 - RNA, 19 nt, Homo sapiens
gaaagcuguucguuggauu

SEQ ID NO: 1007697 - RNA, 19 nt, Homo sapiens
ggauauucccucuucauuu

SEQ ID NO: 1007698 - RNA, 19 nt, Homo sapiens
ugaaauagaaccauggaaa

SEQ ID NO: 1007699 - RNA, 19 nt, Homo sapiens
ugaaguagccgaacaguag

SEQ ID NO: 1007700 - RNA, 19 nt, Homo sapiens
gcucagcacaugugucuuu

SEQ ID NO: 1007701 - RNA, 19 nt, Homo sapiens
caucgucuccuauucauuu

SEQ ID NO: 1007702 - RNA, 19 nt, Homo sapiens
gagaagaagaugaugaguu

SEQ ID NO: 1007703 - RNA, 19 nt, Homo sapiens
ggagaaacagcaaaguuau

SEQ ID NO: 1007704 - RNA, 19 nt, Homo sapiens
uagaugacuugcaauuuga

SEQ ID NO: 1007705 - RNA, 19 nt, Homo sapiens
caacuacggcuacuccaaa

SEQ ID NO: 1007706 - RNA, 19 nt, Homo sapiens
ggaucucucuuggcaauga

SEQ ID NO: 1007707 - RNA, 19 nt, Homo sapiens
uggagaaacagcaaaguua

SEQ ID NO: 1007708 - RNA, 19 nt, Homo sapiens
ggagagaagacguaccauu

SEQ ID NO: 1007709 - RNA, 19 nt, Homo sapiens
cgagaacccugcaaauuuu

SEQ ID NO: 1007710 - RNA, 19 nt, Homo sapiens
cugaauggcugcaaaauaa

SEQ ID NO: 1007711 - RNA, 19 nt, Homo sapiens
ccucuucucuccaaauguu

SEQ ID NO: 1007712 - RNA, 19 nt, Homo sapiens
ccagaugccaccacaguaa

SEQ ID NO: 1007713 - RNA, 19 nt, Homo sapiens
gccgaacaguagaaacuuu

SEQ ID NO: 1007714 - RNA, 19 nt, Homo sapiens
gcacaaauucccagugucu

SEQ ID NO: 1007715 - RNA, 19 nt, Homo sapiens
gcaaaguuaugaacaucgu

SEQ ID NO: 1007716 - RNA, 19 nt, Homo sapiens
ugaauuauguacagacuac

SEQ ID NO: 1007717 - RNA, 19 nt, Homo sapiens
ccaggucuuugacagaauu

SEQ ID NO: 1007718 - RNA, 19 nt, Homo sapiens
caggaucucucuuggcaau

SEQ ID NO: 1007719 - RNA, 19 nt, Homo sapiens
gaaauagaaccauggaaaa

SEQ ID NO: 1007720 - RNA, 19 nt, Homo sapiens
gaagacguaccauuaugug

SEQ ID NO: 1007721 - RNA, 19 nt, Homo sapiens
ccaagaggcucaggaagag

SEQ ID NO: 1007722 - RNA, 19 nt, Homo sapiens
ccaccacaguaaacauuga

SEQ ID NO: 1007723 - RNA, 19 nt, Homo sapiens
gggauccucuucucuccaa

SEQ ID NO: 1007724 - RNA, 19 nt, Homo sapiens
gagcagagccagcagaacu

SEQ ID NO: 1007725 - RNA, 19 nt, Homo sapiens
gagaaacagcaaaguuaug

SEQ ID NO: 1007726 - RNA, 19 nt, Homo sapiens
ugacagaauuaaaggaucu

SEQ ID NO: 1007727 - RNA, 19 nt, Homo sapiens
ugaacugaauggcugcaaa

SEQ ID NO: 1007728 - RNA, 19 nt, Homo sapiens
cuggacagcugaacugaau

SEQ ID NO: 1007729 - RNA, 19 nt, Homo sapiens
cuaaucacccguuuaacaa

SEQ ID NO: 1007730 - RNA, 19 nt, Homo sapiens
caauuguguugcuccauau

SEQ ID NO: 1007731 - RNA, 19 nt, Homo sapiens
gagauugugugugucuaug

SEQ ID NO: 1007732 - RNA, 19 nt, Homo sapiens
uaaccgacgcguugcauug

SEQ ID NO: 1007733 - RNA, 19 nt, Homo sapiens
gcuguucguuggauucuag

SEQ ID NO: 1007734 - RNA, 19 nt, Homo sapiens
agaaacagcaaaguuauga

SEQ ID NO: 1007735 - RNA, 19 nt, Homo sapiens
gcagcaauccagaucucua

SEQ ID NO: 1007736 - RNA, 19 nt, Homo sapiens
ugucuuugguaaccugaua

SEQ ID NO: 1007737 - RNA, 19 nt, Homo sapiens
uguuagccauccugaagua

SEQ ID NO: 1007738 - RNA, 19 nt, Homo sapiens
gcucagugccgucccuuug

SEQ ID NO: 1007739 - RNA, 19 nt, Homo sapiens
ugaagaauuuggcaaugca

SEQ ID NO: 1007740 - RNA, 19 nt, Homo sapiens
cuauggauauucccucuuc

SEQ ID NO: 1007741 - RNA, 19 nt, Homo sapiens
gauugugugugucuaugga

SEQ ID NO: 1007742 - RNA, 19 nt, Homo sapiens
uuaugaacaucgucuccua

SEQ ID NO: 1007743 - RNA, 19 nt, Homo sapiens
gaaacagcaaaguuaugaa

SEQ ID NO: 1007744 - RNA, 19 nt, Homo sapiens
gaauggcagcaguagauga

SEQ ID NO: 1007745 - RNA, 19 nt, Homo sapiens
gaaguagccgaacaguaga

SEQ ID NO: 1007746 - RNA, 19 nt, Homo sapiens
ccuaaucacccguuuaaca

SEQ ID NO: 1007747 - RNA, 19 nt, Homo sapiens
gcagccaaguccagcuaau

SEQ ID NO: 1007748 - RNA, 19 nt, Homo sapiens
cagcaaaguuaugaacauc

SEQ ID NO: 1007749 - RNA, 19 nt, Homo sapiens
gcagcuaccaucaucuaug

SEQ ID NO: 1007750 - RNA, 19 nt, Homo sapiens
ggagauugugugugucuau

SEQ ID NO: 1007751 - RNA, 19 nt, Homo sapiens
uaccaggucuuugacagaa

SEQ ID NO: 1007752 - RNA, 19 nt, Homo sapiens
gcaaugcagccacuucucu

SEQ ID NO: 1007753 - RNA, 19 nt, Homo sapiens
ugacuugcaauuugaagaa

SEQ ID NO: 1007754 - RNA, 19 nt, Homo sapiens
uuucuugacuucuccaguu

SEQ ID NO: 1007755 - RNA, 19 nt, Homo sapiens
ccucauaauugggagaaga

SEQ ID NO: 1007756 - RNA, 19 nt, Homo sapiens
uggcacaaauucccagugu

SEQ ID NO: 1007757 - RNA, 19 nt, Homo sapiens
ccgcaauacuguggauuau

SEQ ID NO: 1007758 - RNA, 19 nt, Homo sapiens
ugaacaucgucuccuauuc

SEQ ID NO: 1007759 - RNA, 19 nt, Homo sapiens
cagcuaccaucaucuaugc

SEQ ID NO: 1007760 - RNA, 19 nt, Homo sapiens
gguuauauauccgcagcaa

SEQ ID NO: 1007761 - RNA, 19 nt, Homo sapiens
ggucuuugacagaauuaaa

SEQ ID NO: 1007762 - RNA, 19 nt, Homo sapiens
ugaugucugugucugcaaa

SEQ ID NO: 1007763 - RNA, 19 nt, Homo sapiens
ggacagcugaacugaaugg

SEQ ID NO: 1007764 - RNA, 19 nt, Homo sapiens
gcaaauuuucuuccucaua

SEQ ID NO: 1007765 - RNA, 19 nt, Homo sapiens
agagaagacguaccauuau

SEQ ID NO: 1007766 - RNA, 19 nt, Homo sapiens
cgccuaaucacccguuuaa

SEQ ID NO: 1007767 - RNA, 19 nt, Homo sapiens
caucucaggaucucucuug

SEQ ID NO: 1007768 - RNA, 19 nt, Homo sapiens
accauuaugugcccgaauu

SEQ ID NO: 1007769 - RNA, 19 nt, Homo sapiens
gaaucuuuccaacuucuug

SEQ ID NO: 1007770 - RNA, 19 nt, Homo sapiens
gaacugaauggcugcaaaa

SEQ ID NO: 1007771 - RNA, 19 nt, Homo sapiens
guaccuuaauaccugaaau

SEQ ID NO: 1007772 - RNA, 19 nt, Homo sapiens
acagcaaaguuaugaacau

SEQ ID NO: 1007773 - RNA, 19 nt, Homo sapiens
ucuggacauuugaauacua

SEQ ID NO: 1007774 - RNA, 19 nt, Homo sapiens
gauggaguggcacaaauuc

SEQ ID NO: 1007775 - RNA, 19 nt, Homo sapiens
gcagagccagcagaacuga

SEQ ID NO: 1007776 - RNA, 19 nt, Homo sapiens
cagcuguucgugaggauaa

SEQ ID NO: 1007777 - RNA, 19 nt, Homo sapiens
guggagaaacagcaaaguu

SEQ ID NO: 1007778 - RNA, 19 nt, Homo sapiens
agcaguagaugacuugcaa

SEQ ID NO: 1007779 - RNA, 19 nt, Homo sapiens
aagacucacuggccgaaug

SEQ ID NO: 1007780 - RNA, 19 nt, Homo sapiens
gaacaagucuuucuaaugu

SEQ ID NO: 1007781 - RNA, 19 nt, Homo sapiens
ccaguugacuucugcauua

SEQ ID NO: 1007782 - RNA, 19 nt, Homo sapiens
gagaggacauuaagugaaa

SEQ ID NO: 1007783 - RNA, 19 nt, Homo sapiens
gcaacggaauagugaauuu

SEQ ID NO: 1007784 - RNA, 19 nt, Homo sapiens
ugacagacaucaccaguug

SEQ ID NO: 1007785 - RNA, 19 nt, Homo sapiens
gacauuaagugaaacaguu

SEQ ID NO: 1007786 - RNA, 19 nt, Homo sapiens
ucaaguuucuggucuuuaa

SEQ ID NO: 1007787 - RNA, 19 nt, Homo sapiens
ucaguuaaguugucagaaa

SEQ ID NO: 1007788 - RNA, 19 nt, Homo sapiens
gaagaugacauaguuugua

SEQ ID NO: 1007789 - RNA, 19 nt, Homo sapiens
uaaccugcaugaucuguuu

SEQ ID NO: 1007790 - RNA, 19 nt, Homo sapiens
gcauuaaccugcaugaucu

SEQ ID NO: 1007791 - RNA, 19 nt, Homo sapiens
caaugcuccuguuuacuua

SEQ ID NO: 1007792 - RNA, 19 nt, Homo sapiens
gcaaaccaguuauucaagu

SEQ ID NO: 1007793 - RNA, 19 nt, Homo sapiens
guaaauguaccacagauga

SEQ ID NO: 1007794 - RNA, 19 nt, Homo sapiens
uaacaaaggccaagaccaa

SEQ ID NO: 1007795 - RNA, 19 nt, Homo sapiens
caaguuggccucucuguug

SEQ ID NO: 1007796 - RNA, 19 nt, Homo sapiens
caaaccaguuauucaaguu

SEQ ID NO: 1007797 - RNA, 19 nt, Homo sapiens
caugaucuguuucuacuau

SEQ ID NO: 1007798 - RNA, 19 nt, Homo sapiens
uccagaacguguagucuua

SEQ ID NO: 1007799 - RNA, 19 nt, Homo sapiens
gauaggaguuuucauuuga

SEQ ID NO: 1007800 - RNA, 19 nt, Homo sapiens
uugaagaucuuggucauuu

SEQ ID NO: 1007801 - RNA, 19 nt, Homo sapiens
guaaauuagugguuaaggu

SEQ ID NO: 1007802 - RNA, 19 nt, Homo sapiens
gcuaaaggcuguuuuggaa

SEQ ID NO: 1007803 - RNA, 19 nt, Homo sapiens
gaacguguagucuuauuag

SEQ ID NO: 1007804 - RNA, 19 nt, Homo sapiens
ccaaggaccuccagaacgu

SEQ ID NO: 1007805 - RNA, 19 nt, Homo sapiens
ugaaauauuuggacaacuc

SEQ ID NO: 1007806 - RNA, 19 nt, Homo sapiens
ggagaggacauuaagugaa

SEQ ID NO: 1007807 - RNA, 19 nt, Homo sapiens
gccucucuguuguaaauua

SEQ ID NO: 1007808 - RNA, 19 nt, Homo sapiens
gacaauggaucuaaaaugu

SEQ ID NO: 1007809 - RNA, 19 nt, Homo sapiens
gaugaaauauuuggacaac

SEQ ID NO: 1007810 - RNA, 19 nt, Homo sapiens
ugaaacaguugacagacau

SEQ ID NO: 1007811 - RNA, 19 nt, Homo sapiens
gagaaaggaccuccaagag

SEQ ID NO: 1007812 - RNA, 19 nt, Homo sapiens
ucaaugcuccuguuuacuu

SEQ ID NO: 1007813 - RNA, 19 nt, Homo sapiens
ugaacaagucuuucuaaug

SEQ ID NO: 1007814 - RNA, 19 nt, Homo sapiens
gaagaucuuggucauuuua

SEQ ID NO: 1007815 - RNA, 19 nt, Homo sapiens
gugaaacaguugacagaca

SEQ ID NO: 1007816 - RNA, 19 nt, Homo sapiens
cagaacguguagucuuauu

SEQ ID NO: 1007817 - RNA, 19 nt, Homo sapiens
gcaugaacaagucuuucua

SEQ ID NO: 1007818 - RNA, 19 nt, Homo sapiens
ggauaggaguuuucauuug

SEQ ID NO: 1007819 - RNA, 19 nt, Homo sapiens
ggugcucaauaaauggaua

SEQ ID NO: 1007820 - RNA, 19 nt, Homo sapiens
caugaacaagucuuucuaa

SEQ ID NO: 1007821 - RNA, 19 nt, Homo sapiens
aggaagagguggugguuuc

SEQ ID NO: 1007822 - RNA, 19 nt, Homo sapiens
ccgcggaggcuuuaacaaa

SEQ ID NO: 1007823 - RNA, 19 nt, Homo sapiens
gggagaggacauuaaguga

SEQ ID NO: 1007824 - RNA, 19 nt, Homo sapiens
ugagaaaggaccuccaaga

SEQ ID NO: 1007825 - RNA, 19 nt, Homo sapiens
ucugggugcucaauaaaug

SEQ ID NO: 1007826 - RNA, 19 nt, Homo sapiens
cugugaagaugacauaguu

SEQ ID NO: 1007827 - RNA, 19 nt, Homo sapiens
gaaauauuuggacaacuca

SEQ ID NO: 1007828 - RNA, 19 nt, Homo sapiens
gcaaguuggccucucuguu

SEQ ID NO: 1007829 - RNA, 19 nt, Homo sapiens
gcaaagugcaacggaauag

SEQ ID NO: 1007830 - RNA, 19 nt, Homo sapiens
gugaagaugacauaguuug

SEQ ID NO: 1007831 - RNA, 19 nt, Homo sapiens
cacucugggugcucaauaa

SEQ ID NO: 1007832 - RNA, 19 nt, Homo sapiens
gcuccuguuuacuuagaaa

SEQ ID NO: 1007833 - RNA, 19 nt, Homo sapiens
uggccucucuguuguaaau

SEQ ID NO: 1007834 - RNA, 19 nt, Homo sapiens
caauaaauggauaggaguu

SEQ ID NO: 1007835 - RNA, 19 nt, Homo sapiens
uaaaagagcaugaacaagu

SEQ ID NO: 1007836 - RNA, 19 nt, Homo sapiens
ggacauuaagugaaacagu

SEQ ID NO: 1007837 - RNA, 19 nt, Homo sapiens
uuggacaacucagagauuu

SEQ ID NO: 1007838 - RNA, 19 nt, Homo sapiens
uaaauguaccacagaugaa

SEQ ID NO: 1007839 - RNA, 19 nt, Homo sapiens
caauggaucuaaaauguca

SEQ ID NO: 1007840 - RNA, 19 nt, Homo sapiens
guuggccucucuguuguaa

SEQ ID NO: 1007841 - RNA, 19 nt, Homo sapiens
ggaggaagagguggugguu

SEQ ID NO: 1007842 - RNA, 19 nt, Homo sapiens
caguugacuucugcauuaa

SEQ ID NO: 1007843 - RNA, 19 nt, Homo sapiens
gacaucaccaguugacuuc

SEQ ID NO: 1007844 - RNA, 19 nt, Homo sapiens
caaaggccaagaccaagga

SEQ ID NO: 1007845 - RNA, 19 nt, Homo sapiens
ggaggucguggaggcuuua

SEQ ID NO: 1007846 - RNA, 19 nt, Homo sapiens
agaacguguagucuuauua

SEQ ID NO: 1007847 - RNA, 19 nt, Homo sapiens
cagagggagaggacauuaa

SEQ ID NO: 1007848 - RNA, 19 nt, Homo sapiens
ggucguggaggcuuuaauc

SEQ ID NO: 1007849 - RNA, 19 nt, Homo sapiens
ucagagggagaggacauua

SEQ ID NO: 1007850 - RNA, 19 nt, Homo sapiens
aagagguggugguuucaga

SEQ ID NO: 1007851 - RNA, 19 nt, Homo sapiens
uggcaaaccaguuauucaa

SEQ ID NO: 1007852 - RNA, 19 nt, Homo sapiens
uuucaaugcuccuguuuac

SEQ ID NO: 1007853 - RNA, 19 nt, Homo sapiens
uuucuacuauggauuggaa

SEQ ID NO: 1007854 - RNA, 19 nt, Homo sapiens
caucaccaguugacuucug

SEQ ID NO: 1007855 - RNA, 19 nt, Homo sapiens
acuauggauuggaaacuug

SEQ ID NO: 1007856 - RNA, 19 nt, Homo sapiens
agacaucaccaguugacuu

SEQ ID NO: 1007857 - RNA, 19 nt, Homo sapiens
ggaugaaauauuuggacaa

SEQ ID NO: 1007858 - RNA, 19 nt, Homo sapiens
aaauguaccacagaugaaa

SEQ ID NO: 1007859 - RNA, 19 nt, Homo sapiens
aaagugcaacggaauagug

SEQ ID NO: 1007860 - RNA, 19 nt, Homo sapiens
ggugagaaaggaccuccaa

SEQ ID NO: 1007861 - RNA, 19 nt, Homo sapiens
gaccaaggaccuccagaac

SEQ ID NO: 1007862 - RNA, 19 nt, Homo sapiens
ggaagagguggugguuuca

SEQ ID NO: 1007863 - RNA, 19 nt, Homo sapiens
gugguuaagguuaucuauu

SEQ ID NO: 1007864 - RNA, 19 nt, Homo sapiens
cggaggucguggaggcuuu

SEQ ID NO: 1007865 - RNA, 19 nt, Homo sapiens
gaggaagagguggugguuu

SEQ ID NO: 1007866 - RNA, 19 nt, Homo sapiens
caguuaaguugucagaaaa

SEQ ID NO: 1007867 - RNA, 19 nt, Homo sapiens
uggaaaaguggaugaaaua

SEQ ID NO: 1007868 - RNA, 19 nt, Homo sapiens
caaguuucuggucuuuaaa

SEQ ID NO: 1007869 - RNA, 19 nt, Homo sapiens
guuccugcaucccugugaa

SEQ ID NO: 1007870 - RNA, 19 nt, Homo sapiens
gagcaugaacaagucuuuc

SEQ ID NO: 1007871 - RNA, 19 nt, Homo sapiens
uacuauggauuggaaacuu

SEQ ID NO: 1007872 - RNA, 19 nt, Homo sapiens
ugcaugaucuguuucuacu

SEQ ID NO: 1007873 - RNA, 19 nt, Homo sapiens
gggaggagaaagaaugucu

SEQ ID NO: 1007874 - RNA, 19 nt, Homo sapiens
agaccaaggaccuccagaa

SEQ ID NO: 1007875 - RNA, 19 nt, Homo sapiens
cagaggcggugguuuuaga

SEQ ID NO: 1007876 - RNA, 19 nt, Homo sapiens
uuauuucaaugcuccuguu

SEQ ID NO: 1007877 - RNA, 19 nt, Homo sapiens
ugaagaugacauaguuugu

SEQ ID NO: 1007878 - RNA, 19 nt, Homo sapiens
aaccaguuauucaaguuuc

SEQ ID NO: 1007879 - RNA, 19 nt, Homo sapiens
gaucuguuucuacuaugga

SEQ ID NO: 1007880 - RNA, 19 nt, Homo sapiens
gaacaagucuuucuaaugu

SEQ ID NO: 1007881 - RNA, 19 nt, Homo sapiens
ccaguugacuucugcauua

SEQ ID NO: 1007882 - RNA, 19 nt, Homo sapiens
gagaggacauuaagugaaa

SEQ ID NO: 1007883 - RNA, 19 nt, Homo sapiens
gcaacggaauagugaauuu

SEQ ID NO: 1007884 - RNA, 19 nt, Homo sapiens
ugacagacaucaccaguug

SEQ ID NO: 1007885 - RNA, 19 nt, Homo sapiens
gacauuaagugaaacaguu

SEQ ID NO: 1007886 - RNA, 19 nt, Homo sapiens
ucaguuaaguugucagaaa

SEQ ID NO: 1007887 - RNA, 19 nt, Homo sapiens
gaagaugacauaguuugua

SEQ ID NO: 1007888 - RNA, 19 nt, Homo sapiens
uaaccugcaugaucuguuu

SEQ ID NO: 1007889 - RNA, 19 nt, Homo sapiens
gcauuaaccugcaugaucu

SEQ ID NO: 1007890 - RNA, 19 nt, Homo sapiens
caaugcuccuguuuacuua

SEQ ID NO: 1007891 - RNA, 19 nt, Homo sapiens
guaaauguaccacagauga

SEQ ID NO: 1007892 - RNA, 19 nt, Homo sapiens
uaacaaaggccaagaccaa

SEQ ID NO: 1007893 - RNA, 19 nt, Homo sapiens
gaggagagagaaugucuuu

SEQ ID NO: 1007894 - RNA, 19 nt, Homo sapiens
caugaucuguuucuacuau

SEQ ID NO: 1007895 - RNA, 19 nt, Homo sapiens
uccagaacguguagucuua

SEQ ID NO: 1007896 - RNA, 19 nt, Homo sapiens
gauaggaguuuucauuuga

SEQ ID NO: 1007897 - RNA, 19 nt, Homo sapiens
uugaagaucuuggucauuu

SEQ ID NO: 1007898 - RNA, 19 nt, Homo sapiens
gaacguguagucuuauuag

SEQ ID NO: 1007899 - RNA, 19 nt, Homo sapiens
ccaaggaccuccagaacgu

SEQ ID NO: 1007900 - RNA, 19 nt, Homo sapiens
ugaaauauuuggacaacuc

SEQ ID NO: 1007901 - RNA, 19 nt, Homo sapiens
ggagaggacauuaagugaa

SEQ ID NO: 1007902 - RNA, 19 nt, Homo sapiens
gacaauggaucuaaaaugu

SEQ ID NO: 1007903 - RNA, 19 nt, Homo sapiens
gaugaaauauuuggacaac

SEQ ID NO: 1007904 - RNA, 19 nt, Homo sapiens
ugaaacaguugacagacau

SEQ ID NO: 1007905 - RNA, 19 nt, Homo sapiens
gagaaaggaccuccaagag

SEQ ID NO: 1007906 - RNA, 19 nt, Homo sapiens
ucaaugcuccuguuuacuu

SEQ ID NO: 1007907 - RNA, 19 nt, Homo sapiens
ugaacaagucuuucuaaug

SEQ ID NO: 1007908 - RNA, 19 nt, Homo sapiens
gaagaucuuggucauuuua

SEQ ID NO: 1007909 - RNA, 19 nt, Homo sapiens
gugaaacaguugacagaca

SEQ ID NO: 1007910 - RNA, 19 nt, Homo sapiens
cagaacguguagucuuauu

SEQ ID NO: 1007911 - RNA, 19 nt, Homo sapiens
gcaugaacaagucuuucua

SEQ ID NO: 1007912 - RNA, 19 nt, Homo sapiens
ggauaggaguuuucauuug

SEQ ID NO: 1007913 - RNA, 19 nt, Homo sapiens
ggugcucaauaaauggaua

SEQ ID NO: 1007914 - RNA, 19 nt, Homo sapiens
caugaacaagucuuucuaa

SEQ ID NO: 1007915 - RNA, 19 nt, Homo sapiens
aggaagagguggugguuuc

SEQ ID NO: 1007916 - RNA, 19 nt, Homo sapiens
ccgcggaggcuuuaacaaa

SEQ ID NO: 1007917 - RNA, 19 nt, Homo sapiens
gggagaggacauuaaguga

SEQ ID NO: 1007918 - RNA, 19 nt, Homo sapiens
ugagaaaggaccuccaaga

SEQ ID NO: 1007919 - RNA, 19 nt, Homo sapiens
ugugggugcucaauaaaug

SEQ ID NO: 1007920 - RNA, 19 nt, Homo sapiens
cugugaagaugacauaguu

SEQ ID NO: 1007921 - RNA, 19 nt, Homo sapiens
gaaauauuuggacaacuca

SEQ ID NO: 1007922 - RNA, 19 nt, Homo sapiens
gcaaagugcaacggaauag

SEQ ID NO: 1007923 - RNA, 19 nt, Homo sapiens
gugaagaugacauaguuug

SEQ ID NO: 1007924 - RNA, 19 nt, Homo sapiens
gcuccuguuuacuuagaaa

SEQ ID NO: 1007925 - RNA, 19 nt, Homo sapiens
caauaaauggauaggaguu

SEQ ID NO: 1007926 - RNA, 19 nt, Homo sapiens
uaaaagagcaugaacaagu

SEQ ID NO: 1007927 - RNA, 19 nt, Homo sapiens
ggacauuaagugaaacagu

SEQ ID NO: 1007928 - RNA, 19 nt, Homo sapiens
uuggacaacucagagauuu

SEQ ID NO: 1007929 - RNA, 19 nt, Homo sapiens
uaaauguaccacagaugaa

SEQ ID NO: 1007930 - RNA, 19 nt, Homo sapiens
caauggaucuaaaauguca

SEQ ID NO: 1007931 - RNA, 19 nt, Homo sapiens
ggaggaagagguggugguu

SEQ ID NO: 1007932 - RNA, 19 nt, Homo sapiens
caaaggccaagaccaagga

SEQ ID NO: 1007933 - RNA, 19 nt, Homo sapiens
caguugacuucugcauuaa

SEQ ID NO: 1007934 - RNA, 19 nt, Homo sapiens
gacaucaccaguugacuuc

SEQ ID NO: 1007935 - RNA, 19 nt, Homo sapiens
ggagagagaaugucuuuuc

SEQ ID NO: 1007936 - RNA, 19 nt, Homo sapiens
ggaggucguggaggcuuua

SEQ ID NO: 1007937 - RNA, 19 nt, Homo sapiens
agaacguguagucuuauua

SEQ ID NO: 1007938 - RNA, 19 nt, Homo sapiens
ggucguggaggcuuuaauc

SEQ ID NO: 1007939 - RNA, 19 nt, Homo sapiens
cagagggagaggacauuaa

SEQ ID NO: 1007940 - RNA, 19 nt, Homo sapiens
ucagagggagaggacauua

SEQ ID NO: 1007941 - RNA, 19 nt, Homo sapiens
aagagguggugguuucaga

SEQ ID NO: 1007942 - RNA, 19 nt, Homo sapiens
uuucaaugcuccuguuuac

SEQ ID NO: 1007943 - RNA, 19 nt, Homo sapiens
uuucuacuauggauuggaa

SEQ ID NO: 1007944 - RNA, 19 nt, Homo sapiens
caucaccaguugacuucug

SEQ ID NO: 1007945 - RNA, 19 nt, Homo sapiens
acuauggauuggaaacuug

SEQ ID NO: 1007946 - RNA, 19 nt, Homo sapiens
agacaucaccaguugacuu

SEQ ID NO: 1007947 - RNA, 19 nt, Homo sapiens
ggaugaaauauuuggacaa

SEQ ID NO: 1007948 - RNA, 19 nt, Homo sapiens
cucugugggugcucaauaa

SEQ ID NO: 1007949 - RNA, 19 nt, Homo sapiens
aaauguaccacagaugaaa

SEQ ID NO: 1007950 - RNA, 19 nt, Homo sapiens
aaagugcaacggaauagug

SEQ ID NO: 1007951 - RNA, 19 nt, Homo sapiens
ggugagaaaggaccuccaa

SEQ ID NO: 1007952 - RNA, 19 nt, Homo sapiens
gaccaaggaccuccagaac

SEQ ID NO: 1007953 - RNA, 19 nt, Homo sapiens
ggaagagguggugguuuca

SEQ ID NO: 1007954 - RNA, 19 nt, Homo sapiens
cggaggucguggaggcuuu

SEQ ID NO: 1007955 - RNA, 19 nt, Homo sapiens
gaggaagagguggugguuu

SEQ ID NO: 1007956 - RNA, 19 nt, Homo sapiens
caguuaaguugucagaaaa

SEQ ID NO: 1007957 - RNA, 19 nt, Homo sapiens
uggaaaaguggaugaaaua

SEQ ID NO: 1007958 - RNA, 19 nt, Homo sapiens
guuccugcaucccugugaa

SEQ ID NO: 1007959 - RNA, 19 nt, Homo sapiens
gagcaugaacaagucuuuc

SEQ ID NO: 1007960 - RNA, 19 nt, Homo sapiens
agaccaaggaccuccagaa

SEQ ID NO: 1007961 - RNA, 19 nt, Homo sapiens
uacuauggauuggaaacuu

SEQ ID NO: 1007962 - RNA, 19 nt, Homo sapiens
ugcaugaucuguuucuacu

SEQ ID NO: 1007963 - RNA, 19 nt, Homo sapiens
ugaagaugacauaguuugu

SEQ ID NO: 1007964 - RNA, 19 nt, Homo sapiens
cagaggcggugguuuuaga

SEQ ID NO: 1007965 - RNA, 19 nt, Homo sapiens
uuauuucaaugcuccuguu

SEQ ID NO: 1007966 - RNA, 19 nt, Homo sapiens
guaccacagaugaaaauaa

SEQ ID NO: 1007967 - RNA, 19 nt, Homo sapiens
gaucuguuucuacuaugga

SEQ ID NO: 1007968 - RNA, 19 nt, Homo sapiens
gcaugaucuguuucuacua

SEQ ID NO: 1007969 - RNA, 19 nt, Homo sapiens
ggaggagagagaaugucuu

SEQ ID NO: 1007970 - RNA, 19 nt, Homo sapiens
aaaagagcaugaacaaguc

SEQ ID NO: 1007971 - RNA, 19 nt, Homo sapiens
gugcaacggaauagugaau

SEQ ID NO: 1007972 - RNA, 19 nt, Homo sapiens
gggaggagagagaaugucu

SEQ ID NO: 1007973 - RNA, 19 nt, Homo sapiens
gcacagaagugguaauaaa

SEQ ID NO: 1007974 - RNA, 19 nt, Homo sapiens
ggaagaacgugcacacaua

SEQ ID NO: 1007975 - RNA, 19 nt, Homo sapiens
gaaggaggcucacugaaga

SEQ ID NO: 1007976 - RNA, 19 nt, Homo sapiens
ccaaagagauucguaauga

SEQ ID NO: 1007977 - RNA, 19 nt, Homo sapiens
ggaggaugaugcuauauuu

SEQ ID NO: 1007978 - RNA, 19 nt, Homo sapiens
cgaagaagaucgaaaauua

SEQ ID NO: 1007979 - RNA, 19 nt, Homo sapiens
ugaaggaacucaaggaauu

SEQ ID NO: 1007980 - RNA, 19 nt, Homo sapiens
ggaaggaugcacauauuua

SEQ ID NO: 1007981 - RNA, 19 nt, Homo sapiens
gagugaaucuuccuucuug

SEQ ID NO: 1007982 - RNA, 19 nt, Homo sapiens
ggaauaaugcucugucuga

SEQ ID NO: 1007983 - RNA, 19 nt, Homo sapiens
gaaggaugcacauauuuaa

SEQ ID NO: 1007984 - RNA, 19 nt, Homo sapiens
cggaagaccuguccaguga

SEQ ID NO: 1007985 - RNA, 19 nt, Homo sapiens
gcaaacagcggcacaacaa

SEQ ID NO: 1007986 - RNA, 19 nt, Homo sapiens
ugaggcagcugucugagua

SEQ ID NO: 1007987 - RNA, 19 nt, Homo sapiens
gaagaaucgucacccaaga

SEQ ID NO: 1007988 - RNA, 19 nt, Homo sapiens
ccaagugccuggugcauug

SEQ ID NO: 1007989 - RNA, 19 nt, Homo sapiens
acaaugagaugcuacuuau

SEQ ID NO: 1007990 - RNA, 19 nt, Homo sapiens
agaaggaugugaagaagaa

SEQ ID NO: 1007991 - RNA, 19 nt, Homo sapiens
caaagagauucguaaugaa

SEQ ID NO: 1007992 - RNA, 19 nt, Homo sapiens
gaauaaugcucugucugaa

SEQ ID NO: 1007993 - RNA, 19 nt, Homo sapiens
caggaaggaugcacauauu

SEQ ID NO: 1007994 - RNA, 19 nt, Homo sapiens
gaaaggcgcagcccucuuc

SEQ ID NO: 1007995 - RNA, 19 nt, Homo sapiens
gacaagcccucccuuaucu

SEQ ID NO: 1007996 - RNA, 19 nt, Homo sapiens
gacaaugagaugcuacuua

SEQ ID NO: 1007997 - RNA, 19 nt, Homo sapiens
cauggaggaugaugcuaua

SEQ ID NO: 1007998 - RNA, 19 nt, Homo sapiens
gagaaacagaugaauugua

SEQ ID NO: 1007999 - RNA, 19 nt, Homo sapiens
ccagacgugucaagacuuu

SEQ ID NO: 1008000 - RNA, 19 nt, Homo sapiens
ggaacucaaggaauuuaua

SEQ ID NO: 1008001 - RNA, 19 nt, Homo sapiens
acagaugaauuguaacuug

SEQ ID NO: 1008002 - RNA, 19 nt, Homo sapiens
caucugggcuaccuacuau

SEQ ID NO: 1008003 - RNA, 19 nt, Homo sapiens
gcacacauccagacuguuc

SEQ ID NO: 1008004 - RNA, 19 nt, Homo sapiens
gagaagaaacuaaccaaca

SEQ ID NO: 1008005 - RNA, 19 nt, Homo sapiens
ggacaagcccucccuuauc

SEQ ID NO: 1008006 - RNA, 19 nt, Homo sapiens
cagaugaauuguaacuuga

SEQ ID NO: 1008007 - RNA, 19 nt, Homo sapiens
gcgcagcccucuucuuaca

SEQ ID NO: 1008008 - RNA, 19 nt, Homo sapiens
gcaggaaggaugcacauau

SEQ ID NO: 1008009 - RNA, 19 nt, Homo sapiens
gaagaaccauguuuuagga

SEQ ID NO: 1008010 - RNA, 19 nt, Homo sapiens
cuacuuaucuugggacaga

SEQ ID NO: 1008011 - RNA, 19 nt, Homo sapiens
ggaaggaggcucacugaag

SEQ ID NO: 1008012 - RNA, 19 nt, Homo sapiens
uaaccaacaugcagcacaa

SEQ ID NO: 1008013 - RNA, 19 nt, Homo sapiens
gaacucaaggaauuuauag

SEQ ID NO: 1008014 - RNA, 19 nt, Homo sapiens
gaaggaacucaaggaauuu

SEQ ID NO: 1008015 - RNA, 19 nt, Homo sapiens
uagagaaacagaugaauug

SEQ ID NO: 1008016 - RNA, 19 nt, Homo sapiens
ccacuggaaugaagcguau

SEQ ID NO: 1008017 - RNA, 19 nt, Homo sapiens
gcgcacacauccagacugu

SEQ ID NO: 1008018 - RNA, 19 nt, Homo sapiens
agaagaaacuaaccaacau

SEQ ID NO: 1008019 - RNA, 19 nt, Homo sapiens
caucuugauuucccuuaaa

SEQ ID NO: 1008020 - RNA, 19 nt, Homo sapiens
cggagaaccuaaacaacaa

SEQ ID NO: 1008021 - RNA, 19 nt, Homo sapiens
ucacaaggccugcgaagug

SEQ ID NO: 1008022 - RNA, 19 nt, Homo sapiens
caacccagcucgaucaaaa

SEQ ID NO: 1008023 - RNA, 19 nt, Homo sapiens
gcagcugucugaguaugaa

SEQ ID NO: 1008024 - RNA, 19 nt, Homo sapiens
ccuaugcaaugaaggaauu

SEQ ID NO: 1008025 - RNA, 19 nt, Homo sapiens
gaagaacgugcacacauag

SEQ ID NO: 1008026 - RNA, 19 nt, Homo sapiens
gaagaaacuaaccaacaug

SEQ ID NO: 1008027 - RNA, 19 nt, Homo sapiens
cagaagugguaauaaagga

SEQ ID NO: 1008028 - RNA, 19 nt, Homo sapiens
ccaacggcauggaggauga

SEQ ID NO: 1008029 - RNA, 19 nt, Homo sapiens
caggugaucugccucaaca

SEQ ID NO: 1008030 - RNA, 19 nt, Homo sapiens
ggaccgagcgccucaucaa

SEQ ID NO: 1008031 - RNA, 19 nt, Homo sapiens
caagaagaaccauguuuua

SEQ ID NO: 1008032 - RNA, 19 nt, Homo sapiens
gcgauagcauccacagugu

SEQ ID NO: 1008033 - RNA, 19 nt, Homo sapiens
ugaggcuucuguucaguaa

SEQ ID NO: 1008034 - RNA, 19 nt, Homo sapiens
cagcacagaagugguaaua

SEQ ID NO: 1008035 - RNA, 19 nt, Homo sapiens
ggagugaugagaagucaga

SEQ ID NO: 1008036 - RNA, 19 nt, Homo sapiens
gcaccaggaguccaucauu

SEQ ID NO: 1008037 - RNA, 19 nt, Homo sapiens
uaaacaaagcgaagaggaa

SEQ ID NO: 1008038 - RNA, 19 nt, Homo sapiens
aggcgcagcccucuucuua

SEQ ID NO: 1008039 - RNA, 19 nt, Homo sapiens
ccacaagcaugcaggugau

SEQ ID NO: 1008040 - RNA, 19 nt, Homo sapiens
ucagaugaguagucccaaa

SEQ ID NO: 1008041 - RNA, 19 nt, Homo sapiens
uaugaucccucccucacuu

SEQ ID NO: 1008042 - RNA, 19 nt, Homo sapiens
gugagaaggaugugaagaa

SEQ ID NO: 1008043 - RNA, 19 nt, Homo sapiens
aguaaaagcugcaccauug

SEQ ID NO: 1008044 - RNA, 19 nt, Homo sapiens
gcacugcugaguaaaguca

SEQ ID NO: 1008045 - RNA, 19 nt, Homo sapiens
gcaagguuccggacucugu

SEQ ID NO: 1008046 - RNA, 19 nt, Homo sapiens
aaagccagcugcccuucuu

SEQ ID NO: 1008047 - RNA, 19 nt, Homo sapiens
acacauaggcgcacacauc

SEQ ID NO: 1008048 - RNA, 19 nt, Homo sapiens
caccaggaguccaucauuc

SEQ ID NO: 1008049 - RNA, 19 nt, Homo sapiens
gaugagccaggaucuagaa

SEQ ID NO: 1008050 - RNA, 19 nt, Homo sapiens
gaggaggagaagaaacuaa

SEQ ID NO: 1008051 - RNA, 19 nt, Homo sapiens
gaccugaggcuucuguuca

SEQ ID NO: 1008052 - RNA, 19 nt, Homo sapiens
gaauuagagaaacagauga

SEQ ID NO: 1008053 - RNA, 19 nt, Homo sapiens
ugaauuagagaaacagaug

SEQ ID NO: 1008054 - RNA, 19 nt, Homo sapiens
aaaugugacuuccaaagag

SEQ ID NO: 1008055 - RNA, 19 nt, Homo sapiens
auaaugcucugucugaaag

SEQ ID NO: 1008056 - RNA, 19 nt, Homo sapiens
gagaggaggagaagaaacu

SEQ ID NO: 1008057 - RNA, 19 nt, Homo sapiens
uaaagagcccuucguggau

SEQ ID NO: 1008058 - RNA, 19 nt, Homo sapiens
uauuugggauccuuaacaa

SEQ ID NO: 1008059 - RNA, 19 nt, Homo sapiens
aaucuuccuucuugcauga

SEQ ID NO: 1008060 - RNA, 19 nt, Homo sapiens
ccaaggaccugaggcuucu

SEQ ID NO: 1008061 - RNA, 19 nt, Homo sapiens
gguaauaaaggaagaaucg

SEQ ID NO: 1008062 - RNA, 19 nt, Homo sapiens
uauagacaaugagaugcua

SEQ ID NO: 1008063 - RNA, 19 nt, Homo sapiens
gaugaauuguaacuugaag

SEQ ID NO: 1008064 - RNA, 19 nt, Homo sapiens
ucacuuucacuguggauuu

SEQ ID NO: 1008065 - RNA, 19 nt, Homo sapiens
gagcuagagcggcugaaga

SEQ ID NO: 1008066 - RNA, 19 nt, Homo sapiens
gaggaugaugcuauauuug

SEQ ID NO: 1008067 - RNA, 19 nt, Homo sapiens
gagaaggaugugaagaaga

SEQ ID NO: 1008068 - RNA, 19 nt, Homo sapiens
ugagaaggaugugaagaag

SEQ ID NO: 1008069 - RNA, 19 nt, Homo sapiens
gcugcaaccuccaaaccau

SEQ ID NO: 1008070 - RNA, 19 nt, Homo sapiens
gccaagcuccgaagcauca

SEQ ID NO: 1008071 - RNA, 19 nt, Homo sapiens
caacaugcagcacaagaag

SEQ ID NO: 1008072 - RNA, 19 nt, Homo sapiens
uuaaacgagugaagucauc

SEQ ID NO: 1008073 - RNA, 19 nt, Homo sapiens
ggaaauaccucaaggagua

SEQ ID NO: 1008074 - RNA, 19 nt, Homo sapiens
ucacaaagcuccuaaguuu

SEQ ID NO: 1008075 - RNA, 19 nt, Homo sapiens
gcaaggcucuguagauuga

SEQ ID NO: 1008076 - RNA, 19 nt, Homo sapiens
caagguagccacuguguua

SEQ ID NO: 1008077 - RNA, 19 nt, Homo sapiens
gagaaacccugcaaagaug

SEQ ID NO: 1008078 - RNA, 19 nt, Homo sapiens
gaauggagguguagagaca

SEQ ID NO: 1008079 - RNA, 19 nt, Homo sapiens
ggacaucuccuaauacaag

SEQ ID NO: 1008080 - RNA, 19 nt, Homo sapiens
gagcacagguccucguuca

SEQ ID NO: 1008081 - RNA, 19 nt, Homo sapiens
cuaaugaucaggaaucuaa

SEQ ID NO: 1008082 - RNA, 19 nt, Homo sapiens
gaagagaaacccugcaaag

SEQ ID NO: 1008083 - RNA, 19 nt, Homo sapiens
agacagacauccucuagau

SEQ ID NO: 1008084 - RNA, 19 nt, Homo sapiens
gcccugaguuucuguguga

SEQ ID NO: 1008085 - RNA, 19 nt, Homo sapiens
caacaggaaucacaaagcu

SEQ ID NO: 1008086 - RNA, 19 nt, Homo sapiens
caagcgcucugucucaaug

SEQ ID NO: 1008087 - RNA, 19 nt, Homo sapiens
cccaggagcugucugagaa

SEQ ID NO: 1008088 - RNA, 19 nt, Homo sapiens
gcucaugcacugccuguuu

SEQ ID NO: 1008089 - RNA, 19 nt, Homo sapiens
gaaucuugguaacuccuaa

SEQ ID NO: 1008090 - RNA, 19 nt, Homo sapiens
gguagccacuguguuacua

SEQ ID NO: 1008091 - RNA, 19 nt, Homo sapiens
ggagaaacccucggaaugg

SEQ ID NO: 1008092 - RNA, 19 nt, Homo sapiens
gggagaaacccucggaaug

SEQ ID NO: 1008093 - RNA, 19 nt, Homo sapiens
ggaagaaggacccgacaca

SEQ ID NO: 1008094 - RNA, 19 nt, Homo sapiens
ggaguaagccugggagcaa

SEQ ID NO: 1008095 - RNA, 19 nt, Homo sapiens
cugcaaggcucuguagauu

SEQ ID NO: 1008096 - RNA, 19 nt, Homo sapiens
acaaagcuccuaaguuuca

SEQ ID NO: 1008097 - RNA, 19 nt, Homo sapiens
gaaauaccucaaggaguaa

SEQ ID NO: 1008098 - RNA, 19 nt, Homo sapiens
gucccucucucuucacuuu

SEQ ID NO: 1008099 - RNA, 19 nt, Homo sapiens
agacccacauaagguauua

SEQ ID NO: 1008100 - RNA, 19 nt, Homo sapiens
uagccacuguguuacuaua

SEQ ID NO: 1008101 - RNA, 19 nt, Homo sapiens
uuuggucccuugacauaua

SEQ ID NO: 1008102 - RNA, 19 nt, Homo sapiens
gguagcagaaucuugguaa

SEQ ID NO: 1008103 - RNA, 19 nt, Homo sapiens
gcagacagacauccucuag

SEQ ID NO: 1008104 - RNA, 19 nt, Homo sapiens
ggaaucacaaagcuccuaa

SEQ ID NO: 1008105 - RNA, 19 nt, Homo sapiens
uguaauccuugccaucgua

SEQ ID NO: 1008106 - RNA, 19 nt, Homo sapiens
agagaaacccugcaaagau

SEQ ID NO: 1008107 - RNA, 19 nt, Homo sapiens
gagaagagaaacccugcaa

SEQ ID NO: 1008108 - RNA, 19 nt, Homo sapiens
ugucuccucuucccaauau

SEQ ID NO: 1008109 - RNA, 19 nt, Homo sapiens
ccacauaagguauuaaagg

SEQ ID NO: 1008110 - RNA, 19 nt, Homo sapiens
ccacuguguuacuauaugu

SEQ ID NO: 1008111 - RNA, 19 nt, Homo sapiens
gauagaauagagaccaguu

SEQ ID NO: 1008112 - RNA, 19 nt, Homo sapiens
gaaggacccgacacagguu

SEQ ID NO: 1008113 - RNA, 19 nt, Homo sapiens
ugacuuuggucccuugaca

SEQ ID NO: 1008114 - RNA, 19 nt, Homo sapiens
auagagaccaguuugcuuu

SEQ ID NO: 1008115 - RNA, 19 nt, Homo sapiens
gagugcaugagauagaaua

SEQ ID NO: 1008116 - RNA, 19 nt, Homo sapiens
gccaagcgcucugucucaa

SEQ ID NO: 1008117 - RNA, 19 nt, Homo sapiens
gggagagggagaagagaaa

SEQ ID NO: 1008118 - RNA, 19 nt, Homo sapiens
uaagcaagcuggugauacc

SEQ ID NO: 1008119 - RNA, 19 nt, Homo sapiens
ggacauggugguguggaaa

SEQ ID NO: 1008120 - RNA, 19 nt, Homo sapiens
gccacuguguuacuauaug

SEQ ID NO: 1008121 - RNA, 19 nt, Homo sapiens
cuugguaacuccuaaugau

SEQ ID NO: 1008122 - RNA, 19 nt, Homo sapiens
uagaauagagaccaguuug

SEQ ID NO: 1008123 - RNA, 19 nt, Homo sapiens
cccguggacucuucuagaa

SEQ ID NO: 1008124 - RNA, 19 nt, Homo sapiens
gggacauggugguguggaa

SEQ ID NO: 1008125 - RNA, 19 nt, Homo sapiens
ggcagacccacauaaggua

SEQ ID NO: 1008126 - RNA, 19 nt, Homo sapiens
cuagaaacccgacacucaa

SEQ ID NO: 1008127 - RNA, 19 nt, Homo sapiens
acauggugguguggaaaua

SEQ ID NO: 1008128 - RNA, 19 nt, Homo sapiens
gaaacccgacacucaaugg

SEQ ID NO: 1008129 - RNA, 19 nt, Homo sapiens
aauacaagguagccacugu

SEQ ID NO: 1008130 - RNA, 19 nt, Homo sapiens
gacucccgcuuguaguauu

SEQ ID NO: 1008131 - RNA, 19 nt, Homo sapiens
gaauagagaccaguuugcu

SEQ ID NO: 1008132 - RNA, 19 nt, Homo sapiens
ggagcugucugagaaacca

SEQ ID NO: 1008133 - RNA, 19 nt, Homo sapiens
ucuagaaacccgacacuca

SEQ ID NO: 1008134 - RNA, 19 nt, Homo sapiens
aagagaaacccugcaaaga

SEQ ID NO: 1008135 - RNA, 19 nt, Homo sapiens
gugacucccgcuuguagua

SEQ ID NO: 1008136 - RNA, 19 nt, Homo sapiens
uauuaaaggccaacugcaa

SEQ ID NO: 1008137 - RNA, 19 nt, Homo sapiens
gcagacccacauaagguau

SEQ ID NO: 1008138 - RNA, 19 nt, Homo sapiens
ggaccaaccugcggggauu

SEQ ID NO: 1008139 - RNA, 19 nt, Homo sapiens
gggaauggagguguagaga

SEQ ID NO: 1008140 - RNA, 19 nt, Homo sapiens
gagcuugcccugggaaugg

SEQ ID NO: 1008141 - RNA, 19 nt, Homo sapiens
gugggugcgugggaacuuu

SEQ ID NO: 1008142 - RNA, 19 nt, Homo sapiens
cucuguagauugauguauu

SEQ ID NO: 1008143 - RNA, 19 nt, Homo sapiens
ccauagcccugaguuucug

SEQ ID NO: 1008144 - RNA, 19 nt, Homo sapiens
ugcaugagauagaauagag

SEQ ID NO: 1008145 - RNA, 19 nt, Homo sapiens
gggagcuuguugccagaga

SEQ ID NO: 1008146 - RNA, 19 nt, Homo sapiens
uaaaggccaacugcaaaga

SEQ ID NO: 1008147 - RNA, 19 nt, Homo sapiens
caucuccuaauacaaggua

SEQ ID NO: 1008148 - RNA, 19 nt, Homo sapiens
guaauccuugccaucguaa

SEQ ID NO: 1008149 - RNA, 19 nt, Homo sapiens
ucacuuucccagacaaugu

SEQ ID NO: 1008150 - RNA, 19 nt, Homo sapiens
uuacaacaggaaucacaaa

SEQ ID NO: 1008151 - RNA, 19 nt, Homo sapiens
ccacgucgcagacagacau

SEQ ID NO: 1008152 - RNA, 19 nt, Homo sapiens
gcgcucugucucaauguuu

SEQ ID NO: 1008153 - RNA, 19 nt, Homo sapiens
gcccaggagcugucugaga

SEQ ID NO: 1008154 - RNA, 19 nt, Homo sapiens
ucaaugggagugagaacug

SEQ ID NO: 1008155 - RNA, 19 nt, Homo sapiens
gcaugagauagaauagaga

SEQ ID NO: 1008156 - RNA, 19 nt, Homo sapiens
cugagugcaugagauagaa

SEQ ID NO: 1008157 - RNA, 19 nt, Homo sapiens
ggugaguacccaggaagaa

SEQ ID NO: 1008158 - RNA, 19 nt, Homo sapiens
cguaagcaagcuggugaua

SEQ ID NO: 1008159 - RNA, 19 nt, Homo sapiens
ucacuuugcaucacggaau

SEQ ID NO: 1008160 - RNA, 19 nt, Homo sapiens
guagcagaaucuugguaac

SEQ ID NO: 1008161 - RNA, 19 nt, Homo sapiens
uacaguggguagcagaauc

SEQ ID NO: 1008162 - RNA, 19 nt, Homo sapiens
ugccugagugcaugagaua

SEQ ID NO: 1008163 - RNA, 19 nt, Homo sapiens
auuaaaggccaacugcaaa

SEQ ID NO: 1008164 - RNA, 19 nt, Homo sapiens
gacauggugguguggaaau

SEQ ID NO: 1008165 - RNA, 19 nt, Homo sapiens
uagaaacccgacacucaau

SEQ ID NO: 1008166 - RNA, 19 nt, Homo sapiens
gugcgugggaacuuuagaa

SEQ ID NO: 1008167 - RNA, 19 nt, Homo sapiens
gaagaaaucuggaaguuuu

SEQ ID NO: 1008168 - RNA, 19 nt, Homo sapiens
ucauugaccuccagaagaa

SEQ ID NO: 1008169 - RNA, 19 nt, Homo sapiens
aagcagggaagaucuauua

SEQ ID NO: 1008170 - RNA, 19 nt, Homo sapiens
aggcacagcugaagaucua

SEQ ID NO: 1008171 - RNA, 19 nt, Homo sapiens
ggaucguggugacguuuaa

SEQ ID NO: 1008172 - RNA, 19 nt, Homo sapiens
gaacguggcccuguacaca

SEQ ID NO: 1008173 - RNA, 19 nt, Homo sapiens
cagggaagaucuauuacau

SEQ ID NO: 1008174 - RNA, 19 nt, Homo sapiens
gcacuggacuacaccaaac

SEQ ID NO: 1008175 - RNA, 19 nt, Homo sapiens
uggcaaaccugcucaugga

SEQ ID NO: 1008176 - RNA, 19 nt, Homo sapiens
gcucucggcuucacucauc

SEQ ID NO: 1008177 - RNA, 19 nt, Homo sapiens
gcauuuaccggaagcagaa

SEQ ID NO: 1008178 - RNA, 19 nt, Homo sapiens
ggccaaauagcaauaaaug

SEQ ID NO: 1008179 - RNA, 19 nt, Homo sapiens
caggagggcuuggaguuug

SEQ ID NO: 1008180 - RNA, 19 nt, Homo sapiens
ugcagaaggugaagaaugu

SEQ ID NO: 1008181 - RNA, 19 nt, Homo sapiens
gcucucagacugcuaccua

SEQ ID NO: 1008182 - RNA, 19 nt, Homo sapiens
ggacuacaccaaacgaagu

SEQ ID NO: 1008183 - RNA, 19 nt, Homo sapiens
gaaagcuggccuccucaug

SEQ ID NO: 1008184 - RNA, 19 nt, Homo sapiens
aaagaaauaccuccaccuu

SEQ ID NO: 1008185 - RNA, 19 nt, Homo sapiens
ggagcagccucaucagcau

SEQ ID NO: 1008186 - RNA, 19 nt, Homo sapiens
uuucaucagugggcucuua

SEQ ID NO: 1008187 - RNA, 19 nt, Homo sapiens
ggaccaggagggcgugauu

SEQ ID NO: 1008188 - RNA, 19 nt, Homo sapiens
guacagccuggacucagua

SEQ ID NO: 1008189 - RNA, 19 nt, Homo sapiens
guggugacguuuaagacuu

SEQ ID NO: 1008190 - RNA, 19 nt, Homo sapiens
ucggugacaucaucuucua

SEQ ID NO: 1008191 - RNA, 19 nt, Homo sapiens
gcagggaagaucuauuaca

SEQ ID NO: 1008192 - RNA, 19 nt, Homo sapiens
ugaagaaaucuggaaguuu

SEQ ID NO: 1008193 - RNA, 19 nt, Homo sapiens
uugaagaaaucuggaaguu

SEQ ID NO: 1008194 - RNA, 19 nt, Homo sapiens
ucuacuacgugaaggugua

SEQ ID NO: 1008195 - RNA, 19 nt, Homo sapiens
gggcgugauugccaacaug

SEQ ID NO: 1008196 - RNA, 19 nt, Homo sapiens
ugucgccgguggcucauuu

SEQ ID NO: 1008197 - RNA, 19 nt, Homo sapiens
gaaggacccguuugaugca

SEQ ID NO: 1008198 - RNA, 19 nt, Homo sapiens
gugucaagguggccucauu

SEQ ID NO: 1008199 - RNA, 19 nt, Homo sapiens
cuagagcggcugcugcuuu

SEQ ID NO: 1008200 - RNA, 19 nt, Homo sapiens
ggagacggccauccaaguc

SEQ ID NO: 1008201 - RNA, 19 nt, Homo sapiens
ugaggcggcuggagacauc

SEQ ID NO: 1008202 - RNA, 19 nt, Homo sapiens
gagcugcggcugugcaaca

SEQ ID NO: 1008203 - RNA, 19 nt, Homo sapiens
gggagaaagcuguguccuu

SEQ ID NO: 1008204 - RNA, 19 nt, Homo sapiens
gcaguggaagccagugcua

SEQ ID NO: 1008205 - RNA, 19 nt, Homo sapiens
agaagaaccgggagaagug

SEQ ID NO: 1008206 - RNA, 19 nt, Homo sapiens
cacaggagaccuugcagaa

SEQ ID NO: 1008207 - RNA, 19 nt, Homo sapiens
gugcggagcagccucauca

SEQ ID NO: 1008208 - RNA, 19 nt, Homo sapiens
gcaagcagggaagaucuau

SEQ ID NO: 1008209 - RNA, 19 nt, Homo sapiens
gaagaaccgggagaagugu

SEQ ID NO: 1008210 - RNA, 19 nt, Homo sapiens
ugagcucacugcugcuguu

SEQ ID NO: 1008211 - RNA, 19 nt, Homo sapiens
ggaggagacggccauccaa

SEQ ID NO: 1008212 - RNA, 19 nt, Homo sapiens
uggugacguuuaagacuuu

SEQ ID NO: 1008213 - RNA, 19 nt, Homo sapiens
ccaggaccuucgccacaga

SEQ ID NO: 1008214 - RNA, 19 nt, Homo sapiens
ggugcucggugacaucauc

SEQ ID NO: 1008215 - RNA, 19 nt, Homo sapiens
ccaggagggcuuggaguuu

SEQ ID NO: 1008216 - RNA, 19 nt, Homo sapiens
caaccuggccagcauuuac

SEQ ID NO: 1008217 - RNA, 19 nt, Homo sapiens
gguccggacuguggucaug

SEQ ID NO: 1008218 - RNA, 19 nt, Homo sapiens
gcaagguggccgacaaggu

SEQ ID NO: 1008219 - RNA, 19 nt, Homo sapiens
caagaaggcacagcugaag

SEQ ID NO: 1008220 - RNA, 19 nt, Homo sapiens
cagaagaaccgggagaagu

SEQ ID NO: 1008221 - RNA, 19 nt, Homo sapiens
guggcgaccucaucgagau

SEQ ID NO: 1008222 - RNA, 19 nt, Homo sapiens
gaacgcaggggccaaauag

SEQ ID NO: 1008223 - RNA, 19 nt, Homo sapiens
gcgagcugguggaccucua

SEQ ID NO: 1008224 - RNA, 19 nt, Homo sapiens
gcccuucuuuguccugugu

SEQ ID NO: 1008225 - RNA, 19 nt, Homo sapiens
acaagaaggcacagcugaa

SEQ ID NO: 1008226 - RNA, 19 nt, Homo sapiens
cagcuuccguggccuguac

SEQ ID NO: 1008227 - RNA, 19 nt, Homo sapiens
gcacagcugaagaucuaca

SEQ ID NO: 1008228 - RNA, 19 nt, Homo sapiens
acaaauccgcacuggacua

SEQ ID NO: 1008229 - RNA, 19 nt, Homo sapiens
ucugugagcugggagaaag

SEQ ID NO: 1008230 - RNA, 19 nt, Homo sapiens
caccaucuaccacaacuuc

SEQ ID NO: 1008231 - RNA, 19 nt, Homo sapiens
ggaccugggcaacaagaag

SEQ ID NO: 1008232 - RNA, 19 nt, Homo sapiens
gcuuggaguuugcccacau

SEQ ID NO: 1008233 - RNA, 19 nt, Homo sapiens
gggccaaauagcaauaaau

SEQ ID NO: 1008234 - RNA, 19 nt, Homo sapiens
cugaaggacccguuugaug

SEQ ID NO: 1008235 - RNA, 19 nt, Homo sapiens
cagagcacuucuaccucaa

SEQ ID NO: 1008236 - RNA, 19 nt, Homo sapiens
cuggagacaucuucuucga

SEQ ID NO: 1008237 - RNA, 19 nt, Homo sapiens
ccugcaagguggccgacaa

SEQ ID NO: 1008238 - RNA, 19 nt, Homo sapiens
gcaauaaauggguuuuguu

SEQ ID NO: 1008239 - RNA, 19 nt, Homo sapiens
gggaguggguuuugugcaa

SEQ ID NO: 1008240 - RNA, 19 nt, Homo sapiens
cauccaagggaguggguuu

SEQ ID NO: 1008241 - RNA, 19 nt, Homo sapiens
agaaggcacagcugaagau

SEQ ID NO: 1008242 - RNA, 19 nt, Homo sapiens
acauccagguggcacagaa

SEQ ID NO: 1008243 - RNA, 19 nt, Homo sapiens
gcugguggaccucuacauc

SEQ ID NO: 1008244 - RNA, 19 nt, Homo sapiens
acuccuggcugacaucuac

SEQ ID NO: 1008245 - RNA, 19 nt, Homo sapiens
uagagcggcugcugcuuuu

SEQ ID NO: 1008246 - RNA, 19 nt, Homo sapiens
gcagaagaaccgggagaag

SEQ ID NO: 1008247 - RNA, 19 nt, Homo sapiens
gcagaaggugaagaauguu

SEQ ID NO: 1008248 - RNA, 19 nt, Homo sapiens
caucagugggcucuuagga

SEQ ID NO: 1008249 - RNA, 19 nt, Homo sapiens
guggaagccagugcuauug

SEQ ID NO: 1008250 - RNA, 19 nt, Homo sapiens
ccacgagagccuccucauc

SEQ ID NO: 1008251 - RNA, 19 nt, Homo sapiens
ggaugagaacgccuuaagg

SEQ ID NO: 1008252 - RNA, 19 nt, Homo sapiens
gaaggcacagcugaagauc

SEQ ID NO: 1008253 - RNA, 19 nt, Homo sapiens
cgaccugaaggacccguuu

SEQ ID NO: 1008254 - RNA, 19 nt, Homo sapiens
gaaagcuguguccuucuac

SEQ ID NO: 1008255 - RNA, 19 nt, Homo sapiens
caaacgaagucuggggauu

SEQ ID NO: 1008256 - RNA, 19 nt, Homo sapiens
ucccugccgugaccacuga

SEQ ID NO: 1008257 - RNA, 19 nt, Homo sapiens
ccaaccuggccagcauuua

SEQ ID NO: 1008258 - RNA, 19 nt, Homo sapiens
gcucacugcugcuguuccu

SEQ ID NO: 1008259 - RNA, 19 nt, Homo sapiens
gaacauggcagcagaauga

SEQ ID NO: 1008260 - RNA, 19 nt, Homo sapiens
ggaugucccucuacuguua

SEQ ID NO: 1008261 - RNA, 19 nt, Homo sapiens
gaaagagaggucagaaaua

SEQ ID NO: 1008262 - RNA, 19 nt, Homo sapiens
gggaugggcuggugagaaa

SEQ ID NO: 1008263 - RNA, 19 nt, Homo sapiens
gcacugagggugugucuuu

SEQ ID NO: 1008264 - RNA, 19 nt, Homo sapiens
gcacgagagugguuugguu

SEQ ID NO: 1008265 - RNA, 19 nt, Homo sapiens
gaagacagcacaaaguaug

SEQ ID NO: 1008266 - RNA, 19 nt, Homo sapiens
uaagguaucuaacggcaaa

SEQ ID NO: 1008267 - RNA, 19 nt, Homo sapiens
agaauccucuuuccuuuaa

SEQ ID NO: 1008268 - RNA, 19 nt, Homo sapiens
gaugaucccugcuggguau

SEQ ID NO: 1008269 - RNA, 19 nt, Homo sapiens
ggagggacagugugaauaa

SEQ ID NO: 1008270 - RNA, 19 nt, Homo sapiens
aaagagaggucagaaauag

SEQ ID NO: 1008271 - RNA, 19 nt, Homo sapiens
gugaauaaauggcaucuag

SEQ ID NO: 1008272 - RNA, 19 nt, Homo sapiens
gcagaacauugccaucaug

SEQ ID NO: 1008273 - RNA, 19 nt, Homo sapiens
gaagcagacugaccacauc

SEQ ID NO: 1008274 - RNA, 19 nt, Homo sapiens
ucagaauccucuuuccuuu

SEQ ID NO: 1008275 - RNA, 19 nt, Homo sapiens
uuacugcgguguuaaggua

SEQ ID NO: 1008276 - RNA, 19 nt, Homo sapiens
cagugugaauuccuaaaua

SEQ ID NO: 1008277 - RNA, 19 nt, Homo sapiens
ggagauucauccagcuuug

SEQ ID NO: 1008278 - RNA, 19 nt, Homo sapiens
gaauaaauggcaucuagga

SEQ ID NO: 1008279 - RNA, 19 nt, Homo sapiens
ggagucaccuuauaacacu

SEQ ID NO: 1008280 - RNA, 19 nt, Homo sapiens
ggucagaaauagcaagcaa

SEQ ID NO: 1008281 - RNA, 19 nt, Homo sapiens
ggucaaggcacuaguauca

SEQ ID NO: 1008282 - RNA, 19 nt, Homo sapiens
aaauaucccuuugaacuug

SEQ ID NO: 1008283 - RNA, 19 nt, Homo sapiens
gagcacaggcugcaccaaa

SEQ ID NO: 1008284 - RNA, 19 nt, Homo sapiens
ucaaggcacuaguaucaga

SEQ ID NO: 1008285 - RNA, 19 nt, Homo sapiens
gcagcaggaugucccucua

SEQ ID NO: 1008286 - RNA, 19 nt, Homo sapiens
gggacagugugaauaaaug

SEQ ID NO: 1008287 - RNA, 19 nt, Homo sapiens
cuaaauagaggguaaagug

SEQ ID NO: 1008288 - RNA, 19 nt, Homo sapiens
gagaaagagaggucagaaa

SEQ ID NO: 1008289 - RNA, 19 nt, Homo sapiens
gauccgagcagaagcagaa

SEQ ID NO: 1008290 - RNA, 19 nt, Homo sapiens
cagaauccucuuuccuuua

SEQ ID NO: 1008291 - RNA, 19 nt, Homo sapiens
guaaagguggaauugagua

SEQ ID NO: 1008292 - RNA, 19 nt, Homo sapiens
ugauugggcuuccucauag

SEQ ID NO: 1008293 - RNA, 19 nt, Homo sapiens
ggugagaaaguucaaauuc

SEQ ID NO: 1008294 - RNA, 19 nt, Homo sapiens
gagggacagugugaauaaa

SEQ ID NO: 1008295 - RNA, 19 nt, Homo sapiens
uaaauagaggguaaaguga

SEQ ID NO: 1008296 - RNA, 19 nt, Homo sapiens
aagaagacagcacaaagua

SEQ ID NO: 1008297 - RNA, 19 nt, Homo sapiens
caagaagacagcacaaagu

SEQ ID NO: 1008298 - RNA, 19 nt, Homo sapiens
ugagaaaguucaaauucca

SEQ ID NO: 1008299 - RNA, 19 nt, Homo sapiens
caaggucaaggcacuagua

SEQ ID NO: 1008300 - RNA, 19 nt, Homo sapiens
agaaagagaggucagaaau

SEQ ID NO: 1008301 - RNA, 19 nt, Homo sapiens
gagcugcgacgacuugaug

SEQ ID NO: 1008302 - RNA, 19 nt, Homo sapiens
cugcugcccuuuacuguga

SEQ ID NO: 1008303 - RNA, 19 nt, Homo sapiens
cuaggaagguaaacuccaa

SEQ ID NO: 1008304 - RNA, 19 nt, Homo sapiens
guagcaaaguggccaccuu

SEQ ID NO: 1008305 - RNA, 19 nt, Homo sapiens
caguaaagguggaauugag

SEQ ID NO: 1008306 - RNA, 19 nt, Homo sapiens
ggcaggagaaggcccauuu

SEQ ID NO: 1008307 - RNA, 19 nt, Homo sapiens
gcagugugaauuccuaaau

SEQ ID NO: 1008308 - RNA, 19 nt, Homo sapiens
ccucaguguugcaguguga

SEQ ID NO: 1008309 - RNA, 19 nt, Homo sapiens
gggugugucuuuguacuug

SEQ ID NO: 1008310 - RNA, 19 nt, Homo sapiens
gcaugaagcagcugaucga

SEQ ID NO: 1008311 - RNA, 19 nt, Homo sapiens
gaucccugcuggguauuug

SEQ ID NO: 1008312 - RNA, 19 nt, Homo sapiens
cagcacaaaguauggguuu

SEQ ID NO: 1008313 - RNA, 19 nt, Homo sapiens
cugagggugugucuuugua

SEQ ID NO: 1008314 - RNA, 19 nt, Homo sapiens
gaucaccagcgaugacuuc

SEQ ID NO: 1008315 - RNA, 19 nt, Homo sapiens
ccaagaagacagcacaaag

SEQ ID NO: 1008316 - RNA, 19 nt, Homo sapiens
aagguggaauugaguauca

SEQ ID NO: 1008317 - RNA, 19 nt, Homo sapiens
ccacacaccuuggccuucu

SEQ ID NO: 1008318 - RNA, 19 nt, Homo sapiens
gaauccucuuuccuuuaaa

SEQ ID NO: 1008319 - RNA, 19 nt, Homo sapiens
cuaccaagcugggcaagag

SEQ ID NO: 1008320 - RNA, 19 nt, Homo sapiens
acacuagccgcauugauga

SEQ ID NO: 1008321 - RNA, 19 nt, Homo sapiens
gcugugugccucaguguug

SEQ ID NO: 1008322 - RNA, 19 nt, Homo sapiens
acggagagcuagggagaaa

SEQ ID NO: 1008323 - RNA, 19 nt, Homo sapiens
cgagagugguuugguuuag

SEQ ID NO: 1008324 - RNA, 19 nt, Homo sapiens
ucaucccgcugcugaaaga

SEQ ID NO: 1008325 - RNA, 19 nt, Homo sapiens
agggauuacugcgguguua

SEQ ID NO: 1008326 - RNA, 19 nt, Homo sapiens
ccaaucagaauccucuuuc

SEQ ID NO: 1008327 - RNA, 19 nt, Homo sapiens
ggagguggagggacagugu

SEQ ID NO: 1008328 - RNA, 19 nt, Homo sapiens
uagcacagauugagaaccu

SEQ ID NO: 1008329 - RNA, 19 nt, Homo sapiens
gugagaaaguucaaauucc

SEQ ID NO: 1008330 - RNA, 19 nt, Homo sapiens
caggaugucccucuacugu

SEQ ID NO: 1008331 - RNA, 19 nt, Homo sapiens
ucaucgaccugcucaccuu

SEQ ID NO: 1008332 - RNA, 19 nt, Homo sapiens
guugcagugugaauuccua

SEQ ID NO: 1008333 - RNA, 19 nt, Homo sapiens
uacacuagccgcauugaug

SEQ ID NO: 1008334 - RNA, 19 nt, Homo sapiens
agugugaauuccuaaauag

SEQ ID NO: 1008335 - RNA, 19 nt, Homo sapiens
uugauugggcuuccucaua

SEQ ID NO: 1008336 - RNA, 19 nt, Homo sapiens
ggacagugugaauaaaugg

SEQ ID NO: 1008337 - RNA, 19 nt, Homo sapiens
gcgaugacuucugcaccuu

SEQ ID NO: 1008338 - RNA, 19 nt, Homo sapiens
ccagcuuuguggauuuaga

SEQ ID NO: 1008339 - RNA, 19 nt, Homo sapiens
uugaguaucagagggauua

SEQ ID NO: 1008340 - RNA, 19 nt, Homo sapiens
ccaagugguucugcaaggu

SEQ ID NO: 1008341 - RNA, 19 nt, Homo sapiens
ggagauccgagcagaagca

SEQ ID NO: 1008342 - RNA, 19 nt, Homo sapiens
cagaacauugccaucauga

SEQ ID NO: 1008343 - RNA, 19 nt, Homo sapiens
uaaagguggaauugaguau

SEQ ID NO: 1008344 - RNA, 19 nt, Homo sapiens
caucaucccgcugcugaaa

SEQ ID NO: 1008345 - RNA, 19 nt, Homo sapiens
ggagagcuagggagaaagg

SEQ ID NO: 1008346 - RNA, 19 nt, Homo sapiens
cuucuacacuagccgcauu

SEQ ID NO: 1008347 - RNA, 19 nt, Homo sapiens
ggcaggguguagacguuug

SEQ ID NO: 1008348 - RNA, 19 nt, Homo sapiens
ccaguaaagguggaauuga

SEQ ID NO: 1008349 - RNA, 19 nt, Homo sapiens
gagggugugucuuuguacu

SEQ ID NO: 1008350 - RNA, 19 nt, Homo sapiens
ucaagcaggaugucacugu

SEQ ID NO: 1008351 - RNA, 19 nt, Homo sapiens
gccuucaguuccaaucaga

SEQ ID NO: 1008352 - RNA, 19 nt, Homo sapiens
gccaagaagacagcacaaa

SEQ ID NO: 1008353 - RNA, 19 nt, Homo sapiens
caccuuauaacacuauuuc

SEQ ID NO: 1008354 - RNA, 19 nt, Homo sapiens
cacgagagugguuugguuu

SEQ ID NO: 1008355 - RNA, 19 nt, Homo sapiens
aauggcaucuaggaaggua

SEQ ID NO: 1008356 - RNA, 19 nt, Homo sapiens
gcagacugaccacaucaag

SEQ ID NO: 1008357 - RNA, 19 nt, Homo sapiens
ggacuuggugugcauuaac

SEQ ID NO: 1008358 - RNA, 19 nt, Homo sapiens
gcaagagcuuuuaggagau

SEQ ID NO: 1008359 - RNA, 19 nt, Homo sapiens
gagaaacacaccucaauga

SEQ ID NO: 1008360 - RNA, 19 nt, Homo sapiens
ggugggcucuuucaaauuc

SEQ ID NO: 1008361 - RNA, 19 nt, Homo sapiens
gaagauggcgcuggccuuu

SEQ ID NO: 1008362 - RNA, 19 nt, Homo sapiens
ugaaggcccugucagaaga

SEQ ID NO: 1008363 - RNA, 19 nt, Homo sapiens
ucaaagagcugcgagaaac

SEQ ID NO: 1008364 - RNA, 19 nt, Homo sapiens
gcagaaaggagaugugauc

SEQ ID NO: 1008365 - RNA, 19 nt, Homo sapiens
caaggugggcucuuucaaa

SEQ ID NO: 1008366 - RNA, 19 nt, Homo sapiens
gcaagaggagcaugaacuu

SEQ ID NO: 1008367 - RNA, 19 nt, Homo sapiens
agaaggagcccacucagaa

SEQ ID NO: 1008368 - RNA, 19 nt, Homo sapiens
caacaaggccuccaaaucc

SEQ ID NO: 1008369 - RNA, 19 nt, Homo sapiens
gaugauaacauuccagaag

SEQ ID NO: 1008370 - RNA, 19 nt, Homo sapiens
gggaaacccugcccauguc

SEQ ID NO: 1008371 - RNA, 19 nt, Homo sapiens
gcagugaggaggcugaaga

SEQ ID NO: 1008372 - RNA, 19 nt, Homo sapiens
gaaggaguuuaaucuggau

SEQ ID NO: 1008373 - RNA, 19 nt, Homo sapiens
gaaguggagggcagugauu

SEQ ID NO: 1008374 - RNA, 19 nt, Homo sapiens
ccaugucccucaccaacaa

SEQ ID NO: 1008375 - RNA, 19 nt, Homo sapiens
gcagugauuucccgaacca

SEQ ID NO: 1008376 - RNA, 19 nt, Homo sapiens
gaagaugggcaagaugaug

SEQ ID NO: 1008377 - RNA, 19 nt, Homo sapiens
gagaaggagcccacucaga

SEQ ID NO: 1008378 - RNA, 19 nt, Homo sapiens
aaggugggcucuuucaaau

SEQ ID NO: 1008379 - RNA, 19 nt, Homo sapiens
ggagcccacucagaagaaa

SEQ ID NO: 1008380 - RNA, 19 nt, Homo sapiens
ccaacaaggccuccaaauc

SEQ ID NO: 1008381 - RNA, 19 nt, Homo sapiens
gcgagaaacacaccucaau

SEQ ID NO: 1008382 - RNA, 19 nt, Homo sapiens
ccagcagcuucaaggauuu

SEQ ID NO: 1008383 - RNA, 19 nt, Homo sapiens
gcaguucuggugaggcuaa

SEQ ID NO: 1008384 - RNA, 19 nt, Homo sapiens
gcgagaaggaguuuaaucu

SEQ ID NO: 1008385 - RNA, 19 nt, Homo sapiens
uccagcagcuucaaggauu

SEQ ID NO: 1008386 - RNA, 19 nt, Homo sapiens
aggcucagcuggagugguu

SEQ ID NO: 1008387 - RNA, 19 nt, Homo sapiens
ugagcgagaaggaguuuaa

SEQ ID NO: 1008388 - RNA, 19 nt, Homo sapiens
gaaggagcccacucagaag

SEQ ID NO: 1008389 - RNA, 19 nt, Homo sapiens
cgagaaacacaccucaaug

SEQ ID NO: 1008390 - RNA, 19 nt, Homo sapiens
cgacagagcaagggcaaga

SEQ ID NO: 1008391 - RNA, 19 nt, Homo sapiens
gaccacgacucgcugaaac

SEQ ID NO: 1008392 - RNA, 19 nt, Homo sapiens
gaguuuaaucuggaugaua

SEQ ID NO: 1008393 - RNA, 19 nt, Homo sapiens
aaggagaugugauccagau

SEQ ID NO: 1008394 - RNA, 19 nt, Homo sapiens
acaggaagaugggcaagau

SEQ ID NO: 1008395 - RNA, 19 nt, Homo sapiens
caaauucaucuauguggau

SEQ ID NO: 1008396 - RNA, 19 nt, Homo sapiens
ggugaaggcccugucagaa

SEQ ID NO: 1008397 - RNA, 19 nt, Homo sapiens
ugauaacauuccagaagau

SEQ ID NO: 1008398 - RNA, 19 nt, Homo sapiens
gcgcgacucaggcugcuuu

SEQ ID NO: 1008399 - RNA, 19 nt, Homo sapiens
augauaacauuccagaaga

SEQ ID NO: 1008400 - RNA, 19 nt, Homo sapiens
gauaacauuccagaagaug

SEQ ID NO: 1008401 - RNA, 19 nt, Homo sapiens
ggaguuuaaucuggaugau

SEQ ID NO: 1008402 - RNA, 19 nt, Homo sapiens
ugagguggcgguggcaaua

SEQ ID NO: 1008403 - RNA, 19 nt, Homo sapiens
ccgagcugcugcuggacua

SEQ ID NO: 1008404 - RNA, 19 nt, Homo sapiens
gcaaggugggcucuuucaa

SEQ ID NO: 1008405 - RNA, 19 nt, Homo sapiens
ggaagaugggcaagaugau

SEQ ID NO: 1008406 - RNA, 19 nt, Homo sapiens
gugauuucccgaaccauga

SEQ ID NO: 1008407 - RNA, 19 nt, Homo sapiens
gcucaauggcuaccagaca

SEQ ID NO: 1008408 - RNA, 19 nt, Homo sapiens
cauccacccuccugcucaa

SEQ ID NO: 1008409 - RNA, 19 nt, Homo sapiens
ccaaugccagugagaagga

SEQ ID NO: 1008410 - RNA, 19 nt, Homo sapiens
cgagaaggaguuuaaucug

SEQ ID NO: 1008411 - RNA, 19 nt, Homo sapiens
agaagaugcugggaagagu

SEQ ID NO: 1008412 - RNA, 19 nt, Homo sapiens
caaagagcugcgagaaaca

SEQ ID NO: 1008413 - RNA, 19 nt, Homo sapiens
uggcugggccuacucaaug

SEQ ID NO: 1008414 - RNA, 19 nt, Homo sapiens
cgacaucuccagacuacag

SEQ ID NO: 1008415 - RNA, 19 nt, Homo sapiens
gugaaggcccugucagaag

SEQ ID NO: 1008416 - RNA, 19 nt, Homo sapiens
ugggcaagaugauggugaa

SEQ ID NO: 1008417 - RNA, 19 nt, Homo sapiens
cccgaaccaugaacaggaa

SEQ ID NO: 1008418 - RNA, 19 nt, Homo sapiens
ggacacuuagggccacaga

SEQ ID NO: 1008419 - RNA, 19 nt, Homo sapiens
gaaacugcagaaaggagau

SEQ ID NO: 1008420 - RNA, 19 nt, Homo sapiens
aggaagaugggcaagauga

SEQ ID NO: 1008421 - RNA, 19 nt, Homo sapiens
ccacccuccugcucaaugg

SEQ ID NO: 1008422 - RNA, 19 nt, Homo sapiens
cccgacaucuccagacuac

SEQ ID NO: 1008423 - RNA, 19 nt, Homo sapiens
gaaccaugaacaggaagau

SEQ ID NO: 1008424 - RNA, 19 nt, Homo sapiens
gcccuggcccugagaagau

SEQ ID NO: 1008425 - RNA, 19 nt, Homo sapiens
ggugagcgagaaggaguuu

SEQ ID NO: 1008426 - RNA, 19 nt, Homo sapiens
caagaggagcaugaacuuc

SEQ ID NO: 1008427 - RNA, 19 nt, Homo sapiens
agccuaagacccugcauga

SEQ ID NO: 1008428 - RNA, 19 nt, Homo sapiens
cgaccacgcugcuuacuua

SEQ ID NO: 1008429 - RNA, 19 nt, Homo sapiens
gcacagaagcggcacuaaa

SEQ ID NO: 1008430 - RNA, 19 nt, Homo sapiens
gaaugcaucugauaaacuc

SEQ ID NO: 1008431 - RNA, 19 nt, Homo sapiens
caggagagauugcuugcuu

SEQ ID NO: 1008432 - RNA, 19 nt, Homo sapiens
gaaggaagggcccaugguu

SEQ ID NO: 1008433 - RNA, 19 nt, Homo sapiens
gagggaagcagaaaugaga

SEQ ID NO: 1008434 - RNA, 19 nt, Homo sapiens
ccaccgagguucugaaugg

SEQ ID NO: 1008435 - RNA, 19 nt, Homo sapiens
gcugggugcucuagugauu

SEQ ID NO: 1008436 - RNA, 19 nt, Homo sapiens
gugaauuucuguacuggaa

SEQ ID NO: 1008437 - RNA, 19 nt, Homo sapiens
gcagugaugccucaagcua

SEQ ID NO: 1008438 - RNA, 19 nt, Homo sapiens
caacagcagccaauccauu

SEQ ID NO: 1008439 - RNA, 19 nt, Homo sapiens
ggugaaaccaggagagauu

SEQ ID NO: 1008440 - RNA, 19 nt, Homo sapiens
caucaucccucuccaucug

SEQ ID NO: 1008441 - RNA, 19 nt, Homo sapiens
gagauugcuugcuucacuu

SEQ ID NO: 1008442 - RNA, 19 nt, Homo sapiens
ugauggacguggacuguga

SEQ ID NO: 1008443 - RNA, 19 nt, Homo sapiens
gaggauucaucacucuguu

SEQ ID NO: 1008444 - RNA, 19 nt, Homo sapiens
agaccgugcuugcccaauu

SEQ ID NO: 1008445 - RNA, 19 nt, Homo sapiens
caacaggaagccacacaga

SEQ ID NO: 1008446 - RNA, 19 nt, Homo sapiens
caaggaguccgcagugaga

SEQ ID NO: 1008447 - RNA, 19 nt, Homo sapiens
gaccgugcuugcccaauuc

SEQ ID NO: 1008448 - RNA, 19 nt, Homo sapiens
ggagguggagguaggaaga

SEQ ID NO: 1008449 - RNA, 19 nt, Homo sapiens
aaacguauugguucgauga

SEQ ID NO: 1008450 - RNA, 19 nt, Homo sapiens
aguggaggccgucagauua

SEQ ID NO: 1008451 - RNA, 19 nt, Homo sapiens
caagccugcugcuggagaa

SEQ ID NO: 1008452 - RNA, 19 nt, Homo sapiens
ggugaaacgggcacaguga

SEQ ID NO: 1008453 - RNA, 19 nt, Homo sapiens
ggagguaggaagauugcuu

SEQ ID NO: 1008454 - RNA, 19 nt, Homo sapiens
guccagggaugagcaguga

SEQ ID NO: 1008455 - RNA, 19 nt, Homo sapiens
ggagagauugcuugcuuca

SEQ ID NO: 1008456 - RNA, 19 nt, Homo sapiens
aggcugcagugaccuauga

SEQ ID NO: 1008457 - RNA, 19 nt, Homo sapiens
agagauugcuugcuucacu

SEQ ID NO: 1008458 - RNA, 19 nt, Homo sapiens
gaaacgggcacagugaagu

SEQ ID NO: 1008459 - RNA, 19 nt, Homo sapiens
uguguaggccucuaauuga

SEQ ID NO: 1008460 - RNA, 19 nt, Homo sapiens
gaacgauggguggaagaga

SEQ ID NO: 1008461 - RNA, 19 nt, Homo sapiens
gaaguggaggcugcaguga

SEQ ID NO: 1008462 - RNA, 19 nt, Homo sapiens
ucacagaggauucaucacu

SEQ ID NO: 1008463 - RNA, 19 nt, Homo sapiens
ggauucaucacucuguuca

SEQ ID NO: 1008464 - RNA, 19 nt, Homo sapiens
gugaaugcaucugauaaac

SEQ ID NO: 1008465 - RNA, 19 nt, Homo sapiens
ccagagcacgugccacaug

SEQ ID NO: 1008466 - RNA, 19 nt, Homo sapiens
ggacuuucuuccagcuucu

SEQ ID NO: 1008467 - RNA, 19 nt, Homo sapiens
gaaaagaaacuagcuaggu

SEQ ID NO: 1008468 - RNA, 19 nt, Homo sapiens
acagagggaagcagaaaug

SEQ ID NO: 1008469 - RNA, 19 nt, Homo sapiens
caagcuaagccaaucaaag

SEQ ID NO: 1008470 - RNA, 19 nt, Homo sapiens
ugggugcucuagugauuug

SEQ ID NO: 1008471 - RNA, 19 nt, Homo sapiens
cgugaaugcaucugauaaa

SEQ ID NO: 1008472 - RNA, 19 nt, Homo sapiens
cagcagccaauccauucua

SEQ ID NO: 1008473 - RNA, 19 nt, Homo sapiens
gagcagccugggcaaccua

SEQ ID NO: 1008474 - RNA, 19 nt, Homo sapiens
caguggaggccgucagauu

SEQ ID NO: 1008475 - RNA, 19 nt, Homo sapiens
gugcagggacucagcugaa

SEQ ID NO: 1008476 - RNA, 19 nt, Homo sapiens
ccucugcugugggugaauu

SEQ ID NO: 1008477 - RNA, 19 nt, Homo sapiens
cuucugcuguccuucuuug

SEQ ID NO: 1008478 - RNA, 19 nt, Homo sapiens
guguaggccucuaauugag

SEQ ID NO: 1008479 - RNA, 19 nt, Homo sapiens
acacagagggaagcagaaa

SEQ ID NO: 1008480 - RNA, 19 nt, Homo sapiens
aacagugccugcagaugga

SEQ ID NO: 1008481 - RNA, 19 nt, Homo sapiens
ggaguccgcagugagauuc

SEQ ID NO: 1008482 - RNA, 19 nt, Homo sapiens
cagugaugccucaagcuaa

SEQ ID NO: 1008483 - RNA, 19 nt, Homo sapiens
cacagaagcggcacuaaac

SEQ ID NO: 1008484 - RNA, 19 nt, Homo sapiens
aggcugaggugggaggauu

SEQ ID NO: 1008485 - RNA, 19 nt, Homo sapiens
gacgcugucuuuacgaaaa

SEQ ID NO: 1008486 - RNA, 19 nt, Homo sapiens
caccauggcgcaacaacug

SEQ ID NO: 1008487 - RNA, 19 nt, Homo sapiens
ccagggaugagcagugaug

SEQ ID NO: 1008488 - RNA, 19 nt, Homo sapiens
gagagcgucuaccccauug

SEQ ID NO: 1008489 - RNA, 19 nt, Homo sapiens
gggcacagugaagucauuu

SEQ ID NO: 1008490 - RNA, 19 nt, Homo sapiens
cgggcacagugaagucauu

SEQ ID NO: 1008491 - RNA, 19 nt, Homo sapiens
gugaaacgggcacagugaa

SEQ ID NO: 1008492 - RNA, 19 nt, Homo sapiens
caucugauaaacucacuca

SEQ ID NO: 1008493 - RNA, 19 nt, Homo sapiens
caucuuggcuaggcaccau

SEQ ID NO: 1008494 - RNA, 19 nt, Homo sapiens
gaagucauuuccccgaagu

SEQ ID NO: 1008495 - RNA, 19 nt, Homo sapiens
gcacagugaagucauuucc

SEQ ID NO: 1008496 - RNA, 19 nt, Homo sapiens
uaugauggcaccacuguac

SEQ ID NO: 1008497 - RNA, 19 nt, Homo sapiens
gguggagguaggaagauug

SEQ ID NO: 1008498 - RNA, 19 nt, Homo sapiens
gcaccaccgagguucugaa

SEQ ID NO: 1008499 - RNA, 19 nt, Homo sapiens
ugggugaauuucuguacug

SEQ ID NO: 1008500 - RNA, 19 nt, Homo sapiens
aagcuaagccaaucaaagc

SEQ ID NO: 1008501 - RNA, 19 nt, Homo sapiens
gccucugacucccaucaug

SEQ ID NO: 1008502 - RNA, 19 nt, Homo sapiens
ucugauaaacucacucaca

SEQ ID NO: 1008503 - RNA, 19 nt, Homo sapiens
aagaaucggcucccagaca

SEQ ID NO: 1008504 - RNA, 19 nt, Homo sapiens
auugcuugcuucacuugua

SEQ ID NO: 1008505 - RNA, 19 nt, Homo sapiens
gcugauggacguggacugu

SEQ ID NO: 1008506 - RNA, 19 nt, Homo sapiens
gaacgaggcucaaggaugu

SEQ ID NO: 1008507 - RNA, 19 nt, Homo sapiens
agucaaggcuucucaauuu

SEQ ID NO: 1008508 - RNA, 19 nt, Homo sapiens
gaaacaggcgccuauuuaa

SEQ ID NO: 1008509 - RNA, 19 nt, Homo sapiens
gaacugccauguccaggaa

SEQ ID NO: 1008510 - RNA, 19 nt, Homo sapiens
uaaggucucuuguauguug

SEQ ID NO: 1008511 - RNA, 19 nt, Homo sapiens
ucgcagagcuccugacaaa

SEQ ID NO: 1008512 - RNA, 19 nt, Homo sapiens
ugaaacaggcgccuauuua

SEQ ID NO: 1008513 - RNA, 19 nt, Homo sapiens
ggacuuaccuccuucuuuu

SEQ ID NO: 1008514 - RNA, 19 nt, Homo sapiens
ccaggaagcuuggcuguga

SEQ ID NO: 1008515 - RNA, 19 nt, Homo sapiens
gaagaaaccugcuuuugau

SEQ ID NO: 1008516 - RNA, 19 nt, Homo sapiens
gcuuagcguuguuugauuu

SEQ ID NO: 1008517 - RNA, 19 nt, Homo sapiens
caaggcuucucaauuugua

SEQ ID NO: 1008518 - RNA, 19 nt, Homo sapiens
gcaagcuggugauuaacaa

SEQ ID NO: 1008519 - RNA, 19 nt, Homo sapiens
aaccaauucuccagcauua

SEQ ID NO: 1008520 - RNA, 19 nt, Homo sapiens
uuacagagcaucacaaaug

SEQ ID NO: 1008521 - RNA, 19 nt, Homo sapiens
uguaaggucucuuguaugu

SEQ ID NO: 1008522 - RNA, 19 nt, Homo sapiens
guagauaggcuugugguuu

SEQ ID NO: 1008523 - RNA, 19 nt, Homo sapiens
ccaaggagcugcacaacac

SEQ ID NO: 1008524 - RNA, 19 nt, Homo sapiens
gcuggaaguucgagcaguu

SEQ ID NO: 1008525 - RNA, 19 nt, Homo sapiens
cgugggagcugcugggauu

SEQ ID NO: 1008526 - RNA, 19 nt, Homo sapiens
ucucgccgcucucucauuu

SEQ ID NO: 1008527 - RNA, 19 nt, Homo sapiens
acggcaagcuggugauuaa

SEQ ID NO: 1008528 - RNA, 19 nt, Homo sapiens
gcagagcuccugacaaagg

SEQ ID NO: 1008529 - RNA, 19 nt, Homo sapiens
cuagagaucugggugugaa

SEQ ID NO: 1008530 - RNA, 19 nt, Homo sapiens
auugacagcugaagaaaug

SEQ ID NO: 1008531 - RNA, 19 nt, Homo sapiens
ugagguggguggugagaga

SEQ ID NO: 1008532 - RNA, 19 nt, Homo sapiens
ccagucaccugauuaacca

SEQ ID NO: 1008533 - RNA, 19 nt, Homo sapiens
caagaacgaggcucaagga

SEQ ID NO: 1008534 - RNA, 19 nt, Homo sapiens
gaccuugacauaguagaua

SEQ ID NO: 1008535 - RNA, 19 nt, Homo sapiens
cagcagagccugggaggaa

SEQ ID NO: 1008536 - RNA, 19 nt, Homo sapiens
uuuguaaggucucuuguau

SEQ ID NO: 1008537 - RNA, 19 nt, Homo sapiens
cggcuccucuuacaacuau

SEQ ID NO: 1008538 - RNA, 19 nt, Homo sapiens
uagauaggcuugugguuuu

SEQ ID NO: 1008539 - RNA, 19 nt, Homo sapiens
aaacaggcgccuauuuaau

SEQ ID NO: 1008540 - RNA, 19 nt, Homo sapiens
gucaaggcuucucaauuug

SEQ ID NO: 1008541 - RNA, 19 nt, Homo sapiens
cgggaucgcugguuucucu

SEQ ID NO: 1008542 - RNA, 19 nt, Homo sapiens
aagcuuggcugugagaaga

SEQ ID NO: 1008543 - RNA, 19 nt, Homo sapiens
ggaugaaacaggcgccuau

SEQ ID NO: 1008544 - RNA, 19 nt, Homo sapiens
ggacaaaauuagagaacga

SEQ ID NO: 1008545 - RNA, 19 nt, Homo sapiens
uuacaacuaugggaacgaa

SEQ ID NO: 1008546 - RNA, 19 nt, Homo sapiens
aggaggagcucacgcagau

SEQ ID NO: 1008547 - RNA, 19 nt, Homo sapiens
acaguuuaaugccuaaguu

SEQ ID NO: 1008548 - RNA, 19 nt, Homo sapiens
gagcugcugggauuccuuu

SEQ ID NO: 1008549 - RNA, 19 nt, Homo sapiens
cguggagacugaucuguuc

SEQ ID NO: 1008550 - RNA, 19 nt, Homo sapiens
ggaaggaguguuggaggaa

SEQ ID NO: 1008551 - RNA, 19 nt, Homo sapiens
cauaguagauaggcuugug

SEQ ID NO: 1008552 - RNA, 19 nt, Homo sapiens
ggucucuuguauguuguua

SEQ ID NO: 1008553 - RNA, 19 nt, Homo sapiens
gcugggauuccuuuagaaa

SEQ ID NO: 1008554 - RNA, 19 nt, Homo sapiens
ggacucagacaaggaugaa

SEQ ID NO: 1008555 - RNA, 19 nt, Homo sapiens
guuggaggaagcagaauuu

SEQ ID NO: 1008556 - RNA, 19 nt, Homo sapiens
cccuggaaauagcaaauaa

SEQ ID NO: 1008557 - RNA, 19 nt, Homo sapiens
gcgcuuugcuuccggaacu

SEQ ID NO: 1008558 - RNA, 19 nt, Homo sapiens
cugcugggauuccuuuaga

SEQ ID NO: 1008559 - RNA, 19 nt, Homo sapiens
uaaccaauucuccagcauu

SEQ ID NO: 1008560 - RNA, 19 nt, Homo sapiens
caaugcuucuggagacuuc

SEQ ID NO: 1008561 - RNA, 19 nt, Homo sapiens
ggacagucaaggcuucuca

SEQ ID NO: 1008562 - RNA, 19 nt, Homo sapiens
caggcgggaucgcugguuu

SEQ ID NO: 1008563 - RNA, 19 nt, Homo sapiens
gcgagaaggccaagauuuu

SEQ ID NO: 1008564 - RNA, 19 nt, Homo sapiens
ucuccagcauuaggacuua

SEQ ID NO: 1008565 - RNA, 19 nt, Homo sapiens
ccuauuuaaucgacagaga

SEQ ID NO: 1008566 - RNA, 19 nt, Homo sapiens
gcuucucaauuuguacuuu

SEQ ID NO: 1008567 - RNA, 19 nt, Homo sapiens
gugagaagaaaccugcuuu

SEQ ID NO: 1008568 - RNA, 19 nt, Homo sapiens
ccaaguggguccgacucaa

SEQ ID NO: 1008569 - RNA, 19 nt, Homo sapiens
ucaccugauuaaccaauuc

SEQ ID NO: 1008570 - RNA, 19 nt, Homo sapiens
guacuuuccaggcaagaga

SEQ ID NO: 1008571 - RNA, 19 nt, Homo sapiens
cugaagaucgugugaagga

SEQ ID NO: 1008572 - RNA, 19 nt, Homo sapiens
ggccucauccuccucuuug

SEQ ID NO: 1008573 - RNA, 19 nt, Homo sapiens
gaugaaacaggcgccuauu

SEQ ID NO: 1008574 - RNA, 19 nt, Homo sapiens
ggccagacguccccaaguu

SEQ ID NO: 1008575 - RNA, 19 nt, Homo sapiens
agaagaaaccugcuuuuga

SEQ ID NO: 1008576 - RNA, 19 nt, Homo sapiens
gcuuggcugugagaagaaa

SEQ ID NO: 1008577 - RNA, 19 nt, Homo sapiens
gagggacacaguauugaca

SEQ ID NO: 1008578 - RNA, 19 nt, Homo sapiens
guuuacagagcaucacaaa

SEQ ID NO: 1008579 - RNA, 19 nt, Homo sapiens
ggagcuggcgucugucagu

SEQ ID NO: 1008580 - RNA, 19 nt, Homo sapiens
ggagacugaucuguuccau

SEQ ID NO: 1008581 - RNA, 19 nt, Homo sapiens
gauagacuccccagcguuu

SEQ ID NO: 1008582 - RNA, 19 nt, Homo sapiens
cagucaaggcuucucaauu

SEQ ID NO: 1008583 - RNA, 19 nt, Homo sapiens
gcuacacacagucuggaaa

SEQ ID NO: 1008584 - RNA, 19 nt, Homo sapiens
ugaagaucgugugaaggaa

SEQ ID NO: 1008585 - RNA, 19 nt, Homo sapiens
gaucugggugugaauccuu

SEQ ID NO: 1008586 - RNA, 19 nt, Homo sapiens
aagccgaguuccucugugu

SEQ ID NO: 1008587 - RNA, 19 nt, Homo sapiens
ggaagcagaauuuuacaau

SEQ ID NO: 1008588 - RNA, 19 nt, Homo sapiens
ggaggaagcagaauuuuac

SEQ ID NO: 1008589 - RNA, 19 nt, Homo sapiens
aacaggcgccuauuuaauc

SEQ ID NO: 1008590 - RNA, 19 nt, Homo sapiens
gaagcuuggcugugagaag

SEQ ID NO: 1008591 - RNA, 19 nt, Homo sapiens
ugaaaauucgggauguuua

SEQ ID NO: 1008592 - RNA, 19 nt, Homo sapiens
gcguggagacugaucuguu

SEQ ID NO: 1008593 - RNA, 19 nt, Homo sapiens
gaaaccugcuuuugaucau

SEQ ID NO: 1008594 - RNA, 19 nt, Homo sapiens
gagaagaaaccugcuuuug

SEQ ID NO: 1008595 - RNA, 19 nt, Homo sapiens
uagagaacgagacagcaaa

SEQ ID NO: 1008596 - RNA, 19 nt, Homo sapiens
caguuuaaugccuaaguuu

SEQ ID NO: 1008597 - RNA, 19 nt, Homo sapiens
ugucacgccuggcauagag

SEQ ID NO: 1008598 - RNA, 19 nt, Homo sapiens
guauugacagcugaagaaa

SEQ ID NO: 1008599 - RNA, 19 nt, Homo sapiens
gaacgagacagcaaaacau

SEQ ID NO: 1008600 - RNA, 19 nt, Homo sapiens
uuucuagaaggcagacuua

SEQ ID NO: 1008601 - RNA, 19 nt, Homo sapiens
ggaucauggcggagaauca

SEQ ID NO: 1008602 - RNA, 19 nt, Homo sapiens
caggcaagagaacuuugua

SEQ ID NO: 1008603 - RNA, 19 nt, Homo sapiens
ucaaggcuucucaauuugu

SEQ ID NO: 1008604 - RNA, 19 nt, Homo sapiens
ugaaggaagcguucuuggu

SEQ ID NO: 1008605 - RNA, 19 nt, Homo sapiens
caagcuggugauuaacaaa

SEQ ID NO: 1008606 - RNA, 19 nt, Homo sapiens
gaaaggcugugaucauuua

SEQ ID NO: 1008607 - RNA, 19 nt, Homo sapiens
ggagauggaucaagcauua

SEQ ID NO: 1008608 - RNA, 19 nt, Homo sapiens
gaaauccgcuugccucuaa

SEQ ID NO: 1008609 - RNA, 19 nt, Homo sapiens
ggauaaaucuggcuaauug

SEQ ID NO: 1008610 - RNA, 19 nt, Homo sapiens
gaacaggaauuaagccuuu

SEQ ID NO: 1008611 - RNA, 19 nt, Homo sapiens
gagagaaucuucagagaaa

SEQ ID NO: 1008612 - RNA, 19 nt, Homo sapiens
ggaacucaauaacgaaaua

SEQ ID NO: 1008613 - RNA, 19 nt, Homo sapiens
gaugaugcgucuuugguua

SEQ ID NO: 1008614 - RNA, 19 nt, Homo sapiens
gcucuuaacugcuguguug

SEQ ID NO: 1008615 - RNA, 19 nt, Homo sapiens
ugacaacacugaaguagaa

SEQ ID NO: 1008616 - RNA, 19 nt, Homo sapiens
gcaaacaacuagaaaccaa

SEQ ID NO: 1008617 - RNA, 19 nt, Homo sapiens
gcaggaagcuacauucugu

SEQ ID NO: 1008618 - RNA, 19 nt, Homo sapiens
gaaaccagaugcagcaaau

SEQ ID NO: 1008619 - RNA, 19 nt, Homo sapiens
agaagaagcugaagcagaa

SEQ ID NO: 1008620 - RNA, 19 nt, Homo sapiens
ggacaaauccuuaaaagua

SEQ ID NO: 1008621 - RNA, 19 nt, Homo sapiens
gaaaggguuugugccaaua

SEQ ID NO: 1008622 - RNA, 19 nt, Homo sapiens
gcucugacauucacuacua

SEQ ID NO: 1008623 - RNA, 19 nt, Homo sapiens
ccaaaccucugcuuucaaa

SEQ ID NO: 1008624 - RNA, 19 nt, Homo sapiens
ggagagggcugaacucaag

SEQ ID NO: 1008625 - RNA, 19 nt, Homo sapiens
ggacuuauccagaugauga

SEQ ID NO: 1008626 - RNA, 19 nt, Homo sapiens
gacauucacuacuacauuu

SEQ ID NO: 1008627 - RNA, 19 nt, Homo sapiens
uuaaugaccucuucaguga

SEQ ID NO: 1008628 - RNA, 19 nt, Homo sapiens
ggcgaugccucuuugaaua

SEQ ID NO: 1008629 - RNA, 19 nt, Homo sapiens
cuuaagagcaucagauuua

SEQ ID NO: 1008630 - RNA, 19 nt, Homo sapiens
gaaacacacuuaagagcau

SEQ ID NO: 1008631 - RNA, 19 nt, Homo sapiens
gaucaagcauuagcagaaa

SEQ ID NO: 1008632 - RNA, 19 nt, Homo sapiens
gcagaaaauugaagugaua

SEQ ID NO: 1008633 - RNA, 19 nt, Homo sapiens
caagugaauuccaguguug

SEQ ID NO: 1008634 - RNA, 19 nt, Homo sapiens
uguuggaucuuacacauua

SEQ ID NO: 1008635 - RNA, 19 nt, Homo sapiens
gaagugauacgugaaauug

SEQ ID NO: 1008636 - RNA, 19 nt, Homo sapiens
gaacguccaucaauaaagc

SEQ ID NO: 1008637 - RNA, 19 nt, Homo sapiens
acaaacaguugguguggua

SEQ ID NO: 1008638 - RNA, 19 nt, Homo sapiens
cugaauaucuccucaaugu

SEQ ID NO: 1008639 - RNA, 19 nt, Homo sapiens
ucaagaacauagcaaagaa

SEQ ID NO: 1008640 - RNA, 19 nt, Homo sapiens
gaauuccaguguugaagaa

SEQ ID NO: 1008641 - RNA, 19 nt, Homo sapiens
ccucaggccuugauaagaa

SEQ ID NO: 1008642 - RNA, 19 nt, Homo sapiens
gaacauagcaaagaaaguc

SEQ ID NO: 1008643 - RNA, 19 nt, Homo sapiens
ucuaaggccuuuacagaaa

SEQ ID NO: 1008644 - RNA, 19 nt, Homo sapiens
ucacaucuauaaccacaaa

SEQ ID NO: 1008645 - RNA, 19 nt, Homo sapiens
uaacugcuguguugaugaa

SEQ ID NO: 1008646 - RNA, 19 nt, Homo sapiens
cagcagaagugaugaaagu

SEQ ID NO: 1008647 - RNA, 19 nt, Homo sapiens
gaaauuuccaugcuaucua

SEQ ID NO: 1008648 - RNA, 19 nt, Homo sapiens
gacgaaaucuagcccuuug

SEQ ID NO: 1008649 - RNA, 19 nt, Homo sapiens
gggcugaacucaagauugg

SEQ ID NO: 1008650 - RNA, 19 nt, Homo sapiens
cuacaaaccuauuggaaag

SEQ ID NO: 1008651 - RNA, 19 nt, Homo sapiens
ccaaggcuauuacuccaaa

SEQ ID NO: 1008652 - RNA, 19 nt, Homo sapiens
ggauaaugaugauaugaca

SEQ ID NO: 1008653 - RNA, 19 nt, Homo sapiens
ucaguuacuuugucagaaa

SEQ ID NO: 1008654 - RNA, 19 nt, Homo sapiens
gaaauucugaguugucuuc

SEQ ID NO: 1008655 - RNA, 19 nt, Homo sapiens
gccuuaaacugggaaauuu

SEQ ID NO: 1008656 - RNA, 19 nt, Homo sapiens
gaagagaacacuuuugauu

SEQ ID NO: 1008657 - RNA, 19 nt, Homo sapiens
uaaugaggaugagaacuuu

SEQ ID NO: 1008658 - RNA, 19 nt, Homo sapiens
guaaugaggaugagaacuu

SEQ ID NO: 1008659 - RNA, 19 nt, Homo sapiens
ugauaugacuuguuacuag

SEQ ID NO: 1008660 - RNA, 19 nt, Homo sapiens
aacagaacguccaucaaua

SEQ ID NO: 1008661 - RNA, 19 nt, Homo sapiens
ggauggcgaugccucuuug

SEQ ID NO: 1008662 - RNA, 19 nt, Homo sapiens
gauagaaccagccaacaga

SEQ ID NO: 1008663 - RNA, 19 nt, Homo sapiens
caaagcgacuccucacauc

SEQ ID NO: 1008664 - RNA, 19 nt, Homo sapiens
aaacagaacguccaucaau

SEQ ID NO: 1008665 - RNA, 19 nt, Homo sapiens
gaucuucuuuacagcauug

SEQ ID NO: 1008666 - RNA, 19 nt, Homo sapiens
gaauaucuccucaaugucu

SEQ ID NO: 1008667 - RNA, 19 nt, Homo sapiens
ucgaaaggcugugaucauu

SEQ ID NO: 1008668 - RNA, 19 nt, Homo sapiens
cgaaaggguuugugccaau

SEQ ID NO: 1008669 - RNA, 19 nt, Homo sapiens
cagauuuacugauugcauu

SEQ ID NO: 1008670 - RNA, 19 nt, Homo sapiens
gcgagagaaucuucagaga

SEQ ID NO: 1008671 - RNA, 19 nt, Homo sapiens
caaaggccauccaagaaag

SEQ ID NO: 1008672 - RNA, 19 nt, Homo sapiens
uaacugauuucugucauuc

SEQ ID NO: 1008673 - RNA, 19 nt, Homo sapiens
acgcaacacuuuugaauua

SEQ ID NO: 1008674 - RNA, 19 nt, Homo sapiens
acaggaagaugcacugaau

SEQ ID NO: 1008675 - RNA, 19 nt, Homo sapiens
agaggaaggugaacuagau

SEQ ID NO: 1008676 - RNA, 19 nt, Homo sapiens
cagaaaaggugaccgaaaa

SEQ ID NO: 1008677 - RNA, 19 nt, Homo sapiens
gaaaucuacuacaucuauc

SEQ ID NO: 1008678 - RNA, 19 nt, Homo sapiens
ccagugaaaucuacuacau

SEQ ID NO: 1008679 - RNA, 19 nt, Homo sapiens
cagcagauaccaucaguga

SEQ ID NO: 1008680 - RNA, 19 nt, Homo sapiens
gcuacaaaccuauuggaaa

SEQ ID NO: 1008681 - RNA, 19 nt, Homo sapiens
aaagcaacauucauucuuc

SEQ ID NO: 1008682 - RNA, 19 nt, Homo sapiens
cgacuccucacaucuauaa

SEQ ID NO: 1008683 - RNA, 19 nt, Homo sapiens
aaauuugucugcaaucuca

SEQ ID NO: 1008684 - RNA, 19 nt, Homo sapiens
ggaaauacuaaguuuguuc

SEQ ID NO: 1008685 - RNA, 19 nt, Homo sapiens
caagauguauccaaugacu

SEQ ID NO: 1008686 - RNA, 19 nt, Homo sapiens
gaaagacaccagcagaagu

SEQ ID NO: 1008687 - RNA, 19 nt, Homo sapiens
gaaaucuagcccuuugaaa

SEQ ID NO: 1008688 - RNA, 19 nt, Homo sapiens
ggagagcguugucaagaac

SEQ ID NO: 1008689 - RNA, 19 nt, Homo sapiens
gaaaccaauugugaaguca

SEQ ID NO: 1008690 - RNA, 19 nt, Homo sapiens
acagaacguccaucaauaa

SEQ ID NO: 1008691 - RNA, 19 nt, Homo sapiens
caccuagacuggaauugaa

SEQ ID NO: 1008692 - RNA, 19 nt, Homo sapiens
ggccauccaagaaagauua

SEQ ID NO: 1008693 - RNA, 19 nt, Homo sapiens
cgaaaccaauugugaaguc

SEQ ID NO: 1008694 - RNA, 19 nt, Homo sapiens
guacaagaacagccuggua

SEQ ID NO: 1008695 - RNA, 19 nt, Homo sapiens
ugcaagauguauccaauga

SEQ ID NO: 1008696 - RNA, 19 nt, Homo sapiens
ggaucaagcauuagcagaa

SEQ ID NO: 1008697 - RNA, 19 nt, Homo sapiens
ccugaaagcucacucuucu

SEQ ID NO: 1008698 - RNA, 19 nt, Homo sapiens
cagaugacauuccugaaag

SEQ ID NO: 1008699 - RNA, 19 nt, Homo sapiens
gaugcuugcuacaaaccua

SEQ ID NO: 1008700 - RNA, 19 nt, Homo sapiens
gaugagaaacgcaagaauc

SEQ ID NO: 1008701 - RNA, 19 nt, Homo sapiens
ucaagugaauuccaguguu

SEQ ID NO: 1008702 - RNA, 19 nt, Homo sapiens
guacuucaaacucucuuaa

SEQ ID NO: 1008703 - RNA, 19 nt, Homo sapiens
aaccagaugcagcaaauua

SEQ ID NO: 1008704 - RNA, 19 nt, Homo sapiens
gaauuuaugccauccaaag

SEQ ID NO: 1008705 - RNA, 19 nt, Homo sapiens
gcgaugccucuuugaauaa

SEQ ID NO: 1008706 - RNA, 19 nt, Homo sapiens
ggaaagacccuccuuguga

SEQ ID NO: 1008707 - RNA, 19 nt, Homo sapiens
gaaggaggcuauuacuuga

SEQ ID NO: 1008708 - RNA, 19 nt, Homo sapiens
gaaguugccuuaugccauu

SEQ ID NO: 1008709 - RNA, 19 nt, Homo sapiens
ggaagcaacucaaggagaa

SEQ ID NO: 1008710 - RNA, 19 nt, Homo sapiens
uaacaaacaugggaacgua

SEQ ID NO: 1008711 - RNA, 19 nt, Homo sapiens
cgucagcucugccuuauaa

SEQ ID NO: 1008712 - RNA, 19 nt, Homo sapiens
cagaaacagucaaccauaa

SEQ ID NO: 1008713 - RNA, 19 nt, Homo sapiens
gcagggauguucuaccauu

SEQ ID NO: 1008714 - RNA, 19 nt, Homo sapiens
guucauaaaucuaccaaga

SEQ ID NO: 1008715 - RNA, 19 nt, Homo sapiens
gaccuuacaucaccacuga

SEQ ID NO: 1008716 - RNA, 19 nt, Homo sapiens
gcucugugcuuuauuaauc

SEQ ID NO: 1008717 - RNA, 19 nt, Homo sapiens
ucaaggaauuugccauaaa

SEQ ID NO: 1008718 - RNA, 19 nt, Homo sapiens
gaucugcgcugagaaguuc

SEQ ID NO: 1008719 - RNA, 19 nt, Homo sapiens
cuaccaagaugcagaagaa

SEQ ID NO: 1008720 - RNA, 19 nt, Homo sapiens
ggagcacuuucucugauaa

SEQ ID NO: 1008721 - RNA, 19 nt, Homo sapiens
ggacaaaugcaccuacuuc

SEQ ID NO: 1008722 - RNA, 19 nt, Homo sapiens
ggaaggauccggaaucagu

SEQ ID NO: 1008723 - RNA, 19 nt, Homo sapiens
guauggcgcugaugacuuc

SEQ ID NO: 1008724 - RNA, 19 nt, Homo sapiens
caaggaauuugccauaaag

SEQ ID NO: 1008725 - RNA, 19 nt, Homo sapiens
ggaucuuccugguucauaa

SEQ ID NO: 1008726 - RNA, 19 nt, Homo sapiens
ggagaucggagaacugaaa

SEQ ID NO: 1008727 - RNA, 19 nt, Homo sapiens
gacaugagcauuucuacuu

SEQ ID NO: 1008728 - RNA, 19 nt, Homo sapiens
ggaauuugccauaaaggaa

SEQ ID NO: 1008729 - RNA, 19 nt, Homo sapiens
acacaaggaugguggcuau

SEQ ID NO: 1008730 - RNA, 19 nt, Homo sapiens
gcuguuacauggagaagga

SEQ ID NO: 1008731 - RNA, 19 nt, Homo sapiens
gcaucaagaacgauccuua

SEQ ID NO: 1008732 - RNA, 19 nt, Homo sapiens
gcugaucccugaagaccaa

SEQ ID NO: 1008733 - RNA, 19 nt, Homo sapiens
gcgaggaaguuucuuuaag

SEQ ID NO: 1008734 - RNA, 19 nt, Homo sapiens
gaauuugccauaaaggaaa

SEQ ID NO: 1008735 - RNA, 19 nt, Homo sapiens
agaaggaggcuauuacuug

SEQ ID NO: 1008736 - RNA, 19 nt, Homo sapiens
ccagaaacagucaaccaua

SEQ ID NO: 1008737 - RNA, 19 nt, Homo sapiens
guguucagcuccuucauga

SEQ ID NO: 1008738 - RNA, 19 nt, Homo sapiens
gaaacccacagcaugguaa

SEQ ID NO: 1008739 - RNA, 19 nt, Homo sapiens
gaggaugugugucagaucu

SEQ ID NO: 1008740 - RNA, 19 nt, Homo sapiens
guucuaccauuuaccuuga

SEQ ID NO: 1008741 - RNA, 19 nt, Homo sapiens
acacugaaaucgaguacau

SEQ ID NO: 1008742 - RNA, 19 nt, Homo sapiens
gcagagggcggugcaaaga

SEQ ID NO: 1008743 - RNA, 19 nt, Homo sapiens
gaaacagucaaccauaaca

SEQ ID NO: 1008744 - RNA, 19 nt, Homo sapiens
ugaaaucgaguacaugaug

SEQ ID NO: 1008745 - RNA, 19 nt, Homo sapiens
uuaauagucuccacacaag

SEQ ID NO: 1008746 - RNA, 19 nt, Homo sapiens
cagcagggauguucuacca

SEQ ID NO: 1008747 - RNA, 19 nt, Homo sapiens
gagaaggaggcuauuacuu

SEQ ID NO: 1008748 - RNA, 19 nt, Homo sapiens
uggagugcauucuaucaaa

SEQ ID NO: 1008749 - RNA, 19 nt, Homo sapiens
cgaggaaguuucuuuaagc

SEQ ID NO: 1008750 - RNA, 19 nt, Homo sapiens
ccacugaggauguguguca

SEQ ID NO: 1008751 - RNA, 19 nt, Homo sapiens
cgacugcucagcucagaaa

SEQ ID NO: 1008752 - RNA, 19 nt, Homo sapiens
caagcgaggaaguuucuuu

SEQ ID NO: 1008753 - RNA, 19 nt, Homo sapiens
gaaggauccggaaucaguu

SEQ ID NO: 1008754 - RNA, 19 nt, Homo sapiens
gaauuuccaagaagaacaa

SEQ ID NO: 1008755 - RNA, 19 nt, Homo sapiens
uggagcacuuucucugaua

SEQ ID NO: 1008756 - RNA, 19 nt, Homo sapiens
cagacgagcaugccagaaa

SEQ ID NO: 1008757 - RNA, 19 nt, Homo sapiens
cagggauguucuaccauuu

SEQ ID NO: 1008758 - RNA, 19 nt, Homo sapiens
cagaauuaccuccgaguug

SEQ ID NO: 1008759 - RNA, 19 nt, Homo sapiens
ggauguauggcgcugauga

SEQ ID NO: 1008760 - RNA, 19 nt, Homo sapiens
gaggauguauggcgcugau

SEQ ID NO: 1008761 - RNA, 19 nt, Homo sapiens
gaccggagcaugccucugu

SEQ ID NO: 1008762 - RNA, 19 nt, Homo sapiens
ggacaagcgaggaaguuuc

SEQ ID NO: 1008763 - RNA, 19 nt, Homo sapiens
caacggggcucugugcuuu

SEQ ID NO: 1008764 - RNA, 19 nt, Homo sapiens
ccaacaggcucagcaucuu

SEQ ID NO: 1008765 - RNA, 19 nt, Homo sapiens
guacagccucuuucucuuc

SEQ ID NO: 1008766 - RNA, 19 nt, Homo sapiens
gaguacagccucuuucucu

SEQ ID NO: 1008767 - RNA, 19 nt, Homo sapiens
gaggaaguuucuuuaagcu

SEQ ID NO: 1008768 - RNA, 19 nt, Homo sapiens
agugugacaugcuugaauu

SEQ ID NO: 1008769 - RNA, 19 nt, Homo sapiens
ccagaugggacuaaauuuc

SEQ ID NO: 1008770 - RNA, 19 nt, Homo sapiens
acaaacgcaucaagaacga

SEQ ID NO: 1008771 - RNA, 19 nt, Homo sapiens
gaaaaucaaagucaaguuc

SEQ ID NO: 1008772 - RNA, 19 nt, Homo sapiens
caacaggcucagcaucuug

SEQ ID NO: 1008773 - RNA, 19 nt, Homo sapiens
caucaagaacgauccuuau

SEQ ID NO: 1008774 - RNA, 19 nt, Homo sapiens
gugacaugcuugaauugga

SEQ ID NO: 1008775 - RNA, 19 nt, Homo sapiens
ggagugcauucuaucaaaa

SEQ ID NO: 1008776 - RNA, 19 nt, Homo sapiens
aagcgaggaaguuucuuua

SEQ ID NO: 1008777 - RNA, 19 nt, Homo sapiens
gaucuuccugguucauaaa

SEQ ID NO: 1008778 - RNA, 19 nt, Homo sapiens
gaucccugaagaccaaaua

SEQ ID NO: 1008779 - RNA, 19 nt, Homo sapiens
ggucaagaacuauuugucu

SEQ ID NO: 1008780 - RNA, 19 nt, Homo sapiens
gagauggugcggacagaug

SEQ ID NO: 1008781 - RNA, 19 nt, Homo sapiens
cggaaucaguuucgcagau

SEQ ID NO: 1008782 - RNA, 19 nt, Homo sapiens
ccauaaaggaaagcacaua

SEQ ID NO: 1008783 - RNA, 19 nt, Homo sapiens
ggggcucugugcuuuauua

SEQ ID NO: 1008784 - RNA, 19 nt, Homo sapiens
ccaagaugcagaagaaagu

SEQ ID NO: 1008785 - RNA, 19 nt, Homo sapiens
gaaguuucuuuaagcucau

SEQ ID NO: 1008786 - RNA, 19 nt, Homo sapiens
ugaauuggacacugaaauc

SEQ ID NO: 1008787 - RNA, 19 nt, Homo sapiens
acagcagccuggaggacua

SEQ ID NO: 1008788 - RNA, 19 nt, Homo sapiens
cagcucugccuuauaaaug

SEQ ID NO: 1008789 - RNA, 19 nt, Homo sapiens
gggauguucuaccauuuac

SEQ ID NO: 1008790 - RNA, 19 nt, Homo sapiens
ggagaaggaggcuauuacu

SEQ ID NO: 1008791 - RNA, 19 nt, Homo sapiens
aggagaaccugcagcuugu

SEQ ID NO: 1008792 - RNA, 19 nt, Homo sapiens
gcacagccaggaccucagu

SEQ ID NO: 1008793 - RNA, 19 nt, Homo sapiens
gauuuauuccggcucauug

SEQ ID NO: 1008794 - RNA, 19 nt, Homo sapiens
ccgccugcccugugaauuu

SEQ ID NO: 1008795 - RNA, 19 nt, Homo sapiens
ggucauggagaacaacuca

SEQ ID NO: 1008796 - RNA, 19 nt, Homo sapiens
ugaccaugcagaagaugua

SEQ ID NO: 1008797 - RNA, 19 nt, Homo sapiens
uaugacagccucuccaaca

SEQ ID NO: 1008798 - RNA, 19 nt, Homo sapiens
ccgccacccgcuauuaaua

SEQ ID NO: 1008799 - RNA, 19 nt, Homo sapiens
caguuucgcagauuuauuc

SEQ ID NO: 1008800 - RNA, 19 nt, Homo sapiens
ucaagaacgauccuuaugg

SEQ ID NO: 1008801 - RNA, 19 nt, Homo sapiens
gcgcugagaaguucaaggu

SEQ ID NO: 1008802 - RNA, 19 nt, Homo sapiens
gagcacuuucucugauaaa

SEQ ID NO: 1008803 - RNA, 19 nt, Homo sapiens
acacggucauggagaacaa

SEQ ID NO: 1008804 - RNA, 19 nt, Homo sapiens
cauggaagcaacucaagga

SEQ ID NO: 1008805 - RNA, 19 nt, Homo sapiens
acaugagcauuucuacuuc

SEQ ID NO: 1008806 - RNA, 19 nt, Homo sapiens
gaacaaaggugauauugaa

SEQ ID NO: 1008807 - RNA, 19 nt, Homo sapiens
gcacuucacucacguguuu

SEQ ID NO: 1008808 - RNA, 19 nt, Homo sapiens
gaacaagccuauaacuuug

SEQ ID NO: 1008809 - RNA, 19 nt, Homo sapiens
gaagauagauuugaagaug

SEQ ID NO: 1008810 - RNA, 19 nt, Homo sapiens
gaaauaaacccucgaguga

SEQ ID NO: 1008811 - RNA, 19 nt, Homo sapiens
ggaaagacagugacaauaa

SEQ ID NO: 1008812 - RNA, 19 nt, Homo sapiens
gaaagacagugacaauaau

SEQ ID NO: 1008813 - RNA, 19 nt, Homo sapiens
ugacugagauucaugaaga

SEQ ID NO: 1008814 - RNA, 19 nt, Homo sapiens
aaauggaacugaaagagua

SEQ ID NO: 1008815 - RNA, 19 nt, Homo sapiens
gaaaauguguggaacaaaa

SEQ ID NO: 1008816 - RNA, 19 nt, Homo sapiens
ugaacaagccuauaacuuu

SEQ ID NO: 1008817 - RNA, 19 nt, Homo sapiens
uuacacaggugacgcauuu

SEQ ID NO: 1008818 - RNA, 19 nt, Homo sapiens
gggagaaguugccuaagaa

SEQ ID NO: 1008819 - RNA, 19 nt, Homo sapiens
aaucagaaguuagcaguua

SEQ ID NO: 1008820 - RNA, 19 nt, Homo sapiens
gggaucaucuuaagaagga

SEQ ID NO: 1008821 - RNA, 19 nt, Homo sapiens
uauaaagguuggaucagua

SEQ ID NO: 1008822 - RNA, 19 nt, Homo sapiens
ggcgauaccuugaaguaaa

SEQ ID NO: 1008823 - RNA, 19 nt, Homo sapiens
gaaggagaauucaucagau

SEQ ID NO: 1008824 - RNA, 19 nt, Homo sapiens
gacaaggucugcaucucua

SEQ ID NO: 1008825 - RNA, 19 nt, Homo sapiens
uagaagcugucucugauaa

SEQ ID NO: 1008826 - RNA, 19 nt, Homo sapiens
ggacaucaguggccagauc

SEQ ID NO: 1008827 - RNA, 19 nt, Homo sapiens
caaaggugauauugaaguu

SEQ ID NO: 1008828 - RNA, 19 nt, Homo sapiens
gguagaagcugucucugau

SEQ ID NO: 1008829 - RNA, 19 nt, Homo sapiens
ggaccaagcugagcaugga

SEQ ID NO: 1008830 - RNA, 19 nt, Homo sapiens
aaauugacauccugacuuu

SEQ ID NO: 1008831 - RNA, 19 nt, Homo sapiens
gaagaacaaaggugauauu

SEQ ID NO: 1008832 - RNA, 19 nt, Homo sapiens
caaagcuggugaagaacua

SEQ ID NO: 1008833 - RNA, 19 nt, Homo sapiens
caaauuacaaggagaaguu

SEQ ID NO: 1008834 - RNA, 19 nt, Homo sapiens
aagaaaggcuucccucuca

SEQ ID NO: 1008835 - RNA, 19 nt, Homo sapiens
ccaauggacugaaagcaau

SEQ ID NO: 1008836 - RNA, 19 nt, Homo sapiens
gaacugaaagaguauaaca

SEQ ID NO: 1008837 - RNA, 19 nt, Homo sapiens
gaacaugucaaauuacaag

SEQ ID NO: 1008838 - RNA, 19 nt, Homo sapiens
caaggaagcagaugacaga

SEQ ID NO: 1008839 - RNA, 19 nt, Homo sapiens
gaagcugucucugauaagu

SEQ ID NO: 1008840 - RNA, 19 nt, Homo sapiens
uuacaugggaugcgauuua

SEQ ID NO: 1008841 - RNA, 19 nt, Homo sapiens
caaauaggagugagaguug

SEQ ID NO: 1008842 - RNA, 19 nt, Homo sapiens
gaaauggaacugaaagagu

SEQ ID NO: 1008843 - RNA, 19 nt, Homo sapiens
ggaagugauugcaguugug

SEQ ID NO: 1008844 - RNA, 19 nt, Homo sapiens
ucgaggagauaguuauuga

SEQ ID NO: 1008845 - RNA, 19 nt, Homo sapiens
gaacucaagacgacaacuu

SEQ ID NO: 1008846 - RNA, 19 nt, Homo sapiens
agacauuccucaaaacuua

SEQ ID NO: 1008847 - RNA, 19 nt, Homo sapiens
ggaagcagguggagaaaau

SEQ ID NO: 1008848 - RNA, 19 nt, Homo sapiens
gaugagcgauuggguagau

SEQ ID NO: 1008849 - RNA, 19 nt, Homo sapiens
gcgauaccuugaaguaaau

SEQ ID NO: 1008850 - RNA, 19 nt, Homo sapiens
gcgauuggguagaugaaau

SEQ ID NO: 1008851 - RNA, 19 nt, Homo sapiens
gaggagauuuaugcagaaa

SEQ ID NO: 1008852 - RNA, 19 nt, Homo sapiens
caauucagauuccaaaugc

SEQ ID NO: 1008853 - RNA, 19 nt, Homo sapiens
gaacacgucauccacuuag

SEQ ID NO: 1008854 - RNA, 19 nt, Homo sapiens
gccuauaacuuugaaccua

SEQ ID NO: 1008855 - RNA, 19 nt, Homo sapiens
ggauauaaagguuggauca

SEQ ID NO: 1008856 - RNA, 19 nt, Homo sapiens
ugaucuggauagagaauaa

SEQ ID NO: 1008857 - RNA, 19 nt, Homo sapiens
cuaaaggaaggaagaagua

SEQ ID NO: 1008858 - RNA, 19 nt, Homo sapiens
gauuauggcaugauugaug

SEQ ID NO: 1008859 - RNA, 19 nt, Homo sapiens
gaaaauaaaguguccaaug

SEQ ID NO: 1008860 - RNA, 19 nt, Homo sapiens
ggucaaaugaagauagauu

SEQ ID NO: 1008861 - RNA, 19 nt, Homo sapiens
ugggagaaguugccuaaga

SEQ ID NO: 1008862 - RNA, 19 nt, Homo sapiens
gagaagacaucuggaaagc

SEQ ID NO: 1008863 - RNA, 19 nt, Homo sapiens
cgacuuugcuguggcuuga

SEQ ID NO: 1008864 - RNA, 19 nt, Homo sapiens
caaguuuucuuccccaaua

SEQ ID NO: 1008865 - RNA, 19 nt, Homo sapiens
cuacgcaggugauaaacug

SEQ ID NO: 1008866 - RNA, 19 nt, Homo sapiens
ucaacccagugcuaaauga

SEQ ID NO: 1008867 - RNA, 19 nt, Homo sapiens
gcgauuauggcaugauuga

SEQ ID NO: 1008868 - RNA, 19 nt, Homo sapiens
acacuaagcugaaaacugu

SEQ ID NO: 1008869 - RNA, 19 nt, Homo sapiens
gauuugaagaugaucgaua

SEQ ID NO: 1008870 - RNA, 19 nt, Homo sapiens
caugauugaugauaugauc

SEQ ID NO: 1008871 - RNA, 19 nt, Homo sapiens
ggagaaguugccuaagaaa

SEQ ID NO: 1008872 - RNA, 19 nt, Homo sapiens
ccuauaacuuugaaccuau

SEQ ID NO: 1008873 - RNA, 19 nt, Homo sapiens
ggacaaggucugcaucucu

SEQ ID NO: 1008874 - RNA, 19 nt, Homo sapiens
gauacaagcgcguggacaa

SEQ ID NO: 1008875 - RNA, 19 nt, Homo sapiens
uaucuggucaucaucauuu

SEQ ID NO: 1008876 - RNA, 19 nt, Homo sapiens
ccaaauaggagugagaguu

SEQ ID NO: 1008877 - RNA, 19 nt, Homo sapiens
ggagaagacaucuggaaag

SEQ ID NO: 1008878 - RNA, 19 nt, Homo sapiens
cugcagagaugagcgauug

SEQ ID NO: 1008879 - RNA, 19 nt, Homo sapiens
guagaagcugucucugaua

SEQ ID NO: 1008880 - RNA, 19 nt, Homo sapiens
gccucacgcuuccggauaa

SEQ ID NO: 1008881 - RNA, 19 nt, Homo sapiens
gacaugccaucgaauacau

SEQ ID NO: 1008882 - RNA, 19 nt, Homo sapiens
gcaguuuggugaacaacag

SEQ ID NO: 1008883 - RNA, 19 nt, Homo sapiens
cagcgauuauggcaugauu

SEQ ID NO: 1008884 - RNA, 19 nt, Homo sapiens
aagaguaucuggucaucau

SEQ ID NO: 1008885 - RNA, 19 nt, Homo sapiens
ugagauucaugaagaagau

SEQ ID NO: 1008886 - RNA, 19 nt, Homo sapiens
cugaaagaguauaacauga

SEQ ID NO: 1008887 - RNA, 19 nt, Homo sapiens
acaagguacugcagcgauu

SEQ ID NO: 1008888 - RNA, 19 nt, Homo sapiens
gcaaucaccagacccaaag

SEQ ID NO: 1008889 - RNA, 19 nt, Homo sapiens
gaaaggcuucccucucauc

SEQ ID NO: 1008890 - RNA, 19 nt, Homo sapiens
gcugggagaaguugccuaa

SEQ ID NO: 1008891 - RNA, 19 nt, Homo sapiens
cuucugaacaugucaaauu

SEQ ID NO: 1008892 - RNA, 19 nt, Homo sapiens
agaaggagaauucaucaga

SEQ ID NO: 1008893 - RNA, 19 nt, Homo sapiens
aaacuuagucagcuguaaa

SEQ ID NO: 1008894 - RNA, 19 nt, Homo sapiens
gaacgauuuugcugaagaa

SEQ ID NO: 1008895 - RNA, 19 nt, Homo sapiens
caagguacugcagcgauua

SEQ ID NO: 1008896 - RNA, 19 nt, Homo sapiens
ugaaagcaaucaggguaga

SEQ ID NO: 1008897 - RNA, 19 nt, Homo sapiens
ucauuucuauggaacgauu

SEQ ID NO: 1008898 - RNA, 19 nt, Homo sapiens
ucugauggauauaaagguu

SEQ ID NO: 1008899 - RNA, 19 nt, Homo sapiens
gauugcaguuguggaagaa

SEQ ID NO: 1008900 - RNA, 19 nt, Homo sapiens
gaaguuagcaguuaaaagg

SEQ ID NO: 1008901 - RNA, 19 nt, Homo sapiens
ggacaugccaucgaauaca

SEQ ID NO: 1008902 - RNA, 19 nt, Homo sapiens
ugaggagauuuaugcagaa

SEQ ID NO: 1008903 - RNA, 19 nt, Homo sapiens
ucauuguggucaucuguga

SEQ ID NO: 1008904 - RNA, 19 nt, Homo sapiens
gagagcaguuuggugaaca

SEQ ID NO: 1008905 - RNA, 19 nt, Homo sapiens
uaaaggaaggaagaaguaa

SEQ ID NO: 1008906 - RNA, 19 nt, Homo sapiens
gagcagagaugaagaaauu

SEQ ID NO: 1008907 - RNA, 19 nt, Homo sapiens
gaacaugcuuguacuguca

SEQ ID NO: 1008908 - RNA, 19 nt, Homo sapiens
ggauggagcugguuguuau

SEQ ID NO: 1008909 - RNA, 19 nt, Homo sapiens
ggucauaccucgucaguca

SEQ ID NO: 1008910 - RNA, 19 nt, Homo sapiens
ugacuugccuuguguuauu

SEQ ID NO: 1008911 - RNA, 19 nt, Homo sapiens
ggaagaacaagaugccaua

SEQ ID NO: 1008912 - RNA, 19 nt, Homo sapiens
aagguaacgucuagaaaua

SEQ ID NO: 1008913 - RNA, 19 nt, Homo sapiens
gagcuaagguaacgucuag

SEQ ID NO: 1008914 - RNA, 19 nt, Homo sapiens
ggaugaaguuccugaugaa

SEQ ID NO: 1008915 - RNA, 19 nt, Homo sapiens
agaacaagaugccauaaug

SEQ ID NO: 1008916 - RNA, 19 nt, Homo sapiens
gaagauggaaccaaggaaa

SEQ ID NO: 1008917 - RNA, 19 nt, Homo sapiens
aaaggucccugaugucaaa

SEQ ID NO: 1008918 - RNA, 19 nt, Homo sapiens
ccaaggaaauagaaaguca

SEQ ID NO: 1008919 - RNA, 19 nt, Homo sapiens
ggaagucauugcugaagau

SEQ ID NO: 1008920 - RNA, 19 nt, Homo sapiens
gaaauggggucuuguuaug

SEQ ID NO: 1008921 - RNA, 19 nt, Homo sapiens
ggaugaaacugugcacguu

SEQ ID NO: 1008922 - RNA, 19 nt, Homo sapiens
ugaaguuccugaugaaguu

SEQ ID NO: 1008923 - RNA, 19 nt, Homo sapiens
guaccuucuuugcuacuua

SEQ ID NO: 1008924 - RNA, 19 nt, Homo sapiens
ucaguugccuuauguugaa

SEQ ID NO: 1008925 - RNA, 19 nt, Homo sapiens
ccaugcaguuguugaagua

SEQ ID NO: 1008926 - RNA, 19 nt, Homo sapiens
cagcagacauuucucagau

SEQ ID NO: 1008927 - RNA, 19 nt, Homo sapiens
guacacacaucauucuagu

SEQ ID NO: 1008928 - RNA, 19 nt, Homo sapiens
caagaugaaggauaaacua

SEQ ID NO: 1008929 - RNA, 19 nt, Homo sapiens
gaaguugagaaccaguuua

SEQ ID NO: 1008930 - RNA, 19 nt, Homo sapiens
gguaacgucuagaaauaau

SEQ ID NO: 1008931 - RNA, 19 nt, Homo sapiens
ccguacagcuguuugguuu

SEQ ID NO: 1008932 - RNA, 19 nt, Homo sapiens
acagaaggaucucaucaug

SEQ ID NO: 1008933 - RNA, 19 nt, Homo sapiens
ggcauuacgccaccacuua

SEQ ID NO: 1008934 - RNA, 19 nt, Homo sapiens
gcagagaugaagaaauuau

SEQ ID NO: 1008935 - RNA, 19 nt, Homo sapiens
gaccugccauagugaguuu

SEQ ID NO: 1008936 - RNA, 19 nt, Homo sapiens
gaaauucagaagcagauug

SEQ ID NO: 1008937 - RNA, 19 nt, Homo sapiens
gugucaagaugaaggauaa

SEQ ID NO: 1008938 - RNA, 19 nt, Homo sapiens
gaagugaggagagccauug

SEQ ID NO: 1008939 - RNA, 19 nt, Homo sapiens
guugagaaccaguuuauau

SEQ ID NO: 1008940 - RNA, 19 nt, Homo sapiens
gcauuacgccaccacuuaa

SEQ ID NO: 1008941 - RNA, 19 nt, Homo sapiens
aguagaagaugucccacua

SEQ ID NO: 1008942 - RNA, 19 nt, Homo sapiens
cagcuugaguuacaggaaa

SEQ ID NO: 1008943 - RNA, 19 nt, Homo sapiens
gggaagucauugcugaaga

SEQ ID NO: 1008944 - RNA, 19 nt, Homo sapiens
cugcuaagcugguugacuu

SEQ ID NO: 1008945 - RNA, 19 nt, Homo sapiens
gaguuuaagugccuaccuu

SEQ ID NO: 1008946 - RNA, 19 nt, Homo sapiens
uuauauugcuucugugcua

SEQ ID NO: 1008947 - RNA, 19 nt, Homo sapiens
gaagaacaagaugccauaa

SEQ ID NO: 1008948 - RNA, 19 nt, Homo sapiens
uaagguaacgucuagaaau

SEQ ID NO: 1008949 - RNA, 19 nt, Homo sapiens
gagaaccaguuuauauugc

SEQ ID NO: 1008950 - RNA, 19 nt, Homo sapiens
acacacaucauucuaguga

SEQ ID NO: 1008951 - RNA, 19 nt, Homo sapiens
uaauuuggauugacuuugg

SEQ ID NO: 1008952 - RNA, 19 nt, Homo sapiens
caguuaagguuaggaagaa

SEQ ID NO: 1008953 - RNA, 19 nt, Homo sapiens
ggacugcauuccugcucaa

SEQ ID NO: 1008954 - RNA, 19 nt, Homo sapiens
gaaccaaggaaauagaaag

SEQ ID NO: 1008955 - RNA, 19 nt, Homo sapiens
gagaggagcuaagguaacg

SEQ ID NO: 1008956 - RNA, 19 nt, Homo sapiens
gguauugucuaacuguaca

SEQ ID NO: 1008957 - RNA, 19 nt, Homo sapiens
gacuuucucuuugucaauu

SEQ ID NO: 1008958 - RNA, 19 nt, Homo sapiens
cuacugauccuaauauagu

SEQ ID NO: 1008959 - RNA, 19 nt, Homo sapiens
gaacaagaugccauaaugc

SEQ ID NO: 1008960 - RNA, 19 nt, Homo sapiens
ugagaaccaguuuauauug

SEQ ID NO: 1008961 - RNA, 19 nt, Homo sapiens
gcuaagguaacgucuagaa

SEQ ID NO: 1008962 - RNA, 19 nt, Homo sapiens
uaacuguacacacaucauu

SEQ ID NO: 1008963 - RNA, 19 nt, Homo sapiens
aagaaaagguuccggaaaa

SEQ ID NO: 1008964 - RNA, 19 nt, Homo sapiens
caucauguaauuuggauug

SEQ ID NO: 1008965 - RNA, 19 nt, Homo sapiens
cugcuuauguucuguuguu

SEQ ID NO: 1008966 - RNA, 19 nt, Homo sapiens
ccacaccaaacaagaauug

SEQ ID NO: 1008967 - RNA, 19 nt, Homo sapiens
uggagcagcuugaguuaca

SEQ ID NO: 1008968 - RNA, 19 nt, Homo sapiens
gcaguuaauacuagauugu

SEQ ID NO: 1008969 - RNA, 19 nt, Homo sapiens
caccaaacaagaauugauu

SEQ ID NO: 1008970 - RNA, 19 nt, Homo sapiens
ccugagaacgcuugauaaa

SEQ ID NO: 1008971 - RNA, 19 nt, Homo sapiens
gcucacaguuuguagucau

SEQ ID NO: 1008972 - RNA, 19 nt, Homo sapiens
gcagauuggaugaaacugu

SEQ ID NO: 1008973 - RNA, 19 nt, Homo sapiens
ccacaaaccuuggauucac

SEQ ID NO: 1008974 - RNA, 19 nt, Homo sapiens
aggaacaguugcagcguuu

SEQ ID NO: 1008975 - RNA, 19 nt, Homo sapiens
cgccaccacuuaagaaugu

SEQ ID NO: 1008976 - RNA, 19 nt, Homo sapiens
aaucaagacaugagugaaa

SEQ ID NO: 1008977 - RNA, 19 nt, Homo sapiens
ggucuauguucuuuaagca

SEQ ID NO: 1008978 - RNA, 19 nt, Homo sapiens
ccucaucaguuaagguuag

SEQ ID NO: 1008979 - RNA, 19 nt, Homo sapiens
guagaaaaggccaguauaa

SEQ ID NO: 1008980 - RNA, 19 nt, Homo sapiens
ucauggaaauucagaagca

SEQ ID NO: 1008981 - RNA, 19 nt, Homo sapiens
ugaaagccaggaugaaguu

SEQ ID NO: 1008982 - RNA, 19 nt, Homo sapiens
gcacuaggaccugccauag

SEQ ID NO: 1008983 - RNA, 19 nt, Homo sapiens
aaaauaugcucacaguuug

SEQ ID NO: 1008984 - RNA, 19 nt, Homo sapiens
gacugcagauuggaugaaa

SEQ ID NO: 1008985 - RNA, 19 nt, Homo sapiens
agucauugcugaagaugga

SEQ ID NO: 1008986 - RNA, 19 nt, Homo sapiens
aauacuagauuguguucug

SEQ ID NO: 1008987 - RNA, 19 nt, Homo sapiens
guacagcuguuugguuugc

SEQ ID NO: 1008988 - RNA, 19 nt, Homo sapiens
ggaaccaaggaaauagaaa

SEQ ID NO: 1008989 - RNA, 19 nt, Homo sapiens
ggucccugaugucaaagaa

SEQ ID NO: 1008990 - RNA, 19 nt, Homo sapiens
gguaccagcagauuauuca

SEQ ID NO: 1008991 - RNA, 19 nt, Homo sapiens
uaccuucuuugcuacuuaa

SEQ ID NO: 1008992 - RNA, 19 nt, Homo sapiens
ccagcugccucuacugauc

SEQ ID NO: 1008993 - RNA, 19 nt, Homo sapiens
aaacagcagacauuucuca

SEQ ID NO: 1008994 - RNA, 19 nt, Homo sapiens
ucucaaagugucaagauga

SEQ ID NO: 1008995 - RNA, 19 nt, Homo sapiens
ccaccacaccaaacaagaa

SEQ ID NO: 1008996 - RNA, 19 nt, Homo sapiens
gaagcucauuucccuacag

SEQ ID NO: 1008997 - RNA, 19 nt, Homo sapiens
cgucagucauggaaauuca

SEQ ID NO: 1008998 - RNA, 19 nt, Homo sapiens
agacauuucucagaugcuu

SEQ ID NO: 1008999 - RNA, 19 nt, Homo sapiens
uugcuucugugcuauggua

SEQ ID NO: 1009000 - RNA, 19 nt, Homo sapiens
agaaaaggccaguauaaaa

SEQ ID NO: 1009001 - RNA, 19 nt, Homo sapiens
cauccagacugcagauugg

SEQ ID NO: 1009002 - RNA, 19 nt, Homo sapiens
ccucgucagucauggaaau

SEQ ID NO: 1009003 - RNA, 19 nt, Homo sapiens
ccuagcacguucucaaagu

SEQ ID NO: 1009004 - RNA, 19 nt, Homo sapiens
uagauuguguucugucucu

SEQ ID NO: 1009005 - RNA, 19 nt, Homo sapiens
acgaggucauuucuacuaa

SEQ ID NO: 1009006 - RNA, 19 nt, Homo sapiens
acaagaagaugcagaagaa

SEQ ID NO: 1009007 - RNA, 19 nt, Homo sapiens
gaagacaaguuugagaucu

SEQ ID NO: 1009008 - RNA, 19 nt, Homo sapiens
uaaaggaggacacaccuaa

SEQ ID NO: 1009009 - RNA, 19 nt, Homo sapiens
gaugaugaacuaaauguug

SEQ ID NO: 1009010 - RNA, 19 nt, Homo sapiens
ggaaaugggaagaggauug

SEQ ID NO: 1009011 - RNA, 19 nt, Homo sapiens
ccacuuauaauacuuguga

SEQ ID NO: 1009012 - RNA, 19 nt, Homo sapiens
ccucaagucucaccaguuc

SEQ ID NO: 1009013 - RNA, 19 nt, Homo sapiens
gaccagcagugauaguaga

SEQ ID NO: 1009014 - RNA, 19 nt, Homo sapiens
ggagguuuguggaaauuca

SEQ ID NO: 1009015 - RNA, 19 nt, Homo sapiens
gaagaugaugaacuaaaug

SEQ ID NO: 1009016 - RNA, 19 nt, Homo sapiens
uggaaucccuccugugaau

SEQ ID NO: 1009017 - RNA, 19 nt, Homo sapiens
gcccacccaccaccuauua

SEQ ID NO: 1009018 - RNA, 19 nt, Homo sapiens
gacaagaagaugcagaaga

SEQ ID NO: 1009019 - RNA, 19 nt, Homo sapiens
caagguugcugggaaguag

SEQ ID NO: 1009020 - RNA, 19 nt, Homo sapiens
gagccgagacugcgaagga

SEQ ID NO: 1009021 - RNA, 19 nt, Homo sapiens
gauaguagacaagaagaug

SEQ ID NO: 1009022 - RNA, 19 nt, Homo sapiens
ucuuguugcugcuugguua

SEQ ID NO: 1009023 - RNA, 19 nt, Homo sapiens
gaggacacaccuaaacaug

SEQ ID NO: 1009024 - RNA, 19 nt, Homo sapiens
gguuggaccagcagugaua

SEQ ID NO: 1009025 - RNA, 19 nt, Homo sapiens
ugaacuaaauguugaagac

SEQ ID NO: 1009026 - RNA, 19 nt, Homo sapiens
gaacuaaauguugaagaca

SEQ ID NO: 1009027 - RNA, 19 nt, Homo sapiens
guucugcucucccaucaag

SEQ ID NO: 1009028 - RNA, 19 nt, Homo sapiens
cagaugccauguuguacug

SEQ ID NO: 1009029 - RNA, 19 nt, Homo sapiens
cuucagaugccauguugua

SEQ ID NO: 1009030 - RNA, 19 nt, Homo sapiens
gcugcuugguuagaucaua

SEQ ID NO: 1009031 - RNA, 19 nt, Homo sapiens
cagcagugauaguagacaa

SEQ ID NO: 1009032 - RNA, 19 nt, Homo sapiens
aaccuuaccucuccuccuu

SEQ ID NO: 1009033 - RNA, 19 nt, Homo sapiens
ugucuuggguccuauucaa

SEQ ID NO: 1009034 - RNA, 19 nt, Homo sapiens
gcagugauaguagacaaga

SEQ ID NO: 1009035 - RNA, 19 nt, Homo sapiens
ggaggacacaccuaaacau

SEQ ID NO: 1009036 - RNA, 19 nt, Homo sapiens
ccuggaaucccuccuguga

SEQ ID NO: 1009037 - RNA, 19 nt, Homo sapiens
gcucucccaucaagcuuca

SEQ ID NO: 1009038 - RNA, 19 nt, Homo sapiens
agacaaguuugagaucugu

SEQ ID NO: 1009039 - RNA, 19 nt, Homo sapiens
gaaaugggaagaggauugc

SEQ ID NO: 1009040 - RNA, 19 nt, Homo sapiens
gucccuacccuccuccaua

SEQ ID NO: 1009041 - RNA, 19 nt, Homo sapiens
ccacaaguaccacaagcau

SEQ ID NO: 1009042 - RNA, 19 nt, Homo sapiens
ggaccagcagugauaguag

SEQ ID NO: 1009043 - RNA, 19 nt, Homo sapiens
ccauggcaauccagcuuuc

SEQ ID NO: 1009044 - RNA, 19 nt, Homo sapiens
gagccucacccugcuguug

SEQ ID NO: 1009045 - RNA, 19 nt, Homo sapiens
caagaagaugcagaagaaa

SEQ ID NO: 1009046 - RNA, 19 nt, Homo sapiens
uagacaagaagaugcagaa

SEQ ID NO: 1009047 - RNA, 19 nt, Homo sapiens
ugagaucuguaaaauguga

SEQ ID NO: 1009048 - RNA, 19 nt, Homo sapiens
acaaguuugagaucuguaa

SEQ ID NO: 1009049 - RNA, 19 nt, Homo sapiens
cugcuugguuagaucauau

SEQ ID NO: 1009050 - RNA, 19 nt, Homo sapiens
aaaggaggacacaccuaaa

SEQ ID NO: 1009051 - RNA, 19 nt, Homo sapiens
caaguuugagaucuguaaa

SEQ ID NO: 1009052 - RNA, 19 nt, Homo sapiens
aagacaaguuugagaucug

SEQ ID NO: 1009053 - RNA, 19 nt, Homo sapiens
caccuaaacauguggaauc

SEQ ID NO: 1009054 - RNA, 19 nt, Homo sapiens
ccacccaccaccuauuaau

SEQ ID NO: 1009055 - RNA, 19 nt, Homo sapiens
uaugcugucuuggguccua

SEQ ID NO: 1009056 - RNA, 19 nt, Homo sapiens
agcccaauaugcugucuug

SEQ ID NO: 1009057 - RNA, 19 nt, Homo sapiens
guugaagacaaguuugaga

SEQ ID NO: 1009058 - RNA, 19 nt, Homo sapiens
agccagggccaaauccaua

SEQ ID NO: 1009059 - RNA, 19 nt, Homo sapiens
caguucugcucucccauca

SEQ ID NO: 1009060 - RNA, 19 nt, Homo sapiens
acccuucccucaagucuca

SEQ ID NO: 1009061 - RNA, 19 nt, Homo sapiens
ccuggacccuucccucaag

SEQ ID NO: 1009062 - RNA, 19 nt, Homo sapiens
ugaagacaaguuugagauc

SEQ ID NO: 1009063 - RNA, 19 nt, Homo sapiens
uugguuagaucauauagcu

SEQ ID NO: 1009064 - RNA, 19 nt, Homo sapiens
gcaccacaaguaccacaag

SEQ ID NO: 1009065 - RNA, 19 nt, Homo sapiens
acuaaauguugaagacaag

SEQ ID NO: 1009066 - RNA, 19 nt, Homo sapiens
cuaaaggaggacacaccua

SEQ ID NO: 1009067 - RNA, 19 nt, Homo sapiens
gaagaaagacaauggaaua

SEQ ID NO: 1009068 - RNA, 19 nt, Homo sapiens
ucaggaaacuugugcauua

SEQ ID NO: 1009069 - RNA, 19 nt, Homo sapiens
gaaagacaauggaauaaca

SEQ ID NO: 1009070 - RNA, 19 nt, Homo sapiens
ggacagggcuggcgacaau

SEQ ID NO: 1009071 - RNA, 19 nt, Homo sapiens
gcacugaagauguuauuua

SEQ ID NO: 1009072 - RNA, 19 nt, Homo sapiens
gaaagcgugugaggauuua

SEQ ID NO: 1009073 - RNA, 19 nt, Homo sapiens
gcagaugcguuccuucaga

SEQ ID NO: 1009074 - RNA, 19 nt, Homo sapiens
gaaacaggcucuaggaaaa

SEQ ID NO: 1009075 - RNA, 19 nt, Homo sapiens
ggaauaacauaccuucaag

SEQ ID NO: 1009076 - RNA, 19 nt, Homo sapiens
gcaguuacauauuuaccaa

SEQ ID NO: 1009077 - RNA, 19 nt, Homo sapiens
ggccauagauacuuguaaa

SEQ ID NO: 1009078 - RNA, 19 nt, Homo sapiens
ggucaaacgguuguuauua

SEQ ID NO: 1009079 - RNA, 19 nt, Homo sapiens
gucaaacgguuguuauuau

SEQ ID NO: 1009080 - RNA, 19 nt, Homo sapiens
ugacaucaguacacagaaa

SEQ ID NO: 1009081 - RNA, 19 nt, Homo sapiens
ggagaaauaacauguauac

SEQ ID NO: 1009082 - RNA, 19 nt, Homo sapiens
guucauagccuacgugugu

SEQ ID NO: 1009083 - RNA, 19 nt, Homo sapiens
uaacauguauaccuaccuu

SEQ ID NO: 1009084 - RNA, 19 nt, Homo sapiens
ugugaacacuuucuaauuc

SEQ ID NO: 1009085 - RNA, 19 nt, Homo sapiens
uaccuaaucucuaaugugu

SEQ ID NO: 1009086 - RNA, 19 nt, Homo sapiens
agacuuccgucguaaagaa

SEQ ID NO: 1009087 - RNA, 19 nt, Homo sapiens
ggaaacuugugcauuacau

SEQ ID NO: 1009088 - RNA, 19 nt, Homo sapiens
ccagaguauugcaccauuu

SEQ ID NO: 1009089 - RNA, 19 nt, Homo sapiens
ggcgacaauucauguguaa

SEQ ID NO: 1009090 - RNA, 19 nt, Homo sapiens
ggccaauagugaaauguga

SEQ ID NO: 1009091 - RNA, 19 nt, Homo sapiens
ccuaaucucuaauguguag

SEQ ID NO: 1009092 - RNA, 19 nt, Homo sapiens
ccacaccauuucauguauu

SEQ ID NO: 1009093 - RNA, 19 nt, Homo sapiens
gggcagcuccacaccauuu

SEQ ID NO: 1009094 - RNA, 19 nt, Homo sapiens
ggaagaaagacaauggaau

SEQ ID NO: 1009095 - RNA, 19 nt, Homo sapiens
gcaggccaauagugaaaug

SEQ ID NO: 1009096 - RNA, 19 nt, Homo sapiens
gaaugcagaugcguuccuu

SEQ ID NO: 1009097 - RNA, 19 nt, Homo sapiens
gacaauucauguguaaaug

SEQ ID NO: 1009098 - RNA, 19 nt, Homo sapiens
ucucuaauguguagcaguu

SEQ ID NO: 1009099 - RNA, 19 nt, Homo sapiens
gagggcagcuccacaccau

SEQ ID NO: 1009100 - RNA, 19 nt, Homo sapiens
gaacuguggccauagauac

SEQ ID NO: 1009101 - RNA, 19 nt, Homo sapiens
cgacaauucauguguaaau

SEQ ID NO: 1009102 - RNA, 19 nt, Homo sapiens
ugaaagcgugugaggauuu

SEQ ID NO: 1009103 - RNA, 19 nt, Homo sapiens
gaaacuugugcauuacauu

SEQ ID NO: 1009104 - RNA, 19 nt, Homo sapiens
cacaccauuucauguauuu

SEQ ID NO: 1009105 - RNA, 19 nt, Homo sapiens
agaaacaggcucuaggaaa

SEQ ID NO: 1009106 - RNA, 19 nt, Homo sapiens
ucaaacaugcaaauacuug

SEQ ID NO: 1009107 - RNA, 19 nt, Homo sapiens
uuacagagaauuccuagga

SEQ ID NO: 1009108 - RNA, 19 nt, Homo sapiens
gaauccagcaggccaauag

SEQ ID NO: 1009109 - RNA, 19 nt, Homo sapiens
gcuucuaacuuugcacuga

SEQ ID NO: 1009110 - RNA, 19 nt, Homo sapiens
gaaauagauguuugaagag

SEQ ID NO: 1009111 - RNA, 19 nt, Homo sapiens
guugaacuguggccauaga

SEQ ID NO: 1009112 - RNA, 19 nt, Homo sapiens
acauguauaccuaccuuua

SEQ ID NO: 1009113 - RNA, 19 nt, Homo sapiens
uccuuuagcuaauccuaua

SEQ ID NO: 1009114 - RNA, 19 nt, Homo sapiens
ggauuuaacuguggguuuu

SEQ ID NO: 1009115 - RNA, 19 nt, Homo sapiens
gaaacagaagugugugugu

SEQ ID NO: 1009116 - RNA, 19 nt, Homo sapiens
guuugaagagugcuuuaua

SEQ ID NO: 1009117 - RNA, 19 nt, Homo sapiens
gaaggaacagaaacaagca

SEQ ID NO: 1009118 - RNA, 19 nt, Homo sapiens
ccauagauacuuguaaaga

SEQ ID NO: 1009119 - RNA, 19 nt, Homo sapiens
cuggagaaauaacauguau

SEQ ID NO: 1009120 - RNA, 19 nt, Homo sapiens
uggcgacaauucaugugua

SEQ ID NO: 1009121 - RNA, 19 nt, Homo sapiens
agacauaucaaacaugcaa

SEQ ID NO: 1009122 - RNA, 19 nt, Homo sapiens
caaggaagaaagacaaugg

SEQ ID NO: 1009123 - RNA, 19 nt, Homo sapiens
gugaacacuuucuaauucu

SEQ ID NO: 1009124 - RNA, 19 nt, Homo sapiens
ggacucugucgauugcuuu

SEQ ID NO: 1009125 - RNA, 19 nt, Homo sapiens
gaacacuuucuaauucuac

SEQ ID NO: 1009126 - RNA, 19 nt, Homo sapiens
uguccucgcccuuccuuua

SEQ ID NO: 1009127 - RNA, 19 nt, Homo sapiens
uggaauaacauaccuucaa

SEQ ID NO: 1009128 - RNA, 19 nt, Homo sapiens
caaacaugcaaauacuuga

SEQ ID NO: 1009129 - RNA, 19 nt, Homo sapiens
cagcaggccaauagugaaa

SEQ ID NO: 1009130 - RNA, 19 nt, Homo sapiens
gcaaggaagaaagacaaug

SEQ ID NO: 1009131 - RNA, 19 nt, Homo sapiens
ugaacuguggccauagaua

SEQ ID NO: 1009132 - RNA, 19 nt, Homo sapiens
gaauaacauaccuucaagu

SEQ ID NO: 1009133 - RNA, 19 nt, Homo sapiens
uccuauacauuacagagaa

SEQ ID NO: 1009134 - RNA, 19 nt, Homo sapiens
uuucuguguuuguguguuu

SEQ ID NO: 1009135 - RNA, 19 nt, Homo sapiens
ggaacagaaacaagcacuu

SEQ ID NO: 1009136 - RNA, 19 nt, Homo sapiens
ggacuaaugcaagaaaauu

SEQ ID NO: 1009137 - RNA, 19 nt, Homo sapiens
guugacaucaguacacaga

SEQ ID NO: 1009138 - RNA, 19 nt, Homo sapiens
cagaaacaggcucuaggaa

SEQ ID NO: 1009139 - RNA, 19 nt, Homo sapiens
caacuccuagcacugaaga

SEQ ID NO: 1009140 - RNA, 19 nt, Homo sapiens
gcacuugggcguggguugu

SEQ ID NO: 1009141 - RNA, 19 nt, Homo sapiens
acagaaacaggcucuagga

SEQ ID NO: 1009142 - RNA, 19 nt, Homo sapiens
gaucaggaaacuugugcau

SEQ ID NO: 1009143 - RNA, 19 nt, Homo sapiens
accaaauaauggacucaaa

SEQ ID NO: 1009144 - RNA, 19 nt, Homo sapiens
gagacgggacaguguuguu

SEQ ID NO: 1009145 - RNA, 19 nt, Homo sapiens
caaggugacaggcguugug

SEQ ID NO: 1009146 - RNA, 19 nt, Homo sapiens
caggaaacuugugcauuac

SEQ ID NO: 1009147 - RNA, 19 nt, Homo sapiens
ccaaauaauggacucaaaa

SEQ ID NO: 1009148 - RNA, 19 nt, Homo sapiens
uccuagcacugaagauguu

SEQ ID NO: 1009149 - RNA, 19 nt, Homo sapiens
gucguaaagaaaccuauuu

SEQ ID NO: 1009150 - RNA, 19 nt, Homo sapiens
gccaauagugaaaugugaa

SEQ ID NO: 1009151 - RNA, 19 nt, Homo sapiens
ccuauacauuacagagaau

SEQ ID NO: 1009152 - RNA, 19 nt, Homo sapiens
uuguugaacuguggccaua

SEQ ID NO: 1009153 - RNA, 19 nt, Homo sapiens
gcuccacaccauuucaugu

SEQ ID NO: 1009154 - RNA, 19 nt, Homo sapiens
cguggguugugacugcuuu

SEQ ID NO: 1009155 - RNA, 19 nt, Homo sapiens
gauguuugaagagugcuuu

SEQ ID NO: 1009156 - RNA, 19 nt, Homo sapiens
cuccacaccauuucaugua

SEQ ID NO: 1009157 - RNA, 19 nt, Homo sapiens
cgugugaggauuuaacugu

SEQ ID NO: 1009158 - RNA, 19 nt, Homo sapiens
uagcacugaagauguuauu

SEQ ID NO: 1009159 - RNA, 19 nt, Homo sapiens
uccacaccauuucauguau

SEQ ID NO: 1009160 - RNA, 19 nt, Homo sapiens
aaagacuuccgucguaaag

SEQ ID NO: 1009161 - RNA, 19 nt, Homo sapiens
cauguauaccuaccuuuag

SEQ ID NO: 1009162 - RNA, 19 nt, Homo sapiens
ccagcaggccaauagugaa

SEQ ID NO: 1009163 - RNA, 19 nt, Homo sapiens
guguuuguguguuugaaag

SEQ ID NO: 1009164 - RNA, 19 nt, Homo sapiens
gcaagaaggccuccaaaua

SEQ ID NO: 1009165 - RNA, 19 nt, Homo sapiens
gcaauaaacucaaaucaca

SEQ ID NO: 1009166 - RNA, 19 nt, Homo sapiens
caagaaggccuccaaauau

SEQ ID NO: 1009167 - RNA, 19 nt, Homo sapiens
gaaacaaucccauuaguca

SEQ ID NO: 1009168 - RNA, 19 nt, Homo sapiens
aagaaggccuccaaauaua

SEQ ID NO: 1009169 - RNA, 19 nt, Homo sapiens
acaaucccauuuccuauua

SEQ ID NO: 1009170 - RNA, 19 nt, Homo sapiens
gcgaaacccucauccaguu

SEQ ID NO: 1009171 - RNA, 19 nt, Homo sapiens
uaaacagaauccucacuau

SEQ ID NO: 1009172 - RNA, 19 nt, Homo sapiens
ggaacuauguguggugguu

SEQ ID NO: 1009173 - RNA, 19 nt, Homo sapiens
gcguuucucuuucugcuuu

SEQ ID NO: 1009174 - RNA, 19 nt, Homo sapiens
gaggaguugugcaggguuu

SEQ ID NO: 1009175 - RNA, 19 nt, Homo sapiens
gcagugagaauaagagaca

SEQ ID NO: 1009176 - RNA, 19 nt, Homo sapiens
aaacucaaaucacaugucu

SEQ ID NO: 1009177 - RNA, 19 nt, Homo sapiens
gguguaguuuguauuaugu

SEQ ID NO: 1009178 - RNA, 19 nt, Homo sapiens
cgacgcgucuuugugguaa

SEQ ID NO: 1009179 - RNA, 19 nt, Homo sapiens
gagaauaagagacaacgau

SEQ ID NO: 1009180 - RNA, 19 nt, Homo sapiens
gaaggccuccaaauauaga

SEQ ID NO: 1009181 - RNA, 19 nt, Homo sapiens
caucggcgguauuaugaga

SEQ ID NO: 1009182 - RNA, 19 nt, Homo sapiens
aauccaaggucauggcaaa

SEQ ID NO: 1009183 - RNA, 19 nt, Homo sapiens
gagugaagguuuaaaucca

SEQ ID NO: 1009184 - RNA, 19 nt, Homo sapiens
uagaaacaaucccauuagu

SEQ ID NO: 1009185 - RNA, 19 nt, Homo sapiens
cuaaacagaauccucacua

SEQ ID NO: 1009186 - RNA, 19 nt, Homo sapiens
ucuacagagugaagguuua

SEQ ID NO: 1009187 - RNA, 19 nt, Homo sapiens
uuaccauucucugcaauaa

SEQ ID NO: 1009188 - RNA, 19 nt, Homo sapiens
guacaaucccauuuccuau

SEQ ID NO: 1009189 - RNA, 19 nt, Homo sapiens
uuaagcaucggcgguauua

SEQ ID NO: 1009190 - RNA, 19 nt, Homo sapiens
gcgcauacaggacccuaaa

SEQ ID NO: 1009191 - RNA, 19 nt, Homo sapiens
aaucacaugucugcaagaa

SEQ ID NO: 1009192 - RNA, 19 nt, Homo sapiens
ucaaaucacaugucugcaa

SEQ ID NO: 1009193 - RNA, 19 nt, Homo sapiens
ccaaagaccaacaaagagu

SEQ ID NO: 1009194 - RNA, 19 nt, Homo sapiens
aaacagaauccucacuaug

SEQ ID NO: 1009195 - RNA, 19 nt, Homo sapiens
gcauacaggacccuaaaca

SEQ ID NO: 1009196 - RNA, 19 nt, Homo sapiens
gcgcgucccugagcauguu

SEQ ID NO: 1009197 - RNA, 19 nt, Homo sapiens
cgucuacuuucuaggauga

SEQ ID NO: 1009198 - RNA, 19 nt, Homo sapiens
acagaauccucacuaugga

SEQ ID NO: 1009199 - RNA, 19 nt, Homo sapiens
cgccaggacugugauggua

SEQ ID NO: 1009200 - RNA, 19 nt, Homo sapiens
aauaagagacaacgauuca

SEQ ID NO: 1009201 - RNA, 19 nt, Homo sapiens
ucucugcaauaaacucaaa

SEQ ID NO: 1009202 - RNA, 19 nt, Homo sapiens
gaacguggaaagcgcauac

SEQ ID NO: 1009203 - RNA, 19 nt, Homo sapiens
uguauuauguugcguuucu

SEQ ID NO: 1009204 - RNA, 19 nt, Homo sapiens
caacgauucacgucuacuu

SEQ ID NO: 1009205 - RNA, 19 nt, Homo sapiens
cgacagagggaaagcuaug

SEQ ID NO: 1009206 - RNA, 19 nt, Homo sapiens
gggcagguuugcgggcuuu

SEQ ID NO: 1009207 - RNA, 19 nt, Homo sapiens
auacaggacccuaaacaga

SEQ ID NO: 1009208 - RNA, 19 nt, Homo sapiens
acaggacccuaaacagaau

SEQ ID NO: 1009209 - RNA, 19 nt, Homo sapiens
uacaggacccuaaacagaa

SEQ ID NO: 1009210 - RNA, 19 nt, Homo sapiens
cgguguaguuuguauuaug

SEQ ID NO: 1009211 - RNA, 19 nt, Homo sapiens
gcgaaagaaucgggcagau

SEQ ID NO: 1009212 - RNA, 19 nt, Homo sapiens
gagggaaagcuaugaaagg

SEQ ID NO: 1009213 - RNA, 19 nt, Homo sapiens
ucacgucuacuuucuagga

SEQ ID NO: 1009214 - RNA, 19 nt, Homo sapiens
agaauaagagacaacgauu

SEQ ID NO: 1009215 - RNA, 19 nt, Homo sapiens
uguacaaucccauuuccua

SEQ ID NO: 1009216 - RNA, 19 nt, Homo sapiens
cccugagcauguugaauuu

SEQ ID NO: 1009217 - RNA, 19 nt, Homo sapiens
ucccugagcauguugaauu

SEQ ID NO: 1009218 - RNA, 19 nt, Homo sapiens
cuacagagugaagguuuaa

SEQ ID NO: 1009219 - RNA, 19 nt, Homo sapiens
uuccaaagaccaacaaaga

SEQ ID NO: 1009220 - RNA, 19 nt, Homo sapiens
caucauccuuuaggcucua

SEQ ID NO: 1009221 - RNA, 19 nt, Homo sapiens
gcccugcugccaucucuuu

SEQ ID NO: 1009222 - RNA, 19 nt, Homo sapiens
aagcaucggcgguauuaug

SEQ ID NO: 1009223 - RNA, 19 nt, Homo sapiens
ccaggacugugaugguaca

SEQ ID NO: 1009224 - RNA, 19 nt, Homo sapiens
uauguugcguuucucuuuc

SEQ ID NO: 1009225 - RNA, 19 nt, Homo sapiens
gacaacgauucacgucuac

SEQ ID NO: 1009226 - RNA, 19 nt, Homo sapiens
gcgacgcgucuuuguggua

SEQ ID NO: 1009227 - RNA, 19 nt, Homo sapiens
uacaaucccauuuccuauu

SEQ ID NO: 1009228 - RNA, 19 nt, Homo sapiens
cagagggaaagcuaugaaa

SEQ ID NO: 1009229 - RNA, 19 nt, Homo sapiens
agugaagguuuaaauccaa

SEQ ID NO: 1009230 - RNA, 19 nt, Homo sapiens
cgauucacgucuacuuucu

SEQ ID NO: 1009231 - RNA, 19 nt, Homo sapiens
ccaaauauagaaacaaucc

SEQ ID NO: 1009232 - RNA, 19 nt, Homo sapiens
cuauuaccauucucugcaa

SEQ ID NO: 1009233 - RNA, 19 nt, Homo sapiens
ccuugucgcucguguccuu

SEQ ID NO: 1009234 - RNA, 19 nt, Homo sapiens
cacuauggaugggcucauu

SEQ ID NO: 1009235 - RNA, 19 nt, Homo sapiens
gcgguguaguuuguauuau

SEQ ID NO: 1009236 - RNA, 19 nt, Homo sapiens
cgcgguguaguuuguauua

SEQ ID NO: 1009237 - RNA, 19 nt, Homo sapiens
ccggugggcuagguacuga

SEQ ID NO: 1009238 - RNA, 19 nt, Homo sapiens
aacagaauccucacuaugg

SEQ ID NO: 1009239 - RNA, 19 nt, Homo sapiens
agggaaagcuaugaaaggu

SEQ ID NO: 1009240 - RNA, 19 nt, Homo sapiens
cagagugaagguuuaaauc

SEQ ID NO: 1009241 - RNA, 19 nt, Homo sapiens
cccauuuccuauuaccauu

SEQ ID NO: 1009242 - RNA, 19 nt, Homo sapiens
acagagugaagguuuaaau

SEQ ID NO: 1009243 - RNA, 19 nt, Homo sapiens
uuauguugcguuucucuuu

SEQ ID NO: 1009244 - RNA, 19 nt, Homo sapiens
gagcauguugaauuuccaa

SEQ ID NO: 1009245 - RNA, 19 nt, Homo sapiens
gauucacgucuacuuucua

SEQ ID NO: 1009246 - RNA, 19 nt, Homo sapiens
agaaacaaucccauuaguc

SEQ ID NO: 1009247 - RNA, 19 nt, Homo sapiens
cgaaagaaucgggcagauc

SEQ ID NO: 1009248 - RNA, 19 nt, Homo sapiens
gacagagggaaagcuauga

SEQ ID NO: 1009249 - RNA, 19 nt, Homo sapiens
cuuucuccaucauccuuua

SEQ ID NO: 1009250 - RNA, 19 nt, Homo sapiens
agaaggccuccaaauauag

SEQ ID NO: 1009251 - RNA, 19 nt, Homo sapiens
accauucucugcaauaaac

SEQ ID NO: 1009252 - RNA, 19 nt, Homo sapiens
ucauugaggacauuaagca

SEQ ID NO: 1009253 - RNA, 19 nt, Homo sapiens
caacucaaccccuuuugga

SEQ ID NO: 1009254 - RNA, 19 nt, Homo sapiens
ggcaaaacaucugaaguuc

SEQ ID NO: 1009255 - RNA, 19 nt, Homo sapiens
gcaauaaacucaaaucaca

SEQ ID NO: 1009256 - RNA, 19 nt, Homo sapiens
acaaucccauuuccuauua

SEQ ID NO: 1009257 - RNA, 19 nt, Homo sapiens
caaaucacaugucugcaaa

SEQ ID NO: 1009258 - RNA, 19 nt, Homo sapiens
gcgaaacccucauccaguu

SEQ ID NO: 1009259 - RNA, 19 nt, Homo sapiens
uaaacagaauccucacuau

SEQ ID NO: 1009260 - RNA, 19 nt, Homo sapiens
aaacucaaaucacaugucu

SEQ ID NO: 1009261 - RNA, 19 nt, Homo sapiens
caucggcgguauuaugaga

SEQ ID NO: 1009262 - RNA, 19 nt, Homo sapiens
aauccaaggucauggcaaa

SEQ ID NO: 1009263 - RNA, 19 nt, Homo sapiens
gagugaagguuuaaaucca

SEQ ID NO: 1009264 - RNA, 19 nt, Homo sapiens
ucuacagagugaagguuua

SEQ ID NO: 1009265 - RNA, 19 nt, Homo sapiens
cuaaacagaauccucacua

SEQ ID NO: 1009266 - RNA, 19 nt, Homo sapiens
uuaccauucucugcaauaa

SEQ ID NO: 1009267 - RNA, 19 nt, Homo sapiens
guacaaucccauuuccuau

SEQ ID NO: 1009268 - RNA, 19 nt, Homo sapiens
uuaagcaucggcgguauua

SEQ ID NO: 1009269 - RNA, 19 nt, Homo sapiens
gcgcauacaggacccuaaa

SEQ ID NO: 1009270 - RNA, 19 nt, Homo sapiens
ucaaaucacaugucugcaa

SEQ ID NO: 1009271 - RNA, 19 nt, Homo sapiens
aaacagaauccucacuaug

SEQ ID NO: 1009272 - RNA, 19 nt, Homo sapiens
gcauacaggacccuaaaca

SEQ ID NO: 1009273 - RNA, 19 nt, Homo sapiens
acagaauccucacuaugga

SEQ ID NO: 1009274 - RNA, 19 nt, Homo sapiens
cgccaggacugugauggua

SEQ ID NO: 1009275 - RNA, 19 nt, Homo sapiens
ucucugcaauaaacucaaa

SEQ ID NO: 1009276 - RNA, 19 nt, Homo sapiens
gaacguggaaagcgcauac

SEQ ID NO: 1009277 - RNA, 19 nt, Homo sapiens
cgacagagggaaagcuaug

SEQ ID NO: 1009278 - RNA, 19 nt, Homo sapiens
auacaggacccuaaacaga

SEQ ID NO: 1009279 - RNA, 19 nt, Homo sapiens
acaggacccuaaacagaau

SEQ ID NO: 1009280 - RNA, 19 nt, Homo sapiens
uacaggacccuaaacagaa

SEQ ID NO: 1009281 - RNA, 19 nt, Homo sapiens
gcgaaagaaucgggcagau

SEQ ID NO: 1009282 - RNA, 19 nt, Homo sapiens
gagggaaagcuaugaaagg

SEQ ID NO: 1009283 - RNA, 19 nt, Homo sapiens
uguacaaucccauuuccua

SEQ ID NO: 1009284 - RNA, 19 nt, Homo sapiens
cuacagagugaagguuuaa

SEQ ID NO: 1009285 - RNA, 19 nt, Homo sapiens
aagcaucggcgguauuaug

SEQ ID NO: 1009286 - RNA, 19 nt, Homo sapiens
ccaggacugugaugguaca

SEQ ID NO: 1009287 - RNA, 19 nt, Homo sapiens
uacaaucccauuuccuauu

SEQ ID NO: 1009288 - RNA, 19 nt, Homo sapiens
agugaagguuuaaauccaa

SEQ ID NO: 1009289 - RNA, 19 nt, Homo sapiens
cagagggaaagcuaugaaa

SEQ ID NO: 1009290 - RNA, 19 nt, Homo sapiens
cuauuaccauucucugcaa

SEQ ID NO: 1009291 - RNA, 19 nt, Homo sapiens
cacuauggaugggcucauu

SEQ ID NO: 1009292 - RNA, 19 nt, Homo sapiens
ccggugggcuagguacuga

SEQ ID NO: 1009293 - RNA, 19 nt, Homo sapiens
aacagaauccucacuaugg

SEQ ID NO: 1009294 - RNA, 19 nt, Homo sapiens
cagagugaagguuuaaauc

SEQ ID NO: 1009295 - RNA, 19 nt, Homo sapiens
agggaaagcuaugaaaggu

SEQ ID NO: 1009296 - RNA, 19 nt, Homo sapiens
cccauuuccuauuaccauu

SEQ ID NO: 1009297 - RNA, 19 nt, Homo sapiens
acagagugaagguuuaaau

SEQ ID NO: 1009298 - RNA, 19 nt, Homo sapiens
cgaaagaaucgggcagauc

SEQ ID NO: 1009299 - RNA, 19 nt, Homo sapiens
gacagagggaaagcuauga

SEQ ID NO: 1009300 - RNA, 19 nt, Homo sapiens
accauucucugcaauaaac

SEQ ID NO: 1009301 - RNA, 19 nt, Homo sapiens
ucauugaggacauuaagca

SEQ ID NO: 1009302 - RNA, 19 nt, Homo sapiens
ggcaaaacaucugaaguuc

SEQ ID NO: 1009303 - RNA, 19 nt, Homo sapiens
gcaaguaccucaucuucac

SEQ ID NO: 1009304 - RNA, 19 nt, Homo sapiens
ggacugcacugugaagauc

SEQ ID NO: 1009305 - RNA, 19 nt, Homo sapiens
gcaacgaccugaccaucuc

SEQ ID NO: 1009306 - RNA, 19 nt, Homo sapiens
caccucagcuucucccauu

SEQ ID NO: 1009307 - RNA, 19 nt, Homo sapiens
uuauagcaguuacgccuua

SEQ ID NO: 1009308 - RNA, 19 nt, Homo sapiens
caacaaugccuuccaggau

SEQ ID NO: 1009309 - RNA, 19 nt, Homo sapiens
gagcaaguaccucaucuuc

SEQ ID NO: 1009310 - RNA, 19 nt, Homo sapiens
ggagagguggagaugcuua

SEQ ID NO: 1009311 - RNA, 19 nt, Homo sapiens
ggaccacgucauagacaua

SEQ ID NO: 1009312 - RNA, 19 nt, Homo sapiens
caagcccuaugacguguuu

SEQ ID NO: 1009313 - RNA, 19 nt, Homo sapiens
cgacgacgccaccaucaaa

SEQ ID NO: 1009314 - RNA, 19 nt, Homo sapiens
cagcggccauguccuggua

SEQ ID NO: 1009315 - RNA, 19 nt, Homo sapiens
gacgagugcuucuucaucu

SEQ ID NO: 1009316 - RNA, 19 nt, Homo sapiens
uccaaggacugcacuguga

SEQ ID NO: 1009317 - RNA, 19 nt, Homo sapiens
ggacaucgccaggcucugu

SEQ ID NO: 1009318 - RNA, 19 nt, Homo sapiens
ggcagaaugucacgaugga

SEQ ID NO: 1009319 - RNA, 19 nt, Homo sapiens
gcacgaggauguggucaac

SEQ ID NO: 1009320 - RNA, 19 nt, Homo sapiens
caacgacgagugcuucuuc

SEQ ID NO: 1009321 - RNA, 19 nt, Homo sapiens
gggcuccgaugccuucuuc

SEQ ID NO: 1009322 - RNA, 19 nt, Homo sapiens
gccacacgcucacacacaa

SEQ ID NO: 1009323 - RNA, 19 nt, Homo sapiens
agauugaccugcugguguu

SEQ ID NO: 1009324 - RNA, 19 nt, Homo sapiens
agacauacacggacacauc

SEQ ID NO: 1009325 - RNA, 19 nt, Homo sapiens
gcccgaguguguugcaugu

SEQ ID NO: 1009326 - RNA, 19 nt, Homo sapiens
gacauacacggacacauca

SEQ ID NO: 1009327 - RNA, 19 nt, Homo sapiens
gcuccuggcugugguugug

SEQ ID NO: 1009328 - RNA, 19 nt, Homo sapiens
gcaguucuaccgcuacuac

SEQ ID NO: 1009329 - RNA, 19 nt, Homo sapiens
acaaugccuuccaggaugu

SEQ ID NO: 1009330 - RNA, 19 nt, Homo sapiens
ggcccugaauaaacaguug

SEQ ID NO: 1009331 - RNA, 19 nt, Homo sapiens
caagagcaaguaccucauc

SEQ ID NO: 1009332 - RNA, 19 nt, Homo sapiens
ccacaggcgccaagagcaa

SEQ ID NO: 1009333 - RNA, 19 nt, Homo sapiens
acacccaguucucccaguu

SEQ ID NO: 1009334 - RNA, 19 nt, Homo sapiens
gagcaguucuaccgcuacu

SEQ ID NO: 1009335 - RNA, 19 nt, Homo sapiens
ggaccgccacuacaacauc

SEQ ID NO: 1009336 - RNA, 19 nt, Homo sapiens
gagguggagaugcuuauag

SEQ ID NO: 1009337 - RNA, 19 nt, Homo sapiens
gauccugccacaccagaug

SEQ ID NO: 1009338 - RNA, 19 nt, Homo sapiens
caacucaguggucuucagu

SEQ ID NO: 1009339 - RNA, 19 nt, Homo sapiens
ggucaacucaguggucuuc

SEQ ID NO: 1009340 - RNA, 19 nt, Homo sapiens
gaccgccacuacaacaucu

SEQ ID NO: 1009341 - RNA, 19 nt, Homo sapiens
cgacgagugcuucuucauc

SEQ ID NO: 1009342 - RNA, 19 nt, Homo sapiens
gagagguggagaugcuuau

SEQ ID NO: 1009343 - RNA, 19 nt, Homo sapiens
caagauccagaaccucaau

SEQ ID NO: 1009344 - RNA, 19 nt, Homo sapiens
gcucggugcuguggcucaa

SEQ ID NO: 1009345 - RNA, 19 nt, Homo sapiens
cgggagagguggagaugcu

SEQ ID NO: 1009346 - RNA, 19 nt, Homo sapiens
ugucggagcgcaugcuaga

SEQ ID NO: 1009347 - RNA, 19 nt, Homo sapiens
ucucccaguucaacaagga

SEQ ID NO: 1009348 - RNA, 19 nt, Homo sapiens
ccaaggacugcacugugaa

SEQ ID NO: 1009349 - RNA, 19 nt, Homo sapiens
gguggccagugcagaugga

SEQ ID NO: 1009350 - RNA, 19 nt, Homo sapiens
ccacacgcucacacacaaa

SEQ ID NO: 1009351 - RNA, 19 nt, Homo sapiens
cgagugcuucuucaucuuc

SEQ ID NO: 1009352 - RNA, 19 nt, Homo sapiens
ccaugcagccgccaccaau

SEQ ID NO: 1009353 - RNA, 19 nt, Homo sapiens
ggaaaugucucucaaagaa

SEQ ID NO: 1009354 - RNA, 19 nt, Homo sapiens
gaaaugaacagcauagaua

SEQ ID NO: 1009355 - RNA, 19 nt, Homo sapiens
ggacagagcugcuaauaag

SEQ ID NO: 1009356 - RNA, 19 nt, Homo sapiens
ggaauaagcuuacccacuu

SEQ ID NO: 1009357 - RNA, 19 nt, Homo sapiens
gcagaaauguuaaccaauu

SEQ ID NO: 1009358 - RNA, 19 nt, Homo sapiens
gcuaauaucugaagacuga

SEQ ID NO: 1009359 - RNA, 19 nt, Homo sapiens
gaagauguuuguugaugua

SEQ ID NO: 1009360 - RNA, 19 nt, Homo sapiens
agacagaccucaaguacua

SEQ ID NO: 1009361 - RNA, 19 nt, Homo sapiens
gcagcaccauuucaauuua

SEQ ID NO: 1009362 - RNA, 19 nt, Homo sapiens
cgaacaggcuugcaauuaa

SEQ ID NO: 1009363 - RNA, 19 nt, Homo sapiens
gcaaagccauccacuaugu

SEQ ID NO: 1009364 - RNA, 19 nt, Homo sapiens
gggcauacauguucuauca

SEQ ID NO: 1009365 - RNA, 19 nt, Homo sapiens
caacagaacuagaauaacu

SEQ ID NO: 1009366 - RNA, 19 nt, Homo sapiens
gaaaagaaaucaugcagaa

SEQ ID NO: 1009367 - RNA, 19 nt, Homo sapiens
ggauguaacucuacugaau

SEQ ID NO: 1009368 - RNA, 19 nt, Homo sapiens
gcauacauguucuaucauu

SEQ ID NO: 1009369 - RNA, 19 nt, Homo sapiens
caugauggcugcaguugua

SEQ ID NO: 1009370 - RNA, 19 nt, Homo sapiens
cagcauaucugccaccaaa

SEQ ID NO: 1009371 - RNA, 19 nt, Homo sapiens
ggaagaugguagucuguaa

SEQ ID NO: 1009372 - RNA, 19 nt, Homo sapiens
uagaauaacuccagaggaa

SEQ ID NO: 1009373 - RNA, 19 nt, Homo sapiens
caccaugccuggcuaauuu

SEQ ID NO: 1009374 - RNA, 19 nt, Homo sapiens
gaagauguuucaaagacaa

SEQ ID NO: 1009375 - RNA, 19 nt, Homo sapiens
gagcagaguugucauacug

SEQ ID NO: 1009376 - RNA, 19 nt, Homo sapiens
ggaaauuaguagaguauuc

SEQ ID NO: 1009377 - RNA, 19 nt, Homo sapiens
ugaaguacaugccauuuga

SEQ ID NO: 1009378 - RNA, 19 nt, Homo sapiens
uaagagaguuggaagaaau

SEQ ID NO: 1009379 - RNA, 19 nt, Homo sapiens
ucaagagccuuaucauuug

SEQ ID NO: 1009380 - RNA, 19 nt, Homo sapiens
aaacauacuucugggaaua

SEQ ID NO: 1009381 - RNA, 19 nt, Homo sapiens
ggaaaccgaucagcuggua

SEQ ID NO: 1009382 - RNA, 19 nt, Homo sapiens
gaacaggcuugcaauuaag

SEQ ID NO: 1009383 - RNA, 19 nt, Homo sapiens
gcacaaaccuaauuaugcu

SEQ ID NO: 1009384 - RNA, 19 nt, Homo sapiens
caaguaugcuaacaagaaa

SEQ ID NO: 1009385 - RNA, 19 nt, Homo sapiens
ccagucacauuccuuuaua

SEQ ID NO: 1009386 - RNA, 19 nt, Homo sapiens
uaaggucucuaagucauua

SEQ ID NO: 1009387 - RNA, 19 nt, Homo sapiens
gaauaagcuuacccacuuu

SEQ ID NO: 1009388 - RNA, 19 nt, Homo sapiens
caaaucaugucaucuuuag

SEQ ID NO: 1009389 - RNA, 19 nt, Homo sapiens
guucaucccucucuacuga

SEQ ID NO: 1009390 - RNA, 19 nt, Homo sapiens
gcaccaaucuacaacuaug

SEQ ID NO: 1009391 - RNA, 19 nt, Homo sapiens
gcuagaagauguuucaaag

SEQ ID NO: 1009392 - RNA, 19 nt, Homo sapiens
ccaauaaucacaacaugua

SEQ ID NO: 1009393 - RNA, 19 nt, Homo sapiens
ggaaauguccauccaguug

SEQ ID NO: 1009394 - RNA, 19 nt, Homo sapiens
cgaguuggccuuauccuua

SEQ ID NO: 1009395 - RNA, 19 nt, Homo sapiens
ggaguggacaggagcauua

SEQ ID NO: 1009396 - RNA, 19 nt, Homo sapiens
caugugaccuugaggauga

SEQ ID NO: 1009397 - RNA, 19 nt, Homo sapiens
ugagauaccugagugauga

SEQ ID NO: 1009398 - RNA, 19 nt, Homo sapiens
uuacaaagccuuaucagaa

SEQ ID NO: 1009399 - RNA, 19 nt, Homo sapiens
acacugaggugcacucuug

SEQ ID NO: 1009400 - RNA, 19 nt, Homo sapiens
gcauaauuaucucagguaa

SEQ ID NO: 1009401 - RNA, 19 nt, Homo sapiens
cauauugaguucuuuggua

SEQ ID NO: 1009402 - RNA, 19 nt, Homo sapiens
agaagauggugauaaagua

SEQ ID NO: 1009403 - RNA, 19 nt, Homo sapiens
ugagggaaaugucuuuauu

SEQ ID NO: 1009404 - RNA, 19 nt, Homo sapiens
gaagugugcuuugcugguu

SEQ ID NO: 1009405 - RNA, 19 nt, Homo sapiens
caacagcuauccauuagag

SEQ ID NO: 1009406 - RNA, 19 nt, Homo sapiens
gcaugucacuuuuccauua

SEQ ID NO: 1009407 - RNA, 19 nt, Homo sapiens
gaguuggccuuauccuuaa

SEQ ID NO: 1009408 - RNA, 19 nt, Homo sapiens
gccauucacuggauagaaa

SEQ ID NO: 1009409 - RNA, 19 nt, Homo sapiens
ugagaaagcuggaguucau

SEQ ID NO: 1009410 - RNA, 19 nt, Homo sapiens
gccugcaaaucuuaaauua

SEQ ID NO: 1009411 - RNA, 19 nt, Homo sapiens
gaggaaaugucucucaaag

SEQ ID NO: 1009412 - RNA, 19 nt, Homo sapiens
uguaaagucucuccugaaa

SEQ ID NO: 1009413 - RNA, 19 nt, Homo sapiens
gauaaagggagguuugaaa

SEQ ID NO: 1009414 - RNA, 19 nt, Homo sapiens
ccuaaggaguuuauuggua

SEQ ID NO: 1009415 - RNA, 19 nt, Homo sapiens
cagcuaauguuacuguuga

SEQ ID NO: 1009416 - RNA, 19 nt, Homo sapiens
caaacacccuggagacgaa

SEQ ID NO: 1009417 - RNA, 19 nt, Homo sapiens
gcugauaaauauacccaaa

SEQ ID NO: 1009418 - RNA, 19 nt, Homo sapiens
gacaguugauggaaauaaa

SEQ ID NO: 1009419 - RNA, 19 nt, Homo sapiens
gacagagucuugcuccauu

SEQ ID NO: 1009420 - RNA, 19 nt, Homo sapiens
uuaaagccauccauauuga

SEQ ID NO: 1009421 - RNA, 19 nt, Homo sapiens
caagaaagcaacuaugguu

SEQ ID NO: 1009422 - RNA, 19 nt, Homo sapiens
ccaaauggcccagguguaa

SEQ ID NO: 1009423 - RNA, 19 nt, Homo sapiens
gggcaccaaucuacaacua

SEQ ID NO: 1009424 - RNA, 19 nt, Homo sapiens
ucacaucucccuuuaaguu

SEQ ID NO: 1009425 - RNA, 19 nt, Homo sapiens
caaauguuccuguagcaua

SEQ ID NO: 1009426 - RNA, 19 nt, Homo sapiens
uaacugagaccaucuaaca

SEQ ID NO: 1009427 - RNA, 19 nt, Homo sapiens
gauguaacucuacugaaua

SEQ ID NO: 1009428 - RNA, 19 nt, Homo sapiens
ccaauuagcucaacuuuuc

SEQ ID NO: 1009429 - RNA, 19 nt, Homo sapiens
caacaucuagucaaacaaa

SEQ ID NO: 1009430 - RNA, 19 nt, Homo sapiens
gcacuaaguuuucuuugaa

SEQ ID NO: 1009431 - RNA, 19 nt, Homo sapiens
ccucgucuaugguguauuu

SEQ ID NO: 1009432 - RNA, 19 nt, Homo sapiens
uaguuuggcuccuucauuu

SEQ ID NO: 1009433 - RNA, 19 nt, Homo sapiens
ucacucaaauuucuagaga

SEQ ID NO: 1009434 - RNA, 19 nt, Homo sapiens
gauauucucgucuuccuaa

SEQ ID NO: 1009435 - RNA, 19 nt, Homo sapiens
gaaagcaacuaugguuugg

SEQ ID NO: 1009436 - RNA, 19 nt, Homo sapiens
gguuauguuugcaugcuua

SEQ ID NO: 1009437 - RNA, 19 nt, Homo sapiens
gagcuuaauugcuugaagu

SEQ ID NO: 1009438 - RNA, 19 nt, Homo sapiens
ugucuuaguucuaguggua

SEQ ID NO: 1009439 - RNA, 19 nt, Homo sapiens
aaacaaaucuaggaugcuu

SEQ ID NO: 1009440 - RNA, 19 nt, Homo sapiens
ucagauagauaaccuuaca

SEQ ID NO: 1009441 - RNA, 19 nt, Homo sapiens
gggauuguuuggccucuaa

SEQ ID NO: 1009442 - RNA, 19 nt, Homo sapiens
guaggacucccacuuguaa

SEQ ID NO: 1009443 - RNA, 19 nt, Homo sapiens
uagcauaaaugguguuaca

SEQ ID NO: 1009444 - RNA, 19 nt, Homo sapiens
aauguugacuccaguaauu

SEQ ID NO: 1009445 - RNA, 19 nt, Homo sapiens
ucugaagacugaaauaaug

SEQ ID NO: 1009446 - RNA, 19 nt, Homo sapiens
gccaucaccugccaauuug

SEQ ID NO: 1009447 - RNA, 19 nt, Homo sapiens
ugaaacgucuccugcauca

SEQ ID NO: 1009448 - RNA, 19 nt, Homo sapiens
agaggaagaugcuacaguu

SEQ ID NO: 1009449 - RNA, 19 nt, Homo sapiens
gcauauaggcuacuguuca

SEQ ID NO: 1009450 - RNA, 19 nt, Homo sapiens
cagccaacaucuagucaaa

SEQ ID NO: 1009451 - RNA, 19 nt, Homo sapiens
cagaagauguuuguugaug

SEQ ID NO: 1009452 - RNA, 19 nt, Homo sapiens
ucaaagaagagaaacauga

SEQ ID NO: 1009453 - RNA, 19 nt, Homo sapiens
ccacugagcucaagagaaa

SEQ ID NO: 1009454 - RNA, 19 nt, Homo sapiens
ggaaucagcuugcaacaga

SEQ ID NO: 1009455 - RNA, 19 nt, Homo sapiens
gcagagcccuggcaaguuu

SEQ ID NO: 1009456 - RNA, 19 nt, Homo sapiens
ugaagaaggugaugacuuu

SEQ ID NO: 1009457 - RNA, 19 nt, Homo sapiens
gaacgucucuacuggguuu

SEQ ID NO: 1009458 - RNA, 19 nt, Homo sapiens
gaacaaaugaugaagauga

SEQ ID NO: 1009459 - RNA, 19 nt, Homo sapiens
ggaaaucuguguucucuuc

SEQ ID NO: 1009460 - RNA, 19 nt, Homo sapiens
gaacuugcuuggcuuuaaa

SEQ ID NO: 1009461 - RNA, 19 nt, Homo sapiens
gacuuaggcuuauuuguaa

SEQ ID NO: 1009462 - RNA, 19 nt, Homo sapiens
ggaggaauauaccugaauu

SEQ ID NO: 1009463 - RNA, 19 nt, Homo sapiens
ggagaagaguuacugaaga

SEQ ID NO: 1009464 - RNA, 19 nt, Homo sapiens
gaacagugaccaaaccuuu

SEQ ID NO: 1009465 - RNA, 19 nt, Homo sapiens
gcauggaaaugaacuuuau

SEQ ID NO: 1009466 - RNA, 19 nt, Homo sapiens
gcagugaauuaauuggaua

SEQ ID NO: 1009467 - RNA, 19 nt, Homo sapiens
gagagugaauugggacuua

SEQ ID NO: 1009468 - RNA, 19 nt, Homo sapiens
gaaaaucucugaacugugu

SEQ ID NO: 1009469 - RNA, 19 nt, Homo sapiens
ggaacuugcuuggcuuuaa

SEQ ID NO: 1009470 - RNA, 19 nt, Homo sapiens
caaagaugacagugaauua

SEQ ID NO: 1009471 - RNA, 19 nt, Homo sapiens
gaaacuaguucuugaugag

SEQ ID NO: 1009472 - RNA, 19 nt, Homo sapiens
agacaaugguuaugaugua

SEQ ID NO: 1009473 - RNA, 19 nt, Homo sapiens
ggacacagacacugaagaa

SEQ ID NO: 1009474 - RNA, 19 nt, Homo sapiens
gaagaaacgugagagaucu

SEQ ID NO: 1009475 - RNA, 19 nt, Homo sapiens
ggaaagaacgucucuacug

SEQ ID NO: 1009476 - RNA, 19 nt, Homo sapiens
uaaagaagcaugcuccauu

SEQ ID NO: 1009477 - RNA, 19 nt, Homo sapiens
ccuaauaccuggaaaauuu

SEQ ID NO: 1009478 - RNA, 19 nt, Homo sapiens
gcugggaaguuaucaauuc

SEQ ID NO: 1009479 - RNA, 19 nt, Homo sapiens
gaacuguaagcuuuaauga

SEQ ID NO: 1009480 - RNA, 19 nt, Homo sapiens
gggaacaaaugaugaagau

SEQ ID NO: 1009481 - RNA, 19 nt, Homo sapiens
gaaacuggauuuuggaauu

SEQ ID NO: 1009482 - RNA, 19 nt, Homo sapiens
acucagcuaucuacuguua

SEQ ID NO: 1009483 - RNA, 19 nt, Homo sapiens
agacuuaggcuuauuugua

SEQ ID NO: 1009484 - RNA, 19 nt, Homo sapiens
agucagagcuggaucaaau

SEQ ID NO: 1009485 - RNA, 19 nt, Homo sapiens
guuaaagggagaagaguua

SEQ ID NO: 1009486 - RNA, 19 nt, Homo sapiens
ucucuuaaaucuucaggua

SEQ ID NO: 1009487 - RNA, 19 nt, Homo sapiens
uggaaucuguuucuuauug

SEQ ID NO: 1009488 - RNA, 19 nt, Homo sapiens
aaagaagcaugcuccauug

SEQ ID NO: 1009489 - RNA, 19 nt, Homo sapiens
guuaccagcuuccuuauuc

SEQ ID NO: 1009490 - RNA, 19 nt, Homo sapiens
ggcaaaagcugggaaguua

SEQ ID NO: 1009491 - RNA, 19 nt, Homo sapiens
guucauucgucauauguuu

SEQ ID NO: 1009492 - RNA, 19 nt, Homo sapiens
ugacacugauagauugaua

SEQ ID NO: 1009493 - RNA, 19 nt, Homo sapiens
caagguaucuuaguugaag

SEQ ID NO: 1009494 - RNA, 19 nt, Homo sapiens
gaccgaaauuaucaaggua

SEQ ID NO: 1009495 - RNA, 19 nt, Homo sapiens
agaaaugccugaaggugaa

SEQ ID NO: 1009496 - RNA, 19 nt, Homo sapiens
gacaaugguuaugauguaa

SEQ ID NO: 1009497 - RNA, 19 nt, Homo sapiens
gaaagcaagcaguugugua

SEQ ID NO: 1009498 - RNA, 19 nt, Homo sapiens
gaaagaaggaacaguugga

SEQ ID NO: 1009499 - RNA, 19 nt, Homo sapiens
gccugaaggugaagacuuu

SEQ ID NO: 1009500 - RNA, 19 nt, Homo sapiens
gaauauaggaaaucugugu

SEQ ID NO: 1009501 - RNA, 19 nt, Homo sapiens
aaugggaccuucaaccuuu

SEQ ID NO: 1009502 - RNA, 19 nt, Homo sapiens
gagaagaguuacugaagac

SEQ ID NO: 1009503 - RNA, 19 nt, Homo sapiens
uaaaauaucuggacugagu

SEQ ID NO: 1009504 - RNA, 19 nt, Homo sapiens
guuagacccuuaucuuuua

SEQ ID NO: 1009505 - RNA, 19 nt, Homo sapiens
gauguaaacagauucaguu

SEQ ID NO: 1009506 - RNA, 19 nt, Homo sapiens
uggauagacugaaacguuu

SEQ ID NO: 1009507 - RNA, 19 nt, Homo sapiens
guaaacaccaacuuucuga

SEQ ID NO: 1009508 - RNA, 19 nt, Homo sapiens
ugugauugcuuaugucauu

SEQ ID NO: 1009509 - RNA, 19 nt, Homo sapiens
aagaguuacugaagacuuu

SEQ ID NO: 1009510 - RNA, 19 nt, Homo sapiens
uugaaggacuugggaaaua

SEQ ID NO: 1009511 - RNA, 19 nt, Homo sapiens
acaccaacuuucugaguaa

SEQ ID NO: 1009512 - RNA, 19 nt, Homo sapiens
uucauuaucuugcccauuu

SEQ ID NO: 1009513 - RNA, 19 nt, Homo sapiens
ugaagacuuugaacacuug

SEQ ID NO: 1009514 - RNA, 19 nt, Homo sapiens
ugaaacuaguucuugauga

SEQ ID NO: 1009515 - RNA, 19 nt, Homo sapiens
ucacauagacaaugguuau

SEQ ID NO: 1009516 - RNA, 19 nt, Homo sapiens
gauauucagcauuagagua

SEQ ID NO: 1009517 - RNA, 19 nt, Homo sapiens
gagaaagaaggaacaguug

SEQ ID NO: 1009518 - RNA, 19 nt, Homo sapiens
gguauuaacccauagaaag

SEQ ID NO: 1009519 - RNA, 19 nt, Homo sapiens
uaucuuaguugaaggacuu

SEQ ID NO: 1009520 - RNA, 19 nt, Homo sapiens
gccaaagaguuaucugugu

SEQ ID NO: 1009521 - RNA, 19 nt, Homo sapiens
gaagcaugcuccauugacu

SEQ ID NO: 1009522 - RNA, 19 nt, Homo sapiens
ggcaggcgcuuuggaaguu

SEQ ID NO: 1009523 - RNA, 19 nt, Homo sapiens
ccagcuuccuuauuccuaa

SEQ ID NO: 1009524 - RNA, 19 nt, Homo sapiens
ugacagugaauuagacuuu

SEQ ID NO: 1009525 - RNA, 19 nt, Homo sapiens
gaagaguuacugaagacuu

SEQ ID NO: 1009526 - RNA, 19 nt, Homo sapiens
uaaguacucuggauagacu

SEQ ID NO: 1009527 - RNA, 19 nt, Homo sapiens
ggucucacccuuccucuga

SEQ ID NO: 1009528 - RNA, 19 nt, Homo sapiens
ccucagaaaggaaggauaa

SEQ ID NO: 1009529 - RNA, 19 nt, Homo sapiens
cagcugacacugauagauu

SEQ ID NO: 1009530 - RNA, 19 nt, Homo sapiens
agaaggugaugacuuugaa

SEQ ID NO: 1009531 - RNA, 19 nt, Homo sapiens
gaaguuaucaauuccaaac

SEQ ID NO: 1009532 - RNA, 19 nt, Homo sapiens
ugaauuaagccuugguuug

SEQ ID NO: 1009533 - RNA, 19 nt, Homo sapiens
uguuugauguccuuuauug

SEQ ID NO: 1009534 - RNA, 19 nt, Homo sapiens
ccaagaauauaggaaaucu

SEQ ID NO: 1009535 - RNA, 19 nt, Homo sapiens
ggaaucuguuucuuauugg

SEQ ID NO: 1009536 - RNA, 19 nt, Homo sapiens
gaucaucagcaauaaagau

SEQ ID NO: 1009537 - RNA, 19 nt, Homo sapiens
cgucauauguuugugauag

SEQ ID NO: 1009538 - RNA, 19 nt, Homo sapiens
ggaaaugaacuuuauacac

SEQ ID NO: 1009539 - RNA, 19 nt, Homo sapiens
ccaaaccuuucaccugaug

SEQ ID NO: 1009540 - RNA, 19 nt, Homo sapiens
auacucagcuaucuacugu

SEQ ID NO: 1009541 - RNA, 19 nt, Homo sapiens
ggaggcaggcgcuuuggaa

SEQ ID NO: 1009542 - RNA, 19 nt, Homo sapiens
aaagcaagcaguuguguau

SEQ ID NO: 1009543 - RNA, 19 nt, Homo sapiens
gaauugggacuuacacaag

SEQ ID NO: 1009544 - RNA, 19 nt, Homo sapiens
gaauuaagccuugguuugc

SEQ ID NO: 1009545 - RNA, 19 nt, Homo sapiens
gaucuugggaaguuacauu

SEQ ID NO: 1009546 - RNA, 19 nt, Homo sapiens
ggaagcagaagcacagcaa

SEQ ID NO: 1009547 - RNA, 19 nt, Homo sapiens
ggugaugacuuugaacuac

SEQ ID NO: 1009548 - RNA, 19 nt, Homo sapiens
gaaggauacacuccacaga

SEQ ID NO: 1009549 - RNA, 19 nt, Homo sapiens
ccacuguauugcagaauca

SEQ ID NO: 1009550 - RNA, 19 nt, Homo sapiens
gugauugcuuaugucauua

SEQ ID NO: 1009551 - RNA, 19 nt, Homo sapiens
ugaugaagaugaauuaagc

SEQ ID NO: 1009552 - RNA, 19 nt, Homo sapiens
aacaccaacuuucugagua

SEQ ID NO: 1009553 - RNA, 19 nt, Homo sapiens
gaaacuggcuaaacaauuu

SEQ ID NO: 1009554 - RNA, 19 nt, Homo sapiens
gcacgagccucaucuguaa

SEQ ID NO: 1009555 - RNA, 19 nt, Homo sapiens
acaaauagcucacaaauag

SEQ ID NO: 1009556 - RNA, 19 nt, Homo sapiens
gaaauguaaugcugacuuu

SEQ ID NO: 1009557 - RNA, 19 nt, Homo sapiens
cgacaugccugaacucuuu

SEQ ID NO: 1009558 - RNA, 19 nt, Homo sapiens
gaagacugcugauaacuau

SEQ ID NO: 1009559 - RNA, 19 nt, Homo sapiens
gaacauggagccaaacuaa

SEQ ID NO: 1009560 - RNA, 19 nt, Homo sapiens
ccacaaauuugacuaugua

SEQ ID NO: 1009561 - RNA, 19 nt, Homo sapiens
gaugagauuucacauauug

SEQ ID NO: 1009562 - RNA, 19 nt, Homo sapiens
gaaaguauaugugagauca

SEQ ID NO: 1009563 - RNA, 19 nt, Homo sapiens
gaaaguauaugugagauca

SEQ ID NO: 1009564 - RNA, 19 nt, Homo sapiens
gaucagaauucuccauuga

SEQ ID NO: 1009565 - RNA, 19 nt, Homo sapiens
ggaagcagaugauguagau

SEQ ID NO: 1009566 - RNA, 19 nt, Homo sapiens
gagguaaucuacguuauuu

SEQ ID NO: 1009567 - RNA, 19 nt, Homo sapiens
ucaggaaaguuagcaauua

SEQ ID NO: 1009568 - RNA, 19 nt, Homo sapiens
gcaguuagguaaaggaaga

SEQ ID NO: 1009569 - RNA, 19 nt, Homo sapiens
ggaaauguauggaaauucu

SEQ ID NO: 1009570 - RNA, 19 nt, Homo sapiens
ugagaacucuuccaauaaa

SEQ ID NO: 1009571 - RNA, 19 nt, Homo sapiens
ucaaguagauacacccaua

SEQ ID NO: 1009572 - RNA, 19 nt, Homo sapiens
gaaguaauuugguacaauc

SEQ ID NO: 1009573 - RNA, 19 nt, Homo sapiens
gaauguaacuucagaucau

SEQ ID NO: 1009574 - RNA, 19 nt, Homo sapiens
caagauaucuguggcaaau

SEQ ID NO: 1009575 - RNA, 19 nt, Homo sapiens
ugacaaagcaguuagguaa

SEQ ID NO: 1009576 - RNA, 19 nt, Homo sapiens
gaagucagcuuugaacaca

SEQ ID NO: 1009577 - RNA, 19 nt, Homo sapiens
gcaauuauguacggauauu

SEQ ID NO: 1009578 - RNA, 19 nt, Homo sapiens
guagauacacccauaauga

SEQ ID NO: 1009579 - RNA, 19 nt, Homo sapiens
caaagaaacaccaagauau

SEQ ID NO: 1009580 - RNA, 19 nt, Homo sapiens
uauaaagccuggacuucua

SEQ ID NO: 1009581 - RNA, 19 nt, Homo sapiens
caaacuaacucagcaacaa

SEQ ID NO: 1009582 - RNA, 19 nt, Homo sapiens
ccaagcaugugaugauauu

SEQ ID NO: 1009583 - RNA, 19 nt, Homo sapiens
uuugagaacucuuccaaua

SEQ ID NO: 1009584 - RNA, 19 nt, Homo sapiens
cgaaauagauaaugcuaca

SEQ ID NO: 1009585 - RNA, 19 nt, Homo sapiens
ucacgaagacugcugauaa

SEQ ID NO: 1009586 - RNA, 19 nt, Homo sapiens
ggucuacucagaaauguua

SEQ ID NO: 1009587 - RNA, 19 nt, Homo sapiens
gaaaggugucaacccauua

SEQ ID NO: 1009588 - RNA, 19 nt, Homo sapiens
ugauguagaugaugauuug

SEQ ID NO: 1009589 - RNA, 19 nt, Homo sapiens
ggacauguauuugaaaguc

SEQ ID NO: 1009590 - RNA, 19 nt, Homo sapiens
gcaaauacaaguccagaug

SEQ ID NO: 1009591 - RNA, 19 nt, Homo sapiens
ucaaagaaacaccaagaua

SEQ ID NO: 1009592 - RNA, 19 nt, Homo sapiens
cagauucuuucucaguuua

SEQ ID NO: 1009593 - RNA, 19 nt, Homo sapiens
caauacaagugaauaguuc

SEQ ID NO: 1009594 - RNA, 19 nt, Homo sapiens
ggaaguaauuugguacaau

SEQ ID NO: 1009595 - RNA, 19 nt, Homo sapiens
acaaggaaguaauuuggua

SEQ ID NO: 1009596 - RNA, 19 nt, Homo sapiens
agauaucuguggcaaauaa

SEQ ID NO: 1009597 - RNA, 19 nt, Homo sapiens
aaagacauaugacagagaa

SEQ ID NO: 1009598 - RNA, 19 nt, Homo sapiens
gacaaauagcucacaaaua

SEQ ID NO: 1009599 - RNA, 19 nt, Homo sapiens
cagaugauguagaugauga

SEQ ID NO: 1009600 - RNA, 19 nt, Homo sapiens
gacagagaauuaauagaug

SEQ ID NO: 1009601 - RNA, 19 nt, Homo sapiens
caaugaagauggagaaagg

SEQ ID NO: 1009602 - RNA, 19 nt, Homo sapiens
gaaaggacaguaagacauc

SEQ ID NO: 1009603 - RNA, 19 nt, Homo sapiens
gaaaggacaguaagacauc

SEQ ID NO: 1009604 - RNA, 19 nt, Homo sapiens
gaacacaagguauucuaau

SEQ ID NO: 1009605 - RNA, 19 nt, Homo sapiens
gacauaugacagagaauua

SEQ ID NO: 1009606 - RNA, 19 nt, Homo sapiens
caggaaaguuagcaauuau

SEQ ID NO: 1009607 - RNA, 19 nt, Homo sapiens
gcaaugagucggcgaagga

SEQ ID NO: 1009608 - RNA, 19 nt, Homo sapiens
gugcagacaucuuugacaa

SEQ ID NO: 1009609 - RNA, 19 nt, Homo sapiens
guuaggagauucaaaagua

SEQ ID NO: 1009610 - RNA, 19 nt, Homo sapiens
cagaucauaugaauacaga

SEQ ID NO: 1009611 - RNA, 19 nt, Homo sapiens
ccagauggacagaaugaua

SEQ ID NO: 1009612 - RNA, 19 nt, Homo sapiens
uagcaauuauguacggaua

SEQ ID NO: 1009613 - RNA, 19 nt, Homo sapiens
gaaaguguucuccugaaga

SEQ ID NO: 1009614 - RNA, 19 nt, Homo sapiens
acaaauagauaagccaaug

SEQ ID NO: 1009615 - RNA, 19 nt, Homo sapiens
aguaagacaucagaaagua

SEQ ID NO: 1009616 - RNA, 19 nt, Homo sapiens
aguaagacaucagaaagua

SEQ ID NO: 1009617 - RNA, 19 nt, Homo sapiens
ccugaacucuuuccuucua

SEQ ID NO: 1009618 - RNA, 19 nt, Homo sapiens
gaaacucuggucauugaaa

SEQ ID NO: 1009619 - RNA, 19 nt, Homo sapiens
agaaaggugucaacccauu

SEQ ID NO: 1009620 - RNA, 19 nt, Homo sapiens
gaaauugaguacuaaucag

SEQ ID NO: 1009621 - RNA, 19 nt, Homo sapiens
caucagaaaguauauguga

SEQ ID NO: 1009622 - RNA, 19 nt, Homo sapiens
caucagaaaguauauguga

SEQ ID NO: 1009623 - RNA, 19 nt, Homo sapiens
guacauugaugcauuuacu

SEQ ID NO: 1009624 - RNA, 19 nt, Homo sapiens
cacaagguauucuaaugaa

SEQ ID NO: 1009625 - RNA, 19 nt, Homo sapiens
caaauucuaugcuggacau

SEQ ID NO: 1009626 - RNA, 19 nt, Homo sapiens
ggaucagaauucuccauug

SEQ ID NO: 1009627 - RNA, 19 nt, Homo sapiens
ggaaaguuagcaauuaugu

SEQ ID NO: 1009628 - RNA, 19 nt, Homo sapiens
gaagaagaacuuaugaaac

SEQ ID NO: 1009629 - RNA, 19 nt, Homo sapiens
aaucagccaugccauaaga

SEQ ID NO: 1009630 - RNA, 19 nt, Homo sapiens
cugcaugugucuuauacua

SEQ ID NO: 1009631 - RNA, 19 nt, Homo sapiens
caacaagacauuagaaagg

SEQ ID NO: 1009632 - RNA, 19 nt, Homo sapiens
caacaagacauuagaaagg

SEQ ID NO: 1009633 - RNA, 19 nt, Homo sapiens
gcagucagaagccauuuga

SEQ ID NO: 1009634 - RNA, 19 nt, Homo sapiens
aaagagguaaucuacguua

SEQ ID NO: 1009635 - RNA, 19 nt, Homo sapiens
cgaagacugcugauaacua

SEQ ID NO: 1009636 - RNA, 19 nt, Homo sapiens
gcucccacuucauuucuuu

SEQ ID NO: 1009637 - RNA, 19 nt, Homo sapiens
ucagauucuuucucaguuu

SEQ ID NO: 1009638 - RNA, 19 nt, Homo sapiens
acacugauguuccaauaca

SEQ ID NO: 1009639 - RNA, 19 nt, Homo sapiens
caagaagaagaacuuauga

SEQ ID NO: 1009640 - RNA, 19 nt, Homo sapiens
cacgaucacuuucuucuca

SEQ ID NO: 1009641 - RNA, 19 nt, Homo sapiens
gaaaauggacucacuguca

SEQ ID NO: 1009642 - RNA, 19 nt, Homo sapiens
uuaugaaacuggcuaaaca

SEQ ID NO: 1009643 - RNA, 19 nt, Homo sapiens
ucaagaagaagaacuuaug

SEQ ID NO: 1009644 - RNA, 19 nt, Homo sapiens
gaaacugcuauuccuugua

SEQ ID NO: 1009645 - RNA, 19 nt, Homo sapiens
gcaacaagacauuagaaag

SEQ ID NO: 1009646 - RNA, 19 nt, Homo sapiens
gcaacaagacauuagaaag

SEQ ID NO: 1009647 - RNA, 19 nt, Homo sapiens
cauaauauaguucccgaaa

SEQ ID NO: 1009648 - RNA, 19 nt, Homo sapiens
aaacugcuauuccuuguac

SEQ ID NO: 1009649 - RNA, 19 nt, Homo sapiens
cuaggaacauagguugaua

SEQ ID NO: 1009650 - RNA, 19 nt, Homo sapiens
agccuggacuucuacuuua

SEQ ID NO: 1009651 - RNA, 19 nt, Homo sapiens
gcaugugucuuauacuaac

SEQ ID NO: 1009652 - RNA, 19 nt, Homo sapiens
gcauuucagugcagacauc

SEQ ID NO: 1009653 - RNA, 19 nt, Homo sapiens
caaagaagauggcuccaaa

SEQ ID NO: 1009654 - RNA, 19 nt, Homo sapiens
gaauaaaguucagcuagaa

SEQ ID NO: 1009655 - RNA, 19 nt, Homo sapiens
ggugaaauaugauggaauu

SEQ ID NO: 1009656 - RNA, 19 nt, Homo sapiens
caaaggaaguggcaacugu

SEQ ID NO: 1009657 - RNA, 19 nt, Homo sapiens
uggaaucccugauaacuaa

SEQ ID NO: 1009658 - RNA, 19 nt, Homo sapiens
gaagauggcuccaaaagga

SEQ ID NO: 1009659 - RNA, 19 nt, Homo sapiens
gaaaggguuuugucucuua

SEQ ID NO: 1009660 - RNA, 19 nt, Homo sapiens
gauaagcaaucuugguaga

SEQ ID NO: 1009661 - RNA, 19 nt, Homo sapiens
agaagaggguccagaguaa

SEQ ID NO: 1009662 - RNA, 19 nt, Homo sapiens
gaaggaaacauccaacuca

SEQ ID NO: 1009663 - RNA, 19 nt, Homo sapiens
gaaggaggaauucaaagaa

SEQ ID NO: 1009664 - RNA, 19 nt, Homo sapiens
gaagagggccacugaggaa

SEQ ID NO: 1009665 - RNA, 19 nt, Homo sapiens
ggaaacauccaacucagaa

SEQ ID NO: 1009666 - RNA, 19 nt, Homo sapiens
agacauggcuauagggaaa

SEQ ID NO: 1009667 - RNA, 19 nt, Homo sapiens
ggaauugacugugucuaug

SEQ ID NO: 1009668 - RNA, 19 nt, Homo sapiens
ucaagcaccuaucaugaaa

SEQ ID NO: 1009669 - RNA, 19 nt, Homo sapiens
ggaaggaggaauucaaaga

SEQ ID NO: 1009670 - RNA, 19 nt, Homo sapiens
caauuucggcugugaauaa

SEQ ID NO: 1009671 - RNA, 19 nt, Homo sapiens
guaagcauguggaauauac

SEQ ID NO: 1009672 - RNA, 19 nt, Homo sapiens
gauccugucuuguacaugu

SEQ ID NO: 1009673 - RNA, 19 nt, Homo sapiens
gcaaagcaguggaacacau

SEQ ID NO: 1009674 - RNA, 19 nt, Homo sapiens
caaguuugaugaugauuuc

SEQ ID NO: 1009675 - RNA, 19 nt, Homo sapiens
gaaauaugauggaauugac

SEQ ID NO: 1009676 - RNA, 19 nt, Homo sapiens
ggaaguggcaacugucaaa

SEQ ID NO: 1009677 - RNA, 19 nt, Homo sapiens
gaagaggcuauguggguua

SEQ ID NO: 1009678 - RNA, 19 nt, Homo sapiens
agaauaaacugaguagaga

SEQ ID NO: 1009679 - RNA, 19 nt, Homo sapiens
ggaauucaaagaagaaaga

SEQ ID NO: 1009680 - RNA, 19 nt, Homo sapiens
aggaggaggugacugcuua

SEQ ID NO: 1009681 - RNA, 19 nt, Homo sapiens
ggacugagccuaguguuuc

SEQ ID NO: 1009682 - RNA, 19 nt, Homo sapiens
ggagugagaauacaggaaa

SEQ ID NO: 1009683 - RNA, 19 nt, Homo sapiens
cugcaaacaugacaaagaa

SEQ ID NO: 1009684 - RNA, 19 nt, Homo sapiens
cauuggagguucacuagaa

SEQ ID NO: 1009685 - RNA, 19 nt, Homo sapiens
gaacgaacagcugucaauu

SEQ ID NO: 1009686 - RNA, 19 nt, Homo sapiens
aaacaucuuugccagcauu

SEQ ID NO: 1009687 - RNA, 19 nt, Homo sapiens
uagguaagcauguggaaua

SEQ ID NO: 1009688 - RNA, 19 nt, Homo sapiens
agaguaagguggagaagga

SEQ ID NO: 1009689 - RNA, 19 nt, Homo sapiens
acgaacagcugucaauuuc

SEQ ID NO: 1009690 - RNA, 19 nt, Homo sapiens
gaugaugauuuccauaucu

SEQ ID NO: 1009691 - RNA, 19 nt, Homo sapiens
aguuguagauggccuaaua

SEQ ID NO: 1009692 - RNA, 19 nt, Homo sapiens
gacuggaacuucacagaga

SEQ ID NO: 1009693 - RNA, 19 nt, Homo sapiens
acugaaagcuuauggaauc

SEQ ID NO: 1009694 - RNA, 19 nt, Homo sapiens
gaaaagaguugugggguau

SEQ ID NO: 1009695 - RNA, 19 nt, Homo sapiens
gaggaaggaggaauucaaa

SEQ ID NO: 1009696 - RNA, 19 nt, Homo sapiens
gcuaaaggauacacaaagg

SEQ ID NO: 1009697 - RNA, 19 nt, Homo sapiens
gaguagagaggaacacaaa

SEQ ID NO: 1009698 - RNA, 19 nt, Homo sapiens
caacucagaaggaagacua

SEQ ID NO: 1009699 - RNA, 19 nt, Homo sapiens
uguaccagcuucuagauga

SEQ ID NO: 1009700 - RNA, 19 nt, Homo sapiens
cucuuuaucuggugaaaua

SEQ ID NO: 1009701 - RNA, 19 nt, Homo sapiens
gaucaggugccuauaaauc

SEQ ID NO: 1009702 - RNA, 19 nt, Homo sapiens
guagagaggaacacaaaga

SEQ ID NO: 1009703 - RNA, 19 nt, Homo sapiens
aaguucagcuagaaucaua

SEQ ID NO: 1009704 - RNA, 19 nt, Homo sapiens
gggagaggcuaaaggauac

SEQ ID NO: 1009705 - RNA, 19 nt, Homo sapiens
uagaagaggguccagagua

SEQ ID NO: 1009706 - RNA, 19 nt, Homo sapiens
ggaacgaacagcugucaau

SEQ ID NO: 1009707 - RNA, 19 nt, Homo sapiens
ccugauaacuaaacaucuu

SEQ ID NO: 1009708 - RNA, 19 nt, Homo sapiens
guacugaaagcuuauggaa

SEQ ID NO: 1009709 - RNA, 19 nt, Homo sapiens
gcucaagcaccuaucauga

SEQ ID NO: 1009710 - RNA, 19 nt, Homo sapiens
guacagcagucucaucacu

SEQ ID NO: 1009711 - RNA, 19 nt, Homo sapiens
uggaucaggugccuauaaa

SEQ ID NO: 1009712 - RNA, 19 nt, Homo sapiens
ggaggaauucaaagaagaa

SEQ ID NO: 1009713 - RNA, 19 nt, Homo sapiens
uaaaggauacacaaaggaa

SEQ ID NO: 1009714 - RNA, 19 nt, Homo sapiens
uaacagagggagagugaga

SEQ ID NO: 1009715 - RNA, 19 nt, Homo sapiens
gccaggauuuccagcauug

SEQ ID NO: 1009716 - RNA, 19 nt, Homo sapiens
ccaaacccucuguguauuu

SEQ ID NO: 1009717 - RNA, 19 nt, Homo sapiens
gaauauaccaaagaagaug

SEQ ID NO: 1009718 - RNA, 19 nt, Homo sapiens
gaugccaaccuugcaaaua

SEQ ID NO: 1009719 - RNA, 19 nt, Homo sapiens
gcagagaggcagaccuuca

SEQ ID NO: 1009720 - RNA, 19 nt, Homo sapiens
aauguugccuuucagugua

SEQ ID NO: 1009721 - RNA, 19 nt, Homo sapiens
ggaauauaccaaagaagau

SEQ ID NO: 1009722 - RNA, 19 nt, Homo sapiens
ggcaucaucucacauuagu

SEQ ID NO: 1009723 - RNA, 19 nt, Homo sapiens
cagacuacauccagacaug

SEQ ID NO: 1009724 - RNA, 19 nt, Homo sapiens
gguagaggauggguuagug

SEQ ID NO: 1009725 - RNA, 19 nt, Homo sapiens
gaaaaguucggguguguuu

SEQ ID NO: 1009726 - RNA, 19 nt, Homo sapiens
uaaacugaguagagaggaa

SEQ ID NO: 1009727 - RNA, 19 nt, Homo sapiens
ggaaggaacaagagauugg

SEQ ID NO: 1009728 - RNA, 19 nt, Homo sapiens
gcuuauggaaucccugaua

SEQ ID NO: 1009729 - RNA, 19 nt, Homo sapiens
gguagugggugcuggucaa

SEQ ID NO: 1009730 - RNA, 19 nt, Homo sapiens
caaagaagaaagacugaca

SEQ ID NO: 1009731 - RNA, 19 nt, Homo sapiens
gagggagagugagaucuug

SEQ ID NO: 1009732 - RNA, 19 nt, Homo sapiens
guaagcccuuugucuuguu

SEQ ID NO: 1009733 - RNA, 19 nt, Homo sapiens
caaacccucuguguauuuc

SEQ ID NO: 1009734 - RNA, 19 nt, Homo sapiens
ugggagaggcuaaaggaua

SEQ ID NO: 1009735 - RNA, 19 nt, Homo sapiens
gaacacaaagaagcuuaga

SEQ ID NO: 1009736 - RNA, 19 nt, Homo sapiens
gcuucuagaugauuauaag

SEQ ID NO: 1009737 - RNA, 19 nt, Homo sapiens
gaugaccuaugagaaggaa

SEQ ID NO: 1009738 - RNA, 19 nt, Homo sapiens
gggcaugcagccaggauuu

SEQ ID NO: 1009739 - RNA, 19 nt, Homo sapiens
gcauguggaauauaccaaa

SEQ ID NO: 1009740 - RNA, 19 nt, Homo sapiens
caaccuugcaaauaccaua

SEQ ID NO: 1009741 - RNA, 19 nt, Homo sapiens
gggaggggaugaccuauga

SEQ ID NO: 1009742 - RNA, 19 nt, Homo sapiens
uggaauauaccaaagaaga

SEQ ID NO: 1009743 - RNA, 19 nt, Homo sapiens
gaucggaaggcccaggaaa

SEQ ID NO: 1009744 - RNA, 19 nt, Homo sapiens
caaaggaagaggcuaugug

SEQ ID NO: 1009745 - RNA, 19 nt, Homo sapiens
uguggaauauaccaaagaa

SEQ ID NO: 1009746 - RNA, 19 nt, Homo sapiens
guggcaucaucucacauua

SEQ ID NO: 1009747 - RNA, 19 nt, Homo sapiens
ccuauaaaucccucucuuu

SEQ ID NO: 1009748 - RNA, 19 nt, Homo sapiens
caucgugggcugcagaauu

SEQ ID NO: 1009749 - RNA, 19 nt, Homo sapiens
gcagucucaucacuccuau

SEQ ID NO: 1009750 - RNA, 19 nt, Homo sapiens
uuaaucaggagccaaguuu

SEQ ID NO: 1009751 - RNA, 19 nt, Homo sapiens
acaaagaagcuuagaagag

SEQ ID NO: 1009752 - RNA, 19 nt, Homo sapiens
acacaaagaagcuuagaag

SEQ ID NO: 1009753 - RNA, 19 nt, Homo sapiens
gaaagaggcuggaaauuug

SEQ ID NO: 1009754 - RNA, 19 nt, Homo sapiens
gaaagcagcagacauaauu

SEQ ID NO: 1009755 - RNA, 19 nt, Homo sapiens
gagaagaacucccuuugga

SEQ ID NO: 1009756 - RNA, 19 nt, Homo sapiens
ugaaaccgcucucguaauu

SEQ ID NO: 1009757 - RNA, 19 nt, Homo sapiens
gaacuaagucuuuaucaug

SEQ ID NO: 1009758 - RNA, 19 nt, Homo sapiens
gcacagagcugacuuuuca

SEQ ID NO: 1009759 - RNA, 19 nt, Homo sapiens
gaaacugaacccacaauaa

SEQ ID NO: 1009760 - RNA, 19 nt, Homo sapiens
uaaacgagcugaauuugau

SEQ ID NO: 1009761 - RNA, 19 nt, Homo sapiens
ccugguaucuuaauuauga

SEQ ID NO: 1009762 - RNA, 19 nt, Homo sapiens
gguauacucugcacuuuau

SEQ ID NO: 1009763 - RNA, 19 nt, Homo sapiens
guaauacccuugccuggaa

SEQ ID NO: 1009764 - RNA, 19 nt, Homo sapiens
cagaagauauggaucagaa

SEQ ID NO: 1009765 - RNA, 19 nt, Homo sapiens
ugaaauguguugccuggua

SEQ ID NO: 1009766 - RNA, 19 nt, Homo sapiens
uuacaggccuuacuaaaga

SEQ ID NO: 1009767 - RNA, 19 nt, Homo sapiens
caacaaaggaucauugguu

SEQ ID NO: 1009768 - RNA, 19 nt, Homo sapiens
guaaauguaugcaguugga

SEQ ID NO: 1009769 - RNA, 19 nt, Homo sapiens
gcauaaacgagcugaauuu

SEQ ID NO: 1009770 - RNA, 19 nt, Homo sapiens
ugaaagaggcuggaaauuu

SEQ ID NO: 1009771 - RNA, 19 nt, Homo sapiens
gaaauguguugccugguau

SEQ ID NO: 1009772 - RNA, 19 nt, Homo sapiens
gcaugcacguguaaaugua

SEQ ID NO: 1009773 - RNA, 19 nt, Homo sapiens
ugauagaacuggagauguu

SEQ ID NO: 1009774 - RNA, 19 nt, Homo sapiens
ggagaguuauguugauaga

SEQ ID NO: 1009775 - RNA, 19 nt, Homo sapiens
guauuugugugucauguuu

SEQ ID NO: 1009776 - RNA, 19 nt, Homo sapiens
aguacuggauugagaauua

SEQ ID NO: 1009777 - RNA, 19 nt, Homo sapiens
acacugcgauuacagcuaa

SEQ ID NO: 1009778 - RNA, 19 nt, Homo sapiens
gagagaaucuuagcuuuac

SEQ ID NO: 1009779 - RNA, 19 nt, Homo sapiens
aaacauaccucagaacaag

SEQ ID NO: 1009780 - RNA, 19 nt, Homo sapiens
uaagagaacccuucaagug

SEQ ID NO: 1009781 - RNA, 19 nt, Homo sapiens
ggaccugaguggacccuuu

SEQ ID NO: 1009782 - RNA, 19 nt, Homo sapiens
ccaacgaaaucuaaaguca

SEQ ID NO: 1009783 - RNA, 19 nt, Homo sapiens
guuacaggguucaccuuua

SEQ ID NO: 1009784 - RNA, 19 nt, Homo sapiens
guggaaagcagcagacaua

SEQ ID NO: 1009785 - RNA, 19 nt, Homo sapiens
aaaccgcucucguaauuug

SEQ ID NO: 1009786 - RNA, 19 nt, Homo sapiens
uguguugccugguaucuua

SEQ ID NO: 1009787 - RNA, 19 nt, Homo sapiens
ggaaccaaaucagaugaaa

SEQ ID NO: 1009788 - RNA, 19 nt, Homo sapiens
gaaugaugcuugucugucu

SEQ ID NO: 1009789 - RNA, 19 nt, Homo sapiens
ucagauacacccuauauga

SEQ ID NO: 1009790 - RNA, 19 nt, Homo sapiens
aaucuaaagucacaaguug

SEQ ID NO: 1009791 - RNA, 19 nt, Homo sapiens
gcaaguuacuguauguuac

SEQ ID NO: 1009792 - RNA, 19 nt, Homo sapiens
gcaauacacagaagauaug

SEQ ID NO: 1009793 - RNA, 19 nt, Homo sapiens
ggagcccaauuacaucuuu

SEQ ID NO: 1009794 - RNA, 19 nt, Homo sapiens
aaacaaaguugcaguacgu

SEQ ID NO: 1009795 - RNA, 19 nt, Homo sapiens
gaaagaagugugcaaccuu

SEQ ID NO: 1009796 - RNA, 19 nt, Homo sapiens
gaucacaucaguaaacaug

SEQ ID NO: 1009797 - RNA, 19 nt, Homo sapiens
gaagauauggaucagaaau

SEQ ID NO: 1009798 - RNA, 19 nt, Homo sapiens
aaacugaacccacaauaau

SEQ ID NO: 1009799 - RNA, 19 nt, Homo sapiens
gauacacccuauaugaaau

SEQ ID NO: 1009800 - RNA, 19 nt, Homo sapiens
ucagaaacauaccucagaa

SEQ ID NO: 1009801 - RNA, 19 nt, Homo sapiens
ggacauaugcuuaguuggu

SEQ ID NO: 1009802 - RNA, 19 nt, Homo sapiens
caauccaaauccugaauga

SEQ ID NO: 1009803 - RNA, 19 nt, Homo sapiens
gaaaggaacggauguagac

SEQ ID NO: 1009804 - RNA, 19 nt, Homo sapiens
aacaaaggaucauugguuu

SEQ ID NO: 1009805 - RNA, 19 nt, Homo sapiens
acucagaacuaagucuuua

SEQ ID NO: 1009806 - RNA, 19 nt, Homo sapiens
gaaacauaccucagaacaa

SEQ ID NO: 1009807 - RNA, 19 nt, Homo sapiens
gagcccaauuacaucuuua

SEQ ID NO: 1009808 - RNA, 19 nt, Homo sapiens
acaagccauucaugacuua

SEQ ID NO: 1009809 - RNA, 19 nt, Homo sapiens
gaacaagccauucaugacu

SEQ ID NO: 1009810 - RNA, 19 nt, Homo sapiens
cagagacuguccagccaua

SEQ ID NO: 1009811 - RNA, 19 nt, Homo sapiens
gcaagucaaucuccuacag

SEQ ID NO: 1009812 - RNA, 19 nt, Homo sapiens
caaaggaucauugguuuau

SEQ ID NO: 1009813 - RNA, 19 nt, Homo sapiens
cagcauggcuuuccuuugc

SEQ ID NO: 1009814 - RNA, 19 nt, Homo sapiens
guucaguacuggauugaga

SEQ ID NO: 1009815 - RNA, 19 nt, Homo sapiens
caagugaaacaggaucuua

SEQ ID NO: 1009816 - RNA, 19 nt, Homo sapiens
cuggcuagcugcugguuua

SEQ ID NO: 1009817 - RNA, 19 nt, Homo sapiens
gcagcuacauuacugucaa

SEQ ID NO: 1009818 - RNA, 19 nt, Homo sapiens
guugauagauuuguugugu

SEQ ID NO: 1009819 - RNA, 19 nt, Homo sapiens
guaaauuccuuagugauac

SEQ ID NO: 1009820 - RNA, 19 nt, Homo sapiens
ggaguggguuggauaagca

SEQ ID NO: 1009821 - RNA, 19 nt, Homo sapiens
caaaaccacuuuaugaguu

SEQ ID NO: 1009822 - RNA, 19 nt, Homo sapiens
guguggagcuuucuaguag

SEQ ID NO: 1009823 - RNA, 19 nt, Homo sapiens
gacauaugcuuaguugguu

SEQ ID NO: 1009824 - RNA, 19 nt, Homo sapiens
gcgcuuugucucauuaaua

SEQ ID NO: 1009825 - RNA, 19 nt, Homo sapiens
gcuuguaaauuccuuagug

SEQ ID NO: 1009826 - RNA, 19 nt, Homo sapiens
gaguggcauuugcuuguaa

SEQ ID NO: 1009827 - RNA, 19 nt, Homo sapiens
agagagaaucuuagcuuua

SEQ ID NO: 1009828 - RNA, 19 nt, Homo sapiens
caauaugggaucuuagaaa

SEQ ID NO: 1009829 - RNA, 19 nt, Homo sapiens
ugggauaucugcagcaaau

SEQ ID NO: 1009830 - RNA, 19 nt, Homo sapiens
gaaaucuccaggcaacaaa

SEQ ID NO: 1009831 - RNA, 19 nt, Homo sapiens
guugcaauaugggaucuua

SEQ ID NO: 1009832 - RNA, 19 nt, Homo sapiens
gaucuuuacguuuaucuga

SEQ ID NO: 1009833 - RNA, 19 nt, Homo sapiens
gcucaccaacgaaaucuaa

SEQ ID NO: 1009834 - RNA, 19 nt, Homo sapiens
gaagugugcaaccuuguga

SEQ ID NO: 1009835 - RNA, 19 nt, Homo sapiens
caucguaaccuagcuauau

SEQ ID NO: 1009836 - RNA, 19 nt, Homo sapiens
gucaagaucauaacucaaa

SEQ ID NO: 1009837 - RNA, 19 nt, Homo sapiens
cauguggaaucuacuguga

SEQ ID NO: 1009838 - RNA, 19 nt, Homo sapiens
caauuucuguggcaaguca

SEQ ID NO: 1009839 - RNA, 19 nt, Homo sapiens
guacuggauugagaauuau

SEQ ID NO: 1009840 - RNA, 19 nt, Homo sapiens
ggguucaccuuuagauguu

SEQ ID NO: 1009841 - RNA, 19 nt, Homo sapiens
guugaccaaugaaaugaaa

SEQ ID NO: 1009842 - RNA, 19 nt, Homo sapiens
caauggcuuuaucggguua

SEQ ID NO: 1009843 - RNA, 19 nt, Homo sapiens
ggaaagcagcagacauaau

SEQ ID NO: 1009844 - RNA, 19 nt, Homo sapiens
ccaaaacccuuaacaaaag

SEQ ID NO: 1009845 - RNA, 19 nt, Homo sapiens
gcuagcugcugguuuagau

SEQ ID NO: 1009846 - RNA, 19 nt, Homo sapiens
cagaacaagccauucauga

SEQ ID NO: 1009847 - RNA, 19 nt, Homo sapiens
cuucauagcucagaaacau

SEQ ID NO: 1009848 - RNA, 19 nt, Homo sapiens
ugguuuacauggugucaua

SEQ ID NO: 1009849 - RNA, 19 nt, Homo sapiens
ggaggaaccaaaucagaug

SEQ ID NO: 1009850 - RNA, 19 nt, Homo sapiens
guucagcugugccucauca

SEQ ID NO: 1009851 - RNA, 19 nt, Homo sapiens
gauauucacaggaguaagu

SEQ ID NO: 1009852 - RNA, 19 nt, Homo sapiens
ugauagauuuguugugugu

SEQ ID NO: 1009853 - RNA, 19 nt, Homo sapiens
gcauuaaucuugcaguuua

SEQ ID NO: 1009854 - RNA, 19 nt, Homo sapiens
gaacauggcucaagaaacu

SEQ ID NO: 1009855 - RNA, 19 nt, Homo sapiens
uaacaaacgugcagaaauu

SEQ ID NO: 1009856 - RNA, 19 nt, Homo sapiens
gaagaaugaucugaaguaa

SEQ ID NO: 1009857 - RNA, 19 nt, Homo sapiens
gcuaaugucugucucaaga

SEQ ID NO: 1009858 - RNA, 19 nt, Homo sapiens
ggacaaagcaguaccugaa

SEQ ID NO: 1009859 - RNA, 19 nt, Homo sapiens
gcacaacuaguuaucagua

SEQ ID NO: 1009860 - RNA, 19 nt, Homo sapiens
cugaugagauuguaaguuu

SEQ ID NO: 1009861 - RNA, 19 nt, Homo sapiens
acagguuucuuucagauua

SEQ ID NO: 1009862 - RNA, 19 nt, Homo sapiens
gaacauuuauuuccauugc

SEQ ID NO: 1009863 - RNA, 19 nt, Homo sapiens
uaaugucugucucaagaua

SEQ ID NO: 1009864 - RNA, 19 nt, Homo sapiens
ggcauuaccuguacccauu

SEQ ID NO: 1009865 - RNA, 19 nt, Homo sapiens
aagaaucgcuguuucaugu

SEQ ID NO: 1009866 - RNA, 19 nt, Homo sapiens
gcagagggcuuuuauaaca

SEQ ID NO: 1009867 - RNA, 19 nt, Homo sapiens
uguagcaucuucucaauug

SEQ ID NO: 1009868 - RNA, 19 nt, Homo sapiens
ugaagaaugaucugaagua

SEQ ID NO: 1009869 - RNA, 19 nt, Homo sapiens
guacacaauugcucuuaca

SEQ ID NO: 1009870 - RNA, 19 nt, Homo sapiens
cagaauaguaguaauggua

SEQ ID NO: 1009871 - RNA, 19 nt, Homo sapiens
aaacacagaaggcuuuaaa

SEQ ID NO: 1009872 - RNA, 19 nt, Homo sapiens
gcagccaucugaagagcaa

SEQ ID NO: 1009873 - RNA, 19 nt, Homo sapiens
gcccagcccuguaucaaau

SEQ ID NO: 1009874 - RNA, 19 nt, Homo sapiens
ggacagcuguuugcucauc

SEQ ID NO: 1009875 - RNA, 19 nt, Homo sapiens
guacaaauggcauguguuc

SEQ ID NO: 1009876 - RNA, 19 nt, Homo sapiens
gaaguaauugugcuguauu

SEQ ID NO: 1009877 - RNA, 19 nt, Homo sapiens
guucauggguuugugugua

SEQ ID NO: 1009878 - RNA, 19 nt, Homo sapiens
cauuauggcugcuucuguu

SEQ ID NO: 1009879 - RNA, 19 nt, Homo sapiens
acucagauguacacaauug

SEQ ID NO: 1009880 - RNA, 19 nt, Homo sapiens
uuacucagauguacacaau

SEQ ID NO: 1009881 - RNA, 19 nt, Homo sapiens
caaagacagaauaguagua

SEQ ID NO: 1009882 - RNA, 19 nt, Homo sapiens
ucaccagucuuugauuaaa

SEQ ID NO: 1009883 - RNA, 19 nt, Homo sapiens
caguguaucuugcauguca

SEQ ID NO: 1009884 - RNA, 19 nt, Homo sapiens
uugagcaucugcaaacuaa

SEQ ID NO: 1009885 - RNA, 19 nt, Homo sapiens
guacaucuguggacaaagc

SEQ ID NO: 1009886 - RNA, 19 nt, Homo sapiens
cuucaaagacagaauagua

SEQ ID NO: 1009887 - RNA, 19 nt, Homo sapiens
gaauaguaguaaugguaga

SEQ ID NO: 1009888 - RNA, 19 nt, Homo sapiens
gaaugccgguguggaaaug

SEQ ID NO: 1009889 - RNA, 19 nt, Homo sapiens
uggaaacccucguacaaau

SEQ ID NO: 1009890 - RNA, 19 nt, Homo sapiens
ugaaguaauugugcuguau

SEQ ID NO: 1009891 - RNA, 19 nt, Homo sapiens
guacaccguuacucagaug

SEQ ID NO: 1009892 - RNA, 19 nt, Homo sapiens
cagcacagcagccaucuga

SEQ ID NO: 1009893 - RNA, 19 nt, Homo sapiens
ccaguucaaugcacagaug

SEQ ID NO: 1009894 - RNA, 19 nt, Homo sapiens
uagucugucugaaucuuua

SEQ ID NO: 1009895 - RNA, 19 nt, Homo sapiens
agaauaagcccaccugcaa

SEQ ID NO: 1009896 - RNA, 19 nt, Homo sapiens
gaaggcagaaagcuaaugu

SEQ ID NO: 1009897 - RNA, 19 nt, Homo sapiens
ggaaacccucguacaaaug

SEQ ID NO: 1009898 - RNA, 19 nt, Homo sapiens
cugaggagacuuaaacuuu

SEQ ID NO: 1009899 - RNA, 19 nt, Homo sapiens
auucaccagucuuugauua

SEQ ID NO: 1009900 - RNA, 19 nt, Homo sapiens
cacaacuaguuaucaguaa

SEQ ID NO: 1009901 - RNA, 19 nt, Homo sapiens
gcaugucaucggaagaaua

SEQ ID NO: 1009902 - RNA, 19 nt, Homo sapiens
acagaaggcuuuaaaaugu

SEQ ID NO: 1009903 - RNA, 19 nt, Homo sapiens
gugaaaagauccaaaagau

SEQ ID NO: 1009904 - RNA, 19 nt, Homo sapiens
ggacuuacuggguuugaau

SEQ ID NO: 1009905 - RNA, 19 nt, Homo sapiens
gcacagcagccaucugaag

SEQ ID NO: 1009906 - RNA, 19 nt, Homo sapiens
caguacaucuguggacaaa

SEQ ID NO: 1009907 - RNA, 19 nt, Homo sapiens
caaauggcauguguucagu

SEQ ID NO: 1009908 - RNA, 19 nt, Homo sapiens
gacaaagcaguaccugaaa

SEQ ID NO: 1009909 - RNA, 19 nt, Homo sapiens
gacucuacaucuucaucua

SEQ ID NO: 1009910 - RNA, 19 nt, Homo sapiens
ucaucaaccucaacugugu

SEQ ID NO: 1009911 - RNA, 19 nt, Homo sapiens
gauuguaaguuuguguguu

SEQ ID NO: 1009912 - RNA, 19 nt, Homo sapiens
gagagugugugcugaugag

SEQ ID NO: 1009913 - RNA, 19 nt, Homo sapiens
gcagcacgauuucucuuuu

SEQ ID NO: 1009914 - RNA, 19 nt, Homo sapiens
gucugaaucuuuaccaguu

SEQ ID NO: 1009915 - RNA, 19 nt, Homo sapiens
gaauagggaaggcagaaag

SEQ ID NO: 1009916 - RNA, 19 nt, Homo sapiens
cuacagguuucuuucagau

SEQ ID NO: 1009917 - RNA, 19 nt, Homo sapiens
gaugagauuguaaguuugu

SEQ ID NO: 1009918 - RNA, 19 nt, Homo sapiens
agcaguaccugaaacagaa

SEQ ID NO: 1009919 - RNA, 19 nt, Homo sapiens
gaaacccucguacaaaugg

SEQ ID NO: 1009920 - RNA, 19 nt, Homo sapiens
gcucaucaaccucaacugu

SEQ ID NO: 1009921 - RNA, 19 nt, Homo sapiens
agacagaauaguaguaaug

SEQ ID NO: 1009922 - RNA, 19 nt, Homo sapiens
ccaagugccuaugcuuugu

SEQ ID NO: 1009923 - RNA, 19 nt, Homo sapiens
uaugaagaaugaucugaag

SEQ ID NO: 1009924 - RNA, 19 nt, Homo sapiens
gggcacaacuaguuaucag

SEQ ID NO: 1009925 - RNA, 19 nt, Homo sapiens
gagaauagggaaggcagaa

SEQ ID NO: 1009926 - RNA, 19 nt, Homo sapiens
ugugcaggcuucaguauca

SEQ ID NO: 1009927 - RNA, 19 nt, Homo sapiens
gcauuucauugcugucuac

SEQ ID NO: 1009928 - RNA, 19 nt, Homo sapiens
ggaauguagagcaguguau

SEQ ID NO: 1009929 - RNA, 19 nt, Homo sapiens
uugaacuccugcuggaaua

SEQ ID NO: 1009930 - RNA, 19 nt, Homo sapiens
guguggaaauguuuacugu

SEQ ID NO: 1009931 - RNA, 19 nt, Homo sapiens
caaagcaguaccugaaaca

SEQ ID NO: 1009932 - RNA, 19 nt, Homo sapiens
gccaagugccuaugcuuug

SEQ ID NO: 1009933 - RNA, 19 nt, Homo sapiens
uauggaaacccucguacaa

SEQ ID NO: 1009934 - RNA, 19 nt, Homo sapiens
gugcagagggcuuuuauaa

SEQ ID NO: 1009935 - RNA, 19 nt, Homo sapiens
ccugcaaccucugucagua

SEQ ID NO: 1009936 - RNA, 19 nt, Homo sapiens
caccagucuuugauuaaau

SEQ ID NO: 1009937 - RNA, 19 nt, Homo sapiens
agugugugcugaugagauu

SEQ ID NO: 1009938 - RNA, 19 nt, Homo sapiens
ucuuugcacccacuauuua

SEQ ID NO: 1009939 - RNA, 19 nt, Homo sapiens
guaaaacacagaaggcuuu

SEQ ID NO: 1009940 - RNA, 19 nt, Homo sapiens
cagaagcccagucagcauu

SEQ ID NO: 1009941 - RNA, 19 nt, Homo sapiens
aauggcauguguucaguau

SEQ ID NO: 1009942 - RNA, 19 nt, Homo sapiens
cugaaguaauugugcugua

SEQ ID NO: 1009943 - RNA, 19 nt, Homo sapiens
caacugugugugcaacuga

SEQ ID NO: 1009944 - RNA, 19 nt, Homo sapiens
gaggaacauggcucaagaa

SEQ ID NO: 1009945 - RNA, 19 nt, Homo sapiens
guagcugcuuaugagaaua

SEQ ID NO: 1009946 - RNA, 19 nt, Homo sapiens
ugaugagauuguaaguuug

SEQ ID NO: 1009947 - RNA, 19 nt, Homo sapiens
cacgauuucucuuuugaua

SEQ ID NO: 1009948 - RNA, 19 nt, Homo sapiens
gaaaagaaaauccaguagu

SEQ ID NO: 1009949 - RNA, 19 nt, Homo sapiens
ucaguaugcuauaaagaac

SEQ ID NO: 1009950 - RNA, 19 nt, Homo sapiens
gcucaagaaacuaaucaca

SEQ ID NO: 1009951 - RNA, 19 nt, Homo sapiens
caagagagugugugcugau

SEQ ID NO: 1009952 - RNA, 19 nt, Homo sapiens
cgccaggaaugaaucugaa

SEQ ID NO: 1009953 - RNA, 19 nt, Homo sapiens
gagcauaucugccuaauua

SEQ ID NO: 1009954 - RNA, 19 nt, Homo sapiens
gaagagagcacacagauaa

SEQ ID NO: 1009955 - RNA, 19 nt, Homo sapiens
gaacuaggguuaaccuuga

SEQ ID NO: 1009956 - RNA, 19 nt, Homo sapiens
gcaagacucugaugauaau

SEQ ID NO: 1009957 - RNA, 19 nt, Homo sapiens
ugacaaacaucucuucauu

SEQ ID NO: 1009958 - RNA, 19 nt, Homo sapiens
uaacaaggauuucuuaugg

SEQ ID NO: 1009959 - RNA, 19 nt, Homo sapiens
ggaaaugacucuuuagcau

SEQ ID NO: 1009960 - RNA, 19 nt, Homo sapiens
acaaacaucucuucauuga

SEQ ID NO: 1009961 - RNA, 19 nt, Homo sapiens
gaucgagacuucuacuuug

SEQ ID NO: 1009962 - RNA, 19 nt, Homo sapiens
uaagcugaaugcaaaguua

SEQ ID NO: 1009963 - RNA, 19 nt, Homo sapiens
ggguuaaccuugacuauau

SEQ ID NO: 1009964 - RNA, 19 nt, Homo sapiens
gaacgcagccuuagacauc

SEQ ID NO: 1009965 - RNA, 19 nt, Homo sapiens
ggaggaauguuuaaucuac

SEQ ID NO: 1009966 - RNA, 19 nt, Homo sapiens
gaaugucccuggcuucuuc

SEQ ID NO: 1009967 - RNA, 19 nt, Homo sapiens
gcaagcugcuguggacaua

SEQ ID NO: 1009968 - RNA, 19 nt, Homo sapiens
ggaugaaucuagaagguau

SEQ ID NO: 1009969 - RNA, 19 nt, Homo sapiens
uagcaagacucugaugaua

SEQ ID NO: 1009970 - RNA, 19 nt, Homo sapiens
uagaagaguuggccuuuga

SEQ ID NO: 1009971 - RNA, 19 nt, Homo sapiens
gaagacaccaucaugaaug

SEQ ID NO: 1009972 - RNA, 19 nt, Homo sapiens
guaaauguauccugaaggu

SEQ ID NO: 1009973 - RNA, 19 nt, Homo sapiens
gagacaguauuuaggguuu

SEQ ID NO: 1009974 - RNA, 19 nt, Homo sapiens
gagcugugauagcauguuu

SEQ ID NO: 1009975 - RNA, 19 nt, Homo sapiens
gcacggccauugacuuugu

SEQ ID NO: 1009976 - RNA, 19 nt, Homo sapiens
gaauuaggauacacucugu

SEQ ID NO: 1009977 - RNA, 19 nt, Homo sapiens
aggauaagcugaaugcaaa

SEQ ID NO: 1009978 - RNA, 19 nt, Homo sapiens
gagugaggcugguagaaga

SEQ ID NO: 1009979 - RNA, 19 nt, Homo sapiens
ggagaggagaggauugaua

SEQ ID NO: 1009980 - RNA, 19 nt, Homo sapiens
acacuuggcuaccuaguug

SEQ ID NO: 1009981 - RNA, 19 nt, Homo sapiens
aaacaucucuucauugacu

SEQ ID NO: 1009982 - RNA, 19 nt, Homo sapiens
ggugacagcugaccacauc

SEQ ID NO: 1009983 - RNA, 19 nt, Homo sapiens
aacaggaaaugacucuuua

SEQ ID NO: 1009984 - RNA, 19 nt, Homo sapiens
uaacaggaaaugacucuuu

SEQ ID NO: 1009985 - RNA, 19 nt, Homo sapiens
ggaagagagcacacagaua

SEQ ID NO: 1009986 - RNA, 19 nt, Homo sapiens
gcaugucccugcaggagaa

SEQ ID NO: 1009987 - RNA, 19 nt, Homo sapiens
gcaagaaggaugacaaugg

SEQ ID NO: 1009988 - RNA, 19 nt, Homo sapiens
gcaaaggcaagaaggauga

SEQ ID NO: 1009989 - RNA, 19 nt, Homo sapiens
gaggauugauagaguguug

SEQ ID NO: 1009990 - RNA, 19 nt, Homo sapiens
uugcaucucugaccaaauu

SEQ ID NO: 1009991 - RNA, 19 nt, Homo sapiens
gaucggugcuaccaaggaa

SEQ ID NO: 1009992 - RNA, 19 nt, Homo sapiens
ggacuuaucagcuacuuag

SEQ ID NO: 1009993 - RNA, 19 nt, Homo sapiens
gagauugcaguauuuauug

SEQ ID NO: 1009994 - RNA, 19 nt, Homo sapiens
ugucacagauuaggaaauu

SEQ ID NO: 1009995 - RNA, 19 nt, Homo sapiens
cuacauuccuccuuguuug

SEQ ID NO: 1009996 - RNA, 19 nt, Homo sapiens
ccacugaagagcugugaua

SEQ ID NO: 1009997 - RNA, 19 nt, Homo sapiens
gcucaccccugaagaaaua

SEQ ID NO: 1009998 - RNA, 19 nt, Homo sapiens
uagcagaagugcagaguag

SEQ ID NO: 1009999 - RNA, 19 nt, Homo sapiens
aaaguuauuugcagguuga

SEQ ID NO: 1010000 - RNA, 19 nt, Homo sapiens
gaccacgguuccuggagua

SEQ ID NO: 1010001 - RNA, 19 nt, Homo sapiens
ggagaagggccuggucuuu

SEQ ID NO: 1010002 - RNA, 19 nt, Homo sapiens
cagaaccuguggucaugua

SEQ ID NO: 1010003 - RNA, 19 nt, Homo sapiens
aaauugagaacuaggguua

SEQ ID NO: 1010004 - RNA, 19 nt, Homo sapiens
gagauaaaggauuugguuu

SEQ ID NO: 1010005 - RNA, 19 nt, Homo sapiens
gagaggagaggauugauag

SEQ ID NO: 1010006 - RNA, 19 nt, Homo sapiens
acauaaagcugagaaucuu

SEQ ID NO: 1010007 - RNA, 19 nt, Homo sapiens
gggaagaacccaacuggau

SEQ ID NO: 1010008 - RNA, 19 nt, Homo sapiens
caacgauaguaacaggaaa

SEQ ID NO: 1010009 - RNA, 19 nt, Homo sapiens
gacuaccucuccaucauug

SEQ ID NO: 1010010 - RNA, 19 nt, Homo sapiens
gagaggcggugcugagucu

SEQ ID NO: 1010011 - RNA, 19 nt, Homo sapiens
ugugauagcauguuucaaa

SEQ ID NO: 1010012 - RNA, 19 nt, Homo sapiens
gguuaaccuugacuauauu

SEQ ID NO: 1010013 - RNA, 19 nt, Homo sapiens
gggaggaggugggcauuuc

SEQ ID NO: 1010014 - RNA, 19 nt, Homo sapiens
gauagcauguuucaaagcu

SEQ ID NO: 1010015 - RNA, 19 nt, Homo sapiens
ccagccagcuaaccaaugu

SEQ ID NO: 1010016 - RNA, 19 nt, Homo sapiens
gaccacauccaacucauug

SEQ ID NO: 1010017 - RNA, 19 nt, Homo sapiens
gagcucaucuacccugucu

SEQ ID NO: 1010018 - RNA, 19 nt, Homo sapiens
ucauugagguucuggugaa

SEQ ID NO: 1010019 - RNA, 19 nt, Homo sapiens
guggcuggcuccaucaauu

SEQ ID NO: 1010020 - RNA, 19 nt, Homo sapiens
cagcuucgcuacacugauc

SEQ ID NO: 1010021 - RNA, 19 nt, Homo sapiens
ucacagauuaggaaauuga

SEQ ID NO: 1010022 - RNA, 19 nt, Homo sapiens
guagaagaguuggccuuug

SEQ ID NO: 1010023 - RNA, 19 nt, Homo sapiens
ccgucaaguugucuuauuu

SEQ ID NO: 1010024 - RNA, 19 nt, Homo sapiens
ggauguggccuuagagcaa

SEQ ID NO: 1010025 - RNA, 19 nt, Homo sapiens
gcugacuggucuccggaua

SEQ ID NO: 1010026 - RNA, 19 nt, Homo sapiens
gaagggccagguagacuug

SEQ ID NO: 1010027 - RNA, 19 nt, Homo sapiens
gauaaaggauuugguuucc

SEQ ID NO: 1010028 - RNA, 19 nt, Homo sapiens
uuacccaacucuuccuauu

SEQ ID NO: 1010029 - RNA, 19 nt, Homo sapiens
ucucuuucgucuccuauuu

SEQ ID NO: 1010030 - RNA, 19 nt, Homo sapiens
gacaaacaucucuucauug

SEQ ID NO: 1010031 - RNA, 19 nt, Homo sapiens
gugaagacaccaucaugaa

SEQ ID NO: 1010032 - RNA, 19 nt, Homo sapiens
gaaccuguggucauguauu

SEQ ID NO: 1010033 - RNA, 19 nt, Homo sapiens
gagcagaaccuguggucau

SEQ ID NO: 1010034 - RNA, 19 nt, Homo sapiens
gagaagggccuggucuuuc

SEQ ID NO: 1010035 - RNA, 19 nt, Homo sapiens
cugaagagcugugauagca

SEQ ID NO: 1010036 - RNA, 19 nt, Homo sapiens
gcugagauugcaguauuua

SEQ ID NO: 1010037 - RNA, 19 nt, Homo sapiens
ggugggcauuuccuacauu

SEQ ID NO: 1010038 - RNA, 19 nt, Homo sapiens
gaaaauccagucacuaguu

SEQ ID NO: 1010039 - RNA, 19 nt, Homo sapiens
ucauaaaugcugagaaugu

SEQ ID NO: 1010040 - RNA, 19 nt, Homo sapiens
ugacuggucuccggauaug

SEQ ID NO: 1010041 - RNA, 19 nt, Homo sapiens
ugagauaaaggauuugguu

SEQ ID NO: 1010042 - RNA, 19 nt, Homo sapiens
uagcaucgauaccucaaca

SEQ ID NO: 1010043 - RNA, 19 nt, Homo sapiens
gauguugccuuuuaguuga

SEQ ID NO: 1010044 - RNA, 19 nt, Homo sapiens
cauaucugccuaauuaaga

SEQ ID NO: 1010045 - RNA, 19 nt, Homo sapiens
ggaagggccagguagacuu

SEQ ID NO: 1010046 - RNA, 19 nt, Homo sapiens
cugaccaaauuucacauaa

SEQ ID NO: 1010047 - RNA, 19 nt, Homo sapiens
aaaucuguaugccugagua

SEQ ID NO: 1010048 - RNA, 19 nt, Homo sapiens
cuacacugaucgagacuuc

SEQ ID NO: 1010049 - RNA, 19 nt, Homo sapiens
cauaaaugcugagaauguc

SEQ ID NO: 1010050 - RNA, 19 nt, Homo sapiens
ugaucgagacuucuacuuu

SEQ ID NO: 1010051 - RNA, 19 nt, Homo sapiens
guucaugccuucuguuuug

SEQ ID NO: 1010052 - RNA, 19 nt, Homo sapiens
gcaguaugagcgugacaaa

SEQ ID NO: 1010053 - RNA, 19 nt, Homo sapiens
gaauagagcuguugauuua

SEQ ID NO: 1010054 - RNA, 19 nt, Homo sapiens
gaacgugcgcuucugauua

SEQ ID NO: 1010055 - RNA, 19 nt, Homo sapiens
gaugguauguuccgugaua

SEQ ID NO: 1010056 - RNA, 19 nt, Homo sapiens
gaagaaagacaugguauuu

SEQ ID NO: 1010057 - RNA, 19 nt, Homo sapiens
caaaguuggccaagaauua

SEQ ID NO: 1010058 - RNA, 19 nt, Homo sapiens
gaaguuagugcuuacauuu

SEQ ID NO: 1010059 - RNA, 19 nt, Homo sapiens
gauguaaacccacugauaa

SEQ ID NO: 1010060 - RNA, 19 nt, Homo sapiens
agaauuagcugguucacaa

SEQ ID NO: 1010061 - RNA, 19 nt, Homo sapiens
caacaagauucccgugaaa

SEQ ID NO: 1010062 - RNA, 19 nt, Homo sapiens
guagauuucuucuccauug

SEQ ID NO: 1010063 - RNA, 19 nt, Homo sapiens
ggaaguuagugcuuacauu

SEQ ID NO: 1010064 - RNA, 19 nt, Homo sapiens
ggaauagagcuguugauuu

SEQ ID NO: 1010065 - RNA, 19 nt, Homo sapiens
gaaagagaaugcccacaag

SEQ ID NO: 1010066 - RNA, 19 nt, Homo sapiens
gaagaagaaagacauggua

SEQ ID NO: 1010067 - RNA, 19 nt, Homo sapiens
agaaagacaugguauuugu

SEQ ID NO: 1010068 - RNA, 19 nt, Homo sapiens
ggauguaaacccacugaua

SEQ ID NO: 1010069 - RNA, 19 nt, Homo sapiens
ggaaaaugcucuugcugua

SEQ ID NO: 1010070 - RNA, 19 nt, Homo sapiens
gaaguggcuuacuguagaa

SEQ ID NO: 1010071 - RNA, 19 nt, Homo sapiens
agaaguggcuuacuguaga

SEQ ID NO: 1010072 - RNA, 19 nt, Homo sapiens
ccaacaagauucccgugaa

SEQ ID NO: 1010073 - RNA, 19 nt, Homo sapiens
ggaaugcugucccaacaag

SEQ ID NO: 1010074 - RNA, 19 nt, Homo sapiens
gguauguuccgugauauua

SEQ ID NO: 1010075 - RNA, 19 nt, Homo sapiens
gagcuucucuucucaacag

SEQ ID NO: 1010076 - RNA, 19 nt, Homo sapiens
gaugugauguaauuggaau

SEQ ID NO: 1010077 - RNA, 19 nt, Homo sapiens
uugcaaggccuuuaauuaa

SEQ ID NO: 1010078 - RNA, 19 nt, Homo sapiens
gaaagacaugguauuuguu

SEQ ID NO: 1010079 - RNA, 19 nt, Homo sapiens
ccagggagcuucucuucuc

SEQ ID NO: 1010080 - RNA, 19 nt, Homo sapiens
aggcaaaguuggccaagaa

SEQ ID NO: 1010081 - RNA, 19 nt, Homo sapiens
ggaacguucuagaugguau

SEQ ID NO: 1010082 - RNA, 19 nt, Homo sapiens
gcaaaguuggccaagaauu

SEQ ID NO: 1010083 - RNA, 19 nt, Homo sapiens
ggacuggaacguucuagau

SEQ ID NO: 1010084 - RNA, 19 nt, Homo sapiens
gcagggcguuggcuaugug

SEQ ID NO: 1010085 - RNA, 19 nt, Homo sapiens
ggaggaaguuagugcuuac

SEQ ID NO: 1010086 - RNA, 19 nt, Homo sapiens
cuaacgcgcuuugcuguga

SEQ ID NO: 1010087 - RNA, 19 nt, Homo sapiens
uggcagcggucacuaagga

SEQ ID NO: 1010088 - RNA, 19 nt, Homo sapiens
uguggaagaugcagaagga

SEQ ID NO: 1010089 - RNA, 19 nt, Homo sapiens
gauaacggacagaaagaga

SEQ ID NO: 1010090 - RNA, 19 nt, Homo sapiens
aggaggaaguuagugcuua

SEQ ID NO: 1010091 - RNA, 19 nt, Homo sapiens
gcagaaggaggaaguuagu

SEQ ID NO: 1010092 - RNA, 19 nt, Homo sapiens
cugcaugucugguguuugu

SEQ ID NO: 1010093 - RNA, 19 nt, Homo sapiens
cagccagccuugugacaga

SEQ ID NO: 1010094 - RNA, 19 nt, Homo sapiens
uuugcaaggccuuuaauua

SEQ ID NO: 1010095 - RNA, 19 nt, Homo sapiens
aacgugcgcuucugauuau

SEQ ID NO: 1010096 - RNA, 19 nt, Homo sapiens
guagaaguggcuuacugua

SEQ ID NO: 1010097 - RNA, 19 nt, Homo sapiens
uuugaaggcuuacuguaga

SEQ ID NO: 1010098 - RNA, 19 nt, Homo sapiens
gcacacacaaucccucaca

SEQ ID NO: 1010099 - RNA, 19 nt, Homo sapiens
ugaaagccauccaggacau

SEQ ID NO: 1010100 - RNA, 19 nt, Homo sapiens
agaaagagaaugcccacaa

SEQ ID NO: 1010101 - RNA, 19 nt, Homo sapiens
gugaugugauguaauugga

SEQ ID NO: 1010102 - RNA, 19 nt, Homo sapiens
ucagaaauuugagaagcuu

SEQ ID NO: 1010103 - RNA, 19 nt, Homo sapiens
ggcgcucacuuaccucuga

SEQ ID NO: 1010104 - RNA, 19 nt, Homo sapiens
gggaggcgcucacuuaccu

SEQ ID NO: 1010105 - RNA, 19 nt, Homo sapiens
gaacccacaccuggaguga

SEQ ID NO: 1010106 - RNA, 19 nt, Homo sapiens
uuucacaagcgcuuuauuu

SEQ ID NO: 1010107 - RNA, 19 nt, Homo sapiens
gaacaucacggugguacag

SEQ ID NO: 1010108 - RNA, 19 nt, Homo sapiens
guauguuccgugauauuaa

SEQ ID NO: 1010109 - RNA, 19 nt, Homo sapiens
gccaagaauuacggcauga

SEQ ID NO: 1010110 - RNA, 19 nt, Homo sapiens
gcuccuggguuugaagaug

SEQ ID NO: 1010111 - RNA, 19 nt, Homo sapiens
ccuuugauccuuugaagaa

SEQ ID NO: 1010112 - RNA, 19 nt, Homo sapiens
gauuuaaggcacacacaau

SEQ ID NO: 1010113 - RNA, 19 nt, Homo sapiens
ucacggugguacaggcaaa

SEQ ID NO: 1010114 - RNA, 19 nt, Homo sapiens
guggagcgccuuccgauuc

SEQ ID NO: 1010115 - RNA, 19 nt, Homo sapiens
gcaagguggaggacaagug

SEQ ID NO: 1010116 - RNA, 19 nt, Homo sapiens
aaagacaugguauuuguuc

SEQ ID NO: 1010117 - RNA, 19 nt, Homo sapiens
agaagaaagacaugguauu

SEQ ID NO: 1010118 - RNA, 19 nt, Homo sapiens
acaagauucccgugaaaga

SEQ ID NO: 1010119 - RNA, 19 nt, Homo sapiens
aaggaaugcugucccaaca

SEQ ID NO: 1010120 - RNA, 19 nt, Homo sapiens
cgacaaggagggcaugauc

SEQ ID NO: 1010121 - RNA, 19 nt, Homo sapiens
cguucuagaugguauguuc

SEQ ID NO: 1010122 - RNA, 19 nt, Homo sapiens
uaacggacagaaagagaau

SEQ ID NO: 1010123 - RNA, 19 nt, Homo sapiens
aaaaugcucuugcuguaga

SEQ ID NO: 1010124 - RNA, 19 nt, Homo sapiens
ggugguacaggcaaaguug

SEQ ID NO: 1010125 - RNA, 19 nt, Homo sapiens
ggacagauuuuaggugaca

SEQ ID NO: 1010126 - RNA, 19 nt, Homo sapiens
uaauuggaauagagcuguu

SEQ ID NO: 1010127 - RNA, 19 nt, Homo sapiens
ugauguaauuggaauagag

SEQ ID NO: 1010128 - RNA, 19 nt, Homo sapiens
uuacgccuguguagauuuc

SEQ ID NO: 1010129 - RNA, 19 nt, Homo sapiens
ggccuuugauccuuugaag

SEQ ID NO: 1010130 - RNA, 19 nt, Homo sapiens
auagagcuguugauuuaag

SEQ ID NO: 1010131 - RNA, 19 nt, Homo sapiens
ggcguggacucuuucuauc

SEQ ID NO: 1010132 - RNA, 19 nt, Homo sapiens
cgagaucuucgaugagaga

SEQ ID NO: 1010133 - RNA, 19 nt, Homo sapiens
gcagcaggcgccuucuuca

SEQ ID NO: 1010134 - RNA, 19 nt, Homo sapiens
gaagaugcagaaggaggaa

SEQ ID NO: 1010135 - RNA, 19 nt, Homo sapiens
uggaauagagcuguugauu

SEQ ID NO: 1010136 - RNA, 19 nt, Homo sapiens
aggcaggaguggucucaga

SEQ ID NO: 1010137 - RNA, 19 nt, Homo sapiens
uggaugaggucgucacacu

SEQ ID NO: 1010138 - RNA, 19 nt, Homo sapiens
gacaaggagggcaugauca

SEQ ID NO: 1010139 - RNA, 19 nt, Homo sapiens
ugaucaaccucgucauguc

SEQ ID NO: 1010140 - RNA, 19 nt, Homo sapiens
acacaaucccucacacugu

SEQ ID NO: 1010141 - RNA, 19 nt, Homo sapiens
acaaggagggcaugaucaa

SEQ ID NO: 1010142 - RNA, 19 nt, Homo sapiens
gauucuucuuuccuucauu

SEQ ID NO: 1010143 - RNA, 19 nt, Homo sapiens
gauauuaacaacucuaacc

SEQ ID NO: 1010144 - RNA, 19 nt, Homo sapiens
gacuggaacguucuagaug

SEQ ID NO: 1010145 - RNA, 19 nt, Homo sapiens
cacaauggcgccaagaauc

SEQ ID NO: 1010146 - RNA, 19 nt, Homo sapiens
aagugggucuucuguggaa

SEQ ID NO: 1010147 - RNA, 19 nt, Homo sapiens
gccugacugugccaucuug

SEQ ID NO: 1010148 - RNA, 19 nt, Homo sapiens
gaacguucuagaugguaug

SEQ ID NO: 1010149 - RNA, 19 nt, Homo sapiens
cuucagcuguggguccuaa

SEQ ID NO: 1010150 - RNA, 19 nt, Homo sapiens
gugcgucucuccuucucau

SEQ ID NO: 1010151 - RNA, 19 nt, Homo sapiens
uagaaguggcuuacuguag

SEQ ID NO: 1010152 - RNA, 19 nt, Homo sapiens
uuuccuguuugaaggcuua

SEQ ID NO: 1010153 - RNA, 19 nt, Homo sapiens
ugaauaaggucuuugauga

SEQ ID NO: 1010154 - RNA, 19 nt, Homo sapiens
gcaaauaaaccacuuucua

SEQ ID NO: 1010155 - RNA, 19 nt, Homo sapiens
gaaccuaaaugaccgucua

SEQ ID NO: 1010156 - RNA, 19 nt, Homo sapiens
gaagagagagauauaaaga

SEQ ID NO: 1010157 - RNA, 19 nt, Homo sapiens
ucaugaagcacaucaauua

SEQ ID NO: 1010158 - RNA, 19 nt, Homo sapiens
caucauuacugccaucuuu

SEQ ID NO: 1010159 - RNA, 19 nt, Homo sapiens
cauaaagacucgacuugaa

SEQ ID NO: 1010160 - RNA, 19 nt, Homo sapiens
caagaaaucagccauaaga

SEQ ID NO: 1010161 - RNA, 19 nt, Homo sapiens
agaccuagcucuccucaaa

SEQ ID NO: 1010162 - RNA, 19 nt, Homo sapiens
aaacagauuuggagauuca

SEQ ID NO: 1010163 - RNA, 19 nt, Homo sapiens
guagaggaauccauguaaa

SEQ ID NO: 1010164 - RNA, 19 nt, Homo sapiens
gaaaucagccauaagaaag

SEQ ID NO: 1010165 - RNA, 19 nt, Homo sapiens
aacaggaaauugcuacuua

SEQ ID NO: 1010166 - RNA, 19 nt, Homo sapiens
gaacaacgaauaccauauc

SEQ ID NO: 1010167 - RNA, 19 nt, Homo sapiens
gagcugcgaagucagauua

SEQ ID NO: 1010168 - RNA, 19 nt, Homo sapiens
gaacuccagucccaucuca

SEQ ID NO: 1010169 - RNA, 19 nt, Homo sapiens
gaaaugaggcagaaguaug

SEQ ID NO: 1010170 - RNA, 19 nt, Homo sapiens
uuaauacucugcagugauu

SEQ ID NO: 1010171 - RNA, 19 nt, Homo sapiens
gcaaggucgugucaucuga

SEQ ID NO: 1010172 - RNA, 19 nt, Homo sapiens
gggcaacacugucaaugug

SEQ ID NO: 1010173 - RNA, 19 nt, Homo sapiens
ccaggaagauuaagacagu

SEQ ID NO: 1010174 - RNA, 19 nt, Homo sapiens
ccauauccuucuugacaua

SEQ ID NO: 1010175 - RNA, 19 nt, Homo sapiens
ggacgacacccagcguuua

SEQ ID NO: 1010176 - RNA, 19 nt, Homo sapiens
ucaaagagguggaagaaaa

SEQ ID NO: 1010177 - RNA, 19 nt, Homo sapiens
gagagaggaauacgucuaa

SEQ ID NO: 1010178 - RNA, 19 nt, Homo sapiens
gcgacuacagugcauauua

SEQ ID NO: 1010179 - RNA, 19 nt, Homo sapiens
ugaagcacaucaauuacaa

SEQ ID NO: 1010180 - RNA, 19 nt, Homo sapiens
gaagagcugcgaagucaga

SEQ ID NO: 1010181 - RNA, 19 nt, Homo sapiens
ccauaagaaagcacuauua

SEQ ID NO: 1010182 - RNA, 19 nt, Homo sapiens
cgcagaagcuuccacagaa

SEQ ID NO: 1010183 - RNA, 19 nt, Homo sapiens
gauuaaggaugcucaacug

SEQ ID NO: 1010184 - RNA, 19 nt, Homo sapiens
caacgaauaccauauccuu

SEQ ID NO: 1010185 - RNA, 19 nt, Homo sapiens
uaaggaugcucaacugcaa

SEQ ID NO: 1010186 - RNA, 19 nt, Homo sapiens
gcauauuacagacaaauug

SEQ ID NO: 1010187 - RNA, 19 nt, Homo sapiens
ugaccuaacccuacauaaa

SEQ ID NO: 1010188 - RNA, 19 nt, Homo sapiens
ugaaugaaaugaggcagaa

SEQ ID NO: 1010189 - RNA, 19 nt, Homo sapiens
gaggaauccauguaaauug

SEQ ID NO: 1010190 - RNA, 19 nt, Homo sapiens
cgugucaucugaagucaaa

SEQ ID NO: 1010191 - RNA, 19 nt, Homo sapiens
gguguguccugcaaauuga

SEQ ID NO: 1010192 - RNA, 19 nt, Homo sapiens
gaacaggaaauugcuacuu

SEQ ID NO: 1010193 - RNA, 19 nt, Homo sapiens
ggaagucgauggccuacac

SEQ ID NO: 1010194 - RNA, 19 nt, Homo sapiens
gaccaccuaauaucaauuu

SEQ ID NO: 1010195 - RNA, 19 nt, Homo sapiens
agaaaucagccauaagaaa

SEQ ID NO: 1010196 - RNA, 19 nt, Homo sapiens
ggaaggagaagacguaaaa

SEQ ID NO: 1010197 - RNA, 19 nt, Homo sapiens
cgacuacagugcauauuac

SEQ ID NO: 1010198 - RNA, 19 nt, Homo sapiens
ugcaagaaaucagccauaa

SEQ ID NO: 1010199 - RNA, 19 nt, Homo sapiens
ggaagagagagauauaaag

SEQ ID NO: 1010200 - RNA, 19 nt, Homo sapiens
cagaacaacgaauaccaua

SEQ ID NO: 1010201 - RNA, 19 nt, Homo sapiens
aaaugaggcagaaguauga

SEQ ID NO: 1010202 - RNA, 19 nt, Homo sapiens
gaauccauguaaauugcaa

SEQ ID NO: 1010203 - RNA, 19 nt, Homo sapiens
ccagacacacggugaacua

SEQ ID NO: 1010204 - RNA, 19 nt, Homo sapiens
cgaauaccauauccuucuu

SEQ ID NO: 1010205 - RNA, 19 nt, Homo sapiens
gacacacggugaacuaugg

SEQ ID NO: 1010206 - RNA, 19 nt, Homo sapiens
gaaccuuggcgucaucaug

SEQ ID NO: 1010207 - RNA, 19 nt, Homo sapiens
ucagaggagcugcaaauug

SEQ ID NO: 1010208 - RNA, 19 nt, Homo sapiens
gacauaaagacucgacuug

SEQ ID NO: 1010209 - RNA, 19 nt, Homo sapiens
ugaugcagauucggaguaa

SEQ ID NO: 1010210 - RNA, 19 nt, Homo sapiens
gaugaccuaacccuacaua

SEQ ID NO: 1010211 - RNA, 19 nt, Homo sapiens
uugaagagcugcgaaguca

SEQ ID NO: 1010212 - RNA, 19 nt, Homo sapiens
ggaccuguuuguuggcaau

SEQ ID NO: 1010213 - RNA, 19 nt, Homo sapiens
uuaagacagucgugcaaga

SEQ ID NO: 1010214 - RNA, 19 nt, Homo sapiens
gaagucauggcccagaaga

SEQ ID NO: 1010215 - RNA, 19 nt, Homo sapiens
gaccuaacccuacauaaaa

SEQ ID NO: 1010216 - RNA, 19 nt, Homo sapiens
guagaccaccuaauaucaa

SEQ ID NO: 1010217 - RNA, 19 nt, Homo sapiens
gacagucgugcaagaagua

SEQ ID NO: 1010218 - RNA, 19 nt, Homo sapiens
gaucuccaaggccugaaua

SEQ ID NO: 1010219 - RNA, 19 nt, Homo sapiens
ccagagccuugagauagaa

SEQ ID NO: 1010220 - RNA, 19 nt, Homo sapiens
cuacagugcauauuacaga

SEQ ID NO: 1010221 - RNA, 19 nt, Homo sapiens
guagguaauguuccugaaa

SEQ ID NO: 1010222 - RNA, 19 nt, Homo sapiens
gcuguagaccaccuaauau

SEQ ID NO: 1010223 - RNA, 19 nt, Homo sapiens
aagaacaguuugagagaca

SEQ ID NO: 1010224 - RNA, 19 nt, Homo sapiens
gaaagcacuauuaauacuc

SEQ ID NO: 1010225 - RNA, 19 nt, Homo sapiens
aagaaaaccaggaagauua

SEQ ID NO: 1010226 - RNA, 19 nt, Homo sapiens
uaccauauccuucuugaca

SEQ ID NO: 1010227 - RNA, 19 nt, Homo sapiens
uggaagagagagauauaaa

SEQ ID NO: 1010228 - RNA, 19 nt, Homo sapiens
ccaugcagaaccuaaauga

SEQ ID NO: 1010229 - RNA, 19 nt, Homo sapiens
cccagagccuugagauaga

SEQ ID NO: 1010230 - RNA, 19 nt, Homo sapiens
agaacugaauaaagaccua

SEQ ID NO: 1010231 - RNA, 19 nt, Homo sapiens
caguccaacuccaaacuug

SEQ ID NO: 1010232 - RNA, 19 nt, Homo sapiens
uagaccaccuaauaucaau

SEQ ID NO: 1010233 - RNA, 19 nt, Homo sapiens
gcaagaaaucagccauaag

SEQ ID NO: 1010234 - RNA, 19 nt, Homo sapiens
gaauaccauauccuucuug

SEQ ID NO: 1010235 - RNA, 19 nt, Homo sapiens
gagaggaauacgucuaaca

SEQ ID NO: 1010236 - RNA, 19 nt, Homo sapiens
gaaguaugagacugagaga

SEQ ID NO: 1010237 - RNA, 19 nt, Homo sapiens
agaggaauccauguaaauu

SEQ ID NO: 1010238 - RNA, 19 nt, Homo sapiens
uaagacagucgugcaagaa

SEQ ID NO: 1010239 - RNA, 19 nt, Homo sapiens
gcaguccaacuccaaacuu

SEQ ID NO: 1010240 - RNA, 19 nt, Homo sapiens
aauaccauauccuucuuga

SEQ ID NO: 1010241 - RNA, 19 nt, Homo sapiens
gaacaguuugagagacaga

SEQ ID NO: 1010242 - RNA, 19 nt, Homo sapiens
uagaggaauccauguaaau

SEQ ID NO: 1010243 - RNA, 19 nt, Homo sapiens
guaauguuccugaaaauug

SEQ ID NO: 1010244 - RNA, 19 nt, Homo sapiens
acugccaucuuuaucauga

SEQ ID NO: 1010245 - RNA, 19 nt, Homo sapiens
gacgacacccagcguuuau

SEQ ID NO: 1010246 - RNA, 19 nt, Homo sapiens
gggacgacacccagcguuu

SEQ ID NO: 1010247 - RNA, 19 nt, Homo sapiens
gaauaaggucuuugaugac

SEQ ID NO: 1010248 - RNA, 19 nt, Homo sapiens
uauuaauacucugcaguga

SEQ ID NO: 1010249 - RNA, 19 nt, Homo sapiens
gauuaagacagucgugcaa

SEQ ID NO: 1010250 - RNA, 19 nt, Homo sapiens
ccuggaagagagagauaua

SEQ ID NO: 1010251 - RNA, 19 nt, Homo sapiens
caucucagcaugaaagagu

SEQ ID NO: 1010252 - RNA, 19 nt, Homo sapiens
ggugcucccuccuggaauc

SEQ ID NO: 1010253 - RNA, 19 nt, Homo sapiens
gguaaggccuccaguauug

SEQ ID NO: 1010254 - RNA, 19 nt, Homo sapiens
gcacagagacaccacauuu

SEQ ID NO: 1010255 - RNA, 19 nt, Homo sapiens
ggacaaaugccuccggaua

SEQ ID NO: 1010256 - RNA, 19 nt, Homo sapiens
caaggacugugcuaaauga

SEQ ID NO: 1010257 - RNA, 19 nt, Homo sapiens
gaacuacucagauuggauu

SEQ ID NO: 1010258 - RNA, 19 nt, Homo sapiens
cagguucuaugaccaaaua

SEQ ID NO: 1010259 - RNA, 19 nt, Homo sapiens
gcacuugccuucccucucu

SEQ ID NO: 1010260 - RNA, 19 nt, Homo sapiens
ggacugugcuaaaugagau

SEQ ID NO: 1010261 - RNA, 19 nt, Homo sapiens
gagcagaaguggguauugu

SEQ ID NO: 1010262 - RNA, 19 nt, Homo sapiens
cacaggaaguugucacuga

SEQ ID NO: 1010263 - RNA, 19 nt, Homo sapiens
gcuagugccuccuuugaca

SEQ ID NO: 1010264 - RNA, 19 nt, Homo sapiens
gacacuggguccuuaguau

SEQ ID NO: 1010265 - RNA, 19 nt, Homo sapiens
ccaaaccauccuuguauaa

SEQ ID NO: 1010266 - RNA, 19 nt, Homo sapiens
gccgagaucuugcccugaa

SEQ ID NO: 1010267 - RNA, 19 nt, Homo sapiens
gaaguggguauuguugaua

SEQ ID NO: 1010268 - RNA, 19 nt, Homo sapiens
gcagaaguggguauuguug

SEQ ID NO: 1010269 - RNA, 19 nt, Homo sapiens
gacaaaugccuccggauau

SEQ ID NO: 1010270 - RNA, 19 nt, Homo sapiens
cuaauuccuuguccuagaa

SEQ ID NO: 1010271 - RNA, 19 nt, Homo sapiens
ggucagaucccagguucua

SEQ ID NO: 1010272 - RNA, 19 nt, Homo sapiens
ugacugcuggcaugaaaua

SEQ ID NO: 1010273 - RNA, 19 nt, Homo sapiens
cacagacacuggguccuua

SEQ ID NO: 1010274 - RNA, 19 nt, Homo sapiens
cagagaagguccuagacau

SEQ ID NO: 1010275 - RNA, 19 nt, Homo sapiens
auaaacugcucagaacuaa

SEQ ID NO: 1010276 - RNA, 19 nt, Homo sapiens
uauaaacugcucagaacua

SEQ ID NO: 1010277 - RNA, 19 nt, Homo sapiens
caaaccauccuuguauaaa

SEQ ID NO: 1010278 - RNA, 19 nt, Homo sapiens
acaaaugccuccggauaug

SEQ ID NO: 1010279 - RNA, 19 nt, Homo sapiens
gaugagguauaugcuguug

SEQ ID NO: 1010280 - RNA, 19 nt, Homo sapiens
ccacgcggaugagguauau

SEQ ID NO: 1010281 - RNA, 19 nt, Homo sapiens
acaccaagcucucaucaac

SEQ ID NO: 1010282 - RNA, 19 nt, Homo sapiens
gagaagguccuagacauca

SEQ ID NO: 1010283 - RNA, 19 nt, Homo sapiens
uccaaaccauccuuguaua

SEQ ID NO: 1010284 - RNA, 19 nt, Homo sapiens
ggcccgaaguucucucuga

SEQ ID NO: 1010285 - RNA, 19 nt, Homo sapiens
gcagcaguaugagcucuga

SEQ ID NO: 1010286 - RNA, 19 nt, Homo sapiens
gagaaucuagggcuguauu

SEQ ID NO: 1010287 - RNA, 19 nt, Homo sapiens
gaaggucacaggaaguugu

SEQ ID NO: 1010288 - RNA, 19 nt, Homo sapiens
ggacgggcuucucuacucu

SEQ ID NO: 1010289 - RNA, 19 nt, Homo sapiens
gaucuugcccugaauguac

SEQ ID NO: 1010290 - RNA, 19 nt, Homo sapiens
agagaggccaguugugaua

SEQ ID NO: 1010291 - RNA, 19 nt, Homo sapiens
acaggaaguugucacugaa

SEQ ID NO: 1010292 - RNA, 19 nt, Homo sapiens
gagaacaaaggcugagaug

SEQ ID NO: 1010293 - RNA, 19 nt, Homo sapiens
uguauaaacugcucagaac

SEQ ID NO: 1010294 - RNA, 19 nt, Homo sapiens
cugcaagaauggccagauu

SEQ ID NO: 1010295 - RNA, 19 nt, Homo sapiens
gccacaggcuaucuucaga

SEQ ID NO: 1010296 - RNA, 19 nt, Homo sapiens
ggguaaggccuccaguauu

SEQ ID NO: 1010297 - RNA, 19 nt, Homo sapiens
ugaaauagaagugcaguuc

SEQ ID NO: 1010298 - RNA, 19 nt, Homo sapiens
gggacgggcuucucuacuc

SEQ ID NO: 1010299 - RNA, 19 nt, Homo sapiens
uaagagagaggccaguugu

SEQ ID NO: 1010300 - RNA, 19 nt, Homo sapiens
gugaggcagucauuucugu

SEQ ID NO: 1010301 - RNA, 19 nt, Homo sapiens
aaaccauccuuguauaaac

SEQ ID NO: 1010302 - RNA, 19 nt, Homo sapiens
ggacaccaagcucucauca

SEQ ID NO: 1010303 - RNA, 19 nt, Homo sapiens
agaaguggguauuguugau

SEQ ID NO: 1010304 - RNA, 19 nt, Homo sapiens
cugcuggcaugaaauagaa

SEQ ID NO: 1010305 - RNA, 19 nt, Homo sapiens
aaucaaggacugugcuaaa

SEQ ID NO: 1010306 - RNA, 19 nt, Homo sapiens
gaguccagauggccagaga

SEQ ID NO: 1010307 - RNA, 19 nt, Homo sapiens
gugcggaucugggacacaa

SEQ ID NO: 1010308 - RNA, 19 nt, Homo sapiens
acacuggguccuuaguaua

SEQ ID NO: 1010309 - RNA, 19 nt, Homo sapiens
gaauucccaucaggacuca

SEQ ID NO: 1010310 - RNA, 19 nt, Homo sapiens
ugaaaggaauucccaucag

SEQ ID NO: 1010311 - RNA, 19 nt, Homo sapiens
agacagagaagguccuaga

SEQ ID NO: 1010312 - RNA, 19 nt, Homo sapiens
ugugacugcuggcaugaaa

SEQ ID NO: 1010313 - RNA, 19 nt, Homo sapiens
guaagagagaggccaguug

SEQ ID NO: 1010314 - RNA, 19 nt, Homo sapiens
ggacagcacacagaaaggu

SEQ ID NO: 1010315 - RNA, 19 nt, Homo sapiens
acagagacaccacauuuca

SEQ ID NO: 1010316 - RNA, 19 nt, Homo sapiens
gauaguggccaaggagaau

SEQ ID NO: 1010317 - RNA, 19 nt, Homo sapiens
agagagaggccaguuguga

SEQ ID NO: 1010318 - RNA, 19 nt, Homo sapiens
guucuaauuccuuguccua

SEQ ID NO: 1010319 - RNA, 19 nt, Homo sapiens
ccgacgacuucaccuuauu

SEQ ID NO: 1010320 - RNA, 19 nt, Homo sapiens
gugaaaggaauucccauca

SEQ ID NO: 1010321 - RNA, 19 nt, Homo sapiens
gagagaggccaguugugau

SEQ ID NO: 1010322 - RNA, 19 nt, Homo sapiens
gcacuggacuacgccaaaa

SEQ ID NO: 1010323 - RNA, 19 nt, Homo sapiens
ucaaggacugugcuaaaug

SEQ ID NO: 1010324 - RNA, 19 nt, Homo sapiens
caccacauuucacaugcaa

SEQ ID NO: 1010325 - RNA, 19 nt, Homo sapiens
ggccugcuguccucgauag

SEQ ID NO: 1010326 - RNA, 19 nt, Homo sapiens
gaaggugugggaugugaag

SEQ ID NO: 1010327 - RNA, 19 nt, Homo sapiens
ggagacagagaagguccua

SEQ ID NO: 1010328 - RNA, 19 nt, Homo sapiens
ggauauggaggagaugaga

SEQ ID NO: 1010329 - RNA, 19 nt, Homo sapiens
ugagguauaugcuguugac

SEQ ID NO: 1010330 - RNA, 19 nt, Homo sapiens
ggaccgcaccaucaaaguc

SEQ ID NO: 1010331 - RNA, 19 nt, Homo sapiens
gucauggucugaacuacuc

SEQ ID NO: 1010332 - RNA, 19 nt, Homo sapiens
ccacgagaacuuucaagca

SEQ ID NO: 1010333 - RNA, 19 nt, Homo sapiens
uagugcaguuccaggauga

SEQ ID NO: 1010334 - RNA, 19 nt, Homo sapiens
gcagggucauggucugaac

SEQ ID NO: 1010335 - RNA, 19 nt, Homo sapiens
agacacuggguccuuagua

SEQ ID NO: 1010336 - RNA, 19 nt, Homo sapiens
cagaaguggguauuguuga

SEQ ID NO: 1010337 - RNA, 19 nt, Homo sapiens
aaucuagggcuguauuguu

SEQ ID NO: 1010338 - RNA, 19 nt, Homo sapiens
gaaucuagggcuguauugu

SEQ ID NO: 1010339 - RNA, 19 nt, Homo sapiens
auacagaggaaguucuuug

SEQ ID NO: 1010340 - RNA, 19 nt, Homo sapiens
agacaccacauuucacaug

SEQ ID NO: 1010341 - RNA, 19 nt, Homo sapiens
gaagguccuagacaucauc

SEQ ID NO: 1010342 - RNA, 19 nt, Homo sapiens
ugccuucccugccagagaa

SEQ ID NO: 1010343 - RNA, 19 nt, Homo sapiens
aaacugcucagaacuaaaa

SEQ ID NO: 1010344 - RNA, 19 nt, Homo sapiens
guauuggacagcacacaga

SEQ ID NO: 1010345 - RNA, 19 nt, Homo sapiens
aggagaaucuagggcugua

SEQ ID NO: 1010346 - RNA, 19 nt, Homo sapiens
gaggccaguugugauagug

SEQ ID NO: 1010347 - RNA, 19 nt, Homo sapiens
gguaagagagaggccaguu

SEQ ID NO: 1010348 - RNA, 19 nt, Homo sapiens
cacaggcuaucuucagagu

SEQ ID NO: 1010349 - RNA, 19 nt, Homo sapiens
cugaaggugugggauguga

SEQ ID NO: 1010350 - RNA, 19 nt, Homo sapiens
ucagaucccagguucuaug

SEQ ID NO: 1010351 - RNA, 19 nt, Homo sapiens
ucaagcagugaaaggaauu

SEQ ID NO: 1010352 - RNA, 19 nt, Homo sapiens
aaauagaagugcaguuccu

SEQ ID NO: 1010353 - RNA, 19 nt, Homo sapiens
ggagagagcugcgauguga

SEQ ID NO: 1010354 - RNA, 19 nt, Homo sapiens
gaaggaggcugaagaggaa

SEQ ID NO: 1010355 - RNA, 19 nt, Homo sapiens
gaaccaguauucuuacauu

SEQ ID NO: 1010356 - RNA, 19 nt, Homo sapiens
ggacuaaagugggcucuaa

SEQ ID NO: 1010357 - RNA, 19 nt, Homo sapiens
aaacaacaaugaagaggua

SEQ ID NO: 1010358 - RNA, 19 nt, Homo sapiens
ggacuggccucaucaaauc

SEQ ID NO: 1010359 - RNA, 19 nt, Homo sapiens
gaaggcagcugcacguguu

SEQ ID NO: 1010360 - RNA, 19 nt, Homo sapiens
gaaaacaaaugaaccagua

SEQ ID NO: 1010361 - RNA, 19 nt, Homo sapiens
caaagagugucucaucaga

SEQ ID NO: 1010362 - RNA, 19 nt, Homo sapiens
aagagugucucaucagaua

SEQ ID NO: 1010363 - RNA, 19 nt, Homo sapiens
gagagaagacagaaucauu

SEQ ID NO: 1010364 - RNA, 19 nt, Homo sapiens
gauauuagcagucccguau

SEQ ID NO: 1010365 - RNA, 19 nt, Homo sapiens
ggacggauccauaauaaag

SEQ ID NO: 1010366 - RNA, 19 nt, Homo sapiens
gaaaggaaaccuguaggaa

SEQ ID NO: 1010367 - RNA, 19 nt, Homo sapiens
gaaaauaagcgacgacauu

SEQ ID NO: 1010368 - RNA, 19 nt, Homo sapiens
agagaagacagaaucauua

SEQ ID NO: 1010369 - RNA, 19 nt, Homo sapiens
gaguugaggucgggaguuu

SEQ ID NO: 1010370 - RNA, 19 nt, Homo sapiens
ggaccgaucccacugaaga

SEQ ID NO: 1010371 - RNA, 19 nt, Homo sapiens
gaagagguaauucacuuga

SEQ ID NO: 1010372 - RNA, 19 nt, Homo sapiens
gaagaugaugagaagcuua

SEQ ID NO: 1010373 - RNA, 19 nt, Homo sapiens
gugaagagcuggcugaaaa

SEQ ID NO: 1010374 - RNA, 19 nt, Homo sapiens
caaaugaaccaguauucuu

SEQ ID NO: 1010375 - RNA, 19 nt, Homo sapiens
ggcagagcaugaagacuuu

SEQ ID NO: 1010376 - RNA, 19 nt, Homo sapiens
gcaucacucuggcccauug

SEQ ID NO: 1010377 - RNA, 19 nt, Homo sapiens
agaccauccuguauaagua

SEQ ID NO: 1010378 - RNA, 19 nt, Homo sapiens
aaagugggcucuaagaucu

SEQ ID NO: 1010379 - RNA, 19 nt, Homo sapiens
ucacuucccuucucaugga

SEQ ID NO: 1010380 - RNA, 19 nt, Homo sapiens
caucagauaugcccaagag

SEQ ID NO: 1010381 - RNA, 19 nt, Homo sapiens
ucaaagugcucaguaguca

SEQ ID NO: 1010382 - RNA, 19 nt, Homo sapiens
gagaagacagaaucauuau

SEQ ID NO: 1010383 - RNA, 19 nt, Homo sapiens
gaagagggaaacaacaaug

SEQ ID NO: 1010384 - RNA, 19 nt, Homo sapiens
uaauaaagacgucccaaau

SEQ ID NO: 1010385 - RNA, 19 nt, Homo sapiens
ggagaagccuguggagaag

SEQ ID NO: 1010386 - RNA, 19 nt, Homo sapiens
gugcgcagaugcucacuug

SEQ ID NO: 1010387 - RNA, 19 nt, Homo sapiens
gaccauuucugccaacauc

SEQ ID NO: 1010388 - RNA, 19 nt, Homo sapiens
caaaggacacuaugcaauc

SEQ ID NO: 1010389 - RNA, 19 nt, Homo sapiens
ccucauggccgacuucaaa

SEQ ID NO: 1010390 - RNA, 19 nt, Homo sapiens
auaaagacgucccaaaugg

SEQ ID NO: 1010391 - RNA, 19 nt, Homo sapiens
gagugucgcugcugcuaug

SEQ ID NO: 1010392 - RNA, 19 nt, Homo sapiens
ugaacaaggugacauaaaa

SEQ ID NO: 1010393 - RNA, 19 nt, Homo sapiens
caggagcugucaccagaaa

SEQ ID NO: 1010394 - RNA, 19 nt, Homo sapiens
uaaauugacuccucuugac

SEQ ID NO: 1010395 - RNA, 19 nt, Homo sapiens
gagacaaaguugccuaaaa

SEQ ID NO: 1010396 - RNA, 19 nt, Homo sapiens
gaagcuggcccauugaaag

SEQ ID NO: 1010397 - RNA, 19 nt, Homo sapiens
gaacagaaaagaaagaaug

SEQ ID NO: 1010398 - RNA, 19 nt, Homo sapiens
acagugaugugaagagguu

SEQ ID NO: 1010399 - RNA, 19 nt, Homo sapiens
caacaaugaagagguaauu

SEQ ID NO: 1010400 - RNA, 19 nt, Homo sapiens
cccagaccauccuguauaa

SEQ ID NO: 1010401 - RNA, 19 nt, Homo sapiens
gcgcagaugcucacuuguu

SEQ ID NO: 1010402 - RNA, 19 nt, Homo sapiens
caacuucccacucaacaug

SEQ ID NO: 1010403 - RNA, 19 nt, Homo sapiens
ggagagaacaccuucaaac

SEQ ID NO: 1010404 - RNA, 19 nt, Homo sapiens
aaggaaaccuguaggaagu

SEQ ID NO: 1010405 - RNA, 19 nt, Homo sapiens
aauaagcgacgacauugua

SEQ ID NO: 1010406 - RNA, 19 nt, Homo sapiens
gcaggagaaucacuugaac

SEQ ID NO: 1010407 - RNA, 19 nt, Homo sapiens
aaacccagauuauccaaag

SEQ ID NO: 1010408 - RNA, 19 nt, Homo sapiens
ccaguauucuuacauugau

SEQ ID NO: 1010409 - RNA, 19 nt, Homo sapiens
cagauuauccaaagagaga

SEQ ID NO: 1010410 - RNA, 19 nt, Homo sapiens
ggaguucacagaccucaga

SEQ ID NO: 1010411 - RNA, 19 nt, Homo sapiens
uaaagugggcucuaagauc

SEQ ID NO: 1010412 - RNA, 19 nt, Homo sapiens
agagggugcuguccaguau

SEQ ID NO: 1010413 - RNA, 19 nt, Homo sapiens
cauccucggucucuggaaa

SEQ ID NO: 1010414 - RNA, 19 nt, Homo sapiens
uaccguaccucuauugaag

SEQ ID NO: 1010415 - RNA, 19 nt, Homo sapiens
ccacagaugccacccuaug

SEQ ID NO: 1010416 - RNA, 19 nt, Homo sapiens
gaacaccuucaaacgcauu

SEQ ID NO: 1010417 - RNA, 19 nt, Homo sapiens
gaugaugagaagcuuauug

SEQ ID NO: 1010418 - RNA, 19 nt, Homo sapiens
ccacugaagaugaugagaa

SEQ ID NO: 1010419 - RNA, 19 nt, Homo sapiens
ggaaaccuguaggaagugu

SEQ ID NO: 1010420 - RNA, 19 nt, Homo sapiens
gaugaaugaagaacaguau

SEQ ID NO: 1010421 - RNA, 19 nt, Homo sapiens
agacaaaguugccuaaaau

SEQ ID NO: 1010422 - RNA, 19 nt, Homo sapiens
gccaagaugagacaaaguu

SEQ ID NO: 1010423 - RNA, 19 nt, Homo sapiens
aaaggacacuaugcaauca

SEQ ID NO: 1010424 - RNA, 19 nt, Homo sapiens
ggaagagggaaacaacaau

SEQ ID NO: 1010425 - RNA, 19 nt, Homo sapiens
aaagagagaagacagaauc

SEQ ID NO: 1010426 - RNA, 19 nt, Homo sapiens
gcagugagccaagauugug

SEQ ID NO: 1010427 - RNA, 19 nt, Homo sapiens
caagguggcgcaugccuau

SEQ ID NO: 1010428 - RNA, 19 nt, Homo sapiens
ccacaggcaucacuuucuc

SEQ ID NO: 1010429 - RNA, 19 nt, Homo sapiens
uggagaagccuguggagaa

SEQ ID NO: 1010430 - RNA, 19 nt, Homo sapiens
gaaugaagaacaguaucaa

SEQ ID NO: 1010431 - RNA, 19 nt, Homo sapiens
agauguauuucaaggacua

SEQ ID NO: 1010432 - RNA, 19 nt, Homo sapiens
uggcuucucagauguauuu

SEQ ID NO: 1010433 - RNA, 19 nt, Homo sapiens
gaccguagcugcggcuucu

SEQ ID NO: 1010434 - RNA, 19 nt, Homo sapiens
aacaagagcaggaguucua

SEQ ID NO: 1010435 - RNA, 19 nt, Homo sapiens
gaggauguucuuucuugaa

SEQ ID NO: 1010436 - RNA, 19 nt, Homo sapiens
cuucucagauguauuucaa

SEQ ID NO: 1010437 - RNA, 19 nt, Homo sapiens
aaagaaagaauggagagaa

SEQ ID NO: 1010438 - RNA, 19 nt, Homo sapiens
gcaaagagugucucaucag

SEQ ID NO: 1010439 - RNA, 19 nt, Homo sapiens
cuaaauugacuccucuuga

SEQ ID NO: 1010440 - RNA, 19 nt, Homo sapiens
aauaaagacgucccaaaug

SEQ ID NO: 1010441 - RNA, 19 nt, Homo sapiens
caacgugcgggucaacuau

SEQ ID NO: 1010442 - RNA, 19 nt, Homo sapiens
ugagaagcuuauugaggaa

SEQ ID NO: 1010443 - RNA, 19 nt, Homo sapiens
ugucgaguuucuauuaaug

SEQ ID NO: 1010444 - RNA, 19 nt, Homo sapiens
gggacuggccucaucaaau

SEQ ID NO: 1010445 - RNA, 19 nt, Homo sapiens
cgaaaggaaaccuguagga

SEQ ID NO: 1010446 - RNA, 19 nt, Homo sapiens
gcucaaaggacacuaugca

SEQ ID NO: 1010447 - RNA, 19 nt, Homo sapiens
guaccucuauugaagaaaa

SEQ ID NO: 1010448 - RNA, 19 nt, Homo sapiens
gucaccauguuuagauauu

SEQ ID NO: 1010449 - RNA, 19 nt, Homo sapiens
gcaacaagagcaggaguuc

SEQ ID NO: 1010450 - RNA, 19 nt, Homo sapiens
ugaccgacgugcucuccuu

SEQ ID NO: 1010451 - RNA, 19 nt, Homo sapiens
ccaaagagagaagacagaa

SEQ ID NO: 1010452 - RNA, 19 nt, Homo sapiens
ucaaaggacacuaugcaau

SEQ ID NO: 1010453 - RNA, 19 nt, Homo sapiens
gaaaguaucugcaguguaa

SEQ ID NO: 1010454 - RNA, 19 nt, Homo sapiens
ggaaagaggucaaauucaa

SEQ ID NO: 1010455 - RNA, 19 nt, Homo sapiens
acaaagcccuucaaauuua

SEQ ID NO: 1010456 - RNA, 19 nt, Homo sapiens
gcaaagagguacuacagaa

SEQ ID NO: 1010457 - RNA, 19 nt, Homo sapiens
gaaauggaguuguggauga

SEQ ID NO: 1010458 - RNA, 19 nt, Homo sapiens
acacaaauguuacugcuua

SEQ ID NO: 1010459 - RNA, 19 nt, Homo sapiens
gagaggagaugugacaaua

SEQ ID NO: 1010460 - RNA, 19 nt, Homo sapiens
gaaaggaaauggaguugug

SEQ ID NO: 1010461 - RNA, 19 nt, Homo sapiens
ggacaguacuggcaugaaa

SEQ ID NO: 1010462 - RNA, 19 nt, Homo sapiens
guacugggcuuauauuuca

SEQ ID NO: 1010463 - RNA, 19 nt, Homo sapiens
auacagaccugaagaagua

SEQ ID NO: 1010464 - RNA, 19 nt, Homo sapiens
gauaauccauuuaggacua

SEQ ID NO: 1010465 - RNA, 19 nt, Homo sapiens
gaacuauacugacuucugu

SEQ ID NO: 1010466 - RNA, 19 nt, Homo sapiens
caagaaauaugccaaguca

SEQ ID NO: 1010467 - RNA, 19 nt, Homo sapiens
uaacgugacuucagauuau

SEQ ID NO: 1010468 - RNA, 19 nt, Homo sapiens
uuacaaagcccuucaaauu

SEQ ID NO: 1010469 - RNA, 19 nt, Homo sapiens
gagguuggcuuuauaaaca

SEQ ID NO: 1010470 - RNA, 19 nt, Homo sapiens
gaacgagcauggagagaau

SEQ ID NO: 1010471 - RNA, 19 nt, Homo sapiens
gaggagaugugacaauaga

SEQ ID NO: 1010472 - RNA, 19 nt, Homo sapiens
ggugcaagauacuauauaa

SEQ ID NO: 1010473 - RNA, 19 nt, Homo sapiens
caaauccgguacuuaguuu

SEQ ID NO: 1010474 - RNA, 19 nt, Homo sapiens
gaacuggacacugccauua

SEQ ID NO: 1010475 - RNA, 19 nt, Homo sapiens
gagcaaauggaaagaauaa

SEQ ID NO: 1010476 - RNA, 19 nt, Homo sapiens
ugaauucucugccaucuga

SEQ ID NO: 1010477 - RNA, 19 nt, Homo sapiens
gaaggauggucaagauaga

SEQ ID NO: 1010478 - RNA, 19 nt, Homo sapiens
gcaauaagcagguuuccaa

SEQ ID NO: 1010479 - RNA, 19 nt, Homo sapiens
ggaaaacgcugucacaaga

SEQ ID NO: 1010480 - RNA, 19 nt, Homo sapiens
caaauucaaugcagcaguu

SEQ ID NO: 1010481 - RNA, 19 nt, Homo sapiens
caagauagacccuuaacaa

SEQ ID NO: 1010482 - RNA, 19 nt, Homo sapiens
ggacuucagcaaagaguua

SEQ ID NO: 1010483 - RNA, 19 nt, Homo sapiens
gugcacagauucagaaaga

SEQ ID NO: 1010484 - RNA, 19 nt, Homo sapiens
acaaagggaugauuuacaa

SEQ ID NO: 1010485 - RNA, 19 nt, Homo sapiens
ccacacuccugucagcuua

SEQ ID NO: 1010486 - RNA, 19 nt, Homo sapiens
gaagguagaggcacauuau

SEQ ID NO: 1010487 - RNA, 19 nt, Homo sapiens
caugagagaugacacaaug

SEQ ID NO: 1010488 - RNA, 19 nt, Homo sapiens
caaacaugcggaccuauua

SEQ ID NO: 1010489 - RNA, 19 nt, Homo sapiens
gaacggccaauaaguauga

SEQ ID NO: 1010490 - RNA, 19 nt, Homo sapiens
cgaaucaacuccugagguu

SEQ ID NO: 1010491 - RNA, 19 nt, Homo sapiens
caaagcccuucaaauuuaa

SEQ ID NO: 1010492 - RNA, 19 nt, Homo sapiens
guuagaugcugcccuagua

SEQ ID NO: 1010493 - RNA, 19 nt, Homo sapiens
gcaaauggaaagaauaaga

SEQ ID NO: 1010494 - RNA, 19 nt, Homo sapiens
ccacuuuccuguuggagua

SEQ ID NO: 1010495 - RNA, 19 nt, Homo sapiens
acacagaccgcaaaucaua

SEQ ID NO: 1010496 - RNA, 19 nt, Homo sapiens
gggcuuauauuucauugga

SEQ ID NO: 1010497 - RNA, 19 nt, Homo sapiens
gaaagaauaagaagacauc

SEQ ID NO: 1010498 - RNA, 19 nt, Homo sapiens
gaagggcugaguaaacaua

SEQ ID NO: 1010499 - RNA, 19 nt, Homo sapiens
agauauugaugccaaguua

SEQ ID NO: 1010500 - RNA, 19 nt, Homo sapiens
uaccaaacauuaccaagaa

SEQ ID NO: 1010501 - RNA, 19 nt, Homo sapiens
gaacuucacgagcuucaaa

SEQ ID NO: 1010502 - RNA, 19 nt, Homo sapiens
gaaagugaccugcaaacau

SEQ ID NO: 1010503 - RNA, 19 nt, Homo sapiens
gaaaguacucgaccaagga

SEQ ID NO: 1010504 - RNA, 19 nt, Homo sapiens
aaccauagagugcuaauua

SEQ ID NO: 1010505 - RNA, 19 nt, Homo sapiens
agacgagguuggcuuuaua

SEQ ID NO: 1010506 - RNA, 19 nt, Homo sapiens
guaagaagauauuguacag

SEQ ID NO: 1010507 - RNA, 19 nt, Homo sapiens
ucauguguguguagucuua

SEQ ID NO: 1010508 - RNA, 19 nt, Homo sapiens
gggaagaagcauauacuuu

SEQ ID NO: 1010509 - RNA, 19 nt, Homo sapiens
uaaaggcuacuuacuauug

SEQ ID NO: 1010510 - RNA, 19 nt, Homo sapiens
uuccagagcuuacuuaguu

SEQ ID NO: 1010511 - RNA, 19 nt, Homo sapiens
caaauggaguaaauucugu

SEQ ID NO: 1010512 - RNA, 19 nt, Homo sapiens
caagagugaaccagaguua

SEQ ID NO: 1010513 - RNA, 19 nt, Homo sapiens
gaaauacacgcuugagcaa

SEQ ID NO: 1010514 - RNA, 19 nt, Homo sapiens
aaagugaccugcaaacauc

SEQ ID NO: 1010515 - RNA, 19 nt, Homo sapiens
ggaaaugauggauaaagaa

SEQ ID NO: 1010516 - RNA, 19 nt, Homo sapiens
gaaggugcaagauacuaua

SEQ ID NO: 1010517 - RNA, 19 nt, Homo sapiens
ggagagaauaugauaaguu

SEQ ID NO: 1010518 - RNA, 19 nt, Homo sapiens
ggaagcauacuguuaccua

SEQ ID NO: 1010519 - RNA, 19 nt, Homo sapiens
cuaaagacauggaccuuca

SEQ ID NO: 1010520 - RNA, 19 nt, Homo sapiens
uagaggaaaucaaacaaug

SEQ ID NO: 1010521 - RNA, 19 nt, Homo sapiens
ggaagaagcauauacuuuu

SEQ ID NO: 1010522 - RNA, 19 nt, Homo sapiens
uaacaacaguggcagaagu

SEQ ID NO: 1010523 - RNA, 19 nt, Homo sapiens
gcauggagagaauaugaua

SEQ ID NO: 1010524 - RNA, 19 nt, Homo sapiens
gagcauggagagaauauga

SEQ ID NO: 1010525 - RNA, 19 nt, Homo sapiens
agacaaggccugaaaguau

SEQ ID NO: 1010526 - RNA, 19 nt, Homo sapiens
uagcuuugcuuaccucuga

SEQ ID NO: 1010527 - RNA, 19 nt, Homo sapiens
ucacaggacaauuguauuu

SEQ ID NO: 1010528 - RNA, 19 nt, Homo sapiens
acaaugagcacauguaaug

SEQ ID NO: 1010529 - RNA, 19 nt, Homo sapiens
cagaagagcauccugaaga

SEQ ID NO: 1010530 - RNA, 19 nt, Homo sapiens
aaacacagaccgcaaauca

SEQ ID NO: 1010531 - RNA, 19 nt, Homo sapiens
ggaguaaauucuguggaaa

SEQ ID NO: 1010532 - RNA, 19 nt, Homo sapiens
uacaaagcccuucaaauuu

SEQ ID NO: 1010533 - RNA, 19 nt, Homo sapiens
ucagaaggauggucaagau

SEQ ID NO: 1010534 - RNA, 19 nt, Homo sapiens
ggcaugaaauuguggaaga

SEQ ID NO: 1010535 - RNA, 19 nt, Homo sapiens
uuacuuaguugcugauuuc

SEQ ID NO: 1010536 - RNA, 19 nt, Homo sapiens
acagaaggaucacauuuca

SEQ ID NO: 1010537 - RNA, 19 nt, Homo sapiens
agaaauagguaugauagga

SEQ ID NO: 1010538 - RNA, 19 nt, Homo sapiens
caaguuaagccgauuaugu

SEQ ID NO: 1010539 - RNA, 19 nt, Homo sapiens
gaggcacauuauacaaaua

SEQ ID NO: 1010540 - RNA, 19 nt, Homo sapiens
gacaaggccugaaaguauc

SEQ ID NO: 1010541 - RNA, 19 nt, Homo sapiens
auagaacacucccaagaaa

SEQ ID NO: 1010542 - RNA, 19 nt, Homo sapiens
guguaaagcugaauucucu

SEQ ID NO: 1010543 - RNA, 19 nt, Homo sapiens
guacuggcaugaaauugug

SEQ ID NO: 1010544 - RNA, 19 nt, Homo sapiens
gaaguacugggcuuauauu

SEQ ID NO: 1010545 - RNA, 19 nt, Homo sapiens
gaaccagaguuaacaacag

SEQ ID NO: 1010546 - RNA, 19 nt, Homo sapiens
caaaauggacugcuuagua

SEQ ID NO: 1010547 - RNA, 19 nt, Homo sapiens
gagaaacggagguccauga

SEQ ID NO: 1010548 - RNA, 19 nt, Homo sapiens
gaaagaggucaaauucaau

SEQ ID NO: 1010549 - RNA, 19 nt, Homo sapiens
aagagguacuacagaaaua

SEQ ID NO: 1010550 - RNA, 19 nt, Homo sapiens
gaagaagcauauacuuuug

SEQ ID NO: 1010551 - RNA, 19 nt, Homo sapiens
agaauacgauguaacuguu

SEQ ID NO: 1010552 - RNA, 19 nt, Homo sapiens
ggagguccaugagagauga

SEQ ID NO: 1010553 - RNA, 19 nt, Homo sapiens
ggagauauuuccaggcuua

SEQ ID NO: 1010554 - RNA, 19 nt, Homo sapiens
uaacacugcuuucucauaa

SEQ ID NO: 1010555 - RNA, 19 nt, Homo sapiens
uaagaaaccugcuuuguca

SEQ ID NO: 1010556 - RNA, 19 nt, Homo sapiens
gaaagaaaccagcauguga

SEQ ID NO: 1010557 - RNA, 19 nt, Homo sapiens
gaaaccagcaugugacuuu

SEQ ID NO: 1010558 - RNA, 19 nt, Homo sapiens
gcucacggguaccuauuua

SEQ ID NO: 1010559 - RNA, 19 nt, Homo sapiens
gaaaccugcuuugucauuu

SEQ ID NO: 1010560 - RNA, 19 nt, Homo sapiens
cuauuugccucaucuauaa

SEQ ID NO: 1010561 - RNA, 19 nt, Homo sapiens
acacugcuuucucauaaua

SEQ ID NO: 1010562 - RNA, 19 nt, Homo sapiens
ggaaacaagcccugucuga

SEQ ID NO: 1010563 - RNA, 19 nt, Homo sapiens
gaagugcuagcaucagaua

SEQ ID NO: 1010564 - RNA, 19 nt, Homo sapiens
gcaugugacuuuccuagau

SEQ ID NO: 1010565 - RNA, 19 nt, Homo sapiens
caugugacuuuccuagaua

SEQ ID NO: 1010566 - RNA, 19 nt, Homo sapiens
ggaagagaguggugacauc

SEQ ID NO: 1010567 - RNA, 19 nt, Homo sapiens
ggaagugccugcaggaaac

SEQ ID NO: 1010568 - RNA, 19 nt, Homo sapiens
gaauucagcaucuccagaa

SEQ ID NO: 1010569 - RNA, 19 nt, Homo sapiens
gaagagaggagcacagaag

SEQ ID NO: 1010570 - RNA, 19 nt, Homo sapiens
gaggaaggcauaggagaua

SEQ ID NO: 1010571 - RNA, 19 nt, Homo sapiens
gcagagcacuguggaugug

SEQ ID NO: 1010572 - RNA, 19 nt, Homo sapiens
gaaggcauaggagauauuu

SEQ ID NO: 1010573 - RNA, 19 nt, Homo sapiens
ucuauaacaugaagugcua

SEQ ID NO: 1010574 - RNA, 19 nt, Homo sapiens
gaccuugagccuucuauuu

SEQ ID NO: 1010575 - RNA, 19 nt, Homo sapiens
gaauuguuccuucugcuuu

SEQ ID NO: 1010576 - RNA, 19 nt, Homo sapiens
gugcuagcaucagauauuu

SEQ ID NO: 1010577 - RNA, 19 nt, Homo sapiens
ucacggguaccuauuuaua

SEQ ID NO: 1010578 - RNA, 19 nt, Homo sapiens
cgccaaggcuucauacuca

SEQ ID NO: 1010579 - RNA, 19 nt, Homo sapiens
gacaucgucucucucauuc

SEQ ID NO: 1010580 - RNA, 19 nt, Homo sapiens
gaaacucaucguacacuug

SEQ ID NO: 1010581 - RNA, 19 nt, Homo sapiens
agauaacacugcuuucuca

SEQ ID NO: 1010582 - RNA, 19 nt, Homo sapiens
gcuagcaucagauauuuga

SEQ ID NO: 1010583 - RNA, 19 nt, Homo sapiens
uccagaagcugucccaaga

SEQ ID NO: 1010584 - RNA, 19 nt, Homo sapiens
ggacucggaggaaggcaua

SEQ ID NO: 1010585 - RNA, 19 nt, Homo sapiens
ggagucauccgcagaguca

SEQ ID NO: 1010586 - RNA, 19 nt, Homo sapiens
caauuucugcccuuuguaa

SEQ ID NO: 1010587 - RNA, 19 nt, Homo sapiens
guacccgggugccugguuu

SEQ ID NO: 1010588 - RNA, 19 nt, Homo sapiens
ugacaucgucucucucauu

SEQ ID NO: 1010589 - RNA, 19 nt, Homo sapiens
agagcuagaugaagccauu

SEQ ID NO: 1010590 - RNA, 19 nt, Homo sapiens
gcacagaagggcaguggau

SEQ ID NO: 1010591 - RNA, 19 nt, Homo sapiens
ucacucacccacuguguuu

SEQ ID NO: 1010592 - RNA, 19 nt, Homo sapiens
caucuggacccaucaguga

SEQ ID NO: 1010593 - RNA, 19 nt, Homo sapiens
ggaaggcauaggagauauu

SEQ ID NO: 1010594 - RNA, 19 nt, Homo sapiens
aaacucaucguacacuuga

SEQ ID NO: 1010595 - RNA, 19 nt, Homo sapiens
caucgucucucucauucau

SEQ ID NO: 1010596 - RNA, 19 nt, Homo sapiens
ggaggaaggcauaggagau

SEQ ID NO: 1010597 - RNA, 19 nt, Homo sapiens
ucuauuugccucaucuaua

SEQ ID NO: 1010598 - RNA, 19 nt, Homo sapiens
cuuagaaacucaucguaca

SEQ ID NO: 1010599 - RNA, 19 nt, Homo sapiens
uuucugcccuuuguaaauu

SEQ ID NO: 1010600 - RNA, 19 nt, Homo sapiens
ggguagcccuguucaagag

SEQ ID NO: 1010601 - RNA, 19 nt, Homo sapiens
ccacucucaucccuccuuu

SEQ ID NO: 1010602 - RNA, 19 nt, Homo sapiens
gcaauuucugcccuuugua

SEQ ID NO: 1010603 - RNA, 19 nt, Homo sapiens
gcucacaugcccacccauu

SEQ ID NO: 1010604 - RNA, 19 nt, Homo sapiens
gaagagcacccggcugucu

SEQ ID NO: 1010605 - RNA, 19 nt, Homo sapiens
gcuaacaagcaccuaacaa

SEQ ID NO: 1010606 - RNA, 19 nt, Homo sapiens
agaaaccugcuuugucauu

SEQ ID NO: 1010607 - RNA, 19 nt, Homo sapiens
ugccauagccugagagugu

SEQ ID NO: 1010608 - RNA, 19 nt, Homo sapiens
acggguaccuauuuauaug

SEQ ID NO: 1010609 - RNA, 19 nt, Homo sapiens
ggugacaucgucucucuca

SEQ ID NO: 1010610 - RNA, 19 nt, Homo sapiens
uuaagaaaccugcuuuguc

SEQ ID NO: 1010611 - RNA, 19 nt, Homo sapiens
ggaagagaggagcacagaa

SEQ ID NO: 1010612 - RNA, 19 nt, Homo sapiens
ggacucuugagcuuagaaa

SEQ ID NO: 1010613 - RNA, 19 nt, Homo sapiens
ccagcgagucugacaguga

SEQ ID NO: 1010614 - RNA, 19 nt, Homo sapiens
cuaacaagcaccuaacaag

SEQ ID NO: 1010615 - RNA, 19 nt, Homo sapiens
auaacacugcuuucucaua

SEQ ID NO: 1010616 - RNA, 19 nt, Homo sapiens
gagcaauuucugcccuuug

SEQ ID NO: 1010617 - RNA, 19 nt, Homo sapiens
gauauuuccaggcuuacga

SEQ ID NO: 1010618 - RNA, 19 nt, Homo sapiens
uagcaucagauauuugaga

SEQ ID NO: 1010619 - RNA, 19 nt, Homo sapiens
gccaaggcuucauacucaa

SEQ ID NO: 1010620 - RNA, 19 nt, Homo sapiens
guggugacaucgucucucu

SEQ ID NO: 1010621 - RNA, 19 nt, Homo sapiens
agaaacucaucguacacuu

SEQ ID NO: 1010622 - RNA, 19 nt, Homo sapiens
gagcuagaugaagccauua

SEQ ID NO: 1010623 - RNA, 19 nt, Homo sapiens
uaacaugaagugcuagcau

SEQ ID NO: 1010624 - RNA, 19 nt, Homo sapiens
gcucagcuaagagugcuuu

SEQ ID NO: 1010625 - RNA, 19 nt, Homo sapiens
ugaccgccaaggcuucaua

SEQ ID NO: 1010626 - RNA, 19 nt, Homo sapiens
ucacaugcccacccauuac

SEQ ID NO: 1010627 - RNA, 19 nt, Homo sapiens
agaaagaaaccagcaugug

SEQ ID NO: 1010628 - RNA, 19 nt, Homo sapiens
augaagugcuagcaucaga

SEQ ID NO: 1010629 - RNA, 19 nt, Homo sapiens
gcuucauacucaaggaugu

SEQ ID NO: 1010630 - RNA, 19 nt, Homo sapiens
gcuagaugaagccauuaug

SEQ ID NO: 1010631 - RNA, 19 nt, Homo sapiens
aaaccagcaugugacuuuc

SEQ ID NO: 1010632 - RNA, 19 nt, Homo sapiens
aaaccugcuuugucauuuu

SEQ ID NO: 1010633 - RNA, 19 nt, Homo sapiens
cacggguaccuauuuauau

SEQ ID NO: 1010634 - RNA, 19 nt, Homo sapiens
gaggaagugccugcaggaa

SEQ ID NO: 1010635 - RNA, 19 nt, Homo sapiens
uagaaagaaaccagcaugu

SEQ ID NO: 1010636 - RNA, 19 nt, Homo sapiens
agagcaauuucugcccuuu

SEQ ID NO: 1010637 - RNA, 19 nt, Homo sapiens
ugcagacaguuccaaagga

SEQ ID NO: 1010638 - RNA, 19 nt, Homo sapiens
auucaugacugaggaagug

SEQ ID NO: 1010639 - RNA, 19 nt, Homo sapiens
agcaauuucugcccuuugu

SEQ ID NO: 1010640 - RNA, 19 nt, Homo sapiens
gagcuuagaaacucaucgu

SEQ ID NO: 1010641 - RNA, 19 nt, Homo sapiens
ugacuuuccuagauaacac

SEQ ID NO: 1010642 - RNA, 19 nt, Homo sapiens
caucaggagaccucuguag

SEQ ID NO: 1010643 - RNA, 19 nt, Homo sapiens
gugcagacaguuccaaagg

SEQ ID NO: 1010644 - RNA, 19 nt, Homo sapiens
agugcuagcaucagauauu

SEQ ID NO: 1010645 - RNA, 19 nt, Homo sapiens
aggaagugccugcaggaaa

SEQ ID NO: 1010646 - RNA, 19 nt, Homo sapiens
gcacaaaucuccacugaug

SEQ ID NO: 1010647 - RNA, 19 nt, Homo sapiens
ggaccgaccugaccaaauu

SEQ ID NO: 1010648 - RNA, 19 nt, Homo sapiens
gggaagagauuauagcaaa

SEQ ID NO: 1010649 - RNA, 19 nt, Homo sapiens
ggagugguaugacaaauau

SEQ ID NO: 1010650 - RNA, 19 nt, Homo sapiens
gcaucuuucuggauaauuu

SEQ ID NO: 1010651 - RNA, 19 nt, Homo sapiens
gcgaagaaauggcaucaau

SEQ ID NO: 1010652 - RNA, 19 nt, Homo sapiens
gaucauugcugccacuguu

SEQ ID NO: 1010653 - RNA, 19 nt, Homo sapiens
acacugaucuggagaacaa

SEQ ID NO: 1010654 - RNA, 19 nt, Homo sapiens
ggacacaagcgaagaaaug

SEQ ID NO: 1010655 - RNA, 19 nt, Homo sapiens
ggugaaaguuaaauaagga

SEQ ID NO: 1010656 - RNA, 19 nt, Homo sapiens
ggacgagauucaagcaaga

SEQ ID NO: 1010657 - RNA, 19 nt, Homo sapiens
cuaggcaucuuucuggaua

SEQ ID NO: 1010658 - RNA, 19 nt, Homo sapiens
gaagaaauggcaucaaucu

SEQ ID NO: 1010659 - RNA, 19 nt, Homo sapiens
gcagagcgcaucacuacaa

SEQ ID NO: 1010660 - RNA, 19 nt, Homo sapiens
ggaggugaccguagaaaug

SEQ ID NO: 1010661 - RNA, 19 nt, Homo sapiens
ggaagagauuauagcaaau

SEQ ID NO: 1010662 - RNA, 19 nt, Homo sapiens
gaaauucaaacgcagauca

SEQ ID NO: 1010663 - RNA, 19 nt, Homo sapiens
gaggaggaaaugaagaaua

SEQ ID NO: 1010664 - RNA, 19 nt, Homo sapiens
gaacuuccagaucaacaaa

SEQ ID NO: 1010665 - RNA, 19 nt, Homo sapiens
gcaagguugucucgucuca

SEQ ID NO: 1010666 - RNA, 19 nt, Homo sapiens
gaacgcagaguacaagcaa

SEQ ID NO: 1010667 - RNA, 19 nt, Homo sapiens
ccaaauuacugaaugacau

SEQ ID NO: 1010668 - RNA, 19 nt, Homo sapiens
gcucagcugucagaaauuc

SEQ ID NO: 1010669 - RNA, 19 nt, Homo sapiens
ugaccaaauuacugaauga

SEQ ID NO: 1010670 - RNA, 19 nt, Homo sapiens
aggaggaaaugaagaauau

SEQ ID NO: 1010671 - RNA, 19 nt, Homo sapiens
agaugcagauugagaguuu

SEQ ID NO: 1010672 - RNA, 19 nt, Homo sapiens
gcucugaccuggagaugca

SEQ ID NO: 1010673 - RNA, 19 nt, Homo sapiens
ggaggaggcuaacacugau

SEQ ID NO: 1010674 - RNA, 19 nt, Homo sapiens
aagcacaaaucuccacuga

SEQ ID NO: 1010675 - RNA, 19 nt, Homo sapiens
gaaggacacaagcgaagaa

SEQ ID NO: 1010676 - RNA, 19 nt, Homo sapiens
gcaagacuagagugacuaa

SEQ ID NO: 1010677 - RNA, 19 nt, Homo sapiens
ugacuaagacuaucguaga

SEQ ID NO: 1010678 - RNA, 19 nt, Homo sapiens
gucaucaccucuccuauuc

SEQ ID NO: 1010679 - RNA, 19 nt, Homo sapiens
ucucaagucagcaguauuu

SEQ ID NO: 1010680 - RNA, 19 nt, Homo sapiens
uggcucagcugucagaaau

SEQ ID NO: 1010681 - RNA, 19 nt, Homo sapiens
ugcaagcccuggaaauuga

SEQ ID NO: 1010682 - RNA, 19 nt, Homo sapiens
gaggugaccguagaaauga

SEQ ID NO: 1010683 - RNA, 19 nt, Homo sapiens
agaaauggcaucaaucuag

SEQ ID NO: 1010684 - RNA, 19 nt, Homo sapiens
gguagaaacucaggaucug

SEQ ID NO: 1010685 - RNA, 19 nt, Homo sapiens
ccaagaaugagauaacaga

SEQ ID NO: 1010686 - RNA, 19 nt, Homo sapiens
gcaggagcaccaugucuug

SEQ ID NO: 1010687 - RNA, 19 nt, Homo sapiens
gaccugaccaaauuacuga

SEQ ID NO: 1010688 - RNA, 19 nt, Homo sapiens
ggaaaugaagaauaugcaa

SEQ ID NO: 1010689 - RNA, 19 nt, Homo sapiens
cuacguggcucagcuguca

SEQ ID NO: 1010690 - RNA, 19 nt, Homo sapiens
gaagaaccacgaggaggaa

SEQ ID NO: 1010691 - RNA, 19 nt, Homo sapiens
ucugguaucuggugacuca

SEQ ID NO: 1010692 - RNA, 19 nt, Homo sapiens
uagccuaccugaggaagaa

SEQ ID NO: 1010693 - RNA, 19 nt, Homo sapiens
cguggaggcugacaucaau

SEQ ID NO: 1010694 - RNA, 19 nt, Homo sapiens
aagcuucaguccagaaaug

SEQ ID NO: 1010695 - RNA, 19 nt, Homo sapiens
agaaugagauaacagaacu

SEQ ID NO: 1010696 - RNA, 19 nt, Homo sapiens
gguaucuggugacucaaga

SEQ ID NO: 1010697 - RNA, 19 nt, Homo sapiens
cucaggaucuguaaacaug

SEQ ID NO: 1010698 - RNA, 19 nt, Homo sapiens
guugguggauggcaagguu

SEQ ID NO: 1010699 - RNA, 19 nt, Homo sapiens
uagaaacucaggaucugua

SEQ ID NO: 1010700 - RNA, 19 nt, Homo sapiens
gaaccacgaggaggaaaug

SEQ ID NO: 1010701 - RNA, 19 nt, Homo sapiens
ggaggugguucuaguuuug

SEQ ID NO: 1010702 - RNA, 19 nt, Homo sapiens
uuugguagcugcucaguag

SEQ ID NO: 1010703 - RNA, 19 nt, Homo sapiens
ucaauggccugcggaaagu

SEQ ID NO: 1010704 - RNA, 19 nt, Homo sapiens
cagauuggcugcugaugac

SEQ ID NO: 1010705 - RNA, 19 nt, Homo sapiens
ccagauuggcugcugauga

SEQ ID NO: 1010706 - RNA, 19 nt, Homo sapiens
caaggagugguaugacaaa

SEQ ID NO: 1010707 - RNA, 19 nt, Homo sapiens
gaaacucaggaucuguaaa

SEQ ID NO: 1010708 - RNA, 19 nt, Homo sapiens
caagucagcaguauuucug

SEQ ID NO: 1010709 - RNA, 19 nt, Homo sapiens
caaauuacugaaugacaug

SEQ ID NO: 1010710 - RNA, 19 nt, Homo sapiens
cgucaucaccucuccuauu

SEQ ID NO: 1010711 - RNA, 19 nt, Homo sapiens
agaaugcucuugaaauagc

SEQ ID NO: 1010712 - RNA, 19 nt, Homo sapiens
ggagagggaggugguucua

SEQ ID NO: 1010713 - RNA, 19 nt, Homo sapiens
uggaggaggcuaacacuga

SEQ ID NO: 1010714 - RNA, 19 nt, Homo sapiens
gcaucaaucuaggcaucuu

SEQ ID NO: 1010715 - RNA, 19 nt, Homo sapiens
gacuaagacuaucguagag

SEQ ID NO: 1010716 - RNA, 19 nt, Homo sapiens
gaccgaccugaccaaauua

SEQ ID NO: 1010717 - RNA, 19 nt, Homo sapiens
aaugaccgcuuggccaauu

SEQ ID NO: 1010718 - RNA, 19 nt, Homo sapiens
gaggugaaaguuaaauaag

SEQ ID NO: 1010719 - RNA, 19 nt, Homo sapiens
gagauucaagcaagacuag

SEQ ID NO: 1010720 - RNA, 19 nt, Homo sapiens
agagggaggugguucuagu

SEQ ID NO: 1010721 - RNA, 19 nt, Homo sapiens
caagaaugagauaacagaa

SEQ ID NO: 1010722 - RNA, 19 nt, Homo sapiens
uggacaagcucauguuugc

SEQ ID NO: 1010723 - RNA, 19 nt, Homo sapiens
ugugggaguucuagauuca

SEQ ID NO: 1010724 - RNA, 19 nt, Homo sapiens
cuucuuauuuccucauuag

SEQ ID NO: 1010725 - RNA, 19 nt, Homo sapiens
cagcuaugguggugguaug

SEQ ID NO: 1010726 - RNA, 19 nt, Homo sapiens
aagcuguucuggucaagga

SEQ ID NO: 1010727 - RNA, 19 nt, Homo sapiens
gaaugagauaacagaacua

SEQ ID NO: 1010728 - RNA, 19 nt, Homo sapiens
gagcgcaucacuacaagca

SEQ ID NO: 1010729 - RNA, 19 nt, Homo sapiens
cuggaugaccugacuauga

SEQ ID NO: 1010730 - RNA, 19 nt, Homo sapiens
ccaugcagaaccucaauga

SEQ ID NO: 1010731 - RNA, 19 nt, Homo sapiens
ggaggcuucuacagcuaug

SEQ ID NO: 1010732 - RNA, 19 nt, Homo sapiens
cuagagugacuaagacuau

SEQ ID NO: 1010733 - RNA, 19 nt, Homo sapiens
ucaagcaagacuagaguga

SEQ ID NO: 1010734 - RNA, 19 nt, Homo sapiens
gaacccuggcugacacaga

SEQ ID NO: 1010735 - RNA, 19 nt, Homo sapiens
aacccuggcugacacagaa

SEQ ID NO: 1010736 - RNA, 19 nt, Homo sapiens
aagcagagcgcaucacuac

SEQ ID NO: 1010737 - RNA, 19 nt, Homo sapiens
caacaagcagagcgcauca

SEQ ID NO: 1010738 - RNA, 19 nt, Homo sapiens
ggucaaggacgagauucaa

SEQ ID NO: 1010739 - RNA, 19 nt, Homo sapiens
gaucgggaagagauuauag

SEQ ID NO: 1010740 - RNA, 19 nt, Homo sapiens
ccgcuuggccaauuaccua

SEQ ID NO: 1010741 - RNA, 19 nt, Homo sapiens
agacuagagugacuaagac

SEQ ID NO: 1010742 - RNA, 19 nt, Homo sapiens
agaauuuggugguagaaac

SEQ ID NO: 1010743 - RNA, 19 nt, Homo sapiens
gagggaggugguucuaguu

SEQ ID NO: 1010744 - RNA, 19 nt, Homo sapiens
gaggaaaugaagaauaugc

SEQ ID NO: 1010745 - RNA, 19 nt, Homo sapiens
ggaucgggaagagauuaua

SEQ ID NO: 1010746 - RNA, 19 nt, Homo sapiens
agacaaagguucagaauua

SEQ ID NO: 1010747 - RNA, 19 nt, Homo sapiens
ggaagaagaugcucggaaa

SEQ ID NO: 1010748 - RNA, 19 nt, Homo sapiens
caaguaagguaguuuguuu

SEQ ID NO: 1010749 - RNA, 19 nt, Homo sapiens
uaagaagccuaaccaauuu

SEQ ID NO: 1010750 - RNA, 19 nt, Homo sapiens
gaacaagauuccugugcua

SEQ ID NO: 1010751 - RNA, 19 nt, Homo sapiens
ccaagaagaugcuuuguug

SEQ ID NO: 1010752 - RNA, 19 nt, Homo sapiens
gcacagaguaauucaauaa

SEQ ID NO: 1010753 - RNA, 19 nt, Homo sapiens
agaagggcaucuugaauua

SEQ ID NO: 1010754 - RNA, 19 nt, Homo sapiens
ugaagaaccuuuagccaaa

SEQ ID NO: 1010755 - RNA, 19 nt, Homo sapiens
gaaagcaucugugugguau

SEQ ID NO: 1010756 - RNA, 19 nt, Homo sapiens
gaagaugcuuuguugaguu

SEQ ID NO: 1010757 - RNA, 19 nt, Homo sapiens
gcacaaacaauaaguaugu

SEQ ID NO: 1010758 - RNA, 19 nt, Homo sapiens
ccacaaagaggcaagauaa

SEQ ID NO: 1010759 - RNA, 19 nt, Homo sapiens
caaaugagauaacacaagu

SEQ ID NO: 1010760 - RNA, 19 nt, Homo sapiens
gguaguaacucgugaaucu

SEQ ID NO: 1010761 - RNA, 19 nt, Homo sapiens
ggagauugguaaaguaguu

SEQ ID NO: 1010762 - RNA, 19 nt, Homo sapiens
caacagaucuugcauuacg

SEQ ID NO: 1010763 - RNA, 19 nt, Homo sapiens
gcccagaaauaaacaauau

SEQ ID NO: 1010764 - RNA, 19 nt, Homo sapiens
uuggaaaccucaaauagua

SEQ ID NO: 1010765 - RNA, 19 nt, Homo sapiens
gaucuugcauuacgauguu

SEQ ID NO: 1010766 - RNA, 19 nt, Homo sapiens
agaaacaacugcuuaaugg

SEQ ID NO: 1010767 - RNA, 19 nt, Homo sapiens
gauacagaaucacagauga

SEQ ID NO: 1010768 - RNA, 19 nt, Homo sapiens
ccaaacgcauaaagaauga

SEQ ID NO: 1010769 - RNA, 19 nt, Homo sapiens
cuuaagagaugaaacagaa

SEQ ID NO: 1010770 - RNA, 19 nt, Homo sapiens
aaauguaacucaagagaga

SEQ ID NO: 1010771 - RNA, 19 nt, Homo sapiens
caauaaguauguucucuuc

SEQ ID NO: 1010772 - RNA, 19 nt, Homo sapiens
gaagagcuguuuucaaaga

SEQ ID NO: 1010773 - RNA, 19 nt, Homo sapiens
ggaaagcaucuguguggua

SEQ ID NO: 1010774 - RNA, 19 nt, Homo sapiens
aagggcaucuugaauuaua

SEQ ID NO: 1010775 - RNA, 19 nt, Homo sapiens
cuucagaaauccaaacauu

SEQ ID NO: 1010776 - RNA, 19 nt, Homo sapiens
gauggaggauacagaauca

SEQ ID NO: 1010777 - RNA, 19 nt, Homo sapiens
aaacagaaauaccugaaca

SEQ ID NO: 1010778 - RNA, 19 nt, Homo sapiens
ucucauauaucuugucaga

SEQ ID NO: 1010779 - RNA, 19 nt, Homo sapiens
caagauuccugugcuaaga

SEQ ID NO: 1010780 - RNA, 19 nt, Homo sapiens
caugcuaccuaaucucuuu

SEQ ID NO: 1010781 - RNA, 19 nt, Homo sapiens
auaagaagccuaaccaauu

SEQ ID NO: 1010782 - RNA, 19 nt, Homo sapiens
gcagacaauucagagauau

SEQ ID NO: 1010783 - RNA, 19 nt, Homo sapiens
caaagaggcaagauaauca

SEQ ID NO: 1010784 - RNA, 19 nt, Homo sapiens
ggguugauauugccuuaaa

SEQ ID NO: 1010785 - RNA, 19 nt, Homo sapiens
aaacagcaggcuucuauuu

SEQ ID NO: 1010786 - RNA, 19 nt, Homo sapiens
gggccaaucugagaauuug

SEQ ID NO: 1010787 - RNA, 19 nt, Homo sapiens
aaauagggcaucuuuguaa

SEQ ID NO: 1010788 - RNA, 19 nt, Homo sapiens
ggaaaggaaugaagaaccu

SEQ ID NO: 1010789 - RNA, 19 nt, Homo sapiens
gauucaagguggauggaaa

SEQ ID NO: 1010790 - RNA, 19 nt, Homo sapiens
ggcuugaauucuacacuua

SEQ ID NO: 1010791 - RNA, 19 nt, Homo sapiens
aauaauaccuaccucacaa

SEQ ID NO: 1010792 - RNA, 19 nt, Homo sapiens
ggaugaugaugauaacaau

SEQ ID NO: 1010793 - RNA, 19 nt, Homo sapiens
ucaaauaguaccacaaaga

SEQ ID NO: 1010794 - RNA, 19 nt, Homo sapiens
ugaaacagcaggcuucuau

SEQ ID NO: 1010795 - RNA, 19 nt, Homo sapiens
caaagguucagaauuacua

SEQ ID NO: 1010796 - RNA, 19 nt, Homo sapiens
gauuagcuaucucauaucu

SEQ ID NO: 1010797 - RNA, 19 nt, Homo sapiens
gaggcaagauaaucagaau

SEQ ID NO: 1010798 - RNA, 19 nt, Homo sapiens
caaccaagcaccugaaaca

SEQ ID NO: 1010799 - RNA, 19 nt, Homo sapiens
agugaaggcuugaauucua

SEQ ID NO: 1010800 - RNA, 19 nt, Homo sapiens
gaugguacauuugccaaga

SEQ ID NO: 1010801 - RNA, 19 nt, Homo sapiens
acucaugacugguuucuau

SEQ ID NO: 1010802 - RNA, 19 nt, Homo sapiens
guuaacugcuuuaccaaau

SEQ ID NO: 1010803 - RNA, 19 nt, Homo sapiens
ggcaagauaaucagaauga

SEQ ID NO: 1010804 - RNA, 19 nt, Homo sapiens
uaacugcuuuaccaaauca

SEQ ID NO: 1010805 - RNA, 19 nt, Homo sapiens
gcaauacuaauuuguguca

SEQ ID NO: 1010806 - RNA, 19 nt, Homo sapiens
caagggaaccuaaaugaag

SEQ ID NO: 1010807 - RNA, 19 nt, Homo sapiens
uagaagggcaucuugaauu

SEQ ID NO: 1010808 - RNA, 19 nt, Homo sapiens
gaaauccaaacauuagaga

SEQ ID NO: 1010809 - RNA, 19 nt, Homo sapiens
gaaaauagggcaucuuugu

SEQ ID NO: 1010810 - RNA, 19 nt, Homo sapiens
ugauggcgcugauuguuug

SEQ ID NO: 1010811 - RNA, 19 nt, Homo sapiens
gauauugccuuaaaagaug

SEQ ID NO: 1010812 - RNA, 19 nt, Homo sapiens
ucauauaucuugucagacu

SEQ ID NO: 1010813 - RNA, 19 nt, Homo sapiens
guaacaagggccaaucuga

SEQ ID NO: 1010814 - RNA, 19 nt, Homo sapiens
gcguauuucuguuuguauu

SEQ ID NO: 1010815 - RNA, 19 nt, Homo sapiens
caacacauaauuagcguau

SEQ ID NO: 1010816 - RNA, 19 nt, Homo sapiens
aaacaacugcuuaauggaa

SEQ ID NO: 1010817 - RNA, 19 nt, Homo sapiens
gggauucaguccugcuuug

SEQ ID NO: 1010818 - RNA, 19 nt, Homo sapiens
uauguaggcacaaacaaua

SEQ ID NO: 1010819 - RNA, 19 nt, Homo sapiens
gaucuggaaagcacaauug

SEQ ID NO: 1010820 - RNA, 19 nt, Homo sapiens
caagagguagugauugauu

SEQ ID NO: 1010821 - RNA, 19 nt, Homo sapiens
uagggcaucuuuguaaauu

SEQ ID NO: 1010822 - RNA, 19 nt, Homo sapiens
ucagaaugaugauagugaa

SEQ ID NO: 1010823 - RNA, 19 nt, Homo sapiens
cagaaauaccugaacaauu

SEQ ID NO: 1010824 - RNA, 19 nt, Homo sapiens
ggacuguuauucucuucug

SEQ ID NO: 1010825 - RNA, 19 nt, Homo sapiens
ggccuuauuuaacucauga

SEQ ID NO: 1010826 - RNA, 19 nt, Homo sapiens
cacaguauaugaagaucaa

SEQ ID NO: 1010827 - RNA, 19 nt, Homo sapiens
uauggagauugguaaagua

SEQ ID NO: 1010828 - RNA, 19 nt, Homo sapiens
ggaaaacacagaaagaaaa

SEQ ID NO: 1010829 - RNA, 19 nt, Homo sapiens
uaugucccauccagcauua

SEQ ID NO: 1010830 - RNA, 19 nt, Homo sapiens
agauauuaaugcaggcuua

SEQ ID NO: 1010831 - RNA, 19 nt, Homo sapiens
gaucaacuagcaaagcauu

SEQ ID NO: 1010832 - RNA, 19 nt, Homo sapiens
guuauucucuucugcaucu

SEQ ID NO: 1010833 - RNA, 19 nt, Homo sapiens
cagaaacaacugcuuaaug

SEQ ID NO: 1010834 - RNA, 19 nt, Homo sapiens
gaugauggaggauacagaa

SEQ ID NO: 1010835 - RNA, 19 nt, Homo sapiens
uccuguaguucuaugauua

SEQ ID NO: 1010836 - RNA, 19 nt, Homo sapiens
aguauguucucuucuguuu

SEQ ID NO: 1010837 - RNA, 19 nt, Homo sapiens
ucagaaauccaaacauuag

SEQ ID NO: 1010838 - RNA, 19 nt, Homo sapiens
caccagaaacaacugcuua

SEQ ID NO: 1010839 - RNA, 19 nt, Homo sapiens
ugaagagcaugaugaugga

SEQ ID NO: 1010840 - RNA, 19 nt, Homo sapiens
gccaaacgcauaaagaaug

SEQ ID NO: 1010841 - RNA, 19 nt, Homo sapiens
aagaugcuuuguugaguuu

SEQ ID NO: 1010842 - RNA, 19 nt, Homo sapiens
gucaagcaauacuaauuug

SEQ ID NO: 1010843 - RNA, 19 nt, Homo sapiens
uagcguauuucuguuugua

SEQ ID NO: 1010844 - RNA, 19 nt, Homo sapiens
ggauacagaaucacagaug

SEQ ID NO: 1010845 - RNA, 19 nt, Homo sapiens
guuccaauuucuucucuau

SEQ ID NO: 1010846 - RNA, 19 nt, Homo sapiens
ggagcuagaugaagaagga

SEQ ID NO: 1010847 - RNA, 19 nt, Homo sapiens
gcuuaaggauguaaagauu

SEQ ID NO: 1010848 - RNA, 19 nt, Homo sapiens
gagcuucucuucucuccaa

SEQ ID NO: 1010849 - RNA, 19 nt, Homo sapiens
cauguuagcuguguagauu

SEQ ID NO: 1010850 - RNA, 19 nt, Homo sapiens
guaaaacucuggucuugua

SEQ ID NO: 1010851 - RNA, 19 nt, Homo sapiens
gaagaggccuugaauuucc

SEQ ID NO: 1010852 - RNA, 19 nt, Homo sapiens
aagauuagcgugagcuuua

SEQ ID NO: 1010853 - RNA, 19 nt, Homo sapiens
uaagaaggaugaggagaau

SEQ ID NO: 1010854 - RNA, 19 nt, Homo sapiens
ucuaaaagcugucuacauu

SEQ ID NO: 1010855 - RNA, 19 nt, Homo sapiens
ucgaugaguuagaagauuu

SEQ ID NO: 1010856 - RNA, 19 nt, Homo sapiens
uguuagcuguguagauuua

SEQ ID NO: 1010857 - RNA, 19 nt, Homo sapiens
gagacagaguggaugaaga

SEQ ID NO: 1010858 - RNA, 19 nt, Homo sapiens
acucuggucuuguaaacua

SEQ ID NO: 1010859 - RNA, 19 nt, Homo sapiens
cuacggagcuucucuucuc

SEQ ID NO: 1010860 - RNA, 19 nt, Homo sapiens
ugagagugcugauaagaag

SEQ ID NO: 1010861 - RNA, 19 nt, Homo sapiens
accgagagcugcaggagua

SEQ ID NO: 1010862 - RNA, 19 nt, Homo sapiens
uaagcugagugcauuguga

SEQ ID NO: 1010863 - RNA, 19 nt, Homo sapiens
aaagcugucuacauuaaug

SEQ ID NO: 1010864 - RNA, 19 nt, Homo sapiens
ccgaugaugaccaagauua

SEQ ID NO: 1010865 - RNA, 19 nt, Homo sapiens
augaagaggccuugaauuu

SEQ ID NO: 1010866 - RNA, 19 nt, Homo sapiens
gaugaugaccaagauuaaa

SEQ ID NO: 1010867 - RNA, 19 nt, Homo sapiens
gaagacagacucgcuuagu

SEQ ID NO: 1010868 - RNA, 19 nt, Homo sapiens
gaugaagaggccuugaauu

SEQ ID NO: 1010869 - RNA, 19 nt, Homo sapiens
guucacggcuaaagcaauc

SEQ ID NO: 1010870 - RNA, 19 nt, Homo sapiens
agaaggaugaggagaauga

SEQ ID NO: 1010871 - RNA, 19 nt, Homo sapiens
guccaguggugcagaggua

SEQ ID NO: 1010872 - RNA, 19 nt, Homo sapiens
cuuagucgccagucacuua

SEQ ID NO: 1010873 - RNA, 19 nt, Homo sapiens
ggaugaagaggccuugaau

SEQ ID NO: 1010874 - RNA, 19 nt, Homo sapiens
ccuguucuguaaucgauaa

SEQ ID NO: 1010875 - RNA, 19 nt, Homo sapiens
uggaugcucugcuggaaga

SEQ ID NO: 1010876 - RNA, 19 nt, Homo sapiens
ugaagaggccuugaauuuc

SEQ ID NO: 1010877 - RNA, 19 nt, Homo sapiens
gugcaugcuugucccuuug

SEQ ID NO: 1010878 - RNA, 19 nt, Homo sapiens
ucauagacccgaacuguag

SEQ ID NO: 1010879 - RNA, 19 nt, Homo sapiens
ggaugacuuugacaacgau

SEQ ID NO: 1010880 - RNA, 19 nt, Homo sapiens
uaaagcaaucguucagaga

SEQ ID NO: 1010881 - RNA, 19 nt, Homo sapiens
ucagcggacuugugcaugu

SEQ ID NO: 1010882 - RNA, 19 nt, Homo sapiens
cgaugaugaccaagauuaa

SEQ ID NO: 1010883 - RNA, 19 nt, Homo sapiens
gugcugauaagaaggauga

SEQ ID NO: 1010884 - RNA, 19 nt, Homo sapiens
gcugagugcauugugauuu

SEQ ID NO: 1010885 - RNA, 19 nt, Homo sapiens
ucucuucucuccaaaggau

SEQ ID NO: 1010886 - RNA, 19 nt, Homo sapiens
caauuuggagcuagaugaa

SEQ ID NO: 1010887 - RNA, 19 nt, Homo sapiens
aagcaaucguucagagaga

SEQ ID NO: 1010888 - RNA, 19 nt, Homo sapiens
aguaugcagugcucgauga

SEQ ID NO: 1010889 - RNA, 19 nt, Homo sapiens
gugagagugcugauaagaa

SEQ ID NO: 1010890 - RNA, 19 nt, Homo sapiens
gcaggaguaaggacaggaa

SEQ ID NO: 1010891 - RNA, 19 nt, Homo sapiens
aaacucuggucuuguaaac

SEQ ID NO: 1010892 - RNA, 19 nt, Homo sapiens
cgugcaugcuugucccuuu

SEQ ID NO: 1010893 - RNA, 19 nt, Homo sapiens
gaaaagagaguggaguaug

SEQ ID NO: 1010894 - RNA, 19 nt, Homo sapiens
cuacgaggaugacuuugac

SEQ ID NO: 1010895 - RNA, 19 nt, Homo sapiens
augcagugcucgaugaguu

SEQ ID NO: 1010896 - RNA, 19 nt, Homo sapiens
auaagaaggaugaggagaa

SEQ ID NO: 1010897 - RNA, 19 nt, Homo sapiens
gcuggaagaaggccuuugu

SEQ ID NO: 1010898 - RNA, 19 nt, Homo sapiens
ucagagagacagaguggau

SEQ ID NO: 1010899 - RNA, 19 nt, Homo sapiens
cugagugcauugugauuuc

SEQ ID NO: 1010900 - RNA, 19 nt, Homo sapiens
ggugagagugcugauaaga

SEQ ID NO: 1010901 - RNA, 19 nt, Homo sapiens
cagcggacuugugcauguu

SEQ ID NO: 1010902 - RNA, 19 nt, Homo sapiens
cgauaaaccccgaucaaaa

SEQ ID NO: 1010903 - RNA, 19 nt, Homo sapiens
caccugcgguccggaaguu

SEQ ID NO: 1010904 - RNA, 19 nt, Homo sapiens
cuuguaaacuagucuuaag

SEQ ID NO: 1010905 - RNA, 19 nt, Homo sapiens
ugaccaagauuaaaacagu

SEQ ID NO: 1010906 - RNA, 19 nt, Homo sapiens
caggcggguucacggcuaa

SEQ ID NO: 1010907 - RNA, 19 nt, Homo sapiens
ggaguaaggacaggaaggu

SEQ ID NO: 1010908 - RNA, 19 nt, Homo sapiens
ugacaacgauguggaugcu

SEQ ID NO: 1010909 - RNA, 19 nt, Homo sapiens
ccuacgaggaugacuuuga

SEQ ID NO: 1010910 - RNA, 19 nt, Homo sapiens
acaauuuggagcuagauga

SEQ ID NO: 1010911 - RNA, 19 nt, Homo sapiens
gaaugagcuggaucaggaa

SEQ ID NO: 1010912 - RNA, 19 nt, Homo sapiens
gagugcggucugcuccuua

SEQ ID NO: 1010913 - RNA, 19 nt, Homo sapiens
ccucauagacccgaacugu

SEQ ID NO: 1010914 - RNA, 19 nt, Homo sapiens
caacuucuacggagcuucu

SEQ ID NO: 1010915 - RNA, 19 nt, Homo sapiens
agagcaauguggccagcuu

SEQ ID NO: 1010916 - RNA, 19 nt, Homo sapiens
cgccucagguagaagaaga

SEQ ID NO: 1010917 - RNA, 19 nt, Homo sapiens
ucagguagaagaagaaagg

SEQ ID NO: 1010918 - RNA, 19 nt, Homo sapiens
caggagaagcggugaugga

SEQ ID NO: 1010919 - RNA, 19 nt, Homo sapiens
agacagaguggaugaagag

SEQ ID NO: 1010920 - RNA, 19 nt, Homo sapiens
agagagacagaguggauga

SEQ ID NO: 1010921 - RNA, 19 nt, Homo sapiens
aggaugacuuugacaacga

SEQ ID NO: 1010922 - RNA, 19 nt, Homo sapiens
gcuaaagcaaucguucaga

SEQ ID NO: 1010923 - RNA, 19 nt, Homo sapiens
auuuggagcuagaugaaga

SEQ ID NO: 1010924 - RNA, 19 nt, Homo sapiens
uugaggcagugguucuaaa

SEQ ID NO: 1010925 - RNA, 19 nt, Homo sapiens
gaaguucuccccugaccuu

SEQ ID NO: 1010926 - RNA, 19 nt, Homo sapiens
caagugugcagccgaugau

SEQ ID NO: 1010927 - RNA, 19 nt, Homo sapiens
gcucgaugaguuagaagau

SEQ ID NO: 1010928 - RNA, 19 nt, Homo sapiens
gcugucuacauuaaugaaa

SEQ ID NO: 1010929 - RNA, 19 nt, Homo sapiens
uuaaaacagugcucaaaag

SEQ ID NO: 1010930 - RNA, 19 nt, Homo sapiens
gcauguuagcuguguagau

SEQ ID NO: 1010931 - RNA, 19 nt, Homo sapiens
gggugagagugcugauaag

SEQ ID NO: 1010932 - RNA, 19 nt, Homo sapiens
cuaaaagcugucuacauua

SEQ ID NO: 1010933 - RNA, 19 nt, Homo sapiens
gaauaaaccagaugccuua

SEQ ID NO: 1010934 - RNA, 19 nt, Homo sapiens
guacagaccugcugaaugc

SEQ ID NO: 1010935 - RNA, 19 nt, Homo sapiens
gaaagagcuuguucagaga

SEQ ID NO: 1010936 - RNA, 19 nt, Homo sapiens
gaauacagccauuggauga

SEQ ID NO: 1010937 - RNA, 19 nt, Homo sapiens
gaaauauucuguggcaaug

SEQ ID NO: 1010938 - RNA, 19 nt, Homo sapiens
uaacauugcucacaugaag

SEQ ID NO: 1010939 - RNA, 19 nt, Homo sapiens
gcagaaagggccaacguaa

SEQ ID NO: 1010940 - RNA, 19 nt, Homo sapiens
gaagaagugggaucaguuu

SEQ ID NO: 1010941 - RNA, 19 nt, Homo sapiens
ggaugaauaugaagacaau

SEQ ID NO: 1010942 - RNA, 19 nt, Homo sapiens
cuaaggaaauggaggaauu

SEQ ID NO: 1010943 - RNA, 19 nt, Homo sapiens
ugauacaucucgguuguua

SEQ ID NO: 1010944 - RNA, 19 nt, Homo sapiens
cuacaagagucaagauuug

SEQ ID NO: 1010945 - RNA, 19 nt, Homo sapiens
guuaagagauggucagaca

SEQ ID NO: 1010946 - RNA, 19 nt, Homo sapiens
ugaagacaauccugaaaga

SEQ ID NO: 1010947 - RNA, 19 nt, Homo sapiens
gguaggcauuccauuguuu

SEQ ID NO: 1010948 - RNA, 19 nt, Homo sapiens
ccaaaugugugauaugaag

SEQ ID NO: 1010949 - RNA, 19 nt, Homo sapiens
caucucgguuguuacuuua

SEQ ID NO: 1010950 - RNA, 19 nt, Homo sapiens
gagauuugaugggaauaaa

SEQ ID NO: 1010951 - RNA, 19 nt, Homo sapiens
caagaaauccugugggaau

SEQ ID NO: 1010952 - RNA, 19 nt, Homo sapiens
gaagacccacuaccuuauu

SEQ ID NO: 1010953 - RNA, 19 nt, Homo sapiens
gugggaauuucaugacaua

SEQ ID NO: 1010954 - RNA, 19 nt, Homo sapiens
gccauuggaugaauaugaa

SEQ ID NO: 1010955 - RNA, 19 nt, Homo sapiens
agaaagggccaacguaauu

SEQ ID NO: 1010956 - RNA, 19 nt, Homo sapiens
caagggagcagcuguuaga

SEQ ID NO: 1010957 - RNA, 19 nt, Homo sapiens
uaacauaccguuuguguac

SEQ ID NO: 1010958 - RNA, 19 nt, Homo sapiens
caacaugaucaaccaguaa

SEQ ID NO: 1010959 - RNA, 19 nt, Homo sapiens
ucaauuuccucauccauuc

SEQ ID NO: 1010960 - RNA, 19 nt, Homo sapiens
cagguaaugguuagaaaua

SEQ ID NO: 1010961 - RNA, 19 nt, Homo sapiens
ccagauagauggguugaca

SEQ ID NO: 1010962 - RNA, 19 nt, Homo sapiens
ggauugaauuugugaugug

SEQ ID NO: 1010963 - RNA, 19 nt, Homo sapiens
cgagcagucuucuggauug

SEQ ID NO: 1010964 - RNA, 19 nt, Homo sapiens
ucaacaugaucaaccagua

SEQ ID NO: 1010965 - RNA, 19 nt, Homo sapiens
gcugauacaucucgguugu

SEQ ID NO: 1010966 - RNA, 19 nt, Homo sapiens
guacuggcaucuucagcuu

SEQ ID NO: 1010967 - RNA, 19 nt, Homo sapiens
uaagagauggucagacauu

SEQ ID NO: 1010968 - RNA, 19 nt, Homo sapiens
gcagucuucuggauugaau

SEQ ID NO: 1010969 - RNA, 19 nt, Homo sapiens
gaaagggccaacguaauug

SEQ ID NO: 1010970 - RNA, 19 nt, Homo sapiens
ggaagacccacuaccuuau

SEQ ID NO: 1010971 - RNA, 19 nt, Homo sapiens
gaagaaaacacuagggaaa

SEQ ID NO: 1010972 - RNA, 19 nt, Homo sapiens
ccagaugccuuaggucuca

SEQ ID NO: 1010973 - RNA, 19 nt, Homo sapiens
uaaaccagaugccuuaggu

SEQ ID NO: 1010974 - RNA, 19 nt, Homo sapiens
agagauuaguuaugucuga

SEQ ID NO: 1010975 - RNA, 19 nt, Homo sapiens
ugacuguacuggcaucuuc

SEQ ID NO: 1010976 - RNA, 19 nt, Homo sapiens
gccaaacaccuucgaguug

SEQ ID NO: 1010977 - RNA, 19 nt, Homo sapiens
gauaacauugcucacauga

SEQ ID NO: 1010978 - RNA, 19 nt, Homo sapiens
ggggaaagcugacauaugg

SEQ ID NO: 1010979 - RNA, 19 nt, Homo sapiens
ucuggaaguuugcuagaaa

SEQ ID NO: 1010980 - RNA, 19 nt, Homo sapiens
gggaauuucaugacauauu

SEQ ID NO: 1010981 - RNA, 19 nt, Homo sapiens
uguggcaacugugauauuu

SEQ ID NO: 1010982 - RNA, 19 nt, Homo sapiens
cuacuuaacauaccguuug

SEQ ID NO: 1010983 - RNA, 19 nt, Homo sapiens
ggagauuugaugggaauaa

SEQ ID NO: 1010984 - RNA, 19 nt, Homo sapiens
ccucauccauucuuaccaa

SEQ ID NO: 1010985 - RNA, 19 nt, Homo sapiens
cccacuaccuuauuugaga

SEQ ID NO: 1010986 - RNA, 19 nt, Homo sapiens
aggaagacccacuaccuua

SEQ ID NO: 1010987 - RNA, 19 nt, Homo sapiens
caugaucuaugugcuuuau

SEQ ID NO: 1010988 - RNA, 19 nt, Homo sapiens
cuguaaagauguaguuuca

SEQ ID NO: 1010989 - RNA, 19 nt, Homo sapiens
acaucucgguuguuacuuu

SEQ ID NO: 1010990 - RNA, 19 nt, Homo sapiens
aauauucuguggcaaugaa

SEQ ID NO: 1010991 - RNA, 19 nt, Homo sapiens
ggguugacaucaguuuauu

SEQ ID NO: 1010992 - RNA, 19 nt, Homo sapiens
gaaaagggaagaagggaaa

SEQ ID NO: 1010993 - RNA, 19 nt, Homo sapiens
uggcaacugugauauuugu

SEQ ID NO: 1010994 - RNA, 19 nt, Homo sapiens
gagcagucuucuggauuga

SEQ ID NO: 1010995 - RNA, 19 nt, Homo sapiens
uaacaugacagcagaaagg

SEQ ID NO: 1010996 - RNA, 19 nt, Homo sapiens
ugcaacagguuaagagaug

SEQ ID NO: 1010997 - RNA, 19 nt, Homo sapiens
guaccacucuuuggaugug

SEQ ID NO: 1010998 - RNA, 19 nt, Homo sapiens
ucagugauaaguaacauga

SEQ ID NO: 1010999 - RNA, 19 nt, Homo sapiens
gagauggucagacauucaa

SEQ ID NO: 1011000 - RNA, 19 nt, Homo sapiens
gauccuucauauaaagaga

SEQ ID NO: 1011001 - RNA, 19 nt, Homo sapiens
cauccauucuuaccaaaca

SEQ ID NO: 1011002 - RNA, 19 nt, Homo sapiens
aagacccacuaccuuauuu

SEQ ID NO: 1011003 - RNA, 19 nt, Homo sapiens
ugugugauaugaagaagug

SEQ ID NO: 1011004 - RNA, 19 nt, Homo sapiens
gaaaacacuagggaaaaua

SEQ ID NO: 1011005 - RNA, 19 nt, Homo sapiens
acuccuggcuacacaauug

SEQ ID NO: 1011006 - RNA, 19 nt, Homo sapiens
aagaaauccugugggaauu

SEQ ID NO: 1011007 - RNA, 19 nt, Homo sapiens
cgaaguuuauccuacaucu

SEQ ID NO: 1011008 - RNA, 19 nt, Homo sapiens
gccaagggagcagcuguua

SEQ ID NO: 1011009 - RNA, 19 nt, Homo sapiens
uuccaaaugugugauauga

SEQ ID NO: 1011010 - RNA, 19 nt, Homo sapiens
ugauaacauugcucacaug

SEQ ID NO: 1011011 - RNA, 19 nt, Homo sapiens
guggagauuugaugggaau

SEQ ID NO: 1011012 - RNA, 19 nt, Homo sapiens
ugaagaagugggaucaguu

SEQ ID NO: 1011013 - RNA, 19 nt, Homo sapiens
ggacugauuuucccuccuu

SEQ ID NO: 1011014 - RNA, 19 nt, Homo sapiens
aagguucuguggagauuug

SEQ ID NO: 1011015 - RNA, 19 nt, Homo sapiens
gggaucaguuuuacaguga

SEQ ID NO: 1011016 - RNA, 19 nt, Homo sapiens
uacagccauuggaugaaua

SEQ ID NO: 1011017 - RNA, 19 nt, Homo sapiens
cugaagacaguaauuaaug

SEQ ID NO: 1011018 - RNA, 19 nt, Homo sapiens
cagaaagggccaacguaau

SEQ ID NO: 1011019 - RNA, 19 nt, Homo sapiens
uaccuguuguuaugucaaa

SEQ ID NO: 1011020 - RNA, 19 nt, Homo sapiens
ccacccagguaaugguuag

SEQ ID NO: 1011021 - RNA, 19 nt, Homo sapiens
gacccacuaccuuauuuga

SEQ ID NO: 1011022 - RNA, 19 nt, Homo sapiens
agaauaucaucaugcaaca

SEQ ID NO: 1011023 - RNA, 19 nt, Homo sapiens
gaaguuuauccuacaucuu

SEQ ID NO: 1011024 - RNA, 19 nt, Homo sapiens
gcaucuaugaggcaaucua

SEQ ID NO: 1011025 - RNA, 19 nt, Homo sapiens
gcugcuggcugcgcuacuu

SEQ ID NO: 1011026 - RNA, 19 nt, Homo sapiens
gaagacaauccugaaagag

SEQ ID NO: 1011027 - RNA, 19 nt, Homo sapiens
caaacaccuucgaguugca

SEQ ID NO: 1011028 - RNA, 19 nt, Homo sapiens
uggcugcgcuacuuaacau

SEQ ID NO: 1011029 - RNA, 19 nt, Homo sapiens
uacuuuagcucugggaguu

SEQ ID NO: 1011030 - RNA, 19 nt, Homo sapiens
ggucagugauaaguaacau

SEQ ID NO: 1011031 - RNA, 19 nt, Homo sapiens
acuacaagagucaagauuu

SEQ ID NO: 1011032 - RNA, 19 nt, Homo sapiens
uaugaagacaauccugaaa

SEQ ID NO: 1011033 - RNA, 19 nt, Homo sapiens
ugaagcagcugcacugaua

SEQ ID NO: 1011034 - RNA, 19 nt, Homo sapiens
guaauuggauucagcagua

SEQ ID NO: 1011035 - RNA, 19 nt, Homo sapiens
guaacaagcugaugaggaa

SEQ ID NO: 1011036 - RNA, 19 nt, Homo sapiens
gaaccacuacuuuguaaua

SEQ ID NO: 1011037 - RNA, 19 nt, Homo sapiens
gagaaccacuacuuuguaa

SEQ ID NO: 1011038 - RNA, 19 nt, Homo sapiens
ggacugauuugagggauuu

SEQ ID NO: 1011039 - RNA, 19 nt, Homo sapiens
cagcuaaccuggagagaaa

SEQ ID NO: 1011040 - RNA, 19 nt, Homo sapiens
cagcugcacugauacauuu

SEQ ID NO: 1011041 - RNA, 19 nt, Homo sapiens
gcaaaugacaguuauugaa

SEQ ID NO: 1011042 - RNA, 19 nt, Homo sapiens
ucaagucacugaaguuuau

SEQ ID NO: 1011043 - RNA, 19 nt, Homo sapiens
uaaauguguucgacaagua

SEQ ID NO: 1011044 - RNA, 19 nt, Homo sapiens
ggaggcagagguugauuua

SEQ ID NO: 1011045 - RNA, 19 nt, Homo sapiens
gcucgaauguguuuggaaa

SEQ ID NO: 1011046 - RNA, 19 nt, Homo sapiens
ccaggaaucuuuguuguau

SEQ ID NO: 1011047 - RNA, 19 nt, Homo sapiens
gauguuggcaguuucauuu

SEQ ID NO: 1011048 - RNA, 19 nt, Homo sapiens
uuagaaacauggccuuauu

SEQ ID NO: 1011049 - RNA, 19 nt, Homo sapiens
ggacuagagcagauugaua

SEQ ID NO: 1011050 - RNA, 19 nt, Homo sapiens
gaaaccaaagcuagcauuu

SEQ ID NO: 1011051 - RNA, 19 nt, Homo sapiens
ggauucagcaguacaguuu

SEQ ID NO: 1011052 - RNA, 19 nt, Homo sapiens
uaacuaugaugcucucaga

SEQ ID NO: 1011053 - RNA, 19 nt, Homo sapiens
acacacauguaucuguaua

SEQ ID NO: 1011054 - RNA, 19 nt, Homo sapiens
ggucacaguugcaauaaag

SEQ ID NO: 1011055 - RNA, 19 nt, Homo sapiens
ucacugaaguuuaugaaca

SEQ ID NO: 1011056 - RNA, 19 nt, Homo sapiens
acggaaauauguggaauua

SEQ ID NO: 1011057 - RNA, 19 nt, Homo sapiens
gaggcuacauuuauauuca

SEQ ID NO: 1011058 - RNA, 19 nt, Homo sapiens
caauaaagucucucucuga

SEQ ID NO: 1011059 - RNA, 19 nt, Homo sapiens
gagcagauugauauguuua

SEQ ID NO: 1011060 - RNA, 19 nt, Homo sapiens
uaaaguucaucaugcugua

SEQ ID NO: 1011061 - RNA, 19 nt, Homo sapiens
uaaagucucucucugaaac

SEQ ID NO: 1011062 - RNA, 19 nt, Homo sapiens
uagagcagauugauauguu

SEQ ID NO: 1011063 - RNA, 19 nt, Homo sapiens
ucagaucaguguuauuuca

SEQ ID NO: 1011064 - RNA, 19 nt, Homo sapiens
cgacaaguaaggagagaua

SEQ ID NO: 1011065 - RNA, 19 nt, Homo sapiens
guaauaguguacaguuugu

SEQ ID NO: 1011066 - RNA, 19 nt, Homo sapiens
aaccaaagcuagcauuuca

SEQ ID NO: 1011067 - RNA, 19 nt, Homo sapiens
aauaaagucucucucugaa

SEQ ID NO: 1011068 - RNA, 19 nt, Homo sapiens
cauuagagauuaucacaag

SEQ ID NO: 1011069 - RNA, 19 nt, Homo sapiens
uuggauaucugcagagaaa

SEQ ID NO: 1011070 - RNA, 19 nt, Homo sapiens
aagcugaaaugguggauug

SEQ ID NO: 1011071 - RNA, 19 nt, Homo sapiens
gacuagagcagauugauau

SEQ ID NO: 1011072 - RNA, 19 nt, Homo sapiens
gacauccucugauccuuug

SEQ ID NO: 1011073 - RNA, 19 nt, Homo sapiens
cgacacauguggacuagag

SEQ ID NO: 1011074 - RNA, 19 nt, Homo sapiens
gaaaugguggauuggauau

SEQ ID NO: 1011075 - RNA, 19 nt, Homo sapiens
guugguggcuugacuuugu

SEQ ID NO: 1011076 - RNA, 19 nt, Homo sapiens
gaccuuuucuucaggauua

SEQ ID NO: 1011077 - RNA, 19 nt, Homo sapiens
gagguugauuuacucaguu

SEQ ID NO: 1011078 - RNA, 19 nt, Homo sapiens
gaaacauggccuuauuuua

SEQ ID NO: 1011079 - RNA, 19 nt, Homo sapiens
ucagacuguucaaguuuaa

SEQ ID NO: 1011080 - RNA, 19 nt, Homo sapiens
uauacaggcucgaaugugu

SEQ ID NO: 1011081 - RNA, 19 nt, Homo sapiens
acacauagacauacagaga

SEQ ID NO: 1011082 - RNA, 19 nt, Homo sapiens
gcucucagaucaguguuau

SEQ ID NO: 1011083 - RNA, 19 nt, Homo sapiens
ugaaaugguggauuggaua

SEQ ID NO: 1011084 - RNA, 19 nt, Homo sapiens
gaucaguguuauuucagau

SEQ ID NO: 1011085 - RNA, 19 nt, Homo sapiens
ucucagaucaguguuauuu

SEQ ID NO: 1011086 - RNA, 19 nt, Homo sapiens
gguggucacaguugcaaua

SEQ ID NO: 1011087 - RNA, 19 nt, Homo sapiens
caggaaucuuuguuguaua

SEQ ID NO: 1011088 - RNA, 19 nt, Homo sapiens
uaaggagagauaacuauga

SEQ ID NO: 1011089 - RNA, 19 nt, Homo sapiens
ggcuugacuuuguccauaa

SEQ ID NO: 1011090 - RNA, 19 nt, Homo sapiens
gauuacagguacacuggau

SEQ ID NO: 1011091 - RNA, 19 nt, Homo sapiens
guucagacuguucaaguuu

SEQ ID NO: 1011092 - RNA, 19 nt, Homo sapiens
gauuggauaucugcagaga

SEQ ID NO: 1011093 - RNA, 19 nt, Homo sapiens
gauuaaagcaaaugacagu

SEQ ID NO: 1011094 - RNA, 19 nt, Homo sapiens
uccggaggcuacauuuaua

SEQ ID NO: 1011095 - RNA, 19 nt, Homo sapiens
uggcuugacuuuguccaua

SEQ ID NO: 1011096 - RNA, 19 nt, Homo sapiens
cuaccacauuccagucuuu

SEQ ID NO: 1011097 - RNA, 19 nt, Homo sapiens
cacaagagaggaaguaugu

SEQ ID NO: 1011098 - RNA, 19 nt, Homo sapiens
gggcaucucuuuuccauca

SEQ ID NO: 1011099 - RNA, 19 nt, Homo sapiens
guaaggagagauaacuaug

SEQ ID NO: 1011100 - RNA, 19 nt, Homo sapiens
cgcaggaagugaccaaguu

SEQ ID NO: 1011101 - RNA, 19 nt, Homo sapiens
agagaaccacuacuuugua

SEQ ID NO: 1011102 - RNA, 19 nt, Homo sapiens
gcagcugcacugauacauu

SEQ ID NO: 1011103 - RNA, 19 nt, Homo sapiens
ccagggagacauccucuga

SEQ ID NO: 1011104 - RNA, 19 nt, Homo sapiens
gaaagaaaaggacauuguu

SEQ ID NO: 1011105 - RNA, 19 nt, Homo sapiens
aaggagagauaacuaugau

SEQ ID NO: 1011106 - RNA, 19 nt, Homo sapiens
caaaugacaguuauugaac

SEQ ID NO: 1011107 - RNA, 19 nt, Homo sapiens
uagaaacauggccuuauuu

SEQ ID NO: 1011108 - RNA, 19 nt, Homo sapiens
gaaggcuuaugaggagcua

SEQ ID NO: 1011109 - RNA, 19 nt, Homo sapiens
cagagaaccacuacuuugu

SEQ ID NO: 1011110 - RNA, 19 nt, Homo sapiens
acagagaaccacuacuuug

SEQ ID NO: 1011111 - RNA, 19 nt, Homo sapiens
uaagagcacaaagaaguuu

SEQ ID NO: 1011112 - RNA, 19 nt, Homo sapiens
agagcagauugauauguuu

SEQ ID NO: 1011113 - RNA, 19 nt, Homo sapiens
uaucaagucacugaaguuu

SEQ ID NO: 1011114 - RNA, 19 nt, Homo sapiens
cacugaaguuuaugaacaa

SEQ ID NO: 1011115 - RNA, 19 nt, Homo sapiens
uagagauuaucacaagaga

SEQ ID NO: 1011116 - RNA, 19 nt, Homo sapiens
cagagaaaauucaaaagga

SEQ ID NO: 1011117 - RNA, 19 nt, Homo sapiens
auacagagaaccacuacuu

SEQ ID NO: 1011118 - RNA, 19 nt, Homo sapiens
gaccgccacuaccacauuc

SEQ ID NO: 1011119 - RNA, 19 nt, Homo sapiens
uucagacuguucaaguuua

SEQ ID NO: 1011120 - RNA, 19 nt, Homo sapiens
aaaggacauuguuaagcuu

SEQ ID NO: 1011121 - RNA, 19 nt, Homo sapiens
ggaggcuacauuuauauuc

SEQ ID NO: 1011122 - RNA, 19 nt, Homo sapiens
acacauguaucuguauagu

SEQ ID NO: 1011123 - RNA, 19 nt, Homo sapiens
ggaaaacuacggaaauaug

SEQ ID NO: 1011124 - RNA, 19 nt, Homo sapiens
gaaguauacaggcucgaau

SEQ ID NO: 1011125 - RNA, 19 nt, Homo sapiens
aggcagagguugauuuacu

SEQ ID NO: 1011126 - RNA, 19 nt, Homo sapiens
gcaggaagugaccaaguuc

SEQ ID NO: 1011127 - RNA, 19 nt, Homo sapiens
guuuaacuccagagacuuu

SEQ ID NO: 1011128 - RNA, 19 nt, Homo sapiens
ccucugauccuuugagcuu

SEQ ID NO: 1011129 - RNA, 19 nt, Homo sapiens
agacauccucugauccuuu

SEQ ID NO: 1011130 - RNA, 19 nt, Homo sapiens
cuauuaaacugugguacau

SEQ ID NO: 1011131 - RNA, 19 nt, Homo sapiens
aaucuuaucuuggacugau

SEQ ID NO: 1011132 - RNA, 19 nt, Homo sapiens
aagcaaaugacaguuauug

SEQ ID NO: 1011133 - RNA, 19 nt, Homo sapiens
gcaaagcucuccaucagaa

SEQ ID NO: 1011134 - RNA, 19 nt, Homo sapiens
gaagguagcauuucaaguu

SEQ ID NO: 1011135 - RNA, 19 nt, Homo sapiens
caugaaauuuccaccauua

SEQ ID NO: 1011136 - RNA, 19 nt, Homo sapiens
aaagagaggucaagucaug

SEQ ID NO: 1011137 - RNA, 19 nt, Homo sapiens
ggaagcaccucccuguaug

SEQ ID NO: 1011138 - RNA, 19 nt, Homo sapiens
guaggaagguagcauuuca

SEQ ID NO: 1011139 - RNA, 19 nt, Homo sapiens
gaggaugguuuaugaaguc

SEQ ID NO: 1011140 - RNA, 19 nt, Homo sapiens
ucaguuuccucaccuguaa

SEQ ID NO: 1011141 - RNA, 19 nt, Homo sapiens
gagaggcagugcuguggaa

SEQ ID NO: 1011142 - RNA, 19 nt, Homo sapiens
acucagaacucacaaguca

SEQ ID NO: 1011143 - RNA, 19 nt, Homo sapiens
gcacggccauccucagcaa

SEQ ID NO: 1011144 - RNA, 19 nt, Homo sapiens
cuucgucccuuguuucuaa

SEQ ID NO: 1011145 - RNA, 19 nt, Homo sapiens
gugcaaagcucuccaucag

SEQ ID NO: 1011146 - RNA, 19 nt, Homo sapiens
ucaaagagaggucaaguca

SEQ ID NO: 1011147 - RNA, 19 nt, Homo sapiens
accaauagauuacugaugu

SEQ ID NO: 1011148 - RNA, 19 nt, Homo sapiens
caccauuaccaauagauua

SEQ ID NO: 1011149 - RNA, 19 nt, Homo sapiens
aguauagugugucgcauuu

SEQ ID NO: 1011150 - RNA, 19 nt, Homo sapiens
gaacucacaagucauggau

SEQ ID NO: 1011151 - RNA, 19 nt, Homo sapiens
gguagcauuucaaguucaa

SEQ ID NO: 1011152 - RNA, 19 nt, Homo sapiens
ggaccacaccugccacuca

SEQ ID NO: 1011153 - RNA, 19 nt, Homo sapiens
ggacucagaacucacaagu

SEQ ID NO: 1011154 - RNA, 19 nt, Homo sapiens
guuauuggcuggcguacgu

SEQ ID NO: 1011155 - RNA, 19 nt, Homo sapiens
gaaauuuccaccauuacca

SEQ ID NO: 1011156 - RNA, 19 nt, Homo sapiens
ucaugaaauuuccaccauu

SEQ ID NO: 1011157 - RNA, 19 nt, Homo sapiens
gaagaugcuggcucuggaa

SEQ ID NO: 1011158 - RNA, 19 nt, Homo sapiens
gcaaugcugcuuauuuaac

SEQ ID NO: 1011159 - RNA, 19 nt, Homo sapiens
ggucugagcauuagaacca

SEQ ID NO: 1011160 - RNA, 19 nt, Homo sapiens
cugcuuauuuaacccauuu

SEQ ID NO: 1011161 - RNA, 19 nt, Homo sapiens
gaugcuggcucuggaaugg

SEQ ID NO: 1011162 - RNA, 19 nt, Homo sapiens
ugauguccauggcaaguga

SEQ ID NO: 1011163 - RNA, 19 nt, Homo sapiens
gcacacacacacacacaca

SEQ ID NO: 1011164 - RNA, 19 nt, Homo sapiens
ggauuccacagcaaauaaa

SEQ ID NO: 1011165 - RNA, 19 nt, Homo sapiens
cauggcaagugaucuguuc

SEQ ID NO: 1011166 - RNA, 19 nt, Homo sapiens
caucuuuccuccagcacuu

SEQ ID NO: 1011167 - RNA, 19 nt, Homo sapiens
cauuucaaguucaaagaga

SEQ ID NO: 1011168 - RNA, 19 nt, Homo sapiens
gggcagggcaucaggacaa

SEQ ID NO: 1011169 - RNA, 19 nt, Homo sapiens
gaucuguucuugguauuuu

SEQ ID NO: 1011170 - RNA, 19 nt, Homo sapiens
caucuggccuuuuaaguau

SEQ ID NO: 1011171 - RNA, 19 nt, Homo sapiens
acucacaagucauggauca

SEQ ID NO: 1011172 - RNA, 19 nt, Homo sapiens
ucagaacucacaagucaug

SEQ ID NO: 1011173 - RNA, 19 nt, Homo sapiens
gcaaauaaaacuguacuga

SEQ ID NO: 1011174 - RNA, 19 nt, Homo sapiens
ugaggaugguuuaugaagu

SEQ ID NO: 1011175 - RNA, 19 nt, Homo sapiens
gaagaggggacaccuuuga

SEQ ID NO: 1011176 - RNA, 19 nt, Homo sapiens
guaaaacugucaugaggau

SEQ ID NO: 1011177 - RNA, 19 nt, Homo sapiens
gccagaacgugcaaauagg

SEQ ID NO: 1011178 - RNA, 19 nt, Homo sapiens
uuccucaccuguaacauga

SEQ ID NO: 1011179 - RNA, 19 nt, Homo sapiens
ccucgucugcuucuuguuu

SEQ ID NO: 1011180 - RNA, 19 nt, Homo sapiens
aagguagcauuucaaguuc

SEQ ID NO: 1011181 - RNA, 19 nt, Homo sapiens
gagccucucugugacucuu

SEQ ID NO: 1011182 - RNA, 19 nt, Homo sapiens
ccuguaacaugagaauaau

SEQ ID NO: 1011183 - RNA, 19 nt, Homo sapiens
uguccugucuccagucaga

SEQ ID NO: 1011184 - RNA, 19 nt, Homo sapiens
cgccagaacgugcaaauag

SEQ ID NO: 1011185 - RNA, 19 nt, Homo sapiens
acaagucauggaucaagua

SEQ ID NO: 1011186 - RNA, 19 nt, Homo sapiens
ccaauagauuacugauguc

SEQ ID NO: 1011187 - RNA, 19 nt, Homo sapiens
ggguaggaagguagcauuu

SEQ ID NO: 1011188 - RNA, 19 nt, Homo sapiens
ccauagcagcccaguguga

SEQ ID NO: 1011189 - RNA, 19 nt, Homo sapiens
agugaucuguucuugguau

SEQ ID NO: 1011190 - RNA, 19 nt, Homo sapiens
gcacgcaugcacacacaca

SEQ ID NO: 1011191 - RNA, 19 nt, Homo sapiens
agucauggaucaaguacag

SEQ ID NO: 1011192 - RNA, 19 nt, Homo sapiens
ccaccauuaccaauagauu

SEQ ID NO: 1011193 - RNA, 19 nt, Homo sapiens
ggucaagucaugcaaccau

SEQ ID NO: 1011194 - RNA, 19 nt, Homo sapiens
cucugugacucuucuguaa

SEQ ID NO: 1011195 - RNA, 19 nt, Homo sapiens
ccacuucgucccuuguuuc

SEQ ID NO: 1011196 - RNA, 19 nt, Homo sapiens
ugacagcgucgcccgaugu

SEQ ID NO: 1011197 - RNA, 19 nt, Homo sapiens
ccuccacccucugaccuuu

SEQ ID NO: 1011198 - RNA, 19 nt, Homo sapiens
ggaggaggagggucugaag

SEQ ID NO: 1011199 - RNA, 19 nt, Homo sapiens
gugaucuguucuugguauu

SEQ ID NO: 1011200 - RNA, 19 nt, Homo sapiens
ccaggcaugugugugugaa

SEQ ID NO: 1011201 - RNA, 19 nt, Homo sapiens
aggaagcaccucccuguau

SEQ ID NO: 1011202 - RNA, 19 nt, Homo sapiens
gcguacugcuccagaaggu

SEQ ID NO: 1011203 - RNA, 19 nt, Homo sapiens
cacaagucauggaucaagu

SEQ ID NO: 1011204 - RNA, 19 nt, Homo sapiens
gcguacgugugugcgcaua

SEQ ID NO: 1011205 - RNA, 19 nt, Homo sapiens
caaugcugcuuauuuaacc

SEQ ID NO: 1011206 - RNA, 19 nt, Homo sapiens
cauagcagcccagugugaa

SEQ ID NO: 1011207 - RNA, 19 nt, Homo sapiens
gggaagaggggacaccuuu

SEQ ID NO: 1011208 - RNA, 19 nt, Homo sapiens
auagauuacugauguccau

SEQ ID NO: 1011209 - RNA, 19 nt, Homo sapiens
ggaagguagcauuucaagu

SEQ ID NO: 1011210 - RNA, 19 nt, Homo sapiens
guacgugugugcgcauacu

SEQ ID NO: 1011211 - RNA, 19 nt, Homo sapiens
aaagcauucuguccugucu

SEQ ID NO: 1011212 - RNA, 19 nt, Homo sapiens
caagucaugcaaccaucuu

SEQ ID NO: 1011213 - RNA, 19 nt, Homo sapiens
gcauuucaaguucaaagag

SEQ ID NO: 1011214 - RNA, 19 nt, Homo sapiens
gguaggaagguagcauuuc

SEQ ID NO: 1011215 - RNA, 19 nt, Homo sapiens
gcacagccccuagaugaug

SEQ ID NO: 1011216 - RNA, 19 nt, Homo sapiens
gcugcuuauuuaacccauu

SEQ ID NO: 1011217 - RNA, 19 nt, Homo sapiens
gcaaauaggggauaaucag

SEQ ID NO: 1011218 - RNA, 19 nt, Homo sapiens
gggugcagccuaagucagu

SEQ ID NO: 1011219 - RNA, 19 nt, Homo sapiens
caagaaagaucacggagua

SEQ ID NO: 1011220 - RNA, 19 nt, Homo sapiens
gaacaaaaccuaaaccuua

SEQ ID NO: 1011221 - RNA, 19 nt, Homo sapiens
uggcaaagguuccaaauuu

SEQ ID NO: 1011222 - RNA, 19 nt, Homo sapiens
ggagacggcuuccucguuu

SEQ ID NO: 1011223 - RNA, 19 nt, Homo sapiens
caaacagacuccaaucuca

SEQ ID NO: 1011224 - RNA, 19 nt, Homo sapiens
gaauauguccuagcacuaa

SEQ ID NO: 1011225 - RNA, 19 nt, Homo sapiens
ucagauaugucuacaaaca

SEQ ID NO: 1011226 - RNA, 19 nt, Homo sapiens
cacuuaaccuuuaccuuua

SEQ ID NO: 1011227 - RNA, 19 nt, Homo sapiens
uaagggaaguguaacaguu

SEQ ID NO: 1011228 - RNA, 19 nt, Homo sapiens
gauuuauccuuccaucuuu

SEQ ID NO: 1011229 - RNA, 19 nt, Homo sapiens
ggucaacaauccauucguu

SEQ ID NO: 1011230 - RNA, 19 nt, Homo sapiens
gaaagaucacggaguauau

SEQ ID NO: 1011231 - RNA, 19 nt, Homo sapiens
acacuuaaccuuuaccuuu

SEQ ID NO: 1011232 - RNA, 19 nt, Homo sapiens
gcuacuaagugaauaggaa

SEQ ID NO: 1011233 - RNA, 19 nt, Homo sapiens
gaacaggaaagguguggaa

SEQ ID NO: 1011234 - RNA, 19 nt, Homo sapiens
uaucgcagcucgaauuuca

SEQ ID NO: 1011235 - RNA, 19 nt, Homo sapiens
guagugcccuccuugaaau

SEQ ID NO: 1011236 - RNA, 19 nt, Homo sapiens
cagcucgaauuucaguuua

SEQ ID NO: 1011237 - RNA, 19 nt, Homo sapiens
caacagcguuugauugcau

SEQ ID NO: 1011238 - RNA, 19 nt, Homo sapiens
gcucgaauuucaguuuaaa

SEQ ID NO: 1011239 - RNA, 19 nt, Homo sapiens
gaauauggcccugaacaau

SEQ ID NO: 1011240 - RNA, 19 nt, Homo sapiens
ggacguaacgcaaguacug

SEQ ID NO: 1011241 - RNA, 19 nt, Homo sapiens
cgugggaguuauaugaaua

SEQ ID NO: 1011242 - RNA, 19 nt, Homo sapiens
ucaccacgcugggcuguuu

SEQ ID NO: 1011243 - RNA, 19 nt, Homo sapiens
ucagaaaacuguucaucua

SEQ ID NO: 1011244 - RNA, 19 nt, Homo sapiens
uaagaagugugcugcaaca

SEQ ID NO: 1011245 - RNA, 19 nt, Homo sapiens
cucagacacuuaaccuuua

SEQ ID NO: 1011246 - RNA, 19 nt, Homo sapiens
gaaagguguggaagggaua

SEQ ID NO: 1011247 - RNA, 19 nt, Homo sapiens
gaucacggaguauauucua

SEQ ID NO: 1011248 - RNA, 19 nt, Homo sapiens
gcagcucgaauuucaguuu

SEQ ID NO: 1011249 - RNA, 19 nt, Homo sapiens
uguacaaucuccuaucaga

SEQ ID NO: 1011250 - RNA, 19 nt, Homo sapiens
ggaggcuacuaagugaaua

SEQ ID NO: 1011251 - RNA, 19 nt, Homo sapiens
gacacaggcuggacugauc

SEQ ID NO: 1011252 - RNA, 19 nt, Homo sapiens
caagccagauucucaccuu

SEQ ID NO: 1011253 - RNA, 19 nt, Homo sapiens
ucaacaauccauucguuaa

SEQ ID NO: 1011254 - RNA, 19 nt, Homo sapiens
guguaacaguugauugauu

SEQ ID NO: 1011255 - RNA, 19 nt, Homo sapiens
agaaagaucacggaguaua

SEQ ID NO: 1011256 - RNA, 19 nt, Homo sapiens
auucuuaggucgucacaaa

SEQ ID NO: 1011257 - RNA, 19 nt, Homo sapiens
gggcaguguuugaauaugg

SEQ ID NO: 1011258 - RNA, 19 nt, Homo sapiens
uacaaucuccuaucagaaa

SEQ ID NO: 1011259 - RNA, 19 nt, Homo sapiens
ugaacccgaucuccuaaga

SEQ ID NO: 1011260 - RNA, 19 nt, Homo sapiens
agauaugucuacaaacaga

SEQ ID NO: 1011261 - RNA, 19 nt, Homo sapiens
gaaguguaacaguugauug

SEQ ID NO: 1011262 - RNA, 19 nt, Homo sapiens
acgcugggcuguuuauuag

SEQ ID NO: 1011263 - RNA, 19 nt, Homo sapiens
aaaccuaaaccuuacaguu

SEQ ID NO: 1011264 - RNA, 19 nt, Homo sapiens
ggaaguguaacaguugauu

SEQ ID NO: 1011265 - RNA, 19 nt, Homo sapiens
cccaaucccugccguugaa

SEQ ID NO: 1011266 - RNA, 19 nt, Homo sapiens
guaguaaacacuguaugaa

SEQ ID NO: 1011267 - RNA, 19 nt, Homo sapiens
ggcaaagguuccaaauuuu

SEQ ID NO: 1011268 - RNA, 19 nt, Homo sapiens
caaucucagucgcacuaaa

SEQ ID NO: 1011269 - RNA, 19 nt, Homo sapiens
cacgcugggcuguuuauua

SEQ ID NO: 1011270 - RNA, 19 nt, Homo sapiens
gaacccgaucuccuaagaa

SEQ ID NO: 1011271 - RNA, 19 nt, Homo sapiens
acucagacacuuaaccuuu

SEQ ID NO: 1011272 - RNA, 19 nt, Homo sapiens
ugaaucugcuguccuaaaa

SEQ ID NO: 1011273 - RNA, 19 nt, Homo sapiens
gucaacaauccauucguua

SEQ ID NO: 1011274 - RNA, 19 nt, Homo sapiens
uuaauacgugggaguuaua

SEQ ID NO: 1011275 - RNA, 19 nt, Homo sapiens
ccuaagaagugugcugcaa

SEQ ID NO: 1011276 - RNA, 19 nt, Homo sapiens
gcugggcuguuuauuaggu

SEQ ID NO: 1011277 - RNA, 19 nt, Homo sapiens
aaagaucacggaguauauu

SEQ ID NO: 1011278 - RNA, 19 nt, Homo sapiens
uguaguaaacacuguauga

SEQ ID NO: 1011279 - RNA, 19 nt, Homo sapiens
guacaaucuccuaucagaa

SEQ ID NO: 1011280 - RNA, 19 nt, Homo sapiens
ggugaaaacauuacuugua

SEQ ID NO: 1011281 - RNA, 19 nt, Homo sapiens
aaucugcuguccuaaaaua

SEQ ID NO: 1011282 - RNA, 19 nt, Homo sapiens
uguggaagggauauucuua

SEQ ID NO: 1011283 - RNA, 19 nt, Homo sapiens
aagccagauucucaccuua

SEQ ID NO: 1011284 - RNA, 19 nt, Homo sapiens
ugauuuauccuuccaucuu

SEQ ID NO: 1011285 - RNA, 19 nt, Homo sapiens
gaacgauuggaacaggaaa

SEQ ID NO: 1011286 - RNA, 19 nt, Homo sapiens
guggguuccugugugcuua

SEQ ID NO: 1011287 - RNA, 19 nt, Homo sapiens
ccuuacaguucuuucaaau

SEQ ID NO: 1011288 - RNA, 19 nt, Homo sapiens
aaagggacguaacgcaagu

SEQ ID NO: 1011289 - RNA, 19 nt, Homo sapiens
auacgugggaguuauauga

SEQ ID NO: 1011290 - RNA, 19 nt, Homo sapiens
gcagccagaacgauuggaa

SEQ ID NO: 1011291 - RNA, 19 nt, Homo sapiens
ucacggaguauauucuaga

SEQ ID NO: 1011292 - RNA, 19 nt, Homo sapiens
guuccugugugcuuaguca

SEQ ID NO: 1011293 - RNA, 19 nt, Homo sapiens
auauggcccugaacaaugu

SEQ ID NO: 1011294 - RNA, 19 nt, Homo sapiens
gaaauguguguuuguucau

SEQ ID NO: 1011295 - RNA, 19 nt, Homo sapiens
cuugaaauguguguuuguu

SEQ ID NO: 1011296 - RNA, 19 nt, Homo sapiens
aaccuaaaccuuacaguuc

SEQ ID NO: 1011297 - RNA, 19 nt, Homo sapiens
guuugaauauggcccugaa

SEQ ID NO: 1011298 - RNA, 19 nt, Homo sapiens
caacaauccauucguuaac

SEQ ID NO: 1011299 - RNA, 19 nt, Homo sapiens
gggaggcuacuaagugaau

SEQ ID NO: 1011300 - RNA, 19 nt, Homo sapiens
uguagugcccuccuugaaa

SEQ ID NO: 1011301 - RNA, 19 nt, Homo sapiens
cuuguacaaucuccuauca

SEQ ID NO: 1011302 - RNA, 19 nt, Homo sapiens
aaaauacacuggugaaaac

SEQ ID NO: 1011303 - RNA, 19 nt, Homo sapiens
ugaauauggcccugaacaa

SEQ ID NO: 1011304 - RNA, 19 nt, Homo sapiens
ugcgggcaguguuugaaua

SEQ ID NO: 1011305 - RNA, 19 nt, Homo sapiens
gcguuugauugcauuagga

SEQ ID NO: 1011306 - RNA, 19 nt, Homo sapiens
gagacggcuuccucguuuc

SEQ ID NO: 1011307 - RNA, 19 nt, Homo sapiens
gugaaaacauuacuuguac

SEQ ID NO: 1011308 - RNA, 19 nt, Homo sapiens
ucccagcgcauuaaucuga

SEQ ID NO: 1011309 - RNA, 19 nt, Homo sapiens
uuuaauacgugggaguuau

SEQ ID NO: 1011310 - RNA, 19 nt, Homo sapiens
aauauggcccugaacaaug

SEQ ID NO: 1011311 - RNA, 19 nt, Homo sapiens
ugauuuaggugguuuuaug

SEQ ID NO: 1011312 - RNA, 19 nt, Homo sapiens
ugaauauguccuagcacua

SEQ ID NO: 1011313 - RNA, 19 nt, Homo sapiens
gaaaacuguucaucuacuc

SEQ ID NO: 1011314 - RNA, 19 nt, Homo sapiens
gcgggcaguguuugaauau

SEQ ID NO: 1011315 - RNA, 19 nt, Homo sapiens
ggaagggauauucuuaggu

SEQ ID NO: 1011316 - RNA, 19 nt, Homo sapiens
guuaucgcagcucgaauuu

SEQ ID NO: 1011317 - RNA, 19 nt, Homo sapiens
uuccaggccugaagcgauu

SEQ ID NO: 1011318 - RNA, 19 nt, Homo sapiens
ccuaaaccuuacaguucuu

SEQ ID NO: 1011319 - RNA, 19 nt, Homo sapiens
gcaaagagaugaacaguuu

SEQ ID NO: 1011320 - RNA, 19 nt, Homo sapiens
gaagaaagauugagacuug

SEQ ID NO: 1011321 - RNA, 19 nt, Homo sapiens
ugaaagaccuuaauaggaa

SEQ ID NO: 1011322 - RNA, 19 nt, Homo sapiens
gaagauacaugugugauau

SEQ ID NO: 1011323 - RNA, 19 nt, Homo sapiens
ggauggaaaugacuacaua

SEQ ID NO: 1011324 - RNA, 19 nt, Homo sapiens
caagugaccucucaucuuc

SEQ ID NO: 1011325 - RNA, 19 nt, Homo sapiens
ccaguuaccuucuccauug

SEQ ID NO: 1011326 - RNA, 19 nt, Homo sapiens
gaacauaccagauugaagu

SEQ ID NO: 1011327 - RNA, 19 nt, Homo sapiens
ccaaggaggugauagcauu

SEQ ID NO: 1011328 - RNA, 19 nt, Homo sapiens
aaacaaauaugcaguccaa

SEQ ID NO: 1011329 - RNA, 19 nt, Homo sapiens
uauggacacuugcaucuua

SEQ ID NO: 1011330 - RNA, 19 nt, Homo sapiens
gaagacaugguccaguuua

SEQ ID NO: 1011331 - RNA, 19 nt, Homo sapiens
cuacuagagugaaaugaua

SEQ ID NO: 1011332 - RNA, 19 nt, Homo sapiens
gaaagaccuuaauaggaaa

SEQ ID NO: 1011333 - RNA, 19 nt, Homo sapiens
gcccaaggauguauuagaa

SEQ ID NO: 1011334 - RNA, 19 nt, Homo sapiens
uaccugaucuuugugauua

SEQ ID NO: 1011335 - RNA, 19 nt, Homo sapiens
cgacacagauggagguuau

SEQ ID NO: 1011336 - RNA, 19 nt, Homo sapiens
gacaugguccaguuuauua

SEQ ID NO: 1011337 - RNA, 19 nt, Homo sapiens
ggaagggucucuguuaauc

SEQ ID NO: 1011338 - RNA, 19 nt, Homo sapiens
gaagaacgauaugaagugu

SEQ ID NO: 1011339 - RNA, 19 nt, Homo sapiens
ggagaagaaauguuacuuu

SEQ ID NO: 1011340 - RNA, 19 nt, Homo sapiens
gaguaaagcucagugugaa

SEQ ID NO: 1011341 - RNA, 19 nt, Homo sapiens
uaacagguauuucaucagu

SEQ ID NO: 1011342 - RNA, 19 nt, Homo sapiens
gauugagacuugaugacua

SEQ ID NO: 1011343 - RNA, 19 nt, Homo sapiens
agaauuaccuugcuaugga

SEQ ID NO: 1011344 - RNA, 19 nt, Homo sapiens
guaggugguuuguaaguga

SEQ ID NO: 1011345 - RNA, 19 nt, Homo sapiens
gagacuugaugacuauaaa

SEQ ID NO: 1011346 - RNA, 19 nt, Homo sapiens
gaugccaaaucuacuauug

SEQ ID NO: 1011347 - RNA, 19 nt, Homo sapiens
gaagucaauuauucaggaa

SEQ ID NO: 1011348 - RNA, 19 nt, Homo sapiens
guacggauaccucauuuga

SEQ ID NO: 1011349 - RNA, 19 nt, Homo sapiens
caaagaaugaugagugauu

SEQ ID NO: 1011350 - RNA, 19 nt, Homo sapiens
ugugugaacuuuaugguaa

SEQ ID NO: 1011351 - RNA, 19 nt, Homo sapiens
guaucaagauuaugagguu

SEQ ID NO: 1011352 - RNA, 19 nt, Homo sapiens
agauggagguuauauagaa

SEQ ID NO: 1011353 - RNA, 19 nt, Homo sapiens
acggauaccucauuugaaa

SEQ ID NO: 1011354 - RNA, 19 nt, Homo sapiens
gauuagaacagaacaauuc

SEQ ID NO: 1011355 - RNA, 19 nt, Homo sapiens
ggaguaacgacugacauua

SEQ ID NO: 1011356 - RNA, 19 nt, Homo sapiens
ccacagacacacacaguuu

SEQ ID NO: 1011357 - RNA, 19 nt, Homo sapiens
uaugguaacuucuacucua

SEQ ID NO: 1011358 - RNA, 19 nt, Homo sapiens
cauagaugcugcuucagaa

SEQ ID NO: 1011359 - RNA, 19 nt, Homo sapiens
auacauagaugcugcuuca

SEQ ID NO: 1011360 - RNA, 19 nt, Homo sapiens
guccgugucugcuucauaa

SEQ ID NO: 1011361 - RNA, 19 nt, Homo sapiens
gcugauggaugaauugaca

SEQ ID NO: 1011362 - RNA, 19 nt, Homo sapiens
gaucuucguuuauauucug

SEQ ID NO: 1011363 - RNA, 19 nt, Homo sapiens
gaguacggauaccucauuu

SEQ ID NO: 1011364 - RNA, 19 nt, Homo sapiens
caagucacauccgguguaa

SEQ ID NO: 1011365 - RNA, 19 nt, Homo sapiens
ccguuucccucauauauuu

SEQ ID NO: 1011366 - RNA, 19 nt, Homo sapiens
gggcagaauauuuaaauug

SEQ ID NO: 1011367 - RNA, 19 nt, Homo sapiens
gauagaagagagcaaagaa

SEQ ID NO: 1011368 - RNA, 19 nt, Homo sapiens
uucaagagcucaccacuga

SEQ ID NO: 1011369 - RNA, 19 nt, Homo sapiens
cuucaaaccagcaauauuu

SEQ ID NO: 1011370 - RNA, 19 nt, Homo sapiens
gaccucucaucuucuauaa

SEQ ID NO: 1011371 - RNA, 19 nt, Homo sapiens
cauaaggaguaacgacuga

SEQ ID NO: 1011372 - RNA, 19 nt, Homo sapiens
gaacuacuagagugaaaug

SEQ ID NO: 1011373 - RNA, 19 nt, Homo sapiens
cuucuaacauuuccuuuga

SEQ ID NO: 1011374 - RNA, 19 nt, Homo sapiens
aauaucaacugcauggauu

SEQ ID NO: 1011375 - RNA, 19 nt, Homo sapiens
aagaagugguuccugagua

SEQ ID NO: 1011376 - RNA, 19 nt, Homo sapiens
ggcagaauauuuaaauugg

SEQ ID NO: 1011377 - RNA, 19 nt, Homo sapiens
gcauguuucucuaucugaa

SEQ ID NO: 1011378 - RNA, 19 nt, Homo sapiens
gcuuguggcucuugcaguu

SEQ ID NO: 1011379 - RNA, 19 nt, Homo sapiens
gaacuuggagacacaggaa

SEQ ID NO: 1011380 - RNA, 19 nt, Homo sapiens
gaucaacagggaaagguuu

SEQ ID NO: 1011381 - RNA, 19 nt, Homo sapiens
uuaaaguagucccuccaua

SEQ ID NO: 1011382 - RNA, 19 nt, Homo sapiens
cuagauagacagauuaaga

SEQ ID NO: 1011383 - RNA, 19 nt, Homo sapiens
ggaaaugaaacaaauaugc

SEQ ID NO: 1011384 - RNA, 19 nt, Homo sapiens
uuauguagguggagaauca

SEQ ID NO: 1011385 - RNA, 19 nt, Homo sapiens
auaaaugaaugccucaguu

SEQ ID NO: 1011386 - RNA, 19 nt, Homo sapiens
gcaaacauccacaaaauau

SEQ ID NO: 1011387 - RNA, 19 nt, Homo sapiens
agaagugguuccugaguau

SEQ ID NO: 1011388 - RNA, 19 nt, Homo sapiens
uuaguucugucacccauuu

SEQ ID NO: 1011389 - RNA, 19 nt, Homo sapiens
ccacauggauggaaaugac

SEQ ID NO: 1011390 - RNA, 19 nt, Homo sapiens
ccaauagucaagcuuguuu

SEQ ID NO: 1011391 - RNA, 19 nt, Homo sapiens
uaaauaccuugcugaugga

SEQ ID NO: 1011392 - RNA, 19 nt, Homo sapiens
gaauuaccuugcuauggau

SEQ ID NO: 1011393 - RNA, 19 nt, Homo sapiens
caaguagauucuucuccaa

SEQ ID NO: 1011394 - RNA, 19 nt, Homo sapiens
ugggaagggucucuguuaa

SEQ ID NO: 1011395 - RNA, 19 nt, Homo sapiens
gccauccguuucccucaua

SEQ ID NO: 1011396 - RNA, 19 nt, Homo sapiens
gaugaacaguuugucugaa

SEQ ID NO: 1011397 - RNA, 19 nt, Homo sapiens
gaugggcugcuuucucuuu

SEQ ID NO: 1011398 - RNA, 19 nt, Homo sapiens
auacucaguugcauuauca

SEQ ID NO: 1011399 - RNA, 19 nt, Homo sapiens
acacagagcacuccaucaa

SEQ ID NO: 1011400 - RNA, 19 nt, Homo sapiens
ggagcccaaggauguauua

SEQ ID NO: 1011401 - RNA, 19 nt, Homo sapiens
gauaugaagugucuaaaag

SEQ ID NO: 1011402 - RNA, 19 nt, Homo sapiens
gaaugcaaacauccacaaa

SEQ ID NO: 1011403 - RNA, 19 nt, Homo sapiens
gagaucagccaguuaccuu

SEQ ID NO: 1011404 - RNA, 19 nt, Homo sapiens
uaaauuggucagucaggua

SEQ ID NO: 1011405 - RNA, 19 nt, Homo sapiens
gaaagauugagacuugaug

SEQ ID NO: 1011406 - RNA, 19 nt, Homo sapiens
gaugccagcugugcuuguu

SEQ ID NO: 1011407 - RNA, 19 nt, Homo sapiens
ccagagauaaaugcuguua

SEQ ID NO: 1011408 - RNA, 19 nt, Homo sapiens
uaaguggaaaccagagaua

SEQ ID NO: 1011409 - RNA, 19 nt, Homo sapiens
ccucucaucuucuauaaac

SEQ ID NO: 1011410 - RNA, 19 nt, Homo sapiens
ccauguaucaagauuauga

SEQ ID NO: 1011411 - RNA, 19 nt, Homo sapiens
caagagcucaccacugaug

SEQ ID NO: 1011412 - RNA, 19 nt, Homo sapiens
ccauagggauuuucaguuu

SEQ ID NO: 1011413 - RNA, 19 nt, Homo sapiens
ucaggaaguugcaagagau

SEQ ID NO: 1011414 - RNA, 19 nt, Homo sapiens
uccaaagaaugaugaguga

SEQ ID NO: 1011415 - RNA, 19 nt, Homo sapiens
ggacacugacguuguuuag

SEQ ID NO: 1011416 - RNA, 19 nt, Homo sapiens
gcauagugguuuuauuuug

SEQ ID NO: 1011417 - RNA, 19 nt, Homo sapiens
uggacaagauuuauaugga

SEQ ID NO: 1011418 - RNA, 19 nt, Homo sapiens
cugaguaugugacacuaaa

SEQ ID NO: 1011419 - RNA, 19 nt, Homo sapiens
gcacgggacucuugucaau

SEQ ID NO: 1011420 - RNA, 19 nt, Homo sapiens
ggaggaggaugaacacuau

SEQ ID NO: 1011421 - RNA, 19 nt, Homo sapiens
ugaccacucuugagcaaua

SEQ ID NO: 1011422 - RNA, 19 nt, Homo sapiens
gcuaaccacuuggaagaua

SEQ ID NO: 1011423 - RNA, 19 nt, Homo sapiens
ugacaaagacagaaaugua

SEQ ID NO: 1011424 - RNA, 19 nt, Homo sapiens
gacaaagacagaaauguaa

SEQ ID NO: 1011425 - RNA, 19 nt, Homo sapiens
ccacagagccaccgucuau

SEQ ID NO: 1011426 - RNA, 19 nt, Homo sapiens
gcagauaugcuacaugaca

SEQ ID NO: 1011427 - RNA, 19 nt, Homo sapiens
gcaagcaggccgucuacuu

SEQ ID NO: 1011428 - RNA, 19 nt, Homo sapiens
gcgaugugcugcccauguu

SEQ ID NO: 1011429 - RNA, 19 nt, Homo sapiens
gcuaugcaguggaguuuca

SEQ ID NO: 1011430 - RNA, 19 nt, Homo sapiens
aggaugaacacuaugauua

SEQ ID NO: 1011431 - RNA, 19 nt, Homo sapiens
ggccggaauuauuaacaaa

SEQ ID NO: 1011432 - RNA, 19 nt, Homo sapiens
ggcagauccugaccuuuga

SEQ ID NO: 1011433 - RNA, 19 nt, Homo sapiens
cuaaccacuuggaagauaa

SEQ ID NO: 1011434 - RNA, 19 nt, Homo sapiens
ggccuugguucucgacauu

SEQ ID NO: 1011435 - RNA, 19 nt, Homo sapiens
augcagauaugcuacauga

SEQ ID NO: 1011436 - RNA, 19 nt, Homo sapiens
cagauaugcuacaugacaa

SEQ ID NO: 1011437 - RNA, 19 nt, Homo sapiens
gaggaugaacacuaugauu

SEQ ID NO: 1011438 - RNA, 19 nt, Homo sapiens
gauccugaccuuugacuuc

SEQ ID NO: 1011439 - RNA, 19 nt, Homo sapiens
ccaacauccuggucacaga

SEQ ID NO: 1011440 - RNA, 19 nt, Homo sapiens
acgggacucuugucaauga

SEQ ID NO: 1011441 - RNA, 19 nt, Homo sapiens
cgacacaggcgacaucauc

SEQ ID NO: 1011442 - RNA, 19 nt, Homo sapiens
caagcaggccgucuacuuc

SEQ ID NO: 1011443 - RNA, 19 nt, Homo sapiens
ggcgagccguucuucacua

SEQ ID NO: 1011444 - RNA, 19 nt, Homo sapiens
ccggaauuauuaacaaaug

SEQ ID NO: 1011445 - RNA, 19 nt, Homo sapiens
caacuggcaaggcugcuuu

SEQ ID NO: 1011446 - RNA, 19 nt, Homo sapiens
uucagcagcuucucacaaa

SEQ ID NO: 1011447 - RNA, 19 nt, Homo sapiens
cagaggaccagcccugaaa

SEQ ID NO: 1011448 - RNA, 19 nt, Homo sapiens
gcauagacuucagcaagca

SEQ ID NO: 1011449 - RNA, 19 nt, Homo sapiens
gauuaagguuaucaacaag

SEQ ID NO: 1011450 - RNA, 19 nt, Homo sapiens
ccacuacacucggauuucu

SEQ ID NO: 1011451 - RNA, 19 nt, Homo sapiens
ggaugaacacuaugauuac

SEQ ID NO: 1011452 - RNA, 19 nt, Homo sapiens
uggcagauccugaccuuug

SEQ ID NO: 1011453 - RNA, 19 nt, Homo sapiens
uaacaaaugaggaccuaca

SEQ ID NO: 1011454 - RNA, 19 nt, Homo sapiens
gcagaggaccagcccugaa

SEQ ID NO: 1011455 - RNA, 19 nt, Homo sapiens
cagaguuguuugacacaga

SEQ ID NO: 1011456 - RNA, 19 nt, Homo sapiens
gaccacucuugagcaauaa

SEQ ID NO: 1011457 - RNA, 19 nt, Homo sapiens
ggcacaaccucuacuucug

SEQ ID NO: 1011458 - RNA, 19 nt, Homo sapiens
gaccagcccugaaaagaau

SEQ ID NO: 1011459 - RNA, 19 nt, Homo sapiens
gagcuagugggcaccauga

SEQ ID NO: 1011460 - RNA, 19 nt, Homo sapiens
cacagcaggugccgacuuc

SEQ ID NO: 1011461 - RNA, 19 nt, Homo sapiens
gaucaaugaccaggacaga

SEQ ID NO: 1011462 - RNA, 19 nt, Homo sapiens
ugagagaguccgccagaug

SEQ ID NO: 1011463 - RNA, 19 nt, Homo sapiens
cacgaugacuacugcguau

SEQ ID NO: 1011464 - RNA, 19 nt, Homo sapiens
uggcuuuagugauaagauu

SEQ ID NO: 1011465 - RNA, 19 nt, Homo sapiens
ggucguggaacaagcuauu

SEQ ID NO: 1011466 - RNA, 19 nt, Homo sapiens
gagccguucuucacuacca

SEQ ID NO: 1011467 - RNA, 19 nt, Homo sapiens
gaccaggacagaacugauc

SEQ ID NO: 1011468 - RNA, 19 nt, Homo sapiens
cugugaagauuguggagaa

SEQ ID NO: 1011469 - RNA, 19 nt, Homo sapiens
gcgacaucaucauggaguu

SEQ ID NO: 1011470 - RNA, 19 nt, Homo sapiens
aggcucaccugcucuggaa

SEQ ID NO: 1011471 - RNA, 19 nt, Homo sapiens
ggcuuuagugauaagauua

SEQ ID NO: 1011472 - RNA, 19 nt, Homo sapiens
ugagugcaguggugugauc

SEQ ID NO: 1011473 - RNA, 19 nt, Homo sapiens
uggagcagguguuuacagu

SEQ ID NO: 1011474 - RNA, 19 nt, Homo sapiens
gaaggacagaggacagaag

SEQ ID NO: 1011475 - RNA, 19 nt, Homo sapiens
caggcgacaucaucaugga

SEQ ID NO: 1011476 - RNA, 19 nt, Homo sapiens
gaugcaguguguguacuuc

SEQ ID NO: 1011477 - RNA, 19 nt, Homo sapiens
gcuaugccaucgagguuuu

SEQ ID NO: 1011478 - RNA, 19 nt, Homo sapiens
gcaggccgucuacuucuuc

SEQ ID NO: 1011479 - RNA, 19 nt, Homo sapiens
ggaccuacagggcagaaag

SEQ ID NO: 1011480 - RNA, 19 nt, Homo sapiens
ccacuuggaagauaaaauu

SEQ ID NO: 1011481 - RNA, 19 nt, Homo sapiens
uggccgagcucaggugguu

SEQ ID NO: 1011482 - RNA, 19 nt, Homo sapiens
uuacaguccucagcgaugu

SEQ ID NO: 1011483 - RNA, 19 nt, Homo sapiens
gcgagccguucuucacuac

SEQ ID NO: 1011484 - RNA, 19 nt, Homo sapiens
cuagugggcaccaugaaga

SEQ ID NO: 1011485 - RNA, 19 nt, Homo sapiens
ggaccagcccugaaaagaa

SEQ ID NO: 1011486 - RNA, 19 nt, Homo sapiens
gccaugccgugccaacauc

SEQ ID NO: 1011487 - RNA, 19 nt, Homo sapiens
uuaagguuaucaacaagca

SEQ ID NO: 1011488 - RNA, 19 nt, Homo sapiens
gaguucaggcaugcagaua

SEQ ID NO: 1011489 - RNA, 19 nt, Homo sapiens
gcccacggacugucagcua

SEQ ID NO: 1011490 - RNA, 19 nt, Homo sapiens
acgcagcggugcuauggau

SEQ ID NO: 1011491 - RNA, 19 nt, Homo sapiens
ccuggcagauccugaccuu

SEQ ID NO: 1011492 - RNA, 19 nt, Homo sapiens
uaaccacuuggaagauaaa

SEQ ID NO: 1011493 - RNA, 19 nt, Homo sapiens
uggaggaggaugaacacua

SEQ ID NO: 1011494 - RNA, 19 nt, Homo sapiens
gcagggcucagcgcucuau

SEQ ID NO: 1011495 - RNA, 19 nt, Homo sapiens
cagcuaugcaguggaguuu

SEQ ID NO: 1011496 - RNA, 19 nt, Homo sapiens
gcugcacgcugugguugug

SEQ ID NO: 1011497 - RNA, 19 nt, Homo sapiens
cagcuucucacaaacuguu

SEQ ID NO: 1011498 - RNA, 19 nt, Homo sapiens
guucagcagcuucucacaa

SEQ ID NO: 1011499 - RNA, 19 nt, Homo sapiens
ucaaugaccaggacagaac

SEQ ID NO: 1011500 - RNA, 19 nt, Homo sapiens
ggaugcaguguguguacuu

SEQ ID NO: 1011501 - RNA, 19 nt, Homo sapiens
ugccauagcaggcgguuug

SEQ ID NO: 1011502 - RNA, 19 nt, Homo sapiens
gguuuggagagaucaauga

SEQ ID NO: 1011503 - RNA, 19 nt, Homo sapiens
caucgucccucccguugac

SEQ ID NO: 1011504 - RNA, 19 nt, Homo sapiens
ugaugcugcugugaagauu

SEQ ID NO: 1011505 - RNA, 19 nt, Homo sapiens
ggaggaugaacacuaugau

SEQ ID NO: 1011506 - RNA, 19 nt, Homo sapiens
ggaguucaggcaugcagau

SEQ ID NO: 1011507 - RNA, 19 nt, Homo sapiens
gggcucagcgcucuaucug

SEQ ID NO: 1011508 - RNA, 19 nt, Homo sapiens
gaugugcugcccauguuca

SEQ ID NO: 1011509 - RNA, 19 nt, Homo sapiens
ggugccgacuucugcuaug

SEQ ID NO: 1011510 - RNA, 19 nt, Homo sapiens
ccagacugaccacucuuga

SEQ ID NO: 1011511 - RNA, 19 nt, Homo sapiens
guuugaaccucugacaucu

SEQ ID NO: 1011512 - RNA, 19 nt, Homo sapiens
gcgcacccucugucuguga

SEQ ID NO: 1011513 - RNA, 19 nt, Homo sapiens
gcugagugcagugguguga

SEQ ID NO: 1011514 - RNA, 19 nt, Homo sapiens
auuaacaaaugaggaccua

SEQ ID NO: 1011515 - RNA, 19 nt, Homo sapiens
uguacuuccugccacaaga

SEQ ID NO: 1011516 - RNA, 19 nt, Homo sapiens
gaugaacacuaugauuacc

SEQ ID NO: 1011517 - RNA, 19 nt, Homo sapiens
caugacaaagacagaaaug

SEQ ID NO: 1011518 - RNA, 19 nt, Homo sapiens
ugugaagauuguggagaaa

SEQ ID NO: 1011519 - RNA, 19 nt, Homo sapiens
gacaagaucuuucuggaau

SEQ ID NO: 1011520 - RNA, 19 nt, Homo sapiens
ggacgugguugaggaauuc

SEQ ID NO: 1011521 - RNA, 19 nt, Homo sapiens
cagaguggcugccugcauu

SEQ ID NO: 1011522 - RNA, 19 nt, Homo sapiens
ccucuguccugccuuguua

SEQ ID NO: 1011523 - RNA, 19 nt, Homo sapiens
gcaacagccuacaguuugu

SEQ ID NO: 1011524 - RNA, 19 nt, Homo sapiens
caggugggccguugaguua

SEQ ID NO: 1011525 - RNA, 19 nt, Homo sapiens
acaacgaggucuauaacuu

SEQ ID NO: 1011526 - RNA, 19 nt, Homo sapiens
ugauguagcuucugcacuu

SEQ ID NO: 1011527 - RNA, 19 nt, Homo sapiens
cuucugcacuugacaaauu

SEQ ID NO: 1011528 - RNA, 19 nt, Homo sapiens
caacgaggucuauaacuug

SEQ ID NO: 1011529 - RNA, 19 nt, Homo sapiens
ggcguggccugcuaccuua

SEQ ID NO: 1011530 - RNA, 19 nt, Homo sapiens
cuucagaccuggcccugua

SEQ ID NO: 1011531 - RNA, 19 nt, Homo sapiens
ggaauucagcgauuuauac

SEQ ID NO: 1011532 - RNA, 19 nt, Homo sapiens
caagaucuuucuggaauuc

SEQ ID NO: 1011533 - RNA, 19 nt, Homo sapiens
ccagaggcccugagauuga

SEQ ID NO: 1011534 - RNA, 19 nt, Homo sapiens
ccaacggccuccuggaaga

SEQ ID NO: 1011535 - RNA, 19 nt, Homo sapiens
ccacuugccuacccucugu

SEQ ID NO: 1011536 - RNA, 19 nt, Homo sapiens
gcaucagccucuauuccaa

SEQ ID NO: 1011537 - RNA, 19 nt, Homo sapiens
gcaggugggaugaggauga

SEQ ID NO: 1011538 - RNA, 19 nt, Homo sapiens
acagucugcucaugaugua

SEQ ID NO: 1011539 - RNA, 19 nt, Homo sapiens
gcaguacaccaguuucuuc

SEQ ID NO: 1011540 - RNA, 19 nt, Homo sapiens
guugaggaauucagcgauu

SEQ ID NO: 1011541 - RNA, 19 nt, Homo sapiens
gcaggugggccguugaguu

SEQ ID NO: 1011542 - RNA, 19 nt, Homo sapiens
gaccuggcccuguagcuuu

SEQ ID NO: 1011543 - RNA, 19 nt, Homo sapiens
gugcaacagccuacaguuu

SEQ ID NO: 1011544 - RNA, 19 nt, Homo sapiens
gaauucagcgauuuauaca

SEQ ID NO: 1011545 - RNA, 19 nt, Homo sapiens
uuccacagcuuguuccaaa

SEQ ID NO: 1011546 - RNA, 19 nt, Homo sapiens
ugaggaauucagcgauuua

SEQ ID NO: 1011547 - RNA, 19 nt, Homo sapiens
ggaacccuaucuaucaucu

SEQ ID NO: 1011548 - RNA, 19 nt, Homo sapiens
agaauggcguggccugcua

SEQ ID NO: 1011549 - RNA, 19 nt, Homo sapiens
gcacgaggcccuugaaaau

SEQ ID NO: 1011550 - RNA, 19 nt, Homo sapiens
cgacaagaucuuucuggaa

SEQ ID NO: 1011551 - RNA, 19 nt, Homo sapiens
guaaccgcaucaggaauga

SEQ ID NO: 1011552 - RNA, 19 nt, Homo sapiens
gugcagagugugaaacuug

SEQ ID NO: 1011553 - RNA, 19 nt, Homo sapiens
guggcugccugcauucauu

SEQ ID NO: 1011554 - RNA, 19 nt, Homo sapiens
gccugaagcucgccaugau

SEQ ID NO: 1011555 - RNA, 19 nt, Homo sapiens
gauguagcuucugcacuug

SEQ ID NO: 1011556 - RNA, 19 nt, Homo sapiens
acaagaucuuucuggaauu

SEQ ID NO: 1011557 - RNA, 19 nt, Homo sapiens
uaucuaucaucuagcagaa

SEQ ID NO: 1011558 - RNA, 19 nt, Homo sapiens
guccugccuuguuauugua

SEQ ID NO: 1011559 - RNA, 19 nt, Homo sapiens
gggcagcaacccuuacuuc

SEQ ID NO: 1011560 - RNA, 19 nt, Homo sapiens
ccacagcuuguuccaaaga

SEQ ID NO: 1011561 - RNA, 19 nt, Homo sapiens
gggcggauguggagaagcu

SEQ ID NO: 1011562 - RNA, 19 nt, Homo sapiens
cauggagggccuuauuuga

SEQ ID NO: 1011563 - RNA, 19 nt, Homo sapiens
ccacccaccgcaaguacua

SEQ ID NO: 1011564 - RNA, 19 nt, Homo sapiens
gaucugcggcuuugauguc

SEQ ID NO: 1011565 - RNA, 19 nt, Homo sapiens
caagaucugcggcuuugau

SEQ ID NO: 1011566 - RNA, 19 nt, Homo sapiens
agucaaugcugaaagucaa

SEQ ID NO: 1011567 - RNA, 19 nt, Homo sapiens
gagcucugguaccgcaaga

SEQ ID NO: 1011568 - RNA, 19 nt, Homo sapiens
ccauggagggccuuauuug

SEQ ID NO: 1011569 - RNA, 19 nt, Homo sapiens
ggaaaccuguccgcugcau

SEQ ID NO: 1011570 - RNA, 19 nt, Homo sapiens
cggacgguaugcaaaguug

SEQ ID NO: 1011571 - RNA, 19 nt, Homo sapiens
uguccugccuuguuauugu

SEQ ID NO: 1011572 - RNA, 19 nt, Homo sapiens
gagaugcugcgucaguuca

SEQ ID NO: 1011573 - RNA, 19 nt, Homo sapiens
aacgaggucuauaacuuga

SEQ ID NO: 1011574 - RNA, 19 nt, Homo sapiens
ugcaacagccuacaguuug

SEQ ID NO: 1011575 - RNA, 19 nt, Homo sapiens
aaaccuguccgcugcauuc

SEQ ID NO: 1011576 - RNA, 19 nt, Homo sapiens
gcacgauaaaccagucaau

SEQ ID NO: 1011577 - RNA, 19 nt, Homo sapiens
ggaugucacugugcuugag

SEQ ID NO: 1011578 - RNA, 19 nt, Homo sapiens
gcagccaaagcacuucuug

SEQ ID NO: 1011579 - RNA, 19 nt, Homo sapiens
gccguugaguuaccucugu

SEQ ID NO: 1011580 - RNA, 19 nt, Homo sapiens
ggagaugcugcgucaguuc

SEQ ID NO: 1011581 - RNA, 19 nt, Homo sapiens
gacagucugcucaugaugu

SEQ ID NO: 1011582 - RNA, 19 nt, Homo sapiens
ugaauccaguggugacagu

SEQ ID NO: 1011583 - RNA, 19 nt, Homo sapiens
gaacccuaucuaucaucua

SEQ ID NO: 1011584 - RNA, 19 nt, Homo sapiens
caaggacgugguugaggaa

SEQ ID NO: 1011585 - RNA, 19 nt, Homo sapiens
aacccuaucuaucaucuag

SEQ ID NO: 1011586 - RNA, 19 nt, Homo sapiens
gguaugcaaaguugugaau

SEQ ID NO: 1011587 - RNA, 19 nt, Homo sapiens
cggagaugcugcgucaguu

SEQ ID NO: 1011588 - RNA, 19 nt, Homo sapiens
ucgccaugauccagcagua

SEQ ID NO: 1011589 - RNA, 19 nt, Homo sapiens
gaggaauucagcgauuuau

SEQ ID NO: 1011590 - RNA, 19 nt, Homo sapiens
uugaggaauucagcgauuu

SEQ ID NO: 1011591 - RNA, 19 nt, Homo sapiens
caugggaacccuaucuauc

SEQ ID NO: 1011592 - RNA, 19 nt, Homo sapiens
gagcgcggacgguaugcaa

SEQ ID NO: 1011593 - RNA, 19 nt, Homo sapiens
uguccucgcugcugagaag

SEQ ID NO: 1011594 - RNA, 19 nt, Homo sapiens
gaaaccuguccgcugcauu

SEQ ID NO: 1011595 - RNA, 19 nt, Homo sapiens
cguaaccgcaucaggaaug

SEQ ID NO: 1011596 - RNA, 19 nt, Homo sapiens
gaaaauguugacagucuug

SEQ ID NO: 1011597 - RNA, 19 nt, Homo sapiens
caaagacagcgcccaugca

SEQ ID NO: 1011598 - RNA, 19 nt, Homo sapiens
gugcugagcggcuggaucu

SEQ ID NO: 1011599 - RNA, 19 nt, Homo sapiens
cgaccacaaucacgacacu

SEQ ID NO: 1011600 - RNA, 19 nt, Homo sapiens
ccuucaauacuuugcauuu

SEQ ID NO: 1011601 - RNA, 19 nt, Homo sapiens
aagaggcaguacaccaguu

SEQ ID NO: 1011602 - RNA, 19 nt, Homo sapiens
auucagcgauuuauacaac

SEQ ID NO: 1011603 - RNA, 19 nt, Homo sapiens
ccugcuaccuuaccaacca

SEQ ID NO: 1011604 - RNA, 19 nt, Homo sapiens
uuuaucuucuguagagcua

SEQ ID NO: 1011605 - RNA, 19 nt, Homo sapiens
uuccugauccucuguagaa

SEQ ID NO: 1011606 - RNA, 19 nt, Homo sapiens
gauguaccgagaccucuuc

SEQ ID NO: 1011607 - RNA, 19 nt, Homo sapiens
uucugcacuugacaaauua

SEQ ID NO: 1011608 - RNA, 19 nt, Homo sapiens
cggcuuugauguccucuac

SEQ ID NO: 1011609 - RNA, 19 nt, Homo sapiens
gcaccaccgacaagaucuu

SEQ ID NO: 1011610 - RNA, 19 nt, Homo sapiens
gcauuggcaccaccgacaa

SEQ ID NO: 1011611 - RNA, 19 nt, Homo sapiens
ucagcgauuuauacaacga

SEQ ID NO: 1011612 - RNA, 19 nt, Homo sapiens
ccaugggaacccuaucuau

SEQ ID NO: 1011613 - RNA, 19 nt, Homo sapiens
aauguugacagucuuguga

SEQ ID NO: 1011614 - RNA, 19 nt, Homo sapiens
gcucugguaccgcaagauc

SEQ ID NO: 1011615 - RNA, 19 nt, Homo sapiens
cggcggaccaugugauugu

SEQ ID NO: 1011616 - RNA, 19 nt, Homo sapiens
cgaggacugugagcugauc

SEQ ID NO: 1011617 - RNA, 19 nt, Homo sapiens
guucuuccggcacgauaaa

SEQ ID NO: 1011618 - RNA, 19 nt, Homo sapiens
gaguucuuccggcacgaua

SEQ ID NO: 1011619 - RNA, 19 nt, Homo sapiens
gacaagaucuuucuggaau

SEQ ID NO: 1011620 - RNA, 19 nt, Homo sapiens
ggacgugguugaggaauuc

SEQ ID NO: 1011621 - RNA, 19 nt, Homo sapiens
ccucuguccugccuuguua

SEQ ID NO: 1011622 - RNA, 19 nt, Homo sapiens
gcaacagccuacaguuugu

SEQ ID NO: 1011623 - RNA, 19 nt, Homo sapiens
caggugggccguugaguua

SEQ ID NO: 1011624 - RNA, 19 nt, Homo sapiens
acaacgaggucuauaacuu

SEQ ID NO: 1011625 - RNA, 19 nt, Homo sapiens
caacgaggucuauaacuug

SEQ ID NO: 1011626 - RNA, 19 nt, Homo sapiens
ggcguggccugcuaccuua

SEQ ID NO: 1011627 - RNA, 19 nt, Homo sapiens
cuucagaccuggcccugua

SEQ ID NO: 1011628 - RNA, 19 nt, Homo sapiens
ggaauucagcgauuuauac

SEQ ID NO: 1011629 - RNA, 19 nt, Homo sapiens
caagaucuuucuggaauuc

SEQ ID NO: 1011630 - RNA, 19 nt, Homo sapiens
ccagaggcccugagauuga

SEQ ID NO: 1011631 - RNA, 19 nt, Homo sapiens
ccaacggccuccuggaaga

SEQ ID NO: 1011632 - RNA, 19 nt, Homo sapiens
ccacuugccuacccucugu

SEQ ID NO: 1011633 - RNA, 19 nt, Homo sapiens
gcaucagccucuauuccaa

SEQ ID NO: 1011634 - RNA, 19 nt, Homo sapiens
gcaggugggaugaggauga

SEQ ID NO: 1011635 - RNA, 19 nt, Homo sapiens
gcaguacaccaguuucuuc

SEQ ID NO: 1011636 - RNA, 19 nt, Homo sapiens
guugaggaauucagcgauu

SEQ ID NO: 1011637 - RNA, 19 nt, Homo sapiens
gcaggugggccguugaguu

SEQ ID NO: 1011638 - RNA, 19 nt, Homo sapiens
gaccuggcccuguagcuuu

SEQ ID NO: 1011639 - RNA, 19 nt, Homo sapiens
gugcaacagccuacaguuu

SEQ ID NO: 1011640 - RNA, 19 nt, Homo sapiens
gaauucagcgauuuauaca

SEQ ID NO: 1011641 - RNA, 19 nt, Homo sapiens
ugaggaauucagcgauuua

SEQ ID NO: 1011642 - RNA, 19 nt, Homo sapiens
ggaacccuaucuaucaucu

SEQ ID NO: 1011643 - RNA, 19 nt, Homo sapiens
agaauggcguggccugcua

SEQ ID NO: 1011644 - RNA, 19 nt, Homo sapiens
cgacaagaucuuucuggaa

SEQ ID NO: 1011645 - RNA, 19 nt, Homo sapiens
guaaccgcaucaggaauga

SEQ ID NO: 1011646 - RNA, 19 nt, Homo sapiens
gugcagagugugaaacuug

SEQ ID NO: 1011647 - RNA, 19 nt, Homo sapiens
gccugaagcucgccaugau

SEQ ID NO: 1011648 - RNA, 19 nt, Homo sapiens
acaagaucuuucuggaauu

SEQ ID NO: 1011649 - RNA, 19 nt, Homo sapiens
uaucuaucaucuagcagaa

SEQ ID NO: 1011650 - RNA, 19 nt, Homo sapiens
guccugccuuguuauugua

SEQ ID NO: 1011651 - RNA, 19 nt, Homo sapiens
gggcagcaacccuuacuuc

SEQ ID NO: 1011652 - RNA, 19 nt, Homo sapiens
gggcggauguggagaagcu

SEQ ID NO: 1011653 - RNA, 19 nt, Homo sapiens
ccacccaccgcaaguacua

SEQ ID NO: 1011654 - RNA, 19 nt, Homo sapiens
gaucugcggcuuugauguc

SEQ ID NO: 1011655 - RNA, 19 nt, Homo sapiens
caagaucugcggcuuugau

SEQ ID NO: 1011656 - RNA, 19 nt, Homo sapiens
agucaaugcugaaagucaa

SEQ ID NO: 1011657 - RNA, 19 nt, Homo sapiens
gagcucugguaccgcaaga

SEQ ID NO: 1011658 - RNA, 19 nt, Homo sapiens
ggaaaccuguccgcugcau

SEQ ID NO: 1011659 - RNA, 19 nt, Homo sapiens
cggacgguaugcaaaguug

SEQ ID NO: 1011660 - RNA, 19 nt, Homo sapiens
uguccugccuuguuauugu

SEQ ID NO: 1011661 - RNA, 19 nt, Homo sapiens
gagaugcugcgucaguuca

SEQ ID NO: 1011662 - RNA, 19 nt, Homo sapiens
aacgaggucuauaacuuga

SEQ ID NO: 1011663 - RNA, 19 nt, Homo sapiens
gcagccaaagcacuucuug

SEQ ID NO: 1011664 - RNA, 19 nt, Homo sapiens
ugcaacagccuacaguuug

SEQ ID NO: 1011665 - RNA, 19 nt, Homo sapiens
aaaccuguccgcugcauuc

SEQ ID NO: 1011666 - RNA, 19 nt, Homo sapiens
ggaugucacugugcuugag

SEQ ID NO: 1011667 - RNA, 19 nt, Homo sapiens
gcacgauaaaccagucaau

SEQ ID NO: 1011668 - RNA, 19 nt, Homo sapiens
gccguugaguuaccucugu

SEQ ID NO: 1011669 - RNA, 19 nt, Homo sapiens
ggagaugcugcgucaguuc

SEQ ID NO: 1011670 - RNA, 19 nt, Homo sapiens
ugaauccaguggugacagu

SEQ ID NO: 1011671 - RNA, 19 nt, Homo sapiens
gcucgccgcagacuuacuu

SEQ ID NO: 1011672 - RNA, 19 nt, Homo sapiens
gaacccuaucuaucaucua

SEQ ID NO: 1011673 - RNA, 19 nt, Homo sapiens
gguaugcaaaguugugaau

SEQ ID NO: 1011674 - RNA, 19 nt, Homo sapiens
caaggacgugguugaggaa

SEQ ID NO: 1011675 - RNA, 19 nt, Homo sapiens
aacccuaucuaucaucuag

SEQ ID NO: 1011676 - RNA, 19 nt, Homo sapiens
cggagaugcugcgucaguu

SEQ ID NO: 1011677 - RNA, 19 nt, Homo sapiens
ucgccaugauccagcagua

SEQ ID NO: 1011678 - RNA, 19 nt, Homo sapiens
gaggaauucagcgauuuau

SEQ ID NO: 1011679 - RNA, 19 nt, Homo sapiens
uugaggaauucagcgauuu

SEQ ID NO: 1011680 - RNA, 19 nt, Homo sapiens
gagcgcggacgguaugcaa

SEQ ID NO: 1011681 - RNA, 19 nt, Homo sapiens
caugggaacccuaucuauc

SEQ ID NO: 1011682 - RNA, 19 nt, Homo sapiens
uguccucgcugcugagaag

SEQ ID NO: 1011683 - RNA, 19 nt, Homo sapiens
gaaaccuguccgcugcauu

SEQ ID NO: 1011684 - RNA, 19 nt, Homo sapiens
cguaaccgcaucaggaaug

SEQ ID NO: 1011685 - RNA, 19 nt, Homo sapiens
caaagacagcgcccaugca

SEQ ID NO: 1011686 - RNA, 19 nt, Homo sapiens
gugcugagcggcuggaucu

SEQ ID NO: 1011687 - RNA, 19 nt, Homo sapiens
cgaccacaaucacgacacu

SEQ ID NO: 1011688 - RNA, 19 nt, Homo sapiens
ccuucaauacuuugcauuu

SEQ ID NO: 1011689 - RNA, 19 nt, Homo sapiens
aagaggcaguacaccaguu

SEQ ID NO: 1011690 - RNA, 19 nt, Homo sapiens
auucagcgauuuauacaac

SEQ ID NO: 1011691 - RNA, 19 nt, Homo sapiens
ccugcuaccuuaccaacca

SEQ ID NO: 1011692 - RNA, 19 nt, Homo sapiens
uuuaucuucuguagagcua

SEQ ID NO: 1011693 - RNA, 19 nt, Homo sapiens
uuccugauccucuguagaa

SEQ ID NO: 1011694 - RNA, 19 nt, Homo sapiens
gauguaccgagaccucuuc

SEQ ID NO: 1011695 - RNA, 19 nt, Homo sapiens
ccaugggaacccuaucuau

SEQ ID NO: 1011696 - RNA, 19 nt, Homo sapiens
cggcuuugauguccucuac

SEQ ID NO: 1011697 - RNA, 19 nt, Homo sapiens
gcaccaccgacaagaucuu

SEQ ID NO: 1011698 - RNA, 19 nt, Homo sapiens
gcauuggcaccaccgacaa

SEQ ID NO: 1011699 - RNA, 19 nt, Homo sapiens
ucagcgauuuauacaacga

SEQ ID NO: 1011700 - RNA, 19 nt, Homo sapiens
gcucugguaccgcaagauc

SEQ ID NO: 1011701 - RNA, 19 nt, Homo sapiens
cggcggaccaugugauugu

SEQ ID NO: 1011702 - RNA, 19 nt, Homo sapiens
cgaggacugugagcugauc

SEQ ID NO: 1011703 - RNA, 19 nt, Homo sapiens
gaggccgugugcagagugu

SEQ ID NO: 1011704 - RNA, 19 nt, Homo sapiens
guucuuccggcacgauaaa

SEQ ID NO: 1011705 - RNA, 19 nt, Homo sapiens
gaguucuuccggcacgaua

SEQ ID NO: 1011706 - RNA, 19 nt, Homo sapiens
agaggcaguacaccaguuu

SEQ ID NO: 1011707 - RNA, 19 nt, Homo sapiens
ggugagggcgaccacaauc

SEQ ID NO: 1011708 - RNA, 19 nt, Homo sapiens
cagaggcccugagauugag

SEQ ID NO: 1011709 - RNA, 19 nt, Homo sapiens
gacaagaucuuucuggaau

SEQ ID NO: 1011710 - RNA, 19 nt, Homo sapiens
ggacgugguugaggaauuc

SEQ ID NO: 1011711 - RNA, 19 nt, Homo sapiens
ccucuguccugccuuguua

SEQ ID NO: 1011712 - RNA, 19 nt, Homo sapiens
gcaacagccuacaguuugu

SEQ ID NO: 1011713 - RNA, 19 nt, Homo sapiens
caggugggccguugaguua

SEQ ID NO: 1011714 - RNA, 19 nt, Homo sapiens
acaacgaggucuauaacuu

SEQ ID NO: 1011715 - RNA, 19 nt, Homo sapiens
caacgaggucuauaacuug

SEQ ID NO: 1011716 - RNA, 19 nt, Homo sapiens
ggcguggccugcuaccuua

SEQ ID NO: 1011717 - RNA, 19 nt, Homo sapiens
cuucagaccuggcccugua

SEQ ID NO: 1011718 - RNA, 19 nt, Homo sapiens
ggaauucagcgauuuauac

SEQ ID NO: 1011719 - RNA, 19 nt, Homo sapiens
caagaucuuucuggaauuc

SEQ ID NO: 1011720 - RNA, 19 nt, Homo sapiens
ccagaggcccugagauuga

SEQ ID NO: 1011721 - RNA, 19 nt, Homo sapiens
ccaacggccuccuggaaga

SEQ ID NO: 1011722 - RNA, 19 nt, Homo sapiens
ccacuugccuacccucugu

SEQ ID NO: 1011723 - RNA, 19 nt, Homo sapiens
gcaucagccucuauuccaa

SEQ ID NO: 1011724 - RNA, 19 nt, Homo sapiens
gcaguacaccaguuucuuc

SEQ ID NO: 1011725 - RNA, 19 nt, Homo sapiens
guugaggaauucagcgauu

SEQ ID NO: 1011726 - RNA, 19 nt, Homo sapiens
gcaggugggccguugaguu

SEQ ID NO: 1011727 - RNA, 19 nt, Homo sapiens
gaccuggcccuguagcuuu

SEQ ID NO: 1011728 - RNA, 19 nt, Homo sapiens
gugcaacagccuacaguuu

SEQ ID NO: 1011729 - RNA, 19 nt, Homo sapiens
gaauucagcgauuuauaca

SEQ ID NO: 1011730 - RNA, 19 nt, Homo sapiens
ugaggaauucagcgauuua

SEQ ID NO: 1011731 - RNA, 19 nt, Homo sapiens
ggaacccuaucuaucaucu

SEQ ID NO: 1011732 - RNA, 19 nt, Homo sapiens
agaauggcguggccugcua

SEQ ID NO: 1011733 - RNA, 19 nt, Homo sapiens
cgacaagaucuuucuggaa

SEQ ID NO: 1011734 - RNA, 19 nt, Homo sapiens
guaaccgcaucaggaauga

SEQ ID NO: 1011735 - RNA, 19 nt, Homo sapiens
gugcagagugugaaacuug

SEQ ID NO: 1011736 - RNA, 19 nt, Homo sapiens
gccugaagcucgccaugau

SEQ ID NO: 1011737 - RNA, 19 nt, Homo sapiens
acaagaucuuucuggaauu

SEQ ID NO: 1011738 - RNA, 19 nt, Homo sapiens
uaucuaucaucuagcagaa

SEQ ID NO: 1011739 - RNA, 19 nt, Homo sapiens
guccugccuuguuauugua

SEQ ID NO: 1011740 - RNA, 19 nt, Homo sapiens
gggcagcaacccuuacuuc

SEQ ID NO: 1011741 - RNA, 19 nt, Homo sapiens
gggcggauguggagaagcu

SEQ ID NO: 1011742 - RNA, 19 nt, Homo sapiens
ccacccaccgcaaguacua

SEQ ID NO: 1011743 - RNA, 19 nt, Homo sapiens
gaucugcggcuuugauguc

SEQ ID NO: 1011744 - RNA, 19 nt, Homo sapiens
caagaucugcggcuuugau

SEQ ID NO: 1011745 - RNA, 19 nt, Homo sapiens
agucaaugcugaaagucaa

SEQ ID NO: 1011746 - RNA, 19 nt, Homo sapiens
gagcucugguaccgcaaga

SEQ ID NO: 1011747 - RNA, 19 nt, Homo sapiens
ggaaaccuguccgcugcau

SEQ ID NO: 1011748 - RNA, 19 nt, Homo sapiens
cggacgguaugcaaaguug

SEQ ID NO: 1011749 - RNA, 19 nt, Homo sapiens
uguccugccuuguuauugu

SEQ ID NO: 1011750 - RNA, 19 nt, Homo sapiens
gagaugcugcgucaguuca

SEQ ID NO: 1011751 - RNA, 19 nt, Homo sapiens
aacgaggucuauaacuuga

SEQ ID NO: 1011752 - RNA, 19 nt, Homo sapiens
gcagccaaagcacuucuug

SEQ ID NO: 1011753 - RNA, 19 nt, Homo sapiens
ugcaacagccuacaguuug

SEQ ID NO: 1011754 - RNA, 19 nt, Homo sapiens
aaaccuguccgcugcauuc

SEQ ID NO: 1011755 - RNA, 19 nt, Homo sapiens
gcacgauaaaccagucaau

SEQ ID NO: 1011756 - RNA, 19 nt, Homo sapiens
ggaugucacugugcuugag

SEQ ID NO: 1011757 - RNA, 19 nt, Homo sapiens
gccguugaguuaccucugu

SEQ ID NO: 1011758 - RNA, 19 nt, Homo sapiens
ggagaugcugcgucaguuc

SEQ ID NO: 1011759 - RNA, 19 nt, Homo sapiens
ugaauccaguggugacagu

SEQ ID NO: 1011760 - RNA, 19 nt, Homo sapiens
gcucgccgcagacuuacuu

SEQ ID NO: 1011761 - RNA, 19 nt, Homo sapiens
gaacccuaucuaucaucua

SEQ ID NO: 1011762 - RNA, 19 nt, Homo sapiens
gguaugcaaaguugugaau

SEQ ID NO: 1011763 - RNA, 19 nt, Homo sapiens
caaggacgugguugaggaa

SEQ ID NO: 1011764 - RNA, 19 nt, Homo sapiens
aacccuaucuaucaucuag

SEQ ID NO: 1011765 - RNA, 19 nt, Homo sapiens
cggagaugcugcgucaguu

SEQ ID NO: 1011766 - RNA, 19 nt, Homo sapiens
ucgccaugauccagcagua

SEQ ID NO: 1011767 - RNA, 19 nt, Homo sapiens
gaggaauucagcgauuuau

SEQ ID NO: 1011768 - RNA, 19 nt, Homo sapiens
uugaggaauucagcgauuu

SEQ ID NO: 1011769 - RNA, 19 nt, Homo sapiens
gagcgcggacgguaugcaa

SEQ ID NO: 1011770 - RNA, 19 nt, Homo sapiens
caugggaacccuaucuauc

SEQ ID NO: 1011771 - RNA, 19 nt, Homo sapiens
uguccucgcugcugagaag

SEQ ID NO: 1011772 - RNA, 19 nt, Homo sapiens
gaaaccuguccgcugcauu

SEQ ID NO: 1011773 - RNA, 19 nt, Homo sapiens
cguaaccgcaucaggaaug

SEQ ID NO: 1011774 - RNA, 19 nt, Homo sapiens
caaagacagcgcccaugca

SEQ ID NO: 1011775 - RNA, 19 nt, Homo sapiens
gugcugagcggcuggaucu

SEQ ID NO: 1011776 - RNA, 19 nt, Homo sapiens
ccuucaauacuuugcauuu

SEQ ID NO: 1011777 - RNA, 19 nt, Homo sapiens
aagaggcaguacaccaguu

SEQ ID NO: 1011778 - RNA, 19 nt, Homo sapiens
auucagcgauuuauacaac

SEQ ID NO: 1011779 - RNA, 19 nt, Homo sapiens
ccugcuaccuuaccaacca

SEQ ID NO: 1011780 - RNA, 19 nt, Homo sapiens
uuuaucuucuguagagcua

SEQ ID NO: 1011781 - RNA, 19 nt, Homo sapiens
uuccugauccucuguagaa

SEQ ID NO: 1011782 - RNA, 19 nt, Homo sapiens
gauguaccgagaccucuuc

SEQ ID NO: 1011783 - RNA, 19 nt, Homo sapiens
ccaugggaacccuaucuau

SEQ ID NO: 1011784 - RNA, 19 nt, Homo sapiens
cggcuuugauguccucuac

SEQ ID NO: 1011785 - RNA, 19 nt, Homo sapiens
gcaccaccgacaagaucuu

SEQ ID NO: 1011786 - RNA, 19 nt, Homo sapiens
gcauuggcaccaccgacaa

SEQ ID NO: 1011787 - RNA, 19 nt, Homo sapiens
ucagcgauuuauacaacga

SEQ ID NO: 1011788 - RNA, 19 nt, Homo sapiens
gaggccgugugcagagugu

SEQ ID NO: 1011789 - RNA, 19 nt, Homo sapiens
gcucugguaccgcaagauc

SEQ ID NO: 1011790 - RNA, 19 nt, Homo sapiens
guucuuccggcacgauaaa

SEQ ID NO: 1011791 - RNA, 19 nt, Homo sapiens
gaguucuuccggcacgaua

SEQ ID NO: 1011792 - RNA, 19 nt, Homo sapiens
agaggcaguacaccaguuu

SEQ ID NO: 1011793 - RNA, 19 nt, Homo sapiens
cagaggcccugagauugag

SEQ ID NO: 1011794 - RNA, 19 nt, Homo sapiens
ggacgugguugaggaauuc

SEQ ID NO: 1011795 - RNA, 19 nt, Homo sapiens
ccucuguccugccuuguua

SEQ ID NO: 1011796 - RNA, 19 nt, Homo sapiens
caggugggccguugaguua

SEQ ID NO: 1011797 - RNA, 19 nt, Homo sapiens
ggcguggccugcuaccuua

SEQ ID NO: 1011798 - RNA, 19 nt, Homo sapiens
cuucagaccuggcccugua

SEQ ID NO: 1011799 - RNA, 19 nt, Homo sapiens
ggaauucagcgauuuauac

SEQ ID NO: 1011800 - RNA, 19 nt, Homo sapiens
ccaacggccuccuggaaga

SEQ ID NO: 1011801 - RNA, 19 nt, Homo sapiens
ccacuugccuacccucugu

SEQ ID NO: 1011802 - RNA, 19 nt, Homo sapiens
gcaucagccucuauuccaa

SEQ ID NO: 1011803 - RNA, 19 nt, Homo sapiens
guugaggaauucagcgauu

SEQ ID NO: 1011804 - RNA, 19 nt, Homo sapiens
gcaggugggccguugaguu

SEQ ID NO: 1011805 - RNA, 19 nt, Homo sapiens
gaccuggcccuguagcuuu

SEQ ID NO: 1011806 - RNA, 19 nt, Homo sapiens
gaauucagcgauuuauaca

SEQ ID NO: 1011807 - RNA, 19 nt, Homo sapiens
ugaggaauucagcgauuua

SEQ ID NO: 1011808 - RNA, 19 nt, Homo sapiens
ggaacccuaucuaucaucu

SEQ ID NO: 1011809 - RNA, 19 nt, Homo sapiens
agaauggcguggccugcua

SEQ ID NO: 1011810 - RNA, 19 nt, Homo sapiens
gugcagagugugaaacuug

SEQ ID NO: 1011811 - RNA, 19 nt, Homo sapiens
uaucuaucaucuagcagaa

SEQ ID NO: 1011812 - RNA, 19 nt, Homo sapiens
guccugccuuguuauugua

SEQ ID NO: 1011813 - RNA, 19 nt, Homo sapiens
ccacccaccgcaaguacua

SEQ ID NO: 1011814 - RNA, 19 nt, Homo sapiens
cggacgguaugcaaaguug

SEQ ID NO: 1011815 - RNA, 19 nt, Homo sapiens
uguccugccuuguuauugu

SEQ ID NO: 1011816 - RNA, 19 nt, Homo sapiens
ggaugucacugugcuugag

SEQ ID NO: 1011817 - RNA, 19 nt, Homo sapiens
gcagccaaagcacuucuug

SEQ ID NO: 1011818 - RNA, 19 nt, Homo sapiens
gccguugaguuaccucugu

SEQ ID NO: 1011819 - RNA, 19 nt, Homo sapiens
ugaauccaguggugacagu

SEQ ID NO: 1011820 - RNA, 19 nt, Homo sapiens
gcucgccgcagacuuacuu

SEQ ID NO: 1011821 - RNA, 19 nt, Homo sapiens
gaacccuaucuaucaucua

SEQ ID NO: 1011822 - RNA, 19 nt, Homo sapiens
caaggacgugguugaggaa

SEQ ID NO: 1011823 - RNA, 19 nt, Homo sapiens
gguaugcaaaguugugaau

SEQ ID NO: 1011824 - RNA, 19 nt, Homo sapiens
aacccuaucuaucaucuag

SEQ ID NO: 1011825 - RNA, 19 nt, Homo sapiens
gagcgcggacgguaugcaa

SEQ ID NO: 1011826 - RNA, 19 nt, Homo sapiens
gaggaauucagcgauuuau

SEQ ID NO: 1011827 - RNA, 19 nt, Homo sapiens
uugaggaauucagcgauuu

SEQ ID NO: 1011828 - RNA, 19 nt, Homo sapiens
caugggaacccuaucuauc

SEQ ID NO: 1011829 - RNA, 19 nt, Homo sapiens
uguccucgcugcugagaag

SEQ ID NO: 1011830 - RNA, 19 nt, Homo sapiens
ccuucaauacuuugcauuu

SEQ ID NO: 1011831 - RNA, 19 nt, Homo sapiens
auucagcgauuuauacaac

SEQ ID NO: 1011832 - RNA, 19 nt, Homo sapiens
ccugcuaccuuaccaacca

SEQ ID NO: 1011833 - RNA, 19 nt, Homo sapiens
uuuaucuucuguagagcua

SEQ ID NO: 1011834 - RNA, 19 nt, Homo sapiens
uuccugauccucuguagaa

SEQ ID NO: 1011835 - RNA, 19 nt, Homo sapiens
gauguaccgagaccucuuc

SEQ ID NO: 1011836 - RNA, 19 nt, Homo sapiens
ucagcgauuuauacaacga

SEQ ID NO: 1011837 - RNA, 19 nt, Homo sapiens
ccaugggaacccuaucuau

SEQ ID NO: 1011838 - RNA, 19 nt, Homo sapiens
gaggccgugugcagagugu

SEQ ID NO: 1011839 - RNA, 19 nt, Homo sapiens
gacaagaucuuucuggaau

SEQ ID NO: 1011840 - RNA, 19 nt, Homo sapiens
ggacgugguugaggaauuc

SEQ ID NO: 1011841 - RNA, 19 nt, Homo sapiens
ccucuguccugccuuguua

SEQ ID NO: 1011842 - RNA, 19 nt, Homo sapiens
gcaacagccuacaguuugu

SEQ ID NO: 1011843 - RNA, 19 nt, Homo sapiens
caggugggccguugaguua

SEQ ID NO: 1011844 - RNA, 19 nt, Homo sapiens
acaacgaggucuauaacuu

SEQ ID NO: 1011845 - RNA, 19 nt, Homo sapiens
caacgaggucuauaacuug

SEQ ID NO: 1011846 - RNA, 19 nt, Homo sapiens
ggcguggccugcuaccuua

SEQ ID NO: 1011847 - RNA, 19 nt, Homo sapiens
cuucagaccuggcccugua

SEQ ID NO: 1011848 - RNA, 19 nt, Homo sapiens
ggaauucagcgauuuauac

SEQ ID NO: 1011849 - RNA, 19 nt, Homo sapiens
caagaucuuucuggaauuc

SEQ ID NO: 1011850 - RNA, 19 nt, Homo sapiens
ccagaggcccugagauuga

SEQ ID NO: 1011851 - RNA, 19 nt, Homo sapiens
ccaacggccuccuggaaga

SEQ ID NO: 1011852 - RNA, 19 nt, Homo sapiens
ccacuugccuacccucugu

SEQ ID NO: 1011853 - RNA, 19 nt, Homo sapiens
gcagcagccuggucaccuu

SEQ ID NO: 1011854 - RNA, 19 nt, Homo sapiens
gcaucagccucuauuccaa

SEQ ID NO: 1011855 - RNA, 19 nt, Homo sapiens
gcaguacaccaguuucuuc

SEQ ID NO: 1011856 - RNA, 19 nt, Homo sapiens
guugaggaauucagcgauu

SEQ ID NO: 1011857 - RNA, 19 nt, Homo sapiens
gcaggugggccguugaguu

SEQ ID NO: 1011858 - RNA, 19 nt, Homo sapiens
gaccuggcccuguagcuuu

SEQ ID NO: 1011859 - RNA, 19 nt, Homo sapiens
gugcaacagccuacaguuu

SEQ ID NO: 1011860 - RNA, 19 nt, Homo sapiens
gaauucagcgauuuauaca

SEQ ID NO: 1011861 - RNA, 19 nt, Homo sapiens
ugaggaauucagcgauuua

SEQ ID NO: 1011862 - RNA, 19 nt, Homo sapiens
ggaacccuaucuaucaucu

SEQ ID NO: 1011863 - RNA, 19 nt, Homo sapiens
ucaaagacagcgcauggaa

SEQ ID NO: 1011864 - RNA, 19 nt, Homo sapiens
agaauggcguggccugcua

SEQ ID NO: 1011865 - RNA, 19 nt, Homo sapiens
cgacaagaucuuucuggaa

SEQ ID NO: 1011866 - RNA, 19 nt, Homo sapiens
guaaccgcaucaggaauga

SEQ ID NO: 1011867 - RNA, 19 nt, Homo sapiens
gugcagagugugaaacuug

SEQ ID NO: 1011868 - RNA, 19 nt, Homo sapiens
gccugaagcucgccaugau

SEQ ID NO: 1011869 - RNA, 19 nt, Homo sapiens
acaagaucuuucuggaauu

SEQ ID NO: 1011870 - RNA, 19 nt, Homo sapiens
uaucuaucaucuagcagaa

SEQ ID NO: 1011871 - RNA, 19 nt, Homo sapiens
guccugccuuguuauugua

SEQ ID NO: 1011872 - RNA, 19 nt, Homo sapiens
gggcagcaacccuuacuuc

SEQ ID NO: 1011873 - RNA, 19 nt, Homo sapiens
gggcggauguggagaagcu

SEQ ID NO: 1011874 - RNA, 19 nt, Homo sapiens
ccacccaccgcaaguacua

SEQ ID NO: 1011875 - RNA, 19 nt, Homo sapiens
gaucugcggcuuugauguc

SEQ ID NO: 1011876 - RNA, 19 nt, Homo sapiens
caagaucugcggcuuugau

SEQ ID NO: 1011877 - RNA, 19 nt, Homo sapiens
agucaaugcugaaagucaa

SEQ ID NO: 1011878 - RNA, 19 nt, Homo sapiens
gaacagccccuggaugcua

SEQ ID NO: 1011879 - RNA, 19 nt, Homo sapiens
gagcucugguaccgcaaga

SEQ ID NO: 1011880 - RNA, 19 nt, Homo sapiens
ggaaaccuguccgcugcau

SEQ ID NO: 1011881 - RNA, 19 nt, Homo sapiens
cggacgguaugcaaaguug

SEQ ID NO: 1011882 - RNA, 19 nt, Homo sapiens
uguccugccuuguuauugu

SEQ ID NO: 1011883 - RNA, 19 nt, Homo sapiens
gagaugcugcgucaguuca

SEQ ID NO: 1011884 - RNA, 19 nt, Homo sapiens
aacgaggucuauaacuuga

SEQ ID NO: 1011885 - RNA, 19 nt, Homo sapiens
gcagccaaagcacuucuug

SEQ ID NO: 1011886 - RNA, 19 nt, Homo sapiens
ggaugucacugugcuugag

SEQ ID NO: 1011887 - RNA, 19 nt, Homo sapiens
guacacagagagcucaaag

SEQ ID NO: 1011888 - RNA, 19 nt, Homo sapiens
ugcaacagccuacaguuug

SEQ ID NO: 1011889 - RNA, 19 nt, Homo sapiens
aaaccuguccgcugcauuc

SEQ ID NO: 1011890 - RNA, 19 nt, Homo sapiens
gcacgauaaaccagucaau

SEQ ID NO: 1011891 - RNA, 19 nt, Homo sapiens
gccguugaguuaccucugu

SEQ ID NO: 1011892 - RNA, 19 nt, Homo sapiens
ggagaugcugcgucaguuc

SEQ ID NO: 1011893 - RNA, 19 nt, Homo sapiens
ugaauccaguggugacagu

SEQ ID NO: 1011894 - RNA, 19 nt, Homo sapiens
gcucgccgcagacuuacuu

SEQ ID NO: 1011895 - RNA, 19 nt, Homo sapiens
gaacccuaucuaucaucua

SEQ ID NO: 1011896 - RNA, 19 nt, Homo sapiens
gguaugcaaaguugugaau

SEQ ID NO: 1011897 - RNA, 19 nt, Homo sapiens
caaggacgugguugaggaa

SEQ ID NO: 1011898 - RNA, 19 nt, Homo sapiens
aacccuaucuaucaucuag

SEQ ID NO: 1011899 - RNA, 19 nt, Homo sapiens
acacagagagcucaaagac

SEQ ID NO: 1011900 - RNA, 19 nt, Homo sapiens
cggagaugcugcgucaguu

SEQ ID NO: 1011901 - RNA, 19 nt, Homo sapiens
ucgccaugauccagcagua

SEQ ID NO: 1011902 - RNA, 19 nt, Homo sapiens
gaggaauucagcgauuuau

SEQ ID NO: 1011903 - RNA, 19 nt, Homo sapiens
uugaggaauucagcgauuu

SEQ ID NO: 1011904 - RNA, 19 nt, Homo sapiens
gagcgcggacgguaugcaa

SEQ ID NO: 1011905 - RNA, 19 nt, Homo sapiens
caugggaacccuaucuauc

SEQ ID NO: 1011906 - RNA, 19 nt, Homo sapiens
uguccucgcugcugagaag

SEQ ID NO: 1011907 - RNA, 19 nt, Homo sapiens
gaaaccuguccgcugcauu

SEQ ID NO: 1011908 - RNA, 19 nt, Homo sapiens
cguaaccgcaucaggaaug

SEQ ID NO: 1011909 - RNA, 19 nt, Homo sapiens
gugcugagcggcuggaucu

SEQ ID NO: 1011910 - RNA, 19 nt, Homo sapiens
ccuucaauacuuugcauuu

SEQ ID NO: 1011911 - RNA, 19 nt, Homo sapiens
aagaggcaguacaccaguu

SEQ ID NO: 1011912 - RNA, 19 nt, Homo sapiens
auucagcgauuuauacaac

SEQ ID NO: 1011913 - RNA, 19 nt, Homo sapiens
ccugcuaccuuaccaacca

SEQ ID NO: 1011914 - RNA, 19 nt, Homo sapiens
uuuaucuucuguagagcua

SEQ ID NO: 1011915 - RNA, 19 nt, Homo sapiens
uuccugauccucuguagaa

SEQ ID NO: 1011916 - RNA, 19 nt, Homo sapiens
ccaugggaacccuaucuau

SEQ ID NO: 1011917 - RNA, 19 nt, Homo sapiens
gauguaccgagaccucuuc

SEQ ID NO: 1011918 - RNA, 19 nt, Homo sapiens
cggcuuugauguccucuac

SEQ ID NO: 1011919 - RNA, 19 nt, Homo sapiens
gcaccaccgacaagaucuu

SEQ ID NO: 1011920 - RNA, 19 nt, Homo sapiens
gcauuggcaccaccgacaa

SEQ ID NO: 1011921 - RNA, 19 nt, Homo sapiens
ucagcgauuuauacaacga

SEQ ID NO: 1011922 - RNA, 19 nt, Homo sapiens
gaggccgugugcagagugu

SEQ ID NO: 1011923 - RNA, 19 nt, Homo sapiens
gcucugguaccgcaagauc

SEQ ID NO: 1011924 - RNA, 19 nt, Homo sapiens
guucuuccggcacgauaaa

SEQ ID NO: 1011925 - RNA, 19 nt, Homo sapiens
gaguucuuccggcacgaua

SEQ ID NO: 1011926 - RNA, 19 nt, Homo sapiens
agaggcaguacaccaguuu

SEQ ID NO: 1011927 - RNA, 19 nt, Homo sapiens
cagaggcccugagauugag

SEQ ID NO: 1011928 - RNA, 19 nt, Homo sapiens
caacagagaucuaucaaug

SEQ ID NO: 1011929 - RNA, 19 nt, Homo sapiens
gaagagaaacugaagaaua

SEQ ID NO: 1011930 - RNA, 19 nt, Homo sapiens
ccaaauacaugacauaaga

SEQ ID NO: 1011931 - RNA, 19 nt, Homo sapiens
gcuauuggcuuuuguuuua

SEQ ID NO: 1011932 - RNA, 19 nt, Homo sapiens
caauaaagaggccaaauuu

SEQ ID NO: 1011933 - RNA, 19 nt, Homo sapiens
cgaaugaaauccauguuug

SEQ ID NO: 1011934 - RNA, 19 nt, Homo sapiens
acaaauagcauccuucuug

SEQ ID NO: 1011935 - RNA, 19 nt, Homo sapiens
gcaaguuggcugucuauga

SEQ ID NO: 1011936 - RNA, 19 nt, Homo sapiens
gacagaacauucagaagau

SEQ ID NO: 1011937 - RNA, 19 nt, Homo sapiens
ugaaauccauguuugcuau

SEQ ID NO: 1011938 - RNA, 19 nt, Homo sapiens
gcaggcagguggauuucuu

SEQ ID NO: 1011939 - RNA, 19 nt, Homo sapiens
cgacagaacauucagaaga

SEQ ID NO: 1011940 - RNA, 19 nt, Homo sapiens
caaauagcauccuucuugu

SEQ ID NO: 1011941 - RNA, 19 nt, Homo sapiens
caaguuggcugucuaugag

SEQ ID NO: 1011942 - RNA, 19 nt, Homo sapiens
caaggacugucucaucgaa

SEQ ID NO: 1011943 - RNA, 19 nt, Homo sapiens
gaagaaggaaacaauaaca

SEQ ID NO: 1011944 - RNA, 19 nt, Homo sapiens
gaaaauagagagacaagaa

SEQ ID NO: 1011945 - RNA, 19 nt, Homo sapiens
agacgaaggugcgagauga

SEQ ID NO: 1011946 - RNA, 19 nt, Homo sapiens
ucaauaaagaggccaaauu

SEQ ID NO: 1011947 - RNA, 19 nt, Homo sapiens
gcagccagcaaacuugaua

SEQ ID NO: 1011948 - RNA, 19 nt, Homo sapiens
gaauaacaacagagaucua

SEQ ID NO: 1011949 - RNA, 19 nt, Homo sapiens
uaacaacagagaucuauca

SEQ ID NO: 1011950 - RNA, 19 nt, Homo sapiens
ggacagacaaguacaagag

SEQ ID NO: 1011951 - RNA, 19 nt, Homo sapiens
cauguuugcuauuggcuuu

SEQ ID NO: 1011952 - RNA, 19 nt, Homo sapiens
caagcaggcagguggauuu

SEQ ID NO: 1011953 - RNA, 19 nt, Homo sapiens
aauagcauccuucuuguuu

SEQ ID NO: 1011954 - RNA, 19 nt, Homo sapiens
guuuaacccuuguaacugu

SEQ ID NO: 1011955 - RNA, 19 nt, Homo sapiens
agagucagcuggucgacaa

SEQ ID NO: 1011956 - RNA, 19 nt, Homo sapiens
guagcaagagccauaggua

SEQ ID NO: 1011957 - RNA, 19 nt, Homo sapiens
gcauccuucuuguuucauu

SEQ ID NO: 1011958 - RNA, 19 nt, Homo sapiens
acagagaucuaucaauggu

SEQ ID NO: 1011959 - RNA, 19 nt, Homo sapiens
cuaugagcauuuagagauu

SEQ ID NO: 1011960 - RNA, 19 nt, Homo sapiens
uagcauccuucuuguuuca

SEQ ID NO: 1011961 - RNA, 19 nt, Homo sapiens
cuaaugggaauguucaauu

SEQ ID NO: 1011962 - RNA, 19 nt, Homo sapiens
gaaauccauguuugcuauu

SEQ ID NO: 1011963 - RNA, 19 nt, Homo sapiens
ugaagaauaacaacagaga

SEQ ID NO: 1011964 - RNA, 19 nt, Homo sapiens
gacaagaagagaaacugaa

SEQ ID NO: 1011965 - RNA, 19 nt, Homo sapiens
gacacucuccucaucguuu

SEQ ID NO: 1011966 - RNA, 19 nt, Homo sapiens
uaucaaugguucgaaugaa

SEQ ID NO: 1011967 - RNA, 19 nt, Homo sapiens
cuacuugggccucuuucua

SEQ ID NO: 1011968 - RNA, 19 nt, Homo sapiens
gagaaacugaagaauaaca

SEQ ID NO: 1011969 - RNA, 19 nt, Homo sapiens
aagaagagaaacugaagaa

SEQ ID NO: 1011970 - RNA, 19 nt, Homo sapiens
agagagacaagaagagaaa

SEQ ID NO: 1011971 - RNA, 19 nt, Homo sapiens
ggcugucuaugagcauuua

SEQ ID NO: 1011972 - RNA, 19 nt, Homo sapiens
cauccuucuuguuucauuu

SEQ ID NO: 1011973 - RNA, 19 nt, Homo sapiens
ggguaugauuagagugaaa

SEQ ID NO: 1011974 - RNA, 19 nt, Homo sapiens
gaagaauaacaacagagau

SEQ ID NO: 1011975 - RNA, 19 nt, Homo sapiens
ggaaacaauaacagaguca

SEQ ID NO: 1011976 - RNA, 19 nt, Homo sapiens
ucugggaaguucucuugaa

SEQ ID NO: 1011977 - RNA, 19 nt, Homo sapiens
ggauugauuaguuaaguuc

SEQ ID NO: 1011978 - RNA, 19 nt, Homo sapiens
acagaacauucagaagauu

SEQ ID NO: 1011979 - RNA, 19 nt, Homo sapiens
guagagugguggcaaagcu

SEQ ID NO: 1011980 - RNA, 19 nt, Homo sapiens
gcauuuagagauuuagaag

SEQ ID NO: 1011981 - RNA, 19 nt, Homo sapiens
guucagguaauguuuaugu

SEQ ID NO: 1011982 - RNA, 19 nt, Homo sapiens
agaaggaaacaauaacaga

SEQ ID NO: 1011983 - RNA, 19 nt, Homo sapiens
ucgaaugaaauccauguuu

SEQ ID NO: 1011984 - RNA, 19 nt, Homo sapiens
caagaagagaaacugaaga

SEQ ID NO: 1011985 - RNA, 19 nt, Homo sapiens
aaauagagagacaagaaga

SEQ ID NO: 1011986 - RNA, 19 nt, Homo sapiens
aaacaaauagcauccuucu

SEQ ID NO: 1011987 - RNA, 19 nt, Homo sapiens
uaguuaaguucagguaaug

SEQ ID NO: 1011988 - RNA, 19 nt, Homo sapiens
ggagaugacaccacagacu

SEQ ID NO: 1011989 - RNA, 19 nt, Homo sapiens
uuacugcccuaaugggaau

SEQ ID NO: 1011990 - RNA, 19 nt, Homo sapiens
gaaugaaauccauguuugc

SEQ ID NO: 1011991 - RNA, 19 nt, Homo sapiens
gauuaguuaaguucaggua

SEQ ID NO: 1011992 - RNA, 19 nt, Homo sapiens
aaauccauguuugcuauug

SEQ ID NO: 1011993 - RNA, 19 nt, Homo sapiens
gacaaguacaagagacuga

SEQ ID NO: 1011994 - RNA, 19 nt, Homo sapiens
guggauugauuaguuaagu

SEQ ID NO: 1011995 - RNA, 19 nt, Homo sapiens
gagcauuuagagauuuaga

SEQ ID NO: 1011996 - RNA, 19 nt, Homo sapiens
guuaaguucagguaauguu

SEQ ID NO: 1011997 - RNA, 19 nt, Homo sapiens
uugggccucuuucuaguuu

SEQ ID NO: 1011998 - RNA, 19 nt, Homo sapiens
guguaugcccugcaaguug

SEQ ID NO: 1011999 - RNA, 19 nt, Homo sapiens
gcaaacuugauagugcuuu

SEQ ID NO: 1012000 - RNA, 19 nt, Homo sapiens
gagacgaaggugcgagaug

SEQ ID NO: 1012001 - RNA, 19 nt, Homo sapiens
aucaaugguucgaaugaaa

SEQ ID NO: 1012002 - RNA, 19 nt, Homo sapiens
agacaagaagagaaacuga

SEQ ID NO: 1012003 - RNA, 19 nt, Homo sapiens
gacagacaaguacaagaga

SEQ ID NO: 1012004 - RNA, 19 nt, Homo sapiens
guaacuguuuguuuuguug

SEQ ID NO: 1012005 - RNA, 19 nt, Homo sapiens
cgagaugagcacuauguuc

SEQ ID NO: 1012006 - RNA, 19 nt, Homo sapiens
ccuuguaacuguuuguuuu

SEQ ID NO: 1012007 - RNA, 19 nt, Homo sapiens
caaacuugauagugcuuuu

SEQ ID NO: 1012008 - RNA, 19 nt, Homo sapiens
ucaaugguucgaaugaaau

SEQ ID NO: 1012009 - RNA, 19 nt, Homo sapiens
aagaauaacaacagagauc

SEQ ID NO: 1012010 - RNA, 19 nt, Homo sapiens
ggacacucuccucaucguu

SEQ ID NO: 1012011 - RNA, 19 nt, Homo sapiens
caagccaaauacaugacau

SEQ ID NO: 1012012 - RNA, 19 nt, Homo sapiens
gccauagguagccuuacua

SEQ ID NO: 1012013 - RNA, 19 nt, Homo sapiens
aggacugucucaucgaaau

SEQ ID NO: 1012014 - RNA, 19 nt, Homo sapiens
acugaagaauaacaacaga

SEQ ID NO: 1012015 - RNA, 19 nt, Homo sapiens
ccugcaaguuggcugucua

SEQ ID NO: 1012016 - RNA, 19 nt, Homo sapiens
gaaaagaagaaggaaacaa

SEQ ID NO: 1012017 - RNA, 19 nt, Homo sapiens
gaaacugaagaauaacaac

SEQ ID NO: 1012018 - RNA, 19 nt, Homo sapiens
gagacaagaagagaaacug

SEQ ID NO: 1012019 - RNA, 19 nt, Homo sapiens
acaucagacuggcaacugu

SEQ ID NO: 1012020 - RNA, 19 nt, Homo sapiens
gaucaauaaagaggccaaa

SEQ ID NO: 1012021 - RNA, 19 nt, Homo sapiens
aagccaaauacaugacaua

SEQ ID NO: 1012022 - RNA, 19 nt, Homo sapiens
gcgagaugagcacuauguu

SEQ ID NO: 1012023 - RNA, 19 nt, Homo sapiens
uuacaggacagacaaguac

SEQ ID NO: 1012024 - RNA, 19 nt, Homo sapiens
cagaacauucagaagauuc

SEQ ID NO: 1012025 - RNA, 19 nt, Homo sapiens
uaacccuuguaacuguuug

SEQ ID NO: 1012026 - RNA, 19 nt, Homo sapiens
aaauagcauccuucuuguu

SEQ ID NO: 1012027 - RNA, 19 nt, Homo sapiens
caucagacuggcaacuguu

SEQ ID NO: 1012028 - RNA, 19 nt, Homo sapiens
ggacaaagaauguauguua

SEQ ID NO: 1012029 - RNA, 19 nt, Homo sapiens
gcaauaagguagcaaguaa

SEQ ID NO: 1012030 - RNA, 19 nt, Homo sapiens
gaagugaggugugcaauaa

SEQ ID NO: 1012031 - RNA, 19 nt, Homo sapiens
ggagagaccuguagaaguu

SEQ ID NO: 1012032 - RNA, 19 nt, Homo sapiens
caaggaagcugccugaauu

SEQ ID NO: 1012033 - RNA, 19 nt, Homo sapiens
gaaggaacauguuggauuc

SEQ ID NO: 1012034 - RNA, 19 nt, Homo sapiens
gaagaauguuagcagauuu

SEQ ID NO: 1012035 - RNA, 19 nt, Homo sapiens
aaggaacgcuugacuauuu

SEQ ID NO: 1012036 - RNA, 19 nt, Homo sapiens
ggaaguuaauguauuguug

SEQ ID NO: 1012037 - RNA, 19 nt, Homo sapiens
gaauguauguuaucguaga

SEQ ID NO: 1012038 - RNA, 19 nt, Homo sapiens
uagaggagcugguggcuuu

SEQ ID NO: 1012039 - RNA, 19 nt, Homo sapiens
gaagaaagaacaguagaaa

SEQ ID NO: 1012040 - RNA, 19 nt, Homo sapiens
guugauggcugaauucuug

SEQ ID NO: 1012041 - RNA, 19 nt, Homo sapiens
gaccagacaaaucaaauua

SEQ ID NO: 1012042 - RNA, 19 nt, Homo sapiens
gaaauaagaagaagaagag

SEQ ID NO: 1012043 - RNA, 19 nt, Homo sapiens
caucauggcgguacuauuu

SEQ ID NO: 1012044 - RNA, 19 nt, Homo sapiens
guggaugccuuugacauua

SEQ ID NO: 1012045 - RNA, 19 nt, Homo sapiens
gaauuugccuguauacucu

SEQ ID NO: 1012046 - RNA, 19 nt, Homo sapiens
gaaggauugucacagaguu

SEQ ID NO: 1012047 - RNA, 19 nt, Homo sapiens
cauaagacaccuuugcaua

SEQ ID NO: 1012048 - RNA, 19 nt, Homo sapiens
caauguuccugaugaugua

SEQ ID NO: 1012049 - RNA, 19 nt, Homo sapiens
ggaagugaggugugcaaua

SEQ ID NO: 1012050 - RNA, 19 nt, Homo sapiens
uaaaggaccagacaaauca

SEQ ID NO: 1012051 - RNA, 19 nt, Homo sapiens
ucacagaguuucacuggau

SEQ ID NO: 1012052 - RNA, 19 nt, Homo sapiens
ugaagaauguuagcagauu

SEQ ID NO: 1012053 - RNA, 19 nt, Homo sapiens
ucaagaagauccgcgacua

SEQ ID NO: 1012054 - RNA, 19 nt, Homo sapiens
gaaauuaaacacuggaucu

SEQ ID NO: 1012055 - RNA, 19 nt, Homo sapiens
gaagaaggaacauguugga

SEQ ID NO: 1012056 - RNA, 19 nt, Homo sapiens
ggaagaaagaacaguagaa

SEQ ID NO: 1012057 - RNA, 19 nt, Homo sapiens
gaaacuaugacccaguauu

SEQ ID NO: 1012058 - RNA, 19 nt, Homo sapiens
auuaagagauucccaaaug

SEQ ID NO: 1012059 - RNA, 19 nt, Homo sapiens
cccaauaacuccaguauac

SEQ ID NO: 1012060 - RNA, 19 nt, Homo sapiens
uaacauuccuuuccaucau

SEQ ID NO: 1012061 - RNA, 19 nt, Homo sapiens
caacagggacuacuuugug

SEQ ID NO: 1012062 - RNA, 19 nt, Homo sapiens
uagcaugccuacguucaua

SEQ ID NO: 1012063 - RNA, 19 nt, Homo sapiens
ccagacaaaucaaauuagu

SEQ ID NO: 1012064 - RNA, 19 nt, Homo sapiens
caugguauguaguuuaaug

SEQ ID NO: 1012065 - RNA, 19 nt, Homo sapiens
ugcgugagcucaacaacua

SEQ ID NO: 1012066 - RNA, 19 nt, Homo sapiens
gaacccauccacauaagga

SEQ ID NO: 1012067 - RNA, 19 nt, Homo sapiens
gaagacagaccacacaaac

SEQ ID NO: 1012068 - RNA, 19 nt, Homo sapiens
ggaccagacaaaucaaauu

SEQ ID NO: 1012069 - RNA, 19 nt, Homo sapiens
gcaauguuccugaugaugu

SEQ ID NO: 1012070 - RNA, 19 nt, Homo sapiens
gaucaugcccuuagcaagu

SEQ ID NO: 1012071 - RNA, 19 nt, Homo sapiens
gaaaagacuugccgcacuu

SEQ ID NO: 1012072 - RNA, 19 nt, Homo sapiens
gaguaaaaccucuguauuu

SEQ ID NO: 1012073 - RNA, 19 nt, Homo sapiens
ggacaacugccgccucuuc

SEQ ID NO: 1012074 - RNA, 19 nt, Homo sapiens
cuaguugccuuaccauguu

SEQ ID NO: 1012075 - RNA, 19 nt, Homo sapiens
aaaguuaugcuucuaguug

SEQ ID NO: 1012076 - RNA, 19 nt, Homo sapiens
gaaggaacgcuugacuauu

SEQ ID NO: 1012077 - RNA, 19 nt, Homo sapiens
caaaagacuugcaaugguu

SEQ ID NO: 1012078 - RNA, 19 nt, Homo sapiens
caacuuagcaugccuacgu

SEQ ID NO: 1012079 - RNA, 19 nt, Homo sapiens
ugaaggaacgcuugacuau

SEQ ID NO: 1012080 - RNA, 19 nt, Homo sapiens
agaagaagaggaagaaaga

SEQ ID NO: 1012081 - RNA, 19 nt, Homo sapiens
guucaugguauguaguuua

SEQ ID NO: 1012082 - RNA, 19 nt, Homo sapiens
gcaagccuaggacugauaa

SEQ ID NO: 1012083 - RNA, 19 nt, Homo sapiens
ugaagaagcgcgaggaaau

SEQ ID NO: 1012084 - RNA, 19 nt, Homo sapiens
acaugugccuguaaauuau

SEQ ID NO: 1012085 - RNA, 19 nt, Homo sapiens
caaagaauguauguuaucg

SEQ ID NO: 1012086 - RNA, 19 nt, Homo sapiens
cgaaauaagaagaagaaga

SEQ ID NO: 1012087 - RNA, 19 nt, Homo sapiens
guacucuccuucuagugaa

SEQ ID NO: 1012088 - RNA, 19 nt, Homo sapiens
agagaccuguagaaguuua

SEQ ID NO: 1012089 - RNA, 19 nt, Homo sapiens
gaaaguuaugcuucuaguu

SEQ ID NO: 1012090 - RNA, 19 nt, Homo sapiens
caugcaaccugaaagugaa

SEQ ID NO: 1012091 - RNA, 19 nt, Homo sapiens
ccuacacacuggccuacua

SEQ ID NO: 1012092 - RNA, 19 nt, Homo sapiens
cauucaaacucaaaucugu

SEQ ID NO: 1012093 - RNA, 19 nt, Homo sapiens
caacaggaggacauugaaa

SEQ ID NO: 1012094 - RNA, 19 nt, Homo sapiens
uguuagagauccauacaau

SEQ ID NO: 1012095 - RNA, 19 nt, Homo sapiens
gcuugacuauuuaugaaga

SEQ ID NO: 1012096 - RNA, 19 nt, Homo sapiens
gaggacaccaucaagaaga

SEQ ID NO: 1012097 - RNA, 19 nt, Homo sapiens
acagaggaaucccaaggaa

SEQ ID NO: 1012098 - RNA, 19 nt, Homo sapiens
gagauucccaaaugccuuu

SEQ ID NO: 1012099 - RNA, 19 nt, Homo sapiens
gguauguaguuuaaugcaa

SEQ ID NO: 1012100 - RNA, 19 nt, Homo sapiens
uuaaucgaguugcauaaga

SEQ ID NO: 1012101 - RNA, 19 nt, Homo sapiens
gauaaguagcucugauaga

SEQ ID NO: 1012102 - RNA, 19 nt, Homo sapiens
ggaacauguuggauucaca

SEQ ID NO: 1012103 - RNA, 19 nt, Homo sapiens
gcaacaggaggacauugaa

SEQ ID NO: 1012104 - RNA, 19 nt, Homo sapiens
aaaguacucuccuucuagu

SEQ ID NO: 1012105 - RNA, 19 nt, Homo sapiens
acucaaaucugugggaaug

SEQ ID NO: 1012106 - RNA, 19 nt, Homo sapiens
ggacuaaccggaagcuucu

SEQ ID NO: 1012107 - RNA, 19 nt, Homo sapiens
aacacuggaucucuccuua

SEQ ID NO: 1012108 - RNA, 19 nt, Homo sapiens
uacaaacaguagugcuuaa

SEQ ID NO: 1012109 - RNA, 19 nt, Homo sapiens
gauacaaacaguagugcuu

SEQ ID NO: 1012110 - RNA, 19 nt, Homo sapiens
aggaacgcuugacuauuua

SEQ ID NO: 1012111 - RNA, 19 nt, Homo sapiens
gcagagugaauguaaaaua

SEQ ID NO: 1012112 - RNA, 19 nt, Homo sapiens
gagaaguucaugguaugua

SEQ ID NO: 1012113 - RNA, 19 nt, Homo sapiens
ccaugugccuuagccuuaa

SEQ ID NO: 1012114 - RNA, 19 nt, Homo sapiens
agaaggaacauguuggauu

SEQ ID NO: 1012115 - RNA, 19 nt, Homo sapiens
cacgguggcuccaaacguu

SEQ ID NO: 1012116 - RNA, 19 nt, Homo sapiens
gaagaagcgcgaggaaauc

SEQ ID NO: 1012117 - RNA, 19 nt, Homo sapiens
gaagaagaggaagaaagaa

SEQ ID NO: 1012118 - RNA, 19 nt, Homo sapiens
gaagaagaagaggaagaaa

SEQ ID NO: 1012119 - RNA, 19 nt, Homo sapiens
aaacuaugacccaguauuc

SEQ ID NO: 1012120 - RNA, 19 nt, Homo sapiens
ccaaauguaauucggauca

SEQ ID NO: 1012121 - RNA, 19 nt, Homo sapiens
gccuaggacugauaaguag

SEQ ID NO: 1012122 - RNA, 19 nt, Homo sapiens
gcacuucugaguccaaaca

SEQ ID NO: 1012123 - RNA, 19 nt, Homo sapiens
gcuacgccuucgucaugua

SEQ ID NO: 1012124 - RNA, 19 nt, Homo sapiens
gcuacagcauggugcaaga

SEQ ID NO: 1012125 - RNA, 19 nt, Homo sapiens
cuaugacccaguauucuua

SEQ ID NO: 1012126 - RNA, 19 nt, Homo sapiens
ccaaggaagcugccugaau

SEQ ID NO: 1012127 - RNA, 19 nt, Homo sapiens
gcaccgcuaacauuccuuu

SEQ ID NO: 1012128 - RNA, 19 nt, Homo sapiens
gcagacaccucucauguua

SEQ ID NO: 1012129 - RNA, 19 nt, Homo sapiens
gaagauggauuauggacuu

SEQ ID NO: 1012130 - RNA, 19 nt, Homo sapiens
caaagaagauggauuaugg

SEQ ID NO: 1012131 - RNA, 19 nt, Homo sapiens
ggacuuaccucaaucagau

SEQ ID NO: 1012132 - RNA, 19 nt, Homo sapiens
guuaucagcucacaaagua

SEQ ID NO: 1012133 - RNA, 19 nt, Homo sapiens
uagcauaucucaucucaaa

SEQ ID NO: 1012134 - RNA, 19 nt, Homo sapiens
ggagguggcugcagaaaug

SEQ ID NO: 1012135 - RNA, 19 nt, Homo sapiens
ggagaaacaccucuugaua

SEQ ID NO: 1012136 - RNA, 19 nt, Homo sapiens
ggacagagugugaauauga

SEQ ID NO: 1012137 - RNA, 19 nt, Homo sapiens
guaugaggcuggauuauau

SEQ ID NO: 1012138 - RNA, 19 nt, Homo sapiens
ucaguuggguggagauuua

SEQ ID NO: 1012139 - RNA, 19 nt, Homo sapiens
caucaugucuuauaaggaa

SEQ ID NO: 1012140 - RNA, 19 nt, Homo sapiens
gagaaacaccucuugauau

SEQ ID NO: 1012141 - RNA, 19 nt, Homo sapiens
gauacuauauuggcuguuu

SEQ ID NO: 1012142 - RNA, 19 nt, Homo sapiens
agaaacaccucuugauaug

SEQ ID NO: 1012143 - RNA, 19 nt, Homo sapiens
ggaccuggcagauuucuuu

SEQ ID NO: 1012144 - RNA, 19 nt, Homo sapiens
gcuagcaacuuuccauuuc

SEQ ID NO: 1012145 - RNA, 19 nt, Homo sapiens
ccaacagccuuucugcuaa

SEQ ID NO: 1012146 - RNA, 19 nt, Homo sapiens
acaaagaacuugccaaugc

SEQ ID NO: 1012147 - RNA, 19 nt, Homo sapiens
ggacuucaauucagauucu

SEQ ID NO: 1012148 - RNA, 19 nt, Homo sapiens
ugacuugguucaucuuauu

SEQ ID NO: 1012149 - RNA, 19 nt, Homo sapiens
ccacaacauucaaagaaga

SEQ ID NO: 1012150 - RNA, 19 nt, Homo sapiens
gaaccaacuggauuucuuu

SEQ ID NO: 1012151 - RNA, 19 nt, Homo sapiens
ugucaaagcuacucaauac

SEQ ID NO: 1012152 - RNA, 19 nt, Homo sapiens
gaaaaugugucgcuucuuc

SEQ ID NO: 1012153 - RNA, 19 nt, Homo sapiens
caacagacuggaucuugua

SEQ ID NO: 1012154 - RNA, 19 nt, Homo sapiens
gguaugaggcuggauuaua

SEQ ID NO: 1012155 - RNA, 19 nt, Homo sapiens
gauccaggcuucacuaagg

SEQ ID NO: 1012156 - RNA, 19 nt, Homo sapiens
ggauauuuaugacuugguu

SEQ ID NO: 1012157 - RNA, 19 nt, Homo sapiens
ggguggagauuuaaauuca

SEQ ID NO: 1012158 - RNA, 19 nt, Homo sapiens
aaaaggaugucuucuagua

SEQ ID NO: 1012159 - RNA, 19 nt, Homo sapiens
gacuggaucuuguaagguu

SEQ ID NO: 1012160 - RNA, 19 nt, Homo sapiens
ggccugaccucccaugaga

SEQ ID NO: 1012161 - RNA, 19 nt, Homo sapiens
gaauucaccuaaguccaaa

SEQ ID NO: 1012162 - RNA, 19 nt, Homo sapiens
caaaguaauugggccagaa

SEQ ID NO: 1012163 - RNA, 19 nt, Homo sapiens
gcagagcaagcauaugaaa

SEQ ID NO: 1012164 - RNA, 19 nt, Homo sapiens
ucaccuaaguccaaaggaa

SEQ ID NO: 1012165 - RNA, 19 nt, Homo sapiens
ucacuccacugccauguau

SEQ ID NO: 1012166 - RNA, 19 nt, Homo sapiens
gcugaugcuuucugugauu

SEQ ID NO: 1012167 - RNA, 19 nt, Homo sapiens
gcucauuauucauaugcua

SEQ ID NO: 1012168 - RNA, 19 nt, Homo sapiens
caaagaacuugccaaugca

SEQ ID NO: 1012169 - RNA, 19 nt, Homo sapiens
gaggcuggauuauauaugg

SEQ ID NO: 1012170 - RNA, 19 nt, Homo sapiens
acaaggacauuuaccuaug

SEQ ID NO: 1012171 - RNA, 19 nt, Homo sapiens
ugaacgauguaaagaguug

SEQ ID NO: 1012172 - RNA, 19 nt, Homo sapiens
guucuucgcucaguaugaa

SEQ ID NO: 1012173 - RNA, 19 nt, Homo sapiens
gaaucagccugcagaagca

SEQ ID NO: 1012174 - RNA, 19 nt, Homo sapiens
ccaccuggcaguauuguuu

SEQ ID NO: 1012175 - RNA, 19 nt, Homo sapiens
cgacaaggacauuuaccua

SEQ ID NO: 1012176 - RNA, 19 nt, Homo sapiens
ucuaguaacugugacauug

SEQ ID NO: 1012177 - RNA, 19 nt, Homo sapiens
ggugaagcccuguguggua

SEQ ID NO: 1012178 - RNA, 19 nt, Homo sapiens
ggaagacaccauacaaucu

SEQ ID NO: 1012179 - RNA, 19 nt, Homo sapiens
aagcagagcaagcauauga

SEQ ID NO: 1012180 - RNA, 19 nt, Homo sapiens
uuucaacacaugccuauua

SEQ ID NO: 1012181 - RNA, 19 nt, Homo sapiens
gcauccaccuggcaguauu

SEQ ID NO: 1012182 - RNA, 19 nt, Homo sapiens
gaugucaggcaaccagaua

SEQ ID NO: 1012183 - RNA, 19 nt, Homo sapiens
ucgaugcccuguaguuuga

SEQ ID NO: 1012184 - RNA, 19 nt, Homo sapiens
caaccaucacuauuacaua

SEQ ID NO: 1012185 - RNA, 19 nt, Homo sapiens
gaaauguuaaugcaguuga

SEQ ID NO: 1012186 - RNA, 19 nt, Homo sapiens
aaacaaagaacuugccaau

SEQ ID NO: 1012187 - RNA, 19 nt, Homo sapiens
gcuauuggauacauauugg

SEQ ID NO: 1012188 - RNA, 19 nt, Homo sapiens
gaagcaggauaugauguca

SEQ ID NO: 1012189 - RNA, 19 nt, Homo sapiens
ccaacuggauuucuuuuaa

SEQ ID NO: 1012190 - RNA, 19 nt, Homo sapiens
agacaccucucauguuauc

SEQ ID NO: 1012191 - RNA, 19 nt, Homo sapiens
uauagcauaucucaucuca

SEQ ID NO: 1012192 - RNA, 19 nt, Homo sapiens
caaggacauuuaccuaugg

SEQ ID NO: 1012193 - RNA, 19 nt, Homo sapiens
gguagaagcaggauaugau

SEQ ID NO: 1012194 - RNA, 19 nt, Homo sapiens
caacagccuuucugcuaag

SEQ ID NO: 1012195 - RNA, 19 nt, Homo sapiens
aaucuuggcagacaucuaa

SEQ ID NO: 1012196 - RNA, 19 nt, Homo sapiens
ggacaucacaguacaccau

SEQ ID NO: 1012197 - RNA, 19 nt, Homo sapiens
ggauacauauuggacuuca

SEQ ID NO: 1012198 - RNA, 19 nt, Homo sapiens
gcagaaaugcgagcucuuc

SEQ ID NO: 1012199 - RNA, 19 nt, Homo sapiens
ucaaagggacagaguguga

SEQ ID NO: 1012200 - RNA, 19 nt, Homo sapiens
gacaaggacauuuaccuau

SEQ ID NO: 1012201 - RNA, 19 nt, Homo sapiens
gcuaaguuauuugucuuug

SEQ ID NO: 1012202 - RNA, 19 nt, Homo sapiens
ggaaauaauacucacugau

SEQ ID NO: 1012203 - RNA, 19 nt, Homo sapiens
ugauaaaucuuggcagaca

SEQ ID NO: 1012204 - RNA, 19 nt, Homo sapiens
gaucuuucaucuauuuguc

SEQ ID NO: 1012205 - RNA, 19 nt, Homo sapiens
gcuacucaauacggaauuu

SEQ ID NO: 1012206 - RNA, 19 nt, Homo sapiens
cauguuaucagcucacaaa

SEQ ID NO: 1012207 - RNA, 19 nt, Homo sapiens
cauccgacaaggacauuua

SEQ ID NO: 1012208 - RNA, 19 nt, Homo sapiens
ggacuuuucugauaaaucu

SEQ ID NO: 1012209 - RNA, 19 nt, Homo sapiens
gaagaaaagcaacccaaaa

SEQ ID NO: 1012210 - RNA, 19 nt, Homo sapiens
ccaucacuauuacauauuc

SEQ ID NO: 1012211 - RNA, 19 nt, Homo sapiens
uaucaucacccuugcagaa

SEQ ID NO: 1012212 - RNA, 19 nt, Homo sapiens
gggcagacaccucucaugu

SEQ ID NO: 1012213 - RNA, 19 nt, Homo sapiens
cagcauaguagccuuucua

SEQ ID NO: 1012214 - RNA, 19 nt, Homo sapiens
gauuggacaucacaguaca

SEQ ID NO: 1012215 - RNA, 19 nt, Homo sapiens
caacuuuccauuucucaug

SEQ ID NO: 1012216 - RNA, 19 nt, Homo sapiens
uaaugcaguugauaagcuu

SEQ ID NO: 1012217 - RNA, 19 nt, Homo sapiens
gugaauaugacagauguaa

SEQ ID NO: 1012218 - RNA, 19 nt, Homo sapiens
gcaaccagauaaagaaaau

SEQ ID NO: 1012219 - RNA, 19 nt, Homo sapiens
aagauggacuuuucugaua

SEQ ID NO: 1012220 - RNA, 19 nt, Homo sapiens
caucuuuguuuccaagguu

SEQ ID NO: 1012221 - RNA, 19 nt, Homo sapiens
guuugaaagugaaguaaag

SEQ ID NO: 1012222 - RNA, 19 nt, Homo sapiens
gcaaccaucacuauuacau

SEQ ID NO: 1012223 - RNA, 19 nt, Homo sapiens
uggcaucugugcacaugaa

SEQ ID NO: 1012224 - RNA, 19 nt, Homo sapiens
ccaugugggcuauuggaua

SEQ ID NO: 1012225 - RNA, 19 nt, Homo sapiens
uaaauucaacuccucuuca

SEQ ID NO: 1012226 - RNA, 19 nt, Homo sapiens
caugugggcuauuggauac

SEQ ID NO: 1012227 - RNA, 19 nt, Homo sapiens
gguggagauuuaaauucaa

SEQ ID NO: 1012228 - RNA, 19 nt, Homo sapiens
ggacagccauuauuucuca

SEQ ID NO: 1012229 - RNA, 19 nt, Homo sapiens
gaacggaauugcuauugga

SEQ ID NO: 1012230 - RNA, 19 nt, Homo sapiens
gcagugccaugaaugcaua

SEQ ID NO: 1012231 - RNA, 19 nt, Homo sapiens
gacugaacaugaagaguua

SEQ ID NO: 1012232 - RNA, 19 nt, Homo sapiens
uaacaagugauccuucuua

SEQ ID NO: 1012233 - RNA, 19 nt, Homo sapiens
ggaaaggaucccaggaaua

SEQ ID NO: 1012234 - RNA, 19 nt, Homo sapiens
ggacugaacaugaagaguu

SEQ ID NO: 1012235 - RNA, 19 nt, Homo sapiens
gcacggaaccugaggauca

SEQ ID NO: 1012236 - RNA, 19 nt, Homo sapiens
ggagauggauauucugauc

SEQ ID NO: 1012237 - RNA, 19 nt, Homo sapiens
gaucagcuuuacuauguga

SEQ ID NO: 1012238 - RNA, 19 nt, Homo sapiens
ugagagaggugaagaucaa

SEQ ID NO: 1012239 - RNA, 19 nt, Homo sapiens
ggaagagaauugaguuugg

SEQ ID NO: 1012240 - RNA, 19 nt, Homo sapiens
acagugaaguggcugguua

SEQ ID NO: 1012241 - RNA, 19 nt, Homo sapiens
gaaaggaucccaggaauac

SEQ ID NO: 1012242 - RNA, 19 nt, Homo sapiens
gaacugguuugaggccuuu

SEQ ID NO: 1012243 - RNA, 19 nt, Homo sapiens
ugaaguggcugguuacauc

SEQ ID NO: 1012244 - RNA, 19 nt, Homo sapiens
ccacggauaugcagucaau

SEQ ID NO: 1012245 - RNA, 19 nt, Homo sapiens
acuacuagauggcgacuua

SEQ ID NO: 1012246 - RNA, 19 nt, Homo sapiens
gcauagaacacaucaggaa

SEQ ID NO: 1012247 - RNA, 19 nt, Homo sapiens
gauaaacuaccuucccaaa

SEQ ID NO: 1012248 - RNA, 19 nt, Homo sapiens
cagaauuccuguaccaaau

SEQ ID NO: 1012249 - RNA, 19 nt, Homo sapiens
gcagaauuccuguaccaaa

SEQ ID NO: 1012250 - RNA, 19 nt, Homo sapiens
gaagagaauugaguuuggu

SEQ ID NO: 1012251 - RNA, 19 nt, Homo sapiens
gaucuacaauggccaacug

SEQ ID NO: 1012252 - RNA, 19 nt, Homo sapiens
ggaaucagacuuuuaauga

SEQ ID NO: 1012253 - RNA, 19 nt, Homo sapiens
aggaucagcuuuacuaugu

SEQ ID NO: 1012254 - RNA, 19 nt, Homo sapiens
guuugaggccuuugaaaua

SEQ ID NO: 1012255 - RNA, 19 nt, Homo sapiens
gggcagacccugagagaug

SEQ ID NO: 1012256 - RNA, 19 nt, Homo sapiens
ugacuuccaucagguaauu

SEQ ID NO: 1012257 - RNA, 19 nt, Homo sapiens
caacagcaaccucuucuuc

SEQ ID NO: 1012258 - RNA, 19 nt, Homo sapiens
gauacaguacagucaguua

SEQ ID NO: 1012259 - RNA, 19 nt, Homo sapiens
ccacaacgcucuccaugcu

SEQ ID NO: 1012260 - RNA, 19 nt, Homo sapiens
acaacgcucuccaugcuuu

SEQ ID NO: 1012261 - RNA, 19 nt, Homo sapiens
ggagguucauccauguuug

SEQ ID NO: 1012262 - RNA, 19 nt, Homo sapiens
aaagagaacaucagagguu

SEQ ID NO: 1012263 - RNA, 19 nt, Homo sapiens
cagaagcagugccaugaau

SEQ ID NO: 1012264 - RNA, 19 nt, Homo sapiens
gaucccgaaucaauuauag

SEQ ID NO: 1012265 - RNA, 19 nt, Homo sapiens
cgagguggaggacauauuu

SEQ ID NO: 1012266 - RNA, 19 nt, Homo sapiens
gaaaaguacuugcgagaag

SEQ ID NO: 1012267 - RNA, 19 nt, Homo sapiens
cgauguagcacgggauuua

SEQ ID NO: 1012268 - RNA, 19 nt, Homo sapiens
ugacaugauuaaucgauuc

SEQ ID NO: 1012269 - RNA, 19 nt, Homo sapiens
ugacagagcgcuccuugau

SEQ ID NO: 1012270 - RNA, 19 nt, Homo sapiens
ggcacaggcuucaguuuua

SEQ ID NO: 1012271 - RNA, 19 nt, Homo sapiens
gcgagaagauacaguacag

SEQ ID NO: 1012272 - RNA, 19 nt, Homo sapiens
ggaagcagaacugguuuga

SEQ ID NO: 1012273 - RNA, 19 nt, Homo sapiens
ggauuuauacagugcacua

SEQ ID NO: 1012274 - RNA, 19 nt, Homo sapiens
ccuuugaaauacuggauaa

SEQ ID NO: 1012275 - RNA, 19 nt, Homo sapiens
ucaggaagcagaacugguu

SEQ ID NO: 1012276 - RNA, 19 nt, Homo sapiens
gaaauaugugccagccauu

SEQ ID NO: 1012277 - RNA, 19 nt, Homo sapiens
aagagaacaucagagguuu

SEQ ID NO: 1012278 - RNA, 19 nt, Homo sapiens
ggagucuuaugcagggaaa

SEQ ID NO: 1012279 - RNA, 19 nt, Homo sapiens
acagugcacuaauucaguu

SEQ ID NO: 1012280 - RNA, 19 nt, Homo sapiens
ucuccaugcuuuacauuga

SEQ ID NO: 1012281 - RNA, 19 nt, Homo sapiens
guucuucccagcucagaua

SEQ ID NO: 1012282 - RNA, 19 nt, Homo sapiens
cuuuaaaucugacagugaa

SEQ ID NO: 1012283 - RNA, 19 nt, Homo sapiens
ggcauggacuggaaaggau

SEQ ID NO: 1012284 - RNA, 19 nt, Homo sapiens
gaaauacuggauaaacuac

SEQ ID NO: 1012285 - RNA, 19 nt, Homo sapiens
uaaacuaccuucccaaaag

SEQ ID NO: 1012286 - RNA, 19 nt, Homo sapiens
auaagguucugaucuacaa

SEQ ID NO: 1012287 - RNA, 19 nt, Homo sapiens
ucccaggacugaacaugaa

SEQ ID NO: 1012288 - RNA, 19 nt, Homo sapiens
uugcacaccucauccauuc

SEQ ID NO: 1012289 - RNA, 19 nt, Homo sapiens
uggaaaggaucccaggaau

SEQ ID NO: 1012290 - RNA, 19 nt, Homo sapiens
gaggaucagcuuuacuaug

SEQ ID NO: 1012291 - RNA, 19 nt, Homo sapiens
uguggaaggugauuguuuc

SEQ ID NO: 1012292 - RNA, 19 nt, Homo sapiens
aaauuggcuuguuggauga

SEQ ID NO: 1012293 - RNA, 19 nt, Homo sapiens
gaugauacccacggauaug

SEQ ID NO: 1012294 - RNA, 19 nt, Homo sapiens
cggaauugcuauuggagau

SEQ ID NO: 1012295 - RNA, 19 nt, Homo sapiens
gggagguucauccauguuu

SEQ ID NO: 1012296 - RNA, 19 nt, Homo sapiens
gccagaagaugccccagua

SEQ ID NO: 1012297 - RNA, 19 nt, Homo sapiens
cauugaagcugggaagauc

SEQ ID NO: 1012298 - RNA, 19 nt, Homo sapiens
augguuaacugaaaucaug

SEQ ID NO: 1012299 - RNA, 19 nt, Homo sapiens
uauuggagauggauauucu

SEQ ID NO: 1012300 - RNA, 19 nt, Homo sapiens
aacaugaccuugcgugaca

SEQ ID NO: 1012301 - RNA, 19 nt, Homo sapiens
ucugagagcuuuugacaug

SEQ ID NO: 1012302 - RNA, 19 nt, Homo sapiens
ccagaauguuacaggaugu

SEQ ID NO: 1012303 - RNA, 19 nt, Homo sapiens
gguuugaggccuuugaaau

SEQ ID NO: 1012304 - RNA, 19 nt, Homo sapiens
agacucaggacagccauua

SEQ ID NO: 1012305 - RNA, 19 nt, Homo sapiens
aaaggaagagaauugaguu

SEQ ID NO: 1012306 - RNA, 19 nt, Homo sapiens
cagaaaaugucauaggaau

SEQ ID NO: 1012307 - RNA, 19 nt, Homo sapiens
aagccaugguuaacugaaa

SEQ ID NO: 1012308 - RNA, 19 nt, Homo sapiens
gaagcugggaagauccaaa

SEQ ID NO: 1012309 - RNA, 19 nt, Homo sapiens
uuccagauauuuccugaau

SEQ ID NO: 1012310 - RNA, 19 nt, Homo sapiens
gaucccaggaauacaagaa

SEQ ID NO: 1012311 - RNA, 19 nt, Homo sapiens
gggcauggacuggaaagga

SEQ ID NO: 1012312 - RNA, 19 nt, Homo sapiens
ugaacggaauugcuauugg

SEQ ID NO: 1012313 - RNA, 19 nt, Homo sapiens
gaucaaccugaacggaauu

SEQ ID NO: 1012314 - RNA, 19 nt, Homo sapiens
guguuuccaugccaccuaa

SEQ ID NO: 1012315 - RNA, 19 nt, Homo sapiens
acagcaaccucuucuucug

SEQ ID NO: 1012316 - RNA, 19 nt, Homo sapiens
cuagauggcgacuuaacaa

SEQ ID NO: 1012317 - RNA, 19 nt, Homo sapiens
caacgcucuccaugcuuua

SEQ ID NO: 1012318 - RNA, 19 nt, Homo sapiens
ucagauacagccagaagau

SEQ ID NO: 1012319 - RNA, 19 nt, Homo sapiens
gaauacaagaaggcagaaa

SEQ ID NO: 1012320 - RNA, 19 nt, Homo sapiens
ggaucagcuuuacuaugug

SEQ ID NO: 1012321 - RNA, 19 nt, Homo sapiens
caucagagguuuucauugc

SEQ ID NO: 1012322 - RNA, 19 nt, Homo sapiens
ugaugggcauggacuggaa

SEQ ID NO: 1012323 - RNA, 19 nt, Homo sapiens
cauuauuucucaccccuua

SEQ ID NO: 1012324 - RNA, 19 nt, Homo sapiens
gaaugcauagaacacauca

SEQ ID NO: 1012325 - RNA, 19 nt, Homo sapiens
gaagcagugccaugaaugc

SEQ ID NO: 1012326 - RNA, 19 nt, Homo sapiens
agaucaaccugaacggaau

SEQ ID NO: 1012327 - RNA, 19 nt, Homo sapiens
cugaugauacccacggaua

SEQ ID NO: 1012328 - RNA, 19 nt, Homo sapiens
ggacagccauuauuucuca

SEQ ID NO: 1012329 - RNA, 19 nt, Homo sapiens
gaacggaauugcuauugga

SEQ ID NO: 1012330 - RNA, 19 nt, Homo sapiens
gcagugccaugaaugcaua

SEQ ID NO: 1012331 - RNA, 19 nt, Homo sapiens
gacugaacaugaagaguua

SEQ ID NO: 1012332 - RNA, 19 nt, Homo sapiens
uaacaagugauccuucuua

SEQ ID NO: 1012333 - RNA, 19 nt, Homo sapiens
ggaaaggaucccaggaaua

SEQ ID NO: 1012334 - RNA, 19 nt, Homo sapiens
ggacugaacaugaagaguu

SEQ ID NO: 1012335 - RNA, 19 nt, Homo sapiens
gcacggaaccugaggauca

SEQ ID NO: 1012336 - RNA, 19 nt, Homo sapiens
ggagauggauauucugauc

SEQ ID NO: 1012337 - RNA, 19 nt, Homo sapiens
gaucagcuuuacuauguga

SEQ ID NO: 1012338 - RNA, 19 nt, Homo sapiens
ugagagaggugaagaucaa

SEQ ID NO: 1012339 - RNA, 19 nt, Homo sapiens
ggaagagaauugaguuugg

SEQ ID NO: 1012340 - RNA, 19 nt, Homo sapiens
acagugaaguggcugguua

SEQ ID NO: 1012341 - RNA, 19 nt, Homo sapiens
gaaaggaucccaggaauac

SEQ ID NO: 1012342 - RNA, 19 nt, Homo sapiens
gaacugguuugaggccuuu

SEQ ID NO: 1012343 - RNA, 19 nt, Homo sapiens
ugaaguggcugguuacauc

SEQ ID NO: 1012344 - RNA, 19 nt, Homo sapiens
ccacggauaugcagucaau

SEQ ID NO: 1012345 - RNA, 19 nt, Homo sapiens
acuacuagauggcgacuua

SEQ ID NO: 1012346 - RNA, 19 nt, Homo sapiens
gcauagaacacaucaggaa

SEQ ID NO: 1012347 - RNA, 19 nt, Homo sapiens
gauaaacuaccuucccaaa

SEQ ID NO: 1012348 - RNA, 19 nt, Homo sapiens
cagaauuccuguaccaaau

SEQ ID NO: 1012349 - RNA, 19 nt, Homo sapiens
gcagaauuccuguaccaaa

SEQ ID NO: 1012350 - RNA, 19 nt, Homo sapiens
gaagagaauugaguuuggu

SEQ ID NO: 1012351 - RNA, 19 nt, Homo sapiens
gaucuacaauggccaacug

SEQ ID NO: 1012352 - RNA, 19 nt, Homo sapiens
ggaaucagacuuuuaauga

SEQ ID NO: 1012353 - RNA, 19 nt, Homo sapiens
aggaucagcuuuacuaugu

SEQ ID NO: 1012354 - RNA, 19 nt, Homo sapiens
guuugaggccuuugaaaua

SEQ ID NO: 1012355 - RNA, 19 nt, Homo sapiens
ugacuuccaucagguaauu

SEQ ID NO: 1012356 - RNA, 19 nt, Homo sapiens
caacagcaaccucuucuuc

SEQ ID NO: 1012357 - RNA, 19 nt, Homo sapiens
gauacaguacagucaguua

SEQ ID NO: 1012358 - RNA, 19 nt, Homo sapiens
ccacaacgcucuccaugcu

SEQ ID NO: 1012359 - RNA, 19 nt, Homo sapiens
acaacgcucuccaugcuuu

SEQ ID NO: 1012360 - RNA, 19 nt, Homo sapiens
ggagguucauccauguuug

SEQ ID NO: 1012361 - RNA, 19 nt, Homo sapiens
aaagagaacaucagagguu

SEQ ID NO: 1012362 - RNA, 19 nt, Homo sapiens
cagaagcagugccaugaau

SEQ ID NO: 1012363 - RNA, 19 nt, Homo sapiens
gaucccgaaucaauuauag

SEQ ID NO: 1012364 - RNA, 19 nt, Homo sapiens
cgagguggaggacauauuu

SEQ ID NO: 1012365 - RNA, 19 nt, Homo sapiens
gaaaaguacuugcgagaag

SEQ ID NO: 1012366 - RNA, 19 nt, Homo sapiens
cgauguagcacgggauuua

SEQ ID NO: 1012367 - RNA, 19 nt, Homo sapiens
ugacaugauuaaucgauuc

SEQ ID NO: 1012368 - RNA, 19 nt, Homo sapiens
ugacagagcgcuccuugau

SEQ ID NO: 1012369 - RNA, 19 nt, Homo sapiens
ggcacaggcuucaguuuua

SEQ ID NO: 1012370 - RNA, 19 nt, Homo sapiens
gcgagaagauacaguacag

SEQ ID NO: 1012371 - RNA, 19 nt, Homo sapiens
ggaagcagaacugguuuga

SEQ ID NO: 1012372 - RNA, 19 nt, Homo sapiens
ggauuuauacagugcacua

SEQ ID NO: 1012373 - RNA, 19 nt, Homo sapiens
ccuuugaaauacuggauaa

SEQ ID NO: 1012374 - RNA, 19 nt, Homo sapiens
ucaggaagcagaacugguu

SEQ ID NO: 1012375 - RNA, 19 nt, Homo sapiens
gaaauaugugccagccauu

SEQ ID NO: 1012376 - RNA, 19 nt, Homo sapiens
aagagaacaucagagguuu

SEQ ID NO: 1012377 - RNA, 19 nt, Homo sapiens
ggagucuuaugcagggaaa

SEQ ID NO: 1012378 - RNA, 19 nt, Homo sapiens
acagugcacuaauucaguu

SEQ ID NO: 1012379 - RNA, 19 nt, Homo sapiens
ucuccaugcuuuacauuga

SEQ ID NO: 1012380 - RNA, 19 nt, Homo sapiens
guucuucccagcucagaua

SEQ ID NO: 1012381 - RNA, 19 nt, Homo sapiens
cuuuaaaucugacagugaa

SEQ ID NO: 1012382 - RNA, 19 nt, Homo sapiens
ggcauggacuggaaaggau

SEQ ID NO: 1012383 - RNA, 19 nt, Homo sapiens
gaaauacuggauaaacuac

SEQ ID NO: 1012384 - RNA, 19 nt, Homo sapiens
uaaacuaccuucccaaaag

SEQ ID NO: 1012385 - RNA, 19 nt, Homo sapiens
auaagguucugaucuacaa

SEQ ID NO: 1012386 - RNA, 19 nt, Homo sapiens
ucccaggacugaacaugaa

SEQ ID NO: 1012387 - RNA, 19 nt, Homo sapiens
uugcacaccucauccauuc

SEQ ID NO: 1012388 - RNA, 19 nt, Homo sapiens
uguggaaggugauuguuuc

SEQ ID NO: 1012389 - RNA, 19 nt, Homo sapiens
uggaaaggaucccaggaau

SEQ ID NO: 1012390 - RNA, 19 nt, Homo sapiens
gaggaucagcuuuacuaug

SEQ ID NO: 1012391 - RNA, 19 nt, Homo sapiens
aaauuggcuuguuggauga

SEQ ID NO: 1012392 - RNA, 19 nt, Homo sapiens
gaugauacccacggauaug

SEQ ID NO: 1012393 - RNA, 19 nt, Homo sapiens
cggaauugcuauuggagau

SEQ ID NO: 1012394 - RNA, 19 nt, Homo sapiens
gggagguucauccauguuu

SEQ ID NO: 1012395 - RNA, 19 nt, Homo sapiens
gccagaagaugccccagua

SEQ ID NO: 1012396 - RNA, 19 nt, Homo sapiens
cauugaagcugggaagauc

SEQ ID NO: 1012397 - RNA, 19 nt, Homo sapiens
augguuaacugaaaucaug

SEQ ID NO: 1012398 - RNA, 19 nt, Homo sapiens
uauuggagauggauauucu

SEQ ID NO: 1012399 - RNA, 19 nt, Homo sapiens
aacaugaccuugcgugaca

SEQ ID NO: 1012400 - RNA, 19 nt, Homo sapiens
ucugagagcuuuugacaug

SEQ ID NO: 1012401 - RNA, 19 nt, Homo sapiens
ccagaauguuacaggaugu

SEQ ID NO: 1012402 - RNA, 19 nt, Homo sapiens
gguuugaggccuuugaaau

SEQ ID NO: 1012403 - RNA, 19 nt, Homo sapiens
agacucaggacagccauua

SEQ ID NO: 1012404 - RNA, 19 nt, Homo sapiens
aaaggaagagaauugaguu

SEQ ID NO: 1012405 - RNA, 19 nt, Homo sapiens
cagaaaaugucauaggaau

SEQ ID NO: 1012406 - RNA, 19 nt, Homo sapiens
gaagcugggaagauccaaa

SEQ ID NO: 1012407 - RNA, 19 nt, Homo sapiens
aagccaugguuaacugaaa

SEQ ID NO: 1012408 - RNA, 19 nt, Homo sapiens
uuccagauauuuccugaau

SEQ ID NO: 1012409 - RNA, 19 nt, Homo sapiens
gaucccaggaauacaagaa

SEQ ID NO: 1012410 - RNA, 19 nt, Homo sapiens
gggcauggacuggaaagga

SEQ ID NO: 1012411 - RNA, 19 nt, Homo sapiens
guguuuccaugccaccuaa

SEQ ID NO: 1012412 - RNA, 19 nt, Homo sapiens
ugaacggaauugcuauugg

SEQ ID NO: 1012413 - RNA, 19 nt, Homo sapiens
gaucaaccugaacggaauu

SEQ ID NO: 1012414 - RNA, 19 nt, Homo sapiens
acagcaaccucuucuucug

SEQ ID NO: 1012415 - RNA, 19 nt, Homo sapiens
cuagauggcgacuuaacaa

SEQ ID NO: 1012416 - RNA, 19 nt, Homo sapiens
caacgcucuccaugcuuua

SEQ ID NO: 1012417 - RNA, 19 nt, Homo sapiens
ucagauacagccagaagau

SEQ ID NO: 1012418 - RNA, 19 nt, Homo sapiens
gaauacaagaaggcagaaa

SEQ ID NO: 1012419 - RNA, 19 nt, Homo sapiens
ggaucagcuuuacuaugug

SEQ ID NO: 1012420 - RNA, 19 nt, Homo sapiens
caucagagguuuucauugc

SEQ ID NO: 1012421 - RNA, 19 nt, Homo sapiens
ugaugggcauggacuggaa

SEQ ID NO: 1012422 - RNA, 19 nt, Homo sapiens
cauuauuucucaccccuua

SEQ ID NO: 1012423 - RNA, 19 nt, Homo sapiens
gaaugcauagaacacauca

SEQ ID NO: 1012424 - RNA, 19 nt, Homo sapiens
gaagcagugccaugaaugc

SEQ ID NO: 1012425 - RNA, 19 nt, Homo sapiens
agaucaaccugaacggaau

SEQ ID NO: 1012426 - RNA, 19 nt, Homo sapiens
cugaugauacccacggaua

SEQ ID NO: 1012427 - RNA, 19 nt, Homo sapiens
gcucagauacagccagaag

SEQ ID NO: 1012428 - RNA, 19 nt, Homo sapiens
gaaagaaccucaugaugua

SEQ ID NO: 1012429 - RNA, 19 nt, Homo sapiens
gagagaaacuacccuaaua

SEQ ID NO: 1012430 - RNA, 19 nt, Homo sapiens
gaucuacacuugauucuaa

SEQ ID NO: 1012431 - RNA, 19 nt, Homo sapiens
gaagaaagcacgacaagaa

SEQ ID NO: 1012432 - RNA, 19 nt, Homo sapiens
gaaagguacuuacaucuug

SEQ ID NO: 1012433 - RNA, 19 nt, Homo sapiens
cgaagaaucucagcaguua

SEQ ID NO: 1012434 - RNA, 19 nt, Homo sapiens
gcagucaguucaucaguua

SEQ ID NO: 1012435 - RNA, 19 nt, Homo sapiens
cggaggaacuuucuuaaua

SEQ ID NO: 1012436 - RNA, 19 nt, Homo sapiens
gaagaagaaguaaccauua

SEQ ID NO: 1012437 - RNA, 19 nt, Homo sapiens
ccaaagaugucccuugaaa

SEQ ID NO: 1012438 - RNA, 19 nt, Homo sapiens
gaagaggacccuaagagua

SEQ ID NO: 1012439 - RNA, 19 nt, Homo sapiens
gaagaugccaugaccaaua

SEQ ID NO: 1012440 - RNA, 19 nt, Homo sapiens
ggaagaaguuauccuguug

SEQ ID NO: 1012441 - RNA, 19 nt, Homo sapiens
gaacaagcagcuaccuuua

SEQ ID NO: 1012442 - RNA, 19 nt, Homo sapiens
cagaguaugugaugaauug

SEQ ID NO: 1012443 - RNA, 19 nt, Homo sapiens
gguacuagccauuaacuua

SEQ ID NO: 1012444 - RNA, 19 nt, Homo sapiens
gcagucagaugaguucuuu

SEQ ID NO: 1012445 - RNA, 19 nt, Homo sapiens
gcagcuaccuuuaaacuag

SEQ ID NO: 1012446 - RNA, 19 nt, Homo sapiens
gaaauugcccuucuuaaag

SEQ ID NO: 1012447 - RNA, 19 nt, Homo sapiens
ggaggaacuuucuuaauag

SEQ ID NO: 1012448 - RNA, 19 nt, Homo sapiens
gaucuacaaugcauaucua

SEQ ID NO: 1012449 - RNA, 19 nt, Homo sapiens
gccacuacauuuacaauaa

SEQ ID NO: 1012450 - RNA, 19 nt, Homo sapiens
guacacccauccucaguaa

SEQ ID NO: 1012451 - RNA, 19 nt, Homo sapiens
gcaguuguaugaucuucua

SEQ ID NO: 1012452 - RNA, 19 nt, Homo sapiens
ggaagaggaagaagaagua

SEQ ID NO: 1012453 - RNA, 19 nt, Homo sapiens
gaucagcaaugcaaugaau

SEQ ID NO: 1012454 - RNA, 19 nt, Homo sapiens
gaacgucuucuuucuauug

SEQ ID NO: 1012455 - RNA, 19 nt, Homo sapiens
ggaacuucuugcauacuua

SEQ ID NO: 1012456 - RNA, 19 nt, Homo sapiens
guuuaaaccuuucagauga

SEQ ID NO: 1012457 - RNA, 19 nt, Homo sapiens
ccaauacacucuuauaugg

SEQ ID NO: 1012458 - RNA, 19 nt, Homo sapiens
ugaaagaaguguccaguca

SEQ ID NO: 1012459 - RNA, 19 nt, Homo sapiens
ggaagaagaaguaaccauu

SEQ ID NO: 1012460 - RNA, 19 nt, Homo sapiens
gcaaagcacaccuaaguau

SEQ ID NO: 1012461 - RNA, 19 nt, Homo sapiens
gguagauacuggaaaugua

SEQ ID NO: 1012462 - RNA, 19 nt, Homo sapiens
gagaaagugcauugaauuu

SEQ ID NO: 1012463 - RNA, 19 nt, Homo sapiens
agaagaccauccaguauuu

SEQ ID NO: 1012464 - RNA, 19 nt, Homo sapiens
gaagauacagucaugaaau

SEQ ID NO: 1012465 - RNA, 19 nt, Homo sapiens
gccaacaccuugcagcuuu

SEQ ID NO: 1012466 - RNA, 19 nt, Homo sapiens
gaagaaguaaccauuaaug

SEQ ID NO: 1012467 - RNA, 19 nt, Homo sapiens
aguaaugugucucauguua

SEQ ID NO: 1012468 - RNA, 19 nt, Homo sapiens
ggagaaagugcauugaauu

SEQ ID NO: 1012469 - RNA, 19 nt, Homo sapiens
uaaguaaugugucucaugu

SEQ ID NO: 1012470 - RNA, 19 nt, Homo sapiens
acaagcagcuaccuuuaaa

SEQ ID NO: 1012471 - RNA, 19 nt, Homo sapiens
gauggaaucucgagcuugu

SEQ ID NO: 1012472 - RNA, 19 nt, Homo sapiens
caucgggacucaauuguug

SEQ ID NO: 1012473 - RNA, 19 nt, Homo sapiens
gaaaaucucccaaacaauu

SEQ ID NO: 1012474 - RNA, 19 nt, Homo sapiens
gcucugcauucuauucuuu

SEQ ID NO: 1012475 - RNA, 19 nt, Homo sapiens
guagguagauacuggaaau

SEQ ID NO: 1012476 - RNA, 19 nt, Homo sapiens
guacacaagagaaagauuu

SEQ ID NO: 1012477 - RNA, 19 nt, Homo sapiens
ggaauuccuuguguggaua

SEQ ID NO: 1012478 - RNA, 19 nt, Homo sapiens
gaggaacuuucuuaauaga

SEQ ID NO: 1012479 - RNA, 19 nt, Homo sapiens
caaacuagagcaaagaauu

SEQ ID NO: 1012480 - RNA, 19 nt, Homo sapiens
cugcaaaucuggauaaauc

SEQ ID NO: 1012481 - RNA, 19 nt, Homo sapiens
ggaguggagugaugcagaa

SEQ ID NO: 1012482 - RNA, 19 nt, Homo sapiens
gcucgaaguuggacuggaa

SEQ ID NO: 1012483 - RNA, 19 nt, Homo sapiens
guaaagcaggaguuaauaa

SEQ ID NO: 1012484 - RNA, 19 nt, Homo sapiens
caacagaguaugugaugaa

SEQ ID NO: 1012485 - RNA, 19 nt, Homo sapiens
guuagaaaccucuuuagaa

SEQ ID NO: 1012486 - RNA, 19 nt, Homo sapiens
gaagauuuggaaccuguua

SEQ ID NO: 1012487 - RNA, 19 nt, Homo sapiens
uugccaaacuucugaauaa

SEQ ID NO: 1012488 - RNA, 19 nt, Homo sapiens
ugaagaugauguccuggua

SEQ ID NO: 1012489 - RNA, 19 nt, Homo sapiens
aaagauagcugucauuuuc

SEQ ID NO: 1012490 - RNA, 19 nt, Homo sapiens
guaaagauagcugucauuu

SEQ ID NO: 1012491 - RNA, 19 nt, Homo sapiens
ggaaacagagccucacaga

SEQ ID NO: 1012492 - RNA, 19 nt, Homo sapiens
caugaaagcagucagauga

SEQ ID NO: 1012493 - RNA, 19 nt, Homo sapiens
gaagauuucacaucaacaa

SEQ ID NO: 1012494 - RNA, 19 nt, Homo sapiens
ucagacuuccuacuaauua

SEQ ID NO: 1012495 - RNA, 19 nt, Homo sapiens
guauuugccacuacauuua

SEQ ID NO: 1012496 - RNA, 19 nt, Homo sapiens
gaaauguaaucuugguucu

SEQ ID NO: 1012497 - RNA, 19 nt, Homo sapiens
ggaaucagcaaauguggaa

SEQ ID NO: 1012498 - RNA, 19 nt, Homo sapiens
caacaacagcauucugaaa

SEQ ID NO: 1012499 - RNA, 19 nt, Homo sapiens
gcaccugggagcuacuuua

SEQ ID NO: 1012500 - RNA, 19 nt, Homo sapiens
aguaugcccuacaaucuua

SEQ ID NO: 1012501 - RNA, 19 nt, Homo sapiens
agaaagaaccucaugaugu

SEQ ID NO: 1012502 - RNA, 19 nt, Homo sapiens
gaagaccauccaguauuua

SEQ ID NO: 1012503 - RNA, 19 nt, Homo sapiens
ggaaguaaauaugaaagag

SEQ ID NO: 1012504 - RNA, 19 nt, Homo sapiens
caugaccaauacacucuua

SEQ ID NO: 1012505 - RNA, 19 nt, Homo sapiens
ggagacguuugucaguaaa

SEQ ID NO: 1012506 - RNA, 19 nt, Homo sapiens
gcagagacggguaucacua

SEQ ID NO: 1012507 - RNA, 19 nt, Homo sapiens
gaagaaacaggcuuuguac

SEQ ID NO: 1012508 - RNA, 19 nt, Homo sapiens
aaagaaguguccagucaga

SEQ ID NO: 1012509 - RNA, 19 nt, Homo sapiens
gcagaucauuacggaauug

SEQ ID NO: 1012510 - RNA, 19 nt, Homo sapiens
ggagacggcccaaggcaaa

SEQ ID NO: 1012511 - RNA, 19 nt, Homo sapiens
ccaacaccuugcagcuuua

SEQ ID NO: 1012512 - RNA, 19 nt, Homo sapiens
caaugaauuugcuccgaaa

SEQ ID NO: 1012513 - RNA, 19 nt, Homo sapiens
uaccaggacuugcucauau

SEQ ID NO: 1012514 - RNA, 19 nt, Homo sapiens
gcaaaucuggauaaaucua

SEQ ID NO: 1012515 - RNA, 19 nt, Homo sapiens
gcaguuaguuuagccaaca

SEQ ID NO: 1012516 - RNA, 19 nt, Homo sapiens
gggaagcaaguaaauguaa

SEQ ID NO: 1012517 - RNA, 19 nt, Homo sapiens
gcaagaacaagaaacacaa

SEQ ID NO: 1012518 - RNA, 19 nt, Homo sapiens
gaaagcagucagaugaguu

SEQ ID NO: 1012519 - RNA, 19 nt, Homo sapiens
ggucaucacauuaaguauu

SEQ ID NO: 1012520 - RNA, 19 nt, Homo sapiens
gaaagcacgacaagaagga

SEQ ID NO: 1012521 - RNA, 19 nt, Homo sapiens
gaagauuuccucuccaaag

SEQ ID NO: 1012522 - RNA, 19 nt, Homo sapiens
ccugaaaucuuacguguac

SEQ ID NO: 1012523 - RNA, 19 nt, Homo sapiens
ggauuauucuguuccugaa

SEQ ID NO: 1012524 - RNA, 19 nt, Homo sapiens
uugaaggcuuuauggauua

SEQ ID NO: 1012525 - RNA, 19 nt, Homo sapiens
agaagaaacaggcuuugua

SEQ ID NO: 1012526 - RNA, 19 nt, Homo sapiens
guaaucaagucugaagaug

SEQ ID NO: 1012527 - RNA, 19 nt, Homo sapiens
aagaggacccuaagaguaa

SEQ ID NO: 1012528 - RNA, 19 nt, Homo sapiens
gaacaacggugaugaagug

SEQ ID NO: 1012529 - RNA, 19 nt, Homo sapiens
gaaguuggcucuccuugga

SEQ ID NO: 1012530 - RNA, 19 nt, Homo sapiens
cagaagaucuuguggauuc

SEQ ID NO: 1012531 - RNA, 19 nt, Homo sapiens
guucagaccucacaucuuc

SEQ ID NO: 1012532 - RNA, 19 nt, Homo sapiens
uaaagauggucaugacaaa

SEQ ID NO: 1012533 - RNA, 19 nt, Homo sapiens
guagagacaucaucugugu

SEQ ID NO: 1012534 - RNA, 19 nt, Homo sapiens
gcucaaacguguaucacuu

SEQ ID NO: 1012535 - RNA, 19 nt, Homo sapiens
ggacagcucuccacauugc

SEQ ID NO: 1012536 - RNA, 19 nt, Homo sapiens
gaaagcaagucugcaguuc

SEQ ID NO: 1012537 - RNA, 19 nt, Homo sapiens
ggacaagaccuguuuccuu

SEQ ID NO: 1012538 - RNA, 19 nt, Homo sapiens
caucaucuguguauccaaa

SEQ ID NO: 1012539 - RNA, 19 nt, Homo sapiens
gggaccgucuuucgauaua

SEQ ID NO: 1012540 - RNA, 19 nt, Homo sapiens
aaggacagcucuccacauu

SEQ ID NO: 1012541 - RNA, 19 nt, Homo sapiens
ggauaugugugugcucaaa

SEQ ID NO: 1012542 - RNA, 19 nt, Homo sapiens
caaggugacugacacaaag

SEQ ID NO: 1012543 - RNA, 19 nt, Homo sapiens
gcaaggugacugacacaaa

SEQ ID NO: 1012544 - RNA, 19 nt, Homo sapiens
caccaucggucacccauug

SEQ ID NO: 1012545 - RNA, 19 nt, Homo sapiens
ggaaagcaagucugcaguu

SEQ ID NO: 1012546 - RNA, 19 nt, Homo sapiens
ggaugucuauaugaucuuu

SEQ ID NO: 1012547 - RNA, 19 nt, Homo sapiens
gaaggcaggaggaaagaga

SEQ ID NO: 1012548 - RNA, 19 nt, Homo sapiens
gcgggaccgucuuucgaua

SEQ ID NO: 1012549 - RNA, 19 nt, Homo sapiens
aaucugagcuacuuagagu

SEQ ID NO: 1012550 - RNA, 19 nt, Homo sapiens
ggaccgucuuucgauauaa

SEQ ID NO: 1012551 - RNA, 19 nt, Homo sapiens
ccuguuuccuugagacuuu

SEQ ID NO: 1012552 - RNA, 19 nt, Homo sapiens
ggugagugcuccuccgaau

SEQ ID NO: 1012553 - RNA, 19 nt, Homo sapiens
agaaggacaagaccuguuu

SEQ ID NO: 1012554 - RNA, 19 nt, Homo sapiens
cagagaggccugugacaug

SEQ ID NO: 1012555 - RNA, 19 nt, Homo sapiens
gcaguuccuugcuaaucug

SEQ ID NO: 1012556 - RNA, 19 nt, Homo sapiens
uuacacagacugagaagga

SEQ ID NO: 1012557 - RNA, 19 nt, Homo sapiens
gccccugccucccuaauua

SEQ ID NO: 1012558 - RNA, 19 nt, Homo sapiens
gcacacagcguagagacau

SEQ ID NO: 1012559 - RNA, 19 nt, Homo sapiens
guggaugucuauaugaucu

SEQ ID NO: 1012560 - RNA, 19 nt, Homo sapiens
ccacccagaacuaauuuau

SEQ ID NO: 1012561 - RNA, 19 nt, Homo sapiens
gagaaggacaagaccuguu

SEQ ID NO: 1012562 - RNA, 19 nt, Homo sapiens
gagguuacacagacugaga

SEQ ID NO: 1012563 - RNA, 19 nt, Homo sapiens
agagacaucaucuguguau

SEQ ID NO: 1012564 - RNA, 19 nt, Homo sapiens
gcagugccggcaggaauuu

SEQ ID NO: 1012565 - RNA, 19 nt, Homo sapiens
gaccucacaucuucuaagc

SEQ ID NO: 1012566 - RNA, 19 nt, Homo sapiens
gcagagaggccugugacau

SEQ ID NO: 1012567 - RNA, 19 nt, Homo sapiens
ggaacaacggugaugaagu

SEQ ID NO: 1012568 - RNA, 19 nt, Homo sapiens
uauuaaagauggucaugac

SEQ ID NO: 1012569 - RNA, 19 nt, Homo sapiens
gggacugcauggauaugug

SEQ ID NO: 1012570 - RNA, 19 nt, Homo sapiens
ccgaugcccuccucaacug

SEQ ID NO: 1012571 - RNA, 19 nt, Homo sapiens
ugagugcuccuccgaaugu

SEQ ID NO: 1012572 - RNA, 19 nt, Homo sapiens
gccuguggaugucuauaug

SEQ ID NO: 1012573 - RNA, 19 nt, Homo sapiens
uuaaagauggucaugacaa

SEQ ID NO: 1012574 - RNA, 19 nt, Homo sapiens
uugcuaaucugagcuacuu

SEQ ID NO: 1012575 - RNA, 19 nt, Homo sapiens
ggacugcauggauaugugu

SEQ ID NO: 1012576 - RNA, 19 nt, Homo sapiens
gagagucugucggcugaag

SEQ ID NO: 1012577 - RNA, 19 nt, Homo sapiens
gcccuaagccucauuucuc

SEQ ID NO: 1012578 - RNA, 19 nt, Homo sapiens
gcguagagacaucaucugu

SEQ ID NO: 1012579 - RNA, 19 nt, Homo sapiens
caagugcucagccgagugu

SEQ ID NO: 1012580 - RNA, 19 nt, Homo sapiens
gcuaucagaagaucuugug

SEQ ID NO: 1012581 - RNA, 19 nt, Homo sapiens
agucugcaguuccuugcua

SEQ ID NO: 1012582 - RNA, 19 nt, Homo sapiens
gacaucaucuguguaucca

SEQ ID NO: 1012583 - RNA, 19 nt, Homo sapiens
aagauggucaugacaaaug

SEQ ID NO: 1012584 - RNA, 19 nt, Homo sapiens
ucagaccucacaucuucua

SEQ ID NO: 1012585 - RNA, 19 nt, Homo sapiens
cccuaagccucauuucuca

SEQ ID NO: 1012586 - RNA, 19 nt, Homo sapiens
aaacguguaucacuuuuca

SEQ ID NO: 1012587 - RNA, 19 nt, Homo sapiens
gaacuuggcgcugguacac

SEQ ID NO: 1012588 - RNA, 19 nt, Homo sapiens
cuucucauuugccuaguau

SEQ ID NO: 1012589 - RNA, 19 nt, Homo sapiens
gaaggacaagaccuguuuc

SEQ ID NO: 1012590 - RNA, 19 nt, Homo sapiens
gaccgucuuucgauauaac

SEQ ID NO: 1012591 - RNA, 19 nt, Homo sapiens
ggaagcaggagcaggaacu

SEQ ID NO: 1012592 - RNA, 19 nt, Homo sapiens
ucauuugccuaguaucucu

SEQ ID NO: 1012593 - RNA, 19 nt, Homo sapiens
ccugauggcuguggagucu

SEQ ID NO: 1012594 - RNA, 19 nt, Homo sapiens
ugauggcuguggagucugu

SEQ ID NO: 1012595 - RNA, 19 nt, Homo sapiens
ccucauuucucauguucag

SEQ ID NO: 1012596 - RNA, 19 nt, Homo sapiens
ccagagaagccggcagguu

SEQ ID NO: 1012597 - RNA, 19 nt, Homo sapiens
cacugccaauccugccuua

SEQ ID NO: 1012598 - RNA, 19 nt, Homo sapiens
ggagcgcuguggacaucuc

SEQ ID NO: 1012599 - RNA, 19 nt, Homo sapiens
uaugaucuuucaggaggaa

SEQ ID NO: 1012600 - RNA, 19 nt, Homo sapiens
caggaaggcaggaggaaag

SEQ ID NO: 1012601 - RNA, 19 nt, Homo sapiens
cugccucccuaauuagcua

SEQ ID NO: 1012602 - RNA, 19 nt, Homo sapiens
gucugcaguuccuugcuaa

SEQ ID NO: 1012603 - RNA, 19 nt, Homo sapiens
ucaaacguguaucacuuuu

SEQ ID NO: 1012604 - RNA, 19 nt, Homo sapiens
cuauguccgucacacugaa

SEQ ID NO: 1012605 - RNA, 19 nt, Homo sapiens
cacccagaacuaauuuauu

SEQ ID NO: 1012606 - RNA, 19 nt, Homo sapiens
ccuucucauuugccuagua

SEQ ID NO: 1012607 - RNA, 19 nt, Homo sapiens
cuaagccucauuucucaug

SEQ ID NO: 1012608 - RNA, 19 nt, Homo sapiens
ccuugagacuuuccuaggu

SEQ ID NO: 1012609 - RNA, 19 nt, Homo sapiens
cgggagaggaacuggauga

SEQ ID NO: 1012610 - RNA, 19 nt, Homo sapiens
uaagccucauuucucaugu

SEQ ID NO: 1012611 - RNA, 19 nt, Homo sapiens
aucaguaugucaucucuuc

SEQ ID NO: 1012612 - RNA, 19 nt, Homo sapiens
gauggaguuuccucucaua

SEQ ID NO: 1012613 - RNA, 19 nt, Homo sapiens
ggaguuuccucucauagug

SEQ ID NO: 1012614 - RNA, 19 nt, Homo sapiens
ccgccaaagugcaauauaa

SEQ ID NO: 1012615 - RNA, 19 nt, Homo sapiens
aaacacaggaucagcauaa

SEQ ID NO: 1012616 - RNA, 19 nt, Homo sapiens
uuaccuaggcuaugaauaa

SEQ ID NO: 1012617 - RNA, 19 nt, Homo sapiens
cagcauaaccgccaaagug

SEQ ID NO: 1012618 - RNA, 19 nt, Homo sapiens
aaaccaggcuuccguagca

SEQ ID NO: 1012619 - RNA, 19 nt, Homo sapiens
ccuaggacguuagcccuua

SEQ ID NO: 1012620 - RNA, 19 nt, Homo sapiens
ggaaccagcagcgaguuaa

SEQ ID NO: 1012621 - RNA, 19 nt, Homo sapiens
gaacuuuaccuaggcuaug

SEQ ID NO: 1012622 - RNA, 19 nt, Homo sapiens
ggccuucccugcuauugug

SEQ ID NO: 1012623 - RNA, 19 nt, Homo sapiens
gcacaguagaaaugaaaug

SEQ ID NO: 1012624 - RNA, 19 nt, Homo sapiens
ugaguugacuauucuacug

SEQ ID NO: 1012625 - RNA, 19 nt, Homo sapiens
gagcugcggacgacacuga

SEQ ID NO: 1012626 - RNA, 19 nt, Homo sapiens
uaccuaggcuaugaauaaa

SEQ ID NO: 1012627 - RNA, 19 nt, Homo sapiens
gggaaccagcagcgaguua

SEQ ID NO: 1012628 - RNA, 19 nt, Homo sapiens
gagcagcccaggugcaugu

SEQ ID NO: 1012629 - RNA, 19 nt, Homo sapiens
acuauucuacugcuuguua

SEQ ID NO: 1012630 - RNA, 19 nt, Homo sapiens
caguagaaaugaaaugaac

SEQ ID NO: 1012631 - RNA, 19 nt, Homo sapiens
guagcacaguagaaaugaa

SEQ ID NO: 1012632 - RNA, 19 nt, Homo sapiens
cggagcaggugcaaucugu

SEQ ID NO: 1012633 - RNA, 19 nt, Homo sapiens
gaggggaggugucacagaa

SEQ ID NO: 1012634 - RNA, 19 nt, Homo sapiens
gaaccagcagcgaguuaau

SEQ ID NO: 1012635 - RNA, 19 nt, Homo sapiens
gcgcucggcuuuucuuuug

SEQ ID NO: 1012636 - RNA, 19 nt, Homo sapiens
uagcacaguagaaaugaaa

SEQ ID NO: 1012637 - RNA, 19 nt, Homo sapiens
cuaggacguuagcccuuaa

SEQ ID NO: 1012638 - RNA, 19 nt, Homo sapiens
ugacuauucuacugcuugu

SEQ ID NO: 1012639 - RNA, 19 nt, Homo sapiens
gccaaagugcaauauaaau

SEQ ID NO: 1012640 - RNA, 19 nt, Homo sapiens
uuagagcuuuggcaucaga

SEQ ID NO: 1012641 - RNA, 19 nt, Homo sapiens
aguuagagcuuuggcauca

SEQ ID NO: 1012642 - RNA, 19 nt, Homo sapiens
ggccguguguagccaaguu

SEQ ID NO: 1012643 - RNA, 19 nt, Homo sapiens
augaacaauuggcgacuuu

SEQ ID NO: 1012644 - RNA, 19 nt, Homo sapiens
cgccaaagugcaauauaaa

SEQ ID NO: 1012645 - RNA, 19 nt, Homo sapiens
caaacacaggaucagcaua

SEQ ID NO: 1012646 - RNA, 19 nt, Homo sapiens
ggacugaggggcacaauag

SEQ ID NO: 1012647 - RNA, 19 nt, Homo sapiens
uaaccgccaaagugcaaua

SEQ ID NO: 1012648 - RNA, 19 nt, Homo sapiens
cauaaccgccaaagugcaa

SEQ ID NO: 1012649 - RNA, 19 nt, Homo sapiens
gaacaauuggcgacuuuug

SEQ ID NO: 1012650 - RNA, 19 nt, Homo sapiens
ggggaggugucacagaaaa

SEQ ID NO: 1012651 - RNA, 19 nt, Homo sapiens
gaguuuccucucauaguga

SEQ ID NO: 1012652 - RNA, 19 nt, Homo sapiens
cacaguagaaaugaaauga

SEQ ID NO: 1012653 - RNA, 19 nt, Homo sapiens
cuuaaaaccuaggacguua

SEQ ID NO: 1012654 - RNA, 19 nt, Homo sapiens
gacguuagcccuuaaaaca

SEQ ID NO: 1012655 - RNA, 19 nt, Homo sapiens
gaucagcauaaccgccaaa

SEQ ID NO: 1012656 - RNA, 19 nt, Homo sapiens
aggcuuccguagcacagua

SEQ ID NO: 1012657 - RNA, 19 nt, Homo sapiens
aacuuuaccuaggcuauga

SEQ ID NO: 1012658 - RNA, 19 nt, Homo sapiens
ucauagugauuugccacaa

SEQ ID NO: 1012659 - RNA, 19 nt, Homo sapiens
uugauggaguuuccucuca

SEQ ID NO: 1012660 - RNA, 19 nt, Homo sapiens
cguuagcccuuaaaacaaa

SEQ ID NO: 1012661 - RNA, 19 nt, Homo sapiens
cuucaggacauucagcaaa

SEQ ID NO: 1012662 - RNA, 19 nt, Homo sapiens
ccaaacacaggaucagcau

SEQ ID NO: 1012663 - RNA, 19 nt, Homo sapiens
ugauggaguuuccucucau

SEQ ID NO: 1012664 - RNA, 19 nt, Homo sapiens
ggcggaauacggcuucuuc

SEQ ID NO: 1012665 - RNA, 19 nt, Homo sapiens
gcaaggaggugacccugaa

SEQ ID NO: 1012666 - RNA, 19 nt, Homo sapiens
ggacaggacuggcccacuu

SEQ ID NO: 1012667 - RNA, 19 nt, Homo sapiens
ggaaggagcugaagaucgu

SEQ ID NO: 1012668 - RNA, 19 nt, Homo sapiens
caacuuggccacugucuuu

SEQ ID NO: 1012669 - RNA, 19 nt, Homo sapiens
gaagucagguugccaaagg

SEQ ID NO: 1012670 - RNA, 19 nt, Homo sapiens
gaccaucuccuuaagguuu

SEQ ID NO: 1012671 - RNA, 19 nt, Homo sapiens
ggccacagccugauuugua

SEQ ID NO: 1012672 - RNA, 19 nt, Homo sapiens
gcuagacucuuggaacauu

SEQ ID NO: 1012673 - RNA, 19 nt, Homo sapiens
gccacagccugauuuguaa

SEQ ID NO: 1012674 - RNA, 19 nt, Homo sapiens
gagauaggcaccacuguau

SEQ ID NO: 1012675 - RNA, 19 nt, Homo sapiens
agacagaccugaggaagga

SEQ ID NO: 1012676 - RNA, 19 nt, Homo sapiens
caucgguguucgagaagua

SEQ ID NO: 1012677 - RNA, 19 nt, Homo sapiens
ucccugaggucacgcauuu

SEQ ID NO: 1012678 - RNA, 19 nt, Homo sapiens
ccaaagugcugggauuaca

SEQ ID NO: 1012679 - RNA, 19 nt, Homo sapiens
caucugaccaucuccuuaa

SEQ ID NO: 1012680 - RNA, 19 nt, Homo sapiens
ucccugggcucccgagaua

SEQ ID NO: 1012681 - RNA, 19 nt, Homo sapiens
agacaggguuucaccaugu

SEQ ID NO: 1012682 - RNA, 19 nt, Homo sapiens
guucauagaccaccugugu

SEQ ID NO: 1012683 - RNA, 19 nt, Homo sapiens
gcaggaaggagcugaagau

SEQ ID NO: 1012684 - RNA, 19 nt, Homo sapiens
cgagauaggcaccacugua

SEQ ID NO: 1012685 - RNA, 19 nt, Homo sapiens
gguaguggguaaacguaga

SEQ ID NO: 1012686 - RNA, 19 nt, Homo sapiens
gguagagguccaacaacua

SEQ ID NO: 1012687 - RNA, 19 nt, Homo sapiens
ccagugcagacucaaguua

SEQ ID NO: 1012688 - RNA, 19 nt, Homo sapiens
gacaggacuggcccacuua

SEQ ID NO: 1012689 - RNA, 19 nt, Homo sapiens
gggaaucaaccaaggaguu

SEQ ID NO: 1012690 - RNA, 19 nt, Homo sapiens
caccacguccggcuaauuu

SEQ ID NO: 1012691 - RNA, 19 nt, Homo sapiens
gacaggguuucaccauguu

SEQ ID NO: 1012692 - RNA, 19 nt, Homo sapiens
gcaagacagaccugaggaa

SEQ ID NO: 1012693 - RNA, 19 nt, Homo sapiens
gaauguggaggacgucuuc

SEQ ID NO: 1012694 - RNA, 19 nt, Homo sapiens
ggaaucaaccaaggaguuc

SEQ ID NO: 1012695 - RNA, 19 nt, Homo sapiens
cgccuaagaugggauaaug

SEQ ID NO: 1012696 - RNA, 19 nt, Homo sapiens
uugcagagcugggcacaug

SEQ ID NO: 1012697 - RNA, 19 nt, Homo sapiens
cggcuagacucuuggaaca

SEQ ID NO: 1012698 - RNA, 19 nt, Homo sapiens
ccaacagccagauaccuaa

SEQ ID NO: 1012699 - RNA, 19 nt, Homo sapiens
gagacauccuggccuccuu

SEQ ID NO: 1012700 - RNA, 19 nt, Homo sapiens
gcucaucggcugcaagaca

SEQ ID NO: 1012701 - RNA, 19 nt, Homo sapiens
ucaugaaucccaccagcua

SEQ ID NO: 1012702 - RNA, 19 nt, Homo sapiens
aggagucggugucgccuaa

SEQ ID NO: 1012703 - RNA, 19 nt, Homo sapiens
ccaguguggucaugagcaa

SEQ ID NO: 1012704 - RNA, 19 nt, Homo sapiens
ggccgagggucugggaauu

SEQ ID NO: 1012705 - RNA, 19 nt, Homo sapiens
gagucggugucgccuaaga

SEQ ID NO: 1012706 - RNA, 19 nt, Homo sapiens
ccucgcugcucauggugua

SEQ ID NO: 1012707 - RNA, 19 nt, Homo sapiens
gcccaggacuuuuaaaaca

SEQ ID NO: 1012708 - RNA, 19 nt, Homo sapiens
gagaacugaugggaucuac

SEQ ID NO: 1012709 - RNA, 19 nt, Homo sapiens
ccuuaagguuucacccaaa

SEQ ID NO: 1012710 - RNA, 19 nt, Homo sapiens
acaacguccucaucaagug

SEQ ID NO: 1012711 - RNA, 19 nt, Homo sapiens
cgacaacguccucaucaag

SEQ ID NO: 1012712 - RNA, 19 nt, Homo sapiens
ucauagaccaccuguguca

SEQ ID NO: 1012713 - RNA, 19 nt, Homo sapiens
ccaaguuucgggagaaugu

SEQ ID NO: 1012714 - RNA, 19 nt, Homo sapiens
gacaacguccucaucaagu

SEQ ID NO: 1012715 - RNA, 19 nt, Homo sapiens
gccuuagccucccaaagug

SEQ ID NO: 1012716 - RNA, 19 nt, Homo sapiens
ccacccaucugaccaucuc

SEQ ID NO: 1012717 - RNA, 19 nt, Homo sapiens
aauggcuucucaguuguua

SEQ ID NO: 1012718 - RNA, 19 nt, Homo sapiens
agaccucgcugcucauggu

SEQ ID NO: 1012719 - RNA, 19 nt, Homo sapiens
gaacauucuggaacucucu

SEQ ID NO: 1012720 - RNA, 19 nt, Homo sapiens
cgccuuagccucccaaagu

SEQ ID NO: 1012721 - RNA, 19 nt, Homo sapiens
ggcaugaucuuggcucacu

SEQ ID NO: 1012722 - RNA, 19 nt, Homo sapiens
ccaucugaccaucuccuua

SEQ ID NO: 1012723 - RNA, 19 nt, Homo sapiens
gcagagcugggcacaugug

SEQ ID NO: 1012724 - RNA, 19 nt, Homo sapiens
caacagccagauaccuaau

SEQ ID NO: 1012725 - RNA, 19 nt, Homo sapiens
cuaccagccuguggaguuc

SEQ ID NO: 1012726 - RNA, 19 nt, Homo sapiens
uggcuucucaguuguuaaa

SEQ ID NO: 1012727 - RNA, 19 nt, Homo sapiens
acguagaccuggcacuguu

SEQ ID NO: 1012728 - RNA, 19 nt, Homo sapiens
gaauguuccgccaaguuuc

SEQ ID NO: 1012729 - RNA, 19 nt, Homo sapiens
cgguagagguccaacaacu

SEQ ID NO: 1012730 - RNA, 19 nt, Homo sapiens
agagugcaguggcaugauc

SEQ ID NO: 1012731 - RNA, 19 nt, Homo sapiens
ccaaccugcugucccucaa

SEQ ID NO: 1012732 - RNA, 19 nt, Homo sapiens
gccgagggucugggaauuu

SEQ ID NO: 1012733 - RNA, 19 nt, Homo sapiens
uucuggaacucucuccuuu

SEQ ID NO: 1012734 - RNA, 19 nt, Homo sapiens
gccugcggcuagacucuug

SEQ ID NO: 1012735 - RNA, 19 nt, Homo sapiens
gcugcucucuaccuggaau

SEQ ID NO: 1012736 - RNA, 19 nt, Homo sapiens
ccacagccugauuuguaaa

SEQ ID NO: 1012737 - RNA, 19 nt, Homo sapiens
gugcucaucggcugcaaga

SEQ ID NO: 1012738 - RNA, 19 nt, Homo sapiens
ucagguugccaaaggaaga

SEQ ID NO: 1012739 - RNA, 19 nt, Homo sapiens
gaacuccugaccucgugau

SEQ ID NO: 1012740 - RNA, 19 nt, Homo sapiens
ggaccacccaucugaccau

SEQ ID NO: 1012741 - RNA, 19 nt, Homo sapiens
agugcagacucaaguuaug

SEQ ID NO: 1012742 - RNA, 19 nt, Homo sapiens
caggagccagugucuguug

SEQ ID NO: 1012743 - RNA, 19 nt, Homo sapiens
gagcagcaaucuuauauaa

SEQ ID NO: 1012744 - RNA, 19 nt, Homo sapiens
ggacaaauuuagcuugaaa

SEQ ID NO: 1012745 - RNA, 19 nt, Homo sapiens
guucaaaucugauacacua

SEQ ID NO: 1012746 - RNA, 19 nt, Homo sapiens
gcauauaucaccacuguua

SEQ ID NO: 1012747 - RNA, 19 nt, Homo sapiens
gaguauaguuugacuguaa

SEQ ID NO: 1012748 - RNA, 19 nt, Homo sapiens
gaaagacacuagauccuau

SEQ ID NO: 1012749 - RNA, 19 nt, Homo sapiens
gaaacaugcuccaaggaaa

SEQ ID NO: 1012750 - RNA, 19 nt, Homo sapiens
gaaaagagaucugaguaua

SEQ ID NO: 1012751 - RNA, 19 nt, Homo sapiens
uaaaggcacugcuuagauu

SEQ ID NO: 1012752 - RNA, 19 nt, Homo sapiens
ugagagagaugcuuauuau

SEQ ID NO: 1012753 - RNA, 19 nt, Homo sapiens
caucagaucucaucacaga

SEQ ID NO: 1012754 - RNA, 19 nt, Homo sapiens
gaaauggaaucuguccuuu

SEQ ID NO: 1012755 - RNA, 19 nt, Homo sapiens
caagaucucucauaccuau

SEQ ID NO: 1012756 - RNA, 19 nt, Homo sapiens
gaaagaaucgcucaggaaa

SEQ ID NO: 1012757 - RNA, 19 nt, Homo sapiens
gaacucagcugcgccauag

SEQ ID NO: 1012758 - RNA, 19 nt, Homo sapiens
gaacaacaacaacaacaaa

SEQ ID NO: 1012759 - RNA, 19 nt, Homo sapiens
ugaccaagcuucuauuaau

SEQ ID NO: 1012760 - RNA, 19 nt, Homo sapiens
aagagacgcuuucaaguuu

SEQ ID NO: 1012761 - RNA, 19 nt, Homo sapiens
gcacuuugcucuuagaucu

SEQ ID NO: 1012762 - RNA, 19 nt, Homo sapiens
ucaagcaaguggauuauga

SEQ ID NO: 1012763 - RNA, 19 nt, Homo sapiens
ggauguggcugauguuuua

SEQ ID NO: 1012764 - RNA, 19 nt, Homo sapiens
uaauugcugugcuguguua

SEQ ID NO: 1012765 - RNA, 19 nt, Homo sapiens
gcuaaggaacugucuauaa

SEQ ID NO: 1012766 - RNA, 19 nt, Homo sapiens
ggaauauugucuuucuuug

SEQ ID NO: 1012767 - RNA, 19 nt, Homo sapiens
aauggaaucuguccuuuaa

SEQ ID NO: 1012768 - RNA, 19 nt, Homo sapiens
gggaagaauuauuauguug

SEQ ID NO: 1012769 - RNA, 19 nt, Homo sapiens
caaaggcaauccucagcua

SEQ ID NO: 1012770 - RNA, 19 nt, Homo sapiens
caacguuccugugguuaua

SEQ ID NO: 1012771 - RNA, 19 nt, Homo sapiens
gggcauauaucaccacugu

SEQ ID NO: 1012772 - RNA, 19 nt, Homo sapiens
gcaaaugagaaauccuuua

SEQ ID NO: 1012773 - RNA, 19 nt, Homo sapiens
gaacaacugugccagaaaa

SEQ ID NO: 1012774 - RNA, 19 nt, Homo sapiens
gaaauucuccucuacuugu

SEQ ID NO: 1012775 - RNA, 19 nt, Homo sapiens
caaaggaaguugaggcaau

SEQ ID NO: 1012776 - RNA, 19 nt, Homo sapiens
ccaaggaaauggaaucugu

SEQ ID NO: 1012777 - RNA, 19 nt, Homo sapiens
gaaacuagccacuguucaa

SEQ ID NO: 1012778 - RNA, 19 nt, Homo sapiens
gaaugggagcugucaguua

SEQ ID NO: 1012779 - RNA, 19 nt, Homo sapiens
gagaagccgauaugaauuu

SEQ ID NO: 1012780 - RNA, 19 nt, Homo sapiens
uaauuaagguuguggaugu

SEQ ID NO: 1012781 - RNA, 19 nt, Homo sapiens
guugaacucuuauaggaaa

SEQ ID NO: 1012782 - RNA, 19 nt, Homo sapiens
agacagugauuaugauuug

SEQ ID NO: 1012783 - RNA, 19 nt, Homo sapiens
gggccugcauugcguaaua

SEQ ID NO: 1012784 - RNA, 19 nt, Homo sapiens
gaccaagcuucuauuaaug

SEQ ID NO: 1012785 - RNA, 19 nt, Homo sapiens
ucauaaaugugucugugua

SEQ ID NO: 1012786 - RNA, 19 nt, Homo sapiens
gaacugguggcagagauua

SEQ ID NO: 1012787 - RNA, 19 nt, Homo sapiens
ugaagugcaugaucuuuga

SEQ ID NO: 1012788 - RNA, 19 nt, Homo sapiens
gggaaauucuccucuacuu

SEQ ID NO: 1012789 - RNA, 19 nt, Homo sapiens
cuaaggaacugucuauaag

SEQ ID NO: 1012790 - RNA, 19 nt, Homo sapiens
guacagcaaugacuucagu

SEQ ID NO: 1012791 - RNA, 19 nt, Homo sapiens
cgaagcaacugguaagcaa

SEQ ID NO: 1012792 - RNA, 19 nt, Homo sapiens
ggaaugccuuggugagaga

SEQ ID NO: 1012793 - RNA, 19 nt, Homo sapiens
ggagaucccugaaaauuau

SEQ ID NO: 1012794 - RNA, 19 nt, Homo sapiens
ucucacagauggaagaauu

SEQ ID NO: 1012795 - RNA, 19 nt, Homo sapiens
uaagagacgcuuucaaguu

SEQ ID NO: 1012796 - RNA, 19 nt, Homo sapiens
ggacgaacgaccaaacaaa

SEQ ID NO: 1012797 - RNA, 19 nt, Homo sapiens
ggacugagaaauaucuuga

SEQ ID NO: 1012798 - RNA, 19 nt, Homo sapiens
uuaacaaacugcuucaaga

SEQ ID NO: 1012799 - RNA, 19 nt, Homo sapiens
caagacauggacaaauuua

SEQ ID NO: 1012800 - RNA, 19 nt, Homo sapiens
cuacagauaugcccuucaa

SEQ ID NO: 1012801 - RNA, 19 nt, Homo sapiens
ugagaaauaucuugaaggu

SEQ ID NO: 1012802 - RNA, 19 nt, Homo sapiens
gauaugcccuucaagacau

SEQ ID NO: 1012803 - RNA, 19 nt, Homo sapiens
ggacugauggagccaagua

SEQ ID NO: 1012804 - RNA, 19 nt, Homo sapiens
uugaagugcuggauauuaa

SEQ ID NO: 1012805 - RNA, 19 nt, Homo sapiens
gaaguugaagugcuggaua

SEQ ID NO: 1012806 - RNA, 19 nt, Homo sapiens
agagagaugcuuauuauga

SEQ ID NO: 1012807 - RNA, 19 nt, Homo sapiens
gaggagaauaucuucauaa

SEQ ID NO: 1012808 - RNA, 19 nt, Homo sapiens
ugaggagaauaucuucaua

SEQ ID NO: 1012809 - RNA, 19 nt, Homo sapiens
aagaaucgcucaggaaaga

SEQ ID NO: 1012810 - RNA, 19 nt, Homo sapiens
ugacaacguuccugugguu

SEQ ID NO: 1012811 - RNA, 19 nt, Homo sapiens
ggaaauggaaucuguccuu

SEQ ID NO: 1012812 - RNA, 19 nt, Homo sapiens
caaaucugauacacuauuc

SEQ ID NO: 1012813 - RNA, 19 nt, Homo sapiens
ucacaacagucaccaguca

SEQ ID NO: 1012814 - RNA, 19 nt, Homo sapiens
guaauaauacggcagaaau

SEQ ID NO: 1012815 - RNA, 19 nt, Homo sapiens
cagagaagccgauaugaau

SEQ ID NO: 1012816 - RNA, 19 nt, Homo sapiens
aaagagaucugaguauagu

SEQ ID NO: 1012817 - RNA, 19 nt, Homo sapiens
gguuggcacuuugcucuua

SEQ ID NO: 1012818 - RNA, 19 nt, Homo sapiens
gaaaucaccauucccaaag

SEQ ID NO: 1012819 - RNA, 19 nt, Homo sapiens
cauggucacuuuaaacuuc

SEQ ID NO: 1012820 - RNA, 19 nt, Homo sapiens
gggauccuauugauacauu

SEQ ID NO: 1012821 - RNA, 19 nt, Homo sapiens
ccuaugagauugauguuca

SEQ ID NO: 1012822 - RNA, 19 nt, Homo sapiens
aaaauucccuccacacaua

SEQ ID NO: 1012823 - RNA, 19 nt, Homo sapiens
aaugggagcugucaguuau

SEQ ID NO: 1012824 - RNA, 19 nt, Homo sapiens
cagaaucuuugaucaugaa

SEQ ID NO: 1012825 - RNA, 19 nt, Homo sapiens
acagaggguuggaucagua

SEQ ID NO: 1012826 - RNA, 19 nt, Homo sapiens
gcacugcuuagauuaguuu

SEQ ID NO: 1012827 - RNA, 19 nt, Homo sapiens
ucucucagcuucuuucaau

SEQ ID NO: 1012828 - RNA, 19 nt, Homo sapiens
gacacuagauccuauaacu

SEQ ID NO: 1012829 - RNA, 19 nt, Homo sapiens
uaagggcaauugacagaga

SEQ ID NO: 1012830 - RNA, 19 nt, Homo sapiens
gaagaagugagucagauca

SEQ ID NO: 1012831 - RNA, 19 nt, Homo sapiens
ucucuacagugaaacauuu

SEQ ID NO: 1012832 - RNA, 19 nt, Homo sapiens
cgccagagcuaggagauuu

SEQ ID NO: 1012833 - RNA, 19 nt, Homo sapiens
acaaacugcuucaagaugu

SEQ ID NO: 1012834 - RNA, 19 nt, Homo sapiens
caaaccacgugccagagaa

SEQ ID NO: 1012835 - RNA, 19 nt, Homo sapiens
guaaugaggagaauaucuu

SEQ ID NO: 1012836 - RNA, 19 nt, Homo sapiens
aagccgauaugaauuugua

SEQ ID NO: 1012837 - RNA, 19 nt, Homo sapiens
guacugggcaagaauuuga

SEQ ID NO: 1012838 - RNA, 19 nt, Homo sapiens
gagagaugcuuauuaugac

SEQ ID NO: 1012839 - RNA, 19 nt, Homo sapiens
uggcagagauuaacaaacu

SEQ ID NO: 1012840 - RNA, 19 nt, Homo sapiens
gcuguugggugaaggauuc

SEQ ID NO: 1012841 - RNA, 19 nt, Homo sapiens
gcaguguugcugguuauua

SEQ ID NO: 1012842 - RNA, 19 nt, Homo sapiens
gaaaucaccaaauccuaug

SEQ ID NO: 1012843 - RNA, 19 nt, Homo sapiens
cuagugaacugucaauaua

SEQ ID NO: 1012844 - RNA, 19 nt, Homo sapiens
ccacccauguccagaauaa

SEQ ID NO: 1012845 - RNA, 19 nt, Homo sapiens
gaccguaaguccugugaga

SEQ ID NO: 1012846 - RNA, 19 nt, Homo sapiens
ggacagggcccuagugaac

SEQ ID NO: 1012847 - RNA, 19 nt, Homo sapiens
caugagagacuuugugugu

SEQ ID NO: 1012848 - RNA, 19 nt, Homo sapiens
cuaugcagcuugugugaau

SEQ ID NO: 1012849 - RNA, 19 nt, Homo sapiens
cacccacgcucccagauug

SEQ ID NO: 1012850 - RNA, 19 nt, Homo sapiens
gcacccacgcucccagauu

SEQ ID NO: 1012851 - RNA, 19 nt, Homo sapiens
gcgugaggccucuaucuug

SEQ ID NO: 1012852 - RNA, 19 nt, Homo sapiens
ggaccuaugcagcuugugu

SEQ ID NO: 1012853 - RNA, 19 nt, Homo sapiens
ucagagaaguaggcagaga

SEQ ID NO: 1012854 - RNA, 19 nt, Homo sapiens
gccgggagcuguaguucuc

SEQ ID NO: 1012855 - RNA, 19 nt, Homo sapiens
agauugcgcugcuugagau

SEQ ID NO: 1012856 - RNA, 19 nt, Homo sapiens
ccuagugaacugucaauau

SEQ ID NO: 1012857 - RNA, 19 nt, Homo sapiens
ugacggcucggccuacauu

SEQ ID NO: 1012858 - RNA, 19 nt, Homo sapiens
cgaagcagccauccucaca

SEQ ID NO: 1012859 - RNA, 19 nt, Homo sapiens
gugcacacccucuuagauc

SEQ ID NO: 1012860 - RNA, 19 nt, Homo sapiens
gcagauggugggaccuaug

SEQ ID NO: 1012861 - RNA, 19 nt, Homo sapiens
ggauacccaugagagacuu

SEQ ID NO: 1012862 - RNA, 19 nt, Homo sapiens
ccacgcucccagauugaua

SEQ ID NO: 1012863 - RNA, 19 nt, Homo sapiens
aagcagccauccucacaca

SEQ ID NO: 1012864 - RNA, 19 nt, Homo sapiens
ggugggaccuaugcagcuu

SEQ ID NO: 1012865 - RNA, 19 nt, Homo sapiens
gcacacccucuuagaucga

SEQ ID NO: 1012866 - RNA, 19 nt, Homo sapiens
cagauugcgcugcuugaga

SEQ ID NO: 1012867 - RNA, 19 nt, Homo sapiens
ccgccagacuuucgaagca

SEQ ID NO: 1012868 - RNA, 19 nt, Homo sapiens
gagaugugcacacccucuu

SEQ ID NO: 1012869 - RNA, 19 nt, Homo sapiens
gaugugcacacccucuuag

SEQ ID NO: 1012870 - RNA, 19 nt, Homo sapiens
agugaacugucaauauagu

SEQ ID NO: 1012871 - RNA, 19 nt, Homo sapiens
acagggcccuagugaacug

SEQ ID NO: 1012872 - RNA, 19 nt, Homo sapiens
agugcuggaugccgggaua

SEQ ID NO: 1012873 - RNA, 19 nt, Homo sapiens
agaugugcacacccucuua

SEQ ID NO: 1012874 - RNA, 19 nt, Homo sapiens
ggcacuggcuguggucuac

SEQ ID NO: 1012875 - RNA, 19 nt, Homo sapiens
gaugauggcuuaugguaua

SEQ ID NO: 1012876 - RNA, 19 nt, Homo sapiens
gaugauagcugcuuaugaa

SEQ ID NO: 1012877 - RNA, 19 nt, Homo sapiens
gugcauaucuguaauguaa

SEQ ID NO: 1012878 - RNA, 19 nt, Homo sapiens
caaauuccuucucaucuua

SEQ ID NO: 1012879 - RNA, 19 nt, Homo sapiens
gagaaacaaugggaaauaa

SEQ ID NO: 1012880 - RNA, 19 nt, Homo sapiens
gaaauaagguuugaggaau

SEQ ID NO: 1012881 - RNA, 19 nt, Homo sapiens
gaagauuguugccauuaaa

SEQ ID NO: 1012882 - RNA, 19 nt, Homo sapiens
gaacagauagugacauuau

SEQ ID NO: 1012883 - RNA, 19 nt, Homo sapiens
caagaaaacugcugacaua

SEQ ID NO: 1012884 - RNA, 19 nt, Homo sapiens
cugcaaagcugacauuaaa

SEQ ID NO: 1012885 - RNA, 19 nt, Homo sapiens
ggagaagcaugugcaguaa

SEQ ID NO: 1012886 - RNA, 19 nt, Homo sapiens
gacauuauaugacgaugaa

SEQ ID NO: 1012887 - RNA, 19 nt, Homo sapiens
cauaaucagugaacagaaa

SEQ ID NO: 1012888 - RNA, 19 nt, Homo sapiens
ggaaauaagguuugaggaa

SEQ ID NO: 1012889 - RNA, 19 nt, Homo sapiens
gaaacagacacuccucuuu

SEQ ID NO: 1012890 - RNA, 19 nt, Homo sapiens
uaacagccauucauuaucu

SEQ ID NO: 1012891 - RNA, 19 nt, Homo sapiens
caacacaacauggccauua

SEQ ID NO: 1012892 - RNA, 19 nt, Homo sapiens
agaauaugaugauggcuua

SEQ ID NO: 1012893 - RNA, 19 nt, Homo sapiens
gaagagaaacaaugggaaa

SEQ ID NO: 1012894 - RNA, 19 nt, Homo sapiens
gcaguaagaggauccgaua

SEQ ID NO: 1012895 - RNA, 19 nt, Homo sapiens
acaggaagauucaguaguu

SEQ ID NO: 1012896 - RNA, 19 nt, Homo sapiens
cagaacagauagugacauu

SEQ ID NO: 1012897 - RNA, 19 nt, Homo sapiens
guagaggucuugcuguaug

SEQ ID NO: 1012898 - RNA, 19 nt, Homo sapiens
cgaagauuguugccauuaa

SEQ ID NO: 1012899 - RNA, 19 nt, Homo sapiens
guaccugacuggagcugua

SEQ ID NO: 1012900 - RNA, 19 nt, Homo sapiens
ccaaauuccuucucaucuu

SEQ ID NO: 1012901 - RNA, 19 nt, Homo sapiens
gaacguauuugaggcaaca

SEQ ID NO: 1012902 - RNA, 19 nt, Homo sapiens
gaauaagugccuaagugua

SEQ ID NO: 1012903 - RNA, 19 nt, Homo sapiens
guauccagcucgagccaua

SEQ ID NO: 1012904 - RNA, 19 nt, Homo sapiens
ggaauugccugugcauauc

SEQ ID NO: 1012905 - RNA, 19 nt, Homo sapiens
gauuauggaucaacugcaa

SEQ ID NO: 1012906 - RNA, 19 nt, Homo sapiens
gaaaacugcugacauaauc

SEQ ID NO: 1012907 - RNA, 19 nt, Homo sapiens
gugacugucuuucauugua

SEQ ID NO: 1012908 - RNA, 19 nt, Homo sapiens
gcaaccagacgcaauagaa

SEQ ID NO: 1012909 - RNA, 19 nt, Homo sapiens
gacuaugucuuaucuuuag

SEQ ID NO: 1012910 - RNA, 19 nt, Homo sapiens
cauaauaccacaccuguug

SEQ ID NO: 1012911 - RNA, 19 nt, Homo sapiens
gaugauggaacuauauuug

SEQ ID NO: 1012912 - RNA, 19 nt, Homo sapiens
ggaacaggaagauucagua

SEQ ID NO: 1012913 - RNA, 19 nt, Homo sapiens
gcaaagcugacauuaaaca

SEQ ID NO: 1012914 - RNA, 19 nt, Homo sapiens
gcaaggugauggagguugu

SEQ ID NO: 1012915 - RNA, 19 nt, Homo sapiens
ggacagcaacagcuuguga

SEQ ID NO: 1012916 - RNA, 19 nt, Homo sapiens
gaauguugacuguuuaaga

SEQ ID NO: 1012917 - RNA, 19 nt, Homo sapiens
gcagaggguuaauaagaag

SEQ ID NO: 1012918 - RNA, 19 nt, Homo sapiens
gauccgauacucuguggua

SEQ ID NO: 1012919 - RNA, 19 nt, Homo sapiens
agaagcaugugcaguaaga

SEQ ID NO: 1012920 - RNA, 19 nt, Homo sapiens
caggaagauucaguaguua

SEQ ID NO: 1012921 - RNA, 19 nt, Homo sapiens
uagugaauguugacuguuu

SEQ ID NO: 1012922 - RNA, 19 nt, Homo sapiens
ugauguggguguugaacua

SEQ ID NO: 1012923 - RNA, 19 nt, Homo sapiens
cagaucaucagaaugguua

SEQ ID NO: 1012924 - RNA, 19 nt, Homo sapiens
gcacugcagaggguuaaua

SEQ ID NO: 1012925 - RNA, 19 nt, Homo sapiens
gguauaagccaccagcuau

SEQ ID NO: 1012926 - RNA, 19 nt, Homo sapiens
cuguuaagauccaagauaa

SEQ ID NO: 1012927 - RNA, 19 nt, Homo sapiens
agagacagguggacauuca

SEQ ID NO: 1012928 - RNA, 19 nt, Homo sapiens
gaaccaagaaccacuagag

SEQ ID NO: 1012929 - RNA, 19 nt, Homo sapiens
gaacaggaagauucaguag

SEQ ID NO: 1012930 - RNA, 19 nt, Homo sapiens
gcuguuaagauccaagaua

SEQ ID NO: 1012931 - RNA, 19 nt, Homo sapiens
aaacaacucuaugcugugu

SEQ ID NO: 1012932 - RNA, 19 nt, Homo sapiens
ugccuugccuugcagaaua

SEQ ID NO: 1012933 - RNA, 19 nt, Homo sapiens
ggagcuguagcaacuauaa

SEQ ID NO: 1012934 - RNA, 19 nt, Homo sapiens
auagaagccuagaagaauu

SEQ ID NO: 1012935 - RNA, 19 nt, Homo sapiens
gcgaagauuguugccauua

SEQ ID NO: 1012936 - RNA, 19 nt, Homo sapiens
guguauauuugccuugauu

SEQ ID NO: 1012937 - RNA, 19 nt, Homo sapiens
gaaacaaugggaaauaagg

SEQ ID NO: 1012938 - RNA, 19 nt, Homo sapiens
cagguggacauucacauua

SEQ ID NO: 1012939 - RNA, 19 nt, Homo sapiens
gaggccagaucaucagaau

SEQ ID NO: 1012940 - RNA, 19 nt, Homo sapiens
cugagaagauuuauguuca

SEQ ID NO: 1012941 - RNA, 19 nt, Homo sapiens
agaaaugccuugccuugca

SEQ ID NO: 1012942 - RNA, 19 nt, Homo sapiens
gaagcacugcagaggguua

SEQ ID NO: 1012943 - RNA, 19 nt, Homo sapiens
ucuaugcuguucaaguuaa

SEQ ID NO: 1012944 - RNA, 19 nt, Homo sapiens
ccuaaacuaucagaauuug

SEQ ID NO: 1012945 - RNA, 19 nt, Homo sapiens
agauaacagccauucauua

SEQ ID NO: 1012946 - RNA, 19 nt, Homo sapiens
uauguucagugguuguuaa

SEQ ID NO: 1012947 - RNA, 19 nt, Homo sapiens
aaacuucuaaccagucuaa

SEQ ID NO: 1012948 - RNA, 19 nt, Homo sapiens
guaccuaaacuaucagaau

SEQ ID NO: 1012949 - RNA, 19 nt, Homo sapiens
caacugcaaagcugacauu

SEQ ID NO: 1012950 - RNA, 19 nt, Homo sapiens
cacguugucucaccuaaug

SEQ ID NO: 1012951 - RNA, 19 nt, Homo sapiens
acucuaugcuguucaaguu

SEQ ID NO: 1012952 - RNA, 19 nt, Homo sapiens
uucaacaacugcuuucaaa

SEQ ID NO: 1012953 - RNA, 19 nt, Homo sapiens
gagaagauuuauguucagu

SEQ ID NO: 1012954 - RNA, 19 nt, Homo sapiens
caccauauuugucuucauc

SEQ ID NO: 1012955 - RNA, 19 nt, Homo sapiens
agauuuauguucagugguu

SEQ ID NO: 1012956 - RNA, 19 nt, Homo sapiens
gagagcguguugauguuuc

SEQ ID NO: 1012957 - RNA, 19 nt, Homo sapiens
ugguagaggucuugcugua

SEQ ID NO: 1012958 - RNA, 19 nt, Homo sapiens
gaacuguuaggaauugugu

SEQ ID NO: 1012959 - RNA, 19 nt, Homo sapiens
ugcagaggguuaauaagaa

SEQ ID NO: 1012960 - RNA, 19 nt, Homo sapiens
agagaaacaaugggaaaua

SEQ ID NO: 1012961 - RNA, 19 nt, Homo sapiens
ggagagcguguugauguuu

SEQ ID NO: 1012962 - RNA, 19 nt, Homo sapiens
cgaagaggccagaucauca

SEQ ID NO: 1012963 - RNA, 19 nt, Homo sapiens
cuaaguguauacagugaga

SEQ ID NO: 1012964 - RNA, 19 nt, Homo sapiens
aauaagugccuaaguguau

SEQ ID NO: 1012965 - RNA, 19 nt, Homo sapiens
gaaauggggcuugcagaua

SEQ ID NO: 1012966 - RNA, 19 nt, Homo sapiens
cauaugccguugguagaaa

SEQ ID NO: 1012967 - RNA, 19 nt, Homo sapiens
ggagacaagaauaccauau

SEQ ID NO: 1012968 - RNA, 19 nt, Homo sapiens
ggaauugcuuucggcugaa

SEQ ID NO: 1012969 - RNA, 19 nt, Homo sapiens
ggguuuggcuuugagagaa

SEQ ID NO: 1012970 - RNA, 19 nt, Homo sapiens
uauagaagccuagaagaau

SEQ ID NO: 1012971 - RNA, 19 nt, Homo sapiens
guaagaggauccgauacuc

SEQ ID NO: 1012972 - RNA, 19 nt, Homo sapiens
gaaccacuagaggguauaa

SEQ ID NO: 1012973 - RNA, 19 nt, Homo sapiens
ucuuacagguggauaguga

SEQ ID NO: 1012974 - RNA, 19 nt, Homo sapiens
gacuggagcuguagcaacu

SEQ ID NO: 1012975 - RNA, 19 nt, Homo sapiens
uguaagagcuguuguuaua

SEQ ID NO: 1012976 - RNA, 19 nt, Homo sapiens
gcauaaacuucgacaaaua

SEQ ID NO: 1012977 - RNA, 19 nt, Homo sapiens
gaacagcgccaaacccuua

SEQ ID NO: 1012978 - RNA, 19 nt, Homo sapiens
gaaauugccuuuaguacau

SEQ ID NO: 1012979 - RNA, 19 nt, Homo sapiens
gaaccagaguguauuauug

SEQ ID NO: 1012980 - RNA, 19 nt, Homo sapiens
gaacuauggucuuuguuga

SEQ ID NO: 1012981 - RNA, 19 nt, Homo sapiens
gauaauacauccacaaugg

SEQ ID NO: 1012982 - RNA, 19 nt, Homo sapiens
gaaaucaacccucauaugu

SEQ ID NO: 1012983 - RNA, 19 nt, Homo sapiens
gaagaaauugccuuuagua

SEQ ID NO: 1012984 - RNA, 19 nt, Homo sapiens
gcagaaaucaacccucaua

SEQ ID NO: 1012985 - RNA, 19 nt, Homo sapiens
ugaagaagcuaaucucugu

SEQ ID NO: 1012986 - RNA, 19 nt, Homo sapiens
gagaaaagcucguugaaau

SEQ ID NO: 1012987 - RNA, 19 nt, Homo sapiens
ugaaucggauaaccauuua

SEQ ID NO: 1012988 - RNA, 19 nt, Homo sapiens
ugaacgaggugguuacaaa

SEQ ID NO: 1012989 - RNA, 19 nt, Homo sapiens
ggaaauaauucagaagcuu

SEQ ID NO: 1012990 - RNA, 19 nt, Homo sapiens
uaacaggacuccagcuuca

SEQ ID NO: 1012991 - RNA, 19 nt, Homo sapiens
ggaagaaauugccuuuagu

SEQ ID NO: 1012992 - RNA, 19 nt, Homo sapiens
uaugaugcaugauggaaua

SEQ ID NO: 1012993 - RNA, 19 nt, Homo sapiens
ggagagagucuaguaauga

SEQ ID NO: 1012994 - RNA, 19 nt, Homo sapiens
gcagaccguucuccaaguu

SEQ ID NO: 1012995 - RNA, 19 nt, Homo sapiens
ucgaagagaucauuucaug

SEQ ID NO: 1012996 - RNA, 19 nt, Homo sapiens
gguguuaacugggaauauu

SEQ ID NO: 1012997 - RNA, 19 nt, Homo sapiens
gaaauucugcgaaacauag

SEQ ID NO: 1012998 - RNA, 19 nt, Homo sapiens
ucucauagcuccuguccuu

SEQ ID NO: 1012999 - RNA, 19 nt, Homo sapiens
gaucuuccuucuaccauug

SEQ ID NO: 1013000 - RNA, 19 nt, Homo sapiens
cagaggaaauucaaagguu

SEQ ID NO: 1013001 - RNA, 19 nt, Homo sapiens
guccagaaaugaagaaguu

SEQ ID NO: 1013002 - RNA, 19 nt, Homo sapiens
caccagcaauucugacuuu

SEQ ID NO: 1013003 - RNA, 19 nt, Homo sapiens
ggucuaggaaguccaaaua

SEQ ID NO: 1013004 - RNA, 19 nt, Homo sapiens
gaagugaacgaggugguua

SEQ ID NO: 1013005 - RNA, 19 nt, Homo sapiens
ggaaagugcccaguucuug

SEQ ID NO: 1013006 - RNA, 19 nt, Homo sapiens
aagguuggcugcagaguuu

SEQ ID NO: 1013007 - RNA, 19 nt, Homo sapiens
guaauaagcgagauaauac

SEQ ID NO: 1013008 - RNA, 19 nt, Homo sapiens
caagagcacuuugaacaca

SEQ ID NO: 1013009 - RNA, 19 nt, Homo sapiens
gcugaucgcauguuggaua

SEQ ID NO: 1013010 - RNA, 19 nt, Homo sapiens
gcagaaggaggagaaagua

SEQ ID NO: 1013011 - RNA, 19 nt, Homo sapiens
ggugauagcucugguuucu

SEQ ID NO: 1013012 - RNA, 19 nt, Homo sapiens
gcccaggaaugccaucaaa

SEQ ID NO: 1013013 - RNA, 19 nt, Homo sapiens
caaccagauuuauuuggaa

SEQ ID NO: 1013014 - RNA, 19 nt, Homo sapiens
ggaggagaaaguagugaua

SEQ ID NO: 1013015 - RNA, 19 nt, Homo sapiens
ggaaccagaguguauuauu

SEQ ID NO: 1013016 - RNA, 19 nt, Homo sapiens
guaaugacugcgaagauaa

SEQ ID NO: 1013017 - RNA, 19 nt, Homo sapiens
aaacauccuucaagucugu

SEQ ID NO: 1013018 - RNA, 19 nt, Homo sapiens
gaauauguucaucgaauug

SEQ ID NO: 1013019 - RNA, 19 nt, Homo sapiens
cuucuaccauugaugaaua

SEQ ID NO: 1013020 - RNA, 19 nt, Homo sapiens
gaagucagaagcagaagga

SEQ ID NO: 1013021 - RNA, 19 nt, Homo sapiens
aguaaugacugcgaagaua

SEQ ID NO: 1013022 - RNA, 19 nt, Homo sapiens
ggacauucaauucgacaaa

SEQ ID NO: 1013023 - RNA, 19 nt, Homo sapiens
gagcuguuguuauauaugg

SEQ ID NO: 1013024 - RNA, 19 nt, Homo sapiens
ggcauaaacuucgacaaau

SEQ ID NO: 1013025 - RNA, 19 nt, Homo sapiens
gaugauggaccuucucgaa

SEQ ID NO: 1013026 - RNA, 19 nt, Homo sapiens
uggaagaaauugccuuuag

SEQ ID NO: 1013027 - RNA, 19 nt, Homo sapiens
uagcacagccucuaguaaa

SEQ ID NO: 1013028 - RNA, 19 nt, Homo sapiens
gaaagugcccaguucuugu

SEQ ID NO: 1013029 - RNA, 19 nt, Homo sapiens
ucaaccagauuuauuugga

SEQ ID NO: 1013030 - RNA, 19 nt, Homo sapiens
gaacacagcuggguuuucu

SEQ ID NO: 1013031 - RNA, 19 nt, Homo sapiens
gauaucauaggcaaagaaa

SEQ ID NO: 1013032 - RNA, 19 nt, Homo sapiens
ugacuuagacccagacgaa

SEQ ID NO: 1013033 - RNA, 19 nt, Homo sapiens
gacagaugcucaacaggau

SEQ ID NO: 1013034 - RNA, 19 nt, Homo sapiens
cuaaagcugguuauacuaa

SEQ ID NO: 1013035 - RNA, 19 nt, Homo sapiens
ggugauacuucucaaagca

SEQ ID NO: 1013036 - RNA, 19 nt, Homo sapiens
gagaugcuggugaguguaa

SEQ ID NO: 1013037 - RNA, 19 nt, Homo sapiens
cagagaugcuggugagugu

SEQ ID NO: 1013038 - RNA, 19 nt, Homo sapiens
cuacacuacugauacaaau

SEQ ID NO: 1013039 - RNA, 19 nt, Homo sapiens
ccaauccaguagaugauga

SEQ ID NO: 1013040 - RNA, 19 nt, Homo sapiens
guaaaaguauugacagaug

SEQ ID NO: 1013041 - RNA, 19 nt, Homo sapiens
caugggagaugaagauugg

SEQ ID NO: 1013042 - RNA, 19 nt, Homo sapiens
caaacagggucugggaaga

SEQ ID NO: 1013043 - RNA, 19 nt, Homo sapiens
guaauaacaggcucuggaa

SEQ ID NO: 1013044 - RNA, 19 nt, Homo sapiens
gagauaauacauccacaau

SEQ ID NO: 1013045 - RNA, 19 nt, Homo sapiens
aaucaacccucauaugucu

SEQ ID NO: 1013046 - RNA, 19 nt, Homo sapiens
acaaguggguggagcaugu

SEQ ID NO: 1013047 - RNA, 19 nt, Homo sapiens
uaacaacauugcuaaagcu

SEQ ID NO: 1013048 - RNA, 19 nt, Homo sapiens
gacacugaauaacaacauu

SEQ ID NO: 1013049 - RNA, 19 nt, Homo sapiens
cauagcuccuguccuugua

SEQ ID NO: 1013050 - RNA, 19 nt, Homo sapiens
ggcaagagcacuuugaaca

SEQ ID NO: 1013051 - RNA, 19 nt, Homo sapiens
uagaagaccaguauuaagu

SEQ ID NO: 1013052 - RNA, 19 nt, Homo sapiens
ucuaggaaguccaaauaau

SEQ ID NO: 1013053 - RNA, 19 nt, Homo sapiens
agagguaguuuccgagguu

SEQ ID NO: 1013054 - RNA, 19 nt, Homo sapiens
caagagaggcggcuaucga

SEQ ID NO: 1013055 - RNA, 19 nt, Homo sapiens
ccagaaaugaagaaguuaa

SEQ ID NO: 1013056 - RNA, 19 nt, Homo sapiens
gaucgcauguuggauaugg

SEQ ID NO: 1013057 - RNA, 19 nt, Homo sapiens
cuggaagacugauggauau

SEQ ID NO: 1013058 - RNA, 19 nt, Homo sapiens
uaggaaguccaaauaauga

SEQ ID NO: 1013059 - RNA, 19 nt, Homo sapiens
ugaagcugaucgcauguug

SEQ ID NO: 1013060 - RNA, 19 nt, Homo sapiens
gaaggaggagaaaguagug

SEQ ID NO: 1013061 - RNA, 19 nt, Homo sapiens
gagauggaaauaauucaga

SEQ ID NO: 1013062 - RNA, 19 nt, Homo sapiens
uccaguagaugaugaguca

SEQ ID NO: 1013063 - RNA, 19 nt, Homo sapiens
gacuccagcuucaucauca

SEQ ID NO: 1013064 - RNA, 19 nt, Homo sapiens
gguggagcauguagagaug

SEQ ID NO: 1013065 - RNA, 19 nt, Homo sapiens
gcgccaaacccuuauguuc

SEQ ID NO: 1013066 - RNA, 19 nt, Homo sapiens
gacauucaauucgacaaau

SEQ ID NO: 1013067 - RNA, 19 nt, Homo sapiens
gcugggacauucaauucga

SEQ ID NO: 1013068 - RNA, 19 nt, Homo sapiens
caggaaccagaguguauua

SEQ ID NO: 1013069 - RNA, 19 nt, Homo sapiens
gaacgaggugguuacaaag

SEQ ID NO: 1013070 - RNA, 19 nt, Homo sapiens
uggcagagcaauuuccuuu

SEQ ID NO: 1013071 - RNA, 19 nt, Homo sapiens
ccuggaagacugauggaua

SEQ ID NO: 1013072 - RNA, 19 nt, Homo sapiens
gcaggaaccagaguguauu

SEQ ID NO: 1013073 - RNA, 19 nt, Homo sapiens
gcuaaagcugguuauacua

SEQ ID NO: 1013074 - RNA, 19 nt, Homo sapiens
gagagagucuaguaaugac

SEQ ID NO: 1013075 - RNA, 19 nt, Homo sapiens
uguaagagcuguuguuaua

SEQ ID NO: 1013076 - RNA, 19 nt, Homo sapiens
gcauaaacuucgacaaaua

SEQ ID NO: 1013077 - RNA, 19 nt, Homo sapiens
gaacagcgccaaacccuua

SEQ ID NO: 1013078 - RNA, 19 nt, Homo sapiens
gaaauugccuuuaguacau

SEQ ID NO: 1013079 - RNA, 19 nt, Homo sapiens
gaaccagaguguauuauug

SEQ ID NO: 1013080 - RNA, 19 nt, Homo sapiens
gaacuauggucuuuguuga

SEQ ID NO: 1013081 - RNA, 19 nt, Homo sapiens
gauaauacauccacaaugg

SEQ ID NO: 1013082 - RNA, 19 nt, Homo sapiens
gaaaucaacccucauaugu

SEQ ID NO: 1013083 - RNA, 19 nt, Homo sapiens
gaagaaauugccuuuagua

SEQ ID NO: 1013084 - RNA, 19 nt, Homo sapiens
gcagaaaucaacccucaua

SEQ ID NO: 1013085 - RNA, 19 nt, Homo sapiens
ugaagaagcuaaucucugu

SEQ ID NO: 1013086 - RNA, 19 nt, Homo sapiens
gagaaaagcucguugaaau

SEQ ID NO: 1013087 - RNA, 19 nt, Homo sapiens
ugaaucggauaaccauuua

SEQ ID NO: 1013088 - RNA, 19 nt, Homo sapiens
ugaacgaggugguuacaaa

SEQ ID NO: 1013089 - RNA, 19 nt, Homo sapiens
ggaaauaauucagaagcuu

SEQ ID NO: 1013090 - RNA, 19 nt, Homo sapiens
uaacaggacuccagcuuca

SEQ ID NO: 1013091 - RNA, 19 nt, Homo sapiens
ggaagaaauugccuuuagu

SEQ ID NO: 1013092 - RNA, 19 nt, Homo sapiens
uaugaugcaugauggaaua

SEQ ID NO: 1013093 - RNA, 19 nt, Homo sapiens
ggagagagucuaguaauga

SEQ ID NO: 1013094 - RNA, 19 nt, Homo sapiens
gcagaccguucuccaaguu

SEQ ID NO: 1013095 - RNA, 19 nt, Homo sapiens
ucgaagagaucauuucaug

SEQ ID NO: 1013096 - RNA, 19 nt, Homo sapiens
gguguuaacugggaauauu

SEQ ID NO: 1013097 - RNA, 19 nt, Homo sapiens
gaaauucugcgaaacauag

SEQ ID NO: 1013098 - RNA, 19 nt, Homo sapiens
ucucauagcuccuguccuu

SEQ ID NO: 1013099 - RNA, 19 nt, Homo sapiens
gaucuuccuucuaccauug

SEQ ID NO: 1013100 - RNA, 19 nt, Homo sapiens
cagaggaaauucaaagguu

SEQ ID NO: 1013101 - RNA, 19 nt, Homo sapiens
guccagaaaugaagaaguu

SEQ ID NO: 1013102 - RNA, 19 nt, Homo sapiens
caccagcaauucugacuuu

SEQ ID NO: 1013103 - RNA, 19 nt, Homo sapiens
ggucuaggaaguccaaaua

SEQ ID NO: 1013104 - RNA, 19 nt, Homo sapiens
gaagugaacgaggugguua

SEQ ID NO: 1013105 - RNA, 19 nt, Homo sapiens
ggaaagugcccaguucuug

SEQ ID NO: 1013106 - RNA, 19 nt, Homo sapiens
aagguuggcugcagaguuu

SEQ ID NO: 1013107 - RNA, 19 nt, Homo sapiens
guaauaagcgagauaauac

SEQ ID NO: 1013108 - RNA, 19 nt, Homo sapiens
caagagcacuuugaacaca

SEQ ID NO: 1013109 - RNA, 19 nt, Homo sapiens
gcugaucgcauguuggaua

SEQ ID NO: 1013110 - RNA, 19 nt, Homo sapiens
gcagaaggaggagaaagua

SEQ ID NO: 1013111 - RNA, 19 nt, Homo sapiens
ggugauagcucugguuucu

SEQ ID NO: 1013112 - RNA, 19 nt, Homo sapiens
aauccuuacugacuaguua

SEQ ID NO: 1013113 - RNA, 19 nt, Homo sapiens
gcccaggaaugccaucaaa

SEQ ID NO: 1013114 - RNA, 19 nt, Homo sapiens
caaccagauuuauuuggaa

SEQ ID NO: 1013115 - RNA, 19 nt, Homo sapiens
ggaggagaaaguagugaua

SEQ ID NO: 1013116 - RNA, 19 nt, Homo sapiens
ggaaccagaguguauuauu

SEQ ID NO: 1013117 - RNA, 19 nt, Homo sapiens
guaaugacugcgaagauaa

SEQ ID NO: 1013118 - RNA, 19 nt, Homo sapiens
aaacauccuucaagucugu

SEQ ID NO: 1013119 - RNA, 19 nt, Homo sapiens
gaauauguucaucgaauug

SEQ ID NO: 1013120 - RNA, 19 nt, Homo sapiens
cuucuaccauugaugaaua

SEQ ID NO: 1013121 - RNA, 19 nt, Homo sapiens
gaagucagaagcagaagga

SEQ ID NO: 1013122 - RNA, 19 nt, Homo sapiens
aguaaugacugcgaagaua

SEQ ID NO: 1013123 - RNA, 19 nt, Homo sapiens
ggacauucaauucgacaaa

SEQ ID NO: 1013124 - RNA, 19 nt, Homo sapiens
gagcuguuguuauauaugg

SEQ ID NO: 1013125 - RNA, 19 nt, Homo sapiens
ggcauaaacuucgacaaau

SEQ ID NO: 1013126 - RNA, 19 nt, Homo sapiens
gaugauggaccuucucgaa

SEQ ID NO: 1013127 - RNA, 19 nt, Homo sapiens
uggaagaaauugccuuuag

SEQ ID NO: 1013128 - RNA, 19 nt, Homo sapiens
uagcacagccucuaguaaa

SEQ ID NO: 1013129 - RNA, 19 nt, Homo sapiens
gaaagugcccaguucuugu

SEQ ID NO: 1013130 - RNA, 19 nt, Homo sapiens
ucaaccagauuuauuugga

SEQ ID NO: 1013131 - RNA, 19 nt, Homo sapiens
gaacacagcuggguuuucu

SEQ ID NO: 1013132 - RNA, 19 nt, Homo sapiens
gauaucauaggcaaagaaa

SEQ ID NO: 1013133 - RNA, 19 nt, Homo sapiens
ugacuuagacccagacgaa

SEQ ID NO: 1013134 - RNA, 19 nt, Homo sapiens
gacagaugcucaacaggau

SEQ ID NO: 1013135 - RNA, 19 nt, Homo sapiens
cuaaagcugguuauacuaa

SEQ ID NO: 1013136 - RNA, 19 nt, Homo sapiens
ggugauacuucucaaagca

SEQ ID NO: 1013137 - RNA, 19 nt, Homo sapiens
gagaugcuggugaguguaa

SEQ ID NO: 1013138 - RNA, 19 nt, Homo sapiens
cagagaugcuggugagugu

SEQ ID NO: 1013139 - RNA, 19 nt, Homo sapiens
ccaauccaguagaugauga

SEQ ID NO: 1013140 - RNA, 19 nt, Homo sapiens
guaaaaguauugacagaug

SEQ ID NO: 1013141 - RNA, 19 nt, Homo sapiens
caugggagaugaagauugg

SEQ ID NO: 1013142 - RNA, 19 nt, Homo sapiens
caaacagggucugggaaga

SEQ ID NO: 1013143 - RNA, 19 nt, Homo sapiens
guaauaacaggcucuggaa

SEQ ID NO: 1013144 - RNA, 19 nt, Homo sapiens
gagauaauacauccacaau

SEQ ID NO: 1013145 - RNA, 19 nt, Homo sapiens
aaucaacccucauaugucu

SEQ ID NO: 1013146 - RNA, 19 nt, Homo sapiens
acaaguggguggagcaugu

SEQ ID NO: 1013147 - RNA, 19 nt, Homo sapiens
uaacaacauugcuaaagcu

SEQ ID NO: 1013148 - RNA, 19 nt, Homo sapiens
gacacugaauaacaacauu

SEQ ID NO: 1013149 - RNA, 19 nt, Homo sapiens
cauagcuccuguccuugua

SEQ ID NO: 1013150 - RNA, 19 nt, Homo sapiens
ggcaagagcacuuugaaca

SEQ ID NO: 1013151 - RNA, 19 nt, Homo sapiens
uagaagaccaguauuaagu

SEQ ID NO: 1013152 - RNA, 19 nt, Homo sapiens
ucuaggaaguccaaauaau

SEQ ID NO: 1013153 - RNA, 19 nt, Homo sapiens
agagguaguuuccgagguu

SEQ ID NO: 1013154 - RNA, 19 nt, Homo sapiens
caagagaggcggcuaucga

SEQ ID NO: 1013155 - RNA, 19 nt, Homo sapiens
ccagaaaugaagaaguuaa

SEQ ID NO: 1013156 - RNA, 19 nt, Homo sapiens
gaucgcauguuggauaugg

SEQ ID NO: 1013157 - RNA, 19 nt, Homo sapiens
cuggaagacugauggauau

SEQ ID NO: 1013158 - RNA, 19 nt, Homo sapiens
uaggaaguccaaauaauga

SEQ ID NO: 1013159 - RNA, 19 nt, Homo sapiens
cuaguuaugugagaugcua

SEQ ID NO: 1013160 - RNA, 19 nt, Homo sapiens
ugaagcugaucgcauguug

SEQ ID NO: 1013161 - RNA, 19 nt, Homo sapiens
gaaggaggagaaaguagug

SEQ ID NO: 1013162 - RNA, 19 nt, Homo sapiens
gagauggaaauaauucaga

SEQ ID NO: 1013163 - RNA, 19 nt, Homo sapiens
uccaguagaugaugaguca

SEQ ID NO: 1013164 - RNA, 19 nt, Homo sapiens
gacuccagcuucaucauca

SEQ ID NO: 1013165 - RNA, 19 nt, Homo sapiens
gguggagcauguagagaug

SEQ ID NO: 1013166 - RNA, 19 nt, Homo sapiens
gcgccaaacccuuauguuc

SEQ ID NO: 1013167 - RNA, 19 nt, Homo sapiens
gacauucaauucgacaaau

SEQ ID NO: 1013168 - RNA, 19 nt, Homo sapiens
gcugggacauucaauucga

SEQ ID NO: 1013169 - RNA, 19 nt, Homo sapiens
caggaaccagaguguauua

SEQ ID NO: 1013170 - RNA, 19 nt, Homo sapiens
gaacgaggugguuacaaag

SEQ ID NO: 1013171 - RNA, 19 nt, Homo sapiens
uggcagagcaauuuccuuu

SEQ ID NO: 1013172 - RNA, 19 nt, Homo sapiens
ccuggaagacugauggaua

SEQ ID NO: 1013173 - RNA, 19 nt, Homo sapiens
gcaggaaccagaguguauu

SEQ ID NO: 1013174 - RNA, 19 nt, Homo sapiens
gcuaaagcugguuauacua

SEQ ID NO: 1013175 - RNA, 19 nt, Homo sapiens
ggucacagaucacagaaua

SEQ ID NO: 1013176 - RNA, 19 nt, Homo sapiens
cagcuugacuuaacaauuu

SEQ ID NO: 1013177 - RNA, 19 nt, Homo sapiens
uaacucagcugaagcauca

SEQ ID NO: 1013178 - RNA, 19 nt, Homo sapiens
gaucaggucuuacaagcaa

SEQ ID NO: 1013179 - RNA, 19 nt, Homo sapiens
uaaggaaacuugcagagaa

SEQ ID NO: 1013180 - RNA, 19 nt, Homo sapiens
acacagaucucucucaaug

SEQ ID NO: 1013181 - RNA, 19 nt, Homo sapiens
caccaugacuguagcaaua

SEQ ID NO: 1013182 - RNA, 19 nt, Homo sapiens
caacacagcagucuccuaa

SEQ ID NO: 1013183 - RNA, 19 nt, Homo sapiens
guacaaagagugccaaaga

SEQ ID NO: 1013184 - RNA, 19 nt, Homo sapiens
cgaugagaaugaagauuua

SEQ ID NO: 1013185 - RNA, 19 nt, Homo sapiens
agaguucacugauugauuu

SEQ ID NO: 1013186 - RNA, 19 nt, Homo sapiens
aaagagguaugauuccuaa

SEQ ID NO: 1013187 - RNA, 19 nt, Homo sapiens
agaaacaccuagaauaaug

SEQ ID NO: 1013188 - RNA, 19 nt, Homo sapiens
cgaaagauuugagaauuga

SEQ ID NO: 1013189 - RNA, 19 nt, Homo sapiens
uugaaacccuggaauauuu

SEQ ID NO: 1013190 - RNA, 19 nt, Homo sapiens
gacaggaacucucaguaga

SEQ ID NO: 1013191 - RNA, 19 nt, Homo sapiens
gaaagaauacccuugaaag

SEQ ID NO: 1013192 - RNA, 19 nt, Homo sapiens
acacagcagucuccuaauu

SEQ ID NO: 1013193 - RNA, 19 nt, Homo sapiens
gcaucuagaagaagaaaua

SEQ ID NO: 1013194 - RNA, 19 nt, Homo sapiens
ggaaagaauacccuugaaa

SEQ ID NO: 1013195 - RNA, 19 nt, Homo sapiens
ggacgcuaccuuacaauaa

SEQ ID NO: 1013196 - RNA, 19 nt, Homo sapiens
cgauuuacauugugguuaa

SEQ ID NO: 1013197 - RNA, 19 nt, Homo sapiens
ugcaugaucuugaaacuuu

SEQ ID NO: 1013198 - RNA, 19 nt, Homo sapiens
cagcaugcaucuagaagaa

SEQ ID NO: 1013199 - RNA, 19 nt, Homo sapiens
acagaaacaccuagaauaa

SEQ ID NO: 1013200 - RNA, 19 nt, Homo sapiens
gaacuuguacagucauuga

SEQ ID NO: 1013201 - RNA, 19 nt, Homo sapiens
gcagucuccuaauuaauga

SEQ ID NO: 1013202 - RNA, 19 nt, Homo sapiens
ucaagauucuccagacaaa

SEQ ID NO: 1013203 - RNA, 19 nt, Homo sapiens
gcugguggaucaggucuua

SEQ ID NO: 1013204 - RNA, 19 nt, Homo sapiens
gaaagagguaugauuccua

SEQ ID NO: 1013205 - RNA, 19 nt, Homo sapiens
uaacacaguuggagguaau

SEQ ID NO: 1013206 - RNA, 19 nt, Homo sapiens
gaucacagaauaaacaaga

SEQ ID NO: 1013207 - RNA, 19 nt, Homo sapiens
ucaaacugcugaacgagaa

SEQ ID NO: 1013208 - RNA, 19 nt, Homo sapiens
gagcuaugauguccuagga

SEQ ID NO: 1013209 - RNA, 19 nt, Homo sapiens
gaaaccauaccauuaacuu

SEQ ID NO: 1013210 - RNA, 19 nt, Homo sapiens
acagaaaccauaccauuaa

SEQ ID NO: 1013211 - RNA, 19 nt, Homo sapiens
uaaacaagacgcugcauga

SEQ ID NO: 1013212 - RNA, 19 nt, Homo sapiens
gcaugcaucuagaagaaga

SEQ ID NO: 1013213 - RNA, 19 nt, Homo sapiens
gcacaugaaauuugaagga

SEQ ID NO: 1013214 - RNA, 19 nt, Homo sapiens
ugaacuagguggccuuaga

SEQ ID NO: 1013215 - RNA, 19 nt, Homo sapiens
ggauuggcuuguguuguua

SEQ ID NO: 1013216 - RNA, 19 nt, Homo sapiens
uauagacuuucguagcuua

SEQ ID NO: 1013217 - RNA, 19 nt, Homo sapiens
ggaugaacuuguacaguca

SEQ ID NO: 1013218 - RNA, 19 nt, Homo sapiens
ccgaaagauuugagaauug

SEQ ID NO: 1013219 - RNA, 19 nt, Homo sapiens
ccuauaaacccaucauaaa

SEQ ID NO: 1013220 - RNA, 19 nt, Homo sapiens
acagcagucuccuaauuaa

SEQ ID NO: 1013221 - RNA, 19 nt, Homo sapiens
gaagauuuaaggaaacuug

SEQ ID NO: 1013222 - RNA, 19 nt, Homo sapiens
uaaaggaagaucagagaaa

SEQ ID NO: 1013223 - RNA, 19 nt, Homo sapiens
agaaugaaaucacuuugug

SEQ ID NO: 1013224 - RNA, 19 nt, Homo sapiens
ggacaggaacucucaguag

SEQ ID NO: 1013225 - RNA, 19 nt, Homo sapiens
uacagaaaccauaccauua

SEQ ID NO: 1013226 - RNA, 19 nt, Homo sapiens
uuaaugacagcuugacuua

SEQ ID NO: 1013227 - RNA, 19 nt, Homo sapiens
agaaauaacucagcugaag

SEQ ID NO: 1013228 - RNA, 19 nt, Homo sapiens
gcauauaacguuagcaaca

SEQ ID NO: 1013229 - RNA, 19 nt, Homo sapiens
ccaauaaacccaucauaag

SEQ ID NO: 1013230 - RNA, 19 nt, Homo sapiens
cacagaaacaccuagaaua

SEQ ID NO: 1013231 - RNA, 19 nt, Homo sapiens
ugaaagagagcuaugaugu

SEQ ID NO: 1013232 - RNA, 19 nt, Homo sapiens
guacagucauugaaggaau

SEQ ID NO: 1013233 - RNA, 19 nt, Homo sapiens
caauaaacccaucauaagu

SEQ ID NO: 1013234 - RNA, 19 nt, Homo sapiens
gguccucgauuuacauugu

SEQ ID NO: 1013235 - RNA, 19 nt, Homo sapiens
acaagacgcugcaugaucu

SEQ ID NO: 1013236 - RNA, 19 nt, Homo sapiens
ucacagaucacagaauaaa

SEQ ID NO: 1013237 - RNA, 19 nt, Homo sapiens
gauuugauccuggaaguaa

SEQ ID NO: 1013238 - RNA, 19 nt, Homo sapiens
agagagcuaugauguccua

SEQ ID NO: 1013239 - RNA, 19 nt, Homo sapiens
cacagcagucuccuaauua

SEQ ID NO: 1013240 - RNA, 19 nt, Homo sapiens
gugguuaauucccaauaaa

SEQ ID NO: 1013241 - RNA, 19 nt, Homo sapiens
acagaugguccucgauuua

SEQ ID NO: 1013242 - RNA, 19 nt, Homo sapiens
ugaaaucacuuugugucaa

SEQ ID NO: 1013243 - RNA, 19 nt, Homo sapiens
gauuggaaguaaaggaaga

SEQ ID NO: 1013244 - RNA, 19 nt, Homo sapiens
ugacaaaguuacgugcaaa

SEQ ID NO: 1013245 - RNA, 19 nt, Homo sapiens
cagacaaacuuccuuaaaa

SEQ ID NO: 1013246 - RNA, 19 nt, Homo sapiens
ccagacaaacuuccuuaaa

SEQ ID NO: 1013247 - RNA, 19 nt, Homo sapiens
gcuacagccuacucaguga

SEQ ID NO: 1013248 - RNA, 19 nt, Homo sapiens
gaaagagagcuaugauguc

SEQ ID NO: 1013249 - RNA, 19 nt, Homo sapiens
auaaagagcuggcuaugac

SEQ ID NO: 1013250 - RNA, 19 nt, Homo sapiens
ggaggauucucuuguucug

SEQ ID NO: 1013251 - RNA, 19 nt, Homo sapiens
uuacacagaucucucucaa

SEQ ID NO: 1013252 - RNA, 19 nt, Homo sapiens
aaagacagaaugcuagaaa

SEQ ID NO: 1013253 - RNA, 19 nt, Homo sapiens
ccuauaggcacaugaaauu

SEQ ID NO: 1013254 - RNA, 19 nt, Homo sapiens
aggauuggcuuguguuguu

SEQ ID NO: 1013255 - RNA, 19 nt, Homo sapiens
uacaauaacuagacaaagg

SEQ ID NO: 1013256 - RNA, 19 nt, Homo sapiens
cccaauaaacccaucauaa

SEQ ID NO: 1013257 - RNA, 19 nt, Homo sapiens
gauaguucaucuuccaaca

SEQ ID NO: 1013258 - RNA, 19 nt, Homo sapiens
gaaauuugaaggagguguu

SEQ ID NO: 1013259 - RNA, 19 nt, Homo sapiens
gagcaaaaguuaaaucucu

SEQ ID NO: 1013260 - RNA, 19 nt, Homo sapiens
ggaacucucaguagauguu

SEQ ID NO: 1013261 - RNA, 19 nt, Homo sapiens
guccuguucuguguaaaua

SEQ ID NO: 1013262 - RNA, 19 nt, Homo sapiens
gugaccaucuguaaucaug

SEQ ID NO: 1013263 - RNA, 19 nt, Homo sapiens
ugcauauucugaagucaua

SEQ ID NO: 1013264 - RNA, 19 nt, Homo sapiens
ccacauagggugaaaguac

SEQ ID NO: 1013265 - RNA, 19 nt, Homo sapiens
uacagucauugaaggaaua

SEQ ID NO: 1013266 - RNA, 19 nt, Homo sapiens
ucuacuggaugaacuugua

SEQ ID NO: 1013267 - RNA, 19 nt, Homo sapiens
gagaaugaaaucacuuugu

SEQ ID NO: 1013268 - RNA, 19 nt, Homo sapiens
guuggaggauucucuuguu

SEQ ID NO: 1013269 - RNA, 19 nt, Homo sapiens
ggaaacuugcagagaauga

SEQ ID NO: 1013270 - RNA, 19 nt, Homo sapiens
gaaaaucagagcaaaaguu

SEQ ID NO: 1013271 - RNA, 19 nt, Homo sapiens
gaaacaccuagaauaaugu

SEQ ID NO: 1013272 - RNA, 19 nt, Homo sapiens
gaucaagcccacuaacauc

SEQ ID NO: 1013273 - RNA, 19 nt, Homo sapiens
ccuguucuguguaaauauu

SEQ ID NO: 1013274 - RNA, 19 nt, Homo sapiens
aaucuuggacgcuaccuua

SEQ ID NO: 1013275 - RNA, 19 nt, Homo sapiens
ggacagaagucauggauuu

SEQ ID NO: 1013276 - RNA, 19 nt, Homo sapiens
gaaaagggcuacuugguua

SEQ ID NO: 1013277 - RNA, 19 nt, Homo sapiens
ggaaaccacuucacuguug

SEQ ID NO: 1013278 - RNA, 19 nt, Homo sapiens
gaauauagucucugcauuu

SEQ ID NO: 1013279 - RNA, 19 nt, Homo sapiens
ggaauaacaugguaagcaa

SEQ ID NO: 1013280 - RNA, 19 nt, Homo sapiens
ggaggaagauggacuuuca

SEQ ID NO: 1013281 - RNA, 19 nt, Homo sapiens
caaaauaacugcacaaaga

SEQ ID NO: 1013282 - RNA, 19 nt, Homo sapiens
gcaagaggauagaagacua

SEQ ID NO: 1013283 - RNA, 19 nt, Homo sapiens
gcucacagcugacaaucuu

SEQ ID NO: 1013284 - RNA, 19 nt, Homo sapiens
ccacagcugucccuacgua

SEQ ID NO: 1013285 - RNA, 19 nt, Homo sapiens
ggaaaccaguguugccauu

SEQ ID NO: 1013286 - RNA, 19 nt, Homo sapiens
guaaugcccuugccugguu

SEQ ID NO: 1013287 - RNA, 19 nt, Homo sapiens
ccaaauauauucuccuaca

SEQ ID NO: 1013288 - RNA, 19 nt, Homo sapiens
ggacggaucagccauuuga

SEQ ID NO: 1013289 - RNA, 19 nt, Homo sapiens
caagaagccuacagggaaa

SEQ ID NO: 1013290 - RNA, 19 nt, Homo sapiens
uggaagagcuauacuacaa

SEQ ID NO: 1013291 - RNA, 19 nt, Homo sapiens
ucaaggagauuggauuuau

SEQ ID NO: 1013292 - RNA, 19 nt, Homo sapiens
ugaggaagaugauguuaau

SEQ ID NO: 1013293 - RNA, 19 nt, Homo sapiens
ggaagucguugcauaugau

SEQ ID NO: 1013294 - RNA, 19 nt, Homo sapiens
gggaagucguugcauauga

SEQ ID NO: 1013295 - RNA, 19 nt, Homo sapiens
gcugggaagucguugcaua

SEQ ID NO: 1013296 - RNA, 19 nt, Homo sapiens
ggcauaauacccagaaaua

SEQ ID NO: 1013297 - RNA, 19 nt, Homo sapiens
gggaagacaccaccaguuu

SEQ ID NO: 1013298 - RNA, 19 nt, Homo sapiens
ugggagagcuucaaggaaa

SEQ ID NO: 1013299 - RNA, 19 nt, Homo sapiens
caaggagauuggauuuauu

SEQ ID NO: 1013300 - RNA, 19 nt, Homo sapiens
ccaccuauauugaggaaga

SEQ ID NO: 1013301 - RNA, 19 nt, Homo sapiens
uaacuacuauggaaugcaa

SEQ ID NO: 1013302 - RNA, 19 nt, Homo sapiens
aagaugggcuacagaauga

SEQ ID NO: 1013303 - RNA, 19 nt, Homo sapiens
ggaccucguucucaaagga

SEQ ID NO: 1013304 - RNA, 19 nt, Homo sapiens
cugaauaagugcuugauga

SEQ ID NO: 1013305 - RNA, 19 nt, Homo sapiens
cgacuucguuguucaugaa

SEQ ID NO: 1013306 - RNA, 19 nt, Homo sapiens
aaagcuauguguggaauaa

SEQ ID NO: 1013307 - RNA, 19 nt, Homo sapiens
cagaaauaaucgcuuaaug

SEQ ID NO: 1013308 - RNA, 19 nt, Homo sapiens
gcaaauacagggcucugaa

SEQ ID NO: 1013309 - RNA, 19 nt, Homo sapiens
gcauaauacccagaaauaa

SEQ ID NO: 1013310 - RNA, 19 nt, Homo sapiens
aaagaaccaucauccauca

SEQ ID NO: 1013311 - RNA, 19 nt, Homo sapiens
gaagagcuauacuacaaaa

SEQ ID NO: 1013312 - RNA, 19 nt, Homo sapiens
cauggaugcuauuaaugua

SEQ ID NO: 1013313 - RNA, 19 nt, Homo sapiens
uaaaagggcuauaacaguu

SEQ ID NO: 1013314 - RNA, 19 nt, Homo sapiens
caccauggaugcuauuaau

SEQ ID NO: 1013315 - RNA, 19 nt, Homo sapiens
caagaugggcuacagaaug

SEQ ID NO: 1013316 - RNA, 19 nt, Homo sapiens
gaaaccacuucacuguugu

SEQ ID NO: 1013317 - RNA, 19 nt, Homo sapiens
gcuagggaauuucagcuau

SEQ ID NO: 1013318 - RNA, 19 nt, Homo sapiens
cagaagacauauuuacagu

SEQ ID NO: 1013319 - RNA, 19 nt, Homo sapiens
ggaaugcagccuaaccaaa

SEQ ID NO: 1013320 - RNA, 19 nt, Homo sapiens
gcaguaccuuguccacaga

SEQ ID NO: 1013321 - RNA, 19 nt, Homo sapiens
ccacagccaccuauauuga

SEQ ID NO: 1013322 - RNA, 19 nt, Homo sapiens
gcuauaacaguucaagaaa

SEQ ID NO: 1013323 - RNA, 19 nt, Homo sapiens
gcuaucaaaucucuguuuc

SEQ ID NO: 1013324 - RNA, 19 nt, Homo sapiens
gaaugcagccuaaccaaag

SEQ ID NO: 1013325 - RNA, 19 nt, Homo sapiens
aaaccaguguugccauuga

SEQ ID NO: 1013326 - RNA, 19 nt, Homo sapiens
ggaaagguggaaagaauuc

SEQ ID NO: 1013327 - RNA, 19 nt, Homo sapiens
gauguuaucuacccaaagc

SEQ ID NO: 1013328 - RNA, 19 nt, Homo sapiens
caacugcugcccucagaaa

SEQ ID NO: 1013329 - RNA, 19 nt, Homo sapiens
gaacugaugaccaaguaca

SEQ ID NO: 1013330 - RNA, 19 nt, Homo sapiens
guuggaagaugaggaagaa

SEQ ID NO: 1013331 - RNA, 19 nt, Homo sapiens
ugggaaagguggaaagaau

SEQ ID NO: 1013332 - RNA, 19 nt, Homo sapiens
gagucaagccaaauauauu

SEQ ID NO: 1013333 - RNA, 19 nt, Homo sapiens
caaauacagggcucugaaa

SEQ ID NO: 1013334 - RNA, 19 nt, Homo sapiens
acccagaaauaaucgcuua

SEQ ID NO: 1013335 - RNA, 19 nt, Homo sapiens
gacagaagucauggauuua

SEQ ID NO: 1013336 - RNA, 19 nt, Homo sapiens
ggaagagcuauacuacaaa

SEQ ID NO: 1013337 - RNA, 19 nt, Homo sapiens
cuucguuguucaugaaaua

SEQ ID NO: 1013338 - RNA, 19 nt, Homo sapiens
gaggaggaaucagagaguu

SEQ ID NO: 1013339 - RNA, 19 nt, Homo sapiens
guaccuuguccacagauua

SEQ ID NO: 1013340 - RNA, 19 nt, Homo sapiens
agacgcagcugaauacaac

SEQ ID NO: 1013341 - RNA, 19 nt, Homo sapiens
cagaagucauggauuuaau

SEQ ID NO: 1013342 - RNA, 19 nt, Homo sapiens
ccacuucacuguuguucuc

SEQ ID NO: 1013343 - RNA, 19 nt, Homo sapiens
agauggagaugacagaaau

SEQ ID NO: 1013344 - RNA, 19 nt, Homo sapiens
aauauagucucugcauuug

SEQ ID NO: 1013345 - RNA, 19 nt, Homo sapiens
gggaauuucagcuaucaaa

SEQ ID NO: 1013346 - RNA, 19 nt, Homo sapiens
aaacaaagacaccauggau

SEQ ID NO: 1013347 - RNA, 19 nt, Homo sapiens
agaaagauacuccgacuuc

SEQ ID NO: 1013348 - RNA, 19 nt, Homo sapiens
ggaagaagaggaggaagau

SEQ ID NO: 1013349 - RNA, 19 nt, Homo sapiens
ccaaagcuauguguggaau

SEQ ID NO: 1013350 - RNA, 19 nt, Homo sapiens
gggcacugguugucgaaga

SEQ ID NO: 1013351 - RNA, 19 nt, Homo sapiens
uuaagagucaagccaaaua

SEQ ID NO: 1013352 - RNA, 19 nt, Homo sapiens
gggaaagguggaaagaauu

SEQ ID NO: 1013353 - RNA, 19 nt, Homo sapiens
gaaauugggagagcuucaa

SEQ ID NO: 1013354 - RNA, 19 nt, Homo sapiens
agacuugcccaccugaaua

SEQ ID NO: 1013355 - RNA, 19 nt, Homo sapiens
caugggaaccaaagauaaa

SEQ ID NO: 1013356 - RNA, 19 nt, Homo sapiens
gaugaagcauggacucacu

SEQ ID NO: 1013357 - RNA, 19 nt, Homo sapiens
aacaggaacugaugaccaa

SEQ ID NO: 1013358 - RNA, 19 nt, Homo sapiens
gaaauauaacaggaacuga

SEQ ID NO: 1013359 - RNA, 19 nt, Homo sapiens
acuuuaagcuagggaauuu

SEQ ID NO: 1013360 - RNA, 19 nt, Homo sapiens
ugaauaagugcuugaugaa

SEQ ID NO: 1013361 - RNA, 19 nt, Homo sapiens
uaucaaaucucuguuucca

SEQ ID NO: 1013362 - RNA, 19 nt, Homo sapiens
gacacaaaauucgagauua

SEQ ID NO: 1013363 - RNA, 19 nt, Homo sapiens
gaaaugcucacagcugaca

SEQ ID NO: 1013364 - RNA, 19 nt, Homo sapiens
agaauauagucucugcauu

SEQ ID NO: 1013365 - RNA, 19 nt, Homo sapiens
ggaaugaagaauauagucu

SEQ ID NO: 1013366 - RNA, 19 nt, Homo sapiens
acuauggaaugcaaagauu

SEQ ID NO: 1013367 - RNA, 19 nt, Homo sapiens
aggaacugaugaccaagua

SEQ ID NO: 1013368 - RNA, 19 nt, Homo sapiens
ugacuggugugucgcugaa

SEQ ID NO: 1013369 - RNA, 19 nt, Homo sapiens
agagaagaaugggcaaaga

SEQ ID NO: 1013370 - RNA, 19 nt, Homo sapiens
aauaagugcuugaugaacu

SEQ ID NO: 1013371 - RNA, 19 nt, Homo sapiens
ggcuauaacaguucaagaa

SEQ ID NO: 1013372 - RNA, 19 nt, Homo sapiens
gcgaggaggaggaaucaga

SEQ ID NO: 1013373 - RNA, 19 nt, Homo sapiens
ggagaugacagaaaugacu

SEQ ID NO: 1013374 - RNA, 19 nt, Homo sapiens
gcccuugccugguuucgau

SEQ ID NO: 1013375 - RNA, 19 nt, Homo sapiens
gaaagaagauggaaagaaa

SEQ ID NO: 1013376 - RNA, 19 nt, Homo sapiens
ggaaggagcucuuuauuug

SEQ ID NO: 1013377 - RNA, 19 nt, Homo sapiens
ggaagacucucuaugauaa

SEQ ID NO: 1013378 - RNA, 19 nt, Homo sapiens
caaggaaacuaaugagaaa

SEQ ID NO: 1013379 - RNA, 19 nt, Homo sapiens
ucacugaugugcucaagua

SEQ ID NO: 1013380 - RNA, 19 nt, Homo sapiens
gaauacggauagccaagua

SEQ ID NO: 1013381 - RNA, 19 nt, Homo sapiens
guacaggcauaaccauuaa

SEQ ID NO: 1013382 - RNA, 19 nt, Homo sapiens
gcugaaacaucgaaggaua

SEQ ID NO: 1013383 - RNA, 19 nt, Homo sapiens
ggagcaagauuucauguca

SEQ ID NO: 1013384 - RNA, 19 nt, Homo sapiens
ggaaagaaauccuggaaaa

SEQ ID NO: 1013385 - RNA, 19 nt, Homo sapiens
gcaaggaaacuaaugagaa

SEQ ID NO: 1013386 - RNA, 19 nt, Homo sapiens
ggaaacuucucacugaugu

SEQ ID NO: 1013387 - RNA, 19 nt, Homo sapiens
ccugacaucuuguucauuu

SEQ ID NO: 1013388 - RNA, 19 nt, Homo sapiens
ucaaguaucucugcuguga

SEQ ID NO: 1013389 - RNA, 19 nt, Homo sapiens
gaauaucugcccaaaugua

SEQ ID NO: 1013390 - RNA, 19 nt, Homo sapiens
gaccaaauguucagcacuu

SEQ ID NO: 1013391 - RNA, 19 nt, Homo sapiens
ccagagacaugcugaaaca

SEQ ID NO: 1013392 - RNA, 19 nt, Homo sapiens
cagaaggagucccaguaua

SEQ ID NO: 1013393 - RNA, 19 nt, Homo sapiens
ggagaaagaggagaaauau

SEQ ID NO: 1013394 - RNA, 19 nt, Homo sapiens
ugagucaagugaagacaua

SEQ ID NO: 1013395 - RNA, 19 nt, Homo sapiens
gaauguaucuucccuucca

SEQ ID NO: 1013396 - RNA, 19 nt, Homo sapiens
ccaguagaguucagaauau

SEQ ID NO: 1013397 - RNA, 19 nt, Homo sapiens
gggaagacucucuaugaua

SEQ ID NO: 1013398 - RNA, 19 nt, Homo sapiens
ggacgggcaugaugagugu

SEQ ID NO: 1013399 - RNA, 19 nt, Homo sapiens
guucagaagcaucaaauaa

SEQ ID NO: 1013400 - RNA, 19 nt, Homo sapiens
gauaaaaugugaugggaaa

SEQ ID NO: 1013401 - RNA, 19 nt, Homo sapiens
uggaacaucuaucauugua

SEQ ID NO: 1013402 - RNA, 19 nt, Homo sapiens
ccacugguaucagccaaua

SEQ ID NO: 1013403 - RNA, 19 nt, Homo sapiens
uuaagaagcucgucgucaa

SEQ ID NO: 1013404 - RNA, 19 nt, Homo sapiens
aaacaucgaaggauaagaa

SEQ ID NO: 1013405 - RNA, 19 nt, Homo sapiens
gaaggagcucuuuauuuga

SEQ ID NO: 1013406 - RNA, 19 nt, Homo sapiens
gaggagaaauaugcuguau

SEQ ID NO: 1013407 - RNA, 19 nt, Homo sapiens
ugaaggaggccaagguuaa

SEQ ID NO: 1013408 - RNA, 19 nt, Homo sapiens
ccaauaugaggaugacuua

SEQ ID NO: 1013409 - RNA, 19 nt, Homo sapiens
gaaagaguccuugcagaau

SEQ ID NO: 1013410 - RNA, 19 nt, Homo sapiens
gaugacacaagaacccuua

SEQ ID NO: 1013411 - RNA, 19 nt, Homo sapiens
gaaagcaaggaaacuaaug

SEQ ID NO: 1013412 - RNA, 19 nt, Homo sapiens
aaggagcucuuuauuugaa

SEQ ID NO: 1013413 - RNA, 19 nt, Homo sapiens
gugaagacauagaccaaau

SEQ ID NO: 1013414 - RNA, 19 nt, Homo sapiens
gcacuuugcugggagagau

SEQ ID NO: 1013415 - RNA, 19 nt, Homo sapiens
gggcuucuggaauuuauua

SEQ ID NO: 1013416 - RNA, 19 nt, Homo sapiens
gaacuggaaggagcucuuu

SEQ ID NO: 1013417 - RNA, 19 nt, Homo sapiens
gagcugaauuuaacuacag

SEQ ID NO: 1013418 - RNA, 19 nt, Homo sapiens
agauuuagaugcucucaug

SEQ ID NO: 1013419 - RNA, 19 nt, Homo sapiens
gaaaaugaaugcuaagaac

SEQ ID NO: 1013420 - RNA, 19 nt, Homo sapiens
cucgagaucuggcguguuu

SEQ ID NO: 1013421 - RNA, 19 nt, Homo sapiens
aaagaaagcaaggaaacua

SEQ ID NO: 1013422 - RNA, 19 nt, Homo sapiens
ggacaauccaggcacagaa

SEQ ID NO: 1013423 - RNA, 19 nt, Homo sapiens
uaaaugaguccuuaaaugc

SEQ ID NO: 1013424 - RNA, 19 nt, Homo sapiens
agaaggagucccaguauau

SEQ ID NO: 1013425 - RNA, 19 nt, Homo sapiens
uguggaacaucuaucauug

SEQ ID NO: 1013426 - RNA, 19 nt, Homo sapiens
ucaaggugcacaugaauga

SEQ ID NO: 1013427 - RNA, 19 nt, Homo sapiens
aaagaguccuugcagaauc

SEQ ID NO: 1013428 - RNA, 19 nt, Homo sapiens
agaaagaguccuugcagaa

SEQ ID NO: 1013429 - RNA, 19 nt, Homo sapiens
acuggaagaccaagauuua

SEQ ID NO: 1013430 - RNA, 19 nt, Homo sapiens
guccuuaaaugcacuggaa

SEQ ID NO: 1013431 - RNA, 19 nt, Homo sapiens
auaaagcgcccacugacua

SEQ ID NO: 1013432 - RNA, 19 nt, Homo sapiens
uggaaggagcucuuuauuu

SEQ ID NO: 1013433 - RNA, 19 nt, Homo sapiens
ggaagaccaagauuuagau

SEQ ID NO: 1013434 - RNA, 19 nt, Homo sapiens
caagagacacagaaaauaa

SEQ ID NO: 1013435 - RNA, 19 nt, Homo sapiens
gcagcuggcccgagauguu

SEQ ID NO: 1013436 - RNA, 19 nt, Homo sapiens
cuaaauggaauguaucuuc

SEQ ID NO: 1013437 - RNA, 19 nt, Homo sapiens
gugcucaaguacaggcaua

SEQ ID NO: 1013438 - RNA, 19 nt, Homo sapiens
ugucagaccucaugaaagc

SEQ ID NO: 1013439 - RNA, 19 nt, Homo sapiens
ggucaugggaauacggaua

SEQ ID NO: 1013440 - RNA, 19 nt, Homo sapiens
gcacaaagucacugauggu

SEQ ID NO: 1013441 - RNA, 19 nt, Homo sapiens
cauaaccauuaacccagua

SEQ ID NO: 1013442 - RNA, 19 nt, Homo sapiens
ucagugcuguucuccaaga

SEQ ID NO: 1013443 - RNA, 19 nt, Homo sapiens
uggagaaagaggagaaaua

SEQ ID NO: 1013444 - RNA, 19 nt, Homo sapiens
ucucauggcagaucuggua

SEQ ID NO: 1013445 - RNA, 19 nt, Homo sapiens
ugucagugcuguucuccaa

SEQ ID NO: 1013446 - RNA, 19 nt, Homo sapiens
gaaggagucccaguauauc

SEQ ID NO: 1013447 - RNA, 19 nt, Homo sapiens
ugaaagaagauggaaagaa

SEQ ID NO: 1013448 - RNA, 19 nt, Homo sapiens
cccaguagaguucagaaua

SEQ ID NO: 1013449 - RNA, 19 nt, Homo sapiens
caagaggcccagagacaug

SEQ ID NO: 1013450 - RNA, 19 nt, Homo sapiens
ggugcagccucucuugguu

SEQ ID NO: 1013451 - RNA, 19 nt, Homo sapiens
gcacuggaagaccaagauu

SEQ ID NO: 1013452 - RNA, 19 nt, Homo sapiens
ggacucagcauaaaaugaa

SEQ ID NO: 1013453 - RNA, 19 nt, Homo sapiens
uuuacgggcuucuggaauu

SEQ ID NO: 1013454 - RNA, 19 nt, Homo sapiens
ccgcagagcagucgagaug

SEQ ID NO: 1013455 - RNA, 19 nt, Homo sapiens
gacaauccaggcacagaaa

SEQ ID NO: 1013456 - RNA, 19 nt, Homo sapiens
cgagaugggugagucaagu

SEQ ID NO: 1013457 - RNA, 19 nt, Homo sapiens
augggaaacuucucacuga

SEQ ID NO: 1013458 - RNA, 19 nt, Homo sapiens
cccaguauaucaaguaucu

SEQ ID NO: 1013459 - RNA, 19 nt, Homo sapiens
acccagagcugaauuuaac

SEQ ID NO: 1013460 - RNA, 19 nt, Homo sapiens
agaaagaggagaaauaugc

SEQ ID NO: 1013461 - RNA, 19 nt, Homo sapiens
gaagaccaagauuuagaug

SEQ ID NO: 1013462 - RNA, 19 nt, Homo sapiens
aguacaggcauaaccauua

SEQ ID NO: 1013463 - RNA, 19 nt, Homo sapiens
aaguaucucugcugugaug

SEQ ID NO: 1013464 - RNA, 19 nt, Homo sapiens
ccacccagagcugaauuua

SEQ ID NO: 1013465 - RNA, 19 nt, Homo sapiens
uuacgggcuucuggaauuu

SEQ ID NO: 1013466 - RNA, 19 nt, Homo sapiens
aaagcaaggaaacuaauga

SEQ ID NO: 1013467 - RNA, 19 nt, Homo sapiens
gagaaagaggagaaauaug

SEQ ID NO: 1013468 - RNA, 19 nt, Homo sapiens
ugaaaucuacccggaacua

SEQ ID NO: 1013469 - RNA, 19 nt, Homo sapiens
gugcagccucucuugguua

SEQ ID NO: 1013470 - RNA, 19 nt, Homo sapiens
aagaaagcaaggaaacuaa

SEQ ID NO: 1013471 - RNA, 19 nt, Homo sapiens
acccggaacuacaaauuga

SEQ ID NO: 1013472 - RNA, 19 nt, Homo sapiens
gcccugacaucuuguucau

SEQ ID NO: 1013473 - RNA, 19 nt, Homo sapiens
aauauaaagcgcccacuga

SEQ ID NO: 1013474 - RNA, 19 nt, Homo sapiens
caaaggaaagacuaagaca

SEQ ID NO: 1013475 - RNA, 19 nt, Homo sapiens
ugacagagcugaagacuua

SEQ ID NO: 1013476 - RNA, 19 nt, Homo sapiens
gaagguaccuguauuugua

SEQ ID NO: 1013477 - RNA, 19 nt, Homo sapiens
gaaacgagcuauagaaaca

SEQ ID NO: 1013478 - RNA, 19 nt, Homo sapiens
gaaaugaucagcccaugua

SEQ ID NO: 1013479 - RNA, 19 nt, Homo sapiens
gaacugggcuauccaagau

SEQ ID NO: 1013480 - RNA, 19 nt, Homo sapiens
gggcuucgcucucgccuua

SEQ ID NO: 1013481 - RNA, 19 nt, Homo sapiens
ggaaugacuugguguauca

SEQ ID NO: 1013482 - RNA, 19 nt, Homo sapiens
gguauaauauggagaaaga

SEQ ID NO: 1013483 - RNA, 19 nt, Homo sapiens
cagaggagcuacuugauga

SEQ ID NO: 1013484 - RNA, 19 nt, Homo sapiens
gugagaaacuggacaaaga

SEQ ID NO: 1013485 - RNA, 19 nt, Homo sapiens
guagagagaugcaguugug

SEQ ID NO: 1013486 - RNA, 19 nt, Homo sapiens
ccaagcaguucuucacuuu

SEQ ID NO: 1013487 - RNA, 19 nt, Homo sapiens
gcuaucagcugaagaaagu

SEQ ID NO: 1013488 - RNA, 19 nt, Homo sapiens
caacuuugauguagauguu

SEQ ID NO: 1013489 - RNA, 19 nt, Homo sapiens
ggaauuaagcaaaguagaa

SEQ ID NO: 1013490 - RNA, 19 nt, Homo sapiens
uaucaccacuugcaacuuu

SEQ ID NO: 1013491 - RNA, 19 nt, Homo sapiens
gaagagaccaguugaacga

SEQ ID NO: 1013492 - RNA, 19 nt, Homo sapiens
gaaugaagauggaaaagaa

SEQ ID NO: 1013493 - RNA, 19 nt, Homo sapiens
auaauacccuggaugauaa

SEQ ID NO: 1013494 - RNA, 19 nt, Homo sapiens
ucacauauuuccuguuguu

SEQ ID NO: 1013495 - RNA, 19 nt, Homo sapiens
ggcaagaauuaaaggcuua

SEQ ID NO: 1013496 - RNA, 19 nt, Homo sapiens
gaagagauuuauugaacuc

SEQ ID NO: 1013497 - RNA, 19 nt, Homo sapiens
cagaagagauuuauugaac

SEQ ID NO: 1013498 - RNA, 19 nt, Homo sapiens
ugauguagauguugauuug

SEQ ID NO: 1013499 - RNA, 19 nt, Homo sapiens
aagcagaggcuauacuuua

SEQ ID NO: 1013500 - RNA, 19 nt, Homo sapiens
cuagacagacgguauaaua

SEQ ID NO: 1013501 - RNA, 19 nt, Homo sapiens
ggcaggagauauggauuua

SEQ ID NO: 1013502 - RNA, 19 nt, Homo sapiens
ggagcuacuugaugaagaa

SEQ ID NO: 1013503 - RNA, 19 nt, Homo sapiens
gacagcaacuggaacgaaa

SEQ ID NO: 1013504 - RNA, 19 nt, Homo sapiens
gugccgagcuaauacagua

SEQ ID NO: 1013505 - RNA, 19 nt, Homo sapiens
caagauacguuuacuacag

SEQ ID NO: 1013506 - RNA, 19 nt, Homo sapiens
gaagcagucugagcuauca

SEQ ID NO: 1013507 - RNA, 19 nt, Homo sapiens
gaacucuaccgccagauuu

SEQ ID NO: 1013508 - RNA, 19 nt, Homo sapiens
cagcaaccacugagaaaua

SEQ ID NO: 1013509 - RNA, 19 nt, Homo sapiens
uauaauacccuggaugaua

SEQ ID NO: 1013510 - RNA, 19 nt, Homo sapiens
aagagaagaugaagaacaa

SEQ ID NO: 1013511 - RNA, 19 nt, Homo sapiens
ggagaaggcugaggacaag

SEQ ID NO: 1013512 - RNA, 19 nt, Homo sapiens
gaagagaugggugacuaua

SEQ ID NO: 1013513 - RNA, 19 nt, Homo sapiens
gaaggaauuaagcaaagua

SEQ ID NO: 1013514 - RNA, 19 nt, Homo sapiens
ccuacaagaucaugaaaug

SEQ ID NO: 1013515 - RNA, 19 nt, Homo sapiens
caaguugacugaaauucug

SEQ ID NO: 1013516 - RNA, 19 nt, Homo sapiens
ugaagaaucucgaauccau

SEQ ID NO: 1013517 - RNA, 19 nt, Homo sapiens
uauggacucugaauaaaga

SEQ ID NO: 1013518 - RNA, 19 nt, Homo sapiens
gauaacacccaucauccua

SEQ ID NO: 1013519 - RNA, 19 nt, Homo sapiens
guaaacacguggcuuggau

SEQ ID NO: 1013520 - RNA, 19 nt, Homo sapiens
gagcagaggagcuacuuga

SEQ ID NO: 1013521 - RNA, 19 nt, Homo sapiens
caagaaaacucuacgauag

SEQ ID NO: 1013522 - RNA, 19 nt, Homo sapiens
ccaguaacauugcgcuuau

SEQ ID NO: 1013523 - RNA, 19 nt, Homo sapiens
gaagauagaauccaaagcu

SEQ ID NO: 1013524 - RNA, 19 nt, Homo sapiens
ggaaacaagagaagaugaa

SEQ ID NO: 1013525 - RNA, 19 nt, Homo sapiens
gcugaggacacgucaauaa

SEQ ID NO: 1013526 - RNA, 19 nt, Homo sapiens
guauuuguauggacucuga

SEQ ID NO: 1013527 - RNA, 19 nt, Homo sapiens
gcagauacagcacacuuga

SEQ ID NO: 1013528 - RNA, 19 nt, Homo sapiens
gcgaaggccuccugaacau

SEQ ID NO: 1013529 - RNA, 19 nt, Homo sapiens
gucaagaacaggaauuuaa

SEQ ID NO: 1013530 - RNA, 19 nt, Homo sapiens
ugaccaagaugaccgcuau

SEQ ID NO: 1013531 - RNA, 19 nt, Homo sapiens
ggcuguaugucauugauuu

SEQ ID NO: 1013532 - RNA, 19 nt, Homo sapiens
gagaugcaguugugaugau

SEQ ID NO: 1013533 - RNA, 19 nt, Homo sapiens
gaaagcgacaguagagaga

SEQ ID NO: 1013534 - RNA, 19 nt, Homo sapiens
gcaagcagcccucgagaag

SEQ ID NO: 1013535 - RNA, 19 nt, Homo sapiens
ugaccgcuauggcaaauga

SEQ ID NO: 1013536 - RNA, 19 nt, Homo sapiens
aagaagagaugggugacua

SEQ ID NO: 1013537 - RNA, 19 nt, Homo sapiens
caaccuggauguuuucuuu

SEQ ID NO: 1013538 - RNA, 19 nt, Homo sapiens
gagaagcagucugagcuau

SEQ ID NO: 1013539 - RNA, 19 nt, Homo sapiens
cagaaggcauuuagcugaa

SEQ ID NO: 1013540 - RNA, 19 nt, Homo sapiens
gggaguacuuguucucugu

SEQ ID NO: 1013541 - RNA, 19 nt, Homo sapiens
uaacacccaucauccuaug

SEQ ID NO: 1013542 - RNA, 19 nt, Homo sapiens
gaacagauuguggaaggaa

SEQ ID NO: 1013543 - RNA, 19 nt, Homo sapiens
aagcaguucuucacuuuau

SEQ ID NO: 1013544 - RNA, 19 nt, Homo sapiens
gaaccugagagcacuugua

SEQ ID NO: 1013545 - RNA, 19 nt, Homo sapiens
ggaaggaauuaagcaaagu

SEQ ID NO: 1013546 - RNA, 19 nt, Homo sapiens
gacagacgguauaauaugg

SEQ ID NO: 1013547 - RNA, 19 nt, Homo sapiens
ugacgaagaccuagacaga

SEQ ID NO: 1013548 - RNA, 19 nt, Homo sapiens
cagagggaguuuccgcuuu

SEQ ID NO: 1013549 - RNA, 19 nt, Homo sapiens
cuacaucgccggaaaguca

SEQ ID NO: 1013550 - RNA, 19 nt, Homo sapiens
ggacucugcucugcugaga

SEQ ID NO: 1013551 - RNA, 19 nt, Homo sapiens
gaagagcagcguauucagu

SEQ ID NO: 1013552 - RNA, 19 nt, Homo sapiens
caccguauaucaccuacaa

SEQ ID NO: 1013553 - RNA, 19 nt, Homo sapiens
cagaggcuauacuuuaaga

SEQ ID NO: 1013554 - RNA, 19 nt, Homo sapiens
gagaaacuuuacaagauac

SEQ ID NO: 1013555 - RNA, 19 nt, Homo sapiens
ugacacgacuacagcaaga

SEQ ID NO: 1013556 - RNA, 19 nt, Homo sapiens
gauauaaugaagccaagaa

SEQ ID NO: 1013557 - RNA, 19 nt, Homo sapiens
ggaggaaugacuuggugua

SEQ ID NO: 1013558 - RNA, 19 nt, Homo sapiens
gcagaggagcuacuugaug

SEQ ID NO: 1013559 - RNA, 19 nt, Homo sapiens
uauaucaccuacaagauca

SEQ ID NO: 1013560 - RNA, 19 nt, Homo sapiens
acaaagaaaccaagcaguu

SEQ ID NO: 1013561 - RNA, 19 nt, Homo sapiens
cuacaagccagauauaaug

SEQ ID NO: 1013562 - RNA, 19 nt, Homo sapiens
gaauauagggaguacuugu

SEQ ID NO: 1013563 - RNA, 19 nt, Homo sapiens
acacguggcuuggauaaca

SEQ ID NO: 1013564 - RNA, 19 nt, Homo sapiens
uuaagacugugaaagaguu

SEQ ID NO: 1013565 - RNA, 19 nt, Homo sapiens
uauauaauacccuggauga

SEQ ID NO: 1013566 - RNA, 19 nt, Homo sapiens
agagaugggugacuauauc

SEQ ID NO: 1013567 - RNA, 19 nt, Homo sapiens
cauuucagggcaagaauua

SEQ ID NO: 1013568 - RNA, 19 nt, Homo sapiens
aaaguagaaugaagaugga

SEQ ID NO: 1013569 - RNA, 19 nt, Homo sapiens
gaaacuggacaaagagcaa

SEQ ID NO: 1013570 - RNA, 19 nt, Homo sapiens
gaucagcccauguaguguu

SEQ ID NO: 1013571 - RNA, 19 nt, Homo sapiens
caaagaaaccaagcaguuc

SEQ ID NO: 1013572 - RNA, 19 nt, Homo sapiens
gaagaaaucgagaaauagc

SEQ ID NO: 1013573 - RNA, 19 nt, Homo sapiens
aagcagcccucgagaagau

SEQ ID NO: 1013574 - RNA, 19 nt, Homo sapiens
gaugaagaaucucgaaucc

SEQ ID NO: 1013575 - RNA, 19 nt, Homo sapiens
gaucacagcugcaaauuuc

SEQ ID NO: 1013576 - RNA, 19 nt, Homo sapiens
gcacaauguuucuauguaa

SEQ ID NO: 1013577 - RNA, 19 nt, Homo sapiens
gaauauggcuagaauaaca

SEQ ID NO: 1013578 - RNA, 19 nt, Homo sapiens
gaagacagauaacacagaa

SEQ ID NO: 1013579 - RNA, 19 nt, Homo sapiens
gagaaugccuuugcuguuu

SEQ ID NO: 1013580 - RNA, 19 nt, Homo sapiens
ucaaaugacuccagaauca

SEQ ID NO: 1013581 - RNA, 19 nt, Homo sapiens
gaaauacaauacugaagga

SEQ ID NO: 1013582 - RNA, 19 nt, Homo sapiens
guauauagguuuccaguag

SEQ ID NO: 1013583 - RNA, 19 nt, Homo sapiens
ugaagacccugaugauaaa

SEQ ID NO: 1013584 - RNA, 19 nt, Homo sapiens
gggauagucuuguuucuag

SEQ ID NO: 1013585 - RNA, 19 nt, Homo sapiens
gcagauguauuuucuauga

SEQ ID NO: 1013586 - RNA, 19 nt, Homo sapiens
gcaccuugcugaggaauau

SEQ ID NO: 1013587 - RNA, 19 nt, Homo sapiens
caacaaccauauguaaaug

SEQ ID NO: 1013588 - RNA, 19 nt, Homo sapiens
ugaaguagauggucagaca

SEQ ID NO: 1013589 - RNA, 19 nt, Homo sapiens
ggucaacaaccauauguaa

SEQ ID NO: 1013590 - RNA, 19 nt, Homo sapiens
acauauagauacugccaua

SEQ ID NO: 1013591 - RNA, 19 nt, Homo sapiens
uguuagagaugaaguguuu

SEQ ID NO: 1013592 - RNA, 19 nt, Homo sapiens
ggucuaaauugugggcuua

SEQ ID NO: 1013593 - RNA, 19 nt, Homo sapiens
ggagagaucguaaugacuu

SEQ ID NO: 1013594 - RNA, 19 nt, Homo sapiens
guauaaggguuacgucaau

SEQ ID NO: 1013595 - RNA, 19 nt, Homo sapiens
uggcaaauaugcagugauu

SEQ ID NO: 1013596 - RNA, 19 nt, Homo sapiens
agaauaacauugccaaaca

SEQ ID NO: 1013597 - RNA, 19 nt, Homo sapiens
gaaaacgacucaacuaaag

SEQ ID NO: 1013598 - RNA, 19 nt, Homo sapiens
gcacaaguuucugcaugaa

SEQ ID NO: 1013599 - RNA, 19 nt, Homo sapiens
gauguuaucuuuggaugug

SEQ ID NO: 1013600 - RNA, 19 nt, Homo sapiens
uaugauggcagauguauuu

SEQ ID NO: 1013601 - RNA, 19 nt, Homo sapiens
gaugaagacccugaugaua

SEQ ID NO: 1013602 - RNA, 19 nt, Homo sapiens
gaaggaaugccauacacaa

SEQ ID NO: 1013603 - RNA, 19 nt, Homo sapiens
gaauaacauugccaaacau

SEQ ID NO: 1013604 - RNA, 19 nt, Homo sapiens
aaaggaauauggcuagaau

SEQ ID NO: 1013605 - RNA, 19 nt, Homo sapiens
cgaaugaaauacaauacug

SEQ ID NO: 1013606 - RNA, 19 nt, Homo sapiens
caagagaugacagguauuu

SEQ ID NO: 1013607 - RNA, 19 nt, Homo sapiens
ggauaaaacagucagauua

SEQ ID NO: 1013608 - RNA, 19 nt, Homo sapiens
gugagaauaugggcuuuaa

SEQ ID NO: 1013609 - RNA, 19 nt, Homo sapiens
cagacuauaugauuugaga

SEQ ID NO: 1013610 - RNA, 19 nt, Homo sapiens
gaagagaaacuaccaacag

SEQ ID NO: 1013611 - RNA, 19 nt, Homo sapiens
caagaccaguuaaauucaa

SEQ ID NO: 1013612 - RNA, 19 nt, Homo sapiens
gaaacuaccaacaggcauu

SEQ ID NO: 1013613 - RNA, 19 nt, Homo sapiens
cacuauccaugaaguauaa

SEQ ID NO: 1013614 - RNA, 19 nt, Homo sapiens
acaaauacauguccgaucu

SEQ ID NO: 1013615 - RNA, 19 nt, Homo sapiens
ggugaacgugcuauaaaua

SEQ ID NO: 1013616 - RNA, 19 nt, Homo sapiens
acacaagaccaguuaaauu

SEQ ID NO: 1013617 - RNA, 19 nt, Homo sapiens
gagaggcaguguuaaugau

SEQ ID NO: 1013618 - RNA, 19 nt, Homo sapiens
ugacuucacuggagcaauc

SEQ ID NO: 1013619 - RNA, 19 nt, Homo sapiens
gcaaauaugcagugauugg

SEQ ID NO: 1013620 - RNA, 19 nt, Homo sapiens
gaugacagguauuuucuaa

SEQ ID NO: 1013621 - RNA, 19 nt, Homo sapiens
gaaagucuaaguucaucaa

SEQ ID NO: 1013622 - RNA, 19 nt, Homo sapiens
gaucuuaguggugaacaua

SEQ ID NO: 1013623 - RNA, 19 nt, Homo sapiens
gaaaggaauauggcuagaa

SEQ ID NO: 1013624 - RNA, 19 nt, Homo sapiens
gguauuaugaagacagaua

SEQ ID NO: 1013625 - RNA, 19 nt, Homo sapiens
caaugcaguuguuacauca

SEQ ID NO: 1013626 - RNA, 19 nt, Homo sapiens
guuagugguucagaagaua

SEQ ID NO: 1013627 - RNA, 19 nt, Homo sapiens
gcaaguuucagccaugauu

SEQ ID NO: 1013628 - RNA, 19 nt, Homo sapiens
gauagaguagaaaggaaua

SEQ ID NO: 1013629 - RNA, 19 nt, Homo sapiens
gacaauguagugagaauau

SEQ ID NO: 1013630 - RNA, 19 nt, Homo sapiens
acaagacaauguagugaga

SEQ ID NO: 1013631 - RNA, 19 nt, Homo sapiens
gugaacgugcuauaaauaa

SEQ ID NO: 1013632 - RNA, 19 nt, Homo sapiens
ggagcacaauguuucuaug

SEQ ID NO: 1013633 - RNA, 19 nt, Homo sapiens
uaacauugccaaacauuag

SEQ ID NO: 1013634 - RNA, 19 nt, Homo sapiens
gcagccagaucaagcaagu

SEQ ID NO: 1013635 - RNA, 19 nt, Homo sapiens
uauaaggguuacgucaaua

SEQ ID NO: 1013636 - RNA, 19 nt, Homo sapiens
ucaggaaagucuaaguuca

SEQ ID NO: 1013637 - RNA, 19 nt, Homo sapiens
ggacaagacaauguaguga

SEQ ID NO: 1013638 - RNA, 19 nt, Homo sapiens
ggagcuguuuggaccauga

SEQ ID NO: 1013639 - RNA, 19 nt, Homo sapiens
cacaagaccaguuaaauuc

SEQ ID NO: 1013640 - RNA, 19 nt, Homo sapiens
ugccaaacauuaggcuuua

SEQ ID NO: 1013641 - RNA, 19 nt, Homo sapiens
uuacuggcauugagccuuu

SEQ ID NO: 1013642 - RNA, 19 nt, Homo sapiens
auacauguccgaucuacua

SEQ ID NO: 1013643 - RNA, 19 nt, Homo sapiens
uccaagagaugacagguau

SEQ ID NO: 1013644 - RNA, 19 nt, Homo sapiens
ggacauaugauggcagaug

SEQ ID NO: 1013645 - RNA, 19 nt, Homo sapiens
gaacgugcuauaaauaaag

SEQ ID NO: 1013646 - RNA, 19 nt, Homo sapiens
aagugaagaugcugaaguu

SEQ ID NO: 1013647 - RNA, 19 nt, Homo sapiens
uaaaggacauacugcugau

SEQ ID NO: 1013648 - RNA, 19 nt, Homo sapiens
caaagcagcacacgguuuc

SEQ ID NO: 1013649 - RNA, 19 nt, Homo sapiens
gcauuaauccucucacucu

SEQ ID NO: 1013650 - RNA, 19 nt, Homo sapiens
guuagcauauguuucugaa

SEQ ID NO: 1013651 - RNA, 19 nt, Homo sapiens
uuaugaacaugcacaaguu

SEQ ID NO: 1013652 - RNA, 19 nt, Homo sapiens
aggaauauggcuagaauaa

SEQ ID NO: 1013653 - RNA, 19 nt, Homo sapiens
ucaaaguggugcaagaucu

SEQ ID NO: 1013654 - RNA, 19 nt, Homo sapiens
ccauacacaagaccaguua

SEQ ID NO: 1013655 - RNA, 19 nt, Homo sapiens
aggaaacccugggcugaua

SEQ ID NO: 1013656 - RNA, 19 nt, Homo sapiens
guuccaggcuaacauacuu

SEQ ID NO: 1013657 - RNA, 19 nt, Homo sapiens
guucagaagauaaguaugu

SEQ ID NO: 1013658 - RNA, 19 nt, Homo sapiens
ccaugaaguauaaggguua

SEQ ID NO: 1013659 - RNA, 19 nt, Homo sapiens
augaagacccugaugauaa

SEQ ID NO: 1013660 - RNA, 19 nt, Homo sapiens
ucaacaauaugcgaaugaa

SEQ ID NO: 1013661 - RNA, 19 nt, Homo sapiens
gagaauaugggcuuuaaaa

SEQ ID NO: 1013662 - RNA, 19 nt, Homo sapiens
ggaaugccauacacaagac

SEQ ID NO: 1013663 - RNA, 19 nt, Homo sapiens
acccugggcugauagagua

SEQ ID NO: 1013664 - RNA, 19 nt, Homo sapiens
aaauaguguuccaggcuaa

SEQ ID NO: 1013665 - RNA, 19 nt, Homo sapiens
gcaccaggcuuugcucacu

SEQ ID NO: 1013666 - RNA, 19 nt, Homo sapiens
gagcacaauguuucuaugu

SEQ ID NO: 1013667 - RNA, 19 nt, Homo sapiens
gagagaucguaaugacuuc

SEQ ID NO: 1013668 - RNA, 19 nt, Homo sapiens
ugagagauuugucacuauc

SEQ ID NO: 1013669 - RNA, 19 nt, Homo sapiens
guugaugguuagcauaugu

SEQ ID NO: 1013670 - RNA, 19 nt, Homo sapiens
caggagagaucguaaugac

SEQ ID NO: 1013671 - RNA, 19 nt, Homo sapiens
gaucuuucauggucuaaaa

SEQ ID NO: 1013672 - RNA, 19 nt, Homo sapiens
uaaggagugagucuucuuu

SEQ ID NO: 1013673 - RNA, 19 nt, Homo sapiens
gccacaccuucugguauua

SEQ ID NO: 1013674 - RNA, 19 nt, Homo sapiens
cuacacaucaugagaagga

SEQ ID NO: 1013675 - RNA, 19 nt, Homo sapiens
caaggucccuggucauuua

SEQ ID NO: 1013676 - RNA, 19 nt, Homo sapiens
gcaagaauauauuggauga

SEQ ID NO: 1013677 - RNA, 19 nt, Homo sapiens
gaagaauucucuaaagaug

SEQ ID NO: 1013678 - RNA, 19 nt, Homo sapiens
gcaguaauauuuccaaugu

SEQ ID NO: 1013679 - RNA, 19 nt, Homo sapiens
gcauuucagucaagauuua

SEQ ID NO: 1013680 - RNA, 19 nt, Homo sapiens
caacagaacagcaauauau

SEQ ID NO: 1013681 - RNA, 19 nt, Homo sapiens
gaauugaucuuaagucuac

SEQ ID NO: 1013682 - RNA, 19 nt, Homo sapiens
caaaucauguccuuagaaa

SEQ ID NO: 1013683 - RNA, 19 nt, Homo sapiens
gagaaugacacucaaauuu

SEQ ID NO: 1013684 - RNA, 19 nt, Homo sapiens
gaugaacuuucuaaccuua

SEQ ID NO: 1013685 - RNA, 19 nt, Homo sapiens
uggaagaacugcagaaauu

SEQ ID NO: 1013686 - RNA, 19 nt, Homo sapiens
ggagugaaauccuaucaga

SEQ ID NO: 1013687 - RNA, 19 nt, Homo sapiens
gaucuuaagucuacuguca

SEQ ID NO: 1013688 - RNA, 19 nt, Homo sapiens
aagaagaacucgaauaugu

SEQ ID NO: 1013689 - RNA, 19 nt, Homo sapiens
guuaauagccugagucaaa

SEQ ID NO: 1013690 - RNA, 19 nt, Homo sapiens
gaaaguauauaggcaacaa

SEQ ID NO: 1013691 - RNA, 19 nt, Homo sapiens
gaagaacugcagaaauuaa

SEQ ID NO: 1013692 - RNA, 19 nt, Homo sapiens
guacucugcugcuuuacua

SEQ ID NO: 1013693 - RNA, 19 nt, Homo sapiens
gagacucauugcaguaaua

SEQ ID NO: 1013694 - RNA, 19 nt, Homo sapiens
gcagcaagauuaaagaaca

SEQ ID NO: 1013695 - RNA, 19 nt, Homo sapiens
gcaagaaguuccagcaucu

SEQ ID NO: 1013696 - RNA, 19 nt, Homo sapiens
gcaaaucaguggcaagaag

SEQ ID NO: 1013697 - RNA, 19 nt, Homo sapiens
ggaagaacugcagaaauua

SEQ ID NO: 1013698 - RNA, 19 nt, Homo sapiens
aaaggcaucugauaaaugu

SEQ ID NO: 1013699 - RNA, 19 nt, Homo sapiens
gaaccaauugaucuucuua

SEQ ID NO: 1013700 - RNA, 19 nt, Homo sapiens
gcaauguguuucuauggaa

SEQ ID NO: 1013701 - RNA, 19 nt, Homo sapiens
ugaaagaggcaauguguuu

SEQ ID NO: 1013702 - RNA, 19 nt, Homo sapiens
caaaugaagccaaacugua

SEQ ID NO: 1013703 - RNA, 19 nt, Homo sapiens
uagaggaauugguugguua

SEQ ID NO: 1013704 - RNA, 19 nt, Homo sapiens
gguugaagcugaagagaau

SEQ ID NO: 1013705 - RNA, 19 nt, Homo sapiens
gagacuaaauuguaaugug

SEQ ID NO: 1013706 - RNA, 19 nt, Homo sapiens
ucagagcaaugcaaaggua

SEQ ID NO: 1013707 - RNA, 19 nt, Homo sapiens
gaaaagaccaugccaacua

SEQ ID NO: 1013708 - RNA, 19 nt, Homo sapiens
gauguuaacuaccaguguu

SEQ ID NO: 1013709 - RNA, 19 nt, Homo sapiens
caacuaccuuuaacagaga

SEQ ID NO: 1013710 - RNA, 19 nt, Homo sapiens
uaucaagcaucuagucauu

SEQ ID NO: 1013711 - RNA, 19 nt, Homo sapiens
cugcagaaauuaagaagaa

SEQ ID NO: 1013712 - RNA, 19 nt, Homo sapiens
ggaaguaauucagcaguuc

SEQ ID NO: 1013713 - RNA, 19 nt, Homo sapiens
ucaaauuucagcagacuua

SEQ ID NO: 1013714 - RNA, 19 nt, Homo sapiens
ucaagcaucuagucauuau

SEQ ID NO: 1013715 - RNA, 19 nt, Homo sapiens
aauguugucuccuuucuaa

SEQ ID NO: 1013716 - RNA, 19 nt, Homo sapiens
gaagaacucgaauauguca

SEQ ID NO: 1013717 - RNA, 19 nt, Homo sapiens
gggcauugauuccaugguu

SEQ ID NO: 1013718 - RNA, 19 nt, Homo sapiens
gagcaagaauauauuggau

SEQ ID NO: 1013719 - RNA, 19 nt, Homo sapiens
gaagcaagauuuccuuucc

SEQ ID NO: 1013720 - RNA, 19 nt, Homo sapiens
ggaacugggucgaauuucu

SEQ ID NO: 1013721 - RNA, 19 nt, Homo sapiens
gaacugcagaaauuaagaa

SEQ ID NO: 1013722 - RNA, 19 nt, Homo sapiens
gagaagggaauaaacagaa

SEQ ID NO: 1013723 - RNA, 19 nt, Homo sapiens
uaacagagaagggaauaaa

SEQ ID NO: 1013724 - RNA, 19 nt, Homo sapiens
gauaggaaagcaaauguug

SEQ ID NO: 1013725 - RNA, 19 nt, Homo sapiens
gguagcaaaugaagccaaa

SEQ ID NO: 1013726 - RNA, 19 nt, Homo sapiens
caacaacagaacagcaaua

SEQ ID NO: 1013727 - RNA, 19 nt, Homo sapiens
aagguacucugcugcuuua

SEQ ID NO: 1013728 - RNA, 19 nt, Homo sapiens
caguuuggaucaagaauug

SEQ ID NO: 1013729 - RNA, 19 nt, Homo sapiens
gaagagaaugacacucaaa

SEQ ID NO: 1013730 - RNA, 19 nt, Homo sapiens
gaacugggucgaauuucuu

SEQ ID NO: 1013731 - RNA, 19 nt, Homo sapiens
ggcauugauuccaugguua

SEQ ID NO: 1013732 - RNA, 19 nt, Homo sapiens
gaguguagcagucaagaaa

SEQ ID NO: 1013733 - RNA, 19 nt, Homo sapiens
gaaaaggcaucugauaaau

SEQ ID NO: 1013734 - RNA, 19 nt, Homo sapiens
gaaaacgugugauaggaaa

SEQ ID NO: 1013735 - RNA, 19 nt, Homo sapiens
gccaaacuguaucuugaaa

SEQ ID NO: 1013736 - RNA, 19 nt, Homo sapiens
uaucagugguagcaaauga

SEQ ID NO: 1013737 - RNA, 19 nt, Homo sapiens
gaugaaagaggcaaugugu

SEQ ID NO: 1013738 - RNA, 19 nt, Homo sapiens
ggaugaacuuucuaaccuu

SEQ ID NO: 1013739 - RNA, 19 nt, Homo sapiens
gaagccaaacuguaucuug

SEQ ID NO: 1013740 - RNA, 19 nt, Homo sapiens
gcaaaugaagccaaacugu

SEQ ID NO: 1013741 - RNA, 19 nt, Homo sapiens
agacuuaccagcauuugua

SEQ ID NO: 1013742 - RNA, 19 nt, Homo sapiens
guagcuugcuuuggcauuu

SEQ ID NO: 1013743 - RNA, 19 nt, Homo sapiens
ucuauggaauggagaaauu

SEQ ID NO: 1013744 - RNA, 19 nt, Homo sapiens
gagcauuucagucaagauu

SEQ ID NO: 1013745 - RNA, 19 nt, Homo sapiens
gaaauccuaucagagcaau

SEQ ID NO: 1013746 - RNA, 19 nt, Homo sapiens
acucgaauaugucacuuaa

SEQ ID NO: 1013747 - RNA, 19 nt, Homo sapiens
aagccaaacuguaucuuga

SEQ ID NO: 1013748 - RNA, 19 nt, Homo sapiens
ggcauuuguuguucuguaa

SEQ ID NO: 1013749 - RNA, 19 nt, Homo sapiens
agaagggaauaaacagaaa

SEQ ID NO: 1013750 - RNA, 19 nt, Homo sapiens
guaauuugggcaagaguuu

SEQ ID NO: 1013751 - RNA, 19 nt, Homo sapiens
gaggcaauguguuucuaug

SEQ ID NO: 1013752 - RNA, 19 nt, Homo sapiens
ucaaccugauuucacauaa

SEQ ID NO: 1013753 - RNA, 19 nt, Homo sapiens
cagaauugaucuuaagucu

SEQ ID NO: 1013754 - RNA, 19 nt, Homo sapiens
ggcaauguguuucuaugga

SEQ ID NO: 1013755 - RNA, 19 nt, Homo sapiens
ggacggcuccaaaucaugu

SEQ ID NO: 1013756 - RNA, 19 nt, Homo sapiens
uaauucagcaguucauuga

SEQ ID NO: 1013757 - RNA, 19 nt, Homo sapiens
guauauaggcaacaacaga

SEQ ID NO: 1013758 - RNA, 19 nt, Homo sapiens
agaaauagucaaccugauu

SEQ ID NO: 1013759 - RNA, 19 nt, Homo sapiens
ugacagaguuauuggugau

SEQ ID NO: 1013760 - RNA, 19 nt, Homo sapiens
ucacuuaauucggccauug

SEQ ID NO: 1013761 - RNA, 19 nt, Homo sapiens
aaaugaagccaaacuguau

SEQ ID NO: 1013762 - RNA, 19 nt, Homo sapiens
uuaauucggccauuggaua

SEQ ID NO: 1013763 - RNA, 19 nt, Homo sapiens
acacaugaaggaaguaauu

SEQ ID NO: 1013764 - RNA, 19 nt, Homo sapiens
cuucaagucuuucuuacug

SEQ ID NO: 1013765 - RNA, 19 nt, Homo sapiens
cagcagacuuaccagcauu

SEQ ID NO: 1013766 - RNA, 19 nt, Homo sapiens
gaauauauuggaugaacug

SEQ ID NO: 1013767 - RNA, 19 nt, Homo sapiens
gcaguuuggaucaagaauu

SEQ ID NO: 1013768 - RNA, 19 nt, Homo sapiens
guugucuccuuucuaaauu

SEQ ID NO: 1013769 - RNA, 19 nt, Homo sapiens
gaacucgaauaugucacuu

SEQ ID NO: 1013770 - RNA, 19 nt, Homo sapiens
cuaauaaacaugucagugu

SEQ ID NO: 1013771 - RNA, 19 nt, Homo sapiens
ugacaguccuaauaaacau

SEQ ID NO: 1013772 - RNA, 19 nt, Homo sapiens
guaauucagcaguucauug

SEQ ID NO: 1013773 - RNA, 19 nt, Homo sapiens
cagcaagauuaaagaacaa

SEQ ID NO: 1013774 - RNA, 19 nt, Homo sapiens
aauaaagguugaagcugaa

SEQ ID NO: 1013775 - RNA, 19 nt, Homo sapiens
caacaaagcuugaacauuu

SEQ ID NO: 1013776 - RNA, 19 nt, Homo sapiens
gaaaggaggugcacuguuc

SEQ ID NO: 1013777 - RNA, 19 nt, Homo sapiens
uaaaggaagugaagaguaa

SEQ ID NO: 1013778 - RNA, 19 nt, Homo sapiens
uauaggaagugcugaauua

SEQ ID NO: 1013779 - RNA, 19 nt, Homo sapiens
gcaaagagcuuggauuucu

SEQ ID NO: 1013780 - RNA, 19 nt, Homo sapiens
ugaaagagcaagcaaguua

SEQ ID NO: 1013781 - RNA, 19 nt, Homo sapiens
gagcuuggauuucuuuaga

SEQ ID NO: 1013782 - RNA, 19 nt, Homo sapiens
gaagugaagaguaaacuaa

SEQ ID NO: 1013783 - RNA, 19 nt, Homo sapiens
gagagauucuugauacauu

SEQ ID NO: 1013784 - RNA, 19 nt, Homo sapiens
gcagagcaauaaugccuuu

SEQ ID NO: 1013785 - RNA, 19 nt, Homo sapiens
ggguuucucugauguauuu

SEQ ID NO: 1013786 - RNA, 19 nt, Homo sapiens
caaauggaaaccaaacuua

SEQ ID NO: 1013787 - RNA, 19 nt, Homo sapiens
gaaagccaaauacaacaua

SEQ ID NO: 1013788 - RNA, 19 nt, Homo sapiens
cauaaaccguccugacaaa

SEQ ID NO: 1013789 - RNA, 19 nt, Homo sapiens
ugacuucuguuuacaaaug

SEQ ID NO: 1013790 - RNA, 19 nt, Homo sapiens
gaaagaagccaaagagacu

SEQ ID NO: 1013791 - RNA, 19 nt, Homo sapiens
uaaccuggcuuuccucugu

SEQ ID NO: 1013792 - RNA, 19 nt, Homo sapiens
gaggauauaugaaaugcau

SEQ ID NO: 1013793 - RNA, 19 nt, Homo sapiens
gaaguagugucauuauguc

SEQ ID NO: 1013794 - RNA, 19 nt, Homo sapiens
aaacacaaauggaaaccaa

SEQ ID NO: 1013795 - RNA, 19 nt, Homo sapiens
uaagccagauuucagauga

SEQ ID NO: 1013796 - RNA, 19 nt, Homo sapiens
gaaguuucccagacugaua

SEQ ID NO: 1013797 - RNA, 19 nt, Homo sapiens
ugaagaugaugaugacauu

SEQ ID NO: 1013798 - RNA, 19 nt, Homo sapiens
uaugggaccuguucuaguu

SEQ ID NO: 1013799 - RNA, 19 nt, Homo sapiens
gaaacacuaagccagauuu

SEQ ID NO: 1013800 - RNA, 19 nt, Homo sapiens
ggaugacauugauuacaaa

SEQ ID NO: 1013801 - RNA, 19 nt, Homo sapiens
caagcaaguuaucuucuga

SEQ ID NO: 1013802 - RNA, 19 nt, Homo sapiens
gcaagcaaguuaucuucug

SEQ ID NO: 1013803 - RNA, 19 nt, Homo sapiens
guuaaugacuucuguuuac

SEQ ID NO: 1013804 - RNA, 19 nt, Homo sapiens
gaaaagagggaaacacuaa

SEQ ID NO: 1013805 - RNA, 19 nt, Homo sapiens
gcuaagaaugcauauguaa

SEQ ID NO: 1013806 - RNA, 19 nt, Homo sapiens
ggagaaagaagggaaagaa

SEQ ID NO: 1013807 - RNA, 19 nt, Homo sapiens
gauuacaaaccuacgaaua

SEQ ID NO: 1013808 - RNA, 19 nt, Homo sapiens
ggaauggcaacucauacua

SEQ ID NO: 1013809 - RNA, 19 nt, Homo sapiens
guaggaauggcaacucaua

SEQ ID NO: 1013810 - RNA, 19 nt, Homo sapiens
caagaaagccaaauacaac

SEQ ID NO: 1013811 - RNA, 19 nt, Homo sapiens
uguaugccuuugcuauuua

SEQ ID NO: 1013812 - RNA, 19 nt, Homo sapiens
aaagcucucuuaauggaaa

SEQ ID NO: 1013813 - RNA, 19 nt, Homo sapiens
gagcaugaacugaucaaga

SEQ ID NO: 1013814 - RNA, 19 nt, Homo sapiens
uggcaacucauacuauuua

SEQ ID NO: 1013815 - RNA, 19 nt, Homo sapiens
uaggagagauucuugauac

SEQ ID NO: 1013816 - RNA, 19 nt, Homo sapiens
ugaaauggacuuacuagga

SEQ ID NO: 1013817 - RNA, 19 nt, Homo sapiens
ccaagaaagccaaauacaa

SEQ ID NO: 1013818 - RNA, 19 nt, Homo sapiens
ggacuuacuaggagagauu

SEQ ID NO: 1013819 - RNA, 19 nt, Homo sapiens
gaaagagcaagcaaguuau

SEQ ID NO: 1013820 - RNA, 19 nt, Homo sapiens
gaggucauaucaacaaugg

SEQ ID NO: 1013821 - RNA, 19 nt, Homo sapiens
gagggaacccgaggucaua

SEQ ID NO: 1013822 - RNA, 19 nt, Homo sapiens
gaauggcaacucauacuau

SEQ ID NO: 1013823 - RNA, 19 nt, Homo sapiens
guacggacagcauauaaau

SEQ ID NO: 1013824 - RNA, 19 nt, Homo sapiens
uaugacaucugacuuccaa

SEQ ID NO: 1013825 - RNA, 19 nt, Homo sapiens
uggaugacauugauuacaa

SEQ ID NO: 1013826 - RNA, 19 nt, Homo sapiens
ggaagugaagaguaaacua

SEQ ID NO: 1013827 - RNA, 19 nt, Homo sapiens
uaucaacaaugggugcaua

SEQ ID NO: 1013828 - RNA, 19 nt, Homo sapiens
ggauauaugaaaugcauug

SEQ ID NO: 1013829 - RNA, 19 nt, Homo sapiens
aaacuagccugaagcugau

SEQ ID NO: 1013830 - RNA, 19 nt, Homo sapiens
gcacacacagcucagauca

SEQ ID NO: 1013831 - RNA, 19 nt, Homo sapiens
gugcugaauuacaauguga

SEQ ID NO: 1013832 - RNA, 19 nt, Homo sapiens
aggaagugcugaauuacaa

SEQ ID NO: 1013833 - RNA, 19 nt, Homo sapiens
gaccuguucuaguucugua

SEQ ID NO: 1013834 - RNA, 19 nt, Homo sapiens
acacuuaccuuucauucag

SEQ ID NO: 1013835 - RNA, 19 nt, Homo sapiens
gaagcugaugaaacuguua

SEQ ID NO: 1013836 - RNA, 19 nt, Homo sapiens
aagcuucuauggagacauu

SEQ ID NO: 1013837 - RNA, 19 nt, Homo sapiens
gacauugauuacaaaccua

SEQ ID NO: 1013838 - RNA, 19 nt, Homo sapiens
acggacagcauauaaauuu

SEQ ID NO: 1013839 - RNA, 19 nt, Homo sapiens
aauggcaacucauacuauu

SEQ ID NO: 1013840 - RNA, 19 nt, Homo sapiens
ggaaaccaaacuuaaaucu

SEQ ID NO: 1013841 - RNA, 19 nt, Homo sapiens
ugaaguagugucauuaugu

SEQ ID NO: 1013842 - RNA, 19 nt, Homo sapiens
gagcaagcaaguuaucuuc

SEQ ID NO: 1013843 - RNA, 19 nt, Homo sapiens
caacacagcaaugaccaaa

SEQ ID NO: 1013844 - RNA, 19 nt, Homo sapiens
cuaaucugguugagcauga

SEQ ID NO: 1013845 - RNA, 19 nt, Homo sapiens
cuacuauacuaaucugguu

SEQ ID NO: 1013846 - RNA, 19 nt, Homo sapiens
caugagauuucccaguguu

SEQ ID NO: 1013847 - RNA, 19 nt, Homo sapiens
ucuagugguuugacagauu

SEQ ID NO: 1013848 - RNA, 19 nt, Homo sapiens
ggauuucuuuagaucaaug

SEQ ID NO: 1013849 - RNA, 19 nt, Homo sapiens
cugcaaagagcuuggauuu

SEQ ID NO: 1013850 - RNA, 19 nt, Homo sapiens
cuaaaggaagugaagagua

SEQ ID NO: 1013851 - RNA, 19 nt, Homo sapiens
gaaacuguuaacccacuaa

SEQ ID NO: 1013852 - RNA, 19 nt, Homo sapiens
gccugaagcugaugaaacu

SEQ ID NO: 1013853 - RNA, 19 nt, Homo sapiens
ucucugauguauuugaaga

SEQ ID NO: 1013854 - RNA, 19 nt, Homo sapiens
ggcaacucauacuauuuaa

SEQ ID NO: 1013855 - RNA, 19 nt, Homo sapiens
ggaaacacuaagccagauu

SEQ ID NO: 1013856 - RNA, 19 nt, Homo sapiens
gaagcggguuuccucuagu

SEQ ID NO: 1013857 - RNA, 19 nt, Homo sapiens
guacaauauacaccaguuu

SEQ ID NO: 1013858 - RNA, 19 nt, Homo sapiens
caaggaaaaugaagaagau

SEQ ID NO: 1013859 - RNA, 19 nt, Homo sapiens
augcaaagcugggacuaaa

SEQ ID NO: 1013860 - RNA, 19 nt, Homo sapiens
ucagugaaauauaggaagu

SEQ ID NO: 1013861 - RNA, 19 nt, Homo sapiens
gcaugaacugaucaagaua

SEQ ID NO: 1013862 - RNA, 19 nt, Homo sapiens
guauugaccaugagauuuc

SEQ ID NO: 1013863 - RNA, 19 nt, Homo sapiens
aaguauguauugaccauga

SEQ ID NO: 1013864 - RNA, 19 nt, Homo sapiens
caucugacuuccaacaaag

SEQ ID NO: 1013865 - RNA, 19 nt, Homo sapiens
guucuaguucuguacaaua

SEQ ID NO: 1013866 - RNA, 19 nt, Homo sapiens
cuguaugccuuugcuauuu

SEQ ID NO: 1013867 - RNA, 19 nt, Homo sapiens
gaagugcugaauuacaaug

SEQ ID NO: 1013868 - RNA, 19 nt, Homo sapiens
acuuaaaucuugcauccaa

SEQ ID NO: 1013869 - RNA, 19 nt, Homo sapiens
acaucugacuuccaacaaa

SEQ ID NO: 1013870 - RNA, 19 nt, Homo sapiens
gcaaagcugggacuaaagg

SEQ ID NO: 1013871 - RNA, 19 nt, Homo sapiens
caaaugagacacucuaacg

SEQ ID NO: 1013872 - RNA, 19 nt, Homo sapiens
acuguuaacccacuaauug

SEQ ID NO: 1013873 - RNA, 19 nt, Homo sapiens
agcaugaacugaucaagau

SEQ ID NO: 1013874 - RNA, 19 nt, Homo sapiens
gaauucuacugugcuuuua

SEQ ID NO: 1013875 - RNA, 19 nt, Homo sapiens
guucaucucuuccuaguaa

SEQ ID NO: 1013876 - RNA, 19 nt, Homo sapiens
gaagagaaacacauugaaa

SEQ ID NO: 1013877 - RNA, 19 nt, Homo sapiens
gaagauagucgucuaaagu

SEQ ID NO: 1013878 - RNA, 19 nt, Homo sapiens
caccagaugugcaggguua

SEQ ID NO: 1013879 - RNA, 19 nt, Homo sapiens
uaaaguaguugcaagaaag

SEQ ID NO: 1013880 - RNA, 19 nt, Homo sapiens
cauauuugcugaaaccauu

SEQ ID NO: 1013881 - RNA, 19 nt, Homo sapiens
caaguucacaccuuucaua

SEQ ID NO: 1013882 - RNA, 19 nt, Homo sapiens
gaagaucuccagagucguu

SEQ ID NO: 1013883 - RNA, 19 nt, Homo sapiens
ggaagauagucgucuaaag

SEQ ID NO: 1013884 - RNA, 19 nt, Homo sapiens
acaaauaacggacuuucua

SEQ ID NO: 1013885 - RNA, 19 nt, Homo sapiens
agaggaauguaucaucuuu

SEQ ID NO: 1013886 - RNA, 19 nt, Homo sapiens
ucaaucuucuggcucauuu

SEQ ID NO: 1013887 - RNA, 19 nt, Homo sapiens
gcacauacacaaauaaacu

SEQ ID NO: 1013888 - RNA, 19 nt, Homo sapiens
gacaccauguagagaauuu

SEQ ID NO: 1013889 - RNA, 19 nt, Homo sapiens
ccuaguguguccaccuuua

SEQ ID NO: 1013890 - RNA, 19 nt, Homo sapiens
guagaggaauguaucaucu

SEQ ID NO: 1013891 - RNA, 19 nt, Homo sapiens
cgucuaaaguucaaucuuc

SEQ ID NO: 1013892 - RNA, 19 nt, Homo sapiens
gagaaacacauugaaauca

SEQ ID NO: 1013893 - RNA, 19 nt, Homo sapiens
cauugcacauacacaaaua

SEQ ID NO: 1013894 - RNA, 19 nt, Homo sapiens
gcauaaaguaguugcaaga

SEQ ID NO: 1013895 - RNA, 19 nt, Homo sapiens
agagggcacugucaacuug

SEQ ID NO: 1013896 - RNA, 19 nt, Homo sapiens
gaaacacauugaaaucacu

SEQ ID NO: 1013897 - RNA, 19 nt, Homo sapiens
aagauagaguuaugcauug

SEQ ID NO: 1013898 - RNA, 19 nt, Homo sapiens
caaauaacggacuuucuau

SEQ ID NO: 1013899 - RNA, 19 nt, Homo sapiens
gaaauacuaccagaacugu

SEQ ID NO: 1013900 - RNA, 19 nt, Homo sapiens
ggaagagaaacacauugaa

SEQ ID NO: 1013901 - RNA, 19 nt, Homo sapiens
ucuauaaugucccuauuca

SEQ ID NO: 1013902 - RNA, 19 nt, Homo sapiens
guucacaccuuucauaagc

SEQ ID NO: 1013903 - RNA, 19 nt, Homo sapiens
gcccguggaucucaucgaa

SEQ ID NO: 1013904 - RNA, 19 nt, Homo sapiens
gaaagagccagugguuguu

SEQ ID NO: 1013905 - RNA, 19 nt, Homo sapiens
ggaggacauugcaaguuca

SEQ ID NO: 1013906 - RNA, 19 nt, Homo sapiens
agagucguuuggaaucuua

SEQ ID NO: 1013907 - RNA, 19 nt, Homo sapiens
uaaugucccuauucaagau

SEQ ID NO: 1013908 - RNA, 19 nt, Homo sapiens
cguuuggaaucuuacguua

SEQ ID NO: 1013909 - RNA, 19 nt, Homo sapiens
ggacaaauaacggacuuuc

SEQ ID NO: 1013910 - RNA, 19 nt, Homo sapiens
gcaauucggaagagaaaca

SEQ ID NO: 1013911 - RNA, 19 nt, Homo sapiens
gaaaaucacuuggaguuac

SEQ ID NO: 1013912 - RNA, 19 nt, Homo sapiens
agaaagagccagugguugu

SEQ ID NO: 1013913 - RNA, 19 nt, Homo sapiens
gcaagacaucucccuggaa

SEQ ID NO: 1013914 - RNA, 19 nt, Homo sapiens
gauagucgucuaaaguuca

SEQ ID NO: 1013915 - RNA, 19 nt, Homo sapiens
gggacaccauguagagaau

SEQ ID NO: 1013916 - RNA, 19 nt, Homo sapiens
ccguggaucucaucgaaga

SEQ ID NO: 1013917 - RNA, 19 nt, Homo sapiens
gugcaggguuagagauguu

SEQ ID NO: 1013918 - RNA, 19 nt, Homo sapiens
gcauugcacauacacaaau

SEQ ID NO: 1013919 - RNA, 19 nt, Homo sapiens
gcacugucaacuuggguuu

SEQ ID NO: 1013920 - RNA, 19 nt, Homo sapiens
gagagggcacugucaacuu

SEQ ID NO: 1013921 - RNA, 19 nt, Homo sapiens
uauaaugucccuauucaag

SEQ ID NO: 1013922 - RNA, 19 nt, Homo sapiens
cggaagagaaacacauuga

SEQ ID NO: 1013923 - RNA, 19 nt, Homo sapiens
uaacggacuuucuauuuuc

SEQ ID NO: 1013924 - RNA, 19 nt, Homo sapiens
gauacuuuaccaugugaaa

SEQ ID NO: 1013925 - RNA, 19 nt, Homo sapiens
ccuggaagauagucgucua

SEQ ID NO: 1013926 - RNA, 19 nt, Homo sapiens
aggaggacauugcaaguuc

SEQ ID NO: 1013927 - RNA, 19 nt, Homo sapiens
agagaaagagccagugguu

SEQ ID NO: 1013928 - RNA, 19 nt, Homo sapiens
cgaucugugucgggcauua

SEQ ID NO: 1013929 - RNA, 19 nt, Homo sapiens
ccuaguaauuggcaagaca

SEQ ID NO: 1013930 - RNA, 19 nt, Homo sapiens
ugagacaguagaagagaaa

SEQ ID NO: 1013931 - RNA, 19 nt, Homo sapiens
acugucaacuuggguuuaa

SEQ ID NO: 1013932 - RNA, 19 nt, Homo sapiens
guaguugcaagaaaguauu

SEQ ID NO: 1013933 - RNA, 19 nt, Homo sapiens
gccagugguuguugagaca

SEQ ID NO: 1013934 - RNA, 19 nt, Homo sapiens
agagaaacacauugaaauc

SEQ ID NO: 1013935 - RNA, 19 nt, Homo sapiens
aagauagucgucuaaaguu

SEQ ID NO: 1013936 - RNA, 19 nt, Homo sapiens
cuguuaggauucauaucua

SEQ ID NO: 1013937 - RNA, 19 nt, Homo sapiens
acauugaaaucacugucuu

SEQ ID NO: 1013938 - RNA, 19 nt, Homo sapiens
cauaaaguaguugcaagaa

SEQ ID NO: 1013939 - RNA, 19 nt, Homo sapiens
ugaaauacuaccagaacug

SEQ ID NO: 1013940 - RNA, 19 nt, Homo sapiens
agaaacacauugaaaucac

SEQ ID NO: 1013941 - RNA, 19 nt, Homo sapiens
gcauacacaccaccugaag

SEQ ID NO: 1013942 - RNA, 19 nt, Homo sapiens
gggcugcucauuagaucuu

SEQ ID NO: 1013943 - RNA, 19 nt, Homo sapiens
ggacaccauguagagaauu

SEQ ID NO: 1013944 - RNA, 19 nt, Homo sapiens
uaagcaauucggaagagaa

SEQ ID NO: 1013945 - RNA, 19 nt, Homo sapiens
acaccuuucauaagcauaa

SEQ ID NO: 1013946 - RNA, 19 nt, Homo sapiens
ucacaccuuucauaagcau

SEQ ID NO: 1013947 - RNA, 19 nt, Homo sapiens
agauagucgucuaaaguuc

SEQ ID NO: 1013948 - RNA, 19 nt, Homo sapiens
cagagucguuuggaaucuu

SEQ ID NO: 1013949 - RNA, 19 nt, Homo sapiens
gugaaauacuaccagaacu

SEQ ID NO: 1013950 - RNA, 19 nt, Homo sapiens
aagcaauucggaagagaaa

SEQ ID NO: 1013951 - RNA, 19 nt, Homo sapiens
uuacgaagccgagcauaca

SEQ ID NO: 1013952 - RNA, 19 nt, Homo sapiens
cuaagcaauucggaagaga

SEQ ID NO: 1013953 - RNA, 19 nt, Homo sapiens
ggcauuaccagaagagucu

SEQ ID NO: 1013954 - RNA, 19 nt, Homo sapiens
cauugcaaguucacaccuu

SEQ ID NO: 1013955 - RNA, 19 nt, Homo sapiens
aagagccagugguuguuga

SEQ ID NO: 1013956 - RNA, 19 nt, Homo sapiens
guaauuggcaagacaucuc

SEQ ID NO: 1013957 - RNA, 19 nt, Homo sapiens
ccagagucguuuggaaucu

SEQ ID NO: 1013958 - RNA, 19 nt, Homo sapiens
uuugauacuuuaccaugug

SEQ ID NO: 1013959 - RNA, 19 nt, Homo sapiens
cauugaaaucacugucuuu

SEQ ID NO: 1013960 - RNA, 19 nt, Homo sapiens
auaaugucccuauucaaga

SEQ ID NO: 1013961 - RNA, 19 nt, Homo sapiens
gucuaaaguucaaucuucu

SEQ ID NO: 1013962 - RNA, 19 nt, Homo sapiens
auacacaccaccugaagau

SEQ ID NO: 1013963 - RNA, 19 nt, Homo sapiens
guuuggaaucuuacguuaa

SEQ ID NO: 1013964 - RNA, 19 nt, Homo sapiens
ccuguuaggauucauaucu

SEQ ID NO: 1013965 - RNA, 19 nt, Homo sapiens
caggaggacauugcaaguu

SEQ ID NO: 1013966 - RNA, 19 nt, Homo sapiens
uaagacaggaggacauugc

SEQ ID NO: 1013967 - RNA, 19 nt, Homo sapiens
gacaaauaacggacuuucu

SEQ ID NO: 1013968 - RNA, 19 nt, Homo sapiens
acacaccaccugaagaucu

SEQ ID NO: 1013969 - RNA, 19 nt, Homo sapiens
ggucauguagucccuaacu

SEQ ID NO: 1013970 - RNA, 19 nt, Homo sapiens
ugggucauguagucccuaa

SEQ ID NO: 1013971 - RNA, 19 nt, Homo sapiens
caucucuuccuaguaauug

SEQ ID NO: 1013972 - RNA, 19 nt, Homo sapiens
guauguuguguauuacuga

SEQ ID NO: 1013973 - RNA, 19 nt, Homo sapiens
gaacauagauggcugaaga

SEQ ID NO: 1013974 - RNA, 19 nt, Homo sapiens
caaauaauguggagauguu

SEQ ID NO: 1013975 - RNA, 19 nt, Homo sapiens
gagcagcuguccucuuuga

SEQ ID NO: 1013976 - RNA, 19 nt, Homo sapiens
gagacaaccuugacagaug

SEQ ID NO: 1013977 - RNA, 19 nt, Homo sapiens
aaagguggcugaaguggaa

SEQ ID NO: 1013978 - RNA, 19 nt, Homo sapiens
gugaagccauuuccaaaga

SEQ ID NO: 1013979 - RNA, 19 nt, Homo sapiens
gaagguguuugcccucaug

SEQ ID NO: 1013980 - RNA, 19 nt, Homo sapiens
ggaccugagugaagccauu

SEQ ID NO: 1013981 - RNA, 19 nt, Homo sapiens
ggaggauccuggagaagug

SEQ ID NO: 1013982 - RNA, 19 nt, Homo sapiens
auagauggcugaagacaga

SEQ ID NO: 1013983 - RNA, 19 nt, Homo sapiens
agaggaagcuguuugucaa

SEQ ID NO: 1013984 - RNA, 19 nt, Homo sapiens
ggaagcagcugagcaagac

SEQ ID NO: 1013985 - RNA, 19 nt, Homo sapiens
ggagauguuuccaccuuca

SEQ ID NO: 1013986 - RNA, 19 nt, Homo sapiens
aaauaaagacgacuacaga

SEQ ID NO: 1013987 - RNA, 19 nt, Homo sapiens
gcugacaguuggagggaaa

SEQ ID NO: 1013988 - RNA, 19 nt, Homo sapiens
ggaagcuguuugucaagga

SEQ ID NO: 1013989 - RNA, 19 nt, Homo sapiens
aggaggagcugaccaggaa

SEQ ID NO: 1013990 - RNA, 19 nt, Homo sapiens
aggaggcucuuuccaguuu

SEQ ID NO: 1013991 - RNA, 19 nt, Homo sapiens
gagugaagccauuuccaaa

SEQ ID NO: 1013992 - RNA, 19 nt, Homo sapiens
cuagagccuucaaauaaug

SEQ ID NO: 1013993 - RNA, 19 nt, Homo sapiens
gugcagagccucacacaca

SEQ ID NO: 1013994 - RNA, 19 nt, Homo sapiens
gcuaagcagcugacaguug

SEQ ID NO: 1013995 - RNA, 19 nt, Homo sapiens
ucuagagccuucaaauaau

SEQ ID NO: 1013996 - RNA, 19 nt, Homo sapiens
aaucuagagccuucaaaua

SEQ ID NO: 1013997 - RNA, 19 nt, Homo sapiens
gcaagguccucaccauucg

SEQ ID NO: 1013998 - RNA, 19 nt, Homo sapiens
gaaucuagagccuucaaau

SEQ ID NO: 1013999 - RNA, 19 nt, Homo sapiens
gcaagacccaggaagacuu

SEQ ID NO: 1014000 - RNA, 19 nt, Homo sapiens
gcugagggcuuggagaagu

SEQ ID NO: 1014001 - RNA, 19 nt, Homo sapiens
ccaccuggcucucagacau

SEQ ID NO: 1014002 - RNA, 19 nt, Homo sapiens
caacaaccgacucagcuau

SEQ ID NO: 1014003 - RNA, 19 nt, Homo sapiens
gaggcucuuuccaguuuga

SEQ ID NO: 1014004 - RNA, 19 nt, Homo sapiens
gaccucaagugaccaugug

SEQ ID NO: 1014005 - RNA, 19 nt, Homo sapiens
uuucaacucugccaagaau

SEQ ID NO: 1014006 - RNA, 19 nt, Homo sapiens
ggagacaaccuugacagau

SEQ ID NO: 1014007 - RNA, 19 nt, Homo sapiens
ggucuccucucccguuaca

SEQ ID NO: 1014008 - RNA, 19 nt, Homo sapiens
ccugauugcucgaaagcuu

SEQ ID NO: 1014009 - RNA, 19 nt, Homo sapiens
gagcggagccaggaacuca

SEQ ID NO: 1014010 - RNA, 19 nt, Homo sapiens
gucagcagcucucagaucu

SEQ ID NO: 1014011 - RNA, 19 nt, Homo sapiens
ggcaagcccugcaagaaaa

SEQ ID NO: 1014012 - RNA, 19 nt, Homo sapiens
ucucuguccugcucgauga

SEQ ID NO: 1014013 - RNA, 19 nt, Homo sapiens
ucagagaggcggcuagaca

SEQ ID NO: 1014014 - RNA, 19 nt, Homo sapiens
aucuagagccuucaaauaa

SEQ ID NO: 1014015 - RNA, 19 nt, Homo sapiens
aacgggauguuuccaguga

SEQ ID NO: 1014016 - RNA, 19 nt, Homo sapiens
gcugaagacagaaucuaga

SEQ ID NO: 1014017 - RNA, 19 nt, Homo sapiens
uaaauaaagacgacuacag

SEQ ID NO: 1014018 - RNA, 19 nt, Homo sapiens
agaagucucugaguagucu

SEQ ID NO: 1014019 - RNA, 19 nt, Homo sapiens
ccaccagggaguccauaaa

SEQ ID NO: 1014020 - RNA, 19 nt, Homo sapiens
gacccugguugagaaucua

SEQ ID NO: 1014021 - RNA, 19 nt, Homo sapiens
gaggaggcucuuuccaguu

SEQ ID NO: 1014022 - RNA, 19 nt, Homo sapiens
ugagugaagccauuuccaa

SEQ ID NO: 1014023 - RNA, 19 nt, Homo sapiens
aaggucuccucucccguua

SEQ ID NO: 1014024 - RNA, 19 nt, Homo sapiens
ugagcaagacccaggaaga

SEQ ID NO: 1014025 - RNA, 19 nt, Homo sapiens
ggaggcucuuuccaguuug

SEQ ID NO: 1014026 - RNA, 19 nt, Homo sapiens
gcuaucaagaugucucaga

SEQ ID NO: 1014027 - RNA, 19 nt, Homo sapiens
uggauaagaagaaaucugu

SEQ ID NO: 1014028 - RNA, 19 nt, Homo sapiens
uuccuucccuacuggauaa

SEQ ID NO: 1014029 - RNA, 19 nt, Homo sapiens
gaaccgccuggaugcagaa

SEQ ID NO: 1014030 - RNA, 19 nt, Homo sapiens
uucagaggcugcaccaaga

SEQ ID NO: 1014031 - RNA, 19 nt, Homo sapiens
acccagagaccucaaguga

SEQ ID NO: 1014032 - RNA, 19 nt, Homo sapiens
ucaacaaccgacucagcua

SEQ ID NO: 1014033 - RNA, 19 nt, Homo sapiens
ggaacuggagcgacagaag

SEQ ID NO: 1014034 - RNA, 19 nt, Homo sapiens
aagaggaagcuguuuguca

SEQ ID NO: 1014035 - RNA, 19 nt, Homo sapiens
ccuacuggauaagaagaaa

SEQ ID NO: 1014036 - RNA, 19 nt, Homo sapiens
gagcuagagagggauaaga

SEQ ID NO: 1014037 - RNA, 19 nt, Homo sapiens
gggaggauccuggagaagu

SEQ ID NO: 1014038 - RNA, 19 nt, Homo sapiens
uucagcaucugcaccugua

SEQ ID NO: 1014039 - RNA, 19 nt, Homo sapiens
cagaggaggcugccagucu

SEQ ID NO: 1014040 - RNA, 19 nt, Homo sapiens
ggagcaacucucagacaca

SEQ ID NO: 1014041 - RNA, 19 nt, Homo sapiens
gagcaagacccaggaagac

SEQ ID NO: 1014042 - RNA, 19 nt, Homo sapiens
cugggaggauccuggagaa

SEQ ID NO: 1014043 - RNA, 19 nt, Homo sapiens
ucaaauaauguggagaugu

SEQ ID NO: 1014044 - RNA, 19 nt, Homo sapiens
ugaagccauuuccaaagag

SEQ ID NO: 1014045 - RNA, 19 nt, Homo sapiens
gaccugagugaagccauuu

SEQ ID NO: 1014046 - RNA, 19 nt, Homo sapiens
aagaaaagguggcugaagu

SEQ ID NO: 1014047 - RNA, 19 nt, Homo sapiens
aggagucccuggcuagcuu

SEQ ID NO: 1014048 - RNA, 19 nt, Homo sapiens
gcuaugcuguccgcaaggu

SEQ ID NO: 1014049 - RNA, 19 nt, Homo sapiens
gcugaggcuuguggucaau

SEQ ID NO: 1014050 - RNA, 19 nt, Homo sapiens
cgcaagguccucaccauuc

SEQ ID NO: 1014051 - RNA, 19 nt, Homo sapiens
cggaagcagcugagcaaga

SEQ ID NO: 1014052 - RNA, 19 nt, Homo sapiens
ccgccuggaugcagaacug

SEQ ID NO: 1014053 - RNA, 19 nt, Homo sapiens
ccgcaagguccucaccauu

SEQ ID NO: 1014054 - RNA, 19 nt, Homo sapiens
gguugagaaucuaagaaaa

SEQ ID NO: 1014055 - RNA, 19 nt, Homo sapiens
aagcagcagcgacuguuga

SEQ ID NO: 1014056 - RNA, 19 nt, Homo sapiens
caagcagcagcgacuguug

SEQ ID NO: 1014057 - RNA, 19 nt, Homo sapiens
acacagagaggaggcugaa

SEQ ID NO: 1014058 - RNA, 19 nt, Homo sapiens
agaccaccauggcuaaggu

SEQ ID NO: 1014059 - RNA, 19 nt, Homo sapiens
gcagagccucacacacauc

SEQ ID NO: 1014060 - RNA, 19 nt, Homo sapiens
ugguugagaaucuaagaaa

SEQ ID NO: 1014061 - RNA, 19 nt, Homo sapiens
ugacccugguugagaaucu

SEQ ID NO: 1014062 - RNA, 19 nt, Homo sapiens
ggagcaagcuuguaaauau

SEQ ID NO: 1014063 - RNA, 19 nt, Homo sapiens
gaagauacaugagggcuua

SEQ ID NO: 1014064 - RNA, 19 nt, Homo sapiens
guaaauaucuugaggacuu

SEQ ID NO: 1014065 - RNA, 19 nt, Homo sapiens
gaagauaucauucgaugua

SEQ ID NO: 1014066 - RNA, 19 nt, Homo sapiens
gaagaaugaucgagacaaa

SEQ ID NO: 1014067 - RNA, 19 nt, Homo sapiens
ggaaaggaaugaaacugua

SEQ ID NO: 1014068 - RNA, 19 nt, Homo sapiens
cuacuuaccuagcugauua

SEQ ID NO: 1014069 - RNA, 19 nt, Homo sapiens
ugacagagcugguacaaau

SEQ ID NO: 1014070 - RNA, 19 nt, Homo sapiens
ggaauucaaucaugucuga

SEQ ID NO: 1014071 - RNA, 19 nt, Homo sapiens
caacagaaauagacgauau

SEQ ID NO: 1014072 - RNA, 19 nt, Homo sapiens
gauaauugcuguccuuaga

SEQ ID NO: 1014073 - RNA, 19 nt, Homo sapiens
gaaauagacgauaugcuua

SEQ ID NO: 1014074 - RNA, 19 nt, Homo sapiens
aaacagaaguugauagaga

SEQ ID NO: 1014075 - RNA, 19 nt, Homo sapiens
gaauaugcaugaaacaguu

SEQ ID NO: 1014076 - RNA, 19 nt, Homo sapiens
gaucuuaacuguucaggau

SEQ ID NO: 1014077 - RNA, 19 nt, Homo sapiens
gaacauggcccucucaaag

SEQ ID NO: 1014078 - RNA, 19 nt, Homo sapiens
gaaacaagcaagacuggua

SEQ ID NO: 1014079 - RNA, 19 nt, Homo sapiens
gguagaagaucacauuuua

SEQ ID NO: 1014080 - RNA, 19 nt, Homo sapiens
gaaacaagccaaaccaaau

SEQ ID NO: 1014081 - RNA, 19 nt, Homo sapiens
cuacuugggugguuuaauu

SEQ ID NO: 1014082 - RNA, 19 nt, Homo sapiens
aaacacugcuuaagaaaug

SEQ ID NO: 1014083 - RNA, 19 nt, Homo sapiens
uuacagaacuccuuaaagu

SEQ ID NO: 1014084 - RNA, 19 nt, Homo sapiens
gaaguuuggugaaugguau

SEQ ID NO: 1014085 - RNA, 19 nt, Homo sapiens
gauuaugacuggacaaugu

SEQ ID NO: 1014086 - RNA, 19 nt, Homo sapiens
ggaaugaaacuguauugaa

SEQ ID NO: 1014087 - RNA, 19 nt, Homo sapiens
caugagggcuuaaacaaga

SEQ ID NO: 1014088 - RNA, 19 nt, Homo sapiens
caccggagcucaacagaaa

SEQ ID NO: 1014089 - RNA, 19 nt, Homo sapiens
guauauggcuuuggaauuc

SEQ ID NO: 1014090 - RNA, 19 nt, Homo sapiens
gcaaguauuggucaugaua

SEQ ID NO: 1014091 - RNA, 19 nt, Homo sapiens
uaacuuagaugucauacag

SEQ ID NO: 1014092 - RNA, 19 nt, Homo sapiens
gcagaaggagaaauauaua

SEQ ID NO: 1014093 - RNA, 19 nt, Homo sapiens
gaugaaggauacuagcaaa

SEQ ID NO: 1014094 - RNA, 19 nt, Homo sapiens
gagcaaguauuggucauga

SEQ ID NO: 1014095 - RNA, 19 nt, Homo sapiens
gcaaauuucccuuucaaga

SEQ ID NO: 1014096 - RNA, 19 nt, Homo sapiens
caaaugcgcacaagaaguu

SEQ ID NO: 1014097 - RNA, 19 nt, Homo sapiens
ggaaacaagccaaaccaaa

SEQ ID NO: 1014098 - RNA, 19 nt, Homo sapiens
caauauauuugcucaguuc

SEQ ID NO: 1014099 - RNA, 19 nt, Homo sapiens
cacaagaaguuuauggaaa

SEQ ID NO: 1014100 - RNA, 19 nt, Homo sapiens
gaagagcuagugguuauuu

SEQ ID NO: 1014101 - RNA, 19 nt, Homo sapiens
ggagaaauauauaccaaac

SEQ ID NO: 1014102 - RNA, 19 nt, Homo sapiens
ccaagaaacuguucauacu

SEQ ID NO: 1014103 - RNA, 19 nt, Homo sapiens
uaagagaccaauacaauga

SEQ ID NO: 1014104 - RNA, 19 nt, Homo sapiens
acaguaagcugaaagaaca

SEQ ID NO: 1014105 - RNA, 19 nt, Homo sapiens
caauagagaagauacauga

SEQ ID NO: 1014106 - RNA, 19 nt, Homo sapiens
ggauuggucuacuuaccua

SEQ ID NO: 1014107 - RNA, 19 nt, Homo sapiens
gaaauaagagaccaauaca

SEQ ID NO: 1014108 - RNA, 19 nt, Homo sapiens
gcagagaaauauuacaacu

SEQ ID NO: 1014109 - RNA, 19 nt, Homo sapiens
gcagccagcuucuaaguac

SEQ ID NO: 1014110 - RNA, 19 nt, Homo sapiens
ugaaacaguugauggcuau

SEQ ID NO: 1014111 - RNA, 19 nt, Homo sapiens
gcacaagaaguuuauggaa

SEQ ID NO: 1014112 - RNA, 19 nt, Homo sapiens
cauacagugugaauuguuu

SEQ ID NO: 1014113 - RNA, 19 nt, Homo sapiens
uggaagagcuagugguuau

SEQ ID NO: 1014114 - RNA, 19 nt, Homo sapiens
gagcaagcuuguaaauauc

SEQ ID NO: 1014115 - RNA, 19 nt, Homo sapiens
acagaacuccuuaaaguaa

SEQ ID NO: 1014116 - RNA, 19 nt, Homo sapiens
gauuuaggccuguaagaaa

SEQ ID NO: 1014117 - RNA, 19 nt, Homo sapiens
aaagcugccugaaaucaaa

SEQ ID NO: 1014118 - RNA, 19 nt, Homo sapiens
agaagcaucuuucaagugu

SEQ ID NO: 1014119 - RNA, 19 nt, Homo sapiens
caagaaacuguucauacua

SEQ ID NO: 1014120 - RNA, 19 nt, Homo sapiens
cuugaggacuuuauaacua

SEQ ID NO: 1014121 - RNA, 19 nt, Homo sapiens
aaaguuagaugcuuguauc

SEQ ID NO: 1014122 - RNA, 19 nt, Homo sapiens
gaauucagcagagaaauau

SEQ ID NO: 1014123 - RNA, 19 nt, Homo sapiens
ccacacagaagauaucauu

SEQ ID NO: 1014124 - RNA, 19 nt, Homo sapiens
uagcagauuucaguacuuu

SEQ ID NO: 1014125 - RNA, 19 nt, Homo sapiens
ucagguuacuuucuucaaa

SEQ ID NO: 1014126 - RNA, 19 nt, Homo sapiens
ggcauacacugaugaacuu

SEQ ID NO: 1014127 - RNA, 19 nt, Homo sapiens
aaacauaugccucuacuca

SEQ ID NO: 1014128 - RNA, 19 nt, Homo sapiens
uagacgauaugcuuagaaa

SEQ ID NO: 1014129 - RNA, 19 nt, Homo sapiens
gaaacacugcuuaagaaau

SEQ ID NO: 1014130 - RNA, 19 nt, Homo sapiens
gaaaggaaugaaacuguau

SEQ ID NO: 1014131 - RNA, 19 nt, Homo sapiens
ccaaauggcaauauaaauc

SEQ ID NO: 1014132 - RNA, 19 nt, Homo sapiens
gggaaauagacaaaucuua

SEQ ID NO: 1014133 - RNA, 19 nt, Homo sapiens
gauagagacagucgugaaa

SEQ ID NO: 1014134 - RNA, 19 nt, Homo sapiens
aagcaucuuucaaguguuu

SEQ ID NO: 1014135 - RNA, 19 nt, Homo sapiens
gaacuuugaguagcuguuu

SEQ ID NO: 1014136 - RNA, 19 nt, Homo sapiens
cagcaaauuucccuuucaa

SEQ ID NO: 1014137 - RNA, 19 nt, Homo sapiens
aaagauaauugcuguccuu

SEQ ID NO: 1014138 - RNA, 19 nt, Homo sapiens
guugauggcuauagaagau

SEQ ID NO: 1014139 - RNA, 19 nt, Homo sapiens
gcagauuucaguacuuuau

SEQ ID NO: 1014140 - RNA, 19 nt, Homo sapiens
agaaauagacgauaugcuu

SEQ ID NO: 1014141 - RNA, 19 nt, Homo sapiens
uucaggaucuuguugauuu

SEQ ID NO: 1014142 - RNA, 19 nt, Homo sapiens
gcacauuuauucuguuuug

SEQ ID NO: 1014143 - RNA, 19 nt, Homo sapiens
aagaagaggaugagaauga

SEQ ID NO: 1014144 - RNA, 19 nt, Homo sapiens
guacaucucuggauuuugu

SEQ ID NO: 1014145 - RNA, 19 nt, Homo sapiens
cuaacuauauugcuuguag

SEQ ID NO: 1014146 - RNA, 19 nt, Homo sapiens
agucagugccucauauuua

SEQ ID NO: 1014147 - RNA, 19 nt, Homo sapiens
cagauacuuuacaggguua

SEQ ID NO: 1014148 - RNA, 19 nt, Homo sapiens
uuaaagaaaucuccauguc

SEQ ID NO: 1014149 - RNA, 19 nt, Homo sapiens
gauagaaaaucuucccaaa

SEQ ID NO: 1014150 - RNA, 19 nt, Homo sapiens
gaugguuccugcacacaga

SEQ ID NO: 1014151 - RNA, 19 nt, Homo sapiens
ggauuuguuugguuugguu

SEQ ID NO: 1014152 - RNA, 19 nt, Homo sapiens
gcuauuacagaacuccuua

SEQ ID NO: 1014153 - RNA, 19 nt, Homo sapiens
ggauuuaggccuguaagaa

SEQ ID NO: 1014154 - RNA, 19 nt, Homo sapiens
gagaggacaggaacuaaau

SEQ ID NO: 1014155 - RNA, 19 nt, Homo sapiens
ugucugauaugguaguauu

SEQ ID NO: 1014156 - RNA, 19 nt, Homo sapiens
aaacacagcccuuacucuu

SEQ ID NO: 1014157 - RNA, 19 nt, Homo sapiens
caacauccuuaaugcagau

SEQ ID NO: 1014158 - RNA, 19 nt, Homo sapiens
cagcagaaggagaaauaua

SEQ ID NO: 1014159 - RNA, 19 nt, Homo sapiens
caaauuucccuuucaagau

SEQ ID NO: 1014160 - RNA, 19 nt, Homo sapiens
augaaacacugcuuaagaa

SEQ ID NO: 1014161 - RNA, 19 nt, Homo sapiens
gaaagaaacaagcaagacu

SEQ ID NO: 1014162 - RNA, 19 nt, Homo sapiens
gagcuggcauuuccuauua

SEQ ID NO: 1014163 - RNA, 19 nt, Homo sapiens
ggagaaaugugucugaauu

SEQ ID NO: 1014164 - RNA, 19 nt, Homo sapiens
ggaagaagcucauguaaaa

SEQ ID NO: 1014165 - RNA, 19 nt, Homo sapiens
gguaagaacuuuaacacaa

SEQ ID NO: 1014166 - RNA, 19 nt, Homo sapiens
gaagagcguucugugguua

SEQ ID NO: 1014167 - RNA, 19 nt, Homo sapiens
gaaaugaucuaccagucaa

SEQ ID NO: 1014168 - RNA, 19 nt, Homo sapiens
agacacagcuucuuuaaug

SEQ ID NO: 1014169 - RNA, 19 nt, Homo sapiens
cgcagaaccuuguguauua

SEQ ID NO: 1014170 - RNA, 19 nt, Homo sapiens
gagaagacauucccucaga

SEQ ID NO: 1014171 - RNA, 19 nt, Homo sapiens
ggaagaaauugcaggcauu

SEQ ID NO: 1014172 - RNA, 19 nt, Homo sapiens
gagaauugcacuagauaua

SEQ ID NO: 1014173 - RNA, 19 nt, Homo sapiens
ucacagauguuguuauuca

SEQ ID NO: 1014174 - RNA, 19 nt, Homo sapiens
ugaagaauauuccagugua

SEQ ID NO: 1014175 - RNA, 19 nt, Homo sapiens
gaggaaguauggcguggua

SEQ ID NO: 1014176 - RNA, 19 nt, Homo sapiens
ggaagagcguucugugguu

SEQ ID NO: 1014177 - RNA, 19 nt, Homo sapiens
aaacagcuauccauuacaa

SEQ ID NO: 1014178 - RNA, 19 nt, Homo sapiens
cgauucagcuugaugguuu

SEQ ID NO: 1014179 - RNA, 19 nt, Homo sapiens
gcagaaccuuguguauuaa

SEQ ID NO: 1014180 - RNA, 19 nt, Homo sapiens
ccuucaaccugauguauua

SEQ ID NO: 1014181 - RNA, 19 nt, Homo sapiens
aagaauaccugaagagaau

SEQ ID NO: 1014182 - RNA, 19 nt, Homo sapiens
guagcaaucuguucucuca

SEQ ID NO: 1014183 - RNA, 19 nt, Homo sapiens
gaacaggaucuacaaacaa

SEQ ID NO: 1014184 - RNA, 19 nt, Homo sapiens
gaaguugauuucuaaugga

SEQ ID NO: 1014185 - RNA, 19 nt, Homo sapiens
ccagauauaugugguaaga

SEQ ID NO: 1014186 - RNA, 19 nt, Homo sapiens
cagaguaugcugaguguua

SEQ ID NO: 1014187 - RNA, 19 nt, Homo sapiens
ugaccugaauccugaauuu

SEQ ID NO: 1014188 - RNA, 19 nt, Homo sapiens
cauaaacucugauaaaggu

SEQ ID NO: 1014189 - RNA, 19 nt, Homo sapiens
cagaggcaguauacaguua

SEQ ID NO: 1014190 - RNA, 19 nt, Homo sapiens
guggaggacugcagcauuu

SEQ ID NO: 1014191 - RNA, 19 nt, Homo sapiens
gaacauacaggaucucaag

SEQ ID NO: 1014192 - RNA, 19 nt, Homo sapiens
gaaaauagccgcauucaca

SEQ ID NO: 1014193 - RNA, 19 nt, Homo sapiens
gugcagcuguguuggauuu

SEQ ID NO: 1014194 - RNA, 19 nt, Homo sapiens
gaaaacagcuauccauuac

SEQ ID NO: 1014195 - RNA, 19 nt, Homo sapiens
gcucacaguucucugaaga

SEQ ID NO: 1014196 - RNA, 19 nt, Homo sapiens
ggugaacaguauagacuuu

SEQ ID NO: 1014197 - RNA, 19 nt, Homo sapiens
gaagacauucccucagaaa

SEQ ID NO: 1014198 - RNA, 19 nt, Homo sapiens
gauuggaacuagaaacaga

SEQ ID NO: 1014199 - RNA, 19 nt, Homo sapiens
gaagaauauuccaguguag

SEQ ID NO: 1014200 - RNA, 19 nt, Homo sapiens
gaacugccaccaaaugaga

SEQ ID NO: 1014201 - RNA, 19 nt, Homo sapiens
gcggaguccuguaaauaaa

SEQ ID NO: 1014202 - RNA, 19 nt, Homo sapiens
uauagggccugaaguggua

SEQ ID NO: 1014203 - RNA, 19 nt, Homo sapiens
cagcaaacauguagcaauc

SEQ ID NO: 1014204 - RNA, 19 nt, Homo sapiens
uaaagagaauugcacuaga

SEQ ID NO: 1014205 - RNA, 19 nt, Homo sapiens
caaggaagaaguacugaaa

SEQ ID NO: 1014206 - RNA, 19 nt, Homo sapiens
gaaauggaucggagaaaug

SEQ ID NO: 1014207 - RNA, 19 nt, Homo sapiens
cuaaauaccuuccacaaaa

SEQ ID NO: 1014208 - RNA, 19 nt, Homo sapiens
aagcgugucuuucuauaaa

SEQ ID NO: 1014209 - RNA, 19 nt, Homo sapiens
ggaagaaguacugaaauga

SEQ ID NO: 1014210 - RNA, 19 nt, Homo sapiens
ccucagagaucaccuaugg

SEQ ID NO: 1014211 - RNA, 19 nt, Homo sapiens
gaagauagcgcuaaaugcu

SEQ ID NO: 1014212 - RNA, 19 nt, Homo sapiens
uggcauauguguccucaaa

SEQ ID NO: 1014213 - RNA, 19 nt, Homo sapiens
ccacaaaagugcuauuaaa

SEQ ID NO: 1014214 - RNA, 19 nt, Homo sapiens
gagagugugugccaacaga

SEQ ID NO: 1014215 - RNA, 19 nt, Homo sapiens
gcaaacauguagcaaucug

SEQ ID NO: 1014216 - RNA, 19 nt, Homo sapiens
gaagaaguacugaaaugau

SEQ ID NO: 1014217 - RNA, 19 nt, Homo sapiens
aagaugaacugccaccaaa

SEQ ID NO: 1014218 - RNA, 19 nt, Homo sapiens
aaagagaauugcacuagau

SEQ ID NO: 1014219 - RNA, 19 nt, Homo sapiens
ggcccaagaucaacauuau

SEQ ID NO: 1014220 - RNA, 19 nt, Homo sapiens
gaacaguauagacuuugua

SEQ ID NO: 1014221 - RNA, 19 nt, Homo sapiens
gcauucacauaaacucuga

SEQ ID NO: 1014222 - RNA, 19 nt, Homo sapiens
gcagucaguuauuaaaucu

SEQ ID NO: 1014223 - RNA, 19 nt, Homo sapiens
acucacagauguuguuauu

SEQ ID NO: 1014224 - RNA, 19 nt, Homo sapiens
gaauauagaaucccagaag

SEQ ID NO: 1014225 - RNA, 19 nt, Homo sapiens
gcaggcauuucaaggaaga

SEQ ID NO: 1014226 - RNA, 19 nt, Homo sapiens
cuuuauaucugaaggauga

SEQ ID NO: 1014227 - RNA, 19 nt, Homo sapiens
uacaggaucucaagaacuu

SEQ ID NO: 1014228 - RNA, 19 nt, Homo sapiens
gagaugaacagccuaaaca

SEQ ID NO: 1014229 - RNA, 19 nt, Homo sapiens
gcauuucaccgaagaagaa

SEQ ID NO: 1014230 - RNA, 19 nt, Homo sapiens
caaacuguaugaauagaca

SEQ ID NO: 1014231 - RNA, 19 nt, Homo sapiens
uggaggagauucugcugua

SEQ ID NO: 1014232 - RNA, 19 nt, Homo sapiens
gaagaugaacugccaccaa

SEQ ID NO: 1014233 - RNA, 19 nt, Homo sapiens
gcuaaaugcucacaguucu

SEQ ID NO: 1014234 - RNA, 19 nt, Homo sapiens
guacuaagaguuguugauu

SEQ ID NO: 1014235 - RNA, 19 nt, Homo sapiens
gaacgcaguagauaaguca

SEQ ID NO: 1014236 - RNA, 19 nt, Homo sapiens
gauuaaagcccagauuuca

SEQ ID NO: 1014237 - RNA, 19 nt, Homo sapiens
ggaacaggcccaagaucaa

SEQ ID NO: 1014238 - RNA, 19 nt, Homo sapiens
caguauagacuuuguagaa

SEQ ID NO: 1014239 - RNA, 19 nt, Homo sapiens
ugaaguugauuucuaaugg

SEQ ID NO: 1014240 - RNA, 19 nt, Homo sapiens
ccaacagaauaucaugaaa

SEQ ID NO: 1014241 - RNA, 19 nt, Homo sapiens
acuaagaguuguugauuuc

SEQ ID NO: 1014242 - RNA, 19 nt, Homo sapiens
cagauguuguuauucauga

SEQ ID NO: 1014243 - RNA, 19 nt, Homo sapiens
gcucaggaauacuguguuc

SEQ ID NO: 1014244 - RNA, 19 nt, Homo sapiens
auaacuagcucuaauaugc

SEQ ID NO: 1014245 - RNA, 19 nt, Homo sapiens
ucuuaguggucauuucuua

SEQ ID NO: 1014246 - RNA, 19 nt, Homo sapiens
gaaccacagagaagacauu

SEQ ID NO: 1014247 - RNA, 19 nt, Homo sapiens
gaaaaucacaguaucagaa

SEQ ID NO: 1014248 - RNA, 19 nt, Homo sapiens
acaagcgugucuuucuaua

SEQ ID NO: 1014249 - RNA, 19 nt, Homo sapiens
uuaaagguuugcccauuug

SEQ ID NO: 1014250 - RNA, 19 nt, Homo sapiens
gcauuucaaggaagaagua

SEQ ID NO: 1014251 - RNA, 19 nt, Homo sapiens
aaggagugguucugauuaa

SEQ ID NO: 1014252 - RNA, 19 nt, Homo sapiens
gaucucaaguccacauuuu

SEQ ID NO: 1014253 - RNA, 19 nt, Homo sapiens
gcauuuacaguguuucuug

SEQ ID NO: 1014254 - RNA, 19 nt, Homo sapiens
aaagcacaguuccgcauuu

SEQ ID NO: 1014255 - RNA, 19 nt, Homo sapiens
gcgcagaaccuuguguauu

SEQ ID NO: 1014256 - RNA, 19 nt, Homo sapiens
agaaauggaucggagaaau

SEQ ID NO: 1014257 - RNA, 19 nt, Homo sapiens
gaugaacugccaccaaaug

SEQ ID NO: 1014258 - RNA, 19 nt, Homo sapiens
cacauaaacucugauaaag

SEQ ID NO: 1014259 - RNA, 19 nt, Homo sapiens
gagauaagaauaccugaag

SEQ ID NO: 1014260 - RNA, 19 nt, Homo sapiens
uaaagucccagaaucuauu

SEQ ID NO: 1014261 - RNA, 19 nt, Homo sapiens
ugacagggcuuuugcuuug

SEQ ID NO: 1014262 - RNA, 19 nt, Homo sapiens
ggagagggcuguggaggaa

SEQ ID NO: 1014263 - RNA, 19 nt, Homo sapiens
ggaaaucgccacccauaug

SEQ ID NO: 1014264 - RNA, 19 nt, Homo sapiens
gaaauagagguuccaagaa

SEQ ID NO: 1014265 - RNA, 19 nt, Homo sapiens
ggacauagggcugagagua

SEQ ID NO: 1014266 - RNA, 19 nt, Homo sapiens
gugcuucuccuguagauua

SEQ ID NO: 1014267 - RNA, 19 nt, Homo sapiens
gaauucagcuggaaaaugu

SEQ ID NO: 1014268 - RNA, 19 nt, Homo sapiens
gaagcggccugaggucauu

SEQ ID NO: 1014269 - RNA, 19 nt, Homo sapiens
gagcagacccagcuggaaa

SEQ ID NO: 1014270 - RNA, 19 nt, Homo sapiens
gcaguuuacucuggaaugu

SEQ ID NO: 1014271 - RNA, 19 nt, Homo sapiens
ggagcgagccacccaagaa

SEQ ID NO: 1014272 - RNA, 19 nt, Homo sapiens
gcaccauccucguacuguu

SEQ ID NO: 1014273 - RNA, 19 nt, Homo sapiens
caauggcacugucuuugug

SEQ ID NO: 1014274 - RNA, 19 nt, Homo sapiens
ggcccuaccucaugccaaa

SEQ ID NO: 1014275 - RNA, 19 nt, Homo sapiens
gcaauggcacugucuuugu

SEQ ID NO: 1014276 - RNA, 19 nt, Homo sapiens
gcugagggcuaccuugaag

SEQ ID NO: 1014277 - RNA, 19 nt, Homo sapiens
uagcgaggaugcugaagga

SEQ ID NO: 1014278 - RNA, 19 nt, Homo sapiens
gaccugggcuguggugugu

SEQ ID NO: 1014279 - RNA, 19 nt, Homo sapiens
caagagcagagaagaguga

SEQ ID NO: 1014280 - RNA, 19 nt, Homo sapiens
gcccaaggcuggugcuucu

SEQ ID NO: 1014281 - RNA, 19 nt, Homo sapiens
gacuacgaguucaaaguga

SEQ ID NO: 1014282 - RNA, 19 nt, Homo sapiens
cgaagggaccuacaugugu

SEQ ID NO: 1014283 - RNA, 19 nt, Homo sapiens
ccacugcuuucuccucugu

SEQ ID NO: 1014284 - RNA, 19 nt, Homo sapiens
caacagcgcaggacauagg

SEQ ID NO: 1014285 - RNA, 19 nt, Homo sapiens
cuccucagcuccucaaaug

SEQ ID NO: 1014286 - RNA, 19 nt, Homo sapiens
guggauagcuuugguuucg

SEQ ID NO: 1014287 - RNA, 19 nt, Homo sapiens
gaaaucgccacccauaugc

SEQ ID NO: 1014288 - RNA, 19 nt, Homo sapiens
gauccagccucgggacaug

SEQ ID NO: 1014289 - RNA, 19 nt, Homo sapiens
ggucuuggccuguguuucu

SEQ ID NO: 1014290 - RNA, 19 nt, Homo sapiens
guacaucagcgucccaaca

SEQ ID NO: 1014291 - RNA, 19 nt, Homo sapiens
gccugugaguuaggaaaua

SEQ ID NO: 1014292 - RNA, 19 nt, Homo sapiens
aaaccacaauggcaucauc

SEQ ID NO: 1014293 - RNA, 19 nt, Homo sapiens
gggccaagacuacgaguuc

SEQ ID NO: 1014294 - RNA, 19 nt, Homo sapiens
uagcuuugguuucggucua

SEQ ID NO: 1014295 - RNA, 19 nt, Homo sapiens
ccucagaguucacggacau

SEQ ID NO: 1014296 - RNA, 19 nt, Homo sapiens
gcugagcugcccuccagua

SEQ ID NO: 1014297 - RNA, 19 nt, Homo sapiens
ucacuaugagcuuaagaaa

SEQ ID NO: 1014298 - RNA, 19 nt, Homo sapiens
caaaagcaccauccucgua

SEQ ID NO: 1014299 - RNA, 19 nt, Homo sapiens
gacauagggcugagaguag

SEQ ID NO: 1014300 - RNA, 19 nt, Homo sapiens
ccucgcugaugcucacuuu

SEQ ID NO: 1014301 - RNA, 19 nt, Homo sapiens
uccaagaaccuuucccaaa

SEQ ID NO: 1014302 - RNA, 19 nt, Homo sapiens
guacuguugucacuaugag

SEQ ID NO: 1014303 - RNA, 19 nt, Homo sapiens
gacugcgucuucauagaug

SEQ ID NO: 1014304 - RNA, 19 nt, Homo sapiens
gcagacacuuggcguucca

SEQ ID NO: 1014305 - RNA, 19 nt, Homo sapiens
gcagagcgcagagcuugga

SEQ ID NO: 1014306 - RNA, 19 nt, Homo sapiens
gcuucuggcugugcgaauu

SEQ ID NO: 1014307 - RNA, 19 nt, Homo sapiens
cagcugagggcuaccuuga

SEQ ID NO: 1014308 - RNA, 19 nt, Homo sapiens
ccucaggaagugacucuaa

SEQ ID NO: 1014309 - RNA, 19 nt, Homo sapiens
ccaagacuacgaguucaaa

SEQ ID NO: 1014310 - RNA, 19 nt, Homo sapiens
ugaaggaagggagguauga

SEQ ID NO: 1014311 - RNA, 19 nt, Homo sapiens
ccaacagccucagaguuca

SEQ ID NO: 1014312 - RNA, 19 nt, Homo sapiens
acaaagugcucgggacaag

SEQ ID NO: 1014313 - RNA, 19 nt, Homo sapiens
ggcuggugcuucuccugua

SEQ ID NO: 1014314 - RNA, 19 nt, Homo sapiens
cagcuccacugucguaugc

SEQ ID NO: 1014315 - RNA, 19 nt, Homo sapiens
cccaacagccucagaguuc

SEQ ID NO: 1014316 - RNA, 19 nt, Homo sapiens
gcacgagcagcaggacaaa

SEQ ID NO: 1014317 - RNA, 19 nt, Homo sapiens
gcccugugcuuggaacuca

SEQ ID NO: 1014318 - RNA, 19 nt, Homo sapiens
cucaggaagugacucuaaa

SEQ ID NO: 1014319 - RNA, 19 nt, Homo sapiens
caaccucaccauggaaaga

SEQ ID NO: 1014320 - RNA, 19 nt, Homo sapiens
agccagaggugccuuugug

SEQ ID NO: 1014321 - RNA, 19 nt, Homo sapiens
caucuccaccugacuccua

SEQ ID NO: 1014322 - RNA, 19 nt, Homo sapiens
ggacccuucugcugcuaca

SEQ ID NO: 1014323 - RNA, 19 nt, Homo sapiens
cuggaaaucgccacccaua

SEQ ID NO: 1014324 - RNA, 19 nt, Homo sapiens
uguggugggugagcaguuu

SEQ ID NO: 1014325 - RNA, 19 nt, Homo sapiens
ccaggccucuucccucucu

SEQ ID NO: 1014326 - RNA, 19 nt, Homo sapiens
ccaagaacccagugagcau

SEQ ID NO: 1014327 - RNA, 19 nt, Homo sapiens
agacuacgaguucaaagug

SEQ ID NO: 1014328 - RNA, 19 nt, Homo sapiens
ugacgaagggaccuacaug

SEQ ID NO: 1014329 - RNA, 19 nt, Homo sapiens
gcuggugcuucuccuguag

SEQ ID NO: 1014330 - RNA, 19 nt, Homo sapiens
ggccaagacuacgaguuca

SEQ ID NO: 1014331 - RNA, 19 nt, Homo sapiens
ccgggaggauuuccagauc

SEQ ID NO: 1014332 - RNA, 19 nt, Homo sapiens
gcaccccucuuuccucaug

SEQ ID NO: 1014333 - RNA, 19 nt, Homo sapiens
ggcaauggcacugucuuug

SEQ ID NO: 1014334 - RNA, 19 nt, Homo sapiens
aaucuuacacggccuuguu

SEQ ID NO: 1014335 - RNA, 19 nt, Homo sapiens
gacgaagggaccuacaugu

SEQ ID NO: 1014336 - RNA, 19 nt, Homo sapiens
ggcaagagcagagaagagu

SEQ ID NO: 1014337 - RNA, 19 nt, Homo sapiens
uaauuaugaaugccacuga

SEQ ID NO: 1014338 - RNA, 19 nt, Homo sapiens
guccagcuccucacuguca

SEQ ID NO: 1014339 - RNA, 19 nt, Homo sapiens
aaagugcucgggacaagga

SEQ ID NO: 1014340 - RNA, 19 nt, Homo sapiens
uguugucacuaugagcuua

SEQ ID NO: 1014341 - RNA, 19 nt, Homo sapiens
ucccaagccuccagagagu

SEQ ID NO: 1014342 - RNA, 19 nt, Homo sapiens
gagaagucagcuccacugu

SEQ ID NO: 1014343 - RNA, 19 nt, Homo sapiens
gagccugggcaacacauca

SEQ ID NO: 1014344 - RNA, 19 nt, Homo sapiens
agucagcuccacugucgua

SEQ ID NO: 1014345 - RNA, 19 nt, Homo sapiens
ccaagccuccagagaguuc

SEQ ID NO: 1014346 - RNA, 19 nt, Homo sapiens
ccugugaguuaggaaauag

SEQ ID NO: 1014347 - RNA, 19 nt, Homo sapiens
aaacacaggauggaucaca

SEQ ID NO: 1014348 - RNA, 19 nt, Homo sapiens
caccauccucguacuguug

SEQ ID NO: 1014349 - RNA, 19 nt, Homo sapiens
ggcacgagcagcaggacaa

SEQ ID NO: 1014350 - RNA, 19 nt, Homo sapiens
gcugguuacucgucaucuc

SEQ ID NO: 1014351 - RNA, 19 nt, Homo sapiens
gaguuaggaaauagagguu

SEQ ID NO: 1014352 - RNA, 19 nt, Homo sapiens
uggcaauggcacugucuuu

SEQ ID NO: 1014353 - RNA, 19 nt, Homo sapiens
gaaaugagcagacccauca

SEQ ID NO: 1014354 - RNA, 19 nt, Homo sapiens
cugagaggcuugugaaaua

SEQ ID NO: 1014355 - RNA, 19 nt, Homo sapiens
gcagacccaucaauaagaa

SEQ ID NO: 1014356 - RNA, 19 nt, Homo sapiens
cgacuugucuucuucuuug

SEQ ID NO: 1014357 - RNA, 19 nt, Homo sapiens
gaggaugagugaccaguug

SEQ ID NO: 1014358 - RNA, 19 nt, Homo sapiens
ggaacuguauccacccaaa

SEQ ID NO: 1014359 - RNA, 19 nt, Homo sapiens
ucucagagcaccuaauuaa

SEQ ID NO: 1014360 - RNA, 19 nt, Homo sapiens
gggaagcucugccucuuuc

SEQ ID NO: 1014361 - RNA, 19 nt, Homo sapiens
gaacaugcgacuugucuuc

SEQ ID NO: 1014362 - RNA, 19 nt, Homo sapiens
cggcugggcuguuugguuu

SEQ ID NO: 1014363 - RNA, 19 nt, Homo sapiens
gcgauuggcugggaacugu

SEQ ID NO: 1014364 - RNA, 19 nt, Homo sapiens
gagcagacccaucaauaag

SEQ ID NO: 1014365 - RNA, 19 nt, Homo sapiens
gacgaaaacuuguaugaga

SEQ ID NO: 1014366 - RNA, 19 nt, Homo sapiens
aaucagaucugggaccuau

SEQ ID NO: 1014367 - RNA, 19 nt, Homo sapiens
cacgacaacuggaagcaaa

SEQ ID NO: 1014368 - RNA, 19 nt, Homo sapiens
ugagcagacccaucaauaa

SEQ ID NO: 1014369 - RNA, 19 nt, Homo sapiens
ugucaccgauuucuuccua

SEQ ID NO: 1014370 - RNA, 19 nt, Homo sapiens
ucagagcaccuaauuaaag

SEQ ID NO: 1014371 - RNA, 19 nt, Homo sapiens
uggccuaucugccugacua

SEQ ID NO: 1014372 - RNA, 19 nt, Homo sapiens
cagagcaccuaauuaaagg

SEQ ID NO: 1014373 - RNA, 19 nt, Homo sapiens
gcaccuuuguggccuaucu

SEQ ID NO: 1014374 - RNA, 19 nt, Homo sapiens
gcgggaagcucugccucuu

SEQ ID NO: 1014375 - RNA, 19 nt, Homo sapiens
cauggcggcugggcuguuu

SEQ ID NO: 1014376 - RNA, 19 nt, Homo sapiens
gaacuguauccacccaaau

SEQ ID NO: 1014377 - RNA, 19 nt, Homo sapiens
gaacccagacucccauggu

SEQ ID NO: 1014378 - RNA, 19 nt, Homo sapiens
ucaccgauuucuuccuaug

SEQ ID NO: 1014379 - RNA, 19 nt, Homo sapiens
gcugagaggcuugugaaau

SEQ ID NO: 1014380 - RNA, 19 nt, Homo sapiens
gcugggcuguuugguuuga

SEQ ID NO: 1014381 - RNA, 19 nt, Homo sapiens
ucagaucugggaccuauau

SEQ ID NO: 1014382 - RNA, 19 nt, Homo sapiens
gcacagucgcauuucuuuc

SEQ ID NO: 1014383 - RNA, 19 nt, Homo sapiens
gcgcacagucgcauuucuu

SEQ ID NO: 1014384 - RNA, 19 nt, Homo sapiens
gaagccacgacaacuggaa

SEQ ID NO: 1014385 - RNA, 19 nt, Homo sapiens
gaugagugaccaguugcua

SEQ ID NO: 1014386 - RNA, 19 nt, Homo sapiens
caugcgacuugucuucuuc

SEQ ID NO: 1014387 - RNA, 19 nt, Homo sapiens
aaacuuguaugagaagaac

SEQ ID NO: 1014388 - RNA, 19 nt, Homo sapiens
gcgacuugucuucuucuuu

SEQ ID NO: 1014389 - RNA, 19 nt, Homo sapiens
gaaauaccgagaggccaau

SEQ ID NO: 1014390 - RNA, 19 nt, Homo sapiens
gugcacaggguguccaaga

SEQ ID NO: 1014391 - RNA, 19 nt, Homo sapiens
gaucugggaccuauauagc

SEQ ID NO: 1014392 - RNA, 19 nt, Homo sapiens
ugagaggcuugugaaauac

SEQ ID NO: 1014393 - RNA, 19 nt, Homo sapiens
cuucucagagcaccuaauu

SEQ ID NO: 1014394 - RNA, 19 nt, Homo sapiens
augagcagacccaucaaua

SEQ ID NO: 1014395 - RNA, 19 nt, Homo sapiens
gagcgugggaugggaugaa

SEQ ID NO: 1014396 - RNA, 19 nt, Homo sapiens
gacccaucaauaagaaauu

SEQ ID NO: 1014397 - RNA, 19 nt, Homo sapiens
acaugcgacuugucuucuu

SEQ ID NO: 1014398 - RNA, 19 nt, Homo sapiens
gaaaacuuguaugagaaga

SEQ ID NO: 1014399 - RNA, 19 nt, Homo sapiens
ugacaaggaccccguuuug

SEQ ID NO: 1014400 - RNA, 19 nt, Homo sapiens
acccagacucccaugguua

SEQ ID NO: 1014401 - RNA, 19 nt, Homo sapiens
uuugagcgcucgccgucuu

SEQ ID NO: 1014402 - RNA, 19 nt, Homo sapiens
cgacaacuggaagcaaaga

SEQ ID NO: 1014403 - RNA, 19 nt, Homo sapiens
gcccaacacugcucucuuu

SEQ ID NO: 1014404 - RNA, 19 nt, Homo sapiens
uggaugagcugcuggaauu

SEQ ID NO: 1014405 - RNA, 19 nt, Homo sapiens
ggacagcaauggcuucucu

SEQ ID NO: 1014406 - RNA, 19 nt, Homo sapiens
caacacugcucucuuugug

SEQ ID NO: 1014407 - RNA, 19 nt, Homo sapiens
gcaauggcuucucuaagga

SEQ ID NO: 1014408 - RNA, 19 nt, Homo sapiens
aagaggagcugcccaugaa

SEQ ID NO: 1014409 - RNA, 19 nt, Homo sapiens
ccagagagaugggaaguuc

SEQ ID NO: 1014410 - RNA, 19 nt, Homo sapiens
gcaaaucguguuucuggaa

SEQ ID NO: 1014411 - RNA, 19 nt, Homo sapiens
caacuucagccucaagaaa

SEQ ID NO: 1014412 - RNA, 19 nt, Homo sapiens
aaagcagacucgucagaaa

SEQ ID NO: 1014413 - RNA, 19 nt, Homo sapiens
gagguggaguacuuuaaga

SEQ ID NO: 1014414 - RNA, 19 nt, Homo sapiens
cgaaagauaaagcaacauu

SEQ ID NO: 1014415 - RNA, 19 nt, Homo sapiens
gcaggcaaaucguguuucu

SEQ ID NO: 1014416 - RNA, 19 nt, Homo sapiens
gagaugggaaguucuguga

SEQ ID NO: 1014417 - RNA, 19 nt, Homo sapiens
gcaaagcagacucgucaga

SEQ ID NO: 1014418 - RNA, 19 nt, Homo sapiens
gccgaaagauaaagcaaca

SEQ ID NO: 1014419 - RNA, 19 nt, Homo sapiens
gagagguggaguacuuuaa

SEQ ID NO: 1014420 - RNA, 19 nt, Homo sapiens
ccuagagcuucccaaagua

SEQ ID NO: 1014421 - RNA, 19 nt, Homo sapiens
ucagaaaguugcugugaac

SEQ ID NO: 1014422 - RNA, 19 nt, Homo sapiens
cagcugaaggcguauaauu

SEQ ID NO: 1014423 - RNA, 19 nt, Homo sapiens
gcugugaacuggaccaacu

SEQ ID NO: 1014424 - RNA, 19 nt, Homo sapiens
gaugggaaguucugugacu

SEQ ID NO: 1014425 - RNA, 19 nt, Homo sapiens
uuuaagagguucuguuugg

SEQ ID NO: 1014426 - RNA, 19 nt, Homo sapiens
gcagacucgucagaaaguu

SEQ ID NO: 1014427 - RNA, 19 nt, Homo sapiens
caaagcagacucgucagaa

SEQ ID NO: 1014428 - RNA, 19 nt, Homo sapiens
gcagcagccugacaucaac

SEQ ID NO: 1014429 - RNA, 19 nt, Homo sapiens
gucagaaaguugcugugaa

SEQ ID NO: 1014430 - RNA, 19 nt, Homo sapiens
gcaagaggcagggcaguca

SEQ ID NO: 1014431 - RNA, 19 nt, Homo sapiens
aagagguucuguuuggauu

SEQ ID NO: 1014432 - RNA, 19 nt, Homo sapiens
uggaguacuuuaagagguu

SEQ ID NO: 1014433 - RNA, 19 nt, Homo sapiens
uccuagagcuucccaaagu

SEQ ID NO: 1014434 - RNA, 19 nt, Homo sapiens
gcagucaggccaagaagag

SEQ ID NO: 1014435 - RNA, 19 nt, Homo sapiens
cagcagaagcucuaaagca

SEQ ID NO: 1014436 - RNA, 19 nt, Homo sapiens
caacagcacggagcccaaa

SEQ ID NO: 1014437 - RNA, 19 nt, Homo sapiens
aaagaggagcugcccauga

SEQ ID NO: 1014438 - RNA, 19 nt, Homo sapiens
ggccagggcugaugguacu

SEQ ID NO: 1014439 - RNA, 19 nt, Homo sapiens
cgagagguggaguacuuua

SEQ ID NO: 1014440 - RNA, 19 nt, Homo sapiens
gcugaaggcguauaauuuu

SEQ ID NO: 1014441 - RNA, 19 nt, Homo sapiens
gaaccacacguuacaagcu

SEQ ID NO: 1014442 - RNA, 19 nt, Homo sapiens
gguccuagagcuucccaaa

SEQ ID NO: 1014443 - RNA, 19 nt, Homo sapiens
caacaccgugcccaaccua

SEQ ID NO: 1014444 - RNA, 19 nt, Homo sapiens
agcaauggcuucucuaagg

SEQ ID NO: 1014445 - RNA, 19 nt, Homo sapiens
ggaacuggaucgggucaac

SEQ ID NO: 1014446 - RNA, 19 nt, Homo sapiens
ggaccaacuucagccucaa

SEQ ID NO: 1014447 - RNA, 19 nt, Homo sapiens
cagcaaggccacagagcuu

SEQ ID NO: 1014448 - RNA, 19 nt, Homo sapiens
cgggugaucugggucaaga

SEQ ID NO: 1014449 - RNA, 19 nt, Homo sapiens
cgugccagcuucagugugu

SEQ ID NO: 1014450 - RNA, 19 nt, Homo sapiens
accgagagguggaguacuu

SEQ ID NO: 1014451 - RNA, 19 nt, Homo sapiens
ugugugagcucagcaugga

SEQ ID NO: 1014452 - RNA, 19 nt, Homo sapiens
gagguucuguuuggauucu

SEQ ID NO: 1014453 - RNA, 19 nt, Homo sapiens
caaccuaucccgggugauc

SEQ ID NO: 1014454 - RNA, 19 nt, Homo sapiens
gagcagcagccugacauca

SEQ ID NO: 1014455 - RNA, 19 nt, Homo sapiens
agauaaagcaacauuugga

SEQ ID NO: 1014456 - RNA, 19 nt, Homo sapiens
gaugagcugcuggaauuca

SEQ ID NO: 1014457 - RNA, 19 nt, Homo sapiens
gaacuggaucgggucaaca

SEQ ID NO: 1014458 - RNA, 19 nt, Homo sapiens
uaagagguucuguuuggau

SEQ ID NO: 1014459 - RNA, 19 nt, Homo sapiens
auaccgagauccgggagaa

SEQ ID NO: 1014460 - RNA, 19 nt, Homo sapiens
acagcaauggcuucucuaa

SEQ ID NO: 1014461 - RNA, 19 nt, Homo sapiens
uuaagagguucuguuugga

SEQ ID NO: 1014462 - RNA, 19 nt, Homo sapiens
ccaacacugcucucuuugu

SEQ ID NO: 1014463 - RNA, 19 nt, Homo sapiens
cgucagaaaguugcuguga

SEQ ID NO: 1014464 - RNA, 19 nt, Homo sapiens
gagcugcuggaauucauca

SEQ ID NO: 1014465 - RNA, 19 nt, Homo sapiens
ccaccuacccguccaagac

SEQ ID NO: 1014466 - RNA, 19 nt, Homo sapiens
agcugaaggcguauaauuu

SEQ ID NO: 1014467 - RNA, 19 nt, Homo sapiens
cugcuggaauucaucaaca

SEQ ID NO: 1014468 - RNA, 19 nt, Homo sapiens
uugauacugugaagaucuu

SEQ ID NO: 1014469 - RNA, 19 nt, Homo sapiens
acuuuaagagguucuguuu

SEQ ID NO: 1014470 - RNA, 19 nt, Homo sapiens
guuggcagcagaagcucua

SEQ ID NO: 1014471 - RNA, 19 nt, Homo sapiens
aaaggagaaggcccaguug

SEQ ID NO: 1014472 - RNA, 19 nt, Homo sapiens
uggaucgggucaacagcuu

SEQ ID NO: 1014473 - RNA, 19 nt, Homo sapiens
gcaggacgcacuugucuua

SEQ ID NO: 1014474 - RNA, 19 nt, Homo sapiens
cggaacagcugcucauuga

SEQ ID NO: 1014475 - RNA, 19 nt, Homo sapiens
gauacucacuguucaugaa

SEQ ID NO: 1014476 - RNA, 19 nt, Homo sapiens
gcacuugucuuagcaguuc

SEQ ID NO: 1014477 - RNA, 19 nt, Homo sapiens
gaagggaccaaguguguuu

SEQ ID NO: 1014478 - RNA, 19 nt, Homo sapiens
gauaagauacucacuguuc

SEQ ID NO: 1014479 - RNA, 19 nt, Homo sapiens
guucaaguauuaagaccua

SEQ ID NO: 1014480 - RNA, 19 nt, Homo sapiens
ccaaguguguuuguuguuu

SEQ ID NO: 1014481 - RNA, 19 nt, Homo sapiens
uguagcauguaccuuauua

SEQ ID NO: 1014482 - RNA, 19 nt, Homo sapiens
ggaggugguuuguguaucu

SEQ ID NO: 1014483 - RNA, 19 nt, Homo sapiens
ucacgacucuggcccaaga

SEQ ID NO: 1014484 - RNA, 19 nt, Homo sapiens
gcugaugccuagccaguug

SEQ ID NO: 1014485 - RNA, 19 nt, Homo sapiens
cuagaacuguuuacaugaa

SEQ ID NO: 1014486 - RNA, 19 nt, Homo sapiens
guuguaggcagcuaucuua

SEQ ID NO: 1014487 - RNA, 19 nt, Homo sapiens
gaucggagcaucacuacug

SEQ ID NO: 1014488 - RNA, 19 nt, Homo sapiens
gaccaaguguguuuguugu

SEQ ID NO: 1014489 - RNA, 19 nt, Homo sapiens
ggaccaaguguguuuguug

SEQ ID NO: 1014490 - RNA, 19 nt, Homo sapiens
ggacgcacuugucuuagca

SEQ ID NO: 1014491 - RNA, 19 nt, Homo sapiens
acgcaugaauguaagagua

SEQ ID NO: 1014492 - RNA, 19 nt, Homo sapiens
caucacuacugaccuguug

SEQ ID NO: 1014493 - RNA, 19 nt, Homo sapiens
caaguguguuuguuguuug

SEQ ID NO: 1014494 - RNA, 19 nt, Homo sapiens
ggauguguguguagcaugu

SEQ ID NO: 1014495 - RNA, 19 nt, Homo sapiens
aagauaagauacucacugu

SEQ ID NO: 1014496 - RNA, 19 nt, Homo sapiens
agacacggcuuaccuggau

SEQ ID NO: 1014497 - RNA, 19 nt, Homo sapiens
guguguagcauguaccuua

SEQ ID NO: 1014498 - RNA, 19 nt, Homo sapiens
ggucuuccaucuagaacug

SEQ ID NO: 1014499 - RNA, 19 nt, Homo sapiens
guaggcagcuaucuuacag

SEQ ID NO: 1014500 - RNA, 19 nt, Homo sapiens
aaacugaggcagccaccua

SEQ ID NO: 1014501 - RNA, 19 nt, Homo sapiens
guauuaagaccuaugcaau

SEQ ID NO: 1014502 - RNA, 19 nt, Homo sapiens
guucaugaauacacuugau

SEQ ID NO: 1014503 - RNA, 19 nt, Homo sapiens
ggacacauaccccucagua

SEQ ID NO: 1014504 - RNA, 19 nt, Homo sapiens
uaagccaggugggcaaaga

SEQ ID NO: 1014505 - RNA, 19 nt, Homo sapiens
gaacuguuuacaugaagau

SEQ ID NO: 1014506 - RNA, 19 nt, Homo sapiens
ucaguacuguagcauggaa

SEQ ID NO: 1014507 - RNA, 19 nt, Homo sapiens
ccaggugggcaaagaacua

SEQ ID NO: 1014508 - RNA, 19 nt, Homo sapiens
ucacuacugaccuguugua

SEQ ID NO: 1014509 - RNA, 19 nt, Homo sapiens
guguguuuguuguuuguuu

SEQ ID NO: 1014510 - RNA, 19 nt, Homo sapiens
ggcccagggugaaggaaga

SEQ ID NO: 1014511 - RNA, 19 nt, Homo sapiens
ccagcuggaugugugugua

SEQ ID NO: 1014512 - RNA, 19 nt, Homo sapiens
ccaagacagagacgacuga

SEQ ID NO: 1014513 - RNA, 19 nt, Homo sapiens
auaagauacucacuguuca

SEQ ID NO: 1014514 - RNA, 19 nt, Homo sapiens
cggaggaagacacggcuua

SEQ ID NO: 1014515 - RNA, 19 nt, Homo sapiens
agacagagacgacugaacu

SEQ ID NO: 1014516 - RNA, 19 nt, Homo sapiens
caucugggucuuccaucua

SEQ ID NO: 1014517 - RNA, 19 nt, Homo sapiens
caccaugccuagccuuugg

SEQ ID NO: 1014518 - RNA, 19 nt, Homo sapiens
ggagugccaucugggucuu

SEQ ID NO: 1014519 - RNA, 19 nt, Homo sapiens
gacagugcccuccaagaca

SEQ ID NO: 1014520 - RNA, 19 nt, Homo sapiens
gggaccaaguguguuuguu

SEQ ID NO: 1014521 - RNA, 19 nt, Homo sapiens
uacucacuguucaugaaua

SEQ ID NO: 1014522 - RNA, 19 nt, Homo sapiens
caucguguacugcagaguu

SEQ ID NO: 1014523 - RNA, 19 nt, Homo sapiens
acagagacgacugaacuuu

SEQ ID NO: 1014524 - RNA, 19 nt, Homo sapiens
cgacagugcccuccaagac

SEQ ID NO: 1014525 - RNA, 19 nt, Homo sapiens
acaccuggcagcugcguuu

SEQ ID NO: 1014526 - RNA, 19 nt, Homo sapiens
ugggaucuuugacacuuga

SEQ ID NO: 1014527 - RNA, 19 nt, Homo sapiens
ucguggaggugguuugugu

SEQ ID NO: 1014528 - RNA, 19 nt, Homo sapiens
ucaagaagaagcuguacag

SEQ ID NO: 1014529 - RNA, 19 nt, Homo sapiens
caugaauacacuugauguu

SEQ ID NO: 1014530 - RNA, 19 nt, Homo sapiens
caucuagaacuguuuacau

SEQ ID NO: 1014531 - RNA, 19 nt, Homo sapiens
ucacuugggaucuuugaca

SEQ ID NO: 1014532 - RNA, 19 nt, Homo sapiens
gaggugguuuguguaucuu

SEQ ID NO: 1014533 - RNA, 19 nt, Homo sapiens
acaguuaacagugguguga

SEQ ID NO: 1014534 - RNA, 19 nt, Homo sapiens
uguguagcauguaccuuau

SEQ ID NO: 1014535 - RNA, 19 nt, Homo sapiens
agaacuguuuacaugaaga

SEQ ID NO: 1014536 - RNA, 19 nt, Homo sapiens
uagaacuguuuacaugaag

SEQ ID NO: 1014537 - RNA, 19 nt, Homo sapiens
aucuagaacuguuuacaug

SEQ ID NO: 1014538 - RNA, 19 nt, Homo sapiens
guaucuuacuggucugaag

SEQ ID NO: 1014539 - RNA, 19 nt, Homo sapiens
gacagagacgacugaacuu

SEQ ID NO: 1014540 - RNA, 19 nt, Homo sapiens
cccugaggaugaacacuug

SEQ ID NO: 1014541 - RNA, 19 nt, Homo sapiens
ccucuucgcccucguccuu

SEQ ID NO: 1014542 - RNA, 19 nt, Homo sapiens
agagacgacugaacuuuug

SEQ ID NO: 1014543 - RNA, 19 nt, Homo sapiens
ucuagaacuguuuacauga

SEQ ID NO: 1014544 - RNA, 19 nt, Homo sapiens
ccaucugggucuuccaucu

SEQ ID NO: 1014545 - RNA, 19 nt, Homo sapiens
cuugggaucuuugacacuu

SEQ ID NO: 1014546 - RNA, 19 nt, Homo sapiens
cagugacccugaggaugaa

SEQ ID NO: 1014547 - RNA, 19 nt, Homo sapiens
ucaucaagaagaagcugua

SEQ ID NO: 1014548 - RNA, 19 nt, Homo sapiens
gcuuccgagucaucaagaa

SEQ ID NO: 1014549 - RNA, 19 nt, Homo sapiens
uaagauacucacuguucau

SEQ ID NO: 1014550 - RNA, 19 nt, Homo sapiens
ggagcugagggacugauuc

SEQ ID NO: 1014551 - RNA, 19 nt, Homo sapiens
gaacagugguccucucuuu

SEQ ID NO: 1014552 - RNA, 19 nt, Homo sapiens
ggaagaaggucguguaaga

SEQ ID NO: 1014553 - RNA, 19 nt, Homo sapiens
ccaaagaugucauugcuaa

SEQ ID NO: 1014554 - RNA, 19 nt, Homo sapiens
cagcuaaucucacguagua

SEQ ID NO: 1014555 - RNA, 19 nt, Homo sapiens
gaaagcaccucuugucucu

SEQ ID NO: 1014556 - RNA, 19 nt, Homo sapiens
ggacucagauacccuuuga

SEQ ID NO: 1014557 - RNA, 19 nt, Homo sapiens
ccaacgagaugacauuauu

SEQ ID NO: 1014558 - RNA, 19 nt, Homo sapiens
gaucaucuuucccauuauu

SEQ ID NO: 1014559 - RNA, 19 nt, Homo sapiens
caaggaaauugaacuaaga

SEQ ID NO: 1014560 - RNA, 19 nt, Homo sapiens
caaagaguguccaggaauu

SEQ ID NO: 1014561 - RNA, 19 nt, Homo sapiens
gaaagggacagauucauug

SEQ ID NO: 1014562 - RNA, 19 nt, Homo sapiens
gcaaggaaauugaacuaag

SEQ ID NO: 1014563 - RNA, 19 nt, Homo sapiens
caccuuaccuuaaaccuuu

SEQ ID NO: 1014564 - RNA, 19 nt, Homo sapiens
gagaugacauuauuagaag

SEQ ID NO: 1014565 - RNA, 19 nt, Homo sapiens
gaagcaggacuccguauuu

SEQ ID NO: 1014566 - RNA, 19 nt, Homo sapiens
gaacaugaugcccaaauug

SEQ ID NO: 1014567 - RNA, 19 nt, Homo sapiens
gaagaagauccaauaauuc

SEQ ID NO: 1014568 - RNA, 19 nt, Homo sapiens
uaacuagaguaccaguaua

SEQ ID NO: 1014569 - RNA, 19 nt, Homo sapiens
cagauuaugucccuuaugu

SEQ ID NO: 1014570 - RNA, 19 nt, Homo sapiens
ggacaguggugauguuaag

SEQ ID NO: 1014571 - RNA, 19 nt, Homo sapiens
ccaagacuccuguaaguaa

SEQ ID NO: 1014572 - RNA, 19 nt, Homo sapiens
gaagaaagugggaaagguu

SEQ ID NO: 1014573 - RNA, 19 nt, Homo sapiens
gaacguuuccucuucuaaa

SEQ ID NO: 1014574 - RNA, 19 nt, Homo sapiens
gaaauggagagguaaagaa

SEQ ID NO: 1014575 - RNA, 19 nt, Homo sapiens
agggacagauucauuguua

SEQ ID NO: 1014576 - RNA, 19 nt, Homo sapiens
caaaugcuguguuaaugga

SEQ ID NO: 1014577 - RNA, 19 nt, Homo sapiens
gaacaggugacccagcuaa

SEQ ID NO: 1014578 - RNA, 19 nt, Homo sapiens
gaucuucccguacagguua

SEQ ID NO: 1014579 - RNA, 19 nt, Homo sapiens
gcacugagccguccaaugc

SEQ ID NO: 1014580 - RNA, 19 nt, Homo sapiens
gaaguggaauucccuggau

SEQ ID NO: 1014581 - RNA, 19 nt, Homo sapiens
ugauuuaucuggucauaga

SEQ ID NO: 1014582 - RNA, 19 nt, Homo sapiens
cgacuaagcccaucagugu

SEQ ID NO: 1014583 - RNA, 19 nt, Homo sapiens
aaagaucaaugccacugua

SEQ ID NO: 1014584 - RNA, 19 nt, Homo sapiens
gagacuagaaccaagauuu

SEQ ID NO: 1014585 - RNA, 19 nt, Homo sapiens
acuaagaaauggagaggua

SEQ ID NO: 1014586 - RNA, 19 nt, Homo sapiens
gauccaauaauucccuuua

SEQ ID NO: 1014587 - RNA, 19 nt, Homo sapiens
gaauguaugcuccugugua

SEQ ID NO: 1014588 - RNA, 19 nt, Homo sapiens
accauaggcuccuguauaa

SEQ ID NO: 1014589 - RNA, 19 nt, Homo sapiens
gcacucaucugucuaucag

SEQ ID NO: 1014590 - RNA, 19 nt, Homo sapiens
gaucaaugccacuguaaga

SEQ ID NO: 1014591 - RNA, 19 nt, Homo sapiens
caacgagaugacauuauua

SEQ ID NO: 1014592 - RNA, 19 nt, Homo sapiens
gcugggcccucuaauguug

SEQ ID NO: 1014593 - RNA, 19 nt, Homo sapiens
guacaaacggaauuucaaa

SEQ ID NO: 1014594 - RNA, 19 nt, Homo sapiens
ugacccagcuaacuuaaau

SEQ ID NO: 1014595 - RNA, 19 nt, Homo sapiens
ggaaacuggugacacuugu

SEQ ID NO: 1014596 - RNA, 19 nt, Homo sapiens
aggaagagcuugaaaagua

SEQ ID NO: 1014597 - RNA, 19 nt, Homo sapiens
cgagaugacauuauuagaa

SEQ ID NO: 1014598 - RNA, 19 nt, Homo sapiens
ggaggaagaaggucgugua

SEQ ID NO: 1014599 - RNA, 19 nt, Homo sapiens
caccauaggcuccuguaua

SEQ ID NO: 1014600 - RNA, 19 nt, Homo sapiens
guaaagguguagcuagcuu

SEQ ID NO: 1014601 - RNA, 19 nt, Homo sapiens
ccagaacccucagcaguug

SEQ ID NO: 1014602 - RNA, 19 nt, Homo sapiens
ucugauggaugauugauug

SEQ ID NO: 1014603 - RNA, 19 nt, Homo sapiens
ccaaacagcaaauacaaga

SEQ ID NO: 1014604 - RNA, 19 nt, Homo sapiens
gccuaucucugauggauga

SEQ ID NO: 1014605 - RNA, 19 nt, Homo sapiens
gccgucaccuuaccuuaaa

SEQ ID NO: 1014606 - RNA, 19 nt, Homo sapiens
auaauucccuuuagugaug

SEQ ID NO: 1014607 - RNA, 19 nt, Homo sapiens
gcaaagaguguccaggaau

SEQ ID NO: 1014608 - RNA, 19 nt, Homo sapiens
caacgaggccacaucauca

SEQ ID NO: 1014609 - RNA, 19 nt, Homo sapiens
caauaauucccuuuaguga

SEQ ID NO: 1014610 - RNA, 19 nt, Homo sapiens
aaacaaguauuggucaugu

SEQ ID NO: 1014611 - RNA, 19 nt, Homo sapiens
guucugcccucucaaggaa

SEQ ID NO: 1014612 - RNA, 19 nt, Homo sapiens
agagagaggccaaugcuuu

SEQ ID NO: 1014613 - RNA, 19 nt, Homo sapiens
gagcaacucauuacuucuu

SEQ ID NO: 1014614 - RNA, 19 nt, Homo sapiens
aagagcaacucauuacuuc

SEQ ID NO: 1014615 - RNA, 19 nt, Homo sapiens
caagagcaacucauuacuu

SEQ ID NO: 1014616 - RNA, 19 nt, Homo sapiens
cauaggaaguacugaaaca

SEQ ID NO: 1014617 - RNA, 19 nt, Homo sapiens
cguuuccucuucuaaauaa

SEQ ID NO: 1014618 - RNA, 19 nt, Homo sapiens
gcaaauacaagacuagcau

SEQ ID NO: 1014619 - RNA, 19 nt, Homo sapiens
gcuacagucuccagaguca

SEQ ID NO: 1014620 - RNA, 19 nt, Homo sapiens
aaucacacaugcagucuau

SEQ ID NO: 1014621 - RNA, 19 nt, Homo sapiens
caacuacuguaucgagcuu

SEQ ID NO: 1014622 - RNA, 19 nt, Homo sapiens
gauggaugauugauugcuu

SEQ ID NO: 1014623 - RNA, 19 nt, Homo sapiens
gagagaggccaaugcuuug

SEQ ID NO: 1014624 - RNA, 19 nt, Homo sapiens
ucggaguuaugaagcauua

SEQ ID NO: 1014625 - RNA, 19 nt, Homo sapiens
ggaggaauuucggaguuau

SEQ ID NO: 1014626 - RNA, 19 nt, Homo sapiens
ggccagcuaugcaagaaga

SEQ ID NO: 1014627 - RNA, 19 nt, Homo sapiens
ccuuucggcuucaugcuua

SEQ ID NO: 1014628 - RNA, 19 nt, Homo sapiens
aaaggaaacuggugacacu

SEQ ID NO: 1014629 - RNA, 19 nt, Homo sapiens
acagauucauuguuacuga

SEQ ID NO: 1014630 - RNA, 19 nt, Homo sapiens
gcaacgaggccacaucauc

SEQ ID NO: 1014631 - RNA, 19 nt, Homo sapiens
gauuaugucccuuauguca

SEQ ID NO: 1014632 - RNA, 19 nt, Homo sapiens
ccaucaguguaucagauua

SEQ ID NO: 1014633 - RNA, 19 nt, Homo sapiens
gcaauucuuuaccuccaau

SEQ ID NO: 1014634 - RNA, 19 nt, Homo sapiens
gaggaagaaggucguguaa

SEQ ID NO: 1014635 - RNA, 19 nt, Homo sapiens
caagacuccuguaaguaau

SEQ ID NO: 1014636 - RNA, 19 nt, Homo sapiens
ccagcuaacuuaaauagac

SEQ ID NO: 1014637 - RNA, 19 nt, Homo sapiens
ggaagcaggacuccguauu

SEQ ID NO: 1014638 - RNA, 19 nt, Homo sapiens
agaacaugaugcccaaauu

SEQ ID NO: 1014639 - RNA, 19 nt, Homo sapiens
uaucagauuaugucccuua

SEQ ID NO: 1014640 - RNA, 19 nt, Homo sapiens
gcacaguaccacacucaga

SEQ ID NO: 1014641 - RNA, 19 nt, Homo sapiens
ugccauaugccgaucauua

SEQ ID NO: 1014642 - RNA, 19 nt, Homo sapiens
ucagauacccuuugaaguc

SEQ ID NO: 1014643 - RNA, 19 nt, Homo sapiens
gggaaagguuggcgcuaau

SEQ ID NO: 1014644 - RNA, 19 nt, Homo sapiens
ggccaagagcaacucauua

SEQ ID NO: 1014645 - RNA, 19 nt, Homo sapiens
cauaggcuccuguauaaau

SEQ ID NO: 1014646 - RNA, 19 nt, Homo sapiens
cacaugcagucuaucauug

SEQ ID NO: 1014647 - RNA, 19 nt, Homo sapiens
ggaaccuuguggucauuug

SEQ ID NO: 1014648 - RNA, 19 nt, Homo sapiens
ugucauuucugucauagga

SEQ ID NO: 1014649 - RNA, 19 nt, Homo sapiens
gaaacuggugacacuugua

SEQ ID NO: 1014650 - RNA, 19 nt, Homo sapiens
gcagagacuagaaccaaga

SEQ ID NO: 1014651 - RNA, 19 nt, Homo sapiens
gcacaaggcucuucacaga

SEQ ID NO: 1014652 - RNA, 19 nt, Homo sapiens
ggacaucauucagucacua

SEQ ID NO: 1014653 - RNA, 19 nt, Homo sapiens
ugauuuaccugggauuuaa

SEQ ID NO: 1014654 - RNA, 19 nt, Homo sapiens
uauuuggucuucuggauuu

SEQ ID NO: 1014655 - RNA, 19 nt, Homo sapiens
uuaucccucuugugauuua

SEQ ID NO: 1014656 - RNA, 19 nt, Homo sapiens
cuuuaucccucuugugauu

SEQ ID NO: 1014657 - RNA, 19 nt, Homo sapiens
caaagaggccaagcagaga

SEQ ID NO: 1014658 - RNA, 19 nt, Homo sapiens
gugauuuaccugggauuua

SEQ ID NO: 1014659 - RNA, 19 nt, Homo sapiens
uggugaagcugagcaaaga

SEQ ID NO: 1014660 - RNA, 19 nt, Homo sapiens
cggaaugccugaaccaacu

SEQ ID NO: 1014661 - RNA, 19 nt, Homo sapiens
gggugcagaucccggaaug

SEQ ID NO: 1014662 - RNA, 19 nt, Homo sapiens
ggcuuuaucccucuuguga

SEQ ID NO: 1014663 - RNA, 19 nt, Homo sapiens
ggacagcauggaagaugug

SEQ ID NO: 1014664 - RNA, 19 nt, Homo sapiens
gccauucgcuggggcuuua

SEQ ID NO: 1014665 - RNA, 19 nt, Homo sapiens
ggagccaguuugccauucg

SEQ ID NO: 1014666 - RNA, 19 nt, Homo sapiens
caucauucagucacuaguu

SEQ ID NO: 1014667 - RNA, 19 nt, Homo sapiens
aaaggauuauuuggucuuc

SEQ ID NO: 1014668 - RNA, 19 nt, Homo sapiens
gacuacagcagcucuucaa

SEQ ID NO: 1014669 - RNA, 19 nt, Homo sapiens
gcggacagcauggaagaug

SEQ ID NO: 1014670 - RNA, 19 nt, Homo sapiens
cagcggacagcauggaaga

SEQ ID NO: 1014671 - RNA, 19 nt, Homo sapiens
gggagccaguuugccauuc

SEQ ID NO: 1014672 - RNA, 19 nt, Homo sapiens
cggacagcauggaagaugu

SEQ ID NO: 1014673 - RNA, 19 nt, Homo sapiens
gagccuacuuuggggauaa

SEQ ID NO: 1014674 - RNA, 19 nt, Homo sapiens
gcucuucacagacgcaucu

SEQ ID NO: 1014675 - RNA, 19 nt, Homo sapiens
gcacuuugauguucagaaa

SEQ ID NO: 1014676 - RNA, 19 nt, Homo sapiens
gaauugcacuuugauguuc

SEQ ID NO: 1014677 - RNA, 19 nt, Homo sapiens
gaaacccacuuuguucuca

SEQ ID NO: 1014678 - RNA, 19 nt, Homo sapiens
cagcaaaugccuauugauu

SEQ ID NO: 1014679 - RNA, 19 nt, Homo sapiens
gaagaugucauaauaaagc

SEQ ID NO: 1014680 - RNA, 19 nt, Homo sapiens
gaacguagugagucuuuca

SEQ ID NO: 1014681 - RNA, 19 nt, Homo sapiens
gcgauguccucucaacaga

SEQ ID NO: 1014682 - RNA, 19 nt, Homo sapiens
gagaacguagugagucuuu

SEQ ID NO: 1014683 - RNA, 19 nt, Homo sapiens
gcucagcaaaugccuauug

SEQ ID NO: 1014684 - RNA, 19 nt, Homo sapiens
gugaggagcuccgcgaugu

SEQ ID NO: 1014685 - RNA, 19 nt, Homo sapiens
ucagaaacccacuuuguuc

SEQ ID NO: 1014686 - RNA, 19 nt, Homo sapiens
gagcgccguuuccgccaaa

SEQ ID NO: 1014687 - RNA, 19 nt, Homo sapiens
cgaauugcacuuugauguu

SEQ ID NO: 1014688 - RNA, 19 nt, Homo sapiens
gcuccgcgauguccucuca

SEQ ID NO: 1014689 - RNA, 19 nt, Homo sapiens
gcgaauugcacuuugaugu

SEQ ID NO: 1014690 - RNA, 19 nt, Homo sapiens
guucagaaacccacuuugu

SEQ ID NO: 1014691 - RNA, 19 nt, Homo sapiens
cgacagcggaguagugguu

SEQ ID NO: 1014692 - RNA, 19 nt, Homo sapiens
ggacacuggacccuacugu

SEQ ID NO: 1014693 - RNA, 19 nt, Homo sapiens
cucagcaaaugccuauuga

SEQ ID NO: 1014694 - RNA, 19 nt, Homo sapiens
ggucccagcgcuccaacaa

SEQ ID NO: 1014695 - RNA, 19 nt, Homo sapiens
ccuauugauuugauugucu

SEQ ID NO: 1014696 - RNA, 19 nt, Homo sapiens
ggcuccagcuccaccaguu

SEQ ID NO: 1014697 - RNA, 19 nt, Homo sapiens
aagcuucuaccuccugaaa

SEQ ID NO: 1014698 - RNA, 19 nt, Homo sapiens
cauaauaaagcuucuaccu

SEQ ID NO: 1014699 - RNA, 19 nt, Homo sapiens
acacuggacccuacugucu

SEQ ID NO: 1014700 - RNA, 19 nt, Homo sapiens
ggaagaaacagaucauuua

SEQ ID NO: 1014701 - RNA, 19 nt, Homo sapiens
gaauguggcuuucauagga

SEQ ID NO: 1014702 - RNA, 19 nt, Homo sapiens
ggaaugcgcuucaaacauc

SEQ ID NO: 1014703 - RNA, 19 nt, Homo sapiens
caauagagauuacagaaug

SEQ ID NO: 1014704 - RNA, 19 nt, Homo sapiens
agaaagggcuucaguaaga

SEQ ID NO: 1014705 - RNA, 19 nt, Homo sapiens
ggucauggccuuugucaua

SEQ ID NO: 1014706 - RNA, 19 nt, Homo sapiens
gcaaagaccuucgaguguu

SEQ ID NO: 1014707 - RNA, 19 nt, Homo sapiens
gugaacagcugcuuuguga

SEQ ID NO: 1014708 - RNA, 19 nt, Homo sapiens
ggacaaaggccaacggaaa

SEQ ID NO: 1014709 - RNA, 19 nt, Homo sapiens
ggauuaugcuuaacaguga

SEQ ID NO: 1014710 - RNA, 19 nt, Homo sapiens
ggauguggauuaugcuuaa

SEQ ID NO: 1014711 - RNA, 19 nt, Homo sapiens
gaucccaauuugaauguua

SEQ ID NO: 1014712 - RNA, 19 nt, Homo sapiens
caacuuucuuugccacuua

SEQ ID NO: 1014713 - RNA, 19 nt, Homo sapiens
gagccagguuggucuguua

SEQ ID NO: 1014714 - RNA, 19 nt, Homo sapiens
ggaaggaauuauuacuuga

SEQ ID NO: 1014715 - RNA, 19 nt, Homo sapiens
gaaauucacacaaacgaaa

SEQ ID NO: 1014716 - RNA, 19 nt, Homo sapiens
uaacccaucucaauuauag

SEQ ID NO: 1014717 - RNA, 19 nt, Homo sapiens
aaccgcaucuguaguauua

SEQ ID NO: 1014718 - RNA, 19 nt, Homo sapiens
gaugcacaaugaaaguuua

SEQ ID NO: 1014719 - RNA, 19 nt, Homo sapiens
gagauugggauguggauua

SEQ ID NO: 1014720 - RNA, 19 nt, Homo sapiens
guacagaauucucaaugga

SEQ ID NO: 1014721 - RNA, 19 nt, Homo sapiens
gagcuaaaccuguauacuu

SEQ ID NO: 1014722 - RNA, 19 nt, Homo sapiens
uaugauaccucagugauuu

SEQ ID NO: 1014723 - RNA, 19 nt, Homo sapiens
caagacaacuuucgagagu

SEQ ID NO: 1014724 - RNA, 19 nt, Homo sapiens
gcagcuggcuugacauaau

SEQ ID NO: 1014725 - RNA, 19 nt, Homo sapiens
gaaccauaccguaauguuu

SEQ ID NO: 1014726 - RNA, 19 nt, Homo sapiens
cuauaggccuucuuaaauu

SEQ ID NO: 1014727 - RNA, 19 nt, Homo sapiens
ggucauggcauaccaauau

SEQ ID NO: 1014728 - RNA, 19 nt, Homo sapiens
uugauugccuuaagaguua

SEQ ID NO: 1014729 - RNA, 19 nt, Homo sapiens
gagccgaguuccucacauu

SEQ ID NO: 1014730 - RNA, 19 nt, Homo sapiens
ucacagaccgugucacuuu

SEQ ID NO: 1014731 - RNA, 19 nt, Homo sapiens
ggaaagcuuugggagauga

SEQ ID NO: 1014732 - RNA, 19 nt, Homo sapiens
caagagaauuagcaaacuu

SEQ ID NO: 1014733 - RNA, 19 nt, Homo sapiens
gaaaggaaugcgcuucaaa

SEQ ID NO: 1014734 - RNA, 19 nt, Homo sapiens
caagaaccauaccguaaug

SEQ ID NO: 1014735 - RNA, 19 nt, Homo sapiens
gaagaaauacccugagaag

SEQ ID NO: 1014736 - RNA, 19 nt, Homo sapiens
uuggacaacugaagaaaua

SEQ ID NO: 1014737 - RNA, 19 nt, Homo sapiens
gcacagacuucaagauugc

SEQ ID NO: 1014738 - RNA, 19 nt, Homo sapiens
ugaaguauguccaggaaga

SEQ ID NO: 1014739 - RNA, 19 nt, Homo sapiens
ccagaaagggcuucaguaa

SEQ ID NO: 1014740 - RNA, 19 nt, Homo sapiens
aaacaucaacgacaacuuu

SEQ ID NO: 1014741 - RNA, 19 nt, Homo sapiens
ucagauagccuguauauac

SEQ ID NO: 1014742 - RNA, 19 nt, Homo sapiens
gaccucugcugucucauuu

SEQ ID NO: 1014743 - RNA, 19 nt, Homo sapiens
gggaagaaacagaucauuu

SEQ ID NO: 1014744 - RNA, 19 nt, Homo sapiens
gauugucaguggcauaauu

SEQ ID NO: 1014745 - RNA, 19 nt, Homo sapiens
agaagaaacuugacuaugc

SEQ ID NO: 1014746 - RNA, 19 nt, Homo sapiens
gcauuugaauucacagaga

SEQ ID NO: 1014747 - RNA, 19 nt, Homo sapiens
gagauugccagcauacuuu

SEQ ID NO: 1014748 - RNA, 19 nt, Homo sapiens
caacgaaggcuauaaaguc

SEQ ID NO: 1014749 - RNA, 19 nt, Homo sapiens
cuaaacugcuuaaacgauu

SEQ ID NO: 1014750 - RNA, 19 nt, Homo sapiens
agugagagcugaaaugaga

SEQ ID NO: 1014751 - RNA, 19 nt, Homo sapiens
guacauacagugaauuguu

SEQ ID NO: 1014752 - RNA, 19 nt, Homo sapiens
ugacuaccaugguuuguug

SEQ ID NO: 1014753 - RNA, 19 nt, Homo sapiens
ucagauuuauggaguguuu

SEQ ID NO: 1014754 - RNA, 19 nt, Homo sapiens
caaauaugcuauggagcua

SEQ ID NO: 1014755 - RNA, 19 nt, Homo sapiens
ggaaaggaaugcgcuucaa

SEQ ID NO: 1014756 - RNA, 19 nt, Homo sapiens
ggucauggguggccacugu

SEQ ID NO: 1014757 - RNA, 19 nt, Homo sapiens
cggaagaccugucaagcaa

SEQ ID NO: 1014758 - RNA, 19 nt, Homo sapiens
gaacagcugcuuugugaag

SEQ ID NO: 1014759 - RNA, 19 nt, Homo sapiens
gugcaaguuuggaaaugua

SEQ ID NO: 1014760 - RNA, 19 nt, Homo sapiens
ucagauagagguauuaaga

SEQ ID NO: 1014761 - RNA, 19 nt, Homo sapiens
ggaggaaguccagaguuua

SEQ ID NO: 1014762 - RNA, 19 nt, Homo sapiens
gcacuaaccuccacuuccu

SEQ ID NO: 1014763 - RNA, 19 nt, Homo sapiens
gaucugcugucuaaaugau

SEQ ID NO: 1014764 - RNA, 19 nt, Homo sapiens
uaaagucugugagagauug

SEQ ID NO: 1014765 - RNA, 19 nt, Homo sapiens
ccaaaggcaacaugaagua

SEQ ID NO: 1014766 - RNA, 19 nt, Homo sapiens
uggaaacuauugacuaaga

SEQ ID NO: 1014767 - RNA, 19 nt, Homo sapiens
gaaagggcuucaguaagau

SEQ ID NO: 1014768 - RNA, 19 nt, Homo sapiens
uggaaggaauuauuacuug

SEQ ID NO: 1014769 - RNA, 19 nt, Homo sapiens
caaagaccuucgaguguuc

SEQ ID NO: 1014770 - RNA, 19 nt, Homo sapiens
gagaccauuuacuuuguuu

SEQ ID NO: 1014771 - RNA, 19 nt, Homo sapiens
caguauggaucccaauuug

SEQ ID NO: 1014772 - RNA, 19 nt, Homo sapiens
guccagaguuuacaagaga

SEQ ID NO: 1014773 - RNA, 19 nt, Homo sapiens
ugagcaaacucuuggaaau

SEQ ID NO: 1014774 - RNA, 19 nt, Homo sapiens
ggaaguaacagagaaggaa

SEQ ID NO: 1014775 - RNA, 19 nt, Homo sapiens
ugucagcacugcccaaaga

SEQ ID NO: 1014776 - RNA, 19 nt, Homo sapiens
ggauaaugaugaaacucaa

SEQ ID NO: 1014777 - RNA, 19 nt, Homo sapiens
gcaaccaucuccgccagaa

SEQ ID NO: 1014778 - RNA, 19 nt, Homo sapiens
ccacuguguugaucagauu

SEQ ID NO: 1014779 - RNA, 19 nt, Homo sapiens
guaucucacugcaucauau

SEQ ID NO: 1014780 - RNA, 19 nt, Homo sapiens
uaagauguguggcauuuac

SEQ ID NO: 1014781 - RNA, 19 nt, Homo sapiens
guugagugauugugaaaga

SEQ ID NO: 1014782 - RNA, 19 nt, Homo sapiens
gcccagcgcuaccuacguu

SEQ ID NO: 1014783 - RNA, 19 nt, Homo sapiens
acagaauucucaauggauu

SEQ ID NO: 1014784 - RNA, 19 nt, Homo sapiens
gcucaagggcaauaagaaa

SEQ ID NO: 1014785 - RNA, 19 nt, Homo sapiens
ucuuggaucugcugucuaa

SEQ ID NO: 1014786 - RNA, 19 nt, Homo sapiens
gauguguggcauuuacuua

SEQ ID NO: 1014787 - RNA, 19 nt, Homo sapiens
agauagagguauuaagaug

SEQ ID NO: 1014788 - RNA, 19 nt, Homo sapiens
guguaacccaucucaauua

SEQ ID NO: 1014789 - RNA, 19 nt, Homo sapiens
gauauucuuggacuugaua

SEQ ID NO: 1014790 - RNA, 19 nt, Homo sapiens
cugaugagcuccaagacaa

SEQ ID NO: 1014791 - RNA, 19 nt, Homo sapiens
gauagccuguauauaccua

SEQ ID NO: 1014792 - RNA, 19 nt, Homo sapiens
ggacacagauauaaaaugg

SEQ ID NO: 1014793 - RNA, 19 nt, Homo sapiens
cugaggaaauucacacaaa

SEQ ID NO: 1014794 - RNA, 19 nt, Homo sapiens
uguaaggucaugacaauuu

SEQ ID NO: 1014795 - RNA, 19 nt, Homo sapiens
ugucauagcaguugaaugu

SEQ ID NO: 1014796 - RNA, 19 nt, Homo sapiens
guauggaucccaauuugaa

SEQ ID NO: 1014797 - RNA, 19 nt, Homo sapiens
gcaagagaauuagcaaacu

SEQ ID NO: 1014798 - RNA, 19 nt, Homo sapiens
gaagaccugucaagcaacu

SEQ ID NO: 1014799 - RNA, 19 nt, Homo sapiens
caaguucagcuuuauguau

SEQ ID NO: 1014800 - RNA, 19 nt, Homo sapiens
cagccugggucaagaauua

SEQ ID NO: 1014801 - RNA, 19 nt, Homo sapiens
gacaacaccugguccauca

SEQ ID NO: 1014802 - RNA, 19 nt, Homo sapiens
gacuaagacuggcuccuuu

SEQ ID NO: 1014803 - RNA, 19 nt, Homo sapiens
cugcuggccuugcucauua

SEQ ID NO: 1014804 - RNA, 19 nt, Homo sapiens
ugaaaguauugcaguauug

SEQ ID NO: 1014805 - RNA, 19 nt, Homo sapiens
acaaacuacuugaacauga

SEQ ID NO: 1014806 - RNA, 19 nt, Homo sapiens
gaauuacacgcuuggauga

SEQ ID NO: 1014807 - RNA, 19 nt, Homo sapiens
gaaaguauugcaguauuga

SEQ ID NO: 1014808 - RNA, 19 nt, Homo sapiens
gcaccuggccagagugaaa

SEQ ID NO: 1014809 - RNA, 19 nt, Homo sapiens
ggauggacaggaugaagua

SEQ ID NO: 1014810 - RNA, 19 nt, Homo sapiens
gagcagacacaaacuacuu

SEQ ID NO: 1014811 - RNA, 19 nt, Homo sapiens
agaauggccugcaccaaga

SEQ ID NO: 1014812 - RNA, 19 nt, Homo sapiens
ugaugaaaguauugcagua

SEQ ID NO: 1014813 - RNA, 19 nt, Homo sapiens
caucuacccgggugucuua

SEQ ID NO: 1014814 - RNA, 19 nt, Homo sapiens
gacacaaacuacuugaaca

SEQ ID NO: 1014815 - RNA, 19 nt, Homo sapiens
caguauugaugccauugua

SEQ ID NO: 1014816 - RNA, 19 nt, Homo sapiens
gaagcuccuguuccucuua

SEQ ID NO: 1014817 - RNA, 19 nt, Homo sapiens
ggacuaagacuggcuccuu

SEQ ID NO: 1014818 - RNA, 19 nt, Homo sapiens
gcaccaagacccugcaaca

SEQ ID NO: 1014819 - RNA, 19 nt, Homo sapiens
uugaugccauuguagaaua

SEQ ID NO: 1014820 - RNA, 19 nt, Homo sapiens
gggagaggauggacaggau

SEQ ID NO: 1014821 - RNA, 19 nt, Homo sapiens
gguggauccugcugacuug

SEQ ID NO: 1014822 - RNA, 19 nt, Homo sapiens
gcagaaacacagccacauc

SEQ ID NO: 1014823 - RNA, 19 nt, Homo sapiens
gaugaaaguauugcaguau

SEQ ID NO: 1014824 - RNA, 19 nt, Homo sapiens
gaugacaggcuugcacuug

SEQ ID NO: 1014825 - RNA, 19 nt, Homo sapiens
agccacaucucuuccauug

SEQ ID NO: 1014826 - RNA, 19 nt, Homo sapiens
gcacuugcccuugggauag

SEQ ID NO: 1014827 - RNA, 19 nt, Homo sapiens
aaacacagccacaucucuu

SEQ ID NO: 1014828 - RNA, 19 nt, Homo sapiens
gagaggauggacaggauga

SEQ ID NO: 1014829 - RNA, 19 nt, Homo sapiens
gaaacacagccacaucucu

SEQ ID NO: 1014830 - RNA, 19 nt, Homo sapiens
caaacuacuugaacaugac

SEQ ID NO: 1014831 - RNA, 19 nt, Homo sapiens
gcagacacaaacuacuuga

SEQ ID NO: 1014832 - RNA, 19 nt, Homo sapiens
aaugugaccuggagugucu

SEQ ID NO: 1014833 - RNA, 19 nt, Homo sapiens
guauugaugccauuguaga

SEQ ID NO: 1014834 - RNA, 19 nt, Homo sapiens
gggcagauuccauccaagu

SEQ ID NO: 1014835 - RNA, 19 nt, Homo sapiens
ccugagugcccucugauga

SEQ ID NO: 1014836 - RNA, 19 nt, Homo sapiens
gcugauguccacccucuuc

SEQ ID NO: 1014837 - RNA, 19 nt, Homo sapiens
uggacaggaugaaguaagu

SEQ ID NO: 1014838 - RNA, 19 nt, Homo sapiens
gcaagccacaaccgagaug

SEQ ID NO: 1014839 - RNA, 19 nt, Homo sapiens
gaaaaggaggggcagauuc

SEQ ID NO: 1014840 - RNA, 19 nt, Homo sapiens
guagaauagaacuggaauu

SEQ ID NO: 1014841 - RNA, 19 nt, Homo sapiens
ggacuuccacaaugaacag

SEQ ID NO: 1014842 - RNA, 19 nt, Homo sapiens
cagaaacacagccacaucu

SEQ ID NO: 1014843 - RNA, 19 nt, Homo sapiens
caacagucccagcccaucu

SEQ ID NO: 1014844 - RNA, 19 nt, Homo sapiens
gacuggcuccuuugggaaa

SEQ ID NO: 1014845 - RNA, 19 nt, Homo sapiens
gcaguauugaugccauugu

SEQ ID NO: 1014846 - RNA, 19 nt, Homo sapiens
aagcuccuguuccucuuau

SEQ ID NO: 1014847 - RNA, 19 nt, Homo sapiens
acacaaacuacuugaacau

SEQ ID NO: 1014848 - RNA, 19 nt, Homo sapiens
cuacccgggugucuuacga

SEQ ID NO: 1014849 - RNA, 19 nt, Homo sapiens
gcaggagccaccacaacca

SEQ ID NO: 1014850 - RNA, 19 nt, Homo sapiens
ugaugccauuguagaauag

SEQ ID NO: 1014851 - RNA, 19 nt, Homo sapiens
gcuccuguuccucuuauuc

SEQ ID NO: 1014852 - RNA, 19 nt, Homo sapiens
agacacaaacuacuugaac

SEQ ID NO: 1014853 - RNA, 19 nt, Homo sapiens
ucucuuccauugccugagu

SEQ ID NO: 1014854 - RNA, 19 nt, Homo sapiens
gggagcagacacaaacuac

SEQ ID NO: 1014855 - RNA, 19 nt, Homo sapiens
gcaaauacgugcucuauga

SEQ ID NO: 1014856 - RNA, 19 nt, Homo sapiens
gagcagagguguaaauaag

SEQ ID NO: 1014857 - RNA, 19 nt, Homo sapiens
gaaaggacaguucagcaaa

SEQ ID NO: 1014858 - RNA, 19 nt, Homo sapiens
gcgugaagcucaagaacuu

SEQ ID NO: 1014859 - RNA, 19 nt, Homo sapiens
ggaugaggaugucaccaaa

SEQ ID NO: 1014860 - RNA, 19 nt, Homo sapiens
gcacaggcgguacgagaua

SEQ ID NO: 1014861 - RNA, 19 nt, Homo sapiens
cagcagaccuagucguuug

SEQ ID NO: 1014862 - RNA, 19 nt, Homo sapiens
gcuauaagaucaaguacag

SEQ ID NO: 1014863 - RNA, 19 nt, Homo sapiens
uggaggaucucaucauuug

SEQ ID NO: 1014864 - RNA, 19 nt, Homo sapiens
gagaagcccucagaaaucu

SEQ ID NO: 1014865 - RNA, 19 nt, Homo sapiens
gcaagaaguacgccaagaa

SEQ ID NO: 1014866 - RNA, 19 nt, Homo sapiens
gggcugagcuuaccuccau

SEQ ID NO: 1014867 - RNA, 19 nt, Homo sapiens
gcuggaggaucucaucauu

SEQ ID NO: 1014868 - RNA, 19 nt, Homo sapiens
gcacaggccuacagcuaca

SEQ ID NO: 1014869 - RNA, 19 nt, Homo sapiens
ggagaagcccucagaaauc

SEQ ID NO: 1014870 - RNA, 19 nt, Homo sapiens
ggugaucgauggcauguca

SEQ ID NO: 1014871 - RNA, 19 nt, Homo sapiens
gguacaagauuuauuucug

SEQ ID NO: 1014872 - RNA, 19 nt, Homo sapiens
gcagcagccugacggagaa

SEQ ID NO: 1014873 - RNA, 19 nt, Homo sapiens
gagcuuaccuccauguacu

SEQ ID NO: 1014874 - RNA, 19 nt, Homo sapiens
ccagucagccuucuagaaa

SEQ ID NO: 1014875 - RNA, 19 nt, Homo sapiens
gcaagagccgggagagaaa

SEQ ID NO: 1014876 - RNA, 19 nt, Homo sapiens
ggaaaggacaguucagcaa

SEQ ID NO: 1014877 - RNA, 19 nt, Homo sapiens
gagugaaggcgaccaauga

SEQ ID NO: 1014878 - RNA, 19 nt, Homo sapiens
ucaccgcgcucaccaccua

SEQ ID NO: 1014879 - RNA, 19 nt, Homo sapiens
gaacaggaagaggagguua

SEQ ID NO: 1014880 - RNA, 19 nt, Homo sapiens
augaggaugucaccaaaua

SEQ ID NO: 1014881 - RNA, 19 nt, Homo sapiens
gagccaagaccuucaccua

SEQ ID NO: 1014882 - RNA, 19 nt, Homo sapiens
ucaccucagugcuguguuu

SEQ ID NO: 1014883 - RNA, 19 nt, Homo sapiens
ggagagccauccucguauc

SEQ ID NO: 1014884 - RNA, 19 nt, Homo sapiens
ggagcagagguguaaauaa

SEQ ID NO: 1014885 - RNA, 19 nt, Homo sapiens
gggacauccucaucaaaga

SEQ ID NO: 1014886 - RNA, 19 nt, Homo sapiens
agaucgagguggcugcuua

SEQ ID NO: 1014887 - RNA, 19 nt, Homo sapiens
gcgggcaucuggagagaga

SEQ ID NO: 1014888 - RNA, 19 nt, Homo sapiens
ugucuggccugaagaaguu

SEQ ID NO: 1014889 - RNA, 19 nt, Homo sapiens
gaccacaaccucagugaau

SEQ ID NO: 1014890 - RNA, 19 nt, Homo sapiens
gcagcugccucgcuucaca

SEQ ID NO: 1014891 - RNA, 19 nt, Homo sapiens
gggcacaggccuacagcua

SEQ ID NO: 1014892 - RNA, 19 nt, Homo sapiens
ccaccaaccugggcauuuc

SEQ ID NO: 1014893 - RNA, 19 nt, Homo sapiens
gauuagguuuaacgcauug

SEQ ID NO: 1014894 - RNA, 19 nt, Homo sapiens
gaagugacagcgaguacga

SEQ ID NO: 1014895 - RNA, 19 nt, Homo sapiens
gcucugccaucgccauuca

SEQ ID NO: 1014896 - RNA, 19 nt, Homo sapiens
cgagguggcugcuuacaac

SEQ ID NO: 1014897 - RNA, 19 nt, Homo sapiens
gggagcagagguguaaaua

SEQ ID NO: 1014898 - RNA, 19 nt, Homo sapiens
ggucaacgacuaugguuuc

SEQ ID NO: 1014899 - RNA, 19 nt, Homo sapiens
gcagaggacaagaucaaug

SEQ ID NO: 1014900 - RNA, 19 nt, Homo sapiens
cacaaugccuccagcuuca

SEQ ID NO: 1014901 - RNA, 19 nt, Homo sapiens
ucucaaggguuacaucauc

SEQ ID NO: 1014902 - RNA, 19 nt, Homo sapiens
gaaccaaccaguccaucau

SEQ ID NO: 1014903 - RNA, 19 nt, Homo sapiens
augaugagcuuggaugaaa

SEQ ID NO: 1014904 - RNA, 19 nt, Homo sapiens
caaauacgugcucuaugaa

SEQ ID NO: 1014905 - RNA, 19 nt, Homo sapiens
cggagaagcccucagaaau

SEQ ID NO: 1014906 - RNA, 19 nt, Homo sapiens
gcacuacucggaugaggau

SEQ ID NO: 1014907 - RNA, 19 nt, Homo sapiens
uccaccagcucuccaauga

SEQ ID NO: 1014908 - RNA, 19 nt, Homo sapiens
ggacaguucagcaaagaca

SEQ ID NO: 1014909 - RNA, 19 nt, Homo sapiens
cgacuggccuuggcacugu

SEQ ID NO: 1014910 - RNA, 19 nt, Homo sapiens
gagagggagcggaggcuaa

SEQ ID NO: 1014911 - RNA, 19 nt, Homo sapiens
aguacgaggucgacucaaa

SEQ ID NO: 1014912 - RNA, 19 nt, Homo sapiens
caaauacaacgaccucauc

SEQ ID NO: 1014913 - RNA, 19 nt, Homo sapiens
gggcaaauacgugcucuau

SEQ ID NO: 1014914 - RNA, 19 nt, Homo sapiens
cggccuaacuuucaagaca

SEQ ID NO: 1014915 - RNA, 19 nt, Homo sapiens
gaggaucucaucauuugga

SEQ ID NO: 1014916 - RNA, 19 nt, Homo sapiens
aggguuacaucaucaggua

SEQ ID NO: 1014917 - RNA, 19 nt, Homo sapiens
ugauuagguuuaacgcauu

SEQ ID NO: 1014918 - RNA, 19 nt, Homo sapiens
gcuuagcgccuuccuuguu

SEQ ID NO: 1014919 - RNA, 19 nt, Homo sapiens
acuaaagggugagaauuug

SEQ ID NO: 1014920 - RNA, 19 nt, Homo sapiens
cgaaagaacggccuguaca

SEQ ID NO: 1014921 - RNA, 19 nt, Homo sapiens
gaaguacgccaagaagaca

SEQ ID NO: 1014922 - RNA, 19 nt, Homo sapiens
ucccggagauggaauacaa

SEQ ID NO: 1014923 - RNA, 19 nt, Homo sapiens
ggcaagagccgggagagaa

SEQ ID NO: 1014924 - RNA, 19 nt, Homo sapiens
auaaggugauguauaagga

SEQ ID NO: 1014925 - RNA, 19 nt, Homo sapiens
gaggaugucaccaaauaca

SEQ ID NO: 1014926 - RNA, 19 nt, Homo sapiens
ucaaagacauccccaagga

SEQ ID NO: 1014927 - RNA, 19 nt, Homo sapiens
cagcagaggacaagaucaa

SEQ ID NO: 1014928 - RNA, 19 nt, Homo sapiens
gguaccaguuuaagaacau

SEQ ID NO: 1014929 - RNA, 19 nt, Homo sapiens
ucagguacaucugggagaa

SEQ ID NO: 1014930 - RNA, 19 nt, Homo sapiens
acagcgagaugaugagcuu

SEQ ID NO: 1014931 - RNA, 19 nt, Homo sapiens
uaugggacauccucaucaa

SEQ ID NO: 1014932 - RNA, 19 nt, Homo sapiens
ccacagcagcaccucguaa

SEQ ID NO: 1014933 - RNA, 19 nt, Homo sapiens
auggaauucucaaggguua

SEQ ID NO: 1014934 - RNA, 19 nt, Homo sapiens
ggagaugucggagaacaau

SEQ ID NO: 1014935 - RNA, 19 nt, Homo sapiens
guauccgccuggacagaaa

SEQ ID NO: 1014936 - RNA, 19 nt, Homo sapiens
gugggaugauuagguuuaa

SEQ ID NO: 1014937 - RNA, 19 nt, Homo sapiens
ggccacagcgagaugauga

SEQ ID NO: 1014938 - RNA, 19 nt, Homo sapiens
ucaccggcuugggcaaaua

SEQ ID NO: 1014939 - RNA, 19 nt, Homo sapiens
ucugugaccuugcaguuca

SEQ ID NO: 1014940 - RNA, 19 nt, Homo sapiens
aaaggacaguucagcaaag

SEQ ID NO: 1014941 - RNA, 19 nt, Homo sapiens
cgggagacaucggcacgua

SEQ ID NO: 1014942 - RNA, 19 nt, Homo sapiens
aaacuaaagggugagaauu

SEQ ID NO: 1014943 - RNA, 19 nt, Homo sapiens
ugacggagaagcccucaga

SEQ ID NO: 1014944 - RNA, 19 nt, Homo sapiens
gaaagaacggccuguacac

SEQ ID NO: 1014945 - RNA, 19 nt, Homo sapiens
caagaaguacgccaagaag

SEQ ID NO: 1014946 - RNA, 19 nt, Homo sapiens
aagaggagguuaccauggu

SEQ ID NO: 1014947 - RNA, 19 nt, Homo sapiens
ugguggagguggagaaguu

SEQ ID NO: 1014948 - RNA, 19 nt, Homo sapiens
gcucuucagcuuugagaug

SEQ ID NO: 1014949 - RNA, 19 nt, Homo sapiens
gcuaucacuuggcagaaag

SEQ ID NO: 1014950 - RNA, 19 nt, Homo sapiens
uggacaaccugaacaagca

SEQ ID NO: 1014951 - RNA, 19 nt, Homo sapiens
agucagccuucuagaaaga

SEQ ID NO: 1014952 - RNA, 19 nt, Homo sapiens
ggagacaucggcacguaca

SEQ ID NO: 1014953 - RNA, 19 nt, Homo sapiens
aacuaaagggugagaauuu

SEQ ID NO: 1014954 - RNA, 19 nt, Homo sapiens
ggacagcacggugaucgau

SEQ ID NO: 1014955 - RNA, 19 nt, Homo sapiens
caacaucccucaucaguuc

SEQ ID NO: 1014956 - RNA, 19 nt, Homo sapiens
ucagauggcuucaccuuug

SEQ ID NO: 1014957 - RNA, 19 nt, Homo sapiens
gcagauggcguccuuaaug

SEQ ID NO: 1014958 - RNA, 19 nt, Homo sapiens
agaaagaacuggaggaucu

SEQ ID NO: 1014959 - RNA, 19 nt, Homo sapiens
gaagagaaggaucccagua

SEQ ID NO: 1014960 - RNA, 19 nt, Homo sapiens
gcaaagcacugugguucga

SEQ ID NO: 1014961 - RNA, 19 nt, Homo sapiens
cagauggcguccuuaauga

SEQ ID NO: 1014962 - RNA, 19 nt, Homo sapiens
ggaauuccagcucuucuuu

SEQ ID NO: 1014963 - RNA, 19 nt, Homo sapiens
gcucauggcuauggaacaa

SEQ ID NO: 1014964 - RNA, 19 nt, Homo sapiens
ggagcaacguggaccaguu

SEQ ID NO: 1014965 - RNA, 19 nt, Homo sapiens
gacaacaccaaauuacuuu

SEQ ID NO: 1014966 - RNA, 19 nt, Homo sapiens
ccacaugggugacuaugag

SEQ ID NO: 1014967 - RNA, 19 nt, Homo sapiens
gaagguguuucccuguugu

SEQ ID NO: 1014968 - RNA, 19 nt, Homo sapiens
gagcaacguggaccaguuu

SEQ ID NO: 1014969 - RNA, 19 nt, Homo sapiens
gaaucacucuguccugaag

SEQ ID NO: 1014970 - RNA, 19 nt, Homo sapiens
ugaaggagacggccaauca

SEQ ID NO: 1014971 - RNA, 19 nt, Homo sapiens
ugacaacaccaaauuacuu

SEQ ID NO: 1014972 - RNA, 19 nt, Homo sapiens
gacauucuucuaccuagua

SEQ ID NO: 1014973 - RNA, 19 nt, Homo sapiens
cagcagcgccugucagaug

SEQ ID NO: 1014974 - RNA, 19 nt, Homo sapiens
ccacggaggaugcaaagga

SEQ ID NO: 1014975 - RNA, 19 nt, Homo sapiens
gcaacaucccucaucaguu

SEQ ID NO: 1014976 - RNA, 19 nt, Homo sapiens
ccucuucggugacauucuu

SEQ ID NO: 1014977 - RNA, 19 nt, Homo sapiens
cgacagaaccacaucaaac

SEQ ID NO: 1014978 - RNA, 19 nt, Homo sapiens
ggagacggccaaucagauc

SEQ ID NO: 1014979 - RNA, 19 nt, Homo sapiens
agagaaggaucccaguauc

SEQ ID NO: 1014980 - RNA, 19 nt, Homo sapiens
agaagguguuucccuguug

SEQ ID NO: 1014981 - RNA, 19 nt, Homo sapiens
aagaagguguuucccuguu

SEQ ID NO: 1014982 - RNA, 19 nt, Homo sapiens
agacagaggaggcguggaa

SEQ ID NO: 1014983 - RNA, 19 nt, Homo sapiens
ggaucucuuucacacgauu

SEQ ID NO: 1014984 - RNA, 19 nt, Homo sapiens
gugcccaggcgccaaauaa

SEQ ID NO: 1014985 - RNA, 19 nt, Homo sapiens
aaaggaagagggucuggaa

SEQ ID NO: 1014986 - RNA, 19 nt, Homo sapiens
ccagccagcuccgacagaa

SEQ ID NO: 1014987 - RNA, 19 nt, Homo sapiens
gauggcguccuuaaugaga

SEQ ID NO: 1014988 - RNA, 19 nt, Homo sapiens
gguguuucccuguuguuaa

SEQ ID NO: 1014989 - RNA, 19 nt, Homo sapiens
cacggaggaugcaaaggaa

SEQ ID NO: 1014990 - RNA, 19 nt, Homo sapiens
gaacuggaggaucucuuuc

SEQ ID NO: 1014991 - RNA, 19 nt, Homo sapiens
gaauuccagcucuucuuug

SEQ ID NO: 1014992 - RNA, 19 nt, Homo sapiens
gccauggguuauaccaaga

SEQ ID NO: 1014993 - RNA, 19 nt, Homo sapiens
cagauggcuucaccuuugu

SEQ ID NO: 1014994 - RNA, 19 nt, Homo sapiens
ggcaagacccuuccaucug

SEQ ID NO: 1014995 - RNA, 19 nt, Homo sapiens
ggugacauucuucuaccua

SEQ ID NO: 1014996 - RNA, 19 nt, Homo sapiens
aauccauccuccacaagaa

SEQ ID NO: 1014997 - RNA, 19 nt, Homo sapiens
gaacugcuuccacaucacu

SEQ ID NO: 1014998 - RNA, 19 nt, Homo sapiens
accacaagcucauggcuau

SEQ ID NO: 1014999 - RNA, 19 nt, Homo sapiens
ugaaggccauggguuauac

SEQ ID NO: 1015000 - RNA, 19 nt, Homo sapiens
cagcuucccaggacccuaa

SEQ ID NO: 1015001 - RNA, 19 nt, Homo sapiens
agaacuggaggaucucuuu

SEQ ID NO: 1015002 - RNA, 19 nt, Homo sapiens
caacguggaccaguuugug

SEQ ID NO: 1015003 - RNA, 19 nt, Homo sapiens
aagagaaggaucccaguau

SEQ ID NO: 1015004 - RNA, 19 nt, Homo sapiens
caauccauccuccacaaga

SEQ ID NO: 1015005 - RNA, 19 nt, Homo sapiens
cuggagaccuugaaucacu

SEQ ID NO: 1015006 - RNA, 19 nt, Homo sapiens
gaccacacccugcccucuu

SEQ ID NO: 1015007 - RNA, 19 nt, Homo sapiens
cagacacuuuggugcagaa

SEQ ID NO: 1015008 - RNA, 19 nt, Homo sapiens
gguggaggccaucgaggaa

SEQ ID NO: 1015009 - RNA, 19 nt, Homo sapiens
ggaggaauuccagcucuuc

SEQ ID NO: 1015010 - RNA, 19 nt, Homo sapiens
guguuucccuguuguuaag

SEQ ID NO: 1015011 - RNA, 19 nt, Homo sapiens
augggaagcuguccuugga

SEQ ID NO: 1015012 - RNA, 19 nt, Homo sapiens
ccacuggcgugaggaacug

SEQ ID NO: 1015013 - RNA, 19 nt, Homo sapiens
ggaccacuggcgugaggaa

SEQ ID NO: 1015014 - RNA, 19 nt, Homo sapiens
ugacauucuucuaccuagu

SEQ ID NO: 1015015 - RNA, 19 nt, Homo sapiens
cuucaccuuugucaucuau

SEQ ID NO: 1015016 - RNA, 19 nt, Homo sapiens
gaaggagacggccaaucag

SEQ ID NO: 1015017 - RNA, 19 nt, Homo sapiens
ggaccacaugggugacuau

SEQ ID NO: 1015018 - RNA, 19 nt, Homo sapiens
acucugacaacaccaaauu

SEQ ID NO: 1015019 - RNA, 19 nt, Homo sapiens
gcaacguggaccaguuugu

SEQ ID NO: 1015020 - RNA, 19 nt, Homo sapiens
gcugacuccgccucucuuu

SEQ ID NO: 1015021 - RNA, 19 nt, Homo sapiens
uggugaagcccaagguuga

SEQ ID NO: 1015022 - RNA, 19 nt, Homo sapiens
ucugcaacaucccucauca

SEQ ID NO: 1015023 - RNA, 19 nt, Homo sapiens
gcuucaccuuugucaucua

SEQ ID NO: 1015024 - RNA, 19 nt, Homo sapiens
uggcguccuuaaugagaaa

SEQ ID NO: 1015025 - RNA, 19 nt, Homo sapiens
ucucuuuucugcagauuuu

SEQ ID NO: 1015026 - RNA, 19 nt, Homo sapiens
ugagaaggcagagcagugu

SEQ ID NO: 1015027 - RNA, 19 nt, Homo sapiens
acacuuuggugcagaagcu

SEQ ID NO: 1015028 - RNA, 19 nt, Homo sapiens
cagcucuucuuugcagaug

SEQ ID NO: 1015029 - RNA, 19 nt, Homo sapiens
uugggaggcuggagagcaa

SEQ ID NO: 1015030 - RNA, 19 nt, Homo sapiens
cugaaggccauggguuaua

SEQ ID NO: 1015031 - RNA, 19 nt, Homo sapiens
uucacacgauugacucuga

SEQ ID NO: 1015032 - RNA, 19 nt, Homo sapiens
guauaaagaugagugcuua

SEQ ID NO: 1015033 - RNA, 19 nt, Homo sapiens
gaaaugaauugagaagcua

SEQ ID NO: 1015034 - RNA, 19 nt, Homo sapiens
aaagaugagugcuuagaua

SEQ ID NO: 1015035 - RNA, 19 nt, Homo sapiens
gaucugugguucucuguuu

SEQ ID NO: 1015036 - RNA, 19 nt, Homo sapiens
gaagcuauccaucucauuu

SEQ ID NO: 1015037 - RNA, 19 nt, Homo sapiens
ggaauuugguggcauccua

SEQ ID NO: 1015038 - RNA, 19 nt, Homo sapiens
gcucaucaccgaaguguuu

SEQ ID NO: 1015039 - RNA, 19 nt, Homo sapiens
gaugagugcuuagauauca

SEQ ID NO: 1015040 - RNA, 19 nt, Homo sapiens
gcucggagauggugaaagu

SEQ ID NO: 1015041 - RNA, 19 nt, Homo sapiens
caaagucacugccauaugc

SEQ ID NO: 1015042 - RNA, 19 nt, Homo sapiens
caaaugcguuggugcaguu

SEQ ID NO: 1015043 - RNA, 19 nt, Homo sapiens
ucaagugucuucccagcua

SEQ ID NO: 1015044 - RNA, 19 nt, Homo sapiens
guaaucgguuguucuuuga

SEQ ID NO: 1015045 - RNA, 19 nt, Homo sapiens
ccacagagcuggccauucc

SEQ ID NO: 1015046 - RNA, 19 nt, Homo sapiens
acacugagcccgcagagua

SEQ ID NO: 1015047 - RNA, 19 nt, Homo sapiens
uggccaagcuccauaagaa

SEQ ID NO: 1015048 - RNA, 19 nt, Homo sapiens
gggcuccgcuaaaucauug

SEQ ID NO: 1015049 - RNA, 19 nt, Homo sapiens
gaagaagaagcaucuggaa

SEQ ID NO: 1015050 - RNA, 19 nt, Homo sapiens
uguaaucgguuguucuuug

SEQ ID NO: 1015051 - RNA, 19 nt, Homo sapiens
ucucauuucugguauaguu

SEQ ID NO: 1015052 - RNA, 19 nt, Homo sapiens
cuacuguucuguucuguau

SEQ ID NO: 1015053 - RNA, 19 nt, Homo sapiens
ccgcagggcuccucuaaag

SEQ ID NO: 1015054 - RNA, 19 nt, Homo sapiens
caucaaccgugccaacaau

SEQ ID NO: 1015055 - RNA, 19 nt, Homo sapiens
caauaugaaugccucaaag

SEQ ID NO: 1015056 - RNA, 19 nt, Homo sapiens
agacacagaugaggaugaa

SEQ ID NO: 1015057 - RNA, 19 nt, Homo sapiens
agaucucgcuccuguguuu

SEQ ID NO: 1015058 - RNA, 19 nt, Homo sapiens
ggagugugccuuugguuau

SEQ ID NO: 1015059 - RNA, 19 nt, Homo sapiens
ugaaaugaauugagaagcu

SEQ ID NO: 1015060 - RNA, 19 nt, Homo sapiens
gccauuccauuaccuugaa

SEQ ID NO: 1015061 - RNA, 19 nt, Homo sapiens
ccagcuaccucccaguuuc

SEQ ID NO: 1015062 - RNA, 19 nt, Homo sapiens
cuacagagaaguaaauauc

SEQ ID NO: 1015063 - RNA, 19 nt, Homo sapiens
acuguucuguucuguauuu

SEQ ID NO: 1015064 - RNA, 19 nt, Homo sapiens
ggaagacacagaugaggau

SEQ ID NO: 1015065 - RNA, 19 nt, Homo sapiens
ugucugaggucgcaagugu

SEQ ID NO: 1015066 - RNA, 19 nt, Homo sapiens
uauaguucauguagcauug

SEQ ID NO: 1015067 - RNA, 19 nt, Homo sapiens
gaaugcagggccucuucua

SEQ ID NO: 1015068 - RNA, 19 nt, Homo sapiens
caacugccaccacucaaga

SEQ ID NO: 1015069 - RNA, 19 nt, Homo sapiens
gaauugagaagcuauccau

SEQ ID NO: 1015070 - RNA, 19 nt, Homo sapiens
aacggucucuuuggaaaua

SEQ ID NO: 1015071 - RNA, 19 nt, Homo sapiens
cagccugccucucugaaug

SEQ ID NO: 1015072 - RNA, 19 nt, Homo sapiens
agagcuggccauuccauua

SEQ ID NO: 1015073 - RNA, 19 nt, Homo sapiens
aaaccacgccuauauuauc

SEQ ID NO: 1015074 - RNA, 19 nt, Homo sapiens
gugcuuagauaucaucaac

SEQ ID NO: 1015075 - RNA, 19 nt, Homo sapiens
gugcuggcuuugugaaaug

SEQ ID NO: 1015076 - RNA, 19 nt, Homo sapiens
caacuugguuucguaucug

SEQ ID NO: 1015077 - RNA, 19 nt, Homo sapiens
gaccgcagggcuccucuaa

SEQ ID NO: 1015078 - RNA, 19 nt, Homo sapiens
ggagcucucugcccguagu

SEQ ID NO: 1015079 - RNA, 19 nt, Homo sapiens
ccaauaugaaugccucaaa

SEQ ID NO: 1015080 - RNA, 19 nt, Homo sapiens
ucaacaagcugggcuacca

SEQ ID NO: 1015081 - RNA, 19 nt, Homo sapiens
ccagugccacccaggauaa

SEQ ID NO: 1015082 - RNA, 19 nt, Homo sapiens
ccaaggcccugggagaauc

SEQ ID NO: 1015083 - RNA, 19 nt, Homo sapiens
ccacagcccaauaugaaug

SEQ ID NO: 1015084 - RNA, 19 nt, Homo sapiens
gagaaugcagggccucuuc

SEQ ID NO: 1015085 - RNA, 19 nt, Homo sapiens
ucaacuugguuucguaucu

SEQ ID NO: 1015086 - RNA, 19 nt, Homo sapiens
ggcagaaguaccuagagua

SEQ ID NO: 1015087 - RNA, 19 nt, Homo sapiens
gaaauacuaagaagcucau

SEQ ID NO: 1015088 - RNA, 19 nt, Homo sapiens
gcaaggccacccggaagaa

SEQ ID NO: 1015089 - RNA, 19 nt, Homo sapiens
ccaucucauuucugguaua

SEQ ID NO: 1015090 - RNA, 19 nt, Homo sapiens
ucaaucggcuacuguucug

SEQ ID NO: 1015091 - RNA, 19 nt, Homo sapiens
gccacacgcuagccuuuca

SEQ ID NO: 1015092 - RNA, 19 nt, Homo sapiens
cauaagaaagauccacaga

SEQ ID NO: 1015093 - RNA, 19 nt, Homo sapiens
caaguuuggccuucugaug

SEQ ID NO: 1015094 - RNA, 19 nt, Homo sapiens
gaauuugguggcauccuau

SEQ ID NO: 1015095 - RNA, 19 nt, Homo sapiens
gcuuugugcuggcuuugug

SEQ ID NO: 1015096 - RNA, 19 nt, Homo sapiens
uaauagguguagcagagau

SEQ ID NO: 1015097 - RNA, 19 nt, Homo sapiens
augcagggccucuucuaua

SEQ ID NO: 1015098 - RNA, 19 nt, Homo sapiens
uuugguggcauccuauuua

SEQ ID NO: 1015099 - RNA, 19 nt, Homo sapiens
aaccacgccuauauuauca

SEQ ID NO: 1015100 - RNA, 19 nt, Homo sapiens
ucaaccgugccaacaauaa

SEQ ID NO: 1015101 - RNA, 19 nt, Homo sapiens
caucucauuucugguauag

SEQ ID NO: 1015102 - RNA, 19 nt, Homo sapiens
ccacgccuauauuaucauc

SEQ ID NO: 1015103 - RNA, 19 nt, Homo sapiens
gagugugccuuugguuauc

SEQ ID NO: 1015104 - RNA, 19 nt, Homo sapiens
ugcagggccucuucuauag

SEQ ID NO: 1015105 - RNA, 19 nt, Homo sapiens
uaaagaugagugcuuagau

SEQ ID NO: 1015106 - RNA, 19 nt, Homo sapiens
gcagggccucuucuauaga

SEQ ID NO: 1015107 - RNA, 19 nt, Homo sapiens
ccaaagucacugccauaug

SEQ ID NO: 1015108 - RNA, 19 nt, Homo sapiens
guuggugcaguuccucuua

SEQ ID NO: 1015109 - RNA, 19 nt, Homo sapiens
gcauuguaaucgguuguuc

SEQ ID NO: 1015110 - RNA, 19 nt, Homo sapiens
uaguucauguagcauugua

SEQ ID NO: 1015111 - RNA, 19 nt, Homo sapiens
guauaguucauguagcauu

SEQ ID NO: 1015112 - RNA, 19 nt, Homo sapiens
gagcuggccauuccauuac

SEQ ID NO: 1015113 - RNA, 19 nt, Homo sapiens
ggccaagcuccauaagaaa

SEQ ID NO: 1015114 - RNA, 19 nt, Homo sapiens
gggcuaccauacagggaau

SEQ ID NO: 1015115 - RNA, 19 nt, Homo sapiens
uggagugugccuuugguua

SEQ ID NO: 1015116 - RNA, 19 nt, Homo sapiens
ucccacagcccaauaugaa

SEQ ID NO: 1015117 - RNA, 19 nt, Homo sapiens
ugguauaguucauguagca

SEQ ID NO: 1015118 - RNA, 19 nt, Homo sapiens
gugcaguuccucuuaguca

SEQ ID NO: 1015119 - RNA, 19 nt, Homo sapiens
ggcgaaucccuuacacuga

SEQ ID NO: 1015120 - RNA, 19 nt, Homo sapiens
uuagacaggcccaaguuug

SEQ ID NO: 1015121 - RNA, 19 nt, Homo sapiens
gguagcagcggcaaauuuu

SEQ ID NO: 1015122 - RNA, 19 nt, Homo sapiens
uaagcuggagugugccuuu

SEQ ID NO: 1015123 - RNA, 19 nt, Homo sapiens
aagaugagugcuuagauau

SEQ ID NO: 1015124 - RNA, 19 nt, Homo sapiens
gcaacugccaccacucaag

SEQ ID NO: 1015125 - RNA, 19 nt, Homo sapiens
ccaagcuccauaagaaaga

SEQ ID NO: 1015126 - RNA, 19 nt, Homo sapiens
acgccuauauuaucaucaa

SEQ ID NO: 1015127 - RNA, 19 nt, Homo sapiens
ggcccugggucucucugaa

SEQ ID NO: 1015128 - RNA, 19 nt, Homo sapiens
ugggagaaucuaaaucuga

SEQ ID NO: 1015129 - RNA, 19 nt, Homo sapiens
ggaucccuuugccugugua

SEQ ID NO: 1015130 - RNA, 19 nt, Homo sapiens
cgguagcagcggcaaauuu

SEQ ID NO: 1015131 - RNA, 19 nt, Homo sapiens
uuuaugugguguugauuuc

SEQ ID NO: 1015132 - RNA, 19 nt, Homo sapiens
ggaauacucugaugugauu

SEQ ID NO: 1015133 - RNA, 19 nt, Homo sapiens
gcugguaccuccuaauuua

SEQ ID NO: 1015134 - RNA, 19 nt, Homo sapiens
gcagaaacgugcagauaaa

SEQ ID NO: 1015135 - RNA, 19 nt, Homo sapiens
gaagagagcaagcagauuu

SEQ ID NO: 1015136 - RNA, 19 nt, Homo sapiens
gaaccuaucugcuuucaag

SEQ ID NO: 1015137 - RNA, 19 nt, Homo sapiens
caauacagcucugcuagua

SEQ ID NO: 1015138 - RNA, 19 nt, Homo sapiens
ccaaagugcugggauuaua

SEQ ID NO: 1015139 - RNA, 19 nt, Homo sapiens
gaagaaagcaaccuccaaa

SEQ ID NO: 1015140 - RNA, 19 nt, Homo sapiens
gaauaccagugaaauaguu

SEQ ID NO: 1015141 - RNA, 19 nt, Homo sapiens
gaggaaggcuuauuacaag

SEQ ID NO: 1015142 - RNA, 19 nt, Homo sapiens
ccucacagcugcaucuuaa

SEQ ID NO: 1015143 - RNA, 19 nt, Homo sapiens
ugaagcaucugcauauuga

SEQ ID NO: 1015144 - RNA, 19 nt, Homo sapiens
ccaaggagguuguggagaa

SEQ ID NO: 1015145 - RNA, 19 nt, Homo sapiens
gcaagcagauuugaaccua

SEQ ID NO: 1015146 - RNA, 19 nt, Homo sapiens
gaagaagggaggcuuauau

SEQ ID NO: 1015147 - RNA, 19 nt, Homo sapiens
gaaagcaaccuccaaagug

SEQ ID NO: 1015148 - RNA, 19 nt, Homo sapiens
gaagaagaagggaggcuua

SEQ ID NO: 1015149 - RNA, 19 nt, Homo sapiens
gaugaaacuuagacacaaa

SEQ ID NO: 1015150 - RNA, 19 nt, Homo sapiens
cauuugagauucauccaua

SEQ ID NO: 1015151 - RNA, 19 nt, Homo sapiens
gaggagauuuccaacuauu

SEQ ID NO: 1015152 - RNA, 19 nt, Homo sapiens
ccacgaggaaggcuuauua

SEQ ID NO: 1015153 - RNA, 19 nt, Homo sapiens
gaaaauagcagaugccauu

SEQ ID NO: 1015154 - RNA, 19 nt, Homo sapiens
gagaucaaguugcuccauu

SEQ ID NO: 1015155 - RNA, 19 nt, Homo sapiens
gcaggaccauugagagcua

SEQ ID NO: 1015156 - RNA, 19 nt, Homo sapiens
caaaggagagaauuacgua

SEQ ID NO: 1015157 - RNA, 19 nt, Homo sapiens
caaccaaaggagagaauua

SEQ ID NO: 1015158 - RNA, 19 nt, Homo sapiens
cgagaccacucuuguauuc

SEQ ID NO: 1015159 - RNA, 19 nt, Homo sapiens
gaagggaggcuuauauagu

SEQ ID NO: 1015160 - RNA, 19 nt, Homo sapiens
caaguaaagcugcuauaaa

SEQ ID NO: 1015161 - RNA, 19 nt, Homo sapiens
gugcugagaucguuaagga

SEQ ID NO: 1015162 - RNA, 19 nt, Homo sapiens
caaucgagaggcugaauua

SEQ ID NO: 1015163 - RNA, 19 nt, Homo sapiens
ggaggagauuuccaacuau

SEQ ID NO: 1015164 - RNA, 19 nt, Homo sapiens
ggagagaauuacguacuug

SEQ ID NO: 1015165 - RNA, 19 nt, Homo sapiens
gcaacaguaugguggaugu

SEQ ID NO: 1015166 - RNA, 19 nt, Homo sapiens
gaucgucuauuggauguga

SEQ ID NO: 1015167 - RNA, 19 nt, Homo sapiens
aagaucagcuucuauauac

SEQ ID NO: 1015168 - RNA, 19 nt, Homo sapiens
gaagugcgcacccacauuc

SEQ ID NO: 1015169 - RNA, 19 nt, Homo sapiens
gaagacuguuauauacaug

SEQ ID NO: 1015170 - RNA, 19 nt, Homo sapiens
ggucucagccucccgagua

SEQ ID NO: 1015171 - RNA, 19 nt, Homo sapiens
gggaagagcagccugauca

SEQ ID NO: 1015172 - RNA, 19 nt, Homo sapiens
uggauuaccuucggaauga

SEQ ID NO: 1015173 - RNA, 19 nt, Homo sapiens
gagaauuacguacuuguug

SEQ ID NO: 1015174 - RNA, 19 nt, Homo sapiens
caucuuaaccuuaccuuug

SEQ ID NO: 1015175 - RNA, 19 nt, Homo sapiens
ccagugaaauaguuugguu

SEQ ID NO: 1015176 - RNA, 19 nt, Homo sapiens
aagagcagccugaucaaua

SEQ ID NO: 1015177 - RNA, 19 nt, Homo sapiens
gaaguggguugaggagaug

SEQ ID NO: 1015178 - RNA, 19 nt, Homo sapiens
ugaaggauguuuaggaucu

SEQ ID NO: 1015179 - RNA, 19 nt, Homo sapiens
agaauuacguacuuguuga

SEQ ID NO: 1015180 - RNA, 19 nt, Homo sapiens
gcucagugcugcagaggau

SEQ ID NO: 1015181 - RNA, 19 nt, Homo sapiens
ccagaccacugagcacuuu

SEQ ID NO: 1015182 - RNA, 19 nt, Homo sapiens
caguuaggaucgucuauug

SEQ ID NO: 1015183 - RNA, 19 nt, Homo sapiens
guacgagaccacucuugua

SEQ ID NO: 1015184 - RNA, 19 nt, Homo sapiens
ggagauuuccaacuauuau

SEQ ID NO: 1015185 - RNA, 19 nt, Homo sapiens
guggagaaauggcuggauu

SEQ ID NO: 1015186 - RNA, 19 nt, Homo sapiens
aggaggaguuugagcauaa

SEQ ID NO: 1015187 - RNA, 19 nt, Homo sapiens
aaguaaagcugcuauaaac

SEQ ID NO: 1015188 - RNA, 19 nt, Homo sapiens
gcugagaucguuaaggaaa

SEQ ID NO: 1015189 - RNA, 19 nt, Homo sapiens
cgaggaaggcuuauuacaa

SEQ ID NO: 1015190 - RNA, 19 nt, Homo sapiens
ccgaguagcugggauuaug

SEQ ID NO: 1015191 - RNA, 19 nt, Homo sapiens
gaggcugaauuaaagaaga

SEQ ID NO: 1015192 - RNA, 19 nt, Homo sapiens
ucgagaggcugaauuaaag

SEQ ID NO: 1015193 - RNA, 19 nt, Homo sapiens
uuuaggaucuuugcaguuu

SEQ ID NO: 1015194 - RNA, 19 nt, Homo sapiens
caaggagguuguggagaaa

SEQ ID NO: 1015195 - RNA, 19 nt, Homo sapiens
gagcacaaggcaacaagaa

SEQ ID NO: 1015196 - RNA, 19 nt, Homo sapiens
uccguaaggugguggaaua

SEQ ID NO: 1015197 - RNA, 19 nt, Homo sapiens
aauagcagaugccauugaa

SEQ ID NO: 1015198 - RNA, 19 nt, Homo sapiens
auacugagcaggccaauga

SEQ ID NO: 1015199 - RNA, 19 nt, Homo sapiens
agaaauggcuggauuaccu

SEQ ID NO: 1015200 - RNA, 19 nt, Homo sapiens
guaaagcugcuauaaacau

SEQ ID NO: 1015201 - RNA, 19 nt, Homo sapiens
guugaaggauguuuaggau

SEQ ID NO: 1015202 - RNA, 19 nt, Homo sapiens
gcaucugcauauugaaaga

SEQ ID NO: 1015203 - RNA, 19 nt, Homo sapiens
gggaauaccagugaaauag

SEQ ID NO: 1015204 - RNA, 19 nt, Homo sapiens
agaagaagaugcagaaacg

SEQ ID NO: 1015205 - RNA, 19 nt, Homo sapiens
ggaagaaagcaaccuccaa

SEQ ID NO: 1015206 - RNA, 19 nt, Homo sapiens
gcuauaaacauuuguaugc

SEQ ID NO: 1015207 - RNA, 19 nt, Homo sapiens
ugagauucauccauauuuc

SEQ ID NO: 1015208 - RNA, 19 nt, Homo sapiens
cagaugccauugaaaauaa

SEQ ID NO: 1015209 - RNA, 19 nt, Homo sapiens
aagaagggaggcuuauaua

SEQ ID NO: 1015210 - RNA, 19 nt, Homo sapiens
gagcauaaggaggaaguuu

SEQ ID NO: 1015211 - RNA, 19 nt, Homo sapiens
gauuugaaccuaucugcuu

SEQ ID NO: 1015212 - RNA, 19 nt, Homo sapiens
gaaggauguuuaggaucuu

SEQ ID NO: 1015213 - RNA, 19 nt, Homo sapiens
aaaccaccguguauaagau

SEQ ID NO: 1015214 - RNA, 19 nt, Homo sapiens
caacuauuauggcgucucu

SEQ ID NO: 1015215 - RNA, 19 nt, Homo sapiens
guaaggugguggaauacuc

SEQ ID NO: 1015216 - RNA, 19 nt, Homo sapiens
caggaggaguuugagcaua

SEQ ID NO: 1015217 - RNA, 19 nt, Homo sapiens
ugaaauggagaucaaguug

SEQ ID NO: 1015218 - RNA, 19 nt, Homo sapiens
gcaguuaggaucgucuauu

SEQ ID NO: 1015219 - RNA, 19 nt, Homo sapiens
gaagagcagccugaucaau

SEQ ID NO: 1015220 - RNA, 19 nt, Homo sapiens
agaaguggguugaggagau

SEQ ID NO: 1015221 - RNA, 19 nt, Homo sapiens
acaaguaaagcugcuauaa

SEQ ID NO: 1015222 - RNA, 19 nt, Homo sapiens
ucauccauauuucucagua

SEQ ID NO: 1015223 - RNA, 19 nt, Homo sapiens
aagggaggcuuauauaguc

SEQ ID NO: 1015224 - RNA, 19 nt, Homo sapiens
ugaugaaacuuagacacaa

SEQ ID NO: 1015225 - RNA, 19 nt, Homo sapiens
uaaagaagaaguggguuga

SEQ ID NO: 1015226 - RNA, 19 nt, Homo sapiens
gcuaugaguaauacauuug

SEQ ID NO: 1015227 - RNA, 19 nt, Homo sapiens
caagcagauuugaaccuau

SEQ ID NO: 1015228 - RNA, 19 nt, Homo sapiens
caaugaagacaccauggaa

SEQ ID NO: 1015229 - RNA, 19 nt, Homo sapiens
gcugcaaccuggaggagau

SEQ ID NO: 1015230 - RNA, 19 nt, Homo sapiens
ccaccacgcccagcuaauu

SEQ ID NO: 1015231 - RNA, 19 nt, Homo sapiens
ccuccuaauuuacauccua

SEQ ID NO: 1015232 - RNA, 19 nt, Homo sapiens
ggacaacacucuuaaacua

SEQ ID NO: 1015233 - RNA, 19 nt, Homo sapiens
gcacaguaauuaugucuuu

SEQ ID NO: 1015234 - RNA, 19 nt, Homo sapiens
gaagcagugucaucaguua

SEQ ID NO: 1015235 - RNA, 19 nt, Homo sapiens
gaacauuuguguccuacuu

SEQ ID NO: 1015236 - RNA, 19 nt, Homo sapiens
cuaaagagauugugcagaa

SEQ ID NO: 1015237 - RNA, 19 nt, Homo sapiens
gagaauggcuagcaaguuc

SEQ ID NO: 1015238 - RNA, 19 nt, Homo sapiens
aaacuaugcucucaaaugu

SEQ ID NO: 1015239 - RNA, 19 nt, Homo sapiens
gcagaaagccaaaguacug

SEQ ID NO: 1015240 - RNA, 19 nt, Homo sapiens
ucaguuaaguuuaguccua

SEQ ID NO: 1015241 - RNA, 19 nt, Homo sapiens
guucauucaucuucaagua

SEQ ID NO: 1015242 - RNA, 19 nt, Homo sapiens
gcucucaaauguacucuug

SEQ ID NO: 1015243 - RNA, 19 nt, Homo sapiens
aaacauacacuggucauaa

SEQ ID NO: 1015244 - RNA, 19 nt, Homo sapiens
gaaauuacaaggccauaca

SEQ ID NO: 1015245 - RNA, 19 nt, Homo sapiens
gcaaggaagugccugaaaa

SEQ ID NO: 1015246 - RNA, 19 nt, Homo sapiens
uccagaaacuuuaagcuuu

SEQ ID NO: 1015247 - RNA, 19 nt, Homo sapiens
caaacuaugcucucaaaug

SEQ ID NO: 1015248 - RNA, 19 nt, Homo sapiens
gcucuagugucuaugauuc

SEQ ID NO: 1015249 - RNA, 19 nt, Homo sapiens
ugaaggcucuagugucuau

SEQ ID NO: 1015250 - RNA, 19 nt, Homo sapiens
gcaaguucuucugcugaua

SEQ ID NO: 1015251 - RNA, 19 nt, Homo sapiens
gaaaucugggcuuaguaua

SEQ ID NO: 1015252 - RNA, 19 nt, Homo sapiens
uuuaaagacuguccagaaa

SEQ ID NO: 1015253 - RNA, 19 nt, Homo sapiens
guaaauacuuucccaucuc

SEQ ID NO: 1015254 - RNA, 19 nt, Homo sapiens
gauuccgucucacaguuua

SEQ ID NO: 1015255 - RNA, 19 nt, Homo sapiens
caucgcaucagcagcauua

SEQ ID NO: 1015256 - RNA, 19 nt, Homo sapiens
uuuggaaccuucagacuaa

SEQ ID NO: 1015257 - RNA, 19 nt, Homo sapiens
gcgcacaggauccuucuaa

SEQ ID NO: 1015258 - RNA, 19 nt, Homo sapiens
gguggaaaguggauugugu

SEQ ID NO: 1015259 - RNA, 19 nt, Homo sapiens
acaauuaaacuguggauga

SEQ ID NO: 1015260 - RNA, 19 nt, Homo sapiens
ccauacagauguugugauc

SEQ ID NO: 1015261 - RNA, 19 nt, Homo sapiens
ggccagaguuuccaguuuc

SEQ ID NO: 1015262 - RNA, 19 nt, Homo sapiens
caggauccuucuaacagua

SEQ ID NO: 1015263 - RNA, 19 nt, Homo sapiens
uaaagagauugugcagaaa

SEQ ID NO: 1015264 - RNA, 19 nt, Homo sapiens
uaugauggccucuguagaa

SEQ ID NO: 1015265 - RNA, 19 nt, Homo sapiens
uaguacaccugcuaacuug

SEQ ID NO: 1015266 - RNA, 19 nt, Homo sapiens
uaaagacuguccagaaacu

SEQ ID NO: 1015267 - RNA, 19 nt, Homo sapiens
ggugaaaucugggcuuagu

SEQ ID NO: 1015268 - RNA, 19 nt, Homo sapiens
acaggaaagugucucaaga

SEQ ID NO: 1015269 - RNA, 19 nt, Homo sapiens
gcacaggauccuucuaaca

SEQ ID NO: 1015270 - RNA, 19 nt, Homo sapiens
guggugaaaucugggcuua

SEQ ID NO: 1015271 - RNA, 19 nt, Homo sapiens
gauggccucuguagaaucu

SEQ ID NO: 1015272 - RNA, 19 nt, Homo sapiens
acaacacucuuaaacuaug

SEQ ID NO: 1015273 - RNA, 19 nt, Homo sapiens
cccaaacuaugcucucaaa

SEQ ID NO: 1015274 - RNA, 19 nt, Homo sapiens
caaccaaggagucaagaga

SEQ ID NO: 1015275 - RNA, 19 nt, Homo sapiens
uaaauacuuucccaucucu

SEQ ID NO: 1015276 - RNA, 19 nt, Homo sapiens
caguuucgguggcuucgua

SEQ ID NO: 1015277 - RNA, 19 nt, Homo sapiens
cauuguaccuaguaaauac

SEQ ID NO: 1015278 - RNA, 19 nt, Homo sapiens
ugucaucaguuaaguuuag

SEQ ID NO: 1015279 - RNA, 19 nt, Homo sapiens
ggaagcagugucaucaguu

SEQ ID NO: 1015280 - RNA, 19 nt, Homo sapiens
gacaacacucuuaaacuau

SEQ ID NO: 1015281 - RNA, 19 nt, Homo sapiens
auuaaacuguggaugagua

SEQ ID NO: 1015282 - RNA, 19 nt, Homo sapiens
caauuaaacuguggaugag

SEQ ID NO: 1015283 - RNA, 19 nt, Homo sapiens
aagagauugugcagaaauu

SEQ ID NO: 1015284 - RNA, 19 nt, Homo sapiens
cgauaacccuccugucucu

SEQ ID NO: 1015285 - RNA, 19 nt, Homo sapiens
cauccaaccuuauaaucuc

SEQ ID NO: 1015286 - RNA, 19 nt, Homo sapiens
agggauauauugcauagug

SEQ ID NO: 1015287 - RNA, 19 nt, Homo sapiens
ccacuaaucccuuugaaaa

SEQ ID NO: 1015288 - RNA, 19 nt, Homo sapiens
ucaaguaccuagccugacu

SEQ ID NO: 1015289 - RNA, 19 nt, Homo sapiens
aauccgccauccaaccuua

SEQ ID NO: 1015290 - RNA, 19 nt, Homo sapiens
ggagaauggcuagcaaguu

SEQ ID NO: 1015291 - RNA, 19 nt, Homo sapiens
gcuuuuagcuucugaaauc

SEQ ID NO: 1015292 - RNA, 19 nt, Homo sapiens
uuacaaggccauacagaug

SEQ ID NO: 1015293 - RNA, 19 nt, Homo sapiens
ucagagccauggcaaccaa

SEQ ID NO: 1015294 - RNA, 19 nt, Homo sapiens
ugaaaucugggcuuaguau

SEQ ID NO: 1015295 - RNA, 19 nt, Homo sapiens
gagauucauacacuacauu

SEQ ID NO: 1015296 - RNA, 19 nt, Homo sapiens
gagcauaugauggaaaaua

SEQ ID NO: 1015297 - RNA, 19 nt, Homo sapiens
guuuaaagacuguccagaa

SEQ ID NO: 1015298 - RNA, 19 nt, Homo sapiens
acagggauauauugcauag

SEQ ID NO: 1015299 - RNA, 19 nt, Homo sapiens
gccgaacauuuguguccua

SEQ ID NO: 1015300 - RNA, 19 nt, Homo sapiens
gacgauaacccuccugucu

SEQ ID NO: 1015301 - RNA, 19 nt, Homo sapiens
ucucaaauguacucuugug

SEQ ID NO: 1015302 - RNA, 19 nt, Homo sapiens
uuacagggauauauugcau

SEQ ID NO: 1015303 - RNA, 19 nt, Homo sapiens
aguaaccacuaaucccuuu

SEQ ID NO: 1015304 - RNA, 19 nt, Homo sapiens
agacuguccagaaacuuua

SEQ ID NO: 1015305 - RNA, 19 nt, Homo sapiens
aaaagcacaucuagaauuc

SEQ ID NO: 1015306 - RNA, 19 nt, Homo sapiens
ugcaucaggucaguguuua

SEQ ID NO: 1015307 - RNA, 19 nt, Homo sapiens
gaugugagaucuggaaaau

SEQ ID NO: 1015308 - RNA, 19 nt, Homo sapiens
gcagugucaucaguuaagu

SEQ ID NO: 1015309 - RNA, 19 nt, Homo sapiens
ccagguccauccauguugu

SEQ ID NO: 1015310 - RNA, 19 nt, Homo sapiens
guguacacauuguuuaucu

SEQ ID NO: 1015311 - RNA, 19 nt, Homo sapiens
ccagguguacacauuguuu

SEQ ID NO: 1015312 - RNA, 19 nt, Homo sapiens
aguauacccucacccaaau

SEQ ID NO: 1015313 - RNA, 19 nt, Homo sapiens
uaguauacccucacccaaa

SEQ ID NO: 1015314 - RNA, 19 nt, Homo sapiens
acaaggccauacagauguu

SEQ ID NO: 1015315 - RNA, 19 nt, Homo sapiens
caucaggucaguguuuaaa

SEQ ID NO: 1015316 - RNA, 19 nt, Homo sapiens
guugugaucucagcagcuu

SEQ ID NO: 1015317 - RNA, 19 nt, Homo sapiens
cuaacaguauuucucaagu

SEQ ID NO: 1015318 - RNA, 19 nt, Homo sapiens
caacacucuuaaacuaugg

SEQ ID NO: 1015319 - RNA, 19 nt, Homo sapiens
gcuuugaaggcuuuaugua

SEQ ID NO: 1015320 - RNA, 19 nt, Homo sapiens
gacuuugucugcucauucu

SEQ ID NO: 1015321 - RNA, 19 nt, Homo sapiens
uagcuaugauggccucugu

SEQ ID NO: 1015322 - RNA, 19 nt, Homo sapiens
gggagcauaugauggaaaa

SEQ ID NO: 1015323 - RNA, 19 nt, Homo sapiens
cggaagcagugucaucagu

SEQ ID NO: 1015324 - RNA, 19 nt, Homo sapiens
ggagucaagagacgccaaa

SEQ ID NO: 1015325 - RNA, 19 nt, Homo sapiens
guacaccugcuaacuugga

SEQ ID NO: 1015326 - RNA, 19 nt, Homo sapiens
ccauccauguuguugcaaa

SEQ ID NO: 1015327 - RNA, 19 nt, Homo sapiens
cagguguacacauuguuua

SEQ ID NO: 1015328 - RNA, 19 nt, Homo sapiens
uauauugcauaguggugaa

SEQ ID NO: 1015329 - RNA, 19 nt, Homo sapiens
uaaccacuaaucccuuuga

SEQ ID NO: 1015330 - RNA, 19 nt, Homo sapiens
ggaaccuucagacuaaaga

SEQ ID NO: 1015331 - RNA, 19 nt, Homo sapiens
auacacuggucauaagaau

SEQ ID NO: 1015332 - RNA, 19 nt, Homo sapiens
gaacagggcugcacugacu

SEQ ID NO: 1015333 - RNA, 19 nt, Homo sapiens
uacaggaggugcuuaauaa

SEQ ID NO: 1015334 - RNA, 19 nt, Homo sapiens
agaagaagcuggaggaguu

SEQ ID NO: 1015335 - RNA, 19 nt, Homo sapiens
gcucugcacuccaugauga

SEQ ID NO: 1015336 - RNA, 19 nt, Homo sapiens
gaagagagugugagaucaa

SEQ ID NO: 1015337 - RNA, 19 nt, Homo sapiens
ggaagaggccgaggugcua

SEQ ID NO: 1015338 - RNA, 19 nt, Homo sapiens
caucguggcucguggaaca

SEQ ID NO: 1015339 - RNA, 19 nt, Homo sapiens
gcauacaggaggugcuuaa

SEQ ID NO: 1015340 - RNA, 19 nt, Homo sapiens
ugcaagaccugccagauuc

SEQ ID NO: 1015341 - RNA, 19 nt, Homo sapiens
agaaggagaucaacaaacg

SEQ ID NO: 1015342 - RNA, 19 nt, Homo sapiens
gcugaaagacugcaucauc

SEQ ID NO: 1015343 - RNA, 19 nt, Homo sapiens
aggcugagcuggccaagau

SEQ ID NO: 1015344 - RNA, 19 nt, Homo sapiens
gugcaagaccugccagauu

SEQ ID NO: 1015345 - RNA, 19 nt, Homo sapiens
aggagcagaucaagaagaa

SEQ ID NO: 1015346 - RNA, 19 nt, Homo sapiens
gcgaagagagugugagauc

SEQ ID NO: 1015347 - RNA, 19 nt, Homo sapiens
ggacaucccuacgguacag

SEQ ID NO: 1015348 - RNA, 19 nt, Homo sapiens
auacaggaggugcuuaaua

SEQ ID NO: 1015349 - RNA, 19 nt, Homo sapiens
uggccaagaucaagcagaa

SEQ ID NO: 1015350 - RNA, 19 nt, Homo sapiens
cgaagagagugugagauca

SEQ ID NO: 1015351 - RNA, 19 nt, Homo sapiens
ucgaggagcagaucaagaa

SEQ ID NO: 1015352 - RNA, 19 nt, Homo sapiens
aaagaaggagaucaacaaa

SEQ ID NO: 1015353 - RNA, 19 nt, Homo sapiens
ccugagcccuggccaagau

SEQ ID NO: 1015354 - RNA, 19 nt, Homo sapiens
aaacgggucuuuugacuuc

SEQ ID NO: 1015355 - RNA, 19 nt, Homo sapiens
gccaagaucaagcagaaga

SEQ ID NO: 1015356 - RNA, 19 nt, Homo sapiens
ggaagacagcagcguuugu

SEQ ID NO: 1015357 - RNA, 19 nt, Homo sapiens
gaggagcagaucaagaaga

SEQ ID NO: 1015358 - RNA, 19 nt, Homo sapiens
cugcgcagcuccaacacuu

SEQ ID NO: 1015359 - RNA, 19 nt, Homo sapiens
gaggaucccuauggcaucu

SEQ ID NO: 1015360 - RNA, 19 nt, Homo sapiens
aagagagugugagaucaaa

SEQ ID NO: 1015361 - RNA, 19 nt, Homo sapiens
gagcugagggucggaggaa

SEQ ID NO: 1015362 - RNA, 19 nt, Homo sapiens
ggaucccuauggcaucuuc

SEQ ID NO: 1015363 - RNA, 19 nt, Homo sapiens
cagaccggcugcuggaaca

SEQ ID NO: 1015364 - RNA, 19 nt, Homo sapiens
ggagcucucucggaaacca

SEQ ID NO: 1015365 - RNA, 19 nt, Homo sapiens
gaaaagaaggagaucaaca

SEQ ID NO: 1015366 - RNA, 19 nt, Homo sapiens
ccagaucgcagagcaguuc

SEQ ID NO: 1015367 - RNA, 19 nt, Homo sapiens
cgguacagguggucaucaa

SEQ ID NO: 1015368 - RNA, 19 nt, Homo sapiens
ccaaccagcccuucuucug

SEQ ID NO: 1015369 - RNA, 19 nt, Homo sapiens
ccaagaucaagcagaagaa

SEQ ID NO: 1015370 - RNA, 19 nt, Homo sapiens
gaagaagcuggaggaguuc

SEQ ID NO: 1015371 - RNA, 19 nt, Homo sapiens
auuaucaucuucaccaaca

SEQ ID NO: 1015372 - RNA, 19 nt, Homo sapiens
ccauuaucaucuucaccaa

SEQ ID NO: 1015373 - RNA, 19 nt, Homo sapiens
ccaccaaccagcccuucuu

SEQ ID NO: 1015374 - RNA, 19 nt, Homo sapiens
cuccaacacuuuuaguaua

SEQ ID NO: 1015375 - RNA, 19 nt, Homo sapiens
gucggcagcuggguuugaa

SEQ ID NO: 1015376 - RNA, 19 nt, Homo sapiens
gggaagacagcagcguuug

SEQ ID NO: 1015377 - RNA, 19 nt, Homo sapiens
gagagugugagaucaaacu

SEQ ID NO: 1015378 - RNA, 19 nt, Homo sapiens
gacaggcagugggaagaca

SEQ ID NO: 1015379 - RNA, 19 nt, Homo sapiens
gugcgaagagagugugaga

SEQ ID NO: 1015380 - RNA, 19 nt, Homo sapiens
guucaaguccagcaucuac

SEQ ID NO: 1015381 - RNA, 19 nt, Homo sapiens
gggcugaaagacugcauca

SEQ ID NO: 1015382 - RNA, 19 nt, Homo sapiens
guuuguccuucccaucuug

SEQ ID NO: 1015383 - RNA, 19 nt, Homo sapiens
aaaagaaggagaucaacaa

SEQ ID NO: 1015384 - RNA, 19 nt, Homo sapiens
cuacaagcggccacaagga

SEQ ID NO: 1015385 - RNA, 19 nt, Homo sapiens
acaggaggugcuuaauaaa

SEQ ID NO: 1015386 - RNA, 19 nt, Homo sapiens
ucaacguggugcgaagaga

SEQ ID NO: 1015387 - RNA, 19 nt, Homo sapiens
caagaaaucucucaacaaa

SEQ ID NO: 1015388 - RNA, 19 nt, Homo sapiens
cgaagaacaucaaguuuaa

SEQ ID NO: 1015389 - RNA, 19 nt, Homo sapiens
gaaccucgauacugcauuu

SEQ ID NO: 1015390 - RNA, 19 nt, Homo sapiens
gaggcgaucuuuggaauua

SEQ ID NO: 1015391 - RNA, 19 nt, Homo sapiens
ccagauauaugacuuggua

SEQ ID NO: 1015392 - RNA, 19 nt, Homo sapiens
uaaccaagauugcccuaua

SEQ ID NO: 1015393 - RNA, 19 nt, Homo sapiens
gaacaaagagucagugaau

SEQ ID NO: 1015394 - RNA, 19 nt, Homo sapiens
ggaaacaguuggcuauuca

SEQ ID NO: 1015395 - RNA, 19 nt, Homo sapiens
gcacuuaugacaacauuaa

SEQ ID NO: 1015396 - RNA, 19 nt, Homo sapiens
cuccagagcuguuauguaa

SEQ ID NO: 1015397 - RNA, 19 nt, Homo sapiens
acacuagguugucgaaaua

SEQ ID NO: 1015398 - RNA, 19 nt, Homo sapiens
ggacgaagaacaucaaguu

SEQ ID NO: 1015399 - RNA, 19 nt, Homo sapiens
gcucuucuauccacccuua

SEQ ID NO: 1015400 - RNA, 19 nt, Homo sapiens
ggaaauauaauccaacuuc

SEQ ID NO: 1015401 - RNA, 19 nt, Homo sapiens
agaaaucucucaacaaaca

SEQ ID NO: 1015402 - RNA, 19 nt, Homo sapiens
gaagagaagagaaagaaga

SEQ ID NO: 1015403 - RNA, 19 nt, Homo sapiens
ggacuuacgacccaaauga

SEQ ID NO: 1015404 - RNA, 19 nt, Homo sapiens
caacauaugcagacauuug

SEQ ID NO: 1015405 - RNA, 19 nt, Homo sapiens
ccuauaagaucuugaacuu

SEQ ID NO: 1015406 - RNA, 19 nt, Homo sapiens
gaauaaugacuuucaguug

SEQ ID NO: 1015407 - RNA, 19 nt, Homo sapiens
guaaucagguaucuuaugg

SEQ ID NO: 1015408 - RNA, 19 nt, Homo sapiens
gcaaccacuuaaaggauuu

SEQ ID NO: 1015409 - RNA, 19 nt, Homo sapiens
gccaacauaugcagacauu

SEQ ID NO: 1015410 - RNA, 19 nt, Homo sapiens
caaauagucagguugauug

SEQ ID NO: 1015411 - RNA, 19 nt, Homo sapiens
gagaggcgaucuuuggaau

SEQ ID NO: 1015412 - RNA, 19 nt, Homo sapiens
gaauuccaaugaugaagau

SEQ ID NO: 1015413 - RNA, 19 nt, Homo sapiens
ucaaggaauuccaaugaug

SEQ ID NO: 1015414 - RNA, 19 nt, Homo sapiens
ggugugcuaugaauauuau

SEQ ID NO: 1015415 - RNA, 19 nt, Homo sapiens
ggaauuagacacuccuuca

SEQ ID NO: 1015416 - RNA, 19 nt, Homo sapiens
cuauaaagcuuuggaagau

SEQ ID NO: 1015417 - RNA, 19 nt, Homo sapiens
ggcaaccacuuaaaggauu

SEQ ID NO: 1015418 - RNA, 19 nt, Homo sapiens
caagauugcccuauagaau

SEQ ID NO: 1015419 - RNA, 19 nt, Homo sapiens
gaucgacacuugagaaagc

SEQ ID NO: 1015420 - RNA, 19 nt, Homo sapiens
caaaccagauauaugacuu

SEQ ID NO: 1015421 - RNA, 19 nt, Homo sapiens
gucagugaauucuuuauga

SEQ ID NO: 1015422 - RNA, 19 nt, Homo sapiens
gauuuagacuucaaggaau

SEQ ID NO: 1015423 - RNA, 19 nt, Homo sapiens
gggaaacaguuggcuauuc

SEQ ID NO: 1015424 - RNA, 19 nt, Homo sapiens
uaacaaugccuacaaugug

SEQ ID NO: 1015425 - RNA, 19 nt, Homo sapiens
cuagaagacuaucuggaaa

SEQ ID NO: 1015426 - RNA, 19 nt, Homo sapiens
gguauauucugcugcaugu

SEQ ID NO: 1015427 - RNA, 19 nt, Homo sapiens
caaggaauuccaaugauga

SEQ ID NO: 1015428 - RNA, 19 nt, Homo sapiens
gaaagaagaaacaaugcau

SEQ ID NO: 1015429 - RNA, 19 nt, Homo sapiens
acgaagaacaucaaguuua

SEQ ID NO: 1015430 - RNA, 19 nt, Homo sapiens
uggcaaaccagauauauga

SEQ ID NO: 1015431 - RNA, 19 nt, Homo sapiens
ggaaaugauugagcagcuu

SEQ ID NO: 1015432 - RNA, 19 nt, Homo sapiens
gagauggugggaugugaua

SEQ ID NO: 1015433 - RNA, 19 nt, Homo sapiens
gauacugcauuuguaauca

SEQ ID NO: 1015434 - RNA, 19 nt, Homo sapiens
ugcaauggaucaacuagaa

SEQ ID NO: 1015435 - RNA, 19 nt, Homo sapiens
ggaauuccaaugaugaaga

SEQ ID NO: 1015436 - RNA, 19 nt, Homo sapiens
ccaguuagccuuggauuau

SEQ ID NO: 1015437 - RNA, 19 nt, Homo sapiens
cgacagcgagugacacaaa

SEQ ID NO: 1015438 - RNA, 19 nt, Homo sapiens
ccucgauacugcauuugua

SEQ ID NO: 1015439 - RNA, 19 nt, Homo sapiens
ggugggaugugauaaccaa

SEQ ID NO: 1015440 - RNA, 19 nt, Homo sapiens
uaacacagaaugccaguuc

SEQ ID NO: 1015441 - RNA, 19 nt, Homo sapiens
gcuggaagcugauaaugcu

SEQ ID NO: 1015442 - RNA, 19 nt, Homo sapiens
gaugugauaaccaagauug

SEQ ID NO: 1015443 - RNA, 19 nt, Homo sapiens
caaaugaaccucgauacug

SEQ ID NO: 1015444 - RNA, 19 nt, Homo sapiens
uacaagaaaucucucaaca

SEQ ID NO: 1015445 - RNA, 19 nt, Homo sapiens
ugacaacauuaacacagaa

SEQ ID NO: 1015446 - RNA, 19 nt, Homo sapiens
gaagagaaagaagaaacaa

SEQ ID NO: 1015447 - RNA, 19 nt, Homo sapiens
aacaaugccuacaauguga

SEQ ID NO: 1015448 - RNA, 19 nt, Homo sapiens
uagcggaggcgccauauug

SEQ ID NO: 1015449 - RNA, 19 nt, Homo sapiens
caacuguagugccagaauc

SEQ ID NO: 1015450 - RNA, 19 nt, Homo sapiens
ccucugggauccuauaaca

SEQ ID NO: 1015451 - RNA, 19 nt, Homo sapiens
cuugguagaucgacacuug

SEQ ID NO: 1015452 - RNA, 19 nt, Homo sapiens
guagaucgacacuugagaa

SEQ ID NO: 1015453 - RNA, 19 nt, Homo sapiens
acaaagagucagugaauuc

SEQ ID NO: 1015454 - RNA, 19 nt, Homo sapiens
agagaaagaagaaacaaug

SEQ ID NO: 1015455 - RNA, 19 nt, Homo sapiens
ucaguuggcaaaccagaua

SEQ ID NO: 1015456 - RNA, 19 nt, Homo sapiens
ccaguuaugaagcauuuaa

SEQ ID NO: 1015457 - RNA, 19 nt, Homo sapiens
aagacuaucuggaaaugau

SEQ ID NO: 1015458 - RNA, 19 nt, Homo sapiens
ccuagaagacuaucuggaa

SEQ ID NO: 1015459 - RNA, 19 nt, Homo sapiens
agacuacuauaaagcuuug

SEQ ID NO: 1015460 - RNA, 19 nt, Homo sapiens
agaagacuaucuggaaaug

SEQ ID NO: 1015461 - RNA, 19 nt, Homo sapiens
ugauuuagacuucaaggaa

SEQ ID NO: 1015462 - RNA, 19 nt, Homo sapiens
cagcgagugacacaaauaa

SEQ ID NO: 1015463 - RNA, 19 nt, Homo sapiens
gaaugcaauggaucaacua

SEQ ID NO: 1015464 - RNA, 19 nt, Homo sapiens
gacgaagaacaucaaguuu

SEQ ID NO: 1015465 - RNA, 19 nt, Homo sapiens
gaaggagggacgaagaaca

SEQ ID NO: 1015466 - RNA, 19 nt, Homo sapiens
gaugaaggagggacgaaga

SEQ ID NO: 1015467 - RNA, 19 nt, Homo sapiens
aacauuggcucguuaucuu

SEQ ID NO: 1015468 - RNA, 19 nt, Homo sapiens
uauccacccuuacgucaga

SEQ ID NO: 1015469 - RNA, 19 nt, Homo sapiens
gacaacagaucauauuccu

SEQ ID NO: 1015470 - RNA, 19 nt, Homo sapiens
aauccaacuucucaccaua

SEQ ID NO: 1015471 - RNA, 19 nt, Homo sapiens
ggaagaugcagaugagaag

SEQ ID NO: 1015472 - RNA, 19 nt, Homo sapiens
cgggaccgcuucacggaaa

SEQ ID NO: 1015473 - RNA, 19 nt, Homo sapiens
caacuagaacaaagaguca

SEQ ID NO: 1015474 - RNA, 19 nt, Homo sapiens
uacacuagguugucgaaau

SEQ ID NO: 1015475 - RNA, 19 nt, Homo sapiens
cagaugagaagguucaguu

SEQ ID NO: 1015476 - RNA, 19 nt, Homo sapiens
gagaagagaaagaagaaac

SEQ ID NO: 1015477 - RNA, 19 nt, Homo sapiens
gggaugugauaaccaagau

SEQ ID NO: 1015478 - RNA, 19 nt, Homo sapiens
cuagguugucgaaauaaua

SEQ ID NO: 1015479 - RNA, 19 nt, Homo sapiens
agacaauccuauaagaucu

SEQ ID NO: 1015480 - RNA, 19 nt, Homo sapiens
gacagcgagugacacaaau

SEQ ID NO: 1015481 - RNA, 19 nt, Homo sapiens
cuacagcucagaugaagga

SEQ ID NO: 1015482 - RNA, 19 nt, Homo sapiens
ccuauaacauuggcucguu

SEQ ID NO: 1015483 - RNA, 19 nt, Homo sapiens
ucugggauccuauaacauu

SEQ ID NO: 1015484 - RNA, 19 nt, Homo sapiens
caaccucugggauccuaua

SEQ ID NO: 1015485 - RNA, 19 nt, Homo sapiens
caaucaccaugcucauuca

SEQ ID NO: 1015486 - RNA, 19 nt, Homo sapiens
ggcgaucuuuggaauuaga

SEQ ID NO: 1015487 - RNA, 19 nt, Homo sapiens
gaagagcauuccugauuua

SEQ ID NO: 1015488 - RNA, 19 nt, Homo sapiens
gggaaaagcugaccaauua

SEQ ID NO: 1015489 - RNA, 19 nt, Homo sapiens
ugacauggcuagcuugaua

SEQ ID NO: 1015490 - RNA, 19 nt, Homo sapiens
cauguaaucuucugugaua

SEQ ID NO: 1015491 - RNA, 19 nt, Homo sapiens
gaacuggacugagcuuuga

SEQ ID NO: 1015492 - RNA, 19 nt, Homo sapiens
gacaauagguuuaucacaa

SEQ ID NO: 1015493 - RNA, 19 nt, Homo sapiens
caaauuaggucacuacaca

SEQ ID NO: 1015494 - RNA, 19 nt, Homo sapiens
gaaggaauauuaucuaggu

SEQ ID NO: 1015495 - RNA, 19 nt, Homo sapiens
gcaauaaccacaugaaaga

SEQ ID NO: 1015496 - RNA, 19 nt, Homo sapiens
caggaaagaaggaauauua

SEQ ID NO: 1015497 - RNA, 19 nt, Homo sapiens
gaaaaccucuuguguauau

SEQ ID NO: 1015498 - RNA, 19 nt, Homo sapiens
caccauaucugauguguga

SEQ ID NO: 1015499 - RNA, 19 nt, Homo sapiens
ggaaaugacccaaaggaaa

SEQ ID NO: 1015500 - RNA, 19 nt, Homo sapiens
gaugagaguuuaauuccaa

SEQ ID NO: 1015501 - RNA, 19 nt, Homo sapiens
gcgaauguauagaaaguaa

SEQ ID NO: 1015502 - RNA, 19 nt, Homo sapiens
gaacagagaaucuuaagag

SEQ ID NO: 1015503 - RNA, 19 nt, Homo sapiens
aagaagcaguuacaaguua

SEQ ID NO: 1015504 - RNA, 19 nt, Homo sapiens
caagaaaguuuggaaguug

SEQ ID NO: 1015505 - RNA, 19 nt, Homo sapiens
gaagggaaaugacccaaag

SEQ ID NO: 1015506 - RNA, 19 nt, Homo sapiens
guacaacuguuugacuuaa

SEQ ID NO: 1015507 - RNA, 19 nt, Homo sapiens
gggaaccaauguuaucuuu

SEQ ID NO: 1015508 - RNA, 19 nt, Homo sapiens
cauguuacgugccaauaua

SEQ ID NO: 1015509 - RNA, 19 nt, Homo sapiens
uaagagcuguuagaaagua

SEQ ID NO: 1015510 - RNA, 19 nt, Homo sapiens
ugaagagcauuccugauuu

SEQ ID NO: 1015511 - RNA, 19 nt, Homo sapiens
gaacuuauagagcaacuga

SEQ ID NO: 1015512 - RNA, 19 nt, Homo sapiens
gaaaugacccaaaggaaag

SEQ ID NO: 1015513 - RNA, 19 nt, Homo sapiens
gaagaagcaguuacaaguu

SEQ ID NO: 1015514 - RNA, 19 nt, Homo sapiens
gcaugggucuaacuacauu

SEQ ID NO: 1015515 - RNA, 19 nt, Homo sapiens
cuaacuacauugaugauga

SEQ ID NO: 1015516 - RNA, 19 nt, Homo sapiens
caauauagcacugggauaa

SEQ ID NO: 1015517 - RNA, 19 nt, Homo sapiens
acagaaauguuuaccaguu

SEQ ID NO: 1015518 - RNA, 19 nt, Homo sapiens
gcaugccagucuuauaauu

SEQ ID NO: 1015519 - RNA, 19 nt, Homo sapiens
cuuaagagcuguuagaaag

SEQ ID NO: 1015520 - RNA, 19 nt, Homo sapiens
gcaccugguuuaugcaguu

SEQ ID NO: 1015521 - RNA, 19 nt, Homo sapiens
ccucuuguguauauucuua

SEQ ID NO: 1015522 - RNA, 19 nt, Homo sapiens
ggcuaugaaugaaguauuu

SEQ ID NO: 1015523 - RNA, 19 nt, Homo sapiens
gcaguuacaaguuaucaaa

SEQ ID NO: 1015524 - RNA, 19 nt, Homo sapiens
ucacugccuugaauaaauu

SEQ ID NO: 1015525 - RNA, 19 nt, Homo sapiens
gagugauucucgagccuua

SEQ ID NO: 1015526 - RNA, 19 nt, Homo sapiens
cagcuaaugucaggaauga

SEQ ID NO: 1015527 - RNA, 19 nt, Homo sapiens
auggcuagcuugauaaaua

SEQ ID NO: 1015528 - RNA, 19 nt, Homo sapiens
ucacagccuuugacagaaa

SEQ ID NO: 1015529 - RNA, 19 nt, Homo sapiens
ugaaauuggugcugacaug

SEQ ID NO: 1015530 - RNA, 19 nt, Homo sapiens
guaaugcgaauguauagaa

SEQ ID NO: 1015531 - RNA, 19 nt, Homo sapiens
acaaaugguuuauggcuau

SEQ ID NO: 1015532 - RNA, 19 nt, Homo sapiens
aauccagccuucauuagua

SEQ ID NO: 1015533 - RNA, 19 nt, Homo sapiens
cauauuaguuaguggagaa

SEQ ID NO: 1015534 - RNA, 19 nt, Homo sapiens
ccaauaaugcaguuuacua

SEQ ID NO: 1015535 - RNA, 19 nt, Homo sapiens
uaacaugacuccuuuugaa

SEQ ID NO: 1015536 - RNA, 19 nt, Homo sapiens
gaaaauagcagaacagaag

SEQ ID NO: 1015537 - RNA, 19 nt, Homo sapiens
cagaugcgauaaaggauug

SEQ ID NO: 1015538 - RNA, 19 nt, Homo sapiens
gcaguuugguauugauaau

SEQ ID NO: 1015539 - RNA, 19 nt, Homo sapiens
aaacauaacaugacuccuu

SEQ ID NO: 1015540 - RNA, 19 nt, Homo sapiens
acaagaaaguuuggaaguu

SEQ ID NO: 1015541 - RNA, 19 nt, Homo sapiens
uuaauucugugcccauaaa

SEQ ID NO: 1015542 - RNA, 19 nt, Homo sapiens
ggaaagaaggaauauuauc

SEQ ID NO: 1015543 - RNA, 19 nt, Homo sapiens
caauuucccuuaagcaaag

SEQ ID NO: 1015544 - RNA, 19 nt, Homo sapiens
guagggcuauuuguuggua

SEQ ID NO: 1015545 - RNA, 19 nt, Homo sapiens
ggaaccaauguuaucuuua

SEQ ID NO: 1015546 - RNA, 19 nt, Homo sapiens
uggcuagcuugauaaauaa

SEQ ID NO: 1015547 - RNA, 19 nt, Homo sapiens
ucaagcaccugguuuaugc

SEQ ID NO: 1015548 - RNA, 19 nt, Homo sapiens
ccaaacaccauaucugaug

SEQ ID NO: 1015549 - RNA, 19 nt, Homo sapiens
gcaguuuacuauugcaaca

SEQ ID NO: 1015550 - RNA, 19 nt, Homo sapiens
gcaucuaucacuaacauug

SEQ ID NO: 1015551 - RNA, 19 nt, Homo sapiens
aacauaacaugacuccuuu

SEQ ID NO: 1015552 - RNA, 19 nt, Homo sapiens
gaugaugagaguuuaauuc

SEQ ID NO: 1015553 - RNA, 19 nt, Homo sapiens
caugccagucuuauaauua

SEQ ID NO: 1015554 - RNA, 19 nt, Homo sapiens
guucuuaacuaaucuuguc

SEQ ID NO: 1015555 - RNA, 19 nt, Homo sapiens
caacagcuaaugucaggaa

SEQ ID NO: 1015556 - RNA, 19 nt, Homo sapiens
ggaacuggacugagcuuug

SEQ ID NO: 1015557 - RNA, 19 nt, Homo sapiens
cagaaauguuuaccaguuc

SEQ ID NO: 1015558 - RNA, 19 nt, Homo sapiens
gagauggagucuugcucuu

SEQ ID NO: 1015559 - RNA, 19 nt, Homo sapiens
gguacaacuguuugacuua

SEQ ID NO: 1015560 - RNA, 19 nt, Homo sapiens
caaacaccauaucugaugu

SEQ ID NO: 1015561 - RNA, 19 nt, Homo sapiens
uagagcaacugagaaauca

SEQ ID NO: 1015562 - RNA, 19 nt, Homo sapiens
gcuaaugucaggaaugaug

SEQ ID NO: 1015563 - RNA, 19 nt, Homo sapiens
agagagguauccaguccua

SEQ ID NO: 1015564 - RNA, 19 nt, Homo sapiens
ugaagaagcaguuacaagu

SEQ ID NO: 1015565 - RNA, 19 nt, Homo sapiens
cuacacagaugcgauaaag

SEQ ID NO: 1015566 - RNA, 19 nt, Homo sapiens
gcugacauguaaugacuuc

SEQ ID NO: 1015567 - RNA, 19 nt, Homo sapiens
cuacauugaugaugagagu

SEQ ID NO: 1015568 - RNA, 19 nt, Homo sapiens
aaccuuaccuuggaaacua

SEQ ID NO: 1015569 - RNA, 19 nt, Homo sapiens
cugaagagcauuccugauu

SEQ ID NO: 1015570 - RNA, 19 nt, Homo sapiens
gcaacaaaauccugaacuu

SEQ ID NO: 1015571 - RNA, 19 nt, Homo sapiens
acacagaugcgauaaagga

SEQ ID NO: 1015572 - RNA, 19 nt, Homo sapiens
ucacuacacagaugcgaua

SEQ ID NO: 1015573 - RNA, 19 nt, Homo sapiens
caccaugcccagcuaauuu

SEQ ID NO: 1015574 - RNA, 19 nt, Homo sapiens
gagcauuccugauuuaacc

SEQ ID NO: 1015575 - RNA, 19 nt, Homo sapiens
cagcagauacagcaacaaa

SEQ ID NO: 1015576 - RNA, 19 nt, Homo sapiens
gauacacaccuagcaguuu

SEQ ID NO: 1015577 - RNA, 19 nt, Homo sapiens
auauuagcauggccacuua

SEQ ID NO: 1015578 - RNA, 19 nt, Homo sapiens
gggauaagguuccauuuuc

SEQ ID NO: 1015579 - RNA, 19 nt, Homo sapiens
gaaaagcugaccaauuaaa

SEQ ID NO: 1015580 - RNA, 19 nt, Homo sapiens
gauggagucuugcucuuuu

SEQ ID NO: 1015581 - RNA, 19 nt, Homo sapiens
aauuggugcugacauguaa

SEQ ID NO: 1015582 - RNA, 19 nt, Homo sapiens
ccuuggaaacuaucaaaua

SEQ ID NO: 1015583 - RNA, 19 nt, Homo sapiens
ccaauuucccuuaagcaaa

SEQ ID NO: 1015584 - RNA, 19 nt, Homo sapiens
ccaagauacaaaugguuua

SEQ ID NO: 1015585 - RNA, 19 nt, Homo sapiens
caacaaaauccugaacuua

SEQ ID NO: 1015586 - RNA, 19 nt, Homo sapiens
gaucagcccagaagauaca

SEQ ID NO: 1015587 - RNA, 19 nt, Homo sapiens
uuacacagcuugaauauga

SEQ ID NO: 1015588 - RNA, 19 nt, Homo sapiens
gaaagaugaugaacuggaa

SEQ ID NO: 1015589 - RNA, 19 nt, Homo sapiens
ggucaagggugcacaauga

SEQ ID NO: 1015590 - RNA, 19 nt, Homo sapiens
agacuucgaugacucuuua

SEQ ID NO: 1015591 - RNA, 19 nt, Homo sapiens
gugaaacacugucuacgua

SEQ ID NO: 1015592 - RNA, 19 nt, Homo sapiens
gagaucagcucaguaacuu

SEQ ID NO: 1015593 - RNA, 19 nt, Homo sapiens
ugauaaaccucauuagugu

SEQ ID NO: 1015594 - RNA, 19 nt, Homo sapiens
ucccagggcugauacuuua

SEQ ID NO: 1015595 - RNA, 19 nt, Homo sapiens
guacaggaacuuauacaaa

SEQ ID NO: 1015596 - RNA, 19 nt, Homo sapiens
gaaacacugucuacguaug

SEQ ID NO: 1015597 - RNA, 19 nt, Homo sapiens
agagagaccuagagaaaga

SEQ ID NO: 1015598 - RNA, 19 nt, Homo sapiens
agagaaagaugaugaacug

SEQ ID NO: 1015599 - RNA, 19 nt, Homo sapiens
aaaccuccauuugugauua

SEQ ID NO: 1015600 - RNA, 19 nt, Homo sapiens
aaacagaacaucaagauca

SEQ ID NO: 1015601 - RNA, 19 nt, Homo sapiens
uacacgagauuucauguuu

SEQ ID NO: 1015602 - RNA, 19 nt, Homo sapiens
ugagagagaccuagagaaa

SEQ ID NO: 1015603 - RNA, 19 nt, Homo sapiens
ggaagagacugugaaagag

SEQ ID NO: 1015604 - RNA, 19 nt, Homo sapiens
ccauuuggcuccaguugaa

SEQ ID NO: 1015605 - RNA, 19 nt, Homo sapiens
caacagggcagccucuuau

SEQ ID NO: 1015606 - RNA, 19 nt, Homo sapiens
gaagagacugugaaagaga

SEQ ID NO: 1015607 - RNA, 19 nt, Homo sapiens
gaggacaucuaucuuagca

SEQ ID NO: 1015608 - RNA, 19 nt, Homo sapiens
gauaaaccuccauuuguga

SEQ ID NO: 1015609 - RNA, 19 nt, Homo sapiens
agauaaaccuccauuugug

SEQ ID NO: 1015610 - RNA, 19 nt, Homo sapiens
ggucuucaaugccagaaug

SEQ ID NO: 1015611 - RNA, 19 nt, Homo sapiens
cugaaugucugauaaguuc

SEQ ID NO: 1015612 - RNA, 19 nt, Homo sapiens
agacaaagaggacaucuau

SEQ ID NO: 1015613 - RNA, 19 nt, Homo sapiens
gcccaggagucgugcuuaa

SEQ ID NO: 1015614 - RNA, 19 nt, Homo sapiens
caagauguacaggaacuua

SEQ ID NO: 1015615 - RNA, 19 nt, Homo sapiens
gaacagcauggacaagaug

SEQ ID NO: 1015616 - RNA, 19 nt, Homo sapiens
ucugauaaguucaaggaaa

SEQ ID NO: 1015617 - RNA, 19 nt, Homo sapiens
gaaaauguuugaugugauc

SEQ ID NO: 1015618 - RNA, 19 nt, Homo sapiens
cagauaaaccuccauuugu

SEQ ID NO: 1015619 - RNA, 19 nt, Homo sapiens
gaugugaucaauaucugua

SEQ ID NO: 1015620 - RNA, 19 nt, Homo sapiens
uggaagagacugugaaaga

SEQ ID NO: 1015621 - RNA, 19 nt, Homo sapiens
gagaacagcauggacaaga

SEQ ID NO: 1015622 - RNA, 19 nt, Homo sapiens
gaacagccuacaauuucuu

SEQ ID NO: 1015623 - RNA, 19 nt, Homo sapiens
ugugugagcuaucugaaga

SEQ ID NO: 1015624 - RNA, 19 nt, Homo sapiens
acagauaaaccuccauuug

SEQ ID NO: 1015625 - RNA, 19 nt, Homo sapiens
ccacguggcacuuuccauu

SEQ ID NO: 1015626 - RNA, 19 nt, Homo sapiens
acaucaggcucaucaaaga

SEQ ID NO: 1015627 - RNA, 19 nt, Homo sapiens
gagcuucucucagggaaag

SEQ ID NO: 1015628 - RNA, 19 nt, Homo sapiens
cugagaccauccaugauaa

SEQ ID NO: 1015629 - RNA, 19 nt, Homo sapiens
ucugagaccauccaugaua

SEQ ID NO: 1015630 - RNA, 19 nt, Homo sapiens
uggacaagauguacaggaa

SEQ ID NO: 1015631 - RNA, 19 nt, Homo sapiens
uaucuuagcaucugugugu

SEQ ID NO: 1015632 - RNA, 19 nt, Homo sapiens
ccaacagggcagccucuua

SEQ ID NO: 1015633 - RNA, 19 nt, Homo sapiens
ggugaauacugguccaaca

SEQ ID NO: 1015634 - RNA, 19 nt, Homo sapiens
gaugagagagaccuagaga

SEQ ID NO: 1015635 - RNA, 19 nt, Homo sapiens
gcucaucaaagacauuuau

SEQ ID NO: 1015636 - RNA, 19 nt, Homo sapiens
gaaaucacaucaggcucau

SEQ ID NO: 1015637 - RNA, 19 nt, Homo sapiens
gaggauuucuggccuucga

SEQ ID NO: 1015638 - RNA, 19 nt, Homo sapiens
gacaagauguacaggaacu

SEQ ID NO: 1015639 - RNA, 19 nt, Homo sapiens
gaacuggaacugaaaagaa

SEQ ID NO: 1015640 - RNA, 19 nt, Homo sapiens
caagucaccugagagaagu

SEQ ID NO: 1015641 - RNA, 19 nt, Homo sapiens
auacagcaguguucgaguu

SEQ ID NO: 1015642 - RNA, 19 nt, Homo sapiens
caagcccuguguuaaauag

SEQ ID NO: 1015643 - RNA, 19 nt, Homo sapiens
cugauaaguucaaggaaau

SEQ ID NO: 1015644 - RNA, 19 nt, Homo sapiens
acaaagaggacaucuaucu

SEQ ID NO: 1015645 - RNA, 19 nt, Homo sapiens
cgugucaauuucucaauga

SEQ ID NO: 1015646 - RNA, 19 nt, Homo sapiens
ccauuuggaugacggugaa

SEQ ID NO: 1015647 - RNA, 19 nt, Homo sapiens
cccaaggauuauaagguua

SEQ ID NO: 1015648 - RNA, 19 nt, Homo sapiens
caggagucgugcuuaaaga

SEQ ID NO: 1015649 - RNA, 19 nt, Homo sapiens
ucacaucaggcucaucaaa

SEQ ID NO: 1015650 - RNA, 19 nt, Homo sapiens
aaacagauaaaccuccauu

SEQ ID NO: 1015651 - RNA, 19 nt, Homo sapiens
ccacacucaggauaaauuu

SEQ ID NO: 1015652 - RNA, 19 nt, Homo sapiens
gaaaugccacacucaggau

SEQ ID NO: 1015653 - RNA, 19 nt, Homo sapiens
gaugaugaacuggaacuga

SEQ ID NO: 1015654 - RNA, 19 nt, Homo sapiens
ggagaucagcucaguaacu

SEQ ID NO: 1015655 - RNA, 19 nt, Homo sapiens
gagucgugcuuaaagacaa

SEQ ID NO: 1015656 - RNA, 19 nt, Homo sapiens
ccucaacaaugccaaagca

SEQ ID NO: 1015657 - RNA, 19 nt, Homo sapiens
agcccaaggucguguagua

SEQ ID NO: 1015658 - RNA, 19 nt, Homo sapiens
acccaaggauuauaagguu

SEQ ID NO: 1015659 - RNA, 19 nt, Homo sapiens
ucuacgacuucagugauua

SEQ ID NO: 1015660 - RNA, 19 nt, Homo sapiens
aaacacugucuacguauga

SEQ ID NO: 1015661 - RNA, 19 nt, Homo sapiens
uucgaugacucuuuagaaa

SEQ ID NO: 1015662 - RNA, 19 nt, Homo sapiens
cgaacagccuacaauuucu

SEQ ID NO: 1015663 - RNA, 19 nt, Homo sapiens
cuacgaacagccuacaauu

SEQ ID NO: 1015664 - RNA, 19 nt, Homo sapiens
gaccauccaugauaaaccu

SEQ ID NO: 1015665 - RNA, 19 nt, Homo sapiens
acagggcagccucuuauaa

SEQ ID NO: 1015666 - RNA, 19 nt, Homo sapiens
ccagaaugguguuugaaaa

SEQ ID NO: 1015667 - RNA, 19 nt, Homo sapiens
ccaagcccuguguuaaaua

SEQ ID NO: 1015668 - RNA, 19 nt, Homo sapiens
uuauugggaucuucuggaa

SEQ ID NO: 1015669 - RNA, 19 nt, Homo sapiens
ccaagucccagggcugaua

SEQ ID NO: 1015670 - RNA, 19 nt, Homo sapiens
acgaacagccuacaauuuc

SEQ ID NO: 1015671 - RNA, 19 nt, Homo sapiens
gaacaucaagaucacaaaa

SEQ ID NO: 1015672 - RNA, 19 nt, Homo sapiens
gccagaaugguguuugaaa

SEQ ID NO: 1015673 - RNA, 19 nt, Homo sapiens
gauuacugaaugucugaua

SEQ ID NO: 1015674 - RNA, 19 nt, Homo sapiens
cuucugagaccauccauga

SEQ ID NO: 1015675 - RNA, 19 nt, Homo sapiens
cgacccaucuuugagaaca

SEQ ID NO: 1015676 - RNA, 19 nt, Homo sapiens
augaugaacuggaacugaa

SEQ ID NO: 1015677 - RNA, 19 nt, Homo sapiens
gcugccgacccaaggauua

SEQ ID NO: 1015678 - RNA, 19 nt, Homo sapiens
caagggugcacaaugauca

SEQ ID NO: 1015679 - RNA, 19 nt, Homo sapiens
gcggcuggcccauuuaaau

SEQ ID NO: 1015680 - RNA, 19 nt, Homo sapiens
uacgaacagccuacaauuu

SEQ ID NO: 1015681 - RNA, 19 nt, Homo sapiens
ccaagucaccugagagaag

SEQ ID NO: 1015682 - RNA, 19 nt, Homo sapiens
gaaugucugauaaguucaa

SEQ ID NO: 1015683 - RNA, 19 nt, Homo sapiens
ggaaagcuucugagaccau

SEQ ID NO: 1015684 - RNA, 19 nt, Homo sapiens
cgcaguagauccuggagau

SEQ ID NO: 1015685 - RNA, 19 nt, Homo sapiens
cuggagaucagcucaguaa

SEQ ID NO: 1015686 - RNA, 19 nt, Homo sapiens
agauguacaggaacuuaua

SEQ ID NO: 1015687 - RNA, 19 nt, Homo sapiens
gaacaacuuugcaggaaua

SEQ ID NO: 1015688 - RNA, 19 nt, Homo sapiens
ugaaacagcuguggaauua

SEQ ID NO: 1015689 - RNA, 19 nt, Homo sapiens
ggaauuagcugcucucugu

SEQ ID NO: 1015690 - RNA, 19 nt, Homo sapiens
gcacuucccugccuuagua

SEQ ID NO: 1015691 - RNA, 19 nt, Homo sapiens
gaaaugcccuuaugaaaca

SEQ ID NO: 1015692 - RNA, 19 nt, Homo sapiens
caaagagcaugaaguauuu

SEQ ID NO: 1015693 - RNA, 19 nt, Homo sapiens
gauagaaucuugaccagaa

SEQ ID NO: 1015694 - RNA, 19 nt, Homo sapiens
cgaaguggcuggaaaugua

SEQ ID NO: 1015695 - RNA, 19 nt, Homo sapiens
ggaaacagcaaauccaaua

SEQ ID NO: 1015696 - RNA, 19 nt, Homo sapiens
caaguuggcuguuacugua

SEQ ID NO: 1015697 - RNA, 19 nt, Homo sapiens
gggcaaagcugaagguuuc

SEQ ID NO: 1015698 - RNA, 19 nt, Homo sapiens
gaacucuccuaucugaaua

SEQ ID NO: 1015699 - RNA, 19 nt, Homo sapiens
gcauuucuguuuaccaaua

SEQ ID NO: 1015700 - RNA, 19 nt, Homo sapiens
aagaggaacugaucucaua

SEQ ID NO: 1015701 - RNA, 19 nt, Homo sapiens
gcuuuacacuuucgaguua

SEQ ID NO: 1015702 - RNA, 19 nt, Homo sapiens
acacagaucuuauaaaguc

SEQ ID NO: 1015703 - RNA, 19 nt, Homo sapiens
gauguaggaucuuuacuau

SEQ ID NO: 1015704 - RNA, 19 nt, Homo sapiens
gcccaggucuccaugguua

SEQ ID NO: 1015705 - RNA, 19 nt, Homo sapiens
ggucaaagagcaugaagua

SEQ ID NO: 1015706 - RNA, 19 nt, Homo sapiens
gaagagaccacuggaguuu

SEQ ID NO: 1015707 - RNA, 19 nt, Homo sapiens
ugaaggagcuaacaaaaua

SEQ ID NO: 1015708 - RNA, 19 nt, Homo sapiens
gggaagagauggcugugaa

SEQ ID NO: 1015709 - RNA, 19 nt, Homo sapiens
gcagugauaucauuaagag

SEQ ID NO: 1015710 - RNA, 19 nt, Homo sapiens
uaaauuaguucccuagcuu

SEQ ID NO: 1015711 - RNA, 19 nt, Homo sapiens
gagcuuugacuguuuguua

SEQ ID NO: 1015712 - RNA, 19 nt, Homo sapiens
gaaucaccguuuguaaaua

SEQ ID NO: 1015713 - RNA, 19 nt, Homo sapiens
gcggaacucuccuaucuga

SEQ ID NO: 1015714 - RNA, 19 nt, Homo sapiens
gaagagauggcugugaaua

SEQ ID NO: 1015715 - RNA, 19 nt, Homo sapiens
ucaaagagcaugaaguauu

SEQ ID NO: 1015716 - RNA, 19 nt, Homo sapiens
gcaccgagcuuugacuguu

SEQ ID NO: 1015717 - RNA, 19 nt, Homo sapiens
ccacagugcagaccauuua

SEQ ID NO: 1015718 - RNA, 19 nt, Homo sapiens
cagaagcaauggaauuuga

SEQ ID NO: 1015719 - RNA, 19 nt, Homo sapiens
gcucaccucuaaccaguaa

SEQ ID NO: 1015720 - RNA, 19 nt, Homo sapiens
ucacagauguugaaguuuc

SEQ ID NO: 1015721 - RNA, 19 nt, Homo sapiens
uagcaaggcugagcacuuu

SEQ ID NO: 1015722 - RNA, 19 nt, Homo sapiens
uguaggaucuuuacuauca

SEQ ID NO: 1015723 - RNA, 19 nt, Homo sapiens
gaaguuaacaagacaguau

SEQ ID NO: 1015724 - RNA, 19 nt, Homo sapiens
gugaggaguuuacaaggua

SEQ ID NO: 1015725 - RNA, 19 nt, Homo sapiens
cuucagagacaguaaauua

SEQ ID NO: 1015726 - RNA, 19 nt, Homo sapiens
uaaaguugaucgauucaug

SEQ ID NO: 1015727 - RNA, 19 nt, Homo sapiens
ggaaucaccguuuguaaau

SEQ ID NO: 1015728 - RNA, 19 nt, Homo sapiens
aguaggaaaugauagcuua

SEQ ID NO: 1015729 - RNA, 19 nt, Homo sapiens
uaagaggauuccaugguuu

SEQ ID NO: 1015730 - RNA, 19 nt, Homo sapiens
guaagaaguccuauuccua

SEQ ID NO: 1015731 - RNA, 19 nt, Homo sapiens
agagauggcugugaauauu

SEQ ID NO: 1015732 - RNA, 19 nt, Homo sapiens
gcaauggaauuugauaucu

SEQ ID NO: 1015733 - RNA, 19 nt, Homo sapiens
gaagcaauggaauuugaua

SEQ ID NO: 1015734 - RNA, 19 nt, Homo sapiens
cuucuaaccugcuuucuga

SEQ ID NO: 1015735 - RNA, 19 nt, Homo sapiens
uaagagcuaucaauaugug

SEQ ID NO: 1015736 - RNA, 19 nt, Homo sapiens
ggcaggaacuggagagaga

SEQ ID NO: 1015737 - RNA, 19 nt, Homo sapiens
cauguacccuccaaucaaa

SEQ ID NO: 1015738 - RNA, 19 nt, Homo sapiens
gaagaaccagcaccuuuga

SEQ ID NO: 1015739 - RNA, 19 nt, Homo sapiens
ggauuuguuugaucagauu

SEQ ID NO: 1015740 - RNA, 19 nt, Homo sapiens
caagguaccuguuuguuuu

SEQ ID NO: 1015741 - RNA, 19 nt, Homo sapiens
gaucaugccaaacccauaa

SEQ ID NO: 1015742 - RNA, 19 nt, Homo sapiens
ugaauggugccaauaauuu

SEQ ID NO: 1015743 - RNA, 19 nt, Homo sapiens
ucaggacgcuaguguaaga

SEQ ID NO: 1015744 - RNA, 19 nt, Homo sapiens
gcauacaagugugugcuuu

SEQ ID NO: 1015745 - RNA, 19 nt, Homo sapiens
uccaauagauccgacuuua

SEQ ID NO: 1015746 - RNA, 19 nt, Homo sapiens
ucagauaaccgaggauuaa

SEQ ID NO: 1015747 - RNA, 19 nt, Homo sapiens
uuaggaauaucuccaaaga

SEQ ID NO: 1015748 - RNA, 19 nt, Homo sapiens
gaacuccuuggauaugaua

SEQ ID NO: 1015749 - RNA, 19 nt, Homo sapiens
ggagugaccacaucuacaa

SEQ ID NO: 1015750 - RNA, 19 nt, Homo sapiens
gaaaaugcuucccgaguga

SEQ ID NO: 1015751 - RNA, 19 nt, Homo sapiens
ugaagccgcugcccaucua

SEQ ID NO: 1015752 - RNA, 19 nt, Homo sapiens
ugaaguuucugaagguuga

SEQ ID NO: 1015753 - RNA, 19 nt, Homo sapiens
gaggaacugaucucauaua

SEQ ID NO: 1015754 - RNA, 19 nt, Homo sapiens
uaagaaguccuauuccuau

SEQ ID NO: 1015755 - RNA, 19 nt, Homo sapiens
cggaucaugugaaguguaa

SEQ ID NO: 1015756 - RNA, 19 nt, Homo sapiens
ggaagccuaguaaacguua

SEQ ID NO: 1015757 - RNA, 19 nt, Homo sapiens
cuugugaacuccuuggaua

SEQ ID NO: 1015758 - RNA, 19 nt, Homo sapiens
caauagauccgacuuuauc

SEQ ID NO: 1015759 - RNA, 19 nt, Homo sapiens
gacagaagcaauggaauuu

SEQ ID NO: 1015760 - RNA, 19 nt, Homo sapiens
ugaggaauguaugugaaua

SEQ ID NO: 1015761 - RNA, 19 nt, Homo sapiens
uguauuuccuuguguguaa

SEQ ID NO: 1015762 - RNA, 19 nt, Homo sapiens
uaacacuugucuccucuug

SEQ ID NO: 1015763 - RNA, 19 nt, Homo sapiens
cauccucacucuccaaaug

SEQ ID NO: 1015764 - RNA, 19 nt, Homo sapiens
gaauggugccaauaauuug

SEQ ID NO: 1015765 - RNA, 19 nt, Homo sapiens
cuagcuuucucaaugaaua

SEQ ID NO: 1015766 - RNA, 19 nt, Homo sapiens
ggguuaauaugauguagga

SEQ ID NO: 1015767 - RNA, 19 nt, Homo sapiens
gagagaagaugaugaaaag

SEQ ID NO: 1015768 - RNA, 19 nt, Homo sapiens
ccacuggaguuugcaugua

SEQ ID NO: 1015769 - RNA, 19 nt, Homo sapiens
ggaggaaucaccguuugua

SEQ ID NO: 1015770 - RNA, 19 nt, Homo sapiens
gacagaauaucaagcuaca

SEQ ID NO: 1015771 - RNA, 19 nt, Homo sapiens
cgacaggcauauuaaucuu

SEQ ID NO: 1015772 - RNA, 19 nt, Homo sapiens
ggaacucuccuaucugaau

SEQ ID NO: 1015773 - RNA, 19 nt, Homo sapiens
gaugugaguagaagaacua

SEQ ID NO: 1015774 - RNA, 19 nt, Homo sapiens
aaacaaggcugaagaaaag

SEQ ID NO: 1015775 - RNA, 19 nt, Homo sapiens
gcagcaagucccuuacaaa

SEQ ID NO: 1015776 - RNA, 19 nt, Homo sapiens
auaauuaccagccucaaua

SEQ ID NO: 1015777 - RNA, 19 nt, Homo sapiens
acacauggcuccagguuac

SEQ ID NO: 1015778 - RNA, 19 nt, Homo sapiens
aaauugaaaugcccuuaug

SEQ ID NO: 1015779 - RNA, 19 nt, Homo sapiens
accaauagcucugccagua

SEQ ID NO: 1015780 - RNA, 19 nt, Homo sapiens
auucugcucucaccaauuu

SEQ ID NO: 1015781 - RNA, 19 nt, Homo sapiens
ggaagagaccacuggaguu

SEQ ID NO: 1015782 - RNA, 19 nt, Homo sapiens
gugaucuucugauggauuu

SEQ ID NO: 1015783 - RNA, 19 nt, Homo sapiens
auccggaaguccauaauua

SEQ ID NO: 1015784 - RNA, 19 nt, Homo sapiens
cagcccagcucugcucuaa

SEQ ID NO: 1015785 - RNA, 19 nt, Homo sapiens
gaguuucgguucauuccaa

SEQ ID NO: 1015786 - RNA, 19 nt, Homo sapiens
uaacauggguaaccucacu

SEQ ID NO: 1015787 - RNA, 19 nt, Homo sapiens
caacugcccuuauggcuuu

SEQ ID NO: 1015788 - RNA, 19 nt, Homo sapiens
caacuaugcuugugaaugu

SEQ ID NO: 1015789 - RNA, 19 nt, Homo sapiens
gacaagagcuuaggagaga

SEQ ID NO: 1015790 - RNA, 19 nt, Homo sapiens
caacugcccuucaauuuca

SEQ ID NO: 1015791 - RNA, 19 nt, Homo sapiens
ggucagaacugguuauugg

SEQ ID NO: 1015792 - RNA, 19 nt, Homo sapiens
gggaagccaugaacaacuu

SEQ ID NO: 1015793 - RNA, 19 nt, Homo sapiens
gcaauguacuugugaugag

SEQ ID NO: 1015794 - RNA, 19 nt, Homo sapiens
gcgcaacccucuccaacug

SEQ ID NO: 1015795 - RNA, 19 nt, Homo sapiens
gaccaugccaggaaaguuu

SEQ ID NO: 1015796 - RNA, 19 nt, Homo sapiens
gcagggaagccaugaacaa

SEQ ID NO: 1015797 - RNA, 19 nt, Homo sapiens
ugaccaagaucucaacuac

SEQ ID NO: 1015798 - RNA, 19 nt, Homo sapiens
caacuacuauggagacaac

SEQ ID NO: 1015799 - RNA, 19 nt, Homo sapiens
acaccgaccucuccacaga

SEQ ID NO: 1015800 - RNA, 19 nt, Homo sapiens
acacaaaccagaagaagga

SEQ ID NO: 1015801 - RNA, 19 nt, Homo sapiens
caaggcugcgcuacucuua

SEQ ID NO: 1015802 - RNA, 19 nt, Homo sapiens
guaccagucuguguguuug

SEQ ID NO: 1015803 - RNA, 19 nt, Homo sapiens
ggccaacuaugcuugugaa

SEQ ID NO: 1015804 - RNA, 19 nt, Homo sapiens
gaagaaggagcuggaagug

SEQ ID NO: 1015805 - RNA, 19 nt, Homo sapiens
acuauggccugcauuguga

SEQ ID NO: 1015806 - RNA, 19 nt, Homo sapiens
ucacaaggcugcgcuacuc

SEQ ID NO: 1015807 - RNA, 19 nt, Homo sapiens
ccagaaggacaaccugauu

SEQ ID NO: 1015808 - RNA, 19 nt, Homo sapiens
gcagugacaacuacuaugg

SEQ ID NO: 1015809 - RNA, 19 nt, Homo sapiens
uaucagaggagaggaauga

SEQ ID NO: 1015810 - RNA, 19 nt, Homo sapiens
gcaauggaggcagcuguaa

SEQ ID NO: 1015811 - RNA, 19 nt, Homo sapiens
accaagaucucaacuacug

SEQ ID NO: 1015812 - RNA, 19 nt, Homo sapiens
gaaggcgccacugcgguua

SEQ ID NO: 1015813 - RNA, 19 nt, Homo sapiens
cagaggagaggaaugaaug

SEQ ID NO: 1015814 - RNA, 19 nt, Homo sapiens
caaaccagcacccucacaa

SEQ ID NO: 1015815 - RNA, 19 nt, Homo sapiens
ccaacugcccuucaauuuc

SEQ ID NO: 1015816 - RNA, 19 nt, Homo sapiens
agaacugguuauuggauga

SEQ ID NO: 1015817 - RNA, 19 nt, Homo sapiens
ccacagugacaagagcuua

SEQ ID NO: 1015818 - RNA, 19 nt, Homo sapiens
ggggaggccuguuuuguga

SEQ ID NO: 1015819 - RNA, 19 nt, Homo sapiens
caucugcagugacaacuac

SEQ ID NO: 1015820 - RNA, 19 nt, Homo sapiens
gcugugaggugcggacauc

SEQ ID NO: 1015821 - RNA, 19 nt, Homo sapiens
aaccacacauuggacuaua

SEQ ID NO: 1015822 - RNA, 19 nt, Homo sapiens
ccacuucggccacuaugug

SEQ ID NO: 1015823 - RNA, 19 nt, Homo sapiens
gccagagugucggauauca

SEQ ID NO: 1015824 - RNA, 19 nt, Homo sapiens
gugugcaacugcccuuaug

SEQ ID NO: 1015825 - RNA, 19 nt, Homo sapiens
ucgagucccugcuucaaca

SEQ ID NO: 1015826 - RNA, 19 nt, Homo sapiens
uccaacugcccuucaauuu

SEQ ID NO: 1015827 - RNA, 19 nt, Homo sapiens
gcuacuauggccugcauug

SEQ ID NO: 1015828 - RNA, 19 nt, Homo sapiens
gggcuacuauggccugcau

SEQ ID NO: 1015829 - RNA, 19 nt, Homo sapiens
gagcucagcgagugugaca

SEQ ID NO: 1015830 - RNA, 19 nt, Homo sapiens
ggaccaugccaggaaaguu

SEQ ID NO: 1015831 - RNA, 19 nt, Homo sapiens
ccacacauuggacuauaau

SEQ ID NO: 1015832 - RNA, 19 nt, Homo sapiens
ggcaauguacuugugauga

SEQ ID NO: 1015833 - RNA, 19 nt, Homo sapiens
caaguccaacuguggcaaa

SEQ ID NO: 1015834 - RNA, 19 nt, Homo sapiens
gcucccgccugugcaagaa

SEQ ID NO: 1015835 - RNA, 19 nt, Homo sapiens
gguaccuucucgcucauca

SEQ ID NO: 1015836 - RNA, 19 nt, Homo sapiens
gagaggaaugaauguguca

SEQ ID NO: 1015837 - RNA, 19 nt, Homo sapiens
cagucuguguguuugauau

SEQ ID NO: 1015838 - RNA, 19 nt, Homo sapiens
cagaaggacaaccugauuc

SEQ ID NO: 1015839 - RNA, 19 nt, Homo sapiens
aagccagagugucggauau

SEQ ID NO: 1015840 - RNA, 19 nt, Homo sapiens
aaagccagagugucggaua

SEQ ID NO: 1015841 - RNA, 19 nt, Homo sapiens
ccaacuaugcuugugaaug

SEQ ID NO: 1015842 - RNA, 19 nt, Homo sapiens
gcgucugccuuaagcacuu

SEQ ID NO: 1015843 - RNA, 19 nt, Homo sapiens
gcaaaccagcacccucaca

SEQ ID NO: 1015844 - RNA, 19 nt, Homo sapiens
ugcaggaguucaucaacga

SEQ ID NO: 1015845 - RNA, 19 nt, Homo sapiens
ucagcaagaucgccaucca

SEQ ID NO: 1015846 - RNA, 19 nt, Homo sapiens
agaagaaggagcuggaagu

SEQ ID NO: 1015847 - RNA, 19 nt, Homo sapiens
acacauuggacuauaaucu

SEQ ID NO: 1015848 - RNA, 19 nt, Homo sapiens
agcacucccuggcaaugua

SEQ ID NO: 1015849 - RNA, 19 nt, Homo sapiens
ucauugccacggagguaua

SEQ ID NO: 1015850 - RNA, 19 nt, Homo sapiens
gauaucagaggagaggaau

SEQ ID NO: 1015851 - RNA, 19 nt, Homo sapiens
accacacauuggacuauaa

SEQ ID NO: 1015852 - RNA, 19 nt, Homo sapiens
aaacacaaaccagaagaag

SEQ ID NO: 1015853 - RNA, 19 nt, Homo sapiens
ggaagccaugaacaacuug

SEQ ID NO: 1015854 - RNA, 19 nt, Homo sapiens
caacugcgagaagaaagug

SEQ ID NO: 1015855 - RNA, 19 nt, Homo sapiens
gcagcacucccuggcaaug

SEQ ID NO: 1015856 - RNA, 19 nt, Homo sapiens
gaggagaggaaugaaugug

SEQ ID NO: 1015857 - RNA, 19 nt, Homo sapiens
gcuccaacugcgagaagaa

SEQ ID NO: 1015858 - RNA, 19 nt, Homo sapiens
gggccaacuaugcuuguga

SEQ ID NO: 1015859 - RNA, 19 nt, Homo sapiens
ucagaggagaggaaugaau

SEQ ID NO: 1015860 - RNA, 19 nt, Homo sapiens
gaagaaagcuauggcaauu

SEQ ID NO: 1015861 - RNA, 19 nt, Homo sapiens
gaaauagccucugaaauuc

SEQ ID NO: 1015862 - RNA, 19 nt, Homo sapiens
agaaauagccucugaaauu

SEQ ID NO: 1015863 - RNA, 19 nt, Homo sapiens
gcacuuggaggaacauuua

SEQ ID NO: 1015864 - RNA, 19 nt, Homo sapiens
gcaggaguuuguuuaauga

SEQ ID NO: 1015865 - RNA, 19 nt, Homo sapiens
gggaagcuuuguaccuuua

SEQ ID NO: 1015866 - RNA, 19 nt, Homo sapiens
caauugaucucuuaaccaa

SEQ ID NO: 1015867 - RNA, 19 nt, Homo sapiens
caucgaaucuugcgaacaa

SEQ ID NO: 1015868 - RNA, 19 nt, Homo sapiens
caaagcgcauggagacuaa

SEQ ID NO: 1015869 - RNA, 19 nt, Homo sapiens
gaucaauggucucagaaau

SEQ ID NO: 1015870 - RNA, 19 nt, Homo sapiens
gaaugaugcuaugaaauug

SEQ ID NO: 1015871 - RNA, 19 nt, Homo sapiens
gaacauggaauugugguuu

SEQ ID NO: 1015872 - RNA, 19 nt, Homo sapiens
gaauuugaagccuacauua

SEQ ID NO: 1015873 - RNA, 19 nt, Homo sapiens
gaguguaggugaaaugaau

SEQ ID NO: 1015874 - RNA, 19 nt, Homo sapiens
gcagaugguugcaauugau

SEQ ID NO: 1015875 - RNA, 19 nt, Homo sapiens
gcuuaauuguugccaaaua

SEQ ID NO: 1015876 - RNA, 19 nt, Homo sapiens
ggagugacccugaauguuc

SEQ ID NO: 1015877 - RNA, 19 nt, Homo sapiens
gaagugcugggcaaguuua

SEQ ID NO: 1015878 - RNA, 19 nt, Homo sapiens
agaagugggugggaaauaa

SEQ ID NO: 1015879 - RNA, 19 nt, Homo sapiens
ggcaauugcugaugcuuug

SEQ ID NO: 1015880 - RNA, 19 nt, Homo sapiens
gauguuuccuccaacuaaa

SEQ ID NO: 1015881 - RNA, 19 nt, Homo sapiens
gaaccauucccuagucauu

SEQ ID NO: 1015882 - RNA, 19 nt, Homo sapiens
gcaaagcgcauggagacua

SEQ ID NO: 1015883 - RNA, 19 nt, Homo sapiens
ucaauggucucagaaauuc

SEQ ID NO: 1015884 - RNA, 19 nt, Homo sapiens
gcuagucaguaaagauauu

SEQ ID NO: 1015885 - RNA, 19 nt, Homo sapiens
gaaauugguggguggugua

SEQ ID NO: 1015886 - RNA, 19 nt, Homo sapiens
gguugcaauugaucucuua

SEQ ID NO: 1015887 - RNA, 19 nt, Homo sapiens
cagacaggcuggcauucua

SEQ ID NO: 1015888 - RNA, 19 nt, Homo sapiens
ggucaguccucaucucugu

SEQ ID NO: 1015889 - RNA, 19 nt, Homo sapiens
caagacccauugagaagug

SEQ ID NO: 1015890 - RNA, 19 nt, Homo sapiens
uaucauagcagcuuagaau

SEQ ID NO: 1015891 - RNA, 19 nt, Homo sapiens
ggaaccacaucaugcacuu

SEQ ID NO: 1015892 - RNA, 19 nt, Homo sapiens
gagaagauaaucauugcuu

SEQ ID NO: 1015893 - RNA, 19 nt, Homo sapiens
gagaacagcauaugauuuu

SEQ ID NO: 1015894 - RNA, 19 nt, Homo sapiens
aggcuggcauucuagauua

SEQ ID NO: 1015895 - RNA, 19 nt, Homo sapiens
uaagaaagcccacaaaucc

SEQ ID NO: 1015896 - RNA, 19 nt, Homo sapiens
ggaauuugaagccuacauu

SEQ ID NO: 1015897 - RNA, 19 nt, Homo sapiens
gccuguggcuuaauuguug

SEQ ID NO: 1015898 - RNA, 19 nt, Homo sapiens
gcgaacaacacgauacuug

SEQ ID NO: 1015899 - RNA, 19 nt, Homo sapiens
gaccgggaauucauggauu

SEQ ID NO: 1015900 - RNA, 19 nt, Homo sapiens
uaggugaaaugaaugaaug

SEQ ID NO: 1015901 - RNA, 19 nt, Homo sapiens
gaauugugguuuucucuuu

SEQ ID NO: 1015902 - RNA, 19 nt, Homo sapiens
caccuuguguguuuaaaga

SEQ ID NO: 1015903 - RNA, 19 nt, Homo sapiens
gcuuauggcuaccggaaau

SEQ ID NO: 1015904 - RNA, 19 nt, Homo sapiens
gagcuggagugacccugaa

SEQ ID NO: 1015905 - RNA, 19 nt, Homo sapiens
gagaagugggugggaaaua

SEQ ID NO: 1015906 - RNA, 19 nt, Homo sapiens
gcacugagaacagcauaug

SEQ ID NO: 1015907 - RNA, 19 nt, Homo sapiens
ccucaucucuguccugcuu

SEQ ID NO: 1015908 - RNA, 19 nt, Homo sapiens
gggcugcaguucucucaug

SEQ ID NO: 1015909 - RNA, 19 nt, Homo sapiens
gcaaauggcaguuuuaauc

SEQ ID NO: 1015910 - RNA, 19 nt, Homo sapiens
ucucagaugccaugacuuu

SEQ ID NO: 1015911 - RNA, 19 nt, Homo sapiens
cagggaagcugcugguagu

SEQ ID NO: 1015912 - RNA, 19 nt, Homo sapiens
gaagcuuuguaccuuuaga

SEQ ID NO: 1015913 - RNA, 19 nt, Homo sapiens
acacaucaauuugguuguu

SEQ ID NO: 1015914 - RNA, 19 nt, Homo sapiens
gaaagcacaaguacgaagu

SEQ ID NO: 1015915 - RNA, 19 nt, Homo sapiens
ucaauggaaagcacaagua

SEQ ID NO: 1015916 - RNA, 19 nt, Homo sapiens
ugcaggaguuuguuuaaug

SEQ ID NO: 1015917 - RNA, 19 nt, Homo sapiens
ugagaacagcauaugauuu

SEQ ID NO: 1015918 - RNA, 19 nt, Homo sapiens
ggcaugaggugguuguagu

SEQ ID NO: 1015919 - RNA, 19 nt, Homo sapiens
cgugauugguuuccucuug

SEQ ID NO: 1015920 - RNA, 19 nt, Homo sapiens
gacccugaauguucuggaa

SEQ ID NO: 1015921 - RNA, 19 nt, Homo sapiens
cagaugccaugacuuucaa

SEQ ID NO: 1015922 - RNA, 19 nt, Homo sapiens
cuagucauuuccaaacuug

SEQ ID NO: 1015923 - RNA, 19 nt, Homo sapiens
cccacgaccucaccuggua

SEQ ID NO: 1015924 - RNA, 19 nt, Homo sapiens
gugaucagauggacaaugc

SEQ ID NO: 1015925 - RNA, 19 nt, Homo sapiens
gaucuucauuggugguauc

SEQ ID NO: 1015926 - RNA, 19 nt, Homo sapiens
cuagaaauagccucugaaa

SEQ ID NO: 1015927 - RNA, 19 nt, Homo sapiens
ugaggugguuguagucaug

SEQ ID NO: 1015928 - RNA, 19 nt, Homo sapiens
gaugacccgugccuuuauc

SEQ ID NO: 1015929 - RNA, 19 nt, Homo sapiens
cuucaucaccuuuaaaugu

SEQ ID NO: 1015930 - RNA, 19 nt, Homo sapiens
gaucagauggacaaugcaa

SEQ ID NO: 1015931 - RNA, 19 nt, Homo sapiens
gaaauuccagagaagaaag

SEQ ID NO: 1015932 - RNA, 19 nt, Homo sapiens
ggauuucgccgaugcucaa

SEQ ID NO: 1015933 - RNA, 19 nt, Homo sapiens
agacuuacucaaccucaua

SEQ ID NO: 1015934 - RNA, 19 nt, Homo sapiens
auuggugggugguguauuu

SEQ ID NO: 1015935 - RNA, 19 nt, Homo sapiens
aggaugacaugugccauuu

SEQ ID NO: 1015936 - RNA, 19 nt, Homo sapiens
ucgcuagucaguaaagaua

SEQ ID NO: 1015937 - RNA, 19 nt, Homo sapiens
ccuuggacgugauugguuu

SEQ ID NO: 1015938 - RNA, 19 nt, Homo sapiens
ccgaugacccgugccuuua

SEQ ID NO: 1015939 - RNA, 19 nt, Homo sapiens
agaaagcuauggcaauugc

SEQ ID NO: 1015940 - RNA, 19 nt, Homo sapiens
cagaaauuccagagaagaa

SEQ ID NO: 1015941 - RNA, 19 nt, Homo sapiens
uggagaacauggaauugug

SEQ ID NO: 1015942 - RNA, 19 nt, Homo sapiens
caacugccaucagggaaag

SEQ ID NO: 1015943 - RNA, 19 nt, Homo sapiens
gaagggaagcuuuguaccu

SEQ ID NO: 1015944 - RNA, 19 nt, Homo sapiens
ggaucaauggucucagaaa

SEQ ID NO: 1015945 - RNA, 19 nt, Homo sapiens
uuugaagccuacauuaaug

SEQ ID NO: 1015946 - RNA, 19 nt, Homo sapiens
ugaugccuguggcuuaauu

SEQ ID NO: 1015947 - RNA, 19 nt, Homo sapiens
gaugcgguguuucuugauc

SEQ ID NO: 1015948 - RNA, 19 nt, Homo sapiens
uuucugaguucauccaaug

SEQ ID NO: 1015949 - RNA, 19 nt, Homo sapiens
aagcacaaguacgaaguuu

SEQ ID NO: 1015950 - RNA, 19 nt, Homo sapiens
ggugguguauuugagaaga

SEQ ID NO: 1015951 - RNA, 19 nt, Homo sapiens
guuaagaaagcccacaaau

SEQ ID NO: 1015952 - RNA, 19 nt, Homo sapiens
gagugacccugaauguucu

SEQ ID NO: 1015953 - RNA, 19 nt, Homo sapiens
cauacacucuggaggaucu

SEQ ID NO: 1015954 - RNA, 19 nt, Homo sapiens
gcaauugaucucuuaacca

SEQ ID NO: 1015955 - RNA, 19 nt, Homo sapiens
gaucuggaccgggaauuca

SEQ ID NO: 1015956 - RNA, 19 nt, Homo sapiens
gcacagugaagacuuacuc

SEQ ID NO: 1015957 - RNA, 19 nt, Homo sapiens
ccuagucauuuccaaacuu

SEQ ID NO: 1015958 - RNA, 19 nt, Homo sapiens
uuaagaaagcccacaaauc

SEQ ID NO: 1015959 - RNA, 19 nt, Homo sapiens
ccucugaaauucuccaaac

SEQ ID NO: 1015960 - RNA, 19 nt, Homo sapiens
gaagaaagcuauggcaauu

SEQ ID NO: 1015961 - RNA, 19 nt, Homo sapiens
caagagagauguggauaua

SEQ ID NO: 1015962 - RNA, 19 nt, Homo sapiens
gaagaaccguuaccaauca

SEQ ID NO: 1015963 - RNA, 19 nt, Homo sapiens
ccaacuuccuuguuaauuu

SEQ ID NO: 1015964 - RNA, 19 nt, Homo sapiens
guacaggaauaacaugauu

SEQ ID NO: 1015965 - RNA, 19 nt, Homo sapiens
gggaagcuuuguaccuuua

SEQ ID NO: 1015966 - RNA, 19 nt, Homo sapiens
gguaucaacuguaagaaga

SEQ ID NO: 1015967 - RNA, 19 nt, Homo sapiens
ucacagggcuccuagguau

SEQ ID NO: 1015968 - RNA, 19 nt, Homo sapiens
caucgaaucuugcgaacaa

SEQ ID NO: 1015969 - RNA, 19 nt, Homo sapiens
caacuuccuuguuaauuug

SEQ ID NO: 1015970 - RNA, 19 nt, Homo sapiens
gauaugacuuugugcuuga

SEQ ID NO: 1015971 - RNA, 19 nt, Homo sapiens
gcauaugauuucuugcuuu

SEQ ID NO: 1015972 - RNA, 19 nt, Homo sapiens
caaagcgcauggagacuaa

SEQ ID NO: 1015973 - RNA, 19 nt, Homo sapiens
gaucaauggucucagaaau

SEQ ID NO: 1015974 - RNA, 19 nt, Homo sapiens
gaaugaugcuaugaaauug

SEQ ID NO: 1015975 - RNA, 19 nt, Homo sapiens
gaacauggaauugugguuu

SEQ ID NO: 1015976 - RNA, 19 nt, Homo sapiens
gaauuugaagccuacauua

SEQ ID NO: 1015977 - RNA, 19 nt, Homo sapiens
gagaacagcauaugauuuc

SEQ ID NO: 1015978 - RNA, 19 nt, Homo sapiens
gaguguaggugaaaugaau

SEQ ID NO: 1015979 - RNA, 19 nt, Homo sapiens
caacgguaauaaagaguuu

SEQ ID NO: 1015980 - RNA, 19 nt, Homo sapiens
gcagaugguugcauugauc

SEQ ID NO: 1015981 - RNA, 19 nt, Homo sapiens
gauccuggcugaguauuug

SEQ ID NO: 1015982 - RNA, 19 nt, Homo sapiens
uaacaacgguaauaaagag

SEQ ID NO: 1015983 - RNA, 19 nt, Homo sapiens
ggagugacccugaauguuc

SEQ ID NO: 1015984 - RNA, 19 nt, Homo sapiens
guuaagauaugacuuugug

SEQ ID NO: 1015985 - RNA, 19 nt, Homo sapiens
gaagugcugggcaaguuua

SEQ ID NO: 1015986 - RNA, 19 nt, Homo sapiens
ggcaauugcugaugcuuug

SEQ ID NO: 1015987 - RNA, 19 nt, Homo sapiens
guggccaacuuccuuguua

SEQ ID NO: 1015988 - RNA, 19 nt, Homo sapiens
gcaaagcgcauggagacua

SEQ ID NO: 1015989 - RNA, 19 nt, Homo sapiens
ucaauggucucagaaauuc

SEQ ID NO: 1015990 - RNA, 19 nt, Homo sapiens
gcuagucaguaaagauauu

SEQ ID NO: 1015991 - RNA, 19 nt, Homo sapiens
agagagauguggauauaau

SEQ ID NO: 1015992 - RNA, 19 nt, Homo sapiens
gaaccguuaccaaucauuu

SEQ ID NO: 1015993 - RNA, 19 nt, Homo sapiens
gaaauugguggguggugua

SEQ ID NO: 1015994 - RNA, 19 nt, Homo sapiens
cauaugauuucuugcuuug

SEQ ID NO: 1015995 - RNA, 19 nt, Homo sapiens
cagacaggcuggcauucua

SEQ ID NO: 1015996 - RNA, 19 nt, Homo sapiens
ggagguaucaacuguaaga

SEQ ID NO: 1015997 - RNA, 19 nt, Homo sapiens
ggucaguccucaucucugu

SEQ ID NO: 1015998 - RNA, 19 nt, Homo sapiens
gagaagauaaucauugcuu

SEQ ID NO: 1015999 - RNA, 19 nt, Homo sapiens
aggcuggcauucuagauua

SEQ ID NO: 1016000 - RNA, 19 nt, Homo sapiens
uaagaaagcccacaaaucc

SEQ ID NO: 1016001 - RNA, 19 nt, Homo sapiens
ggaauuugaagccuacauu

SEQ ID NO: 1016002 - RNA, 19 nt, Homo sapiens
cuguuuggcuguuaagaua

SEQ ID NO: 1016003 - RNA, 19 nt, Homo sapiens
gauguuuccuacaacuaaa

SEQ ID NO: 1016004 - RNA, 19 nt, Homo sapiens
gaacagcauaugauuucuu

SEQ ID NO: 1016005 - RNA, 19 nt, Homo sapiens
gaaccaucccuagucauuu

SEQ ID NO: 1016006 - RNA, 19 nt, Homo sapiens
gcgaacaacacgauacuug

SEQ ID NO: 1016007 - RNA, 19 nt, Homo sapiens
guaagaagaggaaagacuu

SEQ ID NO: 1016008 - RNA, 19 nt, Homo sapiens
gguggugccugaaguuaau

SEQ ID NO: 1016009 - RNA, 19 nt, Homo sapiens
uaggugaaaugaaugaaug

SEQ ID NO: 1016010 - RNA, 19 nt, Homo sapiens
gaauugugguuuucucuuu

SEQ ID NO: 1016011 - RNA, 19 nt, Homo sapiens
caacauggucuucauugga

SEQ ID NO: 1016012 - RNA, 19 nt, Homo sapiens
gagcuggagugacccugaa

SEQ ID NO: 1016013 - RNA, 19 nt, Homo sapiens
gcuguuaagauaugacuuu

SEQ ID NO: 1016014 - RNA, 19 nt, Homo sapiens
guaacaacgguaauaaaga

SEQ ID NO: 1016015 - RNA, 19 nt, Homo sapiens
guuggagcccuaucuauuu

SEQ ID NO: 1016016 - RNA, 19 nt, Homo sapiens
gcccagacccuguguccua

SEQ ID NO: 1016017 - RNA, 19 nt, Homo sapiens
gcacugagaacagcauaug

SEQ ID NO: 1016018 - RNA, 19 nt, Homo sapiens
gcaaauggcaguuuuaauc

SEQ ID NO: 1016019 - RNA, 19 nt, Homo sapiens
cagacagaguacaggaaua

SEQ ID NO: 1016020 - RNA, 19 nt, Homo sapiens
gaagcuuuguaccuuuaga

SEQ ID NO: 1016021 - RNA, 19 nt, Homo sapiens
agacagaguacaggaauaa

SEQ ID NO: 1016022 - RNA, 19 nt, Homo sapiens
cagcuguccucaagagaga

SEQ ID NO: 1016023 - RNA, 19 nt, Homo sapiens
uuaaggagagcaaguuuga

SEQ ID NO: 1016024 - RNA, 19 nt, Homo sapiens
gggacacccugaacuucuu

SEQ ID NO: 1016025 - RNA, 19 nt, Homo sapiens
guaugaaggauauaguuga

SEQ ID NO: 1016026 - RNA, 19 nt, Homo sapiens
ugagaacagcauaugauuu

SEQ ID NO: 1016027 - RNA, 19 nt, Homo sapiens
cgugauugguuuccucuug

SEQ ID NO: 1016028 - RNA, 19 nt, Homo sapiens
gacccugaauguucuggaa

SEQ ID NO: 1016029 - RNA, 19 nt, Homo sapiens
ucacuuugcugagcgauca

SEQ ID NO: 1016030 - RNA, 19 nt, Homo sapiens
cuagucauuuccaaacuug

SEQ ID NO: 1016031 - RNA, 19 nt, Homo sapiens
cccacgaccucaccuggua

SEQ ID NO: 1016032 - RNA, 19 nt, Homo sapiens
gugaucagauggacaaugc

SEQ ID NO: 1016033 - RNA, 19 nt, Homo sapiens
ggucucuguuuggcuguua

SEQ ID NO: 1016034 - RNA, 19 nt, Homo sapiens
caucagcuguccucaagag

SEQ ID NO: 1016035 - RNA, 19 nt, Homo sapiens
ugaaccaucccuagucauu

SEQ ID NO: 1016036 - RNA, 19 nt, Homo sapiens
gaugacccgugccuuuauc

SEQ ID NO: 1016037 - RNA, 19 nt, Homo sapiens
uuggagguaucaacuguaa

SEQ ID NO: 1016038 - RNA, 19 nt, Homo sapiens
uuucagaccacaugacuuu

SEQ ID NO: 1016039 - RNA, 19 nt, Homo sapiens
uuucugauguuuccuacaa

SEQ ID NO: 1016040 - RNA, 19 nt, Homo sapiens
aacagcauaugauuucuug

SEQ ID NO: 1016041 - RNA, 19 nt, Homo sapiens
cuucaucaccuuuaaaugu

SEQ ID NO: 1016042 - RNA, 19 nt, Homo sapiens
ggauauaguugagguucuc

SEQ ID NO: 1016043 - RNA, 19 nt, Homo sapiens
gaucagauggacaaugcaa

SEQ ID NO: 1016044 - RNA, 19 nt, Homo sapiens
gggugauccuggcugagua

SEQ ID NO: 1016045 - RNA, 19 nt, Homo sapiens
ugaagaaccguuaccaauc

SEQ ID NO: 1016046 - RNA, 19 nt, Homo sapiens
cuccuucgcucauuucaga

SEQ ID NO: 1016047 - RNA, 19 nt, Homo sapiens
gaaauuccagagaagaaag

SEQ ID NO: 1016048 - RNA, 19 nt, Homo sapiens
uaaacuaaccacugcuuuc

SEQ ID NO: 1016049 - RNA, 19 nt, Homo sapiens
gacccuguguccuacauuc

SEQ ID NO: 1016050 - RNA, 19 nt, Homo sapiens
guuauuggccuguacuuca

SEQ ID NO: 1016051 - RNA, 19 nt, Homo sapiens
auuggugggugguguauuu

SEQ ID NO: 1016052 - RNA, 19 nt, Homo sapiens
aggaugacaugugccauuu

SEQ ID NO: 1016053 - RNA, 19 nt, Homo sapiens
ucgcuagucaguaaagaua

SEQ ID NO: 1016054 - RNA, 19 nt, Homo sapiens
ccuuggacgugauugguuu

SEQ ID NO: 1016055 - RNA, 19 nt, Homo sapiens
ccgaugacccgugccuuua

SEQ ID NO: 1016056 - RNA, 19 nt, Homo sapiens
agaaagcuauggcaauugc

SEQ ID NO: 1016057 - RNA, 19 nt, Homo sapiens
cagaaauuccagagaagaa

SEQ ID NO: 1016058 - RNA, 19 nt, Homo sapiens
uggagaacauggaauugug

SEQ ID NO: 1016059 - RNA, 19 nt, Homo sapiens
cauuggagguaucaacugu

SEQ ID NO: 1016060 - RNA, 19 nt, Homo sapiens
gaagaaccaccuagaaaua

SEQ ID NO: 1016061 - RNA, 19 nt, Homo sapiens
uaagauggcuucccaguga

SEQ ID NO: 1016062 - RNA, 19 nt, Homo sapiens
gaagauaagcuacuaauag

SEQ ID NO: 1016063 - RNA, 19 nt, Homo sapiens
ggaagaagauaagcuacua

SEQ ID NO: 1016064 - RNA, 19 nt, Homo sapiens
caauaaaccuucagauuca

SEQ ID NO: 1016065 - RNA, 19 nt, Homo sapiens
guaaaccucuucauacuau

SEQ ID NO: 1016066 - RNA, 19 nt, Homo sapiens
ggagguauacuucgaauuu

SEQ ID NO: 1016067 - RNA, 19 nt, Homo sapiens
caagguaaguggagguaua

SEQ ID NO: 1016068 - RNA, 19 nt, Homo sapiens
caagaucuccaaauaguua

SEQ ID NO: 1016069 - RNA, 19 nt, Homo sapiens
gaagacgugugaaauguau

SEQ ID NO: 1016070 - RNA, 19 nt, Homo sapiens
gcacuuuaauuacaacuga

SEQ ID NO: 1016071 - RNA, 19 nt, Homo sapiens
uuacguagcugaguuaauu

SEQ ID NO: 1016072 - RNA, 19 nt, Homo sapiens
ugaagagguuugagcuuua

SEQ ID NO: 1016073 - RNA, 19 nt, Homo sapiens
aaaguuagcuauggaguuu

SEQ ID NO: 1016074 - RNA, 19 nt, Homo sapiens
guuaaugucuuacaaggaa

SEQ ID NO: 1016075 - RNA, 19 nt, Homo sapiens
gaaauaagugcccugugua

SEQ ID NO: 1016076 - RNA, 19 nt, Homo sapiens
uugcaaagcucuucucuga

SEQ ID NO: 1016077 - RNA, 19 nt, Homo sapiens
gaaaggcuguucugugucu

SEQ ID NO: 1016078 - RNA, 19 nt, Homo sapiens
ggacaaagcagauacuaag

SEQ ID NO: 1016079 - RNA, 19 nt, Homo sapiens
ugaaauaagugcccugugu

SEQ ID NO: 1016080 - RNA, 19 nt, Homo sapiens
ucgcaacccucaugaagua

SEQ ID NO: 1016081 - RNA, 19 nt, Homo sapiens
gaaauaacucagcagaauu

SEQ ID NO: 1016082 - RNA, 19 nt, Homo sapiens
aguacaagaucuccaaaua

SEQ ID NO: 1016083 - RNA, 19 nt, Homo sapiens
agaaauaacucagcagaau

SEQ ID NO: 1016084 - RNA, 19 nt, Homo sapiens
gcagaaagaaccuggaaga

SEQ ID NO: 1016085 - RNA, 19 nt, Homo sapiens
gcauuuccguuaccaagaa

SEQ ID NO: 1016086 - RNA, 19 nt, Homo sapiens
ugacugcugugacuuugua

SEQ ID NO: 1016087 - RNA, 19 nt, Homo sapiens
cuauggaguuucuguagua

SEQ ID NO: 1016088 - RNA, 19 nt, Homo sapiens
ucaauaaaccuucagauuc

SEQ ID NO: 1016089 - RNA, 19 nt, Homo sapiens
cgcaauaacuguuugguau

SEQ ID NO: 1016090 - RNA, 19 nt, Homo sapiens
caacaaauccagacuccuu

SEQ ID NO: 1016091 - RNA, 19 nt, Homo sapiens
gguaugaucuugacucacu

SEQ ID NO: 1016092 - RNA, 19 nt, Homo sapiens
caucaagucuguacccaau

SEQ ID NO: 1016093 - RNA, 19 nt, Homo sapiens
ugucuguucuuacguauuu

SEQ ID NO: 1016094 - RNA, 19 nt, Homo sapiens
gaagguaaagccuaguuug

SEQ ID NO: 1016095 - RNA, 19 nt, Homo sapiens
ggaagacgugugaaaugua

SEQ ID NO: 1016096 - RNA, 19 nt, Homo sapiens
uacaagaucuccaaauagu

SEQ ID NO: 1016097 - RNA, 19 nt, Homo sapiens
caccaaccuuccuuugaua

SEQ ID NO: 1016098 - RNA, 19 nt, Homo sapiens
gaagaagauaagcuacuaa

SEQ ID NO: 1016099 - RNA, 19 nt, Homo sapiens
gcuacaaaguacgcaauaa

SEQ ID NO: 1016100 - RNA, 19 nt, Homo sapiens
gaagagguuugagcuuuag

SEQ ID NO: 1016101 - RNA, 19 nt, Homo sapiens
gaugagagagcacgagcua

SEQ ID NO: 1016102 - RNA, 19 nt, Homo sapiens
ugacauugaacccaaauuu

SEQ ID NO: 1016103 - RNA, 19 nt, Homo sapiens
ccagugaggugaugaagag

SEQ ID NO: 1016104 - RNA, 19 nt, Homo sapiens
ggaguggagugguaugauc

SEQ ID NO: 1016105 - RNA, 19 nt, Homo sapiens
caauggaacggguuaugua

SEQ ID NO: 1016106 - RNA, 19 nt, Homo sapiens
ucaccaaccuuccuuugau

SEQ ID NO: 1016107 - RNA, 19 nt, Homo sapiens
ugagagagcacgagcuaaa

SEQ ID NO: 1016108 - RNA, 19 nt, Homo sapiens
cuaguuugcugacauugaa

SEQ ID NO: 1016109 - RNA, 19 nt, Homo sapiens
aggaaaggcuguucugugu

SEQ ID NO: 1016110 - RNA, 19 nt, Homo sapiens
gagagcacgagcuaaagua

SEQ ID NO: 1016111 - RNA, 19 nt, Homo sapiens
agaacgggaugccaaggua

SEQ ID NO: 1016112 - RNA, 19 nt, Homo sapiens
uggaagacuugcagaaaga

SEQ ID NO: 1016113 - RNA, 19 nt, Homo sapiens
guaugucucugacucuaga

SEQ ID NO: 1016114 - RNA, 19 nt, Homo sapiens
guaaggaaacaaacaacuu

SEQ ID NO: 1016115 - RNA, 19 nt, Homo sapiens
gacgcuauuuguuaauuug

SEQ ID NO: 1016116 - RNA, 19 nt, Homo sapiens
ccacuucaccuacaauaau

SEQ ID NO: 1016117 - RNA, 19 nt, Homo sapiens
guacaagaucuccaaauag

SEQ ID NO: 1016118 - RNA, 19 nt, Homo sapiens
ucucugaccugaacaaugg

SEQ ID NO: 1016119 - RNA, 19 nt, Homo sapiens
uacccaauguguagucuuu

SEQ ID NO: 1016120 - RNA, 19 nt, Homo sapiens
caaaguacgcaauaacugu

SEQ ID NO: 1016121 - RNA, 19 nt, Homo sapiens
gaacgggaugccaagguaa

SEQ ID NO: 1016122 - RNA, 19 nt, Homo sapiens
aauccagacuccuucagua

SEQ ID NO: 1016123 - RNA, 19 nt, Homo sapiens
gggaauuccugcagagaag

SEQ ID NO: 1016124 - RNA, 19 nt, Homo sapiens
aaacagucaccauuuacua

SEQ ID NO: 1016125 - RNA, 19 nt, Homo sapiens
cgaauaaaugggauaaaga

SEQ ID NO: 1016126 - RNA, 19 nt, Homo sapiens
ucaagucuguacccaaugu

SEQ ID NO: 1016127 - RNA, 19 nt, Homo sapiens
gacacaauaagaagaguuu

SEQ ID NO: 1016128 - RNA, 19 nt, Homo sapiens
uaagugcccuguguagaau

SEQ ID NO: 1016129 - RNA, 19 nt, Homo sapiens
cagauucagucaguaaaga

SEQ ID NO: 1016130 - RNA, 19 nt, Homo sapiens
cggaagacgugugaaaugu

SEQ ID NO: 1016131 - RNA, 19 nt, Homo sapiens
ccagacuccuucaguacaa

SEQ ID NO: 1016132 - RNA, 19 nt, Homo sapiens
guucuucaguggugauuuc

SEQ ID NO: 1016133 - RNA, 19 nt, Homo sapiens
cuaugucuguucuuacgua

SEQ ID NO: 1016134 - RNA, 19 nt, Homo sapiens
ccaggucacuagcccuuga

SEQ ID NO: 1016135 - RNA, 19 nt, Homo sapiens
ugaagaaccaccuagaaau

SEQ ID NO: 1016136 - RNA, 19 nt, Homo sapiens
aaggagcacuuuaauuaca

SEQ ID NO: 1016137 - RNA, 19 nt, Homo sapiens
gaacccaaauuugauagac

SEQ ID NO: 1016138 - RNA, 19 nt, Homo sapiens
gacauugaacccaaauuug

SEQ ID NO: 1016139 - RNA, 19 nt, Homo sapiens
agacgugugaaauguauua

SEQ ID NO: 1016140 - RNA, 19 nt, Homo sapiens
ggagacggaagacguguga

SEQ ID NO: 1016141 - RNA, 19 nt, Homo sapiens
gcucuucucugaccugaac

SEQ ID NO: 1016142 - RNA, 19 nt, Homo sapiens
gcccuugacuccucuuauc

SEQ ID NO: 1016143 - RNA, 19 nt, Homo sapiens
ugacuccucuuaucaaacu

SEQ ID NO: 1016144 - RNA, 19 nt, Homo sapiens
ugauguggcucugggaauu

SEQ ID NO: 1016145 - RNA, 19 nt, Homo sapiens
gaguuaauuucaucucuac

SEQ ID NO: 1016146 - RNA, 19 nt, Homo sapiens
gagcacgagcuaaaguaaa

SEQ ID NO: 1016147 - RNA, 19 nt, Homo sapiens
acauugaacccaaauuuga

SEQ ID NO: 1016148 - RNA, 19 nt, Homo sapiens
gggcuaacacuugcgauuu

SEQ ID NO: 1016149 - RNA, 19 nt, Homo sapiens
guggaagacuugcagaaag

SEQ ID NO: 1016150 - RNA, 19 nt, Homo sapiens
uggaguuucuguaguauuc

SEQ ID NO: 1016151 - RNA, 19 nt, Homo sapiens
aagagcagauccuggaguu

SEQ ID NO: 1016152 - RNA, 19 nt, Homo sapiens
caauguguagucuuuguuu

SEQ ID NO: 1016153 - RNA, 19 nt, Homo sapiens
uaaugauuguugccaguga

SEQ ID NO: 1016154 - RNA, 19 nt, Homo sapiens
uagcugaguuaauuucauc

SEQ ID NO: 1016155 - RNA, 19 nt, Homo sapiens
guggugauuucugagauuu

SEQ ID NO: 1016156 - RNA, 19 nt, Homo sapiens
gucucugacucuagaauuu

SEQ ID NO: 1016157 - RNA, 19 nt, Homo sapiens
agacaaccaguucgcauuu

SEQ ID NO: 1016158 - RNA, 19 nt, Homo sapiens
cacuucaccuacaauaauu

SEQ ID NO: 1016159 - RNA, 19 nt, Homo sapiens
augaagagguuugagcuuu

SEQ ID NO: 1016160 - RNA, 19 nt, Homo sapiens
gaagaaccaccuagaaaua

SEQ ID NO: 1016161 - RNA, 19 nt, Homo sapiens
uaagauggcuucccaguga

SEQ ID NO: 1016162 - RNA, 19 nt, Homo sapiens
gcaucuagaucuucaaauu

SEQ ID NO: 1016163 - RNA, 19 nt, Homo sapiens
caagaucuccaaauaguua

SEQ ID NO: 1016164 - RNA, 19 nt, Homo sapiens
gaagacgugugaaauguau

SEQ ID NO: 1016165 - RNA, 19 nt, Homo sapiens
ugaagagguuugagcuuua

SEQ ID NO: 1016166 - RNA, 19 nt, Homo sapiens
gagcaucaagggaagauua

SEQ ID NO: 1016167 - RNA, 19 nt, Homo sapiens
uugcaaagcucuucucuga

SEQ ID NO: 1016168 - RNA, 19 nt, Homo sapiens
gaaauaacucagcagaauu

SEQ ID NO: 1016169 - RNA, 19 nt, Homo sapiens
aguacaagaucuccaaaua

SEQ ID NO: 1016170 - RNA, 19 nt, Homo sapiens
agaaauaacucagcagaau

SEQ ID NO: 1016171 - RNA, 19 nt, Homo sapiens
gcagaaagaaccuggaaga

SEQ ID NO: 1016172 - RNA, 19 nt, Homo sapiens
gcauuuccguuaccaagaa

SEQ ID NO: 1016173 - RNA, 19 nt, Homo sapiens
caacaaauccagacuccuu

SEQ ID NO: 1016174 - RNA, 19 nt, Homo sapiens
ggaagacgugugaaaugua

SEQ ID NO: 1016175 - RNA, 19 nt, Homo sapiens
uacaagaucuccaaauagu

SEQ ID NO: 1016176 - RNA, 19 nt, Homo sapiens
gaagagguuugagcuuuag

SEQ ID NO: 1016177 - RNA, 19 nt, Homo sapiens
ccagugaggugaugaagag

SEQ ID NO: 1016178 - RNA, 19 nt, Homo sapiens
caauggaacggguuaugua

SEQ ID NO: 1016179 - RNA, 19 nt, Homo sapiens
uggaagacuugcagaaaga

SEQ ID NO: 1016180 - RNA, 19 nt, Homo sapiens
guaugucucugacucuaga

SEQ ID NO: 1016181 - RNA, 19 nt, Homo sapiens
guacaagaucuccaaauag

SEQ ID NO: 1016182 - RNA, 19 nt, Homo sapiens
ucucugaccugaacaaugg

SEQ ID NO: 1016183 - RNA, 19 nt, Homo sapiens
aauccagacuccuucagua

SEQ ID NO: 1016184 - RNA, 19 nt, Homo sapiens
gggaauuccugcagagaag

SEQ ID NO: 1016185 - RNA, 19 nt, Homo sapiens
gauuacauacgccuugaaa

SEQ ID NO: 1016186 - RNA, 19 nt, Homo sapiens
cggaagacgugugaaaugu

SEQ ID NO: 1016187 - RNA, 19 nt, Homo sapiens
ccagacuccuucaguacaa

SEQ ID NO: 1016188 - RNA, 19 nt, Homo sapiens
ugaagaaccaccuagaaau

SEQ ID NO: 1016189 - RNA, 19 nt, Homo sapiens
agacgugugaaauguauua

SEQ ID NO: 1016190 - RNA, 19 nt, Homo sapiens
ggagacggaagacguguga

SEQ ID NO: 1016191 - RNA, 19 nt, Homo sapiens
ccaggucacuagcccuuga

SEQ ID NO: 1016192 - RNA, 19 nt, Homo sapiens
gcucuucucugaccugaac

SEQ ID NO: 1016193 - RNA, 19 nt, Homo sapiens
ugauguggcucugggaauu

SEQ ID NO: 1016194 - RNA, 19 nt, Homo sapiens
ugacuccucuuaucaaacu

SEQ ID NO: 1016195 - RNA, 19 nt, Homo sapiens
guggaagacuugcagaaag

SEQ ID NO: 1016196 - RNA, 19 nt, Homo sapiens
gcccuugacuccucuuauc

SEQ ID NO: 1016197 - RNA, 19 nt, Homo sapiens
gggcuaacacuugcgauuu

SEQ ID NO: 1016198 - RNA, 19 nt, Homo sapiens
aagagcagauccuggaguu

SEQ ID NO: 1016199 - RNA, 19 nt, Homo sapiens
gaaccuugucucuguugaa

SEQ ID NO: 1016200 - RNA, 19 nt, Homo sapiens
ggaaccuugucucuguuga

SEQ ID NO: 1016201 - RNA, 19 nt, Homo sapiens
augaagagguuugagcuuu

SEQ ID NO: 1016202 - RNA, 19 nt, Homo sapiens
gucucugacucuagaauuu

SEQ ID NO: 1016203 - RNA, 19 nt, Homo sapiens
aaauaacucagcagaauuc

SEQ ID NO: 1016204 - RNA, 19 nt, Homo sapiens
gugaggugaugaagagguu

SEQ ID NO: 1016205 - RNA, 19 nt, Homo sapiens
cuaaguggaaguucuaaga

SEQ ID NO: 1016206 - RNA, 19 nt, Homo sapiens
aagaaccaccuagaaauaa

SEQ ID NO: 1016207 - RNA, 19 nt, Homo sapiens
gguggaagacuugcagaaa

SEQ ID NO: 1016208 - RNA, 19 nt, Homo sapiens
cugaagaaccaccuagaaa

SEQ ID NO: 1016209 - RNA, 19 nt, Homo sapiens
ccagagaaguguacaaaag

SEQ ID NO: 1016210 - RNA, 19 nt, Homo sapiens
ggccagagaaguguacaaa

SEQ ID NO: 1016211 - RNA, 19 nt, Homo sapiens
gguuauguacgucauguug

SEQ ID NO: 1016212 - RNA, 19 nt, Homo sapiens
agaaagaaccuggaagaca

SEQ ID NO: 1016213 - RNA, 19 nt, Homo sapiens
caucuagaucuucaaauuc

SEQ ID NO: 1016214 - RNA, 19 nt, Homo sapiens
ccacugggagcaggaaauu

SEQ ID NO: 1016215 - RNA, 19 nt, Homo sapiens
cacagcaucuagaucuuca

SEQ ID NO: 1016216 - RNA, 19 nt, Homo sapiens
agacggaagacgugugaaa

SEQ ID NO: 1016217 - RNA, 19 nt, Homo sapiens
gcgggaagauggagaaccu

SEQ ID NO: 1016218 - RNA, 19 nt, Homo sapiens
agaacgggaugccaagaca

SEQ ID NO: 1016219 - RNA, 19 nt, Homo sapiens
ggaagacuugcagaaagaa

SEQ ID NO: 1016220 - RNA, 19 nt, Homo sapiens
caguggcccugguggaaga

SEQ ID NO: 1016221 - RNA, 19 nt, Homo sapiens
ggaguugcugguccuagaa

SEQ ID NO: 1016222 - RNA, 19 nt, Homo sapiens
cguauucucucagcuucaa

SEQ ID NO: 1016223 - RNA, 19 nt, Homo sapiens
aaguggaaguucuaagaug

SEQ ID NO: 1016224 - RNA, 19 nt, Homo sapiens
ucuagaauuucaagagaag

SEQ ID NO: 1016225 - RNA, 19 nt, Homo sapiens
cagcaucuagaucuucaaa

SEQ ID NO: 1016226 - RNA, 19 nt, Homo sapiens
caggaaccuugucucuguu

SEQ ID NO: 1016227 - RNA, 19 nt, Homo sapiens
uaucaaacuuccggaacug

SEQ ID NO: 1016228 - RNA, 19 nt, Homo sapiens
uggaguugcugguccuaga

SEQ ID NO: 1016229 - RNA, 19 nt, Homo sapiens
gaugaagagguuugagcuu

SEQ ID NO: 1016230 - RNA, 19 nt, Homo sapiens
gcucucuucuucaccucaa

SEQ ID NO: 1016231 - RNA, 19 nt, Homo sapiens
ggacgcagccaaggcaaag

SEQ ID NO: 1016232 - RNA, 19 nt, Homo sapiens
ggcuaacacuugcgauuuu

SEQ ID NO: 1016233 - RNA, 19 nt, Homo sapiens
ggcuguagcuguggaccaa

SEQ ID NO: 1016234 - RNA, 19 nt, Homo sapiens
gaagagcaucaagggaaga

SEQ ID NO: 1016235 - RNA, 19 nt, Homo sapiens
uuauguacgucauguugau

SEQ ID NO: 1016236 - RNA, 19 nt, Homo sapiens
uaaguggaaguucuaagau

SEQ ID NO: 1016237 - RNA, 19 nt, Homo sapiens
uagaaauaacucagcagaa

SEQ ID NO: 1016238 - RNA, 19 nt, Homo sapiens
aagauuacauacgccuuga

SEQ ID NO: 1016239 - RNA, 19 nt, Homo sapiens
gaaccaccuagaaauaacu

SEQ ID NO: 1016240 - RNA, 19 nt, Homo sapiens
gacggaagacgugugaaau

SEQ ID NO: 1016241 - RNA, 19 nt, Homo sapiens
aaucguccguauucucuca

SEQ ID NO: 1016242 - RNA, 19 nt, Homo sapiens
gaggugaugaagagguuug

SEQ ID NO: 1016243 - RNA, 19 nt, Homo sapiens
gcuaaggccagagaagugu

SEQ ID NO: 1016244 - RNA, 19 nt, Homo sapiens
gaccugaacaauggcugua

SEQ ID NO: 1016245 - RNA, 19 nt, Homo sapiens
cuucaagcuccucuacuuu

SEQ ID NO: 1016246 - RNA, 19 nt, Homo sapiens
ccacagcaucuagaucuuc

SEQ ID NO: 1016247 - RNA, 19 nt, Homo sapiens
agaaccaccuagaaauaac

SEQ ID NO: 1016248 - RNA, 19 nt, Homo sapiens
ggaauuccugcagagaaga

SEQ ID NO: 1016249 - RNA, 19 nt, Homo sapiens
ucaauggaacggguuaugu

SEQ ID NO: 1016250 - RNA, 19 nt, Homo sapiens
aaagagagugugaaagacu

SEQ ID NO: 1016251 - RNA, 19 nt, Homo sapiens
ccacguggaguaggaugaa

SEQ ID NO: 1016252 - RNA, 19 nt, Homo sapiens
guuauguacgucauguuga

SEQ ID NO: 1016253 - RNA, 19 nt, Homo sapiens
uggaacggguuauguacgu

SEQ ID NO: 1016254 - RNA, 19 nt, Homo sapiens
auccauaggcccaaaguga

SEQ ID NO: 1016255 - RNA, 19 nt, Homo sapiens
caucaagggaagauuacau

SEQ ID NO: 1016256 - RNA, 19 nt, Homo sapiens
gaagaaccaccuagaaaua

SEQ ID NO: 1016257 - RNA, 19 nt, Homo sapiens
uaagauggcuucccaguga

SEQ ID NO: 1016258 - RNA, 19 nt, Homo sapiens
gugaagagcuuuggaauga

SEQ ID NO: 1016259 - RNA, 19 nt, Homo sapiens
caagaucuccaaauaguua

SEQ ID NO: 1016260 - RNA, 19 nt, Homo sapiens
gaagacgugugaaauguau

SEQ ID NO: 1016261 - RNA, 19 nt, Homo sapiens
ugaagagguuugagcuuua

SEQ ID NO: 1016262 - RNA, 19 nt, Homo sapiens
uugcaaagcucuucucuga

SEQ ID NO: 1016263 - RNA, 19 nt, Homo sapiens
gaaauaacucagcagaauu

SEQ ID NO: 1016264 - RNA, 19 nt, Homo sapiens
aguacaagaucuccaaaua

SEQ ID NO: 1016265 - RNA, 19 nt, Homo sapiens
gaagagcuuuggaaugaag

SEQ ID NO: 1016266 - RNA, 19 nt, Homo sapiens
agaaauaacucagcagaau

SEQ ID NO: 1016267 - RNA, 19 nt, Homo sapiens
gcagaaagaaccuggaaga

SEQ ID NO: 1016268 - RNA, 19 nt, Homo sapiens
gcauuuccguuaccaagaa

SEQ ID NO: 1016269 - RNA, 19 nt, Homo sapiens
caacaaauccagacuccuu

SEQ ID NO: 1016270 - RNA, 19 nt, Homo sapiens
ggaagacgugugaaaugua

SEQ ID NO: 1016271 - RNA, 19 nt, Homo sapiens
uacaagaucuccaaauagu

SEQ ID NO: 1016272 - RNA, 19 nt, Homo sapiens
gaagagguuugagcuuuag

SEQ ID NO: 1016273 - RNA, 19 nt, Homo sapiens
ccagugaggugaugaagag

SEQ ID NO: 1016274 - RNA, 19 nt, Homo sapiens
caauggaacggguuaugua

SEQ ID NO: 1016275 - RNA, 19 nt, Homo sapiens
gccaagcccugccugaugu

SEQ ID NO: 1016276 - RNA, 19 nt, Homo sapiens
uggaagacuugcagaaaga

SEQ ID NO: 1016277 - RNA, 19 nt, Homo sapiens
guaugucucugacucuaga

SEQ ID NO: 1016278 - RNA, 19 nt, Homo sapiens
guacaagaucuccaaauag

SEQ ID NO: 1016279 - RNA, 19 nt, Homo sapiens
ucucugaccugaacaaugg

SEQ ID NO: 1016280 - RNA, 19 nt, Homo sapiens
aauccagacuccuucagua

SEQ ID NO: 1016281 - RNA, 19 nt, Homo sapiens
gcagaaaagugaagagcuu

SEQ ID NO: 1016282 - RNA, 19 nt, Homo sapiens
gggaauuccugcagagaag

SEQ ID NO: 1016283 - RNA, 19 nt, Homo sapiens
cggaagacgugugaaaugu

SEQ ID NO: 1016284 - RNA, 19 nt, Homo sapiens
ccagacuccuucaguacaa

SEQ ID NO: 1016285 - RNA, 19 nt, Homo sapiens
ugaagaaccaccuagaaau

SEQ ID NO: 1016286 - RNA, 19 nt, Homo sapiens
agacgugugaaauguauua

SEQ ID NO: 1016287 - RNA, 19 nt, Homo sapiens
ccaggucacuagcccuuga

SEQ ID NO: 1016288 - RNA, 19 nt, Homo sapiens
ggagacggaagacguguga

SEQ ID NO: 1016289 - RNA, 19 nt, Homo sapiens
gcucuucucugaccugaac

SEQ ID NO: 1016290 - RNA, 19 nt, Homo sapiens
ugauguggcucugggaauu

SEQ ID NO: 1016291 - RNA, 19 nt, Homo sapiens
gcccuugacuccucuuauc

SEQ ID NO: 1016292 - RNA, 19 nt, Homo sapiens
guggaagacuugcagaaag

SEQ ID NO: 1016293 - RNA, 19 nt, Homo sapiens
ugacuccucuuaucaaacu

SEQ ID NO: 1016294 - RNA, 19 nt, Homo sapiens
gggcuaacacuugcgauuu

SEQ ID NO: 1016295 - RNA, 19 nt, Homo sapiens
aagagcagauccuggaguu

SEQ ID NO: 1016296 - RNA, 19 nt, Homo sapiens
augaagagguuugagcuuu

SEQ ID NO: 1016297 - RNA, 19 nt, Homo sapiens
gucucugacucuagaauuu

SEQ ID NO: 1016298 - RNA, 19 nt, Homo sapiens
aaauaacucagcagaauuc

SEQ ID NO: 1016299 - RNA, 19 nt, Homo sapiens
gugaggugaugaagagguu

SEQ ID NO: 1016300 - RNA, 19 nt, Homo sapiens
cuaaguggaaguucuaaga

SEQ ID NO: 1016301 - RNA, 19 nt, Homo sapiens
aagaaccaccuagaaauaa

SEQ ID NO: 1016302 - RNA, 19 nt, Homo sapiens
gguggaagacuugcagaaa

SEQ ID NO: 1016303 - RNA, 19 nt, Homo sapiens
cugaagaaccaccuagaaa

SEQ ID NO: 1016304 - RNA, 19 nt, Homo sapiens
augaagaucucccggacuu

SEQ ID NO: 1016305 - RNA, 19 nt, Homo sapiens
ccagagaaguguacaaaag

SEQ ID NO: 1016306 - RNA, 19 nt, Homo sapiens
ggccagagaaguguacaaa

SEQ ID NO: 1016307 - RNA, 19 nt, Homo sapiens
cagugcaggugggaaauga

SEQ ID NO: 1016308 - RNA, 19 nt, Homo sapiens
ucacaaugcugcagaaaag

SEQ ID NO: 1016309 - RNA, 19 nt, Homo sapiens
gguuauguacgucauguug

SEQ ID NO: 1016310 - RNA, 19 nt, Homo sapiens
agaaagaaccuggaagaca

SEQ ID NO: 1016311 - RNA, 19 nt, Homo sapiens
ucaaggagauucagaaaac

SEQ ID NO: 1016312 - RNA, 19 nt, Homo sapiens
ccacugggagcaggaaauu

SEQ ID NO: 1016313 - RNA, 19 nt, Homo sapiens
ugaagagcuuuggaaugaa

SEQ ID NO: 1016314 - RNA, 19 nt, Homo sapiens
agacggaagacgugugaaa

SEQ ID NO: 1016315 - RNA, 19 nt, Homo sapiens
gcgggaagauggagaaccu

SEQ ID NO: 1016316 - RNA, 19 nt, Homo sapiens
ggaagacuugcagaaagaa

SEQ ID NO: 1016317 - RNA, 19 nt, Homo sapiens
caguggcccugguggaaga

SEQ ID NO: 1016318 - RNA, 19 nt, Homo sapiens
ggaguugcugguccuagaa

SEQ ID NO: 1016319 - RNA, 19 nt, Homo sapiens
cguauucucucagcuucaa

SEQ ID NO: 1016320 - RNA, 19 nt, Homo sapiens
aaguggaaguucuaagaug

SEQ ID NO: 1016321 - RNA, 19 nt, Homo sapiens
ucuagaauuucaagagaag

SEQ ID NO: 1016322 - RNA, 19 nt, Homo sapiens
uggaguugcugguccuaga

SEQ ID NO: 1016323 - RNA, 19 nt, Homo sapiens
uaucaaacuuccggaacug

SEQ ID NO: 1016324 - RNA, 19 nt, Homo sapiens
gaugaagagguuugagcuu

SEQ ID NO: 1016325 - RNA, 19 nt, Homo sapiens
ggcuaacacuugcgauuuu

SEQ ID NO: 1016326 - RNA, 19 nt, Homo sapiens
ggacgcagccaaggcaaag

SEQ ID NO: 1016327 - RNA, 19 nt, Homo sapiens
gcucucuucuucaccucaa

SEQ ID NO: 1016328 - RNA, 19 nt, Homo sapiens
ggcuguagcuguggaccaa

SEQ ID NO: 1016329 - RNA, 19 nt, Homo sapiens
gcaggugggaaaugaaugg

SEQ ID NO: 1016330 - RNA, 19 nt, Homo sapiens
uuauguacgucauguugau

SEQ ID NO: 1016331 - RNA, 19 nt, Homo sapiens
uaaguggaaguucuaagau

SEQ ID NO: 1016332 - RNA, 19 nt, Homo sapiens
uagaaauaacucagcagaa

SEQ ID NO: 1016333 - RNA, 19 nt, Homo sapiens
gaaccaccuagaaauaacu

SEQ ID NO: 1016334 - RNA, 19 nt, Homo sapiens
gacggaagacgugugaaau

SEQ ID NO: 1016335 - RNA, 19 nt, Homo sapiens
aaucguccguauucucuca

SEQ ID NO: 1016336 - RNA, 19 nt, Homo sapiens
gaggugaugaagagguuug

SEQ ID NO: 1016337 - RNA, 19 nt, Homo sapiens
gcuaaggccagagaagugu

SEQ ID NO: 1016338 - RNA, 19 nt, Homo sapiens
gaccugaacaauggcugua

SEQ ID NO: 1016339 - RNA, 19 nt, Homo sapiens
gggucacaaugcugcagaa

SEQ ID NO: 1016340 - RNA, 19 nt, Homo sapiens
cuucaagcuccucuacuuu

SEQ ID NO: 1016341 - RNA, 19 nt, Homo sapiens
agaaccaccuagaaauaac

SEQ ID NO: 1016342 - RNA, 19 nt, Homo sapiens
ggaauuccugcagagaaga

SEQ ID NO: 1016343 - RNA, 19 nt, Homo sapiens
ucaauggaacggguuaugu

SEQ ID NO: 1016344 - RNA, 19 nt, Homo sapiens
guuauguacgucauguuga

SEQ ID NO: 1016345 - RNA, 19 nt, Homo sapiens
uggaacggguuauguacgu

SEQ ID NO: 1016346 - RNA, 19 nt, Homo sapiens
gggaaaugaaugggagcua

SEQ ID NO: 1016347 - RNA, 19 nt, Homo sapiens
cuucaaggagauucagaaa

SEQ ID NO: 1016348 - RNA, 19 nt, Homo sapiens
gaagaaccaccuagaaaua

SEQ ID NO: 1016349 - RNA, 19 nt, Homo sapiens
uaagauggcuucccaguga

SEQ ID NO: 1016350 - RNA, 19 nt, Homo sapiens
gcaucuagaucuucaaauu

SEQ ID NO: 1016351 - RNA, 19 nt, Homo sapiens
caagaucuccaaauaguua

SEQ ID NO: 1016352 - RNA, 19 nt, Homo sapiens
gaagacgugugaaauguau

SEQ ID NO: 1016353 - RNA, 19 nt, Homo sapiens
ugaagagguuugagcuuua

SEQ ID NO: 1016354 - RNA, 19 nt, Homo sapiens
uugcaaagcucuucucuga

SEQ ID NO: 1016355 - RNA, 19 nt, Homo sapiens
gaaauaacucagcagaauu

SEQ ID NO: 1016356 - RNA, 19 nt, Homo sapiens
aguacaagaucuccaaaua

SEQ ID NO: 1016357 - RNA, 19 nt, Homo sapiens
agaaauaacucagcagaau

SEQ ID NO: 1016358 - RNA, 19 nt, Homo sapiens
gcagaaagaaccuggaaga

SEQ ID NO: 1016359 - RNA, 19 nt, Homo sapiens
gcauuuccguuaccaagaa

SEQ ID NO: 1016360 - RNA, 19 nt, Homo sapiens
caacaaauccagacuccuu

SEQ ID NO: 1016361 - RNA, 19 nt, Homo sapiens
ggaagacgugugaaaugua

SEQ ID NO: 1016362 - RNA, 19 nt, Homo sapiens
uacaagaucuccaaauagu

SEQ ID NO: 1016363 - RNA, 19 nt, Homo sapiens
gaagagguuugagcuuuag

SEQ ID NO: 1016364 - RNA, 19 nt, Homo sapiens
ccagugaggugaugaagag

SEQ ID NO: 1016365 - RNA, 19 nt, Homo sapiens
caauggaacggguuaugua

SEQ ID NO: 1016366 - RNA, 19 nt, Homo sapiens
gccaagcccugccugaugu

SEQ ID NO: 1016367 - RNA, 19 nt, Homo sapiens
uggaagacuugcagaaaga

SEQ ID NO: 1016368 - RNA, 19 nt, Homo sapiens
guaugucucugacucuaga

SEQ ID NO: 1016369 - RNA, 19 nt, Homo sapiens
guacaagaucuccaaauag

SEQ ID NO: 1016370 - RNA, 19 nt, Homo sapiens
ucucugaccugaacaaugg

SEQ ID NO: 1016371 - RNA, 19 nt, Homo sapiens
aauccagacuccuucagua

SEQ ID NO: 1016372 - RNA, 19 nt, Homo sapiens
gggaauuccugcagagaag

SEQ ID NO: 1016373 - RNA, 19 nt, Homo sapiens
cggaagacgugugaaaugu

SEQ ID NO: 1016374 - RNA, 19 nt, Homo sapiens
ccagacuccuucaguacaa

SEQ ID NO: 1016375 - RNA, 19 nt, Homo sapiens
ugaagaaccaccuagaaau

SEQ ID NO: 1016376 - RNA, 19 nt, Homo sapiens
ccaggucacuagcccuuga

SEQ ID NO: 1016377 - RNA, 19 nt, Homo sapiens
agacgugugaaauguauua

SEQ ID NO: 1016378 - RNA, 19 nt, Homo sapiens
ggagacggaagacguguga

SEQ ID NO: 1016379 - RNA, 19 nt, Homo sapiens
gcucuucucugaccugaac

SEQ ID NO: 1016380 - RNA, 19 nt, Homo sapiens
ugauguggcucugggaauu

SEQ ID NO: 1016381 - RNA, 19 nt, Homo sapiens
guggaagacuugcagaaag

SEQ ID NO: 1016382 - RNA, 19 nt, Homo sapiens
ugacuccucuuaucaaacu

SEQ ID NO: 1016383 - RNA, 19 nt, Homo sapiens
gcccuugacuccucuuauc

SEQ ID NO: 1016384 - RNA, 19 nt, Homo sapiens
gggcuaacacuugcgauuu

SEQ ID NO: 1016385 - RNA, 19 nt, Homo sapiens
aagagcagauccuggaguu

SEQ ID NO: 1016386 - RNA, 19 nt, Homo sapiens
augaagagguuugagcuuu

SEQ ID NO: 1016387 - RNA, 19 nt, Homo sapiens
gucucugacucuagaauuu

SEQ ID NO: 1016388 - RNA, 19 nt, Homo sapiens
aaauaacucagcagaauuc

SEQ ID NO: 1016389 - RNA, 19 nt, Homo sapiens
gugaggugaugaagagguu

SEQ ID NO: 1016390 - RNA, 19 nt, Homo sapiens
cuaaguggaaguucuaaga

SEQ ID NO: 1016391 - RNA, 19 nt, Homo sapiens
aagaaccaccuagaaauaa

SEQ ID NO: 1016392 - RNA, 19 nt, Homo sapiens
gguggaagacuugcagaaa

SEQ ID NO: 1016393 - RNA, 19 nt, Homo sapiens
cugaagaaccaccuagaaa

SEQ ID NO: 1016394 - RNA, 19 nt, Homo sapiens
ccagagaaguguacaaaag

SEQ ID NO: 1016395 - RNA, 19 nt, Homo sapiens
ggccagagaaguguacaaa

SEQ ID NO: 1016396 - RNA, 19 nt, Homo sapiens
gguuauguacgucauguug

SEQ ID NO: 1016397 - RNA, 19 nt, Homo sapiens
agaaagaaccuggaagaca

SEQ ID NO: 1016398 - RNA, 19 nt, Homo sapiens
caucuagaucuucaaauuc

SEQ ID NO: 1016399 - RNA, 19 nt, Homo sapiens
ccacugggagcaggaaauu

SEQ ID NO: 1016400 - RNA, 19 nt, Homo sapiens
cacagcaucuagaucuuca

SEQ ID NO: 1016401 - RNA, 19 nt, Homo sapiens
agacggaagacgugugaaa

SEQ ID NO: 1016402 - RNA, 19 nt, Homo sapiens
gcgggaagauggagaaccu

SEQ ID NO: 1016403 - RNA, 19 nt, Homo sapiens
ggaagacuugcagaaagaa

SEQ ID NO: 1016404 - RNA, 19 nt, Homo sapiens
caguggcccugguggaaga

SEQ ID NO: 1016405 - RNA, 19 nt, Homo sapiens
ggaguugcugguccuagaa

SEQ ID NO: 1016406 - RNA, 19 nt, Homo sapiens
cguauucucucagcuucaa

SEQ ID NO: 1016407 - RNA, 19 nt, Homo sapiens
aaguggaaguucuaagaug

SEQ ID NO: 1016408 - RNA, 19 nt, Homo sapiens
ucuagaauuucaagagaag

SEQ ID NO: 1016409 - RNA, 19 nt, Homo sapiens
cagcaucuagaucuucaaa

SEQ ID NO: 1016410 - RNA, 19 nt, Homo sapiens
uggaguugcugguccuaga

SEQ ID NO: 1016411 - RNA, 19 nt, Homo sapiens
uaucaaacuuccggaacug

SEQ ID NO: 1016412 - RNA, 19 nt, Homo sapiens
gaugaagagguuugagcuu

SEQ ID NO: 1016413 - RNA, 19 nt, Homo sapiens
ggcuaacacuugcgauuuu

SEQ ID NO: 1016414 - RNA, 19 nt, Homo sapiens
ggacgcagccaaggcaaag

SEQ ID NO: 1016415 - RNA, 19 nt, Homo sapiens
gcucucuucuucaccucaa

SEQ ID NO: 1016416 - RNA, 19 nt, Homo sapiens
ggcuguagcuguggaccaa

SEQ ID NO: 1016417 - RNA, 19 nt, Homo sapiens
uuauguacgucauguugau

SEQ ID NO: 1016418 - RNA, 19 nt, Homo sapiens
uaaguggaaguucuaagau

SEQ ID NO: 1016419 - RNA, 19 nt, Homo sapiens
uagaaauaacucagcagaa

SEQ ID NO: 1016420 - RNA, 19 nt, Homo sapiens
gaaccaccuagaaauaacu

SEQ ID NO: 1016421 - RNA, 19 nt, Homo sapiens
gacggaagacgugugaaau

SEQ ID NO: 1016422 - RNA, 19 nt, Homo sapiens
aaucguccguauucucuca

SEQ ID NO: 1016423 - RNA, 19 nt, Homo sapiens
gaggugaugaagagguuug

SEQ ID NO: 1016424 - RNA, 19 nt, Homo sapiens
gcuaaggccagagaagugu

SEQ ID NO: 1016425 - RNA, 19 nt, Homo sapiens
gaccugaacaauggcugua

SEQ ID NO: 1016426 - RNA, 19 nt, Homo sapiens
cuucaagcuccucuacuuu

SEQ ID NO: 1016427 - RNA, 19 nt, Homo sapiens
ccacagcaucuagaucuuc

SEQ ID NO: 1016428 - RNA, 19 nt, Homo sapiens
agaaccaccuagaaauaac

SEQ ID NO: 1016429 - RNA, 19 nt, Homo sapiens
ggaauuccugcagagaaga

SEQ ID NO: 1016430 - RNA, 19 nt, Homo sapiens
ucaauggaacggguuaugu

SEQ ID NO: 1016431 - RNA, 19 nt, Homo sapiens
aaagagagugugaaagacu

SEQ ID NO: 1016432 - RNA, 19 nt, Homo sapiens
ccacguggaguaggaugaa

SEQ ID NO: 1016433 - RNA, 19 nt, Homo sapiens
guuauguacgucauguuga

SEQ ID NO: 1016434 - RNA, 19 nt, Homo sapiens
uggaacggguuauguacgu

SEQ ID NO: 1016435 - RNA, 19 nt, Homo sapiens
auccauaggcccaaaguga

SEQ ID NO: 1016436 - RNA, 19 nt, Homo sapiens
gaagaaccaccuagaaaua

SEQ ID NO: 1016437 - RNA, 19 nt, Homo sapiens
uaagauggcuucccaguga

SEQ ID NO: 1016438 - RNA, 19 nt, Homo sapiens
gcaucuagaucuucaaauu

SEQ ID NO: 1016439 - RNA, 19 nt, Homo sapiens
caagaucuccaaauaguua

SEQ ID NO: 1016440 - RNA, 19 nt, Homo sapiens
gaagacgugugaaauguau

SEQ ID NO: 1016441 - RNA, 19 nt, Homo sapiens
ugaagagguuugagcuuua

SEQ ID NO: 1016442 - RNA, 19 nt, Homo sapiens
uugcaaagcucuucucuga

SEQ ID NO: 1016443 - RNA, 19 nt, Homo sapiens
gaaauaacucagcagaauu

SEQ ID NO: 1016444 - RNA, 19 nt, Homo sapiens
aguacaagaucuccaaaua

SEQ ID NO: 1016445 - RNA, 19 nt, Homo sapiens
agaaauaacucagcagaau

SEQ ID NO: 1016446 - RNA, 19 nt, Homo sapiens
gcagaaagaaccuggaaga

SEQ ID NO: 1016447 - RNA, 19 nt, Homo sapiens
gcauuuccguuaccaagaa

SEQ ID NO: 1016448 - RNA, 19 nt, Homo sapiens
caacaaauccagacuccuu

SEQ ID NO: 1016449 - RNA, 19 nt, Homo sapiens
ggaagacgugugaaaugua

SEQ ID NO: 1016450 - RNA, 19 nt, Homo sapiens
uacaagaucuccaaauagu

SEQ ID NO: 1016451 - RNA, 19 nt, Homo sapiens
gaagagguuugagcuuuag

SEQ ID NO: 1016452 - RNA, 19 nt, Homo sapiens
ccagugaggugaugaagag

SEQ ID NO: 1016453 - RNA, 19 nt, Homo sapiens
caauggaacggguuaugua

SEQ ID NO: 1016454 - RNA, 19 nt, Homo sapiens
gccaagcccugccugaugu

SEQ ID NO: 1016455 - RNA, 19 nt, Homo sapiens
uggaagacuugcagaaaga

SEQ ID NO: 1016456 - RNA, 19 nt, Homo sapiens
guaugucucugacucuaga

SEQ ID NO: 1016457 - RNA, 19 nt, Homo sapiens
guacaagaucuccaaauag

SEQ ID NO: 1016458 - RNA, 19 nt, Homo sapiens
ucucugaccugaacaaugg

SEQ ID NO: 1016459 - RNA, 19 nt, Homo sapiens
aauccagacuccuucagua

SEQ ID NO: 1016460 - RNA, 19 nt, Homo sapiens
gggaauuccugcagagaag

SEQ ID NO: 1016461 - RNA, 19 nt, Homo sapiens
cggaagacgugugaaaugu

SEQ ID NO: 1016462 - RNA, 19 nt, Homo sapiens
ccagacuccuucaguacaa

SEQ ID NO: 1016463 - RNA, 19 nt, Homo sapiens
ugaagaaccaccuagaaau

SEQ ID NO: 1016464 - RNA, 19 nt, Homo sapiens
ccaggucacuagcccuuga

SEQ ID NO: 1016465 - RNA, 19 nt, Homo sapiens
gugauucggcuguguauau

SEQ ID NO: 1016466 - RNA, 19 nt, Homo sapiens
agacgugugaaauguauua

SEQ ID NO: 1016467 - RNA, 19 nt, Homo sapiens
ggagacggaagacguguga

SEQ ID NO: 1016468 - RNA, 19 nt, Homo sapiens
gcucuucucugaccugaac

SEQ ID NO: 1016469 - RNA, 19 nt, Homo sapiens
ugauguggcucugggaauu

SEQ ID NO: 1016470 - RNA, 19 nt, Homo sapiens
ugacuccucuuaucaaacu

SEQ ID NO: 1016471 - RNA, 19 nt, Homo sapiens
gcccuugacuccucuuauc

SEQ ID NO: 1016472 - RNA, 19 nt, Homo sapiens
guggaagacuugcagaaag

SEQ ID NO: 1016473 - RNA, 19 nt, Homo sapiens
gggcuaacacuugcgauuu

SEQ ID NO: 1016474 - RNA, 19 nt, Homo sapiens
aagagcagauccuggaguu

SEQ ID NO: 1016475 - RNA, 19 nt, Homo sapiens
augaagagguuugagcuuu

SEQ ID NO: 1016476 - RNA, 19 nt, Homo sapiens
gucucugacucuagaauuu

SEQ ID NO: 1016477 - RNA, 19 nt, Homo sapiens
aaauaacucagcagaauuc

SEQ ID NO: 1016478 - RNA, 19 nt, Homo sapiens
gugaggugaugaagagguu

SEQ ID NO: 1016479 - RNA, 19 nt, Homo sapiens
cuaaguggaaguucuaaga

SEQ ID NO: 1016480 - RNA, 19 nt, Homo sapiens
aagaaccaccuagaaauaa

SEQ ID NO: 1016481 - RNA, 19 nt, Homo sapiens
gguggaagacuugcagaaa

SEQ ID NO: 1016482 - RNA, 19 nt, Homo sapiens
cugaagaaccaccuagaaa

SEQ ID NO: 1016483 - RNA, 19 nt, Homo sapiens
ccagagaaguguacaaaag

SEQ ID NO: 1016484 - RNA, 19 nt, Homo sapiens
ggccagagaaguguacaaa

SEQ ID NO: 1016485 - RNA, 19 nt, Homo sapiens
gguuauguacgucauguug

SEQ ID NO: 1016486 - RNA, 19 nt, Homo sapiens
agaaagaaccuggaagaca

SEQ ID NO: 1016487 - RNA, 19 nt, Homo sapiens
caucuagaucuucaaauuc

SEQ ID NO: 1016488 - RNA, 19 nt, Homo sapiens
ccacugggagcaggaaauu

SEQ ID NO: 1016489 - RNA, 19 nt, Homo sapiens
cacagcaucuagaucuuca

SEQ ID NO: 1016490 - RNA, 19 nt, Homo sapiens
agacggaagacgugugaaa

SEQ ID NO: 1016491 - RNA, 19 nt, Homo sapiens
gcgggaagauggagaaccu

SEQ ID NO: 1016492 - RNA, 19 nt, Homo sapiens
ggaagacuugcagaaagaa

SEQ ID NO: 1016493 - RNA, 19 nt, Homo sapiens
caguggcccugguggaaga

SEQ ID NO: 1016494 - RNA, 19 nt, Homo sapiens
ggaguugcugguccuagaa

SEQ ID NO: 1016495 - RNA, 19 nt, Homo sapiens
cguauucucucagcuucaa

SEQ ID NO: 1016496 - RNA, 19 nt, Homo sapiens
aaguggaaguucuaagaug

SEQ ID NO: 1016497 - RNA, 19 nt, Homo sapiens
ucuagaauuucaagagaag

SEQ ID NO: 1016498 - RNA, 19 nt, Homo sapiens
uaucaaacuuccggaacug

SEQ ID NO: 1016499 - RNA, 19 nt, Homo sapiens
cagcaucuagaucuucaaa

SEQ ID NO: 1016500 - RNA, 19 nt, Homo sapiens
uggaguugcugguccuaga

SEQ ID NO: 1016501 - RNA, 19 nt, Homo sapiens
gaugaagagguuugagcuu

SEQ ID NO: 1016502 - RNA, 19 nt, Homo sapiens
gcucucuucuucaccucaa

SEQ ID NO: 1016503 - RNA, 19 nt, Homo sapiens
ggacgcagccaaggcaaag

SEQ ID NO: 1016504 - RNA, 19 nt, Homo sapiens
ggcuaacacuugcgauuuu

SEQ ID NO: 1016505 - RNA, 19 nt, Homo sapiens
ggcuguagcuguggaccaa

SEQ ID NO: 1016506 - RNA, 19 nt, Homo sapiens
uuauguacgucauguugau

SEQ ID NO: 1016507 - RNA, 19 nt, Homo sapiens
uaaguggaaguucuaagau

SEQ ID NO: 1016508 - RNA, 19 nt, Homo sapiens
uagaaauaacucagcagaa

SEQ ID NO: 1016509 - RNA, 19 nt, Homo sapiens
gaaccaccuagaaauaacu

SEQ ID NO: 1016510 - RNA, 19 nt, Homo sapiens
gacggaagacgugugaaau

SEQ ID NO: 1016511 - RNA, 19 nt, Homo sapiens
aaucguccguauucucuca

SEQ ID NO: 1016512 - RNA, 19 nt, Homo sapiens
gaggugaugaagagguuug

SEQ ID NO: 1016513 - RNA, 19 nt, Homo sapiens
gcuaaggccagagaagugu

SEQ ID NO: 1016514 - RNA, 19 nt, Homo sapiens
gaccugaacaauggcugua

SEQ ID NO: 1016515 - RNA, 19 nt, Homo sapiens
cuguguauaucuccuagga

SEQ ID NO: 1016516 - RNA, 19 nt, Homo sapiens
cuucaagcuccucuacuuu

SEQ ID NO: 1016517 - RNA, 19 nt, Homo sapiens
ccacagcaucuagaucuuc

SEQ ID NO: 1016518 - RNA, 19 nt, Homo sapiens
agaaccaccuagaaauaac

SEQ ID NO: 1016519 - RNA, 19 nt, Homo sapiens
ugauucggcuguguauauc

SEQ ID NO: 1016520 - RNA, 19 nt, Homo sapiens
ggaauuccugcagagaaga

SEQ ID NO: 1016521 - RNA, 19 nt, Homo sapiens
ucaauggaacggguuaugu

SEQ ID NO: 1016522 - RNA, 19 nt, Homo sapiens
aaagagagugugaaagacu

SEQ ID NO: 1016523 - RNA, 19 nt, Homo sapiens
ccacguggaguaggaugaa

SEQ ID NO: 1016524 - RNA, 19 nt, Homo sapiens
guuauguacgucauguuga

SEQ ID NO: 1016525 - RNA, 19 nt, Homo sapiens
uggaacggguuauguacgu

SEQ ID NO: 1016526 - RNA, 19 nt, Homo sapiens
auccauaggcccaaaguga

SEQ ID NO: 1016527 - RNA, 19 nt, Homo sapiens
gaagaaccaccuagaaaua

SEQ ID NO: 1016528 - RNA, 19 nt, Homo sapiens
uaagauggcuucccaguga

SEQ ID NO: 1016529 - RNA, 19 nt, Homo sapiens
gcaucuagaucuucaaauu

SEQ ID NO: 1016530 - RNA, 19 nt, Homo sapiens
caucuaaagugcccuauaa

SEQ ID NO: 1016531 - RNA, 19 nt, Homo sapiens
caagaucuccaaauaguua

SEQ ID NO: 1016532 - RNA, 19 nt, Homo sapiens
gcagugagcugugaucaug

SEQ ID NO: 1016533 - RNA, 19 nt, Homo sapiens
gcaccagugucuucuauga

SEQ ID NO: 1016534 - RNA, 19 nt, Homo sapiens
ggaggagucucaagaggaa

SEQ ID NO: 1016535 - RNA, 19 nt, Homo sapiens
ugaagagguuugagcuuua

SEQ ID NO: 1016536 - RNA, 19 nt, Homo sapiens
uaacaccuuugaugccuua

SEQ ID NO: 1016537 - RNA, 19 nt, Homo sapiens
ggugacaacuuuaagaaau

SEQ ID NO: 1016538 - RNA, 19 nt, Homo sapiens
gcucuguuaugacuaauuu

SEQ ID NO: 1016539 - RNA, 19 nt, Homo sapiens
uugcaaagcucuucucuga

SEQ ID NO: 1016540 - RNA, 19 nt, Homo sapiens
gaaauaacucagcagaauu

SEQ ID NO: 1016541 - RNA, 19 nt, Homo sapiens
aguacaagaucuccaaaua

SEQ ID NO: 1016542 - RNA, 19 nt, Homo sapiens
agaaauaacucagcagaau

SEQ ID NO: 1016543 - RNA, 19 nt, Homo sapiens
gcagaaagaaccuggaaga

SEQ ID NO: 1016544 - RNA, 19 nt, Homo sapiens
gcauuuccguuaccaagaa

SEQ ID NO: 1016545 - RNA, 19 nt, Homo sapiens
gcauagcacuagaagaugu

SEQ ID NO: 1016546 - RNA, 19 nt, Homo sapiens
ugagauggaugcccuguug

SEQ ID NO: 1016547 - RNA, 19 nt, Homo sapiens
caacaaauccagacuccuu

SEQ ID NO: 1016548 - RNA, 19 nt, Homo sapiens
gggcauagcacuagaagau

SEQ ID NO: 1016549 - RNA, 19 nt, Homo sapiens
uauaucccguccucaaaua

SEQ ID NO: 1016550 - RNA, 19 nt, Homo sapiens
caggagaugugauuauugu

SEQ ID NO: 1016551 - RNA, 19 nt, Homo sapiens
gcgggaugguaaugaaaua

SEQ ID NO: 1016552 - RNA, 19 nt, Homo sapiens
gagagaaagguaggaguua

SEQ ID NO: 1016553 - RNA, 19 nt, Homo sapiens
uaacaacauuacaggaaga

SEQ ID NO: 1016554 - RNA, 19 nt, Homo sapiens
uacaagaucuccaaauagu

SEQ ID NO: 1016555 - RNA, 19 nt, Homo sapiens
gaagagguuugagcuuuag

SEQ ID NO: 1016556 - RNA, 19 nt, Homo sapiens
ggagagaaagguaggaguu

SEQ ID NO: 1016557 - RNA, 19 nt, Homo sapiens
ccagugaggugaugaagag

SEQ ID NO: 1016558 - RNA, 19 nt, Homo sapiens
uuaaagauccagucauuug

SEQ ID NO: 1016559 - RNA, 19 nt, Homo sapiens
gagaaagguaggaguuaaa

SEQ ID NO: 1016560 - RNA, 19 nt, Homo sapiens
gagcagcugugagaacaug

SEQ ID NO: 1016561 - RNA, 19 nt, Homo sapiens
agagaaagguaggaguuaa

SEQ ID NO: 1016562 - RNA, 19 nt, Homo sapiens
gaaccagggcauagcacua

SEQ ID NO: 1016563 - RNA, 19 nt, Homo sapiens
uggaagacuugcagaaaga

SEQ ID NO: 1016564 - RNA, 19 nt, Homo sapiens
guaugucucugacucuaga

SEQ ID NO: 1016565 - RNA, 19 nt, Homo sapiens
aguuaaagauccagucauu

SEQ ID NO: 1016566 - RNA, 19 nt, Homo sapiens
ugacucaacccucuacuga

SEQ ID NO: 1016567 - RNA, 19 nt, Homo sapiens
ggauugagaggauuccaaa

SEQ ID NO: 1016568 - RNA, 19 nt, Homo sapiens
guacaagaucuccaaauag

SEQ ID NO: 1016569 - RNA, 19 nt, Homo sapiens
ucucugaccugaacaaugg

SEQ ID NO: 1016570 - RNA, 19 nt, Homo sapiens
aauccagacuccuucagua

SEQ ID NO: 1016571 - RNA, 19 nt, Homo sapiens
ggaugguaaugaaauagug

SEQ ID NO: 1016572 - RNA, 19 nt, Homo sapiens
gggaauuccugcagagaag

SEQ ID NO: 1016573 - RNA, 19 nt, Homo sapiens
gaagagaggagagaaaggu

SEQ ID NO: 1016574 - RNA, 19 nt, Homo sapiens
aagauccagucauuuguuu

SEQ ID NO: 1016575 - RNA, 19 nt, Homo sapiens
ccagacuccuucaguacaa

SEQ ID NO: 1016576 - RNA, 19 nt, Homo sapiens
ugaagaaccaccuagaaau

SEQ ID NO: 1016577 - RNA, 19 nt, Homo sapiens
ccaggucacuagcccuuga

SEQ ID NO: 1016578 - RNA, 19 nt, Homo sapiens
gcucuucucugaccugaac

SEQ ID NO: 1016579 - RNA, 19 nt, Homo sapiens
gucauuuguuuccaucuaa

SEQ ID NO: 1016580 - RNA, 19 nt, Homo sapiens
gcccuugacuccucuuauc

SEQ ID NO: 1016581 - RNA, 19 nt, Homo sapiens
gaaagguaggaguuaaaga

SEQ ID NO: 1016582 - RNA, 19 nt, Homo sapiens
ugacuccucuuaucaaacu

SEQ ID NO: 1016583 - RNA, 19 nt, Homo sapiens
ugauguggcucugggaauu

SEQ ID NO: 1016584 - RNA, 19 nt, Homo sapiens
guggaagacuugcagaaag

SEQ ID NO: 1016585 - RNA, 19 nt, Homo sapiens
gggcuaacacuugcgauuu

SEQ ID NO: 1016586 - RNA, 19 nt, Homo sapiens
gacccagacucagcugaaa

SEQ ID NO: 1016587 - RNA, 19 nt, Homo sapiens
gcucuugcucugcucuuua

SEQ ID NO: 1016588 - RNA, 19 nt, Homo sapiens
aagagcagauccuggaguu

SEQ ID NO: 1016589 - RNA, 19 nt, Homo sapiens
uguccuggcucuguuauga

SEQ ID NO: 1016590 - RNA, 19 nt, Homo sapiens
augaagagguuugagcuuu

SEQ ID NO: 1016591 - RNA, 19 nt, Homo sapiens
gucucugacucuagaauuu

SEQ ID NO: 1016592 - RNA, 19 nt, Homo sapiens
aaagguaggaguuaaagau

SEQ ID NO: 1016593 - RNA, 19 nt, Homo sapiens
caaagggaaccagggcaua

SEQ ID NO: 1016594 - RNA, 19 nt, Homo sapiens
caauguugcuaucgguuca

SEQ ID NO: 1016595 - RNA, 19 nt, Homo sapiens
aaauaacucagcagaauuc

SEQ ID NO: 1016596 - RNA, 19 nt, Homo sapiens
gugaggugaugaagagguu

SEQ ID NO: 1016597 - RNA, 19 nt, Homo sapiens
cuaaguggaaguucuaaga

SEQ ID NO: 1016598 - RNA, 19 nt, Homo sapiens
ggaguuaaagauccaguca

SEQ ID NO: 1016599 - RNA, 19 nt, Homo sapiens
ccagugucuucuaugauga

SEQ ID NO: 1016600 - RNA, 19 nt, Homo sapiens
aagaaccaccuagaaauaa

SEQ ID NO: 1016601 - RNA, 19 nt, Homo sapiens
gguggaagacuugcagaaa

SEQ ID NO: 1016602 - RNA, 19 nt, Homo sapiens
auaaaguguuccauagaug

SEQ ID NO: 1016603 - RNA, 19 nt, Homo sapiens
gguaggaggccuucuuugg

SEQ ID NO: 1016604 - RNA, 19 nt, Homo sapiens
gaugcccuguugagucuug

SEQ ID NO: 1016605 - RNA, 19 nt, Homo sapiens
ugucuucuaugaugagaug

SEQ ID NO: 1016606 - RNA, 19 nt, Homo sapiens
cugaagaaccaccuagaaa

SEQ ID NO: 1016607 - RNA, 19 nt, Homo sapiens
gcaaagccaggagcaccua

SEQ ID NO: 1016608 - RNA, 19 nt, Homo sapiens
uaaaguguuccauagaugu

SEQ ID NO: 1016609 - RNA, 19 nt, Homo sapiens
caggguggcucacaaagac

SEQ ID NO: 1016610 - RNA, 19 nt, Homo sapiens
ccagagaaguguacaaaag

SEQ ID NO: 1016611 - RNA, 19 nt, Homo sapiens
ggccagagaaguguacaaa

SEQ ID NO: 1016612 - RNA, 19 nt, Homo sapiens
gguaggaguuaaagaucca

SEQ ID NO: 1016613 - RNA, 19 nt, Homo sapiens
agaaagaaccuggaagaca

SEQ ID NO: 1016614 - RNA, 19 nt, Homo sapiens
agucauuuguuuccaucua

SEQ ID NO: 1016615 - RNA, 19 nt, Homo sapiens
uaaagauccagucauuugu

SEQ ID NO: 1016616 - RNA, 19 nt, Homo sapiens
gaagcauucaggcucagaa

SEQ ID NO: 1016617 - RNA, 19 nt, Homo sapiens
caucuagaucuucaaauuc

SEQ ID NO: 1016618 - RNA, 19 nt, Homo sapiens
ccacugggagcaggaaauu

SEQ ID NO: 1016619 - RNA, 19 nt, Homo sapiens
aaagauccagucauuuguu

SEQ ID NO: 1016620 - RNA, 19 nt, Homo sapiens
ggcacuuucuaacaccuuu

SEQ ID NO: 1016621 - RNA, 19 nt, Homo sapiens
gugcuaaucuggagaaaag

SEQ ID NO: 1016622 - RNA, 19 nt, Homo sapiens
cacagcaucuagaucuuca

SEQ ID NO: 1016623 - RNA, 19 nt, Homo sapiens
ucuagaauuucaagagaag

SEQ ID NO: 1016624 - RNA, 19 nt, Homo sapiens
ggauacaaagaaaccaaga

SEQ ID NO: 1016625 - RNA, 19 nt, Homo sapiens
cguauucucucagcuucaa

SEQ ID NO: 1016626 - RNA, 19 nt, Homo sapiens
ggaagacuugcagaaagaa

SEQ ID NO: 1016627 - RNA, 19 nt, Homo sapiens
ugagauagcuccuuuauau

SEQ ID NO: 1016628 - RNA, 19 nt, Homo sapiens
gaaaguaggauacacauaa

SEQ ID NO: 1016629 - RNA, 19 nt, Homo sapiens
gaagauaagcuacuaauug

SEQ ID NO: 1016630 - RNA, 19 nt, Homo sapiens
ggaauaaucccaucaguuu

SEQ ID NO: 1016631 - RNA, 19 nt, Homo sapiens
caagaaagcuaauaaaggu

SEQ ID NO: 1016632 - RNA, 19 nt, Homo sapiens
ggagguauacuucgaauuu

SEQ ID NO: 1016633 - RNA, 19 nt, Homo sapiens
caagguaaguggagguaua

SEQ ID NO: 1016634 - RNA, 19 nt, Homo sapiens
ggaaugaguccuccuagua

SEQ ID NO: 1016635 - RNA, 19 nt, Homo sapiens
cagcacagauucuauuaaa

SEQ ID NO: 1016636 - RNA, 19 nt, Homo sapiens
aaaggaagccuaagaagua

SEQ ID NO: 1016637 - RNA, 19 nt, Homo sapiens
gcacuuuaauuacaacuga

SEQ ID NO: 1016638 - RNA, 19 nt, Homo sapiens
gagagucguuaauguagua

SEQ ID NO: 1016639 - RNA, 19 nt, Homo sapiens
ucaaggaucuuuggaacua

SEQ ID NO: 1016640 - RNA, 19 nt, Homo sapiens
ggaggaagauaagcuacua

SEQ ID NO: 1016641 - RNA, 19 nt, Homo sapiens
ggaacaagaaagcuaauaa

SEQ ID NO: 1016642 - RNA, 19 nt, Homo sapiens
guaaaccuguucauacuau

SEQ ID NO: 1016643 - RNA, 19 nt, Homo sapiens
caaggacucucaaugcauu

SEQ ID NO: 1016644 - RNA, 19 nt, Homo sapiens
gaaugaguccuccuaguaa

SEQ ID NO: 1016645 - RNA, 19 nt, Homo sapiens
gaaauaagugcccugugua

SEQ ID NO: 1016646 - RNA, 19 nt, Homo sapiens
ggaagccuaagaaguauua

SEQ ID NO: 1016647 - RNA, 19 nt, Homo sapiens
ccacauguguuuauaagau

SEQ ID NO: 1016648 - RNA, 19 nt, Homo sapiens
ggaagagcagccaugauua

SEQ ID NO: 1016649 - RNA, 19 nt, Homo sapiens
ugaaauaagugcccugugu

SEQ ID NO: 1016650 - RNA, 19 nt, Homo sapiens
ucgcaacccucaugaagua

SEQ ID NO: 1016651 - RNA, 19 nt, Homo sapiens
gcaagcaccacauguguuu

SEQ ID NO: 1016652 - RNA, 19 nt, Homo sapiens
gcaagagauuggauuaaca

SEQ ID NO: 1016653 - RNA, 19 nt, Homo sapiens
acaaauagcagcagaaaga

SEQ ID NO: 1016654 - RNA, 19 nt, Homo sapiens
gaauaaucccaucaguuua

SEQ ID NO: 1016655 - RNA, 19 nt, Homo sapiens
gauaaauuccuuuguguug

SEQ ID NO: 1016656 - RNA, 19 nt, Homo sapiens
gaacacagauugggcacau

SEQ ID NO: 1016657 - RNA, 19 nt, Homo sapiens
ggaauuaucauccucuuuc

SEQ ID NO: 1016658 - RNA, 19 nt, Homo sapiens
ugaacagccuaauuaguaa

SEQ ID NO: 1016659 - RNA, 19 nt, Homo sapiens
ugacugcugugacuuugua

SEQ ID NO: 1016660 - RNA, 19 nt, Homo sapiens
caauaaaccuucagauucg

SEQ ID NO: 1016661 - RNA, 19 nt, Homo sapiens
gcgauaagaucaccuggau

SEQ ID NO: 1016662 - RNA, 19 nt, Homo sapiens
gaacaagcacggcaucugu

SEQ ID NO: 1016663 - RNA, 19 nt, Homo sapiens
cgacaaugcuacuggaguu

SEQ ID NO: 1016664 - RNA, 19 nt, Homo sapiens
gcuacaagguacgcaauaa

SEQ ID NO: 1016665 - RNA, 19 nt, Homo sapiens
ucaauaaaccuucagauuc

SEQ ID NO: 1016666 - RNA, 19 nt, Homo sapiens
cgcaauaacuguuugguau

SEQ ID NO: 1016667 - RNA, 19 nt, Homo sapiens
agacugggaugccaaggua

SEQ ID NO: 1016668 - RNA, 19 nt, Homo sapiens
ggagauggaagauguguga

SEQ ID NO: 1016669 - RNA, 19 nt, Homo sapiens
acaguauacucaagugaua

SEQ ID NO: 1016670 - RNA, 19 nt, Homo sapiens
auaaagcucugggaaagua

SEQ ID NO: 1016671 - RNA, 19 nt, Homo sapiens
gauuguccuuguuuacaua

SEQ ID NO: 1016672 - RNA, 19 nt, Homo sapiens
ccacuucaccuacaauauu

SEQ ID NO: 1016673 - RNA, 19 nt, Homo sapiens
ccaguuugcugacauugaa

SEQ ID NO: 1016674 - RNA, 19 nt, Homo sapiens
gagauuggauuaacaccau

SEQ ID NO: 1016675 - RNA, 19 nt, Homo sapiens
ccacauaguguucgauaaa

SEQ ID NO: 1016676 - RNA, 19 nt, Homo sapiens
uaauaaagcucugggaaag

SEQ ID NO: 1016677 - RNA, 19 nt, Homo sapiens
gccaugagauagcuccuuu

SEQ ID NO: 1016678 - RNA, 19 nt, Homo sapiens
cagcauggacgaccugaua

SEQ ID NO: 1016679 - RNA, 19 nt, Homo sapiens
ugaagucucucuauaacau

SEQ ID NO: 1016680 - RNA, 19 nt, Homo sapiens
gaaauuguuggaagaauca

SEQ ID NO: 1016681 - RNA, 19 nt, Homo sapiens
gaauuaucauccucuuuca

SEQ ID NO: 1016682 - RNA, 19 nt, Homo sapiens
ggaagaaucaaguguuugu

SEQ ID NO: 1016683 - RNA, 19 nt, Homo sapiens
aaauggagauggaagaugu

SEQ ID NO: 1016684 - RNA, 19 nt, Homo sapiens
uugaacagccuaauuagua

SEQ ID NO: 1016685 - RNA, 19 nt, Homo sapiens
gaugagagagcacgagcua

SEQ ID NO: 1016686 - RNA, 19 nt, Homo sapiens
ugacauugaacccaaauuu

SEQ ID NO: 1016687 - RNA, 19 nt, Homo sapiens
ggaagauaagcuacuaauu

SEQ ID NO: 1016688 - RNA, 19 nt, Homo sapiens
caauggaacggguuaugua

SEQ ID NO: 1016689 - RNA, 19 nt, Homo sapiens
agaaacaucuuuggcuuau

SEQ ID NO: 1016690 - RNA, 19 nt, Homo sapiens
ccaaaggacaagcuaauug

SEQ ID NO: 1016691 - RNA, 19 nt, Homo sapiens
ggaaaguaggauacacaua

SEQ ID NO: 1016692 - RNA, 19 nt, Homo sapiens
uauaacaucugaguaagug

SEQ ID NO: 1016693 - RNA, 19 nt, Homo sapiens
uaauaguacccacuucaua

SEQ ID NO: 1016694 - RNA, 19 nt, Homo sapiens
gaauaauaguacccacuuc

SEQ ID NO: 1016695 - RNA, 19 nt, Homo sapiens
uaaaguuccugcucuugug

SEQ ID NO: 1016696 - RNA, 19 nt, Homo sapiens
ugagagagcacgagcuaaa

SEQ ID NO: 1016697 - RNA, 19 nt, Homo sapiens
gagcauauagagauguaaa

SEQ ID NO: 1016698 - RNA, 19 nt, Homo sapiens
gcaccacauguguuuauaa

SEQ ID NO: 1016699 - RNA, 19 nt, Homo sapiens
gagagcacgagcuaaagua

SEQ ID NO: 1016700 - RNA, 19 nt, Homo sapiens
gaaguuacaguauacucaa

SEQ ID NO: 1016701 - RNA, 19 nt, Homo sapiens
aguaaugucugcaacaaug

SEQ ID NO: 1016702 - RNA, 19 nt, Homo sapiens
gaagagcagccaugauuac

SEQ ID NO: 1016703 - RNA, 19 nt, Homo sapiens
gaggcuguaugguguaaug

SEQ ID NO: 1016704 - RNA, 19 nt, Homo sapiens
ugaaauagaggcuguaugg

SEQ ID NO: 1016705 - RNA, 19 nt, Homo sapiens
ccucaaauuucauuaccuu

SEQ ID NO: 1016706 - RNA, 19 nt, Homo sapiens
gaguagagcauauagagau

SEQ ID NO: 1016707 - RNA, 19 nt, Homo sapiens
gcaaguguucuauuugaug

SEQ ID NO: 1016708 - RNA, 19 nt, Homo sapiens
uagcugaguucauuucauc

SEQ ID NO: 1016709 - RNA, 19 nt, Homo sapiens
cagauucggucgguaaaga

SEQ ID NO: 1016710 - RNA, 19 nt, Homo sapiens
gaaacaucuuuggcuuauu

SEQ ID NO: 1016711 - RNA, 19 nt, Homo sapiens
ggacauucauugccucacu

SEQ ID NO: 1016712 - RNA, 19 nt, Homo sapiens
uagagcauauagagaugua

SEQ ID NO: 1016713 - RNA, 19 nt, Homo sapiens
aaacagucaccauuuacua

SEQ ID NO: 1016714 - RNA, 19 nt, Homo sapiens
uggauuaacaccauaguaa

SEQ ID NO: 1016715 - RNA, 19 nt, Homo sapiens
gaaauuugaagaugugagu

SEQ ID NO: 1016716 - RNA, 19 nt, Homo sapiens
ggauuguccuuguuuacau

SEQ ID NO: 1016717 - RNA, 19 nt, Homo sapiens
gagauagcuccuuuauauu

SEQ ID NO: 1016718 - RNA, 19 nt, Homo sapiens
uuccugcucuugugaauaa

SEQ ID NO: 1016719 - RNA, 19 nt, Homo sapiens
ggacaucuauucuuuuaag

SEQ ID NO: 1016720 - RNA, 19 nt, Homo sapiens
cgaauaaaugggauaaaga

SEQ ID NO: 1016721 - RNA, 19 nt, Homo sapiens
gcuguaugguguaauggaa

SEQ ID NO: 1016722 - RNA, 19 nt, Homo sapiens
cgaaaucacagaccuuuua

SEQ ID NO: 1016723 - RNA, 19 nt, Homo sapiens
gcaccccacuuuccacaua

SEQ ID NO: 1016724 - RNA, 19 nt, Homo sapiens
gcaaauggcagagcuagca

SEQ ID NO: 1016725 - RNA, 19 nt, Homo sapiens
ucaaguguuuguggaauga

SEQ ID NO: 1016726 - RNA, 19 nt, Homo sapiens
caaguuugaauuugggaua

SEQ ID NO: 1016727 - RNA, 19 nt, Homo sapiens
ucauggaccuugacuuuga

SEQ ID NO: 1016728 - RNA, 19 nt, Homo sapiens
gcgacgagguucagauucu

SEQ ID NO: 1016729 - RNA, 19 nt, Homo sapiens
gcuugggccugcuguguug

SEQ ID NO: 1016730 - RNA, 19 nt, Homo sapiens
ugagguugguauuuccuuu

SEQ ID NO: 1016731 - RNA, 19 nt, Homo sapiens
cagcgacgagguucagauu

SEQ ID NO: 1016732 - RNA, 19 nt, Homo sapiens
cagcugaggguauuuuaua

SEQ ID NO: 1016733 - RNA, 19 nt, Homo sapiens
gcaagucauggcccaagga

SEQ ID NO: 1016734 - RNA, 19 nt, Homo sapiens
ggacucaugaacucaccaa

SEQ ID NO: 1016735 - RNA, 19 nt, Homo sapiens
guugccagcugaggguauu

SEQ ID NO: 1016736 - RNA, 19 nt, Homo sapiens
gcgugggacucaugaacuc

SEQ ID NO: 1016737 - RNA, 19 nt, Homo sapiens
agaguggccugguacacau

SEQ ID NO: 1016738 - RNA, 19 nt, Homo sapiens
uucaugagguugguauuuc

SEQ ID NO: 1016739 - RNA, 19 nt, Homo sapiens
gcugagaagugguaucuua

SEQ ID NO: 1016740 - RNA, 19 nt, Homo sapiens
ggaccaagauguucuaugu

SEQ ID NO: 1016741 - RNA, 19 nt, Homo sapiens
gaagugguaucuuaagcua

SEQ ID NO: 1016742 - RNA, 19 nt, Homo sapiens
gcauagggcuuguuguuau

SEQ ID NO: 1016743 - RNA, 19 nt, Homo sapiens
ccacacaccucucuacuga

SEQ ID NO: 1016744 - RNA, 19 nt, Homo sapiens
ggaaaagacuggcacaaua

SEQ ID NO: 1016745 - RNA, 19 nt, Homo sapiens
cagaggagguucagcauuu

SEQ ID NO: 1016746 - RNA, 19 nt, Homo sapiens
uauaaaggcccaagacuua

SEQ ID NO: 1016747 - RNA, 19 nt, Homo sapiens
cagcagaacuccuaaacaa

SEQ ID NO: 1016748 - RNA, 19 nt, Homo sapiens
uaagagacaucauuccauu

SEQ ID NO: 1016749 - RNA, 19 nt, Homo sapiens
guaaggcagugauauacua

SEQ ID NO: 1016750 - RNA, 19 nt, Homo sapiens
ggacucagaauaaauguaa

SEQ ID NO: 1016751 - RNA, 19 nt, Homo sapiens
aagcagaacucuuggcuaa

SEQ ID NO: 1016752 - RNA, 19 nt, Homo sapiens
gcuaucagacuucagauua

SEQ ID NO: 1016753 - RNA, 19 nt, Homo sapiens
gaagaaugaccaaaucaaa

SEQ ID NO: 1016754 - RNA, 19 nt, Homo sapiens
caaugcagcuuugguuuaa

SEQ ID NO: 1016755 - RNA, 19 nt, Homo sapiens
guacguuccuauuguuuaa

SEQ ID NO: 1016756 - RNA, 19 nt, Homo sapiens
agaacaaguugcagaauuu

SEQ ID NO: 1016757 - RNA, 19 nt, Homo sapiens
ggcaucauauccacaguua

SEQ ID NO: 1016758 - RNA, 19 nt, Homo sapiens
gcacauggcugaaaaggaa

SEQ ID NO: 1016759 - RNA, 19 nt, Homo sapiens
caagaagaaugaccaaauc

SEQ ID NO: 1016760 - RNA, 19 nt, Homo sapiens
ggacaaaucauuagaaacu

SEQ ID NO: 1016761 - RNA, 19 nt, Homo sapiens
agacaucucugaacuugaa

SEQ ID NO: 1016762 - RNA, 19 nt, Homo sapiens
aaugaacacugucuacuaa

SEQ ID NO: 1016763 - RNA, 19 nt, Homo sapiens
gagagaagggagagaauaa

SEQ ID NO: 1016764 - RNA, 19 nt, Homo sapiens
gaggacaccuucaccauag

SEQ ID NO: 1016765 - RNA, 19 nt, Homo sapiens
ucaaguccauaaagcaaua

SEQ ID NO: 1016766 - RNA, 19 nt, Homo sapiens
gcagaacucuuggcuaaag

SEQ ID NO: 1016767 - RNA, 19 nt, Homo sapiens
gaaauacaggcuacaaaug

SEQ ID NO: 1016768 - RNA, 19 nt, Homo sapiens
gcuaccacaugcaaacaua

SEQ ID NO: 1016769 - RNA, 19 nt, Homo sapiens
ggaggacaccuucaccaua

SEQ ID NO: 1016770 - RNA, 19 nt, Homo sapiens
gguagaauuuguacuuguu

SEQ ID NO: 1016771 - RNA, 19 nt, Homo sapiens
uagaacaaguugcagaauu

SEQ ID NO: 1016772 - RNA, 19 nt, Homo sapiens
uaagauaauuucccugcaa

SEQ ID NO: 1016773 - RNA, 19 nt, Homo sapiens
ucaugagucuguauuacua

SEQ ID NO: 1016774 - RNA, 19 nt, Homo sapiens
uuaggucacuuaccaguuu

SEQ ID NO: 1016775 - RNA, 19 nt, Homo sapiens
gagcauagggcuuguuguu

SEQ ID NO: 1016776 - RNA, 19 nt, Homo sapiens
gaugauucuuucacaugua

SEQ ID NO: 1016777 - RNA, 19 nt, Homo sapiens
gcagugaacaugaacauuc

SEQ ID NO: 1016778 - RNA, 19 nt, Homo sapiens
gcacugagaauucuuuaca

SEQ ID NO: 1016779 - RNA, 19 nt, Homo sapiens
gaagagaaugagaaauuga

SEQ ID NO: 1016780 - RNA, 19 nt, Homo sapiens
ucaccugucucuccauauu

SEQ ID NO: 1016781 - RNA, 19 nt, Homo sapiens
gagaauucuuuacagcaaa

SEQ ID NO: 1016782 - RNA, 19 nt, Homo sapiens
gcaaacagcagcuuaucga

SEQ ID NO: 1016783 - RNA, 19 nt, Homo sapiens
caaaugcacuggaugaaaa

SEQ ID NO: 1016784 - RNA, 19 nt, Homo sapiens
gagccagcauuuacuaugu

SEQ ID NO: 1016785 - RNA, 19 nt, Homo sapiens
gagaguaucacacccuaaa

SEQ ID NO: 1016786 - RNA, 19 nt, Homo sapiens
agaagacacuuaaugacaa

SEQ ID NO: 1016787 - RNA, 19 nt, Homo sapiens
accaagauguucuauguaa

SEQ ID NO: 1016788 - RNA, 19 nt, Homo sapiens
aaucaaagaucugaggaaa

SEQ ID NO: 1016789 - RNA, 19 nt, Homo sapiens
gaagacacuuaaugacaag

SEQ ID NO: 1016790 - RNA, 19 nt, Homo sapiens
guugaagaccauugaaaua

SEQ ID NO: 1016791 - RNA, 19 nt, Homo sapiens
gauguucuuugacguaaau

SEQ ID NO: 1016792 - RNA, 19 nt, Homo sapiens
agaagucacuggaggagaa

SEQ ID NO: 1016793 - RNA, 19 nt, Homo sapiens
gacuucagauuagacuuua

SEQ ID NO: 1016794 - RNA, 19 nt, Homo sapiens
uaaacaaccuacccuccuu

SEQ ID NO: 1016795 - RNA, 19 nt, Homo sapiens
auagugagguggaaucuga

SEQ ID NO: 1016796 - RNA, 19 nt, Homo sapiens
caccauagaugaagucucu

SEQ ID NO: 1016797 - RNA, 19 nt, Homo sapiens
gcaauaacgagccagcauu

SEQ ID NO: 1016798 - RNA, 19 nt, Homo sapiens
ucaaauccauccugcacuu

SEQ ID NO: 1016799 - RNA, 19 nt, Homo sapiens
gauaagaaaccuauauugc

SEQ ID NO: 1016800 - RNA, 19 nt, Homo sapiens
caauaacgagccagcauuu

SEQ ID NO: 1016801 - RNA, 19 nt, Homo sapiens
ugaacacugucuacuaaga

SEQ ID NO: 1016802 - RNA, 19 nt, Homo sapiens
uuacagcagugaacaugaa

SEQ ID NO: 1016803 - RNA, 19 nt, Homo sapiens
gcccaagacuuaaguaacu

SEQ ID NO: 1016804 - RNA, 19 nt, Homo sapiens
gaacagcagaacuccuaaa

SEQ ID NO: 1016805 - RNA, 19 nt, Homo sapiens
ggcuuauccuucugcauua

SEQ ID NO: 1016806 - RNA, 19 nt, Homo sapiens
ugagaauucuuuacagcaa

SEQ ID NO: 1016807 - RNA, 19 nt, Homo sapiens
agaagagaaugagaaauug

SEQ ID NO: 1016808 - RNA, 19 nt, Homo sapiens
uaaacaaagucaaguccau

SEQ ID NO: 1016809 - RNA, 19 nt, Homo sapiens
ccaagaagaaugaccaaau

SEQ ID NO: 1016810 - RNA, 19 nt, Homo sapiens
gaagaccauugaaauacag

SEQ ID NO: 1016811 - RNA, 19 nt, Homo sapiens
ugaagaccauugaaauaca

SEQ ID NO: 1016812 - RNA, 19 nt, Homo sapiens
gaacaaguugcagaauuug

SEQ ID NO: 1016813 - RNA, 19 nt, Homo sapiens
cauagggcuuguuguuauu

SEQ ID NO: 1016814 - RNA, 19 nt, Homo sapiens
gaagaagaggcuuauccuu

SEQ ID NO: 1016815 - RNA, 19 nt, Homo sapiens
acaaugcagcuuugguuua

SEQ ID NO: 1016816 - RNA, 19 nt, Homo sapiens
ucacaugcacugagaauuc

SEQ ID NO: 1016817 - RNA, 19 nt, Homo sapiens
ugagugcuccagagucuua

SEQ ID NO: 1016818 - RNA, 19 nt, Homo sapiens
aaacagcagcuuaucgaaa

SEQ ID NO: 1016819 - RNA, 19 nt, Homo sapiens
gaugaaaagucaaaacuag

SEQ ID NO: 1016820 - RNA, 19 nt, Homo sapiens
ucaagaagagaaugagaaa

SEQ ID NO: 1016821 - RNA, 19 nt, Homo sapiens
gcagcuuugguuuaauuua

SEQ ID NO: 1016822 - RNA, 19 nt, Homo sapiens
caggcagucuguacauuga

SEQ ID NO: 1016823 - RNA, 19 nt, Homo sapiens
aaacaaagucaaguccaua

SEQ ID NO: 1016824 - RNA, 19 nt, Homo sapiens
uauguaaggcagugauaua

SEQ ID NO: 1016825 - RNA, 19 nt, Homo sapiens
aaacauacaagcagucuca

SEQ ID NO: 1016826 - RNA, 19 nt, Homo sapiens
gaaaagacuggcacaauau

SEQ ID NO: 1016827 - RNA, 19 nt, Homo sapiens
uaaaugagcaccaucaaaa

SEQ ID NO: 1016828 - RNA, 19 nt, Homo sapiens
acagaaggcagucuuaaga

SEQ ID NO: 1016829 - RNA, 19 nt, Homo sapiens
aauaaucccucagaaggaa

SEQ ID NO: 1016830 - RNA, 19 nt, Homo sapiens
uagaugaagucucugaagu

SEQ ID NO: 1016831 - RNA, 19 nt, Homo sapiens
cuacaaaugcacuggauga

SEQ ID NO: 1016832 - RNA, 19 nt, Homo sapiens
ugaaauacaggcuacaaau

SEQ ID NO: 1016833 - RNA, 19 nt, Homo sapiens
caggccugcugcugaguua

SEQ ID NO: 1016834 - RNA, 19 nt, Homo sapiens
ugccaagcauuaagauaaa

SEQ ID NO: 1016835 - RNA, 19 nt, Homo sapiens
ccucaccugucucuccaua

SEQ ID NO: 1016836 - RNA, 19 nt, Homo sapiens
aagauaauuucccugcaaa

SEQ ID NO: 1016837 - RNA, 19 nt, Homo sapiens
caacacugccuauaccaau

SEQ ID NO: 1016838 - RNA, 19 nt, Homo sapiens
ggacacagaaggcagucuu

SEQ ID NO: 1016839 - RNA, 19 nt, Homo sapiens
gaagaaaccuuaugcaaua

SEQ ID NO: 1016840 - RNA, 19 nt, Homo sapiens
ggacauagcuccgguauua

SEQ ID NO: 1016841 - RNA, 19 nt, Homo sapiens
gcauagagcuggagaaaua

SEQ ID NO: 1016842 - RNA, 19 nt, Homo sapiens
gaagaauucucuaaggaua

SEQ ID NO: 1016843 - RNA, 19 nt, Homo sapiens
gaaauuaccuaccaaggaa

SEQ ID NO: 1016844 - RNA, 19 nt, Homo sapiens
ggacauacuugaagaaaga

SEQ ID NO: 1016845 - RNA, 19 nt, Homo sapiens
gaacaggacucaaccuuuc

SEQ ID NO: 1016846 - RNA, 19 nt, Homo sapiens
ucagagaacuccaguagua

SEQ ID NO: 1016847 - RNA, 19 nt, Homo sapiens
gaggagagaucuagaaguu

SEQ ID NO: 1016848 - RNA, 19 nt, Homo sapiens
ggacagaguuucagcaaau

SEQ ID NO: 1016849 - RNA, 19 nt, Homo sapiens
uaaaugagcugagugguaa

SEQ ID NO: 1016850 - RNA, 19 nt, Homo sapiens
gaacuaacauccaaagaag

SEQ ID NO: 1016851 - RNA, 19 nt, Homo sapiens
gcaaaugaccaaacagaua

SEQ ID NO: 1016852 - RNA, 19 nt, Homo sapiens
gaaguagugugauuaauag

SEQ ID NO: 1016853 - RNA, 19 nt, Homo sapiens
gaagagaaauuaccuacca

SEQ ID NO: 1016854 - RNA, 19 nt, Homo sapiens
ggaagaaacuauggaauuc

SEQ ID NO: 1016855 - RNA, 19 nt, Homo sapiens
ggaaagagcucugaaacag

SEQ ID NO: 1016856 - RNA, 19 nt, Homo sapiens
cuaauagacucaaagcaua

SEQ ID NO: 1016857 - RNA, 19 nt, Homo sapiens
ggagaaaacucuaaaauag

SEQ ID NO: 1016858 - RNA, 19 nt, Homo sapiens
ggaauaauauaccuuagca

SEQ ID NO: 1016859 - RNA, 19 nt, Homo sapiens
caauauagaugacagagau

SEQ ID NO: 1016860 - RNA, 19 nt, Homo sapiens
gcaaggaauauuacagaua

SEQ ID NO: 1016861 - RNA, 19 nt, Homo sapiens
caaaugaccaaacagauaa

SEQ ID NO: 1016862 - RNA, 19 nt, Homo sapiens
caaagaagcagacuuaaca

SEQ ID NO: 1016863 - RNA, 19 nt, Homo sapiens
uagaggagcuggaugaaga

SEQ ID NO: 1016864 - RNA, 19 nt, Homo sapiens
gagaugagggaaacucuua

SEQ ID NO: 1016865 - RNA, 19 nt, Homo sapiens
ggaagaaaccuuaugcaau

SEQ ID NO: 1016866 - RNA, 19 nt, Homo sapiens
gggcagaggacauaauuaa

SEQ ID NO: 1016867 - RNA, 19 nt, Homo sapiens
gaauggacauacuugaaga

SEQ ID NO: 1016868 - RNA, 19 nt, Homo sapiens
aaagaaaggcaaagagaua

SEQ ID NO: 1016869 - RNA, 19 nt, Homo sapiens
ggauggagaggaugaauuu

SEQ ID NO: 1016870 - RNA, 19 nt, Homo sapiens
ugagcugagugguaaauua

SEQ ID NO: 1016871 - RNA, 19 nt, Homo sapiens
ccagaaggauggacagcua

SEQ ID NO: 1016872 - RNA, 19 nt, Homo sapiens
aagaggagauuggaaauuu

SEQ ID NO: 1016873 - RNA, 19 nt, Homo sapiens
ggacguaucagcaauuaug

SEQ ID NO: 1016874 - RNA, 19 nt, Homo sapiens
uaacagaaacugauaagga

SEQ ID NO: 1016875 - RNA, 19 nt, Homo sapiens
cagaagaacuaacauccaa

SEQ ID NO: 1016876 - RNA, 19 nt, Homo sapiens
gaaaagagacugacuccua

SEQ ID NO: 1016877 - RNA, 19 nt, Homo sapiens
gaauagggcagaggacaua

SEQ ID NO: 1016878 - RNA, 19 nt, Homo sapiens
gcaauggaguaaugucuuc

SEQ ID NO: 1016879 - RNA, 19 nt, Homo sapiens
cagcaacacuggauauuag

SEQ ID NO: 1016880 - RNA, 19 nt, Homo sapiens
gaaggaaagagcucugaaa

SEQ ID NO: 1016881 - RNA, 19 nt, Homo sapiens
guaaaugagcugaguggua

SEQ ID NO: 1016882 - RNA, 19 nt, Homo sapiens
ggagcaaugucuucaaagu

SEQ ID NO: 1016883 - RNA, 19 nt, Homo sapiens
agacuugauugacguauuu

SEQ ID NO: 1016884 - RNA, 19 nt, Homo sapiens
gcacacagaagaacuaaca

SEQ ID NO: 1016885 - RNA, 19 nt, Homo sapiens
gauggaggaugaugaagau

SEQ ID NO: 1016886 - RNA, 19 nt, Homo sapiens
gcaaggacguaucagcaau

SEQ ID NO: 1016887 - RNA, 19 nt, Homo sapiens
ggaauucuagugauaaaga

SEQ ID NO: 1016888 - RNA, 19 nt, Homo sapiens
gaacugcugagacuugauu

SEQ ID NO: 1016889 - RNA, 19 nt, Homo sapiens
gaaaugagagaggaaagaa

SEQ ID NO: 1016890 - RNA, 19 nt, Homo sapiens
aaagagagcaguuaacaga

SEQ ID NO: 1016891 - RNA, 19 nt, Homo sapiens
agaaguaaauggagcaaug

SEQ ID NO: 1016892 - RNA, 19 nt, Homo sapiens
agagagagaagagaaauua

SEQ ID NO: 1016893 - RNA, 19 nt, Homo sapiens
caacaggagucaccaaacu

SEQ ID NO: 1016894 - RNA, 19 nt, Homo sapiens
gaaaccuuaugcaauauag

SEQ ID NO: 1016895 - RNA, 19 nt, Homo sapiens
ugucagugcuugucgagua

SEQ ID NO: 1016896 - RNA, 19 nt, Homo sapiens
guaaagaaaggcaaagaga

SEQ ID NO: 1016897 - RNA, 19 nt, Homo sapiens
gcauucacauacaaauuug

SEQ ID NO: 1016898 - RNA, 19 nt, Homo sapiens
gcaaagccuuagaaaauuu

SEQ ID NO: 1016899 - RNA, 19 nt, Homo sapiens
gagcaaggaauauuacaga

SEQ ID NO: 1016900 - RNA, 19 nt, Homo sapiens
gacagaguuucagcaaaua

SEQ ID NO: 1016901 - RNA, 19 nt, Homo sapiens
ggaacaagaaucagguuga

SEQ ID NO: 1016902 - RNA, 19 nt, Homo sapiens
gaaguugcaacauucguuu

SEQ ID NO: 1016903 - RNA, 19 nt, Homo sapiens
ggagaaauaaccagugaug

SEQ ID NO: 1016904 - RNA, 19 nt, Homo sapiens
gaugaaggagcaguacuua

SEQ ID NO: 1016905 - RNA, 19 nt, Homo sapiens
agagagcaguuaacagaaa

SEQ ID NO: 1016906 - RNA, 19 nt, Homo sapiens
ggaacagacuucagaacag

SEQ ID NO: 1016907 - RNA, 19 nt, Homo sapiens
ugauguaucuacuagugua

SEQ ID NO: 1016908 - RNA, 19 nt, Homo sapiens
cacaaugucugauguaucu

SEQ ID NO: 1016909 - RNA, 19 nt, Homo sapiens
ucaggugucuuggaaauug

SEQ ID NO: 1016910 - RNA, 19 nt, Homo sapiens
ggcuugagcuuccuauuuc

SEQ ID NO: 1016911 - RNA, 19 nt, Homo sapiens
caacacuggauauuaguaa

SEQ ID NO: 1016912 - RNA, 19 nt, Homo sapiens
agacaacacuaacgaauac

SEQ ID NO: 1016913 - RNA, 19 nt, Homo sapiens
cagaggacauaauuaagga

SEQ ID NO: 1016914 - RNA, 19 nt, Homo sapiens
caacauucguuugauagga

SEQ ID NO: 1016915 - RNA, 19 nt, Homo sapiens
uaacagaggaaacagaaga

SEQ ID NO: 1016916 - RNA, 19 nt, Homo sapiens
gagacuugauugacguauu

SEQ ID NO: 1016917 - RNA, 19 nt, Homo sapiens
ggaugaggagcaaggaaua

SEQ ID NO: 1016918 - RNA, 19 nt, Homo sapiens
gaaggauggacagcuaaua

SEQ ID NO: 1016919 - RNA, 19 nt, Homo sapiens
gaacaagaaucagguugac

SEQ ID NO: 1016920 - RNA, 19 nt, Homo sapiens
gaaacuauggaauucaaga

SEQ ID NO: 1016921 - RNA, 19 nt, Homo sapiens
uaauauaccuuagcacucu

SEQ ID NO: 1016922 - RNA, 19 nt, Homo sapiens
caaagucacuagagaugag

SEQ ID NO: 1016923 - RNA, 19 nt, Homo sapiens
ggucauacuuugguagaug

SEQ ID NO: 1016924 - RNA, 19 nt, Homo sapiens
ggaggaggaagaagaagaa

SEQ ID NO: 1016925 - RNA, 19 nt, Homo sapiens
cuacuaguguacaaucaaa

SEQ ID NO: 1016926 - RNA, 19 nt, Homo sapiens
gagaauuacuggggaauaa

SEQ ID NO: 1016927 - RNA, 19 nt, Homo sapiens
gagcaaugucuucaaaguu

SEQ ID NO: 1016928 - RNA, 19 nt, Homo sapiens
agacacaucuuggugaaau

SEQ ID NO: 1016929 - RNA, 19 nt, Homo sapiens
caaugcaaaugaccaaaca

SEQ ID NO: 1016930 - RNA, 19 nt, Homo sapiens
gguaaagaauucagagaac

SEQ ID NO: 1016931 - RNA, 19 nt, Homo sapiens
uagcaggccuguaagaaca

SEQ ID NO: 1016932 - RNA, 19 nt, Homo sapiens
ugaggagcaaggaauauua

SEQ ID NO: 1016933 - RNA, 19 nt, Homo sapiens
gaugaacugcugagacuug

SEQ ID NO: 1016934 - RNA, 19 nt, Homo sapiens
cuucagggauggaggauga

SEQ ID NO: 1016935 - RNA, 19 nt, Homo sapiens
ggaaggauggagaggauga

SEQ ID NO: 1016936 - RNA, 19 nt, Homo sapiens
aaaggagaguuaugagaau

SEQ ID NO: 1016937 - RNA, 19 nt, Homo sapiens
ccauucaggugucuuggaa

SEQ ID NO: 1016938 - RNA, 19 nt, Homo sapiens
gaggagauuggaaauuuga

SEQ ID NO: 1016939 - RNA, 19 nt, Homo sapiens
gaagaaagcuauggcaauu

SEQ ID NO: 1016940 - RNA, 19 nt, Homo sapiens
gaaauagccucugaaauuc

SEQ ID NO: 1016941 - RNA, 19 nt, Homo sapiens
agaaauagccucugaaauu

SEQ ID NO: 1016942 - RNA, 19 nt, Homo sapiens
gcacuuggaggaacauuua

SEQ ID NO: 1016943 - RNA, 19 nt, Homo sapiens
gcacaaguacgaaguauau

SEQ ID NO: 1016944 - RNA, 19 nt, Homo sapiens
gggaagcuuuguaccuuua

SEQ ID NO: 1016945 - RNA, 19 nt, Homo sapiens
caucgaaucuugcgaacaa

SEQ ID NO: 1016946 - RNA, 19 nt, Homo sapiens
ggaaagccguugccuaugg

SEQ ID NO: 1016947 - RNA, 19 nt, Homo sapiens
ggaggaacauuuauuaugc

SEQ ID NO: 1016948 - RNA, 19 nt, Homo sapiens
gcauaugauuucuugcuuu

SEQ ID NO: 1016949 - RNA, 19 nt, Homo sapiens
caaagcgcauggagacuaa

SEQ ID NO: 1016950 - RNA, 19 nt, Homo sapiens
gaucaauggucucagaaau

SEQ ID NO: 1016951 - RNA, 19 nt, Homo sapiens
gaaugaugcuaugaaauug

SEQ ID NO: 1016952 - RNA, 19 nt, Homo sapiens
gaacauggaauugugguuu

SEQ ID NO: 1016953 - RNA, 19 nt, Homo sapiens
gaauuugaagccuacauua

SEQ ID NO: 1016954 - RNA, 19 nt, Homo sapiens
gcaggaguuuguuuaaaga

SEQ ID NO: 1016955 - RNA, 19 nt, Homo sapiens
gagaacagcauaugauuuc

SEQ ID NO: 1016956 - RNA, 19 nt, Homo sapiens
gaguguaggugaaaugaau

SEQ ID NO: 1016957 - RNA, 19 nt, Homo sapiens
gcagaugguugcaauugau

SEQ ID NO: 1016958 - RNA, 19 nt, Homo sapiens
gcuuaauuguugccaaaua

SEQ ID NO: 1016959 - RNA, 19 nt, Homo sapiens
ggagugacccugaauguuc

SEQ ID NO: 1016960 - RNA, 19 nt, Homo sapiens
gaagugcugggcaaguuua

SEQ ID NO: 1016961 - RNA, 19 nt, Homo sapiens
gaaagccguugccuaugga

SEQ ID NO: 1016962 - RNA, 19 nt, Homo sapiens
ggcaauugcugaugcuuug

SEQ ID NO: 1016963 - RNA, 19 nt, Homo sapiens
gaaccauucccuagucauu

SEQ ID NO: 1016964 - RNA, 19 nt, Homo sapiens
gcaaagcgcauggagacua

SEQ ID NO: 1016965 - RNA, 19 nt, Homo sapiens
ucaauggucucagaaauuc

SEQ ID NO: 1016966 - RNA, 19 nt, Homo sapiens
gcuagucaguaaagauauu

SEQ ID NO: 1016967 - RNA, 19 nt, Homo sapiens
gcacagugaagacuuauuc

SEQ ID NO: 1016968 - RNA, 19 nt, Homo sapiens
gaaauugguggguggugua

SEQ ID NO: 1016969 - RNA, 19 nt, Homo sapiens
cauaugauuucuugcuuug

SEQ ID NO: 1016970 - RNA, 19 nt, Homo sapiens
cagacaggcuggcauucua

SEQ ID NO: 1016971 - RNA, 19 nt, Homo sapiens
ggucaguccucaucucugu

SEQ ID NO: 1016972 - RNA, 19 nt, Homo sapiens
gagaagauaaucauugcuu

SEQ ID NO: 1016973 - RNA, 19 nt, Homo sapiens
aggcuggcauucuagauua

SEQ ID NO: 1016974 - RNA, 19 nt, Homo sapiens
uaagaaagcccacaaaucc

SEQ ID NO: 1016975 - RNA, 19 nt, Homo sapiens
ggaauuugaagccuacauu

SEQ ID NO: 1016976 - RNA, 19 nt, Homo sapiens
gaacagcauaugauuucuu

SEQ ID NO: 1016977 - RNA, 19 nt, Homo sapiens
gcgaacaacacgauacuug

SEQ ID NO: 1016978 - RNA, 19 nt, Homo sapiens
uaggugaaaugaaugaaug

SEQ ID NO: 1016979 - RNA, 19 nt, Homo sapiens
gaauugugguuuucucuuu

SEQ ID NO: 1016980 - RNA, 19 nt, Homo sapiens
caccuuguguguuuaaaga

SEQ ID NO: 1016981 - RNA, 19 nt, Homo sapiens
gagcuggagugacccugaa

SEQ ID NO: 1016982 - RNA, 19 nt, Homo sapiens
gcacugagaacagcauaug

SEQ ID NO: 1016983 - RNA, 19 nt, Homo sapiens
uuaauggguucauacaaug

SEQ ID NO: 1016984 - RNA, 19 nt, Homo sapiens
gcaaauggcaguuuuaauc

SEQ ID NO: 1016985 - RNA, 19 nt, Homo sapiens
ucucagaugccaugacuuu

SEQ ID NO: 1016986 - RNA, 19 nt, Homo sapiens
ugaggucggugguggagaa

SEQ ID NO: 1016987 - RNA, 19 nt, Homo sapiens
cauauacccuggaggaucu

SEQ ID NO: 1016988 - RNA, 19 nt, Homo sapiens
gaagcuuuguaccuuuaga

SEQ ID NO: 1016989 - RNA, 19 nt, Homo sapiens
acacaucaauuugguuguu

SEQ ID NO: 1016990 - RNA, 19 nt, Homo sapiens
gaaagcacaaguacgaagu

SEQ ID NO: 1016991 - RNA, 19 nt, Homo sapiens
ucaauggaaagcacaagua

SEQ ID NO: 1016992 - RNA, 19 nt, Homo sapiens
gcaauugauccuuaaccaa

SEQ ID NO: 1016993 - RNA, 19 nt, Homo sapiens
cagcugcaguucucugaug

SEQ ID NO: 1016994 - RNA, 19 nt, Homo sapiens
ugagaacagcauaugauuu

SEQ ID NO: 1016995 - RNA, 19 nt, Homo sapiens
ggcaugaggugguuguagu

SEQ ID NO: 1016996 - RNA, 19 nt, Homo sapiens
cgugauugguuuccucuug

SEQ ID NO: 1016997 - RNA, 19 nt, Homo sapiens
gacccugaauguucuggaa

SEQ ID NO: 1016998 - RNA, 19 nt, Homo sapiens
cagaugccaugacuuucaa

SEQ ID NO: 1016999 - RNA, 19 nt, Homo sapiens
ugaggugguuguagucaug

SEQ ID NO: 1017000 - RNA, 19 nt, Homo sapiens
cuagucauuuccaaacuug

SEQ ID NO: 1017001 - RNA, 19 nt, Homo sapiens
cccacgaccucaccuggua

SEQ ID NO: 1017002 - RNA, 19 nt, Homo sapiens
gugaucagauggacaaugc

SEQ ID NO: 1017003 - RNA, 19 nt, Homo sapiens
gccguugccuauggaauuu

SEQ ID NO: 1017004 - RNA, 19 nt, Homo sapiens
gaucuucauuggugguauc

SEQ ID NO: 1017005 - RNA, 19 nt, Homo sapiens
cuagaaauagccucugaaa

SEQ ID NO: 1017006 - RNA, 19 nt, Homo sapiens
gaugacccgugccuuuauc

SEQ ID NO: 1017007 - RNA, 19 nt, Homo sapiens
gaugggagccacugguuca

SEQ ID NO: 1017008 - RNA, 19 nt, Homo sapiens
uuucugauguuuccuacaa

SEQ ID NO: 1017009 - RNA, 19 nt, Homo sapiens
aacagcauaugauuucuug

SEQ ID NO: 1017010 - RNA, 19 nt, Homo sapiens
gguugcaauugauccuuaa

SEQ ID NO: 1017011 - RNA, 19 nt, Homo sapiens
cuucaucaccuuuaaaugu

SEQ ID NO: 1017012 - RNA, 19 nt, Homo sapiens
gaucagauggacaaugcaa

SEQ ID NO: 1017013 - RNA, 19 nt, Homo sapiens
cuuggaggaacauuuauua

SEQ ID NO: 1017014 - RNA, 19 nt, Homo sapiens
gaaauuccagagaagaaag

SEQ ID NO: 1017015 - RNA, 19 nt, Homo sapiens
auuggugggugguguauuu

SEQ ID NO: 1017016 - RNA, 19 nt, Homo sapiens
ugguugcaauugauccuua

SEQ ID NO: 1017017 - RNA, 19 nt, Homo sapiens
aggaugacaugugccauuu

SEQ ID NO: 1017018 - RNA, 19 nt, Homo sapiens
ucgcuagucaguaaagaua

SEQ ID NO: 1017019 - RNA, 19 nt, Homo sapiens
ccuuggacgugauugguuu

SEQ ID NO: 1017020 - RNA, 19 nt, Homo sapiens
ccgaugacccgugccuuua

SEQ ID NO: 1017021 - RNA, 19 nt, Homo sapiens
agaaagcuauggcaauugc

SEQ ID NO: 1017022 - RNA, 19 nt, Homo sapiens
cagaaauuccagagaagaa

SEQ ID NO: 1017023 - RNA, 19 nt, Homo sapiens
uggagaacauggaauugug

SEQ ID NO: 1017024 - RNA, 19 nt, Homo sapiens
caacugccaucagggaaag

SEQ ID NO: 1017025 - RNA, 19 nt, Homo sapiens
caguguuucucgauccuuu

SEQ ID NO: 1017026 - RNA, 19 nt, Homo sapiens
gaagggaagcuuuguaccu

SEQ ID NO: 1017027 - RNA, 19 nt, Homo sapiens
ggaucaauggucucagaaa

SEQ ID NO: 1017028 - RNA, 19 nt, Homo sapiens
uuugaagccuacauuaaug

SEQ ID NO: 1017029 - RNA, 19 nt, Homo sapiens
ggugguguauuugagaaga

SEQ ID NO: 1017030 - RNA, 19 nt, Homo sapiens
guuaagaaagcccacaaau

SEQ ID NO: 1017031 - RNA, 19 nt, Homo sapiens
gagugacccugaauguucu

SEQ ID NO: 1017032 - RNA, 19 nt, Homo sapiens
ccuagucauuuccaaacuu

SEQ ID NO: 1017033 - RNA, 19 nt, Homo sapiens
uuaagaaagcccacaaauc

SEQ ID NO: 1017034 - RNA, 19 nt, Homo sapiens
ccucugaaauucuccaaac

SEQ ID NO: 1017035 - RNA, 19 nt, Homo sapiens
cuuuguaccuuuagagugu

SEQ ID NO: 1017036 - RNA, 19 nt, Homo sapiens
acaaauccaagacccauug

SEQ ID NO: 1017037 - RNA, 19 nt, Homo sapiens
gugaugaugcccuuguuug

SEQ ID NO: 1017038 - RNA, 19 nt, Homo sapiens
ugcaggaguuuguuuaaag

SEQ ID NO: 1017039 - RNA, 19 nt, Homo sapiens
cugagaagcuuaagacaua

SEQ ID NO: 1017040 - RNA, 19 nt, Homo sapiens
gcaagucucugcucuuugu

SEQ ID NO: 1017041 - RNA, 19 nt, Homo sapiens
ucaaggagcugauauuaca

SEQ ID NO: 1017042 - RNA, 19 nt, Homo sapiens
gaagccagaugugguagua

SEQ ID NO: 1017043 - RNA, 19 nt, Homo sapiens
ugaaggagaucaaggaaga

SEQ ID NO: 1017044 - RNA, 19 nt, Homo sapiens
gggcaagucucugcucuuu

SEQ ID NO: 1017045 - RNA, 19 nt, Homo sapiens
gagcugugcugauggagaa

SEQ ID NO: 1017046 - RNA, 19 nt, Homo sapiens
caagacagccugaaacuuc

SEQ ID NO: 1017047 - RNA, 19 nt, Homo sapiens
gcacugggcuucgaacaca

SEQ ID NO: 1017048 - RNA, 19 nt, Homo sapiens
aagaagagcucaagagucu

SEQ ID NO: 1017049 - RNA, 19 nt, Homo sapiens
ggagaagccagauguggua

SEQ ID NO: 1017050 - RNA, 19 nt, Homo sapiens
gcauagacuuccaccaugu

SEQ ID NO: 1017051 - RNA, 19 nt, Homo sapiens
gcacaaaggaaagaaauuc

SEQ ID NO: 1017052 - RNA, 19 nt, Homo sapiens
caacccaggcauagucuua

SEQ ID NO: 1017053 - RNA, 19 nt, Homo sapiens
ggcauagucuuaaccuuug

SEQ ID NO: 1017054 - RNA, 19 nt, Homo sapiens
ggacagcacgcgcuaacaa

SEQ ID NO: 1017055 - RNA, 19 nt, Homo sapiens
acaaauuccuccugcugua

SEQ ID NO: 1017056 - RNA, 19 nt, Homo sapiens
agacauacuuugaagacaa

SEQ ID NO: 1017057 - RNA, 19 nt, Homo sapiens
gcagcuggcuaccuacugu

SEQ ID NO: 1017058 - RNA, 19 nt, Homo sapiens
gaccccaucucgcauauua

SEQ ID NO: 1017059 - RNA, 19 nt, Homo sapiens
gagcugauauuacauaacc

SEQ ID NO: 1017060 - RNA, 19 nt, Homo sapiens
gagaggccuuguucuuguu

SEQ ID NO: 1017061 - RNA, 19 nt, Homo sapiens
gcaagcacaguccaugauu

SEQ ID NO: 1017062 - RNA, 19 nt, Homo sapiens
ugagaggccuuguucuugu

SEQ ID NO: 1017063 - RNA, 19 nt, Homo sapiens
gcagugagaggccuuguuc

SEQ ID NO: 1017064 - RNA, 19 nt, Homo sapiens
caaaggaaagaaauucaga

SEQ ID NO: 1017065 - RNA, 19 nt, Homo sapiens
gccaugcgcucagugacua

SEQ ID NO: 1017066 - RNA, 19 nt, Homo sapiens
gcagcaagacagccugaaa

SEQ ID NO: 1017067 - RNA, 19 nt, Homo sapiens
caagcacaguccaugauuc

SEQ ID NO: 1017068 - RNA, 19 nt, Homo sapiens
ccacggagcaguuccacuu

SEQ ID NO: 1017069 - RNA, 19 nt, Homo sapiens
cugcagcuguugcuccaua

SEQ ID NO: 1017070 - RNA, 19 nt, Homo sapiens
gaucgagggcuuccgcuau

SEQ ID NO: 1017071 - RNA, 19 nt, Homo sapiens
cacaucaucucacaguuca

SEQ ID NO: 1017072 - RNA, 19 nt, Homo sapiens
agacugaggaagacaaauu

SEQ ID NO: 1017073 - RNA, 19 nt, Homo sapiens
uaacaacccaggcauaguc

SEQ ID NO: 1017074 - RNA, 19 nt, Homo sapiens
gggcauagacuuccaccau

SEQ ID NO: 1017075 - RNA, 19 nt, Homo sapiens
cgacagguccggugguaga

SEQ ID NO: 1017076 - RNA, 19 nt, Homo sapiens
ggacguacaagcacucaag

SEQ ID NO: 1017077 - RNA, 19 nt, Homo sapiens
uaacgaggacguacaagca

SEQ ID NO: 1017078 - RNA, 19 nt, Homo sapiens
gcgaggcucuggugcuuac

SEQ ID NO: 1017079 - RNA, 19 nt, Homo sapiens
gguacgcccucacaagaag

SEQ ID NO: 1017080 - RNA, 19 nt, Homo sapiens
ggagaucaaggaagagcuu

SEQ ID NO: 1017081 - RNA, 19 nt, Homo sapiens
aggcauagucuuaaccuuu

SEQ ID NO: 1017082 - RNA, 19 nt, Homo sapiens
cuacgacugugucauagca

SEQ ID NO: 1017083 - RNA, 19 nt, Homo sapiens
cuucuacgacugugucaua

SEQ ID NO: 1017084 - RNA, 19 nt, Homo sapiens
ccaccugugugcucaaugg

SEQ ID NO: 1017085 - RNA, 19 nt, Homo sapiens
acucaaggagcugauauua

SEQ ID NO: 1017086 - RNA, 19 nt, Homo sapiens
gcacucaaggagcugauau

SEQ ID NO: 1017087 - RNA, 19 nt, Homo sapiens
gcaagacagccugaaacuu

SEQ ID NO: 1017088 - RNA, 19 nt, Homo sapiens
ggcaugaccuaccuuugca

SEQ ID NO: 1017089 - RNA, 19 nt, Homo sapiens
ccacaucaucucacaguuc

SEQ ID NO: 1017090 - RNA, 19 nt, Homo sapiens
gcuuaagacauacuuugaa

SEQ ID NO: 1017091 - RNA, 19 nt, Homo sapiens
gguagaacaggcagugaga

SEQ ID NO: 1017092 - RNA, 19 nt, Homo sapiens
cuuaagacauacuuugaag

SEQ ID NO: 1017093 - RNA, 19 nt, Homo sapiens
gaagcuuaagacauacuuu

SEQ ID NO: 1017094 - RNA, 19 nt, Homo sapiens
ugaagaagagcucaagagu

SEQ ID NO: 1017095 - RNA, 19 nt, Homo sapiens
agagagcugugcugaugga

SEQ ID NO: 1017096 - RNA, 19 nt, Homo sapiens
gagcuucugcauucugaga

SEQ ID NO: 1017097 - RNA, 19 nt, Homo sapiens
aagagcuucugcauucuga

SEQ ID NO: 1017098 - RNA, 19 nt, Homo sapiens
gcuaacaacccaggcauag

SEQ ID NO: 1017099 - RNA, 19 nt, Homo sapiens
gugagaggccuuguucuug

SEQ ID NO: 1017100 - RNA, 19 nt, Homo sapiens
gcauagucuuaaccuuugu

SEQ ID NO: 1017101 - RNA, 19 nt, Homo sapiens
caagcacaaaggaaagaaa

SEQ ID NO: 1017102 - RNA, 19 nt, Homo sapiens
gacauacuuugaagacaac

SEQ ID NO: 1017103 - RNA, 19 nt, Homo sapiens
aaggagcugauauuacaua

SEQ ID NO: 1017104 - RNA, 19 nt, Homo sapiens
uaagacauacuuugaagac

SEQ ID NO: 1017105 - RNA, 19 nt, Homo sapiens
cuacgcugauccaggagaa

SEQ ID NO: 1017106 - RNA, 19 nt, Homo sapiens
ugucugcugugcucaacuu

SEQ ID NO: 1017107 - RNA, 19 nt, Homo sapiens
ugacuaagcaggccauucg

SEQ ID NO: 1017108 - RNA, 19 nt, Homo sapiens
caaauuccuccugcuguau

SEQ ID NO: 1017109 - RNA, 19 nt, Homo sapiens
ggaaggccaagagagcaaa

SEQ ID NO: 1017110 - RNA, 19 nt, Homo sapiens
acaagaagcggaagaagcu

SEQ ID NO: 1017111 - RNA, 19 nt, Homo sapiens
gaugccaugcgcucaguga

SEQ ID NO: 1017112 - RNA, 19 nt, Homo sapiens
agucuuaaccuuugugcuu

SEQ ID NO: 1017113 - RNA, 19 nt, Homo sapiens
cagaccaguuacagcaguu

SEQ ID NO: 1017114 - RNA, 19 nt, Homo sapiens
aagcugucuuccucuugua

SEQ ID NO: 1017115 - RNA, 19 nt, Homo sapiens
cgguuacccuuaaguuaca

SEQ ID NO: 1017116 - RNA, 19 nt, Homo sapiens
aggagcugauauuacauaa

SEQ ID NO: 1017117 - RNA, 19 nt, Homo sapiens
aagcuuaagacauacuuug

SEQ ID NO: 1017118 - RNA, 19 nt, Homo sapiens
ggugccacaucaucucaca

SEQ ID NO: 1017119 - RNA, 19 nt, Homo sapiens
ucugugagacugaggaaga

SEQ ID NO: 1017120 - RNA, 19 nt, Homo sapiens
aguuucagguggucuguga

SEQ ID NO: 1017121 - RNA, 19 nt, Homo sapiens
cccgguuacccuuaaguua

SEQ ID NO: 1017122 - RNA, 19 nt, Homo sapiens
gcagugcugggcccuuuag

SEQ ID NO: 1017123 - RNA, 19 nt, Homo sapiens
aagcacaguccaugauuca

SEQ ID NO: 1017124 - RNA, 19 nt, Homo sapiens
ucucugcucuuugucaaca

SEQ ID NO: 1017125 - RNA, 19 nt, Homo sapiens
gacugaggaagacaaauuc

SEQ ID NO: 1017126 - RNA, 19 nt, Homo sapiens
cagguccggugguagaaca

SEQ ID NO: 1017127 - RNA, 19 nt, Homo sapiens
cacaaaggaaagaaauuca

SEQ ID NO: 1017128 - RNA, 19 nt, Homo sapiens
cacggagcaguuccacuua

SEQ ID NO: 1017129 - RNA, 19 nt, Homo sapiens
ccaaggcuucuacgacugu

SEQ ID NO: 1017130 - RNA, 19 nt, Homo sapiens
ggcuacgccuguucuugga

SEQ ID NO: 1017131 - RNA, 19 nt, Homo sapiens
ccgaguggccaaugucuca

SEQ ID NO: 1017132 - RNA, 19 nt, Homo sapiens
gccacaucaucucacaguu

SEQ ID NO: 1017133 - RNA, 19 nt, Homo sapiens
uuaccaggcuuuucucaug

SEQ ID NO: 1017134 - RNA, 19 nt, Homo sapiens
gggaugccaugcgcucagu

SEQ ID NO: 1017135 - RNA, 19 nt, Homo sapiens
uguaugcccugcucaagcu

SEQ ID NO: 1017136 - RNA, 19 nt, Homo sapiens
ggcaagcacaguccaugau

SEQ ID NO: 1017137 - RNA, 19 nt, Homo sapiens
ggaauugaguuucgauaga

SEQ ID NO: 1017138 - RNA, 19 nt, Homo sapiens
gaauugaguuucgauagau

SEQ ID NO: 1017139 - RNA, 19 nt, Homo sapiens
aaacccagauuccugugua

SEQ ID NO: 1017140 - RNA, 19 nt, Homo sapiens
gaguuucgauagauugauu

SEQ ID NO: 1017141 - RNA, 19 nt, Homo sapiens
uguaugcacugucuauauu

SEQ ID NO: 1017142 - RNA, 19 nt, Homo sapiens
guacagaugcuauuuagag

SEQ ID NO: 1017143 - RNA, 19 nt, Homo sapiens
caucucaagugaacuguau

SEQ ID NO: 1017144 - RNA, 19 nt, Homo sapiens
gagagacacaucuuccuuu

SEQ ID NO: 1017145 - RNA, 19 nt, Homo sapiens
gcaguuguguucccagcaa

SEQ ID NO: 1017146 - RNA, 19 nt, Homo sapiens
gguagaggcuagaggaagu

SEQ ID NO: 1017147 - RNA, 19 nt, Homo sapiens
uaagggagauuguauaccu

SEQ ID NO: 1017148 - RNA, 19 nt, Homo sapiens
gagauuguauaccuguugu

SEQ ID NO: 1017149 - RNA, 19 nt, Homo sapiens
uuaagagugugauuucuca

SEQ ID NO: 1017150 - RNA, 19 nt, Homo sapiens
acacgucccuugcaaaguc

SEQ ID NO: 1017151 - RNA, 19 nt, Homo sapiens
guguacagaugcuauuuag

SEQ ID NO: 1017152 - RNA, 19 nt, Homo sapiens
gaaaaucgcggaauugagu

SEQ ID NO: 1017153 - RNA, 19 nt, Homo sapiens
gaagggacagcaggaguga

SEQ ID NO: 1017154 - RNA, 19 nt, Homo sapiens
ggagauuguauaccuguug

SEQ ID NO: 1017155 - RNA, 19 nt, Homo sapiens
ccagaagccaguaaagaga

SEQ ID NO: 1017156 - RNA, 19 nt, Homo sapiens
gcuaguaagggagauugua

SEQ ID NO: 1017157 - RNA, 19 nt, Homo sapiens
agagugugauuucucauag

SEQ ID NO: 1017158 - RNA, 19 nt, Homo sapiens
gcgggcaagccucugauuu

SEQ ID NO: 1017159 - RNA, 19 nt, Homo sapiens
guauaaagagagacacauc

SEQ ID NO: 1017160 - RNA, 19 nt, Homo sapiens
cgggcaagccucugauuug

SEQ ID NO: 1017161 - RNA, 19 nt, Homo sapiens
cuucagauccuaccagcaa

SEQ ID NO: 1017162 - RNA, 19 nt, Homo sapiens
aagagugugauuucucaua

SEQ ID NO: 1017163 - RNA, 19 nt, Homo sapiens
gaugcuauuuagagggaau

SEQ ID NO: 1017164 - RNA, 19 nt, Homo sapiens
ccaggagccaccucaauca

SEQ ID NO: 1017165 - RNA, 19 nt, Homo sapiens
gaccaggagccaccucaau

SEQ ID NO: 1017166 - RNA, 19 nt, Homo sapiens
ccaagagaaccuucagauc

SEQ ID NO: 1017167 - RNA, 19 nt, Homo sapiens
uaguaagggagauuguaua

SEQ ID NO: 1017168 - RNA, 19 nt, Homo sapiens
cuaguaagggagauuguau

SEQ ID NO: 1017169 - RNA, 19 nt, Homo sapiens
agacacaucuuccuuuuac

SEQ ID NO: 1017170 - RNA, 19 nt, Homo sapiens
uguguacagaugcuauuua

SEQ ID NO: 1017171 - RNA, 19 nt, Homo sapiens
gcggaauugaguuucgaua

SEQ ID NO: 1017172 - RNA, 19 nt, Homo sapiens
agagaaccuucagauccua

SEQ ID NO: 1017173 - RNA, 19 nt, Homo sapiens
gggagauuguauaccuguu

SEQ ID NO: 1017174 - RNA, 19 nt, Homo sapiens
ugccaagccuuuucucuuu

SEQ ID NO: 1017175 - RNA, 19 nt, Homo sapiens
cuauuuagagggaaucaga

SEQ ID NO: 1017176 - RNA, 19 nt, Homo sapiens
ugacacgucccuugcaaag

SEQ ID NO: 1017177 - RNA, 19 nt, Homo sapiens
agagacacaucuuccuuuu

SEQ ID NO: 1017178 - RNA, 19 nt, Homo sapiens
guaugcacugucuauauug

SEQ ID NO: 1017179 - RNA, 19 nt, Homo sapiens
ugaacuguauagccaaguc

SEQ ID NO: 1017180 - RNA, 19 nt, Homo sapiens
gguauaggggaaucauuua

SEQ ID NO: 1017181 - RNA, 19 nt, Homo sapiens
gccugucccugccugaugu

SEQ ID NO: 1017182 - RNA, 19 nt, Homo sapiens
cagcaggagugaggugaag

SEQ ID NO: 1017183 - RNA, 19 nt, Homo sapiens
gcuguaugcacugucuaua

SEQ ID NO: 1017184 - RNA, 19 nt, Homo sapiens
cauccugaaugcacagucu

SEQ ID NO: 1017185 - RNA, 19 nt, Homo sapiens
aagagaaccuucagauccu

SEQ ID NO: 1017186 - RNA, 19 nt, Homo sapiens
agacagaggggcaguguuu

SEQ ID NO: 1017187 - RNA, 19 nt, Homo sapiens
ggaggccgcuaagcauggu

SEQ ID NO: 1017188 - RNA, 19 nt, Homo sapiens
gcaucucaagugaacugua

SEQ ID NO: 1017189 - RNA, 19 nt, Homo sapiens
gagacacaucuuccuuuua

SEQ ID NO: 1017190 - RNA, 19 nt, Homo sapiens
ucugacacgucccuugcaa

SEQ ID NO: 1017191 - RNA, 19 nt, Homo sapiens
gcucaggcauacuguuucc

SEQ ID NO: 1017192 - RNA, 19 nt, Homo sapiens
ggguauaggggaaucauuu

SEQ ID NO: 1017193 - RNA, 19 nt, Homo sapiens
gaacuguauagccaagucu

SEQ ID NO: 1017194 - RNA, 19 nt, Homo sapiens
ucucauagggcuaguaagg

SEQ ID NO: 1017195 - RNA, 19 nt, Homo sapiens
agagagacacaucuuccuu

SEQ ID NO: 1017196 - RNA, 19 nt, Homo sapiens
gguggaggccgcuaagcau

SEQ ID NO: 1017197 - RNA, 19 nt, Homo sapiens
gagugugauuucucauagg

SEQ ID NO: 1017198 - RNA, 19 nt, Homo sapiens
gaacauuacccuuguauua

SEQ ID NO: 1017199 - RNA, 19 nt, Homo sapiens
gaaaggugauuauuuguga

SEQ ID NO: 1017200 - RNA, 19 nt, Homo sapiens
gagggaagcuuucugguuu

SEQ ID NO: 1017201 - RNA, 19 nt, Homo sapiens
gaaggaaaguuacaguauu

SEQ ID NO: 1017202 - RNA, 19 nt, Homo sapiens
caucagaacucuucaggua

SEQ ID NO: 1017203 - RNA, 19 nt, Homo sapiens
aaagguaacugaugacuaa

SEQ ID NO: 1017204 - RNA, 19 nt, Homo sapiens
guagguaucuggguuuaua

SEQ ID NO: 1017205 - RNA, 19 nt, Homo sapiens
ggaauuagaugagugcuau

SEQ ID NO: 1017206 - RNA, 19 nt, Homo sapiens
uaaagaaggcugcuaauug

SEQ ID NO: 1017207 - RNA, 19 nt, Homo sapiens
uggaaacacuuaacuguaa

SEQ ID NO: 1017208 - RNA, 19 nt, Homo sapiens
gagcagcacuuuguuaugu

SEQ ID NO: 1017209 - RNA, 19 nt, Homo sapiens
uaagauagcacuugaauag

SEQ ID NO: 1017210 - RNA, 19 nt, Homo sapiens
caacugcccugggacauuu

SEQ ID NO: 1017211 - RNA, 19 nt, Homo sapiens
uaacuucgucucacaaaua

SEQ ID NO: 1017212 - RNA, 19 nt, Homo sapiens
gaaguuaagcccugucuga

SEQ ID NO: 1017213 - RNA, 19 nt, Homo sapiens
gguaacugaugacuaaauu

SEQ ID NO: 1017214 - RNA, 19 nt, Homo sapiens
ccacacacaccucaucuua

SEQ ID NO: 1017215 - RNA, 19 nt, Homo sapiens
acacuuaacuguaaugcaa

SEQ ID NO: 1017216 - RNA, 19 nt, Homo sapiens
ggaaagggaucuaaaugac

SEQ ID NO: 1017217 - RNA, 19 nt, Homo sapiens
gcuaaagucuacaccaaug

SEQ ID NO: 1017218 - RNA, 19 nt, Homo sapiens
gcaggagucucaguaauca

SEQ ID NO: 1017219 - RNA, 19 nt, Homo sapiens
cgacauuaauugcaaauag

SEQ ID NO: 1017220 - RNA, 19 nt, Homo sapiens
aaagaaggcugcuaauugg

SEQ ID NO: 1017221 - RNA, 19 nt, Homo sapiens
ggcaugauguggauuuauu

SEQ ID NO: 1017222 - RNA, 19 nt, Homo sapiens
caugacggcuggccaauga

SEQ ID NO: 1017223 - RNA, 19 nt, Homo sapiens
auacgugacugccacaaua

SEQ ID NO: 1017224 - RNA, 19 nt, Homo sapiens
guugaucgcucaugauaau

SEQ ID NO: 1017225 - RNA, 19 nt, Homo sapiens
gcuaaagaacacuggauua

SEQ ID NO: 1017226 - RNA, 19 nt, Homo sapiens
gaaggcugcuaauuggauu

SEQ ID NO: 1017227 - RNA, 19 nt, Homo sapiens
acaaaucccuguaugacaa

SEQ ID NO: 1017228 - RNA, 19 nt, Homo sapiens
ggaaguaucuuugcaagcu

SEQ ID NO: 1017229 - RNA, 19 nt, Homo sapiens
gaauccagcucuagucagu

SEQ ID NO: 1017230 - RNA, 19 nt, Homo sapiens
uaccaaaguccacuaaaua

SEQ ID NO: 1017231 - RNA, 19 nt, Homo sapiens
agauagcacuugaauagaa

SEQ ID NO: 1017232 - RNA, 19 nt, Homo sapiens
ggaucuaaaugacaucaga

SEQ ID NO: 1017233 - RNA, 19 nt, Homo sapiens
gcaauaccaguagaaguua

SEQ ID NO: 1017234 - RNA, 19 nt, Homo sapiens
gaaagaagcaaacaaacag

SEQ ID NO: 1017235 - RNA, 19 nt, Homo sapiens
gcaccaggaagacugaaua

SEQ ID NO: 1017236 - RNA, 19 nt, Homo sapiens
gaauacuggaccaucauua

SEQ ID NO: 1017237 - RNA, 19 nt, Homo sapiens
ggucagugcuagaauaaag

SEQ ID NO: 1017238 - RNA, 19 nt, Homo sapiens
ggaaacacuuaacuguaau

SEQ ID NO: 1017239 - RNA, 19 nt, Homo sapiens
gacccagacugcuuuguga

SEQ ID NO: 1017240 - RNA, 19 nt, Homo sapiens
auaaagauguuguggguau

SEQ ID NO: 1017241 - RNA, 19 nt, Homo sapiens
gaacauaauauagcucaga

SEQ ID NO: 1017242 - RNA, 19 nt, Homo sapiens
acacacaccucaucuuaca

SEQ ID NO: 1017243 - RNA, 19 nt, Homo sapiens
cccauuucauugaguauua

SEQ ID NO: 1017244 - RNA, 19 nt, Homo sapiens
agaggucagugcuagaaua

SEQ ID NO: 1017245 - RNA, 19 nt, Homo sapiens
acucacaacugcuagcuuu

SEQ ID NO: 1017246 - RNA, 19 nt, Homo sapiens
cuaaagaacacuggauuaa

SEQ ID NO: 1017247 - RNA, 19 nt, Homo sapiens
guaagaacacucacucaug

SEQ ID NO: 1017248 - RNA, 19 nt, Homo sapiens
caauaugcaucgaagacaa

SEQ ID NO: 1017249 - RNA, 19 nt, Homo sapiens
gggaagcuuucugguuuaa

SEQ ID NO: 1017250 - RNA, 19 nt, Homo sapiens
caccucaucuuacacacua

SEQ ID NO: 1017251 - RNA, 19 nt, Homo sapiens
gcaaguauggugcuaaagu

SEQ ID NO: 1017252 - RNA, 19 nt, Homo sapiens
gcaugauguggauuuauua

SEQ ID NO: 1017253 - RNA, 19 nt, Homo sapiens
aggcaaagguaacugauga

SEQ ID NO: 1017254 - RNA, 19 nt, Homo sapiens
agugugaacuaccuuuaua

SEQ ID NO: 1017255 - RNA, 19 nt, Homo sapiens
gacaugaagcuauggguaa

SEQ ID NO: 1017256 - RNA, 19 nt, Homo sapiens
ggcaauaccaguagaaguu

SEQ ID NO: 1017257 - RNA, 19 nt, Homo sapiens
caaauaugcagauuacuuc

SEQ ID NO: 1017258 - RNA, 19 nt, Homo sapiens
ccaaauaugcagauuacuu

SEQ ID NO: 1017259 - RNA, 19 nt, Homo sapiens
ggccaaauaugcagauuac

SEQ ID NO: 1017260 - RNA, 19 nt, Homo sapiens
cgaaacagaucuucaugac

SEQ ID NO: 1017261 - RNA, 19 nt, Homo sapiens
gaagcuuucugguuuaaaa

SEQ ID NO: 1017262 - RNA, 19 nt, Homo sapiens
gaauaaaguccuguagguu

SEQ ID NO: 1017263 - RNA, 19 nt, Homo sapiens
gaagugguaguuccuguga

SEQ ID NO: 1017264 - RNA, 19 nt, Homo sapiens
gaauuuguacuacuuggaa

SEQ ID NO: 1017265 - RNA, 19 nt, Homo sapiens
ugauuacuauugcugcaua

SEQ ID NO: 1017266 - RNA, 19 nt, Homo sapiens
guggguagcuucugucagu

SEQ ID NO: 1017267 - RNA, 19 nt, Homo sapiens
ggagggaagcuuucugguu

SEQ ID NO: 1017268 - RNA, 19 nt, Homo sapiens
agacuucaauuugccauuu

SEQ ID NO: 1017269 - RNA, 19 nt, Homo sapiens
ccaaaguccacuaaauaaa

SEQ ID NO: 1017270 - RNA, 19 nt, Homo sapiens
ugagaauacuggaccauca

SEQ ID NO: 1017271 - RNA, 19 nt, Homo sapiens
aauguuggcuucuaaguca

SEQ ID NO: 1017272 - RNA, 19 nt, Homo sapiens
uaaaugacaucagaacucu

SEQ ID NO: 1017273 - RNA, 19 nt, Homo sapiens
caauaccaguagaaguuaa

SEQ ID NO: 1017274 - RNA, 19 nt, Homo sapiens
cuacaccaauggaauuaga

SEQ ID NO: 1017275 - RNA, 19 nt, Homo sapiens
gugcuaaagucuacaccaa

SEQ ID NO: 1017276 - RNA, 19 nt, Homo sapiens
caaguauggugcuaaaguc

SEQ ID NO: 1017277 - RNA, 19 nt, Homo sapiens
uuaccaaaguccacuaaau

SEQ ID NO: 1017278 - RNA, 19 nt, Homo sapiens
uggagaaccagaacuauuu

SEQ ID NO: 1017279 - RNA, 19 nt, Homo sapiens
aauaaaguccuguagguuu

SEQ ID NO: 1017280 - RNA, 19 nt, Homo sapiens
agaauaaaguccuguaggu

SEQ ID NO: 1017281 - RNA, 19 nt, Homo sapiens
gaggucagugcuagaauaa

SEQ ID NO: 1017282 - RNA, 19 nt, Homo sapiens
gaaagggaucuaaaugaca

SEQ ID NO: 1017283 - RNA, 19 nt, Homo sapiens
gaucccaacuugaaacaac

SEQ ID NO: 1017284 - RNA, 19 nt, Homo sapiens
uuaacuaccucaauaaugc

SEQ ID NO: 1017285 - RNA, 19 nt, Homo sapiens
gauagcacuugaauagaag

SEQ ID NO: 1017286 - RNA, 19 nt, Homo sapiens
gauuauacuucgucuuucu

SEQ ID NO: 1017287 - RNA, 19 nt, Homo sapiens
cgaagacaaacuuacuaua

SEQ ID NO: 1017288 - RNA, 19 nt, Homo sapiens
acauuuaacucagggaauu

SEQ ID NO: 1017289 - RNA, 19 nt, Homo sapiens
ccugcuggcuuccaaacua

SEQ ID NO: 1017290 - RNA, 19 nt, Homo sapiens
guacagacugcaaaccaaa

SEQ ID NO: 1017291 - RNA, 19 nt, Homo sapiens
guaacuuaaugucuuguca

SEQ ID NO: 1017292 - RNA, 19 nt, Homo sapiens
gaauguggguggguagcuu

SEQ ID NO: 1017293 - RNA, 19 nt, Homo sapiens
gcagcaggagucucaguaa

SEQ ID NO: 1017294 - RNA, 19 nt, Homo sapiens
cauaauauagcucagaaug

SEQ ID NO: 1017295 - RNA, 19 nt, Homo sapiens
ggaaaagacuaaacucuac

SEQ ID NO: 1017296 - RNA, 19 nt, Homo sapiens
ucacaaauaguguagguau

SEQ ID NO: 1017297 - RNA, 19 nt, Homo sapiens
gcaaauuaacaguauguca

SEQ ID NO: 1017298 - RNA, 19 nt, Homo sapiens
gaaauuaguucugagguua

SEQ ID NO: 1017299 - RNA, 19 nt, Homo sapiens
ggaggaagaugcugcagua

SEQ ID NO: 1017300 - RNA, 19 nt, Homo sapiens
ugugauagaugcugauuua

SEQ ID NO: 1017301 - RNA, 19 nt, Homo sapiens
gcaagaaguucaagugugu

SEQ ID NO: 1017302 - RNA, 19 nt, Homo sapiens
gggcuucuguuguauuaua

SEQ ID NO: 1017303 - RNA, 19 nt, Homo sapiens
ucucagggcuucuguugua

SEQ ID NO: 1017304 - RNA, 19 nt, Homo sapiens
guucugagguuaucauaug

SEQ ID NO: 1017305 - RNA, 19 nt, Homo sapiens
gauagaugcugauuuagag

SEQ ID NO: 1017306 - RNA, 19 nt, Homo sapiens
ggagcaaagugacauuguu

SEQ ID NO: 1017307 - RNA, 19 nt, Homo sapiens
ccaccgagcuccuggucua

SEQ ID NO: 1017308 - RNA, 19 nt, Homo sapiens
aaagugacauuguucaaga

SEQ ID NO: 1017309 - RNA, 19 nt, Homo sapiens
gaacagaugggaaauggau

SEQ ID NO: 1017310 - RNA, 19 nt, Homo sapiens
gagccucgcuucucucuag

SEQ ID NO: 1017311 - RNA, 19 nt, Homo sapiens
ugacauuguucaagaagaa

SEQ ID NO: 1017312 - RNA, 19 nt, Homo sapiens
cagggcuucuguuguauua

SEQ ID NO: 1017313 - RNA, 19 nt, Homo sapiens
caagggaacuacaccuguu

SEQ ID NO: 1017314 - RNA, 19 nt, Homo sapiens
gagguuaucauaugccuuu

SEQ ID NO: 1017315 - RNA, 19 nt, Homo sapiens
gcagugaggagcaaaguga

SEQ ID NO: 1017316 - RNA, 19 nt, Homo sapiens
caauaagugccaacugaua

SEQ ID NO: 1017317 - RNA, 19 nt, Homo sapiens
ccaccucccugcacauuga

SEQ ID NO: 1017318 - RNA, 19 nt, Homo sapiens
gcaauaacccaugcacuga

SEQ ID NO: 1017319 - RNA, 19 nt, Homo sapiens
ggagggagcacgugagaga

SEQ ID NO: 1017320 - RNA, 19 nt, Homo sapiens
gaaaucuggcugaguguga

SEQ ID NO: 1017321 - RNA, 19 nt, Homo sapiens
caucuuuccuuccauguau

SEQ ID NO: 1017322 - RNA, 19 nt, Homo sapiens
ccagguugaucuacuguga

SEQ ID NO: 1017323 - RNA, 19 nt, Homo sapiens
gaacagaggucaggaaaac

SEQ ID NO: 1017324 - RNA, 19 nt, Homo sapiens
gagaaguuaugagaauguu

SEQ ID NO: 1017325 - RNA, 19 nt, Homo sapiens
ugcaauaagugccaacuga

SEQ ID NO: 1017326 - RNA, 19 nt, Homo sapiens
ggcaacaucucgggacuga

SEQ ID NO: 1017327 - RNA, 19 nt, Homo sapiens
gcacugagacuuagaaaau

SEQ ID NO: 1017328 - RNA, 19 nt, Homo sapiens
gaagagccaggagguguaa

SEQ ID NO: 1017329 - RNA, 19 nt, Homo sapiens
gcaucaggaucguucaugu

SEQ ID NO: 1017330 - RNA, 19 nt, Homo sapiens
gccaggaacugcugcaaag

SEQ ID NO: 1017331 - RNA, 19 nt, Homo sapiens
gagaggaguugccaaaaga

SEQ ID NO: 1017332 - RNA, 19 nt, Homo sapiens
gagccugucuuccuucucu

SEQ ID NO: 1017333 - RNA, 19 nt, Homo sapiens
ggaucccgcuccuguuguu

SEQ ID NO: 1017334 - RNA, 19 nt, Homo sapiens
gcagcuccuucuccauuau

SEQ ID NO: 1017335 - RNA, 19 nt, Homo sapiens
gcaaagugacauuguucaa

SEQ ID NO: 1017336 - RNA, 19 nt, Homo sapiens
gaauguuacucugcacugu

SEQ ID NO: 1017337 - RNA, 19 nt, Homo sapiens
gaaaacacaagauggaaaa

SEQ ID NO: 1017338 - RNA, 19 nt, Homo sapiens
gagcaaagugacauuguuc

SEQ ID NO: 1017339 - RNA, 19 nt, Homo sapiens
ugaaucagcucagcaagag

SEQ ID NO: 1017340 - RNA, 19 nt, Homo sapiens
gaaguuaugagaauguuac

SEQ ID NO: 1017341 - RNA, 19 nt, Homo sapiens
gaacuccacccucacuauc

SEQ ID NO: 1017342 - RNA, 19 nt, Homo sapiens
acacacaucuuuccuucca

SEQ ID NO: 1017343 - RNA, 19 nt, Homo sapiens
ggagaaguuaugagaaugu

SEQ ID NO: 1017344 - RNA, 19 nt, Homo sapiens
caaaagaaauaccuaagca

SEQ ID NO: 1017345 - RNA, 19 nt, Homo sapiens
guuacaagccacauaguug

SEQ ID NO: 1017346 - RNA, 19 nt, Homo sapiens
aaaucauccuuacuaggua

SEQ ID NO: 1017347 - RNA, 19 nt, Homo sapiens
uagaacagaugggaaaugg

SEQ ID NO: 1017348 - RNA, 19 nt, Homo sapiens
aggaacugcugcaaagaaa

SEQ ID NO: 1017349 - RNA, 19 nt, Homo sapiens
gggaacagaggucaggaaa

SEQ ID NO: 1017350 - RNA, 19 nt, Homo sapiens
agguugaucuacugugaua

SEQ ID NO: 1017351 - RNA, 19 nt, Homo sapiens
gaaguucaaguguguuaca

SEQ ID NO: 1017352 - RNA, 19 nt, Homo sapiens
gcaauaagugccaacugau

SEQ ID NO: 1017353 - RNA, 19 nt, Homo sapiens
gcucuucauucagcuuuga

SEQ ID NO: 1017354 - RNA, 19 nt, Homo sapiens
ugauagaugcugauuuaga

SEQ ID NO: 1017355 - RNA, 19 nt, Homo sapiens
gguuugauuugcucuaagu

SEQ ID NO: 1017356 - RNA, 19 nt, Homo sapiens
uggaggcuguugucauuug

SEQ ID NO: 1017357 - RNA, 19 nt, Homo sapiens
gggcuugcacuaacaaugu

SEQ ID NO: 1017358 - RNA, 19 nt, Homo sapiens
guugucauuuggagaaguu

SEQ ID NO: 1017359 - RNA, 19 nt, Homo sapiens
gggccaagguagaggaagu

SEQ ID NO: 1017360 - RNA, 19 nt, Homo sapiens
gcucuaaguuuucccaaug

SEQ ID NO: 1017361 - RNA, 19 nt, Homo sapiens
uaagugccaacugauauuu

SEQ ID NO: 1017362 - RNA, 19 nt, Homo sapiens
aauaacccaugcacugaga

SEQ ID NO: 1017363 - RNA, 19 nt, Homo sapiens
auuggaggcuguugucauu

SEQ ID NO: 1017364 - RNA, 19 nt, Homo sapiens
uuggagaaguuaugagaau

SEQ ID NO: 1017365 - RNA, 19 nt, Homo sapiens
ggaguugccaaaagaaaua

SEQ ID NO: 1017366 - RNA, 19 nt, Homo sapiens
agagagaggaguugccaaa

SEQ ID NO: 1017367 - RNA, 19 nt, Homo sapiens
gucccucccuucucucuga

SEQ ID NO: 1017368 - RNA, 19 nt, Homo sapiens
aagaaguucaaguguguua

SEQ ID NO: 1017369 - RNA, 19 nt, Homo sapiens
caacggcacccucuaugca

SEQ ID NO: 1017370 - RNA, 19 nt, Homo sapiens
caggaacugcugcaaagaa

SEQ ID NO: 1017371 - RNA, 19 nt, Homo sapiens
aaaccaagcacacacaucu

SEQ ID NO: 1017372 - RNA, 19 nt, Homo sapiens
gcuuggagagcuacauuga

SEQ ID NO: 1017373 - RNA, 19 nt, Homo sapiens
ugacagcagugaggagcaa

SEQ ID NO: 1017374 - RNA, 19 nt, Homo sapiens
ucguucauguugcagcuua

SEQ ID NO: 1017375 - RNA, 19 nt, Homo sapiens
aagcagcuccuucuccauu

SEQ ID NO: 1017376 - RNA, 19 nt, Homo sapiens
uuggagagcuacauugaag

SEQ ID NO: 1017377 - RNA, 19 nt, Homo sapiens
acauagaacagaugggaaa

SEQ ID NO: 1017378 - RNA, 19 nt, Homo sapiens
gcuccuucuccauuauuua

SEQ ID NO: 1017379 - RNA, 19 nt, Homo sapiens
aauaagugccaacugauau

SEQ ID NO: 1017380 - RNA, 19 nt, Homo sapiens
ucgcuucucucuaguggau

SEQ ID NO: 1017381 - RNA, 19 nt, Homo sapiens
gcaggaccacauucacaga

SEQ ID NO: 1017382 - RNA, 19 nt, Homo sapiens
gcuguugucauuuggagaa

SEQ ID NO: 1017383 - RNA, 19 nt, Homo sapiens
ggacaaaacauggaugaug

SEQ ID NO: 1017384 - RNA, 19 nt, Homo sapiens
uagcagccgccaucucauu

SEQ ID NO: 1017385 - RNA, 19 nt, Homo sapiens
caggaucguucauguugca

SEQ ID NO: 1017386 - RNA, 19 nt, Homo sapiens
ccgagcuccuggucuacua

SEQ ID NO: 1017387 - RNA, 19 nt, Homo sapiens
caacucggagccugucuuc

SEQ ID NO: 1017388 - RNA, 19 nt, Homo sapiens
gggagguugggagaaauua

SEQ ID NO: 1017389 - RNA, 19 nt, Homo sapiens
gcugugaauccuggcuuua

SEQ ID NO: 1017390 - RNA, 19 nt, Homo sapiens
guuaugagaauguuacucu

SEQ ID NO: 1017391 - RNA, 19 nt, Homo sapiens
gggacuggccauuaucuca

SEQ ID NO: 1017392 - RNA, 19 nt, Homo sapiens
gggauugugggaaccauug

SEQ ID NO: 1017393 - RNA, 19 nt, Homo sapiens
gcaagagacaucgaaaggu

SEQ ID NO: 1017394 - RNA, 19 nt, Homo sapiens
ugaaugugacucagugguu

SEQ ID NO: 1017395 - RNA, 19 nt, Homo sapiens
ggaaaacacaagauggaaa

SEQ ID NO: 1017396 - RNA, 19 nt, Homo sapiens
caaagugacauuguucaag

SEQ ID NO: 1017397 - RNA, 19 nt, Homo sapiens
ccuagcagccgccaucuca

SEQ ID NO: 1017398 - RNA, 19 nt, Homo sapiens
ggaauauccugccauagua

SEQ ID NO: 1017399 - RNA, 19 nt, Homo sapiens
gcaaagacauuguuucagu

SEQ ID NO: 1017400 - RNA, 19 nt, Homo sapiens
gaaccuaucauguuaguuu

SEQ ID NO: 1017401 - RNA, 19 nt, Homo sapiens
guacauggauuaucugugu

SEQ ID NO: 1017402 - RNA, 19 nt, Homo sapiens
ucucucagcugauuaauuu

SEQ ID NO: 1017403 - RNA, 19 nt, Homo sapiens
ugacauggaugcacugaaa

SEQ ID NO: 1017404 - RNA, 19 nt, Homo sapiens
auacugagcuuauagacua

SEQ ID NO: 1017405 - RNA, 19 nt, Homo sapiens
ggauggaauucauggcuua

SEQ ID NO: 1017406 - RNA, 19 nt, Homo sapiens
ccaugaagcuguaagaaug

SEQ ID NO: 1017407 - RNA, 19 nt, Homo sapiens
gcacucagcucuucagcau

SEQ ID NO: 1017408 - RNA, 19 nt, Homo sapiens
guuaugcacuuuacccuuu

SEQ ID NO: 1017409 - RNA, 19 nt, Homo sapiens
aagugaagcugcaauguaa

SEQ ID NO: 1017410 - RNA, 19 nt, Homo sapiens
ugugaaaucuggcaaagaa

SEQ ID NO: 1017411 - RNA, 19 nt, Homo sapiens
gccagcagcucgcucagua

SEQ ID NO: 1017412 - RNA, 19 nt, Homo sapiens
ggaaggauacauagugauu

SEQ ID NO: 1017413 - RNA, 19 nt, Homo sapiens
ggaaugaugagccugcaua

SEQ ID NO: 1017414 - RNA, 19 nt, Homo sapiens
caaagacauuguuucaguu

SEQ ID NO: 1017415 - RNA, 19 nt, Homo sapiens
ggaguggaguauuauguga

SEQ ID NO: 1017416 - RNA, 19 nt, Homo sapiens
uaacugaggcguuucugua

SEQ ID NO: 1017417 - RNA, 19 nt, Homo sapiens
gaugaccaguuacacaauu

SEQ ID NO: 1017418 - RNA, 19 nt, Homo sapiens
gaaauauucuuuggcauac

SEQ ID NO: 1017419 - RNA, 19 nt, Homo sapiens
gagcaaagacauuguuuca

SEQ ID NO: 1017420 - RNA, 19 nt, Homo sapiens
gguuuaaucuuaugaguag

SEQ ID NO: 1017421 - RNA, 19 nt, Homo sapiens
uauauuggcuucaguaucu

SEQ ID NO: 1017422 - RNA, 19 nt, Homo sapiens
gcaugucucuuccuucugu

SEQ ID NO: 1017423 - RNA, 19 nt, Homo sapiens
ugaauuaucaucggcauua

SEQ ID NO: 1017424 - RNA, 19 nt, Homo sapiens
ccuugaaccuaucauguua

SEQ ID NO: 1017425 - RNA, 19 nt, Homo sapiens
gaugucugaucuccgaaua

SEQ ID NO: 1017426 - RNA, 19 nt, Homo sapiens
ccgaauaacugaggcguuu

SEQ ID NO: 1017427 - RNA, 19 nt, Homo sapiens
uuaaucaccuuaucaggaa

SEQ ID NO: 1017428 - RNA, 19 nt, Homo sapiens
ggaaaacgcuggauucuac

SEQ ID NO: 1017429 - RNA, 19 nt, Homo sapiens
ugacaaagauaacaaagac

SEQ ID NO: 1017430 - RNA, 19 nt, Homo sapiens
gaaagacucacaagaccuu

SEQ ID NO: 1017431 - RNA, 19 nt, Homo sapiens
cuaagcaucucuucuauac

SEQ ID NO: 1017432 - RNA, 19 nt, Homo sapiens
acucucaucucucuauuaa

SEQ ID NO: 1017433 - RNA, 19 nt, Homo sapiens
agggauaaauguacaguuu

SEQ ID NO: 1017434 - RNA, 19 nt, Homo sapiens
uaacaaagacagaaucauc

SEQ ID NO: 1017435 - RNA, 19 nt, Homo sapiens
guuugggaguggaguauua

SEQ ID NO: 1017436 - RNA, 19 nt, Homo sapiens
gaauuaucaucggcauuaa

SEQ ID NO: 1017437 - RNA, 19 nt, Homo sapiens
caggaaggauacauaguga

SEQ ID NO: 1017438 - RNA, 19 nt, Homo sapiens
cuaaguggccaaaugauaa

SEQ ID NO: 1017439 - RNA, 19 nt, Homo sapiens
gauuacaucugaagucucu

SEQ ID NO: 1017440 - RNA, 19 nt, Homo sapiens
gaaucaggaaggauacaua

SEQ ID NO: 1017441 - RNA, 19 nt, Homo sapiens
ucucaucucucuauuaaag

SEQ ID NO: 1017442 - RNA, 19 nt, Homo sapiens
uuuagaagcugcuagaaau

SEQ ID NO: 1017443 - RNA, 19 nt, Homo sapiens
ggcauacuuuguagacuuu

SEQ ID NO: 1017444 - RNA, 19 nt, Homo sapiens
ugauucgagucuucaaaua

SEQ ID NO: 1017445 - RNA, 19 nt, Homo sapiens
gaauauccugccauaguaa

SEQ ID NO: 1017446 - RNA, 19 nt, Homo sapiens
guucuaagcaucucuucua

SEQ ID NO: 1017447 - RNA, 19 nt, Homo sapiens
caaaaggccuugaaccuau

SEQ ID NO: 1017448 - RNA, 19 nt, Homo sapiens
ccucacagguucuggcaaa

SEQ ID NO: 1017449 - RNA, 19 nt, Homo sapiens
uguagacuuugaccacuua

SEQ ID NO: 1017450 - RNA, 19 nt, Homo sapiens
uuaaugccuuccucuagua

SEQ ID NO: 1017451 - RNA, 19 nt, Homo sapiens
cugauaacauccggaaaua

SEQ ID NO: 1017452 - RNA, 19 nt, Homo sapiens
agaaugccaucuugaaugu

SEQ ID NO: 1017453 - RNA, 19 nt, Homo sapiens
ggauacauagugauucgua

SEQ ID NO: 1017454 - RNA, 19 nt, Homo sapiens
gcauagggauaaauguaca

SEQ ID NO: 1017455 - RNA, 19 nt, Homo sapiens
gggcugcagcaaauaaaua

SEQ ID NO: 1017456 - RNA, 19 nt, Homo sapiens
aaagugaagcugcaaugua

SEQ ID NO: 1017457 - RNA, 19 nt, Homo sapiens
gagagugguuagaggaaau

SEQ ID NO: 1017458 - RNA, 19 nt, Homo sapiens
uccaaacucugcagugaaa

SEQ ID NO: 1017459 - RNA, 19 nt, Homo sapiens
gaggcaaguuacacaaugu

SEQ ID NO: 1017460 - RNA, 19 nt, Homo sapiens
cuguagaucagaugaauua

SEQ ID NO: 1017461 - RNA, 19 nt, Homo sapiens
aaugccaucuugaauguaa

SEQ ID NO: 1017462 - RNA, 19 nt, Homo sapiens
aaaccagucuguuguccaa

SEQ ID NO: 1017463 - RNA, 19 nt, Homo sapiens
ccacagacucacacuauau

SEQ ID NO: 1017464 - RNA, 19 nt, Homo sapiens
uaagauggcauggauuuga

SEQ ID NO: 1017465 - RNA, 19 nt, Homo sapiens
gaaugaugagccugcauaa

SEQ ID NO: 1017466 - RNA, 19 nt, Homo sapiens
guuaaugccuuccucuagu

SEQ ID NO: 1017467 - RNA, 19 nt, Homo sapiens
gguuuaagauggcauggau

SEQ ID NO: 1017468 - RNA, 19 nt, Homo sapiens
auucauggcuuauggaaau

SEQ ID NO: 1017469 - RNA, 19 nt, Homo sapiens
gauaacauccggaaauacu

SEQ ID NO: 1017470 - RNA, 19 nt, Homo sapiens
cauagugauucguauacaa

SEQ ID NO: 1017471 - RNA, 19 nt, Homo sapiens
gauaacaaagacagaauca

SEQ ID NO: 1017472 - RNA, 19 nt, Homo sapiens
gcuuuaggcugccggaugu

SEQ ID NO: 1017473 - RNA, 19 nt, Homo sapiens
cacacuauauuacagaaug

SEQ ID NO: 1017474 - RNA, 19 nt, Homo sapiens
aauacuaaguggccaaaug

SEQ ID NO: 1017475 - RNA, 19 nt, Homo sapiens
cagaugaaauauucuuugg

SEQ ID NO: 1017476 - RNA, 19 nt, Homo sapiens
gcugauaacauccggaaau

SEQ ID NO: 1017477 - RNA, 19 nt, Homo sapiens
gauagacuucagacccuua

SEQ ID NO: 1017478 - RNA, 19 nt, Homo sapiens
aagcaucucuucuauacuc

SEQ ID NO: 1017479 - RNA, 19 nt, Homo sapiens
ccacaguuaugcacuuuac

SEQ ID NO: 1017480 - RNA, 19 nt, Homo sapiens
caucaaacacuucuuuaag

SEQ ID NO: 1017481 - RNA, 19 nt, Homo sapiens
gacuguauuugauugauuc

SEQ ID NO: 1017482 - RNA, 19 nt, Homo sapiens
gaggaaauuuagguacaau

SEQ ID NO: 1017483 - RNA, 19 nt, Homo sapiens
uagaggaaauuuagguaca

SEQ ID NO: 1017484 - RNA, 19 nt, Homo sapiens
aauaugaccugguuugcau

SEQ ID NO: 1017485 - RNA, 19 nt, Homo sapiens
gaaaacaggcucccaaaag

SEQ ID NO: 1017486 - RNA, 19 nt, Homo sapiens
gcagcucgcucaguacaag

SEQ ID NO: 1017487 - RNA, 19 nt, Homo sapiens
gaccacagguuuuaguauu

SEQ ID NO: 1017488 - RNA, 19 nt, Homo sapiens
gauucgagucuucaaauau

SEQ ID NO: 1017489 - RNA, 19 nt, Homo sapiens
gcauuaacgucaaguacac

SEQ ID NO: 1017490 - RNA, 19 nt, Homo sapiens
ugaaagacagcuucucuca

SEQ ID NO: 1017491 - RNA, 19 nt, Homo sapiens
ucaugaaucaggaaggaua

SEQ ID NO: 1017492 - RNA, 19 nt, Homo sapiens
ugaugagccugcauaaagu

SEQ ID NO: 1017493 - RNA, 19 nt, Homo sapiens
gaauucauggcuuauggaa

SEQ ID NO: 1017494 - RNA, 19 nt, Homo sapiens
ucuauacucugugcugaaa

SEQ ID NO: 1017495 - RNA, 19 nt, Homo sapiens
gcuguaagaaugugaaauc

SEQ ID NO: 1017496 - RNA, 19 nt, Homo sapiens
uaacgucaaguacacacua

SEQ ID NO: 1017497 - RNA, 19 nt, Homo sapiens
gugaauauucuguagauca

SEQ ID NO: 1017498 - RNA, 19 nt, Homo sapiens
gcaauagccucccugauau

SEQ ID NO: 1017499 - RNA, 19 nt, Homo sapiens
ccacugaguucaaccguua

SEQ ID NO: 1017500 - RNA, 19 nt, Homo sapiens
gaagagacguugaagaaac

SEQ ID NO: 1017501 - RNA, 19 nt, Homo sapiens
ggucaaacaucgagacaug

SEQ ID NO: 1017502 - RNA, 19 nt, Homo sapiens
cagaugauguguaugacua

SEQ ID NO: 1017503 - RNA, 19 nt, Homo sapiens
cagaguacaucuccacuga

SEQ ID NO: 1017504 - RNA, 19 nt, Homo sapiens
ggaguggucugccgaguca

SEQ ID NO: 1017505 - RNA, 19 nt, Homo sapiens
gaaaccaggguccgccuua

SEQ ID NO: 1017506 - RNA, 19 nt, Homo sapiens
gcagugaugcugauucuga

SEQ ID NO: 1017507 - RNA, 19 nt, Homo sapiens
uagaagagacguugaagaa

SEQ ID NO: 1017508 - RNA, 19 nt, Homo sapiens
guuauggcaucuccaauga

SEQ ID NO: 1017509 - RNA, 19 nt, Homo sapiens
gugcucaggugaucuuuga

SEQ ID NO: 1017510 - RNA, 19 nt, Homo sapiens
cgagucaaguacugcaaua

SEQ ID NO: 1017511 - RNA, 19 nt, Homo sapiens
agaaacagcacaaacauga

SEQ ID NO: 1017512 - RNA, 19 nt, Homo sapiens
ugcaauagccucccugaua

SEQ ID NO: 1017513 - RNA, 19 nt, Homo sapiens
aagaggagauggagacaga

SEQ ID NO: 1017514 - RNA, 19 nt, Homo sapiens
aaaucaaucucacagcauu

SEQ ID NO: 1017515 - RNA, 19 nt, Homo sapiens
agaacaggaucguccagua

SEQ ID NO: 1017516 - RNA, 19 nt, Homo sapiens
gaguacaucuccacugagu

SEQ ID NO: 1017517 - RNA, 19 nt, Homo sapiens
caccaucgaucucaucaau

SEQ ID NO: 1017518 - RNA, 19 nt, Homo sapiens
aacaugaccuccugacuga

SEQ ID NO: 1017519 - RNA, 19 nt, Homo sapiens
gaucacagccauugagaag

SEQ ID NO: 1017520 - RNA, 19 nt, Homo sapiens
guacaucuccacugaguuc

SEQ ID NO: 1017521 - RNA, 19 nt, Homo sapiens
gcagugacaaugauucaga

SEQ ID NO: 1017522 - RNA, 19 nt, Homo sapiens
ggagacagaagagaaagaa

SEQ ID NO: 1017523 - RNA, 19 nt, Homo sapiens
ccagugaagcugauaguga

SEQ ID NO: 1017524 - RNA, 19 nt, Homo sapiens
ucagacaccauuauuguga

SEQ ID NO: 1017525 - RNA, 19 nt, Homo sapiens
gauggagacagaagagaaa

SEQ ID NO: 1017526 - RNA, 19 nt, Homo sapiens
ggagaaacagcacaaacau

SEQ ID NO: 1017527 - RNA, 19 nt, Homo sapiens
gaacaggaucguccaguac

SEQ ID NO: 1017528 - RNA, 19 nt, Homo sapiens
ccaggaggauggcagugaa

SEQ ID NO: 1017529 - RNA, 19 nt, Homo sapiens
ggagaucuuuggcagugau

SEQ ID NO: 1017530 - RNA, 19 nt, Homo sapiens
cgaggaagaaauauacaaa

SEQ ID NO: 1017531 - RNA, 19 nt, Homo sapiens
agauccagcugaugagaaa

SEQ ID NO: 1017532 - RNA, 19 nt, Homo sapiens
ccacuuccuuggagaaaca

SEQ ID NO: 1017533 - RNA, 19 nt, Homo sapiens
gaaggagggcagugaagau

SEQ ID NO: 1017534 - RNA, 19 nt, Homo sapiens
agacaugaaugagaaggaa

SEQ ID NO: 1017535 - RNA, 19 nt, Homo sapiens
guucagacaccauuauugu

SEQ ID NO: 1017536 - RNA, 19 nt, Homo sapiens
ggacgaggccagugacaag

SEQ ID NO: 1017537 - RNA, 19 nt, Homo sapiens
gaaaacuacuucuucaucu

SEQ ID NO: 1017538 - RNA, 19 nt, Homo sapiens
caccagaugauguguauga

SEQ ID NO: 1017539 - RNA, 19 nt, Homo sapiens
gauggacuaugcaccagau

SEQ ID NO: 1017540 - RNA, 19 nt, Homo sapiens
gaaccaguuuguggccuau

SEQ ID NO: 1017541 - RNA, 19 nt, Homo sapiens
gagaaacagcacaaacaug

SEQ ID NO: 1017542 - RNA, 19 nt, Homo sapiens
gcagcugcguuggagauga

SEQ ID NO: 1017543 - RNA, 19 nt, Homo sapiens
ggagggcagugaagaugag

SEQ ID NO: 1017544 - RNA, 19 nt, Homo sapiens
gaggaaaacuacuucuuca

SEQ ID NO: 1017545 - RNA, 19 nt, Homo sapiens
ggacuaugcaccagaugau

SEQ ID NO: 1017546 - RNA, 19 nt, Homo sapiens
uuuaagauguggaucaauc

SEQ ID NO: 1017547 - RNA, 19 nt, Homo sapiens
gaaaucaaucucacagcau

SEQ ID NO: 1017548 - RNA, 19 nt, Homo sapiens
ucacagccauugagaagac

SEQ ID NO: 1017549 - RNA, 19 nt, Homo sapiens
agacagggauagccagauc

SEQ ID NO: 1017550 - RNA, 19 nt, Homo sapiens
gccuuucacuuguuuguuc

SEQ ID NO: 1017551 - RNA, 19 nt, Homo sapiens
gaaugagaaggaacuggaa

SEQ ID NO: 1017552 - RNA, 19 nt, Homo sapiens
ggacgaugccgacucugau

SEQ ID NO: 1017553 - RNA, 19 nt, Homo sapiens
aaacaucgagacaugaaug

SEQ ID NO: 1017554 - RNA, 19 nt, Homo sapiens
ucaaacaucgagacaugaa

SEQ ID NO: 1017555 - RNA, 19 nt, Homo sapiens
cgaagguggugccauggau

SEQ ID NO: 1017556 - RNA, 19 nt, Homo sapiens
ucagacagcggcagcaaug

SEQ ID NO: 1017557 - RNA, 19 nt, Homo sapiens
guagaagagacguugaaga

SEQ ID NO: 1017558 - RNA, 19 nt, Homo sapiens
ugaggaagggaaccaguuu

SEQ ID NO: 1017559 - RNA, 19 nt, Homo sapiens
gaggaugcccagaaaucaa

SEQ ID NO: 1017560 - RNA, 19 nt, Homo sapiens
ggaagaaauauacaaagac

SEQ ID NO: 1017561 - RNA, 19 nt, Homo sapiens
gcaguuuaccgaggaagaa

SEQ ID NO: 1017562 - RNA, 19 nt, Homo sapiens
cagaugaggagcaggagaa

SEQ ID NO: 1017563 - RNA, 19 nt, Homo sapiens
ggaagaggaagaggagaug

SEQ ID NO: 1017564 - RNA, 19 nt, Homo sapiens
uuacuacaaugaguuggaa

SEQ ID NO: 1017565 - RNA, 19 nt, Homo sapiens
uuaccgaggaagaaauaua

SEQ ID NO: 1017566 - RNA, 19 nt, Homo sapiens
caucgagacaugaaugaga

SEQ ID NO: 1017567 - RNA, 19 nt, Homo sapiens
gagucucgcuggagcucuu

SEQ ID NO: 1017568 - RNA, 19 nt, Homo sapiens
gcaccaacgcccugcuugu

SEQ ID NO: 1017569 - RNA, 19 nt, Homo sapiens
guuuaccgaggaagaaaua

SEQ ID NO: 1017570 - RNA, 19 nt, Homo sapiens
gaaagacagaguacaucuc

SEQ ID NO: 1017571 - RNA, 19 nt, Homo sapiens
ugaggacgaugccgacucu

SEQ ID NO: 1017572 - RNA, 19 nt, Homo sapiens
aaacuacuucuucaucuuc

SEQ ID NO: 1017573 - RNA, 19 nt, Homo sapiens
ccucaucucaacccacuuu

SEQ ID NO: 1017574 - RNA, 19 nt, Homo sapiens
cagcugcguuggagaugau

SEQ ID NO: 1017575 - RNA, 19 nt, Homo sapiens
gaggaagaaauauacaaag

SEQ ID NO: 1017576 - RNA, 19 nt, Homo sapiens
gcagcaguuuaccgaggaa

SEQ ID NO: 1017577 - RNA, 19 nt, Homo sapiens
caagguggcagugacaaug

SEQ ID NO: 1017578 - RNA, 19 nt, Homo sapiens
aggaggagauggacuaugc

SEQ ID NO: 1017579 - RNA, 19 nt, Homo sapiens
ccuauuuccugccuguaga

SEQ ID NO: 1017580 - RNA, 19 nt, Homo sapiens
ggagauggagacagaagag

SEQ ID NO: 1017581 - RNA, 19 nt, Homo sapiens
acuggaacgugaagaacaa

SEQ ID NO: 1017582 - RNA, 19 nt, Homo sapiens
ucaucaauccugacaccua

SEQ ID NO: 1017583 - RNA, 19 nt, Homo sapiens
ccaucgaucucaucaaucc

SEQ ID NO: 1017584 - RNA, 19 nt, Homo sapiens
gggaagaggaagaggagau

SEQ ID NO: 1017585 - RNA, 19 nt, Homo sapiens
cggaaggcccagcuagaaa

SEQ ID NO: 1017586 - RNA, 19 nt, Homo sapiens
gaucucaucaauccugaca

SEQ ID NO: 1017587 - RNA, 19 nt, Homo sapiens
ggaaaacuacuucuucauc

SEQ ID NO: 1017588 - RNA, 19 nt, Homo sapiens
gaggaagggaaccaguuug

SEQ ID NO: 1017589 - RNA, 19 nt, Homo sapiens
ggaaggcccagcuagaaaa

SEQ ID NO: 1017590 - RNA, 19 nt, Homo sapiens
ccaggguccgccuuaguaa

SEQ ID NO: 1017591 - RNA, 19 nt, Homo sapiens
ggaagggaaccaguuugug

SEQ ID NO: 1017592 - RNA, 19 nt, Homo sapiens
ucucacagcauuacagcaa

SEQ ID NO: 1017593 - RNA, 19 nt, Homo sapiens
cgaaagacagaguacaucu

SEQ ID NO: 1017594 - RNA, 19 nt, Homo sapiens
aagcugauagugacaguga

SEQ ID NO: 1017595 - RNA, 19 nt, Homo sapiens
gaugccgacucugaugaug

SEQ ID NO: 1017596 - RNA, 19 nt, Homo sapiens
cagcuucugauuccaguga

SEQ ID NO: 1017597 - RNA, 19 nt, Homo sapiens
gagaaggagggcagugaag

SEQ ID NO: 1017598 - RNA, 19 nt, Homo sapiens
gaaaagagcucuggagaug

SEQ ID NO: 1017599 - RNA, 19 nt, Homo sapiens
gauaucacaucuaagaaug

SEQ ID NO: 1017600 - RNA, 19 nt, Homo sapiens
gggcuucucuccuaauuug

SEQ ID NO: 1017601 - RNA, 19 nt, Homo sapiens
guacagagauucaguuuug

SEQ ID NO: 1017602 - RNA, 19 nt, Homo sapiens
gcaaguuaaucugcucuaa

SEQ ID NO: 1017603 - RNA, 19 nt, Homo sapiens
caagauaaaugccuuccau

SEQ ID NO: 1017604 - RNA, 19 nt, Homo sapiens
ggagauggaugcugcugau

SEQ ID NO: 1017605 - RNA, 19 nt, Homo sapiens
aaagagcucuggagaugga

SEQ ID NO: 1017606 - RNA, 19 nt, Homo sapiens
gcacagacaaauucauuca

SEQ ID NO: 1017607 - RNA, 19 nt, Homo sapiens
ugaagccgcugcuggagaa

SEQ ID NO: 1017608 - RNA, 19 nt, Homo sapiens
uaauuugccucacguaaca

SEQ ID NO: 1017609 - RNA, 19 nt, Homo sapiens
gcaaugugaaugugcauga

SEQ ID NO: 1017610 - RNA, 19 nt, Homo sapiens
uccauucucuucguacuua

SEQ ID NO: 1017611 - RNA, 19 nt, Homo sapiens
aaacuggguucgaauugga

SEQ ID NO: 1017612 - RNA, 19 nt, Homo sapiens
gagaccaucuuggcuaaca

SEQ ID NO: 1017613 - RNA, 19 nt, Homo sapiens
acagacaaauucauucauc

SEQ ID NO: 1017614 - RNA, 19 nt, Homo sapiens
cagugacaauaacaagaua

SEQ ID NO: 1017615 - RNA, 19 nt, Homo sapiens
gcaggagaauggcaugaac

SEQ ID NO: 1017616 - RNA, 19 nt, Homo sapiens
cuucauggguacagagauu

SEQ ID NO: 1017617 - RNA, 19 nt, Homo sapiens
gaacugcuuccuacucuac

SEQ ID NO: 1017618 - RNA, 19 nt, Homo sapiens
cagaacugcuuccuacucu

SEQ ID NO: 1017619 - RNA, 19 nt, Homo sapiens
ucgagaccaucuuggcuaa

SEQ ID NO: 1017620 - RNA, 19 nt, Homo sapiens
gagauucaguuuugcaaga

SEQ ID NO: 1017621 - RNA, 19 nt, Homo sapiens
gaaaccccaucucuacuau

SEQ ID NO: 1017622 - RNA, 19 nt, Homo sapiens
uuaaucugcucuaacaaag

SEQ ID NO: 1017623 - RNA, 19 nt, Homo sapiens
uucagcagcuccaggguaa

SEQ ID NO: 1017624 - RNA, 19 nt, Homo sapiens
ggaagccugugcaauucag

SEQ ID NO: 1017625 - RNA, 19 nt, Homo sapiens
cagacaaauucauucaucu

SEQ ID NO: 1017626 - RNA, 19 nt, Homo sapiens
cugggaagccugugcaauu

SEQ ID NO: 1017627 - RNA, 19 nt, Homo sapiens
cagcaaaacuggguucgaa

SEQ ID NO: 1017628 - RNA, 19 nt, Homo sapiens
ccagugacaauaacaagau

SEQ ID NO: 1017629 - RNA, 19 nt, Homo sapiens
gucaggagaucgagaccau

SEQ ID NO: 1017630 - RNA, 19 nt, Homo sapiens
ccuguaaucccagcacuuu

SEQ ID NO: 1017631 - RNA, 19 nt, Homo sapiens
ggguacagagauucaguuu

SEQ ID NO: 1017632 - RNA, 19 nt, Homo sapiens
ugggaagccugugcaauuc

SEQ ID NO: 1017633 - RNA, 19 nt, Homo sapiens
gcaaaacuggguucgaauu

SEQ ID NO: 1017634 - RNA, 19 nt, Homo sapiens
gcaccuguggucccagcua

SEQ ID NO: 1017635 - RNA, 19 nt, Homo sapiens
uggcuacaccgcaauguga

SEQ ID NO: 1017636 - RNA, 19 nt, Homo sapiens
caaugugaaugugcaugau

SEQ ID NO: 1017637 - RNA, 19 nt, Homo sapiens
ccugagagcaaguuaaucu

SEQ ID NO: 1017638 - RNA, 19 nt, Homo sapiens
uaucacaucuaagaauggu

SEQ ID NO: 1017639 - RNA, 19 nt, Homo sapiens
ccuaauuugccucacguaa

SEQ ID NO: 1017640 - RNA, 19 nt, Homo sapiens
caccugagagcaaguuaau

SEQ ID NO: 1017641 - RNA, 19 nt, Homo sapiens
aggcacagacaaauucauu

SEQ ID NO: 1017642 - RNA, 19 nt, Homo sapiens
agaacugcuuccuacucua

SEQ ID NO: 1017643 - RNA, 19 nt, Homo sapiens
guccaggcacagacaaauu

SEQ ID NO: 1017644 - RNA, 19 nt, Homo sapiens
gagguggagcuugcaguga

SEQ ID NO: 1017645 - RNA, 19 nt, Homo sapiens
gcagaccauacaccugaga

SEQ ID NO: 1017646 - RNA, 19 nt, Homo sapiens
cagcagcuccaggguaaau

SEQ ID NO: 1017647 - RNA, 19 nt, Homo sapiens
aaccccaucucuacuauaa

SEQ ID NO: 1017648 - RNA, 19 nt, Homo sapiens
ggaaaagagcucuggagau

SEQ ID NO: 1017649 - RNA, 19 nt, Homo sapiens
ucucauucccugugcuuga

SEQ ID NO: 1017650 - RNA, 19 nt, Homo sapiens
gggaagccugugcaauuca

SEQ ID NO: 1017651 - RNA, 19 nt, Homo sapiens
cagagccugagccagcuua

SEQ ID NO: 1017652 - RNA, 19 nt, Homo sapiens
ggaccuauguguacuguua

SEQ ID NO: 1017653 - RNA, 19 nt, Homo sapiens
gauguugguucacuaaaua

SEQ ID NO: 1017654 - RNA, 19 nt, Homo sapiens
aaagagagcucaagacauc

SEQ ID NO: 1017655 - RNA, 19 nt, Homo sapiens
gaggaaauguggaaaugaa

SEQ ID NO: 1017656 - RNA, 19 nt, Homo sapiens
gacaaguccugcucauaua

SEQ ID NO: 1017657 - RNA, 19 nt, Homo sapiens
gcacacaggaguugucuaa

SEQ ID NO: 1017658 - RNA, 19 nt, Homo sapiens
ucaaauguguccgaacuua

SEQ ID NO: 1017659 - RNA, 19 nt, Homo sapiens
guucuuaccugccuucaaa

SEQ ID NO: 1017660 - RNA, 19 nt, Homo sapiens
gauaagaagucacccgaau

SEQ ID NO: 1017661 - RNA, 19 nt, Homo sapiens
ggaaauggaugaugcuucu

SEQ ID NO: 1017662 - RNA, 19 nt, Homo sapiens
gcucaagacaucucuguua

SEQ ID NO: 1017663 - RNA, 19 nt, Homo sapiens
gacaaauccugauauguug

SEQ ID NO: 1017664 - RNA, 19 nt, Homo sapiens
gaacuuaauguccuggaua

SEQ ID NO: 1017665 - RNA, 19 nt, Homo sapiens
ggacauggagaccaauaua

SEQ ID NO: 1017666 - RNA, 19 nt, Homo sapiens
gcaguugccuuuguuaaau

SEQ ID NO: 1017667 - RNA, 19 nt, Homo sapiens
ugacaaauccugauauguu

SEQ ID NO: 1017668 - RNA, 19 nt, Homo sapiens
caccuagccugguuauaua

SEQ ID NO: 1017669 - RNA, 19 nt, Homo sapiens
acacuaagacuacguuuaa

SEQ ID NO: 1017670 - RNA, 19 nt, Homo sapiens
gaggcuacuuuauggcuua

SEQ ID NO: 1017671 - RNA, 19 nt, Homo sapiens
cagugagucuucaguauaa

SEQ ID NO: 1017672 - RNA, 19 nt, Homo sapiens
gcacaaguaaagaaacuaa

SEQ ID NO: 1017673 - RNA, 19 nt, Homo sapiens
gaaugcaccugaggaaaug

SEQ ID NO: 1017674 - RNA, 19 nt, Homo sapiens
ggaagcaucuaguaucucu

SEQ ID NO: 1017675 - RNA, 19 nt, Homo sapiens
gaugaugcuucuccugaaa

SEQ ID NO: 1017676 - RNA, 19 nt, Homo sapiens
ccaauucuguuguuacaug

SEQ ID NO: 1017677 - RNA, 19 nt, Homo sapiens
ucaaacaugucaaacugaa

SEQ ID NO: 1017678 - RNA, 19 nt, Homo sapiens
uaucucugcuagugauuua

SEQ ID NO: 1017679 - RNA, 19 nt, Homo sapiens
ugauauaagugacaagaga

SEQ ID NO: 1017680 - RNA, 19 nt, Homo sapiens
agugauaccucaagacaaa

SEQ ID NO: 1017681 - RNA, 19 nt, Homo sapiens
ucacaaauguuggguacaa

SEQ ID NO: 1017682 - RNA, 19 nt, Homo sapiens
ucauauacauccucaccua

SEQ ID NO: 1017683 - RNA, 19 nt, Homo sapiens
ggcaaugggagaaauguua

SEQ ID NO: 1017684 - RNA, 19 nt, Homo sapiens
gaggaagcaucuaguaucu

SEQ ID NO: 1017685 - RNA, 19 nt, Homo sapiens
ggucaccuguacacucaua

SEQ ID NO: 1017686 - RNA, 19 nt, Homo sapiens
gaugagcccagcacaagua

SEQ ID NO: 1017687 - RNA, 19 nt, Homo sapiens
gaauauaggagcaacuaau

SEQ ID NO: 1017688 - RNA, 19 nt, Homo sapiens
gaaguaguuggaaaucuuu

SEQ ID NO: 1017689 - RNA, 19 nt, Homo sapiens
gaaguauucagaugauuug

SEQ ID NO: 1017690 - RNA, 19 nt, Homo sapiens
gacaguugauuguaguaaa

SEQ ID NO: 1017691 - RNA, 19 nt, Homo sapiens
ugacagaauuguagauaag

SEQ ID NO: 1017692 - RNA, 19 nt, Homo sapiens
caaauauucugggaggaaa

SEQ ID NO: 1017693 - RNA, 19 nt, Homo sapiens
caucccaggugaguucuua

SEQ ID NO: 1017694 - RNA, 19 nt, Homo sapiens
gggaggaaauguggaaaug

SEQ ID NO: 1017695 - RNA, 19 nt, Homo sapiens
guauuuagauucagaugca

SEQ ID NO: 1017696 - RNA, 19 nt, Homo sapiens
gcugacaaauccugauaug

SEQ ID NO: 1017697 - RNA, 19 nt, Homo sapiens
ugacaaguccugcucauau

SEQ ID NO: 1017698 - RNA, 19 nt, Homo sapiens
caacuaaucaaacauguca

SEQ ID NO: 1017699 - RNA, 19 nt, Homo sapiens
ggaugaugcuucuccugaa

SEQ ID NO: 1017700 - RNA, 19 nt, Homo sapiens
gcccuccuccuuuguauua

SEQ ID NO: 1017701 - RNA, 19 nt, Homo sapiens
ucacagaauuggacaugga

SEQ ID NO: 1017702 - RNA, 19 nt, Homo sapiens
caucagaucacuuugaaga

SEQ ID NO: 1017703 - RNA, 19 nt, Homo sapiens
agaaguaguuggaaaucuu

SEQ ID NO: 1017704 - RNA, 19 nt, Homo sapiens
aaaguaaggccgaauguga

SEQ ID NO: 1017705 - RNA, 19 nt, Homo sapiens
guacaucagaucacuuuga

SEQ ID NO: 1017706 - RNA, 19 nt, Homo sapiens
caagacaucucuguuaaaa

SEQ ID NO: 1017707 - RNA, 19 nt, Homo sapiens
aaucaaacaugucaaacug

SEQ ID NO: 1017708 - RNA, 19 nt, Homo sapiens
acacgaacauccuccaaug

SEQ ID NO: 1017709 - RNA, 19 nt, Homo sapiens
uccaagcaaugcaaagaua

SEQ ID NO: 1017710 - RNA, 19 nt, Homo sapiens
caugauagcaguucaagga

SEQ ID NO: 1017711 - RNA, 19 nt, Homo sapiens
gccugaagauaaguauuua

SEQ ID NO: 1017712 - RNA, 19 nt, Homo sapiens
gcaguggugcccuccauaa

SEQ ID NO: 1017713 - RNA, 19 nt, Homo sapiens
uauauaggacugaggauaa

SEQ ID NO: 1017714 - RNA, 19 nt, Homo sapiens
guaaauccuccacauauuc

SEQ ID NO: 1017715 - RNA, 19 nt, Homo sapiens
uguaaauccuccacauauu

SEQ ID NO: 1017716 - RNA, 19 nt, Homo sapiens
cagaaggauuugaaggaaa

SEQ ID NO: 1017717 - RNA, 19 nt, Homo sapiens
ggaggaagcaucuaguauc

SEQ ID NO: 1017718 - RNA, 19 nt, Homo sapiens
uuucaaagacucaggauaa

SEQ ID NO: 1017719 - RNA, 19 nt, Homo sapiens
gaagaaggcaaugaugaug

SEQ ID NO: 1017720 - RNA, 19 nt, Homo sapiens
acacaggaguugucuaaag

SEQ ID NO: 1017721 - RNA, 19 nt, Homo sapiens
agacaaaucaguggaguuu

SEQ ID NO: 1017722 - RNA, 19 nt, Homo sapiens
guuuaaagcugacaaaucc

SEQ ID NO: 1017723 - RNA, 19 nt, Homo sapiens
agaaggcaaugaugauguu

SEQ ID NO: 1017724 - RNA, 19 nt, Homo sapiens
cucaagacaucucuguuaa

SEQ ID NO: 1017725 - RNA, 19 nt, Homo sapiens
cagcagaaguuucaaagcu

SEQ ID NO: 1017726 - RNA, 19 nt, Homo sapiens
guauucagaugauuugucu

SEQ ID NO: 1017727 - RNA, 19 nt, Homo sapiens
ccacaacugccugaagaua

SEQ ID NO: 1017728 - RNA, 19 nt, Homo sapiens
ucagugagucuucaguaua

SEQ ID NO: 1017729 - RNA, 19 nt, Homo sapiens
ucaccuagccugguuauau

SEQ ID NO: 1017730 - RNA, 19 nt, Homo sapiens
cauggagaccaauauauuu

SEQ ID NO: 1017731 - RNA, 19 nt, Homo sapiens
uacaucagaucacuuugaa

SEQ ID NO: 1017732 - RNA, 19 nt, Homo sapiens
gaggacaccagcagaaguu

SEQ ID NO: 1017733 - RNA, 19 nt, Homo sapiens
gaguuguccuuguuauaug

SEQ ID NO: 1017734 - RNA, 19 nt, Homo sapiens
gagcaacuaaucaaacaug

SEQ ID NO: 1017735 - RNA, 19 nt, Homo sapiens
caaauguguccgaacuuaa

SEQ ID NO: 1017736 - RNA, 19 nt, Homo sapiens
gcuagugauuuaucuucaa

SEQ ID NO: 1017737 - RNA, 19 nt, Homo sapiens
ggccgaaugugauaaugug

SEQ ID NO: 1017738 - RNA, 19 nt, Homo sapiens
uaacguuauuccuuugaug

SEQ ID NO: 1017739 - RNA, 19 nt, Homo sapiens
gaugauguugguucacuaa

SEQ ID NO: 1017740 - RNA, 19 nt, Homo sapiens
acagaaggauuugaaggaa

SEQ ID NO: 1017741 - RNA, 19 nt, Homo sapiens
uaaaugaggaagucacaga

SEQ ID NO: 1017742 - RNA, 19 nt, Homo sapiens
ggauagcaguacaucagau

SEQ ID NO: 1017743 - RNA, 19 nt, Homo sapiens
gauauaagugacaagagaa

SEQ ID NO: 1017744 - RNA, 19 nt, Homo sapiens
ccagauagaucaaaauagu

SEQ ID NO: 1017745 - RNA, 19 nt, Homo sapiens
aaagacaguugauuguagu

SEQ ID NO: 1017746 - RNA, 19 nt, Homo sapiens
cagaggcacagaaggauuu

SEQ ID NO: 1017747 - RNA, 19 nt, Homo sapiens
ucagaucacuuugaagaag

SEQ ID NO: 1017748 - RNA, 19 nt, Homo sapiens
aaacaucccaggugaguuc

SEQ ID NO: 1017749 - RNA, 19 nt, Homo sapiens
caauauacaagcaagucua

SEQ ID NO: 1017750 - RNA, 19 nt, Homo sapiens
ggucugaagccaagaagga

SEQ ID NO: 1017751 - RNA, 19 nt, Homo sapiens
aaauaaacuuccaggauac

SEQ ID NO: 1017752 - RNA, 19 nt, Homo sapiens
gaagaaagcuauggcaauu

SEQ ID NO: 1017753 - RNA, 19 nt, Homo sapiens
gaagagauauucuagaagu

SEQ ID NO: 1017754 - RNA, 19 nt, Homo sapiens
gggaagcuuuguaccuuua

SEQ ID NO: 1017755 - RNA, 19 nt, Homo sapiens
caucgaaucuugcgaacaa

SEQ ID NO: 1017756 - RNA, 19 nt, Homo sapiens
gggcggugcuggcuaagua

SEQ ID NO: 1017757 - RNA, 19 nt, Homo sapiens
gcauaugauuucuugcuuu

SEQ ID NO: 1017758 - RNA, 19 nt, Homo sapiens
caaagcgcauggagacuaa

SEQ ID NO: 1017759 - RNA, 19 nt, Homo sapiens
gaucaauggucucagaaau

SEQ ID NO: 1017760 - RNA, 19 nt, Homo sapiens
ccaaauccuuccuccuaua

SEQ ID NO: 1017761 - RNA, 19 nt, Homo sapiens
gaaugaugcuaugaaauug

SEQ ID NO: 1017762 - RNA, 19 nt, Homo sapiens
gaacauggaauugugguuu

SEQ ID NO: 1017763 - RNA, 19 nt, Homo sapiens
gaauuugaagccuacauua

SEQ ID NO: 1017764 - RNA, 19 nt, Homo sapiens
gagaacagcauaugauuuc

SEQ ID NO: 1017765 - RNA, 19 nt, Homo sapiens
gaguguaggugaaaugaau

SEQ ID NO: 1017766 - RNA, 19 nt, Homo sapiens
gcacaucaaagaagagaaa

SEQ ID NO: 1017767 - RNA, 19 nt, Homo sapiens
gcagaugguugcaauugau

SEQ ID NO: 1017768 - RNA, 19 nt, Homo sapiens
ggagugacccugaauguuc

SEQ ID NO: 1017769 - RNA, 19 nt, Homo sapiens
gccacuaucucaggaauuu

SEQ ID NO: 1017770 - RNA, 19 nt, Homo sapiens
gaagugcugggcaaguuua

SEQ ID NO: 1017771 - RNA, 19 nt, Homo sapiens
cugaagagauauucuagaa

SEQ ID NO: 1017772 - RNA, 19 nt, Homo sapiens
ggcaauugcugaugcuuug

SEQ ID NO: 1017773 - RNA, 19 nt, Homo sapiens
gaaccauucccuagucauu

SEQ ID NO: 1017774 - RNA, 19 nt, Homo sapiens
gcaaagcgcauggagacua

SEQ ID NO: 1017775 - RNA, 19 nt, Homo sapiens
ucaauggucucagaaauuc

SEQ ID NO: 1017776 - RNA, 19 nt, Homo sapiens
ccaugugacuuagacuuua

SEQ ID NO: 1017777 - RNA, 19 nt, Homo sapiens
guguggagcuacugcauaa

SEQ ID NO: 1017778 - RNA, 19 nt, Homo sapiens
gcuagucaguaaagauauu

SEQ ID NO: 1017779 - RNA, 19 nt, Homo sapiens
gaaauugguggguggugua

SEQ ID NO: 1017780 - RNA, 19 nt, Homo sapiens
cauaugauuucuugcuuug

SEQ ID NO: 1017781 - RNA, 19 nt, Homo sapiens
cagacaggcuggcauucua

SEQ ID NO: 1017782 - RNA, 19 nt, Homo sapiens
gaauaugcacaucaaagaa

SEQ ID NO: 1017783 - RNA, 19 nt, Homo sapiens
cuagaaguauggcaauuau

SEQ ID NO: 1017784 - RNA, 19 nt, Homo sapiens
ggucaguccucaucucugu

SEQ ID NO: 1017785 - RNA, 19 nt, Homo sapiens
gagaagauaaucauugcuu

SEQ ID NO: 1017786 - RNA, 19 nt, Homo sapiens
aggcuggcauucuagauua

SEQ ID NO: 1017787 - RNA, 19 nt, Homo sapiens
uaagaaagcccacaaaucc

SEQ ID NO: 1017788 - RNA, 19 nt, Homo sapiens
ggaauuugaagccuacauu

SEQ ID NO: 1017789 - RNA, 19 nt, Homo sapiens
gagauauucuagaaguaug

SEQ ID NO: 1017790 - RNA, 19 nt, Homo sapiens
gauguuuccuacaacuaaa

SEQ ID NO: 1017791 - RNA, 19 nt, Homo sapiens
gaacagcauaugauuucuu

SEQ ID NO: 1017792 - RNA, 19 nt, Homo sapiens
gcgaacaacacgauacuug

SEQ ID NO: 1017793 - RNA, 19 nt, Homo sapiens
caugugacuuagacuuuaa

SEQ ID NO: 1017794 - RNA, 19 nt, Homo sapiens
guauggcaauuaugaacaa

SEQ ID NO: 1017795 - RNA, 19 nt, Homo sapiens
uaggugaaaugaaugaaug

SEQ ID NO: 1017796 - RNA, 19 nt, Homo sapiens
gaauugugguuuucucuuu

SEQ ID NO: 1017797 - RNA, 19 nt, Homo sapiens
cacaugacauuccugcaaa

SEQ ID NO: 1017798 - RNA, 19 nt, Homo sapiens
ccuccuauauuccuaaguu

SEQ ID NO: 1017799 - RNA, 19 nt, Homo sapiens
caccuuguguguuuaaaga

SEQ ID NO: 1017800 - RNA, 19 nt, Homo sapiens
gagcuggagugacccugaa

SEQ ID NO: 1017801 - RNA, 19 nt, Homo sapiens
ggacccagaaggaauuuga

SEQ ID NO: 1017802 - RNA, 19 nt, Homo sapiens
agaaguauggcaauuauga

SEQ ID NO: 1017803 - RNA, 19 nt, Homo sapiens
gaaguauggcaauuaugaa

SEQ ID NO: 1017804 - RNA, 19 nt, Homo sapiens
gcacugagaacagcauaug

SEQ ID NO: 1017805 - RNA, 19 nt, Homo sapiens
gcaaauggcaguuuuaauc

SEQ ID NO: 1017806 - RNA, 19 nt, Homo sapiens
guccaaauccuuccuccua

SEQ ID NO: 1017807 - RNA, 19 nt, Homo sapiens
ccugaaugcuacuuccuuu

SEQ ID NO: 1017808 - RNA, 19 nt, Homo sapiens
gaagcuuuguaccuuuaga

SEQ ID NO: 1017809 - RNA, 19 nt, Homo sapiens
ugaauaugcacaucaaaga

SEQ ID NO: 1017810 - RNA, 19 nt, Homo sapiens
gaaugcuacuuccuuugau

SEQ ID NO: 1017811 - RNA, 19 nt, Homo sapiens
gucgauuccugcuguguuu

SEQ ID NO: 1017812 - RNA, 19 nt, Homo sapiens
gcaauugauccuuaaccaa

SEQ ID NO: 1017813 - RNA, 19 nt, Homo sapiens
ugaaugcuacuuccuuuga

SEQ ID NO: 1017814 - RNA, 19 nt, Homo sapiens
ugagaacagcauaugauuu

SEQ ID NO: 1017815 - RNA, 19 nt, Homo sapiens
cgugauugguuuccucuug

SEQ ID NO: 1017816 - RNA, 19 nt, Homo sapiens
gacccugaauguucuggaa

SEQ ID NO: 1017817 - RNA, 19 nt, Homo sapiens
ggaauuugaucgcguuacg

SEQ ID NO: 1017818 - RNA, 19 nt, Homo sapiens
cuagucauuuccaaacuug

SEQ ID NO: 1017819 - RNA, 19 nt, Homo sapiens
cccacgaccucaccuggua

SEQ ID NO: 1017820 - RNA, 19 nt, Homo sapiens
gugaucagauggacaaugc

SEQ ID NO: 1017821 - RNA, 19 nt, Homo sapiens
ccacaugacauuccugcaa

SEQ ID NO: 1017822 - RNA, 19 nt, Homo sapiens
caaauccuuccuccuauau

SEQ ID NO: 1017823 - RNA, 19 nt, Homo sapiens
gcuaaguaccugucgauuc

SEQ ID NO: 1017824 - RNA, 19 nt, Homo sapiens
gaugacccgugccuuuauc

SEQ ID NO: 1017825 - RNA, 19 nt, Homo sapiens
cuaaguaccugucgauucc

SEQ ID NO: 1017826 - RNA, 19 nt, Homo sapiens
uuucugauguuuccuacaa

SEQ ID NO: 1017827 - RNA, 19 nt, Homo sapiens
aacagcauaugauuucuug

SEQ ID NO: 1017828 - RNA, 19 nt, Homo sapiens
gguugcaauugauccuuaa

SEQ ID NO: 1017829 - RNA, 19 nt, Homo sapiens
cuucaucaccuuuaaaugu

SEQ ID NO: 1017830 - RNA, 19 nt, Homo sapiens
gaucagauggacaaugcaa

SEQ ID NO: 1017831 - RNA, 19 nt, Homo sapiens
uggcaauuaugaacaaugu

SEQ ID NO: 1017832 - RNA, 19 nt, Homo sapiens
gaaauuccagagaagaaag

SEQ ID NO: 1017833 - RNA, 19 nt, Homo sapiens
ugguggaucuugucagcua

SEQ ID NO: 1017834 - RNA, 19 nt, Homo sapiens
ucuagaaguauggcaauua

SEQ ID NO: 1017835 - RNA, 19 nt, Homo sapiens
auuggugggugguguauuu

SEQ ID NO: 1017836 - RNA, 19 nt, Homo sapiens
ugguugcaauugauccuua

SEQ ID NO: 1017837 - RNA, 19 nt, Homo sapiens
aggaugacaugugccauuu

SEQ ID NO: 1017838 - RNA, 19 nt, Homo sapiens
ucgcuagucaguaaagaua

SEQ ID NO: 1017839 - RNA, 19 nt, Homo sapiens
ccuuggacgugauugguuu

SEQ ID NO: 1017840 - RNA, 19 nt, Homo sapiens
ccgaugacccgugccuuua

SEQ ID NO: 1017841 - RNA, 19 nt, Homo sapiens
agaaagcuauggcaauugc

SEQ ID NO: 1017842 - RNA, 19 nt, Homo sapiens
cagaaauuccagagaagaa

SEQ ID NO: 1017843 - RNA, 19 nt, Homo sapiens
uggagaacauggaauugug

SEQ ID NO: 1017844 - RNA, 19 nt, Homo sapiens
uggagcuacugcauaauga

SEQ ID NO: 1017845 - RNA, 19 nt, Homo sapiens
gaagggaagcuuuguaccu

SEQ ID NO: 1017846 - RNA, 19 nt, Homo sapiens
ggaucaauggucucagaaa

SEQ ID NO: 1017847 - RNA, 19 nt, Homo sapiens
uuugaagccuacauuaaug

SEQ ID NO: 1017848 - RNA, 19 nt, Homo sapiens
gcaaagggucaagaacaug

SEQ ID NO: 1017849 - RNA, 19 nt, Homo sapiens
ggugguguauuugagaaga

SEQ ID NO: 1017850 - RNA, 19 nt, Homo sapiens
guuaagaaagcccacaaau

SEQ ID NO: 1017851 - RNA, 19 nt, Homo sapiens
gagugacccugaauguucu

SEQ ID NO: 1017852 - RNA, 19 nt, Homo sapiens
gaagaaagcuauggcaauu

SEQ ID NO: 1017853 - RNA, 19 nt, Homo sapiens
gggaagcuuuguaccuuua

SEQ ID NO: 1017854 - RNA, 19 nt, Homo sapiens
gcaucugucuggcuguuua

SEQ ID NO: 1017855 - RNA, 19 nt, Homo sapiens
caucgaaucuugcgaacaa

SEQ ID NO: 1017856 - RNA, 19 nt, Homo sapiens
gcauaugauuucuugcuuu

SEQ ID NO: 1017857 - RNA, 19 nt, Homo sapiens
caaagcgcauggagacuaa

SEQ ID NO: 1017858 - RNA, 19 nt, Homo sapiens
gaucaauggucucagaaau

SEQ ID NO: 1017859 - RNA, 19 nt, Homo sapiens
gaaugaugcuaugaaauug

SEQ ID NO: 1017860 - RNA, 19 nt, Homo sapiens
gaacauggaauugugguuu

SEQ ID NO: 1017861 - RNA, 19 nt, Homo sapiens
gaauuugaagccuacauua

SEQ ID NO: 1017862 - RNA, 19 nt, Homo sapiens
gagaacagcauaugauuuc

SEQ ID NO: 1017863 - RNA, 19 nt, Homo sapiens
ugaaauaguuguccuagca

SEQ ID NO: 1017864 - RNA, 19 nt, Homo sapiens
gaguguaggugaaaugaau

SEQ ID NO: 1017865 - RNA, 19 nt, Homo sapiens
gcagaugguugcaauugau

SEQ ID NO: 1017866 - RNA, 19 nt, Homo sapiens
ggagugacccugaauguuc

SEQ ID NO: 1017867 - RNA, 19 nt, Homo sapiens
gaagugcugggcaaguuua

SEQ ID NO: 1017868 - RNA, 19 nt, Homo sapiens
ggcaauugcugaugcuuug

SEQ ID NO: 1017869 - RNA, 19 nt, Homo sapiens
gaacaugcucauugccuuu

SEQ ID NO: 1017870 - RNA, 19 nt, Homo sapiens
gaaccauucccuagucauu

SEQ ID NO: 1017871 - RNA, 19 nt, Homo sapiens
gcaaagcgcauggagacua

SEQ ID NO: 1017872 - RNA, 19 nt, Homo sapiens
ucaauggucucagaaauuc

SEQ ID NO: 1017873 - RNA, 19 nt, Homo sapiens
gcuagucaguaaagauauu

SEQ ID NO: 1017874 - RNA, 19 nt, Homo sapiens
cagaauuccuucagagaga

SEQ ID NO: 1017875 - RNA, 19 nt, Homo sapiens
gaaauugguggguggugua

SEQ ID NO: 1017876 - RNA, 19 nt, Homo sapiens
cauaugauuucuugcuuug

SEQ ID NO: 1017877 - RNA, 19 nt, Homo sapiens
cagacaggcuggcauucua

SEQ ID NO: 1017878 - RNA, 19 nt, Homo sapiens
ggucaguccucaucucugu

SEQ ID NO: 1017879 - RNA, 19 nt, Homo sapiens
gagaagauaaucauugcuu

SEQ ID NO: 1017880 - RNA, 19 nt, Homo sapiens
gugaagaacaugcucauug

SEQ ID NO: 1017881 - RNA, 19 nt, Homo sapiens
ccaaagggaggaugugaaa

SEQ ID NO: 1017882 - RNA, 19 nt, Homo sapiens
aggcuggcauucuagauua

SEQ ID NO: 1017883 - RNA, 19 nt, Homo sapiens
uaagaaagcccacaaaucc

SEQ ID NO: 1017884 - RNA, 19 nt, Homo sapiens
ggaauuugaagccuacauu

SEQ ID NO: 1017885 - RNA, 19 nt, Homo sapiens
gauguuuccuacaacuaaa

SEQ ID NO: 1017886 - RNA, 19 nt, Homo sapiens
gaacagcauaugauuucuu

SEQ ID NO: 1017887 - RNA, 19 nt, Homo sapiens
gcgaacaacacgauacuug

SEQ ID NO: 1017888 - RNA, 19 nt, Homo sapiens
uaggugaaaugaaugaaug

SEQ ID NO: 1017889 - RNA, 19 nt, Homo sapiens
gaauugugguuuucucuuu

SEQ ID NO: 1017890 - RNA, 19 nt, Homo sapiens
gugacuuugugaaggauua

SEQ ID NO: 1017891 - RNA, 19 nt, Homo sapiens
aaaggacucugcuaugcuu

SEQ ID NO: 1017892 - RNA, 19 nt, Homo sapiens
caccuuguguguuuaaaga

SEQ ID NO: 1017893 - RNA, 19 nt, Homo sapiens
gagcuggagugacccugaa

SEQ ID NO: 1017894 - RNA, 19 nt, Homo sapiens
gcacugagaacagcauaug

SEQ ID NO: 1017895 - RNA, 19 nt, Homo sapiens
gcaaauggcaguuuuaauc

SEQ ID NO: 1017896 - RNA, 19 nt, Homo sapiens
caugcagccuggaauuuga

SEQ ID NO: 1017897 - RNA, 19 nt, Homo sapiens
gcagaggggacaugaaaua

SEQ ID NO: 1017898 - RNA, 19 nt, Homo sapiens
gaagcuuuguaccuuuaga

SEQ ID NO: 1017899 - RNA, 19 nt, Homo sapiens
ugaagaacaugcucauugc

SEQ ID NO: 1017900 - RNA, 19 nt, Homo sapiens
aaagggaggaugugaaaga

SEQ ID NO: 1017901 - RNA, 19 nt, Homo sapiens
gcaauugauccuuaaccaa

SEQ ID NO: 1017902 - RNA, 19 nt, Homo sapiens
ugagaacagcauaugauuu

SEQ ID NO: 1017903 - RNA, 19 nt, Homo sapiens
gaggggacaugaaauaguu

SEQ ID NO: 1017904 - RNA, 19 nt, Homo sapiens
cgugauugguuuccucuug

SEQ ID NO: 1017905 - RNA, 19 nt, Homo sapiens
gacccugaauguucuggaa

SEQ ID NO: 1017906 - RNA, 19 nt, Homo sapiens
agacguacccugugccauu

SEQ ID NO: 1017907 - RNA, 19 nt, Homo sapiens
cuagucauuuccaaacuug

SEQ ID NO: 1017908 - RNA, 19 nt, Homo sapiens
cccacgaccucaccuggua

SEQ ID NO: 1017909 - RNA, 19 nt, Homo sapiens
gugaucagauggacaaugc

SEQ ID NO: 1017910 - RNA, 19 nt, Homo sapiens
gaugacccgugccuuuauc

SEQ ID NO: 1017911 - RNA, 19 nt, Homo sapiens
uuucugauguuuccuacaa

SEQ ID NO: 1017912 - RNA, 19 nt, Homo sapiens
aacagcauaugauuucuug

SEQ ID NO: 1017913 - RNA, 19 nt, Homo sapiens
gguugcaauugauccuuaa

SEQ ID NO: 1017914 - RNA, 19 nt, Homo sapiens
cuucaucaccuuuaaaugu

SEQ ID NO: 1017915 - RNA, 19 nt, Homo sapiens
gaucagauggacaaugcaa

SEQ ID NO: 1017916 - RNA, 19 nt, Homo sapiens
caucaugcccaauaugguu

SEQ ID NO: 1017917 - RNA, 19 nt, Homo sapiens
ccaggccucucuccucuca

SEQ ID NO: 1017918 - RNA, 19 nt, Homo sapiens
gaaauuccagagaagaaag

SEQ ID NO: 1017919 - RNA, 19 nt, Homo sapiens
auuggugggugguguauuu

SEQ ID NO: 1017920 - RNA, 19 nt, Homo sapiens
ugguugcaauugauccuua

SEQ ID NO: 1017921 - RNA, 19 nt, Homo sapiens
aggaugacaugugccauuu

SEQ ID NO: 1017922 - RNA, 19 nt, Homo sapiens
ucgcuagucaguaaagaua

SEQ ID NO: 1017923 - RNA, 19 nt, Homo sapiens
ccuuggacgugauugguuu

SEQ ID NO: 1017924 - RNA, 19 nt, Homo sapiens
ccgaugacccgugccuuua

SEQ ID NO: 1017925 - RNA, 19 nt, Homo sapiens
agaaagcuauggcaauugc

SEQ ID NO: 1017926 - RNA, 19 nt, Homo sapiens
cagaaauuccagagaagaa

SEQ ID NO: 1017927 - RNA, 19 nt, Homo sapiens
uggagaacauggaauugug

SEQ ID NO: 1017928 - RNA, 19 nt, Homo sapiens
gaagggaagcuuuguaccu

SEQ ID NO: 1017929 - RNA, 19 nt, Homo sapiens
ggaucaauggucucagaaa

SEQ ID NO: 1017930 - RNA, 19 nt, Homo sapiens
uuugaagccuacauuaaug

SEQ ID NO: 1017931 - RNA, 19 nt, Homo sapiens
ggugguguauuugagaaga

SEQ ID NO: 1017932 - RNA, 19 nt, Homo sapiens
guuaagaaagcccacaaau

SEQ ID NO: 1017933 - RNA, 19 nt, Homo sapiens
gagugacccugaauguucu

SEQ ID NO: 1017934 - RNA, 19 nt, Homo sapiens
gcacaacaaggagcucaug

SEQ ID NO: 1017935 - RNA, 19 nt, Homo sapiens
gucuggcuguucccacuua

SEQ ID NO: 1017936 - RNA, 19 nt, Homo sapiens
ugauguuuccuacaacuaa

SEQ ID NO: 1017937 - RNA, 19 nt, Homo sapiens
gacguacccugugccauuc

SEQ ID NO: 1017938 - RNA, 19 nt, Homo sapiens
ccuagucauuuccaaacuu

SEQ ID NO: 1017939 - RNA, 19 nt, Homo sapiens
uuaagaaagcccacaaauc

SEQ ID NO: 1017940 - RNA, 19 nt, Homo sapiens
cuuuguaccuuuagagugu

SEQ ID NO: 1017941 - RNA, 19 nt, Homo sapiens
acaaauccaagacccauug

SEQ ID NO: 1017942 - RNA, 19 nt, Homo sapiens
gugaugaugcccuuguuug

SEQ ID NO: 1017943 - RNA, 19 nt, Homo sapiens
guuagucucgggcauaaug

SEQ ID NO: 1017944 - RNA, 19 nt, Homo sapiens
gaacccgaccaucgaaucu

SEQ ID NO: 1017945 - RNA, 19 nt, Homo sapiens
ugggaucaauggucucaga

SEQ ID NO: 1017946 - RNA, 19 nt, Homo sapiens
ggagcugaauuugauaaaa

SEQ ID NO: 1017947 - RNA, 19 nt, Homo sapiens
uaugucaaauggagcugaa

SEQ ID NO: 1017948 - RNA, 19 nt, Homo sapiens
caccugacgccucguugua

SEQ ID NO: 1017949 - RNA, 19 nt, Homo sapiens
agaaagcccacaaauccaa

SEQ ID NO: 1017950 - RNA, 19 nt, Homo sapiens
ugaauguucuggaaaugac

SEQ ID NO: 1017951 - RNA, 19 nt, Homo sapiens
ggugaugaugcccuuguuu

SEQ ID NO: 1017952 - RNA, 19 nt, Homo sapiens
gaagaaagcuauggcaauu

SEQ ID NO: 1017953 - RNA, 19 nt, Homo sapiens
caucgaaucuugcgaacaa

SEQ ID NO: 1017954 - RNA, 19 nt, Homo sapiens
caaagcgcauggagacuaa

SEQ ID NO: 1017955 - RNA, 19 nt, Homo sapiens
gaucaauggucucagaaau

SEQ ID NO: 1017956 - RNA, 19 nt, Homo sapiens
gaacauggaauugugguuu

SEQ ID NO: 1017957 - RNA, 19 nt, Homo sapiens
gaauuugaagccuacauua

SEQ ID NO: 1017958 - RNA, 19 nt, Homo sapiens
cggcagugcuggcuaagua

SEQ ID NO: 1017959 - RNA, 19 nt, Homo sapiens
caauaugucuuuggucuau

SEQ ID NO: 1017960 - RNA, 19 nt, Homo sapiens
ggagugacccugaauguuc

SEQ ID NO: 1017961 - RNA, 19 nt, Homo sapiens
gccacuaucucaggaauuu

SEQ ID NO: 1017962 - RNA, 19 nt, Homo sapiens
guguggagcuacuacauaa

SEQ ID NO: 1017963 - RNA, 19 nt, Homo sapiens
ggcaauugcugaugcuuug

SEQ ID NO: 1017964 - RNA, 19 nt, Homo sapiens
gcaaagcgcauggagacua

SEQ ID NO: 1017965 - RNA, 19 nt, Homo sapiens
ucaauggucucagaaauuc

SEQ ID NO: 1017966 - RNA, 19 nt, Homo sapiens
gaauaugcacaucaaagaa

SEQ ID NO: 1017967 - RNA, 19 nt, Homo sapiens
ccaaacccuuccuccuaua

SEQ ID NO: 1017968 - RNA, 19 nt, Homo sapiens
ucagaaguauggcaauguu

SEQ ID NO: 1017969 - RNA, 19 nt, Homo sapiens
uaagaaagcccacaaaucc

SEQ ID NO: 1017970 - RNA, 19 nt, Homo sapiens
ggaauuugaagccuacauu

SEQ ID NO: 1017971 - RNA, 19 nt, Homo sapiens
gcgaacaacacgauacuug

SEQ ID NO: 1017972 - RNA, 19 nt, Homo sapiens
ccacaggacugcugcuucu

SEQ ID NO: 1017973 - RNA, 19 nt, Homo sapiens
gaauugugguuuucucuuu

SEQ ID NO: 1017974 - RNA, 19 nt, Homo sapiens
ccuccuauauuccuagauu

SEQ ID NO: 1017975 - RNA, 19 nt, Homo sapiens
gagcuggagugacccugaa

SEQ ID NO: 1017976 - RNA, 19 nt, Homo sapiens
ggacccaggaugaauuuga

SEQ ID NO: 1017977 - RNA, 19 nt, Homo sapiens
ccugaaugcuacuuccuuu

SEQ ID NO: 1017978 - RNA, 19 nt, Homo sapiens
gaaugcuacuuccuuugau

SEQ ID NO: 1017979 - RNA, 19 nt, Homo sapiens
gaaguauggcaauguugaa

SEQ ID NO: 1017980 - RNA, 19 nt, Homo sapiens
ugaauaugcacaucaaaga

SEQ ID NO: 1017981 - RNA, 19 nt, Homo sapiens
guccaaacccuuccuccua

SEQ ID NO: 1017982 - RNA, 19 nt, Homo sapiens
ugaaugcuacuuccuuuga

SEQ ID NO: 1017983 - RNA, 19 nt, Homo sapiens
cgugauugguuuccucuug

SEQ ID NO: 1017984 - RNA, 19 nt, Homo sapiens
gacccugaauguucuggaa

SEQ ID NO: 1017985 - RNA, 19 nt, Homo sapiens
ugaauuugaucgccaugug

SEQ ID NO: 1017986 - RNA, 19 nt, Homo sapiens
gacccaggaugaauuugau

SEQ ID NO: 1017987 - RNA, 19 nt, Homo sapiens
cccacgaccucaccuggua

SEQ ID NO: 1017988 - RNA, 19 nt, Homo sapiens
gugaucagauggacaaugc

SEQ ID NO: 1017989 - RNA, 19 nt, Homo sapiens
ccaugugauuuagacuuua

SEQ ID NO: 1017990 - RNA, 19 nt, Homo sapiens
gcuaaguaccugucgauuc

SEQ ID NO: 1017991 - RNA, 19 nt, Homo sapiens
ugaacaauaugucuuuggu

SEQ ID NO: 1017992 - RNA, 19 nt, Homo sapiens
gaugacccgugccuuuauc

SEQ ID NO: 1017993 - RNA, 19 nt, Homo sapiens
uccaugugauuuagacuuu

SEQ ID NO: 1017994 - RNA, 19 nt, Homo sapiens
cuaaguaccugucgauucc

SEQ ID NO: 1017995 - RNA, 19 nt, Homo sapiens
cuucaucaccuuuaaaugu

SEQ ID NO: 1017996 - RNA, 19 nt, Homo sapiens
gaucagauggacaaugcaa

SEQ ID NO: 1017997 - RNA, 19 nt, Homo sapiens
caacaggaagccacuaucu

SEQ ID NO: 1017998 - RNA, 19 nt, Homo sapiens
gaaauuccagagaagaaag

SEQ ID NO: 1017999 - RNA, 19 nt, Homo sapiens
gggccacacucaacuguac

SEQ ID NO: 1018000 - RNA, 19 nt, Homo sapiens
ccuuggacgugauugguuu

SEQ ID NO: 1018001 - RNA, 19 nt, Homo sapiens
gcacaucaaagaagagaac

SEQ ID NO: 1018002 - RNA, 19 nt, Homo sapiens
ccgaugacccgugccuuua

SEQ ID NO: 1018003 - RNA, 19 nt, Homo sapiens
agaaagcuauggcaauugc

SEQ ID NO: 1018004 - RNA, 19 nt, Homo sapiens
cagaaauuccagagaagaa

SEQ ID NO: 1018005 - RNA, 19 nt, Homo sapiens
uggagaacauggaauugug

SEQ ID NO: 1018006 - RNA, 19 nt, Homo sapiens
cuagauuacuaacaaccaa

SEQ ID NO: 1018007 - RNA, 19 nt, Homo sapiens
uccaaacccuuccuccuau

SEQ ID NO: 1018008 - RNA, 19 nt, Homo sapiens
gucgauuccuacuguguuu

SEQ ID NO: 1018009 - RNA, 19 nt, Homo sapiens
ggaucaauggucucagaaa

SEQ ID NO: 1018010 - RNA, 19 nt, Homo sapiens
uuugaagccuacauuaaug

SEQ ID NO: 1018011 - RNA, 19 nt, Homo sapiens
gcaaagggucaagaacaug

SEQ ID NO: 1018012 - RNA, 19 nt, Homo sapiens
guuaagaaagcccacaaau

SEQ ID NO: 1018013 - RNA, 19 nt, Homo sapiens
gagugacccugaauguucu

SEQ ID NO: 1018014 - RNA, 19 nt, Homo sapiens
acaggaagccacuaucuca

SEQ ID NO: 1018015 - RNA, 19 nt, Homo sapiens
gggacuuugugauggacua

SEQ ID NO: 1018016 - RNA, 19 nt, Homo sapiens
uuaagaaagcccacaaauc

SEQ ID NO: 1018017 - RNA, 19 nt, Homo sapiens
acaaauccaagacccauug

SEQ ID NO: 1018018 - RNA, 19 nt, Homo sapiens
gugaugaugcccuuguuug

SEQ ID NO: 1018019 - RNA, 19 nt, Homo sapiens
gauauucucagucaugcau

SEQ ID NO: 1018020 - RNA, 19 nt, Homo sapiens
agaaguauggcaauguuga

SEQ ID NO: 1018021 - RNA, 19 nt, Homo sapiens
gaacccgaccaucgaaucu

SEQ ID NO: 1018022 - RNA, 19 nt, Homo sapiens
ugggaucaauggucucaga

SEQ ID NO: 1018023 - RNA, 19 nt, Homo sapiens
guggagcuacuacauaaug

SEQ ID NO: 1018024 - RNA, 19 nt, Homo sapiens
agaaagcccacaaauccaa

SEQ ID NO: 1018025 - RNA, 19 nt, Homo sapiens
caauucagaccacaugaca

SEQ ID NO: 1018026 - RNA, 19 nt, Homo sapiens
ccugacaaccuaugccauu

SEQ ID NO: 1018027 - RNA, 19 nt, Homo sapiens
ugaauguucuggaaaugac

SEQ ID NO: 1018028 - RNA, 19 nt, Homo sapiens
cugacaaccuaugccauuu

SEQ ID NO: 1018029 - RNA, 19 nt, Homo sapiens
ggugaugaugcccuuguuu

SEQ ID NO: 1018030 - RNA, 19 nt, Homo sapiens
agaagaaagcuauggcaau

SEQ ID NO: 1018031 - RNA, 19 nt, Homo sapiens
gacaaccuaugccauuucg

SEQ ID NO: 1018032 - RNA, 19 nt, Homo sapiens
ugcaaagggucaagaacau

SEQ ID NO: 1018033 - RNA, 19 nt, Homo sapiens
uggagcuacuacauaauga

SEQ ID NO: 1018034 - RNA, 19 nt, Homo sapiens
cuccuauauuccuagauua

SEQ ID NO: 1018035 - RNA, 19 nt, Homo sapiens
ucaucaccuuuaaauguug

SEQ ID NO: 1018036 - RNA, 19 nt, Homo sapiens
uuaaguggcuaccccaaaa

SEQ ID NO: 1018037 - RNA, 19 nt, Homo sapiens
ggaacccgaccaucgaauc

SEQ ID NO: 1018038 - RNA, 19 nt, Homo sapiens
caaacccuuccuccuauau

SEQ ID NO: 1018039 - RNA, 19 nt, Homo sapiens
gaggugaauaugcacauca

SEQ ID NO: 1018040 - RNA, 19 nt, Homo sapiens
caaauccaagacccauuga

SEQ ID NO: 1018041 - RNA, 19 nt, Homo sapiens
guggauauucucagucaug

SEQ ID NO: 1018042 - RNA, 19 nt, Homo sapiens
guugaacaauaugucuuug

SEQ ID NO: 1018043 - RNA, 19 nt, Homo sapiens
auucagaccacaugacauu

SEQ ID NO: 1018044 - RNA, 19 nt, Homo sapiens
gugaauaugcacaucaaag

SEQ ID NO: 1018045 - RNA, 19 nt, Homo sapiens
ugucagugguggauauucu

SEQ ID NO: 1018046 - RNA, 19 nt, Homo sapiens
cauaaugaggcccugauca

SEQ ID NO: 1018047 - RNA, 19 nt, Homo sapiens
uggccuucaucaccuuuaa

SEQ ID NO: 1018048 - RNA, 19 nt, Homo sapiens
ggguggaguuugugaugag

SEQ ID NO: 1018049 - RNA, 19 nt, Homo sapiens
gaagccacuaucucaggaa

SEQ ID NO: 1018050 - RNA, 19 nt, Homo sapiens
ggccaaucaugcccaacau

SEQ ID NO: 1018051 - RNA, 19 nt, Homo sapiens
ugguggauauucucaguca

SEQ ID NO: 1018052 - RNA, 19 nt, Homo sapiens
gaaaggaccugcccugaua

SEQ ID NO: 1018053 - RNA, 19 nt, Homo sapiens
guacuggaauugaguguaa

SEQ ID NO: 1018054 - RNA, 19 nt, Homo sapiens
gaaaggaguuggagacaag

SEQ ID NO: 1018055 - RNA, 19 nt, Homo sapiens
ggaauugaguguaaagaug

SEQ ID NO: 1018056 - RNA, 19 nt, Homo sapiens
ggucagaacguuugcuuua

SEQ ID NO: 1018057 - RNA, 19 nt, Homo sapiens
gggagacuuugacuauuua

SEQ ID NO: 1018058 - RNA, 19 nt, Homo sapiens
gaacagacaacacugaaau

SEQ ID NO: 1018059 - RNA, 19 nt, Homo sapiens
cgaguugucuugaauaaau

SEQ ID NO: 1018060 - RNA, 19 nt, Homo sapiens
agauugagcuguaugaauu

SEQ ID NO: 1018061 - RNA, 19 nt, Homo sapiens
caucaagccucaguucuuu

SEQ ID NO: 1018062 - RNA, 19 nt, Homo sapiens
agacaacacugaaaucuca

SEQ ID NO: 1018063 - RNA, 19 nt, Homo sapiens
gaaccacacuacuugaauc

SEQ ID NO: 1018064 - RNA, 19 nt, Homo sapiens
gacgaguugucuugaauaa

SEQ ID NO: 1018065 - RNA, 19 nt, Homo sapiens
gaagagaacugggcugacu

SEQ ID NO: 1018066 - RNA, 19 nt, Homo sapiens
gaguaaggaugaagcuuug

SEQ ID NO: 1018067 - RNA, 19 nt, Homo sapiens
ucuaggaacugccugguuu

SEQ ID NO: 1018068 - RNA, 19 nt, Homo sapiens
ugggagacuuugacuauuu

SEQ ID NO: 1018069 - RNA, 19 nt, Homo sapiens
caagaacucugcgccauca

SEQ ID NO: 1018070 - RNA, 19 nt, Homo sapiens
gaaccugggagacagauga

SEQ ID NO: 1018071 - RNA, 19 nt, Homo sapiens
gaugacgaguugucuugaa

SEQ ID NO: 1018072 - RNA, 19 nt, Homo sapiens
ugaacuaccuucccuugga

SEQ ID NO: 1018073 - RNA, 19 nt, Homo sapiens
ggaccugcccugauaaugu

SEQ ID NO: 1018074 - RNA, 19 nt, Homo sapiens
cgggacaacuuuaucaaga

SEQ ID NO: 1018075 - RNA, 19 nt, Homo sapiens
uggcaucgcuuaugugcaa

SEQ ID NO: 1018076 - RNA, 19 nt, Homo sapiens
gcccagacauuuccuucuu

SEQ ID NO: 1018077 - RNA, 19 nt, Homo sapiens
gugcaaggcaugaaugaaa

SEQ ID NO: 1018078 - RNA, 19 nt, Homo sapiens
ggacaccgccugcagaaag

SEQ ID NO: 1018079 - RNA, 19 nt, Homo sapiens
gaagccgggugccauagug

SEQ ID NO: 1018080 - RNA, 19 nt, Homo sapiens
gagccgaauugcagauuuc

SEQ ID NO: 1018081 - RNA, 19 nt, Homo sapiens
ggaguggggucacaaauau

SEQ ID NO: 1018082 - RNA, 19 nt, Homo sapiens
gaucaaagucagccucuuc

SEQ ID NO: 1018083 - RNA, 19 nt, Homo sapiens
acacagaaaucuuggaaac

SEQ ID NO: 1018084 - RNA, 19 nt, Homo sapiens
uaaaucauguguucuuugc

SEQ ID NO: 1018085 - RNA, 19 nt, Homo sapiens
ggacacauagaaaccugua

SEQ ID NO: 1018086 - RNA, 19 nt, Homo sapiens
ccagggaggaugugacuuu

SEQ ID NO: 1018087 - RNA, 19 nt, Homo sapiens
ucagacuccuggcuaugua

SEQ ID NO: 1018088 - RNA, 19 nt, Homo sapiens
accaaaugcugcugaguaa

SEQ ID NO: 1018089 - RNA, 19 nt, Homo sapiens
caugauuccucucuccauu

SEQ ID NO: 1018090 - RNA, 19 nt, Homo sapiens
gagcggauccuguucaucu

SEQ ID NO: 1018091 - RNA, 19 nt, Homo sapiens
cagaacguuugcuuuaguu

SEQ ID NO: 1018092 - RNA, 19 nt, Homo sapiens
ccagguggcucuucuacca

SEQ ID NO: 1018093 - RNA, 19 nt, Homo sapiens
acaaagauguccggagguu

SEQ ID NO: 1018094 - RNA, 19 nt, Homo sapiens
ggagcuguaugcccaguuc

SEQ ID NO: 1018095 - RNA, 19 nt, Homo sapiens
gaucuuggacacuuacaga

SEQ ID NO: 1018096 - RNA, 19 nt, Homo sapiens
gaccugcccugauaauguc

SEQ ID NO: 1018097 - RNA, 19 nt, Homo sapiens
ugaguaaggaugaagcuuu

SEQ ID NO: 1018098 - RNA, 19 nt, Homo sapiens
gaaggagcccucaauugca

SEQ ID NO: 1018099 - RNA, 19 nt, Homo sapiens
aaucauguguucuuugcaa

SEQ ID NO: 1018100 - RNA, 19 nt, Homo sapiens
ucagaacguuugcuuuagu

SEQ ID NO: 1018101 - RNA, 19 nt, Homo sapiens
uccaggaccuccaggauga

SEQ ID NO: 1018102 - RNA, 19 nt, Homo sapiens
gaagucaacaccaugucaa

SEQ ID NO: 1018103 - RNA, 19 nt, Homo sapiens
ggagacagaugaggagacu

SEQ ID NO: 1018104 - RNA, 19 nt, Homo sapiens
gacugugucuugcuucaug

SEQ ID NO: 1018105 - RNA, 19 nt, Homo sapiens
ggaacagacaacacugaaa

SEQ ID NO: 1018106 - RNA, 19 nt, Homo sapiens
ugaguucuguacuggaauu

SEQ ID NO: 1018107 - RNA, 19 nt, Homo sapiens
ggaacccauugcuucagaa

SEQ ID NO: 1018108 - RNA, 19 nt, Homo sapiens
gcacaagagccgaauugca

SEQ ID NO: 1018109 - RNA, 19 nt, Homo sapiens
ggaggugcuuggccaaugg

SEQ ID NO: 1018110 - RNA, 19 nt, Homo sapiens
auaaggauguggagcucua

SEQ ID NO: 1018111 - RNA, 19 nt, Homo sapiens
ugaaacccuucguaagaga

SEQ ID NO: 1018112 - RNA, 19 nt, Homo sapiens
ggaagucaacaccauguca

SEQ ID NO: 1018113 - RNA, 19 nt, Homo sapiens
ggaaccacacuacuugaau

SEQ ID NO: 1018114 - RNA, 19 nt, Homo sapiens
guguaaagaugggaagaga

SEQ ID NO: 1018115 - RNA, 19 nt, Homo sapiens
acagaaaucuuggaaacca

SEQ ID NO: 1018116 - RNA, 19 nt, Homo sapiens
acacguacuucaaggacaa

SEQ ID NO: 1018117 - RNA, 19 nt, Homo sapiens
cuuggacacuuacagauug

SEQ ID NO: 1018118 - RNA, 19 nt, Homo sapiens
gaggcuuccugcuugagaa

SEQ ID NO: 1018119 - RNA, 19 nt, Homo sapiens
cuacuugaaucaccauuac

SEQ ID NO: 1018120 - RNA, 19 nt, Homo sapiens
ugucaagucugcacaagag

SEQ ID NO: 1018121 - RNA, 19 nt, Homo sapiens
ugaaggagcccucaauugc

SEQ ID NO: 1018122 - RNA, 19 nt, Homo sapiens
gcugaguccugccgucugu

SEQ ID NO: 1018123 - RNA, 19 nt, Homo sapiens
gcuccaagacucaaaguag

SEQ ID NO: 1018124 - RNA, 19 nt, Homo sapiens
gagauccgggacaacuuua

SEQ ID NO: 1018125 - RNA, 19 nt, Homo sapiens
gggaggaugugacuuuuga

SEQ ID NO: 1018126 - RNA, 19 nt, Homo sapiens
cgagauccgggacaacuuu

SEQ ID NO: 1018127 - RNA, 19 nt, Homo sapiens
ucacuuagaggguucugaa

SEQ ID NO: 1018128 - RNA, 19 nt, Homo sapiens
gggaggugcuuggccaaug

SEQ ID NO: 1018129 - RNA, 19 nt, Homo sapiens
ggcuggagcucgggaaguu

SEQ ID NO: 1018130 - RNA, 19 nt, Homo sapiens
ccugcacucugcccucuuu

SEQ ID NO: 1018131 - RNA, 19 nt, Homo sapiens
ugacaaccgcuuugacuuc

SEQ ID NO: 1018132 - RNA, 19 nt, Homo sapiens
guaaagaugggaagagaac

SEQ ID NO: 1018133 - RNA, 19 nt, Homo sapiens
ccuacaagauggagaaggu

SEQ ID NO: 1018134 - RNA, 19 nt, Homo sapiens
gggacaacuuuaucaagag

SEQ ID NO: 1018135 - RNA, 19 nt, Homo sapiens
gagguugugcccagacauu

SEQ ID NO: 1018136 - RNA, 19 nt, Homo sapiens
ugacgaguugucuugaaua

SEQ ID NO: 1018137 - RNA, 19 nt, Homo sapiens
gggaugaggcauggguaua

SEQ ID NO: 1018138 - RNA, 19 nt, Homo sapiens
aaccaaaugcugcugagua

SEQ ID NO: 1018139 - RNA, 19 nt, Homo sapiens
ccaagcagagggagcugua

SEQ ID NO: 1018140 - RNA, 19 nt, Homo sapiens
ccaagucaccucccuccuu

SEQ ID NO: 1018141 - RNA, 19 nt, Homo sapiens
caaaugcugcugaguaagg

SEQ ID NO: 1018142 - RNA, 19 nt, Homo sapiens
uacuccaccuugaaagaua

SEQ ID NO: 1018143 - RNA, 19 nt, Homo sapiens
acaagauggagaagguuua

SEQ ID NO: 1018144 - RNA, 19 nt, Homo sapiens
uaagagaguggaacagaca

SEQ ID NO: 1018145 - RNA, 19 nt, Homo sapiens
uuugaaacccuucguaaga

SEQ ID NO: 1018146 - RNA, 19 nt, Homo sapiens
ucugaguucuguacuggaa

SEQ ID NO: 1018147 - RNA, 19 nt, Homo sapiens
agaaaggaguuggagacaa

SEQ ID NO: 1018148 - RNA, 19 nt, Homo sapiens
ggaacacguacuucaagga

SEQ ID NO: 1018149 - RNA, 19 nt, Homo sapiens
cggaacccauugcuucaga

SEQ ID NO: 1018150 - RNA, 19 nt, Homo sapiens
gaugacaaccgcuuugacu

SEQ ID NO: 1018151 - RNA, 19 nt, Homo sapiens
gcgccaucaucccuaaaug

SEQ ID NO: 1018152 - RNA, 19 nt, Homo sapiens
gagaaugcuuugaagauau

SEQ ID NO: 1018153 - RNA, 19 nt, Homo sapiens
ggguaaaucuucagcgaaa

SEQ ID NO: 1018154 - RNA, 19 nt, Homo sapiens
ggacagagucuugaggaua

SEQ ID NO: 1018155 - RNA, 19 nt, Homo sapiens
ggaggcaacucagugauug

SEQ ID NO: 1018156 - RNA, 19 nt, Homo sapiens
uaaauaaacugcugaacac

SEQ ID NO: 1018157 - RNA, 19 nt, Homo sapiens
ccaagaacgugcggaauga

SEQ ID NO: 1018158 - RNA, 19 nt, Homo sapiens
agagaaugcuuugaagaua

SEQ ID NO: 1018159 - RNA, 19 nt, Homo sapiens
caaacgagacggagaaaga

SEQ ID NO: 1018160 - RNA, 19 nt, Homo sapiens
guaaauaaacugcugaaca

SEQ ID NO: 1018161 - RNA, 19 nt, Homo sapiens
ggaccaggacauacaguuu

SEQ ID NO: 1018162 - RNA, 19 nt, Homo sapiens
gcagaagaaucgcuugaac

SEQ ID NO: 1018163 - RNA, 19 nt, Homo sapiens
ggagaguacucacuaacag

SEQ ID NO: 1018164 - RNA, 19 nt, Homo sapiens
gacagagucuugaggauac

SEQ ID NO: 1018165 - RNA, 19 nt, Homo sapiens
gcagugagcgcccuguguu

SEQ ID NO: 1018166 - RNA, 19 nt, Homo sapiens
gugcccacuuuguaaauaa

SEQ ID NO: 1018167 - RNA, 19 nt, Homo sapiens
caccgaggauggcauauuc

SEQ ID NO: 1018168 - RNA, 19 nt, Homo sapiens
gaacugccuccucuuguca

SEQ ID NO: 1018169 - RNA, 19 nt, Homo sapiens
agagacagaugaacuuugg

SEQ ID NO: 1018170 - RNA, 19 nt, Homo sapiens
gaagacacagagacagaug

SEQ ID NO: 1018171 - RNA, 19 nt, Homo sapiens
agaaugcuuugaagauaug

SEQ ID NO: 1018172 - RNA, 19 nt, Homo sapiens
agacugggaucuugaaagg

SEQ ID NO: 1018173 - RNA, 19 nt, Homo sapiens
uauggagaguacucacuaa

SEQ ID NO: 1018174 - RNA, 19 nt, Homo sapiens
caacuacacugcgcugcau

SEQ ID NO: 1018175 - RNA, 19 nt, Homo sapiens
gcaccgaggauggcauauu

SEQ ID NO: 1018176 - RNA, 19 nt, Homo sapiens
gccaagaacgugcggaaug

SEQ ID NO: 1018177 - RNA, 19 nt, Homo sapiens
agcggaagcucucggguuu

SEQ ID NO: 1018178 - RNA, 19 nt, Homo sapiens
gggaggcaacucagugauu

SEQ ID NO: 1018179 - RNA, 19 nt, Homo sapiens
ccagguccguguuuaugau

SEQ ID NO: 1018180 - RNA, 19 nt, Homo sapiens
gucuggagcauaagguuua

SEQ ID NO: 1018181 - RNA, 19 nt, Homo sapiens
gaccaccuauggagaguac

SEQ ID NO: 1018182 - RNA, 19 nt, Homo sapiens
gaccaggacauacaguuuc

SEQ ID NO: 1018183 - RNA, 19 nt, Homo sapiens
ggaaugacuggcuggacuu

SEQ ID NO: 1018184 - RNA, 19 nt, Homo sapiens
uaagguuuaucucaagucu

SEQ ID NO: 1018185 - RNA, 19 nt, Homo sapiens
acucagugauugugggaaa

SEQ ID NO: 1018186 - RNA, 19 nt, Homo sapiens
caccgagacugggaucuug

SEQ ID NO: 1018187 - RNA, 19 nt, Homo sapiens
acaggacggugaagcacuu

SEQ ID NO: 1018188 - RNA, 19 nt, Homo sapiens
ugaacugccuccucuuguc

SEQ ID NO: 1018189 - RNA, 19 nt, Homo sapiens
agguuuaucucaagucuca

SEQ ID NO: 1018190 - RNA, 19 nt, Homo sapiens
gcacccucaucacaugugu

SEQ ID NO: 1018191 - RNA, 19 nt, Homo sapiens
gcaccgagacugggaucuu

SEQ ID NO: 1018192 - RNA, 19 nt, Homo sapiens
uagaagacacagagacaga

SEQ ID NO: 1018193 - RNA, 19 nt, Homo sapiens
aaacgagacggagaaagaa

SEQ ID NO: 1018194 - RNA, 19 nt, Homo sapiens
ggucuggagcauaagguuu

SEQ ID NO: 1018195 - RNA, 19 nt, Homo sapiens
cgacggcacccucaucaca

SEQ ID NO: 1018196 - RNA, 19 nt, Homo sapiens
cagcaccgaggauggcaua

SEQ ID NO: 1018197 - RNA, 19 nt, Homo sapiens
ugugcccacuuuguaaaua

SEQ ID NO: 1018198 - RNA, 19 nt, Homo sapiens
ggauacacgggacccagaa

SEQ ID NO: 1018199 - RNA, 19 nt, Homo sapiens
aagagaaugcuuugaagau

SEQ ID NO: 1018200 - RNA, 19 nt, Homo sapiens
gcagugccacccuucaaag

SEQ ID NO: 1018201 - RNA, 19 nt, Homo sapiens
gggcagcuggcagaaauug

SEQ ID NO: 1018202 - RNA, 19 nt, Homo sapiens
agacacagagacagaugaa

SEQ ID NO: 1018203 - RNA, 19 nt, Homo sapiens
cuauggagaguacucacua

SEQ ID NO: 1018204 - RNA, 19 nt, Homo sapiens
ccaccagguccguguuuau

SEQ ID NO: 1018205 - RNA, 19 nt, Homo sapiens
gcacuucagcaccgaggau

SEQ ID NO: 1018206 - RNA, 19 nt, Homo sapiens
cgagacggagaaagaagaa

SEQ ID NO: 1018207 - RNA, 19 nt, Homo sapiens
acacagagacagaugaacu

SEQ ID NO: 1018208 - RNA, 19 nt, Homo sapiens
gagaccaccuauggagagu

SEQ ID NO: 1018209 - RNA, 19 nt, Homo sapiens
gcagggcucugaggaaccu

SEQ ID NO: 1018210 - RNA, 19 nt, Homo sapiens
cggaagcucucggguuugg

SEQ ID NO: 1018211 - RNA, 19 nt, Homo sapiens
gaaugacuggcuggacuug

SEQ ID NO: 1018212 - RNA, 19 nt, Homo sapiens
ggaggcugaggcagaagaa

SEQ ID NO: 1018213 - RNA, 19 nt, Homo sapiens
gcucugaggaaccuguguu

SEQ ID NO: 1018214 - RNA, 19 nt, Homo sapiens
ccaacaaggugccccuaga

SEQ ID NO: 1018215 - RNA, 19 nt, Homo sapiens
ccggaagugugaacugucu

SEQ ID NO: 1018216 - RNA, 19 nt, Homo sapiens
ggcaugacaaggacaagga

SEQ ID NO: 1018217 - RNA, 19 nt, Homo sapiens
gagucuggcaugacaagga

SEQ ID NO: 1018218 - RNA, 19 nt, Homo sapiens
gagacugggaucuugaaag

SEQ ID NO: 1018219 - RNA, 19 nt, Homo sapiens
cagagacagaugaacuuug

SEQ ID NO: 1018220 - RNA, 19 nt, Homo sapiens
acagagacagaugaacuuu

SEQ ID NO: 1018221 - RNA, 19 nt, Homo sapiens
cacagagacagaugaacuu

SEQ ID NO: 1018222 - RNA, 19 nt, Homo sapiens
gggaccaggacauacaguu

SEQ ID NO: 1018223 - RNA, 19 nt, Homo sapiens
gacccacuccuggaacuga

SEQ ID NO: 1018224 - RNA, 19 nt, Homo sapiens
cauauuccagggucagaga

SEQ ID NO: 1018225 - RNA, 19 nt, Homo sapiens
ccuagaagacacagagaca

SEQ ID NO: 1018226 - RNA, 19 nt, Homo sapiens
ggaggcggagguugagcaa

SEQ ID NO: 1018227 - RNA, 19 nt, Homo sapiens
ggcagaagaaucgcuugaa

SEQ ID NO: 1018228 - RNA, 19 nt, Homo sapiens
gaacaaagcuguaugugau

SEQ ID NO: 1018229 - RNA, 19 nt, Homo sapiens
ggaauggacugguuaauag

SEQ ID NO: 1018230 - RNA, 19 nt, Homo sapiens
caaagaagaugcuuaugau

SEQ ID NO: 1018231 - RNA, 19 nt, Homo sapiens
gcaaagaagaugcuuauga

SEQ ID NO: 1018232 - RNA, 19 nt, Homo sapiens
caaagugcauaacauagua

SEQ ID NO: 1018233 - RNA, 19 nt, Homo sapiens
aaacaucacugcccaaguu

SEQ ID NO: 1018234 - RNA, 19 nt, Homo sapiens
ucacacaucuuucuguauu

SEQ ID NO: 1018235 - RNA, 19 nt, Homo sapiens
gaagaaacacaacuuauca

SEQ ID NO: 1018236 - RNA, 19 nt, Homo sapiens
uggaagagauggauuuaaa

SEQ ID NO: 1018237 - RNA, 19 nt, Homo sapiens
gguagaaauuguucaagaa

SEQ ID NO: 1018238 - RNA, 19 nt, Homo sapiens
gaauuuacaggaagagaua

SEQ ID NO: 1018239 - RNA, 19 nt, Homo sapiens
uaggagaccuuaaauugaa

SEQ ID NO: 1018240 - RNA, 19 nt, Homo sapiens
gaagagauggauuuaaaga

SEQ ID NO: 1018241 - RNA, 19 nt, Homo sapiens
ugugauggcuucuguguuu

SEQ ID NO: 1018242 - RNA, 19 nt, Homo sapiens
cacaguaccuaccguuaua

SEQ ID NO: 1018243 - RNA, 19 nt, Homo sapiens
gaaaggcacgcuuaaacaa

SEQ ID NO: 1018244 - RNA, 19 nt, Homo sapiens
guucagaagcguacaauuu

SEQ ID NO: 1018245 - RNA, 19 nt, Homo sapiens
gcagaggaaaugaguuaua

SEQ ID NO: 1018246 - RNA, 19 nt, Homo sapiens
caucaaagugcauaacaua

SEQ ID NO: 1018247 - RNA, 19 nt, Homo sapiens
gagauggauuuaaagaaga

SEQ ID NO: 1018248 - RNA, 19 nt, Homo sapiens
ggaagaaacacaacuuauc

SEQ ID NO: 1018249 - RNA, 19 nt, Homo sapiens
guacucaugaugcaaguua

SEQ ID NO: 1018250 - RNA, 19 nt, Homo sapiens
aaagaaugguguagacuug

SEQ ID NO: 1018251 - RNA, 19 nt, Homo sapiens
cagaggaaaugaguuauau

SEQ ID NO: 1018252 - RNA, 19 nt, Homo sapiens
gaagaacaaagcuguaugu

SEQ ID NO: 1018253 - RNA, 19 nt, Homo sapiens
ugugugaucuucaaacauu

SEQ ID NO: 1018254 - RNA, 19 nt, Homo sapiens
gguacccaguuaucaauuu

SEQ ID NO: 1018255 - RNA, 19 nt, Homo sapiens
guucacacuucuaagagua

SEQ ID NO: 1018256 - RNA, 19 nt, Homo sapiens
gauauuuccuauacucuca

SEQ ID NO: 1018257 - RNA, 19 nt, Homo sapiens
uagcagaggaaaugaguua

SEQ ID NO: 1018258 - RNA, 19 nt, Homo sapiens
ggaaaggcacgcuuaaaca

SEQ ID NO: 1018259 - RNA, 19 nt, Homo sapiens
gcuuuuagcuagacauuua

SEQ ID NO: 1018260 - RNA, 19 nt, Homo sapiens
auagugaaguccauaauga

SEQ ID NO: 1018261 - RNA, 19 nt, Homo sapiens
guaaucaucugcauguuuu

SEQ ID NO: 1018262 - RNA, 19 nt, Homo sapiens
ccuauacucucaaugaaga

SEQ ID NO: 1018263 - RNA, 19 nt, Homo sapiens
uaacauaguacucaugaug

SEQ ID NO: 1018264 - RNA, 19 nt, Homo sapiens
cagcuuggaucuggcauaa

SEQ ID NO: 1018265 - RNA, 19 nt, Homo sapiens
aauaggagaccuuaaauug

SEQ ID NO: 1018266 - RNA, 19 nt, Homo sapiens
uaugauuucuguacucuga

SEQ ID NO: 1018267 - RNA, 19 nt, Homo sapiens
gaggaaaugaguuauaugu

SEQ ID NO: 1018268 - RNA, 19 nt, Homo sapiens
gaccuuaaauugaacaaac

SEQ ID NO: 1018269 - RNA, 19 nt, Homo sapiens
gguaaucaucugcauguuu

SEQ ID NO: 1018270 - RNA, 19 nt, Homo sapiens
agaagaugcuuaugaugga

SEQ ID NO: 1018271 - RNA, 19 nt, Homo sapiens
agagauggauuuaaagaag

SEQ ID NO: 1018272 - RNA, 19 nt, Homo sapiens
gcaaguuacugugacaaca

SEQ ID NO: 1018273 - RNA, 19 nt, Homo sapiens
cuauuacucugucgaaguu

SEQ ID NO: 1018274 - RNA, 19 nt, Homo sapiens
ucagaagcguacaauuuau

SEQ ID NO: 1018275 - RNA, 19 nt, Homo sapiens
cagccuaugucaguuauga

SEQ ID NO: 1018276 - RNA, 19 nt, Homo sapiens
ggaccugcaguucuuguaa

SEQ ID NO: 1018277 - RNA, 19 nt, Homo sapiens
caggagagguaucaguaug

SEQ ID NO: 1018278 - RNA, 19 nt, Homo sapiens
gagauuaaggccaagaaga

SEQ ID NO: 1018279 - RNA, 19 nt, Homo sapiens
guacuaggaucuuuuacuu

SEQ ID NO: 1018280 - RNA, 19 nt, Homo sapiens
ugauuucuguacucugaua

SEQ ID NO: 1018281 - RNA, 19 nt, Homo sapiens
caugaggaauggacugguu

SEQ ID NO: 1018282 - RNA, 19 nt, Homo sapiens
gugauugccuaacacuuau

SEQ ID NO: 1018283 - RNA, 19 nt, Homo sapiens
uucagaagcguacaauuua

SEQ ID NO: 1018284 - RNA, 19 nt, Homo sapiens
caagaagaacaaagcugua

SEQ ID NO: 1018285 - RNA, 19 nt, Homo sapiens
uggcauugauuccauauag

SEQ ID NO: 1018286 - RNA, 19 nt, Homo sapiens
gaaauucagaaacccauag

SEQ ID NO: 1018287 - RNA, 19 nt, Homo sapiens
cacacaucuuucuguauua

SEQ ID NO: 1018288 - RNA, 19 nt, Homo sapiens
ugucacuuauuucagguua

SEQ ID NO: 1018289 - RNA, 19 nt, Homo sapiens
agucauagcuccagucacu

SEQ ID NO: 1018290 - RNA, 19 nt, Homo sapiens
ugaaguccauaaugaagau

SEQ ID NO: 1018291 - RNA, 19 nt, Homo sapiens
guggaagaaacacaacuua

SEQ ID NO: 1018292 - RNA, 19 nt, Homo sapiens
cauaacauaguacucauga

SEQ ID NO: 1018293 - RNA, 19 nt, Homo sapiens
caaauugauuacacaguac

SEQ ID NO: 1018294 - RNA, 19 nt, Homo sapiens
ggagagguaucaguauguc

SEQ ID NO: 1018295 - RNA, 19 nt, Homo sapiens
ucagggaacaggaagaauu

SEQ ID NO: 1018296 - RNA, 19 nt, Homo sapiens
uaaagaaugguguagacuu

SEQ ID NO: 1018297 - RNA, 19 nt, Homo sapiens
gcuuggaucuggcauaaaa

SEQ ID NO: 1018298 - RNA, 19 nt, Homo sapiens
ggggcagucugaauauuua

SEQ ID NO: 1018299 - RNA, 19 nt, Homo sapiens
ugguagaaauuguucaaga

SEQ ID NO: 1018300 - RNA, 19 nt, Homo sapiens
uuucacacaucuuucugua

SEQ ID NO: 1018301 - RNA, 19 nt, Homo sapiens
gcauugauuccauauagug

SEQ ID NO: 1018302 - RNA, 19 nt, Homo sapiens
uauguggaauuuacaggaa

SEQ ID NO: 1018303 - RNA, 19 nt, Homo sapiens
gaaugguguagacuuguuu

SEQ ID NO: 1018304 - RNA, 19 nt, Homo sapiens
gguacagacucauuacaac

SEQ ID NO: 1018305 - RNA, 19 nt, Homo sapiens
cagaagcguacaauuuauu

SEQ ID NO: 1018306 - RNA, 19 nt, Homo sapiens
ucucucaguuuccauaugu

SEQ ID NO: 1018307 - RNA, 19 nt, Homo sapiens
gcucuaucgacgugaaaua

SEQ ID NO: 1018308 - RNA, 19 nt, Homo sapiens
agaaugguguagacuuguu

SEQ ID NO: 1018309 - RNA, 19 nt, Homo sapiens
guacagacucauuacaaca

SEQ ID NO: 1018310 - RNA, 19 nt, Homo sapiens
uggaagaaauggagauguc

SEQ ID NO: 1018311 - RNA, 19 nt, Homo sapiens
gaugcaaguuacugugaca

SEQ ID NO: 1018312 - RNA, 19 nt, Homo sapiens
aggaauggacugguuaaua

SEQ ID NO: 1018313 - RNA, 19 nt, Homo sapiens
ggaauuuacaggaagagau

SEQ ID NO: 1018314 - RNA, 19 nt, Homo sapiens
agaacaaagcuguauguga

SEQ ID NO: 1018315 - RNA, 19 nt, Homo sapiens
agauuaaggccaagaagaa

SEQ ID NO: 1018316 - RNA, 19 nt, Homo sapiens
ggaagagauggauuuaaag

SEQ ID NO: 1018317 - RNA, 19 nt, Homo sapiens
caacugguggcauugauuc

SEQ ID NO: 1018318 - RNA, 19 nt, Homo sapiens
ucaaauaaagugguacaga

SEQ ID NO: 1018319 - RNA, 19 nt, Homo sapiens
gugugaucuucaaacauua

SEQ ID NO: 1018320 - RNA, 19 nt, Homo sapiens
caaguuacugugacaacaa

SEQ ID NO: 1018321 - RNA, 19 nt, Homo sapiens
uaacuauuacucugucgaa

SEQ ID NO: 1018322 - RNA, 19 nt, Homo sapiens
cuucuaagaguacaguuaa

SEQ ID NO: 1018323 - RNA, 19 nt, Homo sapiens
ucaaagugcauaacauagu

SEQ ID NO: 1018324 - RNA, 19 nt, Homo sapiens
ccacuugauaugaaacaaa

SEQ ID NO: 1018325 - RNA, 19 nt, Homo sapiens
cuaugucaguuaugauguu

SEQ ID NO: 1018326 - RNA, 19 nt, Homo sapiens
gauugccuaacacuuauaa

SEQ ID NO: 1018327 - RNA, 19 nt, Homo sapiens
ucacuuauuucagguuagu

SEQ ID NO: 1018328 - RNA, 19 nt, Homo sapiens
ggagaaaucuugccuauaa

SEQ ID NO: 1018329 - RNA, 19 nt, Homo sapiens
gaacagcugugccgauuaa

SEQ ID NO: 1018330 - RNA, 19 nt, Homo sapiens
gaaccgaucucaagcacaa

SEQ ID NO: 1018331 - RNA, 19 nt, Homo sapiens
gaagaagcaugcacagaga

SEQ ID NO: 1018332 - RNA, 19 nt, Homo sapiens
uaacauggacugugguuua

SEQ ID NO: 1018333 - RNA, 19 nt, Homo sapiens
gaaguugacucccaaugug

SEQ ID NO: 1018334 - RNA, 19 nt, Homo sapiens
gcagauaagucucguugga

SEQ ID NO: 1018335 - RNA, 19 nt, Homo sapiens
caauggagauggagagauu

SEQ ID NO: 1018336 - RNA, 19 nt, Homo sapiens
ugaagaaguuggugauuau

SEQ ID NO: 1018337 - RNA, 19 nt, Homo sapiens
caucagaacuuaaucuaca

SEQ ID NO: 1018338 - RNA, 19 nt, Homo sapiens
ucaguuagaucuucaugaa

SEQ ID NO: 1018339 - RNA, 19 nt, Homo sapiens
gaagacgccuuaaaaugua

SEQ ID NO: 1018340 - RNA, 19 nt, Homo sapiens
aaaguagacuggacucuga

SEQ ID NO: 1018341 - RNA, 19 nt, Homo sapiens
gaauucagcuuugcgacaa

SEQ ID NO: 1018342 - RNA, 19 nt, Homo sapiens
guacaaagacuucaguuag

SEQ ID NO: 1018343 - RNA, 19 nt, Homo sapiens
guuaacaacugccucauca

SEQ ID NO: 1018344 - RNA, 19 nt, Homo sapiens
gaagcuaaacuaaaccaaa

SEQ ID NO: 1018345 - RNA, 19 nt, Homo sapiens
uuacauggaugaacucuca

SEQ ID NO: 1018346 - RNA, 19 nt, Homo sapiens
gcacuucaggacuuaauaa

SEQ ID NO: 1018347 - RNA, 19 nt, Homo sapiens
cagcuuagccuggcauaua

SEQ ID NO: 1018348 - RNA, 19 nt, Homo sapiens
agaguuccuugauauguua

SEQ ID NO: 1018349 - RNA, 19 nt, Homo sapiens
gcaacacaaucugcaagaa

SEQ ID NO: 1018350 - RNA, 19 nt, Homo sapiens
cgacaaugauaucuacuuc

SEQ ID NO: 1018351 - RNA, 19 nt, Homo sapiens
uacaaagacuucaguuaga

SEQ ID NO: 1018352 - RNA, 19 nt, Homo sapiens
cagcagauaugccaaaguc

SEQ ID NO: 1018353 - RNA, 19 nt, Homo sapiens
gaugaugggccuauaaugu

SEQ ID NO: 1018354 - RNA, 19 nt, Homo sapiens
gagagaaacaccagaugaa

SEQ ID NO: 1018355 - RNA, 19 nt, Homo sapiens
ccaccugcaucagaacuua

SEQ ID NO: 1018356 - RNA, 19 nt, Homo sapiens
guagaugaagcuaaacuaa

SEQ ID NO: 1018357 - RNA, 19 nt, Homo sapiens
guggguagaugaagcuaaa

SEQ ID NO: 1018358 - RNA, 19 nt, Homo sapiens
gacgaucaaugaaugaaau

SEQ ID NO: 1018359 - RNA, 19 nt, Homo sapiens
aaacaaccaccauuucaaa

SEQ ID NO: 1018360 - RNA, 19 nt, Homo sapiens
agacgacgaucaaugaaug

SEQ ID NO: 1018361 - RNA, 19 nt, Homo sapiens
guuagaagaaucaccauuu

SEQ ID NO: 1018362 - RNA, 19 nt, Homo sapiens
caagaacauucaaccacuu

SEQ ID NO: 1018363 - RNA, 19 nt, Homo sapiens
ggguuugacuggcagagua

SEQ ID NO: 1018364 - RNA, 19 nt, Homo sapiens
gacuagagcucaugcugau

SEQ ID NO: 1018365 - RNA, 19 nt, Homo sapiens
caggaacauucuauucgua

SEQ ID NO: 1018366 - RNA, 19 nt, Homo sapiens
ccgcaucaguaaagaaauu

SEQ ID NO: 1018367 - RNA, 19 nt, Homo sapiens
gaaaucuugccuauaauuc

SEQ ID NO: 1018368 - RNA, 19 nt, Homo sapiens
caacuuuauucaugaggaa

SEQ ID NO: 1018369 - RNA, 19 nt, Homo sapiens
ggacaaauaaauagcacuu

SEQ ID NO: 1018370 - RNA, 19 nt, Homo sapiens
gagaaaucuugccuauaau

SEQ ID NO: 1018371 - RNA, 19 nt, Homo sapiens
gaugaucccuacagcagau

SEQ ID NO: 1018372 - RNA, 19 nt, Homo sapiens
gaacagaugaucccuacag

SEQ ID NO: 1018373 - RNA, 19 nt, Homo sapiens
guacaaacaccuuuuauga

SEQ ID NO: 1018374 - RNA, 19 nt, Homo sapiens
augaagaaguuggugauua

SEQ ID NO: 1018375 - RNA, 19 nt, Homo sapiens
aaauagcacuucaggacuu

SEQ ID NO: 1018376 - RNA, 19 nt, Homo sapiens
cagaguuccuugauauguu

SEQ ID NO: 1018377 - RNA, 19 nt, Homo sapiens
cagcugugccgauuaaauu

SEQ ID NO: 1018378 - RNA, 19 nt, Homo sapiens
gaguacggcugcuguugga

SEQ ID NO: 1018379 - RNA, 19 nt, Homo sapiens
gugauuauuucccagaguu

SEQ ID NO: 1018380 - RNA, 19 nt, Homo sapiens
ccagagagccgaugauuuu

SEQ ID NO: 1018381 - RNA, 19 nt, Homo sapiens
ucagaagacucagccuauu

SEQ ID NO: 1018382 - RNA, 19 nt, Homo sapiens
gagauucagcuguuaacaa

SEQ ID NO: 1018383 - RNA, 19 nt, Homo sapiens
ccgcgaaguucucuuugaa

SEQ ID NO: 1018384 - RNA, 19 nt, Homo sapiens
agaaguuggugauuauuuc

SEQ ID NO: 1018385 - RNA, 19 nt, Homo sapiens
ggaagacgccuuaaaaugu

SEQ ID NO: 1018386 - RNA, 19 nt, Homo sapiens
uuacugauguuguacaaag

SEQ ID NO: 1018387 - RNA, 19 nt, Homo sapiens
cugaggaguuucuugcuuu

SEQ ID NO: 1018388 - RNA, 19 nt, Homo sapiens
gcuaaacuaaaccaaauga

SEQ ID NO: 1018389 - RNA, 19 nt, Homo sapiens
uuagaagaaucaccauuuc

SEQ ID NO: 1018390 - RNA, 19 nt, Homo sapiens
agcaguagaugaagaaguu

SEQ ID NO: 1018391 - RNA, 19 nt, Homo sapiens
gcauggagcggcugcuuau

SEQ ID NO: 1018392 - RNA, 19 nt, Homo sapiens
ucccagaguuccuugauau

SEQ ID NO: 1018393 - RNA, 19 nt, Homo sapiens
gguccuaugcggcagauaa

SEQ ID NO: 1018394 - RNA, 19 nt, Homo sapiens
gcaagaaagauauugaaac

SEQ ID NO: 1018395 - RNA, 19 nt, Homo sapiens
ggaaagcgagaauuagaag

SEQ ID NO: 1018396 - RNA, 19 nt, Homo sapiens
agaugaagcuaaacuaaac

SEQ ID NO: 1018397 - RNA, 19 nt, Homo sapiens
acaaagacuucaguuagau

SEQ ID NO: 1018398 - RNA, 19 nt, Homo sapiens
ugaaagcuguacaauuugg

SEQ ID NO: 1018399 - RNA, 19 nt, Homo sapiens
gaagaaguuggugauuauu

SEQ ID NO: 1018400 - RNA, 19 nt, Homo sapiens
gcacaaggacaagcaggaa

SEQ ID NO: 1018401 - RNA, 19 nt, Homo sapiens
caacugccucaucaucuuu

SEQ ID NO: 1018402 - RNA, 19 nt, Homo sapiens
uaacaacugccucaucauc

SEQ ID NO: 1018403 - RNA, 19 nt, Homo sapiens
ggauuuuacugauguugua

SEQ ID NO: 1018404 - RNA, 19 nt, Homo sapiens
gccaaagucacccuucaaa

SEQ ID NO: 1018405 - RNA, 19 nt, Homo sapiens
cugcuuaucucccagacuu

SEQ ID NO: 1018406 - RNA, 19 nt, Homo sapiens
gaaacaccgagaagacaug

SEQ ID NO: 1018407 - RNA, 19 nt, Homo sapiens
ggcaagaaagauauugaaa

SEQ ID NO: 1018408 - RNA, 19 nt, Homo sapiens
gaggaacaccaguccaaug

SEQ ID NO: 1018409 - RNA, 19 nt, Homo sapiens
aauagcacuucaggacuua

SEQ ID NO: 1018410 - RNA, 19 nt, Homo sapiens
ggaaguacaaaccgucugu

SEQ ID NO: 1018411 - RNA, 19 nt, Homo sapiens
acaacugccucaucaucuu

SEQ ID NO: 1018412 - RNA, 19 nt, Homo sapiens
aaagcgagaauuagaaguu

SEQ ID NO: 1018413 - RNA, 19 nt, Homo sapiens
aacauggacugugguuuaa

SEQ ID NO: 1018414 - RNA, 19 nt, Homo sapiens
gggcaagaaagauauugaa

SEQ ID NO: 1018415 - RNA, 19 nt, Homo sapiens
caagagagaaacaccagau

SEQ ID NO: 1018416 - RNA, 19 nt, Homo sapiens
gguagaugaagcuaaacua

SEQ ID NO: 1018417 - RNA, 19 nt, Homo sapiens
gcucuuguccuucaugcuu

SEQ ID NO: 1018418 - RNA, 19 nt, Homo sapiens
gcgaggaagacgccuuaaa

SEQ ID NO: 1018419 - RNA, 19 nt, Homo sapiens
gacugugguuuaacuggaa

SEQ ID NO: 1018420 - RNA, 19 nt, Homo sapiens
cagcuuugcgacaaugaua

SEQ ID NO: 1018421 - RNA, 19 nt, Homo sapiens
cgagaagacaugcgaggaa

SEQ ID NO: 1018422 - RNA, 19 nt, Homo sapiens
ggaguuucuugcuuugaca

SEQ ID NO: 1018423 - RNA, 19 nt, Homo sapiens
aggaggagccggacaaaga

SEQ ID NO: 1018424 - RNA, 19 nt, Homo sapiens
ccaggaacauucuauucgu

SEQ ID NO: 1018425 - RNA, 19 nt, Homo sapiens
uaaauuuggguaugcaaga

SEQ ID NO: 1018426 - RNA, 19 nt, Homo sapiens
uguacaaagacuucaguua

SEQ ID NO: 1018427 - RNA, 19 nt, Homo sapiens
caaccucgcauaaccaaag

SEQ ID NO: 1018428 - RNA, 19 nt, Homo sapiens
ucaaauagauugcagauga

SEQ ID NO: 1018429 - RNA, 19 nt, Homo sapiens
gaaaccaaccuuugcauua

SEQ ID NO: 1018430 - RNA, 19 nt, Homo sapiens
gcaagcaucuuccuuauca

SEQ ID NO: 1018431 - RNA, 19 nt, Homo sapiens
gaaaucaggccuugguuua

SEQ ID NO: 1018432 - RNA, 19 nt, Homo sapiens
guacaucacugaaaguaaa

SEQ ID NO: 1018433 - RNA, 19 nt, Homo sapiens
gaaaucagcauacacagua

SEQ ID NO: 1018434 - RNA, 19 nt, Homo sapiens
gcaauaugcuacacuuaaa

SEQ ID NO: 1018435 - RNA, 19 nt, Homo sapiens
gaagaagcaugggauuuaa

SEQ ID NO: 1018436 - RNA, 19 nt, Homo sapiens
gaagaaagcuaagaugaag

SEQ ID NO: 1018437 - RNA, 19 nt, Homo sapiens
ggaaauauguacaacuuca

SEQ ID NO: 1018438 - RNA, 19 nt, Homo sapiens
ucacagaaauaccagauaa

SEQ ID NO: 1018439 - RNA, 19 nt, Homo sapiens
ggacaaauucuguagagua

SEQ ID NO: 1018440 - RNA, 19 nt, Homo sapiens
gaaauuugucucccucuua

SEQ ID NO: 1018441 - RNA, 19 nt, Homo sapiens
aacaauggcucuuugaaua

SEQ ID NO: 1018442 - RNA, 19 nt, Homo sapiens
gagcugauuuccaucgaua

SEQ ID NO: 1018443 - RNA, 19 nt, Homo sapiens
guauaaaccucacagaaau

SEQ ID NO: 1018444 - RNA, 19 nt, Homo sapiens
ggagccagauucacuguuu

SEQ ID NO: 1018445 - RNA, 19 nt, Homo sapiens
gcaaagugcucgaauacca

SEQ ID NO: 1018446 - RNA, 19 nt, Homo sapiens
ccugagagcuuuccuucua

SEQ ID NO: 1018447 - RNA, 19 nt, Homo sapiens
gauaacaccuucuggucaa

SEQ ID NO: 1018448 - RNA, 19 nt, Homo sapiens
caacuugcuuucuacaauu

SEQ ID NO: 1018449 - RNA, 19 nt, Homo sapiens
ccugaaaucuacuggauaa

SEQ ID NO: 1018450 - RNA, 19 nt, Homo sapiens
gagcuuuccuucuaaucua

SEQ ID NO: 1018451 - RNA, 19 nt, Homo sapiens
uggauaaccugccagauuu

SEQ ID NO: 1018452 - RNA, 19 nt, Homo sapiens
gguauaaaccucacagaaa

SEQ ID NO: 1018453 - RNA, 19 nt, Homo sapiens
ccacagacuuuccaguaaa

SEQ ID NO: 1018454 - RNA, 19 nt, Homo sapiens
ugaagaagcaugggauuua

SEQ ID NO: 1018455 - RNA, 19 nt, Homo sapiens
gagauaagauugcgugcau

SEQ ID NO: 1018456 - RNA, 19 nt, Homo sapiens
ggacaugccacuccgaauu

SEQ ID NO: 1018457 - RNA, 19 nt, Homo sapiens
ggagcuauguuuccuuuca

SEQ ID NO: 1018458 - RNA, 19 nt, Homo sapiens
aaucacaacuugcuuucua

SEQ ID NO: 1018459 - RNA, 19 nt, Homo sapiens
gaacugagcaacuuacaag

SEQ ID NO: 1018460 - RNA, 19 nt, Homo sapiens
acacccagauccauuuaua

SEQ ID NO: 1018461 - RNA, 19 nt, Homo sapiens
ggacccaccugaauuccaa

SEQ ID NO: 1018462 - RNA, 19 nt, Homo sapiens
gcgaaagacugcaguugug

SEQ ID NO: 1018463 - RNA, 19 nt, Homo sapiens
caaggaaaccuacuccaaa

SEQ ID NO: 1018464 - RNA, 19 nt, Homo sapiens
ggaagcaucuacaguggau

SEQ ID NO: 1018465 - RNA, 19 nt, Homo sapiens
gacaaauucuguagaguag

SEQ ID NO: 1018466 - RNA, 19 nt, Homo sapiens
gacuucaucucaauucaaa

SEQ ID NO: 1018467 - RNA, 19 nt, Homo sapiens
uggcguaacucccaaagaa

SEQ ID NO: 1018468 - RNA, 19 nt, Homo sapiens
gcagugaccagauaaacuu

SEQ ID NO: 1018469 - RNA, 19 nt, Homo sapiens
gaucaacaguaagugguuu

SEQ ID NO: 1018470 - RNA, 19 nt, Homo sapiens
caacuuacaagaacucuau

SEQ ID NO: 1018471 - RNA, 19 nt, Homo sapiens
aagcaacuguuauagguuu

SEQ ID NO: 1018472 - RNA, 19 nt, Homo sapiens
acagcuaugugaggaauua

SEQ ID NO: 1018473 - RNA, 19 nt, Homo sapiens
caauggcucuuugaauauu

SEQ ID NO: 1018474 - RNA, 19 nt, Homo sapiens
uaucuucagucaccaauau

SEQ ID NO: 1018475 - RNA, 19 nt, Homo sapiens
gaagaagaaagcuaagaug

SEQ ID NO: 1018476 - RNA, 19 nt, Homo sapiens
aaccuucucuucuccaaua

SEQ ID NO: 1018477 - RNA, 19 nt, Homo sapiens
gagggaacacuagauauaa

SEQ ID NO: 1018478 - RNA, 19 nt, Homo sapiens
ugagggaacacuagauaua

SEQ ID NO: 1018479 - RNA, 19 nt, Homo sapiens
ggaaauuugucucccucuu

SEQ ID NO: 1018480 - RNA, 19 nt, Homo sapiens
uaauaugccugagcugauu

SEQ ID NO: 1018481 - RNA, 19 nt, Homo sapiens
acacacaaaugcaccuauu

SEQ ID NO: 1018482 - RNA, 19 nt, Homo sapiens
uuaaguaacuggcuucaag

SEQ ID NO: 1018483 - RNA, 19 nt, Homo sapiens
ccuccugccuuccuuuaua

SEQ ID NO: 1018484 - RNA, 19 nt, Homo sapiens
guacuguggcaaccaaaua

SEQ ID NO: 1018485 - RNA, 19 nt, Homo sapiens
cuaauacccugacagacaa

SEQ ID NO: 1018486 - RNA, 19 nt, Homo sapiens
caaauagauugcagaugau

SEQ ID NO: 1018487 - RNA, 19 nt, Homo sapiens
gcaucuuccuuaucaauca

SEQ ID NO: 1018488 - RNA, 19 nt, Homo sapiens
ucuauggcauucaucauuu

SEQ ID NO: 1018489 - RNA, 19 nt, Homo sapiens
gaagcaugggauuuaaaua

SEQ ID NO: 1018490 - RNA, 19 nt, Homo sapiens
cagauaaacuugaauugac

SEQ ID NO: 1018491 - RNA, 19 nt, Homo sapiens
aaacaaacuuacugaacug

SEQ ID NO: 1018492 - RNA, 19 nt, Homo sapiens
guuauagguuuaccaacaa

SEQ ID NO: 1018493 - RNA, 19 nt, Homo sapiens
ugaagucuguuaugaucaa

SEQ ID NO: 1018494 - RNA, 19 nt, Homo sapiens
ggauaaccugccagauuua

SEQ ID NO: 1018495 - RNA, 19 nt, Homo sapiens
gaggugggcuagcacugaa

SEQ ID NO: 1018496 - RNA, 19 nt, Homo sapiens
aaaccaaccuuugcauuag

SEQ ID NO: 1018497 - RNA, 19 nt, Homo sapiens
gaaaucuacuggauaacac

SEQ ID NO: 1018498 - RNA, 19 nt, Homo sapiens
ucagggacaugauggaaau

SEQ ID NO: 1018499 - RNA, 19 nt, Homo sapiens
guggauaaccugccagauu

SEQ ID NO: 1018500 - RNA, 19 nt, Homo sapiens
ccacuaaccaccauggaaa

SEQ ID NO: 1018501 - RNA, 19 nt, Homo sapiens
ugaauacuccacagacuuu

SEQ ID NO: 1018502 - RNA, 19 nt, Homo sapiens
ccagauaaacuugaauuga

SEQ ID NO: 1018503 - RNA, 19 nt, Homo sapiens
caaguucuauguccauucu

SEQ ID NO: 1018504 - RNA, 19 nt, Homo sapiens
aaauuugucucccucuuau

SEQ ID NO: 1018505 - RNA, 19 nt, Homo sapiens
gggacaugauggaaauuug

SEQ ID NO: 1018506 - RNA, 19 nt, Homo sapiens
ugccaaaccucaaggaaau

SEQ ID NO: 1018507 - RNA, 19 nt, Homo sapiens
caacugaucgggugaacga

SEQ ID NO: 1018508 - RNA, 19 nt, Homo sapiens
caaaucuaguguuaaaugg

SEQ ID NO: 1018509 - RNA, 19 nt, Homo sapiens
uaacaauggcucuuugaau

SEQ ID NO: 1018510 - RNA, 19 nt, Homo sapiens
ugacagacaaguucuaugu

SEQ ID NO: 1018511 - RNA, 19 nt, Homo sapiens
ccaauuaucagaaucaaag

SEQ ID NO: 1018512 - RNA, 19 nt, Homo sapiens
uggaaucacucaugcugaa

SEQ ID NO: 1018513 - RNA, 19 nt, Homo sapiens
uuacuagccuggauuuauc

SEQ ID NO: 1018514 - RNA, 19 nt, Homo sapiens
gaccagauaaacuugaauu

SEQ ID NO: 1018515 - RNA, 19 nt, Homo sapiens
agacugcaguugugcuaaa

SEQ ID NO: 1018516 - RNA, 19 nt, Homo sapiens
gaggaauuacuuacagaaa

SEQ ID NO: 1018517 - RNA, 19 nt, Homo sapiens
cuccagaaaugaacuguga

SEQ ID NO: 1018518 - RNA, 19 nt, Homo sapiens
gauuauuggugugauaugu

SEQ ID NO: 1018519 - RNA, 19 nt, Homo sapiens
gauaacaauggcucuuuga

SEQ ID NO: 1018520 - RNA, 19 nt, Homo sapiens
gcagaaccacagccugaaa

SEQ ID NO: 1018521 - RNA, 19 nt, Homo sapiens
uaaaagaguuggggauaaa

SEQ ID NO: 1018522 - RNA, 19 nt, Homo sapiens
acaacuugcuuucuacaau

SEQ ID NO: 1018523 - RNA, 19 nt, Homo sapiens
gaaauaguaaccuucucuu

SEQ ID NO: 1018524 - RNA, 19 nt, Homo sapiens
ggacaugauggaaauuugu

SEQ ID NO: 1018525 - RNA, 19 nt, Homo sapiens
aauagaagcuacuaacaac

SEQ ID NO: 1018526 - RNA, 19 nt, Homo sapiens
gauaaccugccagauuuaa

SEQ ID NO: 1018527 - RNA, 19 nt, Homo sapiens
ccagccagauugccagcua

SEQ ID NO: 1018528 - RNA, 19 nt, Homo sapiens
ggaaagauguugccauauu

SEQ ID NO: 1018529 - RNA, 19 nt, Homo sapiens
gaaagauguugccauauuu

SEQ ID NO: 1018530 - RNA, 19 nt, Homo sapiens
aggaagagguggugaauua

SEQ ID NO: 1018531 - RNA, 19 nt, Homo sapiens
gaugaaaucuacacaguac

SEQ ID NO: 1018532 - RNA, 19 nt, Homo sapiens
gcaaaggcuuggcauauac

SEQ ID NO: 1018533 - RNA, 19 nt, Homo sapiens
gaaagugcccuucuucauc

SEQ ID NO: 1018534 - RNA, 19 nt, Homo sapiens
gaagucaacucugcuugga

SEQ ID NO: 1018535 - RNA, 19 nt, Homo sapiens
gcaaagagcaggaggaacu

SEQ ID NO: 1018536 - RNA, 19 nt, Homo sapiens
agggaaagauguugccaua

SEQ ID NO: 1018537 - RNA, 19 nt, Homo sapiens
ggacucuccuuucccuuug

SEQ ID NO: 1018538 - RNA, 19 nt, Homo sapiens
caugcuggaucaaauguuu

SEQ ID NO: 1018539 - RNA, 19 nt, Homo sapiens
gcuccaagaugaucaccuu

SEQ ID NO: 1018540 - RNA, 19 nt, Homo sapiens
gaagauggaaacauugaau

SEQ ID NO: 1018541 - RNA, 19 nt, Homo sapiens
gcagagauagucuuacugu

SEQ ID NO: 1018542 - RNA, 19 nt, Homo sapiens
ggccgaaccuccagcauca

SEQ ID NO: 1018543 - RNA, 19 nt, Homo sapiens
ucagggauuuguuggcuaa

SEQ ID NO: 1018544 - RNA, 19 nt, Homo sapiens
ccacuuuccugcccaccua

SEQ ID NO: 1018545 - RNA, 19 nt, Homo sapiens
ggcugaagauggaaacauu

SEQ ID NO: 1018546 - RNA, 19 nt, Homo sapiens
ccauauuuccuacucuuua

SEQ ID NO: 1018547 - RNA, 19 nt, Homo sapiens
ccacaggugcuauuuguug

SEQ ID NO: 1018548 - RNA, 19 nt, Homo sapiens
ccaugucacugauguacaa

SEQ ID NO: 1018549 - RNA, 19 nt, Homo sapiens
ggaugaaaucuacacagua

SEQ ID NO: 1018550 - RNA, 19 nt, Homo sapiens
uaagguuucucugugcaua

SEQ ID NO: 1018551 - RNA, 19 nt, Homo sapiens
gcacagggacagugaaugg

SEQ ID NO: 1018552 - RNA, 19 nt, Homo sapiens
caaagggaaagaagaagaa

SEQ ID NO: 1018553 - RNA, 19 nt, Homo sapiens
agcaaaggcuuggcauaua

SEQ ID NO: 1018554 - RNA, 19 nt, Homo sapiens
gcaagggcauggugauggu

SEQ ID NO: 1018555 - RNA, 19 nt, Homo sapiens
aaaggucccugacaaccaa

SEQ ID NO: 1018556 - RNA, 19 nt, Homo sapiens
gcccaucagucuggucuuu

SEQ ID NO: 1018557 - RNA, 19 nt, Homo sapiens
gacagugaaugguaguguu

SEQ ID NO: 1018558 - RNA, 19 nt, Homo sapiens
gcugugugcucaccugguu

SEQ ID NO: 1018559 - RNA, 19 nt, Homo sapiens
ccagguggaugaaaucuac

SEQ ID NO: 1018560 - RNA, 19 nt, Homo sapiens
gauguugccauauuuccua

SEQ ID NO: 1018561 - RNA, 19 nt, Homo sapiens
gaagagguggugaauuaca

SEQ ID NO: 1018562 - RNA, 19 nt, Homo sapiens
agggagagcuggacaaugg

SEQ ID NO: 1018563 - RNA, 19 nt, Homo sapiens
gaggaaagggaaagauguu

SEQ ID NO: 1018564 - RNA, 19 nt, Homo sapiens
cuaccuggcuguggacaaa

SEQ ID NO: 1018565 - RNA, 19 nt, Homo sapiens
caauauauaaggugacuuc

SEQ ID NO: 1018566 - RNA, 19 nt, Homo sapiens
gcggcucuguguguuaaua

SEQ ID NO: 1018567 - RNA, 19 nt, Homo sapiens
ucuuuggccucacaucaua

SEQ ID NO: 1018568 - RNA, 19 nt, Homo sapiens
gcaaggaagagguggugaa

SEQ ID NO: 1018569 - RNA, 19 nt, Homo sapiens
ggaggaaagggaaagaugu

SEQ ID NO: 1018570 - RNA, 19 nt, Homo sapiens
ucagcaagaucgaccuaug

SEQ ID NO: 1018571 - RNA, 19 nt, Homo sapiens
ggauuaugauagcgacaug

SEQ ID NO: 1018572 - RNA, 19 nt, Homo sapiens
agacauaaccguucuucga

SEQ ID NO: 1018573 - RNA, 19 nt, Homo sapiens
ucucugcacuucaggaaug

SEQ ID NO: 1018574 - RNA, 19 nt, Homo sapiens
cuggagaggugccaaacuu

SEQ ID NO: 1018575 - RNA, 19 nt, Homo sapiens
uacgaaaggucccugacaa

SEQ ID NO: 1018576 - RNA, 19 nt, Homo sapiens
cgagaaguggauuaugaua

SEQ ID NO: 1018577 - RNA, 19 nt, Homo sapiens
agcgagaaguggauuauga

SEQ ID NO: 1018578 - RNA, 19 nt, Homo sapiens
uggauccacucaucaauuc

SEQ ID NO: 1018579 - RNA, 19 nt, Homo sapiens
gaaaggucccugacaacca

SEQ ID NO: 1018580 - RNA, 19 nt, Homo sapiens
gagaaguggauuaugauag

SEQ ID NO: 1018581 - RNA, 19 nt, Homo sapiens
cauauuuccuacucuuuag

SEQ ID NO: 1018582 - RNA, 19 nt, Homo sapiens
agagauagucuuacuguuc

SEQ ID NO: 1018583 - RNA, 19 nt, Homo sapiens
ggccaaagggaaagaagaa

SEQ ID NO: 1018584 - RNA, 19 nt, Homo sapiens
ugaggcagagauagucuua

SEQ ID NO: 1018585 - RNA, 19 nt, Homo sapiens
guuucucugugcauauaua

SEQ ID NO: 1018586 - RNA, 19 nt, Homo sapiens
ccaaagggaaagaagaaga

SEQ ID NO: 1018587 - RNA, 19 nt, Homo sapiens
guaaguugcccaucucuac

SEQ ID NO: 1018588 - RNA, 19 nt, Homo sapiens
caccauaaguaccuacaca

SEQ ID NO: 1018589 - RNA, 19 nt, Homo sapiens
gggcagacauaaccguucu

SEQ ID NO: 1018590 - RNA, 19 nt, Homo sapiens
gggcaguccugagggagaa

SEQ ID NO: 1018591 - RNA, 19 nt, Homo sapiens
uuaauaggcuagggagaga

SEQ ID NO: 1018592 - RNA, 19 nt, Homo sapiens
agagagagagagagaacua

SEQ ID NO: 1018593 - RNA, 19 nt, Homo sapiens
gaagaacggaaggaacaga

SEQ ID NO: 1018594 - RNA, 19 nt, Homo sapiens
uggaugaaaucuacacagu

SEQ ID NO: 1018595 - RNA, 19 nt, Homo sapiens
gagagcgagaaguggauua

SEQ ID NO: 1018596 - RNA, 19 nt, Homo sapiens
cgagagagagagagagaga

SEQ ID NO: 1018597 - RNA, 19 nt, Homo sapiens
gcagggaaccaggaggaaa

SEQ ID NO: 1018598 - RNA, 19 nt, Homo sapiens
ccauguaaguugcccaucu

SEQ ID NO: 1018599 - RNA, 19 nt, Homo sapiens
gguguggucucugcacuuc

SEQ ID NO: 1018600 - RNA, 19 nt, Homo sapiens
ggcagggacaguucuauug

SEQ ID NO: 1018601 - RNA, 19 nt, Homo sapiens
cuacacaccaccaucuuug

SEQ ID NO: 1018602 - RNA, 19 nt, Homo sapiens
cccauggacucagggauuu

SEQ ID NO: 1018603 - RNA, 19 nt, Homo sapiens
gaggccgucuaccagauug

SEQ ID NO: 1018604 - RNA, 19 nt, Homo sapiens
ucaccugguuggcucauca

SEQ ID NO: 1018605 - RNA, 19 nt, Homo sapiens
ccgaggugcuaguacgaaa

SEQ ID NO: 1018606 - RNA, 19 nt, Homo sapiens
agaaguggauuaugauagc

SEQ ID NO: 1018607 - RNA, 19 nt, Homo sapiens
cagagauagucuuacuguu

SEQ ID NO: 1018608 - RNA, 19 nt, Homo sapiens
gggcucggcucaaccuuuu

SEQ ID NO: 1018609 - RNA, 19 nt, Homo sapiens
gauccacucaucaauucuu

SEQ ID NO: 1018610 - RNA, 19 nt, Homo sapiens
ugagggagaagacaggauu

SEQ ID NO: 1018611 - RNA, 19 nt, Homo sapiens
uggcggcucuguguguuaa

SEQ ID NO: 1018612 - RNA, 19 nt, Homo sapiens
gguguuugaggcagagaua

SEQ ID NO: 1018613 - RNA, 19 nt, Homo sapiens
gaaccuccagcaucagcuu

SEQ ID NO: 1018614 - RNA, 19 nt, Homo sapiens
guacgaaaggucccugaca

SEQ ID NO: 1018615 - RNA, 19 nt, Homo sapiens
gggauuuguuggcuaaggu

SEQ ID NO: 1018616 - RNA, 19 nt, Homo sapiens
gacgagagagagagagaga

SEQ ID NO: 1018617 - RNA, 19 nt, Homo sapiens
ggacagugaaugguagugu

SEQ ID NO: 1018618 - RNA, 19 nt, Homo sapiens
aaaaggcagugguacguuu

SEQ ID NO: 1018619 - RNA, 19 nt, Homo sapiens
gcaacccuguggccugucu

SEQ ID NO: 1018620 - RNA, 19 nt, Homo sapiens
cuugcucccugccaacuuu

SEQ ID NO: 1018621 - RNA, 19 nt, Homo sapiens
aagaagaacggaaggaaca

SEQ ID NO: 1018622 - RNA, 19 nt, Homo sapiens
ccaagggcaucggccaugu

SEQ ID NO: 1018623 - RNA, 19 nt, Homo sapiens
cagcaaagagcaggaggaa

SEQ ID NO: 1018624 - RNA, 19 nt, Homo sapiens
caaggaagagguggugaau

SEQ ID NO: 1018625 - RNA, 19 nt, Homo sapiens
acagggacagugaauggua

SEQ ID NO: 1018626 - RNA, 19 nt, Homo sapiens
aauugaagcuggugaaucc

SEQ ID NO: 1018627 - RNA, 19 nt, Homo sapiens
cagcaagaucgaccuaugu

SEQ ID NO: 1018628 - RNA, 19 nt, Homo sapiens
gaacuuggcuuuguuagaa

SEQ ID NO: 1018629 - RNA, 19 nt, Homo sapiens
gcucaugccuauaaucuua

SEQ ID NO: 1018630 - RNA, 19 nt, Homo sapiens
ggaagggacucaauuagaa

SEQ ID NO: 1018631 - RNA, 19 nt, Homo sapiens
gagacuccauuaugaauua

SEQ ID NO: 1018632 - RNA, 19 nt, Homo sapiens
caaauuagcuaguaguaug

SEQ ID NO: 1018633 - RNA, 19 nt, Homo sapiens
guacuuacauggguuauaa

SEQ ID NO: 1018634 - RNA, 19 nt, Homo sapiens
ggaaauacuccucuagaua

SEQ ID NO: 1018635 - RNA, 19 nt, Homo sapiens
ugacauauauccacaagaa

SEQ ID NO: 1018636 - RNA, 19 nt, Homo sapiens
gaaauacuccucuagauau

SEQ ID NO: 1018637 - RNA, 19 nt, Homo sapiens
gaaucaugcucucuaaauu

SEQ ID NO: 1018638 - RNA, 19 nt, Homo sapiens
uaucagagaugacagguuu

SEQ ID NO: 1018639 - RNA, 19 nt, Homo sapiens
gaugugcccuuaugcuaua

SEQ ID NO: 1018640 - RNA, 19 nt, Homo sapiens
ggagugaguugguaauaug

SEQ ID NO: 1018641 - RNA, 19 nt, Homo sapiens
ugacaaauccuauaacuug

SEQ ID NO: 1018642 - RNA, 19 nt, Homo sapiens
auacaagccuguuauguuu

SEQ ID NO: 1018643 - RNA, 19 nt, Homo sapiens
gaagagugguggcugaaug

SEQ ID NO: 1018644 - RNA, 19 nt, Homo sapiens
ggauagcaguccacaugua

SEQ ID NO: 1018645 - RNA, 19 nt, Homo sapiens
gcacgagaauaucugauug

SEQ ID NO: 1018646 - RNA, 19 nt, Homo sapiens
gaacuacuggcagcuauua

SEQ ID NO: 1018647 - RNA, 19 nt, Homo sapiens
uaaaucaacugaagaacga

SEQ ID NO: 1018648 - RNA, 19 nt, Homo sapiens
gaacucuacucaucuuuag

SEQ ID NO: 1018649 - RNA, 19 nt, Homo sapiens
acacaaugguuauggauuu

SEQ ID NO: 1018650 - RNA, 19 nt, Homo sapiens
guauaacucuuuggcauaa

SEQ ID NO: 1018651 - RNA, 19 nt, Homo sapiens
gaaagaccacuacaaucua

SEQ ID NO: 1018652 - RNA, 19 nt, Homo sapiens
ggaaagaccacuacaaucu

SEQ ID NO: 1018653 - RNA, 19 nt, Homo sapiens
ugaaaucaaugccuucuau

SEQ ID NO: 1018654 - RNA, 19 nt, Homo sapiens
gggaaggaauguugacuug

SEQ ID NO: 1018655 - RNA, 19 nt, Homo sapiens
cacuucagcuggccuauua

SEQ ID NO: 1018656 - RNA, 19 nt, Homo sapiens
ccuccucgcuguucaauuu

SEQ ID NO: 1018657 - RNA, 19 nt, Homo sapiens
ggagauguauacccucuau

SEQ ID NO: 1018658 - RNA, 19 nt, Homo sapiens
ccuauaaucuuagcacuuu

SEQ ID NO: 1018659 - RNA, 19 nt, Homo sapiens
gauacaagccuguuauguu

SEQ ID NO: 1018660 - RNA, 19 nt, Homo sapiens
gaacacuacuggccuccaa

SEQ ID NO: 1018661 - RNA, 19 nt, Homo sapiens
caccagaaauugcuugaaa

SEQ ID NO: 1018662 - RNA, 19 nt, Homo sapiens
guaguuuacugguauauuc

SEQ ID NO: 1018663 - RNA, 19 nt, Homo sapiens
gaacaaacagacaaauuag

SEQ ID NO: 1018664 - RNA, 19 nt, Homo sapiens
aaagaccacuacaaucuaa

SEQ ID NO: 1018665 - RNA, 19 nt, Homo sapiens
caaaggguaugaauuacau

SEQ ID NO: 1018666 - RNA, 19 nt, Homo sapiens
gcaagucuuacucuaauuu

SEQ ID NO: 1018667 - RNA, 19 nt, Homo sapiens
cagcagcaaugcaaauuau

SEQ ID NO: 1018668 - RNA, 19 nt, Homo sapiens
guuauuauguggaugagaa

SEQ ID NO: 1018669 - RNA, 19 nt, Homo sapiens
guauuuggcuguaauugug

SEQ ID NO: 1018670 - RNA, 19 nt, Homo sapiens
aaaggaagggacucaauua

SEQ ID NO: 1018671 - RNA, 19 nt, Homo sapiens
ugaaacagcuaugacaaga

SEQ ID NO: 1018672 - RNA, 19 nt, Homo sapiens
gauugcggcuuaugccuuu

SEQ ID NO: 1018673 - RNA, 19 nt, Homo sapiens
gaggauagcaguccacaug

SEQ ID NO: 1018674 - RNA, 19 nt, Homo sapiens
gagcugugaugugcccuua

SEQ ID NO: 1018675 - RNA, 19 nt, Homo sapiens
gaggauuauucugagauua

SEQ ID NO: 1018676 - RNA, 19 nt, Homo sapiens
gauagcaguccacauguaa

SEQ ID NO: 1018677 - RNA, 19 nt, Homo sapiens
ccagagaacuuggcuuugu

SEQ ID NO: 1018678 - RNA, 19 nt, Homo sapiens
gcagcagcaaugcaaauua

SEQ ID NO: 1018679 - RNA, 19 nt, Homo sapiens
gaaggaauguugacuugcu

SEQ ID NO: 1018680 - RNA, 19 nt, Homo sapiens
gcaggauccuucugucaau

SEQ ID NO: 1018681 - RNA, 19 nt, Homo sapiens
gacaaauccuauaacuuga

SEQ ID NO: 1018682 - RNA, 19 nt, Homo sapiens
gaaucacauugucagaauu

SEQ ID NO: 1018683 - RNA, 19 nt, Homo sapiens
ugccaaaggguaugaauua

SEQ ID NO: 1018684 - RNA, 19 nt, Homo sapiens
caauguagaguccaucuuu

SEQ ID NO: 1018685 - RNA, 19 nt, Homo sapiens
gaacuaugcaguauuuaag

SEQ ID NO: 1018686 - RNA, 19 nt, Homo sapiens
aaacagcuaugacaagaca

SEQ ID NO: 1018687 - RNA, 19 nt, Homo sapiens
gaccugggauugcagcauu

SEQ ID NO: 1018688 - RNA, 19 nt, Homo sapiens
gaggaaguauaacucuuug

SEQ ID NO: 1018689 - RNA, 19 nt, Homo sapiens
gauaugauacagcugauga

SEQ ID NO: 1018690 - RNA, 19 nt, Homo sapiens
acuagagacuccauuauga

SEQ ID NO: 1018691 - RNA, 19 nt, Homo sapiens
gaagggacucaauuagaaa

SEQ ID NO: 1018692 - RNA, 19 nt, Homo sapiens
caaaggaagggacucaauu

SEQ ID NO: 1018693 - RNA, 19 nt, Homo sapiens
gaagaacgaacauuucagu

SEQ ID NO: 1018694 - RNA, 19 nt, Homo sapiens
agauguauacccucuauua

SEQ ID NO: 1018695 - RNA, 19 nt, Homo sapiens
acagacaaauuagcuagua

SEQ ID NO: 1018696 - RNA, 19 nt, Homo sapiens
ccucaacaauccaaaucua

SEQ ID NO: 1018697 - RNA, 19 nt, Homo sapiens
ugaaucacauugucagaau

SEQ ID NO: 1018698 - RNA, 19 nt, Homo sapiens
gcagcaaugcaaauuauga

SEQ ID NO: 1018699 - RNA, 19 nt, Homo sapiens
caaaagauguuacaagcuu

SEQ ID NO: 1018700 - RNA, 19 nt, Homo sapiens
ggaggcaucugaucuacag

SEQ ID NO: 1018701 - RNA, 19 nt, Homo sapiens
cacaagaagugccauagug

SEQ ID NO: 1018702 - RNA, 19 nt, Homo sapiens
cuacuggccuccaaaggaa

SEQ ID NO: 1018703 - RNA, 19 nt, Homo sapiens
cuaguaguauggagaugua

SEQ ID NO: 1018704 - RNA, 19 nt, Homo sapiens
gacccugucucaaagaaga

SEQ ID NO: 1018705 - RNA, 19 nt, Homo sapiens
cuacaaacuuuaacaaugc

SEQ ID NO: 1018706 - RNA, 19 nt, Homo sapiens
gcuuaugccuuuacaucuu

SEQ ID NO: 1018707 - RNA, 19 nt, Homo sapiens
ucagagaagguacgagaua

SEQ ID NO: 1018708 - RNA, 19 nt, Homo sapiens
cgccagagcuucucagaca

SEQ ID NO: 1018709 - RNA, 19 nt, Homo sapiens
gaaagaggaaguauaacuc

SEQ ID NO: 1018710 - RNA, 19 nt, Homo sapiens
gcugugaugugcccuuaug

SEQ ID NO: 1018711 - RNA, 19 nt, Homo sapiens
guaggaggauugcuugaag

SEQ ID NO: 1018712 - RNA, 19 nt, Homo sapiens
gggagugaguugguaauau

SEQ ID NO: 1018713 - RNA, 19 nt, Homo sapiens
caagucugguuggcuauuu

SEQ ID NO: 1018714 - RNA, 19 nt, Homo sapiens
cguauaccaucacaauuga

SEQ ID NO: 1018715 - RNA, 19 nt, Homo sapiens
gguccugucucuacaagau

SEQ ID NO: 1018716 - RNA, 19 nt, Homo sapiens
ucaauuggcuaaaucaacu

SEQ ID NO: 1018717 - RNA, 19 nt, Homo sapiens
caaugcaagucuuacucua

SEQ ID NO: 1018718 - RNA, 19 nt, Homo sapiens
gagaugggaaggaauguug

SEQ ID NO: 1018719 - RNA, 19 nt, Homo sapiens
uaucauggccguacagaga

SEQ ID NO: 1018720 - RNA, 19 nt, Homo sapiens
cagagaacuuggcuuuguu

SEQ ID NO: 1018721 - RNA, 19 nt, Homo sapiens
ugauacagcugaugaacuc

SEQ ID NO: 1018722 - RNA, 19 nt, Homo sapiens
uggugaacaucaguuauua

SEQ ID NO: 1018723 - RNA, 19 nt, Homo sapiens
ucaagcaguucaucuucuu

SEQ ID NO: 1018724 - RNA, 19 nt, Homo sapiens
gguuauaaauccucucucu

SEQ ID NO: 1018725 - RNA, 19 nt, Homo sapiens
gaaauccugucccgagacu

SEQ ID NO: 1018726 - RNA, 19 nt, Homo sapiens
cagagaagguacgagauau

SEQ ID NO: 1018727 - RNA, 19 nt, Homo sapiens
gaagauggaaggguucaga

SEQ ID NO: 1018728 - RNA, 19 nt, Homo sapiens
gaacuaaucuucuaucagu

SEQ ID NO: 1018729 - RNA, 19 nt, Homo sapiens
gagcauagcuuccucaaau

SEQ ID NO: 1018730 - RNA, 19 nt, Homo sapiens
cuagaagccuggauaaaua

SEQ ID NO: 1018731 - RNA, 19 nt, Homo sapiens
ggaacaaagugaucauuga

SEQ ID NO: 1018732 - RNA, 19 nt, Homo sapiens
gaggcaagguauuaacuua

SEQ ID NO: 1018733 - RNA, 19 nt, Homo sapiens
aagcagaacugacauguaa

SEQ ID NO: 1018734 - RNA, 19 nt, Homo sapiens
gaaagaagagccuccgaua

SEQ ID NO: 1018735 - RNA, 19 nt, Homo sapiens
ggagacggauaguaguuua

SEQ ID NO: 1018736 - RNA, 19 nt, Homo sapiens
gcagaaggguguugugaug

SEQ ID NO: 1018737 - RNA, 19 nt, Homo sapiens
agaaagaaaucguggauga

SEQ ID NO: 1018738 - RNA, 19 nt, Homo sapiens
ggaaaucuucaacauguua

SEQ ID NO: 1018739 - RNA, 19 nt, Homo sapiens
gaaccucacuaaacggaaa

SEQ ID NO: 1018740 - RNA, 19 nt, Homo sapiens
gauaguaguuuagugguaa

SEQ ID NO: 1018741 - RNA, 19 nt, Homo sapiens
ggucagaagugaaggaaga

SEQ ID NO: 1018742 - RNA, 19 nt, Homo sapiens
aaaugaaucuccuaaguga

SEQ ID NO: 1018743 - RNA, 19 nt, Homo sapiens
auacaaaggugaaagaaga

SEQ ID NO: 1018744 - RNA, 19 nt, Homo sapiens
acaaagugaucauugagua

SEQ ID NO: 1018745 - RNA, 19 nt, Homo sapiens
guacagauguccacguugu

SEQ ID NO: 1018746 - RNA, 19 nt, Homo sapiens
ggaaggaaguggacaaagg

SEQ ID NO: 1018747 - RNA, 19 nt, Homo sapiens
caagaacguuggcaaugaa

SEQ ID NO: 1018748 - RNA, 19 nt, Homo sapiens
gaacagcggaccauauuuc

SEQ ID NO: 1018749 - RNA, 19 nt, Homo sapiens
gaaaugaaucuccuaagug

SEQ ID NO: 1018750 - RNA, 19 nt, Homo sapiens
gaccauauuucuagagaug

SEQ ID NO: 1018751 - RNA, 19 nt, Homo sapiens
guaauggaguucgagauaa

SEQ ID NO: 1018752 - RNA, 19 nt, Homo sapiens
ggauaguaguuuaguggua

SEQ ID NO: 1018753 - RNA, 19 nt, Homo sapiens
ccuaagugauuaucgauuu

SEQ ID NO: 1018754 - RNA, 19 nt, Homo sapiens
gaagguaaagggagaggua

SEQ ID NO: 1018755 - RNA, 19 nt, Homo sapiens
ggcauucccuuuaguagaa

SEQ ID NO: 1018756 - RNA, 19 nt, Homo sapiens
uaauggaguucgagauaaa

SEQ ID NO: 1018757 - RNA, 19 nt, Homo sapiens
gcagccacauugaaggaua

SEQ ID NO: 1018758 - RNA, 19 nt, Homo sapiens
ggccugaggugaaggauga

SEQ ID NO: 1018759 - RNA, 19 nt, Homo sapiens
guacagaagaagcaaagua

SEQ ID NO: 1018760 - RNA, 19 nt, Homo sapiens
aaggauaacuuggagauaa

SEQ ID NO: 1018761 - RNA, 19 nt, Homo sapiens
ggacaaaggccagaggaaa

SEQ ID NO: 1018762 - RNA, 19 nt, Homo sapiens
ugaaaugaaucuccuaagu

SEQ ID NO: 1018763 - RNA, 19 nt, Homo sapiens
gaacucuccuuugcacuug

SEQ ID NO: 1018764 - RNA, 19 nt, Homo sapiens
gaaaguucuucaccaagug

SEQ ID NO: 1018765 - RNA, 19 nt, Homo sapiens
cauugaguauccaacauua

SEQ ID NO: 1018766 - RNA, 19 nt, Homo sapiens
aagaagagccuccgauaaa

SEQ ID NO: 1018767 - RNA, 19 nt, Homo sapiens
guaauggacuggucagaag

SEQ ID NO: 1018768 - RNA, 19 nt, Homo sapiens
ggccaaggaucgugaguug

SEQ ID NO: 1018769 - RNA, 19 nt, Homo sapiens
caccuggccuugaacauuu

SEQ ID NO: 1018770 - RNA, 19 nt, Homo sapiens
acucaagucuuaugaauuc

SEQ ID NO: 1018771 - RNA, 19 nt, Homo sapiens
gaagagaccaauaagcaau

SEQ ID NO: 1018772 - RNA, 19 nt, Homo sapiens
aaagaaaucguggaugaua

SEQ ID NO: 1018773 - RNA, 19 nt, Homo sapiens
gcaauaugacuguaagaga

SEQ ID NO: 1018774 - RNA, 19 nt, Homo sapiens
guauauacauggcuuaacu

SEQ ID NO: 1018775 - RNA, 19 nt, Homo sapiens
gaagaaagaaaucguggau

SEQ ID NO: 1018776 - RNA, 19 nt, Homo sapiens
ugggaaaucuucaacaugu

SEQ ID NO: 1018777 - RNA, 19 nt, Homo sapiens
ccacauuguuugagccauu

SEQ ID NO: 1018778 - RNA, 19 nt, Homo sapiens
caguugcccuuucuucuuu

SEQ ID NO: 1018779 - RNA, 19 nt, Homo sapiens
guagugaagcaggaaauua

SEQ ID NO: 1018780 - RNA, 19 nt, Homo sapiens
ggaagagaaggauaacuug

SEQ ID NO: 1018781 - RNA, 19 nt, Homo sapiens
gaacaggagguggaggaua

SEQ ID NO: 1018782 - RNA, 19 nt, Homo sapiens
gcacuugaucagcauagua

SEQ ID NO: 1018783 - RNA, 19 nt, Homo sapiens
gaaaggauccaauaaugac

SEQ ID NO: 1018784 - RNA, 19 nt, Homo sapiens
ggaaauaccgauggaccua

SEQ ID NO: 1018785 - RNA, 19 nt, Homo sapiens
ugaaaggauccaauaauga

SEQ ID NO: 1018786 - RNA, 19 nt, Homo sapiens
uugaaaggauccaauaaug

SEQ ID NO: 1018787 - RNA, 19 nt, Homo sapiens
gcagaacugacauguaaug

SEQ ID NO: 1018788 - RNA, 19 nt, Homo sapiens
gaaguuuguuggucaaugc

SEQ ID NO: 1018789 - RNA, 19 nt, Homo sapiens
ggagaaguuuguuggucaa

SEQ ID NO: 1018790 - RNA, 19 nt, Homo sapiens
aaagucugauccuguaauu

SEQ ID NO: 1018791 - RNA, 19 nt, Homo sapiens
ugaaggaagagaaggauaa

SEQ ID NO: 1018792 - RNA, 19 nt, Homo sapiens
cugugaaacugcaauauga

SEQ ID NO: 1018793 - RNA, 19 nt, Homo sapiens
ugacgaaacccaaggauca

SEQ ID NO: 1018794 - RNA, 19 nt, Homo sapiens
gaagcaaaguacagauguc

SEQ ID NO: 1018795 - RNA, 19 nt, Homo sapiens
gaagagccuccgauaaauc

SEQ ID NO: 1018796 - RNA, 19 nt, Homo sapiens
gagaaacuccuaguacaau

SEQ ID NO: 1018797 - RNA, 19 nt, Homo sapiens
caccacaccuggccuugaa

SEQ ID NO: 1018798 - RNA, 19 nt, Homo sapiens
ugacagggauaaaggagau

SEQ ID NO: 1018799 - RNA, 19 nt, Homo sapiens
gaacaaagugaucauugag

SEQ ID NO: 1018800 - RNA, 19 nt, Homo sapiens
gcagcaaaauuuaguaaga

SEQ ID NO: 1018801 - RNA, 19 nt, Homo sapiens
caagcugaguacauagaaa

SEQ ID NO: 1018802 - RNA, 19 nt, Homo sapiens
aaagaagagccuccgauaa

SEQ ID NO: 1018803 - RNA, 19 nt, Homo sapiens
gaaggauaacuuggagaua

SEQ ID NO: 1018804 - RNA, 19 nt, Homo sapiens
ugaaaagucugauccugua

SEQ ID NO: 1018805 - RNA, 19 nt, Homo sapiens
caagaacagcggaccauau

SEQ ID NO: 1018806 - RNA, 19 nt, Homo sapiens
gcaagaacagcggaccaua

SEQ ID NO: 1018807 - RNA, 19 nt, Homo sapiens
acacaaagcagaacugaca

SEQ ID NO: 1018808 - RNA, 19 nt, Homo sapiens
gaaauaccgauggaccuaa

SEQ ID NO: 1018809 - RNA, 19 nt, Homo sapiens
uaaaggaagagaagguaaa

SEQ ID NO: 1018810 - RNA, 19 nt, Homo sapiens
agacaggguugcgcucuuu

SEQ ID NO: 1018811 - RNA, 19 nt, Homo sapiens
gaucagcauaguacuuauu

SEQ ID NO: 1018812 - RNA, 19 nt, Homo sapiens
gacaaaggccagaggaaau

SEQ ID NO: 1018813 - RNA, 19 nt, Homo sapiens
cccaauggauucaccaaga

SEQ ID NO: 1018814 - RNA, 19 nt, Homo sapiens
acaaaggccagaggaaaua

SEQ ID NO: 1018815 - RNA, 19 nt, Homo sapiens
ggaguuugcugcugaaaau

SEQ ID NO: 1018816 - RNA, 19 nt, Homo sapiens
gguaauuccuccuauuggu

SEQ ID NO: 1018817 - RNA, 19 nt, Homo sapiens
gggaaaucuucaacauguu

SEQ ID NO: 1018818 - RNA, 19 nt, Homo sapiens
ccuaguacaaugucuuaua

SEQ ID NO: 1018819 - RNA, 19 nt, Homo sapiens
ccaaggaucacccauguca

SEQ ID NO: 1018820 - RNA, 19 nt, Homo sapiens
cauuacaugugguauugaa

SEQ ID NO: 1018821 - RNA, 19 nt, Homo sapiens
cugcauacauuucaauaca

SEQ ID NO: 1018822 - RNA, 19 nt, Homo sapiens
agaagagccuccgauaaau

SEQ ID NO: 1018823 - RNA, 19 nt, Homo sapiens
guaaaggaagagaagguaa

SEQ ID NO: 1018824 - RNA, 19 nt, Homo sapiens
gaaacugcaauaugacugu

SEQ ID NO: 1018825 - RNA, 19 nt, Homo sapiens
aaagaguaccagaugauaa

SEQ ID NO: 1018826 - RNA, 19 nt, Homo sapiens
aagucaagcugaguacaua

SEQ ID NO: 1018827 - RNA, 19 nt, Homo sapiens
gcauacauuucaauacaac

SEQ ID NO: 1018828 - RNA, 19 nt, Homo sapiens
ggaaauggaugguggauga

SEQ ID NO: 1018829 - RNA, 19 nt, Homo sapiens
gcacagcagucuucuggua

SEQ ID NO: 1018830 - RNA, 19 nt, Homo sapiens
gcacuggccugcccuauug

SEQ ID NO: 1018831 - RNA, 19 nt, Homo sapiens
gaccuuggcuucugacuug

SEQ ID NO: 1018832 - RNA, 19 nt, Homo sapiens
uaacagaaccuacgaugaa

SEQ ID NO: 1018833 - RNA, 19 nt, Homo sapiens
gccaacaacuggauuaaug

SEQ ID NO: 1018834 - RNA, 19 nt, Homo sapiens
gagaccaucugcucccaua

SEQ ID NO: 1018835 - RNA, 19 nt, Homo sapiens
cuaaaggucuggccaaugu

SEQ ID NO: 1018836 - RNA, 19 nt, Homo sapiens
ccaaguggauugccaacaa

SEQ ID NO: 1018837 - RNA, 19 nt, Homo sapiens
cgacagggaucacuucauc

SEQ ID NO: 1018838 - RNA, 19 nt, Homo sapiens
ggccauggcauuuaacuaa

SEQ ID NO: 1018839 - RNA, 19 nt, Homo sapiens
gaucuugauuccacuuaga

SEQ ID NO: 1018840 - RNA, 19 nt, Homo sapiens
gagaagcucccacuagugu

SEQ ID NO: 1018841 - RNA, 19 nt, Homo sapiens
gaagaggcaaugagcacua

SEQ ID NO: 1018842 - RNA, 19 nt, Homo sapiens
ucagggccauggcauuuaa

SEQ ID NO: 1018843 - RNA, 19 nt, Homo sapiens
ccacuggagucaacacaga

SEQ ID NO: 1018844 - RNA, 19 nt, Homo sapiens
ccuauugucucccauccua

SEQ ID NO: 1018845 - RNA, 19 nt, Homo sapiens
uaacuaagugcaccuguga

SEQ ID NO: 1018846 - RNA, 19 nt, Homo sapiens
gaugaaaugagucugauuc

SEQ ID NO: 1018847 - RNA, 19 nt, Homo sapiens
gaagcucccacuaguguau

SEQ ID NO: 1018848 - RNA, 19 nt, Homo sapiens
ggagaucacuggguuaucc

SEQ ID NO: 1018849 - RNA, 19 nt, Homo sapiens
ccgagaagcucccacuagu

SEQ ID NO: 1018850 - RNA, 19 nt, Homo sapiens
gcucagggccauggcauuu

SEQ ID NO: 1018851 - RNA, 19 nt, Homo sapiens
agacugauguacccacaga

SEQ ID NO: 1018852 - RNA, 19 nt, Homo sapiens
gccagauccugccuacuga

SEQ ID NO: 1018853 - RNA, 19 nt, Homo sapiens
gaagagugucggcucauca

SEQ ID NO: 1018854 - RNA, 19 nt, Homo sapiens
ccacuaguguaugccuuaa

SEQ ID NO: 1018855 - RNA, 19 nt, Homo sapiens
cggcgcaguuccuauauuc

SEQ ID NO: 1018856 - RNA, 19 nt, Homo sapiens
gugcggaacagccaccaua

SEQ ID NO: 1018857 - RNA, 19 nt, Homo sapiens
ucaagccgcugcucuucga

SEQ ID NO: 1018858 - RNA, 19 nt, Homo sapiens
gaaccgugaugggcaccuu

SEQ ID NO: 1018859 - RNA, 19 nt, Homo sapiens
gauccugccuacugaagag

SEQ ID NO: 1018860 - RNA, 19 nt, Homo sapiens
gcugcagguuguucgauau

SEQ ID NO: 1018861 - RNA, 19 nt, Homo sapiens
guggaacucugagggaaga

SEQ ID NO: 1018862 - RNA, 19 nt, Homo sapiens
gaaccuacgaugaaaugag

SEQ ID NO: 1018863 - RNA, 19 nt, Homo sapiens
gcccauuccuccagguguu

SEQ ID NO: 1018864 - RNA, 19 nt, Homo sapiens
acuaguguaugccuuaaug

SEQ ID NO: 1018865 - RNA, 19 nt, Homo sapiens
caaguuguuuacccaaugg

SEQ ID NO: 1018866 - RNA, 19 nt, Homo sapiens
gacuaaaggucuggccaau

SEQ ID NO: 1018867 - RNA, 19 nt, Homo sapiens
ccauugcaacucacaguaa

SEQ ID NO: 1018868 - RNA, 19 nt, Homo sapiens
uaagugcaccugugaucuu

SEQ ID NO: 1018869 - RNA, 19 nt, Homo sapiens
cagagagcauucaggagau

SEQ ID NO: 1018870 - RNA, 19 nt, Homo sapiens
ggucgccaguugcccaaga

SEQ ID NO: 1018871 - RNA, 19 nt, Homo sapiens
auacggcgcaguuccuaua

SEQ ID NO: 1018872 - RNA, 19 nt, Homo sapiens
caacaacuggauuaaugug

SEQ ID NO: 1018873 - RNA, 19 nt, Homo sapiens
cagaaccuacgaugaaaug

SEQ ID NO: 1018874 - RNA, 19 nt, Homo sapiens
gcagguuguucgauauggu

SEQ ID NO: 1018875 - RNA, 19 nt, Homo sapiens
gcagucuucugguacaacu

SEQ ID NO: 1018876 - RNA, 19 nt, Homo sapiens
aacagaaccuacgaugaaa

SEQ ID NO: 1018877 - RNA, 19 nt, Homo sapiens
caacagggcacagcagucu

SEQ ID NO: 1018878 - RNA, 19 nt, Homo sapiens
ccacagacaccaaaacuug

SEQ ID NO: 1018879 - RNA, 19 nt, Homo sapiens
ccauggcauuuaacuaagu

SEQ ID NO: 1018880 - RNA, 19 nt, Homo sapiens
cgucuacgcuugggaccuu

SEQ ID NO: 1018881 - RNA, 19 nt, Homo sapiens
caaguggauugccaacaac

SEQ ID NO: 1018882 - RNA, 19 nt, Homo sapiens
gcaguuccuauauucaugu

SEQ ID NO: 1018883 - RNA, 19 nt, Homo sapiens
ccaacaacuggauuaaugu

SEQ ID NO: 1018884 - RNA, 19 nt, Homo sapiens
cuacagcaacggcgacgaa

SEQ ID NO: 1018885 - RNA, 19 nt, Homo sapiens
gccauggcauuuaacuaag

SEQ ID NO: 1018886 - RNA, 19 nt, Homo sapiens
ggaccuuggcuucugacuu

SEQ ID NO: 1018887 - RNA, 19 nt, Homo sapiens
caucugccccgucaaauaa

SEQ ID NO: 1018888 - RNA, 19 nt, Homo sapiens
aaccuacgaugaaaugagu

SEQ ID NO: 1018889 - RNA, 19 nt, Homo sapiens
uagcuuguccugcccauuc

SEQ ID NO: 1018890 - RNA, 19 nt, Homo sapiens
gcugguagccaacgagucu

SEQ ID NO: 1018891 - RNA, 19 nt, Homo sapiens
caggaacacccaugacaca

SEQ ID NO: 1018892 - RNA, 19 nt, Homo sapiens
cgcugcagguuguucgaua

SEQ ID NO: 1018893 - RNA, 19 nt, Homo sapiens
gcgcaguuccuauauucau

SEQ ID NO: 1018894 - RNA, 19 nt, Homo sapiens
cuccagguguugaucuuga

SEQ ID NO: 1018895 - RNA, 19 nt, Homo sapiens
cuucugacuuggagagugu

SEQ ID NO: 1018896 - RNA, 19 nt, Homo sapiens
uagcagauaacagaaccua

SEQ ID NO: 1018897 - RNA, 19 nt, Homo sapiens
cauugcaacucacaguaag

SEQ ID NO: 1018898 - RNA, 19 nt, Homo sapiens
cauggcauuuaacuaagug

SEQ ID NO: 1018899 - RNA, 19 nt, Homo sapiens
gggccuguguacccagaga

SEQ ID NO: 1018900 - RNA, 19 nt, Homo sapiens
aagaggcaaugagcacuau

SEQ ID NO: 1018901 - RNA, 19 nt, Homo sapiens
ugaagagugucggcucauc

SEQ ID NO: 1018902 - RNA, 19 nt, Homo sapiens
ugggugacguagacgacua

SEQ ID NO: 1018903 - RNA, 19 nt, Homo sapiens
gaaccugggcagcuuaucc

SEQ ID NO: 1018904 - RNA, 19 nt, Homo sapiens
cggcaaguaucucccaacu

SEQ ID NO: 1018905 - RNA, 19 nt, Homo sapiens
aagggaaaccugcguguca

SEQ ID NO: 1018906 - RNA, 19 nt, Homo sapiens
cagacucgccugggaaaug

SEQ ID NO: 1018907 - RNA, 19 nt, Homo sapiens
agccaguucuuuccucuuc

SEQ ID NO: 1018908 - RNA, 19 nt, Homo sapiens
cgagaagcucccacuagug

SEQ ID NO: 1018909 - RNA, 19 nt, Homo sapiens
acauggaccuucgggacuu

SEQ ID NO: 1018910 - RNA, 19 nt, Homo sapiens
ccugacugaugaagagugu

SEQ ID NO: 1018911 - RNA, 19 nt, Homo sapiens
acagcagucuucugguaca

SEQ ID NO: 1018912 - RNA, 19 nt, Homo sapiens
caacucacaguaagagacu

SEQ ID NO: 1018913 - RNA, 19 nt, Homo sapiens
gggccauggcauuuaacua

SEQ ID NO: 1018914 - RNA, 19 nt, Homo sapiens
ccggcuuccugacugauga

SEQ ID NO: 1018915 - RNA, 19 nt, Homo sapiens
caggagaucacuggguuau

SEQ ID NO: 1018916 - RNA, 19 nt, Homo sapiens
ccaagcugguagccaacga

SEQ ID NO: 1018917 - RNA, 19 nt, Homo sapiens
agacucgccugggaaaugg

SEQ ID NO: 1018918 - RNA, 19 nt, Homo sapiens
cgcaguuccuauauucaug

SEQ ID NO: 1018919 - RNA, 19 nt, Homo sapiens
ggguuaucccgguuaguga

SEQ ID NO: 1018920 - RNA, 19 nt, Homo sapiens
acaaggcagaguccaguga

SEQ ID NO: 1018921 - RNA, 19 nt, Homo sapiens
agagagcauucaggagaug

SEQ ID NO: 1018922 - RNA, 19 nt, Homo sapiens
caagaagacugcauuaauu

SEQ ID NO: 1018923 - RNA, 19 nt, Homo sapiens
gaagggagcuugacuuaca

SEQ ID NO: 1018924 - RNA, 19 nt, Homo sapiens
ggacaaagcauguaacuug

SEQ ID NO: 1018925 - RNA, 19 nt, Homo sapiens
caaaaggacuuaugaguua

SEQ ID NO: 1018926 - RNA, 19 nt, Homo sapiens
acagaaaucuccaaccuaa

SEQ ID NO: 1018927 - RNA, 19 nt, Homo sapiens
gcaaugagcccguauauac

SEQ ID NO: 1018928 - RNA, 19 nt, Homo sapiens
ggaacucggugucucuuaa

SEQ ID NO: 1018929 - RNA, 19 nt, Homo sapiens
gaggaagccuguccauuga

SEQ ID NO: 1018930 - RNA, 19 nt, Homo sapiens
gagcuugacuuacacuuug

SEQ ID NO: 1018931 - RNA, 19 nt, Homo sapiens
gagaagggagcuugacuua

SEQ ID NO: 1018932 - RNA, 19 nt, Homo sapiens
uagaagauguugucauuga

SEQ ID NO: 1018933 - RNA, 19 nt, Homo sapiens
acucaagacuggauuauuu

SEQ ID NO: 1018934 - RNA, 19 nt, Homo sapiens
gcaguugcuucuccacaua

SEQ ID NO: 1018935 - RNA, 19 nt, Homo sapiens
ggaagccuguccauugaaa

SEQ ID NO: 1018936 - RNA, 19 nt, Homo sapiens
gcauguaacuugaugaucu

SEQ ID NO: 1018937 - RNA, 19 nt, Homo sapiens
ucucuuacauggccaauuu

SEQ ID NO: 1018938 - RNA, 19 nt, Homo sapiens
gacaaagcauguaacuuga

SEQ ID NO: 1018939 - RNA, 19 nt, Homo sapiens
ucacacagauuauucaaag

SEQ ID NO: 1018940 - RNA, 19 nt, Homo sapiens
ucuagaagauguugucauu

SEQ ID NO: 1018941 - RNA, 19 nt, Homo sapiens
gacagagucuugcuuuguu

SEQ ID NO: 1018942 - RNA, 19 nt, Homo sapiens
gugcccagcuccuugcuua

SEQ ID NO: 1018943 - RNA, 19 nt, Homo sapiens
caacagcaguucugacuac

SEQ ID NO: 1018944 - RNA, 19 nt, Homo sapiens
uaagauggaugaagcaagu

SEQ ID NO: 1018945 - RNA, 19 nt, Homo sapiens
caacccaacugcuaccuau

SEQ ID NO: 1018946 - RNA, 19 nt, Homo sapiens
ggacaucuagguuccaauu

SEQ ID NO: 1018947 - RNA, 19 nt, Homo sapiens
ggaaugaagugggaaccaa

SEQ ID NO: 1018948 - RNA, 19 nt, Homo sapiens
caggaaacguuacucaaga

SEQ ID NO: 1018949 - RNA, 19 nt, Homo sapiens
cgaggaagccuguccauug

SEQ ID NO: 1018950 - RNA, 19 nt, Homo sapiens
caaagcauguaacuugaug

SEQ ID NO: 1018951 - RNA, 19 nt, Homo sapiens
caaccuaacuuugaacaca

SEQ ID NO: 1018952 - RNA, 19 nt, Homo sapiens
guaguuccuuccaauuaaa

SEQ ID NO: 1018953 - RNA, 19 nt, Homo sapiens
gacauccagucaucucuuu

SEQ ID NO: 1018954 - RNA, 19 nt, Homo sapiens
ugaagugggaaccaaauua

SEQ ID NO: 1018955 - RNA, 19 nt, Homo sapiens
gaccaaaacuaaacugaaa

SEQ ID NO: 1018956 - RNA, 19 nt, Homo sapiens
gauuauccuugaccuuuga

SEQ ID NO: 1018957 - RNA, 19 nt, Homo sapiens
ccacgacccucauuucuac

SEQ ID NO: 1018958 - RNA, 19 nt, Homo sapiens
ggagaaacuauuuaagaug

SEQ ID NO: 1018959 - RNA, 19 nt, Homo sapiens
ucaagaagacugcauuaau

SEQ ID NO: 1018960 - RNA, 19 nt, Homo sapiens
uguaguuccuuccaauuaa

SEQ ID NO: 1018961 - RNA, 19 nt, Homo sapiens
guagaauccucucggaauc

SEQ ID NO: 1018962 - RNA, 19 nt, Homo sapiens
ugucaaauguggagucuuc

SEQ ID NO: 1018963 - RNA, 19 nt, Homo sapiens
gaagugggaaccaaauuag

SEQ ID NO: 1018964 - RNA, 19 nt, Homo sapiens
guacggccuuccauuugaa

SEQ ID NO: 1018965 - RNA, 19 nt, Homo sapiens
gcaaagaaacagguuagga

SEQ ID NO: 1018966 - RNA, 19 nt, Homo sapiens
uggguaaucugucucuaaa

SEQ ID NO: 1018967 - RNA, 19 nt, Homo sapiens
caucugugcagccuucuua

SEQ ID NO: 1018968 - RNA, 19 nt, Homo sapiens
guauauacuucaacucaag

SEQ ID NO: 1018969 - RNA, 19 nt, Homo sapiens
ccaaagugcugggauuaca

SEQ ID NO: 1018970 - RNA, 19 nt, Homo sapiens
cuaaguaucugggauuaca

SEQ ID NO: 1018971 - RNA, 19 nt, Homo sapiens
uaaccacugucacuucuca

SEQ ID NO: 1018972 - RNA, 19 nt, Homo sapiens
ucacuuggagaaacuauuu

SEQ ID NO: 1018973 - RNA, 19 nt, Homo sapiens
ccaauucauucacauucuu

SEQ ID NO: 1018974 - RNA, 19 nt, Homo sapiens
gaaugaagugggaaccaaa

SEQ ID NO: 1018975 - RNA, 19 nt, Homo sapiens
gcccaaaugcaaugaguuu

SEQ ID NO: 1018976 - RNA, 19 nt, Homo sapiens
ggacucgaaaggcagcuua

SEQ ID NO: 1018977 - RNA, 19 nt, Homo sapiens
gaaauuugccaagccaaga

SEQ ID NO: 1018978 - RNA, 19 nt, Homo sapiens
ggagcuugacuuacacuuu

SEQ ID NO: 1018979 - RNA, 19 nt, Homo sapiens
gcaggaaacguuacucaag

SEQ ID NO: 1018980 - RNA, 19 nt, Homo sapiens
acacuaaggcugucugcua

SEQ ID NO: 1018981 - RNA, 19 nt, Homo sapiens
gcucuuugguguccuguuc

SEQ ID NO: 1018982 - RNA, 19 nt, Homo sapiens
guauaacccuacugcacuu

SEQ ID NO: 1018983 - RNA, 19 nt, Homo sapiens
ucaaacuccugaccuagug

SEQ ID NO: 1018984 - RNA, 19 nt, Homo sapiens
gcucaucugcugccugaaa

SEQ ID NO: 1018985 - RNA, 19 nt, Homo sapiens
gcagccuucuuaaagcaaa

SEQ ID NO: 1018986 - RNA, 19 nt, Homo sapiens
gguagaauccucucggaau

SEQ ID NO: 1018987 - RNA, 19 nt, Homo sapiens
cuacugcacuuucuauguc

SEQ ID NO: 1018988 - RNA, 19 nt, Homo sapiens
gcaaaaggacuuaugaguu

SEQ ID NO: 1018989 - RNA, 19 nt, Homo sapiens
ccagucaucucuuucuaag

SEQ ID NO: 1018990 - RNA, 19 nt, Homo sapiens
ucaguacggccuuccauuu

SEQ ID NO: 1018991 - RNA, 19 nt, Homo sapiens
caccaaugcuucagugaca

SEQ ID NO: 1018992 - RNA, 19 nt, Homo sapiens
acaaagcucuauguaaagu

SEQ ID NO: 1018993 - RNA, 19 nt, Homo sapiens
gcaggagguuguauuuuga

SEQ ID NO: 1018994 - RNA, 19 nt, Homo sapiens
cggugucucuuaauucauu

SEQ ID NO: 1018995 - RNA, 19 nt, Homo sapiens
ccagggcaguguuccagaa

SEQ ID NO: 1018996 - RNA, 19 nt, Homo sapiens
agaaacagguuaggacauc

SEQ ID NO: 1018997 - RNA, 19 nt, Homo sapiens
gguaaucugucucuaaaau

SEQ ID NO: 1018998 - RNA, 19 nt, Homo sapiens
caaaugcaaugaguuucug

SEQ ID NO: 1018999 - RNA, 19 nt, Homo sapiens
gcccagcuccuugcuuaua

SEQ ID NO: 1019000 - RNA, 19 nt, Homo sapiens
ggagaagggagcuugacuu

SEQ ID NO: 1019001 - RNA, 19 nt, Homo sapiens
ggaaucacuccgcaggaaa

SEQ ID NO: 1019002 - RNA, 19 nt, Homo sapiens
ucgaaaggcagcuuagaaa

SEQ ID NO: 1019003 - RNA, 19 nt, Homo sapiens
guuacaggauaauuacaga

SEQ ID NO: 1019004 - RNA, 19 nt, Homo sapiens
cuagacaacccaacugcua

SEQ ID NO: 1019005 - RNA, 19 nt, Homo sapiens
gaacucggugucucuuaau

SEQ ID NO: 1019006 - RNA, 19 nt, Homo sapiens
ucucagaguucacaauuuu

SEQ ID NO: 1019007 - RNA, 19 nt, Homo sapiens
ccucagaucacuuggagaa

SEQ ID NO: 1019008 - RNA, 19 nt, Homo sapiens
guaacuugaugaucuucga

SEQ ID NO: 1019009 - RNA, 19 nt, Homo sapiens
cauguaacuugaugaucuu

SEQ ID NO: 1019010 - RNA, 19 nt, Homo sapiens
auucaaagcccaccgauau

SEQ ID NO: 1019011 - RNA, 19 nt, Homo sapiens
acaucuagguuccaauuca

SEQ ID NO: 1019012 - RNA, 19 nt, Homo sapiens
uggauuauuugaucaaugg

SEQ ID NO: 1019013 - RNA, 19 nt, Homo sapiens
ucuccaaccuaacuuugaa

SEQ ID NO: 1019014 - RNA, 19 nt, Homo sapiens
ccauaccguuuacagaaau

SEQ ID NO: 1019015 - RNA, 19 nt, Homo sapiens
cccaucaucacacagauua

SEQ ID NO: 1019016 - RNA, 19 nt, Homo sapiens
caucuuugaccagaaauuu

SEQ ID NO: 1019017 - RNA, 19 nt, Homo sapiens
gauguaguuccuuccaauu

SEQ ID NO: 1019018 - RNA, 19 nt, Homo sapiens
guaaccagaagcccaaaug

SEQ ID NO: 1019019 - RNA, 19 nt, Homo sapiens
aaaggcagcuuagaaacca

SEQ ID NO: 1019020 - RNA, 19 nt, Homo sapiens
cccagcuccuugcuuauaa

SEQ ID NO: 1019021 - RNA, 19 nt, Homo sapiens
caucaucacacagauuauu

SEQ ID NO: 1019022 - RNA, 19 nt, Homo sapiens
gaagaauccucuaagauaa

SEQ ID NO: 1019023 - RNA, 19 nt, Homo sapiens
gaauagaagucaaacagua

SEQ ID NO: 1019024 - RNA, 19 nt, Homo sapiens
ggaaggauuugcuuguuua

SEQ ID NO: 1019025 - RNA, 19 nt, Homo sapiens
gaaagaagguuugcaguau

SEQ ID NO: 1019026 - RNA, 19 nt, Homo sapiens
ggcaagagcuaaauuuauu

SEQ ID NO: 1019027 - RNA, 19 nt, Homo sapiens
cagaagaccucgcuuuaaa

SEQ ID NO: 1019028 - RNA, 19 nt, Homo sapiens
gcuguuagauccagacaua

SEQ ID NO: 1019029 - RNA, 19 nt, Homo sapiens
gaaauucuggagcuuauua

SEQ ID NO: 1019030 - RNA, 19 nt, Homo sapiens
ucacagagccuugcaaaua

SEQ ID NO: 1019031 - RNA, 19 nt, Homo sapiens
aaagguaccucaauaauuc

SEQ ID NO: 1019032 - RNA, 19 nt, Homo sapiens
ugaagaaacugaacaugaa

SEQ ID NO: 1019033 - RNA, 19 nt, Homo sapiens
ggaaggcgauguagauguu

SEQ ID NO: 1019034 - RNA, 19 nt, Homo sapiens
ugaagaauccucuaagaua

SEQ ID NO: 1019035 - RNA, 19 nt, Homo sapiens
ggacuugacugaugagcuu

SEQ ID NO: 1019036 - RNA, 19 nt, Homo sapiens
gaagaaacagcaacucaaa

SEQ ID NO: 1019037 - RNA, 19 nt, Homo sapiens
gagcaacuuaucaguauua

SEQ ID NO: 1019038 - RNA, 19 nt, Homo sapiens
uuaacuggcugcacauaua

SEQ ID NO: 1019039 - RNA, 19 nt, Homo sapiens
cacagagccuugcaaauaa

SEQ ID NO: 1019040 - RNA, 19 nt, Homo sapiens
ucaacuggcugcuagaauu

SEQ ID NO: 1019041 - RNA, 19 nt, Homo sapiens
gaaacaaugacaugguuaa

SEQ ID NO: 1019042 - RNA, 19 nt, Homo sapiens
ggacuucagagaccaauaa

SEQ ID NO: 1019043 - RNA, 19 nt, Homo sapiens
agaugaagaugaugacuuu

SEQ ID NO: 1019044 - RNA, 19 nt, Homo sapiens
acggaaggauuguuuaaua

SEQ ID NO: 1019045 - RNA, 19 nt, Homo sapiens
ggacauaguggaagaugaa

SEQ ID NO: 1019046 - RNA, 19 nt, Homo sapiens
ggaugaagaugaagaaacu

SEQ ID NO: 1019047 - RNA, 19 nt, Homo sapiens
gaaggauuguuuaauaugg

SEQ ID NO: 1019048 - RNA, 19 nt, Homo sapiens
gagagaggauauagggaaa

SEQ ID NO: 1019049 - RNA, 19 nt, Homo sapiens
gaugauacauuuggaagga

SEQ ID NO: 1019050 - RNA, 19 nt, Homo sapiens
aaacaguaguggaagagua

SEQ ID NO: 1019051 - RNA, 19 nt, Homo sapiens
ugacagaagucuugcugaa

SEQ ID NO: 1019052 - RNA, 19 nt, Homo sapiens
gaacuuuaagguugucuuu

SEQ ID NO: 1019053 - RNA, 19 nt, Homo sapiens
ggugaaauccuucucuaaa

SEQ ID NO: 1019054 - RNA, 19 nt, Homo sapiens
gcacauauaccuuaauaac

SEQ ID NO: 1019055 - RNA, 19 nt, Homo sapiens
ugaagaugcugaagaaaca

SEQ ID NO: 1019056 - RNA, 19 nt, Homo sapiens
aaacacugcuagagucauu

SEQ ID NO: 1019057 - RNA, 19 nt, Homo sapiens
guauuugucuguugggauu

SEQ ID NO: 1019058 - RNA, 19 nt, Homo sapiens
gaagaaacugaacaugaaa

SEQ ID NO: 1019059 - RNA, 19 nt, Homo sapiens
cauaaaggaugaccagauc

SEQ ID NO: 1019060 - RNA, 19 nt, Homo sapiens
cagaaucagauguguaaua

SEQ ID NO: 1019061 - RNA, 19 nt, Homo sapiens
gaaacagaaucagaugugu

SEQ ID NO: 1019062 - RNA, 19 nt, Homo sapiens
gggcauugauggcauugaa

SEQ ID NO: 1019063 - RNA, 19 nt, Homo sapiens
caugagugcugaagagcua

SEQ ID NO: 1019064 - RNA, 19 nt, Homo sapiens
gaggaacaaucgccagaug

SEQ ID NO: 1019065 - RNA, 19 nt, Homo sapiens
ggaaguaguuuuaauguag

SEQ ID NO: 1019066 - RNA, 19 nt, Homo sapiens
ugaaagaagguuugcagua

SEQ ID NO: 1019067 - RNA, 19 nt, Homo sapiens
cugcacauauaccuuaaua

SEQ ID NO: 1019068 - RNA, 19 nt, Homo sapiens
acaaugacaugguuaaucu

SEQ ID NO: 1019069 - RNA, 19 nt, Homo sapiens
ggaaacagaaucagaugug

SEQ ID NO: 1019070 - RNA, 19 nt, Homo sapiens
cugaagaggucaaagaaau

SEQ ID NO: 1019071 - RNA, 19 nt, Homo sapiens
uauugaagaugcugaagaa

SEQ ID NO: 1019072 - RNA, 19 nt, Homo sapiens
ggcagaaauuugugacuga

SEQ ID NO: 1019073 - RNA, 19 nt, Homo sapiens
acaccaagcuccuuugaca

SEQ ID NO: 1019074 - RNA, 19 nt, Homo sapiens
cugaagagcuacaggaguu

SEQ ID NO: 1019075 - RNA, 19 nt, Homo sapiens
caugaaggaugucugcuau

SEQ ID NO: 1019076 - RNA, 19 nt, Homo sapiens
cggaaggauuguuuaauau

SEQ ID NO: 1019077 - RNA, 19 nt, Homo sapiens
ugacaugguuaaucuggaa

SEQ ID NO: 1019078 - RNA, 19 nt, Homo sapiens
cacaugagauuggauuuga

SEQ ID NO: 1019079 - RNA, 19 nt, Homo sapiens
gggaauuucuuuguuggaa

SEQ ID NO: 1019080 - RNA, 19 nt, Homo sapiens
gaucugcaucacuuaguua

SEQ ID NO: 1019081 - RNA, 19 nt, Homo sapiens
gaagagagagaggauauag

SEQ ID NO: 1019082 - RNA, 19 nt, Homo sapiens
cagaagucuugcugaagua

SEQ ID NO: 1019083 - RNA, 19 nt, Homo sapiens
gaaggaugucugcuaugua

SEQ ID NO: 1019084 - RNA, 19 nt, Homo sapiens
ggaaggauuguuuaauaug

SEQ ID NO: 1019085 - RNA, 19 nt, Homo sapiens
aaacagcaacucaaacuug

SEQ ID NO: 1019086 - RNA, 19 nt, Homo sapiens
cgauguagauguuucagau

SEQ ID NO: 1019087 - RNA, 19 nt, Homo sapiens
gguggaaaguaauuugaga

SEQ ID NO: 1019088 - RNA, 19 nt, Homo sapiens
gccauuagaucgagucagu

SEQ ID NO: 1019089 - RNA, 19 nt, Homo sapiens
ggucuuaggacuugacuga

SEQ ID NO: 1019090 - RNA, 19 nt, Homo sapiens
ccagaaugauaccgugauu

SEQ ID NO: 1019091 - RNA, 19 nt, Homo sapiens
cuauguagaugguaagguu

SEQ ID NO: 1019092 - RNA, 19 nt, Homo sapiens
gugaaauccuucucuaaag

SEQ ID NO: 1019093 - RNA, 19 nt, Homo sapiens
cugcaucacuuaguuauug

SEQ ID NO: 1019094 - RNA, 19 nt, Homo sapiens
caaacccgcuggacaccuu

SEQ ID NO: 1019095 - RNA, 19 nt, Homo sapiens
ugaaggaugucugcuaugu

SEQ ID NO: 1019096 - RNA, 19 nt, Homo sapiens
ugauggcaauguagaguuu

SEQ ID NO: 1019097 - RNA, 19 nt, Homo sapiens
gcucaagcauuuucacuuu

SEQ ID NO: 1019098 - RNA, 19 nt, Homo sapiens
gaagaggucaaagaaauuc

SEQ ID NO: 1019099 - RNA, 19 nt, Homo sapiens
uggaaggauuugcuuguuu

SEQ ID NO: 1019100 - RNA, 19 nt, Homo sapiens
ugaagacuaucaugugcaa

SEQ ID NO: 1019101 - RNA, 19 nt, Homo sapiens
gaucacaccaagcuccuuu

SEQ ID NO: 1019102 - RNA, 19 nt, Homo sapiens
gcaagcuuauucccuuuag

SEQ ID NO: 1019103 - RNA, 19 nt, Homo sapiens
ucacuuaguuauugggaau

SEQ ID NO: 1019104 - RNA, 19 nt, Homo sapiens
gaggauauagggaaacaga

SEQ ID NO: 1019105 - RNA, 19 nt, Homo sapiens
gagaggauauagggaaaca

SEQ ID NO: 1019106 - RNA, 19 nt, Homo sapiens
ggaagagagagaggauaua

SEQ ID NO: 1019107 - RNA, 19 nt, Homo sapiens
gauaaucuuccugcaaauu

SEQ ID NO: 1019108 - RNA, 19 nt, Homo sapiens
uaaggaaggcgauguagau

SEQ ID NO: 1019109 - RNA, 19 nt, Homo sapiens
acagaagucuugcugaagu

SEQ ID NO: 1019110 - RNA, 19 nt, Homo sapiens
acuaucaugugcaaucuuu

SEQ ID NO: 1019111 - RNA, 19 nt, Homo sapiens
gaagaugaugacuuucuga

SEQ ID NO: 1019112 - RNA, 19 nt, Homo sapiens
aaacaaaggaucuauaucg

SEQ ID NO: 1019113 - RNA, 19 nt, Homo sapiens
gcaauguagaguuugaauu

SEQ ID NO: 1019114 - RNA, 19 nt, Homo sapiens
ucacuuuguuucuuacaug

SEQ ID NO: 1019115 - RNA, 19 nt, Homo sapiens
gggaagagagagaggauau

SEQ ID NO: 1019116 - RNA, 19 nt, Homo sapiens
gcuggaaauuauauuggaa

SEQ ID NO: 1019117 - RNA, 19 nt, Homo sapiens
gaaacagcaacucaaacuu

SEQ ID NO: 1019118 - RNA, 19 nt, Homo sapiens
ugaagaaccagcuguuaga

SEQ ID NO: 1019119 - RNA, 19 nt, Homo sapiens
ggauauagggaaacagaau

SEQ ID NO: 1019120 - RNA, 19 nt, Homo sapiens
gaaggauuugcuuguuuaa

SEQ ID NO: 1019121 - RNA, 19 nt, Homo sapiens
gagcggaaaccugaaagaa

SEQ ID NO: 1019122 - RNA, 19 nt, Homo sapiens
guacagagaugacauuaca

SEQ ID NO: 1019123 - RNA, 19 nt, Homo sapiens
cgacugauauugauguuaa

SEQ ID NO: 1019124 - RNA, 19 nt, Homo sapiens
gaucuacucuucuauugaa

SEQ ID NO: 1019125 - RNA, 19 nt, Homo sapiens
guacacagucuaugcauua

SEQ ID NO: 1019126 - RNA, 19 nt, Homo sapiens
caagcaaucugaauuuguu

SEQ ID NO: 1019127 - RNA, 19 nt, Homo sapiens
gaacugagcaggaucuaug

SEQ ID NO: 1019128 - RNA, 19 nt, Homo sapiens
uaaggaggcucuaauuaau

SEQ ID NO: 1019129 - RNA, 19 nt, Homo sapiens
ggcaagcacuucuuuauca

SEQ ID NO: 1019130 - RNA, 19 nt, Homo sapiens
aggaugaccuggcaaauaa

SEQ ID NO: 1019131 - RNA, 19 nt, Homo sapiens
uaucacaggugucuugaaa

SEQ ID NO: 1019132 - RNA, 19 nt, Homo sapiens
gcauccaaauuguacuuua

SEQ ID NO: 1019133 - RNA, 19 nt, Homo sapiens
guucaauucucauguugua

SEQ ID NO: 1019134 - RNA, 19 nt, Homo sapiens
caaucaagcugccugcaaa

SEQ ID NO: 1019135 - RNA, 19 nt, Homo sapiens
gauguaaaguucaaaugga

SEQ ID NO: 1019136 - RNA, 19 nt, Homo sapiens
guaaggaggcauccaaauu

SEQ ID NO: 1019137 - RNA, 19 nt, Homo sapiens
ccagugacaugagaacaua

SEQ ID NO: 1019138 - RNA, 19 nt, Homo sapiens
ugacuggaaugcuucuuaa

SEQ ID NO: 1019139 - RNA, 19 nt, Homo sapiens
gcaaguuggugauccuaau

SEQ ID NO: 1019140 - RNA, 19 nt, Homo sapiens
gauuaaggccacaggauaa

SEQ ID NO: 1019141 - RNA, 19 nt, Homo sapiens
gaacuagaacggcugaaau

SEQ ID NO: 1019142 - RNA, 19 nt, Homo sapiens
guuaaggaggcucuaauua

SEQ ID NO: 1019143 - RNA, 19 nt, Homo sapiens
acaggugucuugaaacauu

SEQ ID NO: 1019144 - RNA, 19 nt, Homo sapiens
ucacaggugucuugaaaca

SEQ ID NO: 1019145 - RNA, 19 nt, Homo sapiens
ccaaguuuauuccuccuaa

SEQ ID NO: 1019146 - RNA, 19 nt, Homo sapiens
gaaugcuucuuaaguggaa

SEQ ID NO: 1019147 - RNA, 19 nt, Homo sapiens
uaaggaggcauccaaauug

SEQ ID NO: 1019148 - RNA, 19 nt, Homo sapiens
gauccaagcaaucugaauu

SEQ ID NO: 1019149 - RNA, 19 nt, Homo sapiens
gcccagaccaguugaauga

SEQ ID NO: 1019150 - RNA, 19 nt, Homo sapiens
ggccaagagugucgugaaa

SEQ ID NO: 1019151 - RNA, 19 nt, Homo sapiens
guaccuaacuggcaugcau

SEQ ID NO: 1019152 - RNA, 19 nt, Homo sapiens
ccaguugaaugacaaugaa

SEQ ID NO: 1019153 - RNA, 19 nt, Homo sapiens
gaaacaggaucggcugcuu

SEQ ID NO: 1019154 - RNA, 19 nt, Homo sapiens
ccaagagugucgugaaaca

SEQ ID NO: 1019155 - RNA, 19 nt, Homo sapiens
uagaacggcugaaauugga

SEQ ID NO: 1019156 - RNA, 19 nt, Homo sapiens
agacuuugcuagagauuga

SEQ ID NO: 1019157 - RNA, 19 nt, Homo sapiens
uggcaauucucaaaugauu

SEQ ID NO: 1019158 - RNA, 19 nt, Homo sapiens
gcucgaauguacagagaug

SEQ ID NO: 1019159 - RNA, 19 nt, Homo sapiens
ccuuaaagcuaaugaauac

SEQ ID NO: 1019160 - RNA, 19 nt, Homo sapiens
cagucacgcugucuaauga

SEQ ID NO: 1019161 - RNA, 19 nt, Homo sapiens
ugaccaagauccaagcaau

SEQ ID NO: 1019162 - RNA, 19 nt, Homo sapiens
caugagacuuugcuagaga

SEQ ID NO: 1019163 - RNA, 19 nt, Homo sapiens
gaggcaagcacuucuuuau

SEQ ID NO: 1019164 - RNA, 19 nt, Homo sapiens
ggacagaugcauggccuuu

SEQ ID NO: 1019165 - RNA, 19 nt, Homo sapiens
ucacaccuuucuucacuga

SEQ ID NO: 1019166 - RNA, 19 nt, Homo sapiens
ucaguucaauucucauguu

SEQ ID NO: 1019167 - RNA, 19 nt, Homo sapiens
gaaaggagaaccaaaaugu

SEQ ID NO: 1019168 - RNA, 19 nt, Homo sapiens
cgauuaaggccacaggaua

SEQ ID NO: 1019169 - RNA, 19 nt, Homo sapiens
ccgauuuccuaauguaauu

SEQ ID NO: 1019170 - RNA, 19 nt, Homo sapiens
cacagucuaugcauuauuc

SEQ ID NO: 1019171 - RNA, 19 nt, Homo sapiens
ggauaaguuucugguguug

SEQ ID NO: 1019172 - RNA, 19 nt, Homo sapiens
gacaaugaauauaccaagu

SEQ ID NO: 1019173 - RNA, 19 nt, Homo sapiens
ccacaaugcucaaaaugaa

SEQ ID NO: 1019174 - RNA, 19 nt, Homo sapiens
uguguagucucuugguuaa

SEQ ID NO: 1019175 - RNA, 19 nt, Homo sapiens
caggugucuugaaacauua

SEQ ID NO: 1019176 - RNA, 19 nt, Homo sapiens
ucacacaccuccuuaucuc

SEQ ID NO: 1019177 - RNA, 19 nt, Homo sapiens
gcagucacgcugucuaaug

SEQ ID NO: 1019178 - RNA, 19 nt, Homo sapiens
uuuaacagcuugaggacuu

SEQ ID NO: 1019179 - RNA, 19 nt, Homo sapiens
guucacaccuuucuucacu

SEQ ID NO: 1019180 - RNA, 19 nt, Homo sapiens
gaucaugagcgccucucua

SEQ ID NO: 1019181 - RNA, 19 nt, Homo sapiens
gucaauagcauccuuaaag

SEQ ID NO: 1019182 - RNA, 19 nt, Homo sapiens
ccucacaccuccacaaguc

SEQ ID NO: 1019183 - RNA, 19 nt, Homo sapiens
uaggaugaccuggcaaaua

SEQ ID NO: 1019184 - RNA, 19 nt, Homo sapiens
gcaaucaagcugccugcaa

SEQ ID NO: 1019185 - RNA, 19 nt, Homo sapiens
caagucaauagcauccuua

SEQ ID NO: 1019186 - RNA, 19 nt, Homo sapiens
caaggaaggagauaugcuu

SEQ ID NO: 1019187 - RNA, 19 nt, Homo sapiens
gugauuauuugacuggaau

SEQ ID NO: 1019188 - RNA, 19 nt, Homo sapiens
gcaauucucaaaugauuac

SEQ ID NO: 1019189 - RNA, 19 nt, Homo sapiens
gcucuuuacuggcaauucu

SEQ ID NO: 1019190 - RNA, 19 nt, Homo sapiens
gcagcaacccaucucauuc

SEQ ID NO: 1019191 - RNA, 19 nt, Homo sapiens
gauugugggugaguaccua

SEQ ID NO: 1019192 - RNA, 19 nt, Homo sapiens
auaaugacaucuccuugga

SEQ ID NO: 1019193 - RNA, 19 nt, Homo sapiens
gugagucgacugauauuga

SEQ ID NO: 1019194 - RNA, 19 nt, Homo sapiens
uuauauugcuggcucuuug

SEQ ID NO: 1019195 - RNA, 19 nt, Homo sapiens
cacccgauuuccuaaugua

SEQ ID NO: 1019196 - RNA, 19 nt, Homo sapiens
agagaugacauuacaauca

SEQ ID NO: 1019197 - RNA, 19 nt, Homo sapiens
ggcaggaugugguuaggau

SEQ ID NO: 1019198 - RNA, 19 nt, Homo sapiens
gaagaggacggcucauggu

SEQ ID NO: 1019199 - RNA, 19 nt, Homo sapiens
ggaaucccagucagaaguu

SEQ ID NO: 1019200 - RNA, 19 nt, Homo sapiens
acagaugcauggccuuuua

SEQ ID NO: 1019201 - RNA, 19 nt, Homo sapiens
gacaggagaaugugugugu

SEQ ID NO: 1019202 - RNA, 19 nt, Homo sapiens
caaaagagagugauagaau

SEQ ID NO: 1019203 - RNA, 19 nt, Homo sapiens
uuucaaagugccagaauuu

SEQ ID NO: 1019204 - RNA, 19 nt, Homo sapiens
ucuauggcacugcauguua

SEQ ID NO: 1019205 - RNA, 19 nt, Homo sapiens
cuggaaugcuucuuaagug

SEQ ID NO: 1019206 - RNA, 19 nt, Homo sapiens
ccagaccaguugaaugaca

SEQ ID NO: 1019207 - RNA, 19 nt, Homo sapiens
ggagauguaaaguucaaau

SEQ ID NO: 1019208 - RNA, 19 nt, Homo sapiens
ucaauagcauccuuaaagc

SEQ ID NO: 1019209 - RNA, 19 nt, Homo sapiens
guaguucaguucaauucuc

SEQ ID NO: 1019210 - RNA, 19 nt, Homo sapiens
gaaugacaaugaauauacc

SEQ ID NO: 1019211 - RNA, 19 nt, Homo sapiens
caaguuggugauccuaauu

SEQ ID NO: 1019212 - RNA, 19 nt, Homo sapiens
ugagucgacugauauugau

SEQ ID NO: 1019213 - RNA, 19 nt, Homo sapiens
gcaccccaaugauuacuuu

SEQ ID NO: 1019214 - RNA, 19 nt, Homo sapiens
uuaguuugaucuacucuuc

SEQ ID NO: 1019215 - RNA, 19 nt, Homo sapiens
acaccuuucuucacugaga

SEQ ID NO: 1019216 - RNA, 19 nt, Homo sapiens
guguguagucucuugguua

SEQ ID NO: 1019217 - RNA, 19 nt, Homo sapiens
cgaauuggaaucccaguca

SEQ ID NO: 1019218 - RNA, 19 nt, Homo sapiens
gagauguaaaguucaaaug

SEQ ID NO: 1019219 - RNA, 19 nt, Homo sapiens
uuggugauccuaauucuuu

SEQ ID NO: 1019220 - RNA, 19 nt, Homo sapiens
guuucaaagugccagaauu

SEQ ID NO: 1019221 - RNA, 19 nt, Homo sapiens
ccacaccacagaaauuuua

SEQ ID NO: 1019222 - RNA, 19 nt, Homo sapiens
gaugaaaugugcuacaaua

SEQ ID NO: 1019223 - RNA, 19 nt, Homo sapiens
gaaaugugcuacaauacaa

SEQ ID NO: 1019224 - RNA, 19 nt, Homo sapiens
gcacagacccugccaaguu

SEQ ID NO: 1019225 - RNA, 19 nt, Homo sapiens
gaguuagucuaguuaguau

SEQ ID NO: 1019226 - RNA, 19 nt, Homo sapiens
ggauaaagccaauggauac

SEQ ID NO: 1019227 - RNA, 19 nt, Homo sapiens
caugaugucugccgcaaug

SEQ ID NO: 1019228 - RNA, 19 nt, Homo sapiens
caaaggacuucuggccaaa

SEQ ID NO: 1019229 - RNA, 19 nt, Homo sapiens
ggaagucgaguuagucuag

SEQ ID NO: 1019230 - RNA, 19 nt, Homo sapiens
uaaagccaauggauacugu

SEQ ID NO: 1019231 - RNA, 19 nt, Homo sapiens
cgaguuagucuaguuagua

SEQ ID NO: 1019232 - RNA, 19 nt, Homo sapiens
ccaugcagcuguagcaaca

SEQ ID NO: 1019233 - RNA, 19 nt, Homo sapiens
gcucagggaagaccacgua

SEQ ID NO: 1019234 - RNA, 19 nt, Homo sapiens
caaguucauuucaguacug

SEQ ID NO: 1019235 - RNA, 19 nt, Homo sapiens
caaccuccuuuccaagaug

SEQ ID NO: 1019236 - RNA, 19 nt, Homo sapiens
gugaugaaaugugcuacaa

SEQ ID NO: 1019237 - RNA, 19 nt, Homo sapiens
uagugcagcucaucgaaga

SEQ ID NO: 1019238 - RNA, 19 nt, Homo sapiens
ggacuacuacacagagguu

SEQ ID NO: 1019239 - RNA, 19 nt, Homo sapiens
gagagcaggaugcauaauc

SEQ ID NO: 1019240 - RNA, 19 nt, Homo sapiens
ccuucaaccuggacuacua

SEQ ID NO: 1019241 - RNA, 19 nt, Homo sapiens
cacagacccugccaaguuc

SEQ ID NO: 1019242 - RNA, 19 nt, Homo sapiens
ggaccucuccuaccugcuu

SEQ ID NO: 1019243 - RNA, 19 nt, Homo sapiens
uggauaaagccaauggaua

SEQ ID NO: 1019244 - RNA, 19 nt, Homo sapiens
gugcuacaauacaagaguu

SEQ ID NO: 1019245 - RNA, 19 nt, Homo sapiens
ugaaaugugcuacaauaca

SEQ ID NO: 1019246 - RNA, 19 nt, Homo sapiens
gucaggcugugaugaaaug

SEQ ID NO: 1019247 - RNA, 19 nt, Homo sapiens
ggagccgacuuccauuucu

SEQ ID NO: 1019248 - RNA, 19 nt, Homo sapiens
cuggagagcaggaugcaua

SEQ ID NO: 1019249 - RNA, 19 nt, Homo sapiens
cgcagcaucuucucccaaa

SEQ ID NO: 1019250 - RNA, 19 nt, Homo sapiens
gcuacaauacaagaguuua

SEQ ID NO: 1019251 - RNA, 19 nt, Homo sapiens
cuauagccuugucuccuuu

SEQ ID NO: 1019252 - RNA, 19 nt, Homo sapiens
caaccuggacuacuacaca

SEQ ID NO: 1019253 - RNA, 19 nt, Homo sapiens
gauauucagcucugcaaag

SEQ ID NO: 1019254 - RNA, 19 nt, Homo sapiens
guaccucccuggccaccau

SEQ ID NO: 1019255 - RNA, 19 nt, Homo sapiens
guuaguaucggccuguuau

SEQ ID NO: 1019256 - RNA, 19 nt, Homo sapiens
aggaagccaugcagcugua

SEQ ID NO: 1019257 - RNA, 19 nt, Homo sapiens
ccucguggauucucacuac

SEQ ID NO: 1019258 - RNA, 19 nt, Homo sapiens
gaagucgaguuagucuagu

SEQ ID NO: 1019259 - RNA, 19 nt, Homo sapiens
acaucaaccuccuuuccaa

SEQ ID NO: 1019260 - RNA, 19 nt, Homo sapiens
gacacggucucagcuguuc

SEQ ID NO: 1019261 - RNA, 19 nt, Homo sapiens
acuauagccuugucuccuu

SEQ ID NO: 1019262 - RNA, 19 nt, Homo sapiens
cgaagacuauagccuuguc

SEQ ID NO: 1019263 - RNA, 19 nt, Homo sapiens
ccaagauggaccucauuga

SEQ ID NO: 1019264 - RNA, 19 nt, Homo sapiens
cagcaucuucucccaaaug

SEQ ID NO: 1019265 - RNA, 19 nt, Homo sapiens
gacauggugccaagcagaa

SEQ ID NO: 1019266 - RNA, 19 nt, Homo sapiens
caacgagguauacguacug

SEQ ID NO: 1019267 - RNA, 19 nt, Homo sapiens
ccaacgagguauacguacu

SEQ ID NO: 1019268 - RNA, 19 nt, Homo sapiens
gagccgacuuccauuucuc

SEQ ID NO: 1019269 - RNA, 19 nt, Homo sapiens
gcagcucaucgaagacuau

SEQ ID NO: 1019270 - RNA, 19 nt, Homo sapiens
gcagcaucuucucccaaau

SEQ ID NO: 1019271 - RNA, 19 nt, Homo sapiens
uagucaggcugugaugaaa

SEQ ID NO: 1019272 - RNA, 19 nt, Homo sapiens
cuagucaggcugugaugaa

SEQ ID NO: 1019273 - RNA, 19 nt, Homo sapiens
ucaaccuccuuuccaagau

SEQ ID NO: 1019274 - RNA, 19 nt, Homo sapiens
gacccugccaaguucauuu

SEQ ID NO: 1019275 - RNA, 19 nt, Homo sapiens
ggauauucagcucugcaaa

SEQ ID NO: 1019276 - RNA, 19 nt, Homo sapiens
cgccaacgagguauacgua

SEQ ID NO: 1019277 - RNA, 19 nt, Homo sapiens
gggagccgacuuccauuuc

SEQ ID NO: 1019278 - RNA, 19 nt, Homo sapiens
uugaccaccuggcuucuga

SEQ ID NO: 1019279 - RNA, 19 nt, Homo sapiens
cagggaagaccacguacug

SEQ ID NO: 1019280 - RNA, 19 nt, Homo sapiens
gcugugaugaaaugugcua

SEQ ID NO: 1019281 - RNA, 19 nt, Homo sapiens
cuuuaucccucucaacauc

SEQ ID NO: 1019282 - RNA, 19 nt, Homo sapiens
gcuagugcagcucaucgaa

SEQ ID NO: 1019283 - RNA, 19 nt, Homo sapiens
guucauuucaguacugugu

SEQ ID NO: 1019284 - RNA, 19 nt, Homo sapiens
ccaaguucauuucaguacu

SEQ ID NO: 1019285 - RNA, 19 nt, Homo sapiens
cgacacggucucagcuguu

SEQ ID NO: 1019286 - RNA, 19 nt, Homo sapiens
gucgagcacugguccuagu

SEQ ID NO: 1019287 - RNA, 19 nt, Homo sapiens
cugccaaguucauuucagu

SEQ ID NO: 1019288 - RNA, 19 nt, Homo sapiens
ggagagagcugauccuuua

SEQ ID NO: 1019289 - RNA, 19 nt, Homo sapiens
gcagucauaugaaccauua

SEQ ID NO: 1019290 - RNA, 19 nt, Homo sapiens
gggaguagcugcuugguuu

SEQ ID NO: 1019291 - RNA, 19 nt, Homo sapiens
gaaaucaucucgguaauca

SEQ ID NO: 1019292 - RNA, 19 nt, Homo sapiens
ugaaagagaugauguagau

SEQ ID NO: 1019293 - RNA, 19 nt, Homo sapiens
gaaaugacugugaagaaua

SEQ ID NO: 1019294 - RNA, 19 nt, Homo sapiens
cuaaggaugugauuuguuu

SEQ ID NO: 1019295 - RNA, 19 nt, Homo sapiens
ucaaacagcagcaauauuu

SEQ ID NO: 1019296 - RNA, 19 nt, Homo sapiens
ggauagaccuggguucaaa

SEQ ID NO: 1019297 - RNA, 19 nt, Homo sapiens
gaacaacucuaauccuuuu

SEQ ID NO: 1019298 - RNA, 19 nt, Homo sapiens
ucacagggcuuccagauca

SEQ ID NO: 1019299 - RNA, 19 nt, Homo sapiens
gcaguucucucauccuuau

SEQ ID NO: 1019300 - RNA, 19 nt, Homo sapiens
ggacagcugugacuuaugg

SEQ ID NO: 1019301 - RNA, 19 nt, Homo sapiens
gcaccuuaaucacuguuua

SEQ ID NO: 1019302 - RNA, 19 nt, Homo sapiens
gaccuggguucaaaucaua

SEQ ID NO: 1019303 - RNA, 19 nt, Homo sapiens
guaaauugauguucaguag

SEQ ID NO: 1019304 - RNA, 19 nt, Homo sapiens
caaaguggcugaaaauauu

SEQ ID NO: 1019305 - RNA, 19 nt, Homo sapiens
gagcauaggcagacuuaaa

SEQ ID NO: 1019306 - RNA, 19 nt, Homo sapiens
gggaacaacucuaauccuu

SEQ ID NO: 1019307 - RNA, 19 nt, Homo sapiens
gacagaaguugcuggguuu

SEQ ID NO: 1019308 - RNA, 19 nt, Homo sapiens
ggaaauauaacaucuaugg

SEQ ID NO: 1019309 - RNA, 19 nt, Homo sapiens
uaagaacacuacuacaguu

SEQ ID NO: 1019310 - RNA, 19 nt, Homo sapiens
uaaagaaggucuggauguu

SEQ ID NO: 1019311 - RNA, 19 nt, Homo sapiens
gguuguaggucauaaagaa

SEQ ID NO: 1019312 - RNA, 19 nt, Homo sapiens
gagaugaagauuugacuaa

SEQ ID NO: 1019313 - RNA, 19 nt, Homo sapiens
aauuacagcugccaguuua

SEQ ID NO: 1019314 - RNA, 19 nt, Homo sapiens
aggauuaacugagagauua

SEQ ID NO: 1019315 - RNA, 19 nt, Homo sapiens
gcaaauauagauugagcua

SEQ ID NO: 1019316 - RNA, 19 nt, Homo sapiens
gugcaaugcugaauaccua

SEQ ID NO: 1019317 - RNA, 19 nt, Homo sapiens
ucaguaguguuaacucuaa

SEQ ID NO: 1019318 - RNA, 19 nt, Homo sapiens
gcccuugucuuuccuacua

SEQ ID NO: 1019319 - RNA, 19 nt, Homo sapiens
aagcaguaguuguuucuua

SEQ ID NO: 1019320 - RNA, 19 nt, Homo sapiens
ggacacauaucuugcaaaa

SEQ ID NO: 1019321 - RNA, 19 nt, Homo sapiens
uaauuggacuuccuacuau

SEQ ID NO: 1019322 - RNA, 19 nt, Homo sapiens
gaucaaacugugcaaauau

SEQ ID NO: 1019323 - RNA, 19 nt, Homo sapiens
agacagaaaugcaaagauc

SEQ ID NO: 1019324 - RNA, 19 nt, Homo sapiens
ugaaaugacugugaagaau

SEQ ID NO: 1019325 - RNA, 19 nt, Homo sapiens
gaugaagauuugacuaaca

SEQ ID NO: 1019326 - RNA, 19 nt, Homo sapiens
uuacagaguugacagucua

SEQ ID NO: 1019327 - RNA, 19 nt, Homo sapiens
gcagagugcuguaggacau

SEQ ID NO: 1019328 - RNA, 19 nt, Homo sapiens
caaacagcagcaauauuua

SEQ ID NO: 1019329 - RNA, 19 nt, Homo sapiens
gaauaauggucggcucuau

SEQ ID NO: 1019330 - RNA, 19 nt, Homo sapiens
gaagacuauuucuaggauu

SEQ ID NO: 1019331 - RNA, 19 nt, Homo sapiens
uaacagugagccuuauuaa

SEQ ID NO: 1019332 - RNA, 19 nt, Homo sapiens
uuaugaaucuguuguguug

SEQ ID NO: 1019333 - RNA, 19 nt, Homo sapiens
gcaaauacucgaauaaacu

SEQ ID NO: 1019334 - RNA, 19 nt, Homo sapiens
gcugauccuuuauuccuuu

SEQ ID NO: 1019335 - RNA, 19 nt, Homo sapiens
gagagcugauccuuuauuc

SEQ ID NO: 1019336 - RNA, 19 nt, Homo sapiens
ucacugccuugcuaacuuu

SEQ ID NO: 1019337 - RNA, 19 nt, Homo sapiens
ggaacaacucuaauccuuu

SEQ ID NO: 1019338 - RNA, 19 nt, Homo sapiens
uaaauggacacauaucuug

SEQ ID NO: 1019339 - RNA, 19 nt, Homo sapiens
gcugaauaccuaauaguuu

SEQ ID NO: 1019340 - RNA, 19 nt, Homo sapiens
agaucaaacugugcaaaua

SEQ ID NO: 1019341 - RNA, 19 nt, Homo sapiens
aagaaggucuggauguuau

SEQ ID NO: 1019342 - RNA, 19 nt, Homo sapiens
caaaucauaguucagcuuu

SEQ ID NO: 1019343 - RNA, 19 nt, Homo sapiens
ugacuaacagugagccuua

SEQ ID NO: 1019344 - RNA, 19 nt, Homo sapiens
aaauugauguucaguagug

SEQ ID NO: 1019345 - RNA, 19 nt, Homo sapiens
gaucaugucucugcuacuc

SEQ ID NO: 1019346 - RNA, 19 nt, Homo sapiens
gauauuaggcaagaugauu

SEQ ID NO: 1019347 - RNA, 19 nt, Homo sapiens
gaaguugcuggguuuguuu

SEQ ID NO: 1019348 - RNA, 19 nt, Homo sapiens
ggacaaaugaaagagauga

SEQ ID NO: 1019349 - RNA, 19 nt, Homo sapiens
aaaaguaaauggagaggua

SEQ ID NO: 1019350 - RNA, 19 nt, Homo sapiens
gaaauuacagcugccaguu

SEQ ID NO: 1019351 - RNA, 19 nt, Homo sapiens
gaaguaauuuugacucaug

SEQ ID NO: 1019352 - RNA, 19 nt, Homo sapiens
guugacaucucauacuuca

SEQ ID NO: 1019353 - RNA, 19 nt, Homo sapiens
gcaacucaagguacuauga

SEQ ID NO: 1019354 - RNA, 19 nt, Homo sapiens
gaacaagaagaagcauaaa

SEQ ID NO: 1019355 - RNA, 19 nt, Homo sapiens
ugaauuauccagaacaaga

SEQ ID NO: 1019356 - RNA, 19 nt, Homo sapiens
ugaugaagaugauagaaca

SEQ ID NO: 1019357 - RNA, 19 nt, Homo sapiens
gaggcuagcaccuuaauca

SEQ ID NO: 1019358 - RNA, 19 nt, Homo sapiens
cagcugaggccaauccuuu

SEQ ID NO: 1019359 - RNA, 19 nt, Homo sapiens
gggauagguuguccuguuc

SEQ ID NO: 1019360 - RNA, 19 nt, Homo sapiens
uaguauauuuccagggaua

SEQ ID NO: 1019361 - RNA, 19 nt, Homo sapiens
gcgcaaauacucgaauaaa

SEQ ID NO: 1019362 - RNA, 19 nt, Homo sapiens
uaacugagagauuaaagga

SEQ ID NO: 1019363 - RNA, 19 nt, Homo sapiens
aagacugguuucuauagua

SEQ ID NO: 1019364 - RNA, 19 nt, Homo sapiens
ggaggacuaugugcuuaga

SEQ ID NO: 1019365 - RNA, 19 nt, Homo sapiens
caagguacuaugaggauuu

SEQ ID NO: 1019366 - RNA, 19 nt, Homo sapiens
gaauuauccagaacaagaa

SEQ ID NO: 1019367 - RNA, 19 nt, Homo sapiens
aaagaaggucuggauguua

SEQ ID NO: 1019368 - RNA, 19 nt, Homo sapiens
ugaccugccugaccaugaa

SEQ ID NO: 1019369 - RNA, 19 nt, Homo sapiens
acacacaguuccccauuua

SEQ ID NO: 1019370 - RNA, 19 nt, Homo sapiens
cugauaagcggccacuuua

SEQ ID NO: 1019371 - RNA, 19 nt, Homo sapiens
gaaaugcaaagaucaaacu

SEQ ID NO: 1019372 - RNA, 19 nt, Homo sapiens
gaaccuaaggaugugauuu

SEQ ID NO: 1019373 - RNA, 19 nt, Homo sapiens
gauaagcugcugcuccuau

SEQ ID NO: 1019374 - RNA, 19 nt, Homo sapiens
agaacaagaagaagcauaa

SEQ ID NO: 1019375 - RNA, 19 nt, Homo sapiens
uuaauuggacuuccuacua

SEQ ID NO: 1019376 - RNA, 19 nt, Homo sapiens
uaaaggaacagcagcacuu

SEQ ID NO: 1019377 - RNA, 19 nt, Homo sapiens
agacugguuucuauaguau

SEQ ID NO: 1019378 - RNA, 19 nt, Homo sapiens
agauugagcuauguuaguu

SEQ ID NO: 1019379 - RNA, 19 nt, Homo sapiens
ugacaucucauacuucaug

SEQ ID NO: 1019380 - RNA, 19 nt, Homo sapiens
gauuuuggcuaaaggauuu

SEQ ID NO: 1019381 - RNA, 19 nt, Homo sapiens
caguaaugcaugucaauaa

SEQ ID NO: 1019382 - RNA, 19 nt, Homo sapiens
gagcagaggaugauuugca

SEQ ID NO: 1019383 - RNA, 19 nt, Homo sapiens
guugguaaauugauguuca

SEQ ID NO: 1019384 - RNA, 19 nt, Homo sapiens
guguggagcccuugucuuu

SEQ ID NO: 1019385 - RNA, 19 nt, Homo sapiens
ucaaugacgacuacuagaa

SEQ ID NO: 1019386 - RNA, 19 nt, Homo sapiens
aaucauaguucagcuuuca

SEQ ID NO: 1019387 - RNA, 19 nt, Homo sapiens
aaccuaaagagccuuauua

SEQ ID NO: 1019388 - RNA, 19 nt, Homo sapiens
gcauauaucuacagaguua

SEQ ID NO: 1019389 - RNA, 19 nt, Homo sapiens
gaacagcccucuacaagaa

SEQ ID NO: 1019390 - RNA, 19 nt, Homo sapiens
aaacaaaggugaagagaaa

SEQ ID NO: 1019391 - RNA, 19 nt, Homo sapiens
gauuggaacuucuuguuua

SEQ ID NO: 1019392 - RNA, 19 nt, Homo sapiens
gcaaaucccuagcuuaguu

SEQ ID NO: 1019393 - RNA, 19 nt, Homo sapiens
gaaaggauccucaugaaga

SEQ ID NO: 1019394 - RNA, 19 nt, Homo sapiens
gcaagcagcucagaagaaa

SEQ ID NO: 1019395 - RNA, 19 nt, Homo sapiens
gaagagagccagaagagaa

SEQ ID NO: 1019396 - RNA, 19 nt, Homo sapiens
gaauagggcugaagcaucu

SEQ ID NO: 1019397 - RNA, 19 nt, Homo sapiens
ggacaaagcauauaucuac

SEQ ID NO: 1019398 - RNA, 19 nt, Homo sapiens
acaagaccauugcaauuua

SEQ ID NO: 1019399 - RNA, 19 nt, Homo sapiens
gaaguuguccucaugaauu

SEQ ID NO: 1019400 - RNA, 19 nt, Homo sapiens
gcuaauuguucuagguuua

SEQ ID NO: 1019401 - RNA, 19 nt, Homo sapiens
gcaaauaggauguuaaagu

SEQ ID NO: 1019402 - RNA, 19 nt, Homo sapiens
ccaaagauggucacuguua

SEQ ID NO: 1019403 - RNA, 19 nt, Homo sapiens
gcagagaucaugaagcuuu

SEQ ID NO: 1019404 - RNA, 19 nt, Homo sapiens
caaaugagcuaaggaaaca

SEQ ID NO: 1019405 - RNA, 19 nt, Homo sapiens
gaauuaaacuuccaaacag

SEQ ID NO: 1019406 - RNA, 19 nt, Homo sapiens
caacauagaugcauuuagc

SEQ ID NO: 1019407 - RNA, 19 nt, Homo sapiens
ucacuaaccuuuucucuua

SEQ ID NO: 1019408 - RNA, 19 nt, Homo sapiens
cagagaagauguuuaaauc

SEQ ID NO: 1019409 - RNA, 19 nt, Homo sapiens
gcaaggaaauguauaucau

SEQ ID NO: 1019410 - RNA, 19 nt, Homo sapiens
uaccuaggauuguaacuua

SEQ ID NO: 1019411 - RNA, 19 nt, Homo sapiens
cagcauagauucauacaca

SEQ ID NO: 1019412 - RNA, 19 nt, Homo sapiens
gauaucaucuaccuuuaug

SEQ ID NO: 1019413 - RNA, 19 nt, Homo sapiens
caaacagcauagauucaua

SEQ ID NO: 1019414 - RNA, 19 nt, Homo sapiens
cuacauguauagcuguuua

SEQ ID NO: 1019415 - RNA, 19 nt, Homo sapiens
gcugaagcaucugauaaua

SEQ ID NO: 1019416 - RNA, 19 nt, Homo sapiens
ggaaauguauaucaucaag

SEQ ID NO: 1019417 - RNA, 19 nt, Homo sapiens
ucaugaagcuuucugaaug

SEQ ID NO: 1019418 - RNA, 19 nt, Homo sapiens
gaagagacacccaaacugu

SEQ ID NO: 1019419 - RNA, 19 nt, Homo sapiens
uuacugggcuucaaacuau

SEQ ID NO: 1019420 - RNA, 19 nt, Homo sapiens
gagcaaauaggauguuaaa

SEQ ID NO: 1019421 - RNA, 19 nt, Homo sapiens
gaacuuuaauuaccauugg

SEQ ID NO: 1019422 - RNA, 19 nt, Homo sapiens
gaaggaaacgaguaucuga

SEQ ID NO: 1019423 - RNA, 19 nt, Homo sapiens
gaaagaagagacacccaaa

SEQ ID NO: 1019424 - RNA, 19 nt, Homo sapiens
gaugauuuaugacauguug

SEQ ID NO: 1019425 - RNA, 19 nt, Homo sapiens
gcucuuggcugugauguga

SEQ ID NO: 1019426 - RNA, 19 nt, Homo sapiens
caaagcauauaucuacaga

SEQ ID NO: 1019427 - RNA, 19 nt, Homo sapiens
gaacagugccagagcagaa

SEQ ID NO: 1019428 - RNA, 19 nt, Homo sapiens
gaugagagaugugauugga

SEQ ID NO: 1019429 - RNA, 19 nt, Homo sapiens
gagagaacaaugagaauga

SEQ ID NO: 1019430 - RNA, 19 nt, Homo sapiens
aagagugaauugcguauaa

SEQ ID NO: 1019431 - RNA, 19 nt, Homo sapiens
gauaucagauuggaacuuc

SEQ ID NO: 1019432 - RNA, 19 nt, Homo sapiens
ugaaugagaagucugauuu

SEQ ID NO: 1019433 - RNA, 19 nt, Homo sapiens
ggaauuggcacuacuagau

SEQ ID NO: 1019434 - RNA, 19 nt, Homo sapiens
gcauuuagcaaaccaugua

SEQ ID NO: 1019435 - RNA, 19 nt, Homo sapiens
ucucgucaaucacucauua

SEQ ID NO: 1019436 - RNA, 19 nt, Homo sapiens
guaaugaggcuauuuccaa

SEQ ID NO: 1019437 - RNA, 19 nt, Homo sapiens
gcuaagcaauaaauguuug

SEQ ID NO: 1019438 - RNA, 19 nt, Homo sapiens
ucgaacaacuggauacuug

SEQ ID NO: 1019439 - RNA, 19 nt, Homo sapiens
gaauuucaccucuuacaug

SEQ ID NO: 1019440 - RNA, 19 nt, Homo sapiens
gaugugauauagcuaguuc

SEQ ID NO: 1019441 - RNA, 19 nt, Homo sapiens
guacuaaaguucugguuac

SEQ ID NO: 1019442 - RNA, 19 nt, Homo sapiens
uugccuacaugaacaauua

SEQ ID NO: 1019443 - RNA, 19 nt, Homo sapiens
ucaaaccgcagacaacaua

SEQ ID NO: 1019444 - RNA, 19 nt, Homo sapiens
caacuccagucacgucuga

SEQ ID NO: 1019445 - RNA, 19 nt, Homo sapiens
gaaggaauuggcacuacua

SEQ ID NO: 1019446 - RNA, 19 nt, Homo sapiens
ucaacaaggugaagccuau

SEQ ID NO: 1019447 - RNA, 19 nt, Homo sapiens
auacacagaucgacucuau

SEQ ID NO: 1019448 - RNA, 19 nt, Homo sapiens
gccugcagcuccuguuaua

SEQ ID NO: 1019449 - RNA, 19 nt, Homo sapiens
caugaagcuuucugaauga

SEQ ID NO: 1019450 - RNA, 19 nt, Homo sapiens
gugauacacagaugauuua

SEQ ID NO: 1019451 - RNA, 19 nt, Homo sapiens
aagacaaacucuccaagaa

SEQ ID NO: 1019452 - RNA, 19 nt, Homo sapiens
caagaccauugcaauuuau

SEQ ID NO: 1019453 - RNA, 19 nt, Homo sapiens
gaguuuguaugcagaaaga

SEQ ID NO: 1019454 - RNA, 19 nt, Homo sapiens
aagggaauauggacaaauu

SEQ ID NO: 1019455 - RNA, 19 nt, Homo sapiens
gaaaagauaucagauugga

SEQ ID NO: 1019456 - RNA, 19 nt, Homo sapiens
gauacaggcuaaagugaca

SEQ ID NO: 1019457 - RNA, 19 nt, Homo sapiens
gaugaugagucacuguaau

SEQ ID NO: 1019458 - RNA, 19 nt, Homo sapiens
ccucagagaagauguuuaa

SEQ ID NO: 1019459 - RNA, 19 nt, Homo sapiens
gauuguaccuaggauugua

SEQ ID NO: 1019460 - RNA, 19 nt, Homo sapiens
gaaauuggcaaggaaaugu

SEQ ID NO: 1019461 - RNA, 19 nt, Homo sapiens
gaacaaugagaaugaacaa

SEQ ID NO: 1019462 - RNA, 19 nt, Homo sapiens
gugauaucaucuaccuuua

SEQ ID NO: 1019463 - RNA, 19 nt, Homo sapiens
cagcuccuguuauaaauga

SEQ ID NO: 1019464 - RNA, 19 nt, Homo sapiens
acuaaaggaugguugguuu

SEQ ID NO: 1019465 - RNA, 19 nt, Homo sapiens
ggacuuggacuggaggaua

SEQ ID NO: 1019466 - RNA, 19 nt, Homo sapiens
gaagaaccccacucaguua

SEQ ID NO: 1019467 - RNA, 19 nt, Homo sapiens
aaaggauccucaugaagaa

SEQ ID NO: 1019468 - RNA, 19 nt, Homo sapiens
gggagaaauuggcaaggaa

SEQ ID NO: 1019469 - RNA, 19 nt, Homo sapiens
caugaacaauuacuccauu

SEQ ID NO: 1019470 - RNA, 19 nt, Homo sapiens
gauacuugcuguuuauucu

SEQ ID NO: 1019471 - RNA, 19 nt, Homo sapiens
cuggagaucugaccacaaa

SEQ ID NO: 1019472 - RNA, 19 nt, Homo sapiens
ccauugcaauuuaugcuuu

SEQ ID NO: 1019473 - RNA, 19 nt, Homo sapiens
ugacauauccccacaauuu

SEQ ID NO: 1019474 - RNA, 19 nt, Homo sapiens
cuauuugccuggugacuuu

SEQ ID NO: 1019475 - RNA, 19 nt, Homo sapiens
cgaauuaaacuuccaaaca

SEQ ID NO: 1019476 - RNA, 19 nt, Homo sapiens
caacagaacauuacuacag

SEQ ID NO: 1019477 - RNA, 19 nt, Homo sapiens
aaguuguccucaugaauua

SEQ ID NO: 1019478 - RNA, 19 nt, Homo sapiens
gaaauucuagugcauuauc

SEQ ID NO: 1019479 - RNA, 19 nt, Homo sapiens
guucaaggguugugauaca

SEQ ID NO: 1019480 - RNA, 19 nt, Homo sapiens
ccaguuagcccucgccauu

SEQ ID NO: 1019481 - RNA, 19 nt, Homo sapiens
aagaggaggagacauaaua

SEQ ID NO: 1019482 - RNA, 19 nt, Homo sapiens
gacaaacucuccaagaaaa

SEQ ID NO: 1019483 - RNA, 19 nt, Homo sapiens
caagcuauccuguuucaga

SEQ ID NO: 1019484 - RNA, 19 nt, Homo sapiens
gcuggugucggaaguaaua

SEQ ID NO: 1019485 - RNA, 19 nt, Homo sapiens
ggaggaaaccgucgaacug

SEQ ID NO: 1019486 - RNA, 19 nt, Homo sapiens
uaacaucaaguucugugua

SEQ ID NO: 1019487 - RNA, 19 nt, Homo sapiens
ucaguuagaaggacaguuu

SEQ ID NO: 1019488 - RNA, 19 nt, Homo sapiens
acaaauggcuggaaauuga

SEQ ID NO: 1019489 - RNA, 19 nt, Homo sapiens
gaaauugaauccaguugug

SEQ ID NO: 1019490 - RNA, 19 nt, Homo sapiens
ucaaagaacucaugcaagu

SEQ ID NO: 1019491 - RNA, 19 nt, Homo sapiens
gcacguguaaugacaaaua

SEQ ID NO: 1019492 - RNA, 19 nt, Homo sapiens
ggagggaucuuccauguac

SEQ ID NO: 1019493 - RNA, 19 nt, Homo sapiens
ggacucagcauucagauau

SEQ ID NO: 1019494 - RNA, 19 nt, Homo sapiens
cuaggaaacuggucaaaga

SEQ ID NO: 1019495 - RNA, 19 nt, Homo sapiens
caagacaacagaugaauug

SEQ ID NO: 1019496 - RNA, 19 nt, Homo sapiens
ggaaauagaagacagaaag

SEQ ID NO: 1019497 - RNA, 19 nt, Homo sapiens
gaacuuacagcuuccuuga

SEQ ID NO: 1019498 - RNA, 19 nt, Homo sapiens
ccaguucacuuguauauac

SEQ ID NO: 1019499 - RNA, 19 nt, Homo sapiens
aaagggauuugguuucgua

SEQ ID NO: 1019500 - RNA, 19 nt, Homo sapiens
caacagaugaauugugaaa

SEQ ID NO: 1019501 - RNA, 19 nt, Homo sapiens
cgucaacccuuauacaaau

SEQ ID NO: 1019502 - RNA, 19 nt, Homo sapiens
acagaugaauugugaaaga

SEQ ID NO: 1019503 - RNA, 19 nt, Homo sapiens
gauuugguuucguaacuuu

SEQ ID NO: 1019504 - RNA, 19 nt, Homo sapiens
gcgcugcccugaagugguu

SEQ ID NO: 1019505 - RNA, 19 nt, Homo sapiens
gcagagagcgcacgggaau

SEQ ID NO: 1019506 - RNA, 19 nt, Homo sapiens
gcaggagaauuccgagcuu

SEQ ID NO: 1019507 - RNA, 19 nt, Homo sapiens
gcauucagauaucaaagca

SEQ ID NO: 1019508 - RNA, 19 nt, Homo sapiens
ggaaacuggucaaagaacu

SEQ ID NO: 1019509 - RNA, 19 nt, Homo sapiens
gagccaugcugaugaugug

SEQ ID NO: 1019510 - RNA, 19 nt, Homo sapiens
caggagggaucuuccaugu

SEQ ID NO: 1019511 - RNA, 19 nt, Homo sapiens
ggaccucagacaaauguuu

SEQ ID NO: 1019512 - RNA, 19 nt, Homo sapiens
ggucaaagaacucaugcaa

SEQ ID NO: 1019513 - RNA, 19 nt, Homo sapiens
gauccggaccucagacaaa

SEQ ID NO: 1019514 - RNA, 19 nt, Homo sapiens
ggacagggcgagggagaaa

SEQ ID NO: 1019515 - RNA, 19 nt, Homo sapiens
cacguguaaugacaaauaa

SEQ ID NO: 1019516 - RNA, 19 nt, Homo sapiens
agacauuuauggugguuau

SEQ ID NO: 1019517 - RNA, 19 nt, Homo sapiens
ggaaauugaauccaguugu

SEQ ID NO: 1019518 - RNA, 19 nt, Homo sapiens
cagcacguguaaugacaaa

SEQ ID NO: 1019519 - RNA, 19 nt, Homo sapiens
ggauuugguuucguaacuu

SEQ ID NO: 1019520 - RNA, 19 nt, Homo sapiens
aaaagaccgucaacccuua

SEQ ID NO: 1019521 - RNA, 19 nt, Homo sapiens
gcagacauuuauggugguu

SEQ ID NO: 1019522 - RNA, 19 nt, Homo sapiens
ugaagugguucuccaagca

SEQ ID NO: 1019523 - RNA, 19 nt, Homo sapiens
gauuuccucuuuauucucu

SEQ ID NO: 1019524 - RNA, 19 nt, Homo sapiens
cuacggcgguguuguuuac

SEQ ID NO: 1019525 - RNA, 19 nt, Homo sapiens
gggauuugguuucguaacu

SEQ ID NO: 1019526 - RNA, 19 nt, Homo sapiens
uguauauacuucugcaaug

SEQ ID NO: 1019527 - RNA, 19 nt, Homo sapiens
cuacagucccgaauucuau

SEQ ID NO: 1019528 - RNA, 19 nt, Homo sapiens
uuauacaaauggcuggaaa

SEQ ID NO: 1019529 - RNA, 19 nt, Homo sapiens
gaaauagaagacagaaagg

SEQ ID NO: 1019530 - RNA, 19 nt, Homo sapiens
ugacugaugccaagacuag

SEQ ID NO: 1019531 - RNA, 19 nt, Homo sapiens
caauaccugcguggaaaua

SEQ ID NO: 1019532 - RNA, 19 nt, Homo sapiens
ugcaauaccugcguggaaa

SEQ ID NO: 1019533 - RNA, 19 nt, Homo sapiens
gcaguaguacaucauuuua

SEQ ID NO: 1019534 - RNA, 19 nt, Homo sapiens
gacaguuacggacgaguuu

SEQ ID NO: 1019535 - RNA, 19 nt, Homo sapiens
ucaagacaacagaugaauu

SEQ ID NO: 1019536 - RNA, 19 nt, Homo sapiens
ucacuuguauauacuucug

SEQ ID NO: 1019537 - RNA, 19 nt, Homo sapiens
caaauggcuggaaauugaa

SEQ ID NO: 1019538 - RNA, 19 nt, Homo sapiens
ggcugcaugucuccaauau

SEQ ID NO: 1019539 - RNA, 19 nt, Homo sapiens
guccggagcaggagaauuc

SEQ ID NO: 1019540 - RNA, 19 nt, Homo sapiens
gaugugggucucguucuuu

SEQ ID NO: 1019541 - RNA, 19 nt, Homo sapiens
guauauacuucugcaaugc

SEQ ID NO: 1019542 - RNA, 19 nt, Homo sapiens
gcuccauacuaaaugacaa

SEQ ID NO: 1019543 - RNA, 19 nt, Homo sapiens
ugaugugggucucguucuu

SEQ ID NO: 1019544 - RNA, 19 nt, Homo sapiens
gagagcagcuaagggguaa

SEQ ID NO: 1019545 - RNA, 19 nt, Homo sapiens
aauagaagacagaaagguu

SEQ ID NO: 1019546 - RNA, 19 nt, Homo sapiens
agucuacagucccgaauuc

SEQ ID NO: 1019547 - RNA, 19 nt, Homo sapiens
ggcucuccuuuguuuauuu

SEQ ID NO: 1019548 - RNA, 19 nt, Homo sapiens
aaaucgagguaaauaaugc

SEQ ID NO: 1019549 - RNA, 19 nt, Homo sapiens
gcuaagggguaaucaggaa

SEQ ID NO: 1019550 - RNA, 19 nt, Homo sapiens
acuuacagcuuccuugauc

SEQ ID NO: 1019551 - RNA, 19 nt, Homo sapiens
auagaagacagaaagguuu

SEQ ID NO: 1019552 - RNA, 19 nt, Homo sapiens
gcaauaccugcguggaaau

SEQ ID NO: 1019553 - RNA, 19 nt, Homo sapiens
auacaaauggcuggaaauu

SEQ ID NO: 1019554 - RNA, 19 nt, Homo sapiens
gaaacuggucaaagaacuc

SEQ ID NO: 1019555 - RNA, 19 nt, Homo sapiens
cagaugaauugugaaagag

SEQ ID NO: 1019556 - RNA, 19 nt, Homo sapiens
ggagccaugcugaugaugu

SEQ ID NO: 1019557 - RNA, 19 nt, Homo sapiens
uaggagccaugcugaugau

SEQ ID NO: 1019558 - RNA, 19 nt, Homo sapiens
ggacagugcgugagaaacc

SEQ ID NO: 1019559 - RNA, 19 nt, Homo sapiens
cacagcacguguaaugaca

SEQ ID NO: 1019560 - RNA, 19 nt, Homo sapiens
guucacuuguauauacuuc

SEQ ID NO: 1019561 - RNA, 19 nt, Homo sapiens
gcggacagugcgugagaaa

SEQ ID NO: 1019562 - RNA, 19 nt, Homo sapiens
cugcaugucuccaauaucc

SEQ ID NO: 1019563 - RNA, 19 nt, Homo sapiens
cauugcaggcuaguauaua

SEQ ID NO: 1019564 - RNA, 19 nt, Homo sapiens
uaggaaacuggucaaagaa

SEQ ID NO: 1019565 - RNA, 19 nt, Homo sapiens
ugacaguuacggacgaguu

SEQ ID NO: 1019566 - RNA, 19 nt, Homo sapiens
acagggcgagggagaaauu

SEQ ID NO: 1019567 - RNA, 19 nt, Homo sapiens
agacacaaccuucugaaaa

SEQ ID NO: 1019568 - RNA, 19 nt, Homo sapiens
gcucuccuuuguuuauuuu

SEQ ID NO: 1019569 - RNA, 19 nt, Homo sapiens
cuaggagccaugcugauga

SEQ ID NO: 1019570 - RNA, 19 nt, Homo sapiens
cggcguuggugccaugaau

SEQ ID NO: 1019571 - RNA, 19 nt, Homo sapiens
gcacacauuaaaccuguac

SEQ ID NO: 1019572 - RNA, 19 nt, Homo sapiens
caaagaacucaugcaagug

SEQ ID NO: 1019573 - RNA, 19 nt, Homo sapiens
ugaaagagagcagcuaagg

SEQ ID NO: 1019574 - RNA, 19 nt, Homo sapiens
auaccugcguggaaauaga

SEQ ID NO: 1019575 - RNA, 19 nt, Homo sapiens
uacaugcaguaguacauca

SEQ ID NO: 1019576 - RNA, 19 nt, Homo sapiens
cugccuacagugacaguua

SEQ ID NO: 1019577 - RNA, 19 nt, Homo sapiens
ugccacagcacguguaaug

SEQ ID NO: 1019578 - RNA, 19 nt, Homo sapiens
gacacaaccuucugaaaac

SEQ ID NO: 1019579 - RNA, 19 nt, Homo sapiens
gcaccgccacacagacaga

SEQ ID NO: 1019580 - RNA, 19 nt, Homo sapiens
ugugaaagagagcagcuaa

SEQ ID NO: 1019581 - RNA, 19 nt, Homo sapiens
ucucguucuuucuucauug

SEQ ID NO: 1019582 - RNA, 19 nt, Homo sapiens
ugaaugcuuuugcaccuuu

SEQ ID NO: 1019583 - RNA, 19 nt, Homo sapiens
ggccuacggcgguguuguu

SEQ ID NO: 1019584 - RNA, 19 nt, Homo sapiens
ggucgcaccguguacaaca

SEQ ID NO: 1019585 - RNA, 19 nt, Homo sapiens
gucaacccuuauacaaaug

SEQ ID NO: 1019586 - RNA, 19 nt, Homo sapiens
gaccgucaacccuuauaca

SEQ ID NO: 1019587 - RNA, 19 nt, Homo sapiens
augcaguaguacaucauuu

SEQ ID NO: 1019588 - RNA, 19 nt, Homo sapiens
gaaguugggucuauagauu

SEQ ID NO: 1019589 - RNA, 19 nt, Homo sapiens
acaaauggcuggaaauuga

SEQ ID NO: 1019590 - RNA, 19 nt, Homo sapiens
ggaagaaguugggucuaua

SEQ ID NO: 1019591 - RNA, 19 nt, Homo sapiens
gaaauugaauccaguugug

SEQ ID NO: 1019592 - RNA, 19 nt, Homo sapiens
ggauuuggcucccagcuuu

SEQ ID NO: 1019593 - RNA, 19 nt, Homo sapiens
ggaauaauaacucuacgua

SEQ ID NO: 1019594 - RNA, 19 nt, Homo sapiens
gcaguggaguuguuaaguu

SEQ ID NO: 1019595 - RNA, 19 nt, Homo sapiens
gcacguguaaugacaaaua

SEQ ID NO: 1019596 - RNA, 19 nt, Homo sapiens
ggagggaucuuccauguac

SEQ ID NO: 1019597 - RNA, 19 nt, Homo sapiens
ugauaucacugcugacuuu

SEQ ID NO: 1019598 - RNA, 19 nt, Homo sapiens
gacagaugcuagauaauga

SEQ ID NO: 1019599 - RNA, 19 nt, Homo sapiens
guacuucuguuugaacuuu

SEQ ID NO: 1019600 - RNA, 19 nt, Homo sapiens
uauccagagugcuauauua

SEQ ID NO: 1019601 - RNA, 19 nt, Homo sapiens
ccagagugcuauauuaugu

SEQ ID NO: 1019602 - RNA, 19 nt, Homo sapiens
agagacagacguauaauuu

SEQ ID NO: 1019603 - RNA, 19 nt, Homo sapiens
ccaguucacuuguauauac

SEQ ID NO: 1019604 - RNA, 19 nt, Homo sapiens
aaagggauuugguuucgua

SEQ ID NO: 1019605 - RNA, 19 nt, Homo sapiens
ccaaaggucauguuguuaa

SEQ ID NO: 1019606 - RNA, 19 nt, Homo sapiens
cgucaacccuuauacaaau

SEQ ID NO: 1019607 - RNA, 19 nt, Homo sapiens
uguaacaacucugcuuuaa

SEQ ID NO: 1019608 - RNA, 19 nt, Homo sapiens
caccaacaaucauuuauca

SEQ ID NO: 1019609 - RNA, 19 nt, Homo sapiens
gugcuuggcuccugacaga

SEQ ID NO: 1019610 - RNA, 19 nt, Homo sapiens
gauuugguuucguaacuuu

SEQ ID NO: 1019611 - RNA, 19 nt, Homo sapiens
gaaacagucuaugaagcuu

SEQ ID NO: 1019612 - RNA, 19 nt, Homo sapiens
gugcaaacccacccuuuaa

SEQ ID NO: 1019613 - RNA, 19 nt, Homo sapiens
cuuaaccagucgcuauuua

SEQ ID NO: 1019614 - RNA, 19 nt, Homo sapiens
ggaagaguguaagugacua

SEQ ID NO: 1019615 - RNA, 19 nt, Homo sapiens
guauucagcuucuuaacca

SEQ ID NO: 1019616 - RNA, 19 nt, Homo sapiens
guuagagacagacguauaa

SEQ ID NO: 1019617 - RNA, 19 nt, Homo sapiens
gaaugaagcugugcaaacc

SEQ ID NO: 1019618 - RNA, 19 nt, Homo sapiens
gaguucuccugcauccuua

SEQ ID NO: 1019619 - RNA, 19 nt, Homo sapiens
gaguagagauaaucauggu

SEQ ID NO: 1019620 - RNA, 19 nt, Homo sapiens
aacagucuaugaagcuuua

SEQ ID NO: 1019621 - RNA, 19 nt, Homo sapiens
gagccaugcugaugaugug

SEQ ID NO: 1019622 - RNA, 19 nt, Homo sapiens
caggagggaucuuccaugu

SEQ ID NO: 1019623 - RNA, 19 nt, Homo sapiens
ggaccucagacaaauguuu

SEQ ID NO: 1019624 - RNA, 19 nt, Homo sapiens
gaagaaguugggucuauag

SEQ ID NO: 1019625 - RNA, 19 nt, Homo sapiens
cguaagaucaguuggauau

SEQ ID NO: 1019626 - RNA, 19 nt, Homo sapiens
guagagauaaucaugguau

SEQ ID NO: 1019627 - RNA, 19 nt, Homo sapiens
gguucuaaguuacucauug

SEQ ID NO: 1019628 - RNA, 19 nt, Homo sapiens
uuugguagcuucaacuuug

SEQ ID NO: 1019629 - RNA, 19 nt, Homo sapiens
guaacaacucugcuuuaaa

SEQ ID NO: 1019630 - RNA, 19 nt, Homo sapiens
ccaauccgcuguaacaacu

SEQ ID NO: 1019631 - RNA, 19 nt, Homo sapiens
guacauccacccucuuaau

SEQ ID NO: 1019632 - RNA, 19 nt, Homo sapiens
gcaguauucagcuucuuaa

SEQ ID NO: 1019633 - RNA, 19 nt, Homo sapiens
caaaggucauguuguuaag

SEQ ID NO: 1019634 - RNA, 19 nt, Homo sapiens
gauccggaccucagacaaa

SEQ ID NO: 1019635 - RNA, 19 nt, Homo sapiens
ggacagggcgagggagaaa

SEQ ID NO: 1019636 - RNA, 19 nt, Homo sapiens
gcucccagcuuuguaguuc

SEQ ID NO: 1019637 - RNA, 19 nt, Homo sapiens
ugugaacaaucugcaauuu

SEQ ID NO: 1019638 - RNA, 19 nt, Homo sapiens
gcaccugcauuauuuuauu

SEQ ID NO: 1019639 - RNA, 19 nt, Homo sapiens
cacguguaaugacaaauaa

SEQ ID NO: 1019640 - RNA, 19 nt, Homo sapiens
cggaagaaguugggucuau

SEQ ID NO: 1019641 - RNA, 19 nt, Homo sapiens
agccaaaggucauguuguu

SEQ ID NO: 1019642 - RNA, 19 nt, Homo sapiens
ggccauauccagagugcua

SEQ ID NO: 1019643 - RNA, 19 nt, Homo sapiens
gagccuguguauggcaaua

SEQ ID NO: 1019644 - RNA, 19 nt, Homo sapiens
ggaaauugaauccaguugu

SEQ ID NO: 1019645 - RNA, 19 nt, Homo sapiens
cagcacguguaaugacaaa

SEQ ID NO: 1019646 - RNA, 19 nt, Homo sapiens
ggauuugguuucguaacuu

SEQ ID NO: 1019647 - RNA, 19 nt, Homo sapiens
ccauugauguguugagcuu

SEQ ID NO: 1019648 - RNA, 19 nt, Homo sapiens
ugucuguacuucuguuuga

SEQ ID NO: 1019649 - RNA, 19 nt, Homo sapiens
guuaaguccucauguguac

SEQ ID NO: 1019650 - RNA, 19 nt, Homo sapiens
gguuaaguccucaugugua

SEQ ID NO: 1019651 - RNA, 19 nt, Homo sapiens
ggcaguauucagcuucuua

SEQ ID NO: 1019652 - RNA, 19 nt, Homo sapiens
gcggaguaguguaucaaga

SEQ ID NO: 1019653 - RNA, 19 nt, Homo sapiens
aaaagaccgucaacccuua

SEQ ID NO: 1019654 - RNA, 19 nt, Homo sapiens
caacucugcuuuaaaacaa

SEQ ID NO: 1019655 - RNA, 19 nt, Homo sapiens
caguggaguuguuaaguuc

SEQ ID NO: 1019656 - RNA, 19 nt, Homo sapiens
gcaccaacaaucauuuauc

SEQ ID NO: 1019657 - RNA, 19 nt, Homo sapiens
guugcuggcuguaggaguu

SEQ ID NO: 1019658 - RNA, 19 nt, Homo sapiens
uguuugaacuuuccacguu

SEQ ID NO: 1019659 - RNA, 19 nt, Homo sapiens
agacagaugcuagauaaug

SEQ ID NO: 1019660 - RNA, 19 nt, Homo sapiens
gggauuugguuucguaacu

SEQ ID NO: 1019661 - RNA, 19 nt, Homo sapiens
gcuggcgucucaaggaguu

SEQ ID NO: 1019662 - RNA, 19 nt, Homo sapiens
aaugaucucuuuaguucug

SEQ ID NO: 1019663 - RNA, 19 nt, Homo sapiens
guggaguuguuaaguucua

SEQ ID NO: 1019664 - RNA, 19 nt, Homo sapiens
gcaaacccacccuuuaaac

SEQ ID NO: 1019665 - RNA, 19 nt, Homo sapiens
gugcaucugaguugaauga

SEQ ID NO: 1019666 - RNA, 19 nt, Homo sapiens
uguauauacuucugcaaug

SEQ ID NO: 1019667 - RNA, 19 nt, Homo sapiens
cuacagucccgaauucuau

SEQ ID NO: 1019668 - RNA, 19 nt, Homo sapiens
guuaaguucuagaaacagu

SEQ ID NO: 1019669 - RNA, 19 nt, Homo sapiens
uuauacaaauggcuggaaa

SEQ ID NO: 1019670 - RNA, 19 nt, Homo sapiens
gcuguaacaacucugcuuu

SEQ ID NO: 1019671 - RNA, 19 nt, Homo sapiens
uagguuaaguccucaugug

SEQ ID NO: 1019672 - RNA, 19 nt, Homo sapiens
uaucagcuguuugggaaga

SEQ ID NO: 1019673 - RNA, 19 nt, Homo sapiens
ugacugaugccaagacuag

SEQ ID NO: 1019674 - RNA, 19 nt, Homo sapiens
aaagcaugcuggcgucuca

SEQ ID NO: 1019675 - RNA, 19 nt, Homo sapiens
ucacgggucuuccuguuuu

SEQ ID NO: 1019676 - RNA, 19 nt, Homo sapiens
guuguuaaguucuagaaac

SEQ ID NO: 1019677 - RNA, 19 nt, Homo sapiens
gcaucugaguugaaugaag

SEQ ID NO: 1019678 - RNA, 19 nt, Homo sapiens
gcaguaguacaucauuuua

SEQ ID NO: 1019679 - RNA, 19 nt, Homo sapiens
gacaguuacggacgaguuu

SEQ ID NO: 1019680 - RNA, 19 nt, Homo sapiens
uuaccuuccuggacugauu

SEQ ID NO: 1019681 - RNA, 19 nt, Homo sapiens
uucaucagcuugguacuuu

SEQ ID NO: 1019682 - RNA, 19 nt, Homo sapiens
gccaaaggucauguuguua

SEQ ID NO: 1019683 - RNA, 19 nt, Homo sapiens
ggguuuggcugaaagaaaa

SEQ ID NO: 1019684 - RNA, 19 nt, Homo sapiens
gaacugggguuuggcugaa

SEQ ID NO: 1019685 - RNA, 19 nt, Homo sapiens
ucaguuggauauuaaacca

SEQ ID NO: 1019686 - RNA, 19 nt, Homo sapiens
cuaugugcaugccguaaga

SEQ ID NO: 1019687 - RNA, 19 nt, Homo sapiens
ggaugcagggccagaguga

SEQ ID NO: 1019688 - RNA, 19 nt, Homo sapiens
gaaguugggucuauagauu

SEQ ID NO: 1019689 - RNA, 19 nt, Homo sapiens
acaaauggcuggaaauuga

SEQ ID NO: 1019690 - RNA, 19 nt, Homo sapiens
ggaagaaguugggucuaua

SEQ ID NO: 1019691 - RNA, 19 nt, Homo sapiens
gaaauugaauccaguugug

SEQ ID NO: 1019692 - RNA, 19 nt, Homo sapiens
ggauuuggcucccagcuuu

SEQ ID NO: 1019693 - RNA, 19 nt, Homo sapiens
ggaauaauaacucuacgua

SEQ ID NO: 1019694 - RNA, 19 nt, Homo sapiens
gcaguggaguuguuaaguu

SEQ ID NO: 1019695 - RNA, 19 nt, Homo sapiens
gcacguguaaugacaaaua

SEQ ID NO: 1019696 - RNA, 19 nt, Homo sapiens
ggagggaucuuccauguac

SEQ ID NO: 1019697 - RNA, 19 nt, Homo sapiens
ugauaucacugcugacuuu

SEQ ID NO: 1019698 - RNA, 19 nt, Homo sapiens
gacagaugcuagauaauga

SEQ ID NO: 1019699 - RNA, 19 nt, Homo sapiens
guacuucuguuugaacuuu

SEQ ID NO: 1019700 - RNA, 19 nt, Homo sapiens
uauccagagugcuauauua

SEQ ID NO: 1019701 - RNA, 19 nt, Homo sapiens
ccagagugcuauauuaugu

SEQ ID NO: 1019702 - RNA, 19 nt, Homo sapiens
agagacagacguauaauuu

SEQ ID NO: 1019703 - RNA, 19 nt, Homo sapiens
ccaguucacuuguauauac

SEQ ID NO: 1019704 - RNA, 19 nt, Homo sapiens
aaagggauuugguuucgua

SEQ ID NO: 1019705 - RNA, 19 nt, Homo sapiens
ccaaaggucauguuguuaa

SEQ ID NO: 1019706 - RNA, 19 nt, Homo sapiens
cgucaacccuuauacaaau

SEQ ID NO: 1019707 - RNA, 19 nt, Homo sapiens
uguaacaacucugcuuuaa

SEQ ID NO: 1019708 - RNA, 19 nt, Homo sapiens
caccaacaaucauuuauca

SEQ ID NO: 1019709 - RNA, 19 nt, Homo sapiens
gugcuuggcuccugacaga

SEQ ID NO: 1019710 - RNA, 19 nt, Homo sapiens
gauuugguuucguaacuuu

SEQ ID NO: 1019711 - RNA, 19 nt, Homo sapiens
gaaacagucuaugaagcuu

SEQ ID NO: 1019712 - RNA, 19 nt, Homo sapiens
gugcaaacccacccuuuaa

SEQ ID NO: 1019713 - RNA, 19 nt, Homo sapiens
cuuaaccagucgcuauuua

SEQ ID NO: 1019714 - RNA, 19 nt, Homo sapiens
ggaagaguguaagugacua

SEQ ID NO: 1019715 - RNA, 19 nt, Homo sapiens
guauucagcuucuuaacca

SEQ ID NO: 1019716 - RNA, 19 nt, Homo sapiens
guuagagacagacguauaa

SEQ ID NO: 1019717 - RNA, 19 nt, Homo sapiens
gaaugaagcugugcaaacc

SEQ ID NO: 1019718 - RNA, 19 nt, Homo sapiens
gaguucuccugcauccuua

SEQ ID NO: 1019719 - RNA, 19 nt, Homo sapiens
gaguagagauaaucauggu

SEQ ID NO: 1019720 - RNA, 19 nt, Homo sapiens
aacagucuaugaagcuuua

SEQ ID NO: 1019721 - RNA, 19 nt, Homo sapiens
caggagggaucuuccaugu

SEQ ID NO: 1019722 - RNA, 19 nt, Homo sapiens
ggaccucagacaaauguuu

SEQ ID NO: 1019723 - RNA, 19 nt, Homo sapiens
gaagaaguugggucuauag

SEQ ID NO: 1019724 - RNA, 19 nt, Homo sapiens
cguaagaucaguuggauau

SEQ ID NO: 1019725 - RNA, 19 nt, Homo sapiens
guagagauaaucaugguau

SEQ ID NO: 1019726 - RNA, 19 nt, Homo sapiens
gguucuaaguuacucauug

SEQ ID NO: 1019727 - RNA, 19 nt, Homo sapiens
uuugguagcuucaacuuug

SEQ ID NO: 1019728 - RNA, 19 nt, Homo sapiens
guaacaacucugcuuuaaa

SEQ ID NO: 1019729 - RNA, 19 nt, Homo sapiens
ccaauccgcuguaacaacu

SEQ ID NO: 1019730 - RNA, 19 nt, Homo sapiens
guacauccacccucuuaau

SEQ ID NO: 1019731 - RNA, 19 nt, Homo sapiens
gcaguauucagcuucuuaa

SEQ ID NO: 1019732 - RNA, 19 nt, Homo sapiens
caaaggucauguuguuaag

SEQ ID NO: 1019733 - RNA, 19 nt, Homo sapiens
gauccggaccucagacaaa

SEQ ID NO: 1019734 - RNA, 19 nt, Homo sapiens
ggacagggcgagggagaaa

SEQ ID NO: 1019735 - RNA, 19 nt, Homo sapiens
gcucccagcuuuguaguuc

SEQ ID NO: 1019736 - RNA, 19 nt, Homo sapiens
ugugaacaaucugcaauuu

SEQ ID NO: 1019737 - RNA, 19 nt, Homo sapiens
gcaccugcauuauuuuauu

SEQ ID NO: 1019738 - RNA, 19 nt, Homo sapiens
cacguguaaugacaaauaa

SEQ ID NO: 1019739 - RNA, 19 nt, Homo sapiens
cggaagaaguugggucuau

SEQ ID NO: 1019740 - RNA, 19 nt, Homo sapiens
agccaaaggucauguuguu

SEQ ID NO: 1019741 - RNA, 19 nt, Homo sapiens
ggccauauccagagugcua

SEQ ID NO: 1019742 - RNA, 19 nt, Homo sapiens
gagccuguguauggcaaua

SEQ ID NO: 1019743 - RNA, 19 nt, Homo sapiens
ggaaauugaauccaguugu

SEQ ID NO: 1019744 - RNA, 19 nt, Homo sapiens
cagcacguguaaugacaaa

SEQ ID NO: 1019745 - RNA, 19 nt, Homo sapiens
ggauuugguuucguaacuu

SEQ ID NO: 1019746 - RNA, 19 nt, Homo sapiens
ccauugauguguugagcuu

SEQ ID NO: 1019747 - RNA, 19 nt, Homo sapiens
ugucuguacuucuguuuga

SEQ ID NO: 1019748 - RNA, 19 nt, Homo sapiens
guuaaguccucauguguac

SEQ ID NO: 1019749 - RNA, 19 nt, Homo sapiens
gguuaaguccucaugugua

SEQ ID NO: 1019750 - RNA, 19 nt, Homo sapiens
ggcaguauucagcuucuua

SEQ ID NO: 1019751 - RNA, 19 nt, Homo sapiens
gcggaguaguguaucaaga

SEQ ID NO: 1019752 - RNA, 19 nt, Homo sapiens
aaaagaccgucaacccuua

SEQ ID NO: 1019753 - RNA, 19 nt, Homo sapiens
caacucugcuuuaaaacaa

SEQ ID NO: 1019754 - RNA, 19 nt, Homo sapiens
caguggaguuguuaaguuc

SEQ ID NO: 1019755 - RNA, 19 nt, Homo sapiens
gcaccaacaaucauuuauc

SEQ ID NO: 1019756 - RNA, 19 nt, Homo sapiens
guugcuggcuguaggaguu

SEQ ID NO: 1019757 - RNA, 19 nt, Homo sapiens
uguuugaacuuuccacguu

SEQ ID NO: 1019758 - RNA, 19 nt, Homo sapiens
agacagaugcuagauaaug

SEQ ID NO: 1019759 - RNA, 19 nt, Homo sapiens
gggauuugguuucguaacu

SEQ ID NO: 1019760 - RNA, 19 nt, Homo sapiens
gcuggcgucucaaggaguu

SEQ ID NO: 1019761 - RNA, 19 nt, Homo sapiens
aaugaucucuuuaguucug

SEQ ID NO: 1019762 - RNA, 19 nt, Homo sapiens
guggaguuguuaaguucua

SEQ ID NO: 1019763 - RNA, 19 nt, Homo sapiens
gcaaacccacccuuuaaac

SEQ ID NO: 1019764 - RNA, 19 nt, Homo sapiens
gugcaucugaguugaauga

SEQ ID NO: 1019765 - RNA, 19 nt, Homo sapiens
uguauauacuucugcaaug

SEQ ID NO: 1019766 - RNA, 19 nt, Homo sapiens
cuacagucccgaauucuau

SEQ ID NO: 1019767 - RNA, 19 nt, Homo sapiens
guuaaguucuagaaacagu

SEQ ID NO: 1019768 - RNA, 19 nt, Homo sapiens
ugccauggcuaguauauac

SEQ ID NO: 1019769 - RNA, 19 nt, Homo sapiens
uuauacaaauggcuggaaa

SEQ ID NO: 1019770 - RNA, 19 nt, Homo sapiens
gcuguaacaacucugcuuu

SEQ ID NO: 1019771 - RNA, 19 nt, Homo sapiens
uagguuaaguccucaugug

SEQ ID NO: 1019772 - RNA, 19 nt, Homo sapiens
uaucagcuguuugggaaga

SEQ ID NO: 1019773 - RNA, 19 nt, Homo sapiens
aaagcaugcuggcgucuca

SEQ ID NO: 1019774 - RNA, 19 nt, Homo sapiens
ucacgggucuuccuguuuu

SEQ ID NO: 1019775 - RNA, 19 nt, Homo sapiens
guuguuaaguucuagaaac

SEQ ID NO: 1019776 - RNA, 19 nt, Homo sapiens
gcaucugaguugaaugaag

SEQ ID NO: 1019777 - RNA, 19 nt, Homo sapiens
gcaguaguacaucauuuua

SEQ ID NO: 1019778 - RNA, 19 nt, Homo sapiens
gacaguuacggacgaguuu

SEQ ID NO: 1019779 - RNA, 19 nt, Homo sapiens
uuaccuuccuggacugauu

SEQ ID NO: 1019780 - RNA, 19 nt, Homo sapiens
uucaucagcuugguacuuu

SEQ ID NO: 1019781 - RNA, 19 nt, Homo sapiens
gccaaaggucauguuguua

SEQ ID NO: 1019782 - RNA, 19 nt, Homo sapiens
ggguuuggcugaaagaaaa

SEQ ID NO: 1019783 - RNA, 19 nt, Homo sapiens
gaacugggguuuggcugaa

SEQ ID NO: 1019784 - RNA, 19 nt, Homo sapiens
ucaguuggauauuaaacca

SEQ ID NO: 1019785 - RNA, 19 nt, Homo sapiens
cuaugugcaugccguaaga

SEQ ID NO: 1019786 - RNA, 19 nt, Homo sapiens
ggaugcagggccagaguga

SEQ ID NO: 1019787 - RNA, 19 nt, Homo sapiens
gccuguguauggcaauaaa

SEQ ID NO: 1019788 - RNA, 19 nt, Homo sapiens
gaaguugggucuauagauu

SEQ ID NO: 1019789 - RNA, 19 nt, Homo sapiens
acaaauggcuggaaauuga

SEQ ID NO: 1019790 - RNA, 19 nt, Homo sapiens
ggaagaaguugggucuaua

SEQ ID NO: 1019791 - RNA, 19 nt, Homo sapiens
gaaauugaauccaguugug

SEQ ID NO: 1019792 - RNA, 19 nt, Homo sapiens
ggauuuggcucccagcuuu

SEQ ID NO: 1019793 - RNA, 19 nt, Homo sapiens
ggaauaauaacucuacgua

SEQ ID NO: 1019794 - RNA, 19 nt, Homo sapiens
gcaguggaguuguuaaguu

SEQ ID NO: 1019795 - RNA, 19 nt, Homo sapiens
gcacguguaaugacaaaua

SEQ ID NO: 1019796 - RNA, 19 nt, Homo sapiens
ggagggaucuuccauguac

SEQ ID NO: 1019797 - RNA, 19 nt, Homo sapiens
ugauaucacugcugacuuu

SEQ ID NO: 1019798 - RNA, 19 nt, Homo sapiens
gacagaugcuagauaauga

SEQ ID NO: 1019799 - RNA, 19 nt, Homo sapiens
guacuucuguuugaacuuu

SEQ ID NO: 1019800 - RNA, 19 nt, Homo sapiens
uauccagagugcuauauua

SEQ ID NO: 1019801 - RNA, 19 nt, Homo sapiens
ccagagugcuauauuaugu

SEQ ID NO: 1019802 - RNA, 19 nt, Homo sapiens
gcagaugaaauuucuugua

SEQ ID NO: 1019803 - RNA, 19 nt, Homo sapiens
agagacagacguauaauuu

SEQ ID NO: 1019804 - RNA, 19 nt, Homo sapiens
ccaguucacuuguauauac

SEQ ID NO: 1019805 - RNA, 19 nt, Homo sapiens
aaagggauuugguuucgua

SEQ ID NO: 1019806 - RNA, 19 nt, Homo sapiens
ccaaaggucauguuguuaa

SEQ ID NO: 1019807 - RNA, 19 nt, Homo sapiens
cgucaacccuuauacaaau

SEQ ID NO: 1019808 - RNA, 19 nt, Homo sapiens
uguaacaacucugcuuuaa

SEQ ID NO: 1019809 - RNA, 19 nt, Homo sapiens
caccaacaaucauuuauca

SEQ ID NO: 1019810 - RNA, 19 nt, Homo sapiens
gaaaucaguucgucuucgu

SEQ ID NO: 1019811 - RNA, 19 nt, Homo sapiens
gugcuuggcuccugacaga

SEQ ID NO: 1019812 - RNA, 19 nt, Homo sapiens
gauuugguuucguaacuuu

SEQ ID NO: 1019813 - RNA, 19 nt, Homo sapiens
gaaacagucuaugaagcuu

SEQ ID NO: 1019814 - RNA, 19 nt, Homo sapiens
gugcaaacccacccuuuaa

SEQ ID NO: 1019815 - RNA, 19 nt, Homo sapiens
cuuaaccagucgcuauuua

SEQ ID NO: 1019816 - RNA, 19 nt, Homo sapiens
ggaagaguguaagugacua

SEQ ID NO: 1019817 - RNA, 19 nt, Homo sapiens
guauucagcuucuuaacca

SEQ ID NO: 1019818 - RNA, 19 nt, Homo sapiens
guuagagacagacguauaa

SEQ ID NO: 1019819 - RNA, 19 nt, Homo sapiens
gaaugaagcugugcaaacc

SEQ ID NO: 1019820 - RNA, 19 nt, Homo sapiens
gaguucuccugcauccuua

SEQ ID NO: 1019821 - RNA, 19 nt, Homo sapiens
gaguagagauaaucauggu

SEQ ID NO: 1019822 - RNA, 19 nt, Homo sapiens
aacagucuaugaagcuuua

SEQ ID NO: 1019823 - RNA, 19 nt, Homo sapiens
gagccaugcugaugaugug

SEQ ID NO: 1019824 - RNA, 19 nt, Homo sapiens
caggagggaucuuccaugu

SEQ ID NO: 1019825 - RNA, 19 nt, Homo sapiens
ggaccucagacaaauguuu

SEQ ID NO: 1019826 - RNA, 19 nt, Homo sapiens
gaagaaguugggucuauag

SEQ ID NO: 1019827 - RNA, 19 nt, Homo sapiens
cguaagaucaguuggauau

SEQ ID NO: 1019828 - RNA, 19 nt, Homo sapiens
guagagauaaucaugguau

SEQ ID NO: 1019829 - RNA, 19 nt, Homo sapiens
gguucuaaguuacucauug

SEQ ID NO: 1019830 - RNA, 19 nt, Homo sapiens
uuugguagcuucaacuuug

SEQ ID NO: 1019831 - RNA, 19 nt, Homo sapiens
guaacaacucugcuuuaaa

SEQ ID NO: 1019832 - RNA, 19 nt, Homo sapiens
ccaauccgcuguaacaacu

SEQ ID NO: 1019833 - RNA, 19 nt, Homo sapiens
guacauccacccucuuaau

SEQ ID NO: 1019834 - RNA, 19 nt, Homo sapiens
gcaguauucagcuucuuaa

SEQ ID NO: 1019835 - RNA, 19 nt, Homo sapiens
caaaggucauguuguuaag

SEQ ID NO: 1019836 - RNA, 19 nt, Homo sapiens
gauccggaccucagacaaa

SEQ ID NO: 1019837 - RNA, 19 nt, Homo sapiens
ggacagggcgagggagaaa

SEQ ID NO: 1019838 - RNA, 19 nt, Homo sapiens
gcucccagcuuuguaguuc

SEQ ID NO: 1019839 - RNA, 19 nt, Homo sapiens
ugugaacaaucugcaauuu

SEQ ID NO: 1019840 - RNA, 19 nt, Homo sapiens
gcaccugcauuauuuuauu

SEQ ID NO: 1019841 - RNA, 19 nt, Homo sapiens
cacguguaaugacaaauaa

SEQ ID NO: 1019842 - RNA, 19 nt, Homo sapiens
cggaagaaguugggucuau

SEQ ID NO: 1019843 - RNA, 19 nt, Homo sapiens
agccaaaggucauguuguu

SEQ ID NO: 1019844 - RNA, 19 nt, Homo sapiens
ggccauauccagagugcua

SEQ ID NO: 1019845 - RNA, 19 nt, Homo sapiens
gagccuguguauggcaaua

SEQ ID NO: 1019846 - RNA, 19 nt, Homo sapiens
ggaaauugaauccaguugu

SEQ ID NO: 1019847 - RNA, 19 nt, Homo sapiens
cagcacguguaaugacaaa

SEQ ID NO: 1019848 - RNA, 19 nt, Homo sapiens
ggauuugguuucguaacuu

SEQ ID NO: 1019849 - RNA, 19 nt, Homo sapiens
ccauugauguguugagcuu

SEQ ID NO: 1019850 - RNA, 19 nt, Homo sapiens
ugucuguacuucuguuuga

SEQ ID NO: 1019851 - RNA, 19 nt, Homo sapiens
guuaaguccucauguguac

SEQ ID NO: 1019852 - RNA, 19 nt, Homo sapiens
gguuaaguccucaugugua

SEQ ID NO: 1019853 - RNA, 19 nt, Homo sapiens
ggcaguauucagcuucuua

SEQ ID NO: 1019854 - RNA, 19 nt, Homo sapiens
gcggaguaguguaucaaga

SEQ ID NO: 1019855 - RNA, 19 nt, Homo sapiens
aaaagaccgucaacccuua

SEQ ID NO: 1019856 - RNA, 19 nt, Homo sapiens
caacucugcuuuaaaacaa

SEQ ID NO: 1019857 - RNA, 19 nt, Homo sapiens
caguggaguuguuaaguuc

SEQ ID NO: 1019858 - RNA, 19 nt, Homo sapiens
gcaccaacaaucauuuauc

SEQ ID NO: 1019859 - RNA, 19 nt, Homo sapiens
guugcuggcuguaggaguu

SEQ ID NO: 1019860 - RNA, 19 nt, Homo sapiens
uguuugaacuuuccacguu

SEQ ID NO: 1019861 - RNA, 19 nt, Homo sapiens
agacagaugcuagauaaug

SEQ ID NO: 1019862 - RNA, 19 nt, Homo sapiens
gggauuugguuucguaacu

SEQ ID NO: 1019863 - RNA, 19 nt, Homo sapiens
gcuggcgucucaaggaguu

SEQ ID NO: 1019864 - RNA, 19 nt, Homo sapiens
aaugaucucuuuaguucug

SEQ ID NO: 1019865 - RNA, 19 nt, Homo sapiens
guggaguuguuaaguucua

SEQ ID NO: 1019866 - RNA, 19 nt, Homo sapiens
gcaaacccacccuuuaaac

SEQ ID NO: 1019867 - RNA, 19 nt, Homo sapiens
gugcaucugaguugaauga

SEQ ID NO: 1019868 - RNA, 19 nt, Homo sapiens
gcaguuacggacgaguuua

SEQ ID NO: 1019869 - RNA, 19 nt, Homo sapiens
cagcagaugaaauuucuug

SEQ ID NO: 1019870 - RNA, 19 nt, Homo sapiens
uguauauacuucugcaaug

SEQ ID NO: 1019871 - RNA, 19 nt, Homo sapiens
cuacagucccgaauucuau

SEQ ID NO: 1019872 - RNA, 19 nt, Homo sapiens
guuaaguucuagaaacagu

SEQ ID NO: 1019873 - RNA, 19 nt, Homo sapiens
uuauacaaauggcuggaaa

SEQ ID NO: 1019874 - RNA, 19 nt, Homo sapiens
gcuguaacaacucugcuuu

SEQ ID NO: 1019875 - RNA, 19 nt, Homo sapiens
uagguuaaguccucaugug

SEQ ID NO: 1019876 - RNA, 19 nt, Homo sapiens
uaucagcuguuugggaaga

SEQ ID NO: 1019877 - RNA, 19 nt, Homo sapiens
ugacugaugccaagacuag

SEQ ID NO: 1019878 - RNA, 19 nt, Homo sapiens
aaagcaugcuggcgucuca

SEQ ID NO: 1019879 - RNA, 19 nt, Homo sapiens
ucacgggucuuccuguuuu

SEQ ID NO: 1019880 - RNA, 19 nt, Homo sapiens
guuguuaaguucuagaaac

SEQ ID NO: 1019881 - RNA, 19 nt, Homo sapiens
gcaucugaguugaaugaag

SEQ ID NO: 1019882 - RNA, 19 nt, Homo sapiens
gcaguaguacaucauuuua

SEQ ID NO: 1019883 - RNA, 19 nt, Homo sapiens
uuaccuuccuggacugauu

SEQ ID NO: 1019884 - RNA, 19 nt, Homo sapiens
uucaucagcuugguacuuu

SEQ ID NO: 1019885 - RNA, 19 nt, Homo sapiens
gccaaaggucauguuguua

SEQ ID NO: 1019886 - RNA, 19 nt, Homo sapiens
ggguuuggcugaaagaaaa

SEQ ID NO: 1019887 - RNA, 19 nt, Homo sapiens
gaacugggguuuggcugaa

SEQ ID NO: 1019888 - RNA, 19 nt, Homo sapiens
gaacaugggugguacauug

SEQ ID NO: 1019889 - RNA, 19 nt, Homo sapiens
caggaaagcccuagaauua

SEQ ID NO: 1019890 - RNA, 19 nt, Homo sapiens
ggauauauuugcacagaua

SEQ ID NO: 1019891 - RNA, 19 nt, Homo sapiens
gaaauugaguagggaaaua

SEQ ID NO: 1019892 - RNA, 19 nt, Homo sapiens
gaccagaccucucuacaaa

SEQ ID NO: 1019893 - RNA, 19 nt, Homo sapiens
gcaauaaaguaggucguua

SEQ ID NO: 1019894 - RNA, 19 nt, Homo sapiens
ccaauuauauggaagaguu

SEQ ID NO: 1019895 - RNA, 19 nt, Homo sapiens
gaacuacugguuugacaua

SEQ ID NO: 1019896 - RNA, 19 nt, Homo sapiens
caagaaagccuggguauug

SEQ ID NO: 1019897 - RNA, 19 nt, Homo sapiens
gaaagccggucucaaagau

SEQ ID NO: 1019898 - RNA, 19 nt, Homo sapiens
ccacuguucuuucucuaua

SEQ ID NO: 1019899 - RNA, 19 nt, Homo sapiens
gaagacacaccauaucuau

SEQ ID NO: 1019900 - RNA, 19 nt, Homo sapiens
cauguucacucccaagaua

SEQ ID NO: 1019901 - RNA, 19 nt, Homo sapiens
gagaguuucuguggauaua

SEQ ID NO: 1019902 - RNA, 19 nt, Homo sapiens
cagagcaucuuguaacuga

SEQ ID NO: 1019903 - RNA, 19 nt, Homo sapiens
ucccauaggcuuaauauua

SEQ ID NO: 1019904 - RNA, 19 nt, Homo sapiens
gcacaagaaucauuugaac

SEQ ID NO: 1019905 - RNA, 19 nt, Homo sapiens
ggugguacauugaggagua

SEQ ID NO: 1019906 - RNA, 19 nt, Homo sapiens
ugccuaagaugaccuauuu

SEQ ID NO: 1019907 - RNA, 19 nt, Homo sapiens
gcaaauacagcgagauguu

SEQ ID NO: 1019908 - RNA, 19 nt, Homo sapiens
gcucacgccuguaauccua

SEQ ID NO: 1019909 - RNA, 19 nt, Homo sapiens
gcaagacucugacucaaaa

SEQ ID NO: 1019910 - RNA, 19 nt, Homo sapiens
ccacaaauaccacuuacaa

SEQ ID NO: 1019911 - RNA, 19 nt, Homo sapiens
cacaguaccuuuccuugaa

SEQ ID NO: 1019912 - RNA, 19 nt, Homo sapiens
gcacaguaccuuuccuuga

SEQ ID NO: 1019913 - RNA, 19 nt, Homo sapiens
uaugaaagccggucucaaa

SEQ ID NO: 1019914 - RNA, 19 nt, Homo sapiens
cagcuucaccuccauauuu

SEQ ID NO: 1019915 - RNA, 19 nt, Homo sapiens
cauagcaaaccuugauuua

SEQ ID NO: 1019916 - RNA, 19 nt, Homo sapiens
gauccgaugugcagccaaa

SEQ ID NO: 1019917 - RNA, 19 nt, Homo sapiens
uaaagaagaugaggaaggu

SEQ ID NO: 1019918 - RNA, 19 nt, Homo sapiens
gcacuggccuggcauucau

SEQ ID NO: 1019919 - RNA, 19 nt, Homo sapiens
ccaguuaucauacauuuga

SEQ ID NO: 1019920 - RNA, 19 nt, Homo sapiens
ucaccugauuguccaguua

SEQ ID NO: 1019921 - RNA, 19 nt, Homo sapiens
gaguuucuguggauauauu

SEQ ID NO: 1019922 - RNA, 19 nt, Homo sapiens
guacauugaggaguauuua

SEQ ID NO: 1019923 - RNA, 19 nt, Homo sapiens
uaacugaagacacaccaua

SEQ ID NO: 1019924 - RNA, 19 nt, Homo sapiens
ccaauggccucauguacau

SEQ ID NO: 1019925 - RNA, 19 nt, Homo sapiens
ugcaggaugugccuuguua

SEQ ID NO: 1019926 - RNA, 19 nt, Homo sapiens
ucaaacagagcaucuugua

SEQ ID NO: 1019927 - RNA, 19 nt, Homo sapiens
caagguggguggaucacuu

SEQ ID NO: 1019928 - RNA, 19 nt, Homo sapiens
agaugaagcaccacuguua

SEQ ID NO: 1019929 - RNA, 19 nt, Homo sapiens
cagcaaccaucucaucuuc

SEQ ID NO: 1019930 - RNA, 19 nt, Homo sapiens
gacauaagaaacuccauuu

SEQ ID NO: 1019931 - RNA, 19 nt, Homo sapiens
gaagagacaccaaaauauu

SEQ ID NO: 1019932 - RNA, 19 nt, Homo sapiens
gcucuaacguccagugcuu

SEQ ID NO: 1019933 - RNA, 19 nt, Homo sapiens
gaaacaugcgcuguaauga

SEQ ID NO: 1019934 - RNA, 19 nt, Homo sapiens
gagcaagacucugacucaa

SEQ ID NO: 1019935 - RNA, 19 nt, Homo sapiens
gcugggaacuacugguuug

SEQ ID NO: 1019936 - RNA, 19 nt, Homo sapiens
cggcgucacugcccuauug

SEQ ID NO: 1019937 - RNA, 19 nt, Homo sapiens
gaggaggaauagugaagga

SEQ ID NO: 1019938 - RNA, 19 nt, Homo sapiens
agauaaauguccuagauca

SEQ ID NO: 1019939 - RNA, 19 nt, Homo sapiens
ggaggccucuuugcaguug

SEQ ID NO: 1019940 - RNA, 19 nt, Homo sapiens
gagauguuguuagccuaua

SEQ ID NO: 1019941 - RNA, 19 nt, Homo sapiens
caagaaucauuugaaccua

SEQ ID NO: 1019942 - RNA, 19 nt, Homo sapiens
gcacauugcaaacugaaau

SEQ ID NO: 1019943 - RNA, 19 nt, Homo sapiens
gauaacugcauccuucauu

SEQ ID NO: 1019944 - RNA, 19 nt, Homo sapiens
aagccggucucaaagauaa

SEQ ID NO: 1019945 - RNA, 19 nt, Homo sapiens
gggcugaggagauuugaaa

SEQ ID NO: 1019946 - RNA, 19 nt, Homo sapiens
uagcaaaccuugauuuagc

SEQ ID NO: 1019947 - RNA, 19 nt, Homo sapiens
guccaguuaucauacauuu

SEQ ID NO: 1019948 - RNA, 19 nt, Homo sapiens
gcaaccaucucaucuucca

SEQ ID NO: 1019949 - RNA, 19 nt, Homo sapiens
gcauaggccuguaauucca

SEQ ID NO: 1019950 - RNA, 19 nt, Homo sapiens
ggaccagaccucucuacaa

SEQ ID NO: 1019951 - RNA, 19 nt, Homo sapiens
ggucggugcucuacuucuu

SEQ ID NO: 1019952 - RNA, 19 nt, Homo sapiens
aaacauagcaaaccuugau

SEQ ID NO: 1019953 - RNA, 19 nt, Homo sapiens
agaauaaugugcuccagau

SEQ ID NO: 1019954 - RNA, 19 nt, Homo sapiens
gaaaggucuucuacugucu

SEQ ID NO: 1019955 - RNA, 19 nt, Homo sapiens
ugagacagccugagauaug

SEQ ID NO: 1019956 - RNA, 19 nt, Homo sapiens
ucauggaacucaaacagau

SEQ ID NO: 1019957 - RNA, 19 nt, Homo sapiens
gaucauuaccuuauucagu

SEQ ID NO: 1019958 - RNA, 19 nt, Homo sapiens
cauucuccauucucgauua

SEQ ID NO: 1019959 - RNA, 19 nt, Homo sapiens
aagaucagauuguuacugu

SEQ ID NO: 1019960 - RNA, 19 nt, Homo sapiens
cuacugguuugacauauuc

SEQ ID NO: 1019961 - RNA, 19 nt, Homo sapiens
uuccaucccuguacccuua

SEQ ID NO: 1019962 - RNA, 19 nt, Homo sapiens
uaaucaauccugucucaaa

SEQ ID NO: 1019963 - RNA, 19 nt, Homo sapiens
gagcauuuccaauuauaug

SEQ ID NO: 1019964 - RNA, 19 nt, Homo sapiens
gaauaugcaauuucugugu

SEQ ID NO: 1019965 - RNA, 19 nt, Homo sapiens
gaugugggcuggcguaagc

SEQ ID NO: 1019966 - RNA, 19 nt, Homo sapiens
gauguucccgcaaaucaaa

SEQ ID NO: 1019967 - RNA, 19 nt, Homo sapiens
acaaugagccauccaacaa

SEQ ID NO: 1019968 - RNA, 19 nt, Homo sapiens
cuggcaaggugguguauuu

SEQ ID NO: 1019969 - RNA, 19 nt, Homo sapiens
ccacacaguacuucuggua

SEQ ID NO: 1019970 - RNA, 19 nt, Homo sapiens
gaucauggacuccggaaag

SEQ ID NO: 1019971 - RNA, 19 nt, Homo sapiens
auaaugugcuccagaugaa

SEQ ID NO: 1019972 - RNA, 19 nt, Homo sapiens
guccagugcuuccuugaga

SEQ ID NO: 1019973 - RNA, 19 nt, Homo sapiens
uaacugcaauaaaguaggu

SEQ ID NO: 1019974 - RNA, 19 nt, Homo sapiens
guaccuuuccuugaacuua

SEQ ID NO: 1019975 - RNA, 19 nt, Homo sapiens
aaacaugcgcuguaaugaa

SEQ ID NO: 1019976 - RNA, 19 nt, Homo sapiens
gaucagauuguuacugugu

SEQ ID NO: 1019977 - RNA, 19 nt, Homo sapiens
gaaaagaaagaucagauug

SEQ ID NO: 1019978 - RNA, 19 nt, Homo sapiens
ugaggagauuugaaaguga

SEQ ID NO: 1019979 - RNA, 19 nt, Homo sapiens
ggucuggugugccuuguca

SEQ ID NO: 1019980 - RNA, 19 nt, Homo sapiens
gagauguucccgcaaauca

SEQ ID NO: 1019981 - RNA, 19 nt, Homo sapiens
guggauauauuugcacaga

SEQ ID NO: 1019982 - RNA, 19 nt, Homo sapiens
aacaugcgcuguaaugaau

SEQ ID NO: 1019983 - RNA, 19 nt, Homo sapiens
caaacagagcaucuuguaa

SEQ ID NO: 1019984 - RNA, 19 nt, Homo sapiens
ccaggaaagcccuagaauu

SEQ ID NO: 1019985 - RNA, 19 nt, Homo sapiens
gaaacuccucggcugcuuu

SEQ ID NO: 1019986 - RNA, 19 nt, Homo sapiens
caacagcuucaccuccaua

SEQ ID NO: 1019987 - RNA, 19 nt, Homo sapiens
cagaucuucuucucacuug

SEQ ID NO: 1019988 - RNA, 19 nt, Homo sapiens
gaacaugggugguacauug

SEQ ID NO: 1019989 - RNA, 19 nt, Homo sapiens
caggaaagcccuagaauua

SEQ ID NO: 1019990 - RNA, 19 nt, Homo sapiens
ggauauauuugcacagaua

SEQ ID NO: 1019991 - RNA, 19 nt, Homo sapiens
gaaauugaguagggaaaua

SEQ ID NO: 1019992 - RNA, 19 nt, Homo sapiens
gaccagaccucucuacaaa

SEQ ID NO: 1019993 - RNA, 19 nt, Homo sapiens
gcaauaaaguaggucguua

SEQ ID NO: 1019994 - RNA, 19 nt, Homo sapiens
ccaauuauauggaagaguu

SEQ ID NO: 1019995 - RNA, 19 nt, Homo sapiens
gaacuacugguuugacaua

SEQ ID NO: 1019996 - RNA, 19 nt, Homo sapiens
caagaaagccuggguauug

SEQ ID NO: 1019997 - RNA, 19 nt, Homo sapiens
gaaagccggucucaaagau

SEQ ID NO: 1019998 - RNA, 19 nt, Homo sapiens
ccacuguucuuucucuaua

SEQ ID NO: 1019999 - RNA, 19 nt, Homo sapiens
gaagacacaccauaucuau

SEQ ID NO: 1020000 - RNA, 19 nt, Homo sapiens
gagaguuucuguggauaua

SEQ ID NO: 1020001 - RNA, 19 nt, Homo sapiens
cagagcaucuuguaacuga

SEQ ID NO: 1020002 - RNA, 19 nt, Homo sapiens
ucccauaggcuuaauauua

SEQ ID NO: 1020003 - RNA, 19 nt, Homo sapiens
gcacaagaaucauuugaac

SEQ ID NO: 1020004 - RNA, 19 nt, Homo sapiens
ggugguacauugaggagua

SEQ ID NO: 1020005 - RNA, 19 nt, Homo sapiens
ugccuaagaugaccuauuu

SEQ ID NO: 1020006 - RNA, 19 nt, Homo sapiens
gcaaauacagcgagauguu

SEQ ID NO: 1020007 - RNA, 19 nt, Homo sapiens
gcucacgccuguaauccua

SEQ ID NO: 1020008 - RNA, 19 nt, Homo sapiens
cgaguccacuggcaagaua

SEQ ID NO: 1020009 - RNA, 19 nt, Homo sapiens
gcaagacucugacucaaaa

SEQ ID NO: 1020010 - RNA, 19 nt, Homo sapiens
ccacaaauaccacuuacaa

SEQ ID NO: 1020011 - RNA, 19 nt, Homo sapiens
cacaguaccuuuccuugaa

SEQ ID NO: 1020012 - RNA, 19 nt, Homo sapiens
gcacaguaccuuuccuuga

SEQ ID NO: 1020013 - RNA, 19 nt, Homo sapiens
uaugaaagccggucucaaa

SEQ ID NO: 1020014 - RNA, 19 nt, Homo sapiens
cagcuucaccuccauauuu

SEQ ID NO: 1020015 - RNA, 19 nt, Homo sapiens
cauagcaaaccuugauuua

SEQ ID NO: 1020016 - RNA, 19 nt, Homo sapiens
gauccgaugugcagccaaa

SEQ ID NO: 1020017 - RNA, 19 nt, Homo sapiens
uaaagaagaugaggaaggu

SEQ ID NO: 1020018 - RNA, 19 nt, Homo sapiens
gcacuggccuggcauucau

SEQ ID NO: 1020019 - RNA, 19 nt, Homo sapiens
ccaguuaucauacauuuga

SEQ ID NO: 1020020 - RNA, 19 nt, Homo sapiens
ucaccugauuguccaguua

SEQ ID NO: 1020021 - RNA, 19 nt, Homo sapiens
gaguuucuguggauauauu

SEQ ID NO: 1020022 - RNA, 19 nt, Homo sapiens
guacauugaggaguauuua

SEQ ID NO: 1020023 - RNA, 19 nt, Homo sapiens
uaacugaagacacaccaua

SEQ ID NO: 1020024 - RNA, 19 nt, Homo sapiens
ugcaggaugugccuuguua

SEQ ID NO: 1020025 - RNA, 19 nt, Homo sapiens
ucaaacagagcaucuugua

SEQ ID NO: 1020026 - RNA, 19 nt, Homo sapiens
caagguggguggaucacuu

SEQ ID NO: 1020027 - RNA, 19 nt, Homo sapiens
agaugaagcaccacuguua

SEQ ID NO: 1020028 - RNA, 19 nt, Homo sapiens
cagcaaccaucucaucuuc

SEQ ID NO: 1020029 - RNA, 19 nt, Homo sapiens
gacauaagaaacuccauuu

SEQ ID NO: 1020030 - RNA, 19 nt, Homo sapiens
gaagagacaccaaaauauu

SEQ ID NO: 1020031 - RNA, 19 nt, Homo sapiens
gcucuaacguccagugcuu

SEQ ID NO: 1020032 - RNA, 19 nt, Homo sapiens
gaaacaugcgcuguaauga

SEQ ID NO: 1020033 - RNA, 19 nt, Homo sapiens
gagcaagacucugacucaa

SEQ ID NO: 1020034 - RNA, 19 nt, Homo sapiens
gcugggaacuacugguuug

SEQ ID NO: 1020035 - RNA, 19 nt, Homo sapiens
gaggaggaauagugaagga

SEQ ID NO: 1020036 - RNA, 19 nt, Homo sapiens
agauaaauguccuagauca

SEQ ID NO: 1020037 - RNA, 19 nt, Homo sapiens
ggaggccucuuugcaguug

SEQ ID NO: 1020038 - RNA, 19 nt, Homo sapiens
gagauguuguuagccuaua

SEQ ID NO: 1020039 - RNA, 19 nt, Homo sapiens
caagaaucauuugaaccua

SEQ ID NO: 1020040 - RNA, 19 nt, Homo sapiens
gcacauugcaaacugaaau

SEQ ID NO: 1020041 - RNA, 19 nt, Homo sapiens
gauaacugcauccuucauu

SEQ ID NO: 1020042 - RNA, 19 nt, Homo sapiens
aagccggucucaaagauaa

SEQ ID NO: 1020043 - RNA, 19 nt, Homo sapiens
gggcugaggagauuugaaa

SEQ ID NO: 1020044 - RNA, 19 nt, Homo sapiens
uagcaaaccuugauuuagc

SEQ ID NO: 1020045 - RNA, 19 nt, Homo sapiens
guccaguuaucauacauuu

SEQ ID NO: 1020046 - RNA, 19 nt, Homo sapiens
gcaaccaucucaucuucca

SEQ ID NO: 1020047 - RNA, 19 nt, Homo sapiens
gcauaggccuguaauucca

SEQ ID NO: 1020048 - RNA, 19 nt, Homo sapiens
ggaccagaccucucuacaa

SEQ ID NO: 1020049 - RNA, 19 nt, Homo sapiens
ggucggugcucuacuucuu

SEQ ID NO: 1020050 - RNA, 19 nt, Homo sapiens
aaacauagcaaaccuugau

SEQ ID NO: 1020051 - RNA, 19 nt, Homo sapiens
agaauaaugugcuccagau

SEQ ID NO: 1020052 - RNA, 19 nt, Homo sapiens
gaaaggucuucuacugucu

SEQ ID NO: 1020053 - RNA, 19 nt, Homo sapiens
ugagacagccugagauaug

SEQ ID NO: 1020054 - RNA, 19 nt, Homo sapiens
ucauggaacucaaacagau

SEQ ID NO: 1020055 - RNA, 19 nt, Homo sapiens
gaucauuaccuuauucagu

SEQ ID NO: 1020056 - RNA, 19 nt, Homo sapiens
cauucuccauucucgauua

SEQ ID NO: 1020057 - RNA, 19 nt, Homo sapiens
aagaucagauuguuacugu

SEQ ID NO: 1020058 - RNA, 19 nt, Homo sapiens
cuacugguuugacauauuc

SEQ ID NO: 1020059 - RNA, 19 nt, Homo sapiens
uuccaucccuguacccuua

SEQ ID NO: 1020060 - RNA, 19 nt, Homo sapiens
uaaucaauccugucucaaa

SEQ ID NO: 1020061 - RNA, 19 nt, Homo sapiens
gagcauuuccaauuauaug

SEQ ID NO: 1020062 - RNA, 19 nt, Homo sapiens
gaauaugcaauuucugugu

SEQ ID NO: 1020063 - RNA, 19 nt, Homo sapiens
gaugugggcuggcguaagc

SEQ ID NO: 1020064 - RNA, 19 nt, Homo sapiens
gauguucccgcaaaucaaa

SEQ ID NO: 1020065 - RNA, 19 nt, Homo sapiens
acaaugagccauccaacaa

SEQ ID NO: 1020066 - RNA, 19 nt, Homo sapiens
ccacacaguacuucuggua

SEQ ID NO: 1020067 - RNA, 19 nt, Homo sapiens
gaucauggacuccggaaag

SEQ ID NO: 1020068 - RNA, 19 nt, Homo sapiens
auaaugugcuccagaugaa

SEQ ID NO: 1020069 - RNA, 19 nt, Homo sapiens
guccagugcuuccuugaga

SEQ ID NO: 1020070 - RNA, 19 nt, Homo sapiens
uaacugcaauaaaguaggu

SEQ ID NO: 1020071 - RNA, 19 nt, Homo sapiens
guaccuuuccuugaacuua

SEQ ID NO: 1020072 - RNA, 19 nt, Homo sapiens
aaacaugcgcuguaaugaa

SEQ ID NO: 1020073 - RNA, 19 nt, Homo sapiens
gaucagauuguuacugugu

SEQ ID NO: 1020074 - RNA, 19 nt, Homo sapiens
gaaaagaaagaucagauug

SEQ ID NO: 1020075 - RNA, 19 nt, Homo sapiens
ugaggagauuugaaaguga

SEQ ID NO: 1020076 - RNA, 19 nt, Homo sapiens
ggucuggugugccuuguca

SEQ ID NO: 1020077 - RNA, 19 nt, Homo sapiens
gagauguucccgcaaauca

SEQ ID NO: 1020078 - RNA, 19 nt, Homo sapiens
guggauauauuugcacaga

SEQ ID NO: 1020079 - RNA, 19 nt, Homo sapiens
aacaugcgcuguaaugaau

SEQ ID NO: 1020080 - RNA, 19 nt, Homo sapiens
caaacagagcaucuuguaa

SEQ ID NO: 1020081 - RNA, 19 nt, Homo sapiens
ccaggaaagcccuagaauu

SEQ ID NO: 1020082 - RNA, 19 nt, Homo sapiens
gaaacuccucggcugcuuu

SEQ ID NO: 1020083 - RNA, 19 nt, Homo sapiens
caacagcuucaccuccaua

SEQ ID NO: 1020084 - RNA, 19 nt, Homo sapiens
cagaucuucuucucacuug

SEQ ID NO: 1020085 - RNA, 19 nt, Homo sapiens
agaaagaacauggguggua

SEQ ID NO: 1020086 - RNA, 19 nt, Homo sapiens
gaugugcagccaaauuuga

SEQ ID NO: 1020087 - RNA, 19 nt, Homo sapiens
ugaggaaggugugcaggaa

SEQ ID NO: 1020088 - RNA, 19 nt, Homo sapiens
gaucacacaucuacacauu

SEQ ID NO: 1020089 - RNA, 19 nt, Homo sapiens
gaacagaggagcagaagga

SEQ ID NO: 1020090 - RNA, 19 nt, Homo sapiens
gaagaaagaaagugucauu

SEQ ID NO: 1020091 - RNA, 19 nt, Homo sapiens
gaugauacccauugccaua

SEQ ID NO: 1020092 - RNA, 19 nt, Homo sapiens
gagacaauguugagaggaa

SEQ ID NO: 1020093 - RNA, 19 nt, Homo sapiens
ucacacaucuacacauuuc

SEQ ID NO: 1020094 - RNA, 19 nt, Homo sapiens
gauccugccuguuaucaug

SEQ ID NO: 1020095 - RNA, 19 nt, Homo sapiens
gagcuucgccucagggaaa

SEQ ID NO: 1020096 - RNA, 19 nt, Homo sapiens
guggugauccugccuguua

SEQ ID NO: 1020097 - RNA, 19 nt, Homo sapiens
gcaucuuccuggacuauga

SEQ ID NO: 1020098 - RNA, 19 nt, Homo sapiens
gcccugaccucccuuaagu

SEQ ID NO: 1020099 - RNA, 19 nt, Homo sapiens
gaacguguccugcucuauc

SEQ ID NO: 1020100 - RNA, 19 nt, Homo sapiens
gaaccaccuuugugagcaa

SEQ ID NO: 1020101 - RNA, 19 nt, Homo sapiens
uggcaggacuggacucuga

SEQ ID NO: 1020102 - RNA, 19 nt, Homo sapiens
aaagaagugugacauugga

SEQ ID NO: 1020103 - RNA, 19 nt, Homo sapiens
caaaagaagugugacauug

SEQ ID NO: 1020104 - RNA, 19 nt, Homo sapiens
gggagaaccaccuuuguga

SEQ ID NO: 1020105 - RNA, 19 nt, Homo sapiens
guaguuccuuugguuguaa

SEQ ID NO: 1020106 - RNA, 19 nt, Homo sapiens
cugcaguguuuguguauaa

SEQ ID NO: 1020107 - RNA, 19 nt, Homo sapiens
gaucauacacaaugucaca

SEQ ID NO: 1020108 - RNA, 19 nt, Homo sapiens
ucacagccauggaaacaag

SEQ ID NO: 1020109 - RNA, 19 nt, Homo sapiens
ccuguucaccuccucauua

SEQ ID NO: 1020110 - RNA, 19 nt, Homo sapiens
uaugacagccaaaucuuaa

SEQ ID NO: 1020111 - RNA, 19 nt, Homo sapiens
caaugccucugguggaaga

SEQ ID NO: 1020112 - RNA, 19 nt, Homo sapiens
gcauagggaacuaguuguu

SEQ ID NO: 1020113 - RNA, 19 nt, Homo sapiens
caacaugagggacagauca

SEQ ID NO: 1020114 - RNA, 19 nt, Homo sapiens
ggaccuuggagaugcauaa

SEQ ID NO: 1020115 - RNA, 19 nt, Homo sapiens
cagcguggcccugaucaua

SEQ ID NO: 1020116 - RNA, 19 nt, Homo sapiens
ggagguagauguggaaaau

SEQ ID NO: 1020117 - RNA, 19 nt, Homo sapiens
ggaaaaugcugaggacaug

SEQ ID NO: 1020118 - RNA, 19 nt, Homo sapiens
cucauuagguguggcuuua

SEQ ID NO: 1020119 - RNA, 19 nt, Homo sapiens
uuaaguggauucucucucu

SEQ ID NO: 1020120 - RNA, 19 nt, Homo sapiens
gaaacauuacuuggaggua

SEQ ID NO: 1020121 - RNA, 19 nt, Homo sapiens
gaucaacaaucuccaaaag

SEQ ID NO: 1020122 - RNA, 19 nt, Homo sapiens
ugaccucccuuaaguggau

SEQ ID NO: 1020123 - RNA, 19 nt, Homo sapiens
acucugagcccgucauuga

SEQ ID NO: 1020124 - RNA, 19 nt, Homo sapiens
uuuaguaguuccuuugguu

SEQ ID NO: 1020125 - RNA, 19 nt, Homo sapiens
cacaaugccucugguggaa

SEQ ID NO: 1020126 - RNA, 19 nt, Homo sapiens
aaucugcucugcauucaca

SEQ ID NO: 1020127 - RNA, 19 nt, Homo sapiens
ccauaugcaucuacuggau

SEQ ID NO: 1020128 - RNA, 19 nt, Homo sapiens
ggagaugcauaaaaggaaa

SEQ ID NO: 1020129 - RNA, 19 nt, Homo sapiens
ccuguuaucaugauuauuc

SEQ ID NO: 1020130 - RNA, 19 nt, Homo sapiens
ucaacaaucuccaaaagga

SEQ ID NO: 1020131 - RNA, 19 nt, Homo sapiens
agguguggcuuuaguaguu

SEQ ID NO: 1020132 - RNA, 19 nt, Homo sapiens
cagagagauucgacaguca

SEQ ID NO: 1020133 - RNA, 19 nt, Homo sapiens
gcccugaucauacacaaug

SEQ ID NO: 1020134 - RNA, 19 nt, Homo sapiens
agacacuggucaucccuau

SEQ ID NO: 1020135 - RNA, 19 nt, Homo sapiens
uuaugacagccaaaucuua

SEQ ID NO: 1020136 - RNA, 19 nt, Homo sapiens
gagauucgacagucagcuu

SEQ ID NO: 1020137 - RNA, 19 nt, Homo sapiens
cgagggagaaccaccuuug

SEQ ID NO: 1020138 - RNA, 19 nt, Homo sapiens
caccacagcccacagaauc

SEQ ID NO: 1020139 - RNA, 19 nt, Homo sapiens
agacaauguugagaggaaa

SEQ ID NO: 1020140 - RNA, 19 nt, Homo sapiens
cagaagaaagaaaguguca

SEQ ID NO: 1020141 - RNA, 19 nt, Homo sapiens
cuaccaguguuacuuccaa

SEQ ID NO: 1020142 - RNA, 19 nt, Homo sapiens
gggcuggacacuucacaga

SEQ ID NO: 1020143 - RNA, 19 nt, Homo sapiens
ugauacccauugccauaug

SEQ ID NO: 1020144 - RNA, 19 nt, Homo sapiens
ggacucugagcccgucauu

SEQ ID NO: 1020145 - RNA, 19 nt, Homo sapiens
gcguggcccugaucauaca

SEQ ID NO: 1020146 - RNA, 19 nt, Homo sapiens
ucuacuggaucaacaaucu

SEQ ID NO: 1020147 - RNA, 19 nt, Homo sapiens
guaacuaugggauggaauc

SEQ ID NO: 1020148 - RNA, 19 nt, Homo sapiens
cagcuggagugcauaucug

SEQ ID NO: 1020149 - RNA, 19 nt, Homo sapiens
cauuagguguggcuuuagu

SEQ ID NO: 1020150 - RNA, 19 nt, Homo sapiens
ccacuacuuccucagaaug

SEQ ID NO: 1020151 - RNA, 19 nt, Homo sapiens
cagggaaacauuacuugga

SEQ ID NO: 1020152 - RNA, 19 nt, Homo sapiens
cagacagccucuucauggu

SEQ ID NO: 1020153 - RNA, 19 nt, Homo sapiens
ccaguguuacuuccaagaa

SEQ ID NO: 1020154 - RNA, 19 nt, Homo sapiens
gagggagaaccaccuuugu

SEQ ID NO: 1020155 - RNA, 19 nt, Homo sapiens
aguaguuccuuugguugua

SEQ ID NO: 1020156 - RNA, 19 nt, Homo sapiens
gggucacggugccugaaga

SEQ ID NO: 1020157 - RNA, 19 nt, Homo sapiens
uuaaucugcucugcauuca

SEQ ID NO: 1020158 - RNA, 19 nt, Homo sapiens
gaucuguagagacaauguu

SEQ ID NO: 1020159 - RNA, 19 nt, Homo sapiens
uaacggcaucuaccagugu

SEQ ID NO: 1020160 - RNA, 19 nt, Homo sapiens
cuugcaggauggagaagaa

SEQ ID NO: 1020161 - RNA, 19 nt, Homo sapiens
gggagaaaacacuacguua

SEQ ID NO: 1020162 - RNA, 19 nt, Homo sapiens
acauggaggugcggugguu

SEQ ID NO: 1020163 - RNA, 19 nt, Homo sapiens
ugacagccaaaucuuaauc

SEQ ID NO: 1020164 - RNA, 19 nt, Homo sapiens
gacgucuccuucuacaaca

SEQ ID NO: 1020165 - RNA, 19 nt, Homo sapiens
aacauuacuuggagguaga

SEQ ID NO: 1020166 - RNA, 19 nt, Homo sapiens
uauaaggguggaagagaga

SEQ ID NO: 1020167 - RNA, 19 nt, Homo sapiens
gggcaacccagagagauuc

SEQ ID NO: 1020168 - RNA, 19 nt, Homo sapiens
gccagaagaaagaaagugu

SEQ ID NO: 1020169 - RNA, 19 nt, Homo sapiens
gcaucuaccaguguuacuu

SEQ ID NO: 1020170 - RNA, 19 nt, Homo sapiens
gagaacagaggagcagaag

SEQ ID NO: 1020171 - RNA, 19 nt, Homo sapiens
guucuccccugcaguguuu

SEQ ID NO: 1020172 - RNA, 19 nt, Homo sapiens
ugacgcagacagccucuuc

SEQ ID NO: 1020173 - RNA, 19 nt, Homo sapiens
aggcauagggaacuaguug

SEQ ID NO: 1020174 - RNA, 19 nt, Homo sapiens
uggcuuuaguaguuccuuu

SEQ ID NO: 1020175 - RNA, 19 nt, Homo sapiens
guuacgaugcugucuguca

SEQ ID NO: 1020176 - RNA, 19 nt, Homo sapiens
gguguggcuuuaguaguuc

SEQ ID NO: 1020177 - RNA, 19 nt, Homo sapiens
aaacaagcccuggccaucu

SEQ ID NO: 1020178 - RNA, 19 nt, Homo sapiens
gaggaguaccgagggagaa

SEQ ID NO: 1020179 - RNA, 19 nt, Homo sapiens
ucccuuaaguggauucucu

SEQ ID NO: 1020180 - RNA, 19 nt, Homo sapiens
gauacccauugccauaugc

SEQ ID NO: 1020181 - RNA, 19 nt, Homo sapiens
ucugagcccgucauugaaa

SEQ ID NO: 1020182 - RNA, 19 nt, Homo sapiens
caucuaccaguguuacuuc

SEQ ID NO: 1020183 - RNA, 19 nt, Homo sapiens
gcucccagccaggaagaaa

SEQ ID NO: 1020184 - RNA, 19 nt, Homo sapiens
gcaggauggagaagaacau

SEQ ID NO: 1020185 - RNA, 19 nt, Homo sapiens
cccagcaggucuccaugug

SEQ ID NO: 1020186 - RNA, 19 nt, Homo sapiens
ggagaaaacacuacguuac

SEQ ID NO: 1020187 - RNA, 19 nt, Homo sapiens
ggucuuaugacagccaaau

SEQ ID NO: 1020188 - RNA, 19 nt, Homo sapiens
ggaaguagcugaugaagau

SEQ ID NO: 1020189 - RNA, 19 nt, Homo sapiens
gaacagagagaaauuugaa

SEQ ID NO: 1020190 - RNA, 19 nt, Homo sapiens
aaagaaagcucugcuaugu

SEQ ID NO: 1020191 - RNA, 19 nt, Homo sapiens
caaucuagaugcauauuug

SEQ ID NO: 1020192 - RNA, 19 nt, Homo sapiens
ggaugacaguugcaaguaa

SEQ ID NO: 1020193 - RNA, 19 nt, Homo sapiens
gaaauaaaauggccguuug

SEQ ID NO: 1020194 - RNA, 19 nt, Homo sapiens
agaaagcucugcuaugugu

SEQ ID NO: 1020195 - RNA, 19 nt, Homo sapiens
uaaauuugguccuaccuau

SEQ ID NO: 1020196 - RNA, 19 nt, Homo sapiens
gucagucucuccuuuauga

SEQ ID NO: 1020197 - RNA, 19 nt, Homo sapiens
agagaaauuugaagcguuu

SEQ ID NO: 1020198 - RNA, 19 nt, Homo sapiens
gaauuuacgucugcaaucu

SEQ ID NO: 1020199 - RNA, 19 nt, Homo sapiens
gaaaagguguuacuguguu

SEQ ID NO: 1020200 - RNA, 19 nt, Homo sapiens
ucacauacccaguaaugaa

SEQ ID NO: 1020201 - RNA, 19 nt, Homo sapiens
gagaacagagagaaauuug

SEQ ID NO: 1020202 - RNA, 19 nt, Homo sapiens
agaaggaucauuugaagaa

SEQ ID NO: 1020203 - RNA, 19 nt, Homo sapiens
gagagaacagagagaaauu

SEQ ID NO: 1020204 - RNA, 19 nt, Homo sapiens
gaaggaucauuugaagaau

SEQ ID NO: 1020205 - RNA, 19 nt, Homo sapiens
gcaaucuagaugcauauuu

SEQ ID NO: 1020206 - RNA, 19 nt, Homo sapiens
cauacccaguaaugaaaua

SEQ ID NO: 1020207 - RNA, 19 nt, Homo sapiens
gaugacaguugcaaguaag

SEQ ID NO: 1020208 - RNA, 19 nt, Homo sapiens
uaaagaaagcucugcuaug

SEQ ID NO: 1020209 - RNA, 19 nt, Homo sapiens
gguaggacaaguggaaaua

SEQ ID NO: 1020210 - RNA, 19 nt, Homo sapiens
ugauggaacuagacacguu

SEQ ID NO: 1020211 - RNA, 19 nt, Homo sapiens
ggacaaguggaaauaagug

SEQ ID NO: 1020212 - RNA, 19 nt, Homo sapiens
gggacuguuugcuuugaaa

SEQ ID NO: 1020213 - RNA, 19 nt, Homo sapiens
uuaugggacuguuugcuuu

SEQ ID NO: 1020214 - RNA, 19 nt, Homo sapiens
acagugaaauaucagauuc

SEQ ID NO: 1020215 - RNA, 19 nt, Homo sapiens
ugaugaagauaacagugaa

SEQ ID NO: 1020216 - RNA, 19 nt, Homo sapiens
uaauuuaucgggaaccaaa

SEQ ID NO: 1020217 - RNA, 19 nt, Homo sapiens
uaaaauggccguuuggauu

SEQ ID NO: 1020218 - RNA, 19 nt, Homo sapiens
gaagucagaauggccugua

SEQ ID NO: 1020219 - RNA, 19 nt, Homo sapiens
gaaccaaauguuucuccuu

SEQ ID NO: 1020220 - RNA, 19 nt, Homo sapiens
cuaccuauaugugugugua

SEQ ID NO: 1020221 - RNA, 19 nt, Homo sapiens
ugccauacaaggaaaguua

SEQ ID NO: 1020222 - RNA, 19 nt, Homo sapiens
aauaucagauucagaggau

SEQ ID NO: 1020223 - RNA, 19 nt, Homo sapiens
gagaagguauuuaaaacug

SEQ ID NO: 1020224 - RNA, 19 nt, Homo sapiens
guucacauacccaguaaug

SEQ ID NO: 1020225 - RNA, 19 nt, Homo sapiens
augaauugcuguaugagaa

SEQ ID NO: 1020226 - RNA, 19 nt, Homo sapiens
ggaauggguaggacaagug

SEQ ID NO: 1020227 - RNA, 19 nt, Homo sapiens
auagaaggaucauuugaag

SEQ ID NO: 1020228 - RNA, 19 nt, Homo sapiens
uaucgggaaccaaauguuu

SEQ ID NO: 1020229 - RNA, 19 nt, Homo sapiens
cuagaugcauauuuguaga

SEQ ID NO: 1020230 - RNA, 19 nt, Homo sapiens
ggaacuagacacguuggaa

SEQ ID NO: 1020231 - RNA, 19 nt, Homo sapiens
guuaacuugucaauuguuc

SEQ ID NO: 1020232 - RNA, 19 nt, Homo sapiens
guaggacaaguggaaauaa

SEQ ID NO: 1020233 - RNA, 19 nt, Homo sapiens
cuugucaauuguucacaua

SEQ ID NO: 1020234 - RNA, 19 nt, Homo sapiens
cugcugaaguuucuuuauc

SEQ ID NO: 1020235 - RNA, 19 nt, Homo sapiens
aaauguuucuccuucacaa

SEQ ID NO: 1020236 - RNA, 19 nt, Homo sapiens
cgagagaacagagagaaau

SEQ ID NO: 1020237 - RNA, 19 nt, Homo sapiens
gagaauuuacgucugcaau

SEQ ID NO: 1020238 - RNA, 19 nt, Homo sapiens
ggaaaguuaaguaaauguc

SEQ ID NO: 1020239 - RNA, 19 nt, Homo sapiens
gaggaugacaguugcaagu

SEQ ID NO: 1020240 - RNA, 19 nt, Homo sapiens
gaaguagcugaugaagaua

SEQ ID NO: 1020241 - RNA, 19 nt, Homo sapiens
guguaucccauaaaguaua

SEQ ID NO: 1020242 - RNA, 19 nt, Homo sapiens
uaggacaaguggaaauaag

SEQ ID NO: 1020243 - RNA, 19 nt, Homo sapiens
aaauuugguccuaccuaua

SEQ ID NO: 1020244 - RNA, 19 nt, Homo sapiens
uaucagauucagaggauga

SEQ ID NO: 1020245 - RNA, 19 nt, Homo sapiens
aaauugugauggaacuaga

SEQ ID NO: 1020246 - RNA, 19 nt, Homo sapiens
cacauacccaguaaugaaa

SEQ ID NO: 1020247 - RNA, 19 nt, Homo sapiens
agaacucuuuguuacauca

SEQ ID NO: 1020248 - RNA, 19 nt, Homo sapiens
uauaaagaaagcucugcua

SEQ ID NO: 1020249 - RNA, 19 nt, Homo sapiens
uuuguuacaucagguauug

SEQ ID NO: 1020250 - RNA, 19 nt, Homo sapiens
gaugaagauaacagugaaa

SEQ ID NO: 1020251 - RNA, 19 nt, Homo sapiens
gugucagucucuccuuuau

SEQ ID NO: 1020252 - RNA, 19 nt, Homo sapiens
uuguguaucccauaaagua

SEQ ID NO: 1020253 - RNA, 19 nt, Homo sapiens
gccauacaaggaaaguuaa

SEQ ID NO: 1020254 - RNA, 19 nt, Homo sapiens
agucucuccuuuaugaauu

SEQ ID NO: 1020255 - RNA, 19 nt, Homo sapiens
auaaagaaagcucugcuau

SEQ ID NO: 1020256 - RNA, 19 nt, Homo sapiens
agagaacagagagaaauuu

SEQ ID NO: 1020257 - RNA, 19 nt, Homo sapiens
uuaucccugucacuaauuu

SEQ ID NO: 1020258 - RNA, 19 nt, Homo sapiens
cguuggaaguagcugauga

SEQ ID NO: 1020259 - RNA, 19 nt, Homo sapiens
cuagacacguuggaaguag

SEQ ID NO: 1020260 - RNA, 19 nt, Homo sapiens
ugaagcguuuauagaagga

SEQ ID NO: 1020261 - RNA, 19 nt, Homo sapiens
uuagugccauacaaggaaa

SEQ ID NO: 1020262 - RNA, 19 nt, Homo sapiens
ccaaauguuucuccuucac

SEQ ID NO: 1020263 - RNA, 19 nt, Homo sapiens
ucucuuauguacaggaaag

SEQ ID NO: 1020264 - RNA, 19 nt, Homo sapiens
cuauauguguguguauugu

SEQ ID NO: 1020265 - RNA, 19 nt, Homo sapiens
uauuguguaucccauaaag

SEQ ID NO: 1020266 - RNA, 19 nt, Homo sapiens
ccguuuggauuuccuucaa

SEQ ID NO: 1020267 - RNA, 19 nt, Homo sapiens
aauuugguccuaccuauau

SEQ ID NO: 1020268 - RNA, 19 nt, Homo sapiens
guuucuccuucacaaguaa

SEQ ID NO: 1020269 - RNA, 19 nt, Homo sapiens
uguuucuccuucacaagua

SEQ ID NO: 1020270 - RNA, 19 nt, Homo sapiens
ugugucagucucuccuuua

SEQ ID NO: 1020271 - RNA, 19 nt, Homo sapiens
cuuuaucccugucacuaau

SEQ ID NO: 1020272 - RNA, 19 nt, Homo sapiens
caaguaagaaugaaauccu

SEQ ID NO: 1020273 - RNA, 19 nt, Homo sapiens
gacaguugcaaguaagaau

SEQ ID NO: 1020274 - RNA, 19 nt, Homo sapiens
auucagaggaugacaguug

SEQ ID NO: 1020275 - RNA, 19 nt, Homo sapiens
cugaugaagauaacaguga

SEQ ID NO: 1020276 - RNA, 19 nt, Homo sapiens
gagaaauuugaagcguuua

SEQ ID NO: 1020277 - RNA, 19 nt, Homo sapiens
aauaagugcccuuucucuu

SEQ ID NO: 1020278 - RNA, 19 nt, Homo sapiens
gguauugcacucucagucu

SEQ ID NO: 1020279 - RNA, 19 nt, Homo sapiens
caaauguuucuccuucaca

SEQ ID NO: 1020280 - RNA, 19 nt, Homo sapiens
agaacagagagaaauuuga

SEQ ID NO: 1020281 - RNA, 19 nt, Homo sapiens
caguugcaaguaagaauga

SEQ ID NO: 1020282 - RNA, 19 nt, Homo sapiens
aaaagguguuacuguguuu

SEQ ID NO: 1020283 - RNA, 19 nt, Homo sapiens
ucuauuaugggacuguuug

SEQ ID NO: 1020284 - RNA, 19 nt, Homo sapiens
guggaaauaagugcccuuu

SEQ ID NO: 1020285 - RNA, 19 nt, Homo sapiens
gagaagaagugcuuuauug

SEQ ID NO: 1020286 - RNA, 19 nt, Homo sapiens
ggacgcagcuguaugacaa

SEQ ID NO: 1020287 - RNA, 19 nt, Homo sapiens
gaagcgcgcucuacuuuca

SEQ ID NO: 1020288 - RNA, 19 nt, Homo sapiens
uuacaugaguuucccaaua

SEQ ID NO: 1020289 - RNA, 19 nt, Homo sapiens
ggcagcagcuuggcuaaua

SEQ ID NO: 1020290 - RNA, 19 nt, Homo sapiens
uacaugaguuucccaauaa

SEQ ID NO: 1020291 - RNA, 19 nt, Homo sapiens
caaugacuaugcagaaauu

SEQ ID NO: 1020292 - RNA, 19 nt, Homo sapiens
gcaaauuccugcccucucu

SEQ ID NO: 1020293 - RNA, 19 nt, Homo sapiens
gaccugagcugcuucacau

SEQ ID NO: 1020294 - RNA, 19 nt, Homo sapiens
gagggcagguucacuuuca

SEQ ID NO: 1020295 - RNA, 19 nt, Homo sapiens
gaaccgggcuggguagagu

SEQ ID NO: 1020296 - RNA, 19 nt, Homo sapiens
ggagaagaagugcuuuauu

SEQ ID NO: 1020297 - RNA, 19 nt, Homo sapiens
gaauguggcccugcaguug

SEQ ID NO: 1020298 - RNA, 19 nt, Homo sapiens
cuaaagacaaguugaguga

SEQ ID NO: 1020299 - RNA, 19 nt, Homo sapiens
gaagaagugcuuuauugag

SEQ ID NO: 1020300 - RNA, 19 nt, Homo sapiens
agaaauugcugcuaaagac

SEQ ID NO: 1020301 - RNA, 19 nt, Homo sapiens
gccaaugacuaugcagaaa

SEQ ID NO: 1020302 - RNA, 19 nt, Homo sapiens
aaagacaaguugagugagu

SEQ ID NO: 1020303 - RNA, 19 nt, Homo sapiens
cggaagcgcgcucuacuuu

SEQ ID NO: 1020304 - RNA, 19 nt, Homo sapiens
gcaagccagucuucugucu

SEQ ID NO: 1020305 - RNA, 19 nt, Homo sapiens
caccagaucugucuucacu

SEQ ID NO: 1020306 - RNA, 19 nt, Homo sapiens
ccucagaaucacaguguua

SEQ ID NO: 1020307 - RNA, 19 nt, Homo sapiens
agccauaccuguucuggaa

SEQ ID NO: 1020308 - RNA, 19 nt, Homo sapiens
ggaauguggcccugcaguu

SEQ ID NO: 1020309 - RNA, 19 nt, Homo sapiens
ggacauccagguaggugaa

SEQ ID NO: 1020310 - RNA, 19 nt, Homo sapiens
gaacaugccaaugacuaug

SEQ ID NO: 1020311 - RNA, 19 nt, Homo sapiens
agaagaagugcuuuauuga

SEQ ID NO: 1020312 - RNA, 19 nt, Homo sapiens
agaaagagcagaacuacca

SEQ ID NO: 1020313 - RNA, 19 nt, Homo sapiens
gaaauugcugcuaaagaca

SEQ ID NO: 1020314 - RNA, 19 nt, Homo sapiens
uaggugaacaugccaauga

SEQ ID NO: 1020315 - RNA, 19 nt, Homo sapiens
acaagcagcgggaggagua

SEQ ID NO: 1020316 - RNA, 19 nt, Homo sapiens
gagagacggagaagaagug

SEQ ID NO: 1020317 - RNA, 19 nt, Homo sapiens
gcagcuuggcuaauacuga

SEQ ID NO: 1020318 - RNA, 19 nt, Homo sapiens
ccaccaaguucucccucuu

SEQ ID NO: 1020319 - RNA, 19 nt, Homo sapiens
gugaacaugccaaugacua

SEQ ID NO: 1020320 - RNA, 19 nt, Homo sapiens
ggaggcaugcugagaguuc

SEQ ID NO: 1020321 - RNA, 19 nt, Homo sapiens
gcagcagcuuggcuaauac

SEQ ID NO: 1020322 - RNA, 19 nt, Homo sapiens
guagguuuguuacaugagu

SEQ ID NO: 1020323 - RNA, 19 nt, Homo sapiens
cagaaauugcugcuaaaga

SEQ ID NO: 1020324 - RNA, 19 nt, Homo sapiens
ucggagagacggagaagaa

SEQ ID NO: 1020325 - RNA, 19 nt, Homo sapiens
gcauguuuguggaggugaa

SEQ ID NO: 1020326 - RNA, 19 nt, Homo sapiens
aagccagucuucugucuuc

SEQ ID NO: 1020327 - RNA, 19 nt, Homo sapiens
gugcuguggugguccauuc

SEQ ID NO: 1020328 - RNA, 19 nt, Homo sapiens
gaucugucuucacuccaau

SEQ ID NO: 1020329 - RNA, 19 nt, Homo sapiens
gcagguucacuuucacuuc

SEQ ID NO: 1020330 - RNA, 19 nt, Homo sapiens
ugaaggacccagaggacaa

SEQ ID NO: 1020331 - RNA, 19 nt, Homo sapiens
acaugaguuucccaauaaa

SEQ ID NO: 1020332 - RNA, 19 nt, Homo sapiens
ggagagacggagaagaagu

SEQ ID NO: 1020333 - RNA, 19 nt, Homo sapiens
ccaaugacuaugcagaaau

SEQ ID NO: 1020334 - RNA, 19 nt, Homo sapiens
ccagucuucugucuuccuu

SEQ ID NO: 1020335 - RNA, 19 nt, Homo sapiens
ggcuaauacugagcaggua

SEQ ID NO: 1020336 - RNA, 19 nt, Homo sapiens
uggaacaaguggagcagau

SEQ ID NO: 1020337 - RNA, 19 nt, Homo sapiens
ggaagcgcgcucuacuuuc

SEQ ID NO: 1020338 - RNA, 19 nt, Homo sapiens
caccaaguucucccucuuu

SEQ ID NO: 1020339 - RNA, 19 nt, Homo sapiens
agucuucugucuuccuuug

SEQ ID NO: 1020340 - RNA, 19 nt, Homo sapiens
uuacugaucagggauguga

SEQ ID NO: 1020341 - RNA, 19 nt, Homo sapiens
gagcaccagaucugucuuc

SEQ ID NO: 1020342 - RNA, 19 nt, Homo sapiens
ucacuguucucucuuucag

SEQ ID NO: 1020343 - RNA, 19 nt, Homo sapiens
ugucuuccuuugcuaacuu

SEQ ID NO: 1020344 - RNA, 19 nt, Homo sapiens
ugcgacagcugguggaaca

SEQ ID NO: 1020345 - RNA, 19 nt, Homo sapiens
ugaacaugccaaugacuau

SEQ ID NO: 1020346 - RNA, 19 nt, Homo sapiens
agacggagaagaagugcuu

SEQ ID NO: 1020347 - RNA, 19 nt, Homo sapiens
gccuagaccugcugaucca

SEQ ID NO: 1020348 - RNA, 19 nt, Homo sapiens
gaggcaugcugagaguuca

SEQ ID NO: 1020349 - RNA, 19 nt, Homo sapiens
caguugaccugagcugcuu

SEQ ID NO: 1020350 - RNA, 19 nt, Homo sapiens
gucuuccuuugcuaacuua

SEQ ID NO: 1020351 - RNA, 19 nt, Homo sapiens
gcagaugcggcaccucaag

SEQ ID NO: 1020352 - RNA, 19 nt, Homo sapiens
gacagcugguggaacaagu

SEQ ID NO: 1020353 - RNA, 19 nt, Homo sapiens
aagacaaguugagugaguu

SEQ ID NO: 1020354 - RNA, 19 nt, Homo sapiens
gguaaagccccuccucuug

SEQ ID NO: 1020355 - RNA, 19 nt, Homo sapiens
gcggaagcgcgcucuacuu

SEQ ID NO: 1020356 - RNA, 19 nt, Homo sapiens
uccuggaacugacuucuuc

SEQ ID NO: 1020357 - RNA, 19 nt, Homo sapiens
ccagaaagagcagaacuac

SEQ ID NO: 1020358 - RNA, 19 nt, Homo sapiens
gaaggacccagaggacaag

SEQ ID NO: 1020359 - RNA, 19 nt, Homo sapiens
ccucuuggcaccucagaau

SEQ ID NO: 1020360 - RNA, 19 nt, Homo sapiens
ucugggccguuugguagua

SEQ ID NO: 1020361 - RNA, 19 nt, Homo sapiens
ugucuucacuccaauucca

SEQ ID NO: 1020362 - RNA, 19 nt, Homo sapiens
agaucugucuucacuccaa

SEQ ID NO: 1020363 - RNA, 19 nt, Homo sapiens
ugagcugcuucacaugguu

SEQ ID NO: 1020364 - RNA, 19 nt, Homo sapiens
cagggugugugugaguuga

SEQ ID NO: 1020365 - RNA, 19 nt, Homo sapiens
caaguucucccucuuugcu

SEQ ID NO: 1020366 - RNA, 19 nt, Homo sapiens
accaaguucucccucuuug

SEQ ID NO: 1020367 - RNA, 19 nt, Homo sapiens
cagaugcggcaccucaaga

SEQ ID NO: 1020368 - RNA, 19 nt, Homo sapiens
cggagaagaagugcuuuau

SEQ ID NO: 1020369 - RNA, 19 nt, Homo sapiens
ggaacaaguggagcagauc

SEQ ID NO: 1020370 - RNA, 19 nt, Homo sapiens
gcagaaagauacaaaguga

SEQ ID NO: 1020371 - RNA, 19 nt, Homo sapiens
ggaaauagcagacucagaa

SEQ ID NO: 1020372 - RNA, 19 nt, Homo sapiens
uuucagagcuccauauaua

SEQ ID NO: 1020373 - RNA, 19 nt, Homo sapiens
cuucagagcuuuaucaauu

SEQ ID NO: 1020374 - RNA, 19 nt, Homo sapiens
gaaaggaacacugaacaaa

SEQ ID NO: 1020375 - RNA, 19 nt, Homo sapiens
gaacaauuaucagugguau

SEQ ID NO: 1020376 - RNA, 19 nt, Homo sapiens
guauacagcuauugauugu

SEQ ID NO: 1020377 - RNA, 19 nt, Homo sapiens
gauauaagugugaguacua

SEQ ID NO: 1020378 - RNA, 19 nt, Homo sapiens
ggucagauguuguccuugu

SEQ ID NO: 1020379 - RNA, 19 nt, Homo sapiens
guuaauaugugucaucagu

SEQ ID NO: 1020380 - RNA, 19 nt, Homo sapiens
ugaagaagcugagcagaca

SEQ ID NO: 1020381 - RNA, 19 nt, Homo sapiens
gggaguaaguguucacauc

SEQ ID NO: 1020382 - RNA, 19 nt, Homo sapiens
aaucauuucucaccaaaga

SEQ ID NO: 1020383 - RNA, 19 nt, Homo sapiens
gauauugccagcauucauu

SEQ ID NO: 1020384 - RNA, 19 nt, Homo sapiens
aggaauacaucgugaagaa

SEQ ID NO: 1020385 - RNA, 19 nt, Homo sapiens
ggagugauguauugauugg

SEQ ID NO: 1020386 - RNA, 19 nt, Homo sapiens
guaaguguucacaucauua

SEQ ID NO: 1020387 - RNA, 19 nt, Homo sapiens
gacccacucugcugucuug

SEQ ID NO: 1020388 - RNA, 19 nt, Homo sapiens
acaaugcuauuacuacuuc

SEQ ID NO: 1020389 - RNA, 19 nt, Homo sapiens
guuaguagcugggauuaca

SEQ ID NO: 1020390 - RNA, 19 nt, Homo sapiens
caugguuggugcagacaua

SEQ ID NO: 1020391 - RNA, 19 nt, Homo sapiens
gugcuaggauuacagaugu

SEQ ID NO: 1020392 - RNA, 19 nt, Homo sapiens
ggaacaauuaucaguggua

SEQ ID NO: 1020393 - RNA, 19 nt, Homo sapiens
gucagaugcuucaagguuu

SEQ ID NO: 1020394 - RNA, 19 nt, Homo sapiens
gaaaccaagcuaagagugu

SEQ ID NO: 1020395 - RNA, 19 nt, Homo sapiens
ggcugaagcuggaggagaa

SEQ ID NO: 1020396 - RNA, 19 nt, Homo sapiens
gcucugucaugguuuauuc

SEQ ID NO: 1020397 - RNA, 19 nt, Homo sapiens
ccaaagugcugggauuaca

SEQ ID NO: 1020398 - RNA, 19 nt, Homo sapiens
gcaaacucuucaccuggaa

SEQ ID NO: 1020399 - RNA, 19 nt, Homo sapiens
ggaguaaguguucacauca

SEQ ID NO: 1020400 - RNA, 19 nt, Homo sapiens
ccacucugcugucuuguag

SEQ ID NO: 1020401 - RNA, 19 nt, Homo sapiens
guuggacucuuucuguuug

SEQ ID NO: 1020402 - RNA, 19 nt, Homo sapiens
gcauuugcccuguguaugu

SEQ ID NO: 1020403 - RNA, 19 nt, Homo sapiens
caugcaagauacagaguga

SEQ ID NO: 1020404 - RNA, 19 nt, Homo sapiens
ggaagcuaauuaugugauc

SEQ ID NO: 1020405 - RNA, 19 nt, Homo sapiens
caucagcucaagaaacuaa

SEQ ID NO: 1020406 - RNA, 19 nt, Homo sapiens
caauaucuguucguguuga

SEQ ID NO: 1020407 - RNA, 19 nt, Homo sapiens
gguauacagcuauugauug

SEQ ID NO: 1020408 - RNA, 19 nt, Homo sapiens
gauguuguccuuguguaua

SEQ ID NO: 1020409 - RNA, 19 nt, Homo sapiens
gucauacucuccaacaguu

SEQ ID NO: 1020410 - RNA, 19 nt, Homo sapiens
ccagcuaaguuuuguauuu

SEQ ID NO: 1020411 - RNA, 19 nt, Homo sapiens
aaggaacacugaacaaagu

SEQ ID NO: 1020412 - RNA, 19 nt, Homo sapiens
gcggaccucuacagccuuu

SEQ ID NO: 1020413 - RNA, 19 nt, Homo sapiens
ucaaauuccugagcuaaag

SEQ ID NO: 1020414 - RNA, 19 nt, Homo sapiens
gcuaagaguguguuucugu

SEQ ID NO: 1020415 - RNA, 19 nt, Homo sapiens
gcagaaaccaagcuaagag

SEQ ID NO: 1020416 - RNA, 19 nt, Homo sapiens
gaaauagcagacucagaau

SEQ ID NO: 1020417 - RNA, 19 nt, Homo sapiens
uaucagugguauacagcua

SEQ ID NO: 1020418 - RNA, 19 nt, Homo sapiens
gugccuggccuguuuguuu

SEQ ID NO: 1020419 - RNA, 19 nt, Homo sapiens
accaauaucuguucguguu

SEQ ID NO: 1020420 - RNA, 19 nt, Homo sapiens
gagcagaaaccaagcuaag

SEQ ID NO: 1020421 - RNA, 19 nt, Homo sapiens
guccuucacugucaucaug

SEQ ID NO: 1020422 - RNA, 19 nt, Homo sapiens
gggacuagcagauguggaa

SEQ ID NO: 1020423 - RNA, 19 nt, Homo sapiens
cacaguaucacaacaaaga

SEQ ID NO: 1020424 - RNA, 19 nt, Homo sapiens
cucacgaccuccuggaaua

SEQ ID NO: 1020425 - RNA, 19 nt, Homo sapiens
cgaaagugcuaggauuaca

SEQ ID NO: 1020426 - RNA, 19 nt, Homo sapiens
agaguguguuucuguguuu

SEQ ID NO: 1020427 - RNA, 19 nt, Homo sapiens
ugauggcucugucaugguu

SEQ ID NO: 1020428 - RNA, 19 nt, Homo sapiens
uguggaagcuaauuaugug

SEQ ID NO: 1020429 - RNA, 19 nt, Homo sapiens
gcuugcuguuccuaauuua

SEQ ID NO: 1020430 - RNA, 19 nt, Homo sapiens
gcuuugaauucauggaaau

SEQ ID NO: 1020431 - RNA, 19 nt, Homo sapiens
gaaccuucccacaauuguu

SEQ ID NO: 1020432 - RNA, 19 nt, Homo sapiens
cagauguuguccuugugua

SEQ ID NO: 1020433 - RNA, 19 nt, Homo sapiens
cgucagagccuaccaguac

SEQ ID NO: 1020434 - RNA, 19 nt, Homo sapiens
cagauguggaagcuaauua

SEQ ID NO: 1020435 - RNA, 19 nt, Homo sapiens
ccuguuuguuuguuuguuu

SEQ ID NO: 1020436 - RNA, 19 nt, Homo sapiens
ugaguacuauacaagcauu

SEQ ID NO: 1020437 - RNA, 19 nt, Homo sapiens
ccacaggccuuuggguaca

SEQ ID NO: 1020438 - RNA, 19 nt, Homo sapiens
ugucaugguuuauucuuca

SEQ ID NO: 1020439 - RNA, 19 nt, Homo sapiens
gaguaaguguucacaucau

SEQ ID NO: 1020440 - RNA, 19 nt, Homo sapiens
uggaguacguuuccucugu

SEQ ID NO: 1020441 - RNA, 19 nt, Homo sapiens
ggaauggugggccuguuug

SEQ ID NO: 1020442 - RNA, 19 nt, Homo sapiens
ugagauauaagugugagua

SEQ ID NO: 1020443 - RNA, 19 nt, Homo sapiens
cagaauggacacucuacaa

SEQ ID NO: 1020444 - RNA, 19 nt, Homo sapiens
gcuuugggauuccuguguu

SEQ ID NO: 1020445 - RNA, 19 nt, Homo sapiens
gagagggacgcgagcaaga

SEQ ID NO: 1020446 - RNA, 19 nt, Homo sapiens
aguaaguguucacaucauu

SEQ ID NO: 1020447 - RNA, 19 nt, Homo sapiens
cacugugccuggccuguuu

SEQ ID NO: 1020448 - RNA, 19 nt, Homo sapiens
gcauugggauugacaaccu

SEQ ID NO: 1020449 - RNA, 19 nt, Homo sapiens
ucagugguauacagcuauu

SEQ ID NO: 1020450 - RNA, 19 nt, Homo sapiens
cucuucaccuggaauauuu

SEQ ID NO: 1020451 - RNA, 19 nt, Homo sapiens
ccaggcuaaucucaaauuc

SEQ ID NO: 1020452 - RNA, 19 nt, Homo sapiens
cuccuggauucaaguguua

SEQ ID NO: 1020453 - RNA, 19 nt, Homo sapiens
gauaaaaggcaaacucuuc

SEQ ID NO: 1020454 - RNA, 19 nt, Homo sapiens
aaacucuucaccuggaaua

SEQ ID NO: 1020455 - RNA, 19 nt, Homo sapiens
gcagauguggaagcuaauu

SEQ ID NO: 1020456 - RNA, 19 nt, Homo sapiens
uaaggauauugccagcauu

SEQ ID NO: 1020457 - RNA, 19 nt, Homo sapiens
agggagugauguauugauu

SEQ ID NO: 1020458 - RNA, 19 nt, Homo sapiens
gcagggagggaagacaauu

SEQ ID NO: 1020459 - RNA, 19 nt, Homo sapiens
ggucauacucuccaacagu

SEQ ID NO: 1020460 - RNA, 19 nt, Homo sapiens
ccuaauuuauacagugaug

SEQ ID NO: 1020461 - RNA, 19 nt, Homo sapiens
cuugaaaagucuugagaua

SEQ ID NO: 1020462 - RNA, 19 nt, Homo sapiens
ugucagaugcuucaagguu

SEQ ID NO: 1020463 - RNA, 19 nt, Homo sapiens
ggcuuugaauucauggaaa

SEQ ID NO: 1020464 - RNA, 19 nt, Homo sapiens
caaaaugccacuuucagaa

SEQ ID NO: 1020465 - RNA, 19 nt, Homo sapiens
aaucuguaaugcccuguga

SEQ ID NO: 1020466 - RNA, 19 nt, Homo sapiens
agacaaugcuauuacuacu

SEQ ID NO: 1020467 - RNA, 19 nt, Homo sapiens
ggucagcccuugaaaaguc

SEQ ID NO: 1020468 - RNA, 19 nt, Homo sapiens
ucacgguggcucuggagua

SEQ ID NO: 1020469 - RNA, 19 nt, Homo sapiens
aagaguguguuucuguguu

SEQ ID NO: 1020470 - RNA, 19 nt, Homo sapiens
gaccgaagcucccucaauc

SEQ ID NO: 1020471 - RNA, 19 nt, Homo sapiens
uaacgagugccaaaucuuu

SEQ ID NO: 1020472 - RNA, 19 nt, Homo sapiens
ccucaauccuugucuggua

SEQ ID NO: 1020473 - RNA, 19 nt, Homo sapiens
ggcggcagcgcuuuaauua

SEQ ID NO: 1020474 - RNA, 19 nt, Homo sapiens
acaagaacaucaugagcaa

SEQ ID NO: 1020475 - RNA, 19 nt, Homo sapiens
gaaaggcagcggacagauc

SEQ ID NO: 1020476 - RNA, 19 nt, Homo sapiens
caacaugaacuacgacaag

SEQ ID NO: 1020477 - RNA, 19 nt, Homo sapiens
ccaaaucuuuucccacuuu

SEQ ID NO: 1020478 - RNA, 19 nt, Homo sapiens
gcaagcccaacaugaacua

SEQ ID NO: 1020479 - RNA, 19 nt, Homo sapiens
ggaccgaagcucccucaau

SEQ ID NO: 1020480 - RNA, 19 nt, Homo sapiens
cgucaaccguccucuaauc

SEQ ID NO: 1020481 - RNA, 19 nt, Homo sapiens
gagcagguuuggugaaagc

SEQ ID NO: 1020482 - RNA, 19 nt, Homo sapiens
uaucacuacucuuuaacga

SEQ ID NO: 1020483 - RNA, 19 nt, Homo sapiens
gagaaacucccgguguguu

SEQ ID NO: 1020484 - RNA, 19 nt, Homo sapiens
agagcaagcccaacaugaa

SEQ ID NO: 1020485 - RNA, 19 nt, Homo sapiens
caagagcaagcccaacaug

SEQ ID NO: 1020486 - RNA, 19 nt, Homo sapiens
gagcaagcccaacaugaac

SEQ ID NO: 1020487 - RNA, 19 nt, Homo sapiens
cugagcagguuuggugaaa

SEQ ID NO: 1020488 - RNA, 19 nt, Homo sapiens
gaagccccauucaauauca

SEQ ID NO: 1020489 - RNA, 19 nt, Homo sapiens
gcaagagcaagcccaacau

SEQ ID NO: 1020490 - RNA, 19 nt, Homo sapiens
caacauguaccugccagau

SEQ ID NO: 1020491 - RNA, 19 nt, Homo sapiens
gcggcagcgcuuuaauuaa

SEQ ID NO: 1020492 - RNA, 19 nt, Homo sapiens
uuauugcgaugggacgaua

SEQ ID NO: 1020493 - RNA, 19 nt, Homo sapiens
gaaaagacacgcgcucuag

SEQ ID NO: 1020494 - RNA, 19 nt, Homo sapiens
cuagaagccccauucaaua

SEQ ID NO: 1020495 - RNA, 19 nt, Homo sapiens
cagaaaggcagcggacaga

SEQ ID NO: 1020496 - RNA, 19 nt, Homo sapiens
gcgcguuggagacuuuauu

SEQ ID NO: 1020497 - RNA, 19 nt, Homo sapiens
gcuacuacuacgacaagaa

SEQ ID NO: 1020498 - RNA, 19 nt, Homo sapiens
cgucuucuccuccuuguca

SEQ ID NO: 1020499 - RNA, 19 nt, Homo sapiens
ggaaaagacacgcgcucua

SEQ ID NO: 1020500 - RNA, 19 nt, Homo sapiens
cauucaauaucacuacucu

SEQ ID NO: 1020501 - RNA, 19 nt, Homo sapiens
aagagcaagcccaacauga

SEQ ID NO: 1020502 - RNA, 19 nt, Homo sapiens
ucuccaaacucaaccucau

SEQ ID NO: 1020503 - RNA, 19 nt, Homo sapiens
gcgcuacuacuacgacaag

SEQ ID NO: 1020504 - RNA, 19 nt, Homo sapiens
cgaggcggcagcgcuuuaa

SEQ ID NO: 1020505 - RNA, 19 nt, Homo sapiens
caacuugacuucauguuaa

SEQ ID NO: 1020506 - RNA, 19 nt, Homo sapiens
gaaagguacuacaaauuca

SEQ ID NO: 1020507 - RNA, 19 nt, Homo sapiens
ccaaagacaagaaguauaa

SEQ ID NO: 1020508 - RNA, 19 nt, Homo sapiens
ggaaagguacuacaaauuc

SEQ ID NO: 1020509 - RNA, 19 nt, Homo sapiens
ggaaaucuacugucauuau

SEQ ID NO: 1020510 - RNA, 19 nt, Homo sapiens
uaaagcagccuaugacauu

SEQ ID NO: 1020511 - RNA, 19 nt, Homo sapiens
gacaagaaguauaaacaga

SEQ ID NO: 1020512 - RNA, 19 nt, Homo sapiens
gcacuucaguccuauucaa

SEQ ID NO: 1020513 - RNA, 19 nt, Homo sapiens
gaaaguucaucaaagaaag

SEQ ID NO: 1020514 - RNA, 19 nt, Homo sapiens
aaacaaaacucacguauca

SEQ ID NO: 1020515 - RNA, 19 nt, Homo sapiens
caacaaaccaggcgucgaa

SEQ ID NO: 1020516 - RNA, 19 nt, Homo sapiens
ggagaaaugccggugguua

SEQ ID NO: 1020517 - RNA, 19 nt, Homo sapiens
gagcauuacucuugagaag

SEQ ID NO: 1020518 - RNA, 19 nt, Homo sapiens
ugugaaaggugauggguuu

SEQ ID NO: 1020519 - RNA, 19 nt, Homo sapiens
gaaagauguucguccaaag

SEQ ID NO: 1020520 - RNA, 19 nt, Homo sapiens
cgaaggaacauaccucaaa

SEQ ID NO: 1020521 - RNA, 19 nt, Homo sapiens
gagauaaagcagccuauga

SEQ ID NO: 1020522 - RNA, 19 nt, Homo sapiens
acaaggcacuucaguccua

SEQ ID NO: 1020523 - RNA, 19 nt, Homo sapiens
gauuuccucuucauucuga

SEQ ID NO: 1020524 - RNA, 19 nt, Homo sapiens
auaaacagauuuccucuuc

SEQ ID NO: 1020525 - RNA, 19 nt, Homo sapiens
aaagggaaaucuacuguca

SEQ ID NO: 1020526 - RNA, 19 nt, Homo sapiens
uaagagccaucuaugacaa

SEQ ID NO: 1020527 - RNA, 19 nt, Homo sapiens
gaaagcaccaagaagcaaa

SEQ ID NO: 1020528 - RNA, 19 nt, Homo sapiens
gaaggaacauaccucaaaa

SEQ ID NO: 1020529 - RNA, 19 nt, Homo sapiens
agaaagauguucguccaaa

SEQ ID NO: 1020530 - RNA, 19 nt, Homo sapiens
ucaaagaaagcaccaagaa

SEQ ID NO: 1020531 - RNA, 19 nt, Homo sapiens
ggagcgcccuguugagugu

SEQ ID NO: 1020532 - RNA, 19 nt, Homo sapiens
uaauaagagccaucuauga

SEQ ID NO: 1020533 - RNA, 19 nt, Homo sapiens
ucacguaucaucucaauag

SEQ ID NO: 1020534 - RNA, 19 nt, Homo sapiens
aaacagauuuccucuucau

SEQ ID NO: 1020535 - RNA, 19 nt, Homo sapiens
agcaaaagcuggagcauua

SEQ ID NO: 1020536 - RNA, 19 nt, Homo sapiens
uaaaucaacaucaggagaa

SEQ ID NO: 1020537 - RNA, 19 nt, Homo sapiens
uaaauguuguccagacuca

SEQ ID NO: 1020538 - RNA, 19 nt, Homo sapiens
ccacagcaaucaggcaaga

SEQ ID NO: 1020539 - RNA, 19 nt, Homo sapiens
cuucaucucuuccaaguca

SEQ ID NO: 1020540 - RNA, 19 nt, Homo sapiens
agggaaaucuacugucauu

SEQ ID NO: 1020541 - RNA, 19 nt, Homo sapiens
aaggaaagguacuacaaau

SEQ ID NO: 1020542 - RNA, 19 nt, Homo sapiens
gugguuagcuucaucaaaa

SEQ ID NO: 1020543 - RNA, 19 nt, Homo sapiens
ccaaggcuguggccaguuc

SEQ ID NO: 1020544 - RNA, 19 nt, Homo sapiens
gcuggagcauuacucuuga

SEQ ID NO: 1020545 - RNA, 19 nt, Homo sapiens
aaacucacguaucaucuca

SEQ ID NO: 1020546 - RNA, 19 nt, Homo sapiens
gagaaaugccggugguuag

SEQ ID NO: 1020547 - RNA, 19 nt, Homo sapiens
ggaagucucgccacagcaa

SEQ ID NO: 1020548 - RNA, 19 nt, Homo sapiens
cagccaacaucauacugaa

SEQ ID NO: 1020549 - RNA, 19 nt, Homo sapiens
gugagaaauuucagcuaga

SEQ ID NO: 1020550 - RNA, 19 nt, Homo sapiens
ggaaaacaagugagaaauu

SEQ ID NO: 1020551 - RNA, 19 nt, Homo sapiens
gauccuaaaucaacaucag

SEQ ID NO: 1020552 - RNA, 19 nt, Homo sapiens
cagcagagcaugcagaagu

SEQ ID NO: 1020553 - RNA, 19 nt, Homo sapiens
aaccacagccaacaucaua

SEQ ID NO: 1020554 - RNA, 19 nt, Homo sapiens
uguagucucugccaacuuc

SEQ ID NO: 1020555 - RNA, 19 nt, Homo sapiens
aaaggaaagguacuacaaa

SEQ ID NO: 1020556 - RNA, 19 nt, Homo sapiens
cagguuggguguacgaugu

SEQ ID NO: 1020557 - RNA, 19 nt, Homo sapiens
ugagaaauuucagcuagau

SEQ ID NO: 1020558 - RNA, 19 nt, Homo sapiens
ccauauggguaaauguugu

SEQ ID NO: 1020559 - RNA, 19 nt, Homo sapiens
gaaguccucgcuggaguuu

SEQ ID NO: 1020560 - RNA, 19 nt, Homo sapiens
ggaacauaccucaaaauaa

SEQ ID NO: 1020561 - RNA, 19 nt, Homo sapiens
gaaaggugauggguuuuau

SEQ ID NO: 1020562 - RNA, 19 nt, Homo sapiens
caaaccaggcgucgaagga

SEQ ID NO: 1020563 - RNA, 19 nt, Homo sapiens
uaaacagauuuccucuuca

SEQ ID NO: 1020564 - RNA, 19 nt, Homo sapiens
gaguguaaguucugcaaac

SEQ ID NO: 1020565 - RNA, 19 nt, Homo sapiens
ggcaagagaaagaaguaaa

SEQ ID NO: 1020566 - RNA, 19 nt, Homo sapiens
caaagaaagcaccaagaag

SEQ ID NO: 1020567 - RNA, 19 nt, Homo sapiens
cagauuuccucuucauucu

SEQ ID NO: 1020568 - RNA, 19 nt, Homo sapiens
gccaacaucauacugaaug

SEQ ID NO: 1020569 - RNA, 19 nt, Homo sapiens
gauaaagcagccuaugaca

SEQ ID NO: 1020570 - RNA, 19 nt, Homo sapiens
caacauaguacuggaaguc

SEQ ID NO: 1020571 - RNA, 19 nt, Homo sapiens
aaagauguucguccaaaga

SEQ ID NO: 1020572 - RNA, 19 nt, Homo sapiens
gaaauucuuccuucaucuc

SEQ ID NO: 1020573 - RNA, 19 nt, Homo sapiens
ccaaaugauuccagaaaau

SEQ ID NO: 1020574 - RNA, 19 nt, Homo sapiens
caacuucacccuccaugag

SEQ ID NO: 1020575 - RNA, 19 nt, Homo sapiens
gcaagagaaagaaguaaaa

SEQ ID NO: 1020576 - RNA, 19 nt, Homo sapiens
aaaucaacaucaggagaaa

SEQ ID NO: 1020577 - RNA, 19 nt, Homo sapiens
gagaaauuucagcuagauu

SEQ ID NO: 1020578 - RNA, 19 nt, Homo sapiens
ggagauaaagcagccuaug

SEQ ID NO: 1020579 - RNA, 19 nt, Homo sapiens
gguaaauguuguccagacu

SEQ ID NO: 1020580 - RNA, 19 nt, Homo sapiens
gaaaagguuuggcagaacu

SEQ ID NO: 1020581 - RNA, 19 nt, Homo sapiens
gugguggucuugugaaagg

SEQ ID NO: 1020582 - RNA, 19 nt, Homo sapiens
caccauauggguaaauguu

SEQ ID NO: 1020583 - RNA, 19 nt, Homo sapiens
ggaggagcacugcaagcuu

SEQ ID NO: 1020584 - RNA, 19 nt, Homo sapiens
gauguucguccaaagacaa

SEQ ID NO: 1020585 - RNA, 19 nt, Homo sapiens
ugaaagggaaaucuacugu

SEQ ID NO: 1020586 - RNA, 19 nt, Homo sapiens
caggcaagagaaagaagua

SEQ ID NO: 1020587 - RNA, 19 nt, Homo sapiens
caaggcacuucaguccuau

SEQ ID NO: 1020588 - RNA, 19 nt, Homo sapiens
aguccucgcuggaguuuca

SEQ ID NO: 1020589 - RNA, 19 nt, Homo sapiens
cguccaaagacaagaagua

SEQ ID NO: 1020590 - RNA, 19 nt, Homo sapiens
gagaaagauguucguccaa

SEQ ID NO: 1020591 - RNA, 19 nt, Homo sapiens
acagauuuccucuucauuc

SEQ ID NO: 1020592 - RNA, 19 nt, Homo sapiens
aaccaaaugauuccagaaa

SEQ ID NO: 1020593 - RNA, 19 nt, Homo sapiens
caaucaggcaagagaaaga

SEQ ID NO: 1020594 - RNA, 19 nt, Homo sapiens
uuuauucguugggcuuuaa

SEQ ID NO: 1020595 - RNA, 19 nt, Homo sapiens
aauuucagcuagauuugga

SEQ ID NO: 1020596 - RNA, 19 nt, Homo sapiens
ugucauuauugcaaccaaa

SEQ ID NO: 1020597 - RNA, 19 nt, Homo sapiens
gggaaaucuacugucauua

SEQ ID NO: 1020598 - RNA, 19 nt, Homo sapiens
gcaaucaggcaagagaaag

SEQ ID NO: 1020599 - RNA, 19 nt, Homo sapiens
ggagcauuacucuugagaa

SEQ ID NO: 1020600 - RNA, 19 nt, Homo sapiens
auaauaagagccaucuaug

SEQ ID NO: 1020601 - RNA, 19 nt, Homo sapiens
aggaaagguacuacaaauu

SEQ ID NO: 1020602 - RNA, 19 nt, Homo sapiens
acucacguaucaucucaau

SEQ ID NO: 1020603 - RNA, 19 nt, Homo sapiens
aaaugccggugguuagcuu

SEQ ID NO: 1020604 - RNA, 19 nt, Homo sapiens
guccaaagacaagaaguau

SEQ ID NO: 1020605 - RNA, 19 nt, Homo sapiens
caaauagaccugucaaauu

SEQ ID NO: 1020606 - RNA, 19 nt, Homo sapiens
gguguuaccugcucauuug

SEQ ID NO: 1020607 - RNA, 19 nt, Homo sapiens
gcaaauagaccugucaaau

SEQ ID NO: 1020608 - RNA, 19 nt, Homo sapiens
gaacuggcauauuucuuca

SEQ ID NO: 1020609 - RNA, 19 nt, Homo sapiens
ggaguuguaugcacaugaa

SEQ ID NO: 1020610 - RNA, 19 nt, Homo sapiens
ccaagagccucaacauuuc

SEQ ID NO: 1020611 - RNA, 19 nt, Homo sapiens
gucgggaacuggcauauuu

SEQ ID NO: 1020612 - RNA, 19 nt, Homo sapiens
ccuagagccuuauuagaaa

SEQ ID NO: 1020613 - RNA, 19 nt, Homo sapiens
gccuuuggauuuccuguua

SEQ ID NO: 1020614 - RNA, 19 nt, Homo sapiens
gaugugccuuagaggauua

SEQ ID NO: 1020615 - RNA, 19 nt, Homo sapiens
uuaaagcucucguggcauu

SEQ ID NO: 1020616 - RNA, 19 nt, Homo sapiens
gcauauuucuucacuacug

SEQ ID NO: 1020617 - RNA, 19 nt, Homo sapiens
gcacaugaaaguuugagaa

SEQ ID NO: 1020618 - RNA, 19 nt, Homo sapiens
gaagcaucaucauagagaa

SEQ ID NO: 1020619 - RNA, 19 nt, Homo sapiens
gaugagauccaaaggaguu

SEQ ID NO: 1020620 - RNA, 19 nt, Homo sapiens
ggaacuggcauauuucuuc

SEQ ID NO: 1020621 - RNA, 19 nt, Homo sapiens
ugagaagcaucaucauaga

SEQ ID NO: 1020622 - RNA, 19 nt, Homo sapiens
caugaaaguuugagaagca

SEQ ID NO: 1020623 - RNA, 19 nt, Homo sapiens
ccaaaagagucaccuauga

SEQ ID NO: 1020624 - RNA, 19 nt, Homo sapiens
accaagagccucaacauuu

SEQ ID NO: 1020625 - RNA, 19 nt, Homo sapiens
ggaugugccuuagaggauu

SEQ ID NO: 1020626 - RNA, 19 nt, Homo sapiens
guuaccugcucauuuguuu

SEQ ID NO: 1020627 - RNA, 19 nt, Homo sapiens
guaugcacaugaaaguuug

SEQ ID NO: 1020628 - RNA, 19 nt, Homo sapiens
gaccaagagccucaacauu

SEQ ID NO: 1020629 - RNA, 19 nt, Homo sapiens
uguaguccaugcuauuaaa

SEQ ID NO: 1020630 - RNA, 19 nt, Homo sapiens
guggaucccucuuuguguu

SEQ ID NO: 1020631 - RNA, 19 nt, Homo sapiens
ugguagcacuuuauucuga

SEQ ID NO: 1020632 - RNA, 19 nt, Homo sapiens
aaacaucacacccaacuuc

SEQ ID NO: 1020633 - RNA, 19 nt, Homo sapiens
auaaguaggagaugaguuu

SEQ ID NO: 1020634 - RNA, 19 nt, Homo sapiens
gcaucaucauagagaagua

SEQ ID NO: 1020635 - RNA, 19 nt, Homo sapiens
gaaaguuugagaagcauca

SEQ ID NO: 1020636 - RNA, 19 nt, Homo sapiens
cuacuggaauuguuguuuc

SEQ ID NO: 1020637 - RNA, 19 nt, Homo sapiens
gcagugcaucgaaaccuuu

SEQ ID NO: 1020638 - RNA, 19 nt, Homo sapiens
acacccaacuuccuuaucu

SEQ ID NO: 1020639 - RNA, 19 nt, Homo sapiens
gauuacagugcauugaauu

SEQ ID NO: 1020640 - RNA, 19 nt, Homo sapiens
gcugggaugugccuuagag

SEQ ID NO: 1020641 - RNA, 19 nt, Homo sapiens
guuguaguccaugcuauua

SEQ ID NO: 1020642 - RNA, 19 nt, Homo sapiens
uuguuuggcuguucaugua

SEQ ID NO: 1020643 - RNA, 19 nt, Homo sapiens
guagcacuuuauucugauu

SEQ ID NO: 1020644 - RNA, 19 nt, Homo sapiens
ucuuagaacucauacuauc

SEQ ID NO: 1020645 - RNA, 19 nt, Homo sapiens
uguaugcacaugaaaguuu

SEQ ID NO: 1020646 - RNA, 19 nt, Homo sapiens
gagauccaaaggaguugua

SEQ ID NO: 1020647 - RNA, 19 nt, Homo sapiens
aacauuuccuagagccuua

SEQ ID NO: 1020648 - RNA, 19 nt, Homo sapiens
ugauuacagugcauugaau

SEQ ID NO: 1020649 - RNA, 19 nt, Homo sapiens
gcacuuuauucugauuaca

SEQ ID NO: 1020650 - RNA, 19 nt, Homo sapiens
uuucuucacuacuggaauu

SEQ ID NO: 1020651 - RNA, 19 nt, Homo sapiens
uggcauauuucuucacuac

SEQ ID NO: 1020652 - RNA, 19 nt, Homo sapiens
guaaacaucacacccaacu

SEQ ID NO: 1020653 - RNA, 19 nt, Homo sapiens
ggacugacuuuucuuaugc

SEQ ID NO: 1020654 - RNA, 19 nt, Homo sapiens
uccuagagccuuauuagaa

SEQ ID NO: 1020655 - RNA, 19 nt, Homo sapiens
ucacggugcucucagaaaa

SEQ ID NO: 1020656 - RNA, 19 nt, Homo sapiens
agaagcaucaucauagaga

SEQ ID NO: 1020657 - RNA, 19 nt, Homo sapiens
gaucccucuuuguguugua

SEQ ID NO: 1020658 - RNA, 19 nt, Homo sapiens
gguagcacuuuauucugau

SEQ ID NO: 1020659 - RNA, 19 nt, Homo sapiens
ucauagagaaguaaacauc

SEQ ID NO: 1020660 - RNA, 19 nt, Homo sapiens
cuagagccuuauuagaaau

SEQ ID NO: 1020661 - RNA, 19 nt, Homo sapiens
gcccuuauucguccugauu

SEQ ID NO: 1020662 - RNA, 19 nt, Homo sapiens
uggauuuccuguuauucuu

SEQ ID NO: 1020663 - RNA, 19 nt, Homo sapiens
gcagucauuuuccuuacaa

SEQ ID NO: 1020664 - RNA, 19 nt, Homo sapiens
guguggcugugaucaaaug

SEQ ID NO: 1020665 - RNA, 19 nt, Homo sapiens
ggauuuccuguuauucuug

SEQ ID NO: 1020666 - RNA, 19 nt, Homo sapiens
caacuuccuuaucuuucca

SEQ ID NO: 1020667 - RNA, 19 nt, Homo sapiens
caucacacccaacuuccuu

SEQ ID NO: 1020668 - RNA, 19 nt, Homo sapiens
caucauagagaaguaaaca

SEQ ID NO: 1020669 - RNA, 19 nt, Homo sapiens
gggaugugccuuagaggau

SEQ ID NO: 1020670 - RNA, 19 nt, Homo sapiens
cuucacuacuggaauuguu

SEQ ID NO: 1020671 - RNA, 19 nt, Homo sapiens
ggguguuaccugcucauuu

SEQ ID NO: 1020672 - RNA, 19 nt, Homo sapiens
gugcauugaauuucuuaga

SEQ ID NO: 1020673 - RNA, 19 nt, Homo sapiens
ggaagaggagaugauuuua

SEQ ID NO: 1020674 - RNA, 19 nt, Homo sapiens
cauagagaaguaaacauca

SEQ ID NO: 1020675 - RNA, 19 nt, Homo sapiens
uuugagaagcaucaucaua

SEQ ID NO: 1020676 - RNA, 19 nt, Homo sapiens
ggcguuuacuggcccuuau

SEQ ID NO: 1020677 - RNA, 19 nt, Homo sapiens
uuacuuguuuggcuguuca

SEQ ID NO: 1020678 - RNA, 19 nt, Homo sapiens
auagaccugucaaauuuag

SEQ ID NO: 1020679 - RNA, 19 nt, Homo sapiens
acagugcauugaauuucuu

SEQ ID NO: 1020680 - RNA, 19 nt, Homo sapiens
caucaucauagagaaguaa

SEQ ID NO: 1020681 - RNA, 19 nt, Homo sapiens
ucguguggcugugaucaaa

SEQ ID NO: 1020682 - RNA, 19 nt, Homo sapiens
uugagaagcaucaucauag

SEQ ID NO: 1020683 - RNA, 19 nt, Homo sapiens
uacagugcauugaauuucu

SEQ ID NO: 1020684 - RNA, 19 nt, Homo sapiens
gagaagcaucaucauagag

SEQ ID NO: 1020685 - RNA, 19 nt, Homo sapiens
ggguggaucccucuuugug

SEQ ID NO: 1020686 - RNA, 19 nt, Homo sapiens
cuuuggauuuccuguuauu

SEQ ID NO: 1020687 - RNA, 19 nt, Homo sapiens
gaagaggagaugauuuuag

SEQ ID NO: 1020688 - RNA, 19 nt, Homo sapiens
uaaaccacuuaaccucucu

SEQ ID NO: 1020689 - RNA, 19 nt, Homo sapiens
ccaacuuccuuaucuuucc

SEQ ID NO: 1020690 - RNA, 19 nt, Homo sapiens
cacccaacuuccuuaucuu

SEQ ID NO: 1020691 - RNA, 19 nt, Homo sapiens
ucagaugcaaccaguagug

SEQ ID NO: 1020692 - RNA, 19 nt, Homo sapiens
uagaacucauacuaucugu

SEQ ID NO: 1020693 - RNA, 19 nt, Homo sapiens
uagaggauuauggcguuua

SEQ ID NO: 1020694 - RNA, 19 nt, Homo sapiens
uaugcugggaugugccuua

SEQ ID NO: 1020695 - RNA, 19 nt, Homo sapiens
uaaagcucucguggcauua

SEQ ID NO: 1020696 - RNA, 19 nt, Homo sapiens
gauccaaaggaguuguaug

SEQ ID NO: 1020697 - RNA, 19 nt, Homo sapiens
ggaucccucuuuguguugu

SEQ ID NO: 1020698 - RNA, 19 nt, Homo sapiens
uuacagugcauugaauuuc

SEQ ID NO: 1020699 - RNA, 19 nt, Homo sapiens
gugcacagauucauaaauu

SEQ ID NO: 1020700 - RNA, 19 nt, Homo sapiens
ggacgagggugacaauaga

SEQ ID NO: 1020701 - RNA, 19 nt, Homo sapiens
gaaaucagacucaaaguuc

SEQ ID NO: 1020702 - RNA, 19 nt, Homo sapiens
guugucaccuguugcauua

SEQ ID NO: 1020703 - RNA, 19 nt, Homo sapiens
ggcagaagauaacuaauug

SEQ ID NO: 1020704 - RNA, 19 nt, Homo sapiens
gagaguaugugcugagaug

SEQ ID NO: 1020705 - RNA, 19 nt, Homo sapiens
guagagagcaucaggguaa

SEQ ID NO: 1020706 - RNA, 19 nt, Homo sapiens
aaucaaaccuuguaacuca

SEQ ID NO: 1020707 - RNA, 19 nt, Homo sapiens
caucaguguucaaagaaua

SEQ ID NO: 1020708 - RNA, 19 nt, Homo sapiens
ccaaggaggugcaaaugga

SEQ ID NO: 1020709 - RNA, 19 nt, Homo sapiens
uaacucacauucagaggaa

SEQ ID NO: 1020710 - RNA, 19 nt, Homo sapiens
ccuuguaacucauuuauug

SEQ ID NO: 1020711 - RNA, 19 nt, Homo sapiens
gaagacaucccuggaguga

SEQ ID NO: 1020712 - RNA, 19 nt, Homo sapiens
ggaggcagaagauaacuaa

SEQ ID NO: 1020713 - RNA, 19 nt, Homo sapiens
gaaaucaaaccuuguaacu

SEQ ID NO: 1020714 - RNA, 19 nt, Homo sapiens
guccagaucuccugaguag

SEQ ID NO: 1020715 - RNA, 19 nt, Homo sapiens
ggcguucauuucucuguua

SEQ ID NO: 1020716 - RNA, 19 nt, Homo sapiens
ucauuucucuguuaagaug

SEQ ID NO: 1020717 - RNA, 19 nt, Homo sapiens
guucauuucucuguuaaga

SEQ ID NO: 1020718 - RNA, 19 nt, Homo sapiens
acagagccauacugcguua

SEQ ID NO: 1020719 - RNA, 19 nt, Homo sapiens
gaagcgguuucuccuggaa

SEQ ID NO: 1020720 - RNA, 19 nt, Homo sapiens
agacaucccuggagugaag

SEQ ID NO: 1020721 - RNA, 19 nt, Homo sapiens
ccuaucaacucaucagugu

SEQ ID NO: 1020722 - RNA, 19 nt, Homo sapiens
agaguguggugucauguuu

SEQ ID NO: 1020723 - RNA, 19 nt, Homo sapiens
uugauuaccucuugguuug

SEQ ID NO: 1020724 - RNA, 19 nt, Homo sapiens
acucaucaguguucaaaga

SEQ ID NO: 1020725 - RNA, 19 nt, Homo sapiens
caacucaucaguguucaaa

SEQ ID NO: 1020726 - RNA, 19 nt, Homo sapiens
ccagaucuccugaguagug

SEQ ID NO: 1020727 - RNA, 19 nt, Homo sapiens
ccucaaggguucuuuaacu

SEQ ID NO: 1020728 - RNA, 19 nt, Homo sapiens
caggugcaguuggcucuua

SEQ ID NO: 1020729 - RNA, 19 nt, Homo sapiens
caaaccuuguaacucauuu

SEQ ID NO: 1020730 - RNA, 19 nt, Homo sapiens
caaccuuuccuaccagauu

SEQ ID NO: 1020731 - RNA, 19 nt, Homo sapiens
caaccugacugcgagacaa

SEQ ID NO: 1020732 - RNA, 19 nt, Homo sapiens
ugucaccuguugcauuaaa

SEQ ID NO: 1020733 - RNA, 19 nt, Homo sapiens
gcguucauuucucuguuaa

SEQ ID NO: 1020734 - RNA, 19 nt, Homo sapiens
gagccauacugcguuauag

SEQ ID NO: 1020735 - RNA, 19 nt, Homo sapiens
agaaaucagacucaaaguu

SEQ ID NO: 1020736 - RNA, 19 nt, Homo sapiens
caggugcacagauucauaa

SEQ ID NO: 1020737 - RNA, 19 nt, Homo sapiens
cagaagauaacuaauugug

SEQ ID NO: 1020738 - RNA, 19 nt, Homo sapiens
gacucaaaguuccaccaaa

SEQ ID NO: 1020739 - RNA, 19 nt, Homo sapiens
cuaauuguguugaagaaac

SEQ ID NO: 1020740 - RNA, 19 nt, Homo sapiens
ccucaaguguuguaaaauu

SEQ ID NO: 1020741 - RNA, 19 nt, Homo sapiens
gacccaagccagaggagaa

SEQ ID NO: 1020742 - RNA, 19 nt, Homo sapiens
gagagcaucaggguaaaug

SEQ ID NO: 1020743 - RNA, 19 nt, Homo sapiens
aggcagaagauaacuaauu

SEQ ID NO: 1020744 - RNA, 19 nt, Homo sapiens
uaucaacucaucaguguuc

SEQ ID NO: 1020745 - RNA, 19 nt, Homo sapiens
aauagaguguggugucaug

SEQ ID NO: 1020746 - RNA, 19 nt, Homo sapiens
gcagugcuccgcugguugu

SEQ ID NO: 1020747 - RNA, 19 nt, Homo sapiens
gaacggacgagggugacaa

SEQ ID NO: 1020748 - RNA, 19 nt, Homo sapiens
guugauuaccucuugguuu

SEQ ID NO: 1020749 - RNA, 19 nt, Homo sapiens
ugagaugcuuccgaccuuu

SEQ ID NO: 1020750 - RNA, 19 nt, Homo sapiens
gagggaggccuaaguacca

SEQ ID NO: 1020751 - RNA, 19 nt, Homo sapiens
gaucuccugaguagugauu

SEQ ID NO: 1020752 - RNA, 19 nt, Homo sapiens
cagaggaaguccagaucuc

SEQ ID NO: 1020753 - RNA, 19 nt, Homo sapiens
cuucaaaaguucacgaaaa

SEQ ID NO: 1020754 - RNA, 19 nt, Homo sapiens
acaauagagugugguguca

SEQ ID NO: 1020755 - RNA, 19 nt, Homo sapiens
gcacagauucauaaauucc

SEQ ID NO: 1020756 - RNA, 19 nt, Homo sapiens
ggccaccuaucaacucauc

SEQ ID NO: 1020757 - RNA, 19 nt, Homo sapiens
caggguaaauggcguucau

SEQ ID NO: 1020758 - RNA, 19 nt, Homo sapiens
gcagaagauaacuaauugu

SEQ ID NO: 1020759 - RNA, 19 nt, Homo sapiens
cagaucuccugaguaguga

SEQ ID NO: 1020760 - RNA, 19 nt, Homo sapiens
uagagagcaucaggguaaa

SEQ ID NO: 1020761 - RNA, 19 nt, Homo sapiens
acucaaaguuccaccaaaa

SEQ ID NO: 1020762 - RNA, 19 nt, Homo sapiens
acaggugcacagauucaua

SEQ ID NO: 1020763 - RNA, 19 nt, Homo sapiens
ucaaaccuuguaacucauu

SEQ ID NO: 1020764 - RNA, 19 nt, Homo sapiens
ucaaggguucuuuaacuca

SEQ ID NO: 1020765 - RNA, 19 nt, Homo sapiens
ccuguugcauuaaacuugu

SEQ ID NO: 1020766 - RNA, 19 nt, Homo sapiens
ucaucaguguucaaagaau

SEQ ID NO: 1020767 - RNA, 19 nt, Homo sapiens
uccaggaggcagaagauaa

SEQ ID NO: 1020768 - RNA, 19 nt, Homo sapiens
cugagaugcuuccgaccuu

SEQ ID NO: 1020769 - RNA, 19 nt, Homo sapiens
agagccauacugcguuaua

SEQ ID NO: 1020770 - RNA, 19 nt, Homo sapiens
agaccguugucaccuguug

SEQ ID NO: 1020771 - RNA, 19 nt, Homo sapiens
gcugggagcaugggugaga

SEQ ID NO: 1020772 - RNA, 19 nt, Homo sapiens
gagggugacaauagagugu

SEQ ID NO: 1020773 - RNA, 19 nt, Homo sapiens
gagaugcuuccgaccuuuc

SEQ ID NO: 1020774 - RNA, 19 nt, Homo sapiens
gagaaaucagacucaaagu

SEQ ID NO: 1020775 - RNA, 19 nt, Homo sapiens
ggccuaaguaccacucaug

SEQ ID NO: 1020776 - RNA, 19 nt, Homo sapiens
uaccucaaguguuguaaaa

SEQ ID NO: 1020777 - RNA, 19 nt, Homo sapiens
cgcuguggauggcugcuuu

SEQ ID NO: 1020778 - RNA, 19 nt, Homo sapiens
ugauuuuggugacaaguuu

SEQ ID NO: 1020779 - RNA, 19 nt, Homo sapiens
gggcauaaauuguaacaua

SEQ ID NO: 1020780 - RNA, 19 nt, Homo sapiens
gaagucaccuuaaagagaa

SEQ ID NO: 1020781 - RNA, 19 nt, Homo sapiens
ggaauuuggugcucacuuu

SEQ ID NO: 1020782 - RNA, 19 nt, Homo sapiens
gaaacgccaucccuacuaa

SEQ ID NO: 1020783 - RNA, 19 nt, Homo sapiens
gagcuuugguccuguguua

SEQ ID NO: 1020784 - RNA, 19 nt, Homo sapiens
gcagagagcugucauuacu

SEQ ID NO: 1020785 - RNA, 19 nt, Homo sapiens
ccaaauuucuuaucacuga

SEQ ID NO: 1020786 - RNA, 19 nt, Homo sapiens
gcuaugggcucaagucuga

SEQ ID NO: 1020787 - RNA, 19 nt, Homo sapiens
caagagagguuagggaauu

SEQ ID NO: 1020788 - RNA, 19 nt, Homo sapiens
gaccagcgcuuaucuuuca

SEQ ID NO: 1020789 - RNA, 19 nt, Homo sapiens
gggcauccauuguguguaa

SEQ ID NO: 1020790 - RNA, 19 nt, Homo sapiens
ucacagccuuguaugaaua

SEQ ID NO: 1020791 - RNA, 19 nt, Homo sapiens
aaagguaccuguuauguuc

SEQ ID NO: 1020792 - RNA, 19 nt, Homo sapiens
guuagugacuccucuguuu

SEQ ID NO: 1020793 - RNA, 19 nt, Homo sapiens
gauagaaucagaccuuaaa

SEQ ID NO: 1020794 - RNA, 19 nt, Homo sapiens
gcaaggcucuguuuuguuu

SEQ ID NO: 1020795 - RNA, 19 nt, Homo sapiens
gaucuuguguggcgucauu

SEQ ID NO: 1020796 - RNA, 19 nt, Homo sapiens
ggagaagaaucacuuaaac

SEQ ID NO: 1020797 - RNA, 19 nt, Homo sapiens
gaagaaauugggauacuug

SEQ ID NO: 1020798 - RNA, 19 nt, Homo sapiens
gagcauccuuuaaugaguu

SEQ ID NO: 1020799 - RNA, 19 nt, Homo sapiens
gagccaagcugguggaagu

SEQ ID NO: 1020800 - RNA, 19 nt, Homo sapiens
gcugaaauguuuaaugauc

SEQ ID NO: 1020801 - RNA, 19 nt, Homo sapiens
ggauaauuguugauaguug

SEQ ID NO: 1020802 - RNA, 19 nt, Homo sapiens
gagaccagauuuacuuguu

SEQ ID NO: 1020803 - RNA, 19 nt, Homo sapiens
gaaagguaccuguuauguu

SEQ ID NO: 1020804 - RNA, 19 nt, Homo sapiens
gguccuguguuauuacuaa

SEQ ID NO: 1020805 - RNA, 19 nt, Homo sapiens
gaucaggaguuugagacua

SEQ ID NO: 1020806 - RNA, 19 nt, Homo sapiens
cagcccagguuucuagaua

SEQ ID NO: 1020807 - RNA, 19 nt, Homo sapiens
ccuguucacuugcaguuua

SEQ ID NO: 1020808 - RNA, 19 nt, Homo sapiens
gagaguaaccuuaacuaau

SEQ ID NO: 1020809 - RNA, 19 nt, Homo sapiens
gaaacaggcgcaucggaaa

SEQ ID NO: 1020810 - RNA, 19 nt, Homo sapiens
cugcugaaauguuuaauga

SEQ ID NO: 1020811 - RNA, 19 nt, Homo sapiens
ccacagugcagcuugguua

SEQ ID NO: 1020812 - RNA, 19 nt, Homo sapiens
guaagagugugaaucuguu

SEQ ID NO: 1020813 - RNA, 19 nt, Homo sapiens
ucaguugguuccaguguuu

SEQ ID NO: 1020814 - RNA, 19 nt, Homo sapiens
gggagaagaaucacuuaaa

SEQ ID NO: 1020815 - RNA, 19 nt, Homo sapiens
ucaagggacucuuuguguu

SEQ ID NO: 1020816 - RNA, 19 nt, Homo sapiens
gcuagacagucaauguuug

SEQ ID NO: 1020817 - RNA, 19 nt, Homo sapiens
cuagaaagguaccuguuau

SEQ ID NO: 1020818 - RNA, 19 nt, Homo sapiens
guggagugauggugucaua

SEQ ID NO: 1020819 - RNA, 19 nt, Homo sapiens
ccaguaacuucacauccua

SEQ ID NO: 1020820 - RNA, 19 nt, Homo sapiens
gcacacaugcacacgaauu

SEQ ID NO: 1020821 - RNA, 19 nt, Homo sapiens
caagaagccgaacgugaua

SEQ ID NO: 1020822 - RNA, 19 nt, Homo sapiens
gagcacccaucuuguguca

SEQ ID NO: 1020823 - RNA, 19 nt, Homo sapiens
ccagcacacugaaggaauu

SEQ ID NO: 1020824 - RNA, 19 nt, Homo sapiens
ggagugauggugucauaaa

SEQ ID NO: 1020825 - RNA, 19 nt, Homo sapiens
aaagaaagagaccagauuu

SEQ ID NO: 1020826 - RNA, 19 nt, Homo sapiens
ugaagggccuauauaaauc

SEQ ID NO: 1020827 - RNA, 19 nt, Homo sapiens
caagggacucuuuguguuu

SEQ ID NO: 1020828 - RNA, 19 nt, Homo sapiens
gaaauuuccguaagagugu

SEQ ID NO: 1020829 - RNA, 19 nt, Homo sapiens
uaaagaaagagaccagauu

SEQ ID NO: 1020830 - RNA, 19 nt, Homo sapiens
gcaguauaauucuucuaug

SEQ ID NO: 1020831 - RNA, 19 nt, Homo sapiens
caaagugaaauuuccguaa

SEQ ID NO: 1020832 - RNA, 19 nt, Homo sapiens
ggaggggaaucauguuaua

SEQ ID NO: 1020833 - RNA, 19 nt, Homo sapiens
cagcugggauuacagguau

SEQ ID NO: 1020834 - RNA, 19 nt, Homo sapiens
aaagagaccagauuuacuu

SEQ ID NO: 1020835 - RNA, 19 nt, Homo sapiens
uauccucucuccuuaaaug

SEQ ID NO: 1020836 - RNA, 19 nt, Homo sapiens
ggaaguugguugcagaaac

SEQ ID NO: 1020837 - RNA, 19 nt, Homo sapiens
guugauaguugacuuagca

SEQ ID NO: 1020838 - RNA, 19 nt, Homo sapiens
ccagcuguauguaagaauu

SEQ ID NO: 1020839 - RNA, 19 nt, Homo sapiens
gccaaggccugugugguuu

SEQ ID NO: 1020840 - RNA, 19 nt, Homo sapiens
cagugcagcuugguuaauu

SEQ ID NO: 1020841 - RNA, 19 nt, Homo sapiens
gacagucaauguuuguuca

SEQ ID NO: 1020842 - RNA, 19 nt, Homo sapiens
auaaggcacugucguucua

SEQ ID NO: 1020843 - RNA, 19 nt, Homo sapiens
gguggagacaggcuucuua

SEQ ID NO: 1020844 - RNA, 19 nt, Homo sapiens
aaaaucagcuugucuuguu

SEQ ID NO: 1020845 - RNA, 19 nt, Homo sapiens
cugucuagcuuuaggauaa

SEQ ID NO: 1020846 - RNA, 19 nt, Homo sapiens
gaccagauuuacuuguuuc

SEQ ID NO: 1020847 - RNA, 19 nt, Homo sapiens
guacuucacagccuuguau

SEQ ID NO: 1020848 - RNA, 19 nt, Homo sapiens
ugaagucaccuuaaagaga

SEQ ID NO: 1020849 - RNA, 19 nt, Homo sapiens
agacauaacuugauauccu

SEQ ID NO: 1020850 - RNA, 19 nt, Homo sapiens
ugugauagaucucaguuca

SEQ ID NO: 1020851 - RNA, 19 nt, Homo sapiens
guucauaggagaauugaga

SEQ ID NO: 1020852 - RNA, 19 nt, Homo sapiens
uggcuugccucauauaugu

SEQ ID NO: 1020853 - RNA, 19 nt, Homo sapiens
ggagacaggcuucuuaggu

SEQ ID NO: 1020854 - RNA, 19 nt, Homo sapiens
gcuacacaguauauuaguu

SEQ ID NO: 1020855 - RNA, 19 nt, Homo sapiens
gcaccuugcuguuuucauu

SEQ ID NO: 1020856 - RNA, 19 nt, Homo sapiens
agucugaagucaccuuaaa

SEQ ID NO: 1020857 - RNA, 19 nt, Homo sapiens
ugagagaguugguaaucau

SEQ ID NO: 1020858 - RNA, 19 nt, Homo sapiens
ccugugugguuucaucaua

SEQ ID NO: 1020859 - RNA, 19 nt, Homo sapiens
aaacuaaccagcugggauu

SEQ ID NO: 1020860 - RNA, 19 nt, Homo sapiens
ggcacuuuauucuucuuua

SEQ ID NO: 1020861 - RNA, 19 nt, Homo sapiens
gcaaagauaaccacuagac

SEQ ID NO: 1020862 - RNA, 19 nt, Homo sapiens
gaaagagaccagauuuacu

SEQ ID NO: 1020863 - RNA, 19 nt, Homo sapiens
uaucagccuuuauacuuug

SEQ ID NO: 1020864 - RNA, 19 nt, Homo sapiens
gacuggguauucugcuaua

SEQ ID NO: 1020865 - RNA, 19 nt, Homo sapiens
auaaugggauguucuaagu

SEQ ID NO: 1020866 - RNA, 19 nt, Homo sapiens
gugcuucacugucuagcuu

SEQ ID NO: 1020867 - RNA, 19 nt, Homo sapiens
agaccagauuuacuuguuu

SEQ ID NO: 1020868 - RNA, 19 nt, Homo sapiens
gagaguugguaaucaugga

SEQ ID NO: 1020869 - RNA, 19 nt, Homo sapiens
uaaggcagguccagaggau

SEQ ID NO: 1020870 - RNA, 19 nt, Homo sapiens
gagaucuucagacagaaua

SEQ ID NO: 1020871 - RNA, 19 nt, Homo sapiens
gcuucacugucuagcuuua

SEQ ID NO: 1020872 - RNA, 19 nt, Homo sapiens
aaagugaaauuuccguaag

SEQ ID NO: 1020873 - RNA, 19 nt, Homo sapiens
ccagcuaugucaaagugaa

SEQ ID NO: 1020874 - RNA, 19 nt, Homo sapiens
aagaaagagaccagauuua

SEQ ID NO: 1020875 - RNA, 19 nt, Homo sapiens
ccuucuggcuuguggcuua

SEQ ID NO: 1020876 - RNA, 19 nt, Homo sapiens
gugguuucaucauagauuu

SEQ ID NO: 1020877 - RNA, 19 nt, Homo sapiens
ugaagaaauugggauacuu

SEQ ID NO: 1020878 - RNA, 19 nt, Homo sapiens
ucuagaaagguaccuguua

SEQ ID NO: 1020879 - RNA, 19 nt, Homo sapiens
ggagagacuuccaguaaua

SEQ ID NO: 1020880 - RNA, 19 nt, Homo sapiens
caggaaaccuuuaccauaa

SEQ ID NO: 1020881 - RNA, 19 nt, Homo sapiens
ggagugauguuucagauug

SEQ ID NO: 1020882 - RNA, 19 nt, Homo sapiens
ucaggacacucauccauua

SEQ ID NO: 1020883 - RNA, 19 nt, Homo sapiens
ggacuagaguucccucgua

SEQ ID NO: 1020884 - RNA, 19 nt, Homo sapiens
gcaagaguauugauguaug

SEQ ID NO: 1020885 - RNA, 19 nt, Homo sapiens
gcaaggcaguuuagagaau

SEQ ID NO: 1020886 - RNA, 19 nt, Homo sapiens
cagcaaguauuuauuguug

SEQ ID NO: 1020887 - RNA, 19 nt, Homo sapiens
uaaaucccuuccagacuua

SEQ ID NO: 1020888 - RNA, 19 nt, Homo sapiens
gcaugcauuucucacaaua

SEQ ID NO: 1020889 - RNA, 19 nt, Homo sapiens
gagcaugcauuucucacaa

SEQ ID NO: 1020890 - RNA, 19 nt, Homo sapiens
gaagaccaguacuccauug

SEQ ID NO: 1020891 - RNA, 19 nt, Homo sapiens
gucaagaugugaaugcuaa

SEQ ID NO: 1020892 - RNA, 19 nt, Homo sapiens
ccaggaaaccuuuaccaua

SEQ ID NO: 1020893 - RNA, 19 nt, Homo sapiens
ggagauggauaugagacua

SEQ ID NO: 1020894 - RNA, 19 nt, Homo sapiens
ucagcuagauccuaugaaa

SEQ ID NO: 1020895 - RNA, 19 nt, Homo sapiens
gagcaaggcaguuuagaga

SEQ ID NO: 1020896 - RNA, 19 nt, Homo sapiens
uuaggaagaugcacauuga

SEQ ID NO: 1020897 - RNA, 19 nt, Homo sapiens
guauaaggauggagugaug

SEQ ID NO: 1020898 - RNA, 19 nt, Homo sapiens
gcacggguauacacauaau

SEQ ID NO: 1020899 - RNA, 19 nt, Homo sapiens
aaacuacagugugauauug

SEQ ID NO: 1020900 - RNA, 19 nt, Homo sapiens
gauauugucuacgcgguuu

SEQ ID NO: 1020901 - RNA, 19 nt, Homo sapiens
uggcauggcccaauugaua

SEQ ID NO: 1020902 - RNA, 19 nt, Homo sapiens
cuuccagacuuaagaauuu

SEQ ID NO: 1020903 - RNA, 19 nt, Homo sapiens
uuaaaucccuuccagacuu

SEQ ID NO: 1020904 - RNA, 19 nt, Homo sapiens
aaagucagcuagauccuau

SEQ ID NO: 1020905 - RNA, 19 nt, Homo sapiens
ggacagaaagucagcuaga

SEQ ID NO: 1020906 - RNA, 19 nt, Homo sapiens
ucacagacuugucaauaca

SEQ ID NO: 1020907 - RNA, 19 nt, Homo sapiens
caagaguauugauguaugu

SEQ ID NO: 1020908 - RNA, 19 nt, Homo sapiens
ggaagggucaguaagagaa

SEQ ID NO: 1020909 - RNA, 19 nt, Homo sapiens
acggguaccuuguauguuu

SEQ ID NO: 1020910 - RNA, 19 nt, Homo sapiens
ggacacucauccauuaucu

SEQ ID NO: 1020911 - RNA, 19 nt, Homo sapiens
uaaccucucugucugacuu

SEQ ID NO: 1020912 - RNA, 19 nt, Homo sapiens
gauaugagacuagucaaga

SEQ ID NO: 1020913 - RNA, 19 nt, Homo sapiens
gggagagacuuccaguaau

SEQ ID NO: 1020914 - RNA, 19 nt, Homo sapiens
gaaagucagcuagauccua

SEQ ID NO: 1020915 - RNA, 19 nt, Homo sapiens
caggucagcucauucacaa

SEQ ID NO: 1020916 - RNA, 19 nt, Homo sapiens
cauaaacuacagugugaua

SEQ ID NO: 1020917 - RNA, 19 nt, Homo sapiens
uaaaguguuucaugugauc

SEQ ID NO: 1020918 - RNA, 19 nt, Homo sapiens
ucacuccuuuggucauuaa

SEQ ID NO: 1020919 - RNA, 19 nt, Homo sapiens
ugaaugugguugaguuugu

SEQ ID NO: 1020920 - RNA, 19 nt, Homo sapiens
ggagacaggagacuauugu

SEQ ID NO: 1020921 - RNA, 19 nt, Homo sapiens
uaagcugugugauaauuuc

SEQ ID NO: 1020922 - RNA, 19 nt, Homo sapiens
gcaaguauuuauuguugac

SEQ ID NO: 1020923 - RNA, 19 nt, Homo sapiens
ggauuggcaucuauacagu

SEQ ID NO: 1020924 - RNA, 19 nt, Homo sapiens
gacagaaagucagcuagau

SEQ ID NO: 1020925 - RNA, 19 nt, Homo sapiens
gagagacuuccaguaauaa

SEQ ID NO: 1020926 - RNA, 19 nt, Homo sapiens
ggucagcucauucacaaga

SEQ ID NO: 1020927 - RNA, 19 nt, Homo sapiens
gcauggcccaauugauaua

SEQ ID NO: 1020928 - RNA, 19 nt, Homo sapiens
uaucugcccauuuaucuuu

SEQ ID NO: 1020929 - RNA, 19 nt, Homo sapiens
gaagggacaggaagcacuu

SEQ ID NO: 1020930 - RNA, 19 nt, Homo sapiens
gcacgagccauguaagcuu

SEQ ID NO: 1020931 - RNA, 19 nt, Homo sapiens
ucuauacagucaaggauug

SEQ ID NO: 1020932 - RNA, 19 nt, Homo sapiens
gagugauguuucagauuga

SEQ ID NO: 1020933 - RNA, 19 nt, Homo sapiens
gaagaaugccagccucucu

SEQ ID NO: 1020934 - RNA, 19 nt, Homo sapiens
gcagcaaguauuuauuguu

SEQ ID NO: 1020935 - RNA, 19 nt, Homo sapiens
gcgaggguguggccauaug

SEQ ID NO: 1020936 - RNA, 19 nt, Homo sapiens
cauagucagugcccuaagu

SEQ ID NO: 1020937 - RNA, 19 nt, Homo sapiens
cagguuauguaccagcaaa

SEQ ID NO: 1020938 - RNA, 19 nt, Homo sapiens
gcauagcacgagccaugua

SEQ ID NO: 1020939 - RNA, 19 nt, Homo sapiens
aaaccuggauuggcaucua

SEQ ID NO: 1020940 - RNA, 19 nt, Homo sapiens
cggguaccuuguauguuua

SEQ ID NO: 1020941 - RNA, 19 nt, Homo sapiens
ugauguaugugcugaaucu

SEQ ID NO: 1020942 - RNA, 19 nt, Homo sapiens
gcacuuuggccuuccuaga

SEQ ID NO: 1020943 - RNA, 19 nt, Homo sapiens
accauaaacuacaguguga

SEQ ID NO: 1020944 - RNA, 19 nt, Homo sapiens
agggagagacuuccaguaa

SEQ ID NO: 1020945 - RNA, 19 nt, Homo sapiens
uccauuaucuuggcuguga

SEQ ID NO: 1020946 - RNA, 19 nt, Homo sapiens
acacucauccauuaucuug

SEQ ID NO: 1020947 - RNA, 19 nt, Homo sapiens
caaggcaguuuagagaauc

SEQ ID NO: 1020948 - RNA, 19 nt, Homo sapiens
gacauccagcuggguauua

SEQ ID NO: 1020949 - RNA, 19 nt, Homo sapiens
ucccaagccuggaugaguu

SEQ ID NO: 1020950 - RNA, 19 nt, Homo sapiens
uggagaagaugagcgaaga

SEQ ID NO: 1020951 - RNA, 19 nt, Homo sapiens
acauccagcuggguauuaa

SEQ ID NO: 1020952 - RNA, 19 nt, Homo sapiens
gccacugcauuuccuguug

SEQ ID NO: 1020953 - RNA, 19 nt, Homo sapiens
uguuuuaucugcccauuua

SEQ ID NO: 1020954 - RNA, 19 nt, Homo sapiens
gugauaauuucugcuuuca

SEQ ID NO: 1020955 - RNA, 19 nt, Homo sapiens
gcaccacugccacugcauu

SEQ ID NO: 1020956 - RNA, 19 nt, Homo sapiens
agaaggaaaugaaaagcua

SEQ ID NO: 1020957 - RNA, 19 nt, Homo sapiens
acacuuuggguauuucuaa

SEQ ID NO: 1020958 - RNA, 19 nt, Homo sapiens
uuaguuaccaggagaaaug

SEQ ID NO: 1020959 - RNA, 19 nt, Homo sapiens
gcccauuuaucuuucuuag

SEQ ID NO: 1020960 - RNA, 19 nt, Homo sapiens
ggcagcaaguauuuauugu

SEQ ID NO: 1020961 - RNA, 19 nt, Homo sapiens
guuauguaccagcaaagua

SEQ ID NO: 1020962 - RNA, 19 nt, Homo sapiens
ugugauaauuucugcuuuc

SEQ ID NO: 1020963 - RNA, 19 nt, Homo sapiens
cuucacagacuugucaaua

SEQ ID NO: 1020964 - RNA, 19 nt, Homo sapiens
ugucuacacuggcauagca

SEQ ID NO: 1020965 - RNA, 19 nt, Homo sapiens
gcuaauuggagagaaauau

SEQ ID NO: 1020966 - RNA, 19 nt, Homo sapiens
caaagaugacccugacaca

SEQ ID NO: 1020967 - RNA, 19 nt, Homo sapiens
uuaaauucccugcagagaa

SEQ ID NO: 1020968 - RNA, 19 nt, Homo sapiens
cauagggaagggucaguaa

SEQ ID NO: 1020969 - RNA, 19 nt, Homo sapiens
uauggacacuuuggguauu

SEQ ID NO: 1020970 - RNA, 19 nt, Homo sapiens
caagaugugaaugcuaauu

SEQ ID NO: 1020971 - RNA, 19 nt, Homo sapiens
ggacaggaagcacuuuggu

SEQ ID NO: 1020972 - RNA, 19 nt, Homo sapiens
uuccuuauguguugaaugu

SEQ ID NO: 1020973 - RNA, 19 nt, Homo sapiens
cauagcacgagccauguaa

SEQ ID NO: 1020974 - RNA, 19 nt, Homo sapiens
aaugcuaauuggagagaaa

SEQ ID NO: 1020975 - RNA, 19 nt, Homo sapiens
gaaugcuaauuggagagaa

SEQ ID NO: 1020976 - RNA, 19 nt, Homo sapiens
uacacaggcaguauucuaa

SEQ ID NO: 1020977 - RNA, 19 nt, Homo sapiens
augcaagaguauugaugua

SEQ ID NO: 1020978 - RNA, 19 nt, Homo sapiens
uggcagcaaguauuuauug

SEQ ID NO: 1020979 - RNA, 19 nt, Homo sapiens
gcaagcagccggucaguuu

SEQ ID NO: 1020980 - RNA, 19 nt, Homo sapiens
ggaggaggcuguacugaag

SEQ ID NO: 1020981 - RNA, 19 nt, Homo sapiens
gcaauuuggucaacuucuu

SEQ ID NO: 1020982 - RNA, 19 nt, Homo sapiens
gggucuaggucccucauua

SEQ ID NO: 1020983 - RNA, 19 nt, Homo sapiens
gugcaagcccuacaaauuu

SEQ ID NO: 1020984 - RNA, 19 nt, Homo sapiens
ugauggagcuaaagccuaa

SEQ ID NO: 1020985 - RNA, 19 nt, Homo sapiens
cagcaucucugccuucuca

SEQ ID NO: 1020986 - RNA, 19 nt, Homo sapiens
uuaaagaacugcaggucaa

SEQ ID NO: 1020987 - RNA, 19 nt, Homo sapiens
gagcacaccgucaacaauu

SEQ ID NO: 1020988 - RNA, 19 nt, Homo sapiens
cuaggucccucauuaaaga

SEQ ID NO: 1020989 - RNA, 19 nt, Homo sapiens
ggugcaagcccuacaaauu

SEQ ID NO: 1020990 - RNA, 19 nt, Homo sapiens
gcaaagaaucguccaugga

SEQ ID NO: 1020991 - RNA, 19 nt, Homo sapiens
gcacuacugucaagcugau

SEQ ID NO: 1020992 - RNA, 19 nt, Homo sapiens
ccaagacacaggagaauga

SEQ ID NO: 1020993 - RNA, 19 nt, Homo sapiens
guccauggaucuucaacaa

SEQ ID NO: 1020994 - RNA, 19 nt, Homo sapiens
caaagaaucguccauggau

SEQ ID NO: 1020995 - RNA, 19 nt, Homo sapiens
gaccgucacuaccaaagga

SEQ ID NO: 1020996 - RNA, 19 nt, Homo sapiens
gaaagaaaacuucaacaug

SEQ ID NO: 1020997 - RNA, 19 nt, Homo sapiens
ggucuaggucccucauuaa

SEQ ID NO: 1020998 - RNA, 19 nt, Homo sapiens
ugaagccgcugccaguaga

SEQ ID NO: 1020999 - RNA, 19 nt, Homo sapiens
cagaggcacuccaucaagu

SEQ ID NO: 1021000 - RNA, 19 nt, Homo sapiens
gaugaaugcccuugaccaa

SEQ ID NO: 1021001 - RNA, 19 nt, Homo sapiens
ggacaccccucaccuacuu

SEQ ID NO: 1021002 - RNA, 19 nt, Homo sapiens
gcagcuuuccugagaacua

SEQ ID NO: 1021003 - RNA, 19 nt, Homo sapiens
caugagaccuaccauacca

SEQ ID NO: 1021004 - RNA, 19 nt, Homo sapiens
gggaggaggcuguacugaa

SEQ ID NO: 1021005 - RNA, 19 nt, Homo sapiens
uugcaacccuggccacuga

SEQ ID NO: 1021006 - RNA, 19 nt, Homo sapiens
ugaaugcccuugaccaacu

SEQ ID NO: 1021007 - RNA, 19 nt, Homo sapiens
caucagaggcacuccauca

SEQ ID NO: 1021008 - RNA, 19 nt, Homo sapiens
acccugagcuggagacaga

SEQ ID NO: 1021009 - RNA, 19 nt, Homo sapiens
auaccuauuucccuguuaa

SEQ ID NO: 1021010 - RNA, 19 nt, Homo sapiens
ugcaagcccuacaaauuug

SEQ ID NO: 1021011 - RNA, 19 nt, Homo sapiens
caacagcagcuucuuugca

SEQ ID NO: 1021012 - RNA, 19 nt, Homo sapiens
gcugaaccccaucaaauua

SEQ ID NO: 1021013 - RNA, 19 nt, Homo sapiens
gacugcagcucugaugaga

SEQ ID NO: 1021014 - RNA, 19 nt, Homo sapiens
ucagaaaccagagccauga

SEQ ID NO: 1021015 - RNA, 19 nt, Homo sapiens
ucaccuacuuucagcuuca

SEQ ID NO: 1021016 - RNA, 19 nt, Homo sapiens
agacacaggagaaugaguu

SEQ ID NO: 1021017 - RNA, 19 nt, Homo sapiens
gauaccaucaaccuacuga

SEQ ID NO: 1021018 - RNA, 19 nt, Homo sapiens
aggcuguacugaagaaaga

SEQ ID NO: 1021019 - RNA, 19 nt, Homo sapiens
gcuggaggaucuggaauac

SEQ ID NO: 1021020 - RNA, 19 nt, Homo sapiens
ggugucaucccgaacaaau

SEQ ID NO: 1021021 - RNA, 19 nt, Homo sapiens
gaaugcccuugaccaacug

SEQ ID NO: 1021022 - RNA, 19 nt, Homo sapiens
ucuaccagcuccuguuaca

SEQ ID NO: 1021023 - RNA, 19 nt, Homo sapiens
gcccaacagcagcuucuuu

SEQ ID NO: 1021024 - RNA, 19 nt, Homo sapiens
uaccaaaggacucccacua

SEQ ID NO: 1021025 - RNA, 19 nt, Homo sapiens
ucaacgcacucagaaucuu

SEQ ID NO: 1021026 - RNA, 19 nt, Homo sapiens
uaaagaacugcaggucaaa

SEQ ID NO: 1021027 - RNA, 19 nt, Homo sapiens
gccaugagaccuaccauac

SEQ ID NO: 1021028 - RNA, 19 nt, Homo sapiens
ggcuggaggaucuggaaua

SEQ ID NO: 1021029 - RNA, 19 nt, Homo sapiens
caauuuggucaacuucuug

SEQ ID NO: 1021030 - RNA, 19 nt, Homo sapiens
ucaacuucuuggaggauga

SEQ ID NO: 1021031 - RNA, 19 nt, Homo sapiens
aaucguccauggaucuuca

SEQ ID NO: 1021032 - RNA, 19 nt, Homo sapiens
ccucaacgcacucagaauc

SEQ ID NO: 1021033 - RNA, 19 nt, Homo sapiens
ugaacaaacucagcuucuc

SEQ ID NO: 1021034 - RNA, 19 nt, Homo sapiens
ccaagaaugcagaaaauga

SEQ ID NO: 1021035 - RNA, 19 nt, Homo sapiens
uggaggaucuggaauaccu

SEQ ID NO: 1021036 - RNA, 19 nt, Homo sapiens
caacgcacucagaaucuuc

SEQ ID NO: 1021037 - RNA, 19 nt, Homo sapiens
ggccaagaaugcagaaaau

SEQ ID NO: 1021038 - RNA, 19 nt, Homo sapiens
cagcagcuuuccugagaac

SEQ ID NO: 1021039 - RNA, 19 nt, Homo sapiens
uacaggagguggccaagac

SEQ ID NO: 1021040 - RNA, 19 nt, Homo sapiens
agacagaaaccuccucaac

SEQ ID NO: 1021041 - RNA, 19 nt, Homo sapiens
gaaaacuucaacaugauga

SEQ ID NO: 1021042 - RNA, 19 nt, Homo sapiens
cccaacagcagcuucuuug

SEQ ID NO: 1021043 - RNA, 19 nt, Homo sapiens
cccaucaaauuagcuguga

SEQ ID NO: 1021044 - RNA, 19 nt, Homo sapiens
gaggaucuggaauaccuau

SEQ ID NO: 1021045 - RNA, 19 nt, Homo sapiens
gucuaggucccucauuaaa

SEQ ID NO: 1021046 - RNA, 19 nt, Homo sapiens
ggcaaaagaucguguccau

SEQ ID NO: 1021047 - RNA, 19 nt, Homo sapiens
gaggaggcuguacugaaga

SEQ ID NO: 1021048 - RNA, 19 nt, Homo sapiens
aggaggcuguacugaagaa

SEQ ID NO: 1021049 - RNA, 19 nt, Homo sapiens
caugaugaaugcccuugac

SEQ ID NO: 1021050 - RNA, 19 nt, Homo sapiens
ugucaucccgaacaaauca

SEQ ID NO: 1021051 - RNA, 19 nt, Homo sapiens
gaacuaccccauccagauc

SEQ ID NO: 1021052 - RNA, 19 nt, Homo sapiens
cagcuuuccugagaacuac

SEQ ID NO: 1021053 - RNA, 19 nt, Homo sapiens
ccacugcccacagcugcua

SEQ ID NO: 1021054 - RNA, 19 nt, Homo sapiens
gaggcuggaggaucuggaa

SEQ ID NO: 1021055 - RNA, 19 nt, Homo sapiens
gcuguacugaagaaagaaa

SEQ ID NO: 1021056 - RNA, 19 nt, Homo sapiens
gacacaggagaaugaguug

SEQ ID NO: 1021057 - RNA, 19 nt, Homo sapiens
uuucuaccagcuccuguua

SEQ ID NO: 1021058 - RNA, 19 nt, Homo sapiens
gaugagagauuucuuauug

SEQ ID NO: 1021059 - RNA, 19 nt, Homo sapiens
gaagauaccugcacuaauc

SEQ ID NO: 1021060 - RNA, 19 nt, Homo sapiens
gaaaugagucucuguguua

SEQ ID NO: 1021061 - RNA, 19 nt, Homo sapiens
gacaacagcuugccaaauu

SEQ ID NO: 1021062 - RNA, 19 nt, Homo sapiens
gcagagagcuugcuaugug

SEQ ID NO: 1021063 - RNA, 19 nt, Homo sapiens
gaaagugacugaauauaca

SEQ ID NO: 1021064 - RNA, 19 nt, Homo sapiens
ucaagaaagugacugaaua

SEQ ID NO: 1021065 - RNA, 19 nt, Homo sapiens
caacaucaccuucaaauau

SEQ ID NO: 1021066 - RNA, 19 nt, Homo sapiens
gaacuggaauggaaucuca

SEQ ID NO: 1021067 - RNA, 19 nt, Homo sapiens
gagagugacuucugccuaa

SEQ ID NO: 1021068 - RNA, 19 nt, Homo sapiens
uaauugagcugguggauga

SEQ ID NO: 1021069 - RNA, 19 nt, Homo sapiens
gaaaucaagugccagucua

SEQ ID NO: 1021070 - RNA, 19 nt, Homo sapiens
gagaaugggucauccagaa

SEQ ID NO: 1021071 - RNA, 19 nt, Homo sapiens
caagaaaagugaugcauua

SEQ ID NO: 1021072 - RNA, 19 nt, Homo sapiens
guacaucucucacuaccuu

SEQ ID NO: 1021073 - RNA, 19 nt, Homo sapiens
cagcuggucuguauuauug

SEQ ID NO: 1021074 - RNA, 19 nt, Homo sapiens
gcuauuggcuaccuugauu

SEQ ID NO: 1021075 - RNA, 19 nt, Homo sapiens
caaaagaacuggaauggaa

SEQ ID NO: 1021076 - RNA, 19 nt, Homo sapiens
cgaagcagcucaacaguag

SEQ ID NO: 1021077 - RNA, 19 nt, Homo sapiens
ccaaagguaugaaguacuu

SEQ ID NO: 1021078 - RNA, 19 nt, Homo sapiens
gccaacaacugauucuaaa

SEQ ID NO: 1021079 - RNA, 19 nt, Homo sapiens
ggaauggaaucucaaccuu

SEQ ID NO: 1021080 - RNA, 19 nt, Homo sapiens
gggcagaggugaaucagau

SEQ ID NO: 1021081 - RNA, 19 nt, Homo sapiens
cagaauaaauugagaaguc

SEQ ID NO: 1021082 - RNA, 19 nt, Homo sapiens
cagcuuuguucaugaaaua

SEQ ID NO: 1021083 - RNA, 19 nt, Homo sapiens
gaagaacuacaaacacaaa

SEQ ID NO: 1021084 - RNA, 19 nt, Homo sapiens
guuggugucuggaaguuua

SEQ ID NO: 1021085 - RNA, 19 nt, Homo sapiens
cgaaagagucuaagcauug

SEQ ID NO: 1021086 - RNA, 19 nt, Homo sapiens
gaacucacuccuuaagaaa

SEQ ID NO: 1021087 - RNA, 19 nt, Homo sapiens
guccaaacuugcuaacaua

SEQ ID NO: 1021088 - RNA, 19 nt, Homo sapiens
cauacucacugcucuguaa

SEQ ID NO: 1021089 - RNA, 19 nt, Homo sapiens
ugccauggguguuaaauaa

SEQ ID NO: 1021090 - RNA, 19 nt, Homo sapiens
ggagcaaacuacagagaug

SEQ ID NO: 1021091 - RNA, 19 nt, Homo sapiens
ugaacucacuccuuaagaa

SEQ ID NO: 1021092 - RNA, 19 nt, Homo sapiens
ggaacaugaugagagauuu

SEQ ID NO: 1021093 - RNA, 19 nt, Homo sapiens
gcacuaaucauucagacuu

SEQ ID NO: 1021094 - RNA, 19 nt, Homo sapiens
caugggugcuguuagauuu

SEQ ID NO: 1021095 - RNA, 19 nt, Homo sapiens
gaaggucuuucucugcuau

SEQ ID NO: 1021096 - RNA, 19 nt, Homo sapiens
cauguuguauugcagauaa

SEQ ID NO: 1021097 - RNA, 19 nt, Homo sapiens
gcucugagucuuccacaua

SEQ ID NO: 1021098 - RNA, 19 nt, Homo sapiens
gcucaacaguagcuucaaa

SEQ ID NO: 1021099 - RNA, 19 nt, Homo sapiens
cuacagaguuucuauuucu

SEQ ID NO: 1021100 - RNA, 19 nt, Homo sapiens
uugacaaacucuccaauuu

SEQ ID NO: 1021101 - RNA, 19 nt, Homo sapiens
guaaagauggccagaauca

SEQ ID NO: 1021102 - RNA, 19 nt, Homo sapiens
gcaauuaccacccuuucuu

SEQ ID NO: 1021103 - RNA, 19 nt, Homo sapiens
ggaaguuuauucuuaagag

SEQ ID NO: 1021104 - RNA, 19 nt, Homo sapiens
gaacuacaaacacaaagga

SEQ ID NO: 1021105 - RNA, 19 nt, Homo sapiens
uuaccacccuuucuucuuu

SEQ ID NO: 1021106 - RNA, 19 nt, Homo sapiens
gucuggaaguuuauucuua

SEQ ID NO: 1021107 - RNA, 19 nt, Homo sapiens
caucauagccacagaaauc

SEQ ID NO: 1021108 - RNA, 19 nt, Homo sapiens
ugaaaugagucucuguguu

SEQ ID NO: 1021109 - RNA, 19 nt, Homo sapiens
gcaaguuuaucgccgucua

SEQ ID NO: 1021110 - RNA, 19 nt, Homo sapiens
gaauggaaucucaaccuuu

SEQ ID NO: 1021111 - RNA, 19 nt, Homo sapiens
cuacccagcuggucuguau

SEQ ID NO: 1021112 - RNA, 19 nt, Homo sapiens
caagaaagugacugaauau

SEQ ID NO: 1021113 - RNA, 19 nt, Homo sapiens
ggacaagaagaacuacaaa

SEQ ID NO: 1021114 - RNA, 19 nt, Homo sapiens
ugaaauaaggcaucucuga

SEQ ID NO: 1021115 - RNA, 19 nt, Homo sapiens
guauucagcuuuguucaug

SEQ ID NO: 1021116 - RNA, 19 nt, Homo sapiens
caguaaagauggccagaau

SEQ ID NO: 1021117 - RNA, 19 nt, Homo sapiens
caaccuuuccugaauauga

SEQ ID NO: 1021118 - RNA, 19 nt, Homo sapiens
gaggagaagcauuaacuga

SEQ ID NO: 1021119 - RNA, 19 nt, Homo sapiens
gaagagucauuuuauguug

SEQ ID NO: 1021120 - RNA, 19 nt, Homo sapiens
guagggaggaaauauguaa

SEQ ID NO: 1021121 - RNA, 19 nt, Homo sapiens
acaaggauauuuggaguga

SEQ ID NO: 1021122 - RNA, 19 nt, Homo sapiens
ucuaagcauugccacuuua

SEQ ID NO: 1021123 - RNA, 19 nt, Homo sapiens
aagaagaacuacaaacaca

SEQ ID NO: 1021124 - RNA, 19 nt, Homo sapiens
ugaaugucguccaguguuu

SEQ ID NO: 1021125 - RNA, 19 nt, Homo sapiens
ucucaaccuuuccugaaua

SEQ ID NO: 1021126 - RNA, 19 nt, Homo sapiens
caaacuugcuaacauacga

SEQ ID NO: 1021127 - RNA, 19 nt, Homo sapiens
cagauaagaccaacaugaa

SEQ ID NO: 1021128 - RNA, 19 nt, Homo sapiens
uguaaugaaugcugucuug

SEQ ID NO: 1021129 - RNA, 19 nt, Homo sapiens
uagcauguguguaaugaau

SEQ ID NO: 1021130 - RNA, 19 nt, Homo sapiens
gaacugguuuugacuaaug

SEQ ID NO: 1021131 - RNA, 19 nt, Homo sapiens
cuaaagcuguguccugaau

SEQ ID NO: 1021132 - RNA, 19 nt, Homo sapiens
ggaggaaauauguaaagaa

SEQ ID NO: 1021133 - RNA, 19 nt, Homo sapiens
gggaggaaauauguaaaga

SEQ ID NO: 1021134 - RNA, 19 nt, Homo sapiens
uaccggauaucuugacaaa

SEQ ID NO: 1021135 - RNA, 19 nt, Homo sapiens
gaaagagucuaagcauugc

SEQ ID NO: 1021136 - RNA, 19 nt, Homo sapiens
gugauugccucagaauaaa

SEQ ID NO: 1021137 - RNA, 19 nt, Homo sapiens
caugaugagagauuucuua

SEQ ID NO: 1021138 - RNA, 19 nt, Homo sapiens
gaagggguauguugagaaa

SEQ ID NO: 1021139 - RNA, 19 nt, Homo sapiens
gaaaugcuggccaguacuu

SEQ ID NO: 1021140 - RNA, 19 nt, Homo sapiens
ggaagacagugccaacaac

SEQ ID NO: 1021141 - RNA, 19 nt, Homo sapiens
ugaaggagauugguuaguc

SEQ ID NO: 1021142 - RNA, 19 nt, Homo sapiens
aaggauauuuggagugaaa

SEQ ID NO: 1021143 - RNA, 19 nt, Homo sapiens
caacaugcaccaguuuauu

SEQ ID NO: 1021144 - RNA, 19 nt, Homo sapiens
aaagagagugcuaguuaaa

SEQ ID NO: 1021145 - RNA, 19 nt, Homo sapiens
uggaggugauggccaguua

SEQ ID NO: 1021146 - RNA, 19 nt, Homo sapiens
acaacagcuugccaaauuu

SEQ ID NO: 1021147 - RNA, 19 nt, Homo sapiens
ugaaaggcauguccauaag

SEQ ID NO: 1021148 - RNA, 19 nt, Homo sapiens
ccggauaucuugacaaacu

SEQ ID NO: 1021149 - RNA, 19 nt, Homo sapiens
guuuaucgccgucuacuuu

SEQ ID NO: 1021150 - RNA, 19 nt, Homo sapiens
ggaugacacuaacacaaca

SEQ ID NO: 1021151 - RNA, 19 nt, Homo sapiens
uaaugaaaccauaguguga

SEQ ID NO: 1021152 - RNA, 19 nt, Homo sapiens
uauggaaucuggaaugagu

SEQ ID NO: 1021153 - RNA, 19 nt, Homo sapiens
ucucaugggugcuguuaga

SEQ ID NO: 1021154 - RNA, 19 nt, Homo sapiens
gaaugacuuucuacagagu

SEQ ID NO: 1021155 - RNA, 19 nt, Homo sapiens
aaagcuguguccugaauau

SEQ ID NO: 1021156 - RNA, 19 nt, Homo sapiens
cgacagggcagcagaagga

SEQ ID NO: 1021157 - RNA, 19 nt, Homo sapiens
gguguuaaauaagcuuuga

SEQ ID NO: 1021158 - RNA, 19 nt, Homo sapiens
ccauggaacugaaucuuua

SEQ ID NO: 1021159 - RNA, 19 nt, Homo sapiens
gagaaucacugcuggaaga

SEQ ID NO: 1021160 - RNA, 19 nt, Homo sapiens
gaugauggguuccuuauuc

SEQ ID NO: 1021161 - RNA, 19 nt, Homo sapiens
ggacgacacucccaugaug

SEQ ID NO: 1021162 - RNA, 19 nt, Homo sapiens
gaucgcagcuuuccaucug

SEQ ID NO: 1021163 - RNA, 19 nt, Homo sapiens
gacacaagauguacagaga

SEQ ID NO: 1021164 - RNA, 19 nt, Homo sapiens
gcagcgagaugaagagaca

SEQ ID NO: 1021165 - RNA, 19 nt, Homo sapiens
caucuucgacuucuugaua

SEQ ID NO: 1021166 - RNA, 19 nt, Homo sapiens
gaaggaagcaggacauuuu

SEQ ID NO: 1021167 - RNA, 19 nt, Homo sapiens
ggcccaagcugacuacaga

SEQ ID NO: 1021168 - RNA, 19 nt, Homo sapiens
aaacagaucuacccguaca

SEQ ID NO: 1021169 - RNA, 19 nt, Homo sapiens
guaaaugucaccaaggaaa

SEQ ID NO: 1021170 - RNA, 19 nt, Homo sapiens
gugcugagguucucggauu

SEQ ID NO: 1021171 - RNA, 19 nt, Homo sapiens
gaaauccugcagaguguuu

SEQ ID NO: 1021172 - RNA, 19 nt, Homo sapiens
ucagcaaacuucugcaaga

SEQ ID NO: 1021173 - RNA, 19 nt, Homo sapiens
gaacaggcgacacaagaug

SEQ ID NO: 1021174 - RNA, 19 nt, Homo sapiens
ggacuucuucuacuucauu

SEQ ID NO: 1021175 - RNA, 19 nt, Homo sapiens
aggaggcgcugcgguauua

SEQ ID NO: 1021176 - RNA, 19 nt, Homo sapiens
gcaaacuucugcaagacau

SEQ ID NO: 1021177 - RNA, 19 nt, Homo sapiens
caagucagcuaggaaggaa

SEQ ID NO: 1021178 - RNA, 19 nt, Homo sapiens
ggacaggauucuggacuuc

SEQ ID NO: 1021179 - RNA, 19 nt, Homo sapiens
gagagcagaugaaccuuac

SEQ ID NO: 1021180 - RNA, 19 nt, Homo sapiens
ggaaggaagcaggacauuu

SEQ ID NO: 1021181 - RNA, 19 nt, Homo sapiens
ucccagugcugcaugauaa

SEQ ID NO: 1021182 - RNA, 19 nt, Homo sapiens
ggagucaagucagcuagga

SEQ ID NO: 1021183 - RNA, 19 nt, Homo sapiens
gccagcggcuccucaaugu

SEQ ID NO: 1021184 - RNA, 19 nt, Homo sapiens
caagcugacuacagacuca

SEQ ID NO: 1021185 - RNA, 19 nt, Homo sapiens
uaguaaaugucaccaagga

SEQ ID NO: 1021186 - RNA, 19 nt, Homo sapiens
uaugagauguucaccaagu

SEQ ID NO: 1021187 - RNA, 19 nt, Homo sapiens
gcucagcccuguccucacu

SEQ ID NO: 1021188 - RNA, 19 nt, Homo sapiens
gagacacaaugcugagauc

SEQ ID NO: 1021189 - RNA, 19 nt, Homo sapiens
gcagaguccaguuucagaa

SEQ ID NO: 1021190 - RNA, 19 nt, Homo sapiens
gaucgaaggcuccaaacca

SEQ ID NO: 1021191 - RNA, 19 nt, Homo sapiens
guacuaaugguaacaaguc

SEQ ID NO: 1021192 - RNA, 19 nt, Homo sapiens
caggagaguacuaauggua

SEQ ID NO: 1021193 - RNA, 19 nt, Homo sapiens
ggaaggccauguucaaacc

SEQ ID NO: 1021194 - RNA, 19 nt, Homo sapiens
gcacccagauugugaaacc

SEQ ID NO: 1021195 - RNA, 19 nt, Homo sapiens
ggagaguacuaaugguaac

SEQ ID NO: 1021196 - RNA, 19 nt, Homo sapiens
gcaccauuaugagauguuc

SEQ ID NO: 1021197 - RNA, 19 nt, Homo sapiens
gggaggauaguaaauguca

SEQ ID NO: 1021198 - RNA, 19 nt, Homo sapiens
ccuacacacuggcaggaaa

SEQ ID NO: 1021199 - RNA, 19 nt, Homo sapiens
gacggaguaugcugucugu

SEQ ID NO: 1021200 - RNA, 19 nt, Homo sapiens
uccuagaggucaccaagaa

SEQ ID NO: 1021201 - RNA, 19 nt, Homo sapiens
ggaacaggcgacacaagau

SEQ ID NO: 1021202 - RNA, 19 nt, Homo sapiens
auuaugagauguucaccaa

SEQ ID NO: 1021203 - RNA, 19 nt, Homo sapiens
gaggucaccaagaaugaaa

SEQ ID NO: 1021204 - RNA, 19 nt, Homo sapiens
agagagcagaugaaccuua

SEQ ID NO: 1021205 - RNA, 19 nt, Homo sapiens
acacucccaugaugaaauc

SEQ ID NO: 1021206 - RNA, 19 nt, Homo sapiens
cuaaugguaacaagucaaa

SEQ ID NO: 1021207 - RNA, 19 nt, Homo sapiens
cgccaaguguccauacaug

SEQ ID NO: 1021208 - RNA, 19 nt, Homo sapiens
ccaguggacuucuucuacu

SEQ ID NO: 1021209 - RNA, 19 nt, Homo sapiens
agacaccaguggacuucuu

SEQ ID NO: 1021210 - RNA, 19 nt, Homo sapiens
ucaagcuggugcugagguu

SEQ ID NO: 1021211 - RNA, 19 nt, Homo sapiens
gaucccaggagaguacuaa

SEQ ID NO: 1021212 - RNA, 19 nt, Homo sapiens
ugagugcacugggaaaucu

SEQ ID NO: 1021213 - RNA, 19 nt, Homo sapiens
gggaugauggguuccuuau

SEQ ID NO: 1021214 - RNA, 19 nt, Homo sapiens
gacagcagcgagaugaaga

SEQ ID NO: 1021215 - RNA, 19 nt, Homo sapiens
ugagacagcagcgagauga

SEQ ID NO: 1021216 - RNA, 19 nt, Homo sapiens
ggaugauggguuccuuauu

SEQ ID NO: 1021217 - RNA, 19 nt, Homo sapiens
gaccggcaccauuaugaga

SEQ ID NO: 1021218 - RNA, 19 nt, Homo sapiens
cagcggcuccucaauguca

SEQ ID NO: 1021219 - RNA, 19 nt, Homo sapiens
ucaauccccuuuacuguga

SEQ ID NO: 1021220 - RNA, 19 nt, Homo sapiens
ccaaguguccauacaugug

SEQ ID NO: 1021221 - RNA, 19 nt, Homo sapiens
uaaaugucaccaaggaaau

SEQ ID NO: 1021222 - RNA, 19 nt, Homo sapiens
caguggacuucuucuacuu

SEQ ID NO: 1021223 - RNA, 19 nt, Homo sapiens
gcgagaaucacugcuggaa

SEQ ID NO: 1021224 - RNA, 19 nt, Homo sapiens
ucauugacuuucagagaca

SEQ ID NO: 1021225 - RNA, 19 nt, Homo sapiens
caccgacgaucuccugagu

SEQ ID NO: 1021226 - RNA, 19 nt, Homo sapiens
caucaaggccaccgacgau

SEQ ID NO: 1021227 - RNA, 19 nt, Homo sapiens
guacagagagcagaugaac

SEQ ID NO: 1021228 - RNA, 19 nt, Homo sapiens
caagacaugaggcacuuuc

SEQ ID NO: 1021229 - RNA, 19 nt, Homo sapiens
aacugaaucuuuacuccuu

SEQ ID NO: 1021230 - RNA, 19 nt, Homo sapiens
gacgacacucccaugauga

SEQ ID NO: 1021231 - RNA, 19 nt, Homo sapiens
gaucuacccguacaacaac

SEQ ID NO: 1021232 - RNA, 19 nt, Homo sapiens
cuagaggucaccaagaaug

SEQ ID NO: 1021233 - RNA, 19 nt, Homo sapiens
gcacuuucccaccaucagu

SEQ ID NO: 1021234 - RNA, 19 nt, Homo sapiens
gcguugccuugcuccguuu

SEQ ID NO: 1021235 - RNA, 19 nt, Homo sapiens
ggccaucuucgacuucuug

SEQ ID NO: 1021236 - RNA, 19 nt, Homo sapiens
uggaacaggcgacacaaga

SEQ ID NO: 1021237 - RNA, 19 nt, Homo sapiens
gcugauuacagucaagaug

SEQ ID NO: 1021238 - RNA, 19 nt, Homo sapiens
acugggaaaucuggguaua

SEQ ID NO: 1021239 - RNA, 19 nt, Homo sapiens
gcgaugugaugcgagaauc

SEQ ID NO: 1021240 - RNA, 19 nt, Homo sapiens
guggacuucuucuacuuca

SEQ ID NO: 1021241 - RNA, 19 nt, Homo sapiens
caguuccaccuggguauua

SEQ ID NO: 1021242 - RNA, 19 nt, Homo sapiens
gaguacuaaugguaacaag

SEQ ID NO: 1021243 - RNA, 19 nt, Homo sapiens
cccauggaacugaaucuuu

SEQ ID NO: 1021244 - RNA, 19 nt, Homo sapiens
ggacuccaggcaccucuuc

SEQ ID NO: 1021245 - RNA, 19 nt, Homo sapiens
gugacacagugaaacagau

SEQ ID NO: 1021246 - RNA, 19 nt, Homo sapiens
uagaggucaccaagaauga

SEQ ID NO: 1021247 - RNA, 19 nt, Homo sapiens
gacuucuucuacuucauug

SEQ ID NO: 1021248 - RNA, 19 nt, Homo sapiens
cagcaaacuucugcaagac

SEQ ID NO: 1021249 - RNA, 19 nt, Homo sapiens
gcgggucgagcuccaaguu

SEQ ID NO: 1021250 - RNA, 19 nt, Homo sapiens
ugagaucgcagcuuuccau

SEQ ID NO: 1021251 - RNA, 19 nt, Homo sapiens
gcaagacaugaggcacuuu

SEQ ID NO: 1021252 - RNA, 19 nt, Homo sapiens
gggaaggccauguucaaac

SEQ ID NO: 1021253 - RNA, 19 nt, Homo sapiens
cugauuacagucaagauga

SEQ ID NO: 1021254 - RNA, 19 nt, Homo sapiens
caaguugcaggcccucuuc

SEQ ID NO: 1021255 - RNA, 19 nt, Homo sapiens
ggcagaguccaguuucaga

SEQ ID NO: 1021256 - RNA, 19 nt, Homo sapiens
gacacucccaugaugaaau

SEQ ID NO: 1021257 - RNA, 19 nt, Homo sapiens
ucaucgacauggccaucuu

SEQ ID NO: 1021258 - RNA, 19 nt, Homo sapiens
ucaacgaucuguacuucua

SEQ ID NO: 1021259 - RNA, 19 nt, Homo sapiens
gggauuacaucuacuacaa

SEQ ID NO: 1021260 - RNA, 19 nt, Homo sapiens
gagagcaguucuaccacua

SEQ ID NO: 1021261 - RNA, 19 nt, Homo sapiens
ugagaaagaugaguuaauc

SEQ ID NO: 1021262 - RNA, 19 nt, Homo sapiens
gcaagaagggcaagaagga

SEQ ID NO: 1021263 - RNA, 19 nt, Homo sapiens
gaagacaaguggguuugga

SEQ ID NO: 1021264 - RNA, 19 nt, Homo sapiens
ggacagcugugggucuuug

SEQ ID NO: 1021265 - RNA, 19 nt, Homo sapiens
gaaacagagaguuaagaaa

SEQ ID NO: 1021266 - RNA, 19 nt, Homo sapiens
auaacgagcucuaugucua

SEQ ID NO: 1021267 - RNA, 19 nt, Homo sapiens
cgacguguaugccuuuaau

SEQ ID NO: 1021268 - RNA, 19 nt, Homo sapiens
gaaagaugaguuaauccuu

SEQ ID NO: 1021269 - RNA, 19 nt, Homo sapiens
ccgccaagauggagaagaa

SEQ ID NO: 1021270 - RNA, 19 nt, Homo sapiens
aaacagagaguuaagaaag

SEQ ID NO: 1021271 - RNA, 19 nt, Homo sapiens
gaaaguacacgggauuaca

SEQ ID NO: 1021272 - RNA, 19 nt, Homo sapiens
gaacuuucucccaugguuu

SEQ ID NO: 1021273 - RNA, 19 nt, Homo sapiens
cgaaacagagaguuaagaa

SEQ ID NO: 1021274 - RNA, 19 nt, Homo sapiens
gacaauugauccuguuugg

SEQ ID NO: 1021275 - RNA, 19 nt, Homo sapiens
gaacaagucaaaucaacag

SEQ ID NO: 1021276 - RNA, 19 nt, Homo sapiens
gggaacaagucaaaucaac

SEQ ID NO: 1021277 - RNA, 19 nt, Homo sapiens
gaaaggacaccuggaccaa

SEQ ID NO: 1021278 - RNA, 19 nt, Homo sapiens
ggaaggccuugguggagau

SEQ ID NO: 1021279 - RNA, 19 nt, Homo sapiens
ugaagggacccaagucuga

SEQ ID NO: 1021280 - RNA, 19 nt, Homo sapiens
ggagauggacccagaaacu

SEQ ID NO: 1021281 - RNA, 19 nt, Homo sapiens
guacacgggauuacaucua

SEQ ID NO: 1021282 - RNA, 19 nt, Homo sapiens
caacgacguguaugccuuu

SEQ ID NO: 1021283 - RNA, 19 nt, Homo sapiens
gagcaguucuaccacuaca

SEQ ID NO: 1021284 - RNA, 19 nt, Homo sapiens
uuugguggcuuccaugaaa

SEQ ID NO: 1021285 - RNA, 19 nt, Homo sapiens
cagccuguguguuguguga

SEQ ID NO: 1021286 - RNA, 19 nt, Homo sapiens
ugaacuuucucccaugguu

SEQ ID NO: 1021287 - RNA, 19 nt, Homo sapiens
gaagggacccaagucugaa

SEQ ID NO: 1021288 - RNA, 19 nt, Homo sapiens
ggacggaagagaagacaag

SEQ ID NO: 1021289 - RNA, 19 nt, Homo sapiens
ggaacaagucaaaucaaca

SEQ ID NO: 1021290 - RNA, 19 nt, Homo sapiens
ccaagaggacucagacugu

SEQ ID NO: 1021291 - RNA, 19 nt, Homo sapiens
aacagagaguuaagaaaga

SEQ ID NO: 1021292 - RNA, 19 nt, Homo sapiens
uggagaagaaggugucuaa

SEQ ID NO: 1021293 - RNA, 19 nt, Homo sapiens
gaccugggaacaagucaaa

SEQ ID NO: 1021294 - RNA, 19 nt, Homo sapiens
ggaggaggaagaccuggaa

SEQ ID NO: 1021295 - RNA, 19 nt, Homo sapiens
ggacucagacuguggaacu

SEQ ID NO: 1021296 - RNA, 19 nt, Homo sapiens
ggacgaagacagccuugag

SEQ ID NO: 1021297 - RNA, 19 nt, Homo sapiens
gaagccagaggacggaaga

SEQ ID NO: 1021298 - RNA, 19 nt, Homo sapiens
gcacacggcacucagacau

SEQ ID NO: 1021299 - RNA, 19 nt, Homo sapiens
gagaagacaaguggguuug

SEQ ID NO: 1021300 - RNA, 19 nt, Homo sapiens
ccuuuaaucuggacaccuu

SEQ ID NO: 1021301 - RNA, 19 nt, Homo sapiens
cgagcucuaugucuacaau

SEQ ID NO: 1021302 - RNA, 19 nt, Homo sapiens
uaagaaagacguggacaag

SEQ ID NO: 1021303 - RNA, 19 nt, Homo sapiens
gcggacagcugugggucuu

SEQ ID NO: 1021304 - RNA, 19 nt, Homo sapiens
gagaagaaggugucuaagc

SEQ ID NO: 1021305 - RNA, 19 nt, Homo sapiens
gaugguggccuggaagaga

SEQ ID NO: 1021306 - RNA, 19 nt, Homo sapiens
ggacaccuggaccaaaguu

SEQ ID NO: 1021307 - RNA, 19 nt, Homo sapiens
acacggcacucagacaugu

SEQ ID NO: 1021308 - RNA, 19 nt, Homo sapiens
gagacaauugauccuguuu

SEQ ID NO: 1021309 - RNA, 19 nt, Homo sapiens
gcaguucuaccacuacaag

SEQ ID NO: 1021310 - RNA, 19 nt, Homo sapiens
cuucaacgaucuguacuuc

SEQ ID NO: 1021311 - RNA, 19 nt, Homo sapiens
agagacaauugauccuguu

SEQ ID NO: 1021312 - RNA, 19 nt, Homo sapiens
gccuguguguugugugaaa

SEQ ID NO: 1021313 - RNA, 19 nt, Homo sapiens
cgaaucaccagacacuguu

SEQ ID NO: 1021314 - RNA, 19 nt, Homo sapiens
caugaaaguacacgggauu

SEQ ID NO: 1021315 - RNA, 19 nt, Homo sapiens
aaggacaccuggaccaaag

SEQ ID NO: 1021316 - RNA, 19 nt, Homo sapiens
gggugucugugacgaggaa

SEQ ID NO: 1021317 - RNA, 19 nt, Homo sapiens
cagaucaggcugccagaug

SEQ ID NO: 1021318 - RNA, 19 nt, Homo sapiens
ggacccagccguguugagu

SEQ ID NO: 1021319 - RNA, 19 nt, Homo sapiens
agaucaggcugccagaugu

SEQ ID NO: 1021320 - RNA, 19 nt, Homo sapiens
cuggacaccuucacaugga

SEQ ID NO: 1021321 - RNA, 19 nt, Homo sapiens
caacggagagcaguucuac

SEQ ID NO: 1021322 - RNA, 19 nt, Homo sapiens
gccagaggacggaagagaa

SEQ ID NO: 1021323 - RNA, 19 nt, Homo sapiens
cauagcccauuuccagaca

SEQ ID NO: 1021324 - RNA, 19 nt, Homo sapiens
gccagggugugaacuuucu

SEQ ID NO: 1021325 - RNA, 19 nt, Homo sapiens
gaagcgcucauagcccauu

SEQ ID NO: 1021326 - RNA, 19 nt, Homo sapiens
uguguguugugugaaauaa

SEQ ID NO: 1021327 - RNA, 19 nt, Homo sapiens
agagaagacaaguggguuu

SEQ ID NO: 1021328 - RNA, 19 nt, Homo sapiens
ccggcaagaugggcaagaa

SEQ ID NO: 1021329 - RNA, 19 nt, Homo sapiens
gagcucuaugucuacaaua

SEQ ID NO: 1021330 - RNA, 19 nt, Homo sapiens
acccagccguguugaguga

SEQ ID NO: 1021331 - RNA, 19 nt, Homo sapiens
gggcuacucgaaacagaga

SEQ ID NO: 1021332 - RNA, 19 nt, Homo sapiens
cugugcagcuggucaagga

SEQ ID NO: 1021333 - RNA, 19 nt, Homo sapiens
ggacccaagucugaaaaga

SEQ ID NO: 1021334 - RNA, 19 nt, Homo sapiens
ccagaggacggaagagaag

SEQ ID NO: 1021335 - RNA, 19 nt, Homo sapiens
acaccuggaccaaaguuga

SEQ ID NO: 1021336 - RNA, 19 nt, Homo sapiens
gaauauuucaacggccaaa

SEQ ID NO: 1021337 - RNA, 19 nt, Homo sapiens
gaggagcccgaagguggua

SEQ ID NO: 1021338 - RNA, 19 nt, Homo sapiens
gagauggacccagaaacuc

SEQ ID NO: 1021339 - RNA, 19 nt, Homo sapiens
ccgaaucaccagacacugu

SEQ ID NO: 1021340 - RNA, 19 nt, Homo sapiens
uaacgagcucuaugucuac

SEQ ID NO: 1021341 - RNA, 19 nt, Homo sapiens
aaaguacacgggauuacau

SEQ ID NO: 1021342 - RNA, 19 nt, Homo sapiens
uguauaacgagcucuaugu

SEQ ID NO: 1021343 - RNA, 19 nt, Homo sapiens
aaaggacaccuggaccaaa

SEQ ID NO: 1021344 - RNA, 19 nt, Homo sapiens
gcacaggagagagcugaag

SEQ ID NO: 1021345 - RNA, 19 nt, Homo sapiens
guauaacgagcucuauguc

SEQ ID NO: 1021346 - RNA, 19 nt, Homo sapiens
uacacgggauuacaucuac

SEQ ID NO: 1021347 - RNA, 19 nt, Homo sapiens
aacuuucucccaugguuua

SEQ ID NO: 1021348 - RNA, 19 nt, Homo sapiens
aggccagggugugaacuuu

SEQ ID NO: 1021349 - RNA, 19 nt, Homo sapiens
gcgaguucuucaacgaucu

SEQ ID NO: 1021350 - RNA, 19 nt, Homo sapiens
uuaagaaagacguggacaa

SEQ ID NO: 1021351 - RNA, 19 nt, Homo sapiens
gaacaacuauugccuuuaa

SEQ ID NO: 1021352 - RNA, 19 nt, Homo sapiens
gaacugaauuucucugaua

SEQ ID NO: 1021353 - RNA, 19 nt, Homo sapiens
gaaaauaccuggaagaaaa

SEQ ID NO: 1021354 - RNA, 19 nt, Homo sapiens
cugaagagcucacucauua

SEQ ID NO: 1021355 - RNA, 19 nt, Homo sapiens
cgaaguaaguugcuuuaua

SEQ ID NO: 1021356 - RNA, 19 nt, Homo sapiens
gaagucugaugcuuuguua

SEQ ID NO: 1021357 - RNA, 19 nt, Homo sapiens
aaacagaaaugcaggcuaa

SEQ ID NO: 1021358 - RNA, 19 nt, Homo sapiens
ccacuuaucucauagcauu

SEQ ID NO: 1021359 - RNA, 19 nt, Homo sapiens
gaagaaaccucuaugucau

SEQ ID NO: 1021360 - RNA, 19 nt, Homo sapiens
uaacucagaugcaagcuuu

SEQ ID NO: 1021361 - RNA, 19 nt, Homo sapiens
gaauugcucuuuaccaguu

SEQ ID NO: 1021362 - RNA, 19 nt, Homo sapiens
uaucuugccuccucacuua

SEQ ID NO: 1021363 - RNA, 19 nt, Homo sapiens
gaaaauagguugugauuac

SEQ ID NO: 1021364 - RNA, 19 nt, Homo sapiens
ccauacaaguggcucauua

SEQ ID NO: 1021365 - RNA, 19 nt, Homo sapiens
gagaauaggugagcaagau

SEQ ID NO: 1021366 - RNA, 19 nt, Homo sapiens
uaagaugagucaauacuug

SEQ ID NO: 1021367 - RNA, 19 nt, Homo sapiens
gauaagaccaagaggauaa

SEQ ID NO: 1021368 - RNA, 19 nt, Homo sapiens
gaacauuucuuucaguaac

SEQ ID NO: 1021369 - RNA, 19 nt, Homo sapiens
cagaaacuauucagaagaa

SEQ ID NO: 1021370 - RNA, 19 nt, Homo sapiens
gaagauuucucuguuaaag

SEQ ID NO: 1021371 - RNA, 19 nt, Homo sapiens
gaagaaccauccucugagu

SEQ ID NO: 1021372 - RNA, 19 nt, Homo sapiens
ggauaaacaggacaauaua

SEQ ID NO: 1021373 - RNA, 19 nt, Homo sapiens
ugacuaauauugacagaug

SEQ ID NO: 1021374 - RNA, 19 nt, Homo sapiens
ugagaaagaucuucaugga

SEQ ID NO: 1021375 - RNA, 19 nt, Homo sapiens
gguagaaguugcuaauuuc

SEQ ID NO: 1021376 - RNA, 19 nt, Homo sapiens
gaaaguauugacuccguua

SEQ ID NO: 1021377 - RNA, 19 nt, Homo sapiens
gagcagaaacuauucagaa

SEQ ID NO: 1021378 - RNA, 19 nt, Homo sapiens
uaacgucacucuuauugug

SEQ ID NO: 1021379 - RNA, 19 nt, Homo sapiens
gauauugcuucuucauuug

SEQ ID NO: 1021380 - RNA, 19 nt, Homo sapiens
gcaauuauuucugugauuc

SEQ ID NO: 1021381 - RNA, 19 nt, Homo sapiens
ccacauggcauuauuauag

SEQ ID NO: 1021382 - RNA, 19 nt, Homo sapiens
cauauaacauuuccagguu

SEQ ID NO: 1021383 - RNA, 19 nt, Homo sapiens
gaagagcucacucauuaug

SEQ ID NO: 1021384 - RNA, 19 nt, Homo sapiens
gaucaggcccaucguuuaa

SEQ ID NO: 1021385 - RNA, 19 nt, Homo sapiens
gaaaagaauuccuggaguu

SEQ ID NO: 1021386 - RNA, 19 nt, Homo sapiens
gcuaagaguuuccacagau

SEQ ID NO: 1021387 - RNA, 19 nt, Homo sapiens
cagaaguacugacacauga

SEQ ID NO: 1021388 - RNA, 19 nt, Homo sapiens
gcacguaugucccaguaca

SEQ ID NO: 1021389 - RNA, 19 nt, Homo sapiens
gaacuaagauuggcuucag

SEQ ID NO: 1021390 - RNA, 19 nt, Homo sapiens
gaacgaugaccuacacuau

SEQ ID NO: 1021391 - RNA, 19 nt, Homo sapiens
caucauccuugagauaaua

SEQ ID NO: 1021392 - RNA, 19 nt, Homo sapiens
ccagacgaaugaaggauuu

SEQ ID NO: 1021393 - RNA, 19 nt, Homo sapiens
cauggagccucggcaauua

SEQ ID NO: 1021394 - RNA, 19 nt, Homo sapiens
guaugugugugacuuguuu

SEQ ID NO: 1021395 - RNA, 19 nt, Homo sapiens
gcauguugaugaugauuau

SEQ ID NO: 1021396 - RNA, 19 nt, Homo sapiens
agaaaccucuaugucauua

SEQ ID NO: 1021397 - RNA, 19 nt, Homo sapiens
cagagauacuuggaacuua

SEQ ID NO: 1021398 - RNA, 19 nt, Homo sapiens
agagauacuuggaacuuaa

SEQ ID NO: 1021399 - RNA, 19 nt, Homo sapiens
ugagaugccuguagagaau

SEQ ID NO: 1021400 - RNA, 19 nt, Homo sapiens
cagaucaaaugcauacuug

SEQ ID NO: 1021401 - RNA, 19 nt, Homo sapiens
gguaaggauuuauguagug

SEQ ID NO: 1021402 - RNA, 19 nt, Homo sapiens
gcacagaauccguacaugu

SEQ ID NO: 1021403 - RNA, 19 nt, Homo sapiens
ggaguucuuuggaggacua

SEQ ID NO: 1021404 - RNA, 19 nt, Homo sapiens
gaaauuugccaguucuaga

SEQ ID NO: 1021405 - RNA, 19 nt, Homo sapiens
ggaagaguaucgaaguaag

SEQ ID NO: 1021406 - RNA, 19 nt, Homo sapiens
gguauggucucauuucuac

SEQ ID NO: 1021407 - RNA, 19 nt, Homo sapiens
gcauggcuguugaaagcua

SEQ ID NO: 1021408 - RNA, 19 nt, Homo sapiens
gaaaacguuugaucuacua

SEQ ID NO: 1021409 - RNA, 19 nt, Homo sapiens
uuugguagauucagaagua

SEQ ID NO: 1021410 - RNA, 19 nt, Homo sapiens
gggcacguaugucccagua

SEQ ID NO: 1021411 - RNA, 19 nt, Homo sapiens
aaacuuuccucucagcauu

SEQ ID NO: 1021412 - RNA, 19 nt, Homo sapiens
gagaauaagaugagucaau

SEQ ID NO: 1021413 - RNA, 19 nt, Homo sapiens
guuugguucuucuaaguua

SEQ ID NO: 1021414 - RNA, 19 nt, Homo sapiens
gcaugcaaauuuaauaguc

SEQ ID NO: 1021415 - RNA, 19 nt, Homo sapiens
ggucucauuucuacaguga

SEQ ID NO: 1021416 - RNA, 19 nt, Homo sapiens
gaaaugcaggcuaagaguu

SEQ ID NO: 1021417 - RNA, 19 nt, Homo sapiens
uaagguauguagcacaaug

SEQ ID NO: 1021418 - RNA, 19 nt, Homo sapiens
agggaaaguugaaguguuu

SEQ ID NO: 1021419 - RNA, 19 nt, Homo sapiens
caaguguacugacuaucaa

SEQ ID NO: 1021420 - RNA, 19 nt, Homo sapiens
ggaagugacacaucugguu

SEQ ID NO: 1021421 - RNA, 19 nt, Homo sapiens
gagauaagaccaagaggau

SEQ ID NO: 1021422 - RNA, 19 nt, Homo sapiens
uaaaucaggccauugaaga

SEQ ID NO: 1021423 - RNA, 19 nt, Homo sapiens
ucuauaccgugaacagaua

SEQ ID NO: 1021424 - RNA, 19 nt, Homo sapiens
gagugagcauucagaggua

SEQ ID NO: 1021425 - RNA, 19 nt, Homo sapiens
ccagguuuguguacuguaa

SEQ ID NO: 1021426 - RNA, 19 nt, Homo sapiens
ugacagaauguuugaauug

SEQ ID NO: 1021427 - RNA, 19 nt, Homo sapiens
agguagaaguugcuaauuu

SEQ ID NO: 1021428 - RNA, 19 nt, Homo sapiens
aaauuuagccucugauaug

SEQ ID NO: 1021429 - RNA, 19 nt, Homo sapiens
agucaauacuuguaaggua

SEQ ID NO: 1021430 - RNA, 19 nt, Homo sapiens
cuugaagauuucucuguua

SEQ ID NO: 1021431 - RNA, 19 nt, Homo sapiens
ugacacaucugguugaaaa

SEQ ID NO: 1021432 - RNA, 19 nt, Homo sapiens
gaggauaaacaggacaaua

SEQ ID NO: 1021433 - RNA, 19 nt, Homo sapiens
guugaaagcuagugaucug

SEQ ID NO: 1021434 - RNA, 19 nt, Homo sapiens
gcagaaacuauucagaaga

SEQ ID NO: 1021435 - RNA, 19 nt, Homo sapiens
gagcuggaguggguucaaa

SEQ ID NO: 1021436 - RNA, 19 nt, Homo sapiens
agaagaaaccucuauguca

SEQ ID NO: 1021437 - RNA, 19 nt, Homo sapiens
gggcaucauccuugagaua

SEQ ID NO: 1021438 - RNA, 19 nt, Homo sapiens
gcagagauacuuggaacuu

SEQ ID NO: 1021439 - RNA, 19 nt, Homo sapiens
gaaagcuagugaucugaag

SEQ ID NO: 1021440 - RNA, 19 nt, Homo sapiens
gaauaggugagcaagauau

SEQ ID NO: 1021441 - RNA, 19 nt, Homo sapiens
guuauaagccagacauaga

SEQ ID NO: 1021442 - RNA, 19 nt, Homo sapiens
accagaagguuauguuaaa

SEQ ID NO: 1021443 - RNA, 19 nt, Homo sapiens
ggaggacuauuucaaacag

SEQ ID NO: 1021444 - RNA, 19 nt, Homo sapiens
gaucagcugagaacgauga

SEQ ID NO: 1021445 - RNA, 19 nt, Homo sapiens
gcuaagugcagcagauauu

SEQ ID NO: 1021446 - RNA, 19 nt, Homo sapiens
ccaggucagucacucacua

SEQ ID NO: 1021447 - RNA, 19 nt, Homo sapiens
guguauacauucuuacugu

SEQ ID NO: 1021448 - RNA, 19 nt, Homo sapiens
ggauauuacaggaaagaaa

SEQ ID NO: 1021449 - RNA, 19 nt, Homo sapiens
cuaagaguuuccacagauu

SEQ ID NO: 1021450 - RNA, 19 nt, Homo sapiens
uaaagaaagucgggaagca

SEQ ID NO: 1021451 - RNA, 19 nt, Homo sapiens
gauagugugugaggucuua

SEQ ID NO: 1021452 - RNA, 19 nt, Homo sapiens
gugaaugacuuuacccaaa

SEQ ID NO: 1021453 - RNA, 19 nt, Homo sapiens
gcucugggaguuacuauua

SEQ ID NO: 1021454 - RNA, 19 nt, Homo sapiens
gaagauacagagaugauug

SEQ ID NO: 1021455 - RNA, 19 nt, Homo sapiens
ggagaucucugcaucacau

SEQ ID NO: 1021456 - RNA, 19 nt, Homo sapiens
caccugagcuguuaaagau

SEQ ID NO: 1021457 - RNA, 19 nt, Homo sapiens
caggauugcucucaucgua

SEQ ID NO: 1021458 - RNA, 19 nt, Homo sapiens
caacugguacacacuaaua

SEQ ID NO: 1021459 - RNA, 19 nt, Homo sapiens
cgaagaugcugaaggaguu

SEQ ID NO: 1021460 - RNA, 19 nt, Homo sapiens
caaagaaucacacuaagga

SEQ ID NO: 1021461 - RNA, 19 nt, Homo sapiens
gagaauaggccaaccaauc

SEQ ID NO: 1021462 - RNA, 19 nt, Homo sapiens
uaaagauccugcauucuca

SEQ ID NO: 1021463 - RNA, 19 nt, Homo sapiens
ggagacacauguuacucaa

SEQ ID NO: 1021464 - RNA, 19 nt, Homo sapiens
aaaggaagauacagagaug

SEQ ID NO: 1021465 - RNA, 19 nt, Homo sapiens
guaauuggcccugauggua

SEQ ID NO: 1021466 - RNA, 19 nt, Homo sapiens
ggauugcucucaucguaug

SEQ ID NO: 1021467 - RNA, 19 nt, Homo sapiens
gcaaguuccugccaucuac

SEQ ID NO: 1021468 - RNA, 19 nt, Homo sapiens
cacuaaggauagcaauuua

SEQ ID NO: 1021469 - RNA, 19 nt, Homo sapiens
ggaaguaauuggcccugau

SEQ ID NO: 1021470 - RNA, 19 nt, Homo sapiens
acacguauauugccaaagu

SEQ ID NO: 1021471 - RNA, 19 nt, Homo sapiens
guucagcaccuuccaguuu

SEQ ID NO: 1021472 - RNA, 19 nt, Homo sapiens
uaccaaaacucucaagaua

SEQ ID NO: 1021473 - RNA, 19 nt, Homo sapiens
gguacacacuaauaaacaa

SEQ ID NO: 1021474 - RNA, 19 nt, Homo sapiens
ugauuguacuucagaauga

SEQ ID NO: 1021475 - RNA, 19 nt, Homo sapiens
gcaggaugcuaaacuacau

SEQ ID NO: 1021476 - RNA, 19 nt, Homo sapiens
gggaguuacuauuaccaaa

SEQ ID NO: 1021477 - RNA, 19 nt, Homo sapiens
acacuaaggauagcaauuu

SEQ ID NO: 1021478 - RNA, 19 nt, Homo sapiens
acucaaagaaucacacuaa

SEQ ID NO: 1021479 - RNA, 19 nt, Homo sapiens
agacacauguuacucaaag

SEQ ID NO: 1021480 - RNA, 19 nt, Homo sapiens
uguuaaagauccugcauuc

SEQ ID NO: 1021481 - RNA, 19 nt, Homo sapiens
caauggcucagacagauaa

SEQ ID NO: 1021482 - RNA, 19 nt, Homo sapiens
gaaguaauuggcccugaug

SEQ ID NO: 1021483 - RNA, 19 nt, Homo sapiens
caguuucucuacacguaua

SEQ ID NO: 1021484 - RNA, 19 nt, Homo sapiens
ugugugaggucuuaucaug

SEQ ID NO: 1021485 - RNA, 19 nt, Homo sapiens
aagaaucacacuaaggaua

SEQ ID NO: 1021486 - RNA, 19 nt, Homo sapiens
agacugcuaucacgcauuc

SEQ ID NO: 1021487 - RNA, 19 nt, Homo sapiens
gagaugauuguacuucaga

SEQ ID NO: 1021488 - RNA, 19 nt, Homo sapiens
agaauaggccaaccaauca

SEQ ID NO: 1021489 - RNA, 19 nt, Homo sapiens
cagagaugauuguacuuca

SEQ ID NO: 1021490 - RNA, 19 nt, Homo sapiens
gaugcuaaacuacauggaa

SEQ ID NO: 1021491 - RNA, 19 nt, Homo sapiens
gggaugguguggugagcaa

SEQ ID NO: 1021492 - RNA, 19 nt, Homo sapiens
ggaagauacagagaugauu

SEQ ID NO: 1021493 - RNA, 19 nt, Homo sapiens
cuacauggaacaggaagua

SEQ ID NO: 1021494 - RNA, 19 nt, Homo sapiens
cuacacguauauugccaaa

SEQ ID NO: 1021495 - RNA, 19 nt, Homo sapiens
ccaaaacucucaagauagu

SEQ ID NO: 1021496 - RNA, 19 nt, Homo sapiens
aauuggcccugaugguaua

SEQ ID NO: 1021497 - RNA, 19 nt, Homo sapiens
cauggaacaggaaguaauu

SEQ ID NO: 1021498 - RNA, 19 nt, Homo sapiens
uaaaggaagauacagagau

SEQ ID NO: 1021499 - RNA, 19 nt, Homo sapiens
ggguucagcuggaguaaaa

SEQ ID NO: 1021500 - RNA, 19 nt, Homo sapiens
ugugaggucuuaucaugug

SEQ ID NO: 1021501 - RNA, 19 nt, Homo sapiens
gagaucgaguggcugaagu

SEQ ID NO: 1021502 - RNA, 19 nt, Homo sapiens
ugccgaagaugcugaagga

SEQ ID NO: 1021503 - RNA, 19 nt, Homo sapiens
gaauaggccaaccaaucaa

SEQ ID NO: 1021504 - RNA, 19 nt, Homo sapiens
ugaaugacuuuacccaaaa

SEQ ID NO: 1021505 - RNA, 19 nt, Homo sapiens
ccagugggcagccgauuau

SEQ ID NO: 1021506 - RNA, 19 nt, Homo sapiens
agacagauaagccaacaug

SEQ ID NO: 1021507 - RNA, 19 nt, Homo sapiens
gggagacacauguuacuca

SEQ ID NO: 1021508 - RNA, 19 nt, Homo sapiens
uggugaaucucccaacaga

SEQ ID NO: 1021509 - RNA, 19 nt, Homo sapiens
gaagaugcugaaggaguuu

SEQ ID NO: 1021510 - RNA, 19 nt, Homo sapiens
uacaacugguacacacuaa

SEQ ID NO: 1021511 - RNA, 19 nt, Homo sapiens
uccaguuucucuacacgua

SEQ ID NO: 1021512 - RNA, 19 nt, Homo sapiens
gaucgaguggcugaaguuu

SEQ ID NO: 1021513 - RNA, 19 nt, Homo sapiens
uuaaagauccugcauucuc

SEQ ID NO: 1021514 - RNA, 19 nt, Homo sapiens
cagauaagccaacaugcau

SEQ ID NO: 1021515 - RNA, 19 nt, Homo sapiens
gaaugacugaaacccauau

SEQ ID NO: 1021516 - RNA, 19 nt, Homo sapiens
gacacauguuacucaaaga

SEQ ID NO: 1021517 - RNA, 19 nt, Homo sapiens
gaaucgaaguuuucaucuu

SEQ ID NO: 1021518 - RNA, 19 nt, Homo sapiens
uaauuggcccugaugguau

SEQ ID NO: 1021519 - RNA, 19 nt, Homo sapiens
ucaauggcucagacagaua

SEQ ID NO: 1021520 - RNA, 19 nt, Homo sapiens
caucacaugucagcaggau

SEQ ID NO: 1021521 - RNA, 19 nt, Homo sapiens
cagaucuguuuaauagugu

SEQ ID NO: 1021522 - RNA, 19 nt, Homo sapiens
uguggaaaguggugaaucu

SEQ ID NO: 1021523 - RNA, 19 nt, Homo sapiens
acacauguuacucaaagaa

SEQ ID NO: 1021524 - RNA, 19 nt, Homo sapiens
caucguaugaaucgaaguu

SEQ ID NO: 1021525 - RNA, 19 nt, Homo sapiens
gcaccuuccaguuucucua

SEQ ID NO: 1021526 - RNA, 19 nt, Homo sapiens
ucagacagauaagccaaca

SEQ ID NO: 1021527 - RNA, 19 nt, Homo sapiens
gagacacauguuacucaaa

SEQ ID NO: 1021528 - RNA, 19 nt, Homo sapiens
uugcagcgcucugggaguu

SEQ ID NO: 1021529 - RNA, 19 nt, Homo sapiens
agaaucacacuaaggauag

SEQ ID NO: 1021530 - RNA, 19 nt, Homo sapiens
gaugauuguacuucagaau

SEQ ID NO: 1021531 - RNA, 19 nt, Homo sapiens
acauguuacucaaagaauc

SEQ ID NO: 1021532 - RNA, 19 nt, Homo sapiens
guauauugccaaaguggau

SEQ ID NO: 1021533 - RNA, 19 nt, Homo sapiens
ucaaagaaucacacuaagg

SEQ ID NO: 1021534 - RNA, 19 nt, Homo sapiens
agaaugacugaaacccaua

SEQ ID NO: 1021535 - RNA, 19 nt, Homo sapiens
cauguuacucaaagaauca

SEQ ID NO: 1021536 - RNA, 19 nt, Homo sapiens
gcagcgcucugggaguuac

SEQ ID NO: 1021537 - RNA, 19 nt, Homo sapiens
acaccugagcuguuaaaga

SEQ ID NO: 1021538 - RNA, 19 nt, Homo sapiens
gacugaaacccauauacca

SEQ ID NO: 1021539 - RNA, 19 nt, Homo sapiens
ggagaucgaguggcugaag

SEQ ID NO: 1021540 - RNA, 19 nt, Homo sapiens
aaucaauggcucagacaga

SEQ ID NO: 1021541 - RNA, 19 nt, Homo sapiens
aaacuacauggaacaggaa

SEQ ID NO: 1021542 - RNA, 19 nt, Homo sapiens
gugaggucuuaucauguga

SEQ ID NO: 1021543 - RNA, 19 nt, Homo sapiens
ggaguuacuauuaccaaaa

SEQ ID NO: 1021544 - RNA, 19 nt, Homo sapiens
agagacgccuccggugaga

SEQ ID NO: 1021545 - RNA, 19 nt, Homo sapiens
acagauaagccaacaugca

SEQ ID NO: 1021546 - RNA, 19 nt, Homo sapiens
guccaggauugcucucauc

SEQ ID NO: 1021547 - RNA, 19 nt, Homo sapiens
gcccagaguccccaaaauu

SEQ ID NO: 1021548 - RNA, 19 nt, Homo sapiens
uaaccgggcagagcuaaca

SEQ ID NO: 1021549 - RNA, 19 nt, Homo sapiens
gaagaagaaucuccaauua

SEQ ID NO: 1021550 - RNA, 19 nt, Homo sapiens
gaaauaaacugaacacuag

SEQ ID NO: 1021551 - RNA, 19 nt, Homo sapiens
gaauuuaucuccaguguuu

SEQ ID NO: 1021552 - RNA, 19 nt, Homo sapiens
gaacaaauccggagagaga

SEQ ID NO: 1021553 - RNA, 19 nt, Homo sapiens
gaucaaaccucguuauauc

SEQ ID NO: 1021554 - RNA, 19 nt, Homo sapiens
caagaagacugggcauuua

SEQ ID NO: 1021555 - RNA, 19 nt, Homo sapiens
cagcagauauugaagauuu

SEQ ID NO: 1021556 - RNA, 19 nt, Homo sapiens
gaaguacgcuugcugaauc

SEQ ID NO: 1021557 - RNA, 19 nt, Homo sapiens
uaagugggcuugugaauau

SEQ ID NO: 1021558 - RNA, 19 nt, Homo sapiens
ggagaaacuuuaggauaua

SEQ ID NO: 1021559 - RNA, 19 nt, Homo sapiens
gggagaaacuuuaggauau

SEQ ID NO: 1021560 - RNA, 19 nt, Homo sapiens
ggaauuggcuacacguuug

SEQ ID NO: 1021561 - RNA, 19 nt, Homo sapiens
gcaaucaaguguacuaugu

SEQ ID NO: 1021562 - RNA, 19 nt, Homo sapiens
ugacugaccugguaacauu

SEQ ID NO: 1021563 - RNA, 19 nt, Homo sapiens
gaucaucccagaccuaaua

SEQ ID NO: 1021564 - RNA, 19 nt, Homo sapiens
ugauuuagcugccauagaa

SEQ ID NO: 1021565 - RNA, 19 nt, Homo sapiens
gauguuggcuauacucuug

SEQ ID NO: 1021566 - RNA, 19 nt, Homo sapiens
gaagaacaauggcaagaag

SEQ ID NO: 1021567 - RNA, 19 nt, Homo sapiens
gcacuggacuugcucuguu

SEQ ID NO: 1021568 - RNA, 19 nt, Homo sapiens
ggaaguaguccuuugauau

SEQ ID NO: 1021569 - RNA, 19 nt, Homo sapiens
gcaagaagacugggcauuu

SEQ ID NO: 1021570 - RNA, 19 nt, Homo sapiens
aaagauguguuguuuguga

SEQ ID NO: 1021571 - RNA, 19 nt, Homo sapiens
gaccaagggugaaaucuuc

SEQ ID NO: 1021572 - RNA, 19 nt, Homo sapiens
gaaguaguccuuugauaug

SEQ ID NO: 1021573 - RNA, 19 nt, Homo sapiens
ccacuucucugcuuugguu

SEQ ID NO: 1021574 - RNA, 19 nt, Homo sapiens
gacgaccaauuauaguuua

SEQ ID NO: 1021575 - RNA, 19 nt, Homo sapiens
ccaaagaccuaguggaaca

SEQ ID NO: 1021576 - RNA, 19 nt, Homo sapiens
ugacacagcucacuucaag

SEQ ID NO: 1021577 - RNA, 19 nt, Homo sapiens
guuaaucucauccuucuua

SEQ ID NO: 1021578 - RNA, 19 nt, Homo sapiens
uguaaugacccuaaaguua

SEQ ID NO: 1021579 - RNA, 19 nt, Homo sapiens
gagguggaauguaguuauu

SEQ ID NO: 1021580 - RNA, 19 nt, Homo sapiens
ggagcuagguaaugaggaa

SEQ ID NO: 1021581 - RNA, 19 nt, Homo sapiens
aaaggaagcuacuccaugu

SEQ ID NO: 1021582 - RNA, 19 nt, Homo sapiens
gcuauacucuuguacacuu

SEQ ID NO: 1021583 - RNA, 19 nt, Homo sapiens
ggaaguugcaguaguggua

SEQ ID NO: 1021584 - RNA, 19 nt, Homo sapiens
guacuggcacauauucuua

SEQ ID NO: 1021585 - RNA, 19 nt, Homo sapiens
caaaguguauuccagcaau

SEQ ID NO: 1021586 - RNA, 19 nt, Homo sapiens
uuacagaggugucucaaca

SEQ ID NO: 1021587 - RNA, 19 nt, Homo sapiens
gcgggacucugaagugaaa

SEQ ID NO: 1021588 - RNA, 19 nt, Homo sapiens
ggaauuaagugggcuugug

SEQ ID NO: 1021589 - RNA, 19 nt, Homo sapiens
gcuaaaagauguguuguuu

SEQ ID NO: 1021590 - RNA, 19 nt, Homo sapiens
ggacacagcacuggacuug

SEQ ID NO: 1021591 - RNA, 19 nt, Homo sapiens
gaagauccauuuaaaagug

SEQ ID NO: 1021592 - RNA, 19 nt, Homo sapiens
ccuaguggaacaauuauua

SEQ ID NO: 1021593 - RNA, 19 nt, Homo sapiens
cggaucugcucccaaguua

SEQ ID NO: 1021594 - RNA, 19 nt, Homo sapiens
gcauuuauacucucucuug

SEQ ID NO: 1021595 - RNA, 19 nt, Homo sapiens
gaaucguccuucugccuuu

SEQ ID NO: 1021596 - RNA, 19 nt, Homo sapiens
gcucaccgcagaugaagua

SEQ ID NO: 1021597 - RNA, 19 nt, Homo sapiens
caaggcaucagaucuguaa

SEQ ID NO: 1021598 - RNA, 19 nt, Homo sapiens
ggagacugccuacuugauu

SEQ ID NO: 1021599 - RNA, 19 nt, Homo sapiens
agaggcuucuucaauaaua

SEQ ID NO: 1021600 - RNA, 19 nt, Homo sapiens
caagugauguugguagaga

SEQ ID NO: 1021601 - RNA, 19 nt, Homo sapiens
acacacaccuuauggagau

SEQ ID NO: 1021602 - RNA, 19 nt, Homo sapiens
gaucuguaaugacccuaaa

SEQ ID NO: 1021603 - RNA, 19 nt, Homo sapiens
ggcaucagaucuguaauga

SEQ ID NO: 1021604 - RNA, 19 nt, Homo sapiens
cugcaugacuguucacauu

SEQ ID NO: 1021605 - RNA, 19 nt, Homo sapiens
gguuguagaaggugauuua

SEQ ID NO: 1021606 - RNA, 19 nt, Homo sapiens
gguaauagccaaaggagau

SEQ ID NO: 1021607 - RNA, 19 nt, Homo sapiens
gaauuaagugggcuuguga

SEQ ID NO: 1021608 - RNA, 19 nt, Homo sapiens
auucuuagacgaccaauua

SEQ ID NO: 1021609 - RNA, 19 nt, Homo sapiens
cauagaagcauacaaguca

SEQ ID NO: 1021610 - RNA, 19 nt, Homo sapiens
gagacugccuacuugauuc

SEQ ID NO: 1021611 - RNA, 19 nt, Homo sapiens
caacaagcagcaaagugua

SEQ ID NO: 1021612 - RNA, 19 nt, Homo sapiens
ucccagaccuaauaacauu

SEQ ID NO: 1021613 - RNA, 19 nt, Homo sapiens
guggaacaauuauuacaga

SEQ ID NO: 1021614 - RNA, 19 nt, Homo sapiens
agaccuaguggaacaauua

SEQ ID NO: 1021615 - RNA, 19 nt, Homo sapiens
gagaggaagaugaggauga

SEQ ID NO: 1021616 - RNA, 19 nt, Homo sapiens
uaacugguccuuggaauug

SEQ ID NO: 1021617 - RNA, 19 nt, Homo sapiens
gauggccucccugaaauua

SEQ ID NO: 1021618 - RNA, 19 nt, Homo sapiens
gcaaugguguguccugaac

SEQ ID NO: 1021619 - RNA, 19 nt, Homo sapiens
gaggcuucuucaauaauaa

SEQ ID NO: 1021620 - RNA, 19 nt, Homo sapiens
guguuuaucugccuuuguu

SEQ ID NO: 1021621 - RNA, 19 nt, Homo sapiens
cuacgaagcgggacucuga

SEQ ID NO: 1021622 - RNA, 19 nt, Homo sapiens
gcucaagaccaguugcuuu

SEQ ID NO: 1021623 - RNA, 19 nt, Homo sapiens
gagcuuugguuuacauuuu

SEQ ID NO: 1021624 - RNA, 19 nt, Homo sapiens
agaagaagaaucuccaauu

SEQ ID NO: 1021625 - RNA, 19 nt, Homo sapiens
cguuauaucuccugccuau

SEQ ID NO: 1021626 - RNA, 19 nt, Homo sapiens
gaucaccuccugcuacgaa

SEQ ID NO: 1021627 - RNA, 19 nt, Homo sapiens
gcccaaagaccuaguggaa

SEQ ID NO: 1021628 - RNA, 19 nt, Homo sapiens
uacacacgcuggaaagauu

SEQ ID NO: 1021629 - RNA, 19 nt, Homo sapiens
ucucagagcuuugguuuac

SEQ ID NO: 1021630 - RNA, 19 nt, Homo sapiens
ugugaggaauacaaugaua

SEQ ID NO: 1021631 - RNA, 19 nt, Homo sapiens
gugaauauuguacguauga

SEQ ID NO: 1021632 - RNA, 19 nt, Homo sapiens
gcaugcaucuuuugagaaa

SEQ ID NO: 1021633 - RNA, 19 nt, Homo sapiens
ucaaacagcagaagaccaa

SEQ ID NO: 1021634 - RNA, 19 nt, Homo sapiens
gaucugcucccaaguuauc

SEQ ID NO: 1021635 - RNA, 19 nt, Homo sapiens
guaaugaggaacagcaaga

SEQ ID NO: 1021636 - RNA, 19 nt, Homo sapiens
uagaucaaaccucguuaua

SEQ ID NO: 1021637 - RNA, 19 nt, Homo sapiens
ggauuuugcuugcuauauu

SEQ ID NO: 1021638 - RNA, 19 nt, Homo sapiens
guccugaacugacagaaca

SEQ ID NO: 1021639 - RNA, 19 nt, Homo sapiens
gaagcgggacucugaagug

SEQ ID NO: 1021640 - RNA, 19 nt, Homo sapiens
ugaggaugaugaagaugaa

SEQ ID NO: 1021641 - RNA, 19 nt, Homo sapiens
ggaagaugaggaugaugaa

SEQ ID NO: 1021642 - RNA, 19 nt, Homo sapiens
uggcuggacugcuguguga

SEQ ID NO: 1021643 - RNA, 19 nt, Homo sapiens
uuuauacucucucuugcua

SEQ ID NO: 1021644 - RNA, 19 nt, Homo sapiens
auuaguggcuucccguuaa

SEQ ID NO: 1021645 - RNA, 19 nt, Homo sapiens
acacagcucacuucaagaa

SEQ ID NO: 1021646 - RNA, 19 nt, Homo sapiens
acagagaacuuuuguugaa

SEQ ID NO: 1021647 - RNA, 19 nt, Homo sapiens
gaccaauuauaguuuaugg

SEQ ID NO: 1021648 - RNA, 19 nt, Homo sapiens
gcaugacuguucacauugg

SEQ ID NO: 1021649 - RNA, 19 nt, Homo sapiens
ggaaggaucuggaauaauc

SEQ ID NO: 1021650 - RNA, 19 nt, Homo sapiens
gagaaagaguuaaagauga

SEQ ID NO: 1021651 - RNA, 19 nt, Homo sapiens
cauauaugcuucuagguua

SEQ ID NO: 1021652 - RNA, 19 nt, Homo sapiens
gcaaguggguuauguguuc

SEQ ID NO: 1021653 - RNA, 19 nt, Homo sapiens
gaccaaagaagucugauua

SEQ ID NO: 1021654 - RNA, 19 nt, Homo sapiens
gcauacaacuagaaccaua

SEQ ID NO: 1021655 - RNA, 19 nt, Homo sapiens
ggaucucacucuccucuua

SEQ ID NO: 1021656 - RNA, 19 nt, Homo sapiens
gaauuuccauuguagguuu

SEQ ID NO: 1021657 - RNA, 19 nt, Homo sapiens
ccaaagaagucugauuaaa

SEQ ID NO: 1021658 - RNA, 19 nt, Homo sapiens
gcaagguaauucuuauuug

SEQ ID NO: 1021659 - RNA, 19 nt, Homo sapiens
gugaagggcuggaauguau

SEQ ID NO: 1021660 - RNA, 19 nt, Homo sapiens
uaagauggaugacuggaaa

SEQ ID NO: 1021661 - RNA, 19 nt, Homo sapiens
cgaagccuuugaagaauua

SEQ ID NO: 1021662 - RNA, 19 nt, Homo sapiens
gaacggaaaugaccuuagg

SEQ ID NO: 1021663 - RNA, 19 nt, Homo sapiens
caaaugguuuagagucaua

SEQ ID NO: 1021664 - RNA, 19 nt, Homo sapiens
ggagaaagaguuaaagaug

SEQ ID NO: 1021665 - RNA, 19 nt, Homo sapiens
gagcucagacccuaaagua

SEQ ID NO: 1021666 - RNA, 19 nt, Homo sapiens
cagcucaucucccagcaua

SEQ ID NO: 1021667 - RNA, 19 nt, Homo sapiens
caagguagggccaaauuaa

SEQ ID NO: 1021668 - RNA, 19 nt, Homo sapiens
agacgaagccuuugaagaa

SEQ ID NO: 1021669 - RNA, 19 nt, Homo sapiens
auaggaaucuugcaaggua

SEQ ID NO: 1021670 - RNA, 19 nt, Homo sapiens
cgcauagacuguuaagaua

SEQ ID NO: 1021671 - RNA, 19 nt, Homo sapiens
gcaagguagggccaaauua

SEQ ID NO: 1021672 - RNA, 19 nt, Homo sapiens
agaaagugauugcugauga

SEQ ID NO: 1021673 - RNA, 19 nt, Homo sapiens
uaagaaaguucagaaagug

SEQ ID NO: 1021674 - RNA, 19 nt, Homo sapiens
uaaaguaacucgggaccaa

SEQ ID NO: 1021675 - RNA, 19 nt, Homo sapiens
gaucuggaauaaucuugaa

SEQ ID NO: 1021676 - RNA, 19 nt, Homo sapiens
uaggaaggaucuggaauaa

SEQ ID NO: 1021677 - RNA, 19 nt, Homo sapiens
cacuaaagaugccaggaua

SEQ ID NO: 1021678 - RNA, 19 nt, Homo sapiens
ucacucuccucuaccuuua

SEQ ID NO: 1021679 - RNA, 19 nt, Homo sapiens
gcauagacuguuaagauaa

SEQ ID NO: 1021680 - RNA, 19 nt, Homo sapiens
gggagaaacugaggcagaa

SEQ ID NO: 1021681 - RNA, 19 nt, Homo sapiens
gaaacagaaacaauacuug

SEQ ID NO: 1021682 - RNA, 19 nt, Homo sapiens
gaccaaaugaagauguuua

SEQ ID NO: 1021683 - RNA, 19 nt, Homo sapiens
ggauuguccugacucacua

SEQ ID NO: 1021684 - RNA, 19 nt, Homo sapiens
gauauauccuccuuuaacu

SEQ ID NO: 1021685 - RNA, 19 nt, Homo sapiens
gaaagugauugcugaugag

SEQ ID NO: 1021686 - RNA, 19 nt, Homo sapiens
cgaagaagacaaccaagaa

SEQ ID NO: 1021687 - RNA, 19 nt, Homo sapiens
gcucaucucccagcauaua

SEQ ID NO: 1021688 - RNA, 19 nt, Homo sapiens
aaaguccaguucuacauuu

SEQ ID NO: 1021689 - RNA, 19 nt, Homo sapiens
gcaggaauuuaagaaaguu

SEQ ID NO: 1021690 - RNA, 19 nt, Homo sapiens
gaaggccgcuaugaucgaa

SEQ ID NO: 1021691 - RNA, 19 nt, Homo sapiens
gcucaucuguguccugugu

SEQ ID NO: 1021692 - RNA, 19 nt, Homo sapiens
gaagacagcgaggaagaaa

SEQ ID NO: 1021693 - RNA, 19 nt, Homo sapiens
gcuuugugcucccgaguaa

SEQ ID NO: 1021694 - RNA, 19 nt, Homo sapiens
cagagacacuccugagguu

SEQ ID NO: 1021695 - RNA, 19 nt, Homo sapiens
gaggaagugugccgagaau

SEQ ID NO: 1021696 - RNA, 19 nt, Homo sapiens
aggaagaaauggaggauga

SEQ ID NO: 1021697 - RNA, 19 nt, Homo sapiens
gaagcucccaggcauauau

SEQ ID NO: 1021698 - RNA, 19 nt, Homo sapiens
uaaagaugaggaagagaua

SEQ ID NO: 1021699 - RNA, 19 nt, Homo sapiens
cuugauaccucuaaugaau

SEQ ID NO: 1021700 - RNA, 19 nt, Homo sapiens
ccauagaccuucagaucau

SEQ ID NO: 1021701 - RNA, 19 nt, Homo sapiens
ugaagaagaggacacauga

SEQ ID NO: 1021702 - RNA, 19 nt, Homo sapiens
aaacugaggcagaaaguga

SEQ ID NO: 1021703 - RNA, 19 nt, Homo sapiens
uccaagggaugaccaguuu

SEQ ID NO: 1021704 - RNA, 19 nt, Homo sapiens
uguaacggcuucugauuuc

SEQ ID NO: 1021705 - RNA, 19 nt, Homo sapiens
cagcaggaauuuaagaaag

SEQ ID NO: 1021706 - RNA, 19 nt, Homo sapiens
caagguaauucuuauuugc

SEQ ID NO: 1021707 - RNA, 19 nt, Homo sapiens
ucauacgcauagacuguua

SEQ ID NO: 1021708 - RNA, 19 nt, Homo sapiens
ggcagaaguuccucaguca

SEQ ID NO: 1021709 - RNA, 19 nt, Homo sapiens
ccacauggauagguugaug

SEQ ID NO: 1021710 - RNA, 19 nt, Homo sapiens
gguguucacuuacgaagca

SEQ ID NO: 1021711 - RNA, 19 nt, Homo sapiens
ggacugaaggccgcuauga

SEQ ID NO: 1021712 - RNA, 19 nt, Homo sapiens
aaaccugcaucuucuugaa

SEQ ID NO: 1021713 - RNA, 19 nt, Homo sapiens
gucaguaaaggaucuaaua

SEQ ID NO: 1021714 - RNA, 19 nt, Homo sapiens
caagagcucagacccuaaa

SEQ ID NO: 1021715 - RNA, 19 nt, Homo sapiens
gacgaagccuuugaagaau

SEQ ID NO: 1021716 - RNA, 19 nt, Homo sapiens
gucaccaucuggccgaaua

SEQ ID NO: 1021717 - RNA, 19 nt, Homo sapiens
cacaauuucuuacaaccaa

SEQ ID NO: 1021718 - RNA, 19 nt, Homo sapiens
gaagggcuggaauguauau

SEQ ID NO: 1021719 - RNA, 19 nt, Homo sapiens
gaagggaagucagaguuuu

SEQ ID NO: 1021720 - RNA, 19 nt, Homo sapiens
caguaucgcuuuguuagga

SEQ ID NO: 1021721 - RNA, 19 nt, Homo sapiens
ccugugaccuguguacgua

SEQ ID NO: 1021722 - RNA, 19 nt, Homo sapiens
caacuagaaccauauccaa

SEQ ID NO: 1021723 - RNA, 19 nt, Homo sapiens
gggcuggaauguauauuac

SEQ ID NO: 1021724 - RNA, 19 nt, Homo sapiens
aaacguacuuccaccagau

SEQ ID NO: 1021725 - RNA, 19 nt, Homo sapiens
gaagaagaggacacaugaa

SEQ ID NO: 1021726 - RNA, 19 nt, Homo sapiens
ugaaucagcugagccaaag

SEQ ID NO: 1021727 - RNA, 19 nt, Homo sapiens
gaaaguucagaaagugauu

SEQ ID NO: 1021728 - RNA, 19 nt, Homo sapiens
gggaccaaaugaagauguu

SEQ ID NO: 1021729 - RNA, 19 nt, Homo sapiens
gaagaagacaaccaagaag

SEQ ID NO: 1021730 - RNA, 19 nt, Homo sapiens
gaagucugauuaaaaguug

SEQ ID NO: 1021731 - RNA, 19 nt, Homo sapiens
ucagugcuguggaaaugaa

SEQ ID NO: 1021732 - RNA, 19 nt, Homo sapiens
gguguuggagaaagaguua

SEQ ID NO: 1021733 - RNA, 19 nt, Homo sapiens
guggugccaugaauuaaga

SEQ ID NO: 1021734 - RNA, 19 nt, Homo sapiens
uuaggaaggaucuggaaua

SEQ ID NO: 1021735 - RNA, 19 nt, Homo sapiens
gaacaacuugauaccucua

SEQ ID NO: 1021736 - RNA, 19 nt, Homo sapiens
ggaagaagcggaggucaag

SEQ ID NO: 1021737 - RNA, 19 nt, Homo sapiens
gcagagagaguggccaaga

SEQ ID NO: 1021738 - RNA, 19 nt, Homo sapiens
uuacgaagcauacaacuag

SEQ ID NO: 1021739 - RNA, 19 nt, Homo sapiens
gguuggacuuccuugcuuu

SEQ ID NO: 1021740 - RNA, 19 nt, Homo sapiens
agaaagaguuaaagaugag

SEQ ID NO: 1021741 - RNA, 19 nt, Homo sapiens
uguccugacucacuaaaga

SEQ ID NO: 1021742 - RNA, 19 nt, Homo sapiens
guacguauuacaggcuuua

SEQ ID NO: 1021743 - RNA, 19 nt, Homo sapiens
guauuuugguguucacuua

SEQ ID NO: 1021744 - RNA, 19 nt, Homo sapiens
gaaugcggcuucugcuacu

SEQ ID NO: 1021745 - RNA, 19 nt, Homo sapiens
ggaccaaagaagucugauu

SEQ ID NO: 1021746 - RNA, 19 nt, Homo sapiens
gaauuaagaagcaaagacu

SEQ ID NO: 1021747 - RNA, 19 nt, Homo sapiens
gaguaccuauugccaggaa

SEQ ID NO: 1021748 - RNA, 19 nt, Homo sapiens
gaccaugggcuugauuuga

SEQ ID NO: 1021749 - RNA, 19 nt, Homo sapiens
caaggaaccucgugucauu

SEQ ID NO: 1021750 - RNA, 19 nt, Homo sapiens
ggaacuauaucaacaaauc

SEQ ID NO: 1021751 - RNA, 19 nt, Homo sapiens
gcaggaagaugagaagaaa

SEQ ID NO: 1021752 - RNA, 19 nt, Homo sapiens
gaaguaugcuguagguaug

SEQ ID NO: 1021753 - RNA, 19 nt, Homo sapiens
gggcauguguggaaaguaa

SEQ ID NO: 1021754 - RNA, 19 nt, Homo sapiens
cgaaggagaugaccauaug

SEQ ID NO: 1021755 - RNA, 19 nt, Homo sapiens
gaaauugcaacaacaguuu

SEQ ID NO: 1021756 - RNA, 19 nt, Homo sapiens
gcagaagcauccuaagugu

SEQ ID NO: 1021757 - RNA, 19 nt, Homo sapiens
aaacagcccuuucaaucuu

SEQ ID NO: 1021758 - RNA, 19 nt, Homo sapiens
gaagaguauuuaucagguu

SEQ ID NO: 1021759 - RNA, 19 nt, Homo sapiens
guagaucccuuugaaguau

SEQ ID NO: 1021760 - RNA, 19 nt, Homo sapiens
gaaagggcauguguggaaa

SEQ ID NO: 1021761 - RNA, 19 nt, Homo sapiens
agaagcauccuaaguguua

SEQ ID NO: 1021762 - RNA, 19 nt, Homo sapiens
gaagauggaggcccagauu

SEQ ID NO: 1021763 - RNA, 19 nt, Homo sapiens
caaaucaguuaugccguua

SEQ ID NO: 1021764 - RNA, 19 nt, Homo sapiens
guaaacagcaaauagaaga

SEQ ID NO: 1021765 - RNA, 19 nt, Homo sapiens
gagaugaaauugcaacaac

SEQ ID NO: 1021766 - RNA, 19 nt, Homo sapiens
ggaggaaugggaacuauau

SEQ ID NO: 1021767 - RNA, 19 nt, Homo sapiens
gcaauccgaagaguauuua

SEQ ID NO: 1021768 - RNA, 19 nt, Homo sapiens
caugagagaugaaauugca

SEQ ID NO: 1021769 - RNA, 19 nt, Homo sapiens
gguagaucccuuugaagua

SEQ ID NO: 1021770 - RNA, 19 nt, Homo sapiens
ggauaaacaacaaucagaa

SEQ ID NO: 1021771 - RNA, 19 nt, Homo sapiens
ugaugacgaucuuguuuga

SEQ ID NO: 1021772 - RNA, 19 nt, Homo sapiens
ucccagaccuccuuaucua

SEQ ID NO: 1021773 - RNA, 19 nt, Homo sapiens
ggaaugggaacuauaucaa

SEQ ID NO: 1021774 - RNA, 19 nt, Homo sapiens
cauuuacaguugcuucuuu

SEQ ID NO: 1021775 - RNA, 19 nt, Homo sapiens
aaagaucccauucuagaaa

SEQ ID NO: 1021776 - RNA, 19 nt, Homo sapiens
cagaccuccuuaucuauuu

SEQ ID NO: 1021777 - RNA, 19 nt, Homo sapiens
gcaucaggauaaacaacaa

SEQ ID NO: 1021778 - RNA, 19 nt, Homo sapiens
cagaaaagcugaugacgau

SEQ ID NO: 1021779 - RNA, 19 nt, Homo sapiens
ccacaucugggaaugaauu

SEQ ID NO: 1021780 - RNA, 19 nt, Homo sapiens
gaaccucgugucauuccua

SEQ ID NO: 1021781 - RNA, 19 nt, Homo sapiens
gaauuugcagcaccuggua

SEQ ID NO: 1021782 - RNA, 19 nt, Homo sapiens
auaaagaucccauucuaga

SEQ ID NO: 1021783 - RNA, 19 nt, Homo sapiens
auagaagacuuugcagaaa

SEQ ID NO: 1021784 - RNA, 19 nt, Homo sapiens
aaccauccauuuacaguug

SEQ ID NO: 1021785 - RNA, 19 nt, Homo sapiens
agaaagggcauguguggaa

SEQ ID NO: 1021786 - RNA, 19 nt, Homo sapiens
ugaaguaugcuguagguau

SEQ ID NO: 1021787 - RNA, 19 nt, Homo sapiens
uaaagaucccauucuagaa

SEQ ID NO: 1021788 - RNA, 19 nt, Homo sapiens
gcugaugacgaucuuguuu

SEQ ID NO: 1021789 - RNA, 19 nt, Homo sapiens
aauagaagacuuugcagaa

SEQ ID NO: 1021790 - RNA, 19 nt, Homo sapiens
augacgaucuuguuugaaa

SEQ ID NO: 1021791 - RNA, 19 nt, Homo sapiens
gaagucacuggcacucuga

SEQ ID NO: 1021792 - RNA, 19 nt, Homo sapiens
ccagaccuccuuaucuauu

SEQ ID NO: 1021793 - RNA, 19 nt, Homo sapiens
gcucgcagaagcauccuaa

SEQ ID NO: 1021794 - RNA, 19 nt, Homo sapiens
ucagcaauccgaagaguau

SEQ ID NO: 1021795 - RNA, 19 nt, Homo sapiens
cuaaguaaacagcaaauag

SEQ ID NO: 1021796 - RNA, 19 nt, Homo sapiens
ugggaacuauaucaacaaa

SEQ ID NO: 1021797 - RNA, 19 nt, Homo sapiens
aaugggaacuauaucaaca

SEQ ID NO: 1021798 - RNA, 19 nt, Homo sapiens
gggaggaaugggaacuaua

SEQ ID NO: 1021799 - RNA, 19 nt, Homo sapiens
agaaaguuguagcaaggaa

SEQ ID NO: 1021800 - RNA, 19 nt, Homo sapiens
ucaggugcaucaggauaaa

SEQ ID NO: 1021801 - RNA, 19 nt, Homo sapiens
gcacucugauugcccuucu

SEQ ID NO: 1021802 - RNA, 19 nt, Homo sapiens
ugaaauugcaacaacaguu

SEQ ID NO: 1021803 - RNA, 19 nt, Homo sapiens
ggguagaucccuuugaagu

SEQ ID NO: 1021804 - RNA, 19 nt, Homo sapiens
gaguauuuaucagguugaa

SEQ ID NO: 1021805 - RNA, 19 nt, Homo sapiens
uagaagacuuugcagaaaa

SEQ ID NO: 1021806 - RNA, 19 nt, Homo sapiens
ggcaggaagaugagaagaa

SEQ ID NO: 1021807 - RNA, 19 nt, Homo sapiens
gcaaggaaccucgugucau

SEQ ID NO: 1021808 - RNA, 19 nt, Homo sapiens
ucaguuaugccguuaguag

SEQ ID NO: 1021809 - RNA, 19 nt, Homo sapiens
gaugaagaaaguuguagca

SEQ ID NO: 1021810 - RNA, 19 nt, Homo sapiens
agacguuucucuuucugau

SEQ ID NO: 1021811 - RNA, 19 nt, Homo sapiens
gaaugggaacuauaucaac

SEQ ID NO: 1021812 - RNA, 19 nt, Homo sapiens
ccagauucuugagacguuu

SEQ ID NO: 1021813 - RNA, 19 nt, Homo sapiens
ugcagcaccugguagaaga

SEQ ID NO: 1021814 - RNA, 19 nt, Homo sapiens
guguuggccuccugggaaa

SEQ ID NO: 1021815 - RNA, 19 nt, Homo sapiens
uuucuugaaucaugagaga

SEQ ID NO: 1021816 - RNA, 19 nt, Homo sapiens
aaagucagcaauccgaaga

SEQ ID NO: 1021817 - RNA, 19 nt, Homo sapiens
gauggaggcccagauucuu

SEQ ID NO: 1021818 - RNA, 19 nt, Homo sapiens
aaaggcagaugggaggaau

SEQ ID NO: 1021819 - RNA, 19 nt, Homo sapiens
auggguagaucccuuugaa

SEQ ID NO: 1021820 - RNA, 19 nt, Homo sapiens
cauauggguagaucccuuu

SEQ ID NO: 1021821 - RNA, 19 nt, Homo sapiens
uguggaaaguaauguagau

SEQ ID NO: 1021822 - RNA, 19 nt, Homo sapiens
cgcagaagcauccuaagug

SEQ ID NO: 1021823 - RNA, 19 nt, Homo sapiens
cuguagguauggugagaaa

SEQ ID NO: 1021824 - RNA, 19 nt, Homo sapiens
cccagauucuugagacguu

SEQ ID NO: 1021825 - RNA, 19 nt, Homo sapiens
gaaacauacagaagucacu

SEQ ID NO: 1021826 - RNA, 19 nt, Homo sapiens
agaugaaauugcaacaaca

SEQ ID NO: 1021827 - RNA, 19 nt, Homo sapiens
gcaccggcuggacagaauu

SEQ ID NO: 1021828 - RNA, 19 nt, Homo sapiens
gcauguguggaaaguaaug

SEQ ID NO: 1021829 - RNA, 19 nt, Homo sapiens
gaugaaauugcaacaacag

SEQ ID NO: 1021830 - RNA, 19 nt, Homo sapiens
gcccuuucaaucuugguua

SEQ ID NO: 1021831 - RNA, 19 nt, Homo sapiens
aaccucgugucauuccuaa

SEQ ID NO: 1021832 - RNA, 19 nt, Homo sapiens
aaucaguuaugccguuagu

SEQ ID NO: 1021833 - RNA, 19 nt, Homo sapiens
gcuccuccacucccucauu

SEQ ID NO: 1021834 - RNA, 19 nt, Homo sapiens
gaagcauccuaaguguuac

SEQ ID NO: 1021835 - RNA, 19 nt, Homo sapiens
cagaagcauccuaaguguu

SEQ ID NO: 1021836 - RNA, 19 nt, Homo sapiens
aaacuugaaacagcccuuu

SEQ ID NO: 1021837 - RNA, 19 nt, Homo sapiens
gaaggagaugaccauaugg

SEQ ID NO: 1021838 - RNA, 19 nt, Homo sapiens
uuugaaacauacagaaguc

SEQ ID NO: 1021839 - RNA, 19 nt, Homo sapiens
gcagcaccugguagaagaa

SEQ ID NO: 1021840 - RNA, 19 nt, Homo sapiens
aaaccauccauuuacaguu

SEQ ID NO: 1021841 - RNA, 19 nt, Homo sapiens
ccgaaggagaugaccauau

SEQ ID NO: 1021842 - RNA, 19 nt, Homo sapiens
aggaagaugagaagaaauc

SEQ ID NO: 1021843 - RNA, 19 nt, Homo sapiens
gaaaagcugaugacgaucu

SEQ ID NO: 1021844 - RNA, 19 nt, Homo sapiens
acagcaaauagaagacuuu

SEQ ID NO: 1021845 - RNA, 19 nt, Homo sapiens
gcaacaacaguuuucuuug

SEQ ID NO: 1021846 - RNA, 19 nt, Homo sapiens
caaucuugguuacaaaucc

SEQ ID NO: 1021847 - RNA, 19 nt, Homo sapiens
ugggaggaaugggaacuau

SEQ ID NO: 1021848 - RNA, 19 nt, Homo sapiens
cagccaagcucaaccauaa

SEQ ID NO: 1021849 - RNA, 19 nt, Homo sapiens
gaagagcccacucagcuua

SEQ ID NO: 1021850 - RNA, 19 nt, Homo sapiens
uaaauucucuugcauguuc

SEQ ID NO: 1021851 - RNA, 19 nt, Homo sapiens
caaaggguguccguucuua

SEQ ID NO: 1021852 - RNA, 19 nt, Homo sapiens
ucuaagagcuguucaauac

SEQ ID NO: 1021853 - RNA, 19 nt, Homo sapiens
cauuauacgugucuucuaa

SEQ ID NO: 1021854 - RNA, 19 nt, Homo sapiens
ggacuuggcuuccugaaaa

SEQ ID NO: 1021855 - RNA, 19 nt, Homo sapiens
guauaaugcccacguguua

SEQ ID NO: 1021856 - RNA, 19 nt, Homo sapiens
ccuguuagaucuccuguuu

SEQ ID NO: 1021857 - RNA, 19 nt, Homo sapiens
gaaguuauucacuguguuu

SEQ ID NO: 1021858 - RNA, 19 nt, Homo sapiens
uaauugcucugccaucgua

SEQ ID NO: 1021859 - RNA, 19 nt, Homo sapiens
gauagugccuguuagaucu

SEQ ID NO: 1021860 - RNA, 19 nt, Homo sapiens
ucaguuggcagaacauuua

SEQ ID NO: 1021861 - RNA, 19 nt, Homo sapiens
uuacagcuauuucagguuu

SEQ ID NO: 1021862 - RNA, 19 nt, Homo sapiens
ucucuugcauguuccauua

SEQ ID NO: 1021863 - RNA, 19 nt, Homo sapiens
gaggauaucgugacaguau

SEQ ID NO: 1021864 - RNA, 19 nt, Homo sapiens
gcaagugcgugaucaugug

SEQ ID NO: 1021865 - RNA, 19 nt, Homo sapiens
ggauaucgugacaguauua

SEQ ID NO: 1021866 - RNA, 19 nt, Homo sapiens
ggaaagagaagcucaaagg

SEQ ID NO: 1021867 - RNA, 19 nt, Homo sapiens
gugugcaucuuuaaucuuu

SEQ ID NO: 1021868 - RNA, 19 nt, Homo sapiens
gcaccuuaaugaaauacuu

SEQ ID NO: 1021869 - RNA, 19 nt, Homo sapiens
caacaugccugagcagagu

SEQ ID NO: 1021870 - RNA, 19 nt, Homo sapiens
cacacuugcucucucaaua

SEQ ID NO: 1021871 - RNA, 19 nt, Homo sapiens
ugaggaguauaacuucuuu

SEQ ID NO: 1021872 - RNA, 19 nt, Homo sapiens
uuagaucuccuguuuguuu

SEQ ID NO: 1021873 - RNA, 19 nt, Homo sapiens
ugaucuaucuguauuggaa

SEQ ID NO: 1021874 - RNA, 19 nt, Homo sapiens
gaucagaugguccaaagug

SEQ ID NO: 1021875 - RNA, 19 nt, Homo sapiens
agaagccaaucacaucuuu

SEQ ID NO: 1021876 - RNA, 19 nt, Homo sapiens
gcacagggagggcuuaagu

SEQ ID NO: 1021877 - RNA, 19 nt, Homo sapiens
gagaacugcuugacuccau

SEQ ID NO: 1021878 - RNA, 19 nt, Homo sapiens
caagccaaauuacagcuau

SEQ ID NO: 1021879 - RNA, 19 nt, Homo sapiens
gcacauuccgggagagcua

SEQ ID NO: 1021880 - RNA, 19 nt, Homo sapiens
caggguagcauguauaaug

SEQ ID NO: 1021881 - RNA, 19 nt, Homo sapiens
guaccgagaggacuaaaug

SEQ ID NO: 1021882 - RNA, 19 nt, Homo sapiens
gggaacaagugugaugaga

SEQ ID NO: 1021883 - RNA, 19 nt, Homo sapiens
gugagagcguguuaaccua

SEQ ID NO: 1021884 - RNA, 19 nt, Homo sapiens
cagaaguuauucacugugu

SEQ ID NO: 1021885 - RNA, 19 nt, Homo sapiens
auaauguuccuguguguua

SEQ ID NO: 1021886 - RNA, 19 nt, Homo sapiens
caauaauguuccugugugu

SEQ ID NO: 1021887 - RNA, 19 nt, Homo sapiens
gcagggauaagugcacuaa

SEQ ID NO: 1021888 - RNA, 19 nt, Homo sapiens
gacagaagccaaucacauc

SEQ ID NO: 1021889 - RNA, 19 nt, Homo sapiens
gagagcguguuaaccuaga

SEQ ID NO: 1021890 - RNA, 19 nt, Homo sapiens
uguuagaucuccuguuugu

SEQ ID NO: 1021891 - RNA, 19 nt, Homo sapiens
uguuauacaucgaggguuu

SEQ ID NO: 1021892 - RNA, 19 nt, Homo sapiens
gaggugagaagaucagaug

SEQ ID NO: 1021893 - RNA, 19 nt, Homo sapiens
aaaccgcccugacuuuaca

SEQ ID NO: 1021894 - RNA, 19 nt, Homo sapiens
aguauucacucuagaaaca

SEQ ID NO: 1021895 - RNA, 19 nt, Homo sapiens
gaugaucuaucuguauugg

SEQ ID NO: 1021896 - RNA, 19 nt, Homo sapiens
acacuuugcaccuuaauga

SEQ ID NO: 1021897 - RNA, 19 nt, Homo sapiens
cagcaaaggccaucagaca

SEQ ID NO: 1021898 - RNA, 19 nt, Homo sapiens
caagagcucccugguguug

SEQ ID NO: 1021899 - RNA, 19 nt, Homo sapiens
gggaggagcagcugugugu

SEQ ID NO: 1021900 - RNA, 19 nt, Homo sapiens
gugaggauaucgugacagu

SEQ ID NO: 1021901 - RNA, 19 nt, Homo sapiens
gaggacugguacccacaaa

SEQ ID NO: 1021902 - RNA, 19 nt, Homo sapiens
gaacugcuugacuccauga

SEQ ID NO: 1021903 - RNA, 19 nt, Homo sapiens
gaguauuuaucuucaugug

SEQ ID NO: 1021904 - RNA, 19 nt, Homo sapiens
ggguguccguucuuaauuc

SEQ ID NO: 1021905 - RNA, 19 nt, Homo sapiens
gaagaucagaugguccaaa

SEQ ID NO: 1021906 - RNA, 19 nt, Homo sapiens
gcucaaccauaacgugaag

SEQ ID NO: 1021907 - RNA, 19 nt, Homo sapiens
gcucaagcccaucuacgaa

SEQ ID NO: 1021908 - RNA, 19 nt, Homo sapiens
gagcgugggaggugccuuu

SEQ ID NO: 1021909 - RNA, 19 nt, Homo sapiens
ggaagagcccacucagcuu

SEQ ID NO: 1021910 - RNA, 19 nt, Homo sapiens
gacuaaaugucaucuacgu

SEQ ID NO: 1021911 - RNA, 19 nt, Homo sapiens
ggcaagugaucagcuguga

SEQ ID NO: 1021912 - RNA, 19 nt, Homo sapiens
ccucucuggucucccaaua

SEQ ID NO: 1021913 - RNA, 19 nt, Homo sapiens
gauuuugugugcaucuuua

SEQ ID NO: 1021914 - RNA, 19 nt, Homo sapiens
gcaggaagaggugagaaga

SEQ ID NO: 1021915 - RNA, 19 nt, Homo sapiens
cgagaugcguccuauuguc

SEQ ID NO: 1021916 - RNA, 19 nt, Homo sapiens
ggaggugccuuugagaacu

SEQ ID NO: 1021917 - RNA, 19 nt, Homo sapiens
gugcaucuuuaaucuuuca

SEQ ID NO: 1021918 - RNA, 19 nt, Homo sapiens
ucuugcauguuccauuaua

SEQ ID NO: 1021919 - RNA, 19 nt, Homo sapiens
aguaaauucucuugcaugu

SEQ ID NO: 1021920 - RNA, 19 nt, Homo sapiens
ugccacacuuugcaccuua

SEQ ID NO: 1021921 - RNA, 19 nt, Homo sapiens
uaaauaacucgaucuguac

SEQ ID NO: 1021922 - RNA, 19 nt, Homo sapiens
gaccgugagucuccagauc

SEQ ID NO: 1021923 - RNA, 19 nt, Homo sapiens
gaacaaaaccgcccugacu

SEQ ID NO: 1021924 - RNA, 19 nt, Homo sapiens
caugaucuccuagaacaaa

SEQ ID NO: 1021925 - RNA, 19 nt, Homo sapiens
uccaugaucuccuagaaca

SEQ ID NO: 1021926 - RNA, 19 nt, Homo sapiens
gugcugcucugucggaagu

SEQ ID NO: 1021927 - RNA, 19 nt, Homo sapiens
caaaaccgcccugacuuua

SEQ ID NO: 1021928 - RNA, 19 nt, Homo sapiens
cugagcagaguaacgauua

SEQ ID NO: 1021929 - RNA, 19 nt, Homo sapiens
agggauaagugcacuaaca

SEQ ID NO: 1021930 - RNA, 19 nt, Homo sapiens
auucccaccuggccuguua

SEQ ID NO: 1021931 - RNA, 19 nt, Homo sapiens
cgagaggacuaaaugucau

SEQ ID NO: 1021932 - RNA, 19 nt, Homo sapiens
aagaucagaugguccaaag

SEQ ID NO: 1021933 - RNA, 19 nt, Homo sapiens
gaggugccuuugagaacug

SEQ ID NO: 1021934 - RNA, 19 nt, Homo sapiens
gcacacuugcucucucaau

SEQ ID NO: 1021935 - RNA, 19 nt, Homo sapiens
acauguauaugccacacuu

SEQ ID NO: 1021936 - RNA, 19 nt, Homo sapiens
ugaccugugaggaguauaa

SEQ ID NO: 1021937 - RNA, 19 nt, Homo sapiens
uaaucgagaugcguccuau

SEQ ID NO: 1021938 - RNA, 19 nt, Homo sapiens
gcaagcagcagaaaaggaa

SEQ ID NO: 1021939 - RNA, 19 nt, Homo sapiens
cuaguuaggaaguaucauu

SEQ ID NO: 1021940 - RNA, 19 nt, Homo sapiens
ggaagaggugagaagauca

SEQ ID NO: 1021941 - RNA, 19 nt, Homo sapiens
uaacucacccuugggaugu

SEQ ID NO: 1021942 - RNA, 19 nt, Homo sapiens
gaaacagaaguuauucacu

SEQ ID NO: 1021943 - RNA, 19 nt, Homo sapiens
ucaagcccaucuacgaaca

SEQ ID NO: 1021944 - RNA, 19 nt, Homo sapiens
cacuugcucucucaauaug

SEQ ID NO: 1021945 - RNA, 19 nt, Homo sapiens
acagggagggcuuaaguug

SEQ ID NO: 1021946 - RNA, 19 nt, Homo sapiens
gccacacuuugcaccuuaa

SEQ ID NO: 1021947 - RNA, 19 nt, Homo sapiens
gcccaucuacgaacaaauc

SEQ ID NO: 1021948 - RNA, 19 nt, Homo sapiens
caaaggcacuggauucuga

SEQ ID NO: 1021949 - RNA, 19 nt, Homo sapiens
ccacauagauggucucuca

SEQ ID NO: 1021950 - RNA, 19 nt, Homo sapiens
gcucuaaggucucaacuga

SEQ ID NO: 1021951 - RNA, 19 nt, Homo sapiens
gcaaagaugcccugaacaa

SEQ ID NO: 1021952 - RNA, 19 nt, Homo sapiens
gcucugaugucaccuguug

SEQ ID NO: 1021953 - RNA, 19 nt, Homo sapiens
ggaguacaguggcgugauu

SEQ ID NO: 1021954 - RNA, 19 nt, Homo sapiens
uaacauaggacuuaccauu

SEQ ID NO: 1021955 - RNA, 19 nt, Homo sapiens
caaauucuagcaaaccuua

SEQ ID NO: 1021956 - RNA, 19 nt, Homo sapiens
gcaccaccaugccagcuaa

SEQ ID NO: 1021957 - RNA, 19 nt, Homo sapiens
uggcagacauccucaauga

SEQ ID NO: 1021958 - RNA, 19 nt, Homo sapiens
gaaggacucgugacuuuga

SEQ ID NO: 1021959 - RNA, 19 nt, Homo sapiens
caacaaaggcacuggauuc

SEQ ID NO: 1021960 - RNA, 19 nt, Homo sapiens
cugaguagcugggauuaua

SEQ ID NO: 1021961 - RNA, 19 nt, Homo sapiens
gccaugcauucuucacuua

SEQ ID NO: 1021962 - RNA, 19 nt, Homo sapiens
gugcacaucugacaugguu

SEQ ID NO: 1021963 - RNA, 19 nt, Homo sapiens
ccaggugucucuaaaggaa

SEQ ID NO: 1021964 - RNA, 19 nt, Homo sapiens
ggugacaaauucuagcaaa

SEQ ID NO: 1021965 - RNA, 19 nt, Homo sapiens
cugaaggacucgugacuuu

SEQ ID NO: 1021966 - RNA, 19 nt, Homo sapiens
ggaagccaguuguggagaa

SEQ ID NO: 1021967 - RNA, 19 nt, Homo sapiens
caucugacaugguuacuag

SEQ ID NO: 1021968 - RNA, 19 nt, Homo sapiens
caugccagcuaauuaauau

SEQ ID NO: 1021969 - RNA, 19 nt, Homo sapiens
ccaccaugccagcuaauua

SEQ ID NO: 1021970 - RNA, 19 nt, Homo sapiens
ggccacggagcuuuaauua

SEQ ID NO: 1021971 - RNA, 19 nt, Homo sapiens
uagauggucucucacaguu

SEQ ID NO: 1021972 - RNA, 19 nt, Homo sapiens
cguaacaggugaucgucua

SEQ ID NO: 1021973 - RNA, 19 nt, Homo sapiens
ggacgcaugugcucuucug

SEQ ID NO: 1021974 - RNA, 19 nt, Homo sapiens
guuacuaguugugugauuu

SEQ ID NO: 1021975 - RNA, 19 nt, Homo sapiens
caaagaugcccugaacaaa

SEQ ID NO: 1021976 - RNA, 19 nt, Homo sapiens
gcagaguugcgaggaaaua

SEQ ID NO: 1021977 - RNA, 19 nt, Homo sapiens
ccucgaagguauuguagug

SEQ ID NO: 1021978 - RNA, 19 nt, Homo sapiens
cggcugagguuaauuaaaa

SEQ ID NO: 1021979 - RNA, 19 nt, Homo sapiens
ucaaauuccuggccucaag

SEQ ID NO: 1021980 - RNA, 19 nt, Homo sapiens
gaggcuuggugacaaauuc

SEQ ID NO: 1021981 - RNA, 19 nt, Homo sapiens
caccucaccugcuuucuuc

SEQ ID NO: 1021982 - RNA, 19 nt, Homo sapiens
ggugaucgucuaagagaaa

SEQ ID NO: 1021983 - RNA, 19 nt, Homo sapiens
ugacaugguuacuaguugu

SEQ ID NO: 1021984 - RNA, 19 nt, Homo sapiens
caccaugccagcuaauuaa

SEQ ID NO: 1021985 - RNA, 19 nt, Homo sapiens
gaagccaguuguggagaau

SEQ ID NO: 1021986 - RNA, 19 nt, Homo sapiens
gacccucccuucccucguu

SEQ ID NO: 1021987 - RNA, 19 nt, Homo sapiens
gcaggugggugggacuaug

SEQ ID NO: 1021988 - RNA, 19 nt, Homo sapiens
guccugcaguggcgauuaa

SEQ ID NO: 1021989 - RNA, 19 nt, Homo sapiens
ccaggcugaucucaaauuc

SEQ ID NO: 1021990 - RNA, 19 nt, Homo sapiens
caguggcgauuaaugcaaa

SEQ ID NO: 1021991 - RNA, 19 nt, Homo sapiens
cuaguugugugauuucugu

SEQ ID NO: 1021992 - RNA, 19 nt, Homo sapiens
cuccugggcucaagcaauu

SEQ ID NO: 1021993 - RNA, 19 nt, Homo sapiens
ccacagacgcucagccaau

SEQ ID NO: 1021994 - RNA, 19 nt, Homo sapiens
cauaggacuuaccauuuua

SEQ ID NO: 1021995 - RNA, 19 nt, Homo sapiens
ccaugccagcuaauuaaua

SEQ ID NO: 1021996 - RNA, 19 nt, Homo sapiens
ugucuucccucucauucuu

SEQ ID NO: 1021997 - RNA, 19 nt, Homo sapiens
ucaaauaccuggggcuaaa

SEQ ID NO: 1021998 - RNA, 19 nt, Homo sapiens
cacagacgcucagccaaug

SEQ ID NO: 1021999 - RNA, 19 nt, Homo sapiens
gcuugcugcuguuuauaga

SEQ ID NO: 1022000 - RNA, 19 nt, Homo sapiens
aaagaugcccugaacaaag

SEQ ID NO: 1022001 - RNA, 19 nt, Homo sapiens
ucccuucccucguucauug

SEQ ID NO: 1022002 - RNA, 19 nt, Homo sapiens
ugcccaggcugaucucaaa

SEQ ID NO: 1022003 - RNA, 19 nt, Homo sapiens
acauaggacuuaccauuuu

SEQ ID NO: 1022004 - RNA, 19 nt, Homo sapiens
aacauaggacuuaccauuu

SEQ ID NO: 1022005 - RNA, 19 nt, Homo sapiens
ggccaggugucucuaaagg

SEQ ID NO: 1022006 - RNA, 19 nt, Homo sapiens
guccuuggcgcucagauuu

SEQ ID NO: 1022007 - RNA, 19 nt, Homo sapiens
gcacaucugacaugguuac

SEQ ID NO: 1022008 - RNA, 19 nt, Homo sapiens
ggcgauuaaugcaaagaug

SEQ ID NO: 1022009 - RNA, 19 nt, Homo sapiens
gguuacuaguugugugauu

SEQ ID NO: 1022010 - RNA, 19 nt, Homo sapiens
caggugaucgucuaagaga

SEQ ID NO: 1022011 - RNA, 19 nt, Homo sapiens
ugauuugccuguccugaag

SEQ ID NO: 1022012 - RNA, 19 nt, Homo sapiens
acccauaacauaggacuua

SEQ ID NO: 1022013 - RNA, 19 nt, Homo sapiens
caugcauucuucacuuaau

SEQ ID NO: 1022014 - RNA, 19 nt, Homo sapiens
aaauacccauaacauagga

SEQ ID NO: 1022015 - RNA, 19 nt, Homo sapiens
gccacggagcuuuaauuaa

SEQ ID NO: 1022016 - RNA, 19 nt, Homo sapiens
caaggccaggugucucuaa

SEQ ID NO: 1022017 - RNA, 19 nt, Homo sapiens
ccuuggcgcucagauuuga

SEQ ID NO: 1022018 - RNA, 19 nt, Homo sapiens
gcugcagaguugcgaggaa

SEQ ID NO: 1022019 - RNA, 19 nt, Homo sapiens
gaucgggaaccagccauga

SEQ ID NO: 1022020 - RNA, 19 nt, Homo sapiens
aacaggugaucgucuaaga

SEQ ID NO: 1022021 - RNA, 19 nt, Homo sapiens
guaacaggugaucgucuaa

SEQ ID NO: 1022022 - RNA, 19 nt, Homo sapiens
gcaguggcgauuaaugcaa

SEQ ID NO: 1022023 - RNA, 19 nt, Homo sapiens
cugcagaguugcgaggaaa

SEQ ID NO: 1022024 - RNA, 19 nt, Homo sapiens
guucugcucuaaggucuca

SEQ ID NO: 1022025 - RNA, 19 nt, Homo sapiens
gacaaauucuagcaaaccu

SEQ ID NO: 1022026 - RNA, 19 nt, Homo sapiens
ccucagaugauccucuuug

SEQ ID NO: 1022027 - RNA, 19 nt, Homo sapiens
aagaugcccugaacaaagc

SEQ ID NO: 1022028 - RNA, 19 nt, Homo sapiens
caugaagacaggccagaga

SEQ ID NO: 1022029 - RNA, 19 nt, Homo sapiens
ggaaccagccaugaagaca

SEQ ID NO: 1022030 - RNA, 19 nt, Homo sapiens
ugugcuugcugcuguuuau

SEQ ID NO: 1022031 - RNA, 19 nt, Homo sapiens
gugggucccugcucagaag

SEQ ID NO: 1022032 - RNA, 19 nt, Homo sapiens
ugacucugguugcuaggau

SEQ ID NO: 1022033 - RNA, 19 nt, Homo sapiens
cugcugggcucugauguca

SEQ ID NO: 1022034 - RNA, 19 nt, Homo sapiens
ugccaugcauucuucacuu

SEQ ID NO: 1022035 - RNA, 19 nt, Homo sapiens
acucugccaugcauucuuc

SEQ ID NO: 1022036 - RNA, 19 nt, Homo sapiens
cugacaugguuacuaguug

SEQ ID NO: 1022037 - RNA, 19 nt, Homo sapiens
augcaaagaugcccugaac

SEQ ID NO: 1022038 - RNA, 19 nt, Homo sapiens
aaggccaggugucucuaaa

SEQ ID NO: 1022039 - RNA, 19 nt, Homo sapiens
ccaugcauucuucacuuaa

SEQ ID NO: 1022040 - RNA, 19 nt, Homo sapiens
ucaccucaccugcuuucuu

SEQ ID NO: 1022041 - RNA, 19 nt, Homo sapiens
gaguacaguggcgugauuu

SEQ ID NO: 1022042 - RNA, 19 nt, Homo sapiens
aaaccaaauggaucuuguu

SEQ ID NO: 1022043 - RNA, 19 nt, Homo sapiens
gcagaggagagugcucaug

SEQ ID NO: 1022044 - RNA, 19 nt, Homo sapiens
auaccucccuugcuguugu

SEQ ID NO: 1022045 - RNA, 19 nt, Homo sapiens
gugacaaauucuagcaaac

SEQ ID NO: 1022046 - RNA, 19 nt, Homo sapiens
acccugugaugccaguaua

SEQ ID NO: 1022047 - RNA, 19 nt, Homo sapiens
gaggaggagaggccuguag

SEQ ID NO: 1022048 - RNA, 19 nt, Homo sapiens
ggagaaaucuguccuguua

SEQ ID NO: 1022049 - RNA, 19 nt, Homo sapiens
ggaauucugucucuuggua

SEQ ID NO: 1022050 - RNA, 19 nt, Homo sapiens
ggagaacaauauucauuug

SEQ ID NO: 1022051 - RNA, 19 nt, Homo sapiens
gaaggaaggugccguaggu

SEQ ID NO: 1022052 - RNA, 19 nt, Homo sapiens
gaucaugccuacuuucuuc

SEQ ID NO: 1022053 - RNA, 19 nt, Homo sapiens
gcaguagggucaugauguu

SEQ ID NO: 1022054 - RNA, 19 nt, Homo sapiens
ggaaauagacacgugcuuu

SEQ ID NO: 1022055 - RNA, 19 nt, Homo sapiens
ggaaagagaggaauaaagg

SEQ ID NO: 1022056 - RNA, 19 nt, Homo sapiens
gaaacuaacgggacugguu

SEQ ID NO: 1022057 - RNA, 19 nt, Homo sapiens
ggaaaugacaggaggaaga

SEQ ID NO: 1022058 - RNA, 19 nt, Homo sapiens
gaugcuagacacucauuua

SEQ ID NO: 1022059 - RNA, 19 nt, Homo sapiens
uaaauuggcucagaaagca

SEQ ID NO: 1022060 - RNA, 19 nt, Homo sapiens
aaugguaccuugucugaaa

SEQ ID NO: 1022061 - RNA, 19 nt, Homo sapiens
ucacugccgucucgucuuu

SEQ ID NO: 1022062 - RNA, 19 nt, Homo sapiens
caucccagguucugacuuu

SEQ ID NO: 1022063 - RNA, 19 nt, Homo sapiens
ggagagagcaguguggaaa

SEQ ID NO: 1022064 - RNA, 19 nt, Homo sapiens
gcaggaaagagaggaauaa

SEQ ID NO: 1022065 - RNA, 19 nt, Homo sapiens
ggucucaggugcaaagcaa

SEQ ID NO: 1022066 - RNA, 19 nt, Homo sapiens
guguagauauaacuggaua

SEQ ID NO: 1022067 - RNA, 19 nt, Homo sapiens
uaaggaugcuagacacuca

SEQ ID NO: 1022068 - RNA, 19 nt, Homo sapiens
ucagcugucuuccaaguau

SEQ ID NO: 1022069 - RNA, 19 nt, Homo sapiens
gucuauagcuugacuccuu

SEQ ID NO: 1022070 - RNA, 19 nt, Homo sapiens
ucugugaguuugucuuauu

SEQ ID NO: 1022071 - RNA, 19 nt, Homo sapiens
caucugugaguuugucuua

SEQ ID NO: 1022072 - RNA, 19 nt, Homo sapiens
uuucaaagcaguuaucuug

SEQ ID NO: 1022073 - RNA, 19 nt, Homo sapiens
gaaauagacacgugcuuuu

SEQ ID NO: 1022074 - RNA, 19 nt, Homo sapiens
ggaggaagacguggguuug

SEQ ID NO: 1022075 - RNA, 19 nt, Homo sapiens
uaacuggauauacggauuu

SEQ ID NO: 1022076 - RNA, 19 nt, Homo sapiens
gcaaaaggaccauuuaaag

SEQ ID NO: 1022077 - RNA, 19 nt, Homo sapiens
ccagugaucaugccuacuu

SEQ ID NO: 1022078 - RNA, 19 nt, Homo sapiens
gaaccgacccagugaucau

SEQ ID NO: 1022079 - RNA, 19 nt, Homo sapiens
gcuuuguucuuacuagguu

SEQ ID NO: 1022080 - RNA, 19 nt, Homo sapiens
guacaaguccuggcccuau

SEQ ID NO: 1022081 - RNA, 19 nt, Homo sapiens
gcagggcauguuucuguuu

SEQ ID NO: 1022082 - RNA, 19 nt, Homo sapiens
uaaaucccaucugugaguu

SEQ ID NO: 1022083 - RNA, 19 nt, Homo sapiens
ccuacuuucuucuuuguau

SEQ ID NO: 1022084 - RNA, 19 nt, Homo sapiens
gugcacaggugucuuuggu

SEQ ID NO: 1022085 - RNA, 19 nt, Homo sapiens
aaauguauguggaauucug

SEQ ID NO: 1022086 - RNA, 19 nt, Homo sapiens
cagaagggacagacacuug

SEQ ID NO: 1022087 - RNA, 19 nt, Homo sapiens
gcccuagguuggugacaga

SEQ ID NO: 1022088 - RNA, 19 nt, Homo sapiens
aaagcaagagggagauaaa

SEQ ID NO: 1022089 - RNA, 19 nt, Homo sapiens
aaaucuguccuguuacuuu

SEQ ID NO: 1022090 - RNA, 19 nt, Homo sapiens
agaaaucuguccuguuacu

SEQ ID NO: 1022091 - RNA, 19 nt, Homo sapiens
aagcaguuaucuugggaaa

SEQ ID NO: 1022092 - RNA, 19 nt, Homo sapiens
caugccuacuuucuucuuu

SEQ ID NO: 1022093 - RNA, 19 nt, Homo sapiens
gauaagcagagcuguucuu

SEQ ID NO: 1022094 - RNA, 19 nt, Homo sapiens
ggaggucucgggaguguag

SEQ ID NO: 1022095 - RNA, 19 nt, Homo sapiens
uaacgggacugguuuucaa

SEQ ID NO: 1022096 - RNA, 19 nt, Homo sapiens
uuuggaccguguagauaua

SEQ ID NO: 1022097 - RNA, 19 nt, Homo sapiens
gaauucugucucuugguaa

SEQ ID NO: 1022098 - RNA, 19 nt, Homo sapiens
gaagggacagacacuugug

SEQ ID NO: 1022099 - RNA, 19 nt, Homo sapiens
guccugggauggaguguca

SEQ ID NO: 1022100 - RNA, 19 nt, Homo sapiens
ccucagcugucuuccaagu

SEQ ID NO: 1022101 - RNA, 19 nt, Homo sapiens
gcaagagggagauaaaucc

SEQ ID NO: 1022102 - RNA, 19 nt, Homo sapiens
guaauuucagagaguguuu

SEQ ID NO: 1022103 - RNA, 19 nt, Homo sapiens
ggcaggaaagagaggaaua

SEQ ID NO: 1022104 - RNA, 19 nt, Homo sapiens
auacagggcaggaaagaga

SEQ ID NO: 1022105 - RNA, 19 nt, Homo sapiens
ggcagggcauguuucuguu

SEQ ID NO: 1022106 - RNA, 19 nt, Homo sapiens
cagugaucaugccuacuuu

SEQ ID NO: 1022107 - RNA, 19 nt, Homo sapiens
cuucacacgugcucuguuc

SEQ ID NO: 1022108 - RNA, 19 nt, Homo sapiens
acaggugucuuuggugaug

SEQ ID NO: 1022109 - RNA, 19 nt, Homo sapiens
aguccugggugaagauauu

SEQ ID NO: 1022110 - RNA, 19 nt, Homo sapiens
gaaaugacaggaggaagac

SEQ ID NO: 1022111 - RNA, 19 nt, Homo sapiens
aaucuguccuguuacuuuc

SEQ ID NO: 1022112 - RNA, 19 nt, Homo sapiens
gagaacaauauucauuugg

SEQ ID NO: 1022113 - RNA, 19 nt, Homo sapiens
ccucagggccuacuggaau

SEQ ID NO: 1022114 - RNA, 19 nt, Homo sapiens
caauauucauuugguugug

SEQ ID NO: 1022115 - RNA, 19 nt, Homo sapiens
gaggaaaugacaggaggaa

SEQ ID NO: 1022116 - RNA, 19 nt, Homo sapiens
ucccgugccugucguguug

SEQ ID NO: 1022117 - RNA, 19 nt, Homo sapiens
auaacuggauauacggauu

SEQ ID NO: 1022118 - RNA, 19 nt, Homo sapiens
gaaaucuguccuguuacuu

SEQ ID NO: 1022119 - RNA, 19 nt, Homo sapiens
caaaaggaccauuuaaagu

SEQ ID NO: 1022120 - RNA, 19 nt, Homo sapiens
ggaugaggaaggccaagga

SEQ ID NO: 1022121 - RNA, 19 nt, Homo sapiens
ggcaguagggucaugaugu

SEQ ID NO: 1022122 - RNA, 19 nt, Homo sapiens
gggagaaaucuguccuguu

SEQ ID NO: 1022123 - RNA, 19 nt, Homo sapiens
cagggaguccagcgaauga

SEQ ID NO: 1022124 - RNA, 19 nt, Homo sapiens
cagcugucuuccaaguauu

SEQ ID NO: 1022125 - RNA, 19 nt, Homo sapiens
cauugugagucuauagcuu

SEQ ID NO: 1022126 - RNA, 19 nt, Homo sapiens
gcugcgugcaugucgauaa

SEQ ID NO: 1022127 - RNA, 19 nt, Homo sapiens
caggaaagagaggaauaaa

SEQ ID NO: 1022128 - RNA, 19 nt, Homo sapiens
uagaaagcuguuugaauuc

SEQ ID NO: 1022129 - RNA, 19 nt, Homo sapiens
uacaaguccuggcccuaug

SEQ ID NO: 1022130 - RNA, 19 nt, Homo sapiens
ccagcugccucggguacaa

SEQ ID NO: 1022131 - RNA, 19 nt, Homo sapiens
cucccagcgugacuuauuu

SEQ ID NO: 1022132 - RNA, 19 nt, Homo sapiens
uggcagggcauguuucugu

SEQ ID NO: 1022133 - RNA, 19 nt, Homo sapiens
agacguggguuuggguuag

SEQ ID NO: 1022134 - RNA, 19 nt, Homo sapiens
caaagcaaaaggaccauuu

SEQ ID NO: 1022135 - RNA, 19 nt, Homo sapiens
gggaaccgacccagugauc

SEQ ID NO: 1022136 - RNA, 19 nt, Homo sapiens
guauacagggcaggaaaga

SEQ ID NO: 1022137 - RNA, 19 nt, Homo sapiens
aauucugucucuugguaaa

SEQ ID NO: 1022138 - RNA, 19 nt, Homo sapiens
uauguggaauucugucucu

SEQ ID NO: 1022139 - RNA, 19 nt, Homo sapiens
uuccucagcugucuuccaa

SEQ ID NO: 1022140 - RNA, 19 nt, Homo sapiens
gcgugcaugucgauaagca

SEQ ID NO: 1022141 - RNA, 19 nt, Homo sapiens
guuuggaccguguagauau

SEQ ID NO: 1022142 - RNA, 19 nt, Homo sapiens
aaucccaucugugaguuug

SEQ ID NO: 1022143 - RNA, 19 nt, Homo sapiens
ccucccagcgugacuuauu

SEQ ID NO: 1022144 - RNA, 19 nt, Homo sapiens
gcgucaggaugaggaaaug

SEQ ID NO: 1022145 - RNA, 19 nt, Homo sapiens
ccauggccacguugucauu

SEQ ID NO: 1022146 - RNA, 19 nt, Homo sapiens
gaggaaggccaaggagagu

SEQ ID NO: 1022147 - RNA, 19 nt, Homo sapiens
guaggugggcuuuuagaaa

SEQ ID NO: 1022148 - RNA, 19 nt, Homo sapiens
ggagggacgucuucuauuu

SEQ ID NO: 1022149 - RNA, 19 nt, Homo sapiens
gagcagggauccaagaaug

SEQ ID NO: 1022150 - RNA, 19 nt, Homo sapiens
ggaaggaacugaggaccaa

SEQ ID NO: 1022151 - RNA, 19 nt, Homo sapiens
caagaacgcuucgcugaga

SEQ ID NO: 1022152 - RNA, 19 nt, Homo sapiens
gaacugaggaccaagaagu

SEQ ID NO: 1022153 - RNA, 19 nt, Homo sapiens
ugacagcccugcccagaga

SEQ ID NO: 1022154 - RNA, 19 nt, Homo sapiens
ccaagaaugugccaagagu

SEQ ID NO: 1022155 - RNA, 19 nt, Homo sapiens
ucagcaaacucuccaagug

SEQ ID NO: 1022156 - RNA, 19 nt, Homo sapiens
gaagguauuuucgagauaa

SEQ ID NO: 1022157 - RNA, 19 nt, Homo sapiens
ccugugaccuggccgauga

SEQ ID NO: 1022158 - RNA, 19 nt, Homo sapiens
caccaggccugcauugaug

SEQ ID NO: 1022159 - RNA, 19 nt, Homo sapiens
gaauugcuccuucaugaca

SEQ ID NO: 1022160 - RNA, 19 nt, Homo sapiens
gaacccagaacccucaaug

SEQ ID NO: 1022161 - RNA, 19 nt, Homo sapiens
acauugaggugaugagguu

SEQ ID NO: 1022162 - RNA, 19 nt, Homo sapiens
aaagcucgcucccgucuca

SEQ ID NO: 1022163 - RNA, 19 nt, Homo sapiens
gcaccaggccugcauugau

SEQ ID NO: 1022164 - RNA, 19 nt, Homo sapiens
cagcaaacucuccaaguga

SEQ ID NO: 1022165 - RNA, 19 nt, Homo sapiens
gaagugcaaggaucaguag

SEQ ID NO: 1022166 - RNA, 19 nt, Homo sapiens
ggaaguacugagccuguug

SEQ ID NO: 1022167 - RNA, 19 nt, Homo sapiens
ccaagaagugcaaggauca

SEQ ID NO: 1022168 - RNA, 19 nt, Homo sapiens
ggaccaagaagugcaagga

SEQ ID NO: 1022169 - RNA, 19 nt, Homo sapiens
gagaagguauuuucgagau

SEQ ID NO: 1022170 - RNA, 19 nt, Homo sapiens
ugaccuggccgaugaggaa

SEQ ID NO: 1022171 - RNA, 19 nt, Homo sapiens
ggagguggugcgcuucuug

SEQ ID NO: 1022172 - RNA, 19 nt, Homo sapiens
gggagggacgucuucuauu

SEQ ID NO: 1022173 - RNA, 19 nt, Homo sapiens
ggagcccucuguccugucu

SEQ ID NO: 1022174 - RNA, 19 nt, Homo sapiens
caagcgggcagaagaggaa

SEQ ID NO: 1022175 - RNA, 19 nt, Homo sapiens
gcagggauccaagaaugug

SEQ ID NO: 1022176 - RNA, 19 nt, Homo sapiens
ccagagacgggaccaggaa

SEQ ID NO: 1022177 - RNA, 19 nt, Homo sapiens
gagucggaaucccagagaa

SEQ ID NO: 1022178 - RNA, 19 nt, Homo sapiens
gggaugaggagucggaauc

SEQ ID NO: 1022179 - RNA, 19 nt, Homo sapiens
cagccaagcgggcagaaga

SEQ ID NO: 1022180 - RNA, 19 nt, Homo sapiens
gucgugaaguugccacuca

SEQ ID NO: 1022181 - RNA, 19 nt, Homo sapiens
uccuggaacuggagagauu

SEQ ID NO: 1022182 - RNA, 19 nt, Homo sapiens
cccagaaccugagccagaa

SEQ ID NO: 1022183 - RNA, 19 nt, Homo sapiens
uccuguggcuaccuagaua

SEQ ID NO: 1022184 - RNA, 19 nt, Homo sapiens
agaagugcaaggaucagua

SEQ ID NO: 1022185 - RNA, 19 nt, Homo sapiens
ucccgcacccguauuuaua

SEQ ID NO: 1022186 - RNA, 19 nt, Homo sapiens
ggagucggaaucccagaga

SEQ ID NO: 1022187 - RNA, 19 nt, Homo sapiens
agauuucccuccaggacuu

SEQ ID NO: 1022188 - RNA, 19 nt, Homo sapiens
ggaggaccuucggaaccaa

SEQ ID NO: 1022189 - RNA, 19 nt, Homo sapiens
gagcagucgcgagaagauu

SEQ ID NO: 1022190 - RNA, 19 nt, Homo sapiens
gggcuacauugaggugaug

SEQ ID NO: 1022191 - RNA, 19 nt, Homo sapiens
acgaggugcuggcugaaug

SEQ ID NO: 1022192 - RNA, 19 nt, Homo sapiens
ccuggccgaugaggaagua

SEQ ID NO: 1022193 - RNA, 19 nt, Homo sapiens
ccaccaacgccgacgguau

SEQ ID NO: 1022194 - RNA, 19 nt, Homo sapiens
gcuccgucuugccagaauu

SEQ ID NO: 1022195 - RNA, 19 nt, Homo sapiens
ccagacggaggcuuuagga

SEQ ID NO: 1022196 - RNA, 19 nt, Homo sapiens
ucgccucccuccaggauuc

SEQ ID NO: 1022197 - RNA, 19 nt, Homo sapiens
gcuuuggccuccugaagac

SEQ ID NO: 1022198 - RNA, 19 nt, Homo sapiens
ugaugagguugcuccuuca

SEQ ID NO: 1022199 - RNA, 19 nt, Homo sapiens
gaccaagaagugcaaggau

SEQ ID NO: 1022200 - RNA, 19 nt, Homo sapiens
gaugagaaugcagcguuga

SEQ ID NO: 1022201 - RNA, 19 nt, Homo sapiens
caccaacgccgacgguauc

SEQ ID NO: 1022202 - RNA, 19 nt, Homo sapiens
acaaccagcgccucaagga

SEQ ID NO: 1022203 - RNA, 19 nt, Homo sapiens
gcagucgcgagaagauuuc

SEQ ID NO: 1022204 - RNA, 19 nt, Homo sapiens
gaggaccuucggaaccaaa

SEQ ID NO: 1022205 - RNA, 19 nt, Homo sapiens
uaggguccaugugcaauag

SEQ ID NO: 1022206 - RNA, 19 nt, Homo sapiens
gauccgcgucaucagcaaa

SEQ ID NO: 1022207 - RNA, 19 nt, Homo sapiens
agagucccgugcagcuuga

SEQ ID NO: 1022208 - RNA, 19 nt, Homo sapiens
ggaaauggcucuggacaug

SEQ ID NO: 1022209 - RNA, 19 nt, Homo sapiens
ggacauggcccugaacaua

SEQ ID NO: 1022210 - RNA, 19 nt, Homo sapiens
ggaaucgccuccauaaaga

SEQ ID NO: 1022211 - RNA, 19 nt, Homo sapiens
gacagaagguggcgugaaa

SEQ ID NO: 1022212 - RNA, 19 nt, Homo sapiens
gagaaacccaaguucauua

SEQ ID NO: 1022213 - RNA, 19 nt, Homo sapiens
ggaagagggugccacaaag

SEQ ID NO: 1022214 - RNA, 19 nt, Homo sapiens
gcaaagacaaggagaggaa

SEQ ID NO: 1022215 - RNA, 19 nt, Homo sapiens
gcaguggccuccuggaugu

SEQ ID NO: 1022216 - RNA, 19 nt, Homo sapiens
gaugagggauguccugcuu

SEQ ID NO: 1022217 - RNA, 19 nt, Homo sapiens
ccacuaaacaaacaacaaa

SEQ ID NO: 1022218 - RNA, 19 nt, Homo sapiens
gaacauaggcucggaacca

SEQ ID NO: 1022219 - RNA, 19 nt, Homo sapiens
gccaugaacuugcaagagu

SEQ ID NO: 1022220 - RNA, 19 nt, Homo sapiens
guucauuacugcagccaaa

SEQ ID NO: 1022221 - RNA, 19 nt, Homo sapiens
agagaagccuagcgaagaa

SEQ ID NO: 1022222 - RNA, 19 nt, Homo sapiens
ugagguugccgauaagaua

SEQ ID NO: 1022223 - RNA, 19 nt, Homo sapiens
ugagaugccuccgaccuuu

SEQ ID NO: 1022224 - RNA, 19 nt, Homo sapiens
gcagcgguuucuucuucua

SEQ ID NO: 1022225 - RNA, 19 nt, Homo sapiens
gaccagaagacuauucaga

SEQ ID NO: 1022226 - RNA, 19 nt, Homo sapiens
cuuccugucccauauauua

SEQ ID NO: 1022227 - RNA, 19 nt, Homo sapiens
agccugagguugccgauaa

SEQ ID NO: 1022228 - RNA, 19 nt, Homo sapiens
gaagagggugccacaaagu

SEQ ID NO: 1022229 - RNA, 19 nt, Homo sapiens
ggugaugcgucuggccaua

SEQ ID NO: 1022230 - RNA, 19 nt, Homo sapiens
cgccauggcugaggaagaa

SEQ ID NO: 1022231 - RNA, 19 nt, Homo sapiens
uggaaggucucucuguguu

SEQ ID NO: 1022232 - RNA, 19 nt, Homo sapiens
cgagaaacccaaguucauu

SEQ ID NO: 1022233 - RNA, 19 nt, Homo sapiens
gcuuagaccagaagacuau

SEQ ID NO: 1022234 - RNA, 19 nt, Homo sapiens
gaaaugcuaacuccugucu

SEQ ID NO: 1022235 - RNA, 19 nt, Homo sapiens
ggaagucgaagggcaaaga

SEQ ID NO: 1022236 - RNA, 19 nt, Homo sapiens
gagcuuccugucccauaua

SEQ ID NO: 1022237 - RNA, 19 nt, Homo sapiens
cugcagcgguuucuucuuc

SEQ ID NO: 1022238 - RNA, 19 nt, Homo sapiens
ugccguagcugaggaagaa

SEQ ID NO: 1022239 - RNA, 19 nt, Homo sapiens
gggacaauuuccucugugu

SEQ ID NO: 1022240 - RNA, 19 nt, Homo sapiens
agagauuggucgccaugaa

SEQ ID NO: 1022241 - RNA, 19 nt, Homo sapiens
gugaggacauggcccugaa

SEQ ID NO: 1022242 - RNA, 19 nt, Homo sapiens
aaacccaaguucauuacug

SEQ ID NO: 1022243 - RNA, 19 nt, Homo sapiens
ucacugagcagcauuuuaa

SEQ ID NO: 1022244 - RNA, 19 nt, Homo sapiens
gcagaacaccagugacuac

SEQ ID NO: 1022245 - RNA, 19 nt, Homo sapiens
gagagcuuccugucccaua

SEQ ID NO: 1022246 - RNA, 19 nt, Homo sapiens
uuuaaccucuugaaugaga

SEQ ID NO: 1022247 - RNA, 19 nt, Homo sapiens
agaagcugcuggcggacua

SEQ ID NO: 1022248 - RNA, 19 nt, Homo sapiens
gacauggcccugaacauag

SEQ ID NO: 1022249 - RNA, 19 nt, Homo sapiens
cagcauccagggcuuauau

SEQ ID NO: 1022250 - RNA, 19 nt, Homo sapiens
uaaagaagagacagaaggu

SEQ ID NO: 1022251 - RNA, 19 nt, Homo sapiens
cagagacgaugagggaugu

SEQ ID NO: 1022252 - RNA, 19 nt, Homo sapiens
uauugucacuucaagacuu

SEQ ID NO: 1022253 - RNA, 19 nt, Homo sapiens
ucaacuugguccuguaugg

SEQ ID NO: 1022254 - RNA, 19 nt, Homo sapiens
gaagccaauuggagaaacg

SEQ ID NO: 1022255 - RNA, 19 nt, Homo sapiens
gaaucgccuccauaaagaa

SEQ ID NO: 1022256 - RNA, 19 nt, Homo sapiens
agauaguccuggucacaga

SEQ ID NO: 1022257 - RNA, 19 nt, Homo sapiens
gcaucauagucgacucaga

SEQ ID NO: 1022258 - RNA, 19 nt, Homo sapiens
gguuucuucuucuauggaa

SEQ ID NO: 1022259 - RNA, 19 nt, Homo sapiens
aagagaagccuagcgaaga

SEQ ID NO: 1022260 - RNA, 19 nt, Homo sapiens
gaaccaaggcgaggcuucu

SEQ ID NO: 1022261 - RNA, 19 nt, Homo sapiens
ggaagccaauuggagaaac

SEQ ID NO: 1022262 - RNA, 19 nt, Homo sapiens
ccauaaagaagagacagaa

SEQ ID NO: 1022263 - RNA, 19 nt, Homo sapiens
ucacagcauccagggcuua

SEQ ID NO: 1022264 - RNA, 19 nt, Homo sapiens
ggagcuggagguagaggaa

SEQ ID NO: 1022265 - RNA, 19 nt, Homo sapiens
ccagggcccagaaaugcua

SEQ ID NO: 1022266 - RNA, 19 nt, Homo sapiens
uaagauaguccuggucaca

SEQ ID NO: 1022267 - RNA, 19 nt, Homo sapiens
gccugcagguggaagagaa

SEQ ID NO: 1022268 - RNA, 19 nt, Homo sapiens
aggaagagggugccacaaa

SEQ ID NO: 1022269 - RNA, 19 nt, Homo sapiens
caagcucggccucguggaa

SEQ ID NO: 1022270 - RNA, 19 nt, Homo sapiens
gagcucugccugccugugu

SEQ ID NO: 1022271 - RNA, 19 nt, Homo sapiens
gcucaacuugguccuguau

SEQ ID NO: 1022272 - RNA, 19 nt, Homo sapiens
ggaaggucucucuguguuc

SEQ ID NO: 1022273 - RNA, 19 nt, Homo sapiens
cauaggcucggaaccagaa

SEQ ID NO: 1022274 - RNA, 19 nt, Homo sapiens
gguguacagugaggacaug

SEQ ID NO: 1022275 - RNA, 19 nt, Homo sapiens
cagcuccggugccaagaca

SEQ ID NO: 1022276 - RNA, 19 nt, Homo sapiens
ggagaggcgaggaccugaa

SEQ ID NO: 1022277 - RNA, 19 nt, Homo sapiens
agagcuuccugucccauau

SEQ ID NO: 1022278 - RNA, 19 nt, Homo sapiens
ucuauggaauggagagcuu

SEQ ID NO: 1022279 - RNA, 19 nt, Homo sapiens
aaagauuccaagacacauu

SEQ ID NO: 1022280 - RNA, 19 nt, Homo sapiens
ggacaugcuccaguucauc

SEQ ID NO: 1022281 - RNA, 19 nt, Homo sapiens
caaagacaaggagaggaaa

SEQ ID NO: 1022282 - RNA, 19 nt, Homo sapiens
ugaguugcuuagaccagaa

SEQ ID NO: 1022283 - RNA, 19 nt, Homo sapiens
gggaagccaauuggagaaa

SEQ ID NO: 1022284 - RNA, 19 nt, Homo sapiens
cgacucagacaacuucaag

SEQ ID NO: 1022285 - RNA, 19 nt, Homo sapiens
aggcccagguguacaguga

SEQ ID NO: 1022286 - RNA, 19 nt, Homo sapiens
aagggacaauuuccucugu

SEQ ID NO: 1022287 - RNA, 19 nt, Homo sapiens
cagggccuauugucacuuc

SEQ ID NO: 1022288 - RNA, 19 nt, Homo sapiens
aagggaggcuucacagcau

SEQ ID NO: 1022289 - RNA, 19 nt, Homo sapiens
uauauuaguggagagauug

SEQ ID NO: 1022290 - RNA, 19 nt, Homo sapiens
gaaagauuccaagacacau

SEQ ID NO: 1022291 - RNA, 19 nt, Homo sapiens
gagguugccgauaagauag

SEQ ID NO: 1022292 - RNA, 19 nt, Homo sapiens
gagaggcgaggaccugaag

SEQ ID NO: 1022293 - RNA, 19 nt, Homo sapiens
cagcguccagggccuauug

SEQ ID NO: 1022294 - RNA, 19 nt, Homo sapiens
cgggacaucugggaagcaa

SEQ ID NO: 1022295 - RNA, 19 nt, Homo sapiens
cuccaucacccaagacauu

SEQ ID NO: 1022296 - RNA, 19 nt, Homo sapiens
gagcuucugcagccgcuau

SEQ ID NO: 1022297 - RNA, 19 nt, Homo sapiens
uuacugcagccaaaggaaa

SEQ ID NO: 1022298 - RNA, 19 nt, Homo sapiens
gagauuggucgccaugaac

SEQ ID NO: 1022299 - RNA, 19 nt, Homo sapiens
cuucaaaugcuguggaauc

SEQ ID NO: 1022300 - RNA, 19 nt, Homo sapiens
cggacuaucugcagaacac

SEQ ID NO: 1022301 - RNA, 19 nt, Homo sapiens
uggagaugguggagugugu

SEQ ID NO: 1022302 - RNA, 19 nt, Homo sapiens
aaacggugcgucuccuuca

SEQ ID NO: 1022303 - RNA, 19 nt, Homo sapiens
gacaugcuccaguucaucu

SEQ ID NO: 1022304 - RNA, 19 nt, Homo sapiens
gcgguuucuucuucuaugg

SEQ ID NO: 1022305 - RNA, 19 nt, Homo sapiens
cagcugcagcgguuucuuc

SEQ ID NO: 1022306 - RNA, 19 nt, Homo sapiens
ggccuauugucacuucaag

SEQ ID NO: 1022307 - RNA, 19 nt, Homo sapiens
cgacgaggcggugaaccaa

SEQ ID NO: 1022308 - RNA, 19 nt, Homo sapiens
ggaaagaccuccacaagua

SEQ ID NO: 1022309 - RNA, 19 nt, Homo sapiens
guacauacuugcagauuua

SEQ ID NO: 1022310 - RNA, 19 nt, Homo sapiens
gaagaaagauuaggcaaug

SEQ ID NO: 1022311 - RNA, 19 nt, Homo sapiens
guauaaagauccucuagaa

SEQ ID NO: 1022312 - RNA, 19 nt, Homo sapiens
aagguuagcugcuuuagua

SEQ ID NO: 1022313 - RNA, 19 nt, Homo sapiens
gcaaauaguaguucuggua

SEQ ID NO: 1022314 - RNA, 19 nt, Homo sapiens
ucaauaagcuugcauuaag

SEQ ID NO: 1022315 - RNA, 19 nt, Homo sapiens
gaacagaauacaacccaua

SEQ ID NO: 1022316 - RNA, 19 nt, Homo sapiens
caaaauggcugcuguauau

SEQ ID NO: 1022317 - RNA, 19 nt, Homo sapiens
ccaaagauggcaugacuua

SEQ ID NO: 1022318 - RNA, 19 nt, Homo sapiens
uauauggaguucugaguua

SEQ ID NO: 1022319 - RNA, 19 nt, Homo sapiens
ucaaauaucuucucaugca

SEQ ID NO: 1022320 - RNA, 19 nt, Homo sapiens
gaucauaugugaagauguc

SEQ ID NO: 1022321 - RNA, 19 nt, Homo sapiens
gcagauaagaguugaauau

SEQ ID NO: 1022322 - RNA, 19 nt, Homo sapiens
gagcaacagugguaucaga

SEQ ID NO: 1022323 - RNA, 19 nt, Homo sapiens
gcaaaugcauccagucagu

SEQ ID NO: 1022324 - RNA, 19 nt, Homo sapiens
gcagguaucugugcauuca

SEQ ID NO: 1022325 - RNA, 19 nt, Homo sapiens
cuacaugucucuuguuuua

SEQ ID NO: 1022326 - RNA, 19 nt, Homo sapiens
gaaaguugacaccauguuu

SEQ ID NO: 1022327 - RNA, 19 nt, Homo sapiens
cagaauacaacccauauaa

SEQ ID NO: 1022328 - RNA, 19 nt, Homo sapiens
uugaggaacugauucauuu

SEQ ID NO: 1022329 - RNA, 19 nt, Homo sapiens
gcgcagauuuggaagcauu

SEQ ID NO: 1022330 - RNA, 19 nt, Homo sapiens
ugacuuaccugcgcagauu

SEQ ID NO: 1022331 - RNA, 19 nt, Homo sapiens
ucacauccguuacauuuca

SEQ ID NO: 1022332 - RNA, 19 nt, Homo sapiens
uaauaucacugucuguaug

SEQ ID NO: 1022333 - RNA, 19 nt, Homo sapiens
ggaacugauucauuuggaa

SEQ ID NO: 1022334 - RNA, 19 nt, Homo sapiens
gcauuucuuugcacauauu

SEQ ID NO: 1022335 - RNA, 19 nt, Homo sapiens
ucucaaauaucuucucaug

SEQ ID NO: 1022336 - RNA, 19 nt, Homo sapiens
uauauacucccacuucaua

SEQ ID NO: 1022337 - RNA, 19 nt, Homo sapiens
gaaucuacaugucucuugu

SEQ ID NO: 1022338 - RNA, 19 nt, Homo sapiens
gauaucugcuuacauugau

SEQ ID NO: 1022339 - RNA, 19 nt, Homo sapiens
ccacccagcugucccaguu

SEQ ID NO: 1022340 - RNA, 19 nt, Homo sapiens
ugagacgucuuccauguau

SEQ ID NO: 1022341 - RNA, 19 nt, Homo sapiens
caaggccacuucaucauca

SEQ ID NO: 1022342 - RNA, 19 nt, Homo sapiens
aauggcugcuguauauuua

SEQ ID NO: 1022343 - RNA, 19 nt, Homo sapiens
aaagucagcugaaucuaca

SEQ ID NO: 1022344 - RNA, 19 nt, Homo sapiens
guaaauaaagucagcugaa

SEQ ID NO: 1022345 - RNA, 19 nt, Homo sapiens
ccucacauccguuacauuu

SEQ ID NO: 1022346 - RNA, 19 nt, Homo sapiens
ccaacucacuuagccagua

SEQ ID NO: 1022347 - RNA, 19 nt, Homo sapiens
caaccuuuaucaucaauag

SEQ ID NO: 1022348 - RNA, 19 nt, Homo sapiens
uaucagaagucauggaagu

SEQ ID NO: 1022349 - RNA, 19 nt, Homo sapiens
caacagugguaucagaagu

SEQ ID NO: 1022350 - RNA, 19 nt, Homo sapiens
ccagagugaucaguauaaa

SEQ ID NO: 1022351 - RNA, 19 nt, Homo sapiens
ggaagaagggacugaggaa

SEQ ID NO: 1022352 - RNA, 19 nt, Homo sapiens
cuucaucacuuacaauuag

SEQ ID NO: 1022353 - RNA, 19 nt, Homo sapiens
gagacugcauccucaugaa

SEQ ID NO: 1022354 - RNA, 19 nt, Homo sapiens
gaccugagcaacaguggua

SEQ ID NO: 1022355 - RNA, 19 nt, Homo sapiens
guacugcagucaaccaaag

SEQ ID NO: 1022356 - RNA, 19 nt, Homo sapiens
ccaaguguguguugaccaa

SEQ ID NO: 1022357 - RNA, 19 nt, Homo sapiens
ggacugaggaagacacaga

SEQ ID NO: 1022358 - RNA, 19 nt, Homo sapiens
ucccauggaucauauguga

SEQ ID NO: 1022359 - RNA, 19 nt, Homo sapiens
uauacaggauagccuaauu

SEQ ID NO: 1022360 - RNA, 19 nt, Homo sapiens
uuaagucacuggcagguau

SEQ ID NO: 1022361 - RNA, 19 nt, Homo sapiens
aaacagcucugaugaacac

SEQ ID NO: 1022362 - RNA, 19 nt, Homo sapiens
ugaaacagcucugaugaac

SEQ ID NO: 1022363 - RNA, 19 nt, Homo sapiens
ggaagaaagauuaggcaau

SEQ ID NO: 1022364 - RNA, 19 nt, Homo sapiens
guucaaaggaggaggauga

SEQ ID NO: 1022365 - RNA, 19 nt, Homo sapiens
ucauggagcaucugcauuu

SEQ ID NO: 1022366 - RNA, 19 nt, Homo sapiens
gcacaaauuauacugucaa

SEQ ID NO: 1022367 - RNA, 19 nt, Homo sapiens
uuagacugcuguucugauu

SEQ ID NO: 1022368 - RNA, 19 nt, Homo sapiens
uguacuaucuguuugucua

SEQ ID NO: 1022369 - RNA, 19 nt, Homo sapiens
cagccaauuucgcaccaua

SEQ ID NO: 1022370 - RNA, 19 nt, Homo sapiens
gugaagaugucaauaagcu

SEQ ID NO: 1022371 - RNA, 19 nt, Homo sapiens
agaggaaggugaagaugug

SEQ ID NO: 1022372 - RNA, 19 nt, Homo sapiens
ucacgcaccuccucgacuu

SEQ ID NO: 1022373 - RNA, 19 nt, Homo sapiens
ggucaugggcaucauauuc

SEQ ID NO: 1022374 - RNA, 19 nt, Homo sapiens
ugacaaggccacuucauca

SEQ ID NO: 1022375 - RNA, 19 nt, Homo sapiens
caagucaaccuuuaucauc

SEQ ID NO: 1022376 - RNA, 19 nt, Homo sapiens
cucccgagcugcaaucuuu

SEQ ID NO: 1022377 - RNA, 19 nt, Homo sapiens
cacauaggaugcacccaaa

SEQ ID NO: 1022378 - RNA, 19 nt, Homo sapiens
caguacagcugcaccaauc

SEQ ID NO: 1022379 - RNA, 19 nt, Homo sapiens
caaauaucuucucaugcaa

SEQ ID NO: 1022380 - RNA, 19 nt, Homo sapiens
gaaagauuaggcaauguca

SEQ ID NO: 1022381 - RNA, 19 nt, Homo sapiens
ccacagcccucucucucau

SEQ ID NO: 1022382 - RNA, 19 nt, Homo sapiens
gcuagauuguacauacuug

SEQ ID NO: 1022383 - RNA, 19 nt, Homo sapiens
caguuuauguauacaguug

SEQ ID NO: 1022384 - RNA, 19 nt, Homo sapiens
ugaaagauguacauaucca

SEQ ID NO: 1022385 - RNA, 19 nt, Homo sapiens
gcuauccucacauccguua

SEQ ID NO: 1022386 - RNA, 19 nt, Homo sapiens
caacccauauaaaucagau

SEQ ID NO: 1022387 - RNA, 19 nt, Homo sapiens
gaguuaaauaccauccuua

SEQ ID NO: 1022388 - RNA, 19 nt, Homo sapiens
ugaguuaaauaccauccuu

SEQ ID NO: 1022389 - RNA, 19 nt, Homo sapiens
uguacauacuugcagauuu

SEQ ID NO: 1022390 - RNA, 19 nt, Homo sapiens
guagucacaucaccagagu

SEQ ID NO: 1022391 - RNA, 19 nt, Homo sapiens
guuagcugcuuuaguaagu

SEQ ID NO: 1022392 - RNA, 19 nt, Homo sapiens
guaauaucacugucuguau

SEQ ID NO: 1022393 - RNA, 19 nt, Homo sapiens
cuucauacauuaccaagag

SEQ ID NO: 1022394 - RNA, 19 nt, Homo sapiens
gaaagaccuccacaaguac

SEQ ID NO: 1022395 - RNA, 19 nt, Homo sapiens
uguagaauuuguugucuuc

SEQ ID NO: 1022396 - RNA, 19 nt, Homo sapiens
caacacagugcagauaaga

SEQ ID NO: 1022397 - RNA, 19 nt, Homo sapiens
ggaaggugaagaugugaga

SEQ ID NO: 1022398 - RNA, 19 nt, Homo sapiens
ccugggaacugggaauuga

SEQ ID NO: 1022399 - RNA, 19 nt, Homo sapiens
guacaugcuuuccauucuc

SEQ ID NO: 1022400 - RNA, 19 nt, Homo sapiens
gcucugaugaacacuauau

SEQ ID NO: 1022401 - RNA, 19 nt, Homo sapiens
gucaauaagcuugcauuaa

SEQ ID NO: 1022402 - RNA, 19 nt, Homo sapiens
ggaggaaguuuuaaucuac

SEQ ID NO: 1022403 - RNA, 19 nt, Homo sapiens
guuauauacucccacuuca

SEQ ID NO: 1022404 - RNA, 19 nt, Homo sapiens
cagcucugaugaacacuau

SEQ ID NO: 1022405 - RNA, 19 nt, Homo sapiens
caaacaagauggggaagaa

SEQ ID NO: 1022406 - RNA, 19 nt, Homo sapiens
ccucaaguggauuauguua

SEQ ID NO: 1022407 - RNA, 19 nt, Homo sapiens
caggauagccuaauuuuau

SEQ ID NO: 1022408 - RNA, 19 nt, Homo sapiens
ggaagaaucucaucaagaa

SEQ ID NO: 1022409 - RNA, 19 nt, Homo sapiens
gaaugccggugacaaauua

SEQ ID NO: 1022410 - RNA, 19 nt, Homo sapiens
uaacagagguccuugaaga

SEQ ID NO: 1022411 - RNA, 19 nt, Homo sapiens
ggacucaaauggauaguga

SEQ ID NO: 1022412 - RNA, 19 nt, Homo sapiens
gugaagaccuuugagauuu

SEQ ID NO: 1022413 - RNA, 19 nt, Homo sapiens
gaaagcggcauguauugua

SEQ ID NO: 1022414 - RNA, 19 nt, Homo sapiens
gaaacucuacucacacaua

SEQ ID NO: 1022415 - RNA, 19 nt, Homo sapiens
uaauagagccuguuaguau

SEQ ID NO: 1022416 - RNA, 19 nt, Homo sapiens
gaccugagcuccuuugaca

SEQ ID NO: 1022417 - RNA, 19 nt, Homo sapiens
gcuagaagcugaagaacuc

SEQ ID NO: 1022418 - RNA, 19 nt, Homo sapiens
gagcuccuuugacauguua

SEQ ID NO: 1022419 - RNA, 19 nt, Homo sapiens
gaaacucaccgccauauuc

SEQ ID NO: 1022420 - RNA, 19 nt, Homo sapiens
gaagauaacaggcagaaca

SEQ ID NO: 1022421 - RNA, 19 nt, Homo sapiens
gcagaaaacaccuuuaaua

SEQ ID NO: 1022422 - RNA, 19 nt, Homo sapiens
gaaguugcacggugaauug

SEQ ID NO: 1022423 - RNA, 19 nt, Homo sapiens
caaagcagcugcgcucaga

SEQ ID NO: 1022424 - RNA, 19 nt, Homo sapiens
ggaauuauagcuuugaguu

SEQ ID NO: 1022425 - RNA, 19 nt, Homo sapiens
gaaagaaguagaaagaauc

SEQ ID NO: 1022426 - RNA, 19 nt, Homo sapiens
gaugcccacuuucuuguuu

SEQ ID NO: 1022427 - RNA, 19 nt, Homo sapiens
uaagaagaauggaagaauc

SEQ ID NO: 1022428 - RNA, 19 nt, Homo sapiens
acacagagccgucggauuc

SEQ ID NO: 1022429 - RNA, 19 nt, Homo sapiens
ccuuugacauguuaagaua

SEQ ID NO: 1022430 - RNA, 19 nt, Homo sapiens
ucaaauggauagugaaguc

SEQ ID NO: 1022431 - RNA, 19 nt, Homo sapiens
aaugagggauuugaacaua

SEQ ID NO: 1022432 - RNA, 19 nt, Homo sapiens
ucaagaagcaacagagaaa

SEQ ID NO: 1022433 - RNA, 19 nt, Homo sapiens
caacagagaaagaaguaga

SEQ ID NO: 1022434 - RNA, 19 nt, Homo sapiens
ucaugguugucuuugauua

SEQ ID NO: 1022435 - RNA, 19 nt, Homo sapiens
gggaggagauugugaagac

SEQ ID NO: 1022436 - RNA, 19 nt, Homo sapiens
aaacucuacucacacauau

SEQ ID NO: 1022437 - RNA, 19 nt, Homo sapiens
acacacaaguuagaaauca

SEQ ID NO: 1022438 - RNA, 19 nt, Homo sapiens
gauuguugcagacauauuu

SEQ ID NO: 1022439 - RNA, 19 nt, Homo sapiens
gaagaccuuugagauuuca

SEQ ID NO: 1022440 - RNA, 19 nt, Homo sapiens
guaauagagccuguuagua

SEQ ID NO: 1022441 - RNA, 19 nt, Homo sapiens
agagaaagaaguagaaaga

SEQ ID NO: 1022442 - RNA, 19 nt, Homo sapiens
ucaaggaauuauagcuuug

SEQ ID NO: 1022443 - RNA, 19 nt, Homo sapiens
ccaguaauagagccuguua

SEQ ID NO: 1022444 - RNA, 19 nt, Homo sapiens
gcagacauauuuucgagaa

SEQ ID NO: 1022445 - RNA, 19 nt, Homo sapiens
gagagugcccugugccaaa

SEQ ID NO: 1022446 - RNA, 19 nt, Homo sapiens
uaugacuccuggaagauaa

SEQ ID NO: 1022447 - RNA, 19 nt, Homo sapiens
caaguuagaaaucaaggaa

SEQ ID NO: 1022448 - RNA, 19 nt, Homo sapiens
aagaaaaguuccugugaua

SEQ ID NO: 1022449 - RNA, 19 nt, Homo sapiens
gaguugaucguccaagaaa

SEQ ID NO: 1022450 - RNA, 19 nt, Homo sapiens
caucaacuccguccaacaa

SEQ ID NO: 1022451 - RNA, 19 nt, Homo sapiens
ugaagaccuuugagauuuc

SEQ ID NO: 1022452 - RNA, 19 nt, Homo sapiens
gaaggacucaaauggauag

SEQ ID NO: 1022453 - RNA, 19 nt, Homo sapiens
gagaaagaaguagaaagaa

SEQ ID NO: 1022454 - RNA, 19 nt, Homo sapiens
ggaaacucaccgccauauu

SEQ ID NO: 1022455 - RNA, 19 nt, Homo sapiens
gaagaauggaagaaucuca

SEQ ID NO: 1022456 - RNA, 19 nt, Homo sapiens
cauguuuccuucauuauac

SEQ ID NO: 1022457 - RNA, 19 nt, Homo sapiens
caaauuaacagagguccuu

SEQ ID NO: 1022458 - RNA, 19 nt, Homo sapiens
ggaaagcggcauguauugu

SEQ ID NO: 1022459 - RNA, 19 nt, Homo sapiens
ucaccgccauauucacaaa

SEQ ID NO: 1022460 - RNA, 19 nt, Homo sapiens
cugaaggacucaaauggau

SEQ ID NO: 1022461 - RNA, 19 nt, Homo sapiens
ccaauguccuucuuugacu

SEQ ID NO: 1022462 - RNA, 19 nt, Homo sapiens
ugggauuguugcagacaua

SEQ ID NO: 1022463 - RNA, 19 nt, Homo sapiens
gcaaugccugcccaguuaa

SEQ ID NO: 1022464 - RNA, 19 nt, Homo sapiens
ugaagugucccgagcaaga

SEQ ID NO: 1022465 - RNA, 19 nt, Homo sapiens
ugaaggacucaaauggaua

SEQ ID NO: 1022466 - RNA, 19 nt, Homo sapiens
gaauggaagaaucucauca

SEQ ID NO: 1022467 - RNA, 19 nt, Homo sapiens
gaagauaguccugauuuug

SEQ ID NO: 1022468 - RNA, 19 nt, Homo sapiens
ggguguaaauccgcuagaa

SEQ ID NO: 1022469 - RNA, 19 nt, Homo sapiens
ugaaugccggugacaaauu

SEQ ID NO: 1022470 - RNA, 19 nt, Homo sapiens
gcugaaggacucaaaugga

SEQ ID NO: 1022471 - RNA, 19 nt, Homo sapiens
gauuugaacauaacacaca

SEQ ID NO: 1022472 - RNA, 19 nt, Homo sapiens
uagagccuguuaguauuaa

SEQ ID NO: 1022473 - RNA, 19 nt, Homo sapiens
gcauagagaaagcaaagca

SEQ ID NO: 1022474 - RNA, 19 nt, Homo sapiens
aaacucaccgccauauuca

SEQ ID NO: 1022475 - RNA, 19 nt, Homo sapiens
caagucagaggcagcagaa

SEQ ID NO: 1022476 - RNA, 19 nt, Homo sapiens
caauguccuucuuugacuu

SEQ ID NO: 1022477 - RNA, 19 nt, Homo sapiens
gaugaagauaguccugauu

SEQ ID NO: 1022478 - RNA, 19 nt, Homo sapiens
ugugaagaccuuugagauu

SEQ ID NO: 1022479 - RNA, 19 nt, Homo sapiens
auagagccuguuaguauua

SEQ ID NO: 1022480 - RNA, 19 nt, Homo sapiens
ugucaugguugucuuugau

SEQ ID NO: 1022481 - RNA, 19 nt, Homo sapiens
gauuucagagccugugauu

SEQ ID NO: 1022482 - RNA, 19 nt, Homo sapiens
aguccuggaugcccacuuu

SEQ ID NO: 1022483 - RNA, 19 nt, Homo sapiens
ugguugauccucauucuuu

SEQ ID NO: 1022484 - RNA, 19 nt, Homo sapiens
gaaaaguuccugugauaca

SEQ ID NO: 1022485 - RNA, 19 nt, Homo sapiens
ucuguuggguucaauauac

SEQ ID NO: 1022486 - RNA, 19 nt, Homo sapiens
gucuaugacuccuggaaga

SEQ ID NO: 1022487 - RNA, 19 nt, Homo sapiens
gcucaucaacuccguccaa

SEQ ID NO: 1022488 - RNA, 19 nt, Homo sapiens
caagaaaaguuccugugau

SEQ ID NO: 1022489 - RNA, 19 nt, Homo sapiens
gggcauagagaaagcaaag

SEQ ID NO: 1022490 - RNA, 19 nt, Homo sapiens
gugaggacauacugaaugc

SEQ ID NO: 1022491 - RNA, 19 nt, Homo sapiens
uguugaaacucuacucaca

SEQ ID NO: 1022492 - RNA, 19 nt, Homo sapiens
uuucagagccugugauuac

SEQ ID NO: 1022493 - RNA, 19 nt, Homo sapiens
caaggaauuauagcuuuga

SEQ ID NO: 1022494 - RNA, 19 nt, Homo sapiens
caucaagaagcaacagaga

SEQ ID NO: 1022495 - RNA, 19 nt, Homo sapiens
ggcuucagauuugggcaua

SEQ ID NO: 1022496 - RNA, 19 nt, Homo sapiens
aaacggaaagcggcaugua

SEQ ID NO: 1022497 - RNA, 19 nt, Homo sapiens
ugagggauuugaacauaac

SEQ ID NO: 1022498 - RNA, 19 nt, Homo sapiens
gguugauccucauucuuuc

SEQ ID NO: 1022499 - RNA, 19 nt, Homo sapiens
caugguugucuuugauuaa

SEQ ID NO: 1022500 - RNA, 19 nt, Homo sapiens
cggaaagcggcauguauug

SEQ ID NO: 1022501 - RNA, 19 nt, Homo sapiens
acccauacauuccacuuuc

SEQ ID NO: 1022502 - RNA, 19 nt, Homo sapiens
ugaugaagauaguccugau

SEQ ID NO: 1022503 - RNA, 19 nt, Homo sapiens
gugauuacuccaagucaga

SEQ ID NO: 1022504 - RNA, 19 nt, Homo sapiens
cacacaaguuagaaaucaa

SEQ ID NO: 1022505 - RNA, 19 nt, Homo sapiens
augagggauuugaacauaa

SEQ ID NO: 1022506 - RNA, 19 nt, Homo sapiens
uggaagaaucucaucaaga

SEQ ID NO: 1022507 - RNA, 19 nt, Homo sapiens
cgaaguugcacggugaauu

SEQ ID NO: 1022508 - RNA, 19 nt, Homo sapiens
gaaagcaacuucagaaaug

SEQ ID NO: 1022509 - RNA, 19 nt, Homo sapiens
gaagggagcuauauuugaa

SEQ ID NO: 1022510 - RNA, 19 nt, Homo sapiens
gaucagaccuuuacaagug

SEQ ID NO: 1022511 - RNA, 19 nt, Homo sapiens
gaacugauuuagagaauug

SEQ ID NO: 1022512 - RNA, 19 nt, Homo sapiens
aaaccaaggugcaucauua

SEQ ID NO: 1022513 - RNA, 19 nt, Homo sapiens
cuacaacacuuacaaauga

SEQ ID NO: 1022514 - RNA, 19 nt, Homo sapiens
gaaaggaauuuguccgauu

SEQ ID NO: 1022515 - RNA, 19 nt, Homo sapiens
gauauuagcuguguccaaa

SEQ ID NO: 1022516 - RNA, 19 nt, Homo sapiens
ccaaauggguucugaauuc

SEQ ID NO: 1022517 - RNA, 19 nt, Homo sapiens
gaaauaacacuguaaggaa

SEQ ID NO: 1022518 - RNA, 19 nt, Homo sapiens
gguauugacucauugauug

SEQ ID NO: 1022519 - RNA, 19 nt, Homo sapiens
ggacagaacaguagcuaaa

SEQ ID NO: 1022520 - RNA, 19 nt, Homo sapiens
gaugcaguauggauauuua

SEQ ID NO: 1022521 - RNA, 19 nt, Homo sapiens
caaggugcaucauuaauau

SEQ ID NO: 1022522 - RNA, 19 nt, Homo sapiens
gaagaacuguaaccucaga

SEQ ID NO: 1022523 - RNA, 19 nt, Homo sapiens
gugcugaucuuucucguuu

SEQ ID NO: 1022524 - RNA, 19 nt, Homo sapiens
gauacuaaauccagagcua

SEQ ID NO: 1022525 - RNA, 19 nt, Homo sapiens
gagaugcauuugaggauuu

SEQ ID NO: 1022526 - RNA, 19 nt, Homo sapiens
ggaggaucauucaccaaua

SEQ ID NO: 1022527 - RNA, 19 nt, Homo sapiens
cuacugcaaucaaagcuua

SEQ ID NO: 1022528 - RNA, 19 nt, Homo sapiens
aggaauaacuuaccuauca

SEQ ID NO: 1022529 - RNA, 19 nt, Homo sapiens
gcaaucaaagcuuauauga

SEQ ID NO: 1022530 - RNA, 19 nt, Homo sapiens
gaggaucauucaccaauau

SEQ ID NO: 1022531 - RNA, 19 nt, Homo sapiens
gaaagaaagacaucauugu

SEQ ID NO: 1022532 - RNA, 19 nt, Homo sapiens
aaaggaauuuguccgauuu

SEQ ID NO: 1022533 - RNA, 19 nt, Homo sapiens
acagagaaguauuguauug

SEQ ID NO: 1022534 - RNA, 19 nt, Homo sapiens
ggagaaugacauaucuuua

SEQ ID NO: 1022535 - RNA, 19 nt, Homo sapiens
ccaaggugcaucauuaaua

SEQ ID NO: 1022536 - RNA, 19 nt, Homo sapiens
ggaaagaaagacaucauug

SEQ ID NO: 1022537 - RNA, 19 nt, Homo sapiens
cagaacaguagcuaaauua

SEQ ID NO: 1022538 - RNA, 19 nt, Homo sapiens
aaagguaccucuguagaaa

SEQ ID NO: 1022539 - RNA, 19 nt, Homo sapiens
ucaagaugcucuguucuaa

SEQ ID NO: 1022540 - RNA, 19 nt, Homo sapiens
ggaaagcaacuucagaaau

SEQ ID NO: 1022541 - RNA, 19 nt, Homo sapiens
gggaggagaucagaccuuu

SEQ ID NO: 1022542 - RNA, 19 nt, Homo sapiens
uaacuuaccuaucacuaca

SEQ ID NO: 1022543 - RNA, 19 nt, Homo sapiens
gaggauccuucuggucuua

SEQ ID NO: 1022544 - RNA, 19 nt, Homo sapiens
ggaauuacagaauguggua

SEQ ID NO: 1022545 - RNA, 19 nt, Homo sapiens
gagacagaguggaaagaaa

SEQ ID NO: 1022546 - RNA, 19 nt, Homo sapiens
ugaaagaucuaaacauggu

SEQ ID NO: 1022547 - RNA, 19 nt, Homo sapiens
gguccaagauguaauuauc

SEQ ID NO: 1022548 - RNA, 19 nt, Homo sapiens
guacaucacugucauucca

SEQ ID NO: 1022549 - RNA, 19 nt, Homo sapiens
ucugaaagaucuaaacaug

SEQ ID NO: 1022550 - RNA, 19 nt, Homo sapiens
gaaguauuguauugagaga

SEQ ID NO: 1022551 - RNA, 19 nt, Homo sapiens
gagugaauaugguagaguu

SEQ ID NO: 1022552 - RNA, 19 nt, Homo sapiens
gagaaguauuguauugaga

SEQ ID NO: 1022553 - RNA, 19 nt, Homo sapiens
uuacguagcuuauucuucu

SEQ ID NO: 1022554 - RNA, 19 nt, Homo sapiens
gaaguggcaauaaagaauu

SEQ ID NO: 1022555 - RNA, 19 nt, Homo sapiens
gagaucagacucccuaaga

SEQ ID NO: 1022556 - RNA, 19 nt, Homo sapiens
gcacucauuuaauagaugu

SEQ ID NO: 1022557 - RNA, 19 nt, Homo sapiens
uuaagccgcuguaaucuug

SEQ ID NO: 1022558 - RNA, 19 nt, Homo sapiens
guauuuacguagcuuauuc

SEQ ID NO: 1022559 - RNA, 19 nt, Homo sapiens
gagaaugacauaucuuuag

SEQ ID NO: 1022560 - RNA, 19 nt, Homo sapiens
gagaguggcuaccuuaaaa

SEQ ID NO: 1022561 - RNA, 19 nt, Homo sapiens
ugaacgagcugaucucucu

SEQ ID NO: 1022562 - RNA, 19 nt, Homo sapiens
gcaaagcuuuccuuaacag

SEQ ID NO: 1022563 - RNA, 19 nt, Homo sapiens
gcagggauauuagcugugu

SEQ ID NO: 1022564 - RNA, 19 nt, Homo sapiens
ucacaagcauaggaagaua

SEQ ID NO: 1022565 - RNA, 19 nt, Homo sapiens
cuacacaugucacaaagug

SEQ ID NO: 1022566 - RNA, 19 nt, Homo sapiens
ggagcuauauuugaagaga

SEQ ID NO: 1022567 - RNA, 19 nt, Homo sapiens
aagaugcucuguucuaaug

SEQ ID NO: 1022568 - RNA, 19 nt, Homo sapiens
aagcuuuccuuaacaguaa

SEQ ID NO: 1022569 - RNA, 19 nt, Homo sapiens
guuagaagaagcaagauuu

SEQ ID NO: 1022570 - RNA, 19 nt, Homo sapiens
agaaagacaucauuguaca

SEQ ID NO: 1022571 - RNA, 19 nt, Homo sapiens
agacagagaaguauuguau

SEQ ID NO: 1022572 - RNA, 19 nt, Homo sapiens
gggagaaugacauaucuuu

SEQ ID NO: 1022573 - RNA, 19 nt, Homo sapiens
cccaagagcagggauauua

SEQ ID NO: 1022574 - RNA, 19 nt, Homo sapiens
acagaacaguagcuaaauu

SEQ ID NO: 1022575 - RNA, 19 nt, Homo sapiens
ggaggaagauguaaaagau

SEQ ID NO: 1022576 - RNA, 19 nt, Homo sapiens
ggcaggaacugauuuagag

SEQ ID NO: 1022577 - RNA, 19 nt, Homo sapiens
ugaaagguguggauaugga

SEQ ID NO: 1022578 - RNA, 19 nt, Homo sapiens
agaaggugcuaaucugaaa

SEQ ID NO: 1022579 - RNA, 19 nt, Homo sapiens
gaucuaauguauacugcau

SEQ ID NO: 1022580 - RNA, 19 nt, Homo sapiens
gcuuagaaacugcagauuu

SEQ ID NO: 1022581 - RNA, 19 nt, Homo sapiens
gcuaaaaggcaauguaaua

SEQ ID NO: 1022582 - RNA, 19 nt, Homo sapiens
gaucaagcaauucuaucua

SEQ ID NO: 1022583 - RNA, 19 nt, Homo sapiens
gcacaacauaugcaauuau

SEQ ID NO: 1022584 - RNA, 19 nt, Homo sapiens
gaagaaauaacacuguaag

SEQ ID NO: 1022585 - RNA, 19 nt, Homo sapiens
ggaacugauuuagagaauu

SEQ ID NO: 1022586 - RNA, 19 nt, Homo sapiens
ggaaaagguuguucagguu

SEQ ID NO: 1022587 - RNA, 19 nt, Homo sapiens
agaaggagcaucccugaaa

SEQ ID NO: 1022588 - RNA, 19 nt, Homo sapiens
gagucaagaugcucuguuc

SEQ ID NO: 1022589 - RNA, 19 nt, Homo sapiens
guaugaauauggugagauc

SEQ ID NO: 1022590 - RNA, 19 nt, Homo sapiens
gaaagcacaacauaugcaa

SEQ ID NO: 1022591 - RNA, 19 nt, Homo sapiens
ucaagaagccaaccugaga

SEQ ID NO: 1022592 - RNA, 19 nt, Homo sapiens
gaaggagcaucccugaaac

SEQ ID NO: 1022593 - RNA, 19 nt, Homo sapiens
uaaagguaccucuguagaa

SEQ ID NO: 1022594 - RNA, 19 nt, Homo sapiens
gguauucauucacuuaaag

SEQ ID NO: 1022595 - RNA, 19 nt, Homo sapiens
caaagugucagaugagaau

SEQ ID NO: 1022596 - RNA, 19 nt, Homo sapiens
ccacuacacaugucacaaa

SEQ ID NO: 1022597 - RNA, 19 nt, Homo sapiens
uaaaggguacauaugcaua

SEQ ID NO: 1022598 - RNA, 19 nt, Homo sapiens
ggaggaauaacuuaccuau

SEQ ID NO: 1022599 - RNA, 19 nt, Homo sapiens
aaauaggcaugauguggaa

SEQ ID NO: 1022600 - RNA, 19 nt, Homo sapiens
guagggaaacuagauauug

SEQ ID NO: 1022601 - RNA, 19 nt, Homo sapiens
cagaaaagcacucauuuaa

SEQ ID NO: 1022602 - RNA, 19 nt, Homo sapiens
ugacuugguguccuuauuu

SEQ ID NO: 1022603 - RNA, 19 nt, Homo sapiens
gauguagggaaacuagaua

SEQ ID NO: 1022604 - RNA, 19 nt, Homo sapiens
ucaguugucuagaagaaau

SEQ ID NO: 1022605 - RNA, 19 nt, Homo sapiens
caacgugaagggagcuaua

SEQ ID NO: 1022606 - RNA, 19 nt, Homo sapiens
ggagaucagaccuuuacaa

SEQ ID NO: 1022607 - RNA, 19 nt, Homo sapiens
ccacucaguugucuagaag

SEQ ID NO: 1022608 - RNA, 19 nt, Homo sapiens
ggaaagaccuggcguucaa

SEQ ID NO: 1022609 - RNA, 19 nt, Homo sapiens
gggaggagcuagaguuuga

SEQ ID NO: 1022610 - RNA, 19 nt, Homo sapiens
gggcacagauggccaugua

SEQ ID NO: 1022611 - RNA, 19 nt, Homo sapiens
gcacgacguucauaguuga

SEQ ID NO: 1022612 - RNA, 19 nt, Homo sapiens
gggaaucggugcauaagga

SEQ ID NO: 1022613 - RNA, 19 nt, Homo sapiens
ggagcgaccugcuucuuug

SEQ ID NO: 1022614 - RNA, 19 nt, Homo sapiens
ggauccagcugcaguuuau

SEQ ID NO: 1022615 - RNA, 19 nt, Homo sapiens
gcaccugcgucucccagua

SEQ ID NO: 1022616 - RNA, 19 nt, Homo sapiens
gaugggcguugaccucuuu

SEQ ID NO: 1022617 - RNA, 19 nt, Homo sapiens
ggagauggguuccaaugca

SEQ ID NO: 1022618 - RNA, 19 nt, Homo sapiens
ggagugucauccuuacaaa

SEQ ID NO: 1022619 - RNA, 19 nt, Homo sapiens
ucauugccauguucaguua

SEQ ID NO: 1022620 - RNA, 19 nt, Homo sapiens
ucucgaagcuucccucaug

SEQ ID NO: 1022621 - RNA, 19 nt, Homo sapiens
ggagauauggccagcacua

SEQ ID NO: 1022622 - RNA, 19 nt, Homo sapiens
ugagcaagaugaugaagga

SEQ ID NO: 1022623 - RNA, 19 nt, Homo sapiens
ggaugggucugaggaauuc

SEQ ID NO: 1022624 - RNA, 19 nt, Homo sapiens
gcaguuuccucagcucuug

SEQ ID NO: 1022625 - RNA, 19 nt, Homo sapiens
ggaauucgagaccauaguu

SEQ ID NO: 1022626 - RNA, 19 nt, Homo sapiens
gaauagagacacccucauc

SEQ ID NO: 1022627 - RNA, 19 nt, Homo sapiens
gaccuggcguucaaguuug

SEQ ID NO: 1022628 - RNA, 19 nt, Homo sapiens
ccacagcgcaggcaccaaa

SEQ ID NO: 1022629 - RNA, 19 nt, Homo sapiens
guacgaacagcgccugaaa

SEQ ID NO: 1022630 - RNA, 19 nt, Homo sapiens
acagcgaucucuacuggaa

SEQ ID NO: 1022631 - RNA, 19 nt, Homo sapiens
ugaaacagcugggacacau

SEQ ID NO: 1022632 - RNA, 19 nt, Homo sapiens
ugacgcccgugccuucuuu

SEQ ID NO: 1022633 - RNA, 19 nt, Homo sapiens
uaaagccauuucagaggaa

SEQ ID NO: 1022634 - RNA, 19 nt, Homo sapiens
ggauuuugcuccuagagua

SEQ ID NO: 1022635 - RNA, 19 nt, Homo sapiens
ggagcuagaguuugacaug

SEQ ID NO: 1022636 - RNA, 19 nt, Homo sapiens
ggacauugcccagagugaa

SEQ ID NO: 1022637 - RNA, 19 nt, Homo sapiens
caacuacucggccuucuuc

SEQ ID NO: 1022638 - RNA, 19 nt, Homo sapiens
ccucaccacucacagauuc

SEQ ID NO: 1022639 - RNA, 19 nt, Homo sapiens
gaaccagugcgaccuagug

SEQ ID NO: 1022640 - RNA, 19 nt, Homo sapiens
gagaucgaaucaggcguuu

SEQ ID NO: 1022641 - RNA, 19 nt, Homo sapiens
gaggaugggucugaggaau

SEQ ID NO: 1022642 - RNA, 19 nt, Homo sapiens
gcaugguggugccggagaa

SEQ ID NO: 1022643 - RNA, 19 nt, Homo sapiens
gaauucgagaccauaguuu

SEQ ID NO: 1022644 - RNA, 19 nt, Homo sapiens
uuacacauucggcaaagua

SEQ ID NO: 1022645 - RNA, 19 nt, Homo sapiens
gaucgaaucaggcguuucu

SEQ ID NO: 1022646 - RNA, 19 nt, Homo sapiens
caucuucacggucaacaaa

SEQ ID NO: 1022647 - RNA, 19 nt, Homo sapiens
gggugcugcucguggauuu

SEQ ID NO: 1022648 - RNA, 19 nt, Homo sapiens
ugaaugaccggccugaguu

SEQ ID NO: 1022649 - RNA, 19 nt, Homo sapiens
uggacgcccugcugaauga

SEQ ID NO: 1022650 - RNA, 19 nt, Homo sapiens
ccucaucaccuucaggaaa

SEQ ID NO: 1022651 - RNA, 19 nt, Homo sapiens
agaccuggcguucaaguuu

SEQ ID NO: 1022652 - RNA, 19 nt, Homo sapiens
cgaaucaggcguuucuuuc

SEQ ID NO: 1022653 - RNA, 19 nt, Homo sapiens
gaagauguugacgcgaaua

SEQ ID NO: 1022654 - RNA, 19 nt, Homo sapiens
cuggucaacuugcucauug

SEQ ID NO: 1022655 - RNA, 19 nt, Homo sapiens
gcacuguccucugcaucga

SEQ ID NO: 1022656 - RNA, 19 nt, Homo sapiens
gcuagaguuugacauggau

SEQ ID NO: 1022657 - RNA, 19 nt, Homo sapiens
gcauguugguguggcugua

SEQ ID NO: 1022658 - RNA, 19 nt, Homo sapiens
cagcugcaguuuauagucu

SEQ ID NO: 1022659 - RNA, 19 nt, Homo sapiens
gggagugucauccuuacaa

SEQ ID NO: 1022660 - RNA, 19 nt, Homo sapiens
uucgugcgcuugcucauuu

SEQ ID NO: 1022661 - RNA, 19 nt, Homo sapiens
gaugaugaaggacguguuc

SEQ ID NO: 1022662 - RNA, 19 nt, Homo sapiens
uggauagugucauuaaugg

SEQ ID NO: 1022663 - RNA, 19 nt, Homo sapiens
gggagggacuggaauugac

SEQ ID NO: 1022664 - RNA, 19 nt, Homo sapiens
ggaugggcguugaccucuu

SEQ ID NO: 1022665 - RNA, 19 nt, Homo sapiens
ggaggcagcacggaggaaa

SEQ ID NO: 1022666 - RNA, 19 nt, Homo sapiens
gcacagauggccauguacu

SEQ ID NO: 1022667 - RNA, 19 nt, Homo sapiens
gcaaggcgaagcccgagau

SEQ ID NO: 1022668 - RNA, 19 nt, Homo sapiens
gauugauggugaugagaag

SEQ ID NO: 1022669 - RNA, 19 nt, Homo sapiens
gucccuaccugcagaucuu

SEQ ID NO: 1022670 - RNA, 19 nt, Homo sapiens
ugcaucgacuucaugguuu

SEQ ID NO: 1022671 - RNA, 19 nt, Homo sapiens
uacagucucugcugacaca

SEQ ID NO: 1022672 - RNA, 19 nt, Homo sapiens
gcccagguggagaggauua

SEQ ID NO: 1022673 - RNA, 19 nt, Homo sapiens
auaguugacuccacagauc

SEQ ID NO: 1022674 - RNA, 19 nt, Homo sapiens
gcuugcgccuggaguccua

SEQ ID NO: 1022675 - RNA, 19 nt, Homo sapiens
uggcggacuucaaggagaa

SEQ ID NO: 1022676 - RNA, 19 nt, Homo sapiens
cauggauagugucauuaau

SEQ ID NO: 1022677 - RNA, 19 nt, Homo sapiens
acauggauagugucauuaa

SEQ ID NO: 1022678 - RNA, 19 nt, Homo sapiens
ggaccaccuuugggagugu

SEQ ID NO: 1022679 - RNA, 19 nt, Homo sapiens
ggacuuggcacugaaacag

SEQ ID NO: 1022680 - RNA, 19 nt, Homo sapiens
gagcggaagcugcuaacgu

SEQ ID NO: 1022681 - RNA, 19 nt, Homo sapiens
acuggaaggcgcagcguua

SEQ ID NO: 1022682 - RNA, 19 nt, Homo sapiens
ccaacauccugcuggucaa

SEQ ID NO: 1022683 - RNA, 19 nt, Homo sapiens
gguacagucucugcugaca

SEQ ID NO: 1022684 - RNA, 19 nt, Homo sapiens
gccgcaagcacagcaauuu

SEQ ID NO: 1022685 - RNA, 19 nt, Homo sapiens
ugcacgacguucauaguug

SEQ ID NO: 1022686 - RNA, 19 nt, Homo sapiens
gaaugaccggccugaguuc

SEQ ID NO: 1022687 - RNA, 19 nt, Homo sapiens
ucgaaucaggcguuucuuu

SEQ ID NO: 1022688 - RNA, 19 nt, Homo sapiens
aagguggacuuggcacuga

SEQ ID NO: 1022689 - RNA, 19 nt, Homo sapiens
cucaucaccuucaggaaau

SEQ ID NO: 1022690 - RNA, 19 nt, Homo sapiens
ucgcucauccgcaaccuuu

SEQ ID NO: 1022691 - RNA, 19 nt, Homo sapiens
aggcucagcucccaugucu

SEQ ID NO: 1022692 - RNA, 19 nt, Homo sapiens
gauguugacgcgaauagag

SEQ ID NO: 1022693 - RNA, 19 nt, Homo sapiens
gaagcgcacgucccagaag

SEQ ID NO: 1022694 - RNA, 19 nt, Homo sapiens
gggcaacagcgaucucuac

SEQ ID NO: 1022695 - RNA, 19 nt, Homo sapiens
ggagggacuggaauugaca

SEQ ID NO: 1022696 - RNA, 19 nt, Homo sapiens
cugguggccuuguccuuga

SEQ ID NO: 1022697 - RNA, 19 nt, Homo sapiens
ucgagcauuuccggguuua

SEQ ID NO: 1022698 - RNA, 19 nt, Homo sapiens
cugcaucgacuucaugguu

SEQ ID NO: 1022699 - RNA, 19 nt, Homo sapiens
caucuacacccgccucauc

SEQ ID NO: 1022700 - RNA, 19 nt, Homo sapiens
gaccugcacgacguucaua

SEQ ID NO: 1022701 - RNA, 19 nt, Homo sapiens
ggaaccgcguggacauugc

SEQ ID NO: 1022702 - RNA, 19 nt, Homo sapiens
ggccucagccuaccuggau

SEQ ID NO: 1022703 - RNA, 19 nt, Homo sapiens
gaagcccgagaucgaauca

SEQ ID NO: 1022704 - RNA, 19 nt, Homo sapiens
guccugcuccuccugauug

SEQ ID NO: 1022705 - RNA, 19 nt, Homo sapiens
cagguggagaggauuauga

SEQ ID NO: 1022706 - RNA, 19 nt, Homo sapiens
gcggagacccuggaagaca

SEQ ID NO: 1022707 - RNA, 19 nt, Homo sapiens
agaagauguugacgcgaau

SEQ ID NO: 1022708 - RNA, 19 nt, Homo sapiens
ggagugggaucuuugauuu

SEQ ID NO: 1022709 - RNA, 19 nt, Homo sapiens
ucacuucccuuuauaguuu

SEQ ID NO: 1022710 - RNA, 19 nt, Homo sapiens
gcaaggaccuccgcgauga

SEQ ID NO: 1022711 - RNA, 19 nt, Homo sapiens
ccaaagaacucgaugacau

SEQ ID NO: 1022712 - RNA, 19 nt, Homo sapiens
gauaaacacuaggugcuuu

SEQ ID NO: 1022713 - RNA, 19 nt, Homo sapiens
ccagauggccuacguguuu

SEQ ID NO: 1022714 - RNA, 19 nt, Homo sapiens
uuacaucgucucugaauua

SEQ ID NO: 1022715 - RNA, 19 nt, Homo sapiens
ugagagaaaugcacaagug

SEQ ID NO: 1022716 - RNA, 19 nt, Homo sapiens
gaaguuucaggaucucuua

SEQ ID NO: 1022717 - RNA, 19 nt, Homo sapiens
acauaaaccuacaucguaa

SEQ ID NO: 1022718 - RNA, 19 nt, Homo sapiens
guaaacuguugaccaaaga

SEQ ID NO: 1022719 - RNA, 19 nt, Homo sapiens
ggaccuccgcgaugaauuu

SEQ ID NO: 1022720 - RNA, 19 nt, Homo sapiens
gaacccuaaucuccacaaa

SEQ ID NO: 1022721 - RNA, 19 nt, Homo sapiens
caucgucucugaauuaugg

SEQ ID NO: 1022722 - RNA, 19 nt, Homo sapiens
caugagagcuuuacaucgu

SEQ ID NO: 1022723 - RNA, 19 nt, Homo sapiens
guagauuagucucagaaug

SEQ ID NO: 1022724 - RNA, 19 nt, Homo sapiens
caaggugaaggaagaauuu

SEQ ID NO: 1022725 - RNA, 19 nt, Homo sapiens
cagacacagugccaacaua

SEQ ID NO: 1022726 - RNA, 19 nt, Homo sapiens
gcacauacacacacacaca

SEQ ID NO: 1022727 - RNA, 19 nt, Homo sapiens
cguauuuccuugagauaaa

SEQ ID NO: 1022728 - RNA, 19 nt, Homo sapiens
cuacauauacacacacgua

SEQ ID NO: 1022729 - RNA, 19 nt, Homo sapiens
cauagucagugugcgcuua

SEQ ID NO: 1022730 - RNA, 19 nt, Homo sapiens
aaaccuacaucguaaacug

SEQ ID NO: 1022731 - RNA, 19 nt, Homo sapiens
gaaaacagaguaccccuuu

SEQ ID NO: 1022732 - RNA, 19 nt, Homo sapiens
gagcaauggugggaucaug

SEQ ID NO: 1022733 - RNA, 19 nt, Homo sapiens
caaagaacucgaugacaug

SEQ ID NO: 1022734 - RNA, 19 nt, Homo sapiens
gaaaucggcacagucagaa

SEQ ID NO: 1022735 - RNA, 19 nt, Homo sapiens
gaauggacacuacaaaugc

SEQ ID NO: 1022736 - RNA, 19 nt, Homo sapiens
aacauaaaccuacaucgua

SEQ ID NO: 1022737 - RNA, 19 nt, Homo sapiens
caacauaaaccuacaucgu

SEQ ID NO: 1022738 - RNA, 19 nt, Homo sapiens
ucaucaaggugaaggaaga

SEQ ID NO: 1022739 - RNA, 19 nt, Homo sapiens
cacaguggcugguugcaau

SEQ ID NO: 1022740 - RNA, 19 nt, Homo sapiens
cgaaaucggcacagucaga

SEQ ID NO: 1022741 - RNA, 19 nt, Homo sapiens
cuacaugguccuugacuug

SEQ ID NO: 1022742 - RNA, 19 nt, Homo sapiens
agacacagugccaacauaa

SEQ ID NO: 1022743 - RNA, 19 nt, Homo sapiens
cuacaggaacguucacuug

SEQ ID NO: 1022744 - RNA, 19 nt, Homo sapiens
gugagaggccugaugagaa

SEQ ID NO: 1022745 - RNA, 19 nt, Homo sapiens
uaacaggacccggugcauu

SEQ ID NO: 1022746 - RNA, 19 nt, Homo sapiens
acacguauuuccuugagau

SEQ ID NO: 1022747 - RNA, 19 nt, Homo sapiens
ugagaggccugaugagaac

SEQ ID NO: 1022748 - RNA, 19 nt, Homo sapiens
gcacacacacacacacaca

SEQ ID NO: 1022749 - RNA, 19 nt, Homo sapiens
agugugcgcuuauguacuu

SEQ ID NO: 1022750 - RNA, 19 nt, Homo sapiens
cguaaacuguugaccaaag

SEQ ID NO: 1022751 - RNA, 19 nt, Homo sapiens
ggaaggggaugagcacauu

SEQ ID NO: 1022752 - RNA, 19 nt, Homo sapiens
agaauggacacuacaaaug

SEQ ID NO: 1022753 - RNA, 19 nt, Homo sapiens
ucacuucaguagauuaguc

SEQ ID NO: 1022754 - RNA, 19 nt, Homo sapiens
aaacugugcauuugagaga

SEQ ID NO: 1022755 - RNA, 19 nt, Homo sapiens
aaacauucccuucacuuca

SEQ ID NO: 1022756 - RNA, 19 nt, Homo sapiens
caaagucccagguugcaau

SEQ ID NO: 1022757 - RNA, 19 nt, Homo sapiens
uucaggaucucuuauguuc

SEQ ID NO: 1022758 - RNA, 19 nt, Homo sapiens
aaccugagcgggacuauga

SEQ ID NO: 1022759 - RNA, 19 nt, Homo sapiens
cagaauggacacuacaaau

SEQ ID NO: 1022760 - RNA, 19 nt, Homo sapiens
gucccagguugcaauauga

SEQ ID NO: 1022761 - RNA, 19 nt, Homo sapiens
caggaucucuuauguucag

SEQ ID NO: 1022762 - RNA, 19 nt, Homo sapiens
aguauggacuguacaaugg

SEQ ID NO: 1022763 - RNA, 19 nt, Homo sapiens
aacaggacccggugcauuu

SEQ ID NO: 1022764 - RNA, 19 nt, Homo sapiens
gcacauucacagcgaagug

SEQ ID NO: 1022765 - RNA, 19 nt, Homo sapiens
gcaagaagaguuucaaaag

SEQ ID NO: 1022766 - RNA, 19 nt, Homo sapiens
ugccagcucucaccagaug

SEQ ID NO: 1022767 - RNA, 19 nt, Homo sapiens
gcaauggugggaucaugug

SEQ ID NO: 1022768 - RNA, 19 nt, Homo sapiens
gugugugugugcauaaaug

SEQ ID NO: 1022769 - RNA, 19 nt, Homo sapiens
uagauuagucucagaaugg

SEQ ID NO: 1022770 - RNA, 19 nt, Homo sapiens
ucgcagcccucccuuagca

SEQ ID NO: 1022771 - RNA, 19 nt, Homo sapiens
ccgacagcaugacuucuga

SEQ ID NO: 1022772 - RNA, 19 nt, Homo sapiens
guuucaggaucucuuaugu

SEQ ID NO: 1022773 - RNA, 19 nt, Homo sapiens
ucuguuaugugugcaagaa

SEQ ID NO: 1022774 - RNA, 19 nt, Homo sapiens
acuaggugcuuuugaauuu

SEQ ID NO: 1022775 - RNA, 19 nt, Homo sapiens
ucagaauggacacuacaaa

SEQ ID NO: 1022776 - RNA, 19 nt, Homo sapiens
ucccuucacuucaguagau

SEQ ID NO: 1022777 - RNA, 19 nt, Homo sapiens
gacacagugccaacauaaa

SEQ ID NO: 1022778 - RNA, 19 nt, Homo sapiens
gagaacgagucugagucuu

SEQ ID NO: 1022779 - RNA, 19 nt, Homo sapiens
gcacaguggcugguugcaa

SEQ ID NO: 1022780 - RNA, 19 nt, Homo sapiens
ugaaggaagaauuuacaga

SEQ ID NO: 1022781 - RNA, 19 nt, Homo sapiens
ggugaaggaagaauuuaca

SEQ ID NO: 1022782 - RNA, 19 nt, Homo sapiens
aaacagaguaccccuuuaa

SEQ ID NO: 1022783 - RNA, 19 nt, Homo sapiens
uguuugaacugccauaguc

SEQ ID NO: 1022784 - RNA, 19 nt, Homo sapiens
cagauggccuacguguuug

SEQ ID NO: 1022785 - RNA, 19 nt, Homo sapiens
cagcuugucugggagcaau

SEQ ID NO: 1022786 - RNA, 19 nt, Homo sapiens
cccaaaaucuguuaugugu

SEQ ID NO: 1022787 - RNA, 19 nt, Homo sapiens
ucaaggugaaggaagaauu

SEQ ID NO: 1022788 - RNA, 19 nt, Homo sapiens
cuacaaaugccagcucuca

SEQ ID NO: 1022789 - RNA, 19 nt, Homo sapiens
ucaguagauuagucucaga

SEQ ID NO: 1022790 - RNA, 19 nt, Homo sapiens
gggcgaggaauccauggaa

SEQ ID NO: 1022791 - RNA, 19 nt, Homo sapiens
agugggaucuuugauuuca

SEQ ID NO: 1022792 - RNA, 19 nt, Homo sapiens
ccugagagugcacuacaaa

SEQ ID NO: 1022793 - RNA, 19 nt, Homo sapiens
ggauucuucucgaugacau

SEQ ID NO: 1022794 - RNA, 19 nt, Homo sapiens
uguuaugugugcaagaaga

SEQ ID NO: 1022795 - RNA, 19 nt, Homo sapiens
acacacguauuuccuugag

SEQ ID NO: 1022796 - RNA, 19 nt, Homo sapiens
gcucuguggcuacauauac

SEQ ID NO: 1022797 - RNA, 19 nt, Homo sapiens
ggugggaucaugugcaaca

SEQ ID NO: 1022798 - RNA, 19 nt, Homo sapiens
acuaugagaacgagucuga

SEQ ID NO: 1022799 - RNA, 19 nt, Homo sapiens
uacaggaacguucacuuga

SEQ ID NO: 1022800 - RNA, 19 nt, Homo sapiens
uacaucgucucugaauuau

SEQ ID NO: 1022801 - RNA, 19 nt, Homo sapiens
cugaugagaaccacaguga

SEQ ID NO: 1022802 - RNA, 19 nt, Homo sapiens
aaagucccagguugcaaua

SEQ ID NO: 1022803 - RNA, 19 nt, Homo sapiens
gaccaaagaacucgaugac

SEQ ID NO: 1022804 - RNA, 19 nt, Homo sapiens
cauaaaccuacaucguaaa

SEQ ID NO: 1022805 - RNA, 19 nt, Homo sapiens
gugcaagaagaguuucaaa

SEQ ID NO: 1022806 - RNA, 19 nt, Homo sapiens
acacgcacauacacacaca

SEQ ID NO: 1022807 - RNA, 19 nt, Homo sapiens
acacacacacacgcacaua

SEQ ID NO: 1022808 - RNA, 19 nt, Homo sapiens
gagaugguauuccuccuua

SEQ ID NO: 1022809 - RNA, 19 nt, Homo sapiens
guacaagguugguaacauu

SEQ ID NO: 1022810 - RNA, 19 nt, Homo sapiens
gagaggauggugagaauua

SEQ ID NO: 1022811 - RNA, 19 nt, Homo sapiens
gagcuuguguuacauggua

SEQ ID NO: 1022812 - RNA, 19 nt, Homo sapiens
gaacuucgcagaacagcua

SEQ ID NO: 1022813 - RNA, 19 nt, Homo sapiens
gaggaucuguccacauuug

SEQ ID NO: 1022814 - RNA, 19 nt, Homo sapiens
gcugugagcuuguguuaca

SEQ ID NO: 1022815 - RNA, 19 nt, Homo sapiens
caugacagccuuucuuuaa

SEQ ID NO: 1022816 - RNA, 19 nt, Homo sapiens
gaaccucaccgacuucuug

SEQ ID NO: 1022817 - RNA, 19 nt, Homo sapiens
gaccggagaugacgccauu

SEQ ID NO: 1022818 - RNA, 19 nt, Homo sapiens
uaaagccaaugaagagaaa

SEQ ID NO: 1022819 - RNA, 19 nt, Homo sapiens
gggaaaccagaauaaauua

SEQ ID NO: 1022820 - RNA, 19 nt, Homo sapiens
aagaggaucuguccacauu

SEQ ID NO: 1022821 - RNA, 19 nt, Homo sapiens
ucaugaagauuauggugua

SEQ ID NO: 1022822 - RNA, 19 nt, Homo sapiens
ggaauuaagugugguagca

SEQ ID NO: 1022823 - RNA, 19 nt, Homo sapiens
guaauaaagccaaugaaga

SEQ ID NO: 1022824 - RNA, 19 nt, Homo sapiens
ucacggagaaucuaucuaa

SEQ ID NO: 1022825 - RNA, 19 nt, Homo sapiens
gcacuguucuccucaugug

SEQ ID NO: 1022826 - RNA, 19 nt, Homo sapiens
guaagggcaucaugaagau

SEQ ID NO: 1022827 - RNA, 19 nt, Homo sapiens
ggccuauccuuacuuguuu

SEQ ID NO: 1022828 - RNA, 19 nt, Homo sapiens
ccggagugcugguaucuaa

SEQ ID NO: 1022829 - RNA, 19 nt, Homo sapiens
ggacauuuguuccguaagg

SEQ ID NO: 1022830 - RNA, 19 nt, Homo sapiens
gggagaggauggugagaau

SEQ ID NO: 1022831 - RNA, 19 nt, Homo sapiens
ggcaggacauggucucuga

SEQ ID NO: 1022832 - RNA, 19 nt, Homo sapiens
ccaagaggcucaugugacu

SEQ ID NO: 1022833 - RNA, 19 nt, Homo sapiens
agacuuuccuugaccauga

SEQ ID NO: 1022834 - RNA, 19 nt, Homo sapiens
gagcgaaacuccgucucaa

SEQ ID NO: 1022835 - RNA, 19 nt, Homo sapiens
ccaccaugcucagcuaauu

SEQ ID NO: 1022836 - RNA, 19 nt, Homo sapiens
gaccaugaguuuguugcua

SEQ ID NO: 1022837 - RNA, 19 nt, Homo sapiens
ucuccuaucucguggaauu

SEQ ID NO: 1022838 - RNA, 19 nt, Homo sapiens
gacggagucucgcuuuguu

SEQ ID NO: 1022839 - RNA, 19 nt, Homo sapiens
caagguugguaacauuaga

SEQ ID NO: 1022840 - RNA, 19 nt, Homo sapiens
uaucuaaucccacuguauu

SEQ ID NO: 1022841 - RNA, 19 nt, Homo sapiens
ccaaagugcugggauuaca

SEQ ID NO: 1022842 - RNA, 19 nt, Homo sapiens
gaaacugcguggacauugc

SEQ ID NO: 1022843 - RNA, 19 nt, Homo sapiens
uaauaaagccaaugaagag

SEQ ID NO: 1022844 - RNA, 19 nt, Homo sapiens
cgauuucacuuucaugaca

SEQ ID NO: 1022845 - RNA, 19 nt, Homo sapiens
gcacugaggccuugucacu

SEQ ID NO: 1022846 - RNA, 19 nt, Homo sapiens
ugaagauuaugguguacaa

SEQ ID NO: 1022847 - RNA, 19 nt, Homo sapiens
gccaugcccuggugcgaaa

SEQ ID NO: 1022848 - RNA, 19 nt, Homo sapiens
ccagcaagccagcccauuu

SEQ ID NO: 1022849 - RNA, 19 nt, Homo sapiens
gggccuauccuuacuuguu

SEQ ID NO: 1022850 - RNA, 19 nt, Homo sapiens
caagccagcccauuuguuc

SEQ ID NO: 1022851 - RNA, 19 nt, Homo sapiens
ccaguuguguugucuucaa

SEQ ID NO: 1022852 - RNA, 19 nt, Homo sapiens
acauggaaccugagacuuu

SEQ ID NO: 1022853 - RNA, 19 nt, Homo sapiens
cugaugacaugaagaacuu

SEQ ID NO: 1022854 - RNA, 19 nt, Homo sapiens
gcagggaaguguuuuagau

SEQ ID NO: 1022855 - RNA, 19 nt, Homo sapiens
cacccaaggucaggaguuu

SEQ ID NO: 1022856 - RNA, 19 nt, Homo sapiens
gguaauaaagccaaugaag

SEQ ID NO: 1022857 - RNA, 19 nt, Homo sapiens
gacauggucucugaugaca

SEQ ID NO: 1022858 - RNA, 19 nt, Homo sapiens
ccucuaaucccagcacuuu

SEQ ID NO: 1022859 - RNA, 19 nt, Homo sapiens
cguaagggcaucaugaaga

SEQ ID NO: 1022860 - RNA, 19 nt, Homo sapiens
accaugaguuuguugcuaa

SEQ ID NO: 1022861 - RNA, 19 nt, Homo sapiens
aagggcaucaugaagauua

SEQ ID NO: 1022862 - RNA, 19 nt, Homo sapiens
gcaagccagcccauuuguu

SEQ ID NO: 1022863 - RNA, 19 nt, Homo sapiens
cauggaaccugagacuuuc

SEQ ID NO: 1022864 - RNA, 19 nt, Homo sapiens
agaggauggugagaauuaa

SEQ ID NO: 1022865 - RNA, 19 nt, Homo sapiens
cagcaagccagcccauuug

SEQ ID NO: 1022866 - RNA, 19 nt, Homo sapiens
gcaccuccagucaccauga

SEQ ID NO: 1022867 - RNA, 19 nt, Homo sapiens
caugauggaguaccuguug

SEQ ID NO: 1022868 - RNA, 19 nt, Homo sapiens
ggagugcugguaucuaauc

SEQ ID NO: 1022869 - RNA, 19 nt, Homo sapiens
ucaugacagccuuucuuua

SEQ ID NO: 1022870 - RNA, 19 nt, Homo sapiens
agguauaucccgugccuua

SEQ ID NO: 1022871 - RNA, 19 nt, Homo sapiens
gacauugccacaucugaga

SEQ ID NO: 1022872 - RNA, 19 nt, Homo sapiens
uacaagguugguaacauua

SEQ ID NO: 1022873 - RNA, 19 nt, Homo sapiens
ggggaaaccagaauaaauu

SEQ ID NO: 1022874 - RNA, 19 nt, Homo sapiens
gaacccaggaggugaaggu

SEQ ID NO: 1022875 - RNA, 19 nt, Homo sapiens
cugaguagcugggauuaca

SEQ ID NO: 1022876 - RNA, 19 nt, Homo sapiens
ucaccgacuucuugaugga

SEQ ID NO: 1022877 - RNA, 19 nt, Homo sapiens
caacauggaaccugagacu

SEQ ID NO: 1022878 - RNA, 19 nt, Homo sapiens
cggagaaucuaucuaaucc

SEQ ID NO: 1022879 - RNA, 19 nt, Homo sapiens
aagaggcucaugugacuaa

SEQ ID NO: 1022880 - RNA, 19 nt, Homo sapiens
ggacauggucucugaugac

SEQ ID NO: 1022881 - RNA, 19 nt, Homo sapiens
ggauggugagaauuaauug

SEQ ID NO: 1022882 - RNA, 19 nt, Homo sapiens
uaucuaaucgucgcucaaa

SEQ ID NO: 1022883 - RNA, 19 nt, Homo sapiens
gggcaccauuaacaugaug

SEQ ID NO: 1022884 - RNA, 19 nt, Homo sapiens
guagcaggcgcuuguaauc

SEQ ID NO: 1022885 - RNA, 19 nt, Homo sapiens
gcgaaacugcguggacauu

SEQ ID NO: 1022886 - RNA, 19 nt, Homo sapiens
uuagaucacaguuuggaaa

SEQ ID NO: 1022887 - RNA, 19 nt, Homo sapiens
gcgaaacuccgucucaaaa

SEQ ID NO: 1022888 - RNA, 19 nt, Homo sapiens
gaaaccccaucucuacgaa

SEQ ID NO: 1022889 - RNA, 19 nt, Homo sapiens
augacagccuuucuuuaaa

SEQ ID NO: 1022890 - RNA, 19 nt, Homo sapiens
uaaccggagugcugguauc

SEQ ID NO: 1022891 - RNA, 19 nt, Homo sapiens
ggucucugaugacaugaag

SEQ ID NO: 1022892 - RNA, 19 nt, Homo sapiens
cauuagaggcugugagcuu

SEQ ID NO: 1022893 - RNA, 19 nt, Homo sapiens
gguagcaggcgcuuguaau

SEQ ID NO: 1022894 - RNA, 19 nt, Homo sapiens
caccaugcucagcuaauuu

SEQ ID NO: 1022895 - RNA, 19 nt, Homo sapiens
guccaguuguguugucuuc

SEQ ID NO: 1022896 - RNA, 19 nt, Homo sapiens
gaggugaagguugcaguga

SEQ ID NO: 1022897 - RNA, 19 nt, Homo sapiens
gaauuaauugguucuuugc

SEQ ID NO: 1022898 - RNA, 19 nt, Homo sapiens
ggagaggauggugagaauu

SEQ ID NO: 1022899 - RNA, 19 nt, Homo sapiens
agggacauuuguuccguaa

SEQ ID NO: 1022900 - RNA, 19 nt, Homo sapiens
gaugguauuccuccuuaag

SEQ ID NO: 1022901 - RNA, 19 nt, Homo sapiens
aaccugagacuuuccuuga

SEQ ID NO: 1022902 - RNA, 19 nt, Homo sapiens
gcgcuuguaaucccagcua

SEQ ID NO: 1022903 - RNA, 19 nt, Homo sapiens
ggaugucacggagaaucua

SEQ ID NO: 1022904 - RNA, 19 nt, Homo sapiens
cauguggcgauuucacuuu

SEQ ID NO: 1022905 - RNA, 19 nt, Homo sapiens
ucucugaugacaugaagaa

SEQ ID NO: 1022906 - RNA, 19 nt, Homo sapiens
aagauuaugguguacaaga

SEQ ID NO: 1022907 - RNA, 19 nt, Homo sapiens
ccagaaaugggagacaaga

SEQ ID NO: 1022908 - RNA, 19 nt, Homo sapiens
ggaauuaucuucuuaguug

SEQ ID NO: 1022909 - RNA, 19 nt, Homo sapiens
gaagacaccuuggaaauga

SEQ ID NO: 1022910 - RNA, 19 nt, Homo sapiens
gaaccaaguuugcuauuga

SEQ ID NO: 1022911 - RNA, 19 nt, Homo sapiens
gagagaaggagaauuauua

SEQ ID NO: 1022912 - RNA, 19 nt, Homo sapiens
gaaaucaucuacaacauca

SEQ ID NO: 1022913 - RNA, 19 nt, Homo sapiens
gaaggagaauuauuaggaa

SEQ ID NO: 1022914 - RNA, 19 nt, Homo sapiens
gcucaaagccuuccagaaa

SEQ ID NO: 1022915 - RNA, 19 nt, Homo sapiens
gcaaauccuugacuaugaa

SEQ ID NO: 1022916 - RNA, 19 nt, Homo sapiens
cccgagagcucuuacuuua

SEQ ID NO: 1022917 - RNA, 19 nt, Homo sapiens
gaauaaagacagacaguug

SEQ ID NO: 1022918 - RNA, 19 nt, Homo sapiens
acacuggaguucuuuauuu

SEQ ID NO: 1022919 - RNA, 19 nt, Homo sapiens
aaagucaacucaacaaaga

SEQ ID NO: 1022920 - RNA, 19 nt, Homo sapiens
uuaaaccucuggauuauga

SEQ ID NO: 1022921 - RNA, 19 nt, Homo sapiens
guugagagaaggagaauua

SEQ ID NO: 1022922 - RNA, 19 nt, Homo sapiens
guaaauagaaccaauggaa

SEQ ID NO: 1022923 - RNA, 19 nt, Homo sapiens
gauuaaaccucuggauuau

SEQ ID NO: 1022924 - RNA, 19 nt, Homo sapiens
gagcaucccuacagaaagu

SEQ ID NO: 1022925 - RNA, 19 nt, Homo sapiens
auacucaucugcauucuaa

SEQ ID NO: 1022926 - RNA, 19 nt, Homo sapiens
ugauuaaaccucuggauua

SEQ ID NO: 1022927 - RNA, 19 nt, Homo sapiens
ggucacaguuccugaauca

SEQ ID NO: 1022928 - RNA, 19 nt, Homo sapiens
ccacagcugucauaucaau

SEQ ID NO: 1022929 - RNA, 19 nt, Homo sapiens
ggaaccaaguuugcuauug

SEQ ID NO: 1022930 - RNA, 19 nt, Homo sapiens
gcagaaaucaucuacaaca

SEQ ID NO: 1022931 - RNA, 19 nt, Homo sapiens
ccucuugccucaguauuua

SEQ ID NO: 1022932 - RNA, 19 nt, Homo sapiens
gaccagcucuccugccuau

SEQ ID NO: 1022933 - RNA, 19 nt, Homo sapiens
gugcagcucuuucaacuca

SEQ ID NO: 1022934 - RNA, 19 nt, Homo sapiens
gagaaacugcagaagauaa

SEQ ID NO: 1022935 - RNA, 19 nt, Homo sapiens
ugaugcaacugccuccuua

SEQ ID NO: 1022936 - RNA, 19 nt, Homo sapiens
gauggugacugccgaaaca

SEQ ID NO: 1022937 - RNA, 19 nt, Homo sapiens
gaugcggacuugagaguga

SEQ ID NO: 1022938 - RNA, 19 nt, Homo sapiens
cgagagcucuuacuuuagu

SEQ ID NO: 1022939 - RNA, 19 nt, Homo sapiens
cuaaggaauucuccauuga

SEQ ID NO: 1022940 - RNA, 19 nt, Homo sapiens
caaagaagacaccuuggaa

SEQ ID NO: 1022941 - RNA, 19 nt, Homo sapiens
caucaucagugguaauuca

SEQ ID NO: 1022942 - RNA, 19 nt, Homo sapiens
cacaguuccugaaucaaua

SEQ ID NO: 1022943 - RNA, 19 nt, Homo sapiens
ccaaguaccugcucaccau

SEQ ID NO: 1022944 - RNA, 19 nt, Homo sapiens
acuaaaggaugaacauuug

SEQ ID NO: 1022945 - RNA, 19 nt, Homo sapiens
ggaaugguugaguuuaaua

SEQ ID NO: 1022946 - RNA, 19 nt, Homo sapiens
gaccaugcaccucaguuua

SEQ ID NO: 1022947 - RNA, 19 nt, Homo sapiens
ucaguguccuggaugauaa

SEQ ID NO: 1022948 - RNA, 19 nt, Homo sapiens
cagaauauccuuauaagca

SEQ ID NO: 1022949 - RNA, 19 nt, Homo sapiens
ggcacaauauuuacuauca

SEQ ID NO: 1022950 - RNA, 19 nt, Homo sapiens
caucugcauucuaauugua

SEQ ID NO: 1022951 - RNA, 19 nt, Homo sapiens
ggaacacacaucaguggua

SEQ ID NO: 1022952 - RNA, 19 nt, Homo sapiens
cuaagcaaauccuugacua

SEQ ID NO: 1022953 - RNA, 19 nt, Homo sapiens
uacuaucagucccguauua

SEQ ID NO: 1022954 - RNA, 19 nt, Homo sapiens
gaagaaaugacugaauaug

SEQ ID NO: 1022955 - RNA, 19 nt, Homo sapiens
gaacuuaaagcagaagaug

SEQ ID NO: 1022956 - RNA, 19 nt, Homo sapiens
ggaugaacauuugcauaug

SEQ ID NO: 1022957 - RNA, 19 nt, Homo sapiens
agacaaaggugaugcaacu

SEQ ID NO: 1022958 - RNA, 19 nt, Homo sapiens
gaccuauucuauuguauca

SEQ ID NO: 1022959 - RNA, 19 nt, Homo sapiens
gagauaggaauagaagaua

SEQ ID NO: 1022960 - RNA, 19 nt, Homo sapiens
ggagauaggaauagaagau

SEQ ID NO: 1022961 - RNA, 19 nt, Homo sapiens
agaaaugacugaauaugag

SEQ ID NO: 1022962 - RNA, 19 nt, Homo sapiens
uaaagcagaagaugaaguu

SEQ ID NO: 1022963 - RNA, 19 nt, Homo sapiens
caagaaugccggcaguaaa

SEQ ID NO: 1022964 - RNA, 19 nt, Homo sapiens
cauccuggcugacguuaga

SEQ ID NO: 1022965 - RNA, 19 nt, Homo sapiens
ggaaggagaaacugcagaa

SEQ ID NO: 1022966 - RNA, 19 nt, Homo sapiens
aaccucaucuccuuucuuu

SEQ ID NO: 1022967 - RNA, 19 nt, Homo sapiens
uuucaaacaucgaccauga

SEQ ID NO: 1022968 - RNA, 19 nt, Homo sapiens
ggauuugaauucagcuuuc

SEQ ID NO: 1022969 - RNA, 19 nt, Homo sapiens
ucuaaggaauucuccauug

SEQ ID NO: 1022970 - RNA, 19 nt, Homo sapiens
ccacagacuuagaaagcaa

SEQ ID NO: 1022971 - RNA, 19 nt, Homo sapiens
acaacuaucacuggaauua

SEQ ID NO: 1022972 - RNA, 19 nt, Homo sapiens
ggagaaacugcagaagaua

SEQ ID NO: 1022973 - RNA, 19 nt, Homo sapiens
ccggaaugguugaguuuaa

SEQ ID NO: 1022974 - RNA, 19 nt, Homo sapiens
ucacuggaauuaucuucuu

SEQ ID NO: 1022975 - RNA, 19 nt, Homo sapiens
ucuaccauaugcucuauaa

SEQ ID NO: 1022976 - RNA, 19 nt, Homo sapiens
ccacugggaugccaaguac

SEQ ID NO: 1022977 - RNA, 19 nt, Homo sapiens
gaaggcaugacucccaauu

SEQ ID NO: 1022978 - RNA, 19 nt, Homo sapiens
ucacucaagaucaguauuu

SEQ ID NO: 1022979 - RNA, 19 nt, Homo sapiens
gaugaacauuugcauaugc

SEQ ID NO: 1022980 - RNA, 19 nt, Homo sapiens
ucacacccaugucaaggaa

SEQ ID NO: 1022981 - RNA, 19 nt, Homo sapiens
ccauuaaaguuucuccaau

SEQ ID NO: 1022982 - RNA, 19 nt, Homo sapiens
agacaacuaucacuggaau

SEQ ID NO: 1022983 - RNA, 19 nt, Homo sapiens
cauggaaugucuuaugauc

SEQ ID NO: 1022984 - RNA, 19 nt, Homo sapiens
ucacuguggucucagcaaa

SEQ ID NO: 1022985 - RNA, 19 nt, Homo sapiens
uugauggagucauucuuua

SEQ ID NO: 1022986 - RNA, 19 nt, Homo sapiens
ccuauuuccucuaccauau

SEQ ID NO: 1022987 - RNA, 19 nt, Homo sapiens
caacaucaucucuggaaau

SEQ ID NO: 1022988 - RNA, 19 nt, Homo sapiens
uuccacagcugucauauca

SEQ ID NO: 1022989 - RNA, 19 nt, Homo sapiens
gaacaauuuucauguggaa

SEQ ID NO: 1022990 - RNA, 19 nt, Homo sapiens
cagcuuucauauucaguuu

SEQ ID NO: 1022991 - RNA, 19 nt, Homo sapiens
gcagcucuuucaacucaga

SEQ ID NO: 1022992 - RNA, 19 nt, Homo sapiens
uaaaugagcaucccuacag

SEQ ID NO: 1022993 - RNA, 19 nt, Homo sapiens
aggagaaacugcagaagau

SEQ ID NO: 1022994 - RNA, 19 nt, Homo sapiens
gcaccucaguuuauguucu

SEQ ID NO: 1022995 - RNA, 19 nt, Homo sapiens
gacaguggcugcccuccau

SEQ ID NO: 1022996 - RNA, 19 nt, Homo sapiens
agaaggagaauuauuagga

SEQ ID NO: 1022997 - RNA, 19 nt, Homo sapiens
ccaagaaugccggcaguaa

SEQ ID NO: 1022998 - RNA, 19 nt, Homo sapiens
uaaguaucauggagaagga

SEQ ID NO: 1022999 - RNA, 19 nt, Homo sapiens
aaagacagacaguugauug

SEQ ID NO: 1023000 - RNA, 19 nt, Homo sapiens
cauccaaauuucugauuca

SEQ ID NO: 1023001 - RNA, 19 nt, Homo sapiens
ccagacaguucagaagaga

SEQ ID NO: 1023002 - RNA, 19 nt, Homo sapiens
caauaaauacugccucaca

SEQ ID NO: 1023003 - RNA, 19 nt, Homo sapiens
cuuauaagcaagucgguua

SEQ ID NO: 1023004 - RNA, 19 nt, Homo sapiens
acagucaaauccuauaauc

SEQ ID NO: 1023005 - RNA, 19 nt, Homo sapiens
gcacaauauuuacuaucag

SEQ ID NO: 1023006 - RNA, 19 nt, Homo sapiens
cacuggaauuaucuucuua

SEQ ID NO: 1023007 - RNA, 19 nt, Homo sapiens
gaagggauagaugaauuug

SEQ ID NO: 1023008 - RNA, 19 nt, Homo sapiens
gagcagaucuuccuuguuu

SEQ ID NO: 1023009 - RNA, 19 nt, Homo sapiens
ggaggaagauuaagacuag

SEQ ID NO: 1023010 - RNA, 19 nt, Homo sapiens
gaauagagucugugaauga

SEQ ID NO: 1023011 - RNA, 19 nt, Homo sapiens
ggaaugaaauuggaagcua

SEQ ID NO: 1023012 - RNA, 19 nt, Homo sapiens
gguaagacauuaagacuca

SEQ ID NO: 1023013 - RNA, 19 nt, Homo sapiens
gaaauuagaagcaguagau

SEQ ID NO: 1023014 - RNA, 19 nt, Homo sapiens
gauuaagacuaguguauga

SEQ ID NO: 1023015 - RNA, 19 nt, Homo sapiens
caacaacaauaucacagaa

SEQ ID NO: 1023016 - RNA, 19 nt, Homo sapiens
gagagucgcucccagauag

SEQ ID NO: 1023017 - RNA, 19 nt, Homo sapiens
cacaguaacucgaauuauu

SEQ ID NO: 1023018 - RNA, 19 nt, Homo sapiens
gaagaaagcgaagauagaa

SEQ ID NO: 1023019 - RNA, 19 nt, Homo sapiens
acacaacagucaccaaauu

SEQ ID NO: 1023020 - RNA, 19 nt, Homo sapiens
ggaacaaguacccuuauuu

SEQ ID NO: 1023021 - RNA, 19 nt, Homo sapiens
ggacaagaauauaccuaug

SEQ ID NO: 1023022 - RNA, 19 nt, Homo sapiens
gaaugaaauuggaagcuau

SEQ ID NO: 1023023 - RNA, 19 nt, Homo sapiens
cuagaacuauucagcauaa

SEQ ID NO: 1023024 - RNA, 19 nt, Homo sapiens
gaaacaggauggacauuuu

SEQ ID NO: 1023025 - RNA, 19 nt, Homo sapiens
gaaaugauuaccacaguau

SEQ ID NO: 1023026 - RNA, 19 nt, Homo sapiens
guaaguugguauacagaaa

SEQ ID NO: 1023027 - RNA, 19 nt, Homo sapiens
aagcauaggucaucgauuc

SEQ ID NO: 1023028 - RNA, 19 nt, Homo sapiens
ggacuucuggugcaauaua

SEQ ID NO: 1023029 - RNA, 19 nt, Homo sapiens
gagaaaugauuaccacagu

SEQ ID NO: 1023030 - RNA, 19 nt, Homo sapiens
gaucugacugguucuguua

SEQ ID NO: 1023031 - RNA, 19 nt, Homo sapiens
gaugacuucuggugccaua

SEQ ID NO: 1023032 - RNA, 19 nt, Homo sapiens
gaguagaaguucccaauac

SEQ ID NO: 1023033 - RNA, 19 nt, Homo sapiens
ccaaucagcuucaucaaaa

SEQ ID NO: 1023034 - RNA, 19 nt, Homo sapiens
gaacaaguacccuuauuuu

SEQ ID NO: 1023035 - RNA, 19 nt, Homo sapiens
ggagccacguuuaauaugu

SEQ ID NO: 1023036 - RNA, 19 nt, Homo sapiens
ggugcuagcugacggauuc

SEQ ID NO: 1023037 - RNA, 19 nt, Homo sapiens
gaauauaccuaugucugau

SEQ ID NO: 1023038 - RNA, 19 nt, Homo sapiens
gaguagaagugguugacaa

SEQ ID NO: 1023039 - RNA, 19 nt, Homo sapiens
gcaauucuccagaggacua

SEQ ID NO: 1023040 - RNA, 19 nt, Homo sapiens
gcugacggauuccugauga

SEQ ID NO: 1023041 - RNA, 19 nt, Homo sapiens
guauaauggucuugguaaa

SEQ ID NO: 1023042 - RNA, 19 nt, Homo sapiens
caacagucaccaaauuaaa

SEQ ID NO: 1023043 - RNA, 19 nt, Homo sapiens
cauuaagacucaacaacaa

SEQ ID NO: 1023044 - RNA, 19 nt, Homo sapiens
guaggguggugucaguuaa

SEQ ID NO: 1023045 - RNA, 19 nt, Homo sapiens
auaaggauguuccaaauca

SEQ ID NO: 1023046 - RNA, 19 nt, Homo sapiens
cagggaaacuggcuccauu

SEQ ID NO: 1023047 - RNA, 19 nt, Homo sapiens
uuucaaaccuugcaugaga

SEQ ID NO: 1023048 - RNA, 19 nt, Homo sapiens
caauauaugugguucugau

SEQ ID NO: 1023049 - RNA, 19 nt, Homo sapiens
guaggaacaaguacccuua

SEQ ID NO: 1023050 - RNA, 19 nt, Homo sapiens
agaggacuaucucacauaa

SEQ ID NO: 1023051 - RNA, 19 nt, Homo sapiens
cagcuccgguuaccuguuu

SEQ ID NO: 1023052 - RNA, 19 nt, Homo sapiens
gguaaagaauagagucugu

SEQ ID NO: 1023053 - RNA, 19 nt, Homo sapiens
ugugagaacugaugauugu

SEQ ID NO: 1023054 - RNA, 19 nt, Homo sapiens
gcucacaggacaagaauau

SEQ ID NO: 1023055 - RNA, 19 nt, Homo sapiens
gcacagcccauuaauacau

SEQ ID NO: 1023056 - RNA, 19 nt, Homo sapiens
aaacacugccuccugauuu

SEQ ID NO: 1023057 - RNA, 19 nt, Homo sapiens
gaacugaugauugugcauu

SEQ ID NO: 1023058 - RNA, 19 nt, Homo sapiens
gaagcuauagacccauuaa

SEQ ID NO: 1023059 - RNA, 19 nt, Homo sapiens
agaaaugauuaccacagua

SEQ ID NO: 1023060 - RNA, 19 nt, Homo sapiens
gcuuaaaggugcaguaugc

SEQ ID NO: 1023061 - RNA, 19 nt, Homo sapiens
ugauauaucuugugagaac

SEQ ID NO: 1023062 - RNA, 19 nt, Homo sapiens
caugcaaccucuccuucua

SEQ ID NO: 1023063 - RNA, 19 nt, Homo sapiens
gguggaaaguguaauugga

SEQ ID NO: 1023064 - RNA, 19 nt, Homo sapiens
uauacaaacuggaaagcuu

SEQ ID NO: 1023065 - RNA, 19 nt, Homo sapiens
cacaacagucaccaaauua

SEQ ID NO: 1023066 - RNA, 19 nt, Homo sapiens
gaagaagaguaugaucagu

SEQ ID NO: 1023067 - RNA, 19 nt, Homo sapiens
ugauacaccaccacauuua

SEQ ID NO: 1023068 - RNA, 19 nt, Homo sapiens
gaaacccugucuccaccaa

SEQ ID NO: 1023069 - RNA, 19 nt, Homo sapiens
gcuauagacccauuaaauc

SEQ ID NO: 1023070 - RNA, 19 nt, Homo sapiens
cauauugguuggucucgaa

SEQ ID NO: 1023071 - RNA, 19 nt, Homo sapiens
acaaugcccuuuuaagaua

SEQ ID NO: 1023072 - RNA, 19 nt, Homo sapiens
aaguauacgugguaaagaa

SEQ ID NO: 1023073 - RNA, 19 nt, Homo sapiens
aaacacaacagucaccaaa

SEQ ID NO: 1023074 - RNA, 19 nt, Homo sapiens
gaaauuggaagcuauagac

SEQ ID NO: 1023075 - RNA, 19 nt, Homo sapiens
cuggauugcuggaauugua

SEQ ID NO: 1023076 - RNA, 19 nt, Homo sapiens
uaaagaauagagucuguga

SEQ ID NO: 1023077 - RNA, 19 nt, Homo sapiens
uaauuggagucacaguauu

SEQ ID NO: 1023078 - RNA, 19 nt, Homo sapiens
gguagguaauaaaugcuuu

SEQ ID NO: 1023079 - RNA, 19 nt, Homo sapiens
caucgucucuugaggauac

SEQ ID NO: 1023080 - RNA, 19 nt, Homo sapiens
gagccacguuuaauaugug

SEQ ID NO: 1023081 - RNA, 19 nt, Homo sapiens
cauggagccacguuuaaua

SEQ ID NO: 1023082 - RNA, 19 nt, Homo sapiens
ggaucugacugguucuguu

SEQ ID NO: 1023083 - RNA, 19 nt, Homo sapiens
ccaccacauuuauuugcua

SEQ ID NO: 1023084 - RNA, 19 nt, Homo sapiens
cauaggucaucgauucaaa

SEQ ID NO: 1023085 - RNA, 19 nt, Homo sapiens
ugaagaaagcgaagauaga

SEQ ID NO: 1023086 - RNA, 19 nt, Homo sapiens
caacuguaucgucuaaauu

SEQ ID NO: 1023087 - RNA, 19 nt, Homo sapiens
caaugugaauccaauaguc

SEQ ID NO: 1023088 - RNA, 19 nt, Homo sapiens
acaacaauaucacagaauc

SEQ ID NO: 1023089 - RNA, 19 nt, Homo sapiens
gggaagaagaguaugauca

SEQ ID NO: 1023090 - RNA, 19 nt, Homo sapiens
gagaguagaaguucccaau

SEQ ID NO: 1023091 - RNA, 19 nt, Homo sapiens
cauaugcacagcccauuaa

SEQ ID NO: 1023092 - RNA, 19 nt, Homo sapiens
gcgaagauagaacagauga

SEQ ID NO: 1023093 - RNA, 19 nt, Homo sapiens
uaagacuaguguaugaaga

SEQ ID NO: 1023094 - RNA, 19 nt, Homo sapiens
acaacuguaucgucuaaau

SEQ ID NO: 1023095 - RNA, 19 nt, Homo sapiens
gacaagaauauaccuaugu

SEQ ID NO: 1023096 - RNA, 19 nt, Homo sapiens
accaaagucuucuggauug

SEQ ID NO: 1023097 - RNA, 19 nt, Homo sapiens
gaaaguguaauuggaggaa

SEQ ID NO: 1023098 - RNA, 19 nt, Homo sapiens
caauacaaaggacauaaga

SEQ ID NO: 1023099 - RNA, 19 nt, Homo sapiens
ucaaggaaggaaugaaauu

SEQ ID NO: 1023100 - RNA, 19 nt, Homo sapiens
gaagauagaacagaugacu

SEQ ID NO: 1023101 - RNA, 19 nt, Homo sapiens
gaagauuaagacuagugua

SEQ ID NO: 1023102 - RNA, 19 nt, Homo sapiens
cagagcaucauguacuuaa

SEQ ID NO: 1023103 - RNA, 19 nt, Homo sapiens
ggaagaagaguaugaucag

SEQ ID NO: 1023104 - RNA, 19 nt, Homo sapiens
gaugggaagaagaguauga

SEQ ID NO: 1023105 - RNA, 19 nt, Homo sapiens
ggaaggaaugaaauuggaa

SEQ ID NO: 1023106 - RNA, 19 nt, Homo sapiens
caaggaaggaaugaaauug

SEQ ID NO: 1023107 - RNA, 19 nt, Homo sapiens
caccacauuuauuugcuaa

SEQ ID NO: 1023108 - RNA, 19 nt, Homo sapiens
guaauaacaugaagcagua

SEQ ID NO: 1023109 - RNA, 19 nt, Homo sapiens
gaagaucacuacagagaau

SEQ ID NO: 1023110 - RNA, 19 nt, Homo sapiens
uaaacaaccugaucuaugu

SEQ ID NO: 1023111 - RNA, 19 nt, Homo sapiens
ucaagccucuuucagauua

SEQ ID NO: 1023112 - RNA, 19 nt, Homo sapiens
ccaaggcaauauacuguua

SEQ ID NO: 1023113 - RNA, 19 nt, Homo sapiens
cgugaugucuggauuuaua

SEQ ID NO: 1023114 - RNA, 19 nt, Homo sapiens
uggcuaagcuuccagaauu

SEQ ID NO: 1023115 - RNA, 19 nt, Homo sapiens
gaauguacaguaucucuuu

SEQ ID NO: 1023116 - RNA, 19 nt, Homo sapiens
agaauucuccugaguguua

SEQ ID NO: 1023117 - RNA, 19 nt, Homo sapiens
gagccgagaucgagccauu

SEQ ID NO: 1023118 - RNA, 19 nt, Homo sapiens
uaacagcuguaucccuaaa

SEQ ID NO: 1023119 - RNA, 19 nt, Homo sapiens
gaaaugauguccccaagga

SEQ ID NO: 1023120 - RNA, 19 nt, Homo sapiens
ucaaaucgauggacugaag

SEQ ID NO: 1023121 - RNA, 19 nt, Homo sapiens
gugaugaacuuguuauugg

SEQ ID NO: 1023122 - RNA, 19 nt, Homo sapiens
caucaagccucuuucagau

SEQ ID NO: 1023123 - RNA, 19 nt, Homo sapiens
ggugauaguugucguugga

SEQ ID NO: 1023124 - RNA, 19 nt, Homo sapiens
gcaagacgguaccacauac

SEQ ID NO: 1023125 - RNA, 19 nt, Homo sapiens
caacuugauccuuguaauu

SEQ ID NO: 1023126 - RNA, 19 nt, Homo sapiens
guuaucaguuguugcauga

SEQ ID NO: 1023127 - RNA, 19 nt, Homo sapiens
caaaauggcuguccuccuu

SEQ ID NO: 1023128 - RNA, 19 nt, Homo sapiens
gccgugaugucuggauuua

SEQ ID NO: 1023129 - RNA, 19 nt, Homo sapiens
ugagcgaguuggaggauuu

SEQ ID NO: 1023130 - RNA, 19 nt, Homo sapiens
ccacauacuugggaaugaa

SEQ ID NO: 1023131 - RNA, 19 nt, Homo sapiens
ucaaaacacucuucacaaa

SEQ ID NO: 1023132 - RNA, 19 nt, Homo sapiens
cugaagcuauggaauguuu

SEQ ID NO: 1023133 - RNA, 19 nt, Homo sapiens
gcaacuugauccuuguaau

SEQ ID NO: 1023134 - RNA, 19 nt, Homo sapiens
gagcgaaacuccgucucaa

SEQ ID NO: 1023135 - RNA, 19 nt, Homo sapiens
ccagaauucuccugagugu

SEQ ID NO: 1023136 - RNA, 19 nt, Homo sapiens
uggaggaccugaugauaau

SEQ ID NO: 1023137 - RNA, 19 nt, Homo sapiens
ggacugaccaaggcaauau

SEQ ID NO: 1023138 - RNA, 19 nt, Homo sapiens
gugcuacgauccuguaaca

SEQ ID NO: 1023139 - RNA, 19 nt, Homo sapiens
gaucugagaagaccacugu

SEQ ID NO: 1023140 - RNA, 19 nt, Homo sapiens
guggaggaccugaugauaa

SEQ ID NO: 1023141 - RNA, 19 nt, Homo sapiens
gcuaagcuuccagaauuua

SEQ ID NO: 1023142 - RNA, 19 nt, Homo sapiens
caguugaaguggaccaauu

SEQ ID NO: 1023143 - RNA, 19 nt, Homo sapiens
gcaggagaauugcuugaac

SEQ ID NO: 1023144 - RNA, 19 nt, Homo sapiens
gaccugaugauaauacuug

SEQ ID NO: 1023145 - RNA, 19 nt, Homo sapiens
ggcuaagcuuccagaauuu

SEQ ID NO: 1023146 - RNA, 19 nt, Homo sapiens
cagagaauguacaguaucu

SEQ ID NO: 1023147 - RNA, 19 nt, Homo sapiens
gaccaaguacauaaucauu

SEQ ID NO: 1023148 - RNA, 19 nt, Homo sapiens
acgauccaguugaagauua

SEQ ID NO: 1023149 - RNA, 19 nt, Homo sapiens
gaugaacuuguuauuggua

SEQ ID NO: 1023150 - RNA, 19 nt, Homo sapiens
cuaaacaaccugaucuaug

SEQ ID NO: 1023151 - RNA, 19 nt, Homo sapiens
gcugauacccauucacuca

SEQ ID NO: 1023152 - RNA, 19 nt, Homo sapiens
ggagcaacuugauccuugu

SEQ ID NO: 1023153 - RNA, 19 nt, Homo sapiens
gguggcgcauugccuguaa

SEQ ID NO: 1023154 - RNA, 19 nt, Homo sapiens
gaaaccccgucucuacuaa

SEQ ID NO: 1023155 - RNA, 19 nt, Homo sapiens
ggaagucuuuggcuaagcu

SEQ ID NO: 1023156 - RNA, 19 nt, Homo sapiens
gacuagcuguguaggcaaa

SEQ ID NO: 1023157 - RNA, 19 nt, Homo sapiens
ugauacccauucacucaaa

SEQ ID NO: 1023158 - RNA, 19 nt, Homo sapiens
gggaccaaguacauaauca

SEQ ID NO: 1023159 - RNA, 19 nt, Homo sapiens
gaccaaggcaauauacugu

SEQ ID NO: 1023160 - RNA, 19 nt, Homo sapiens
aaaggcagauggcgucaca

SEQ ID NO: 1023161 - RNA, 19 nt, Homo sapiens
guaaagaggagaugguuuu

SEQ ID NO: 1023162 - RNA, 19 nt, Homo sapiens
cgagguggauagaucacuu

SEQ ID NO: 1023163 - RNA, 19 nt, Homo sapiens
uaacaugaagcaguacaaa

SEQ ID NO: 1023164 - RNA, 19 nt, Homo sapiens
uuagcagcguagaauguua

SEQ ID NO: 1023165 - RNA, 19 nt, Homo sapiens
caucccaacuacuuuguuc

SEQ ID NO: 1023166 - RNA, 19 nt, Homo sapiens
ucugagaagaccacuguua

SEQ ID NO: 1023167 - RNA, 19 nt, Homo sapiens
uaagagggaccaaguacau

SEQ ID NO: 1023168 - RNA, 19 nt, Homo sapiens
ggaugcacguacagaauac

SEQ ID NO: 1023169 - RNA, 19 nt, Homo sapiens
gagaccagccugaccaaca

SEQ ID NO: 1023170 - RNA, 19 nt, Homo sapiens
ggcaauauacuguuacgau

SEQ ID NO: 1023171 - RNA, 19 nt, Homo sapiens
gaguugccucucucaauaa

SEQ ID NO: 1023172 - RNA, 19 nt, Homo sapiens
gaauucuccugaguguuau

SEQ ID NO: 1023173 - RNA, 19 nt, Homo sapiens
uacacgagcuccugacaca

SEQ ID NO: 1023174 - RNA, 19 nt, Homo sapiens
ugagacaucaagccucuuu

SEQ ID NO: 1023175 - RNA, 19 nt, Homo sapiens
ucaaucuuaugauccagaa

SEQ ID NO: 1023176 - RNA, 19 nt, Homo sapiens
gcagauggcgucacaaaau

SEQ ID NO: 1023177 - RNA, 19 nt, Homo sapiens
caggagaauggaagucuuu

SEQ ID NO: 1023178 - RNA, 19 nt, Homo sapiens
uggcuauucugaggugaua

SEQ ID NO: 1023179 - RNA, 19 nt, Homo sapiens
gagcaacuugauccuugua

SEQ ID NO: 1023180 - RNA, 19 nt, Homo sapiens
agagggaccaaguacauaa

SEQ ID NO: 1023181 - RNA, 19 nt, Homo sapiens
uggaugcacguacagaaua

SEQ ID NO: 1023182 - RNA, 19 nt, Homo sapiens
gguggaggaccugaugaua

SEQ ID NO: 1023183 - RNA, 19 nt, Homo sapiens
uggcuguccuccuugguaa

SEQ ID NO: 1023184 - RNA, 19 nt, Homo sapiens
uaugcagucugugcucuaa

SEQ ID NO: 1023185 - RNA, 19 nt, Homo sapiens
ugaaguggaccaauugauc

SEQ ID NO: 1023186 - RNA, 19 nt, Homo sapiens
gacaaagaugaacuuauug

SEQ ID NO: 1023187 - RNA, 19 nt, Homo sapiens
gaaaccccgucucugcuaa

SEQ ID NO: 1023188 - RNA, 19 nt, Homo sapiens
gccgucagguaauaacaug

SEQ ID NO: 1023189 - RNA, 19 nt, Homo sapiens
auucagccgucagguaaua

SEQ ID NO: 1023190 - RNA, 19 nt, Homo sapiens
acauucagccgucagguaa

SEQ ID NO: 1023191 - RNA, 19 nt, Homo sapiens
gagcgaguuggaggauuua

SEQ ID NO: 1023192 - RNA, 19 nt, Homo sapiens
gguaaagaggagaugguuu

SEQ ID NO: 1023193 - RNA, 19 nt, Homo sapiens
gaacuuguuauugguaaag

SEQ ID NO: 1023194 - RNA, 19 nt, Homo sapiens
cagcguagaauguuaugau

SEQ ID NO: 1023195 - RNA, 19 nt, Homo sapiens
uguccuccuugguaaagua

SEQ ID NO: 1023196 - RNA, 19 nt, Homo sapiens
caugugagacucccucugu

SEQ ID NO: 1023197 - RNA, 19 nt, Homo sapiens
cgucaugcguugggucuau

SEQ ID NO: 1023198 - RNA, 19 nt, Homo sapiens
ccuguaaucccagcacuuu

SEQ ID NO: 1023199 - RNA, 19 nt, Homo sapiens
ggaccaaguacauaaucau

SEQ ID NO: 1023200 - RNA, 19 nt, Homo sapiens
ugaugcaugugccaaguuc

SEQ ID NO: 1023201 - RNA, 19 nt, Homo sapiens
uaucaguuguugcaugaag

SEQ ID NO: 1023202 - RNA, 19 nt, Homo sapiens
gcgaaacuccgucucaaaa

SEQ ID NO: 1023203 - RNA, 19 nt, Homo sapiens
agaccagccugaccaacau

SEQ ID NO: 1023204 - RNA, 19 nt, Homo sapiens
gguucaaucuuaugaucca

SEQ ID NO: 1023205 - RNA, 19 nt, Homo sapiens
acaucaagccucuuucaga

SEQ ID NO: 1023206 - RNA, 19 nt, Homo sapiens
gcagugacuagcuguguag

SEQ ID NO: 1023207 - RNA, 19 nt, Homo sapiens
caaaacacucuucacaaaa

SEQ ID NO: 1023208 - RNA, 19 nt, Homo sapiens
ggaaguagauggcuuaaua

SEQ ID NO: 1023209 - RNA, 19 nt, Homo sapiens
guagauggcuuaauaguua

SEQ ID NO: 1023210 - RNA, 19 nt, Homo sapiens
gaacaaagauugagaacca

SEQ ID NO: 1023211 - RNA, 19 nt, Homo sapiens
uaacaaaccuuccacaaau

SEQ ID NO: 1023212 - RNA, 19 nt, Homo sapiens
gcacuuaaauugaagcuau

SEQ ID NO: 1023213 - RNA, 19 nt, Homo sapiens
ggaagaaguuggucaucua

SEQ ID NO: 1023214 - RNA, 19 nt, Homo sapiens
caacaaacgucaagcaaug

SEQ ID NO: 1023215 - RNA, 19 nt, Homo sapiens
gcagguacguuguugcaua

SEQ ID NO: 1023216 - RNA, 19 nt, Homo sapiens
uaaaugugcuuccuuggua

SEQ ID NO: 1023217 - RNA, 19 nt, Homo sapiens
cagaauagccucacaguaa

SEQ ID NO: 1023218 - RNA, 19 nt, Homo sapiens
cauguggucuuucuaguua

SEQ ID NO: 1023219 - RNA, 19 nt, Homo sapiens
gagaaacccuuaauuacug

SEQ ID NO: 1023220 - RNA, 19 nt, Homo sapiens
gaagaugaguagacacuug

SEQ ID NO: 1023221 - RNA, 19 nt, Homo sapiens
ggaacacugucaaacuaua

SEQ ID NO: 1023222 - RNA, 19 nt, Homo sapiens
ggaaauagagauucacauu

SEQ ID NO: 1023223 - RNA, 19 nt, Homo sapiens
uaaacaggcuuaaugauuc

SEQ ID NO: 1023224 - RNA, 19 nt, Homo sapiens
ugaaaucuccuaugguuua

SEQ ID NO: 1023225 - RNA, 19 nt, Homo sapiens
cgugaugccuuucauauaa

SEQ ID NO: 1023226 - RNA, 19 nt, Homo sapiens
gaagugauguuugauggaa

SEQ ID NO: 1023227 - RNA, 19 nt, Homo sapiens
ggagaacuaccuaauuuaa

SEQ ID NO: 1023228 - RNA, 19 nt, Homo sapiens
gagaaaagcuauugaaaug

SEQ ID NO: 1023229 - RNA, 19 nt, Homo sapiens
guacguuguugcauauaua

SEQ ID NO: 1023230 - RNA, 19 nt, Homo sapiens
gaugaucucacaacuauaa

SEQ ID NO: 1023231 - RNA, 19 nt, Homo sapiens
gaacugcugcuaggaaaua

SEQ ID NO: 1023232 - RNA, 19 nt, Homo sapiens
guaacuaccuucuuugcaa

SEQ ID NO: 1023233 - RNA, 19 nt, Homo sapiens
cagaagaaguguaugcaaa

SEQ ID NO: 1023234 - RNA, 19 nt, Homo sapiens
ccacaggacuugcacaaau

SEQ ID NO: 1023235 - RNA, 19 nt, Homo sapiens
ggaaauuuauggaaguaga

SEQ ID NO: 1023236 - RNA, 19 nt, Homo sapiens
gaacaaggaacaaccauca

SEQ ID NO: 1023237 - RNA, 19 nt, Homo sapiens
ggaauaaagugcaugugau

SEQ ID NO: 1023238 - RNA, 19 nt, Homo sapiens
caacagcccugccucuuuc

SEQ ID NO: 1023239 - RNA, 19 nt, Homo sapiens
gaugaaauaugaacguugu

SEQ ID NO: 1023240 - RNA, 19 nt, Homo sapiens
guacgaaacuugagaucug

SEQ ID NO: 1023241 - RNA, 19 nt, Homo sapiens
ggaccagucucucaccaaa

SEQ ID NO: 1023242 - RNA, 19 nt, Homo sapiens
ugaaggugaugaaauauga

SEQ ID NO: 1023243 - RNA, 19 nt, Homo sapiens
gagaacugcugcuaggaaa

SEQ ID NO: 1023244 - RNA, 19 nt, Homo sapiens
gaagaaguguaugcaaaga

SEQ ID NO: 1023245 - RNA, 19 nt, Homo sapiens
gaaauuaggagcucaugga

SEQ ID NO: 1023246 - RNA, 19 nt, Homo sapiens
cuugagaucugaauguaua

SEQ ID NO: 1023247 - RNA, 19 nt, Homo sapiens
aaucuuaccucucgaauuc

SEQ ID NO: 1023248 - RNA, 19 nt, Homo sapiens
uaaaugaagucuugaaggu

SEQ ID NO: 1023249 - RNA, 19 nt, Homo sapiens
gaacacugucaaacuauaa

SEQ ID NO: 1023250 - RNA, 19 nt, Homo sapiens
guaacaaaccuuccacaaa

SEQ ID NO: 1023251 - RNA, 19 nt, Homo sapiens
gaagaggaguuuaugaaaa

SEQ ID NO: 1023252 - RNA, 19 nt, Homo sapiens
gcagucaguuucaucauca

SEQ ID NO: 1023253 - RNA, 19 nt, Homo sapiens
uagcugaaguuaacauuug

SEQ ID NO: 1023254 - RNA, 19 nt, Homo sapiens
gaaaauauuggaccacuua

SEQ ID NO: 1023255 - RNA, 19 nt, Homo sapiens
aaacagaacuaaagaacca

SEQ ID NO: 1023256 - RNA, 19 nt, Homo sapiens
ucuugaaggugaugaaaua

SEQ ID NO: 1023257 - RNA, 19 nt, Homo sapiens
ccaauaugcuuuagaugga

SEQ ID NO: 1023258 - RNA, 19 nt, Homo sapiens
gcauccaagugaacacaua

SEQ ID NO: 1023259 - RNA, 19 nt, Homo sapiens
gaagcuaugccacaggaua

SEQ ID NO: 1023260 - RNA, 19 nt, Homo sapiens
gaagaaguuggucaucuaa

SEQ ID NO: 1023261 - RNA, 19 nt, Homo sapiens
aagaauagcugaaguuaac

SEQ ID NO: 1023262 - RNA, 19 nt, Homo sapiens
ugacaaaguaguaguguaa

SEQ ID NO: 1023263 - RNA, 19 nt, Homo sapiens
ugucagauguugcaaagaa

SEQ ID NO: 1023264 - RNA, 19 nt, Homo sapiens
ccuccuauaucauggaaua

SEQ ID NO: 1023265 - RNA, 19 nt, Homo sapiens
cuuuagaggucuugauaua

SEQ ID NO: 1023266 - RNA, 19 nt, Homo sapiens
ucugagaaacccuuaauua

SEQ ID NO: 1023267 - RNA, 19 nt, Homo sapiens
ggguagagauugguaacua

SEQ ID NO: 1023268 - RNA, 19 nt, Homo sapiens
gaugaagacguacccauuu

SEQ ID NO: 1023269 - RNA, 19 nt, Homo sapiens
gaauuuagcauggcugauu

SEQ ID NO: 1023270 - RNA, 19 nt, Homo sapiens
ucaaauggaugcugaacau

SEQ ID NO: 1023271 - RNA, 19 nt, Homo sapiens
caagauuuguugcaaugaa

SEQ ID NO: 1023272 - RNA, 19 nt, Homo sapiens
aaggaacacugucaaacua

SEQ ID NO: 1023273 - RNA, 19 nt, Homo sapiens
caagcaagauuuggaaugu

SEQ ID NO: 1023274 - RNA, 19 nt, Homo sapiens
gaaaagcuauugaaaugga

SEQ ID NO: 1023275 - RNA, 19 nt, Homo sapiens
ccaccaaugucuccgcuuu

SEQ ID NO: 1023276 - RNA, 19 nt, Homo sapiens
ucaggaaaaugcacaauua

SEQ ID NO: 1023277 - RNA, 19 nt, Homo sapiens
ugacauacaucagcuugaa

SEQ ID NO: 1023278 - RNA, 19 nt, Homo sapiens
ugaaguauuuggacaacaa

SEQ ID NO: 1023279 - RNA, 19 nt, Homo sapiens
gagauugaaaugugaagua

SEQ ID NO: 1023280 - RNA, 19 nt, Homo sapiens
uuggagaacuaccuaauuu

SEQ ID NO: 1023281 - RNA, 19 nt, Homo sapiens
gaaccacaauagcauguag

SEQ ID NO: 1023282 - RNA, 19 nt, Homo sapiens
gauaucaaguggaauuagu

SEQ ID NO: 1023283 - RNA, 19 nt, Homo sapiens
gcaauaggauagaugugau

SEQ ID NO: 1023284 - RNA, 19 nt, Homo sapiens
ccacagcucucugaaggaa

SEQ ID NO: 1023285 - RNA, 19 nt, Homo sapiens
agagagaaguuguuaguuc

SEQ ID NO: 1023286 - RNA, 19 nt, Homo sapiens
caaguggaauaaagaauag

SEQ ID NO: 1023287 - RNA, 19 nt, Homo sapiens
ucugaaaucuccuaugguu

SEQ ID NO: 1023288 - RNA, 19 nt, Homo sapiens
acauguaacuaccuucuuu

SEQ ID NO: 1023289 - RNA, 19 nt, Homo sapiens
ggugauaguaccuacaaua

SEQ ID NO: 1023290 - RNA, 19 nt, Homo sapiens
uaaagugcaugugaugauu

SEQ ID NO: 1023291 - RNA, 19 nt, Homo sapiens
gaauaaagugcaugugaug

SEQ ID NO: 1023292 - RNA, 19 nt, Homo sapiens
ccugagaagugauguuuga

SEQ ID NO: 1023293 - RNA, 19 nt, Homo sapiens
cuaaacaggcuuaaugauu

SEQ ID NO: 1023294 - RNA, 19 nt, Homo sapiens
gauacgaggcucugaagaa

SEQ ID NO: 1023295 - RNA, 19 nt, Homo sapiens
ucauuugacugaagagaaa

SEQ ID NO: 1023296 - RNA, 19 nt, Homo sapiens
gaacuaaagaaccaauuca

SEQ ID NO: 1023297 - RNA, 19 nt, Homo sapiens
gcuaggaaauagagauuca

SEQ ID NO: 1023298 - RNA, 19 nt, Homo sapiens
caagugaacacauacuauu

SEQ ID NO: 1023299 - RNA, 19 nt, Homo sapiens
gaaugauccugagaaguga

SEQ ID NO: 1023300 - RNA, 19 nt, Homo sapiens
guagguauaugagauugaa

SEQ ID NO: 1023301 - RNA, 19 nt, Homo sapiens
aaacagaugauacgcuuaa

SEQ ID NO: 1023302 - RNA, 19 nt, Homo sapiens
gcacaaucaaagagaauuu

SEQ ID NO: 1023303 - RNA, 19 nt, Homo sapiens
gcugaaccgugaugccuuu

SEQ ID NO: 1023304 - RNA, 19 nt, Homo sapiens
gcaaggagaauggcauaaa

SEQ ID NO: 1023305 - RNA, 19 nt, Homo sapiens
gggacucucuguaaauguu

SEQ ID NO: 1023306 - RNA, 19 nt, Homo sapiens
ggccaugugucaucuuuau

SEQ ID NO: 1023307 - RNA, 19 nt, Homo sapiens
ucucagaucugucacuuuc

SEQ ID NO: 1023308 - RNA, 19 nt, Homo sapiens
gccaggagcuugcaaguuu

SEQ ID NO: 1023309 - RNA, 19 nt, Homo sapiens
caauaaagaugccauacaa

SEQ ID NO: 1023310 - RNA, 19 nt, Homo sapiens
ggaaaguucuugucaauac

SEQ ID NO: 1023311 - RNA, 19 nt, Homo sapiens
caacugcucugauugaaga

SEQ ID NO: 1023312 - RNA, 19 nt, Homo sapiens
gaagaagauuggacucaga

SEQ ID NO: 1023313 - RNA, 19 nt, Homo sapiens
gaugagcgcuuggauaaga

SEQ ID NO: 1023314 - RNA, 19 nt, Homo sapiens
gaaacaggaaucucucaua

SEQ ID NO: 1023315 - RNA, 19 nt, Homo sapiens
caaagaaccuaaagagaag

SEQ ID NO: 1023316 - RNA, 19 nt, Homo sapiens
uaagagauaugcccggaaa

SEQ ID NO: 1023317 - RNA, 19 nt, Homo sapiens
gugguggacuucagaaaua

SEQ ID NO: 1023318 - RNA, 19 nt, Homo sapiens
ucaaggaauuucacgagua

SEQ ID NO: 1023319 - RNA, 19 nt, Homo sapiens
caacggacccuaccucuug

SEQ ID NO: 1023320 - RNA, 19 nt, Homo sapiens
ucaauuggcuucaaggaau

SEQ ID NO: 1023321 - RNA, 19 nt, Homo sapiens
aaaggaggauggucuugua

SEQ ID NO: 1023322 - RNA, 19 nt, Homo sapiens
acaaagaaccuaaagagaa

SEQ ID NO: 1023323 - RNA, 19 nt, Homo sapiens
aaacaggaaucucucauag

SEQ ID NO: 1023324 - RNA, 19 nt, Homo sapiens
ggacucagaugcugucaac

SEQ ID NO: 1023325 - RNA, 19 nt, Homo sapiens
uaaagaugccauacaauga

SEQ ID NO: 1023326 - RNA, 19 nt, Homo sapiens
uagaugagcgcuuggauaa

SEQ ID NO: 1023327 - RNA, 19 nt, Homo sapiens
acaggaaucucucauagug

SEQ ID NO: 1023328 - RNA, 19 nt, Homo sapiens
ggaggauggucuuguacuu

SEQ ID NO: 1023329 - RNA, 19 nt, Homo sapiens
caugguaucuuccaaucaa

SEQ ID NO: 1023330 - RNA, 19 nt, Homo sapiens
gcuauaaucagaagaaugu

SEQ ID NO: 1023331 - RNA, 19 nt, Homo sapiens
gagaaguuaucaccugugu

SEQ ID NO: 1023332 - RNA, 19 nt, Homo sapiens
uaacaaagaaccuaaagag

SEQ ID NO: 1023333 - RNA, 19 nt, Homo sapiens
caaugaagcugagaacaag

SEQ ID NO: 1023334 - RNA, 19 nt, Homo sapiens
agaaagugauugaccgaaa

SEQ ID NO: 1023335 - RNA, 19 nt, Homo sapiens
ggagaugggcacugagaaa

SEQ ID NO: 1023336 - RNA, 19 nt, Homo sapiens
acgaguaccugaucacuga

SEQ ID NO: 1023337 - RNA, 19 nt, Homo sapiens
gaaagugauugaccgaaaa

SEQ ID NO: 1023338 - RNA, 19 nt, Homo sapiens
uaucugaugucucgaagug

SEQ ID NO: 1023339 - RNA, 19 nt, Homo sapiens
gcuuagagguaucugaugu

SEQ ID NO: 1023340 - RNA, 19 nt, Homo sapiens
gcacacuggagacuaguaa

SEQ ID NO: 1023341 - RNA, 19 nt, Homo sapiens
gaggguggaugacaugcuu

SEQ ID NO: 1023342 - RNA, 19 nt, Homo sapiens
gaaacaaguaacuaagaga

SEQ ID NO: 1023343 - RNA, 19 nt, Homo sapiens
caaggaauuucacgaguac

SEQ ID NO: 1023344 - RNA, 19 nt, Homo sapiens
cacagacgcuauaaucaga

SEQ ID NO: 1023345 - RNA, 19 nt, Homo sapiens
ugggaggaaccaauuauua

SEQ ID NO: 1023346 - RNA, 19 nt, Homo sapiens
uggaggaacuaagagauuu

SEQ ID NO: 1023347 - RNA, 19 nt, Homo sapiens
ugaaacaaguaacuaagag

SEQ ID NO: 1023348 - RNA, 19 nt, Homo sapiens
gaaugggcagcgcacauaa

SEQ ID NO: 1023349 - RNA, 19 nt, Homo sapiens
cgaaugggcagcgcacaua

SEQ ID NO: 1023350 - RNA, 19 nt, Homo sapiens
gcugagaacaagagaaguu

SEQ ID NO: 1023351 - RNA, 19 nt, Homo sapiens
aggaaucucucauagugaa

SEQ ID NO: 1023352 - RNA, 19 nt, Homo sapiens
guacuucacaaacgccuaa

SEQ ID NO: 1023353 - RNA, 19 nt, Homo sapiens
aaagaugccauacaaugaa

SEQ ID NO: 1023354 - RNA, 19 nt, Homo sapiens
cuacagccacuccaauaaa

SEQ ID NO: 1023355 - RNA, 19 nt, Homo sapiens
guauugaggcucugaaaca

SEQ ID NO: 1023356 - RNA, 19 nt, Homo sapiens
uugaaucucugcucuggaa

SEQ ID NO: 1023357 - RNA, 19 nt, Homo sapiens
ggaggaaccaauuauuaca

SEQ ID NO: 1023358 - RNA, 19 nt, Homo sapiens
caagguuucugcccaagag

SEQ ID NO: 1023359 - RNA, 19 nt, Homo sapiens
ucucugcucuggaaaguuc

SEQ ID NO: 1023360 - RNA, 19 nt, Homo sapiens
cauagaaagucagaguguu

SEQ ID NO: 1023361 - RNA, 19 nt, Homo sapiens
acaaugaagcugagaacaa

SEQ ID NO: 1023362 - RNA, 19 nt, Homo sapiens
auaaagaugccauacaaug

SEQ ID NO: 1023363 - RNA, 19 nt, Homo sapiens
caacaugguaucuuccaau

SEQ ID NO: 1023364 - RNA, 19 nt, Homo sapiens
caucaucaccaacaagguu

SEQ ID NO: 1023365 - RNA, 19 nt, Homo sapiens
gagaacaagagaaguuauc

SEQ ID NO: 1023366 - RNA, 19 nt, Homo sapiens
ugaaccugcucuugaaauc

SEQ ID NO: 1023367 - RNA, 19 nt, Homo sapiens
gauaagaggguggaugaca

SEQ ID NO: 1023368 - RNA, 19 nt, Homo sapiens
gaaaaguggagcuugaaaa

SEQ ID NO: 1023369 - RNA, 19 nt, Homo sapiens
cuggaaaguucuugucaau

SEQ ID NO: 1023370 - RNA, 19 nt, Homo sapiens
gaucaagagcugaaaugca

SEQ ID NO: 1023371 - RNA, 19 nt, Homo sapiens
gaccauaacaaagaaccua

SEQ ID NO: 1023372 - RNA, 19 nt, Homo sapiens
gcugucaacaccauagaaa

SEQ ID NO: 1023373 - RNA, 19 nt, Homo sapiens
gccuacagccacuccaaua

SEQ ID NO: 1023374 - RNA, 19 nt, Homo sapiens
uugaaaucgugcaaaguuu

SEQ ID NO: 1023375 - RNA, 19 nt, Homo sapiens
ccagguggacccagaaaug

SEQ ID NO: 1023376 - RNA, 19 nt, Homo sapiens
gaagaaaagaagaagauug

SEQ ID NO: 1023377 - RNA, 19 nt, Homo sapiens
ucuugaaccugcucuugaa

SEQ ID NO: 1023378 - RNA, 19 nt, Homo sapiens
acuaguaaccagcuucuaa

SEQ ID NO: 1023379 - RNA, 19 nt, Homo sapiens
cuagaugagcgcuuggaua

SEQ ID NO: 1023380 - RNA, 19 nt, Homo sapiens
gccuagacaucaucaccaa

SEQ ID NO: 1023381 - RNA, 19 nt, Homo sapiens
gggaggaaccaauuauuac

SEQ ID NO: 1023382 - RNA, 19 nt, Homo sapiens
gagauaugcccggaaacaa

SEQ ID NO: 1023383 - RNA, 19 nt, Homo sapiens
gcucugaaacaaguaacua

SEQ ID NO: 1023384 - RNA, 19 nt, Homo sapiens
cuaguaaccagcuucuaaa

SEQ ID NO: 1023385 - RNA, 19 nt, Homo sapiens
ugaagaaacaggaaucucu

SEQ ID NO: 1023386 - RNA, 19 nt, Homo sapiens
auagaaagucagaguguuu

SEQ ID NO: 1023387 - RNA, 19 nt, Homo sapiens
ccaauaaagaugccauaca

SEQ ID NO: 1023388 - RNA, 19 nt, Homo sapiens
agauaugcccggaaacaaa

SEQ ID NO: 1023389 - RNA, 19 nt, Homo sapiens
gaaucucucauagugaauu

SEQ ID NO: 1023390 - RNA, 19 nt, Homo sapiens
ucaacaccauagaaaguca

SEQ ID NO: 1023391 - RNA, 19 nt, Homo sapiens
gcaacggacccuaccucuu

SEQ ID NO: 1023392 - RNA, 19 nt, Homo sapiens
cuugaaaucgugcaaaguu

SEQ ID NO: 1023393 - RNA, 19 nt, Homo sapiens
uauugaggcucugaaacaa

SEQ ID NO: 1023394 - RNA, 19 nt, Homo sapiens
cuaucaacaugguaucuuc

SEQ ID NO: 1023395 - RNA, 19 nt, Homo sapiens
caaaauuccuauuguugug

SEQ ID NO: 1023396 - RNA, 19 nt, Homo sapiens
ccaaaucccacuugaacca

SEQ ID NO: 1023397 - RNA, 19 nt, Homo sapiens
ugaccucugugaucgaauc

SEQ ID NO: 1023398 - RNA, 19 nt, Homo sapiens
ggagacuaguaaccagcuu

SEQ ID NO: 1023399 - RNA, 19 nt, Homo sapiens
acuaagagauuuucacaga

SEQ ID NO: 1023400 - RNA, 19 nt, Homo sapiens
gaacuaagagauuuucaca

SEQ ID NO: 1023401 - RNA, 19 nt, Homo sapiens
ccuacagccacuccaauaa

SEQ ID NO: 1023402 - RNA, 19 nt, Homo sapiens
gaagugggaagagucuguu

SEQ ID NO: 1023403 - RNA, 19 nt, Homo sapiens
ccaggacuaucaacauggu

SEQ ID NO: 1023404 - RNA, 19 nt, Homo sapiens
uggauaagaggguggauga

SEQ ID NO: 1023405 - RNA, 19 nt, Homo sapiens
ccaagcugcauccacauga

SEQ ID NO: 1023406 - RNA, 19 nt, Homo sapiens
aggauggucuuguacuuca

SEQ ID NO: 1023407 - RNA, 19 nt, Homo sapiens
gaaaguucuugucaauacc

SEQ ID NO: 1023408 - RNA, 19 nt, Homo sapiens
gaaagaagguaugaaguuu

SEQ ID NO: 1023409 - RNA, 19 nt, Homo sapiens
caacagaaguagaagcauu

SEQ ID NO: 1023410 - RNA, 19 nt, Homo sapiens
gaacugaaauaugaugaga

SEQ ID NO: 1023411 - RNA, 19 nt, Homo sapiens
ggaaagaagguaugaaguu

SEQ ID NO: 1023412 - RNA, 19 nt, Homo sapiens
gcaauaaccagcucaauuc

SEQ ID NO: 1023413 - RNA, 19 nt, Homo sapiens
gaagaaaucaucaaaucug

SEQ ID NO: 1023414 - RNA, 19 nt, Homo sapiens
uagaagaugugauugaaga

SEQ ID NO: 1023415 - RNA, 19 nt, Homo sapiens
gcaacaagccaguagacua

SEQ ID NO: 1023416 - RNA, 19 nt, Homo sapiens
gcacggagaaggagaagaa

SEQ ID NO: 1023417 - RNA, 19 nt, Homo sapiens
uccaggaacugaaauauga

SEQ ID NO: 1023418 - RNA, 19 nt, Homo sapiens
gaaaucaucaaaucugaga

SEQ ID NO: 1023419 - RNA, 19 nt, Homo sapiens
cggagaaggagaagaauua

SEQ ID NO: 1023420 - RNA, 19 nt, Homo sapiens
gaucugcaguuuguuaaga

SEQ ID NO: 1023421 - RNA, 19 nt, Homo sapiens
cuacacagaugccaaaugg

SEQ ID NO: 1023422 - RNA, 19 nt, Homo sapiens
gaacuugauuccgcccaaa

SEQ ID NO: 1023423 - RNA, 19 nt, Homo sapiens
gggcauggcguucaagauu

SEQ ID NO: 1023424 - RNA, 19 nt, Homo sapiens
aagaagguaugaaguuuga

SEQ ID NO: 1023425 - RNA, 19 nt, Homo sapiens
ggcauggcguucaagauuu

SEQ ID NO: 1023426 - RNA, 19 nt, Homo sapiens
caacgaaggcgccaucuag

SEQ ID NO: 1023427 - RNA, 19 nt, Homo sapiens
gaaauaugaugagaagaac

SEQ ID NO: 1023428 - RNA, 19 nt, Homo sapiens
ccaagucugucaucacugu

SEQ ID NO: 1023429 - RNA, 19 nt, Homo sapiens
gaagaugugauugaagaaa

SEQ ID NO: 1023430 - RNA, 19 nt, Homo sapiens
caggaagauuuaacauuug

SEQ ID NO: 1023431 - RNA, 19 nt, Homo sapiens
gcuggaagaauuuaagaaa

SEQ ID NO: 1023432 - RNA, 19 nt, Homo sapiens
guacagccagggucaguuu

SEQ ID NO: 1023433 - RNA, 19 nt, Homo sapiens
gguaaacaaugagggagaa

SEQ ID NO: 1023434 - RNA, 19 nt, Homo sapiens
guaaaucucaccuggcuau

SEQ ID NO: 1023435 - RNA, 19 nt, Homo sapiens
gaagaagaccguguuacug

SEQ ID NO: 1023436 - RNA, 19 nt, Homo sapiens
ccacuagaacauacuuuaa

SEQ ID NO: 1023437 - RNA, 19 nt, Homo sapiens
gaaugaagaagaccguguu

SEQ ID NO: 1023438 - RNA, 19 nt, Homo sapiens
auaaccagcucaauucuuc

SEQ ID NO: 1023439 - RNA, 19 nt, Homo sapiens
gaucguaggcgaagagaag

SEQ ID NO: 1023440 - RNA, 19 nt, Homo sapiens
ugaaaaccaucaccaaauu

SEQ ID NO: 1023441 - RNA, 19 nt, Homo sapiens
gcgaagccauccuggacuu

SEQ ID NO: 1023442 - RNA, 19 nt, Homo sapiens
gcaacauccugagaccaaa

SEQ ID NO: 1023443 - RNA, 19 nt, Homo sapiens
ggaagaauuuaagaaaggu

SEQ ID NO: 1023444 - RNA, 19 nt, Homo sapiens
ccaaacagggauucagaaa

SEQ ID NO: 1023445 - RNA, 19 nt, Homo sapiens
ugucugaacucugcuguga

SEQ ID NO: 1023446 - RNA, 19 nt, Homo sapiens
gagaaggggauccauuuua

SEQ ID NO: 1023447 - RNA, 19 nt, Homo sapiens
aaacagggauucagaaacc

SEQ ID NO: 1023448 - RNA, 19 nt, Homo sapiens
cagccaaccugcucaacga

SEQ ID NO: 1023449 - RNA, 19 nt, Homo sapiens
cgauuugcaugaaguugaa

SEQ ID NO: 1023450 - RNA, 19 nt, Homo sapiens
gaaaguggaaguugaagcu

SEQ ID NO: 1023451 - RNA, 19 nt, Homo sapiens
ggaauggaaacgagagaug

SEQ ID NO: 1023452 - RNA, 19 nt, Homo sapiens
ggacagugagggaggaaug

SEQ ID NO: 1023453 - RNA, 19 nt, Homo sapiens
gccgagaccaccuggauuu

SEQ ID NO: 1023454 - RNA, 19 nt, Homo sapiens
cgaucucgcuggcugaaug

SEQ ID NO: 1023455 - RNA, 19 nt, Homo sapiens
acgcuaugcuggaagaauu

SEQ ID NO: 1023456 - RNA, 19 nt, Homo sapiens
ggaaguugaagcugggaaa

SEQ ID NO: 1023457 - RNA, 19 nt, Homo sapiens
uuuauacacugacaacaga

SEQ ID NO: 1023458 - RNA, 19 nt, Homo sapiens
cuuagaagaugugauugaa

SEQ ID NO: 1023459 - RNA, 19 nt, Homo sapiens
gcugcacucuguacugugu

SEQ ID NO: 1023460 - RNA, 19 nt, Homo sapiens
uuucggaucugcaguuugu

SEQ ID NO: 1023461 - RNA, 19 nt, Homo sapiens
ucucguaccuuuguuguca

SEQ ID NO: 1023462 - RNA, 19 nt, Homo sapiens
ccauguggcuugaaucacu

SEQ ID NO: 1023463 - RNA, 19 nt, Homo sapiens
gaagguaugaaguuugaag

SEQ ID NO: 1023464 - RNA, 19 nt, Homo sapiens
gggaacgaaagcaagauuu

SEQ ID NO: 1023465 - RNA, 19 nt, Homo sapiens
caccuuagaagaugugauu

SEQ ID NO: 1023466 - RNA, 19 nt, Homo sapiens
gggaaucgucaccuuagaa

SEQ ID NO: 1023467 - RNA, 19 nt, Homo sapiens
uggaagaauuuaagaaagg

SEQ ID NO: 1023468 - RNA, 19 nt, Homo sapiens
gcaacgugcuggucaacac

SEQ ID NO: 1023469 - RNA, 19 nt, Homo sapiens
aaacgagucggaccuucua

SEQ ID NO: 1023470 - RNA, 19 nt, Homo sapiens
gcucccacccuaaggaauu

SEQ ID NO: 1023471 - RNA, 19 nt, Homo sapiens
ggguguagccugccucaga

SEQ ID NO: 1023472 - RNA, 19 nt, Homo sapiens
gaaccugccaagucuguca

SEQ ID NO: 1023473 - RNA, 19 nt, Homo sapiens
gcaugaaguugaaaauugu

SEQ ID NO: 1023474 - RNA, 19 nt, Homo sapiens
gcauggcguucaagauuuu

SEQ ID NO: 1023475 - RNA, 19 nt, Homo sapiens
aacgagagaugugaaguug

SEQ ID NO: 1023476 - RNA, 19 nt, Homo sapiens
gaauggaaacgagagaugu

SEQ ID NO: 1023477 - RNA, 19 nt, Homo sapiens
ggagggaacuuuggggauu

SEQ ID NO: 1023478 - RNA, 19 nt, Homo sapiens
gcugugaucccaugaugug

SEQ ID NO: 1023479 - RNA, 19 nt, Homo sapiens
gucccugucucguaccuuu

SEQ ID NO: 1023480 - RNA, 19 nt, Homo sapiens
gaaaaccaucaccaaauuu

SEQ ID NO: 1023481 - RNA, 19 nt, Homo sapiens
aggaggagcugaacaucau

SEQ ID NO: 1023482 - RNA, 19 nt, Homo sapiens
ggucaccgaucccuacaac

SEQ ID NO: 1023483 - RNA, 19 nt, Homo sapiens
gaccugcaaucaccucucu

SEQ ID NO: 1023484 - RNA, 19 nt, Homo sapiens
cgagcgccuucucauacua

SEQ ID NO: 1023485 - RNA, 19 nt, Homo sapiens
ucugaacucugcugugauc

SEQ ID NO: 1023486 - RNA, 19 nt, Homo sapiens
aaacgagagaugugaaguu

SEQ ID NO: 1023487 - RNA, 19 nt, Homo sapiens
ugagauucuugaugaaaca

SEQ ID NO: 1023488 - RNA, 19 nt, Homo sapiens
ccuucuagcugcacucugu

SEQ ID NO: 1023489 - RNA, 19 nt, Homo sapiens
gcucucccuuuuaucauua

SEQ ID NO: 1023490 - RNA, 19 nt, Homo sapiens
cuacuucguucucauucug

SEQ ID NO: 1023491 - RNA, 19 nt, Homo sapiens
acugaaauaugaugagaag

SEQ ID NO: 1023492 - RNA, 19 nt, Homo sapiens
ggaaucgucaccuuagaag

SEQ ID NO: 1023493 - RNA, 19 nt, Homo sapiens
ucaaagacuuggccuucgu

SEQ ID NO: 1023494 - RNA, 19 nt, Homo sapiens
uagcugcacucuguacugu

SEQ ID NO: 1023495 - RNA, 19 nt, Homo sapiens
gguccuugcucuuguuaac

SEQ ID NO: 1023496 - RNA, 19 nt, Homo sapiens
uuuaaguuguucugucuga

SEQ ID NO: 1023497 - RNA, 19 nt, Homo sapiens
caccaucgguaucgucauc

SEQ ID NO: 1023498 - RNA, 19 nt, Homo sapiens
ccaaccugcucaacgaaca

SEQ ID NO: 1023499 - RNA, 19 nt, Homo sapiens
ccugacagccucuccaguu

SEQ ID NO: 1023500 - RNA, 19 nt, Homo sapiens
aguugaagcugggaaagaa

SEQ ID NO: 1023501 - RNA, 19 nt, Homo sapiens
cccacuagaacauacuuua

SEQ ID NO: 1023502 - RNA, 19 nt, Homo sapiens
ugaagaagaccguguuacu

SEQ ID NO: 1023503 - RNA, 19 nt, Homo sapiens
ugauuccgcccaaauagaa

SEQ ID NO: 1023504 - RNA, 19 nt, Homo sapiens
ucaccgaucccuacaacga

SEQ ID NO: 1023505 - RNA, 19 nt, Homo sapiens
gcaguuuguuaagaucuca

SEQ ID NO: 1023506 - RNA, 19 nt, Homo sapiens
aaagaagguaugaaguuug

SEQ ID NO: 1023507 - RNA, 19 nt, Homo sapiens
ggaacgaaagcaagauuuu

SEQ ID NO: 1023508 - RNA, 19 nt, Homo sapiens
gaaagaaacugaaagaaca

SEQ ID NO: 1023509 - RNA, 19 nt, Homo sapiens
gauaaggucugcugauaaa

SEQ ID NO: 1023510 - RNA, 19 nt, Homo sapiens
gacaguacuuugagaauua

SEQ ID NO: 1023511 - RNA, 19 nt, Homo sapiens
caaaggagauuaagaggaa

SEQ ID NO: 1023512 - RNA, 19 nt, Homo sapiens
gucaaagccuucuuaauua

SEQ ID NO: 1023513 - RNA, 19 nt, Homo sapiens
guuaagagcugccgaaaug

SEQ ID NO: 1023514 - RNA, 19 nt, Homo sapiens
gaaauaacaagccgagaua

SEQ ID NO: 1023515 - RNA, 19 nt, Homo sapiens
agaaagaccuauccaaauu

SEQ ID NO: 1023516 - RNA, 19 nt, Homo sapiens
ugaaagaacaguugacuua

SEQ ID NO: 1023517 - RNA, 19 nt, Homo sapiens
gaaagaaacuacaagugau

SEQ ID NO: 1023518 - RNA, 19 nt, Homo sapiens
gaaagaccuauccaaauua

SEQ ID NO: 1023519 - RNA, 19 nt, Homo sapiens
gaaagggacaggaagguua

SEQ ID NO: 1023520 - RNA, 19 nt, Homo sapiens
gcaggaggcugaaauguuc

SEQ ID NO: 1023521 - RNA, 19 nt, Homo sapiens
aaacaccucuucucacuaa

SEQ ID NO: 1023522 - RNA, 19 nt, Homo sapiens
gaagagaagagacugauuu

SEQ ID NO: 1023523 - RNA, 19 nt, Homo sapiens
gcauaucagugccauguaa

SEQ ID NO: 1023524 - RNA, 19 nt, Homo sapiens
gcaagacucuaucuccaaa

SEQ ID NO: 1023525 - RNA, 19 nt, Homo sapiens
gagaagagacugauuuaga

SEQ ID NO: 1023526 - RNA, 19 nt, Homo sapiens
gaauaccuaugucaagauu

SEQ ID NO: 1023527 - RNA, 19 nt, Homo sapiens
uaggaugucuguuaaguaa

SEQ ID NO: 1023528 - RNA, 19 nt, Homo sapiens
ucacaacagucuaaguuaa

SEQ ID NO: 1023529 - RNA, 19 nt, Homo sapiens
caaaggaaguaauaaagug

SEQ ID NO: 1023530 - RNA, 19 nt, Homo sapiens
cuaaagcaguugcagauaa

SEQ ID NO: 1023531 - RNA, 19 nt, Homo sapiens
gagaacaaguagccaugua

SEQ ID NO: 1023532 - RNA, 19 nt, Homo sapiens
ugucaaagccuucuuaauu

SEQ ID NO: 1023533 - RNA, 19 nt, Homo sapiens
gugcaccacuggacuauaa

SEQ ID NO: 1023534 - RNA, 19 nt, Homo sapiens
aaacuucgcuugcagcuau

SEQ ID NO: 1023535 - RNA, 19 nt, Homo sapiens
gaagacagcaugcaagaug

SEQ ID NO: 1023536 - RNA, 19 nt, Homo sapiens
ccauguaacugaagaaaug

SEQ ID NO: 1023537 - RNA, 19 nt, Homo sapiens
agaagaggaugaagaauug

SEQ ID NO: 1023538 - RNA, 19 nt, Homo sapiens
gaacaaagcacagaagaca

SEQ ID NO: 1023539 - RNA, 19 nt, Homo sapiens
agaagagacugauuuagaa

SEQ ID NO: 1023540 - RNA, 19 nt, Homo sapiens
caacgguaguggcucuuua

SEQ ID NO: 1023541 - RNA, 19 nt, Homo sapiens
guaaaccagugcauuguga

SEQ ID NO: 1023542 - RNA, 19 nt, Homo sapiens
gugaaacacuguaucaaga

SEQ ID NO: 1023543 - RNA, 19 nt, Homo sapiens
gaugaucccgacacuauua

SEQ ID NO: 1023544 - RNA, 19 nt, Homo sapiens
gugauaaggucugcugaua

SEQ ID NO: 1023545 - RNA, 19 nt, Homo sapiens
gagccaagaucacgccauu

SEQ ID NO: 1023546 - RNA, 19 nt, Homo sapiens
uaaauuccauccagcugua

SEQ ID NO: 1023547 - RNA, 19 nt, Homo sapiens
cacagaaccuggauuagaa

SEQ ID NO: 1023548 - RNA, 19 nt, Homo sapiens
gacagucaauuccauuaaa

SEQ ID NO: 1023549 - RNA, 19 nt, Homo sapiens
guuauuaggaugucuguua

SEQ ID NO: 1023550 - RNA, 19 nt, Homo sapiens
gcugaccgcucaagagauu

SEQ ID NO: 1023551 - RNA, 19 nt, Homo sapiens
caacgaagaugcagcuagu

SEQ ID NO: 1023552 - RNA, 19 nt, Homo sapiens
gaagauucauaguacuuug

SEQ ID NO: 1023553 - RNA, 19 nt, Homo sapiens
uaagagagcuaguaguuac

SEQ ID NO: 1023554 - RNA, 19 nt, Homo sapiens
gaaaguuccagacuguaua

SEQ ID NO: 1023555 - RNA, 19 nt, Homo sapiens
gucaauaugucaagaaaga

SEQ ID NO: 1023556 - RNA, 19 nt, Homo sapiens
gaacaaguagccauguauu

SEQ ID NO: 1023557 - RNA, 19 nt, Homo sapiens
gggagaagauucauaguac

SEQ ID NO: 1023558 - RNA, 19 nt, Homo sapiens
ugaaagaaacuacaaguga

SEQ ID NO: 1023559 - RNA, 19 nt, Homo sapiens
gcauugagguguaaauuuu

SEQ ID NO: 1023560 - RNA, 19 nt, Homo sapiens
gcacauaccuauuuuguag

SEQ ID NO: 1023561 - RNA, 19 nt, Homo sapiens
gaaaacaucucaccugaca

SEQ ID NO: 1023562 - RNA, 19 nt, Homo sapiens
caacguggccuuugaguuc

SEQ ID NO: 1023563 - RNA, 19 nt, Homo sapiens
ccacaauggaagaauauua

SEQ ID NO: 1023564 - RNA, 19 nt, Homo sapiens
aaacaaggaaagccaaaua

SEQ ID NO: 1023565 - RNA, 19 nt, Homo sapiens
ccucaugccuguaauccua

SEQ ID NO: 1023566 - RNA, 19 nt, Homo sapiens
agaacugccuccugagaua

SEQ ID NO: 1023567 - RNA, 19 nt, Homo sapiens
gauaguggacggccuguuu

SEQ ID NO: 1023568 - RNA, 19 nt, Homo sapiens
gaccuugucuugggaguuu

SEQ ID NO: 1023569 - RNA, 19 nt, Homo sapiens
uaaagcaguugcagauaau

SEQ ID NO: 1023570 - RNA, 19 nt, Homo sapiens
aaagaagacuaaagcaguu

SEQ ID NO: 1023571 - RNA, 19 nt, Homo sapiens
cggaaacuccugagaauaa

SEQ ID NO: 1023572 - RNA, 19 nt, Homo sapiens
gaaucgaucagaugaacua

SEQ ID NO: 1023573 - RNA, 19 nt, Homo sapiens
caaauuaucgggagaagau

SEQ ID NO: 1023574 - RNA, 19 nt, Homo sapiens
ccaagaaagugaaaacuaa

SEQ ID NO: 1023575 - RNA, 19 nt, Homo sapiens
aaagguguuugcguuauua

SEQ ID NO: 1023576 - RNA, 19 nt, Homo sapiens
gggauuaucagcauagaaa

SEQ ID NO: 1023577 - RNA, 19 nt, Homo sapiens
gaaauuccuucuggacguu

SEQ ID NO: 1023578 - RNA, 19 nt, Homo sapiens
agacacagaaccuggauua

SEQ ID NO: 1023579 - RNA, 19 nt, Homo sapiens
caucucaccugacacuauu

SEQ ID NO: 1023580 - RNA, 19 nt, Homo sapiens
ggaugucuguuaaguaauc

SEQ ID NO: 1023581 - RNA, 19 nt, Homo sapiens
gaaaugcacagaggugaaa

SEQ ID NO: 1023582 - RNA, 19 nt, Homo sapiens
ggaccaaggacacauaaug

SEQ ID NO: 1023583 - RNA, 19 nt, Homo sapiens
gaugguauaguguauguuu

SEQ ID NO: 1023584 - RNA, 19 nt, Homo sapiens
ugaaauaagcucaauggaa

SEQ ID NO: 1023585 - RNA, 19 nt, Homo sapiens
gaaggcaaaugagggaaga

SEQ ID NO: 1023586 - RNA, 19 nt, Homo sapiens
guaagagagcuaguaguua

SEQ ID NO: 1023587 - RNA, 19 nt, Homo sapiens
gaaccuggauuagaagagu

SEQ ID NO: 1023588 - RNA, 19 nt, Homo sapiens
gacggccuguuucaucuua

SEQ ID NO: 1023589 - RNA, 19 nt, Homo sapiens
gaaauggcaaaggagauua

SEQ ID NO: 1023590 - RNA, 19 nt, Homo sapiens
gcacugaguuuucauuguu

SEQ ID NO: 1023591 - RNA, 19 nt, Homo sapiens
caaggacacauaauggaua

SEQ ID NO: 1023592 - RNA, 19 nt, Homo sapiens
cuaaucauguggcuaguga

SEQ ID NO: 1023593 - RNA, 19 nt, Homo sapiens
gaauuuguccacacugaaa

SEQ ID NO: 1023594 - RNA, 19 nt, Homo sapiens
ucaccgaacugauagacuu

SEQ ID NO: 1023595 - RNA, 19 nt, Homo sapiens
aaacaugucccgcugugua

SEQ ID NO: 1023596 - RNA, 19 nt, Homo sapiens
gaaaggauccacuacuucu

SEQ ID NO: 1023597 - RNA, 19 nt, Homo sapiens
aagaaaggauccacuacuu

SEQ ID NO: 1023598 - RNA, 19 nt, Homo sapiens
ugacaaaccaaauggaauu

SEQ ID NO: 1023599 - RNA, 19 nt, Homo sapiens
agacuaggcucagaaucua

SEQ ID NO: 1023600 - RNA, 19 nt, Homo sapiens
agaaacaggagaacaagua

SEQ ID NO: 1023601 - RNA, 19 nt, Homo sapiens
uaagggaauuccaauaagu

SEQ ID NO: 1023602 - RNA, 19 nt, Homo sapiens
auacggauauggaaaguug

SEQ ID NO: 1023603 - RNA, 19 nt, Homo sapiens
aaacaaacaccucuucuca

SEQ ID NO: 1023604 - RNA, 19 nt, Homo sapiens
caauggaaaugcaaacauc

SEQ ID NO: 1023605 - RNA, 19 nt, Homo sapiens
uauauuacccaccuacuaa

SEQ ID NO: 1023606 - RNA, 19 nt, Homo sapiens
gaugagaguccuaaaguca

SEQ ID NO: 1023607 - RNA, 19 nt, Homo sapiens
ugacacaguugaaggugaa

SEQ ID NO: 1023608 - RNA, 19 nt, Homo sapiens
ucaaauagcugcauacauu

SEQ ID NO: 1023609 - RNA, 19 nt, Homo sapiens
cagcaaauaugggaaauua

SEQ ID NO: 1023610 - RNA, 19 nt, Homo sapiens
ccaaagcucuucacucuug

SEQ ID NO: 1023611 - RNA, 19 nt, Homo sapiens
auaaaggccuuguugcuua

SEQ ID NO: 1023612 - RNA, 19 nt, Homo sapiens
gagcaaagcguuaugaaug

SEQ ID NO: 1023613 - RNA, 19 nt, Homo sapiens
ucacagaguucuuaagaug

SEQ ID NO: 1023614 - RNA, 19 nt, Homo sapiens
ggaauauucuuuagcuaga

SEQ ID NO: 1023615 - RNA, 19 nt, Homo sapiens
gggaaauccuuuagcuuaa

SEQ ID NO: 1023616 - RNA, 19 nt, Homo sapiens
gagaaaggccuuaugaaug

SEQ ID NO: 1023617 - RNA, 19 nt, Homo sapiens
gagaaaggccuuaugaaug

SEQ ID NO: 1023618 - RNA, 19 nt, Homo sapiens
cuggagaccuugacacuua

SEQ ID NO: 1023619 - RNA, 19 nt, Homo sapiens
ggaauggagucuucuuaau

SEQ ID NO: 1023620 - RNA, 19 nt, Homo sapiens
agaaaggccuuaugaaugu

SEQ ID NO: 1023621 - RNA, 19 nt, Homo sapiens
gcugaaaacuccagucuua

SEQ ID NO: 1023622 - RNA, 19 nt, Homo sapiens
ggacucuucugauaacuug

SEQ ID NO: 1023623 - RNA, 19 nt, Homo sapiens
ggaaugaggccuuauaagu

SEQ ID NO: 1023624 - RNA, 19 nt, Homo sapiens
ggagaaaggccuuaugaau

SEQ ID NO: 1023625 - RNA, 19 nt, Homo sapiens
cagagcacguguauacaua

SEQ ID NO: 1023626 - RNA, 19 nt, Homo sapiens
gaaugaggccuuauaagug

SEQ ID NO: 1023627 - RNA, 19 nt, Homo sapiens
gggaaguccuuugcuuaua

SEQ ID NO: 1023628 - RNA, 19 nt, Homo sapiens
caucuagucucauuaaaca

SEQ ID NO: 1023629 - RNA, 19 nt, Homo sapiens
gaauggagucuucuuaaug

SEQ ID NO: 1023630 - RNA, 19 nt, Homo sapiens
agauguggcuguaaacuuu

SEQ ID NO: 1023631 - RNA, 19 nt, Homo sapiens
gaaaggccuuaugaaugua

SEQ ID NO: 1023632 - RNA, 19 nt, Homo sapiens
agaaaggccuuaugagugu

SEQ ID NO: 1023633 - RNA, 19 nt, Homo sapiens
caccaaagcucuucacucu

SEQ ID NO: 1023634 - RNA, 19 nt, Homo sapiens
agaaaggccuuaugagugu

SEQ ID NO: 1023635 - RNA, 19 nt, Homo sapiens
uaaaggccuuguugcuuaa

SEQ ID NO: 1023636 - RNA, 19 nt, Homo sapiens
ccauaugaaugcauugauu

SEQ ID NO: 1023637 - RNA, 19 nt, Homo sapiens
ggagaaaggccuuaugagu

SEQ ID NO: 1023638 - RNA, 19 nt, Homo sapiens
ggaaguccuuugcuuauac

SEQ ID NO: 1023639 - RNA, 19 nt, Homo sapiens
ggagaaaggccuuaugagu

SEQ ID NO: 1023640 - RNA, 19 nt, Homo sapiens
ggagaaaggccuuaugagu

SEQ ID NO: 1023641 - RNA, 19 nt, Homo sapiens
ggaaauccuuuagccgaaa

SEQ ID NO: 1023642 - RNA, 19 nt, Homo sapiens
ccucagcacucauucuauu

SEQ ID NO: 1023643 - RNA, 19 nt, Homo sapiens
ggaggaaggccauaugaau

SEQ ID NO: 1023644 - RNA, 19 nt, Homo sapiens
aauggagucuucuuaauga

SEQ ID NO: 1023645 - RNA, 19 nt, Homo sapiens
aaugaggccuuauaaguga

SEQ ID NO: 1023646 - RNA, 19 nt, Homo sapiens
ggagagaggccuuaugagu

SEQ ID NO: 1023647 - RNA, 19 nt, Homo sapiens
gcuuauacaucuagucuca

SEQ ID NO: 1023648 - RNA, 19 nt, Homo sapiens
gaaaaguccagucucauua

SEQ ID NO: 1023649 - RNA, 19 nt, Homo sapiens
ugggaaauccuuuagcuua

SEQ ID NO: 1023650 - RNA, 19 nt, Homo sapiens
gaggaauggagucuucuua

SEQ ID NO: 1023651 - RNA, 19 nt, Homo sapiens
gaaaacuccagucuuauua

SEQ ID NO: 1023652 - RNA, 19 nt, Homo sapiens
gaacaaguccugccucacu

SEQ ID NO: 1023653 - RNA, 19 nt, Homo sapiens
gcccugauuuguguuauaa

SEQ ID NO: 1023654 - RNA, 19 nt, Homo sapiens
gggaaauccuuugcugaaa

SEQ ID NO: 1023655 - RNA, 19 nt, Homo sapiens
ucagagaguucacacuaga

SEQ ID NO: 1023656 - RNA, 19 nt, Homo sapiens
gaaugugggaaauccuuua

SEQ ID NO: 1023657 - RNA, 19 nt, Homo sapiens
agaaaggccuuaugaaugc

SEQ ID NO: 1023658 - RNA, 19 nt, Homo sapiens
gaaaacuccagccuuauua

SEQ ID NO: 1023659 - RNA, 19 nt, Homo sapiens
ggaaauccuuugcugaaaa

SEQ ID NO: 1023660 - RNA, 19 nt, Homo sapiens
caucagagaguucacacua

SEQ ID NO: 1023661 - RNA, 19 nt, Homo sapiens
gaaaggccuuaugagugua

SEQ ID NO: 1023662 - RNA, 19 nt, Homo sapiens
gcuagacuucugugacuua

SEQ ID NO: 1023663 - RNA, 19 nt, Homo sapiens
gaggaaggccauaugaaug

SEQ ID NO: 1023664 - RNA, 19 nt, Homo sapiens
cagaagagaucacaaacac

SEQ ID NO: 1023665 - RNA, 19 nt, Homo sapiens
ggaaauccuuuagcuuaag

SEQ ID NO: 1023666 - RNA, 19 nt, Homo sapiens
ccaaugaguuaggccauga

SEQ ID NO: 1023667 - RNA, 19 nt, Homo sapiens
gcccaggucucuugcuaga

SEQ ID NO: 1023668 - RNA, 19 nt, Homo sapiens
ugugggaacugcauaguau

SEQ ID NO: 1023669 - RNA, 19 nt, Homo sapiens
cuucagcccucucucauug

SEQ ID NO: 1023670 - RNA, 19 nt, Homo sapiens
guacaucauucgccuaacu

SEQ ID NO: 1023671 - RNA, 19 nt, Homo sapiens
gaaguccuuugcuuauaca

SEQ ID NO: 1023672 - RNA, 19 nt, Homo sapiens
ucagacagccugccaccua

SEQ ID NO: 1023673 - RNA, 19 nt, Homo sapiens
uauaauaaaggccuuguug

SEQ ID NO: 1023674 - RNA, 19 nt, Homo sapiens
agauguggagguaauauua

SEQ ID NO: 1023675 - RNA, 19 nt, Homo sapiens
agagaaaggccuuaugaau

SEQ ID NO: 1023676 - RNA, 19 nt, Homo sapiens
cuagagaaaggccuuauga

SEQ ID NO: 1023677 - RNA, 19 nt, Homo sapiens
gggagauccuuugcugaaa

SEQ ID NO: 1023678 - RNA, 19 nt, Homo sapiens
cuagagaaaggccuuauga

SEQ ID NO: 1023679 - RNA, 19 nt, Homo sapiens
uugaagauguggcuguaaa

SEQ ID NO: 1023680 - RNA, 19 nt, Homo sapiens
gcagagcacguguauacau

SEQ ID NO: 1023681 - RNA, 19 nt, Homo sapiens
aaugcuagcuucuuuacau

SEQ ID NO: 1023682 - RNA, 19 nt, Homo sapiens
ccuuauaagugaagcaaau

SEQ ID NO: 1023683 - RNA, 19 nt, Homo sapiens
caggagaaaggccuuauga

SEQ ID NO: 1023684 - RNA, 19 nt, Homo sapiens
gugggaaguccuuugcuua

SEQ ID NO: 1023685 - RNA, 19 nt, Homo sapiens
gcaaagcguuaugaaugca

SEQ ID NO: 1023686 - RNA, 19 nt, Homo sapiens
ggagcaaagcguuaugaau

SEQ ID NO: 1023687 - RNA, 19 nt, Homo sapiens
gaucacaaacacaggaaug

SEQ ID NO: 1023688 - RNA, 19 nt, Homo sapiens
acagaguucuuaagaugga

SEQ ID NO: 1023689 - RNA, 19 nt, Homo sapiens
gacuuacaguucucuucua

SEQ ID NO: 1023690 - RNA, 19 nt, Homo sapiens
auuaaacacuugagaguuc

SEQ ID NO: 1023691 - RNA, 19 nt, Homo sapiens
ucagagcagugugaccuuu

SEQ ID NO: 1023692 - RNA, 19 nt, Homo sapiens
auuaaacacuugagaguuc

SEQ ID NO: 1023693 - RNA, 19 nt, Homo sapiens
ggagauccuuugcugaaaa

SEQ ID NO: 1023694 - RNA, 19 nt, Homo sapiens
gaaugugggagauccuuug

SEQ ID NO: 1023695 - RNA, 19 nt, Homo sapiens
ccauauucaugagagauuu

SEQ ID NO: 1023696 - RNA, 19 nt, Homo sapiens
gcagugugaccuuugaaga

SEQ ID NO: 1023697 - RNA, 19 nt, Homo sapiens
cgucagacacuucacacua

SEQ ID NO: 1023698 - RNA, 19 nt, Homo sapiens
ggaaaccccuuaugaggau

SEQ ID NO: 1023699 - RNA, 19 nt, Homo sapiens
caauauaacacuggaggaa

SEQ ID NO: 1023700 - RNA, 19 nt, Homo sapiens
gucagacacuucacacuag

SEQ ID NO: 1023701 - RNA, 19 nt, Homo sapiens
ggaucucacagaguucuua

SEQ ID NO: 1023702 - RNA, 19 nt, Homo sapiens
uacaucaaauagcugcaua

SEQ ID NO: 1023703 - RNA, 19 nt, Homo sapiens
ugucauacaucaaauagcu

SEQ ID NO: 1023704 - RNA, 19 nt, Homo sapiens
guggagaaaggccuuauga

SEQ ID NO: 1023705 - RNA, 19 nt, Homo sapiens
auacuggaaugaggccuua

SEQ ID NO: 1023706 - RNA, 19 nt, Homo sapiens
aagcagagcacguguauac

SEQ ID NO: 1023707 - RNA, 19 nt, Homo sapiens
acacuucacacuagagaaa

SEQ ID NO: 1023708 - RNA, 19 nt, Homo sapiens
ggaaucagcuucucucauu

SEQ ID NO: 1023709 - RNA, 19 nt, Homo sapiens
acaaguaccuucacacaaa

SEQ ID NO: 1023710 - RNA, 19 nt, Homo sapiens
gaaguagacagacagguua

SEQ ID NO: 1023711 - RNA, 19 nt, Homo sapiens
gaacucauccuucauuuca

SEQ ID NO: 1023712 - RNA, 19 nt, Homo sapiens
caaauuaucugcuuaagcu

SEQ ID NO: 1023713 - RNA, 19 nt, Homo sapiens
gaugauggcuucaacagau

SEQ ID NO: 1023714 - RNA, 19 nt, Homo sapiens
gaagcuauaucaacaaugg

SEQ ID NO: 1023715 - RNA, 19 nt, Homo sapiens
gcacaagaccuaaauguca

SEQ ID NO: 1023716 - RNA, 19 nt, Homo sapiens
gagguucgcugaguucuaa

SEQ ID NO: 1023717 - RNA, 19 nt, Homo sapiens
caaauucccuucaccacaa

SEQ ID NO: 1023718 - RNA, 19 nt, Homo sapiens
gaagaagugauucgaauga

SEQ ID NO: 1023719 - RNA, 19 nt, Homo sapiens
ccacaugccuuccagauca

SEQ ID NO: 1023720 - RNA, 19 nt, Homo sapiens
gaauugcugugcuguuuga

SEQ ID NO: 1023721 - RNA, 19 nt, Homo sapiens
caacagauccauucaugaa

SEQ ID NO: 1023722 - RNA, 19 nt, Homo sapiens
gaggaaauacacaacaaua

SEQ ID NO: 1023723 - RNA, 19 nt, Homo sapiens
gauauuccacucuuagaua

SEQ ID NO: 1023724 - RNA, 19 nt, Homo sapiens
ggacaaauuaucugcuuaa

SEQ ID NO: 1023725 - RNA, 19 nt, Homo sapiens
gcaacucuccucuuguaua

SEQ ID NO: 1023726 - RNA, 19 nt, Homo sapiens
gcaaauaugucggcacagu

SEQ ID NO: 1023727 - RNA, 19 nt, Homo sapiens
aagcaacucuccucuugua

SEQ ID NO: 1023728 - RNA, 19 nt, Homo sapiens
gagauucuguaucauguug

SEQ ID NO: 1023729 - RNA, 19 nt, Homo sapiens
gaggaggaauuacaacuuc

SEQ ID NO: 1023730 - RNA, 19 nt, Homo sapiens
uaacagaaguagacagaca

SEQ ID NO: 1023731 - RNA, 19 nt, Homo sapiens
gaaucagcuucucucauuu

SEQ ID NO: 1023732 - RNA, 19 nt, Homo sapiens
gcacggaaucuaucucuga

SEQ ID NO: 1023733 - RNA, 19 nt, Homo sapiens
ccaagcagcccuucaaguu

SEQ ID NO: 1023734 - RNA, 19 nt, Homo sapiens
cuggugaucuccuucuuua

SEQ ID NO: 1023735 - RNA, 19 nt, Homo sapiens
gcugagacguggaaacaug

SEQ ID NO: 1023736 - RNA, 19 nt, Homo sapiens
uaacucagcguagauagua

SEQ ID NO: 1023737 - RNA, 19 nt, Homo sapiens
gaacggguccuggaaauca

SEQ ID NO: 1023738 - RNA, 19 nt, Homo sapiens
gcuagaagaugggaucgaa

SEQ ID NO: 1023739 - RNA, 19 nt, Homo sapiens
caccauggauuccgacuga

SEQ ID NO: 1023740 - RNA, 19 nt, Homo sapiens
gccauuauguccuucaaga

SEQ ID NO: 1023741 - RNA, 19 nt, Homo sapiens
gggaggaaauacacaacaa

SEQ ID NO: 1023742 - RNA, 19 nt, Homo sapiens
ggaaaugcagguuuaagga

SEQ ID NO: 1023743 - RNA, 19 nt, Homo sapiens
uuacaaacgcgaucucuuu

SEQ ID NO: 1023744 - RNA, 19 nt, Homo sapiens
gaagugauucgaaugaugu

SEQ ID NO: 1023745 - RNA, 19 nt, Homo sapiens
aagacagacugaagaaauu

SEQ ID NO: 1023746 - RNA, 19 nt, Homo sapiens
aagaauugcugugcuguuu

SEQ ID NO: 1023747 - RNA, 19 nt, Homo sapiens
gaugucagaggaggaauua

SEQ ID NO: 1023748 - RNA, 19 nt, Homo sapiens
gcaaacuugugaagaccuu

SEQ ID NO: 1023749 - RNA, 19 nt, Homo sapiens
gagcaucagccacaaguau

SEQ ID NO: 1023750 - RNA, 19 nt, Homo sapiens
ggaggaagcaaccauuuca

SEQ ID NO: 1023751 - RNA, 19 nt, Homo sapiens
uagaagaugggaucgaaua

SEQ ID NO: 1023752 - RNA, 19 nt, Homo sapiens
caacucuccucuuguauac

SEQ ID NO: 1023753 - RNA, 19 nt, Homo sapiens
gaggaucaucaguuuauuu

SEQ ID NO: 1023754 - RNA, 19 nt, Homo sapiens
ggacuugcaucaggaguag

SEQ ID NO: 1023755 - RNA, 19 nt, Homo sapiens
ucacugauauuccacucuu

SEQ ID NO: 1023756 - RNA, 19 nt, Homo sapiens
caauuacaguucugacuca

SEQ ID NO: 1023757 - RNA, 19 nt, Homo sapiens
cugaagaaauuuccagaau

SEQ ID NO: 1023758 - RNA, 19 nt, Homo sapiens
acacaguccuugagagguu

SEQ ID NO: 1023759 - RNA, 19 nt, Homo sapiens
cccagaggaucaucaguuu

SEQ ID NO: 1023760 - RNA, 19 nt, Homo sapiens
gucugcaggucauuaguua

SEQ ID NO: 1023761 - RNA, 19 nt, Homo sapiens
ugguguaucuucuguuaaa

SEQ ID NO: 1023762 - RNA, 19 nt, Homo sapiens
cuugguguaucuucuguua

SEQ ID NO: 1023763 - RNA, 19 nt, Homo sapiens
caaguaccuucacacaaau

SEQ ID NO: 1023764 - RNA, 19 nt, Homo sapiens
gcuguuugcugaaaguguu

SEQ ID NO: 1023765 - RNA, 19 nt, Homo sapiens
ucacacacuuugauuugga

SEQ ID NO: 1023766 - RNA, 19 nt, Homo sapiens
gcaucagccacaaguauuu

SEQ ID NO: 1023767 - RNA, 19 nt, Homo sapiens
ccaaagacagacugaagaa

SEQ ID NO: 1023768 - RNA, 19 nt, Homo sapiens
cgaucucuuugaacaauuu

SEQ ID NO: 1023769 - RNA, 19 nt, Homo sapiens
gcugaguucuaaugauguu

SEQ ID NO: 1023770 - RNA, 19 nt, Homo sapiens
cagaggaucaucaguuuau

SEQ ID NO: 1023771 - RNA, 19 nt, Homo sapiens
gguaacagaaguagacaga

SEQ ID NO: 1023772 - RNA, 19 nt, Homo sapiens
aaagacagacugaagaaau

SEQ ID NO: 1023773 - RNA, 19 nt, Homo sapiens
gaacaauuucgaacucauc

SEQ ID NO: 1023774 - RNA, 19 nt, Homo sapiens
aguagaagcuauaucaaca

SEQ ID NO: 1023775 - RNA, 19 nt, Homo sapiens
cagaaccacaucuucauuu

SEQ ID NO: 1023776 - RNA, 19 nt, Homo sapiens
ggaaaucuuggugcacuaa

SEQ ID NO: 1023777 - RNA, 19 nt, Homo sapiens
ggugcuaguuggcaauaga

SEQ ID NO: 1023778 - RNA, 19 nt, Homo sapiens
cauguuggcucgcacagau

SEQ ID NO: 1023779 - RNA, 19 nt, Homo sapiens
ggacugcuuuauggacuug

SEQ ID NO: 1023780 - RNA, 19 nt, Homo sapiens
gaugcgagguccaugucuu

SEQ ID NO: 1023781 - RNA, 19 nt, Homo sapiens
agaaccacaucuucauuug

SEQ ID NO: 1023782 - RNA, 19 nt, Homo sapiens
aaucuuggugcacuaauua

SEQ ID NO: 1023783 - RNA, 19 nt, Homo sapiens
gaagcaaccauuucagucu

SEQ ID NO: 1023784 - RNA, 19 nt, Homo sapiens
ucgcugaguucuaaugaug

SEQ ID NO: 1023785 - RNA, 19 nt, Homo sapiens
aaauaugucggcacaguuu

SEQ ID NO: 1023786 - RNA, 19 nt, Homo sapiens
caauacaacaugacuagga

SEQ ID NO: 1023787 - RNA, 19 nt, Homo sapiens
caaccagagucuccugcuu

SEQ ID NO: 1023788 - RNA, 19 nt, Homo sapiens
gaagaauugcugugcuguu

SEQ ID NO: 1023789 - RNA, 19 nt, Homo sapiens
cagcguagauaguauugca

SEQ ID NO: 1023790 - RNA, 19 nt, Homo sapiens
uauacgcccugcuuuacaa

SEQ ID NO: 1023791 - RNA, 19 nt, Homo sapiens
gauucuguaucauguugaa

SEQ ID NO: 1023792 - RNA, 19 nt, Homo sapiens
ccagcaaacuugugaagac

SEQ ID NO: 1023793 - RNA, 19 nt, Homo sapiens
gcagacacacaaugcuuug

SEQ ID NO: 1023794 - RNA, 19 nt, Homo sapiens
gcuaguuggcaauagauaa

SEQ ID NO: 1023795 - RNA, 19 nt, Homo sapiens
gcagguuuaaggacaaauu

SEQ ID NO: 1023796 - RNA, 19 nt, Homo sapiens
aaaucuuggugcacuaauu

SEQ ID NO: 1023797 - RNA, 19 nt, Homo sapiens
ggauugcacgaguguguuu

SEQ ID NO: 1023798 - RNA, 19 nt, Homo sapiens
agaagugauucgaaugaug

SEQ ID NO: 1023799 - RNA, 19 nt, Homo sapiens
agaaaggaauucacaccau

SEQ ID NO: 1023800 - RNA, 19 nt, Homo sapiens
caagauagcaguccuuucc

SEQ ID NO: 1023801 - RNA, 19 nt, Homo sapiens
ugaaauaucaguagaagcu

SEQ ID NO: 1023802 - RNA, 19 nt, Homo sapiens
auagauaacucagcguaga

SEQ ID NO: 1023803 - RNA, 19 nt, Homo sapiens
ggagaauuggugcuaguug

SEQ ID NO: 1023804 - RNA, 19 nt, Homo sapiens
gcccagaggaucaucaguu

SEQ ID NO: 1023805 - RNA, 19 nt, Homo sapiens
acagauccauucaugaagu

SEQ ID NO: 1023806 - RNA, 19 nt, Homo sapiens
gaaauaucaguagaagcua

SEQ ID NO: 1023807 - RNA, 19 nt, Homo sapiens
ggaggaaauacacaacaau

SEQ ID NO: 1023808 - RNA, 19 nt, Homo sapiens
ggagaaagguggcuggaua

SEQ ID NO: 1023809 - RNA, 19 nt, Homo sapiens
ggagcaacauuuauucuua

SEQ ID NO: 1023810 - RNA, 19 nt, Homo sapiens
gcaaauauguuccuugguu

SEQ ID NO: 1023811 - RNA, 19 nt, Homo sapiens
gcaagacauuucuacauua

SEQ ID NO: 1023812 - RNA, 19 nt, Homo sapiens
ggagaaaccuaguagcuuu

SEQ ID NO: 1023813 - RNA, 19 nt, Homo sapiens
gaacacagacuagauauuu

SEQ ID NO: 1023814 - RNA, 19 nt, Homo sapiens
gacauggucuugccaaaua

SEQ ID NO: 1023815 - RNA, 19 nt, Homo sapiens
caauauagcugguuaucaa

SEQ ID NO: 1023816 - RNA, 19 nt, Homo sapiens
guaauaagcuggcuacaca

SEQ ID NO: 1023817 - RNA, 19 nt, Homo sapiens
caaagaaucucaacagcaa

SEQ ID NO: 1023818 - RNA, 19 nt, Homo sapiens
ccaauguacuggcagauua

SEQ ID NO: 1023819 - RNA, 19 nt, Homo sapiens
aaaguagguuggagaauua

SEQ ID NO: 1023820 - RNA, 19 nt, Homo sapiens
caaaguagguuggagaauu

SEQ ID NO: 1023821 - RNA, 19 nt, Homo sapiens
aaacagaggucaucgaaug

SEQ ID NO: 1023822 - RNA, 19 nt, Homo sapiens
guagagagaugcaggagaa

SEQ ID NO: 1023823 - RNA, 19 nt, Homo sapiens
caacacaggucuuggauca

SEQ ID NO: 1023824 - RNA, 19 nt, Homo sapiens
caauaggacugacuuauca

SEQ ID NO: 1023825 - RNA, 19 nt, Homo sapiens
gaucaucaauguaucaugu

SEQ ID NO: 1023826 - RNA, 19 nt, Homo sapiens
gaagaagauugucuacuca

SEQ ID NO: 1023827 - RNA, 19 nt, Homo sapiens
gcagugagauucaguuaag

SEQ ID NO: 1023828 - RNA, 19 nt, Homo sapiens
ggcaagacauuucuacauu

SEQ ID NO: 1023829 - RNA, 19 nt, Homo sapiens
agaaagaaauugcaaagga

SEQ ID NO: 1023830 - RNA, 19 nt, Homo sapiens
gaccagugcuuuaagaaga

SEQ ID NO: 1023831 - RNA, 19 nt, Homo sapiens
caaccuaccuccagauuag

SEQ ID NO: 1023832 - RNA, 19 nt, Homo sapiens
cuaauuagcuuaucaacuc

SEQ ID NO: 1023833 - RNA, 19 nt, Homo sapiens
gcauauuucuuucuuggaa

SEQ ID NO: 1023834 - RNA, 19 nt, Homo sapiens
ggaggaaacgggaacauuu

SEQ ID NO: 1023835 - RNA, 19 nt, Homo sapiens
caaauauguuccuugguuu

SEQ ID NO: 1023836 - RNA, 19 nt, Homo sapiens
gcauagagaaggugucuuu

SEQ ID NO: 1023837 - RNA, 19 nt, Homo sapiens
gaaccugacaauucuuaua

SEQ ID NO: 1023838 - RNA, 19 nt, Homo sapiens
gaagacaccagauauuaau

SEQ ID NO: 1023839 - RNA, 19 nt, Homo sapiens
gaaaguauccaucgguuca

SEQ ID NO: 1023840 - RNA, 19 nt, Homo sapiens
gaaagguggcuggauauuu

SEQ ID NO: 1023841 - RNA, 19 nt, Homo sapiens
ugaaggaaaugaagcaguu

SEQ ID NO: 1023842 - RNA, 19 nt, Homo sapiens
ucccaaauccugauaaaua

SEQ ID NO: 1023843 - RNA, 19 nt, Homo sapiens
caucggaccuuaccaaagu

SEQ ID NO: 1023844 - RNA, 19 nt, Homo sapiens
cuaagcagaucaucaaugu

SEQ ID NO: 1023845 - RNA, 19 nt, Homo sapiens
gaaggagugagauauauga

SEQ ID NO: 1023846 - RNA, 19 nt, Homo sapiens
caagaucuaugcuuuaaac

SEQ ID NO: 1023847 - RNA, 19 nt, Homo sapiens
gaucaacauucugaacaaa

SEQ ID NO: 1023848 - RNA, 19 nt, Homo sapiens
aaacugaggagcaacauuu

SEQ ID NO: 1023849 - RNA, 19 nt, Homo sapiens
cgagaagucuugcaaccaa

SEQ ID NO: 1023850 - RNA, 19 nt, Homo sapiens
ugaagaagauugucuacuc

SEQ ID NO: 1023851 - RNA, 19 nt, Homo sapiens
gcuauaagcacuaugaaau

SEQ ID NO: 1023852 - RNA, 19 nt, Homo sapiens
uuucugggcucuuggaaua

SEQ ID NO: 1023853 - RNA, 19 nt, Homo sapiens
ggaccaaccagucuucuga

SEQ ID NO: 1023854 - RNA, 19 nt, Homo sapiens
guuaugaguucuacaagga

SEQ ID NO: 1023855 - RNA, 19 nt, Homo sapiens
caaauuauguuggauaugc

SEQ ID NO: 1023856 - RNA, 19 nt, Homo sapiens
gaaaagcuaucaccugaau

SEQ ID NO: 1023857 - RNA, 19 nt, Homo sapiens
ggagugagauauaugaaaa

SEQ ID NO: 1023858 - RNA, 19 nt, Homo sapiens
acacaggucuuggaucaaa

SEQ ID NO: 1023859 - RNA, 19 nt, Homo sapiens
gaaguugggcuuuacacaa

SEQ ID NO: 1023860 - RNA, 19 nt, Homo sapiens
gauuguauccgaagucaaa

SEQ ID NO: 1023861 - RNA, 19 nt, Homo sapiens
gacuagauauuugaggaua

SEQ ID NO: 1023862 - RNA, 19 nt, Homo sapiens
aggagaaguuaguguaaua

SEQ ID NO: 1023863 - RNA, 19 nt, Homo sapiens
aagaagacaccagauauua

SEQ ID NO: 1023864 - RNA, 19 nt, Homo sapiens
ggucuuggaucaaaguuca

SEQ ID NO: 1023865 - RNA, 19 nt, Homo sapiens
gaagauagagaguaugaag

SEQ ID NO: 1023866 - RNA, 19 nt, Homo sapiens
caacuaaagggcaacauau

SEQ ID NO: 1023867 - RNA, 19 nt, Homo sapiens
caccagauauuaauuccuu

SEQ ID NO: 1023868 - RNA, 19 nt, Homo sapiens
gaacauuucaguugaugau

SEQ ID NO: 1023869 - RNA, 19 nt, Homo sapiens
ugaagcaguugaagcugua

SEQ ID NO: 1023870 - RNA, 19 nt, Homo sapiens
gacucaagaucuaugcuuu

SEQ ID NO: 1023871 - RNA, 19 nt, Homo sapiens
gaggcccacuugcuuauga

SEQ ID NO: 1023872 - RNA, 19 nt, Homo sapiens
aaagcuaucaccugaauaa

SEQ ID NO: 1023873 - RNA, 19 nt, Homo sapiens
cugaacaaaugaaagagua

SEQ ID NO: 1023874 - RNA, 19 nt, Homo sapiens
gagaaaccuaguagcuuua

SEQ ID NO: 1023875 - RNA, 19 nt, Homo sapiens
ggucaagucuacaaaagua

SEQ ID NO: 1023876 - RNA, 19 nt, Homo sapiens
uaagaagacaccagauauu

SEQ ID NO: 1023877 - RNA, 19 nt, Homo sapiens
cccaaauccugauaaauau

SEQ ID NO: 1023878 - RNA, 19 nt, Homo sapiens
uccagaagaugccaaugua

SEQ ID NO: 1023879 - RNA, 19 nt, Homo sapiens
gaagauugucuacucaaau

SEQ ID NO: 1023880 - RNA, 19 nt, Homo sapiens
ccaagaauuugaucucagu

SEQ ID NO: 1023881 - RNA, 19 nt, Homo sapiens
gaaagauuguauccgaagu

SEQ ID NO: 1023882 - RNA, 19 nt, Homo sapiens
caacagcaaagugaagaua

SEQ ID NO: 1023883 - RNA, 19 nt, Homo sapiens
ucauagaaccugacaauuc

SEQ ID NO: 1023884 - RNA, 19 nt, Homo sapiens
gauaugggcagucaucaau

SEQ ID NO: 1023885 - RNA, 19 nt, Homo sapiens
cagauuaacauacaaccua

SEQ ID NO: 1023886 - RNA, 19 nt, Homo sapiens
gagcaacauuuauucuuac

SEQ ID NO: 1023887 - RNA, 19 nt, Homo sapiens
gaucucaguacccauuuaa

SEQ ID NO: 1023888 - RNA, 19 nt, Homo sapiens
gaaaccuaguagcuuuaaa

SEQ ID NO: 1023889 - RNA, 19 nt, Homo sapiens
agauagaaguugggcuuua

SEQ ID NO: 1023890 - RNA, 19 nt, Homo sapiens
ucaggucucuggaucuuau

SEQ ID NO: 1023891 - RNA, 19 nt, Homo sapiens
gcagaagcauagagaaggu

SEQ ID NO: 1023892 - RNA, 19 nt, Homo sapiens
aaagguggcuggauauuuu

SEQ ID NO: 1023893 - RNA, 19 nt, Homo sapiens
aaacccaggaacaauauua

SEQ ID NO: 1023894 - RNA, 19 nt, Homo sapiens
gauagagaguaugaaguga

SEQ ID NO: 1023895 - RNA, 19 nt, Homo sapiens
caacaacuagaucaacauu

SEQ ID NO: 1023896 - RNA, 19 nt, Homo sapiens
ugaaauguauagugaacga

SEQ ID NO: 1023897 - RNA, 19 nt, Homo sapiens
uauugaagauuccaugguu

SEQ ID NO: 1023898 - RNA, 19 nt, Homo sapiens
aagauugucuacucaaaug

SEQ ID NO: 1023899 - RNA, 19 nt, Homo sapiens
ggagaaguuaguguaauaa

SEQ ID NO: 1023900 - RNA, 19 nt, Homo sapiens
aaacauaugcaucguacaa

SEQ ID NO: 1023901 - RNA, 19 nt, Homo sapiens
caaauucuccagcucauuc

SEQ ID NO: 1023902 - RNA, 19 nt, Homo sapiens
gauagaaguugggcuuuac

SEQ ID NO: 1023903 - RNA, 19 nt, Homo sapiens
ggucuugccaaauaauuaa

SEQ ID NO: 1023904 - RNA, 19 nt, Homo sapiens
gaggaagaccagacauuau

SEQ ID NO: 1023905 - RNA, 19 nt, Homo sapiens
agaggaagaccagacauua

SEQ ID NO: 1023906 - RNA, 19 nt, Homo sapiens
gauacagccucuagcucuu

SEQ ID NO: 1023907 - RNA, 19 nt, Homo sapiens
ccaauugcauauuucuuuc

SEQ ID NO: 1023908 - RNA, 19 nt, Homo sapiens
gaaaugaccuaaauaagga

SEQ ID NO: 1023909 - RNA, 19 nt, Homo sapiens
gaggaacucuuuacuauga

SEQ ID NO: 1023910 - RNA, 19 nt, Homo sapiens
caaaguaaauccagaugaa

SEQ ID NO: 1023911 - RNA, 19 nt, Homo sapiens
guaguaugcuuaagagaaa

SEQ ID NO: 1023912 - RNA, 19 nt, Homo sapiens
cgucggagaucuuauauug

SEQ ID NO: 1023913 - RNA, 19 nt, Homo sapiens
cauaguaucuucacugugu

SEQ ID NO: 1023914 - RNA, 19 nt, Homo sapiens
aaauagagcugaggucaaa

SEQ ID NO: 1023915 - RNA, 19 nt, Homo sapiens
gcuaagaaguuaaaggaau

SEQ ID NO: 1023916 - RNA, 19 nt, Homo sapiens
uaaagauggugguguuauu

SEQ ID NO: 1023917 - RNA, 19 nt, Homo sapiens
gaagaaacaacccaucguu

SEQ ID NO: 1023918 - RNA, 19 nt, Homo sapiens
ggaaagucaucaggagaaa

SEQ ID NO: 1023919 - RNA, 19 nt, Homo sapiens
cgaagaggauuaugaugug

SEQ ID NO: 1023920 - RNA, 19 nt, Homo sapiens
uaauacccaugcuuuguuu

SEQ ID NO: 1023921 - RNA, 19 nt, Homo sapiens
gucaaaggcuggaaaguca

SEQ ID NO: 1023922 - RNA, 19 nt, Homo sapiens
ggaauucgagauauugauu

SEQ ID NO: 1023923 - RNA, 19 nt, Homo sapiens
gaaacaacccaucguucuu

SEQ ID NO: 1023924 - RNA, 19 nt, Homo sapiens
caaacgaagaggauuauga

SEQ ID NO: 1023925 - RNA, 19 nt, Homo sapiens
ggucucaccauuacagaua

SEQ ID NO: 1023926 - RNA, 19 nt, Homo sapiens
aggaggaacucuuuacuau

SEQ ID NO: 1023927 - RNA, 19 nt, Homo sapiens
gaguauuucucgacagaug

SEQ ID NO: 1023928 - RNA, 19 nt, Homo sapiens
gcacuugacgaaacucuug

SEQ ID NO: 1023929 - RNA, 19 nt, Homo sapiens
ggaagaagaaggccaaguc

SEQ ID NO: 1023930 - RNA, 19 nt, Homo sapiens
acuaugauguugcuaagaa

SEQ ID NO: 1023931 - RNA, 19 nt, Homo sapiens
caugggaauucgagauauu

SEQ ID NO: 1023932 - RNA, 19 nt, Homo sapiens
gaaauagagcugaggucaa

SEQ ID NO: 1023933 - RNA, 19 nt, Homo sapiens
gauguaguaugcuuaagag

SEQ ID NO: 1023934 - RNA, 19 nt, Homo sapiens
gaagaggauuaugaugugu

SEQ ID NO: 1023935 - RNA, 19 nt, Homo sapiens
cgaaacucuuggagacuuu

SEQ ID NO: 1023936 - RNA, 19 nt, Homo sapiens
ugauguugcuaagaaguua

SEQ ID NO: 1023937 - RNA, 19 nt, Homo sapiens
cauauuugcccaugugaaa

SEQ ID NO: 1023938 - RNA, 19 nt, Homo sapiens
ugauuuaccucauaguauc

SEQ ID NO: 1023939 - RNA, 19 nt, Homo sapiens
aaacaacccaucguucuuu

SEQ ID NO: 1023940 - RNA, 19 nt, Homo sapiens
ggacaaaguaaauccagau

SEQ ID NO: 1023941 - RNA, 19 nt, Homo sapiens
ccaaagcaaaggcaauuga

SEQ ID NO: 1023942 - RNA, 19 nt, Homo sapiens
ggacuagaagauuucauau

SEQ ID NO: 1023943 - RNA, 19 nt, Homo sapiens
aaacuaggauuggaguaug

SEQ ID NO: 1023944 - RNA, 19 nt, Homo sapiens
gagaaaugaccuaaauaag

SEQ ID NO: 1023945 - RNA, 19 nt, Homo sapiens
gcacuuuaaacacaccuaa

SEQ ID NO: 1023946 - RNA, 19 nt, Homo sapiens
gaaaugccuucugaaacca

SEQ ID NO: 1023947 - RNA, 19 nt, Homo sapiens
aauuaaagauggugguguu

SEQ ID NO: 1023948 - RNA, 19 nt, Homo sapiens
ggaaaggacaaaguaaauc

SEQ ID NO: 1023949 - RNA, 19 nt, Homo sapiens
caaagcaaaggcaauugaa

SEQ ID NO: 1023950 - RNA, 19 nt, Homo sapiens
ucggagaucuuauauugca

SEQ ID NO: 1023951 - RNA, 19 nt, Homo sapiens
ccauuaauacccaugcuuu

SEQ ID NO: 1023952 - RNA, 19 nt, Homo sapiens
agaaaugaccuaaauaagg

SEQ ID NO: 1023953 - RNA, 19 nt, Homo sapiens
ccuaagaaggcauuugaaa

SEQ ID NO: 1023954 - RNA, 19 nt, Homo sapiens
ggacaccuuuacuaacucu

SEQ ID NO: 1023955 - RNA, 19 nt, Homo sapiens
aaacgaagaggauuaugau

SEQ ID NO: 1023956 - RNA, 19 nt, Homo sapiens
ggaggaacucuuuacuaug

SEQ ID NO: 1023957 - RNA, 19 nt, Homo sapiens
guuaauagaaccuaagaag

SEQ ID NO: 1023958 - RNA, 19 nt, Homo sapiens
aggauuggaguaugauuua

SEQ ID NO: 1023959 - RNA, 19 nt, Homo sapiens
gcugauguaguaugcuuaa

SEQ ID NO: 1023960 - RNA, 19 nt, Homo sapiens
ugaauuugcuguggcacuu

SEQ ID NO: 1023961 - RNA, 19 nt, Homo sapiens
uugaugauguucuugaguu

SEQ ID NO: 1023962 - RNA, 19 nt, Homo sapiens
caaaggcaauugaaaagau

SEQ ID NO: 1023963 - RNA, 19 nt, Homo sapiens
gguguuauugacucaguua

SEQ ID NO: 1023964 - RNA, 19 nt, Homo sapiens
gaaaggacaaaguaaaucc

SEQ ID NO: 1023965 - RNA, 19 nt, Homo sapiens
ggaacucuuuacuaugaag

SEQ ID NO: 1023966 - RNA, 19 nt, Homo sapiens
cuccaucucugaagaaaca

SEQ ID NO: 1023967 - RNA, 19 nt, Homo sapiens
agaagaaggccaaguccaa

SEQ ID NO: 1023968 - RNA, 19 nt, Homo sapiens
acacuucgccugagaucaa

SEQ ID NO: 1023969 - RNA, 19 nt, Homo sapiens
ggcaacacuucgccugaga

SEQ ID NO: 1023970 - RNA, 19 nt, Homo sapiens
ggucaaaggcuggaaaguc

SEQ ID NO: 1023971 - RNA, 19 nt, Homo sapiens
gguguuggcuaugcuuuua

SEQ ID NO: 1023972 - RNA, 19 nt, Homo sapiens
uaaacuaggauuggaguau

SEQ ID NO: 1023973 - RNA, 19 nt, Homo sapiens
gaaccuaagaaggcauuug

SEQ ID NO: 1023974 - RNA, 19 nt, Homo sapiens
gaaguuaauagaaccuaag

SEQ ID NO: 1023975 - RNA, 19 nt, Homo sapiens
gcuggaaaggacaaaguaa

SEQ ID NO: 1023976 - RNA, 19 nt, Homo sapiens
ugauuuagccaccacaaug

SEQ ID NO: 1023977 - RNA, 19 nt, Homo sapiens
gugaauguguauaaaucug

SEQ ID NO: 1023978 - RNA, 19 nt, Homo sapiens
ucacuaugauguugcuaag

SEQ ID NO: 1023979 - RNA, 19 nt, Homo sapiens
aaauugacauggaaagacu

SEQ ID NO: 1023980 - RNA, 19 nt, Homo sapiens
cgaauuugucuuugauguu

SEQ ID NO: 1023981 - RNA, 19 nt, Homo sapiens
uacaugggaauucgagaua

SEQ ID NO: 1023982 - RNA, 19 nt, Homo sapiens
agauaaugguguuggcuau

SEQ ID NO: 1023983 - RNA, 19 nt, Homo sapiens
uguaguaugcuuaagagaa

SEQ ID NO: 1023984 - RNA, 19 nt, Homo sapiens
gauuuagccaccacaaugu

SEQ ID NO: 1023985 - RNA, 19 nt, Homo sapiens
guacaugggaauucgagau

SEQ ID NO: 1023986 - RNA, 19 nt, Homo sapiens
augauguucuugaguugua

SEQ ID NO: 1023987 - RNA, 19 nt, Homo sapiens
ugaugauguucuugaguug

SEQ ID NO: 1023988 - RNA, 19 nt, Homo sapiens
aaagcaaaggcaauugaaa

SEQ ID NO: 1023989 - RNA, 19 nt, Homo sapiens
aggacuagaagauuucaua

SEQ ID NO: 1023990 - RNA, 19 nt, Homo sapiens
gaugauuucaauagcuuug

SEQ ID NO: 1023991 - RNA, 19 nt, Homo sapiens
gagaucuuauauugcacuu

SEQ ID NO: 1023992 - RNA, 19 nt, Homo sapiens
uaggauuggaguaugauuu

SEQ ID NO: 1023993 - RNA, 19 nt, Homo sapiens
aggaguauuucucgacaga

SEQ ID NO: 1023994 - RNA, 19 nt, Homo sapiens
uggaaaggacaaaguaaau

SEQ ID NO: 1023995 - RNA, 19 nt, Homo sapiens
aaggaggaacucuuuacua

SEQ ID NO: 1023996 - RNA, 19 nt, Homo sapiens
uuaauacccaugcuuuguu

SEQ ID NO: 1023997 - RNA, 19 nt, Homo sapiens
ccuaaauaaggaucaauug

SEQ ID NO: 1023998 - RNA, 19 nt, Homo sapiens
ugauguaguaugcuuaaga

SEQ ID NO: 1023999 - RNA, 19 nt, Homo sapiens
acucuuaggaggacaacua

SEQ ID NO: 1024000 - RNA, 19 nt, Homo sapiens
aaagauggugguguuauug

SEQ ID NO: 1024001 - RNA, 19 nt, Homo sapiens
gauugaugauguucuugag

SEQ ID NO: 1024002 - RNA, 19 nt, Homo sapiens
caugugaaaggaaucgaaa

SEQ ID NO: 1024003 - RNA, 19 nt, Homo sapiens
ugccaaacgaagaggauua

SEQ ID NO: 1024004 - RNA, 19 nt, Homo sapiens
acaaaguaaauccagauga

SEQ ID NO: 1024005 - RNA, 19 nt, Homo sapiens
uuucauauuugcccaugug

SEQ ID NO: 1024006 - RNA, 19 nt, Homo sapiens
ugaccuaaauaaggaucaa

SEQ ID NO: 1024007 - RNA, 19 nt, Homo sapiens
acgaagaggauuaugaugu

SEQ ID NO: 1024008 - RNA, 19 nt, Homo sapiens
ccaaauggcuuagaaauua

SEQ ID NO: 1024009 - RNA, 19 nt, Homo sapiens
ggaccaaggugaaauuaaa

SEQ ID NO: 1024010 - RNA, 19 nt, Homo sapiens
ggacaggcauaagaaauua

SEQ ID NO: 1024011 - RNA, 19 nt, Homo sapiens
ggaagauccuuuagaaauu

SEQ ID NO: 1024012 - RNA, 19 nt, Homo sapiens
aaacacacaugcuguauaa

SEQ ID NO: 1024013 - RNA, 19 nt, Homo sapiens
gaagcucucucuaaauauu

SEQ ID NO: 1024014 - RNA, 19 nt, Homo sapiens
gaauggagauugccuguau

SEQ ID NO: 1024015 - RNA, 19 nt, Homo sapiens
gacaggcucuggcuuguua

SEQ ID NO: 1024016 - RNA, 19 nt, Homo sapiens
gugcaaagaucaucagauu

SEQ ID NO: 1024017 - RNA, 19 nt, Homo sapiens
ggagagaaguccuuugaau

SEQ ID NO: 1024018 - RNA, 19 nt, Homo sapiens
gaaauaaagggacagagua

SEQ ID NO: 1024019 - RNA, 19 nt, Homo sapiens
gcacaaaucacucaugcua

SEQ ID NO: 1024020 - RNA, 19 nt, Homo sapiens
gaauacaacaucaugguua

SEQ ID NO: 1024021 - RNA, 19 nt, Homo sapiens
gaagagaaauguggcuuug

SEQ ID NO: 1024022 - RNA, 19 nt, Homo sapiens
gggaaauccuucacuaauu

SEQ ID NO: 1024023 - RNA, 19 nt, Homo sapiens
gaaaugauguggugaugca

SEQ ID NO: 1024024 - RNA, 19 nt, Homo sapiens
gauuguagaucagcuauaa

SEQ ID NO: 1024025 - RNA, 19 nt, Homo sapiens
gagaaacccuaucagugua

SEQ ID NO: 1024026 - RNA, 19 nt, Homo sapiens
uaagauggcugauauaguc

SEQ ID NO: 1024027 - RNA, 19 nt, Homo sapiens
agaaauuccucauccuuua

SEQ ID NO: 1024028 - RNA, 19 nt, Homo sapiens
gagagaagccuuaugaaug

SEQ ID NO: 1024029 - RNA, 19 nt, Homo sapiens
ggcagugucucuuauagua

SEQ ID NO: 1024030 - RNA, 19 nt, Homo sapiens
gcaaagaucaucagauuag

SEQ ID NO: 1024031 - RNA, 19 nt, Homo sapiens
ggagaaauacuaugaaugu

SEQ ID NO: 1024032 - RNA, 19 nt, Homo sapiens
agacaaagacacagaaaua

SEQ ID NO: 1024033 - RNA, 19 nt, Homo sapiens
caagauaugugggaaagaa

SEQ ID NO: 1024034 - RNA, 19 nt, Homo sapiens
ggaaaagucuucaccuuaa

SEQ ID NO: 1024035 - RNA, 19 nt, Homo sapiens
ucacagacaucaaguacuu

SEQ ID NO: 1024036 - RNA, 19 nt, Homo sapiens
gcaccuagcucaugauggu

SEQ ID NO: 1024037 - RNA, 19 nt, Homo sapiens
ucagccaacuugagaaaua

SEQ ID NO: 1024038 - RNA, 19 nt, Homo sapiens
cgaugaagcucucucuaaa

SEQ ID NO: 1024039 - RNA, 19 nt, Homo sapiens
ucacagugcugcagagauu

SEQ ID NO: 1024040 - RNA, 19 nt, Homo sapiens
ggagugaaaccauccauaa

SEQ ID NO: 1024041 - RNA, 19 nt, Homo sapiens
gaagauccuuuagaaauuc

SEQ ID NO: 1024042 - RNA, 19 nt, Homo sapiens
gaagacaacccuacgaaug

SEQ ID NO: 1024043 - RNA, 19 nt, Homo sapiens
ucaaguacuuuacaaggua

SEQ ID NO: 1024044 - RNA, 19 nt, Homo sapiens
acaaaucacucaugcuauu

SEQ ID NO: 1024045 - RNA, 19 nt, Homo sapiens
gaucauagcauuaacaagu

SEQ ID NO: 1024046 - RNA, 19 nt, Homo sapiens
caacucaccuuacucaaca

SEQ ID NO: 1024047 - RNA, 19 nt, Homo sapiens
gagaaguccuuugaaugua

SEQ ID NO: 1024048 - RNA, 19 nt, Homo sapiens
gaugguaccuaauaaauac

SEQ ID NO: 1024049 - RNA, 19 nt, Homo sapiens
gcaccauugucauugauaa

SEQ ID NO: 1024050 - RNA, 19 nt, Homo sapiens
ggugagauaugcacucuau

SEQ ID NO: 1024051 - RNA, 19 nt, Homo sapiens
aagguuaucucucuuguuu

SEQ ID NO: 1024052 - RNA, 19 nt, Homo sapiens
gggaaagccuucacuagau

SEQ ID NO: 1024053 - RNA, 19 nt, Homo sapiens
ggucagaauuuaagguuau

SEQ ID NO: 1024054 - RNA, 19 nt, Homo sapiens
guggagaggucuucaguga

SEQ ID NO: 1024055 - RNA, 19 nt, Homo sapiens
gaauuuccucuuccuaaua

SEQ ID NO: 1024056 - RNA, 19 nt, Homo sapiens
augaagcucucucuaaaua

SEQ ID NO: 1024057 - RNA, 19 nt, Homo sapiens
gaaagguaaaugcaagaua

SEQ ID NO: 1024058 - RNA, 19 nt, Homo sapiens
gaauguggaagauccuuua

SEQ ID NO: 1024059 - RNA, 19 nt, Homo sapiens
ugacaggauugagagauua

SEQ ID NO: 1024060 - RNA, 19 nt, Homo sapiens
cgauggagaccaacaaaua

SEQ ID NO: 1024061 - RNA, 19 nt, Homo sapiens
gauggaaacucugugagaa

SEQ ID NO: 1024062 - RNA, 19 nt, Homo sapiens
agagaagccuuaugaaugu

SEQ ID NO: 1024063 - RNA, 19 nt, Homo sapiens
ggaaagccuucacuagauc

SEQ ID NO: 1024064 - RNA, 19 nt, Homo sapiens
gaaauuccucauccuuuaa

SEQ ID NO: 1024065 - RNA, 19 nt, Homo sapiens
cacacaugcuguauaauuu

SEQ ID NO: 1024066 - RNA, 19 nt, Homo sapiens
uguaagcacucaggaauaa

SEQ ID NO: 1024067 - RNA, 19 nt, Homo sapiens
ggauugagagauuaaagua

SEQ ID NO: 1024068 - RNA, 19 nt, Homo sapiens
ggaaugccuugagcaguuu

SEQ ID NO: 1024069 - RNA, 19 nt, Homo sapiens
cuagaggaauuaagacaaa

SEQ ID NO: 1024070 - RNA, 19 nt, Homo sapiens
ugaguguuguuaccauuua

SEQ ID NO: 1024071 - RNA, 19 nt, Homo sapiens
ggagagaagccuuaugaau

SEQ ID NO: 1024072 - RNA, 19 nt, Homo sapiens
gaaguccuuugaauguaaa

SEQ ID NO: 1024073 - RNA, 19 nt, Homo sapiens
caaggaagccucuauugga

SEQ ID NO: 1024074 - RNA, 19 nt, Homo sapiens
gaggguaauuguuauggaa

SEQ ID NO: 1024075 - RNA, 19 nt, Homo sapiens
gaguuugucccacauauuu

SEQ ID NO: 1024076 - RNA, 19 nt, Homo sapiens
gcucuuuccucaugccuaa

SEQ ID NO: 1024077 - RNA, 19 nt, Homo sapiens
gggagagccuucaauagau

SEQ ID NO: 1024078 - RNA, 19 nt, Homo sapiens
gaucaacuggucugacuaa

SEQ ID NO: 1024079 - RNA, 19 nt, Homo sapiens
gggagggagugugcaaaua

SEQ ID NO: 1024080 - RNA, 19 nt, Homo sapiens
caaagacacagaaauauag

SEQ ID NO: 1024081 - RNA, 19 nt, Homo sapiens
gagcaugucaggagugaaa

SEQ ID NO: 1024082 - RNA, 19 nt, Homo sapiens
gcacaaggaagccucuauu

SEQ ID NO: 1024083 - RNA, 19 nt, Homo sapiens
agagaaauguggcuuuguu

SEQ ID NO: 1024084 - RNA, 19 nt, Homo sapiens
ucacauagguucuuuucua

SEQ ID NO: 1024085 - RNA, 19 nt, Homo sapiens
ugagauaugcacucuauuu

SEQ ID NO: 1024086 - RNA, 19 nt, Homo sapiens
ccgagggucugaaauuaaa

SEQ ID NO: 1024087 - RNA, 19 nt, Homo sapiens
gggccuugcuauacacaua

SEQ ID NO: 1024088 - RNA, 19 nt, Homo sapiens
gaacucacacuggaauaaa

SEQ ID NO: 1024089 - RNA, 19 nt, Homo sapiens
gugcccagauuucauauug

SEQ ID NO: 1024090 - RNA, 19 nt, Homo sapiens
gaauaccgcagaccaaaug

SEQ ID NO: 1024091 - RNA, 19 nt, Homo sapiens
gaauaacccuuaccaaccu

SEQ ID NO: 1024092 - RNA, 19 nt, Homo sapiens
ccacacaaauguacggaau

SEQ ID NO: 1024093 - RNA, 19 nt, Homo sapiens
agaaguccuuugaauguaa

SEQ ID NO: 1024094 - RNA, 19 nt, Homo sapiens
gaaacucugugagaauugu

SEQ ID NO: 1024095 - RNA, 19 nt, Homo sapiens
ggagugcaaugguaugauc

SEQ ID NO: 1024096 - RNA, 19 nt, Homo sapiens
uaagaagugugacaaccuu

SEQ ID NO: 1024097 - RNA, 19 nt, Homo sapiens
uuucacagcugauuauuuc

SEQ ID NO: 1024098 - RNA, 19 nt, Homo sapiens
guauccaccuagauucaua

SEQ ID NO: 1024099 - RNA, 19 nt, Homo sapiens
gaugucagccuuugauaug

SEQ ID NO: 1024100 - RNA, 19 nt, Homo sapiens
acaagaagcuacaguggau

SEQ ID NO: 1024101 - RNA, 19 nt, Homo sapiens
guaaagacaggcauaggaa

SEQ ID NO: 1024102 - RNA, 19 nt, Homo sapiens
ucacuucucaguaccaaua

SEQ ID NO: 1024103 - RNA, 19 nt, Homo sapiens
ccaagguucucuucuguuc

SEQ ID NO: 1024104 - RNA, 19 nt, Homo sapiens
ggagagccuucaauagauc

SEQ ID NO: 1024105 - RNA, 19 nt, Homo sapiens
guacacgggccuugcuaua

SEQ ID NO: 1024106 - RNA, 19 nt, Homo sapiens
uguggaagauccuuuagaa

SEQ ID NO: 1024107 - RNA, 19 nt, Homo sapiens
gagagaaguccuuugaaug

SEQ ID NO: 1024108 - RNA, 19 nt, Homo sapiens
ggaaagaccaggaaauuua

SEQ ID NO: 1024109 - RNA, 19 nt, Homo sapiens
caaagugacugaugcauuu

SEQ ID NO: 1024110 - RNA, 19 nt, Homo sapiens
ggacugagcuacaggauau

SEQ ID NO: 1024111 - RNA, 19 nt, Homo sapiens
gcaaugauaucaaugaaga

SEQ ID NO: 1024112 - RNA, 19 nt, Homo sapiens
ggagcaagguguaaauuaa

SEQ ID NO: 1024113 - RNA, 19 nt, Homo sapiens
gaaagcaacugaacaaugg

SEQ ID NO: 1024114 - RNA, 19 nt, Homo sapiens
ggacaucacugcugaacuu

SEQ ID NO: 1024115 - RNA, 19 nt, Homo sapiens
ggaauuuacuuguuacuga

SEQ ID NO: 1024116 - RNA, 19 nt, Homo sapiens
gaaauagaaugugcaguuu

SEQ ID NO: 1024117 - RNA, 19 nt, Homo sapiens
gagaagagcaccuaaguga

SEQ ID NO: 1024118 - RNA, 19 nt, Homo sapiens
ucaaugaacugaauucugu

SEQ ID NO: 1024119 - RNA, 19 nt, Homo sapiens
gcacugaaccuguugcaaa

SEQ ID NO: 1024120 - RNA, 19 nt, Homo sapiens
guaaugacuuugugacuug

SEQ ID NO: 1024121 - RNA, 19 nt, Homo sapiens
gaaagaccaggaaauuuaa

SEQ ID NO: 1024122 - RNA, 19 nt, Homo sapiens
gaugugaauuggacaguuu

SEQ ID NO: 1024123 - RNA, 19 nt, Homo sapiens
gaagcagccuguuauagug

SEQ ID NO: 1024124 - RNA, 19 nt, Homo sapiens
caauguagcugauucaaag

SEQ ID NO: 1024125 - RNA, 19 nt, Homo sapiens
uuaaagagauugugucugu

SEQ ID NO: 1024126 - RNA, 19 nt, Homo sapiens
gcaagaaggugagauugga

SEQ ID NO: 1024127 - RNA, 19 nt, Homo sapiens
gguagaagcuuggauaaca

SEQ ID NO: 1024128 - RNA, 19 nt, Homo sapiens
gagaaggaccaaauuauau

SEQ ID NO: 1024129 - RNA, 19 nt, Homo sapiens
ucagagcacuuuccacauu

SEQ ID NO: 1024130 - RNA, 19 nt, Homo sapiens
gagcagaggaugaugauga

SEQ ID NO: 1024131 - RNA, 19 nt, Homo sapiens
ggauauaaaugcuguuucu

SEQ ID NO: 1024132 - RNA, 19 nt, Homo sapiens
agacucagcugauaauuca

SEQ ID NO: 1024133 - RNA, 19 nt, Homo sapiens
agagagacauguagaagaa

SEQ ID NO: 1024134 - RNA, 19 nt, Homo sapiens
gaaauccccuucagucuuu

SEQ ID NO: 1024135 - RNA, 19 nt, Homo sapiens
gaacacauguacaucugau

SEQ ID NO: 1024136 - RNA, 19 nt, Homo sapiens
gagcagagacagaauguug

SEQ ID NO: 1024137 - RNA, 19 nt, Homo sapiens
ggaugauucuuuaagugua

SEQ ID NO: 1024138 - RNA, 19 nt, Homo sapiens
gcacuaaccauucgggaaa

SEQ ID NO: 1024139 - RNA, 19 nt, Homo sapiens
ccaagaggagacaauauua

SEQ ID NO: 1024140 - RNA, 19 nt, Homo sapiens
ugaaccaggugaugacuuu

SEQ ID NO: 1024141 - RNA, 19 nt, Homo sapiens
gaaaggacagucugauguu

SEQ ID NO: 1024142 - RNA, 19 nt, Homo sapiens
gcacauggcuugagauacc

SEQ ID NO: 1024143 - RNA, 19 nt, Homo sapiens
gagauugugucuguuuaaa

SEQ ID NO: 1024144 - RNA, 19 nt, Homo sapiens
ggaaucagccacuucaguu

SEQ ID NO: 1024145 - RNA, 19 nt, Homo sapiens
gcacugaguauaauuuaga

SEQ ID NO: 1024146 - RNA, 19 nt, Homo sapiens
ggaccaaauuauaugaaug

SEQ ID NO: 1024147 - RNA, 19 nt, Homo sapiens
gaagagcaccuaagugaag

SEQ ID NO: 1024148 - RNA, 19 nt, Homo sapiens
agagaggccuuaccugaaa

SEQ ID NO: 1024149 - RNA, 19 nt, Homo sapiens
acaagcacuuugccaauaa

SEQ ID NO: 1024150 - RNA, 19 nt, Homo sapiens
gaaugucaauuggcaagaa

SEQ ID NO: 1024151 - RNA, 19 nt, Homo sapiens
gaaaggauacaauuagaag

SEQ ID NO: 1024152 - RNA, 19 nt, Homo sapiens
agagaaggaccaaauuaua

SEQ ID NO: 1024153 - RNA, 19 nt, Homo sapiens
ucagagaaggaccaaauua

SEQ ID NO: 1024154 - RNA, 19 nt, Homo sapiens
gcaagaaaaucuaguggaa

SEQ ID NO: 1024155 - RNA, 19 nt, Homo sapiens
caagaggagacaauauuaa

SEQ ID NO: 1024156 - RNA, 19 nt, Homo sapiens
uaaaugugcucaccuaugc

SEQ ID NO: 1024157 - RNA, 19 nt, Homo sapiens
ggaaaggauacaauuagaa

SEQ ID NO: 1024158 - RNA, 19 nt, Homo sapiens
aaacucaaaucuucacugu

SEQ ID NO: 1024159 - RNA, 19 nt, Homo sapiens
gcagacggauaacugaugu

SEQ ID NO: 1024160 - RNA, 19 nt, Homo sapiens
acaagcacaucuaccagua

SEQ ID NO: 1024161 - RNA, 19 nt, Homo sapiens
gagaagacaagcacaucua

SEQ ID NO: 1024162 - RNA, 19 nt, Homo sapiens
caccagauaugaacacaug

SEQ ID NO: 1024163 - RNA, 19 nt, Homo sapiens
caggaugacugcaaugguu

SEQ ID NO: 1024164 - RNA, 19 nt, Homo sapiens
guagaagcuuggauaacaa

SEQ ID NO: 1024165 - RNA, 19 nt, Homo sapiens
gaaggaccaaauuauauga

SEQ ID NO: 1024166 - RNA, 19 nt, Homo sapiens
ggaugaugaugaugaugaa

SEQ ID NO: 1024167 - RNA, 19 nt, Homo sapiens
guucagacagcuuuauuaa

SEQ ID NO: 1024168 - RNA, 19 nt, Homo sapiens
uaacaaagucagaccuaaa

SEQ ID NO: 1024169 - RNA, 19 nt, Homo sapiens
gaaguggcuuuggguagaa

SEQ ID NO: 1024170 - RNA, 19 nt, Homo sapiens
guagauagccuuacaagcu

SEQ ID NO: 1024171 - RNA, 19 nt, Homo sapiens
ggaagccucuuagcacuca

SEQ ID NO: 1024172 - RNA, 19 nt, Homo sapiens
ggaguuguaugaguuaaca

SEQ ID NO: 1024173 - RNA, 19 nt, Homo sapiens
gagagaggccuuaccugaa

SEQ ID NO: 1024174 - RNA, 19 nt, Homo sapiens
ugccaaauauucaggauga

SEQ ID NO: 1024175 - RNA, 19 nt, Homo sapiens
cagagcacuuuccacauuu

SEQ ID NO: 1024176 - RNA, 19 nt, Homo sapiens
uauaggguauggaucauug

SEQ ID NO: 1024177 - RNA, 19 nt, Homo sapiens
cuagaaagguauacauagu

SEQ ID NO: 1024178 - RNA, 19 nt, Homo sapiens
ggacaguuucuauugcuuu

SEQ ID NO: 1024179 - RNA, 19 nt, Homo sapiens
gaauuggacaguuucuauu

SEQ ID NO: 1024180 - RNA, 19 nt, Homo sapiens
ggauaacugaugugaauug

SEQ ID NO: 1024181 - RNA, 19 nt, Homo sapiens
gcaccuaagugaagaagcu

SEQ ID NO: 1024182 - RNA, 19 nt, Homo sapiens
gauaugaacacauguacau

SEQ ID NO: 1024183 - RNA, 19 nt, Homo sapiens
uaagaagcagccuguuaua

SEQ ID NO: 1024184 - RNA, 19 nt, Homo sapiens
aauaagaagcagccuguua

SEQ ID NO: 1024185 - RNA, 19 nt, Homo sapiens
ggaauagacacccgaaaca

SEQ ID NO: 1024186 - RNA, 19 nt, Homo sapiens
gaggagacaauauuaacaa

SEQ ID NO: 1024187 - RNA, 19 nt, Homo sapiens
gcauaccugcucuaauuaa

SEQ ID NO: 1024188 - RNA, 19 nt, Homo sapiens
uccacaagcucucaagaaa

SEQ ID NO: 1024189 - RNA, 19 nt, Homo sapiens
gauguucccagccacguua

SEQ ID NO: 1024190 - RNA, 19 nt, Homo sapiens
aacaagcacuuugccaaua

SEQ ID NO: 1024191 - RNA, 19 nt, Homo sapiens
ucaagacucugaugauuuu

SEQ ID NO: 1024192 - RNA, 19 nt, Homo sapiens
guguaggguuuguugauuu

SEQ ID NO: 1024193 - RNA, 19 nt, Homo sapiens
gcucaccuaugcauggauu

SEQ ID NO: 1024194 - RNA, 19 nt, Homo sapiens
gagaggaucagguuugugu

SEQ ID NO: 1024195 - RNA, 19 nt, Homo sapiens
gagaagcacuaaccauucg

SEQ ID NO: 1024196 - RNA, 19 nt, Homo sapiens
agaaauagaaugugcaguu

SEQ ID NO: 1024197 - RNA, 19 nt, Homo sapiens
gccaagaggagacaauauu

SEQ ID NO: 1024198 - RNA, 19 nt, Homo sapiens
ugaugacuuuggagaauuu

SEQ ID NO: 1024199 - RNA, 19 nt, Homo sapiens
gaggaucagguuuguguuu

SEQ ID NO: 1024200 - RNA, 19 nt, Homo sapiens
cauaccugcucuaauuaaa

SEQ ID NO: 1024201 - RNA, 19 nt, Homo sapiens
caagcacuuugccaauaaa

SEQ ID NO: 1024202 - RNA, 19 nt, Homo sapiens
gguguaggguuuguugauu

SEQ ID NO: 1024203 - RNA, 19 nt, Homo sapiens
aaggugagauuggacauuu

SEQ ID NO: 1024204 - RNA, 19 nt, Homo sapiens
ggugaugacuuuggagaau

SEQ ID NO: 1024205 - RNA, 19 nt, Homo sapiens
uagauagccuuacaagcuu

SEQ ID NO: 1024206 - RNA, 19 nt, Homo sapiens
acucaaaucuucacugucu

SEQ ID NO: 1024207 - RNA, 19 nt, Homo sapiens
aaguucagcugauuuguug

SEQ ID NO: 1024208 - RNA, 19 nt, Homo sapiens
cuacaugccugcuaacuua

SEQ ID NO: 1024209 - RNA, 19 nt, Homo sapiens
ggaauggguuugaaugaaa

SEQ ID NO: 1024210 - RNA, 19 nt, Homo sapiens
gaaauacuuagcacaguua

SEQ ID NO: 1024211 - RNA, 19 nt, Homo sapiens
gaacagugagguugaguuu

SEQ ID NO: 1024212 - RNA, 19 nt, Homo sapiens
gaauguagcuaccgaagag

SEQ ID NO: 1024213 - RNA, 19 nt, Homo sapiens
gagacaagccugggcauua

SEQ ID NO: 1024214 - RNA, 19 nt, Homo sapiens
caaguaugauguacaagaa

SEQ ID NO: 1024215 - RNA, 19 nt, Homo sapiens
ggaaccauuuacauguuua

SEQ ID NO: 1024216 - RNA, 19 nt, Homo sapiens
uagaagcgcuaccaaagaa

SEQ ID NO: 1024217 - RNA, 19 nt, Homo sapiens
gcaaaccuacuccagauaa

SEQ ID NO: 1024218 - RNA, 19 nt, Homo sapiens
acuaaacaguguacgauua

SEQ ID NO: 1024219 - RNA, 19 nt, Homo sapiens
ugacuuggaugaaauuguu

SEQ ID NO: 1024220 - RNA, 19 nt, Homo sapiens
ccgaguaggugauguuaaa

SEQ ID NO: 1024221 - RNA, 19 nt, Homo sapiens
ggacaggaauggguuugaa

SEQ ID NO: 1024222 - RNA, 19 nt, Homo sapiens
gcaaagaagagaacuagga

SEQ ID NO: 1024223 - RNA, 19 nt, Homo sapiens
gaaugaagcccuaaaguac

SEQ ID NO: 1024224 - RNA, 19 nt, Homo sapiens
gaagauagcaaagaagaga

SEQ ID NO: 1024225 - RNA, 19 nt, Homo sapiens
auagaaggcuuuccuaaau

SEQ ID NO: 1024226 - RNA, 19 nt, Homo sapiens
ugaaugaagcccuaaagua

SEQ ID NO: 1024227 - RNA, 19 nt, Homo sapiens
cuacuuaacucugccauug

SEQ ID NO: 1024228 - RNA, 19 nt, Homo sapiens
agggaaaucuggacucuuu

SEQ ID NO: 1024229 - RNA, 19 nt, Homo sapiens
ugacaucauucuccgagua

SEQ ID NO: 1024230 - RNA, 19 nt, Homo sapiens
gagauccuguccuuacaaa

SEQ ID NO: 1024231 - RNA, 19 nt, Homo sapiens
cgaccuacaugccugcuaa

SEQ ID NO: 1024232 - RNA, 19 nt, Homo sapiens
uacaagaacgccagaaaua

SEQ ID NO: 1024233 - RNA, 19 nt, Homo sapiens
ccacuugcauucugaacaa

SEQ ID NO: 1024234 - RNA, 19 nt, Homo sapiens
gagcagccauagauaauac

SEQ ID NO: 1024235 - RNA, 19 nt, Homo sapiens
cauagacucucccaucaga

SEQ ID NO: 1024236 - RNA, 19 nt, Homo sapiens
guauuggaauuucucguuu

SEQ ID NO: 1024237 - RNA, 19 nt, Homo sapiens
ccaauaacuuagauuagga

SEQ ID NO: 1024238 - RNA, 19 nt, Homo sapiens
uaaccugggugacagaaug

SEQ ID NO: 1024239 - RNA, 19 nt, Homo sapiens
gauaaaacuuguccugaaa

SEQ ID NO: 1024240 - RNA, 19 nt, Homo sapiens
ccacaucagaagagauuua

SEQ ID NO: 1024241 - RNA, 19 nt, Homo sapiens
gcauuagagucuuggauca

SEQ ID NO: 1024242 - RNA, 19 nt, Homo sapiens
caaaccuacuccagauaaa

SEQ ID NO: 1024243 - RNA, 19 nt, Homo sapiens
cagcaaaccuacuccagau

SEQ ID NO: 1024244 - RNA, 19 nt, Homo sapiens
acagugagguugaguuuca

SEQ ID NO: 1024245 - RNA, 19 nt, Homo sapiens
cgaacucugugacaucauu

SEQ ID NO: 1024246 - RNA, 19 nt, Homo sapiens
gcagugagcuaugaaugca

SEQ ID NO: 1024247 - RNA, 19 nt, Homo sapiens
uagauaggauugcuucaug

SEQ ID NO: 1024248 - RNA, 19 nt, Homo sapiens
agaaggcuuuccuaaauga

SEQ ID NO: 1024249 - RNA, 19 nt, Homo sapiens
ggcagccacuaaauacaua

SEQ ID NO: 1024250 - RNA, 19 nt, Homo sapiens
gaaaacaguucacuagaag

SEQ ID NO: 1024251 - RNA, 19 nt, Homo sapiens
caaagaagagaacuaggaa

SEQ ID NO: 1024252 - RNA, 19 nt, Homo sapiens
ucgcugugcucccaaagua

SEQ ID NO: 1024253 - RNA, 19 nt, Homo sapiens
gugaugaucgcacuuguaa

SEQ ID NO: 1024254 - RNA, 19 nt, Homo sapiens
cugcagggcuugaaucuuc

SEQ ID NO: 1024255 - RNA, 19 nt, Homo sapiens
aauggcaacugauaaauuc

SEQ ID NO: 1024256 - RNA, 19 nt, Homo sapiens
guagauugcuuuucccuuu

SEQ ID NO: 1024257 - RNA, 19 nt, Homo sapiens
gaccacaucagaagagauu

SEQ ID NO: 1024258 - RNA, 19 nt, Homo sapiens
agaaauacuuagcacaguu

SEQ ID NO: 1024259 - RNA, 19 nt, Homo sapiens
caaugacuguuugaaugua

SEQ ID NO: 1024260 - RNA, 19 nt, Homo sapiens
agacaagccugggcauuau

SEQ ID NO: 1024261 - RNA, 19 nt, Homo sapiens
gagagcagccauagauaau

SEQ ID NO: 1024262 - RNA, 19 nt, Homo sapiens
ugugagccauguaaucuuu

SEQ ID NO: 1024263 - RNA, 19 nt, Homo sapiens
uagaaggcuuuccuaaaug

SEQ ID NO: 1024264 - RNA, 19 nt, Homo sapiens
gcuuacacaugcugacuug

SEQ ID NO: 1024265 - RNA, 19 nt, Homo sapiens
aaagcuauguucacuggaa

SEQ ID NO: 1024266 - RNA, 19 nt, Homo sapiens
uuaccauuguugaguguua

SEQ ID NO: 1024267 - RNA, 19 nt, Homo sapiens
uaacccacuugcauucuga

SEQ ID NO: 1024268 - RNA, 19 nt, Homo sapiens
cuaaauacauaugccagaa

SEQ ID NO: 1024269 - RNA, 19 nt, Homo sapiens
caauggcaacugauaaauu

SEQ ID NO: 1024270 - RNA, 19 nt, Homo sapiens
uaacuuaacccacuugcau

SEQ ID NO: 1024271 - RNA, 19 nt, Homo sapiens
gaucgcacuuguaaacauc

SEQ ID NO: 1024272 - RNA, 19 nt, Homo sapiens
gaagcaaaucaucuuauuc

SEQ ID NO: 1024273 - RNA, 19 nt, Homo sapiens
guacaagaacgccagaaau

SEQ ID NO: 1024274 - RNA, 19 nt, Homo sapiens
aaacuuguccugaaagaau

SEQ ID NO: 1024275 - RNA, 19 nt, Homo sapiens
ugagagcagccauagauaa

SEQ ID NO: 1024276 - RNA, 19 nt, Homo sapiens
caacacaggaggaucacuu

SEQ ID NO: 1024277 - RNA, 19 nt, Homo sapiens
uccaaugacuguuugaaug

SEQ ID NO: 1024278 - RNA, 19 nt, Homo sapiens
acaggaggaucacuugaga

SEQ ID NO: 1024279 - RNA, 19 nt, Homo sapiens
guacuuugaguguaauuug

SEQ ID NO: 1024280 - RNA, 19 nt, Homo sapiens
gaugaucgcacuuguaaac

SEQ ID NO: 1024281 - RNA, 19 nt, Homo sapiens
cagaagauagcaaagaaga

SEQ ID NO: 1024282 - RNA, 19 nt, Homo sapiens
ggagggaaaucuggacucu

SEQ ID NO: 1024283 - RNA, 19 nt, Homo sapiens
gcccguauuucaaagcuau

SEQ ID NO: 1024284 - RNA, 19 nt, Homo sapiens
guggauuucugaccauuuc

SEQ ID NO: 1024285 - RNA, 19 nt, Homo sapiens
ccaccugguuacucacaaa

SEQ ID NO: 1024286 - RNA, 19 nt, Homo sapiens
uaaauagaaggcuuuccua

SEQ ID NO: 1024287 - RNA, 19 nt, Homo sapiens
uuucaucaauggcaacuga

SEQ ID NO: 1024288 - RNA, 19 nt, Homo sapiens
acuuaacucugccauugua

SEQ ID NO: 1024289 - RNA, 19 nt, Homo sapiens
uggaaccauuuacauguuu

SEQ ID NO: 1024290 - RNA, 19 nt, Homo sapiens
aauagaaggcuuuccuaaa

SEQ ID NO: 1024291 - RNA, 19 nt, Homo sapiens
gauaggauugcuucaugaa

SEQ ID NO: 1024292 - RNA, 19 nt, Homo sapiens
gaagcgcuaccaaagaaau

SEQ ID NO: 1024293 - RNA, 19 nt, Homo sapiens
aaauagaaggcuuuccuaa

SEQ ID NO: 1024294 - RNA, 19 nt, Homo sapiens
ucaaguaugauguacaaga

SEQ ID NO: 1024295 - RNA, 19 nt, Homo sapiens
uauguucacuggaaaccuu

SEQ ID NO: 1024296 - RNA, 19 nt, Homo sapiens
caacuugauccugguaauu

SEQ ID NO: 1024297 - RNA, 19 nt, Homo sapiens
gacaagccugggcauuaua

SEQ ID NO: 1024298 - RNA, 19 nt, Homo sapiens
auacuuagcacaguuacua

SEQ ID NO: 1024299 - RNA, 19 nt, Homo sapiens
ccaaugacuguuugaaugu

SEQ ID NO: 1024300 - RNA, 19 nt, Homo sapiens
agauaggauugcuucauga

SEQ ID NO: 1024301 - RNA, 19 nt, Homo sapiens
gauagcuugccaacccuua

SEQ ID NO: 1024302 - RNA, 19 nt, Homo sapiens
gauuaggaauugucagacu

SEQ ID NO: 1024303 - RNA, 19 nt, Homo sapiens
gaauggguuugaaugaaaa

SEQ ID NO: 1024304 - RNA, 19 nt, Homo sapiens
caagaacgccagaaauacu

SEQ ID NO: 1024305 - RNA, 19 nt, Homo sapiens
ccugguaauuguauuggaa

SEQ ID NO: 1024306 - RNA, 19 nt, Homo sapiens
gaaguugcagugagcuaug

SEQ ID NO: 1024307 - RNA, 19 nt, Homo sapiens
auaacgagauccuguccuu

SEQ ID NO: 1024308 - RNA, 19 nt, Homo sapiens
gaugacagccagaggaaua

SEQ ID NO: 1024309 - RNA, 19 nt, Homo sapiens
gacuccaucucaauaaaua

SEQ ID NO: 1024310 - RNA, 19 nt, Homo sapiens
ggaaaucuccaagucagaa

SEQ ID NO: 1024311 - RNA, 19 nt, Homo sapiens
agaagcgucugcaccguuu

SEQ ID NO: 1024312 - RNA, 19 nt, Homo sapiens
ggagcuggaucccuucaca

SEQ ID NO: 1024313 - RNA, 19 nt, Homo sapiens
guacagguuucagggcaaa

SEQ ID NO: 1024314 - RNA, 19 nt, Homo sapiens
ccaccaggauccaggcuau

SEQ ID NO: 1024315 - RNA, 19 nt, Homo sapiens
caacagagcgagacuccau

SEQ ID NO: 1024316 - RNA, 19 nt, Homo sapiens
gugaagaggcgcugaagga

SEQ ID NO: 1024317 - RNA, 19 nt, Homo sapiens
guucggcucuugccucugu

SEQ ID NO: 1024318 - RNA, 19 nt, Homo sapiens
cagcgucucuggagcacuu

SEQ ID NO: 1024319 - RNA, 19 nt, Homo sapiens
gaaaucuccaagucagaaa

SEQ ID NO: 1024320 - RNA, 19 nt, Homo sapiens
ccagaggaauaagaacuug

SEQ ID NO: 1024321 - RNA, 19 nt, Homo sapiens
ccaguggacuuuggcaaug

SEQ ID NO: 1024322 - RNA, 19 nt, Homo sapiens
uagcgugcuuggccaauga

SEQ ID NO: 1024323 - RNA, 19 nt, Homo sapiens
gagcugcgggucccauuga

SEQ ID NO: 1024324 - RNA, 19 nt, Homo sapiens
ggagcuggcccaagcacuu

SEQ ID NO: 1024325 - RNA, 19 nt, Homo sapiens
cuauugagcucuuuaugcu

SEQ ID NO: 1024326 - RNA, 19 nt, Homo sapiens
ucauaccuuugucuccuaa

SEQ ID NO: 1024327 - RNA, 19 nt, Homo sapiens
gagaggacugugagagaga

SEQ ID NO: 1024328 - RNA, 19 nt, Homo sapiens
ccuagggugugcugguuug

SEQ ID NO: 1024329 - RNA, 19 nt, Homo sapiens
gggaugacagccagaggaa

SEQ ID NO: 1024330 - RNA, 19 nt, Homo sapiens
auaccuuugucuccuaauu

SEQ ID NO: 1024331 - RNA, 19 nt, Homo sapiens
gcucggcguucuacaccau

SEQ ID NO: 1024332 - RNA, 19 nt, Homo sapiens
ccucauggagccacucuug

SEQ ID NO: 1024333 - RNA, 19 nt, Homo sapiens
gaccuucuuucuuuugauu

SEQ ID NO: 1024334 - RNA, 19 nt, Homo sapiens
gugcuuggccaaugacugu

SEQ ID NO: 1024335 - RNA, 19 nt, Homo sapiens
gcuauugagcucuuuaugc

SEQ ID NO: 1024336 - RNA, 19 nt, Homo sapiens
gccagaggaauaagaacuu

SEQ ID NO: 1024337 - RNA, 19 nt, Homo sapiens
cuguguuccuggcugaaua

SEQ ID NO: 1024338 - RNA, 19 nt, Homo sapiens
ggacaccgaggucaaucuc

SEQ ID NO: 1024339 - RNA, 19 nt, Homo sapiens
cggcugaggagcauugaga

SEQ ID NO: 1024340 - RNA, 19 nt, Homo sapiens
ccaggauccaggcuauuga

SEQ ID NO: 1024341 - RNA, 19 nt, Homo sapiens
gcaacugcucuucuuggau

SEQ ID NO: 1024342 - RNA, 19 nt, Homo sapiens
agaggacugugagagagaa

SEQ ID NO: 1024343 - RNA, 19 nt, Homo sapiens
acccuugccugccauuaug

SEQ ID NO: 1024344 - RNA, 19 nt, Homo sapiens
gggaaaucuccaagucaga

SEQ ID NO: 1024345 - RNA, 19 nt, Homo sapiens
caacuugugccgcauucuc

SEQ ID NO: 1024346 - RNA, 19 nt, Homo sapiens
cacccacgguacacaacuu

SEQ ID NO: 1024347 - RNA, 19 nt, Homo sapiens
ugcaacugcucuucuugga

SEQ ID NO: 1024348 - RNA, 19 nt, Homo sapiens
gacagccagaggaauaaga

SEQ ID NO: 1024349 - RNA, 19 nt, Homo sapiens
gagcugagcagggccaaaa

SEQ ID NO: 1024350 - RNA, 19 nt, Homo sapiens
gcaaacagcuggagaagac

SEQ ID NO: 1024351 - RNA, 19 nt, Homo sapiens
gcacagaugucaggauuuc

SEQ ID NO: 1024352 - RNA, 19 nt, Homo sapiens
gaacagacccagccagaga

SEQ ID NO: 1024353 - RNA, 19 nt, Homo sapiens
cagcaaauccacagcauua

SEQ ID NO: 1024354 - RNA, 19 nt, Homo sapiens
gagaaaggaugaucaagca

SEQ ID NO: 1024355 - RNA, 19 nt, Homo sapiens
gaaggaagaauugagguua

SEQ ID NO: 1024356 - RNA, 19 nt, Homo sapiens
ucaagcagcugaaggaaga

SEQ ID NO: 1024357 - RNA, 19 nt, Homo sapiens
aaacacaacugcuacaaca

SEQ ID NO: 1024358 - RNA, 19 nt, Homo sapiens
gcgcacagaugucaggauu

SEQ ID NO: 1024359 - RNA, 19 nt, Homo sapiens
gaaaagcaguccugaagaa

SEQ ID NO: 1024360 - RNA, 19 nt, Homo sapiens
guaauucccuuuagagucu

SEQ ID NO: 1024361 - RNA, 19 nt, Homo sapiens
uccagaagcugcccauuaa

SEQ ID NO: 1024362 - RNA, 19 nt, Homo sapiens
gcaguuagggacuuuaauu

SEQ ID NO: 1024363 - RNA, 19 nt, Homo sapiens
ggauuugcuuucagacuuu

SEQ ID NO: 1024364 - RNA, 19 nt, Homo sapiens
gagaguaccuccuggacau

SEQ ID NO: 1024365 - RNA, 19 nt, Homo sapiens
gaauugagguuagaagaag

SEQ ID NO: 1024366 - RNA, 19 nt, Homo sapiens
gaagaacgagaaaggauga

SEQ ID NO: 1024367 - RNA, 19 nt, Homo sapiens
auuguuggcuucagauuua

SEQ ID NO: 1024368 - RNA, 19 nt, Homo sapiens
ccauggcgaucuauaaguu

SEQ ID NO: 1024369 - RNA, 19 nt, Homo sapiens
auucuuggcugcaaaguuu

SEQ ID NO: 1024370 - RNA, 19 nt, Homo sapiens
gaacgagaaaggaugauca

SEQ ID NO: 1024371 - RNA, 19 nt, Homo sapiens
cagcagcccugagcagaaa

SEQ ID NO: 1024372 - RNA, 19 nt, Homo sapiens
gaagaagcaugccgaacac

SEQ ID NO: 1024373 - RNA, 19 nt, Homo sapiens
agacuuagcagaagaacaa

SEQ ID NO: 1024374 - RNA, 19 nt, Homo sapiens
gaggauuguuggcuucaga

SEQ ID NO: 1024375 - RNA, 19 nt, Homo sapiens
ugugagaacugcaugacaa

SEQ ID NO: 1024376 - RNA, 19 nt, Homo sapiens
cgaagaagcaugccgaaca

SEQ ID NO: 1024377 - RNA, 19 nt, Homo sapiens
caacaacgaguucaucuac

SEQ ID NO: 1024378 - RNA, 19 nt, Homo sapiens
uggaggagguggugcagaa

SEQ ID NO: 1024379 - RNA, 19 nt, Homo sapiens
caacugcuacaacauucua

SEQ ID NO: 1024380 - RNA, 19 nt, Homo sapiens
acacaacugcuacaacauu

SEQ ID NO: 1024381 - RNA, 19 nt, Homo sapiens
gaugucaggauuuccguuu

SEQ ID NO: 1024382 - RNA, 19 nt, Homo sapiens
gaacaaacugaagaacaga

SEQ ID NO: 1024383 - RNA, 19 nt, Homo sapiens
cagaagaacaaacugaaga

SEQ ID NO: 1024384 - RNA, 19 nt, Homo sapiens
agaacaaacugaagaacag

SEQ ID NO: 1024385 - RNA, 19 nt, Homo sapiens
gcgggacccuugcguuugu

SEQ ID NO: 1024386 - RNA, 19 nt, Homo sapiens
agaagacgcuacucgagau

SEQ ID NO: 1024387 - RNA, 19 nt, Homo sapiens
gaucaggucugcuuuuagu

SEQ ID NO: 1024388 - RNA, 19 nt, Homo sapiens
cagcugaacgccuccauug

SEQ ID NO: 1024389 - RNA, 19 nt, Homo sapiens
ggucaccucugccgagucu

SEQ ID NO: 1024390 - RNA, 19 nt, Homo sapiens
gauuguuggcuucagauuu

SEQ ID NO: 1024391 - RNA, 19 nt, Homo sapiens
gaugauggaguuaaaagua

SEQ ID NO: 1024392 - RNA, 19 nt, Homo sapiens
ugacaaccaaccagaagaa

SEQ ID NO: 1024393 - RNA, 19 nt, Homo sapiens
gcagcugaaggaagaauug

SEQ ID NO: 1024394 - RNA, 19 nt, Homo sapiens
cagaaugaccgaagaagca

SEQ ID NO: 1024395 - RNA, 19 nt, Homo sapiens
caguuagggacuuuaauuu

SEQ ID NO: 1024396 - RNA, 19 nt, Homo sapiens
gucaggauuugcuuucaga

SEQ ID NO: 1024397 - RNA, 19 nt, Homo sapiens
gcagcagcccugagcagaa

SEQ ID NO: 1024398 - RNA, 19 nt, Homo sapiens
cggcagagucaaauacaaa

SEQ ID NO: 1024399 - RNA, 19 nt, Homo sapiens
gcaaaacucguguuguuga

SEQ ID NO: 1024400 - RNA, 19 nt, Homo sapiens
aagcaaaacucguguuguu

SEQ ID NO: 1024401 - RNA, 19 nt, Homo sapiens
gaacacggagucagaaacg

SEQ ID NO: 1024402 - RNA, 19 nt, Homo sapiens
cagaagccguuccgugucu

SEQ ID NO: 1024403 - RNA, 19 nt, Homo sapiens
ggauuuccguuugggucua

SEQ ID NO: 1024404 - RNA, 19 nt, Homo sapiens
cacaacugcuacaacauuc

SEQ ID NO: 1024405 - RNA, 19 nt, Homo sapiens
gcagaagaacaaacugaag

SEQ ID NO: 1024406 - RNA, 19 nt, Homo sapiens
gcaugacaaccaaccagaa

SEQ ID NO: 1024407 - RNA, 19 nt, Homo sapiens
gcggcagagucaaauacaa

SEQ ID NO: 1024408 - RNA, 19 nt, Homo sapiens
gaagaauugagguuagaag

SEQ ID NO: 1024409 - RNA, 19 nt, Homo sapiens
ccaacaacgaguucaucua

SEQ ID NO: 1024410 - RNA, 19 nt, Homo sapiens
ggaagaauugagguuagaa

SEQ ID NO: 1024411 - RNA, 19 nt, Homo sapiens
aagcaguccugaagaacga

SEQ ID NO: 1024412 - RNA, 19 nt, Homo sapiens
ucauuucgauggacgcaau

SEQ ID NO: 1024413 - RNA, 19 nt, Homo sapiens
uuccagaagcugcccauua

SEQ ID NO: 1024414 - RNA, 19 nt, Homo sapiens
uagcagaagaacaaacuga

SEQ ID NO: 1024415 - RNA, 19 nt, Homo sapiens
uuucuuccuuucucucuuu

SEQ ID NO: 1024416 - RNA, 19 nt, Homo sapiens
gcaaauccacagcauuagg

SEQ ID NO: 1024417 - RNA, 19 nt, Homo sapiens
gcccagaagcccacagguu

SEQ ID NO: 1024418 - RNA, 19 nt, Homo sapiens
aggauuugcuuucagacuu

SEQ ID NO: 1024419 - RNA, 19 nt, Homo sapiens
ggcgaucuauaaguugaaa

SEQ ID NO: 1024420 - RNA, 19 nt, Homo sapiens
agaauugagguuagaagaa

SEQ ID NO: 1024421 - RNA, 19 nt, Homo sapiens
agaagaacaaacugaagaa

SEQ ID NO: 1024422 - RNA, 19 nt, Homo sapiens
cugcuacaacauucuaaua

SEQ ID NO: 1024423 - RNA, 19 nt, Homo sapiens
uaagggagaaggagaggau

SEQ ID NO: 1024424 - RNA, 19 nt, Homo sapiens
guggagagcaagaaaauaa

SEQ ID NO: 1024425 - RNA, 19 nt, Homo sapiens
cacccaaacugcagaacuc

SEQ ID NO: 1024426 - RNA, 19 nt, Homo sapiens
agaagaaggcgcucaaggu

SEQ ID NO: 1024427 - RNA, 19 nt, Homo sapiens
agaacugcaugacaaccaa

SEQ ID NO: 1024428 - RNA, 19 nt, Homo sapiens
acguaugucuccaugaguu

SEQ ID NO: 1024429 - RNA, 19 nt, Homo sapiens
gaagcagggauuccagaag

SEQ ID NO: 1024430 - RNA, 19 nt, Homo sapiens
gacaugcgcaccucacaca

SEQ ID NO: 1024431 - RNA, 19 nt, Homo sapiens
aaggaagaauugagguuag

SEQ ID NO: 1024432 - RNA, 19 nt, Homo sapiens
gaucaagcagcugaaggaa

SEQ ID NO: 1024433 - RNA, 19 nt, Homo sapiens
ccaccgccuucaaacacaa

SEQ ID NO: 1024434 - RNA, 19 nt, Homo sapiens
auacguaugucuccaugag

SEQ ID NO: 1024435 - RNA, 19 nt, Homo sapiens
gagcucacaggucgucaug

SEQ ID NO: 1024436 - RNA, 19 nt, Homo sapiens
aaacacugacggagacaug

SEQ ID NO: 1024437 - RNA, 19 nt, Homo sapiens
ccaugcaguuagggacuuu

SEQ ID NO: 1024438 - RNA, 19 nt, Homo sapiens
uucgauggacgcaaucuua

SEQ ID NO: 1024439 - RNA, 19 nt, Homo sapiens
cgagcgggguguuucauuu

SEQ ID NO: 1024440 - RNA, 19 nt, Homo sapiens
cccgugggcuuucuuccuu

SEQ ID NO: 1024441 - RNA, 19 nt, Homo sapiens
aaacucguguuguugaaaa

SEQ ID NO: 1024442 - RNA, 19 nt, Homo sapiens
gagguuagaagaagcaaaa

SEQ ID NO: 1024443 - RNA, 19 nt, Homo sapiens
ugaaggaagaauugagguu

SEQ ID NO: 1024444 - RNA, 19 nt, Homo sapiens
gaagaacaaacugaagaac

SEQ ID NO: 1024445 - RNA, 19 nt, Homo sapiens
cgaucuauaaguugaaaga

SEQ ID NO: 1024446 - RNA, 19 nt, Homo sapiens
ucucuuugccuuuaguuug

SEQ ID NO: 1024447 - RNA, 19 nt, Homo sapiens
ggagagcaagaaaauaaaa

SEQ ID NO: 1024448 - RNA, 19 nt, Homo sapiens
caaaacucguguuguugaa

SEQ ID NO: 1024449 - RNA, 19 nt, Homo sapiens
aggaagaauugagguuaga

SEQ ID NO: 1024450 - RNA, 19 nt, Homo sapiens
gaagaaagcauaacaguuu

SEQ ID NO: 1024451 - RNA, 19 nt, Homo sapiens
uaagauggcugcuaaauug

SEQ ID NO: 1024452 - RNA, 19 nt, Homo sapiens
uaacauggcugaaagagaa

SEQ ID NO: 1024453 - RNA, 19 nt, Homo sapiens
uaauauggcuacacacuua

SEQ ID NO: 1024454 - RNA, 19 nt, Homo sapiens
caccauauaugcaucauua

SEQ ID NO: 1024455 - RNA, 19 nt, Homo sapiens
gcauaacaguuucagauaa

SEQ ID NO: 1024456 - RNA, 19 nt, Homo sapiens
gaaauggaguugaagaugu

SEQ ID NO: 1024457 - RNA, 19 nt, Homo sapiens
guggaaaggucucauuuaa

SEQ ID NO: 1024458 - RNA, 19 nt, Homo sapiens
ggaaauaacccuagcacaa

SEQ ID NO: 1024459 - RNA, 19 nt, Homo sapiens
gaacaguaguuugcuuuga

SEQ ID NO: 1024460 - RNA, 19 nt, Homo sapiens
gaaccugugucuaaggaaa

SEQ ID NO: 1024461 - RNA, 19 nt, Homo sapiens
ucauaaaccuggugaaaug

SEQ ID NO: 1024462 - RNA, 19 nt, Homo sapiens
gcaaguaaaccuaauacaa

SEQ ID NO: 1024463 - RNA, 19 nt, Homo sapiens
gaaguagugucugaucaaa

SEQ ID NO: 1024464 - RNA, 19 nt, Homo sapiens
gcaaggcaguauucauuug

SEQ ID NO: 1024465 - RNA, 19 nt, Homo sapiens
gagcaaggcaguauucauu

SEQ ID NO: 1024466 - RNA, 19 nt, Homo sapiens
caaagcacauuggcuagua

SEQ ID NO: 1024467 - RNA, 19 nt, Homo sapiens
uagcaaagccuauguaaau

SEQ ID NO: 1024468 - RNA, 19 nt, Homo sapiens
gaagaacaguaguuugcuu

SEQ ID NO: 1024469 - RNA, 19 nt, Homo sapiens
aaacuuccaucaauccuaa

SEQ ID NO: 1024470 - RNA, 19 nt, Homo sapiens
guucagaaauggaaauaug

SEQ ID NO: 1024471 - RNA, 19 nt, Homo sapiens
gaaccugaaucuguuaguu

SEQ ID NO: 1024472 - RNA, 19 nt, Homo sapiens
gaacagaagacucacacaa

SEQ ID NO: 1024473 - RNA, 19 nt, Homo sapiens
gcucaguggugcuguugua

SEQ ID NO: 1024474 - RNA, 19 nt, Homo sapiens
caguagaccuggaagauga

SEQ ID NO: 1024475 - RNA, 19 nt, Homo sapiens
gaggacaaauagaauguga

SEQ ID NO: 1024476 - RNA, 19 nt, Homo sapiens
ucuauaagauggcugcuaa

SEQ ID NO: 1024477 - RNA, 19 nt, Homo sapiens
acaaaugcauugaguguug

SEQ ID NO: 1024478 - RNA, 19 nt, Homo sapiens
ccauaugucugccagguuu

SEQ ID NO: 1024479 - RNA, 19 nt, Homo sapiens
gagcaugcuuagaguacua

SEQ ID NO: 1024480 - RNA, 19 nt, Homo sapiens
gcaaaccacuuuccuacgu

SEQ ID NO: 1024481 - RNA, 19 nt, Homo sapiens
cuaaacaacuagaaggauu

SEQ ID NO: 1024482 - RNA, 19 nt, Homo sapiens
caacaccaucgaacauuua

SEQ ID NO: 1024483 - RNA, 19 nt, Homo sapiens
acacaacuauugauucaga

SEQ ID NO: 1024484 - RNA, 19 nt, Homo sapiens
uguaagcuguguagaaauu

SEQ ID NO: 1024485 - RNA, 19 nt, Homo sapiens
gaaacaccauuuggaacuu

SEQ ID NO: 1024486 - RNA, 19 nt, Homo sapiens
caaaccacuuuccuacgua

SEQ ID NO: 1024487 - RNA, 19 nt, Homo sapiens
guagaaacccauuguugaa

SEQ ID NO: 1024488 - RNA, 19 nt, Homo sapiens
ggaugaugcugguaaaugg

SEQ ID NO: 1024489 - RNA, 19 nt, Homo sapiens
gaagggauuuggaaaccau

SEQ ID NO: 1024490 - RNA, 19 nt, Homo sapiens
uaagggaggucacacauac

SEQ ID NO: 1024491 - RNA, 19 nt, Homo sapiens
ugagcaccuuucugaauua

SEQ ID NO: 1024492 - RNA, 19 nt, Homo sapiens
acaaauagaaugugacuug

SEQ ID NO: 1024493 - RNA, 19 nt, Homo sapiens
ugaguguuguuccgaaaua

SEQ ID NO: 1024494 - RNA, 19 nt, Homo sapiens
ucaacaccaucgaacauuu

SEQ ID NO: 1024495 - RNA, 19 nt, Homo sapiens
caacacguuugucaggaaa

SEQ ID NO: 1024496 - RNA, 19 nt, Homo sapiens
caaguaaaccuaauacaag

SEQ ID NO: 1024497 - RNA, 19 nt, Homo sapiens
ucaccuacaccuuccauua

SEQ ID NO: 1024498 - RNA, 19 nt, Homo sapiens
gaacaaaaguuacuauucg

SEQ ID NO: 1024499 - RNA, 19 nt, Homo sapiens
gauaagggcauuuggaaca

SEQ ID NO: 1024500 - RNA, 19 nt, Homo sapiens
caacagaggcaacaguaga

SEQ ID NO: 1024501 - RNA, 19 nt, Homo sapiens
gaaaauggaucauaagacu

SEQ ID NO: 1024502 - RNA, 19 nt, Homo sapiens
gaaacuccuguagcuauua

SEQ ID NO: 1024503 - RNA, 19 nt, Homo sapiens
aaugaaggcuuuauuugug

SEQ ID NO: 1024504 - RNA, 19 nt, Homo sapiens
gaagaugugccaaaguuca

SEQ ID NO: 1024505 - RNA, 19 nt, Homo sapiens
gaaauugcaagaccuaaca

SEQ ID NO: 1024506 - RNA, 19 nt, Homo sapiens
gagcaccuuucugaauuaa

SEQ ID NO: 1024507 - RNA, 19 nt, Homo sapiens
gaacugguuuuggaaauuu

SEQ ID NO: 1024508 - RNA, 19 nt, Homo sapiens
caagacugaugaaguagug

SEQ ID NO: 1024509 - RNA, 19 nt, Homo sapiens
agccaagacugaugaagua

SEQ ID NO: 1024510 - RNA, 19 nt, Homo sapiens
gaacaagaaccugugucua

SEQ ID NO: 1024511 - RNA, 19 nt, Homo sapiens
caccaucgaacauuuauaa

SEQ ID NO: 1024512 - RNA, 19 nt, Homo sapiens
gauggcugcuaaauugauu

SEQ ID NO: 1024513 - RNA, 19 nt, Homo sapiens
cuaaugagaauuuggauga

SEQ ID NO: 1024514 - RNA, 19 nt, Homo sapiens
ggauuugguugcugacaug

SEQ ID NO: 1024515 - RNA, 19 nt, Homo sapiens
gaaauaacccuagcacaac

SEQ ID NO: 1024516 - RNA, 19 nt, Homo sapiens
gacaugaaccugaaucugu

SEQ ID NO: 1024517 - RNA, 19 nt, Homo sapiens
aacaagaaccugugucuaa

SEQ ID NO: 1024518 - RNA, 19 nt, Homo sapiens
gcaaagccuauguaaauca

SEQ ID NO: 1024519 - RNA, 19 nt, Homo sapiens
uguguaagcuguguagaaa

SEQ ID NO: 1024520 - RNA, 19 nt, Homo sapiens
cagugaaaguggaauuauu

SEQ ID NO: 1024521 - RNA, 19 nt, Homo sapiens
cugccaggcuguaagcuua

SEQ ID NO: 1024522 - RNA, 19 nt, Homo sapiens
uaacugagaggaagggauu

SEQ ID NO: 1024523 - RNA, 19 nt, Homo sapiens
guaugaagccacagagauu

SEQ ID NO: 1024524 - RNA, 19 nt, Homo sapiens
ucuguuaguucugauguua

SEQ ID NO: 1024525 - RNA, 19 nt, Homo sapiens
uguaagcauugaucaguuu

SEQ ID NO: 1024526 - RNA, 19 nt, Homo sapiens
cauaacaguuucagauaag

SEQ ID NO: 1024527 - RNA, 19 nt, Homo sapiens
gaaggcucaucaacaacaa

SEQ ID NO: 1024528 - RNA, 19 nt, Homo sapiens
gcaccuuucugaauuaaaa

SEQ ID NO: 1024529 - RNA, 19 nt, Homo sapiens
guuucuggcuuagauaaua

SEQ ID NO: 1024530 - RNA, 19 nt, Homo sapiens
guaguuugcuuugaaauac

SEQ ID NO: 1024531 - RNA, 19 nt, Homo sapiens
ugaaacuccuguagcuauu

SEQ ID NO: 1024532 - RNA, 19 nt, Homo sapiens
gguaaauggagcaugcuua

SEQ ID NO: 1024533 - RNA, 19 nt, Homo sapiens
gaccuaacauggcugaaag

SEQ ID NO: 1024534 - RNA, 19 nt, Homo sapiens
gaaggacaaucauaaaccu

SEQ ID NO: 1024535 - RNA, 19 nt, Homo sapiens
guaagggaggucacacaua

SEQ ID NO: 1024536 - RNA, 19 nt, Homo sapiens
gaaauggaaauauguaagg

SEQ ID NO: 1024537 - RNA, 19 nt, Homo sapiens
uugaagaugugccaaaguu

SEQ ID NO: 1024538 - RNA, 19 nt, Homo sapiens
ggaaauggaguugaagaug

SEQ ID NO: 1024539 - RNA, 19 nt, Homo sapiens
uagauaauauggcuacaca

SEQ ID NO: 1024540 - RNA, 19 nt, Homo sapiens
aaugugcuuuggauucuua

SEQ ID NO: 1024541 - RNA, 19 nt, Homo sapiens
caacgcaaguaaaccuaau

SEQ ID NO: 1024542 - RNA, 19 nt, Homo sapiens
ucaaauccaacgcaaguaa

SEQ ID NO: 1024543 - RNA, 19 nt, Homo sapiens
gaacuugcuaugcccguuu

SEQ ID NO: 1024544 - RNA, 19 nt, Homo sapiens
caaauauuggugcagauaa

SEQ ID NO: 1024545 - RNA, 19 nt, Homo sapiens
gcugaaagagaaacagaaa

SEQ ID NO: 1024546 - RNA, 19 nt, Homo sapiens
caucgucaguugugauuca

SEQ ID NO: 1024547 - RNA, 19 nt, Homo sapiens
gagaaacagaaacaucaaa

SEQ ID NO: 1024548 - RNA, 19 nt, Homo sapiens
gaaucuuuguaccuccaua

SEQ ID NO: 1024549 - RNA, 19 nt, Homo sapiens
gaucuaaugagaauuugga

SEQ ID NO: 1024550 - RNA, 19 nt, Homo sapiens
gaugaaagcuccucuaguu

SEQ ID NO: 1024551 - RNA, 19 nt, Homo sapiens
ggauuaaucugguguguuu

SEQ ID NO: 1024552 - RNA, 19 nt, Homo sapiens
ggaaagagguaucauuugu

SEQ ID NO: 1024553 - RNA, 19 nt, Homo sapiens
gaaauagaguugcuccauu

SEQ ID NO: 1024554 - RNA, 19 nt, Homo sapiens
caaggagccuauuaauaua

SEQ ID NO: 1024555 - RNA, 19 nt, Homo sapiens
ucaaggagccuauuaauau

SEQ ID NO: 1024556 - RNA, 19 nt, Homo sapiens
gaagaaaacaggcuauuua

SEQ ID NO: 1024557 - RNA, 19 nt, Homo sapiens
aaagaaagcagccauguaa

SEQ ID NO: 1024558 - RNA, 19 nt, Homo sapiens
caacaaagcauuggagaaa

SEQ ID NO: 1024559 - RNA, 19 nt, Homo sapiens
gagacaagcugaagcgaau

SEQ ID NO: 1024560 - RNA, 19 nt, Homo sapiens
gaaagagguaucauuugua

SEQ ID NO: 1024561 - RNA, 19 nt, Homo sapiens
uagaguugcuccauucaua

SEQ ID NO: 1024562 - RNA, 19 nt, Homo sapiens
guugaaaucuagcaugaaa

SEQ ID NO: 1024563 - RNA, 19 nt, Homo sapiens
guaagagcauagagaauau

SEQ ID NO: 1024564 - RNA, 19 nt, Homo sapiens
gauuccagcucuuccagua

SEQ ID NO: 1024565 - RNA, 19 nt, Homo sapiens
gcugaaaucugcaaaucug

SEQ ID NO: 1024566 - RNA, 19 nt, Homo sapiens
cauaggauauacauaguug

SEQ ID NO: 1024567 - RNA, 19 nt, Homo sapiens
cauguaagaugucagaaau

SEQ ID NO: 1024568 - RNA, 19 nt, Homo sapiens
gcgaauaagcaacauguaa

SEQ ID NO: 1024569 - RNA, 19 nt, Homo sapiens
gaaaucugcaaaucuguuu

SEQ ID NO: 1024570 - RNA, 19 nt, Homo sapiens
gagauacugcacaauauuu

SEQ ID NO: 1024571 - RNA, 19 nt, Homo sapiens
aaucuagcaugaaagguua

SEQ ID NO: 1024572 - RNA, 19 nt, Homo sapiens
aaucugguguguuuacaua

SEQ ID NO: 1024573 - RNA, 19 nt, Homo sapiens
ggugaacauuucuagaauu

SEQ ID NO: 1024574 - RNA, 19 nt, Homo sapiens
gagagagacuuuuauuuga

SEQ ID NO: 1024575 - RNA, 19 nt, Homo sapiens
uagcagcucugacgaugaa

SEQ ID NO: 1024576 - RNA, 19 nt, Homo sapiens
aaagagguaucauuuguag

SEQ ID NO: 1024577 - RNA, 19 nt, Homo sapiens
gaauaagcaacauguaaga

SEQ ID NO: 1024578 - RNA, 19 nt, Homo sapiens
aaauagaguugcuccauuc

SEQ ID NO: 1024579 - RNA, 19 nt, Homo sapiens
agaaaccaauguagaaaga

SEQ ID NO: 1024580 - RNA, 19 nt, Homo sapiens
gugaugagucuuugguuua

SEQ ID NO: 1024581 - RNA, 19 nt, Homo sapiens
ggagauacugcacaauauu

SEQ ID NO: 1024582 - RNA, 19 nt, Homo sapiens
uaagugguauguucaagga

SEQ ID NO: 1024583 - RNA, 19 nt, Homo sapiens
gugaacauuucuagaauuc

SEQ ID NO: 1024584 - RNA, 19 nt, Homo sapiens
uaaagaacacggaugagaa

SEQ ID NO: 1024585 - RNA, 19 nt, Homo sapiens
uguguuacgucauucauuu

SEQ ID NO: 1024586 - RNA, 19 nt, Homo sapiens
gguuuaacaucacaguauu

SEQ ID NO: 1024587 - RNA, 19 nt, Homo sapiens
uguaagagcauagagaaua

SEQ ID NO: 1024588 - RNA, 19 nt, Homo sapiens
ggagaaaccaauguagaaa

SEQ ID NO: 1024589 - RNA, 19 nt, Homo sapiens
uuacauagguugcaucacu

SEQ ID NO: 1024590 - RNA, 19 nt, Homo sapiens
gaacacggaugagaaaaga

SEQ ID NO: 1024591 - RNA, 19 nt, Homo sapiens
guuugucucuguaaaggua

SEQ ID NO: 1024592 - RNA, 19 nt, Homo sapiens
acuguaagcuuaggaguuu

SEQ ID NO: 1024593 - RNA, 19 nt, Homo sapiens
uuaaggagccuguaauugu

SEQ ID NO: 1024594 - RNA, 19 nt, Homo sapiens
gaacuuaaagcugaaaucu

SEQ ID NO: 1024595 - RNA, 19 nt, Homo sapiens
cagcagaacuaaagaaagc

SEQ ID NO: 1024596 - RNA, 19 nt, Homo sapiens
ggacagcagaacuaaagaa

SEQ ID NO: 1024597 - RNA, 19 nt, Homo sapiens
cuacauaggcccucaagga

SEQ ID NO: 1024598 - RNA, 19 nt, Homo sapiens
ugaugagucuuugguuuaa

SEQ ID NO: 1024599 - RNA, 19 nt, Homo sapiens
ggacauuggacuuaugaau

SEQ ID NO: 1024600 - RNA, 19 nt, Homo sapiens
uaaggagccuguaauuguc

SEQ ID NO: 1024601 - RNA, 19 nt, Homo sapiens
aaagaacacggaugagaaa

SEQ ID NO: 1024602 - RNA, 19 nt, Homo sapiens
guaaaaugcuguuauugug

SEQ ID NO: 1024603 - RNA, 19 nt, Homo sapiens
uaguugaaaucuagcauga

SEQ ID NO: 1024604 - RNA, 19 nt, Homo sapiens
guuucaaauugcuguguua

SEQ ID NO: 1024605 - RNA, 19 nt, Homo sapiens
ggcuguauguuauguaaga

SEQ ID NO: 1024606 - RNA, 19 nt, Homo sapiens
aguauucugugaugucuuu

SEQ ID NO: 1024607 - RNA, 19 nt, Homo sapiens
aaggagauacugcacaaua

SEQ ID NO: 1024608 - RNA, 19 nt, Homo sapiens
guaggaagaagagguaauu

SEQ ID NO: 1024609 - RNA, 19 nt, Homo sapiens
uagguuaacuggugaacau

SEQ ID NO: 1024610 - RNA, 19 nt, Homo sapiens
agaaagaaaggccaagaaa

SEQ ID NO: 1024611 - RNA, 19 nt, Homo sapiens
uagaagugcuagaaauauc

SEQ ID NO: 1024612 - RNA, 19 nt, Homo sapiens
gaaagcagccauguaagag

SEQ ID NO: 1024613 - RNA, 19 nt, Homo sapiens
gaugaaccaccaaagaaga

SEQ ID NO: 1024614 - RNA, 19 nt, Homo sapiens
gcaacaaagcauuggagaa

SEQ ID NO: 1024615 - RNA, 19 nt, Homo sapiens
ugucagaaaugcuuggaau

SEQ ID NO: 1024616 - RNA, 19 nt, Homo sapiens
gacagcagaacuaaagaaa

SEQ ID NO: 1024617 - RNA, 19 nt, Homo sapiens
gaaagaaaggccaagaaaa

SEQ ID NO: 1024618 - RNA, 19 nt, Homo sapiens
agagguaucauuuguagaa

SEQ ID NO: 1024619 - RNA, 19 nt, Homo sapiens
gacaagcugaagcgaauaa

SEQ ID NO: 1024620 - RNA, 19 nt, Homo sapiens
ugugaugagucuuugguuu

SEQ ID NO: 1024621 - RNA, 19 nt, Homo sapiens
gcuguaaguuucaaauugc

SEQ ID NO: 1024622 - RNA, 19 nt, Homo sapiens
gcuuauagagagagacuuu

SEQ ID NO: 1024623 - RNA, 19 nt, Homo sapiens
guuaaggccaaguagguua

SEQ ID NO: 1024624 - RNA, 19 nt, Homo sapiens
gagguaucauuuguagaaa

SEQ ID NO: 1024625 - RNA, 19 nt, Homo sapiens
gguauuauaguuuguaugg

SEQ ID NO: 1024626 - RNA, 19 nt, Homo sapiens
ggaaagguaggaagaagag

SEQ ID NO: 1024627 - RNA, 19 nt, Homo sapiens
agaaagcagccauguaaga

SEQ ID NO: 1024628 - RNA, 19 nt, Homo sapiens
ggcaguggauuucuaaugc

SEQ ID NO: 1024629 - RNA, 19 nt, Homo sapiens
guuaacuggugaacauuuc

SEQ ID NO: 1024630 - RNA, 19 nt, Homo sapiens
uaagaugucagaaaugcuu

SEQ ID NO: 1024631 - RNA, 19 nt, Homo sapiens
guaaccaguuccaguagca

SEQ ID NO: 1024632 - RNA, 19 nt, Homo sapiens
uuaccaaucaggcacauuu

SEQ ID NO: 1024633 - RNA, 19 nt, Homo sapiens
ucaaauugcuguguuacgu

SEQ ID NO: 1024634 - RNA, 19 nt, Homo sapiens
gaauuuggacauuggacuu

SEQ ID NO: 1024635 - RNA, 19 nt, Homo sapiens
aggagauacugcacaauau

SEQ ID NO: 1024636 - RNA, 19 nt, Homo sapiens
caauguuggucgccuuuua

SEQ ID NO: 1024637 - RNA, 19 nt, Homo sapiens
cuuggugccuucuguuaaa

SEQ ID NO: 1024638 - RNA, 19 nt, Homo sapiens
gacgaugaaccaccaaaga

SEQ ID NO: 1024639 - RNA, 19 nt, Homo sapiens
ugacaguucugccagugau

SEQ ID NO: 1024640 - RNA, 19 nt, Homo sapiens
ucacuugacagauagaguu

SEQ ID NO: 1024641 - RNA, 19 nt, Homo sapiens
ucccaugcaucggcuaaua

SEQ ID NO: 1024642 - RNA, 19 nt, Homo sapiens
cuaagaguguaaccaguuc

SEQ ID NO: 1024643 - RNA, 19 nt, Homo sapiens
cgaauaagcaacauguaag

SEQ ID NO: 1024644 - RNA, 19 nt, Homo sapiens
gaaugacuaggauuaaucu

SEQ ID NO: 1024645 - RNA, 19 nt, Homo sapiens
gagaaaccaauguagaaag

SEQ ID NO: 1024646 - RNA, 19 nt, Homo sapiens
guuauugugaugagucuuu

SEQ ID NO: 1024647 - RNA, 19 nt, Homo sapiens
uggagaaaccaauguagaa

SEQ ID NO: 1024648 - RNA, 19 nt, Homo sapiens
gaguugcuccauucauauu

SEQ ID NO: 1024649 - RNA, 19 nt, Homo sapiens
caucacuugcaguuaaaua

SEQ ID NO: 1024650 - RNA, 19 nt, Homo sapiens
ggacccagcucaaguuuaa

SEQ ID NO: 1024651 - RNA, 19 nt, Homo sapiens
gcucucaacuucauucuaa

SEQ ID NO: 1024652 - RNA, 19 nt, Homo sapiens
ggaagaagcuaacuauugg

SEQ ID NO: 1024653 - RNA, 19 nt, Homo sapiens
ggaaagaucuggcgaugac

SEQ ID NO: 1024654 - RNA, 19 nt, Homo sapiens
gauaucagcccucaacauu

SEQ ID NO: 1024655 - RNA, 19 nt, Homo sapiens
gaagcuaacuauuggaaag

SEQ ID NO: 1024656 - RNA, 19 nt, Homo sapiens
gcgaugaccuacaaacaga

SEQ ID NO: 1024657 - RNA, 19 nt, Homo sapiens
gguguucacugauugagaa

SEQ ID NO: 1024658 - RNA, 19 nt, Homo sapiens
ggaugaagccagagauuug

SEQ ID NO: 1024659 - RNA, 19 nt, Homo sapiens
ggagggaagccgagaauau

SEQ ID NO: 1024660 - RNA, 19 nt, Homo sapiens
ggaggaagaagcuaacuau

SEQ ID NO: 1024661 - RNA, 19 nt, Homo sapiens
agacgcagcugcaacaaau

SEQ ID NO: 1024662 - RNA, 19 nt, Homo sapiens
gcaccuggauguugagagu

SEQ ID NO: 1024663 - RNA, 19 nt, Homo sapiens
uaucagcccucaacauugu

SEQ ID NO: 1024664 - RNA, 19 nt, Homo sapiens
gcaaaguccugcagcuucu

SEQ ID NO: 1024665 - RNA, 19 nt, Homo sapiens
gagaauaugaagcugaauu

SEQ ID NO: 1024666 - RNA, 19 nt, Homo sapiens
gcaaaugacgaccuggaaa

SEQ ID NO: 1024667 - RNA, 19 nt, Homo sapiens
gcgcagaccaaagccauua

SEQ ID NO: 1024668 - RNA, 19 nt, Homo sapiens
gcaagaggaacuccgagaa

SEQ ID NO: 1024669 - RNA, 19 nt, Homo sapiens
gaaucaggccaucgaaaga

SEQ ID NO: 1024670 - RNA, 19 nt, Homo sapiens
aagaggaacuccgagaauu

SEQ ID NO: 1024671 - RNA, 19 nt, Homo sapiens
caaaacacaugggcuagua

SEQ ID NO: 1024672 - RNA, 19 nt, Homo sapiens
ccacggugcuggcaaaguc

SEQ ID NO: 1024673 - RNA, 19 nt, Homo sapiens
cacaugggcuaguacuuga

SEQ ID NO: 1024674 - RNA, 19 nt, Homo sapiens
aagaccaauugcagaaaua

SEQ ID NO: 1024675 - RNA, 19 nt, Homo sapiens
aaagaccaauugcagaaau

SEQ ID NO: 1024676 - RNA, 19 nt, Homo sapiens
gaccaaagccauuaaagac

SEQ ID NO: 1024677 - RNA, 19 nt, Homo sapiens
gagggaagccgagaauaug

SEQ ID NO: 1024678 - RNA, 19 nt, Homo sapiens
ccgagaauaugaagcugaa

SEQ ID NO: 1024679 - RNA, 19 nt, Homo sapiens
gcugaagccuguucuuggu

SEQ ID NO: 1024680 - RNA, 19 nt, Homo sapiens
cagcucaaguuuaaacaca

SEQ ID NO: 1024681 - RNA, 19 nt, Homo sapiens
uggaaaccaucaaggagaa

SEQ ID NO: 1024682 - RNA, 19 nt, Homo sapiens
aggaagaagcuaacuauug

SEQ ID NO: 1024683 - RNA, 19 nt, Homo sapiens
gcagaccaaagccauuaaa

SEQ ID NO: 1024684 - RNA, 19 nt, Homo sapiens
uacuugagguguucacuga

SEQ ID NO: 1024685 - RNA, 19 nt, Homo sapiens
guagacacguugagcuucu

SEQ ID NO: 1024686 - RNA, 19 nt, Homo sapiens
caagaggaacuccgagaau

SEQ ID NO: 1024687 - RNA, 19 nt, Homo sapiens
gcuaguacuugagguguuc

SEQ ID NO: 1024688 - RNA, 19 nt, Homo sapiens
ugagaggacccaugaagga

SEQ ID NO: 1024689 - RNA, 19 nt, Homo sapiens
uuaaagaccaauugcagaa

SEQ ID NO: 1024690 - RNA, 19 nt, Homo sapiens
gaggaagaagcuaacuauu

SEQ ID NO: 1024691 - RNA, 19 nt, Homo sapiens
gggcggagcagcaagaaca

SEQ ID NO: 1024692 - RNA, 19 nt, Homo sapiens
gagaggacccaugaaggaa

SEQ ID NO: 1024693 - RNA, 19 nt, Homo sapiens
caacauugugggagaccua

SEQ ID NO: 1024694 - RNA, 19 nt, Homo sapiens
agaccaaagccauuaaaga

SEQ ID NO: 1024695 - RNA, 19 nt, Homo sapiens
cuugagguguucacugauu

SEQ ID NO: 1024696 - RNA, 19 nt, Homo sapiens
caaaugacgaccuggaaag

SEQ ID NO: 1024697 - RNA, 19 nt, Homo sapiens
gagacgcagcugcaacaaa

SEQ ID NO: 1024698 - RNA, 19 nt, Homo sapiens
aaacagagggcagaaaaua

SEQ ID NO: 1024699 - RNA, 19 nt, Homo sapiens
caaagccauuaaagaccaa

SEQ ID NO: 1024700 - RNA, 19 nt, Homo sapiens
ucucagccuuggaggauga

SEQ ID NO: 1024701 - RNA, 19 nt, Homo sapiens
gaucucagccuuggaggau

SEQ ID NO: 1024702 - RNA, 19 nt, Homo sapiens
acacaugggcuaguacuug

SEQ ID NO: 1024703 - RNA, 19 nt, Homo sapiens
gaggacccagcucaaguuu

SEQ ID NO: 1024704 - RNA, 19 nt, Homo sapiens
gcgccacgaucaugucucu

SEQ ID NO: 1024705 - RNA, 19 nt, Homo sapiens
caaauugaaaccaggaaca

SEQ ID NO: 1024706 - RNA, 19 nt, Homo sapiens
agaauaugaagcugaauug

SEQ ID NO: 1024707 - RNA, 19 nt, Homo sapiens
gagaagcgaagaccauguc

SEQ ID NO: 1024708 - RNA, 19 nt, Homo sapiens
gggaagccgagaauaugaa

SEQ ID NO: 1024709 - RNA, 19 nt, Homo sapiens
gaagaagcuaacuauugga

SEQ ID NO: 1024710 - RNA, 19 nt, Homo sapiens
agaaucuccuggaaucugu

SEQ ID NO: 1024711 - RNA, 19 nt, Homo sapiens
caaggagaaguuugaagug

SEQ ID NO: 1024712 - RNA, 19 nt, Homo sapiens
ccacguccuuggccagcuu

SEQ ID NO: 1024713 - RNA, 19 nt, Homo sapiens
ggauaucagcccucaacau

SEQ ID NO: 1024714 - RNA, 19 nt, Homo sapiens
cgaggacccagcucaaguu

SEQ ID NO: 1024715 - RNA, 19 nt, Homo sapiens
uaaagaccaauugcagaaa

SEQ ID NO: 1024716 - RNA, 19 nt, Homo sapiens
gaaggaugaagccagagau

SEQ ID NO: 1024717 - RNA, 19 nt, Homo sapiens
cagcugcaacaaauugaaa

SEQ ID NO: 1024718 - RNA, 19 nt, Homo sapiens
gcuaacuauuggaaagauc

SEQ ID NO: 1024719 - RNA, 19 nt, Homo sapiens
ugaaucaggccaucgaaag

SEQ ID NO: 1024720 - RNA, 19 nt, Homo sapiens
gcagcuucguagacacguu

SEQ ID NO: 1024721 - RNA, 19 nt, Homo sapiens
ggacaccaugccacaagga

SEQ ID NO: 1024722 - RNA, 19 nt, Homo sapiens
gcagcugcaacaaauugaa

SEQ ID NO: 1024723 - RNA, 19 nt, Homo sapiens
ugggugagguucucgaucu

SEQ ID NO: 1024724 - RNA, 19 nt, Homo sapiens
aauaugaagcugaauugga

SEQ ID NO: 1024725 - RNA, 19 nt, Homo sapiens
cugugacgcucucaacuuc

SEQ ID NO: 1024726 - RNA, 19 nt, Homo sapiens
guccuuggccagcuuaaug

SEQ ID NO: 1024727 - RNA, 19 nt, Homo sapiens
ggagaccuacugcggaaag

SEQ ID NO: 1024728 - RNA, 19 nt, Homo sapiens
ggcuaguacuugagguguu

SEQ ID NO: 1024729 - RNA, 19 nt, Homo sapiens
gugacgcucucaacuucau

SEQ ID NO: 1024730 - RNA, 19 nt, Homo sapiens
gaagccuguucuuggucuu

SEQ ID NO: 1024731 - RNA, 19 nt, Homo sapiens
gaauaugaagcugaauugg

SEQ ID NO: 1024732 - RNA, 19 nt, Homo sapiens
ccgaggaggaagaagcuaa

SEQ ID NO: 1024733 - RNA, 19 nt, Homo sapiens
ucguuaagcaucccuguga

SEQ ID NO: 1024734 - RNA, 19 nt, Homo sapiens
uggcgcagcuucguagaca

SEQ ID NO: 1024735 - RNA, 19 nt, Homo sapiens
ggagcagcaagaacagaga

SEQ ID NO: 1024736 - RNA, 19 nt, Homo sapiens
agaggaacuccgagaauuc

SEQ ID NO: 1024737 - RNA, 19 nt, Homo sapiens
caucagagagcuggagcaa

SEQ ID NO: 1024738 - RNA, 19 nt, Homo sapiens
gaaggcuaccggcagaucu

SEQ ID NO: 1024739 - RNA, 19 nt, Homo sapiens
ggaagccgagaauaugaag

SEQ ID NO: 1024740 - RNA, 19 nt, Homo sapiens
aagaagcuaacuauuggaa

SEQ ID NO: 1024741 - RNA, 19 nt, Homo sapiens
agagaccuccuguccgaaa

SEQ ID NO: 1024742 - RNA, 19 nt, Homo sapiens
ggugccaagagacugguua

SEQ ID NO: 1024743 - RNA, 19 nt, Homo sapiens
gagcagcaagaacagagau

SEQ ID NO: 1024744 - RNA, 19 nt, Homo sapiens
gaagcugagaggacagaca

SEQ ID NO: 1024745 - RNA, 19 nt, Homo sapiens
ugaaggaugaagccagaga

SEQ ID NO: 1024746 - RNA, 19 nt, Homo sapiens
uccuggagcugggaacuga

SEQ ID NO: 1024747 - RNA, 19 nt, Homo sapiens
cuuccacggugcuggcaaa

SEQ ID NO: 1024748 - RNA, 19 nt, Homo sapiens
gagcuggagcaagcaaaug

SEQ ID NO: 1024749 - RNA, 19 nt, Homo sapiens
gaaaccaucaaggagaagu

SEQ ID NO: 1024750 - RNA, 19 nt, Homo sapiens
caagaucucuccaguauaa

SEQ ID NO: 1024751 - RNA, 19 nt, Homo sapiens
aaagauaccucaagcauaa

SEQ ID NO: 1024752 - RNA, 19 nt, Homo sapiens
ggaggucucuuauuaauau

SEQ ID NO: 1024753 - RNA, 19 nt, Homo sapiens
gaaagacgaugaaccagaa

SEQ ID NO: 1024754 - RNA, 19 nt, Homo sapiens
gaagaaaugcccuaaauug

SEQ ID NO: 1024755 - RNA, 19 nt, Homo sapiens
ucuaggaggucucuuauua

SEQ ID NO: 1024756 - RNA, 19 nt, Homo sapiens
ugaaauagcugaugaccuu

SEQ ID NO: 1024757 - RNA, 19 nt, Homo sapiens
gaauguaaccuguuuauug

SEQ ID NO: 1024758 - RNA, 19 nt, Homo sapiens
gaaaugcccuaaauugaau

SEQ ID NO: 1024759 - RNA, 19 nt, Homo sapiens
gagaaacacugucuucaga

SEQ ID NO: 1024760 - RNA, 19 nt, Homo sapiens
caaaggguccugaagauua

SEQ ID NO: 1024761 - RNA, 19 nt, Homo sapiens
gaaacacugucuucagaaa

SEQ ID NO: 1024762 - RNA, 19 nt, Homo sapiens
caacacaucucucuuucaa

SEQ ID NO: 1024763 - RNA, 19 nt, Homo sapiens
uuaaagcgcuugacauaaa

SEQ ID NO: 1024764 - RNA, 19 nt, Homo sapiens
guagaagaaucucacuaua

SEQ ID NO: 1024765 - RNA, 19 nt, Homo sapiens
caacaaagaacuagaaaug

SEQ ID NO: 1024766 - RNA, 19 nt, Homo sapiens
acacaucucucuuucaauu

SEQ ID NO: 1024767 - RNA, 19 nt, Homo sapiens
gcuaagagaaccuguauuu

SEQ ID NO: 1024768 - RNA, 19 nt, Homo sapiens
guuaugcucuugacuuuaa

SEQ ID NO: 1024769 - RNA, 19 nt, Homo sapiens
gaacaacaaagaacuagaa

SEQ ID NO: 1024770 - RNA, 19 nt, Homo sapiens
caugugaucugucuguuaa

SEQ ID NO: 1024771 - RNA, 19 nt, Homo sapiens
gaaacaauuugaugcuuca

SEQ ID NO: 1024772 - RNA, 19 nt, Homo sapiens
cagaagaaguaguaguuaa

SEQ ID NO: 1024773 - RNA, 19 nt, Homo sapiens
caaauacccaguaguguaa

SEQ ID NO: 1024774 - RNA, 19 nt, Homo sapiens
gaaccuguauuuccuucuu

SEQ ID NO: 1024775 - RNA, 19 nt, Homo sapiens
gaagaacuuuguacuaacu

SEQ ID NO: 1024776 - RNA, 19 nt, Homo sapiens
aaacaaguccagcugguua

SEQ ID NO: 1024777 - RNA, 19 nt, Homo sapiens
caaagagggugagaaacaa

SEQ ID NO: 1024778 - RNA, 19 nt, Homo sapiens
aagaagaaaugcccuaaau

SEQ ID NO: 1024779 - RNA, 19 nt, Homo sapiens
ucugagcacuagcuuaaua

SEQ ID NO: 1024780 - RNA, 19 nt, Homo sapiens
ggcgaagccuccaaguaua

SEQ ID NO: 1024781 - RNA, 19 nt, Homo sapiens
cuagaaggauuguuucaga

SEQ ID NO: 1024782 - RNA, 19 nt, Homo sapiens
guauaaaggugaauguuac

SEQ ID NO: 1024783 - RNA, 19 nt, Homo sapiens
aacaagaucucuccaguau

SEQ ID NO: 1024784 - RNA, 19 nt, Homo sapiens
guagaagaacuuuguacua

SEQ ID NO: 1024785 - RNA, 19 nt, Homo sapiens
ucaaauacccaguagugua

SEQ ID NO: 1024786 - RNA, 19 nt, Homo sapiens
guacacaugugaucugucu

SEQ ID NO: 1024787 - RNA, 19 nt, Homo sapiens
gaagauaucaguuccaaaa

SEQ ID NO: 1024788 - RNA, 19 nt, Homo sapiens
cggcagaggcuacaaauga

SEQ ID NO: 1024789 - RNA, 19 nt, Homo sapiens
uaaagauaccucaagcaua

SEQ ID NO: 1024790 - RNA, 19 nt, Homo sapiens
acuaaaggaugaugagauu

SEQ ID NO: 1024791 - RNA, 19 nt, Homo sapiens
uagaucaacuaaaggauga

SEQ ID NO: 1024792 - RNA, 19 nt, Homo sapiens
caacaaaggguucagaaag

SEQ ID NO: 1024793 - RNA, 19 nt, Homo sapiens
gagcacuagcuuaauauuu

SEQ ID NO: 1024794 - RNA, 19 nt, Homo sapiens
gaaagaaaauagcuugugu

SEQ ID NO: 1024795 - RNA, 19 nt, Homo sapiens
ggacauggaggaaagacuu

SEQ ID NO: 1024796 - RNA, 19 nt, Homo sapiens
uaggaggucucuuauuaau

SEQ ID NO: 1024797 - RNA, 19 nt, Homo sapiens
ucucaucugugaaacaauu

SEQ ID NO: 1024798 - RNA, 19 nt, Homo sapiens
ccaaagagggugagaaaca

SEQ ID NO: 1024799 - RNA, 19 nt, Homo sapiens
acaaagaacuagaaaugag

SEQ ID NO: 1024800 - RNA, 19 nt, Homo sapiens
ugaagauuauccagaagaa

SEQ ID NO: 1024801 - RNA, 19 nt, Homo sapiens
gaauucgagucucaaaaua

SEQ ID NO: 1024802 - RNA, 19 nt, Homo sapiens
gguagaagaaucucacuau

SEQ ID NO: 1024803 - RNA, 19 nt, Homo sapiens
ucccauaauuggauucuuu

SEQ ID NO: 1024804 - RNA, 19 nt, Homo sapiens
gagaauguaaccuguuuau

SEQ ID NO: 1024805 - RNA, 19 nt, Homo sapiens
gcaaaggguccugaagauu

SEQ ID NO: 1024806 - RNA, 19 nt, Homo sapiens
aaguaaagcuagaaggauu

SEQ ID NO: 1024807 - RNA, 19 nt, Homo sapiens
uagagcauguugagaaaga

SEQ ID NO: 1024808 - RNA, 19 nt, Homo sapiens
agaaaugcccuaaauugaa

SEQ ID NO: 1024809 - RNA, 19 nt, Homo sapiens
gugcagauccugaaguuau

SEQ ID NO: 1024810 - RNA, 19 nt, Homo sapiens
cgacagcagugaagcaaag

SEQ ID NO: 1024811 - RNA, 19 nt, Homo sapiens
cgaugaaccagaagaagua

SEQ ID NO: 1024812 - RNA, 19 nt, Homo sapiens
uugaugaucugcccaaaga

SEQ ID NO: 1024813 - RNA, 19 nt, Homo sapiens
gcugguuaaugacgucuaa

SEQ ID NO: 1024814 - RNA, 19 nt, Homo sapiens
aaaggguccugaagauuau

SEQ ID NO: 1024815 - RNA, 19 nt, Homo sapiens
auaaagaguuccugaugga

SEQ ID NO: 1024816 - RNA, 19 nt, Homo sapiens
ggggauagcuggaaucuca

SEQ ID NO: 1024817 - RNA, 19 nt, Homo sapiens
gcacuagcuuaauauuucu

SEQ ID NO: 1024818 - RNA, 19 nt, Homo sapiens
ucaauucucaucugugaaa

SEQ ID NO: 1024819 - RNA, 19 nt, Homo sapiens
aaacaagaucucuccagua

SEQ ID NO: 1024820 - RNA, 19 nt, Homo sapiens
agaagagcuugauguggua

SEQ ID NO: 1024821 - RNA, 19 nt, Homo sapiens
uaaagaagagcuugaugug

SEQ ID NO: 1024822 - RNA, 19 nt, Homo sapiens
ugaucugucuguuaaagaa

SEQ ID NO: 1024823 - RNA, 19 nt, Homo sapiens
gaaguaguaguuaaagcaa

SEQ ID NO: 1024824 - RNA, 19 nt, Homo sapiens
guaugcaugugauuucaau

SEQ ID NO: 1024825 - RNA, 19 nt, Homo sapiens
guuuggaaguguagaagaa

SEQ ID NO: 1024826 - RNA, 19 nt, Homo sapiens
gcccaaagagggugagaaa

SEQ ID NO: 1024827 - RNA, 19 nt, Homo sapiens
gcaaguguagucauugaug

SEQ ID NO: 1024828 - RNA, 19 nt, Homo sapiens
aaagcuagaaggauuguuu

SEQ ID NO: 1024829 - RNA, 19 nt, Homo sapiens
aagaaaugcccuaaauuga

SEQ ID NO: 1024830 - RNA, 19 nt, Homo sapiens
ccagaagaaguaguaguua

SEQ ID NO: 1024831 - RNA, 19 nt, Homo sapiens
caaagaagaaaugcccuaa

SEQ ID NO: 1024832 - RNA, 19 nt, Homo sapiens
uuaacuguguuguuucuug

SEQ ID NO: 1024833 - RNA, 19 nt, Homo sapiens
uuucaauucucaucuguga

SEQ ID NO: 1024834 - RNA, 19 nt, Homo sapiens
gaaguaaagcuagaaggau

SEQ ID NO: 1024835 - RNA, 19 nt, Homo sapiens
aaucagaaguaaagcuaga

SEQ ID NO: 1024836 - RNA, 19 nt, Homo sapiens
agaggaaccuucagcaucu

SEQ ID NO: 1024837 - RNA, 19 nt, Homo sapiens
ugcaauccuuggcccauua

SEQ ID NO: 1024838 - RNA, 19 nt, Homo sapiens
uugccuaccugcagucuuu

SEQ ID NO: 1024839 - RNA, 19 nt, Homo sapiens
agcacuagcuuaauauuuc

SEQ ID NO: 1024840 - RNA, 19 nt, Homo sapiens
aagcauaaauccauucaac

SEQ ID NO: 1024841 - RNA, 19 nt, Homo sapiens
gaagaaguaguaguuaaag

SEQ ID NO: 1024842 - RNA, 19 nt, Homo sapiens
ugaaccagaagaaguagua

SEQ ID NO: 1024843 - RNA, 19 nt, Homo sapiens
guacuuagcaaaucaacca

SEQ ID NO: 1024844 - RNA, 19 nt, Homo sapiens
guuaccaccuugcaagaug

SEQ ID NO: 1024845 - RNA, 19 nt, Homo sapiens
uugagaauguaaccuguuu

SEQ ID NO: 1024846 - RNA, 19 nt, Homo sapiens
aaguccagcugguuaauga

SEQ ID NO: 1024847 - RNA, 19 nt, Homo sapiens
gaggauccuuccggagaaa

SEQ ID NO: 1024848 - RNA, 19 nt, Homo sapiens
uggcgaagccuccaaguau

SEQ ID NO: 1024849 - RNA, 19 nt, Homo sapiens
ccucaagcauaaauccauu

SEQ ID NO: 1024850 - RNA, 19 nt, Homo sapiens
gauuauggcucuuguauua

SEQ ID NO: 1024851 - RNA, 19 nt, Homo sapiens
gaaaggagcuuaucacugu

SEQ ID NO: 1024852 - RNA, 19 nt, Homo sapiens
gaacagaugugcauucaga

SEQ ID NO: 1024853 - RNA, 19 nt, Homo sapiens
gaaaagagauccugugaua

SEQ ID NO: 1024854 - RNA, 19 nt, Homo sapiens
gaaauaacuugaugagguu

SEQ ID NO: 1024855 - RNA, 19 nt, Homo sapiens
ggaaaugacuuguucuaau

SEQ ID NO: 1024856 - RNA, 19 nt, Homo sapiens
ucacagagcauuccauuua

SEQ ID NO: 1024857 - RNA, 19 nt, Homo sapiens
ggaaagaaauaacuugaug

SEQ ID NO: 1024858 - RNA, 19 nt, Homo sapiens
ugaaauugcucacuuauga

SEQ ID NO: 1024859 - RNA, 19 nt, Homo sapiens
cgaagacacucaugaagua

SEQ ID NO: 1024860 - RNA, 19 nt, Homo sapiens
ggauagaguugcauuugua

SEQ ID NO: 1024861 - RNA, 19 nt, Homo sapiens
guuaauacauggucaagua

SEQ ID NO: 1024862 - RNA, 19 nt, Homo sapiens
gaagggaaaugacuuguuc

SEQ ID NO: 1024863 - RNA, 19 nt, Homo sapiens
acgaagagcugucaaagua

SEQ ID NO: 1024864 - RNA, 19 nt, Homo sapiens
guucaagaauggauuguua

SEQ ID NO: 1024865 - RNA, 19 nt, Homo sapiens
ggguuaggcuccauauuua

SEQ ID NO: 1024866 - RNA, 19 nt, Homo sapiens
gaagagaguucacccaaca

SEQ ID NO: 1024867 - RNA, 19 nt, Homo sapiens
ccacuggacuuacgaauau

SEQ ID NO: 1024868 - RNA, 19 nt, Homo sapiens
gaacauaacagaagagauc

SEQ ID NO: 1024869 - RNA, 19 nt, Homo sapiens
gcucacaccuguacacaaa

SEQ ID NO: 1024870 - RNA, 19 nt, Homo sapiens
ggaggaaauuguuugguaa

SEQ ID NO: 1024871 - RNA, 19 nt, Homo sapiens
ccauauaguuucucuguuu

SEQ ID NO: 1024872 - RNA, 19 nt, Homo sapiens
ggaaguguuuaaagaagua

SEQ ID NO: 1024873 - RNA, 19 nt, Homo sapiens
gaaauacucagaugugaaa

SEQ ID NO: 1024874 - RNA, 19 nt, Homo sapiens
gggaggaaauuguuuggua

SEQ ID NO: 1024875 - RNA, 19 nt, Homo sapiens
ggucaaguauuuacaaaga

SEQ ID NO: 1024876 - RNA, 19 nt, Homo sapiens
gagggaauguguauauauu

SEQ ID NO: 1024877 - RNA, 19 nt, Homo sapiens
gaaggcaauuuccaauauu

SEQ ID NO: 1024878 - RNA, 19 nt, Homo sapiens
gaacaguccuucagacaag

SEQ ID NO: 1024879 - RNA, 19 nt, Homo sapiens
gagaugugguugcuccuua

SEQ ID NO: 1024880 - RNA, 19 nt, Homo sapiens
caugaacucuugcauauau

SEQ ID NO: 1024881 - RNA, 19 nt, Homo sapiens
gaagagcaguguguugaaa

SEQ ID NO: 1024882 - RNA, 19 nt, Homo sapiens
ucaguuggccguugaauua

SEQ ID NO: 1024883 - RNA, 19 nt, Homo sapiens
ggaguuggucgcacaauua

SEQ ID NO: 1024884 - RNA, 19 nt, Homo sapiens
cugaagaacuggaguaauu

SEQ ID NO: 1024885 - RNA, 19 nt, Homo sapiens
gaccaaagauugauacagu

SEQ ID NO: 1024886 - RNA, 19 nt, Homo sapiens
caccaaaccugaagucauu

SEQ ID NO: 1024887 - RNA, 19 nt, Homo sapiens
acacuuagcuccucucuuc

SEQ ID NO: 1024888 - RNA, 19 nt, Homo sapiens
ggacuaagauuuggagcaa

SEQ ID NO: 1024889 - RNA, 19 nt, Homo sapiens
gaagaacuuuacaacacua

SEQ ID NO: 1024890 - RNA, 19 nt, Homo sapiens
ggaguaagcaugcauaaau

SEQ ID NO: 1024891 - RNA, 19 nt, Homo sapiens
gaagagagaauucguguca

SEQ ID NO: 1024892 - RNA, 19 nt, Homo sapiens
gaguaagcaugcauaaauu

SEQ ID NO: 1024893 - RNA, 19 nt, Homo sapiens
gcaccucacagaaauguua

SEQ ID NO: 1024894 - RNA, 19 nt, Homo sapiens
gaaaguaaaccagaagauu

SEQ ID NO: 1024895 - RNA, 19 nt, Homo sapiens
ccauauugcuguuagagua

SEQ ID NO: 1024896 - RNA, 19 nt, Homo sapiens
ggaugagccuucagauuug

SEQ ID NO: 1024897 - RNA, 19 nt, Homo sapiens
gggaggagguuuacgaaga

SEQ ID NO: 1024898 - RNA, 19 nt, Homo sapiens
ggucucacuucuccauuua

SEQ ID NO: 1024899 - RNA, 19 nt, Homo sapiens
gaaagaaagauaagacuuc

SEQ ID NO: 1024900 - RNA, 19 nt, Homo sapiens
ggcaggaccuuauguaaug

SEQ ID NO: 1024901 - RNA, 19 nt, Homo sapiens
gaaguuaccuuuugaggaa

SEQ ID NO: 1024902 - RNA, 19 nt, Homo sapiens
aaggugaucuugaaaguaa

SEQ ID NO: 1024903 - RNA, 19 nt, Homo sapiens
caagauagaccaucaaaca

SEQ ID NO: 1024904 - RNA, 19 nt, Homo sapiens
ggacgugguugacuccauu

SEQ ID NO: 1024905 - RNA, 19 nt, Homo sapiens
gcucuuguauuacuuaguu

SEQ ID NO: 1024906 - RNA, 19 nt, Homo sapiens
ucucuuaugugguacaaua

SEQ ID NO: 1024907 - RNA, 19 nt, Homo sapiens
gaagagcugucaaaguaca

SEQ ID NO: 1024908 - RNA, 19 nt, Homo sapiens
gaacugagcauuuccaaac

SEQ ID NO: 1024909 - RNA, 19 nt, Homo sapiens
ugaaggcaauuuccaauau

SEQ ID NO: 1024910 - RNA, 19 nt, Homo sapiens
gcagagcccgauauuauuu

SEQ ID NO: 1024911 - RNA, 19 nt, Homo sapiens
cagcagagcccgauauuau

SEQ ID NO: 1024912 - RNA, 19 nt, Homo sapiens
gauuugcacuaucggaaua

SEQ ID NO: 1024913 - RNA, 19 nt, Homo sapiens
ccaaauccauaccauauuc

SEQ ID NO: 1024914 - RNA, 19 nt, Homo sapiens
ggagaugggaggagguuua

SEQ ID NO: 1024915 - RNA, 19 nt, Homo sapiens
ugaaguagauuccaaagca

SEQ ID NO: 1024916 - RNA, 19 nt, Homo sapiens
uaagaucuaucguucaaug

SEQ ID NO: 1024917 - RNA, 19 nt, Homo sapiens
gcaacauggugaagaauca

SEQ ID NO: 1024918 - RNA, 19 nt, Homo sapiens
cagcagcacuccucaguug

SEQ ID NO: 1024919 - RNA, 19 nt, Homo sapiens
ccaaugcuguuucaucuug

SEQ ID NO: 1024920 - RNA, 19 nt, Homo sapiens
gaagaauggucuguggaaa

SEQ ID NO: 1024921 - RNA, 19 nt, Homo sapiens
gagaugauaagcuguuuaa

SEQ ID NO: 1024922 - RNA, 19 nt, Homo sapiens
gaacugaagaacuggagua

SEQ ID NO: 1024923 - RNA, 19 nt, Homo sapiens
aaaccaagcgcuuuccuua

SEQ ID NO: 1024924 - RNA, 19 nt, Homo sapiens
gcacagcccuaccgaccaa

SEQ ID NO: 1024925 - RNA, 19 nt, Homo sapiens
gcaaauggaguuacccaaa

SEQ ID NO: 1024926 - RNA, 19 nt, Homo sapiens
uaggauuucugaugcuuua

SEQ ID NO: 1024927 - RNA, 19 nt, Homo sapiens
agagugaccugguagauga

SEQ ID NO: 1024928 - RNA, 19 nt, Homo sapiens
uaaacaagguccaacuaau

SEQ ID NO: 1024929 - RNA, 19 nt, Homo sapiens
gagggugggccaaauguua

SEQ ID NO: 1024930 - RNA, 19 nt, Homo sapiens
gagaugcccucaaagaaca

SEQ ID NO: 1024931 - RNA, 19 nt, Homo sapiens
uuacaaacuucuccaaaga

SEQ ID NO: 1024932 - RNA, 19 nt, Homo sapiens
ucaagucacuguuaaguag

SEQ ID NO: 1024933 - RNA, 19 nt, Homo sapiens
gaggaucucauuugacuuu

SEQ ID NO: 1024934 - RNA, 19 nt, Homo sapiens
gcaaaugcauaugauaauc

SEQ ID NO: 1024935 - RNA, 19 nt, Homo sapiens
gaacaugcuuccagaucau

SEQ ID NO: 1024936 - RNA, 19 nt, Homo sapiens
caacuaauacucuggaaga

SEQ ID NO: 1024937 - RNA, 19 nt, Homo sapiens
agaaggagauaauacagaa

SEQ ID NO: 1024938 - RNA, 19 nt, Homo sapiens
gaagcuagcaaaguucaua

SEQ ID NO: 1024939 - RNA, 19 nt, Homo sapiens
gcuaugaaauugcucacuu

SEQ ID NO: 1024940 - RNA, 19 nt, Homo sapiens
gcauucccauuucauauug

SEQ ID NO: 1024941 - RNA, 19 nt, Homo sapiens
gaacccaaauuguguaaaa

SEQ ID NO: 1024942 - RNA, 19 nt, Homo sapiens
ggacgguauuuaugaauca

SEQ ID NO: 1024943 - RNA, 19 nt, Homo sapiens
gcauucagauuaaagaagu

SEQ ID NO: 1024944 - RNA, 19 nt, Homo sapiens
ccauggaaguguuuaaaga

SEQ ID NO: 1024945 - RNA, 19 nt, Homo sapiens
cuaugaaauugcucacuua

SEQ ID NO: 1024946 - RNA, 19 nt, Homo sapiens
ccaaagauugauacaguua

SEQ ID NO: 1024947 - RNA, 19 nt, Homo sapiens
aaacaugaacucuugcaua

SEQ ID NO: 1024948 - RNA, 19 nt, Homo sapiens
gaucucauuugacuuuguu

SEQ ID NO: 1024949 - RNA, 19 nt, Homo sapiens
ugagagaaauucaacaaca

SEQ ID NO: 1024950 - RNA, 19 nt, Homo sapiens
gaacaaugaugaucgagua

SEQ ID NO: 1024951 - RNA, 19 nt, Homo sapiens
ggauuuaccuggagaguua

SEQ ID NO: 1024952 - RNA, 19 nt, Homo sapiens
gcagaaaacugaacauuua

SEQ ID NO: 1024953 - RNA, 19 nt, Homo sapiens
gaacagcacggauguauuu

SEQ ID NO: 1024954 - RNA, 19 nt, Homo sapiens
gaaaucagaucauacagau

SEQ ID NO: 1024955 - RNA, 19 nt, Homo sapiens
gaaauugacuuagaagaug

SEQ ID NO: 1024956 - RNA, 19 nt, Homo sapiens
caacagaaguaccagguuu

SEQ ID NO: 1024957 - RNA, 19 nt, Homo sapiens
gauuauaacuccaacaaga

SEQ ID NO: 1024958 - RNA, 19 nt, Homo sapiens
ggaauugcauuuguccuua

SEQ ID NO: 1024959 - RNA, 19 nt, Homo sapiens
ggaauaaacuccauagacu

SEQ ID NO: 1024960 - RNA, 19 nt, Homo sapiens
gaagacagaagaucaguuu

SEQ ID NO: 1024961 - RNA, 19 nt, Homo sapiens
ggauauaaguacugauuug

SEQ ID NO: 1024962 - RNA, 19 nt, Homo sapiens
gaagacaugcucaacuaua

SEQ ID NO: 1024963 - RNA, 19 nt, Homo sapiens
gaaagagaauaccuggaaa

SEQ ID NO: 1024964 - RNA, 19 nt, Homo sapiens
gaagaagcauuuauauguc

SEQ ID NO: 1024965 - RNA, 19 nt, Homo sapiens
ugaaagaacucaagaaagg

SEQ ID NO: 1024966 - RNA, 19 nt, Homo sapiens
gugaagacaugcucaacua

SEQ ID NO: 1024967 - RNA, 19 nt, Homo sapiens
gaacagguuuaucuucaau

SEQ ID NO: 1024968 - RNA, 19 nt, Homo sapiens
agaauugagugcagaguua

SEQ ID NO: 1024969 - RNA, 19 nt, Homo sapiens
caaagaagcaucauauuca

SEQ ID NO: 1024970 - RNA, 19 nt, Homo sapiens
gcauuuguccuuaagaaua

SEQ ID NO: 1024971 - RNA, 19 nt, Homo sapiens
ggaaaggagagccguauuu

SEQ ID NO: 1024972 - RNA, 19 nt, Homo sapiens
caaagaauccugugggaaa

SEQ ID NO: 1024973 - RNA, 19 nt, Homo sapiens
ggauguauuucaaagauug

SEQ ID NO: 1024974 - RNA, 19 nt, Homo sapiens
ccagaaacuuguagaagaa

SEQ ID NO: 1024975 - RNA, 19 nt, Homo sapiens
caagaaaucuggucuaucc

SEQ ID NO: 1024976 - RNA, 19 nt, Homo sapiens
ccagugaugugaaaccuaa

SEQ ID NO: 1024977 - RNA, 19 nt, Homo sapiens
gcagaguccuucuucaaau

SEQ ID NO: 1024978 - RNA, 19 nt, Homo sapiens
gaaauugacacucucagaa

SEQ ID NO: 1024979 - RNA, 19 nt, Homo sapiens
gccaguaucucuaaggaaa

SEQ ID NO: 1024980 - RNA, 19 nt, Homo sapiens
gaauugcauuuguccuuaa

SEQ ID NO: 1024981 - RNA, 19 nt, Homo sapiens
gaugaaagaacucaagaaa

SEQ ID NO: 1024982 - RNA, 19 nt, Homo sapiens
caaauuuacugcccaggaa

SEQ ID NO: 1024983 - RNA, 19 nt, Homo sapiens
gagagaagaugaaagaacu

SEQ ID NO: 1024984 - RNA, 19 nt, Homo sapiens
ccaaagaccuauuaaacuc

SEQ ID NO: 1024985 - RNA, 19 nt, Homo sapiens
uaagaucaguuucaucaga

SEQ ID NO: 1024986 - RNA, 19 nt, Homo sapiens
caaugcaucuguuuauaug

SEQ ID NO: 1024987 - RNA, 19 nt, Homo sapiens
gaaggaauucaaaggauuu

SEQ ID NO: 1024988 - RNA, 19 nt, Homo sapiens
gaaguuuguuacaugcuuu

SEQ ID NO: 1024989 - RNA, 19 nt, Homo sapiens
ccaacaagauaauuaagga

SEQ ID NO: 1024990 - RNA, 19 nt, Homo sapiens
gcacggauguauuucaaag

SEQ ID NO: 1024991 - RNA, 19 nt, Homo sapiens
guaaacaaccuccuucaga

SEQ ID NO: 1024992 - RNA, 19 nt, Homo sapiens
aaacaacacccuugaaaga

SEQ ID NO: 1024993 - RNA, 19 nt, Homo sapiens
gcagaguuauuacacuuau

SEQ ID NO: 1024994 - RNA, 19 nt, Homo sapiens
aaacaaaggccuaauaagu

SEQ ID NO: 1024995 - RNA, 19 nt, Homo sapiens
ggugaucgccuauuacuga

SEQ ID NO: 1024996 - RNA, 19 nt, Homo sapiens
guacaaggucaaauuauga

SEQ ID NO: 1024997 - RNA, 19 nt, Homo sapiens
ggaaauugacuuagaagau

SEQ ID NO: 1024998 - RNA, 19 nt, Homo sapiens
ggaugcagaucaagagaug

SEQ ID NO: 1024999 - RNA, 19 nt, Homo sapiens
gcaaugcaucuguuuauau

SEQ ID NO: 1025000 - RNA, 19 nt, Homo sapiens
guacauuccuccucugcaa

SEQ ID NO: 1025001 - RNA, 19 nt, Homo sapiens
guauggaaauugacuuaga

SEQ ID NO: 1025002 - RNA, 19 nt, Homo sapiens
gcucccagguuucauuaaa

SEQ ID NO: 1025003 - RNA, 19 nt, Homo sapiens
ggaacagguuuaucuucaa

SEQ ID NO: 1025004 - RNA, 19 nt, Homo sapiens
gaaaggaagaaacaguaaa

SEQ ID NO: 1025005 - RNA, 19 nt, Homo sapiens
ugaagucacucaguaaaga

SEQ ID NO: 1025006 - RNA, 19 nt, Homo sapiens
caaugaugaucgaguacua

SEQ ID NO: 1025007 - RNA, 19 nt, Homo sapiens
ugacuuagaagaugaugua

SEQ ID NO: 1025008 - RNA, 19 nt, Homo sapiens
guccuaagauugccaguga

SEQ ID NO: 1025009 - RNA, 19 nt, Homo sapiens
gcauuucuuucaacccuaa

SEQ ID NO: 1025010 - RNA, 19 nt, Homo sapiens
gagaguguuuggauuacaa

SEQ ID NO: 1025011 - RNA, 19 nt, Homo sapiens
cuagagaguguuuggauua

SEQ ID NO: 1025012 - RNA, 19 nt, Homo sapiens
ccacagaccuuugcucaag

SEQ ID NO: 1025013 - RNA, 19 nt, Homo sapiens
cauggacucuacuacauuu

SEQ ID NO: 1025014 - RNA, 19 nt, Homo sapiens
cauuguaucugaucuugaa

SEQ ID NO: 1025015 - RNA, 19 nt, Homo sapiens
uuagagaaauggaagagaa

SEQ ID NO: 1025016 - RNA, 19 nt, Homo sapiens
ccagcaaguucuacuaguu

SEQ ID NO: 1025017 - RNA, 19 nt, Homo sapiens
uugcagaggucaagacaaa

SEQ ID NO: 1025018 - RNA, 19 nt, Homo sapiens
gaagaucaguuucaaaauc

SEQ ID NO: 1025019 - RNA, 19 nt, Homo sapiens
ucugugggcuugucacuuu

SEQ ID NO: 1025020 - RNA, 19 nt, Homo sapiens
gaucaugcucaccauauuu

SEQ ID NO: 1025021 - RNA, 19 nt, Homo sapiens
ugaaagagagcuauaagga

SEQ ID NO: 1025022 - RNA, 19 nt, Homo sapiens
ugacacaaauauucugaug

SEQ ID NO: 1025023 - RNA, 19 nt, Homo sapiens
gcucugacuacuucaaaua

SEQ ID NO: 1025024 - RNA, 19 nt, Homo sapiens
gaguauggaaauugacuua

SEQ ID NO: 1025025 - RNA, 19 nt, Homo sapiens
gacagaagaucaguuucaa

SEQ ID NO: 1025026 - RNA, 19 nt, Homo sapiens
aaaaggugaucgccuauua

SEQ ID NO: 1025027 - RNA, 19 nt, Homo sapiens
ccaggaaauuuaugauugu

SEQ ID NO: 1025028 - RNA, 19 nt, Homo sapiens
cuaauaaggcaguggauuu

SEQ ID NO: 1025029 - RNA, 19 nt, Homo sapiens
aaggaggaaucuacaaauu

SEQ ID NO: 1025030 - RNA, 19 nt, Homo sapiens
gcagaaacaacacccuuga

SEQ ID NO: 1025031 - RNA, 19 nt, Homo sapiens
guucaugaguggaaacgaa

SEQ ID NO: 1025032 - RNA, 19 nt, Homo sapiens
gaagcaucauauucaaaug

SEQ ID NO: 1025033 - RNA, 19 nt, Homo sapiens
uaaaggaauugcauuuguc

SEQ ID NO: 1025034 - RNA, 19 nt, Homo sapiens
cagcaggcaucaagaaauc

SEQ ID NO: 1025035 - RNA, 19 nt, Homo sapiens
ucaguacaaggucaaauua

SEQ ID NO: 1025036 - RNA, 19 nt, Homo sapiens
gaaacaacacccuugaaag

SEQ ID NO: 1025037 - RNA, 19 nt, Homo sapiens
agaaacaaaggccuaauaa

SEQ ID NO: 1025038 - RNA, 19 nt, Homo sapiens
gcaaauaauacuucagaca

SEQ ID NO: 1025039 - RNA, 19 nt, Homo sapiens
ucaaagaagcaucauauuc

SEQ ID NO: 1025040 - RNA, 19 nt, Homo sapiens
gagccaguaucucuaagga

SEQ ID NO: 1025041 - RNA, 19 nt, Homo sapiens
gaaaacacagugacuaaaa

SEQ ID NO: 1025042 - RNA, 19 nt, Homo sapiens
agacaaaacuuaagccaaa

SEQ ID NO: 1025043 - RNA, 19 nt, Homo sapiens
gacaaggacugaaaagauu

SEQ ID NO: 1025044 - RNA, 19 nt, Homo sapiens
caucagccuuguauuccua

SEQ ID NO: 1025045 - RNA, 19 nt, Homo sapiens
cccaggaaauuuaugauug

SEQ ID NO: 1025046 - RNA, 19 nt, Homo sapiens
gaccuuugcucaaguaaac

SEQ ID NO: 1025047 - RNA, 19 nt, Homo sapiens
aaacauugguuggcuguau

SEQ ID NO: 1025048 - RNA, 19 nt, Homo sapiens
cauuauggauugagugaug

SEQ ID NO: 1025049 - RNA, 19 nt, Homo sapiens
gagcaagcuugaccaugga

SEQ ID NO: 1025050 - RNA, 19 nt, Homo sapiens
gcacaggcaucaauacaug

SEQ ID NO: 1025051 - RNA, 19 nt, Homo sapiens
gcacacagcaggcacuuga

SEQ ID NO: 1025052 - RNA, 19 nt, Homo sapiens
cagaaaugcugguagaaug

SEQ ID NO: 1025053 - RNA, 19 nt, Homo sapiens
ggucagaaaugcugguaga

SEQ ID NO: 1025054 - RNA, 19 nt, Homo sapiens
gaacaccacuggcuuucuc

SEQ ID NO: 1025055 - RNA, 19 nt, Homo sapiens
gaucaugggugccaagucu

SEQ ID NO: 1025056 - RNA, 19 nt, Homo sapiens
uuaagaagcagacacauuu

SEQ ID NO: 1025057 - RNA, 19 nt, Homo sapiens
gcagacacauuuguugaau

SEQ ID NO: 1025058 - RNA, 19 nt, Homo sapiens
gccuagagcucaccugaug

SEQ ID NO: 1025059 - RNA, 19 nt, Homo sapiens
gaaaugcugguagaaugua

SEQ ID NO: 1025060 - RNA, 19 nt, Homo sapiens
gaagcagacacauuuguug

SEQ ID NO: 1025061 - RNA, 19 nt, Homo sapiens
cagacacauuuguugaaua

SEQ ID NO: 1025062 - RNA, 19 nt, Homo sapiens
ccugagggcugaaggauca

SEQ ID NO: 1025063 - RNA, 19 nt, Homo sapiens
gaacaugggcuaaaacaga

SEQ ID NO: 1025064 - RNA, 19 nt, Homo sapiens
gagacuguucugacacuua

SEQ ID NO: 1025065 - RNA, 19 nt, Homo sapiens
gggcacaucgcuucucuga

SEQ ID NO: 1025066 - RNA, 19 nt, Homo sapiens
gcauaauucacagacaaua

SEQ ID NO: 1025067 - RNA, 19 nt, Homo sapiens
caggcucucuagcagcuua

SEQ ID NO: 1025068 - RNA, 19 nt, Homo sapiens
gcucaaugauggucagcau

SEQ ID NO: 1025069 - RNA, 19 nt, Homo sapiens
cagcuucauugaggcauaa

SEQ ID NO: 1025070 - RNA, 19 nt, Homo sapiens
gaauguaggggaaaaugua

SEQ ID NO: 1025071 - RNA, 19 nt, Homo sapiens
agaaugaagcaauggauga

SEQ ID NO: 1025072 - RNA, 19 nt, Homo sapiens
ucagaacaccacuggcuuu

SEQ ID NO: 1025073 - RNA, 19 nt, Homo sapiens
ccacagggcuaugucuucu

SEQ ID NO: 1025074 - RNA, 19 nt, Homo sapiens
caccuugccagacacaaua

SEQ ID NO: 1025075 - RNA, 19 nt, Homo sapiens
agacuguucugacacuuag

SEQ ID NO: 1025076 - RNA, 19 nt, Homo sapiens
aggcauaauucacagacaa

SEQ ID NO: 1025077 - RNA, 19 nt, Homo sapiens
gcugaucgcccuuguacuc

SEQ ID NO: 1025078 - RNA, 19 nt, Homo sapiens
gauaacagccccuccaugu

SEQ ID NO: 1025079 - RNA, 19 nt, Homo sapiens
guggaagacucgggcuuug

SEQ ID NO: 1025080 - RNA, 19 nt, Homo sapiens
ggaagacucgggcuuugag

SEQ ID NO: 1025081 - RNA, 19 nt, Homo sapiens
gcuggcacaggcaucaaua

SEQ ID NO: 1025082 - RNA, 19 nt, Homo sapiens
uaagaagcagacacauuug

SEQ ID NO: 1025083 - RNA, 19 nt, Homo sapiens
ucucuucucucccaauucu

SEQ ID NO: 1025084 - RNA, 19 nt, Homo sapiens
ucucugagccugucuguac

SEQ ID NO: 1025085 - RNA, 19 nt, Homo sapiens
ggccuuguccuccaucuuc

SEQ ID NO: 1025086 - RNA, 19 nt, Homo sapiens
aagcagacacauuuguuga

SEQ ID NO: 1025087 - RNA, 19 nt, Homo sapiens
cagcaggcacuugacagua

SEQ ID NO: 1025088 - RNA, 19 nt, Homo sapiens
ucagaaaugcugguagaau

SEQ ID NO: 1025089 - RNA, 19 nt, Homo sapiens
agaagcagacacauuuguu

SEQ ID NO: 1025090 - RNA, 19 nt, Homo sapiens
acagcuucauugaggcaua

SEQ ID NO: 1025091 - RNA, 19 nt, Homo sapiens
gaggcauaauucacagaca

SEQ ID NO: 1025092 - RNA, 19 nt, Homo sapiens
gaaugaagcaauggaugag

SEQ ID NO: 1025093 - RNA, 19 nt, Homo sapiens
aggaucaccuugccagaca

SEQ ID NO: 1025094 - RNA, 19 nt, Homo sapiens
ucauccagcuggugcucaa

SEQ ID NO: 1025095 - RNA, 19 nt, Homo sapiens
agggcuaugucuucucuga

SEQ ID NO: 1025096 - RNA, 19 nt, Homo sapiens
ugggagcucugagaacaug

SEQ ID NO: 1025097 - RNA, 19 nt, Homo sapiens
agaaaugcugguagaaugu

SEQ ID NO: 1025098 - RNA, 19 nt, Homo sapiens
cagcuggugcucaaugaug

SEQ ID NO: 1025099 - RNA, 19 nt, Homo sapiens
uuuaagaagcagacacauu

SEQ ID NO: 1025100 - RNA, 19 nt, Homo sapiens
ccacuggcuuucucuucuc

SEQ ID NO: 1025101 - RNA, 19 nt, Homo sapiens
cauggauucuggcuguauc

SEQ ID NO: 1025102 - RNA, 19 nt, Homo sapiens
acagggcuaugucuucucu

SEQ ID NO: 1025103 - RNA, 19 nt, Homo sapiens
agugggagcucugagaaca

SEQ ID NO: 1025104 - RNA, 19 nt, Homo sapiens
uuucucuucucucccaauu

SEQ ID NO: 1025105 - RNA, 19 nt, Homo sapiens
uaucgggagcgcugucuug

SEQ ID NO: 1025106 - RNA, 19 nt, Homo sapiens
uccagcaccuugcaguuca

SEQ ID NO: 1025107 - RNA, 19 nt, Homo sapiens
uguacucgccgaaguggaa

SEQ ID NO: 1025108 - RNA, 19 nt, Homo sapiens
agcaggcacuugacaguag

SEQ ID NO: 1025109 - RNA, 19 nt, Homo sapiens
aaacagaacuuggggaacu

SEQ ID NO: 1025110 - RNA, 19 nt, Homo sapiens
gcucaucagugucaucaua

SEQ ID NO: 1025111 - RNA, 19 nt, Homo sapiens
cgaaacagcucaucagugu

SEQ ID NO: 1025112 - RNA, 19 nt, Homo sapiens
acacagggcuccucagaaa

SEQ ID NO: 1025113 - RNA, 19 nt, Homo sapiens
ccaaugaccuggacucugu

SEQ ID NO: 1025114 - RNA, 19 nt, Homo sapiens
gcaaagccaucgacuacga

SEQ ID NO: 1025115 - RNA, 19 nt, Homo sapiens
agacacaccucaacaucua

SEQ ID NO: 1025116 - RNA, 19 nt, Homo sapiens
gggcagaccucuuccaagu

SEQ ID NO: 1025117 - RNA, 19 nt, Homo sapiens
ugaaagacgugaacgacaa

SEQ ID NO: 1025118 - RNA, 19 nt, Homo sapiens
ggacuacaguauacauugu

SEQ ID NO: 1025119 - RNA, 19 nt, Homo sapiens
caaggcaccuaccaaguga

SEQ ID NO: 1025120 - RNA, 19 nt, Homo sapiens
gaaugacaaugcacccuau

SEQ ID NO: 1025121 - RNA, 19 nt, Homo sapiens
ggacuaacauguacaacac

SEQ ID NO: 1025122 - RNA, 19 nt, Homo sapiens
ccaaguggaucccgucuca

SEQ ID NO: 1025123 - RNA, 19 nt, Homo sapiens
cuaccucgaugccuacuuu

SEQ ID NO: 1025124 - RNA, 19 nt, Homo sapiens
caaccaggacuacaguaua

SEQ ID NO: 1025125 - RNA, 19 nt, Homo sapiens
gagcaaagccaucgacuac

SEQ ID NO: 1025126 - RNA, 19 nt, Homo sapiens
ucaaugacccugugaucua

SEQ ID NO: 1025127 - RNA, 19 nt, Homo sapiens
gacaagaacagucaggaaa

SEQ ID NO: 1025128 - RNA, 19 nt, Homo sapiens
ggacgugaaugacaaugca

SEQ ID NO: 1025129 - RNA, 19 nt, Homo sapiens
gcugaaggccugugacuug

SEQ ID NO: 1025130 - RNA, 19 nt, Homo sapiens
ggacagcgagcaucucuuc

SEQ ID NO: 1025131 - RNA, 19 nt, Homo sapiens
gggagaugcuggugauugu

SEQ ID NO: 1025132 - RNA, 19 nt, Homo sapiens
gagacacucuacacauuca

SEQ ID NO: 1025133 - RNA, 19 nt, Homo sapiens
ggacaccacggaccuguga

SEQ ID NO: 1025134 - RNA, 19 nt, Homo sapiens
caagaacagucaggaaauc

SEQ ID NO: 1025135 - RNA, 19 nt, Homo sapiens
agucagaccugucgaaaca

SEQ ID NO: 1025136 - RNA, 19 nt, Homo sapiens
gaauaagacuuuugugauc

SEQ ID NO: 1025137 - RNA, 19 nt, Homo sapiens
caacagccgucugcucuuc

SEQ ID NO: 1025138 - RNA, 19 nt, Homo sapiens
ggacaagaacagucaggaa

SEQ ID NO: 1025139 - RNA, 19 nt, Homo sapiens
cgacaacucuguggaugug

SEQ ID NO: 1025140 - RNA, 19 nt, Homo sapiens
gaccauggccuucgugugu

SEQ ID NO: 1025141 - RNA, 19 nt, Homo sapiens
caacggcucuguguacauc

SEQ ID NO: 1025142 - RNA, 19 nt, Homo sapiens
cggaagaccaggacaauga

SEQ ID NO: 1025143 - RNA, 19 nt, Homo sapiens
acaaugacccucugaccua

SEQ ID NO: 1025144 - RNA, 19 nt, Homo sapiens
acaaagaccugggcuugga

SEQ ID NO: 1025145 - RNA, 19 nt, Homo sapiens
caacaugacgucagugauc

SEQ ID NO: 1025146 - RNA, 19 nt, Homo sapiens
gagccuggauuacgagaca

SEQ ID NO: 1025147 - RNA, 19 nt, Homo sapiens
guaccucucucccuccaau

SEQ ID NO: 1025148 - RNA, 19 nt, Homo sapiens
agauacagcuugugaacau

SEQ ID NO: 1025149 - RNA, 19 nt, Homo sapiens
caguccagcuacaacuuua

SEQ ID NO: 1025150 - RNA, 19 nt, Homo sapiens
uauccgcgcugguggacua

SEQ ID NO: 1025151 - RNA, 19 nt, Homo sapiens
ggccagagacgaugauuca

SEQ ID NO: 1025152 - RNA, 19 nt, Homo sapiens
gcacaggccaccacacaca

SEQ ID NO: 1025153 - RNA, 19 nt, Homo sapiens
gcaaccaggacuacaguau

SEQ ID NO: 1025154 - RNA, 19 nt, Homo sapiens
ccagguggcuguggugguu

SEQ ID NO: 1025155 - RNA, 19 nt, Homo sapiens
ggacaucaacgacaaugca

SEQ ID NO: 1025156 - RNA, 19 nt, Homo sapiens
acgagacacucuacacauu

SEQ ID NO: 1025157 - RNA, 19 nt, Homo sapiens
aaacagcucaucaguguca

SEQ ID NO: 1025158 - RNA, 19 nt, Homo sapiens
guagacgucugcgugaaug

SEQ ID NO: 1025159 - RNA, 19 nt, Homo sapiens
ggugccaacuacuucauga

SEQ ID NO: 1025160 - RNA, 19 nt, Homo sapiens
caacaagagcgcuuucuac

SEQ ID NO: 1025161 - RNA, 19 nt, Homo sapiens
gagcacaggccaccacaca

SEQ ID NO: 1025162 - RNA, 19 nt, Homo sapiens
ccaacagacaggcgauuaa

SEQ ID NO: 1025163 - RNA, 19 nt, Homo sapiens
ccaaggcaccuaccaagug

SEQ ID NO: 1025164 - RNA, 19 nt, Homo sapiens
caauggcaccuuccuguug

SEQ ID NO: 1025165 - RNA, 19 nt, Homo sapiens
gcaauggcaccuuccuguu

SEQ ID NO: 1025166 - RNA, 19 nt, Homo sapiens
gaacagucaggaaaucaag

SEQ ID NO: 1025167 - RNA, 19 nt, Homo sapiens
ucaacucccuggacgacaa

SEQ ID NO: 1025168 - RNA, 19 nt, Homo sapiens
gaaagacgugaacgacaau

SEQ ID NO: 1025169 - RNA, 19 nt, Homo sapiens
gcuacaacuuuacggugaa

SEQ ID NO: 1025170 - RNA, 19 nt, Homo sapiens
guuagcggcuccuacaaca

SEQ ID NO: 1025171 - RNA, 19 nt, Homo sapiens
gacaaugcacccgugguua

SEQ ID NO: 1025172 - RNA, 19 nt, Homo sapiens
ggacggugacggugaggaa

SEQ ID NO: 1025173 - RNA, 19 nt, Homo sapiens
gagaaggucaucccuagca

SEQ ID NO: 1025174 - RNA, 19 nt, Homo sapiens
caaugacccucugaccuau

SEQ ID NO: 1025175 - RNA, 19 nt, Homo sapiens
ccucugaccuaugggauga

SEQ ID NO: 1025176 - RNA, 19 nt, Homo sapiens
ccaccacccugaaucucuu

SEQ ID NO: 1025177 - RNA, 19 nt, Homo sapiens
gauacagcuugugaacauu

SEQ ID NO: 1025178 - RNA, 19 nt, Homo sapiens
ggaguggugccaacuacuu

SEQ ID NO: 1025179 - RNA, 19 nt, Homo sapiens
gcgacaaaggcaucaauga

SEQ ID NO: 1025180 - RNA, 19 nt, Homo sapiens
ggacgacaacucuguggau

SEQ ID NO: 1025181 - RNA, 19 nt, Homo sapiens
ggacauucaggacauagau

SEQ ID NO: 1025182 - RNA, 19 nt, Homo sapiens
caacagacaggcgauuaau

SEQ ID NO: 1025183 - RNA, 19 nt, Homo sapiens
guacaucaaccagagcaaa

SEQ ID NO: 1025184 - RNA, 19 nt, Homo sapiens
ggaccagccugaccuugac

SEQ ID NO: 1025185 - RNA, 19 nt, Homo sapiens
gcauguaccacaacaccuu

SEQ ID NO: 1025186 - RNA, 19 nt, Homo sapiens
ggccguggauaaagacaug

SEQ ID NO: 1025187 - RNA, 19 nt, Homo sapiens
gccaacagacaggcgauua

SEQ ID NO: 1025188 - RNA, 19 nt, Homo sapiens
gagaauaagacuuuuguga

SEQ ID NO: 1025189 - RNA, 19 nt, Homo sapiens
cgacaaugcacccgugguu

SEQ ID NO: 1025190 - RNA, 19 nt, Homo sapiens
ggagucagaccugucgaaa

SEQ ID NO: 1025191 - RNA, 19 nt, Homo sapiens
gcgauuaaugcggcucuua

SEQ ID NO: 1025192 - RNA, 19 nt, Homo sapiens
ggagauacagcuugugaac

SEQ ID NO: 1025193 - RNA, 19 nt, Homo sapiens
gugcccagcuggagauaca

SEQ ID NO: 1025194 - RNA, 19 nt, Homo sapiens
acaauggcgucauccuguu

SEQ ID NO: 1025195 - RNA, 19 nt, Homo sapiens
ucagugucaucauaggauu

SEQ ID NO: 1025196 - RNA, 19 nt, Homo sapiens
caguauacauuguggacau

SEQ ID NO: 1025197 - RNA, 19 nt, Homo sapiens
ggaagccuccucauuacca

SEQ ID NO: 1025198 - RNA, 19 nt, Homo sapiens
ggcuguggauggcgacaaa

SEQ ID NO: 1025199 - RNA, 19 nt, Homo sapiens
cgaaguuccuagccaacau

SEQ ID NO: 1025200 - RNA, 19 nt, Homo sapiens
cagggugucuucucgaucu

SEQ ID NO: 1025201 - RNA, 19 nt, Homo sapiens
ugacacagggcuccucaga

SEQ ID NO: 1025202 - RNA, 19 nt, Homo sapiens
gaaguuccuagccaacaug

SEQ ID NO: 1025203 - RNA, 19 nt, Homo sapiens
cgaagaggcccaagugaac

SEQ ID NO: 1025204 - RNA, 19 nt, Homo sapiens
ccgaagaggcccaagugaa

SEQ ID NO: 1025205 - RNA, 19 nt, Homo sapiens
agagggagaugcuggugau

SEQ ID NO: 1025206 - RNA, 19 nt, Homo sapiens
gaagccuccucauuaccau

SEQ ID NO: 1025207 - RNA, 19 nt, Homo sapiens
gaccacaggcccacguuuc

SEQ ID NO: 1025208 - RNA, 19 nt, Homo sapiens
ugagagugauggacgucaa

SEQ ID NO: 1025209 - RNA, 19 nt, Homo sapiens
caaugacccugugaucuac

SEQ ID NO: 1025210 - RNA, 19 nt, Homo sapiens
caacagaagucauguauau

SEQ ID NO: 1025211 - RNA, 19 nt, Homo sapiens
gaucauaguucucuugaaa

SEQ ID NO: 1025212 - RNA, 19 nt, Homo sapiens
gaaaaucucuccauugaua

SEQ ID NO: 1025213 - RNA, 19 nt, Homo sapiens
ggacaucugugaccaauga

SEQ ID NO: 1025214 - RNA, 19 nt, Homo sapiens
caaacgaacuggugaauau

SEQ ID NO: 1025215 - RNA, 19 nt, Homo sapiens
gaaaagaccuaucaaaaug

SEQ ID NO: 1025216 - RNA, 19 nt, Homo sapiens
gaacaacaauuuggaugaa

SEQ ID NO: 1025217 - RNA, 19 nt, Homo sapiens
caaggaucgugaacuauua

SEQ ID NO: 1025218 - RNA, 19 nt, Homo sapiens
ccuaucagcuguuucauuu

SEQ ID NO: 1025219 - RNA, 19 nt, Homo sapiens
gcuuaaaucugucguuuga

SEQ ID NO: 1025220 - RNA, 19 nt, Homo sapiens
caauguaacucacuuggaa

SEQ ID NO: 1025221 - RNA, 19 nt, Homo sapiens
caaauauucugguggaaga

SEQ ID NO: 1025222 - RNA, 19 nt, Homo sapiens
gaaaguacaccuaacacaa

SEQ ID NO: 1025223 - RNA, 19 nt, Homo sapiens
ugagagaaguggcauaaga

SEQ ID NO: 1025224 - RNA, 19 nt, Homo sapiens
gaagaugcaacuauuggua

SEQ ID NO: 1025225 - RNA, 19 nt, Homo sapiens
agaggaagcuuaaaucugu

SEQ ID NO: 1025226 - RNA, 19 nt, Homo sapiens
gcaaggaucgugaacuauu

SEQ ID NO: 1025227 - RNA, 19 nt, Homo sapiens
gaagucauguauaugcuau

SEQ ID NO: 1025228 - RNA, 19 nt, Homo sapiens
gguggaagaugcaacuauu

SEQ ID NO: 1025229 - RNA, 19 nt, Homo sapiens
gaucaugacuacauuggau

SEQ ID NO: 1025230 - RNA, 19 nt, Homo sapiens
aagcaaggaucgugaacua

SEQ ID NO: 1025231 - RNA, 19 nt, Homo sapiens
caauugggaugaucaccua

SEQ ID NO: 1025232 - RNA, 19 nt, Homo sapiens
caaagcauuucucuccaaa

SEQ ID NO: 1025233 - RNA, 19 nt, Homo sapiens
gaucaccuaucagcuguuu

SEQ ID NO: 1025234 - RNA, 19 nt, Homo sapiens
ugaaguggauggugauaau

SEQ ID NO: 1025235 - RNA, 19 nt, Homo sapiens
guacagauuguuuggcaua

SEQ ID NO: 1025236 - RNA, 19 nt, Homo sapiens
gaaaauccauggaguuuag

SEQ ID NO: 1025237 - RNA, 19 nt, Homo sapiens
ugacagauuuguucaccaa

SEQ ID NO: 1025238 - RNA, 19 nt, Homo sapiens
ggaguuuaguuacuguuga

SEQ ID NO: 1025239 - RNA, 19 nt, Homo sapiens
ccagguucuugaauacuua

SEQ ID NO: 1025240 - RNA, 19 nt, Homo sapiens
gauagacgaucauaguucu

SEQ ID NO: 1025241 - RNA, 19 nt, Homo sapiens
gcaauuaaagaagcugaua

SEQ ID NO: 1025242 - RNA, 19 nt, Homo sapiens
gaacuguacagauuguuug

SEQ ID NO: 1025243 - RNA, 19 nt, Homo sapiens
guaacucacuuggaaccua

SEQ ID NO: 1025244 - RNA, 19 nt, Homo sapiens
uuaagagaaugccaugaaa

SEQ ID NO: 1025245 - RNA, 19 nt, Homo sapiens
gagagaaguggcauaagaa

SEQ ID NO: 1025246 - RNA, 19 nt, Homo sapiens
ggaccaaagagaugaauuc

SEQ ID NO: 1025247 - RNA, 19 nt, Homo sapiens
uacauuggauugccugaaa

SEQ ID NO: 1025248 - RNA, 19 nt, Homo sapiens
gaugugcuguccugagaga

SEQ ID NO: 1025249 - RNA, 19 nt, Homo sapiens
gguugguccuugugucaua

SEQ ID NO: 1025250 - RNA, 19 nt, Homo sapiens
ucacaccucuggaacuguu

SEQ ID NO: 1025251 - RNA, 19 nt, Homo sapiens
gaaguggauggugauaaua

SEQ ID NO: 1025252 - RNA, 19 nt, Homo sapiens
gcaacagaagucauguaua

SEQ ID NO: 1025253 - RNA, 19 nt, Homo sapiens
gcauuucucuccaaacacu

SEQ ID NO: 1025254 - RNA, 19 nt, Homo sapiens
ucaaagcauuucucuccaa

SEQ ID NO: 1025255 - RNA, 19 nt, Homo sapiens
ggaaaagacagaaaacaaa

SEQ ID NO: 1025256 - RNA, 19 nt, Homo sapiens
gaucgugaacuauuagaau

SEQ ID NO: 1025257 - RNA, 19 nt, Homo sapiens
ggcauaaagcaaauuguaa

SEQ ID NO: 1025258 - RNA, 19 nt, Homo sapiens
agaauccagugaacaagaa

SEQ ID NO: 1025259 - RNA, 19 nt, Homo sapiens
gagaauccagugaacaaga

SEQ ID NO: 1025260 - RNA, 19 nt, Homo sapiens
ccaccucgguucacaaugg

SEQ ID NO: 1025261 - RNA, 19 nt, Homo sapiens
gauugcauauuacaaacga

SEQ ID NO: 1025262 - RNA, 19 nt, Homo sapiens
agaugcaacuauugguaua

SEQ ID NO: 1025263 - RNA, 19 nt, Homo sapiens
aagcuuaaaucugucguuu

SEQ ID NO: 1025264 - RNA, 19 nt, Homo sapiens
cauaagagaauccagugaa

SEQ ID NO: 1025265 - RNA, 19 nt, Homo sapiens
ggaaaguacaccuaacaca

SEQ ID NO: 1025266 - RNA, 19 nt, Homo sapiens
auauggaccuccucagaaa

SEQ ID NO: 1025267 - RNA, 19 nt, Homo sapiens
gguaauuguuucagaagag

SEQ ID NO: 1025268 - RNA, 19 nt, Homo sapiens
caccuuaagcccuacauaa

SEQ ID NO: 1025269 - RNA, 19 nt, Homo sapiens
agauggagaacaacaauuu

SEQ ID NO: 1025270 - RNA, 19 nt, Homo sapiens
aagcauuucucuccaaaca

SEQ ID NO: 1025271 - RNA, 19 nt, Homo sapiens
cuaacacaaucaaagcauu

SEQ ID NO: 1025272 - RNA, 19 nt, Homo sapiens
caacaauuuggaugaacua

SEQ ID NO: 1025273 - RNA, 19 nt, Homo sapiens
caauggaaaguacaccuaa

SEQ ID NO: 1025274 - RNA, 19 nt, Homo sapiens
cgaaacagcaccuucucaa

SEQ ID NO: 1025275 - RNA, 19 nt, Homo sapiens
aaaagugggucaugaaguu

SEQ ID NO: 1025276 - RNA, 19 nt, Homo sapiens
gacccucacucugguagaa

SEQ ID NO: 1025277 - RNA, 19 nt, Homo sapiens
gagaaugccaugaaaauga

SEQ ID NO: 1025278 - RNA, 19 nt, Homo sapiens
gagaggaagcuuaaaucug

SEQ ID NO: 1025279 - RNA, 19 nt, Homo sapiens
gcugaccacccaaacaauu

SEQ ID NO: 1025280 - RNA, 19 nt, Homo sapiens
uggcauaaagcaaauugua

SEQ ID NO: 1025281 - RNA, 19 nt, Homo sapiens
gagaaguggcauaagaaga

SEQ ID NO: 1025282 - RNA, 19 nt, Homo sapiens
gaguuuaguuacuguugau

SEQ ID NO: 1025283 - RNA, 19 nt, Homo sapiens
gauuggagcauaucaagca

SEQ ID NO: 1025284 - RNA, 19 nt, Homo sapiens
ggcagaucaugacuacauu

SEQ ID NO: 1025285 - RNA, 19 nt, Homo sapiens
aaaguacaccuaacacaau

SEQ ID NO: 1025286 - RNA, 19 nt, Homo sapiens
gaaacagcaccuucucaag

SEQ ID NO: 1025287 - RNA, 19 nt, Homo sapiens
guccuugugucauagacua

SEQ ID NO: 1025288 - RNA, 19 nt, Homo sapiens
ugaauggguugguccuugu

SEQ ID NO: 1025289 - RNA, 19 nt, Homo sapiens
cagauuguuuggcauaaag

SEQ ID NO: 1025290 - RNA, 19 nt, Homo sapiens
gaccaaugaugccaaacag

SEQ ID NO: 1025291 - RNA, 19 nt, Homo sapiens
ggagaacaacaauuuggau

SEQ ID NO: 1025292 - RNA, 19 nt, Homo sapiens
caguggagcucaucauggu

SEQ ID NO: 1025293 - RNA, 19 nt, Homo sapiens
acgaaaaucucuccauuga

SEQ ID NO: 1025294 - RNA, 19 nt, Homo sapiens
guucaguaguggcagauca

SEQ ID NO: 1025295 - RNA, 19 nt, Homo sapiens
uggaugugcuguccugaga

SEQ ID NO: 1025296 - RNA, 19 nt, Homo sapiens
gauggagaacaacaauuug

SEQ ID NO: 1025297 - RNA, 19 nt, Homo sapiens
ggauggugauaauacaagu

SEQ ID NO: 1025298 - RNA, 19 nt, Homo sapiens
ucacuuggaaccuacuaaa

SEQ ID NO: 1025299 - RNA, 19 nt, Homo sapiens
uaucagcuguuucauuugc

SEQ ID NO: 1025300 - RNA, 19 nt, Homo sapiens
gaacuguuaacccaaugga

SEQ ID NO: 1025301 - RNA, 19 nt, Homo sapiens
acaaugguccguaguggaa

SEQ ID NO: 1025302 - RNA, 19 nt, Homo sapiens
gccaaacaguggguauaug

SEQ ID NO: 1025303 - RNA, 19 nt, Homo sapiens
ggaccuucaucuuaaacag

SEQ ID NO: 1025304 - RNA, 19 nt, Homo sapiens
aaauuccgauuggagcaua

SEQ ID NO: 1025305 - RNA, 19 nt, Homo sapiens
gcagaucaugacuacauug

SEQ ID NO: 1025306 - RNA, 19 nt, Homo sapiens
ccaauggaaaguacaccua

SEQ ID NO: 1025307 - RNA, 19 nt, Homo sapiens
uauauggaccuccucagaa

SEQ ID NO: 1025308 - RNA, 19 nt, Homo sapiens
cuuuaucucuugcaagguu

SEQ ID NO: 1025309 - RNA, 19 nt, Homo sapiens
agauaaaucacgagaggaa

SEQ ID NO: 1025310 - RNA, 19 nt, Homo sapiens
gagcagagaaucuacauua

SEQ ID NO: 1025311 - RNA, 19 nt, Homo sapiens
guaaacaaacugcaacuua

SEQ ID NO: 1025312 - RNA, 19 nt, Homo sapiens
ugacagaacuggaggagaa

SEQ ID NO: 1025313 - RNA, 19 nt, Homo sapiens
guacaaugaugcagaaaga

SEQ ID NO: 1025314 - RNA, 19 nt, Homo sapiens
gcagaaagauuuagugacu

SEQ ID NO: 1025315 - RNA, 19 nt, Homo sapiens
ucagggagauguacaauga

SEQ ID NO: 1025316 - RNA, 19 nt, Homo sapiens
uaaaggauccuaaucauga

SEQ ID NO: 1025317 - RNA, 19 nt, Homo sapiens
aaacaccacugauaucauu

SEQ ID NO: 1025318 - RNA, 19 nt, Homo sapiens
gaaagagaaaugcaaguuu

SEQ ID NO: 1025319 - RNA, 19 nt, Homo sapiens
aaagagaaaugcaaguuug

SEQ ID NO: 1025320 - RNA, 19 nt, Homo sapiens
gaacucagaauaaaggaaa

SEQ ID NO: 1025321 - RNA, 19 nt, Homo sapiens
gcucuaaacuuauccaucu

SEQ ID NO: 1025322 - RNA, 19 nt, Homo sapiens
gggcaugucuggagaaaca

SEQ ID NO: 1025323 - RNA, 19 nt, Homo sapiens
agaaacaguugcaaugaaa

SEQ ID NO: 1025324 - RNA, 19 nt, Homo sapiens
gcauauggcacaaauaaug

SEQ ID NO: 1025325 - RNA, 19 nt, Homo sapiens
gacaagagguaugccagua

SEQ ID NO: 1025326 - RNA, 19 nt, Homo sapiens
gcacuguuguuuauauuag

SEQ ID NO: 1025327 - RNA, 19 nt, Homo sapiens
aaucugggcuuccacuuaa

SEQ ID NO: 1025328 - RNA, 19 nt, Homo sapiens
gcaugaaucuggaaaauug

SEQ ID NO: 1025329 - RNA, 19 nt, Homo sapiens
caaagaaacaguugcaaug

SEQ ID NO: 1025330 - RNA, 19 nt, Homo sapiens
ggaaugacauccacaaucc

SEQ ID NO: 1025331 - RNA, 19 nt, Homo sapiens
gcacacugguggcuucaga

SEQ ID NO: 1025332 - RNA, 19 nt, Homo sapiens
cagagaaucuacauuaugg

SEQ ID NO: 1025333 - RNA, 19 nt, Homo sapiens
gauguacaaugaugcagaa

SEQ ID NO: 1025334 - RNA, 19 nt, Homo sapiens
caaaguccuuauucccuaa

SEQ ID NO: 1025335 - RNA, 19 nt, Homo sapiens
gcagagaaucuacauuaug

SEQ ID NO: 1025336 - RNA, 19 nt, Homo sapiens
uuagugacuuucaugguua

SEQ ID NO: 1025337 - RNA, 19 nt, Homo sapiens
gaaaugcaaguuuggaaug

SEQ ID NO: 1025338 - RNA, 19 nt, Homo sapiens
acaccuagcucgccagaga

SEQ ID NO: 1025339 - RNA, 19 nt, Homo sapiens
caauucagcuaaaugagau

SEQ ID NO: 1025340 - RNA, 19 nt, Homo sapiens
ggaauccugucuccuguag

SEQ ID NO: 1025341 - RNA, 19 nt, Homo sapiens
ccacugauaucauuaaagc

SEQ ID NO: 1025342 - RNA, 19 nt, Homo sapiens
caagacaccuauggguaaa

SEQ ID NO: 1025343 - RNA, 19 nt, Homo sapiens
acacccaccucaacaugua

SEQ ID NO: 1025344 - RNA, 19 nt, Homo sapiens
aaauguggguguagagauu

SEQ ID NO: 1025345 - RNA, 19 nt, Homo sapiens
ucaaagagauggaguaccu

SEQ ID NO: 1025346 - RNA, 19 nt, Homo sapiens
ucaagacaccuauggguaa

SEQ ID NO: 1025347 - RNA, 19 nt, Homo sapiens
ugacuuucaugguuacauu

SEQ ID NO: 1025348 - RNA, 19 nt, Homo sapiens
gcucugaauucccaacuag

SEQ ID NO: 1025349 - RNA, 19 nt, Homo sapiens
gccaguggauggaauacuu

SEQ ID NO: 1025350 - RNA, 19 nt, Homo sapiens
ggucaaauguggguguaga

SEQ ID NO: 1025351 - RNA, 19 nt, Homo sapiens
aagaaacaguugcaaugaa

SEQ ID NO: 1025352 - RNA, 19 nt, Homo sapiens
gaaaagagccuacccuucu

SEQ ID NO: 1025353 - RNA, 19 nt, Homo sapiens
ucagcuaaaugagauguuu

SEQ ID NO: 1025354 - RNA, 19 nt, Homo sapiens
ggaaaacucauauaccuaa

SEQ ID NO: 1025355 - RNA, 19 nt, Homo sapiens
ggucugcucuaaacuuauc

SEQ ID NO: 1025356 - RNA, 19 nt, Homo sapiens
caaugaugcagaaagauuu

SEQ ID NO: 1025357 - RNA, 19 nt, Homo sapiens
ccacaaagccauucagcau

SEQ ID NO: 1025358 - RNA, 19 nt, Homo sapiens
gaaaucauagagaaacuag

SEQ ID NO: 1025359 - RNA, 19 nt, Homo sapiens
aaacucauauaccuaaugg

SEQ ID NO: 1025360 - RNA, 19 nt, Homo sapiens
ggaaaucauagagaaacua

SEQ ID NO: 1025361 - RNA, 19 nt, Homo sapiens
uaaucugggcuuccacuua

SEQ ID NO: 1025362 - RNA, 19 nt, Homo sapiens
gagaaaugcaaguuuggaa

SEQ ID NO: 1025363 - RNA, 19 nt, Homo sapiens
ccaauucagcuaaaugaga

SEQ ID NO: 1025364 - RNA, 19 nt, Homo sapiens
ccagagagucuauguaugg

SEQ ID NO: 1025365 - RNA, 19 nt, Homo sapiens
cauuaaagccacuaacaga

SEQ ID NO: 1025366 - RNA, 19 nt, Homo sapiens
gagccuacccuucuugauc

SEQ ID NO: 1025367 - RNA, 19 nt, Homo sapiens
gaucaaugaccuauucagu

SEQ ID NO: 1025368 - RNA, 19 nt, Homo sapiens
aauccugucuccuguaguu

SEQ ID NO: 1025369 - RNA, 19 nt, Homo sapiens
aaagaaacaguugcaauga

SEQ ID NO: 1025370 - RNA, 19 nt, Homo sapiens
gaggucaaaugugggugua

SEQ ID NO: 1025371 - RNA, 19 nt, Homo sapiens
uauuggcacuguuguuuau

SEQ ID NO: 1025372 - RNA, 19 nt, Homo sapiens
acacuaugguuaucaucaa

SEQ ID NO: 1025373 - RNA, 19 nt, Homo sapiens
gagaagcccagacacuaug

SEQ ID NO: 1025374 - RNA, 19 nt, Homo sapiens
acaaagccauucagcaucu

SEQ ID NO: 1025375 - RNA, 19 nt, Homo sapiens
caguggaucugcaugaauc

SEQ ID NO: 1025376 - RNA, 19 nt, Homo sapiens
aaaugcaaguuuggaauga

SEQ ID NO: 1025377 - RNA, 19 nt, Homo sapiens
caaaugcaacaaagaaaca

SEQ ID NO: 1025378 - RNA, 19 nt, Homo sapiens
gcacagccaccauccucaa

SEQ ID NO: 1025379 - RNA, 19 nt, Homo sapiens
aaaggauccuaaucaugaa

SEQ ID NO: 1025380 - RNA, 19 nt, Homo sapiens
gaagucaagacaccuaugg

SEQ ID NO: 1025381 - RNA, 19 nt, Homo sapiens
uugcauauggcacaaauaa

SEQ ID NO: 1025382 - RNA, 19 nt, Homo sapiens
uuuagugacuuucaugguu

SEQ ID NO: 1025383 - RNA, 19 nt, Homo sapiens
uuggucugcucuaaacuua

SEQ ID NO: 1025384 - RNA, 19 nt, Homo sapiens
acaaugaugcagaaagauu

SEQ ID NO: 1025385 - RNA, 19 nt, Homo sapiens
caaagccaguaucaacaca

SEQ ID NO: 1025386 - RNA, 19 nt, Homo sapiens
ugaaagagaaaugcaaguu

SEQ ID NO: 1025387 - RNA, 19 nt, Homo sapiens
gcccagacacuaugguuau

SEQ ID NO: 1025388 - RNA, 19 nt, Homo sapiens
ccagaacuccacaaagguu

SEQ ID NO: 1025389 - RNA, 19 nt, Homo sapiens
uuuauugacugucuacuag

SEQ ID NO: 1025390 - RNA, 19 nt, Homo sapiens
auugaugccugggauauaa

SEQ ID NO: 1025391 - RNA, 19 nt, Homo sapiens
ggcccucaauguccacaaa

SEQ ID NO: 1025392 - RNA, 19 nt, Homo sapiens
ucagacccuuucccauuga

SEQ ID NO: 1025393 - RNA, 19 nt, Homo sapiens
guguagagauuauggaaaa

SEQ ID NO: 1025394 - RNA, 19 nt, Homo sapiens
gccagagagucuauguaug

SEQ ID NO: 1025395 - RNA, 19 nt, Homo sapiens
ggcacuguuguuuauauua

SEQ ID NO: 1025396 - RNA, 19 nt, Homo sapiens
guacacccaccucaacaug

SEQ ID NO: 1025397 - RNA, 19 nt, Homo sapiens
caauaucucaucauaaagg

SEQ ID NO: 1025398 - RNA, 19 nt, Homo sapiens
guggauggaauacuucaaa

SEQ ID NO: 1025399 - RNA, 19 nt, Homo sapiens
caauuagugccuccaaaug

SEQ ID NO: 1025400 - RNA, 19 nt, Homo sapiens
caccacugauaucauuaaa

SEQ ID NO: 1025401 - RNA, 19 nt, Homo sapiens
ggaacaacuccacaaaguc

SEQ ID NO: 1025402 - RNA, 19 nt, Homo sapiens
caccaauucagcuaaauga

SEQ ID NO: 1025403 - RNA, 19 nt, Homo sapiens
guaaacuaaaggauccuaa

SEQ ID NO: 1025404 - RNA, 19 nt, Homo sapiens
gcaaugaaagagaaaugca

SEQ ID NO: 1025405 - RNA, 19 nt, Homo sapiens
caguugcaaugaaagagaa

SEQ ID NO: 1025406 - RNA, 19 nt, Homo sapiens
ggguaaaaguucucucuga

SEQ ID NO: 1025407 - RNA, 19 nt, Homo sapiens
ugagaagcccagacacuau

SEQ ID NO: 1025408 - RNA, 19 nt, Homo sapiens
ccuauucagucaaagagau

SEQ ID NO: 1025409 - RNA, 19 nt, Homo sapiens
ggauuuggauaggaacauc

SEQ ID NO: 1025410 - RNA, 19 nt, Homo sapiens
ggucaugguuugcaaauaa

SEQ ID NO: 1025411 - RNA, 19 nt, Homo sapiens
gaaccgccuuuguugauua

SEQ ID NO: 1025412 - RNA, 19 nt, Homo sapiens
gaacaccucuaacagaaga

SEQ ID NO: 1025413 - RNA, 19 nt, Homo sapiens
ggaagagauugaacaagaa

SEQ ID NO: 1025414 - RNA, 19 nt, Homo sapiens
gggagaaacugaagccaaa

SEQ ID NO: 1025415 - RNA, 19 nt, Homo sapiens
cagaugcaguacaguauua

SEQ ID NO: 1025416 - RNA, 19 nt, Homo sapiens
aaacgaaccggcaaaguua

SEQ ID NO: 1025417 - RNA, 19 nt, Homo sapiens
aacaagaacugacgucuaa

SEQ ID NO: 1025418 - RNA, 19 nt, Homo sapiens
gugcacgucuuguccaaua

SEQ ID NO: 1025419 - RNA, 19 nt, Homo sapiens
gaagcucggucccugugua

SEQ ID NO: 1025420 - RNA, 19 nt, Homo sapiens
gaacaagaacugacgucua

SEQ ID NO: 1025421 - RNA, 19 nt, Homo sapiens
ggucaaguccauucaauuu

SEQ ID NO: 1025422 - RNA, 19 nt, Homo sapiens
cauaugacauccugcauug

SEQ ID NO: 1025423 - RNA, 19 nt, Homo sapiens
gaaaagugcuggacuggaa

SEQ ID NO: 1025424 - RNA, 19 nt, Homo sapiens
uggaagagauugaacaaga

SEQ ID NO: 1025425 - RNA, 19 nt, Homo sapiens
acaguuaucucauccaguu

SEQ ID NO: 1025426 - RNA, 19 nt, Homo sapiens
caaacgaaccggcaaaguu

SEQ ID NO: 1025427 - RNA, 19 nt, Homo sapiens
ggccaaacaugaauccuau

SEQ ID NO: 1025428 - RNA, 19 nt, Homo sapiens
ggagugaaccgccuuuguu

SEQ ID NO: 1025429 - RNA, 19 nt, Homo sapiens
gaacggaggcccagaguac

SEQ ID NO: 1025430 - RNA, 19 nt, Homo sapiens
gaacauccaggucaugguu

SEQ ID NO: 1025431 - RNA, 19 nt, Homo sapiens
gaaaauugcugccuuugau

SEQ ID NO: 1025432 - RNA, 19 nt, Homo sapiens
gaauugcagccaccguuua

SEQ ID NO: 1025433 - RNA, 19 nt, Homo sapiens
caagacuccuauaacaauu

SEQ ID NO: 1025434 - RNA, 19 nt, Homo sapiens
gcaauaaacggauccuugu

SEQ ID NO: 1025435 - RNA, 19 nt, Homo sapiens
gaguuugucuuucuuaucu

SEQ ID NO: 1025436 - RNA, 19 nt, Homo sapiens
uuugauagcuguacuuuca

SEQ ID NO: 1025437 - RNA, 19 nt, Homo sapiens
gaucuguauucacuucgua

SEQ ID NO: 1025438 - RNA, 19 nt, Homo sapiens
gaucuccgcugcccaccaa

SEQ ID NO: 1025439 - RNA, 19 nt, Homo sapiens
cagcauaccaagaaacuuu

SEQ ID NO: 1025440 - RNA, 19 nt, Homo sapiens
gcacugcacccaagauuag

SEQ ID NO: 1025441 - RNA, 19 nt, Homo sapiens
gaacagccaagacuccuau

SEQ ID NO: 1025442 - RNA, 19 nt, Homo sapiens
gaaaacaaguugauucgau

SEQ ID NO: 1025443 - RNA, 19 nt, Homo sapiens
gaagaugaagaauggcuuu

SEQ ID NO: 1025444 - RNA, 19 nt, Homo sapiens
gaaugaagcuauggcuaca

SEQ ID NO: 1025445 - RNA, 19 nt, Homo sapiens
ccaggcaucaucacaguua

SEQ ID NO: 1025446 - RNA, 19 nt, Homo sapiens
ggacaugccucuucuuccu

SEQ ID NO: 1025447 - RNA, 19 nt, Homo sapiens
acaggaagaugaagaaugg

SEQ ID NO: 1025448 - RNA, 19 nt, Homo sapiens
uaaaccuccuccacaaauu

SEQ ID NO: 1025449 - RNA, 19 nt, Homo sapiens
uuucaugucuuccaaauuc

SEQ ID NO: 1025450 - RNA, 19 nt, Homo sapiens
ugugauaacuuugcugaaa

SEQ ID NO: 1025451 - RNA, 19 nt, Homo sapiens
uggaacaccucuaacagaa

SEQ ID NO: 1025452 - RNA, 19 nt, Homo sapiens
ggaaguccugggcccauua

SEQ ID NO: 1025453 - RNA, 19 nt, Homo sapiens
ccaagaagacccagucguu

SEQ ID NO: 1025454 - RNA, 19 nt, Homo sapiens
gaagcuauggcuacagauu

SEQ ID NO: 1025455 - RNA, 19 nt, Homo sapiens
gccaggugcuugugaguga

SEQ ID NO: 1025456 - RNA, 19 nt, Homo sapiens
caaaucaagcagccaauga

SEQ ID NO: 1025457 - RNA, 19 nt, Homo sapiens
ggagaaaauugcugccuuu

SEQ ID NO: 1025458 - RNA, 19 nt, Homo sapiens
ucacaaagcaguccuacau

SEQ ID NO: 1025459 - RNA, 19 nt, Homo sapiens
ggaagcaucgagacucuga

SEQ ID NO: 1025460 - RNA, 19 nt, Homo sapiens
gcaaauaaugcaggucuga

SEQ ID NO: 1025461 - RNA, 19 nt, Homo sapiens
ccaagacuccuauaacaau

SEQ ID NO: 1025462 - RNA, 19 nt, Homo sapiens
gcuaaaacauugaaaagug

SEQ ID NO: 1025463 - RNA, 19 nt, Homo sapiens
gcaguacaguauuaucagu

SEQ ID NO: 1025464 - RNA, 19 nt, Homo sapiens
guugagucccuguacauua

SEQ ID NO: 1025465 - RNA, 19 nt, Homo sapiens
uaauacaaguggaaugcuu

SEQ ID NO: 1025466 - RNA, 19 nt, Homo sapiens
guuacaagcugcuauccau

SEQ ID NO: 1025467 - RNA, 19 nt, Homo sapiens
gagcuggagacuagcguua

SEQ ID NO: 1025468 - RNA, 19 nt, Homo sapiens
gcauaugacauccugcauu

SEQ ID NO: 1025469 - RNA, 19 nt, Homo sapiens
caagauuagugacgacaca

SEQ ID NO: 1025470 - RNA, 19 nt, Homo sapiens
aaagaucaguccaaacaag

SEQ ID NO: 1025471 - RNA, 19 nt, Homo sapiens
ugacagugauggcauugug

SEQ ID NO: 1025472 - RNA, 19 nt, Homo sapiens
uaugaucuccauugcaaua

SEQ ID NO: 1025473 - RNA, 19 nt, Homo sapiens
gcucuucucuguucgacau

SEQ ID NO: 1025474 - RNA, 19 nt, Homo sapiens
gcagaugcaguacaguauu

SEQ ID NO: 1025475 - RNA, 19 nt, Homo sapiens
caguugcuauggcaccuua

SEQ ID NO: 1025476 - RNA, 19 nt, Homo sapiens
gacaacauucagucuuaua

SEQ ID NO: 1025477 - RNA, 19 nt, Homo sapiens
gcuguacuuucacgaagaa

SEQ ID NO: 1025478 - RNA, 19 nt, Homo sapiens
ccaaacaugaauccuauug

SEQ ID NO: 1025479 - RNA, 19 nt, Homo sapiens
gcacaagcccaccguacug

SEQ ID NO: 1025480 - RNA, 19 nt, Homo sapiens
gcacgucuuguccaauaaa

SEQ ID NO: 1025481 - RNA, 19 nt, Homo sapiens
caguuuagcuucugaccau

SEQ ID NO: 1025482 - RNA, 19 nt, Homo sapiens
acacaccacuggaaaugau

SEQ ID NO: 1025483 - RNA, 19 nt, Homo sapiens
uuuaugaucuccauugcaa

SEQ ID NO: 1025484 - RNA, 19 nt, Homo sapiens
guacaggacaucugcuuca

SEQ ID NO: 1025485 - RNA, 19 nt, Homo sapiens
gucaaguccauucaauuua

SEQ ID NO: 1025486 - RNA, 19 nt, Homo sapiens
caaguggaaugcuucuagu

SEQ ID NO: 1025487 - RNA, 19 nt, Homo sapiens
gagugaggauucugacagu

SEQ ID NO: 1025488 - RNA, 19 nt, Homo sapiens
aaacaugaauccuauugcu

SEQ ID NO: 1025489 - RNA, 19 nt, Homo sapiens
ccacuucccugcccaugag

SEQ ID NO: 1025490 - RNA, 19 nt, Homo sapiens
gagugaaccgccuuuguug

SEQ ID NO: 1025491 - RNA, 19 nt, Homo sapiens
caucaagaaaucuggaauu

SEQ ID NO: 1025492 - RNA, 19 nt, Homo sapiens
aaaccacaguuaucucauc

SEQ ID NO: 1025493 - RNA, 19 nt, Homo sapiens
cagcuggacucugguuaga

SEQ ID NO: 1025494 - RNA, 19 nt, Homo sapiens
gaucaguccaaacaaguug

SEQ ID NO: 1025495 - RNA, 19 nt, Homo sapiens
ccucggcucucuccucuuc

SEQ ID NO: 1025496 - RNA, 19 nt, Homo sapiens
gugcuggacuggaagagau

SEQ ID NO: 1025497 - RNA, 19 nt, Homo sapiens
uagggaaaguggugacuca

SEQ ID NO: 1025498 - RNA, 19 nt, Homo sapiens
gggccaaacaugaauccua

SEQ ID NO: 1025499 - RNA, 19 nt, Homo sapiens
ccaaaccacaguuaucuca

SEQ ID NO: 1025500 - RNA, 19 nt, Homo sapiens
uugagucccuguacauuau

SEQ ID NO: 1025501 - RNA, 19 nt, Homo sapiens
caaagcaguccuacaugga

SEQ ID NO: 1025502 - RNA, 19 nt, Homo sapiens
uuacugaggcccuguugaa

SEQ ID NO: 1025503 - RNA, 19 nt, Homo sapiens
aaaccuccuccacaaauuu

SEQ ID NO: 1025504 - RNA, 19 nt, Homo sapiens
agacaccuauuuaugaucu

SEQ ID NO: 1025505 - RNA, 19 nt, Homo sapiens
gauuaugauuggcuacagu

SEQ ID NO: 1025506 - RNA, 19 nt, Homo sapiens
guaguugagucccuguaca

SEQ ID NO: 1025507 - RNA, 19 nt, Homo sapiens
aaauaaugcaggucugaaa

SEQ ID NO: 1025508 - RNA, 19 nt, Homo sapiens
caccaucuguauacucuuc

SEQ ID NO: 1025509 - RNA, 19 nt, Homo sapiens
ugacuuucaugucuuccaa

SEQ ID NO: 1025510 - RNA, 19 nt, Homo sapiens
gaaauuaccuuaucauguc

SEQ ID NO: 1025511 - RNA, 19 nt, Homo sapiens
ggaagagccuggacacuaa

SEQ ID NO: 1025512 - RNA, 19 nt, Homo sapiens
gcucagaguucuuuaugua

SEQ ID NO: 1025513 - RNA, 19 nt, Homo sapiens
caaacccucuugauaauaa

SEQ ID NO: 1025514 - RNA, 19 nt, Homo sapiens
gagcuucacuuagauuaua

SEQ ID NO: 1025515 - RNA, 19 nt, Homo sapiens
uaacgaagauucacccaaa

SEQ ID NO: 1025516 - RNA, 19 nt, Homo sapiens
ugaaauaccuccagauaau

SEQ ID NO: 1025517 - RNA, 19 nt, Homo sapiens
gaccauuccuuucuucaua

SEQ ID NO: 1025518 - RNA, 19 nt, Homo sapiens
cgaaagcucuauauaaaug

SEQ ID NO: 1025519 - RNA, 19 nt, Homo sapiens
guaaaugacuucuguccaa

SEQ ID NO: 1025520 - RNA, 19 nt, Homo sapiens
gccaaacuauugauacaua

SEQ ID NO: 1025521 - RNA, 19 nt, Homo sapiens
caaccaacauuccauuuga

SEQ ID NO: 1025522 - RNA, 19 nt, Homo sapiens
gaacucagaauucaugaaa

SEQ ID NO: 1025523 - RNA, 19 nt, Homo sapiens
ggacuacucucuucugaca

SEQ ID NO: 1025524 - RNA, 19 nt, Homo sapiens
gagcccgucuuuauguuua

SEQ ID NO: 1025525 - RNA, 19 nt, Homo sapiens
gagaaacacaucuaguaua

SEQ ID NO: 1025526 - RNA, 19 nt, Homo sapiens
ggguaguacuguaauauuu

SEQ ID NO: 1025527 - RNA, 19 nt, Homo sapiens
gugcaaacccucuugauaa

SEQ ID NO: 1025528 - RNA, 19 nt, Homo sapiens
gaaauaccacuuaaucuuc

SEQ ID NO: 1025529 - RNA, 19 nt, Homo sapiens
ucaacaacccggugaaaua

SEQ ID NO: 1025530 - RNA, 19 nt, Homo sapiens
aagcagagcaucaaauuaa

SEQ ID NO: 1025531 - RNA, 19 nt, Homo sapiens
gauaaaugcuacucauaag

SEQ ID NO: 1025532 - RNA, 19 nt, Homo sapiens
caguggaacuugaggauuu

SEQ ID NO: 1025533 - RNA, 19 nt, Homo sapiens
acauaaaucucaugcuuga

SEQ ID NO: 1025534 - RNA, 19 nt, Homo sapiens
caagaaauuucaacggaau

SEQ ID NO: 1025535 - RNA, 19 nt, Homo sapiens
ggacucacuucacuuuaug

SEQ ID NO: 1025536 - RNA, 19 nt, Homo sapiens
guacauugcucagauuuag

SEQ ID NO: 1025537 - RNA, 19 nt, Homo sapiens
gggaguaaaugacuucugu

SEQ ID NO: 1025538 - RNA, 19 nt, Homo sapiens
gaaacaagcaucuauugca

SEQ ID NO: 1025539 - RNA, 19 nt, Homo sapiens
uaacauaccacgugugaga

SEQ ID NO: 1025540 - RNA, 19 nt, Homo sapiens
ugaagaauaugaugcugaa

SEQ ID NO: 1025541 - RNA, 19 nt, Homo sapiens
uggaagaccuugcuuggaa

SEQ ID NO: 1025542 - RNA, 19 nt, Homo sapiens
gagaaacaagcaucuauug

SEQ ID NO: 1025543 - RNA, 19 nt, Homo sapiens
accgaaagcucuauauaaa

SEQ ID NO: 1025544 - RNA, 19 nt, Homo sapiens
ccuaaaggcuuaccaccaa

SEQ ID NO: 1025545 - RNA, 19 nt, Homo sapiens
uuuaguagcuuggguagua

SEQ ID NO: 1025546 - RNA, 19 nt, Homo sapiens
uaaauggaaugcuugacuu

SEQ ID NO: 1025547 - RNA, 19 nt, Homo sapiens
uauauaacauugccacuuc

SEQ ID NO: 1025548 - RNA, 19 nt, Homo sapiens
uguaauaccuccucaucuu

SEQ ID NO: 1025549 - RNA, 19 nt, Homo sapiens
uaucuauucucaaguggua

SEQ ID NO: 1025550 - RNA, 19 nt, Homo sapiens
uagcagaacucagaauuca

SEQ ID NO: 1025551 - RNA, 19 nt, Homo sapiens
gaggacuacucucuucuga

SEQ ID NO: 1025552 - RNA, 19 nt, Homo sapiens
uaacaaagacaguaaugug

SEQ ID NO: 1025553 - RNA, 19 nt, Homo sapiens
gcucuuucauuugcuguua

SEQ ID NO: 1025554 - RNA, 19 nt, Homo sapiens
uauuggagcuucacuuaga

SEQ ID NO: 1025555 - RNA, 19 nt, Homo sapiens
gcagaacucagaauucaug

SEQ ID NO: 1025556 - RNA, 19 nt, Homo sapiens
guugaaauaccuccagaua

SEQ ID NO: 1025557 - RNA, 19 nt, Homo sapiens
gcaaacccucuugauaaua

SEQ ID NO: 1025558 - RNA, 19 nt, Homo sapiens
acauaaggguugagagaaa

SEQ ID NO: 1025559 - RNA, 19 nt, Homo sapiens
acaacaagcuaacgaagau

SEQ ID NO: 1025560 - RNA, 19 nt, Homo sapiens
agacacagaugaugaugau

SEQ ID NO: 1025561 - RNA, 19 nt, Homo sapiens
aguaguacaugguggauaa

SEQ ID NO: 1025562 - RNA, 19 nt, Homo sapiens
gugcauuacacuauucuua

SEQ ID NO: 1025563 - RNA, 19 nt, Homo sapiens
caacagugccaaagaugaa

SEQ ID NO: 1025564 - RNA, 19 nt, Homo sapiens
gagagaaacaagcaucuau

SEQ ID NO: 1025565 - RNA, 19 nt, Homo sapiens
ugccaaagaugaagaaauc

SEQ ID NO: 1025566 - RNA, 19 nt, Homo sapiens
gcaguuuauuccaguauca

SEQ ID NO: 1025567 - RNA, 19 nt, Homo sapiens
uggaauacuugaacucuau

SEQ ID NO: 1025568 - RNA, 19 nt, Homo sapiens
gaaauacugggaaaugcaa

SEQ ID NO: 1025569 - RNA, 19 nt, Homo sapiens
gagcaucaaauuaaacaga

SEQ ID NO: 1025570 - RNA, 19 nt, Homo sapiens
guaauaccuccucaucuuu

SEQ ID NO: 1025571 - RNA, 19 nt, Homo sapiens
caaagacaguaaugugaag

SEQ ID NO: 1025572 - RNA, 19 nt, Homo sapiens
acaagcaucuauugcaguu

SEQ ID NO: 1025573 - RNA, 19 nt, Homo sapiens
cagaaugaguguucagcuu

SEQ ID NO: 1025574 - RNA, 19 nt, Homo sapiens
gcuaacauaccacguguga

SEQ ID NO: 1025575 - RNA, 19 nt, Homo sapiens
aaugaaugcuuuacacguu

SEQ ID NO: 1025576 - RNA, 19 nt, Homo sapiens
aaaccgaaagcucuauaua

SEQ ID NO: 1025577 - RNA, 19 nt, Homo sapiens
uaagcagagcaucaaauua

SEQ ID NO: 1025578 - RNA, 19 nt, Homo sapiens
uaaaugcucagaguucuuu

SEQ ID NO: 1025579 - RNA, 19 nt, Homo sapiens
guggauaacuucuacuuuu

SEQ ID NO: 1025580 - RNA, 19 nt, Homo sapiens
ggagcaguuuauuccagua

SEQ ID NO: 1025581 - RNA, 19 nt, Homo sapiens
cauuugaucuguuuccaau

SEQ ID NO: 1025582 - RNA, 19 nt, Homo sapiens
gguguuccauaucagaauu

SEQ ID NO: 1025583 - RNA, 19 nt, Homo sapiens
ggucugauccugaacaaca

SEQ ID NO: 1025584 - RNA, 19 nt, Homo sapiens
acacagaugaugaugauga

SEQ ID NO: 1025585 - RNA, 19 nt, Homo sapiens
agaauaugaugcugaagga

SEQ ID NO: 1025586 - RNA, 19 nt, Homo sapiens
aguaugugcuccuauuauu

SEQ ID NO: 1025587 - RNA, 19 nt, Homo sapiens
gaaaccgaaagcucuauau

SEQ ID NO: 1025588 - RNA, 19 nt, Homo sapiens
guucauuaccaacuugaua

SEQ ID NO: 1025589 - RNA, 19 nt, Homo sapiens
uaucagaauugcagaagca

SEQ ID NO: 1025590 - RNA, 19 nt, Homo sapiens
ggaagacacagaugaugau

SEQ ID NO: 1025591 - RNA, 19 nt, Homo sapiens
cuuauuggcauucaacaua

SEQ ID NO: 1025592 - RNA, 19 nt, Homo sapiens
gaauaagcagagcaucaaa

SEQ ID NO: 1025593 - RNA, 19 nt, Homo sapiens
gagauaucccuuuggaaga

SEQ ID NO: 1025594 - RNA, 19 nt, Homo sapiens
uagcuuggguaguacugua

SEQ ID NO: 1025595 - RNA, 19 nt, Homo sapiens
gauauucgguauuuaacac

SEQ ID NO: 1025596 - RNA, 19 nt, Homo sapiens
gauuaccagaguugaaaua

SEQ ID NO: 1025597 - RNA, 19 nt, Homo sapiens
gaaaaugggagucuugcua

SEQ ID NO: 1025598 - RNA, 19 nt, Homo sapiens
cuauauaaaugcucagagu

SEQ ID NO: 1025599 - RNA, 19 nt, Homo sapiens
ggaacuuuggaauguaaua

SEQ ID NO: 1025600 - RNA, 19 nt, Homo sapiens
gggugacgguguuccauau

SEQ ID NO: 1025601 - RNA, 19 nt, Homo sapiens
guacaugguggauaacuuc

SEQ ID NO: 1025602 - RNA, 19 nt, Homo sapiens
cacuuaaucuucccaaauc

SEQ ID NO: 1025603 - RNA, 19 nt, Homo sapiens
uuaaaggacucacuucacu

SEQ ID NO: 1025604 - RNA, 19 nt, Homo sapiens
ucagugcuauucacgaguu

SEQ ID NO: 1025605 - RNA, 19 nt, Homo sapiens
aauaugaugcugaaggaua

SEQ ID NO: 1025606 - RNA, 19 nt, Homo sapiens
aaccgaaagcucuauauaa

SEQ ID NO: 1025607 - RNA, 19 nt, Homo sapiens
cugagaaacacaucuagua

SEQ ID NO: 1025608 - RNA, 19 nt, Homo sapiens
ucaacuaagugaaauacca

SEQ ID NO: 1025609 - RNA, 19 nt, Homo sapiens
ugagaaacacaucuaguau

SEQ ID NO: 1025610 - RNA, 19 nt, Homo sapiens
gcaugucguuucuggauua

SEQ ID NO: 1025611 - RNA, 19 nt, Homo sapiens
gaccauaucuucagcaugu

SEQ ID NO: 1025612 - RNA, 19 nt, Homo sapiens
gaaaguguguuauagagau

SEQ ID NO: 1025613 - RNA, 19 nt, Homo sapiens
gaccauacauugauugaga

SEQ ID NO: 1025614 - RNA, 19 nt, Homo sapiens
caacuccugugaugacaua

SEQ ID NO: 1025615 - RNA, 19 nt, Homo sapiens
ggaggaacuuuacagguuu

SEQ ID NO: 1025616 - RNA, 19 nt, Homo sapiens
auaaagaagugcaguauga

SEQ ID NO: 1025617 - RNA, 19 nt, Homo sapiens
caccagaucugcagaauuc

SEQ ID NO: 1025618 - RNA, 19 nt, Homo sapiens
ugucguuucuggauuauua

SEQ ID NO: 1025619 - RNA, 19 nt, Homo sapiens
gcuauugggcucucauuua

SEQ ID NO: 1025620 - RNA, 19 nt, Homo sapiens
ggaaccuacugucuaguuu

SEQ ID NO: 1025621 - RNA, 19 nt, Homo sapiens
caaaggaaccuacugucua

SEQ ID NO: 1025622 - RNA, 19 nt, Homo sapiens
uaaagucucuucuucucaa

SEQ ID NO: 1025623 - RNA, 19 nt, Homo sapiens
aaagguaaguuucaaggaa

SEQ ID NO: 1025624 - RNA, 19 nt, Homo sapiens
ggagucaucagcagguuua

SEQ ID NO: 1025625 - RNA, 19 nt, Homo sapiens
guacaugccaaccuauaua

SEQ ID NO: 1025626 - RNA, 19 nt, Homo sapiens
ucacuccaguugaaucaua

SEQ ID NO: 1025627 - RNA, 19 nt, Homo sapiens
uggagggucuuauaaauga

SEQ ID NO: 1025628 - RNA, 19 nt, Homo sapiens
ccuuauacuucaacuguua

SEQ ID NO: 1025629 - RNA, 19 nt, Homo sapiens
ggugagaugauucguauuu

SEQ ID NO: 1025630 - RNA, 19 nt, Homo sapiens
gaaccaaaaccaacuguua

SEQ ID NO: 1025631 - RNA, 19 nt, Homo sapiens
gaagugcaguaugaauuau

SEQ ID NO: 1025632 - RNA, 19 nt, Homo sapiens
gcagcaggaacuagaauuu

SEQ ID NO: 1025633 - RNA, 19 nt, Homo sapiens
gaacaaagugaaacuggau

SEQ ID NO: 1025634 - RNA, 19 nt, Homo sapiens
agaagugcaguaugaauua

SEQ ID NO: 1025635 - RNA, 19 nt, Homo sapiens
uggaggaacuuuacagguu

SEQ ID NO: 1025636 - RNA, 19 nt, Homo sapiens
aaaggaaccuacugucuag

SEQ ID NO: 1025637 - RNA, 19 nt, Homo sapiens
caaccuauauagugcuaga

SEQ ID NO: 1025638 - RNA, 19 nt, Homo sapiens
gcuggaagaucaagagaag

SEQ ID NO: 1025639 - RNA, 19 nt, Homo sapiens
gcaguuuaccucaauauca

SEQ ID NO: 1025640 - RNA, 19 nt, Homo sapiens
ucaagcaccaugcaguuua

SEQ ID NO: 1025641 - RNA, 19 nt, Homo sapiens
gaaaaguuaggguagauua

SEQ ID NO: 1025642 - RNA, 19 nt, Homo sapiens
caguuuaccucaauaucaa

SEQ ID NO: 1025643 - RNA, 19 nt, Homo sapiens
gaugcugacucuauaugug

SEQ ID NO: 1025644 - RNA, 19 nt, Homo sapiens
gaagugguaacacggguuu

SEQ ID NO: 1025645 - RNA, 19 nt, Homo sapiens
agucuggucuccuguguuu

SEQ ID NO: 1025646 - RNA, 19 nt, Homo sapiens
gaagguagaagugguaaca

SEQ ID NO: 1025647 - RNA, 19 nt, Homo sapiens
ccuacaaauucugauguua

SEQ ID NO: 1025648 - RNA, 19 nt, Homo sapiens
gaccagaguggacuucauu

SEQ ID NO: 1025649 - RNA, 19 nt, Homo sapiens
gaccuccacugcugcuauu

SEQ ID NO: 1025650 - RNA, 19 nt, Homo sapiens
gaaaagauuggaacaagaa

SEQ ID NO: 1025651 - RNA, 19 nt, Homo sapiens
gaaacuggaucagaaaaga

SEQ ID NO: 1025652 - RNA, 19 nt, Homo sapiens
uaaaugaguggaaccuuga

SEQ ID NO: 1025653 - RNA, 19 nt, Homo sapiens
caacacuacuaccacaauc

SEQ ID NO: 1025654 - RNA, 19 nt, Homo sapiens
uagaaaguguguuauagag

SEQ ID NO: 1025655 - RNA, 19 nt, Homo sapiens
gaaccuacugucuaguuug

SEQ ID NO: 1025656 - RNA, 19 nt, Homo sapiens
gcuagauacuguaaagucu

SEQ ID NO: 1025657 - RNA, 19 nt, Homo sapiens
guauuguacuguugagaau

SEQ ID NO: 1025658 - RNA, 19 nt, Homo sapiens
agaguggacuucauuaucu

SEQ ID NO: 1025659 - RNA, 19 nt, Homo sapiens
gauugagaauggugagaug

SEQ ID NO: 1025660 - RNA, 19 nt, Homo sapiens
uugaaaaccuuguaccuua

SEQ ID NO: 1025661 - RNA, 19 nt, Homo sapiens
ggugauuuccguauauuug

SEQ ID NO: 1025662 - RNA, 19 nt, Homo sapiens
gagcagggaggaaaaguua

SEQ ID NO: 1025663 - RNA, 19 nt, Homo sapiens
ccucuuagaugcugacucu

SEQ ID NO: 1025664 - RNA, 19 nt, Homo sapiens
gaggaacuuuacagguuug

SEQ ID NO: 1025665 - RNA, 19 nt, Homo sapiens
uggaagaucaagagaagua

SEQ ID NO: 1025666 - RNA, 19 nt, Homo sapiens
guuaaggaaagguaaguuu

SEQ ID NO: 1025667 - RNA, 19 nt, Homo sapiens
guaaggguuuggagucauc

SEQ ID NO: 1025668 - RNA, 19 nt, Homo sapiens
gcaguggauugaucggaau

SEQ ID NO: 1025669 - RNA, 19 nt, Homo sapiens
ggagaagugaacaaaguga

SEQ ID NO: 1025670 - RNA, 19 nt, Homo sapiens
ugagaauggugagaugauu

SEQ ID NO: 1025671 - RNA, 19 nt, Homo sapiens
cgacuaccaccgccacuuu

SEQ ID NO: 1025672 - RNA, 19 nt, Homo sapiens
gacagcaaccucuuagaug

SEQ ID NO: 1025673 - RNA, 19 nt, Homo sapiens
aagugaaacuggaucagaa

SEQ ID NO: 1025674 - RNA, 19 nt, Homo sapiens
gucaucagcagguuuaauu

SEQ ID NO: 1025675 - RNA, 19 nt, Homo sapiens
caucuggagggucuuauaa

SEQ ID NO: 1025676 - RNA, 19 nt, Homo sapiens
aaaaguacaugccaaccua

SEQ ID NO: 1025677 - RNA, 19 nt, Homo sapiens
cgaggagcaugcacacaau

SEQ ID NO: 1025678 - RNA, 19 nt, Homo sapiens
ucuccuguguuucauguuu

SEQ ID NO: 1025679 - RNA, 19 nt, Homo sapiens
ggucuccuguguuucaugu

SEQ ID NO: 1025680 - RNA, 19 nt, Homo sapiens
guuggugauuuccguauau

SEQ ID NO: 1025681 - RNA, 19 nt, Homo sapiens
ucuggagggucuuauaaau

SEQ ID NO: 1025682 - RNA, 19 nt, Homo sapiens
gagcaugcacacaauguca

SEQ ID NO: 1025683 - RNA, 19 nt, Homo sapiens
cuauugggcucucauuuac

SEQ ID NO: 1025684 - RNA, 19 nt, Homo sapiens
ccuuguaccuuauacuuca

SEQ ID NO: 1025685 - RNA, 19 nt, Homo sapiens
gccaaccuauauagugcua

SEQ ID NO: 1025686 - RNA, 19 nt, Homo sapiens
gagaagugaacaaagugaa

SEQ ID NO: 1025687 - RNA, 19 nt, Homo sapiens
aaugaauugugcauccuuu

SEQ ID NO: 1025688 - RNA, 19 nt, Homo sapiens
ccaugcaguuuaccucaau

SEQ ID NO: 1025689 - RNA, 19 nt, Homo sapiens
aagaagugcaguaugaauu

SEQ ID NO: 1025690 - RNA, 19 nt, Homo sapiens
aaccuacugucuaguuuga

SEQ ID NO: 1025691 - RNA, 19 nt, Homo sapiens
ccuccucacuccaguugaa

SEQ ID NO: 1025692 - RNA, 19 nt, Homo sapiens
guuucuggauuauuaccua

SEQ ID NO: 1025693 - RNA, 19 nt, Homo sapiens
aagauuggaacaagaauug

SEQ ID NO: 1025694 - RNA, 19 nt, Homo sapiens
aguagcaacuccugugaug

SEQ ID NO: 1025695 - RNA, 19 nt, Homo sapiens
gaaaaccuuguaccuuaua

SEQ ID NO: 1025696 - RNA, 19 nt, Homo sapiens
uaaagaagugcaguaugaa

SEQ ID NO: 1025697 - RNA, 19 nt, Homo sapiens
caagcaccaugcaguuuac

SEQ ID NO: 1025698 - RNA, 19 nt, Homo sapiens
uguaaagucucuucuucuc

SEQ ID NO: 1025699 - RNA, 19 nt, Homo sapiens
uacuucaacuguuagugua

SEQ ID NO: 1025700 - RNA, 19 nt, Homo sapiens
aagguaaguuucaaggaau

SEQ ID NO: 1025701 - RNA, 19 nt, Homo sapiens
cugucuaguuugagauaua

SEQ ID NO: 1025702 - RNA, 19 nt, Homo sapiens
gggcucucauuuacaacuu

SEQ ID NO: 1025703 - RNA, 19 nt, Homo sapiens
ccuacugucuaguuugaga

SEQ ID NO: 1025704 - RNA, 19 nt, Homo sapiens
guaaagucucuucuucuca

SEQ ID NO: 1025705 - RNA, 19 nt, Homo sapiens
acuguaaagucucuucuuc

SEQ ID NO: 1025706 - RNA, 19 nt, Homo sapiens
gaguggacuucauuaucug

SEQ ID NO: 1025707 - RNA, 19 nt, Homo sapiens
ucuguugacuuauuuagag

SEQ ID NO: 1025708 - RNA, 19 nt, Homo sapiens
cacaaucaccaguggcuuu

SEQ ID NO: 1025709 - RNA, 19 nt, Homo sapiens
uggauauacuggcauuuua

SEQ ID NO: 1025710 - RNA, 19 nt, Homo sapiens
ucgagaagcuugugauuua

SEQ ID NO: 1025711 - RNA, 19 nt, Homo sapiens
ggaaugcucuuucacuaug

SEQ ID NO: 1025712 - RNA, 19 nt, Homo sapiens
uacaguaggugcucaauaa

SEQ ID NO: 1025713 - RNA, 19 nt, Homo sapiens
gugaagaugugacugacua

SEQ ID NO: 1025714 - RNA, 19 nt, Homo sapiens
gaacucauccuacaacaag

SEQ ID NO: 1025715 - RNA, 19 nt, Homo sapiens
agaggacgaugaugacuuu

SEQ ID NO: 1025716 - RNA, 19 nt, Homo sapiens
guggaaugcucuuucacua

SEQ ID NO: 1025717 - RNA, 19 nt, Homo sapiens
gcgaggagcgcaagaaguu

SEQ ID NO: 1025718 - RNA, 19 nt, Homo sapiens
aguaggugcucaauaaauu

SEQ ID NO: 1025719 - RNA, 19 nt, Homo sapiens
uuacaaagaccacgaccua

SEQ ID NO: 1025720 - RNA, 19 nt, Homo sapiens
uggacgagauguaugauga

SEQ ID NO: 1025721 - RNA, 19 nt, Homo sapiens
ggacgaugaugacuuugag

SEQ ID NO: 1025722 - RNA, 19 nt, Homo sapiens
gaaugcucuuucacuauga

SEQ ID NO: 1025723 - RNA, 19 nt, Homo sapiens
caagugaagaugugacuga

SEQ ID NO: 1025724 - RNA, 19 nt, Homo sapiens
ccaaagaagacaugcaguu

SEQ ID NO: 1025725 - RNA, 19 nt, Homo sapiens
uguccugccugaauucuuu

SEQ ID NO: 1025726 - RNA, 19 nt, Homo sapiens
gagaagcuugugauuuauu

SEQ ID NO: 1025727 - RNA, 19 nt, Homo sapiens
ccaacuuucugaucgauag

SEQ ID NO: 1025728 - RNA, 19 nt, Homo sapiens
aggagaaucuggccugaga

SEQ ID NO: 1025729 - RNA, 19 nt, Homo sapiens
gguggaggcuggguuuaug

SEQ ID NO: 1025730 - RNA, 19 nt, Homo sapiens
ggcauuaaagcauuuggua

SEQ ID NO: 1025731 - RNA, 19 nt, Homo sapiens
caaagaagacaugcaguuc

SEQ ID NO: 1025732 - RNA, 19 nt, Homo sapiens
gugcuuggcuuuuauguga

SEQ ID NO: 1025733 - RNA, 19 nt, Homo sapiens
gauuuauugugaccaguau

SEQ ID NO: 1025734 - RNA, 19 nt, Homo sapiens
agaagcuugugauuuauug

SEQ ID NO: 1025735 - RNA, 19 nt, Homo sapiens
cgagaagcuugugauuuau

SEQ ID NO: 1025736 - RNA, 19 nt, Homo sapiens
uaaagcauuugguauacag

SEQ ID NO: 1025737 - RNA, 19 nt, Homo sapiens
gcauuaaagcauuugguau

SEQ ID NO: 1025738 - RNA, 19 nt, Homo sapiens
cuuccuggcuugccucauu

SEQ ID NO: 1025739 - RNA, 19 nt, Homo sapiens
ccaucgcacuguacagcua

SEQ ID NO: 1025740 - RNA, 19 nt, Homo sapiens
ucgaggagcugaauguuuu

SEQ ID NO: 1025741 - RNA, 19 nt, Homo sapiens
gaggagcgcaagaaguuug

SEQ ID NO: 1025742 - RNA, 19 nt, Homo sapiens
acaucacgcuggccaaaga

SEQ ID NO: 1025743 - RNA, 19 nt, Homo sapiens
acaaagaccacgaccuaga

SEQ ID NO: 1025744 - RNA, 19 nt, Homo sapiens
ccucauuggucgccaguuc

SEQ ID NO: 1025745 - RNA, 19 nt, Homo sapiens
ucugaucgauagaaacuuc

SEQ ID NO: 1025746 - RNA, 19 nt, Homo sapiens
gagaggacgaugaugacuu

SEQ ID NO: 1025747 - RNA, 19 nt, Homo sapiens
cugacuaccuccucgaguu

SEQ ID NO: 1025748 - RNA, 19 nt, Homo sapiens
uggcugugcuggagaagga

SEQ ID NO: 1025749 - RNA, 19 nt, Homo sapiens
gagcgcaagaaguuugaaa

SEQ ID NO: 1025750 - RNA, 19 nt, Homo sapiens
ccucguaugccuuuguaaa

SEQ ID NO: 1025751 - RNA, 19 nt, Homo sapiens
gcgaggaggaggagaaucu

SEQ ID NO: 1025752 - RNA, 19 nt, Homo sapiens
aagaagacaugcaguucca

SEQ ID NO: 1025753 - RNA, 19 nt, Homo sapiens
uuccagggcuccaccuuug

SEQ ID NO: 1025754 - RNA, 19 nt, Homo sapiens
aaccugaacucauccuaca

SEQ ID NO: 1025755 - RNA, 19 nt, Homo sapiens
gcaaauguggaaugcucuu

SEQ ID NO: 1025756 - RNA, 19 nt, Homo sapiens
gaccaacuuucugaucgau

SEQ ID NO: 1025757 - RNA, 19 nt, Homo sapiens
aauguggaaugcucuuuca

SEQ ID NO: 1025758 - RNA, 19 nt, Homo sapiens
gacaacagcgcccuuaagc

SEQ ID NO: 1025759 - RNA, 19 nt, Homo sapiens
ugacuuugagaccaacuuu

SEQ ID NO: 1025760 - RNA, 19 nt, Homo sapiens
caaauguggaaugcucuuu

SEQ ID NO: 1025761 - RNA, 19 nt, Homo sapiens
cgacaacagcgcccuuaag

SEQ ID NO: 1025762 - RNA, 19 nt, Homo sapiens
gcaguggacgagauguaug

SEQ ID NO: 1025763 - RNA, 19 nt, Homo sapiens
ucggagaggacgaugauga

SEQ ID NO: 1025764 - RNA, 19 nt, Homo sapiens
gcgacaacagcgcccuuaa

SEQ ID NO: 1025765 - RNA, 19 nt, Homo sapiens
ccgaaccgcuuacccucau

SEQ ID NO: 1025766 - RNA, 19 nt, Homo sapiens
caguaggugcucaauaaau

SEQ ID NO: 1025767 - RNA, 19 nt, Homo sapiens
ugacuaccuccucgaguug

SEQ ID NO: 1025768 - RNA, 19 nt, Homo sapiens
ugacaucacgcuggccaaa

SEQ ID NO: 1025769 - RNA, 19 nt, Homo sapiens
caaagaccacgaccuagac

SEQ ID NO: 1025770 - RNA, 19 nt, Homo sapiens
ugauuuauugugaccagua

SEQ ID NO: 1025771 - RNA, 19 nt, Homo sapiens
auacaguaggugcucaaua

SEQ ID NO: 1025772 - RNA, 19 nt, Homo sapiens
gcccugaccaccagcucua

SEQ ID NO: 1025773 - RNA, 19 nt, Homo sapiens
caguggacgagauguauga

SEQ ID NO: 1025774 - RNA, 19 nt, Homo sapiens
agaccaacuuucugaucga

SEQ ID NO: 1025775 - RNA, 19 nt, Homo sapiens
cggcucaggguuacaaaga

SEQ ID NO: 1025776 - RNA, 19 nt, Homo sapiens
gagugcugccuaccgcuuu

SEQ ID NO: 1025777 - RNA, 19 nt, Homo sapiens
gaaacuuccagguguccau

SEQ ID NO: 1025778 - RNA, 19 nt, Homo sapiens
aagcauuugguauacagua

SEQ ID NO: 1025779 - RNA, 19 nt, Homo sapiens
ucgcugcccgcauguguuu

SEQ ID NO: 1025780 - RNA, 19 nt, Homo sapiens
gggcuccaccuuugacauc

SEQ ID NO: 1025781 - RNA, 19 nt, Homo sapiens
ucuugcaguucuucuucua

SEQ ID NO: 1025782 - RNA, 19 nt, Homo sapiens
gugggagcaucuacaaacu

SEQ ID NO: 1025783 - RNA, 19 nt, Homo sapiens
acaguaggugcucaauaaa

SEQ ID NO: 1025784 - RNA, 19 nt, Homo sapiens
ggacuuguacugggaugca

SEQ ID NO: 1025785 - RNA, 19 nt, Homo sapiens
uggaaugcucuuucacuau

SEQ ID NO: 1025786 - RNA, 19 nt, Homo sapiens
ggacagaaauaauucauug

SEQ ID NO: 1025787 - RNA, 19 nt, Homo sapiens
ggaaggagcugcuggauuc

SEQ ID NO: 1025788 - RNA, 19 nt, Homo sapiens
gaagaaaggucacuaaagg

SEQ ID NO: 1025789 - RNA, 19 nt, Homo sapiens
caagagagaucagcuuaua

SEQ ID NO: 1025790 - RNA, 19 nt, Homo sapiens
gagcuuauaugacacaauu

SEQ ID NO: 1025791 - RNA, 19 nt, Homo sapiens
ucacuggucuugucuauaa

SEQ ID NO: 1025792 - RNA, 19 nt, Homo sapiens
gguaauuacuugcauauga

SEQ ID NO: 1025793 - RNA, 19 nt, Homo sapiens
ucaaggcccugaagaauuu

SEQ ID NO: 1025794 - RNA, 19 nt, Homo sapiens
ugaaggaguugaagcuuua

SEQ ID NO: 1025795 - RNA, 19 nt, Homo sapiens
ucaaaucacugaauucaug

SEQ ID NO: 1025796 - RNA, 19 nt, Homo sapiens
uuaagggcaucacaaauua

SEQ ID NO: 1025797 - RNA, 19 nt, Homo sapiens
gaaaugagcuuagaaugac

SEQ ID NO: 1025798 - RNA, 19 nt, Homo sapiens
gaccuuauauucaaacuug

SEQ ID NO: 1025799 - RNA, 19 nt, Homo sapiens
ggaaacccauuuggauuaa

SEQ ID NO: 1025800 - RNA, 19 nt, Homo sapiens
gcaaaggucaauaggcuua

SEQ ID NO: 1025801 - RNA, 19 nt, Homo sapiens
ucaagacucugaaauaugu

SEQ ID NO: 1025802 - RNA, 19 nt, Homo sapiens
gagaugaguuucaccaugu

SEQ ID NO: 1025803 - RNA, 19 nt, Homo sapiens
gaucuuggcucacugcaau

SEQ ID NO: 1025804 - RNA, 19 nt, Homo sapiens
uggagugacuggaauaaua

SEQ ID NO: 1025805 - RNA, 19 nt, Homo sapiens
ggaguuguaucucgaauca

SEQ ID NO: 1025806 - RNA, 19 nt, Homo sapiens
gaguuaacauucuugguaa

SEQ ID NO: 1025807 - RNA, 19 nt, Homo sapiens
gcagagagagcauguaaug

SEQ ID NO: 1025808 - RNA, 19 nt, Homo sapiens
gaaauucgauaucaguucu

SEQ ID NO: 1025809 - RNA, 19 nt, Homo sapiens
aaacgucacuucaaacuca

SEQ ID NO: 1025810 - RNA, 19 nt, Homo sapiens
cagcuuauauggaguguug

SEQ ID NO: 1025811 - RNA, 19 nt, Homo sapiens
ugacuaguguucuuugaaa

SEQ ID NO: 1025812 - RNA, 19 nt, Homo sapiens
aagaugagcuuauaugaca

SEQ ID NO: 1025813 - RNA, 19 nt, Homo sapiens
ggaguguuguuaggcauua

SEQ ID NO: 1025814 - RNA, 19 nt, Homo sapiens
ucacagcuguugacaaugu

SEQ ID NO: 1025815 - RNA, 19 nt, Homo sapiens
aaucacagcuguugacaau

SEQ ID NO: 1025816 - RNA, 19 nt, Homo sapiens
gcaagaagacaauccuuau

SEQ ID NO: 1025817 - RNA, 19 nt, Homo sapiens
agaaucaacugaggaagua

SEQ ID NO: 1025818 - RNA, 19 nt, Homo sapiens
guagauauggccaguagua

SEQ ID NO: 1025819 - RNA, 19 nt, Homo sapiens
ggagugacuggaauaauaa

SEQ ID NO: 1025820 - RNA, 19 nt, Homo sapiens
gaaguugcauuugaguuug

SEQ ID NO: 1025821 - RNA, 19 nt, Homo sapiens
ugauguggaugaccuuaua

SEQ ID NO: 1025822 - RNA, 19 nt, Homo sapiens
cauagcaacuguucuagug

SEQ ID NO: 1025823 - RNA, 19 nt, Homo sapiens
uaacuaaugcccuaaaugu

SEQ ID NO: 1025824 - RNA, 19 nt, Homo sapiens
ggaaagguuuggcagcaau

SEQ ID NO: 1025825 - RNA, 19 nt, Homo sapiens
guauuuacauccucuuuca

SEQ ID NO: 1025826 - RNA, 19 nt, Homo sapiens
guaauugaaugaagaaagg

SEQ ID NO: 1025827 - RNA, 19 nt, Homo sapiens
acagauguauguccuugua

SEQ ID NO: 1025828 - RNA, 19 nt, Homo sapiens
ggaaauguuugcaguucau

SEQ ID NO: 1025829 - RNA, 19 nt, Homo sapiens
ugaagaaucagacaaagaa

SEQ ID NO: 1025830 - RNA, 19 nt, Homo sapiens
gaagacaauccuuaugguu

SEQ ID NO: 1025831 - RNA, 19 nt, Homo sapiens
ggacaaggaauaucagcaa

SEQ ID NO: 1025832 - RNA, 19 nt, Homo sapiens
gauaucaguucuacaagag

SEQ ID NO: 1025833 - RNA, 19 nt, Homo sapiens
aaagggaucauuaucagua

SEQ ID NO: 1025834 - RNA, 19 nt, Homo sapiens
ccagguaauugaaugaaga

SEQ ID NO: 1025835 - RNA, 19 nt, Homo sapiens
gacaaggaauaucagcaaa

SEQ ID NO: 1025836 - RNA, 19 nt, Homo sapiens
uaaaccagguaauugaaug

SEQ ID NO: 1025837 - RNA, 19 nt, Homo sapiens
agacuucaaugacugauau

SEQ ID NO: 1025838 - RNA, 19 nt, Homo sapiens
gagcuuagaaugacuagug

SEQ ID NO: 1025839 - RNA, 19 nt, Homo sapiens
agaaaugagcuuagaauga

SEQ ID NO: 1025840 - RNA, 19 nt, Homo sapiens
gagaaugcaguaacuaaug

SEQ ID NO: 1025841 - RNA, 19 nt, Homo sapiens
ucucaagacucugaaauau

SEQ ID NO: 1025842 - RNA, 19 nt, Homo sapiens
agggagaaaugacauguuu

SEQ ID NO: 1025843 - RNA, 19 nt, Homo sapiens
ugaguuaacauucuuggua

SEQ ID NO: 1025844 - RNA, 19 nt, Homo sapiens
uggaugaccuuauauucaa

SEQ ID NO: 1025845 - RNA, 19 nt, Homo sapiens
guaauuacuugcauaugag

SEQ ID NO: 1025846 - RNA, 19 nt, Homo sapiens
caauuacaauggacaagga

SEQ ID NO: 1025847 - RNA, 19 nt, Homo sapiens
cgauaucaguucuacaaga

SEQ ID NO: 1025848 - RNA, 19 nt, Homo sapiens
cuaaugcccuaaauguuug

SEQ ID NO: 1025849 - RNA, 19 nt, Homo sapiens
aagacaauccuuaugguua

SEQ ID NO: 1025850 - RNA, 19 nt, Homo sapiens
uggaaacccauuuggauua

SEQ ID NO: 1025851 - RNA, 19 nt, Homo sapiens
aagccuuacugaagaauaa

SEQ ID NO: 1025852 - RNA, 19 nt, Homo sapiens
aaucaaggcuguguucgaa

SEQ ID NO: 1025853 - RNA, 19 nt, Homo sapiens
ugagggcucugacuuacuu

SEQ ID NO: 1025854 - RNA, 19 nt, Homo sapiens
gcuggauucuuuaaaggaa

SEQ ID NO: 1025855 - RNA, 19 nt, Homo sapiens
ggagugagaagccucuuug

SEQ ID NO: 1025856 - RNA, 19 nt, Homo sapiens
ugaaguugcauuugaguuu

SEQ ID NO: 1025857 - RNA, 19 nt, Homo sapiens
cuaaauguuugaucucugu

SEQ ID NO: 1025858 - RNA, 19 nt, Homo sapiens
ccugugaaguugcauuuga

SEQ ID NO: 1025859 - RNA, 19 nt, Homo sapiens
ccaauugccaucuuaauca

SEQ ID NO: 1025860 - RNA, 19 nt, Homo sapiens
cagcagagagagcauguaa

SEQ ID NO: 1025861 - RNA, 19 nt, Homo sapiens
gguuagauguacuuggaaa

SEQ ID NO: 1025862 - RNA, 19 nt, Homo sapiens
ggaugaccuuauauucaaa

SEQ ID NO: 1025863 - RNA, 19 nt, Homo sapiens
gugcuacucugacugaugu

SEQ ID NO: 1025864 - RNA, 19 nt, Homo sapiens
gauagugguucugucauca

SEQ ID NO: 1025865 - RNA, 19 nt, Homo sapiens
gcauauauaaugacacugu

SEQ ID NO: 1025866 - RNA, 19 nt, Homo sapiens
ccaaagugcugggauuaca

SEQ ID NO: 1025867 - RNA, 19 nt, Homo sapiens
guugaaauccugggccuua

SEQ ID NO: 1025868 - RNA, 19 nt, Homo sapiens
aggcgaguguuguguauaa

SEQ ID NO: 1025869 - RNA, 19 nt, Homo sapiens
gcucugacuuacuugagaa

SEQ ID NO: 1025870 - RNA, 19 nt, Homo sapiens
cagaauuaauggagacuuc

SEQ ID NO: 1025871 - RNA, 19 nt, Homo sapiens
acuaaugcccuaaauguuu

SEQ ID NO: 1025872 - RNA, 19 nt, Homo sapiens
ucuggacaaucaaaccuua

SEQ ID NO: 1025873 - RNA, 19 nt, Homo sapiens
caccacgccuggguaauuu

SEQ ID NO: 1025874 - RNA, 19 nt, Homo sapiens
aaggagagacuuaccgaua

SEQ ID NO: 1025875 - RNA, 19 nt, Homo sapiens
agagguaauuacuugcaua

SEQ ID NO: 1025876 - RNA, 19 nt, Homo sapiens
uagcaacuguucuaguguu

SEQ ID NO: 1025877 - RNA, 19 nt, Homo sapiens
gugguuaauugcaguuuau

SEQ ID NO: 1025878 - RNA, 19 nt, Homo sapiens
ucacugaauucauggagau

SEQ ID NO: 1025879 - RNA, 19 nt, Homo sapiens
gcacgccuagaauguauuu

SEQ ID NO: 1025880 - RNA, 19 nt, Homo sapiens
gaagaaucagacaaagaaa

SEQ ID NO: 1025881 - RNA, 19 nt, Homo sapiens
gaguugaagcuuuauucua

SEQ ID NO: 1025882 - RNA, 19 nt, Homo sapiens
ccauuuggauuaauuagag

SEQ ID NO: 1025883 - RNA, 19 nt, Homo sapiens
uuugagagguaauuacuug

SEQ ID NO: 1025884 - RNA, 19 nt, Homo sapiens
gcuacacucugcccucugu

SEQ ID NO: 1025885 - RNA, 19 nt, Homo sapiens
gcauuugaguuugucuuug

SEQ ID NO: 1025886 - RNA, 19 nt, Homo sapiens
ccaauuagcugugugauaa

SEQ ID NO: 1025887 - RNA, 19 nt, Homo sapiens
gcaaugagcugagauagug

SEQ ID NO: 1025888 - RNA, 19 nt, Homo sapiens
gcaggaaacuucuguacaa

SEQ ID NO: 1025889 - RNA, 19 nt, Homo sapiens
uaacauggccuacuaauga

SEQ ID NO: 1025890 - RNA, 19 nt, Homo sapiens
gaacauccuugcagacuau

SEQ ID NO: 1025891 - RNA, 19 nt, Homo sapiens
agccuuagcuuuaguauua

SEQ ID NO: 1025892 - RNA, 19 nt, Homo sapiens
gaagaaaccaugagauuau

SEQ ID NO: 1025893 - RNA, 19 nt, Homo sapiens
caaagugucuccucgguaa

SEQ ID NO: 1025894 - RNA, 19 nt, Homo sapiens
gagcuaagauaguagauau

SEQ ID NO: 1025895 - RNA, 19 nt, Homo sapiens
gaaauuagcugggcauggu

SEQ ID NO: 1025896 - RNA, 19 nt, Homo sapiens
uaaagugccugcugcaauu

SEQ ID NO: 1025897 - RNA, 19 nt, Homo sapiens
gagaauagcaugagggaaa

SEQ ID NO: 1025898 - RNA, 19 nt, Homo sapiens
caaaccauaucaauccaua

SEQ ID NO: 1025899 - RNA, 19 nt, Homo sapiens
ccacaacaccugggaauua

SEQ ID NO: 1025900 - RNA, 19 nt, Homo sapiens
uuacaaaggcuuacacuaa

SEQ ID NO: 1025901 - RNA, 19 nt, Homo sapiens
gaccaguuauccauuaauu

SEQ ID NO: 1025902 - RNA, 19 nt, Homo sapiens
gacuauagauuccuuaaca

SEQ ID NO: 1025903 - RNA, 19 nt, Homo sapiens
ggaaaggggucuugauuga

SEQ ID NO: 1025904 - RNA, 19 nt, Homo sapiens
aaugagagcuaagauagua

SEQ ID NO: 1025905 - RNA, 19 nt, Homo sapiens
caucagaucucaugaaagc

SEQ ID NO: 1025906 - RNA, 19 nt, Homo sapiens
gcuuugagauucugagcua

SEQ ID NO: 1025907 - RNA, 19 nt, Homo sapiens
ugaagaaaccaugagauua

SEQ ID NO: 1025908 - RNA, 19 nt, Homo sapiens
gagcauuuggcacuauuua

SEQ ID NO: 1025909 - RNA, 19 nt, Homo sapiens
aaagaguacuuccaaacuu

SEQ ID NO: 1025910 - RNA, 19 nt, Homo sapiens
ucaauuaccuaccacaaca

SEQ ID NO: 1025911 - RNA, 19 nt, Homo sapiens
gcaacaaucacucaagaau

SEQ ID NO: 1025912 - RNA, 19 nt, Homo sapiens
gguaaugagagcuaagaua

SEQ ID NO: 1025913 - RNA, 19 nt, Homo sapiens
aagaguacuuccaaacuuu

SEQ ID NO: 1025914 - RNA, 19 nt, Homo sapiens
gcacuuguaguucagcuaa

SEQ ID NO: 1025915 - RNA, 19 nt, Homo sapiens
guaaugagagcuaagauag

SEQ ID NO: 1025916 - RNA, 19 nt, Homo sapiens
ugaaagcucacuaucauga

SEQ ID NO: 1025917 - RNA, 19 nt, Homo sapiens
caucagacaaugguaaaua

SEQ ID NO: 1025918 - RNA, 19 nt, Homo sapiens
gaaacccugucucuaccaa

SEQ ID NO: 1025919 - RNA, 19 nt, Homo sapiens
gcuaagauaguagauauga

SEQ ID NO: 1025920 - RNA, 19 nt, Homo sapiens
caacaccugggaauuauga

SEQ ID NO: 1025921 - RNA, 19 nt, Homo sapiens
caaaugguuuauccaagga

SEQ ID NO: 1025922 - RNA, 19 nt, Homo sapiens
acaaguacauuucaagaag

SEQ ID NO: 1025923 - RNA, 19 nt, Homo sapiens
cuuccaaacuuuacccuuu

SEQ ID NO: 1025924 - RNA, 19 nt, Homo sapiens
gcacauuugccuuaaagug

SEQ ID NO: 1025925 - RNA, 19 nt, Homo sapiens
gcauuuggcacuauuuaug

SEQ ID NO: 1025926 - RNA, 19 nt, Homo sapiens
gaaaccaugagauuaugaa

SEQ ID NO: 1025927 - RNA, 19 nt, Homo sapiens
uaacuugcuugagauaaug

SEQ ID NO: 1025928 - RNA, 19 nt, Homo sapiens
gcuauucaauucagcaagu

SEQ ID NO: 1025929 - RNA, 19 nt, Homo sapiens
ccuguaaucccaacacuuu

SEQ ID NO: 1025930 - RNA, 19 nt, Homo sapiens
aagcaacaaucacucaaga

SEQ ID NO: 1025931 - RNA, 19 nt, Homo sapiens
ccaguuauccauuaauuca

SEQ ID NO: 1025932 - RNA, 19 nt, Homo sapiens
ggcaugcacuuguaguuca

SEQ ID NO: 1025933 - RNA, 19 nt, Homo sapiens
ucaaguggcuaaggugaga

SEQ ID NO: 1025934 - RNA, 19 nt, Homo sapiens
caggaaacuucuguacaaa

SEQ ID NO: 1025935 - RNA, 19 nt, Homo sapiens
gagcugacccuuuaauggu

SEQ ID NO: 1025936 - RNA, 19 nt, Homo sapiens
cacaacaccugggaauuau

SEQ ID NO: 1025937 - RNA, 19 nt, Homo sapiens
aacaaucacucaagaaucu

SEQ ID NO: 1025938 - RNA, 19 nt, Homo sapiens
aaacaggaaugcaggaaac

SEQ ID NO: 1025939 - RNA, 19 nt, Homo sapiens
guagauaugagacuaguag

SEQ ID NO: 1025940 - RNA, 19 nt, Homo sapiens
guaauacucccucuuuuaa

SEQ ID NO: 1025941 - RNA, 19 nt, Homo sapiens
ugaccuagauauacugaag

SEQ ID NO: 1025942 - RNA, 19 nt, Homo sapiens
uacuuacacucuacaauug

SEQ ID NO: 1025943 - RNA, 19 nt, Homo sapiens
acagccagccuuagcuuua

SEQ ID NO: 1025944 - RNA, 19 nt, Homo sapiens
ggugaaacccugucucuac

SEQ ID NO: 1025945 - RNA, 19 nt, Homo sapiens
ccacaaguacauuucaaga

SEQ ID NO: 1025946 - RNA, 19 nt, Homo sapiens
cucgguaacugcuauuaaa

SEQ ID NO: 1025947 - RNA, 19 nt, Homo sapiens
ggccuacuaaugagaauaa

SEQ ID NO: 1025948 - RNA, 19 nt, Homo sapiens
gggcaaaugguuuauccaa

SEQ ID NO: 1025949 - RNA, 19 nt, Homo sapiens
aaacuuuacccuuucagaa

SEQ ID NO: 1025950 - RNA, 19 nt, Homo sapiens
caaacaaacauuaguacca

SEQ ID NO: 1025951 - RNA, 19 nt, Homo sapiens
gaaaacagacuuagcaucu

SEQ ID NO: 1025952 - RNA, 19 nt, Homo sapiens
ccauugaugcuuugagauu

SEQ ID NO: 1025953 - RNA, 19 nt, Homo sapiens
guccauugaugcuuugaga

SEQ ID NO: 1025954 - RNA, 19 nt, Homo sapiens
gagaccagcugggcaacau

SEQ ID NO: 1025955 - RNA, 19 nt, Homo sapiens
caacaaucacucaagaauc

SEQ ID NO: 1025956 - RNA, 19 nt, Homo sapiens
cuauuuguuucacgacuuu

SEQ ID NO: 1025957 - RNA, 19 nt, Homo sapiens
guucauauugaccuagaua

SEQ ID NO: 1025958 - RNA, 19 nt, Homo sapiens
gugcacauuugccuuaaag

SEQ ID NO: 1025959 - RNA, 19 nt, Homo sapiens
agaacauccuugcagacua

SEQ ID NO: 1025960 - RNA, 19 nt, Homo sapiens
caaacaggaaugcaggaaa

SEQ ID NO: 1025961 - RNA, 19 nt, Homo sapiens
acagugcacauuugccuua

SEQ ID NO: 1025962 - RNA, 19 nt, Homo sapiens
aauguaauacucccucuuu

SEQ ID NO: 1025963 - RNA, 19 nt, Homo sapiens
cugaagaaaccaugagauu

SEQ ID NO: 1025964 - RNA, 19 nt, Homo sapiens
aagcuauacuuacacucua

SEQ ID NO: 1025965 - RNA, 19 nt, Homo sapiens
accaucagaucucaugaaa

SEQ ID NO: 1025966 - RNA, 19 nt, Homo sapiens
cuuuacccuuucagaauua

SEQ ID NO: 1025967 - RNA, 19 nt, Homo sapiens
caacagucaaacaaacauu

SEQ ID NO: 1025968 - RNA, 19 nt, Homo sapiens
ggagguggaggcugcaaug

SEQ ID NO: 1025969 - RNA, 19 nt, Homo sapiens
cgcuugagcucaggaguuu

SEQ ID NO: 1025970 - RNA, 19 nt, Homo sapiens
gacaagcuauacuuacacu

SEQ ID NO: 1025971 - RNA, 19 nt, Homo sapiens
aaacauuaguaccacaagu

SEQ ID NO: 1025972 - RNA, 19 nt, Homo sapiens
agauacugcuauucaauuc

SEQ ID NO: 1025973 - RNA, 19 nt, Homo sapiens
gaucaaggaaugcaauggu

SEQ ID NO: 1025974 - RNA, 19 nt, Homo sapiens
agacuuagcaucuccaucu

SEQ ID NO: 1025975 - RNA, 19 nt, Homo sapiens
cuacucaaguggcuaaggu

SEQ ID NO: 1025976 - RNA, 19 nt, Homo sapiens
aagaaaccaugagauuaug

SEQ ID NO: 1025977 - RNA, 19 nt, Homo sapiens
ucagaauuacaaaggcuua

SEQ ID NO: 1025978 - RNA, 19 nt, Homo sapiens
gcugcaaugagcugagaua

SEQ ID NO: 1025979 - RNA, 19 nt, Homo sapiens
gauaugagacuaguagacu

SEQ ID NO: 1025980 - RNA, 19 nt, Homo sapiens
gagccaaggaauucgagaa

SEQ ID NO: 1025981 - RNA, 19 nt, Homo sapiens
acuuuaacauggccuacua

SEQ ID NO: 1025982 - RNA, 19 nt, Homo sapiens
uugagauucugagcuauuu

SEQ ID NO: 1025983 - RNA, 19 nt, Homo sapiens
ucaugaaagcucacuauca

SEQ ID NO: 1025984 - RNA, 19 nt, Homo sapiens
acuuuacccuuucagaauu

SEQ ID NO: 1025985 - RNA, 19 nt, Homo sapiens
agaguacuuccaaacuuua

SEQ ID NO: 1025986 - RNA, 19 nt, Homo sapiens
ggacaaggcucucuuauau

SEQ ID NO: 1025987 - RNA, 19 nt, Homo sapiens
gaaaggagauguggcauua

SEQ ID NO: 1025988 - RNA, 19 nt, Homo sapiens
gaaggaagaucuccagaaa

SEQ ID NO: 1025989 - RNA, 19 nt, Homo sapiens
gaagugauauucauuguug

SEQ ID NO: 1025990 - RNA, 19 nt, Homo sapiens
gaagaucuccagaaacuua

SEQ ID NO: 1025991 - RNA, 19 nt, Homo sapiens
guaagaagauuccuagaga

SEQ ID NO: 1025992 - RNA, 19 nt, Homo sapiens
gcacauauuaguacucuua

SEQ ID NO: 1025993 - RNA, 19 nt, Homo sapiens
ccaagaauguggaaaugua

SEQ ID NO: 1025994 - RNA, 19 nt, Homo sapiens
acaaggcucucuuauauuu

SEQ ID NO: 1025995 - RNA, 19 nt, Homo sapiens
gcugagaguucccuuuaua

SEQ ID NO: 1025996 - RNA, 19 nt, Homo sapiens
ggaagacacuguucgauca

SEQ ID NO: 1025997 - RNA, 19 nt, Homo sapiens
gaagauagcauuuagaaag

SEQ ID NO: 1025998 - RNA, 19 nt, Homo sapiens
gaacgacagauuagaauaa

SEQ ID NO: 1025999 - RNA, 19 nt, Homo sapiens
caucaucucucuaacauug

SEQ ID NO: 1026000 - RNA, 19 nt, Homo sapiens
gaaggaguauguauuagug

SEQ ID NO: 1026001 - RNA, 19 nt, Homo sapiens
ggacuuagaauguuaaugu

SEQ ID NO: 1026002 - RNA, 19 nt, Homo sapiens
ugaagaaacucuacgaugu

SEQ ID NO: 1026003 - RNA, 19 nt, Homo sapiens
ggaaggagauauugacaag

SEQ ID NO: 1026004 - RNA, 19 nt, Homo sapiens
guucaaaggugucaacaug

SEQ ID NO: 1026005 - RNA, 19 nt, Homo sapiens
gaagauuccuagagauuca

SEQ ID NO: 1026006 - RNA, 19 nt, Homo sapiens
gaagaaacauuccuguaac

SEQ ID NO: 1026007 - RNA, 19 nt, Homo sapiens
gaugaaggcuugggaguug

SEQ ID NO: 1026008 - RNA, 19 nt, Homo sapiens
gcacuccucuuguccuuga

SEQ ID NO: 1026009 - RNA, 19 nt, Homo sapiens
cauaggacuuagaauguua

SEQ ID NO: 1026010 - RNA, 19 nt, Homo sapiens
guacagccauugugaauac

SEQ ID NO: 1026011 - RNA, 19 nt, Homo sapiens
gaagaaacucuacgauguu

SEQ ID NO: 1026012 - RNA, 19 nt, Homo sapiens
guugaucucucuuucauug

SEQ ID NO: 1026013 - RNA, 19 nt, Homo sapiens
ccagggagcugauaauugg

SEQ ID NO: 1026014 - RNA, 19 nt, Homo sapiens
gauauucauuguugcugua

SEQ ID NO: 1026015 - RNA, 19 nt, Homo sapiens
gacuguaucuucagccuuu

SEQ ID NO: 1026016 - RNA, 19 nt, Homo sapiens
gaaacauuccuguaacauu

SEQ ID NO: 1026017 - RNA, 19 nt, Homo sapiens
cuaccuaccugcagauauu

SEQ ID NO: 1026018 - RNA, 19 nt, Homo sapiens
cuaaccagaugcauuguuu

SEQ ID NO: 1026019 - RNA, 19 nt, Homo sapiens
ggaauuugaaggcuguuua

SEQ ID NO: 1026020 - RNA, 19 nt, Homo sapiens
gaggaucugucugauauug

SEQ ID NO: 1026021 - RNA, 19 nt, Homo sapiens
gaagcagcaucaaagaaau

SEQ ID NO: 1026022 - RNA, 19 nt, Homo sapiens
cgaauucuccauuagauaa

SEQ ID NO: 1026023 - RNA, 19 nt, Homo sapiens
gaaagucucacagauaaga

SEQ ID NO: 1026024 - RNA, 19 nt, Homo sapiens
ucacagagguaucaugaag

SEQ ID NO: 1026025 - RNA, 19 nt, Homo sapiens
aaacauaggacuuagaaug

SEQ ID NO: 1026026 - RNA, 19 nt, Homo sapiens
gaaauauacagaaccaaug

SEQ ID NO: 1026027 - RNA, 19 nt, Homo sapiens
cagaaccaauguaugcuaa

SEQ ID NO: 1026028 - RNA, 19 nt, Homo sapiens
gacaccgaauucuccauua

SEQ ID NO: 1026029 - RNA, 19 nt, Homo sapiens
guaccugaacgacagauua

SEQ ID NO: 1026030 - RNA, 19 nt, Homo sapiens
gcaaugaaagucucacaga

SEQ ID NO: 1026031 - RNA, 19 nt, Homo sapiens
acgaauagcuaccuguuga

SEQ ID NO: 1026032 - RNA, 19 nt, Homo sapiens
aaacgggccuuacuauaca

SEQ ID NO: 1026033 - RNA, 19 nt, Homo sapiens
ggacagugauggugguagu

SEQ ID NO: 1026034 - RNA, 19 nt, Homo sapiens
gaaauuauaaucgcugguu

SEQ ID NO: 1026035 - RNA, 19 nt, Homo sapiens
gcacuucgcacuguaagaa

SEQ ID NO: 1026036 - RNA, 19 nt, Homo sapiens
augaaagucucacagauaa

SEQ ID NO: 1026037 - RNA, 19 nt, Homo sapiens
gugaauaccagcaaugaaa

SEQ ID NO: 1026038 - RNA, 19 nt, Homo sapiens
gaaacucuacgauguuguu

SEQ ID NO: 1026039 - RNA, 19 nt, Homo sapiens
cagcugagaguucccuuua

SEQ ID NO: 1026040 - RNA, 19 nt, Homo sapiens
ugccuuagcuugguuauga

SEQ ID NO: 1026041 - RNA, 19 nt, Homo sapiens
guacaucccacauuucguu

SEQ ID NO: 1026042 - RNA, 19 nt, Homo sapiens
cugaggaucugucugauau

SEQ ID NO: 1026043 - RNA, 19 nt, Homo sapiens
cuaaggacauuucauagca

SEQ ID NO: 1026044 - RNA, 19 nt, Homo sapiens
guucacaucaucucucuaa

SEQ ID NO: 1026045 - RNA, 19 nt, Homo sapiens
cagauugacuuuccuccuu

SEQ ID NO: 1026046 - RNA, 19 nt, Homo sapiens
gcugcuaccucucuacuuc

SEQ ID NO: 1026047 - RNA, 19 nt, Homo sapiens
ccucuaaggacauuucaua

SEQ ID NO: 1026048 - RNA, 19 nt, Homo sapiens
gaaacaagaagacuguauc

SEQ ID NO: 1026049 - RNA, 19 nt, Homo sapiens
ccagaugcauuguuugcuu

SEQ ID NO: 1026050 - RNA, 19 nt, Homo sapiens
gcacauaagcaaucuaaaa

SEQ ID NO: 1026051 - RNA, 19 nt, Homo sapiens
ugugaaggaguauguauua

SEQ ID NO: 1026052 - RNA, 19 nt, Homo sapiens
gaguugaucucucuuucau

SEQ ID NO: 1026053 - RNA, 19 nt, Homo sapiens
caaugaaagucucacagau

SEQ ID NO: 1026054 - RNA, 19 nt, Homo sapiens
ggagauguggcauuacuga

SEQ ID NO: 1026055 - RNA, 19 nt, Homo sapiens
aaaaggaccgcacauauua

SEQ ID NO: 1026056 - RNA, 19 nt, Homo sapiens
cauggaugauuuggucuua

SEQ ID NO: 1026057 - RNA, 19 nt, Homo sapiens
ggaaauguaucugacaaaa

SEQ ID NO: 1026058 - RNA, 19 nt, Homo sapiens
gcagaagcagcaucaaaga

SEQ ID NO: 1026059 - RNA, 19 nt, Homo sapiens
ggaaaggagauguggcauu

SEQ ID NO: 1026060 - RNA, 19 nt, Homo sapiens
guuccgaucucaacagugu

SEQ ID NO: 1026061 - RNA, 19 nt, Homo sapiens
ucagauccaugguguuaau

SEQ ID NO: 1026062 - RNA, 19 nt, Homo sapiens
gauaaaccaccaagacugu

SEQ ID NO: 1026063 - RNA, 19 nt, Homo sapiens
ggacaccgaauucuccauu

SEQ ID NO: 1026064 - RNA, 19 nt, Homo sapiens
gaaaacgggccuuacuaua

SEQ ID NO: 1026065 - RNA, 19 nt, Homo sapiens
gauauugacaagcaaagaa

SEQ ID NO: 1026066 - RNA, 19 nt, Homo sapiens
aaacguacuucaacuagca

SEQ ID NO: 1026067 - RNA, 19 nt, Homo sapiens
aaugaaagucucacagaua

SEQ ID NO: 1026068 - RNA, 19 nt, Homo sapiens
cuacacagcacuccucuug

SEQ ID NO: 1026069 - RNA, 19 nt, Homo sapiens
uuugugaccugccaucuuu

SEQ ID NO: 1026070 - RNA, 19 nt, Homo sapiens
uaagaauccugugucagaa

SEQ ID NO: 1026071 - RNA, 19 nt, Homo sapiens
auaaggacgucaauggaaa

SEQ ID NO: 1026072 - RNA, 19 nt, Homo sapiens
caccaagacuguucacauc

SEQ ID NO: 1026073 - RNA, 19 nt, Homo sapiens
agaagcagcaucaaagaaa

SEQ ID NO: 1026074 - RNA, 19 nt, Homo sapiens
gaacugcacacauuuuaaa

SEQ ID NO: 1026075 - RNA, 19 nt, Homo sapiens
auucugaacugcacacauu

SEQ ID NO: 1026076 - RNA, 19 nt, Homo sapiens
gaauggaaggagauauuga

SEQ ID NO: 1026077 - RNA, 19 nt, Homo sapiens
cagauuagaauaagugaga

SEQ ID NO: 1026078 - RNA, 19 nt, Homo sapiens
uaagaagauuccuagagau

SEQ ID NO: 1026079 - RNA, 19 nt, Homo sapiens
acagugggaccuaaauaua

SEQ ID NO: 1026080 - RNA, 19 nt, Homo sapiens
uggaugauuuggucuuauu

SEQ ID NO: 1026081 - RNA, 19 nt, Homo sapiens
gagaauuaccugaguccaa

SEQ ID NO: 1026082 - RNA, 19 nt, Homo sapiens
gccacuuccuccacgaaua

SEQ ID NO: 1026083 - RNA, 19 nt, Homo sapiens
cagugggaccuaaauauaa

SEQ ID NO: 1026084 - RNA, 19 nt, Homo sapiens
gaagcaaaauugacaaaag

SEQ ID NO: 1026085 - RNA, 19 nt, Homo sapiens
acacagcacuccucuuguc

SEQ ID NO: 1026086 - RNA, 19 nt, Homo sapiens
ccaccaaccucucaaauug

SEQ ID NO: 1026087 - RNA, 19 nt, Homo sapiens
gaaggacucugcccuacaa

SEQ ID NO: 1026088 - RNA, 19 nt, Homo sapiens
gagaauguguuuauacugu

SEQ ID NO: 1026089 - RNA, 19 nt, Homo sapiens
cuacaacuaucuucuguuu

SEQ ID NO: 1026090 - RNA, 19 nt, Homo sapiens
caccacaccuggcuaauuu

SEQ ID NO: 1026091 - RNA, 19 nt, Homo sapiens
uaacagauauggcagaaca

SEQ ID NO: 1026092 - RNA, 19 nt, Homo sapiens
caccacaccuggccuguua

SEQ ID NO: 1026093 - RNA, 19 nt, Homo sapiens
guauagaguuggaauguau

SEQ ID NO: 1026094 - RNA, 19 nt, Homo sapiens
gaaaggagaccucaaacug

SEQ ID NO: 1026095 - RNA, 19 nt, Homo sapiens
uuaagcaaauggucaguua

SEQ ID NO: 1026096 - RNA, 19 nt, Homo sapiens
aaacauacuucccuaccua

SEQ ID NO: 1026097 - RNA, 19 nt, Homo sapiens
gcaugucgcuuucaagugu

SEQ ID NO: 1026098 - RNA, 19 nt, Homo sapiens
ccaaaggcuugauuauauu

SEQ ID NO: 1026099 - RNA, 19 nt, Homo sapiens
uccaaaggcuugauuauau

SEQ ID NO: 1026100 - RNA, 19 nt, Homo sapiens
cuaaauagccuuauaccaa

SEQ ID NO: 1026101 - RNA, 19 nt, Homo sapiens
gauagggucuugcuguguu

SEQ ID NO: 1026102 - RNA, 19 nt, Homo sapiens
aaacugaugcugagaagua

SEQ ID NO: 1026103 - RNA, 19 nt, Homo sapiens
caaacucuuucccaucuuu

SEQ ID NO: 1026104 - RNA, 19 nt, Homo sapiens
aagcacaaaugaacacuaa

SEQ ID NO: 1026105 - RNA, 19 nt, Homo sapiens
gaucauagaaggugagaau

SEQ ID NO: 1026106 - RNA, 19 nt, Homo sapiens
ugucauaucuuuacaugug

SEQ ID NO: 1026107 - RNA, 19 nt, Homo sapiens
ugaauuccuuccucuuuaa

SEQ ID NO: 1026108 - RNA, 19 nt, Homo sapiens
gcacaaaugaacacuaaau

SEQ ID NO: 1026109 - RNA, 19 nt, Homo sapiens
cauaugagcucuggagguu

SEQ ID NO: 1026110 - RNA, 19 nt, Homo sapiens
gacauagucuaguucuaaa

SEQ ID NO: 1026111 - RNA, 19 nt, Homo sapiens
gaaaguuugcugugugauu

SEQ ID NO: 1026112 - RNA, 19 nt, Homo sapiens
gagagacaauuagaaaugu

SEQ ID NO: 1026113 - RNA, 19 nt, Homo sapiens
gcaaagagaaguguaauac

SEQ ID NO: 1026114 - RNA, 19 nt, Homo sapiens
gguuaucuauuuccauuug

SEQ ID NO: 1026115 - RNA, 19 nt, Homo sapiens
ggaaaccuaaugccucuuu

SEQ ID NO: 1026116 - RNA, 19 nt, Homo sapiens
ggacucugcccuacaacua

SEQ ID NO: 1026117 - RNA, 19 nt, Homo sapiens
gaauaauacggacauaguu

SEQ ID NO: 1026118 - RNA, 19 nt, Homo sapiens
gcacuaaacaagcacaaau

SEQ ID NO: 1026119 - RNA, 19 nt, Homo sapiens
gcuaacuucauguuucuua

SEQ ID NO: 1026120 - RNA, 19 nt, Homo sapiens
gaguuggucugcugugcua

SEQ ID NO: 1026121 - RNA, 19 nt, Homo sapiens
gguauaccuuccuaauuau

SEQ ID NO: 1026122 - RNA, 19 nt, Homo sapiens
uccaguggcuucuuuacua

SEQ ID NO: 1026123 - RNA, 19 nt, Homo sapiens
gucagaggcuuuacuaauc

SEQ ID NO: 1026124 - RNA, 19 nt, Homo sapiens
acaagcagccauauacuaa

SEQ ID NO: 1026125 - RNA, 19 nt, Homo sapiens
agauauggcagaacaauuu

SEQ ID NO: 1026126 - RNA, 19 nt, Homo sapiens
gugcaugccugugauauuc

SEQ ID NO: 1026127 - RNA, 19 nt, Homo sapiens
gguuggaguuggaaaguga

SEQ ID NO: 1026128 - RNA, 19 nt, Homo sapiens
aaucagcucucagacuuaa

SEQ ID NO: 1026129 - RNA, 19 nt, Homo sapiens
ggucugcugugcuaacuuc

SEQ ID NO: 1026130 - RNA, 19 nt, Homo sapiens
aaaguuugcugugugauug

SEQ ID NO: 1026131 - RNA, 19 nt, Homo sapiens
gaguuggaauguauuguuc

SEQ ID NO: 1026132 - RNA, 19 nt, Homo sapiens
gcagugacaugaucauagc

SEQ ID NO: 1026133 - RNA, 19 nt, Homo sapiens
gaauguacuuggugugcau

SEQ ID NO: 1026134 - RNA, 19 nt, Homo sapiens
ccguagcauuucuuaauaa

SEQ ID NO: 1026135 - RNA, 19 nt, Homo sapiens
uguagaaguuucagugaga

SEQ ID NO: 1026136 - RNA, 19 nt, Homo sapiens
gauugcaucccaccuguuu

SEQ ID NO: 1026137 - RNA, 19 nt, Homo sapiens
ccuaaugccucuuuucuaa

SEQ ID NO: 1026138 - RNA, 19 nt, Homo sapiens
cauagaaggugagaaugug

SEQ ID NO: 1026139 - RNA, 19 nt, Homo sapiens
uaaguugcauugagagaca

SEQ ID NO: 1026140 - RNA, 19 nt, Homo sapiens
ggccuguuauuccuucuuu

SEQ ID NO: 1026141 - RNA, 19 nt, Homo sapiens
augaauuccuuccucuuua

SEQ ID NO: 1026142 - RNA, 19 nt, Homo sapiens
ugagagacaauuagaaaug

SEQ ID NO: 1026143 - RNA, 19 nt, Homo sapiens
aaaggagaccucaaacuga

SEQ ID NO: 1026144 - RNA, 19 nt, Homo sapiens
uccguagcauuucuuaaua

SEQ ID NO: 1026145 - RNA, 19 nt, Homo sapiens
caauaguaguuucuguaga

SEQ ID NO: 1026146 - RNA, 19 nt, Homo sapiens
guaaauagggcaaaacauu

SEQ ID NO: 1026147 - RNA, 19 nt, Homo sapiens
guagaaguuucagugagaa

SEQ ID NO: 1026148 - RNA, 19 nt, Homo sapiens
gugcauguguuaacagaag

SEQ ID NO: 1026149 - RNA, 19 nt, Homo sapiens
acauguggauuaugaacaa

SEQ ID NO: 1026150 - RNA, 19 nt, Homo sapiens
ugggcucccuguuguauuu

SEQ ID NO: 1026151 - RNA, 19 nt, Homo sapiens
ggcaaaacauuaguugaua

SEQ ID NO: 1026152 - RNA, 19 nt, Homo sapiens
gaaggugagaauguguuua

SEQ ID NO: 1026153 - RNA, 19 nt, Homo sapiens
cccaugaguucaaauuaau

SEQ ID NO: 1026154 - RNA, 19 nt, Homo sapiens
ccacucggcuuuucugauu

SEQ ID NO: 1026155 - RNA, 19 nt, Homo sapiens
caaaugaacacuaaauagc

SEQ ID NO: 1026156 - RNA, 19 nt, Homo sapiens
gugagaauguguuuauacu

SEQ ID NO: 1026157 - RNA, 19 nt, Homo sapiens
cguagucacuguucuuagu

SEQ ID NO: 1026158 - RNA, 19 nt, Homo sapiens
uaugaauuccuuccucuuu

SEQ ID NO: 1026159 - RNA, 19 nt, Homo sapiens
uaaacaagcacaaaugaac

SEQ ID NO: 1026160 - RNA, 19 nt, Homo sapiens
cuuuacauguggauuauga

SEQ ID NO: 1026161 - RNA, 19 nt, Homo sapiens
gagacaauuagaaauguug

SEQ ID NO: 1026162 - RNA, 19 nt, Homo sapiens
gaacaauaccccaugaguu

SEQ ID NO: 1026163 - RNA, 19 nt, Homo sapiens
gcuagaauuacaagcauga

SEQ ID NO: 1026164 - RNA, 19 nt, Homo sapiens
ccucucaaauugcuagaau

SEQ ID NO: 1026165 - RNA, 19 nt, Homo sapiens
gugcagcagugacaugauc

SEQ ID NO: 1026166 - RNA, 19 nt, Homo sapiens
aaaaucagcucucagacuu

SEQ ID NO: 1026167 - RNA, 19 nt, Homo sapiens
aaggagaccucaaacugau

SEQ ID NO: 1026168 - RNA, 19 nt, Homo sapiens
ucagaggcuuuacuaaucu

SEQ ID NO: 1026169 - RNA, 19 nt, Homo sapiens
guaauacaagugaucauag

SEQ ID NO: 1026170 - RNA, 19 nt, Homo sapiens
ucaagugcauguguuaaca

SEQ ID NO: 1026171 - RNA, 19 nt, Homo sapiens
cugguuaucuauuuccauu

SEQ ID NO: 1026172 - RNA, 19 nt, Homo sapiens
ggcaugguaugaauuccuu

SEQ ID NO: 1026173 - RNA, 19 nt, Homo sapiens
ucacuggcaugucgcuuuc

SEQ ID NO: 1026174 - RNA, 19 nt, Homo sapiens
ucacagagccuggguaagg

SEQ ID NO: 1026175 - RNA, 19 nt, Homo sapiens
agaguccaguggcuucuuu

SEQ ID NO: 1026176 - RNA, 19 nt, Homo sapiens
ucuaaugugugcuaagcuu

SEQ ID NO: 1026177 - RNA, 19 nt, Homo sapiens
ugaauaauacggacauagu

SEQ ID NO: 1026178 - RNA, 19 nt, Homo sapiens
aagcaaauggucaguuauu

SEQ ID NO: 1026179 - RNA, 19 nt, Homo sapiens
aaagcauucuuguaacugu

SEQ ID NO: 1026180 - RNA, 19 nt, Homo sapiens
gacacuugcuguggaaugu

SEQ ID NO: 1026181 - RNA, 19 nt, Homo sapiens
ugaaaacccuagacacuug

SEQ ID NO: 1026182 - RNA, 19 nt, Homo sapiens
cuaccuauauguauuccau

SEQ ID NO: 1026183 - RNA, 19 nt, Homo sapiens
uguauuccauggcuaacaa

SEQ ID NO: 1026184 - RNA, 19 nt, Homo sapiens
gccaccaaccucucaaauu

SEQ ID NO: 1026185 - RNA, 19 nt, Homo sapiens
ucaaacugaugcugagaag

SEQ ID NO: 1026186 - RNA, 19 nt, Homo sapiens
uagagcagcugauaaguuu

SEQ ID NO: 1026187 - RNA, 19 nt, Homo sapiens
ucacagguguccaaacuuu

SEQ ID NO: 1026188 - RNA, 19 nt, Homo sapiens
gcaggugaguggauggaua

SEQ ID NO: 1026189 - RNA, 19 nt, Homo sapiens
ggagauugcugcuuugagu

SEQ ID NO: 1026190 - RNA, 19 nt, Homo sapiens
agaaagagcugagggaguu

SEQ ID NO: 1026191 - RNA, 19 nt, Homo sapiens
gggaucaugucuccaggua

SEQ ID NO: 1026192 - RNA, 19 nt, Homo sapiens
gguuggagauugcugcuuu

SEQ ID NO: 1026193 - RNA, 19 nt, Homo sapiens
gcacgugggcauuauuaaa

SEQ ID NO: 1026194 - RNA, 19 nt, Homo sapiens
gagggugucuucacuuugu

SEQ ID NO: 1026195 - RNA, 19 nt, Homo sapiens
gaucuaggcauaaccugua

SEQ ID NO: 1026196 - RNA, 19 nt, Homo sapiens
gaucaggaguuucguuucu

SEQ ID NO: 1026197 - RNA, 19 nt, Homo sapiens
cagaaaugcucucuucaca

SEQ ID NO: 1026198 - RNA, 19 nt, Homo sapiens
gugcugccaucaccaagua

SEQ ID NO: 1026199 - RNA, 19 nt, Homo sapiens
gaucaugucuccagguaac

SEQ ID NO: 1026200 - RNA, 19 nt, Homo sapiens
ccaggagucggaaauguua

SEQ ID NO: 1026201 - RNA, 19 nt, Homo sapiens
guggauggauagauggaua

SEQ ID NO: 1026202 - RNA, 19 nt, Homo sapiens
cgaaagacccugaccuuca

SEQ ID NO: 1026203 - RNA, 19 nt, Homo sapiens
ugacauggcacauagagaa

SEQ ID NO: 1026204 - RNA, 19 nt, Homo sapiens
gagaagcacugccauucag

SEQ ID NO: 1026205 - RNA, 19 nt, Homo sapiens
gaucagaccauuucuaucg

SEQ ID NO: 1026206 - RNA, 19 nt, Homo sapiens
ggucuucucucgcuaugau

SEQ ID NO: 1026207 - RNA, 19 nt, Homo sapiens
ggccacauuugaagaagaa

SEQ ID NO: 1026208 - RNA, 19 nt, Homo sapiens
gggcacgugggcauuauua

SEQ ID NO: 1026209 - RNA, 19 nt, Homo sapiens
gugaguggauggauagaug

SEQ ID NO: 1026210 - RNA, 19 nt, Homo sapiens
ucaaaggccugugcagaug

SEQ ID NO: 1026211 - RNA, 19 nt, Homo sapiens
guaaaucacagguguccaa

SEQ ID NO: 1026212 - RNA, 19 nt, Homo sapiens
ggagaagcacugccauuca

SEQ ID NO: 1026213 - RNA, 19 nt, Homo sapiens
gcagcgagggaacugguua

SEQ ID NO: 1026214 - RNA, 19 nt, Homo sapiens
aggcauaaccuguaaauca

SEQ ID NO: 1026215 - RNA, 19 nt, Homo sapiens
cccauuaacucagugcuuu

SEQ ID NO: 1026216 - RNA, 19 nt, Homo sapiens
cgagggaacugguuaucca

SEQ ID NO: 1026217 - RNA, 19 nt, Homo sapiens
gcaauugucagaugaucga

SEQ ID NO: 1026218 - RNA, 19 nt, Homo sapiens
gaaagagcugagggaguua

SEQ ID NO: 1026219 - RNA, 19 nt, Homo sapiens
agucggaaauguuaaacuu

SEQ ID NO: 1026220 - RNA, 19 nt, Homo sapiens
ccagguaacccgacuguag

SEQ ID NO: 1026221 - RNA, 19 nt, Homo sapiens
auagugagcaugcaauaaa

SEQ ID NO: 1026222 - RNA, 19 nt, Homo sapiens
gaaacagggcccauaacca

SEQ ID NO: 1026223 - RNA, 19 nt, Homo sapiens
gaagaagcagagggcauuu

SEQ ID NO: 1026224 - RNA, 19 nt, Homo sapiens
cgaagaagcagagggcauu

SEQ ID NO: 1026225 - RNA, 19 nt, Homo sapiens
cauggugccuggugcauag

SEQ ID NO: 1026226 - RNA, 19 nt, Homo sapiens
cugagggugucuucacuuu

SEQ ID NO: 1026227 - RNA, 19 nt, Homo sapiens
ucaaaggguuggagauugc

SEQ ID NO: 1026228 - RNA, 19 nt, Homo sapiens
aaucacagguguccaaacu

SEQ ID NO: 1026229 - RNA, 19 nt, Homo sapiens
agagaaacagggcccauaa

SEQ ID NO: 1026230 - RNA, 19 nt, Homo sapiens
ucagaaggagcaagagauu

SEQ ID NO: 1026231 - RNA, 19 nt, Homo sapiens
uguuucagaucuaggcaua

SEQ ID NO: 1026232 - RNA, 19 nt, Homo sapiens
aaugaugugugugguguuu

SEQ ID NO: 1026233 - RNA, 19 nt, Homo sapiens
gaguuucguuucucacaca

SEQ ID NO: 1026234 - RNA, 19 nt, Homo sapiens
acucggagcccacuacuga

SEQ ID NO: 1026235 - RNA, 19 nt, Homo sapiens
gagcgaggagcagcgguua

SEQ ID NO: 1026236 - RNA, 19 nt, Homo sapiens
uggcuaaaguuuccacauc

SEQ ID NO: 1026237 - RNA, 19 nt, Homo sapiens
uaaccagugggcagcuuua

SEQ ID NO: 1026238 - RNA, 19 nt, Homo sapiens
ccgaggcgcugcagaaacu

SEQ ID NO: 1026239 - RNA, 19 nt, Homo sapiens
ggcauaaccuguaaaucac

SEQ ID NO: 1026240 - RNA, 19 nt, Homo sapiens
augcagaaaugcucucuuc

SEQ ID NO: 1026241 - RNA, 19 nt, Homo sapiens
gggccacauuugaagaaga

SEQ ID NO: 1026242 - RNA, 19 nt, Homo sapiens
ccagugggcagcuuuagga

SEQ ID NO: 1026243 - RNA, 19 nt, Homo sapiens
ccgaucagaccauuucuau

SEQ ID NO: 1026244 - RNA, 19 nt, Homo sapiens
ugagccagccuccggcaua

SEQ ID NO: 1026245 - RNA, 19 nt, Homo sapiens
ucaggaguuucguuucuca

SEQ ID NO: 1026246 - RNA, 19 nt, Homo sapiens
cgagaggaccgaagaagca

SEQ ID NO: 1026247 - RNA, 19 nt, Homo sapiens
gcauggugccuggugcaua

SEQ ID NO: 1026248 - RNA, 19 nt, Homo sapiens
ccaaauccaccaugcaucu

SEQ ID NO: 1026249 - RNA, 19 nt, Homo sapiens
uaaguuucccuaccugaug

SEQ ID NO: 1026250 - RNA, 19 nt, Homo sapiens
acacaagagcaaccugaaa

SEQ ID NO: 1026251 - RNA, 19 nt, Homo sapiens
gacauggcacauagagaaa

SEQ ID NO: 1026252 - RNA, 19 nt, Homo sapiens
uagugagcaugcaauaaau

SEQ ID NO: 1026253 - RNA, 19 nt, Homo sapiens
ggccauguuucuacucagu

SEQ ID NO: 1026254 - RNA, 19 nt, Homo sapiens
ggacauacggaucgaugag

SEQ ID NO: 1026255 - RNA, 19 nt, Homo sapiens
uuagagcagcugauaaguu

SEQ ID NO: 1026256 - RNA, 19 nt, Homo sapiens
gcagaaaugcucucuucac

SEQ ID NO: 1026257 - RNA, 19 nt, Homo sapiens
ggauagauggauaggugaa

SEQ ID NO: 1026258 - RNA, 19 nt, Homo sapiens
gugagcaugcaauaaauau

SEQ ID NO: 1026259 - RNA, 19 nt, Homo sapiens
gcaaggguucuggcaguga

SEQ ID NO: 1026260 - RNA, 19 nt, Homo sapiens
gagcugagggaguuaagag

SEQ ID NO: 1026261 - RNA, 19 nt, Homo sapiens
acucagugcuuuugucuuu

SEQ ID NO: 1026262 - RNA, 19 nt, Homo sapiens
ggccuuagucucccaaauc

SEQ ID NO: 1026263 - RNA, 19 nt, Homo sapiens
gaugaccuccagcugauuc

SEQ ID NO: 1026264 - RNA, 19 nt, Homo sapiens
ucgcuaugaucaggaguuu

SEQ ID NO: 1026265 - RNA, 19 nt, Homo sapiens
cauagugagcaugcaauaa

SEQ ID NO: 1026266 - RNA, 19 nt, Homo sapiens
ccacauuugaagaagaauu

SEQ ID NO: 1026267 - RNA, 19 nt, Homo sapiens
gcucugugcccaucaugug

SEQ ID NO: 1026268 - RNA, 19 nt, Homo sapiens
cagccugugcccacugaua

SEQ ID NO: 1026269 - RNA, 19 nt, Homo sapiens
gugacuggguggauguugu

SEQ ID NO: 1026270 - RNA, 19 nt, Homo sapiens
aaaaguccuugcauucaaa

SEQ ID NO: 1026271 - RNA, 19 nt, Homo sapiens
ugcagaaacuugacaccau

SEQ ID NO: 1026272 - RNA, 19 nt, Homo sapiens
ccaccuccuuccagaaugg

SEQ ID NO: 1026273 - RNA, 19 nt, Homo sapiens
gucaaaggccugugcagau

SEQ ID NO: 1026274 - RNA, 19 nt, Homo sapiens
cagaaggagcaagagauuu

SEQ ID NO: 1026275 - RNA, 19 nt, Homo sapiens
gcuguucacaugcagaaau

SEQ ID NO: 1026276 - RNA, 19 nt, Homo sapiens
ccauguuucuacucagugu

SEQ ID NO: 1026277 - RNA, 19 nt, Homo sapiens
caggccauguuucuacuca

SEQ ID NO: 1026278 - RNA, 19 nt, Homo sapiens
gcuaugaucaggaguuucg

SEQ ID NO: 1026279 - RNA, 19 nt, Homo sapiens
cacaagagcaaccugaaag

SEQ ID NO: 1026280 - RNA, 19 nt, Homo sapiens
ggcauuauuaaaggucuua

SEQ ID NO: 1026281 - RNA, 19 nt, Homo sapiens
guuggagauugcugcuuug

SEQ ID NO: 1026282 - RNA, 19 nt, Homo sapiens
uuucguuucucacacaaug

SEQ ID NO: 1026283 - RNA, 19 nt, Homo sapiens
ggccuggugggcaugcuua

SEQ ID NO: 1026284 - RNA, 19 nt, Homo sapiens
ggugccuggugcauaguga

SEQ ID NO: 1026285 - RNA, 19 nt, Homo sapiens
gggccuuagucucccaaau

SEQ ID NO: 1026286 - RNA, 19 nt, Homo sapiens
gcagaaagaugcuccaaga

SEQ ID NO: 1026287 - RNA, 19 nt, Homo sapiens
gaaccuggcuccaaaggaa

SEQ ID NO: 1026288 - RNA, 19 nt, Homo sapiens
gaucggagcugcaccuuga

SEQ ID NO: 1026289 - RNA, 19 nt, Homo sapiens
gaacucaggcccuccuuua

SEQ ID NO: 1026290 - RNA, 19 nt, Homo sapiens
gaacagagagaccauugua

SEQ ID NO: 1026291 - RNA, 19 nt, Homo sapiens
ggaaggcccuggauucuca

SEQ ID NO: 1026292 - RNA, 19 nt, Homo sapiens
guuuagcacuucuguauuu

SEQ ID NO: 1026293 - RNA, 19 nt, Homo sapiens
gcacacaggccgagagaaa

SEQ ID NO: 1026294 - RNA, 19 nt, Homo sapiens
gaaccaacacuaucaaugu

SEQ ID NO: 1026295 - RNA, 19 nt, Homo sapiens
gaacagguccuaugucucu

SEQ ID NO: 1026296 - RNA, 19 nt, Homo sapiens
gcacuucuguauuuauugu

SEQ ID NO: 1026297 - RNA, 19 nt, Homo sapiens
gcucagauuugaacagaug

SEQ ID NO: 1026298 - RNA, 19 nt, Homo sapiens
gaggcgagguuaaagcauu

SEQ ID NO: 1026299 - RNA, 19 nt, Homo sapiens
gaucuugaaucucuuucuu

SEQ ID NO: 1026300 - RNA, 19 nt, Homo sapiens
gacgaagcaacaugaauua

SEQ ID NO: 1026301 - RNA, 19 nt, Homo sapiens
gcaagacaguggcauuucu

SEQ ID NO: 1026302 - RNA, 19 nt, Homo sapiens
uaacaugagacacguauga

SEQ ID NO: 1026303 - RNA, 19 nt, Homo sapiens
caucauuguuugccuuauu

SEQ ID NO: 1026304 - RNA, 19 nt, Homo sapiens
gaagauacacacuauaacu

SEQ ID NO: 1026305 - RNA, 19 nt, Homo sapiens
gcagaugccuagguggaaa

SEQ ID NO: 1026306 - RNA, 19 nt, Homo sapiens
gagacacguaugaaauuua

SEQ ID NO: 1026307 - RNA, 19 nt, Homo sapiens
gggaacagguccuaugucu

SEQ ID NO: 1026308 - RNA, 19 nt, Homo sapiens
ugagacacguaugaaauuu

SEQ ID NO: 1026309 - RNA, 19 nt, Homo sapiens
ugacgaagcaacaugaauu

SEQ ID NO: 1026310 - RNA, 19 nt, Homo sapiens
ccaguacugugguguguga

SEQ ID NO: 1026311 - RNA, 19 nt, Homo sapiens
gcugcaccuugaacaaaua

SEQ ID NO: 1026312 - RNA, 19 nt, Homo sapiens
cuacauuccucuccucuuc

SEQ ID NO: 1026313 - RNA, 19 nt, Homo sapiens
ucucucaucucccugaauu

SEQ ID NO: 1026314 - RNA, 19 nt, Homo sapiens
gccaucaccucaucucaau

SEQ ID NO: 1026315 - RNA, 19 nt, Homo sapiens
gcuuuggaauugaaacauu

SEQ ID NO: 1026316 - RNA, 19 nt, Homo sapiens
gagaguauuaaaccuagua

SEQ ID NO: 1026317 - RNA, 19 nt, Homo sapiens
cuuagaaccuggcuccaaa

SEQ ID NO: 1026318 - RNA, 19 nt, Homo sapiens
gcauugacucuauuaauca

SEQ ID NO: 1026319 - RNA, 19 nt, Homo sapiens
cagguccuaugucucuuua

SEQ ID NO: 1026320 - RNA, 19 nt, Homo sapiens
gagguuaaagcauuacuau

SEQ ID NO: 1026321 - RNA, 19 nt, Homo sapiens
gauaauggucuguuuagca

SEQ ID NO: 1026322 - RNA, 19 nt, Homo sapiens
gagaacagagagaccauug

SEQ ID NO: 1026323 - RNA, 19 nt, Homo sapiens
gauggucuguacucugcua

SEQ ID NO: 1026324 - RNA, 19 nt, Homo sapiens
ccaagaaccaacacuauca

SEQ ID NO: 1026325 - RNA, 19 nt, Homo sapiens
gagcugcaccuugaacaaa

SEQ ID NO: 1026326 - RNA, 19 nt, Homo sapiens
gauacacacuauaacuaca

SEQ ID NO: 1026327 - RNA, 19 nt, Homo sapiens
ggucuguacucugcuagaa

SEQ ID NO: 1026328 - RNA, 19 nt, Homo sapiens
uugguugccuguuaccuua

SEQ ID NO: 1026329 - RNA, 19 nt, Homo sapiens
uugaacagauggauggaaa

SEQ ID NO: 1026330 - RNA, 19 nt, Homo sapiens
ggaggccuauggcaugugu

SEQ ID NO: 1026331 - RNA, 19 nt, Homo sapiens
guuaguaucaucugguaaa

SEQ ID NO: 1026332 - RNA, 19 nt, Homo sapiens
acuaucacccguccaaaua

SEQ ID NO: 1026333 - RNA, 19 nt, Homo sapiens
gccuagaggaauuaaauaa

SEQ ID NO: 1026334 - RNA, 19 nt, Homo sapiens
ucuugaaucucuuucuuug

SEQ ID NO: 1026335 - RNA, 19 nt, Homo sapiens
gcccagcuuuggaauugaa

SEQ ID NO: 1026336 - RNA, 19 nt, Homo sapiens
gcaguccaguaaagguuau

SEQ ID NO: 1026337 - RNA, 19 nt, Homo sapiens
aggcgagguuaaagcauua

SEQ ID NO: 1026338 - RNA, 19 nt, Homo sapiens
uagcucagauuugaacaga

SEQ ID NO: 1026339 - RNA, 19 nt, Homo sapiens
uaguuaguaucaucuggua

SEQ ID NO: 1026340 - RNA, 19 nt, Homo sapiens
gggaagccuagaggaauua

SEQ ID NO: 1026341 - RNA, 19 nt, Homo sapiens
gauagguaacuaaucagaa

SEQ ID NO: 1026342 - RNA, 19 nt, Homo sapiens
ggauagguaacuaaucaga

SEQ ID NO: 1026343 - RNA, 19 nt, Homo sapiens
ggggauagguaacuaauca

SEQ ID NO: 1026344 - RNA, 19 nt, Homo sapiens
ugcauugacucuauuaauc

SEQ ID NO: 1026345 - RNA, 19 nt, Homo sapiens
caugagacacguaugaaau

SEQ ID NO: 1026346 - RNA, 19 nt, Homo sapiens
auagguaccaucauuguuu

SEQ ID NO: 1026347 - RNA, 19 nt, Homo sapiens
ccaaaucaaccaucuagag

SEQ ID NO: 1026348 - RNA, 19 nt, Homo sapiens
uaucacccguccaaauaau

SEQ ID NO: 1026349 - RNA, 19 nt, Homo sapiens
ugggaagccuagaggaauu

SEQ ID NO: 1026350 - RNA, 19 nt, Homo sapiens
gaaaauaagcugauagacu

SEQ ID NO: 1026351 - RNA, 19 nt, Homo sapiens
ccaacacuaucaaugucuu

SEQ ID NO: 1026352 - RNA, 19 nt, Homo sapiens
gcuccaagaaccaacacua

SEQ ID NO: 1026353 - RNA, 19 nt, Homo sapiens
uggcccagcuuuggaauug

SEQ ID NO: 1026354 - RNA, 19 nt, Homo sapiens
uagguaccaucauuguuug

SEQ ID NO: 1026355 - RNA, 19 nt, Homo sapiens
cuaucaaugucuuugcaaa

SEQ ID NO: 1026356 - RNA, 19 nt, Homo sapiens
gccgagagaaauguaauaa

SEQ ID NO: 1026357 - RNA, 19 nt, Homo sapiens
gguccuaugucucuuuacu

SEQ ID NO: 1026358 - RNA, 19 nt, Homo sapiens
ggaacucaggcccuccuuu

SEQ ID NO: 1026359 - RNA, 19 nt, Homo sapiens
gaagcacucacuccuugga

SEQ ID NO: 1026360 - RNA, 19 nt, Homo sapiens
gugcugcauugacucuauu

SEQ ID NO: 1026361 - RNA, 19 nt, Homo sapiens
ggcccuggauucucacuca

SEQ ID NO: 1026362 - RNA, 19 nt, Homo sapiens
caagaaccaacacuaucaa

SEQ ID NO: 1026363 - RNA, 19 nt, Homo sapiens
gagcacacaggccgagaga

SEQ ID NO: 1026364 - RNA, 19 nt, Homo sapiens
cacauccacuggcugaaug

SEQ ID NO: 1026365 - RNA, 19 nt, Homo sapiens
ggcaguccaguaaagguua

SEQ ID NO: 1026366 - RNA, 19 nt, Homo sapiens
uaaauccagacuucacauu

SEQ ID NO: 1026367 - RNA, 19 nt, Homo sapiens
caacacuaucaaugucuuu

SEQ ID NO: 1026368 - RNA, 19 nt, Homo sapiens
gaaugaucagggaggcaua

SEQ ID NO: 1026369 - RNA, 19 nt, Homo sapiens
gcacucacuccuuggacuu

SEQ ID NO: 1026370 - RNA, 19 nt, Homo sapiens
gguugccuguuaccuuauu

SEQ ID NO: 1026371 - RNA, 19 nt, Homo sapiens
caaccaaggggacaugaua

SEQ ID NO: 1026372 - RNA, 19 nt, Homo sapiens
gauagacucaaucacuuuc

SEQ ID NO: 1026373 - RNA, 19 nt, Homo sapiens
caaauucacccuacauucc

SEQ ID NO: 1026374 - RNA, 19 nt, Homo sapiens
ucaaucagagaugaacaua

SEQ ID NO: 1026375 - RNA, 19 nt, Homo sapiens
gugcaagacaguggcauuu

SEQ ID NO: 1026376 - RNA, 19 nt, Homo sapiens
ucacaucaggcuguucuuu

SEQ ID NO: 1026377 - RNA, 19 nt, Homo sapiens
ucaaauucacccuacauuc

SEQ ID NO: 1026378 - RNA, 19 nt, Homo sapiens
gaaucucuuucuuuguucu

SEQ ID NO: 1026379 - RNA, 19 nt, Homo sapiens
cuucggauccgcacucauu

SEQ ID NO: 1026380 - RNA, 19 nt, Homo sapiens
gggacugucugucaaaaga

SEQ ID NO: 1026381 - RNA, 19 nt, Homo sapiens
ggccgagagaaauguaaua

SEQ ID NO: 1026382 - RNA, 19 nt, Homo sapiens
gcauuucuccucuccucuu

SEQ ID NO: 1026383 - RNA, 19 nt, Homo sapiens
caaucagagaugaacauaa

SEQ ID NO: 1026384 - RNA, 19 nt, Homo sapiens
ggagcugcaccuugaacaa

SEQ ID NO: 1026385 - RNA, 19 nt, Homo sapiens
gcugggaagccuagaggaa

SEQ ID NO: 1026386 - RNA, 19 nt, Homo sapiens
ggacaaagaugcagaaugu

SEQ ID NO: 1026387 - RNA, 19 nt, Homo sapiens
gggaggagcugcugaaaga

SEQ ID NO: 1026388 - RNA, 19 nt, Homo sapiens
gaagaugucucgugugaag

SEQ ID NO: 1026389 - RNA, 19 nt, Homo sapiens
cagaagaugucucguguga

SEQ ID NO: 1026390 - RNA, 19 nt, Homo sapiens
ggaagaaacaccuugguau

SEQ ID NO: 1026391 - RNA, 19 nt, Homo sapiens
guucuggugugaaagguua

SEQ ID NO: 1026392 - RNA, 19 nt, Homo sapiens
agacgaagcauugauguua

SEQ ID NO: 1026393 - RNA, 19 nt, Homo sapiens
gaaacaccuugguaucugu

SEQ ID NO: 1026394 - RNA, 19 nt, Homo sapiens
gaagaaacaccuugguauc

SEQ ID NO: 1026395 - RNA, 19 nt, Homo sapiens
gaacgaugaugauauucag

SEQ ID NO: 1026396 - RNA, 19 nt, Homo sapiens
cuacugggccguuguauga

SEQ ID NO: 1026397 - RNA, 19 nt, Homo sapiens
gaauagguuugugcucuga

SEQ ID NO: 1026398 - RNA, 19 nt, Homo sapiens
gagcaggacucucccaacu

SEQ ID NO: 1026399 - RNA, 19 nt, Homo sapiens
ucaaagaguucaacacacu

SEQ ID NO: 1026400 - RNA, 19 nt, Homo sapiens
ccaugacgaugaccucaaa

SEQ ID NO: 1026401 - RNA, 19 nt, Homo sapiens
gacgaagcauugauguuau

SEQ ID NO: 1026402 - RNA, 19 nt, Homo sapiens
gugcucugauucuaguuua

SEQ ID NO: 1026403 - RNA, 19 nt, Homo sapiens
gaagaaggaaacccacaga

SEQ ID NO: 1026404 - RNA, 19 nt, Homo sapiens
cuugaacgaugaugauauu

SEQ ID NO: 1026405 - RNA, 19 nt, Homo sapiens
gcauugauguuauggaaaa

SEQ ID NO: 1026406 - RNA, 19 nt, Homo sapiens
acgaugaccucaaagaguu

SEQ ID NO: 1026407 - RNA, 19 nt, Homo sapiens
aagcauugauguuauggaa

SEQ ID NO: 1026408 - RNA, 19 nt, Homo sapiens
aaacugaccacuuggaaga

SEQ ID NO: 1026409 - RNA, 19 nt, Homo sapiens
ggacugugcccugacauga

SEQ ID NO: 1026410 - RNA, 19 nt, Homo sapiens
cgagagaagcauuaaguga

SEQ ID NO: 1026411 - RNA, 19 nt, Homo sapiens
gguggcggcugucuuggaa

SEQ ID NO: 1026412 - RNA, 19 nt, Homo sapiens
caaguuggccuucaaagag

SEQ ID NO: 1026413 - RNA, 19 nt, Homo sapiens
ccucugaccuaccaguuga

SEQ ID NO: 1026414 - RNA, 19 nt, Homo sapiens
uaagagaacguugcuguau

SEQ ID NO: 1026415 - RNA, 19 nt, Homo sapiens
ucagagagauguguuuuaa

SEQ ID NO: 1026416 - RNA, 19 nt, Homo sapiens
ggaaggaggcugggacugu

SEQ ID NO: 1026417 - RNA, 19 nt, Homo sapiens
ccacaagggcacaguguug

SEQ ID NO: 1026418 - RNA, 19 nt, Homo sapiens
gaaagaugacagcucugaa

SEQ ID NO: 1026419 - RNA, 19 nt, Homo sapiens
gaaacagacagcggacuga

SEQ ID NO: 1026420 - RNA, 19 nt, Homo sapiens
gggccuuccuggacaaaga

SEQ ID NO: 1026421 - RNA, 19 nt, Homo sapiens
gaagacgccugggagacau

SEQ ID NO: 1026422 - RNA, 19 nt, Homo sapiens
ggagaggcagcccaucuug

SEQ ID NO: 1026423 - RNA, 19 nt, Homo sapiens
uaaagucaaaucucaccua

SEQ ID NO: 1026424 - RNA, 19 nt, Homo sapiens
ccgcaugccugcugcugaa

SEQ ID NO: 1026425 - RNA, 19 nt, Homo sapiens
aagcaucgcugacccugau

SEQ ID NO: 1026426 - RNA, 19 nt, Homo sapiens
gccuggcucucacacagua

SEQ ID NO: 1026427 - RNA, 19 nt, Homo sapiens
cuucuccucuccugcauuu

SEQ ID NO: 1026428 - RNA, 19 nt, Homo sapiens
gaaccacgagagaagcauu

SEQ ID NO: 1026429 - RNA, 19 nt, Homo sapiens
agagaacguugcuguaucu

SEQ ID NO: 1026430 - RNA, 19 nt, Homo sapiens
gauauucagacgaagcauu

SEQ ID NO: 1026431 - RNA, 19 nt, Homo sapiens
gaggagcugcugaaagaug

SEQ ID NO: 1026432 - RNA, 19 nt, Homo sapiens
gagcuacugggccguugua

SEQ ID NO: 1026433 - RNA, 19 nt, Homo sapiens
agaaacaccuugguaucug

SEQ ID NO: 1026434 - RNA, 19 nt, Homo sapiens
aaagacagcugaaaacaag

SEQ ID NO: 1026435 - RNA, 19 nt, Homo sapiens
ggcccuggaugaagaagga

SEQ ID NO: 1026436 - RNA, 19 nt, Homo sapiens
ugacaugauucuuggugau

SEQ ID NO: 1026437 - RNA, 19 nt, Homo sapiens
aaucucaccuaccuguuug

SEQ ID NO: 1026438 - RNA, 19 nt, Homo sapiens
ugaccgagcagccaccaaa

SEQ ID NO: 1026439 - RNA, 19 nt, Homo sapiens
ugaaagaugacagcucuga

SEQ ID NO: 1026440 - RNA, 19 nt, Homo sapiens
cuccaucuccuuucuuuaa

SEQ ID NO: 1026441 - RNA, 19 nt, Homo sapiens
gcaaacagccaaaacaaca

SEQ ID NO: 1026442 - RNA, 19 nt, Homo sapiens
cacacaguauuuaucuuug

SEQ ID NO: 1026443 - RNA, 19 nt, Homo sapiens
acaaagaugcagaauguag

SEQ ID NO: 1026444 - RNA, 19 nt, Homo sapiens
gguuugugcucugauucua

SEQ ID NO: 1026445 - RNA, 19 nt, Homo sapiens
guggagggcuaaguugguu

SEQ ID NO: 1026446 - RNA, 19 nt, Homo sapiens
augaugauauucagacgaa

SEQ ID NO: 1026447 - RNA, 19 nt, Homo sapiens
uggaagaaacaccuuggua

SEQ ID NO: 1026448 - RNA, 19 nt, Homo sapiens
acugggccguuguaugaua

SEQ ID NO: 1026449 - RNA, 19 nt, Homo sapiens
acugugcccugacaugauu

SEQ ID NO: 1026450 - RNA, 19 nt, Homo sapiens
aaaucucaccuaccuguuu

SEQ ID NO: 1026451 - RNA, 19 nt, Homo sapiens
gcugcugccuccacagugu

SEQ ID NO: 1026452 - RNA, 19 nt, Homo sapiens
cagcagaagcagcacaaga

SEQ ID NO: 1026453 - RNA, 19 nt, Homo sapiens
acaggugacucgggcauug

SEQ ID NO: 1026454 - RNA, 19 nt, Homo sapiens
ccucaaagaguucaacaca

SEQ ID NO: 1026455 - RNA, 19 nt, Homo sapiens
gacgaugaccucaaagagu

SEQ ID NO: 1026456 - RNA, 19 nt, Homo sapiens
gcugagcugcgauaggaaa

SEQ ID NO: 1026457 - RNA, 19 nt, Homo sapiens
gcucucacacaguauuuau

SEQ ID NO: 1026458 - RNA, 19 nt, Homo sapiens
gcccuuuggucuauguuca

SEQ ID NO: 1026459 - RNA, 19 nt, Homo sapiens
caagccagcauugagcuaa

SEQ ID NO: 1026460 - RNA, 19 nt, Homo sapiens
aagagaacguugcuguauc

SEQ ID NO: 1026461 - RNA, 19 nt, Homo sapiens
gcacagagcagccccuugu

SEQ ID NO: 1026462 - RNA, 19 nt, Homo sapiens
gaauggaggcagcaaacag

SEQ ID NO: 1026463 - RNA, 19 nt, Homo sapiens
aggagcugcugaaagauga

SEQ ID NO: 1026464 - RNA, 19 nt, Homo sapiens
ucucugcccuuuggucuau

SEQ ID NO: 1026465 - RNA, 19 nt, Homo sapiens
agucaaaucucaccuaccu

SEQ ID NO: 1026466 - RNA, 19 nt, Homo sapiens
ccucauacccuaacuccau

SEQ ID NO: 1026467 - RNA, 19 nt, Homo sapiens
guagggaggagcugcugaa

SEQ ID NO: 1026468 - RNA, 19 nt, Homo sapiens
ugacguuuguggcucuuuc

SEQ ID NO: 1026469 - RNA, 19 nt, Homo sapiens
agagaagcauuaagugacu

SEQ ID NO: 1026470 - RNA, 19 nt, Homo sapiens
gggagaaccacgagagaag

SEQ ID NO: 1026471 - RNA, 19 nt, Homo sapiens
acgaagcauugauguuaug

SEQ ID NO: 1026472 - RNA, 19 nt, Homo sapiens
gcccugugcauaugaaguu

SEQ ID NO: 1026473 - RNA, 19 nt, Homo sapiens
ugguggcaguuguuuguuu

SEQ ID NO: 1026474 - RNA, 19 nt, Homo sapiens
uuaagagaacguugcugua

SEQ ID NO: 1026475 - RNA, 19 nt, Homo sapiens
gcacccgacagcaaagaga

SEQ ID NO: 1026476 - RNA, 19 nt, Homo sapiens
ggcugguucuggugugaaa

SEQ ID NO: 1026477 - RNA, 19 nt, Homo sapiens
gguaggggcuuguugaucu

SEQ ID NO: 1026478 - RNA, 19 nt, Homo sapiens
ccagcaacuuggcaaagca

SEQ ID NO: 1026479 - RNA, 19 nt, Homo sapiens
caaauuccaggugacaaga

SEQ ID NO: 1026480 - RNA, 19 nt, Homo sapiens
guucaacacacucaucgau

SEQ ID NO: 1026481 - RNA, 19 nt, Homo sapiens
cuaaguugguucugugacu

SEQ ID NO: 1026482 - RNA, 19 nt, Homo sapiens
cacgagagaagcauuaagu

SEQ ID NO: 1026483 - RNA, 19 nt, Homo sapiens
gacaaagaugcagaaugua

SEQ ID NO: 1026484 - RNA, 19 nt, Homo sapiens
uccaucuccuuucuuuaaa

SEQ ID NO: 1026485 - RNA, 19 nt, Homo sapiens
aacuccaucuccuuucuuu

SEQ ID NO: 1026486 - RNA, 19 nt, Homo sapiens
gaacagaggugacacagaa

SEQ ID NO: 1026487 - RNA, 19 nt, Homo sapiens
caacaacacuauccuauaa

SEQ ID NO: 1026488 - RNA, 19 nt, Homo sapiens
gaacuuaacuugcgacaca

SEQ ID NO: 1026489 - RNA, 19 nt, Homo sapiens
ugagagauguggauaauuu

SEQ ID NO: 1026490 - RNA, 19 nt, Homo sapiens
gcacuggaaucucuggaua

SEQ ID NO: 1026491 - RNA, 19 nt, Homo sapiens
ccacagaaaucaacaugaa

SEQ ID NO: 1026492 - RNA, 19 nt, Homo sapiens
caacaaugcuuuacaaggu

SEQ ID NO: 1026493 - RNA, 19 nt, Homo sapiens
gcacugggcucucacgaau

SEQ ID NO: 1026494 - RNA, 19 nt, Homo sapiens
uguagcaucuucugaguua

SEQ ID NO: 1026495 - RNA, 19 nt, Homo sapiens
gcaaggugaucauauuaau

SEQ ID NO: 1026496 - RNA, 19 nt, Homo sapiens
gagaaaggaaggauuaauu

SEQ ID NO: 1026497 - RNA, 19 nt, Homo sapiens
gaaggaagccacagaaauc

SEQ ID NO: 1026498 - RNA, 19 nt, Homo sapiens
cuaauucucugcaccuuaa

SEQ ID NO: 1026499 - RNA, 19 nt, Homo sapiens
gaagcacccucucugcauu

SEQ ID NO: 1026500 - RNA, 19 nt, Homo sapiens
acacauaccuuguugaagu

SEQ ID NO: 1026501 - RNA, 19 nt, Homo sapiens
ggccacagauguucauuga

SEQ ID NO: 1026502 - RNA, 19 nt, Homo sapiens
gacacagaaugauaugaua

SEQ ID NO: 1026503 - RNA, 19 nt, Homo sapiens
ggauacacuuucccuauau

SEQ ID NO: 1026504 - RNA, 19 nt, Homo sapiens
ccacuguucucauagcuaa

SEQ ID NO: 1026505 - RNA, 19 nt, Homo sapiens
gauaggaauuggaguguuc

SEQ ID NO: 1026506 - RNA, 19 nt, Homo sapiens
gcucaucauugucaucauu

SEQ ID NO: 1026507 - RNA, 19 nt, Homo sapiens
gagaaucacggaagaagaa

SEQ ID NO: 1026508 - RNA, 19 nt, Homo sapiens
caacaugaccuugaaagaa

SEQ ID NO: 1026509 - RNA, 19 nt, Homo sapiens
cacaaaucgugcuacauua

SEQ ID NO: 1026510 - RNA, 19 nt, Homo sapiens
caacaacgaguagccaaua

SEQ ID NO: 1026511 - RNA, 19 nt, Homo sapiens
ggaaagucauaaacaaucu

SEQ ID NO: 1026512 - RNA, 19 nt, Homo sapiens
aacaugaccuugaaagaaa

SEQ ID NO: 1026513 - RNA, 19 nt, Homo sapiens
gaaccuggacugucuccua

SEQ ID NO: 1026514 - RNA, 19 nt, Homo sapiens
ccugggagaugaccucuuu

SEQ ID NO: 1026515 - RNA, 19 nt, Homo sapiens
gcgggaaagucauaaacaa

SEQ ID NO: 1026516 - RNA, 19 nt, Homo sapiens
ucccauagcucaagaguca

SEQ ID NO: 1026517 - RNA, 19 nt, Homo sapiens
acacaaaucgugcuacauu

SEQ ID NO: 1026518 - RNA, 19 nt, Homo sapiens
gcuaagccauuucaguaug

SEQ ID NO: 1026519 - RNA, 19 nt, Homo sapiens
acacuguccuucagaauau

SEQ ID NO: 1026520 - RNA, 19 nt, Homo sapiens
caggagaaaggaaggauua

SEQ ID NO: 1026521 - RNA, 19 nt, Homo sapiens
ggaaugaucacaacagucu

SEQ ID NO: 1026522 - RNA, 19 nt, Homo sapiens
cguuagggaugcagucaua

SEQ ID NO: 1026523 - RNA, 19 nt, Homo sapiens
gaggugacacagaaugaua

SEQ ID NO: 1026524 - RNA, 19 nt, Homo sapiens
ggaaauacuauguacuguu

SEQ ID NO: 1026525 - RNA, 19 nt, Homo sapiens
uggaaucucuggauaggaa

SEQ ID NO: 1026526 - RNA, 19 nt, Homo sapiens
uuacaagguuuaucuguca

SEQ ID NO: 1026527 - RNA, 19 nt, Homo sapiens
ggacuugcaacaacgagua

SEQ ID NO: 1026528 - RNA, 19 nt, Homo sapiens
gaccguauguccuaucauc

SEQ ID NO: 1026529 - RNA, 19 nt, Homo sapiens
caucaucgcuuccugaaaa

SEQ ID NO: 1026530 - RNA, 19 nt, Homo sapiens
caacaacaacacuauccua

SEQ ID NO: 1026531 - RNA, 19 nt, Homo sapiens
caacgaguagccaauauug

SEQ ID NO: 1026532 - RNA, 19 nt, Homo sapiens
ugaagagaaucacggaaga

SEQ ID NO: 1026533 - RNA, 19 nt, Homo sapiens
gcccaaagcacguaguauu

SEQ ID NO: 1026534 - RNA, 19 nt, Homo sapiens
aaacaaccuuugggaacua

SEQ ID NO: 1026535 - RNA, 19 nt, Homo sapiens
gggaugcagucauagaaau

SEQ ID NO: 1026536 - RNA, 19 nt, Homo sapiens
cuacuagaauccaaaggaa

SEQ ID NO: 1026537 - RNA, 19 nt, Homo sapiens
gaagagaagaagcgggaaa

SEQ ID NO: 1026538 - RNA, 19 nt, Homo sapiens
gcaaucccauagcucaaga

SEQ ID NO: 1026539 - RNA, 19 nt, Homo sapiens
gacaaaagcugaccguaug

SEQ ID NO: 1026540 - RNA, 19 nt, Homo sapiens
cagagaaccuggacugucu

SEQ ID NO: 1026541 - RNA, 19 nt, Homo sapiens
gcagcaauuuaacgcacua

SEQ ID NO: 1026542 - RNA, 19 nt, Homo sapiens
aaucuuugcuuaaggagaa

SEQ ID NO: 1026543 - RNA, 19 nt, Homo sapiens
gaagaaauuagugggcuuu

SEQ ID NO: 1026544 - RNA, 19 nt, Homo sapiens
uaggcaaggugaucauauu

SEQ ID NO: 1026545 - RNA, 19 nt, Homo sapiens
caaaucgugcuacauuaaa

SEQ ID NO: 1026546 - RNA, 19 nt, Homo sapiens
aaacacaaaucgugcuaca

SEQ ID NO: 1026547 - RNA, 19 nt, Homo sapiens
caaaagacuuguaggagaa

SEQ ID NO: 1026548 - RNA, 19 nt, Homo sapiens
ggaaauccaguugucaauu

SEQ ID NO: 1026549 - RNA, 19 nt, Homo sapiens
gcccaacuccgucguauug

SEQ ID NO: 1026550 - RNA, 19 nt, Homo sapiens
caauuucgguaucuacuag

SEQ ID NO: 1026551 - RNA, 19 nt, Homo sapiens
gcaauuucgguaucuacua

SEQ ID NO: 1026552 - RNA, 19 nt, Homo sapiens
ucaaggaaauccaguuguc

SEQ ID NO: 1026553 - RNA, 19 nt, Homo sapiens
aggcagaucuaacagagaa

SEQ ID NO: 1026554 - RNA, 19 nt, Homo sapiens
caacagucuccuucacuuu

SEQ ID NO: 1026555 - RNA, 19 nt, Homo sapiens
ccaauauugcuacaaauga

SEQ ID NO: 1026556 - RNA, 19 nt, Homo sapiens
gaagaagaaaggcguaugg

SEQ ID NO: 1026557 - RNA, 19 nt, Homo sapiens
aagcuuagaugucuuggau

SEQ ID NO: 1026558 - RNA, 19 nt, Homo sapiens
cuacagaaguuaauaucgu

SEQ ID NO: 1026559 - RNA, 19 nt, Homo sapiens
gauacacuuucccuauaug

SEQ ID NO: 1026560 - RNA, 19 nt, Homo sapiens
gaagagaaucacggaagaa

SEQ ID NO: 1026561 - RNA, 19 nt, Homo sapiens
ugaaagaaacuacucaagu

SEQ ID NO: 1026562 - RNA, 19 nt, Homo sapiens
caagcuaaauaaagacaca

SEQ ID NO: 1026563 - RNA, 19 nt, Homo sapiens
agaaaggaaggauuaauug

SEQ ID NO: 1026564 - RNA, 19 nt, Homo sapiens
acaaaucgugcuacauuaa

SEQ ID NO: 1026565 - RNA, 19 nt, Homo sapiens
gcucaagagucaugguaca

SEQ ID NO: 1026566 - RNA, 19 nt, Homo sapiens
gacacaaucaaaucacuuu

SEQ ID NO: 1026567 - RNA, 19 nt, Homo sapiens
gauaugauaauggcugaaa

SEQ ID NO: 1026568 - RNA, 19 nt, Homo sapiens
ucaaacagcaggaaugauc

SEQ ID NO: 1026569 - RNA, 19 nt, Homo sapiens
agaagaagcgggaaaguca

SEQ ID NO: 1026570 - RNA, 19 nt, Homo sapiens
guacaaacacacuguccuu

SEQ ID NO: 1026571 - RNA, 19 nt, Homo sapiens
ggaaggcagaucuaacaga

SEQ ID NO: 1026572 - RNA, 19 nt, Homo sapiens
gaaaauagaacgaggaagu

SEQ ID NO: 1026573 - RNA, 19 nt, Homo sapiens
caacgacuguguggcucua

SEQ ID NO: 1026574 - RNA, 19 nt, Homo sapiens
cauccuugguucuugcuuu

SEQ ID NO: 1026575 - RNA, 19 nt, Homo sapiens
ggaaagcaggagaaaggaa

SEQ ID NO: 1026576 - RNA, 19 nt, Homo sapiens
acaacaacacuauccuaua

SEQ ID NO: 1026577 - RNA, 19 nt, Homo sapiens
cagaagcuuuggccacaga

SEQ ID NO: 1026578 - RNA, 19 nt, Homo sapiens
ggauaggaauuggaguguu

SEQ ID NO: 1026579 - RNA, 19 nt, Homo sapiens
gggaaagucauaaacaauc

SEQ ID NO: 1026580 - RNA, 19 nt, Homo sapiens
ucaaaucuggagaaucuaa

SEQ ID NO: 1026581 - RNA, 19 nt, Homo sapiens
ggaugcagucauagaaauu

SEQ ID NO: 1026582 - RNA, 19 nt, Homo sapiens
caggagcacuggaaucucu

SEQ ID NO: 1026583 - RNA, 19 nt, Homo sapiens
acucaacaaugcuuuacaa

SEQ ID NO: 1026584 - RNA, 19 nt, Homo sapiens
uuaaugggcuggauucacu

SEQ ID NO: 1026585 - RNA, 19 nt, Homo sapiens
ggcaaggugaucauauuaa

SEQ ID NO: 1026586 - RNA, 19 nt, Homo sapiens
ucaaaguacuucaggauua

SEQ ID NO: 1026587 - RNA, 19 nt, Homo sapiens
gaaucagacuuccacauuu

SEQ ID NO: 1026588 - RNA, 19 nt, Homo sapiens
caagggauaugucaaggua

SEQ ID NO: 1026589 - RNA, 19 nt, Homo sapiens
gaaauguucucgacagcaa

SEQ ID NO: 1026590 - RNA, 19 nt, Homo sapiens
acaagaggcugguagagua

SEQ ID NO: 1026591 - RNA, 19 nt, Homo sapiens
ggaauucuuucaauacaga

SEQ ID NO: 1026592 - RNA, 19 nt, Homo sapiens
gcaaacugcuggcaccuau

SEQ ID NO: 1026593 - RNA, 19 nt, Homo sapiens
uuaaguagguggaaacuau

SEQ ID NO: 1026594 - RNA, 19 nt, Homo sapiens
gcccuucuaucccagauua

SEQ ID NO: 1026595 - RNA, 19 nt, Homo sapiens
ggaauucugucucaucagu

SEQ ID NO: 1026596 - RNA, 19 nt, Homo sapiens
gcauugggcugguuauaca

SEQ ID NO: 1026597 - RNA, 19 nt, Homo sapiens
ggaauuuggguuugucaua

SEQ ID NO: 1026598 - RNA, 19 nt, Homo sapiens
gagcaacucuggccaaugc

SEQ ID NO: 1026599 - RNA, 19 nt, Homo sapiens
gaaguucagcuaacaauca

SEQ ID NO: 1026600 - RNA, 19 nt, Homo sapiens
gaaaggugguuggugaaug

SEQ ID NO: 1026601 - RNA, 19 nt, Homo sapiens
aaaggugguuggugaauga

SEQ ID NO: 1026602 - RNA, 19 nt, Homo sapiens
gcaaagccauguucacacu

SEQ ID NO: 1026603 - RNA, 19 nt, Homo sapiens
aaagaacccuggccuggaa

SEQ ID NO: 1026604 - RNA, 19 nt, Homo sapiens
gaauuuggguuugucauag

SEQ ID NO: 1026605 - RNA, 19 nt, Homo sapiens
guuuauaggugaggaaauu

SEQ ID NO: 1026606 - RNA, 19 nt, Homo sapiens
aaaugcagguuuacaaaga

SEQ ID NO: 1026607 - RNA, 19 nt, Homo sapiens
ugaaagaacaucucaggaa

SEQ ID NO: 1026608 - RNA, 19 nt, Homo sapiens
gaaacacacaggaagagaa

SEQ ID NO: 1026609 - RNA, 19 nt, Homo sapiens
gguuauacauuucuguuuc

SEQ ID NO: 1026610 - RNA, 19 nt, Homo sapiens
ugucauagauguauucucu

SEQ ID NO: 1026611 - RNA, 19 nt, Homo sapiens
aagcagaguuugaggaaga

SEQ ID NO: 1026612 - RNA, 19 nt, Homo sapiens
cgaaucagacuuccacauu

SEQ ID NO: 1026613 - RNA, 19 nt, Homo sapiens
cagaauacuuccuagaauc

SEQ ID NO: 1026614 - RNA, 19 nt, Homo sapiens
gaaagcagaguguaacaag

SEQ ID NO: 1026615 - RNA, 19 nt, Homo sapiens
aaucagacuuccacauuug

SEQ ID NO: 1026616 - RNA, 19 nt, Homo sapiens
caaaguacuucaggauuag

SEQ ID NO: 1026617 - RNA, 19 nt, Homo sapiens
uagaguaacuguccgagau

SEQ ID NO: 1026618 - RNA, 19 nt, Homo sapiens
ccaaaggcccguuaccauu

SEQ ID NO: 1026619 - RNA, 19 nt, Homo sapiens
gugaggaaauugagacuag

SEQ ID NO: 1026620 - RNA, 19 nt, Homo sapiens
gaacaccuugaacuccuua

SEQ ID NO: 1026621 - RNA, 19 nt, Homo sapiens
caaaggcccguuaccauug

SEQ ID NO: 1026622 - RNA, 19 nt, Homo sapiens
ugaggcaucucucuuaagu

SEQ ID NO: 1026623 - RNA, 19 nt, Homo sapiens
agaaagagaucaggcaaca

SEQ ID NO: 1026624 - RNA, 19 nt, Homo sapiens
ggaagcauugggcugguua

SEQ ID NO: 1026625 - RNA, 19 nt, Homo sapiens
uagagccacuacuuucuuu

SEQ ID NO: 1026626 - RNA, 19 nt, Homo sapiens
uaucccagauuaccuaaau

SEQ ID NO: 1026627 - RNA, 19 nt, Homo sapiens
uggacaaccuuuaaucaga

SEQ ID NO: 1026628 - RNA, 19 nt, Homo sapiens
gaggguggcugggauauac

SEQ ID NO: 1026629 - RNA, 19 nt, Homo sapiens
aggcaacagugauucuaua

SEQ ID NO: 1026630 - RNA, 19 nt, Homo sapiens
gagcaaagccauguucaca

SEQ ID NO: 1026631 - RNA, 19 nt, Homo sapiens
caauacagaauacuuccua

SEQ ID NO: 1026632 - RNA, 19 nt, Homo sapiens
aaacuccgcuuccgauugg

SEQ ID NO: 1026633 - RNA, 19 nt, Homo sapiens
gcaucucucuuaaguaggu

SEQ ID NO: 1026634 - RNA, 19 nt, Homo sapiens
caggaauucugucucauca

SEQ ID NO: 1026635 - RNA, 19 nt, Homo sapiens
ggauuaggaauuuggguuu

SEQ ID NO: 1026636 - RNA, 19 nt, Homo sapiens
acagaauacuuccuagaau

SEQ ID NO: 1026637 - RNA, 19 nt, Homo sapiens
gggaaaaggugauuguaga

SEQ ID NO: 1026638 - RNA, 19 nt, Homo sapiens
gaaaagaggcuagaugaug

SEQ ID NO: 1026639 - RNA, 19 nt, Homo sapiens
ggaccuccauuuccagucu

SEQ ID NO: 1026640 - RNA, 19 nt, Homo sapiens
uaaagcagaguuugaggaa

SEQ ID NO: 1026641 - RNA, 19 nt, Homo sapiens
ggaacaccuugaacuccuu

SEQ ID NO: 1026642 - RNA, 19 nt, Homo sapiens
gcuugaagauuucuaugca

SEQ ID NO: 1026643 - RNA, 19 nt, Homo sapiens
aaacacacaggaagagaaa

SEQ ID NO: 1026644 - RNA, 19 nt, Homo sapiens
aggcaucucucuuaaguag

SEQ ID NO: 1026645 - RNA, 19 nt, Homo sapiens
aaagccauguucacacuga

SEQ ID NO: 1026646 - RNA, 19 nt, Homo sapiens
ugaucgagaugguacaaga

SEQ ID NO: 1026647 - RNA, 19 nt, Homo sapiens
gacagcaaguacaguugaa

SEQ ID NO: 1026648 - RNA, 19 nt, Homo sapiens
augaacagcugguagauca

SEQ ID NO: 1026649 - RNA, 19 nt, Homo sapiens
guuugaggcaucucucuua

SEQ ID NO: 1026650 - RNA, 19 nt, Homo sapiens
gauuaggaauuuggguuug

SEQ ID NO: 1026651 - RNA, 19 nt, Homo sapiens
ucuuggaccuguugucuga

SEQ ID NO: 1026652 - RNA, 19 nt, Homo sapiens
gagaaaagaggcuagauga

SEQ ID NO: 1026653 - RNA, 19 nt, Homo sapiens
ccagauuaccuaaauguuc

SEQ ID NO: 1026654 - RNA, 19 nt, Homo sapiens
caagaggcugguagaguaa

SEQ ID NO: 1026655 - RNA, 19 nt, Homo sapiens
uaacaagggauaugucaag

SEQ ID NO: 1026656 - RNA, 19 nt, Homo sapiens
ucucaggaauucugucuca

SEQ ID NO: 1026657 - RNA, 19 nt, Homo sapiens
uuaagcauaugcacacugu

SEQ ID NO: 1026658 - RNA, 19 nt, Homo sapiens
ggugauaaaggauaaauac

SEQ ID NO: 1026659 - RNA, 19 nt, Homo sapiens
agggauaugucaagguaaa

SEQ ID NO: 1026660 - RNA, 19 nt, Homo sapiens
ucacugauaagaaauguuc

SEQ ID NO: 1026661 - RNA, 19 nt, Homo sapiens
caaacuccgcuuccgauug

SEQ ID NO: 1026662 - RNA, 19 nt, Homo sapiens
gagcaggugguggugauaa

SEQ ID NO: 1026663 - RNA, 19 nt, Homo sapiens
gcaacagugauucuauaga

SEQ ID NO: 1026664 - RNA, 19 nt, Homo sapiens
ugauugagcugugaagucu

SEQ ID NO: 1026665 - RNA, 19 nt, Homo sapiens
gaacagcugguagaucaca

SEQ ID NO: 1026666 - RNA, 19 nt, Homo sapiens
gcaaacuccgcuuccgauu

SEQ ID NO: 1026667 - RNA, 19 nt, Homo sapiens
cgacagcaaguacaguuga

SEQ ID NO: 1026668 - RNA, 19 nt, Homo sapiens
gcauggacaaccuuuaauc

SEQ ID NO: 1026669 - RNA, 19 nt, Homo sapiens
uaugagccauguacaucuu

SEQ ID NO: 1026670 - RNA, 19 nt, Homo sapiens
gaaaagaugcaccuaucaa

SEQ ID NO: 1026671 - RNA, 19 nt, Homo sapiens
aaagagaucaggcaacagu

SEQ ID NO: 1026672 - RNA, 19 nt, Homo sapiens
ggaaacacacaggaagaga

SEQ ID NO: 1026673 - RNA, 19 nt, Homo sapiens
ccuaaauguucccuucuca

SEQ ID NO: 1026674 - RNA, 19 nt, Homo sapiens
gcucaaaguacuucaggau

SEQ ID NO: 1026675 - RNA, 19 nt, Homo sapiens
uagaguggcucaaaguacu

SEQ ID NO: 1026676 - RNA, 19 nt, Homo sapiens
uacagaauacuuccuagaa

SEQ ID NO: 1026677 - RNA, 19 nt, Homo sapiens
cuugaacuccuuaagcaua

SEQ ID NO: 1026678 - RNA, 19 nt, Homo sapiens
gggaaaagaugcaccuauc

SEQ ID NO: 1026679 - RNA, 19 nt, Homo sapiens
gguuggaguuuucuucuaa

SEQ ID NO: 1026680 - RNA, 19 nt, Homo sapiens
gcaaguacaguugaaagca

SEQ ID NO: 1026681 - RNA, 19 nt, Homo sapiens
ggaaaggugguuggugaau

SEQ ID NO: 1026682 - RNA, 19 nt, Homo sapiens
auacugaugggucuuguuu

SEQ ID NO: 1026683 - RNA, 19 nt, Homo sapiens
caauguagaguggcucaaa

SEQ ID NO: 1026684 - RNA, 19 nt, Homo sapiens
gugaacuucuacucauuuc

SEQ ID NO: 1026685 - RNA, 19 nt, Homo sapiens
gggagcaacucuggccaau

SEQ ID NO: 1026686 - RNA, 19 nt, Homo sapiens
ucaaaguacuucaggauua

SEQ ID NO: 1026687 - RNA, 19 nt, Homo sapiens
gaaucagacuuccacauuu

SEQ ID NO: 1026688 - RNA, 19 nt, Homo sapiens
caagggauaugucaaggua

SEQ ID NO: 1026689 - RNA, 19 nt, Homo sapiens
gaaauguucucgacagcaa

SEQ ID NO: 1026690 - RNA, 19 nt, Homo sapiens
acaagaggcugguagagua

SEQ ID NO: 1026691 - RNA, 19 nt, Homo sapiens
ggaauucuuucaauacaga

SEQ ID NO: 1026692 - RNA, 19 nt, Homo sapiens
gcaaacugcuggcaccuau

SEQ ID NO: 1026693 - RNA, 19 nt, Homo sapiens
uuaaguagguggaaacuau

SEQ ID NO: 1026694 - RNA, 19 nt, Homo sapiens
gcccuucuaucccagauua

SEQ ID NO: 1026695 - RNA, 19 nt, Homo sapiens
ggaauucugucucaucagu

SEQ ID NO: 1026696 - RNA, 19 nt, Homo sapiens
gcauugggcugguuauaca

SEQ ID NO: 1026697 - RNA, 19 nt, Homo sapiens
ggaauuuggguuugucaua

SEQ ID NO: 1026698 - RNA, 19 nt, Homo sapiens
gagcaacucuggccaaugc

SEQ ID NO: 1026699 - RNA, 19 nt, Homo sapiens
gaaguucagcuaacaauca

SEQ ID NO: 1026700 - RNA, 19 nt, Homo sapiens
gaaaggugguuggugaaug

SEQ ID NO: 1026701 - RNA, 19 nt, Homo sapiens
aaaggugguuggugaauga

SEQ ID NO: 1026702 - RNA, 19 nt, Homo sapiens
gcaaagccauguucacacu

SEQ ID NO: 1026703 - RNA, 19 nt, Homo sapiens
aaagaacccuggccuggaa

SEQ ID NO: 1026704 - RNA, 19 nt, Homo sapiens
gaauuuggguuugucauag

SEQ ID NO: 1026705 - RNA, 19 nt, Homo sapiens
aagaguagcugggauuuga

SEQ ID NO: 1026706 - RNA, 19 nt, Homo sapiens
aaaugcagguuuacaaaga

SEQ ID NO: 1026707 - RNA, 19 nt, Homo sapiens
ugaaagaacaucucaggaa

SEQ ID NO: 1026708 - RNA, 19 nt, Homo sapiens
gaaacacacaggaagagaa

SEQ ID NO: 1026709 - RNA, 19 nt, Homo sapiens
gguuauacauuucuguuuc

SEQ ID NO: 1026710 - RNA, 19 nt, Homo sapiens
ugucauagauguauucucu

SEQ ID NO: 1026711 - RNA, 19 nt, Homo sapiens
cgaaucagacuuccacauu

SEQ ID NO: 1026712 - RNA, 19 nt, Homo sapiens
cagaauacuuccuagaauc

SEQ ID NO: 1026713 - RNA, 19 nt, Homo sapiens
gaaagcagaguguaacaag

SEQ ID NO: 1026714 - RNA, 19 nt, Homo sapiens
aaucagacuuccacauuug

SEQ ID NO: 1026715 - RNA, 19 nt, Homo sapiens
caaaguacuucaggauuag

SEQ ID NO: 1026716 - RNA, 19 nt, Homo sapiens
uagaguaacuguccgagau

SEQ ID NO: 1026717 - RNA, 19 nt, Homo sapiens
ccaaaggcccguuaccauu

SEQ ID NO: 1026718 - RNA, 19 nt, Homo sapiens
gaacaccuugaacuccuua

SEQ ID NO: 1026719 - RNA, 19 nt, Homo sapiens
caaaggcccguuaccauug

SEQ ID NO: 1026720 - RNA, 19 nt, Homo sapiens
ugaggcaucucucuuaagu

SEQ ID NO: 1026721 - RNA, 19 nt, Homo sapiens
agaaagagaucaggcaaca

SEQ ID NO: 1026722 - RNA, 19 nt, Homo sapiens
ggaagcauugggcugguua

SEQ ID NO: 1026723 - RNA, 19 nt, Homo sapiens
uagagccacuacuuucuuu

SEQ ID NO: 1026724 - RNA, 19 nt, Homo sapiens
uaucccagauuaccuaaau

SEQ ID NO: 1026725 - RNA, 19 nt, Homo sapiens
uggacaaccuuuaaucaga

SEQ ID NO: 1026726 - RNA, 19 nt, Homo sapiens
gaggguggcugggauauac

SEQ ID NO: 1026727 - RNA, 19 nt, Homo sapiens
aggcaacagugauucuaua

SEQ ID NO: 1026728 - RNA, 19 nt, Homo sapiens
cauggugaaugaacuuuau

SEQ ID NO: 1026729 - RNA, 19 nt, Homo sapiens
gagcaaagccauguucaca

SEQ ID NO: 1026730 - RNA, 19 nt, Homo sapiens
caauacagaauacuuccua

SEQ ID NO: 1026731 - RNA, 19 nt, Homo sapiens
aaacuccgcuuccgauugg

SEQ ID NO: 1026732 - RNA, 19 nt, Homo sapiens
gcaucucucuuaaguaggu

SEQ ID NO: 1026733 - RNA, 19 nt, Homo sapiens
caggaauucugucucauca

SEQ ID NO: 1026734 - RNA, 19 nt, Homo sapiens
ggauuaggaauuuggguuu

SEQ ID NO: 1026735 - RNA, 19 nt, Homo sapiens
acagaauacuuccuagaau

SEQ ID NO: 1026736 - RNA, 19 nt, Homo sapiens
gggaaaaggugauuguaga

SEQ ID NO: 1026737 - RNA, 19 nt, Homo sapiens
gaaaagaggcuagaugaug

SEQ ID NO: 1026738 - RNA, 19 nt, Homo sapiens
ggaccuccauuuccagucu

SEQ ID NO: 1026739 - RNA, 19 nt, Homo sapiens
ggaacaccuugaacuccuu

SEQ ID NO: 1026740 - RNA, 19 nt, Homo sapiens
gcuugaagauuucuaugca

SEQ ID NO: 1026741 - RNA, 19 nt, Homo sapiens
aaacacacaggaagagaaa

SEQ ID NO: 1026742 - RNA, 19 nt, Homo sapiens
ggaaggaccaagaggugaa

SEQ ID NO: 1026743 - RNA, 19 nt, Homo sapiens
aggcaucucucuuaaguag

SEQ ID NO: 1026744 - RNA, 19 nt, Homo sapiens
aaagccauguucacacuga

SEQ ID NO: 1026745 - RNA, 19 nt, Homo sapiens
ugaucgagaugguacaaga

SEQ ID NO: 1026746 - RNA, 19 nt, Homo sapiens
gacagcaaguacaguugaa

SEQ ID NO: 1026747 - RNA, 19 nt, Homo sapiens
guuugaggcaucucucuua

SEQ ID NO: 1026748 - RNA, 19 nt, Homo sapiens
gauuaggaauuuggguuug

SEQ ID NO: 1026749 - RNA, 19 nt, Homo sapiens
ugaguaacgugaauuuguc

SEQ ID NO: 1026750 - RNA, 19 nt, Homo sapiens
ucuuggaccuguugucuga

SEQ ID NO: 1026751 - RNA, 19 nt, Homo sapiens
gagaaaagaggcuagauga

SEQ ID NO: 1026752 - RNA, 19 nt, Homo sapiens
ccagauuaccuaaauguuc

SEQ ID NO: 1026753 - RNA, 19 nt, Homo sapiens
caagaggcugguagaguaa

SEQ ID NO: 1026754 - RNA, 19 nt, Homo sapiens
uaacaagggauaugucaag

SEQ ID NO: 1026755 - RNA, 19 nt, Homo sapiens
ucucaggaauucugucuca

SEQ ID NO: 1026756 - RNA, 19 nt, Homo sapiens
uuaagcauaugcacacugu

SEQ ID NO: 1026757 - RNA, 19 nt, Homo sapiens
ggugauaaaggauaaauac

SEQ ID NO: 1026758 - RNA, 19 nt, Homo sapiens
agggauaugucaagguaaa

SEQ ID NO: 1026759 - RNA, 19 nt, Homo sapiens
ucacugauaagaaauguuc

SEQ ID NO: 1026760 - RNA, 19 nt, Homo sapiens
gugaggcacagaugaguaa

SEQ ID NO: 1026761 - RNA, 19 nt, Homo sapiens
guagcugggauuugacuuu

SEQ ID NO: 1026762 - RNA, 19 nt, Homo sapiens
caaacuccgcuuccgauug

SEQ ID NO: 1026763 - RNA, 19 nt, Homo sapiens
gagcaggugguggugauaa

SEQ ID NO: 1026764 - RNA, 19 nt, Homo sapiens
gcaacagugauucuauaga

SEQ ID NO: 1026765 - RNA, 19 nt, Homo sapiens
ugauugagcugugaagucu

SEQ ID NO: 1026766 - RNA, 19 nt, Homo sapiens
cgacagcaaguacaguuga

SEQ ID NO: 1026767 - RNA, 19 nt, Homo sapiens
gcaaacuccgcuuccgauu

SEQ ID NO: 1026768 - RNA, 19 nt, Homo sapiens
gcauggacaaccuuuaauc

SEQ ID NO: 1026769 - RNA, 19 nt, Homo sapiens
uaugagccauguacaucuu

SEQ ID NO: 1026770 - RNA, 19 nt, Homo sapiens
gaaaagaugcaccuaucaa

SEQ ID NO: 1026771 - RNA, 19 nt, Homo sapiens
aaagagaucaggcaacagu

SEQ ID NO: 1026772 - RNA, 19 nt, Homo sapiens
ggaaacacacaggaagaga

SEQ ID NO: 1026773 - RNA, 19 nt, Homo sapiens
ccuaaauguucccuucuca

SEQ ID NO: 1026774 - RNA, 19 nt, Homo sapiens
gcucaaaguacuucaggau

SEQ ID NO: 1026775 - RNA, 19 nt, Homo sapiens
uagaguggcucaaaguacu

SEQ ID NO: 1026776 - RNA, 19 nt, Homo sapiens
uacagaauacuuccuagaa

SEQ ID NO: 1026777 - RNA, 19 nt, Homo sapiens
cuugaacuccuuaagcaua

SEQ ID NO: 1026778 - RNA, 19 nt, Homo sapiens
gggaaaagaugcaccuauc

SEQ ID NO: 1026779 - RNA, 19 nt, Homo sapiens
gcaaguacaguugaaagca

SEQ ID NO: 1026780 - RNA, 19 nt, Homo sapiens
gguuggaguuuucuucuaa

SEQ ID NO: 1026781 - RNA, 19 nt, Homo sapiens
acagaugaguaacgugaau

SEQ ID NO: 1026782 - RNA, 19 nt, Homo sapiens
ggaaaggugguuggugaau

SEQ ID NO: 1026783 - RNA, 19 nt, Homo sapiens
auacugaugggucuuguuu

SEQ ID NO: 1026784 - RNA, 19 nt, Homo sapiens
caauguagaguggcucaaa

SEQ ID NO: 1026785 - RNA, 19 nt, Homo sapiens
gugaacuucuacucauuuc

SEQ ID NO: 1026786 - RNA, 19 nt, Homo sapiens
ucaaaguacuucaggauua

SEQ ID NO: 1026787 - RNA, 19 nt, Homo sapiens
gaaucagacuuccacauuu

SEQ ID NO: 1026788 - RNA, 19 nt, Homo sapiens
caagggauaugucaaggua

SEQ ID NO: 1026789 - RNA, 19 nt, Homo sapiens
gaaauguucucgacagcaa

SEQ ID NO: 1026790 - RNA, 19 nt, Homo sapiens
acaagaggcugguagagua

SEQ ID NO: 1026791 - RNA, 19 nt, Homo sapiens
ggaauucuuucaauacaga

SEQ ID NO: 1026792 - RNA, 19 nt, Homo sapiens
gcaaacugcuggcaccuau

SEQ ID NO: 1026793 - RNA, 19 nt, Homo sapiens
uuaaguagguggaaacuau

SEQ ID NO: 1026794 - RNA, 19 nt, Homo sapiens
gcccuucuaucccagauua

SEQ ID NO: 1026795 - RNA, 19 nt, Homo sapiens
ggaauucugucucaucagu

SEQ ID NO: 1026796 - RNA, 19 nt, Homo sapiens
gcauugggcugguuauaca

SEQ ID NO: 1026797 - RNA, 19 nt, Homo sapiens
ggaauuuggguuugucaua

SEQ ID NO: 1026798 - RNA, 19 nt, Homo sapiens
gagcaacucuggccaaugc

SEQ ID NO: 1026799 - RNA, 19 nt, Homo sapiens
gaaguucagcuaacaauca

SEQ ID NO: 1026800 - RNA, 19 nt, Homo sapiens
gaaaggugguuggugaaug

SEQ ID NO: 1026801 - RNA, 19 nt, Homo sapiens
aaaggugguuggugaauga

SEQ ID NO: 1026802 - RNA, 19 nt, Homo sapiens
gcaaagccauguucacacu

SEQ ID NO: 1026803 - RNA, 19 nt, Homo sapiens
aaagaacccuggccuggaa

SEQ ID NO: 1026804 - RNA, 19 nt, Homo sapiens
gaauuuggguuugucauag

SEQ ID NO: 1026805 - RNA, 19 nt, Homo sapiens
aaaugcagguuuacaaaga

SEQ ID NO: 1026806 - RNA, 19 nt, Homo sapiens
ugaaagaacaucucaggaa

SEQ ID NO: 1026807 - RNA, 19 nt, Homo sapiens
gaaacacacaggaagagaa

SEQ ID NO: 1026808 - RNA, 19 nt, Homo sapiens
cgaaucagacuuccacauu

SEQ ID NO: 1026809 - RNA, 19 nt, Homo sapiens
gguuauacauuucuguuuc

SEQ ID NO: 1026810 - RNA, 19 nt, Homo sapiens
ugucauagauguauucucu

SEQ ID NO: 1026811 - RNA, 19 nt, Homo sapiens
aagcagaguuugaggaaga

SEQ ID NO: 1026812 - RNA, 19 nt, Homo sapiens
cagaauacuuccuagaauc

SEQ ID NO: 1026813 - RNA, 19 nt, Homo sapiens
aaucagacuuccacauuug

SEQ ID NO: 1026814 - RNA, 19 nt, Homo sapiens
gaaagcagaguguaacaag

SEQ ID NO: 1026815 - RNA, 19 nt, Homo sapiens
caaaguacuucaggauuag

SEQ ID NO: 1026816 - RNA, 19 nt, Homo sapiens
uagaguaacuguccgagau

SEQ ID NO: 1026817 - RNA, 19 nt, Homo sapiens
ccaaaggcccguuaccauu

SEQ ID NO: 1026818 - RNA, 19 nt, Homo sapiens
gaacaccuugaacuccuua

SEQ ID NO: 1026819 - RNA, 19 nt, Homo sapiens
caaaggcccguuaccauug

SEQ ID NO: 1026820 - RNA, 19 nt, Homo sapiens
ugaggcaucucucuuaagu

SEQ ID NO: 1026821 - RNA, 19 nt, Homo sapiens
agaaagagaucaggcaaca

SEQ ID NO: 1026822 - RNA, 19 nt, Homo sapiens
ggaagcauugggcugguua

SEQ ID NO: 1026823 - RNA, 19 nt, Homo sapiens
uagagccacuacuuucuuu

SEQ ID NO: 1026824 - RNA, 19 nt, Homo sapiens
uaucccagauuaccuaaau

SEQ ID NO: 1026825 - RNA, 19 nt, Homo sapiens
uggacaaccuuuaaucaga

SEQ ID NO: 1026826 - RNA, 19 nt, Homo sapiens
gaggguggcugggauauac

SEQ ID NO: 1026827 - RNA, 19 nt, Homo sapiens
aggcaacagugauucuaua

SEQ ID NO: 1026828 - RNA, 19 nt, Homo sapiens
gagcaaagccauguucaca

SEQ ID NO: 1026829 - RNA, 19 nt, Homo sapiens
caauacagaauacuuccua

SEQ ID NO: 1026830 - RNA, 19 nt, Homo sapiens
aaacuccgcuuccgauugg

SEQ ID NO: 1026831 - RNA, 19 nt, Homo sapiens
gcaucucucuuaaguaggu

SEQ ID NO: 1026832 - RNA, 19 nt, Homo sapiens
caggaauucugucucauca

SEQ ID NO: 1026833 - RNA, 19 nt, Homo sapiens
ggauuaggaauuuggguuu

SEQ ID NO: 1026834 - RNA, 19 nt, Homo sapiens
acagaauacuuccuagaau

SEQ ID NO: 1026835 - RNA, 19 nt, Homo sapiens
gggaaaaggugauuguaga

SEQ ID NO: 1026836 - RNA, 19 nt, Homo sapiens
gaaaagaggcuagaugaug

SEQ ID NO: 1026837 - RNA, 19 nt, Homo sapiens
ggaccuccauuuccagucu

SEQ ID NO: 1026838 - RNA, 19 nt, Homo sapiens
uaaagcagaguuugaggaa

SEQ ID NO: 1026839 - RNA, 19 nt, Homo sapiens
ggaacaccuugaacuccuu

SEQ ID NO: 1026840 - RNA, 19 nt, Homo sapiens
gcuugaagauuucuaugca

SEQ ID NO: 1026841 - RNA, 19 nt, Homo sapiens
aaacacacaggaagagaaa

SEQ ID NO: 1026842 - RNA, 19 nt, Homo sapiens
gacagcaaguacaguugaa

SEQ ID NO: 1026843 - RNA, 19 nt, Homo sapiens
aggcaucucucuuaaguag

SEQ ID NO: 1026844 - RNA, 19 nt, Homo sapiens
aaagccauguucacacuga

SEQ ID NO: 1026845 - RNA, 19 nt, Homo sapiens
ugaucgagaugguacaaga

SEQ ID NO: 1026846 - RNA, 19 nt, Homo sapiens
guuugaggcaucucucuua

SEQ ID NO: 1026847 - RNA, 19 nt, Homo sapiens
gauuaggaauuuggguuug

SEQ ID NO: 1026848 - RNA, 19 nt, Homo sapiens
ucuuggaccuguugucuga

SEQ ID NO: 1026849 - RNA, 19 nt, Homo sapiens
gagaaaagaggcuagauga

SEQ ID NO: 1026850 - RNA, 19 nt, Homo sapiens
ccagauuaccuaaauguuc

SEQ ID NO: 1026851 - RNA, 19 nt, Homo sapiens
caagaggcugguagaguaa

SEQ ID NO: 1026852 - RNA, 19 nt, Homo sapiens
uaacaagggauaugucaag

SEQ ID NO: 1026853 - RNA, 19 nt, Homo sapiens
ucucaggaauucugucuca

SEQ ID NO: 1026854 - RNA, 19 nt, Homo sapiens
uuaagcauaugcacacugu

SEQ ID NO: 1026855 - RNA, 19 nt, Homo sapiens
ggugauaaaggauaaauac

SEQ ID NO: 1026856 - RNA, 19 nt, Homo sapiens
agggauaugucaagguaaa

SEQ ID NO: 1026857 - RNA, 19 nt, Homo sapiens
ucacugauaagaaauguuc

SEQ ID NO: 1026858 - RNA, 19 nt, Homo sapiens
caaacuccgcuuccgauug

SEQ ID NO: 1026859 - RNA, 19 nt, Homo sapiens
gagcaggugguggugauaa

SEQ ID NO: 1026860 - RNA, 19 nt, Homo sapiens
gcaacagugauucuauaga

SEQ ID NO: 1026861 - RNA, 19 nt, Homo sapiens
ugauugagcugugaagucu

SEQ ID NO: 1026862 - RNA, 19 nt, Homo sapiens
cgacagcaaguacaguuga

SEQ ID NO: 1026863 - RNA, 19 nt, Homo sapiens
gcaaacuccgcuuccgauu

SEQ ID NO: 1026864 - RNA, 19 nt, Homo sapiens
gcauggacaaccuuuaauc

SEQ ID NO: 1026865 - RNA, 19 nt, Homo sapiens
uaugagccauguacaucuu

SEQ ID NO: 1026866 - RNA, 19 nt, Homo sapiens
gaaaagaugcaccuaucaa

SEQ ID NO: 1026867 - RNA, 19 nt, Homo sapiens
aaagagaucaggcaacagu

SEQ ID NO: 1026868 - RNA, 19 nt, Homo sapiens
ggaaacacacaggaagaga

SEQ ID NO: 1026869 - RNA, 19 nt, Homo sapiens
ccuaaauguucccuucuca

SEQ ID NO: 1026870 - RNA, 19 nt, Homo sapiens
gcucaaaguacuucaggau

SEQ ID NO: 1026871 - RNA, 19 nt, Homo sapiens
uagaguggcucaaaguacu

SEQ ID NO: 1026872 - RNA, 19 nt, Homo sapiens
uacagaauacuuccuagaa

SEQ ID NO: 1026873 - RNA, 19 nt, Homo sapiens
cuugaacuccuuaagcaua

SEQ ID NO: 1026874 - RNA, 19 nt, Homo sapiens
gggaaaagaugcaccuauc

SEQ ID NO: 1026875 - RNA, 19 nt, Homo sapiens
gguuggaguuuucuucuaa

SEQ ID NO: 1026876 - RNA, 19 nt, Homo sapiens
gcaaguacaguugaaagca

SEQ ID NO: 1026877 - RNA, 19 nt, Homo sapiens
ggaaaggugguuggugaau

SEQ ID NO: 1026878 - RNA, 19 nt, Homo sapiens
auacugaugggucuuguuu

SEQ ID NO: 1026879 - RNA, 19 nt, Homo sapiens
caauguagaguggcucaaa

SEQ ID NO: 1026880 - RNA, 19 nt, Homo sapiens
gugaacuucuacucauuuc

SEQ ID NO: 1026881 - RNA, 19 nt, Homo sapiens
gggagcaacucuggccaau

SEQ ID NO: 1026882 - RNA, 19 nt, Homo sapiens
uuugaggcaucucucuuaa

SEQ ID NO: 1026883 - RNA, 19 nt, Homo sapiens
gaacuucuacucauuuccu

SEQ ID NO: 1026884 - RNA, 19 nt, Homo sapiens
aagaacaucucaggaagca

SEQ ID NO: 1026885 - RNA, 19 nt, Homo sapiens
guccuuccaugcccuucua

SEQ ID NO: 1026886 - RNA, 19 nt, Homo sapiens
ucaaaguacuucaggauua

SEQ ID NO: 1026887 - RNA, 19 nt, Homo sapiens
gaaucagacuuccacauuu

SEQ ID NO: 1026888 - RNA, 19 nt, Homo sapiens
caagggauaugucaaggua

SEQ ID NO: 1026889 - RNA, 19 nt, Homo sapiens
gaaauguucucgacagcaa

SEQ ID NO: 1026890 - RNA, 19 nt, Homo sapiens
acaagaggcugguagagua

SEQ ID NO: 1026891 - RNA, 19 nt, Homo sapiens
ggaauucuuucaauacaga

SEQ ID NO: 1026892 - RNA, 19 nt, Homo sapiens
gcaaacugcuggcaccuau

SEQ ID NO: 1026893 - RNA, 19 nt, Homo sapiens
uuaaguagguggaaacuau

SEQ ID NO: 1026894 - RNA, 19 nt, Homo sapiens
gcccuucuaucccagauua

SEQ ID NO: 1026895 - RNA, 19 nt, Homo sapiens
ggaauucugucucaucagu

SEQ ID NO: 1026896 - RNA, 19 nt, Homo sapiens
gcauugggcugguuauaca

SEQ ID NO: 1026897 - RNA, 19 nt, Homo sapiens
ggaauuuggguuugucaua

SEQ ID NO: 1026898 - RNA, 19 nt, Homo sapiens
gagcaacucuggccaaugc

SEQ ID NO: 1026899 - RNA, 19 nt, Homo sapiens
gaaguucagcuaacaauca

SEQ ID NO: 1026900 - RNA, 19 nt, Homo sapiens
gaaaggugguuggugaaug

SEQ ID NO: 1026901 - RNA, 19 nt, Homo sapiens
aaaggugguuggugaauga

SEQ ID NO: 1026902 - RNA, 19 nt, Homo sapiens
gcaaagccauguucacacu

SEQ ID NO: 1026903 - RNA, 19 nt, Homo sapiens
aaagaacccuggccuggaa

SEQ ID NO: 1026904 - RNA, 19 nt, Homo sapiens
gaauuuggguuugucauag

SEQ ID NO: 1026905 - RNA, 19 nt, Homo sapiens
aaaugcagguuuacaaaga

SEQ ID NO: 1026906 - RNA, 19 nt, Homo sapiens
ugaaagaacaucucaggaa

SEQ ID NO: 1026907 - RNA, 19 nt, Homo sapiens
gaaacacacaggaagagaa

SEQ ID NO: 1026908 - RNA, 19 nt, Homo sapiens
gguuauacauuucuguuuc

SEQ ID NO: 1026909 - RNA, 19 nt, Homo sapiens
ugucauagauguauucucu

SEQ ID NO: 1026910 - RNA, 19 nt, Homo sapiens
cgaaucagacuuccacauu

SEQ ID NO: 1026911 - RNA, 19 nt, Homo sapiens
cagaauacuuccuagaauc

SEQ ID NO: 1026912 - RNA, 19 nt, Homo sapiens
gaugagguguugcuguguu

SEQ ID NO: 1026913 - RNA, 19 nt, Homo sapiens
gaaagcagaguguaacaag

SEQ ID NO: 1026914 - RNA, 19 nt, Homo sapiens
aaucagacuuccacauuug

SEQ ID NO: 1026915 - RNA, 19 nt, Homo sapiens
caaaguacuucaggauuag

SEQ ID NO: 1026916 - RNA, 19 nt, Homo sapiens
uagaguaacuguccgagau

SEQ ID NO: 1026917 - RNA, 19 nt, Homo sapiens
ccaaaggcccguuaccauu

SEQ ID NO: 1026918 - RNA, 19 nt, Homo sapiens
gaacaccuugaacuccuua

SEQ ID NO: 1026919 - RNA, 19 nt, Homo sapiens
caaaggcccguuaccauug

SEQ ID NO: 1026920 - RNA, 19 nt, Homo sapiens
ugaggcaucucucuuaagu

SEQ ID NO: 1026921 - RNA, 19 nt, Homo sapiens
agaaagagaucaggcaaca

SEQ ID NO: 1026922 - RNA, 19 nt, Homo sapiens
ggaagcauugggcugguua

SEQ ID NO: 1026923 - RNA, 19 nt, Homo sapiens
uagagccacuacuuucuuu

SEQ ID NO: 1026924 - RNA, 19 nt, Homo sapiens
uaucccagauuaccuaaau

SEQ ID NO: 1026925 - RNA, 19 nt, Homo sapiens
uggacaaccuuuaaucaga

SEQ ID NO: 1026926 - RNA, 19 nt, Homo sapiens
gaggguggcugggauauac

SEQ ID NO: 1026927 - RNA, 19 nt, Homo sapiens
aggcaacagugauucuaua

SEQ ID NO: 1026928 - RNA, 19 nt, Homo sapiens
cauggugaaugaacuuuau

SEQ ID NO: 1026929 - RNA, 19 nt, Homo sapiens
gagcaaagccauguucaca

SEQ ID NO: 1026930 - RNA, 19 nt, Homo sapiens
caauacagaauacuuccua

SEQ ID NO: 1026931 - RNA, 19 nt, Homo sapiens
aaacuccgcuuccgauugg

SEQ ID NO: 1026932 - RNA, 19 nt, Homo sapiens
gcaucucucuuaaguaggu

SEQ ID NO: 1026933 - RNA, 19 nt, Homo sapiens
caggaauucugucucauca

SEQ ID NO: 1026934 - RNA, 19 nt, Homo sapiens
ggauuaggaauuuggguuu

SEQ ID NO: 1026935 - RNA, 19 nt, Homo sapiens
acagaauacuuccuagaau

SEQ ID NO: 1026936 - RNA, 19 nt, Homo sapiens
gggaaaaggugauuguaga

SEQ ID NO: 1026937 - RNA, 19 nt, Homo sapiens
gaaaagaggcuagaugaug

SEQ ID NO: 1026938 - RNA, 19 nt, Homo sapiens
ggaccuccauuuccagucu

SEQ ID NO: 1026939 - RNA, 19 nt, Homo sapiens
ggaacaccuugaacuccuu

SEQ ID NO: 1026940 - RNA, 19 nt, Homo sapiens
gcuugaagauuucuaugca

SEQ ID NO: 1026941 - RNA, 19 nt, Homo sapiens
aaacacacaggaagagaaa

SEQ ID NO: 1026942 - RNA, 19 nt, Homo sapiens
ggaaggaccaagaggugaa

SEQ ID NO: 1026943 - RNA, 19 nt, Homo sapiens
aggcaucucucuuaaguag

SEQ ID NO: 1026944 - RNA, 19 nt, Homo sapiens
aaagccauguucacacuga

SEQ ID NO: 1026945 - RNA, 19 nt, Homo sapiens
ugaucgagaugguacaaga

SEQ ID NO: 1026946 - RNA, 19 nt, Homo sapiens
guuugaggcaucucucuua

SEQ ID NO: 1026947 - RNA, 19 nt, Homo sapiens
gauuaggaauuuggguuug

SEQ ID NO: 1026948 - RNA, 19 nt, Homo sapiens
ucuuggaccuguugucuga

SEQ ID NO: 1026949 - RNA, 19 nt, Homo sapiens
gagaaaagaggcuagauga

SEQ ID NO: 1026950 - RNA, 19 nt, Homo sapiens
ccagauuaccuaaauguuc

SEQ ID NO: 1026951 - RNA, 19 nt, Homo sapiens
caagaggcugguagaguaa

SEQ ID NO: 1026952 - RNA, 19 nt, Homo sapiens
uaacaagggauaugucaag

SEQ ID NO: 1026953 - RNA, 19 nt, Homo sapiens
ucucaggaauucugucuca

SEQ ID NO: 1026954 - RNA, 19 nt, Homo sapiens
uuaagcauaugcacacugu

SEQ ID NO: 1026955 - RNA, 19 nt, Homo sapiens
ggugauaaaggauaaauac

SEQ ID NO: 1026956 - RNA, 19 nt, Homo sapiens
agggauaugucaagguaaa

SEQ ID NO: 1026957 - RNA, 19 nt, Homo sapiens
ucacugauaagaaauguuc

SEQ ID NO: 1026958 - RNA, 19 nt, Homo sapiens
caaacuccgcuuccgauug

SEQ ID NO: 1026959 - RNA, 19 nt, Homo sapiens
gagcaggugguggugauaa

SEQ ID NO: 1026960 - RNA, 19 nt, Homo sapiens
gcaacagugauucuauaga

SEQ ID NO: 1026961 - RNA, 19 nt, Homo sapiens
ugauugagcugugaagucu

SEQ ID NO: 1026962 - RNA, 19 nt, Homo sapiens
gcaaacuccgcuuccgauu

SEQ ID NO: 1026963 - RNA, 19 nt, Homo sapiens
gcauggacaaccuuuaauc

SEQ ID NO: 1026964 - RNA, 19 nt, Homo sapiens
uaugagccauguacaucuu

SEQ ID NO: 1026965 - RNA, 19 nt, Homo sapiens
gaaaagaugcaccuaucaa

SEQ ID NO: 1026966 - RNA, 19 nt, Homo sapiens
aaagagaucaggcaacagu

SEQ ID NO: 1026967 - RNA, 19 nt, Homo sapiens
ggaaacacacaggaagaga

SEQ ID NO: 1026968 - RNA, 19 nt, Homo sapiens
ccuaaauguucccuucuca

SEQ ID NO: 1026969 - RNA, 19 nt, Homo sapiens
gcucaaaguacuucaggau

SEQ ID NO: 1026970 - RNA, 19 nt, Homo sapiens
uagaguggcucaaaguacu

SEQ ID NO: 1026971 - RNA, 19 nt, Homo sapiens
uacagaauacuuccuagaa

SEQ ID NO: 1026972 - RNA, 19 nt, Homo sapiens
cuugaacuccuuaagcaua

SEQ ID NO: 1026973 - RNA, 19 nt, Homo sapiens
gggaaaagaugcaccuauc

SEQ ID NO: 1026974 - RNA, 19 nt, Homo sapiens
gguuggaguuuucuucuaa

SEQ ID NO: 1026975 - RNA, 19 nt, Homo sapiens
ggaaaggugguuggugaau

SEQ ID NO: 1026976 - RNA, 19 nt, Homo sapiens
auacugaugggucuuguuu

SEQ ID NO: 1026977 - RNA, 19 nt, Homo sapiens
caauguagaguggcucaaa

SEQ ID NO: 1026978 - RNA, 19 nt, Homo sapiens
gugaacuucuacucauuuc

SEQ ID NO: 1026979 - RNA, 19 nt, Homo sapiens
gggagcaacucuggccaau

SEQ ID NO: 1026980 - RNA, 19 nt, Homo sapiens
uuugaggcaucucucuuaa

SEQ ID NO: 1026981 - RNA, 19 nt, Homo sapiens
gaacuucuacucauuuccu

SEQ ID NO: 1026982 - RNA, 19 nt, Homo sapiens
aagaacaucucaggaagca

SEQ ID NO: 1026983 - RNA, 19 nt, Homo sapiens
ccaccagcauugacucagu

SEQ ID NO: 1026984 - RNA, 19 nt, Homo sapiens
uaaagcagguaggagucaa

SEQ ID NO: 1026985 - RNA, 19 nt, Homo sapiens
guccuuccaugcccuucua

SEQ ID NO: 1026986 - RNA, 19 nt, Homo sapiens
ucaaaguacuucaggauua

SEQ ID NO: 1026987 - RNA, 19 nt, Homo sapiens
gaaucagacuuccacauuu

SEQ ID NO: 1026988 - RNA, 19 nt, Homo sapiens
caagggauaugucaaggua

SEQ ID NO: 1026989 - RNA, 19 nt, Homo sapiens
gaaauguucucgacagcaa

SEQ ID NO: 1026990 - RNA, 19 nt, Homo sapiens
acaagaggcugguagagua

SEQ ID NO: 1026991 - RNA, 19 nt, Homo sapiens
ggaauucuuucaauacaga

SEQ ID NO: 1026992 - RNA, 19 nt, Homo sapiens
gcaaacugcuggcaccuau

SEQ ID NO: 1026993 - RNA, 19 nt, Homo sapiens
uuaaguagguggaaacuau

SEQ ID NO: 1026994 - RNA, 19 nt, Homo sapiens
gcccuucuaucccagauua

SEQ ID NO: 1026995 - RNA, 19 nt, Homo sapiens
ggaauucugucucaucagu

SEQ ID NO: 1026996 - RNA, 19 nt, Homo sapiens
gcauugggcugguuauaca

SEQ ID NO: 1026997 - RNA, 19 nt, Homo sapiens
ggaauuuggguuugucaua

SEQ ID NO: 1026998 - RNA, 19 nt, Homo sapiens
gagcaacucuggccaaugc

SEQ ID NO: 1026999 - RNA, 19 nt, Homo sapiens
gaaguucagcuaacaauca

SEQ ID NO: 1027000 - RNA, 19 nt, Homo sapiens
gaaaggugguuggugaaug

SEQ ID NO: 1027001 - RNA, 19 nt, Homo sapiens
aaaggugguuggugaauga

SEQ ID NO: 1027002 - RNA, 19 nt, Homo sapiens
gcaaagccauguucacacu

SEQ ID NO: 1027003 - RNA, 19 nt, Homo sapiens
aaagaacccuggccuggaa

SEQ ID NO: 1027004 - RNA, 19 nt, Homo sapiens
gaauuuggguuugucauag

SEQ ID NO: 1027005 - RNA, 19 nt, Homo sapiens
aaaugcagguuuacaaaga

SEQ ID NO: 1027006 - RNA, 19 nt, Homo sapiens
ugaaagaacaucucaggaa

SEQ ID NO: 1027007 - RNA, 19 nt, Homo sapiens
gaaacacacaggaagagaa

SEQ ID NO: 1027008 - RNA, 19 nt, Homo sapiens
gguuauacauuucuguuuc

SEQ ID NO: 1027009 - RNA, 19 nt, Homo sapiens
ugucauagauguauucucu

SEQ ID NO: 1027010 - RNA, 19 nt, Homo sapiens
cgaaucagacuuccacauu

SEQ ID NO: 1027011 - RNA, 19 nt, Homo sapiens
gaugagguguugcuguguu

SEQ ID NO: 1027012 - RNA, 19 nt, Homo sapiens
cagaauacuuccuagaauc

SEQ ID NO: 1027013 - RNA, 19 nt, Homo sapiens
gaaagcagaguguaacaag

SEQ ID NO: 1027014 - RNA, 19 nt, Homo sapiens
aaucagacuuccacauuug

SEQ ID NO: 1027015 - RNA, 19 nt, Homo sapiens
caaaguacuucaggauuag

SEQ ID NO: 1027016 - RNA, 19 nt, Homo sapiens
uagaguaacuguccgagau

SEQ ID NO: 1027017 - RNA, 19 nt, Homo sapiens
ccaaaggcccguuaccauu

SEQ ID NO: 1027018 - RNA, 19 nt, Homo sapiens
gaacaccuugaacuccuua

SEQ ID NO: 1027019 - RNA, 19 nt, Homo sapiens
caaaggcccguuaccauug

SEQ ID NO: 1027020 - RNA, 19 nt, Homo sapiens
ugaggcaucucucuuaagu

SEQ ID NO: 1027021 - RNA, 19 nt, Homo sapiens
agaaagagaucaggcaaca

SEQ ID NO: 1027022 - RNA, 19 nt, Homo sapiens
ggaagcauugggcugguua

SEQ ID NO: 1027023 - RNA, 19 nt, Homo sapiens
uagagccacuacuuucuuu

SEQ ID NO: 1027024 - RNA, 19 nt, Homo sapiens
uaucccagauuaccuaaau

SEQ ID NO: 1027025 - RNA, 19 nt, Homo sapiens
uggacaaccuuuaaucaga

SEQ ID NO: 1027026 - RNA, 19 nt, Homo sapiens
gaggguggcugggauauac

SEQ ID NO: 1027027 - RNA, 19 nt, Homo sapiens
aggcaacagugauucuaua

SEQ ID NO: 1027028 - RNA, 19 nt, Homo sapiens
cauggugaaugaacuuuau

SEQ ID NO: 1027029 - RNA, 19 nt, Homo sapiens
gagcaaagccauguucaca

SEQ ID NO: 1027030 - RNA, 19 nt, Homo sapiens
caauacagaauacuuccua

SEQ ID NO: 1027031 - RNA, 19 nt, Homo sapiens
aaacuccgcuuccgauugg

SEQ ID NO: 1027032 - RNA, 19 nt, Homo sapiens
gcaucucucuuaaguaggu

SEQ ID NO: 1027033 - RNA, 19 nt, Homo sapiens
caggaauucugucucauca

SEQ ID NO: 1027034 - RNA, 19 nt, Homo sapiens
ggauuaggaauuuggguuu

SEQ ID NO: 1027035 - RNA, 19 nt, Homo sapiens
acagaauacuuccuagaau

SEQ ID NO: 1027036 - RNA, 19 nt, Homo sapiens
gggaaaaggugauuguaga

SEQ ID NO: 1027037 - RNA, 19 nt, Homo sapiens
gaaaagaggcuagaugaug

SEQ ID NO: 1027038 - RNA, 19 nt, Homo sapiens
ggaccuccauuuccagucu

SEQ ID NO: 1027039 - RNA, 19 nt, Homo sapiens
ggaacaccuugaacuccuu

SEQ ID NO: 1027040 - RNA, 19 nt, Homo sapiens
gcuugaagauuucuaugca

SEQ ID NO: 1027041 - RNA, 19 nt, Homo sapiens
aaacacacaggaagagaaa

SEQ ID NO: 1027042 - RNA, 19 nt, Homo sapiens
ggaaggaccaagaggugaa

SEQ ID NO: 1027043 - RNA, 19 nt, Homo sapiens
aggcaucucucuuaaguag

SEQ ID NO: 1027044 - RNA, 19 nt, Homo sapiens
aaagccauguucacacuga

SEQ ID NO: 1027045 - RNA, 19 nt, Homo sapiens
ugaucgagaugguacaaga

SEQ ID NO: 1027046 - RNA, 19 nt, Homo sapiens
gacagcaaguacaguugaa

SEQ ID NO: 1027047 - RNA, 19 nt, Homo sapiens
guuugaggcaucucucuua

SEQ ID NO: 1027048 - RNA, 19 nt, Homo sapiens
gauuaggaauuuggguuug

SEQ ID NO: 1027049 - RNA, 19 nt, Homo sapiens
ugaguaacgugaauuuguc

SEQ ID NO: 1027050 - RNA, 19 nt, Homo sapiens
ucuuggaccuguugucuga

SEQ ID NO: 1027051 - RNA, 19 nt, Homo sapiens
gagaaaagaggcuagauga

SEQ ID NO: 1027052 - RNA, 19 nt, Homo sapiens
ccagauuaccuaaauguuc

SEQ ID NO: 1027053 - RNA, 19 nt, Homo sapiens
caagaggcugguagaguaa

SEQ ID NO: 1027054 - RNA, 19 nt, Homo sapiens
uaacaagggauaugucaag

SEQ ID NO: 1027055 - RNA, 19 nt, Homo sapiens
ucucaggaauucugucuca

SEQ ID NO: 1027056 - RNA, 19 nt, Homo sapiens
uuaagcauaugcacacugu

SEQ ID NO: 1027057 - RNA, 19 nt, Homo sapiens
ggugauaaaggauaaauac

SEQ ID NO: 1027058 - RNA, 19 nt, Homo sapiens
agggauaugucaagguaaa

SEQ ID NO: 1027059 - RNA, 19 nt, Homo sapiens
ucacugauaagaaauguuc

SEQ ID NO: 1027060 - RNA, 19 nt, Homo sapiens
caaacuccgcuuccgauug

SEQ ID NO: 1027061 - RNA, 19 nt, Homo sapiens
gagcaggugguggugauaa

SEQ ID NO: 1027062 - RNA, 19 nt, Homo sapiens
gcaacagugauucuauaga

SEQ ID NO: 1027063 - RNA, 19 nt, Homo sapiens
ugauugagcugugaagucu

SEQ ID NO: 1027064 - RNA, 19 nt, Homo sapiens
gcaaacuccgcuuccgauu

SEQ ID NO: 1027065 - RNA, 19 nt, Homo sapiens
cgacagcaaguacaguuga

SEQ ID NO: 1027066 - RNA, 19 nt, Homo sapiens
gcauggacaaccuuuaauc

SEQ ID NO: 1027067 - RNA, 19 nt, Homo sapiens
uaugagccauguacaucuu

SEQ ID NO: 1027068 - RNA, 19 nt, Homo sapiens
gaaaagaugcaccuaucaa

SEQ ID NO: 1027069 - RNA, 19 nt, Homo sapiens
aaagagaucaggcaacagu

SEQ ID NO: 1027070 - RNA, 19 nt, Homo sapiens
ggaaacacacaggaagaga

SEQ ID NO: 1027071 - RNA, 19 nt, Homo sapiens
ccuaaauguucccuucuca

SEQ ID NO: 1027072 - RNA, 19 nt, Homo sapiens
uccgacuucuggagauuua

SEQ ID NO: 1027073 - RNA, 19 nt, Homo sapiens
gcucaaaguacuucaggau

SEQ ID NO: 1027074 - RNA, 19 nt, Homo sapiens
uagaguggcucaaaguacu

SEQ ID NO: 1027075 - RNA, 19 nt, Homo sapiens
uacagaauacuuccuagaa

SEQ ID NO: 1027076 - RNA, 19 nt, Homo sapiens
cuugaacuccuuaagcaua

SEQ ID NO: 1027077 - RNA, 19 nt, Homo sapiens
gggaaaagaugcaccuauc

SEQ ID NO: 1027078 - RNA, 19 nt, Homo sapiens
gguuggaguuuucuucuaa

SEQ ID NO: 1027079 - RNA, 19 nt, Homo sapiens
gcaaguacaguugaaagca

SEQ ID NO: 1027080 - RNA, 19 nt, Homo sapiens
ggaaaggugguuggugaau

SEQ ID NO: 1027081 - RNA, 19 nt, Homo sapiens
auacugaugggucuuguuu

SEQ ID NO: 1027082 - RNA, 19 nt, Homo sapiens
caauguagaguggcucaaa

SEQ ID NO: 1027083 - RNA, 19 nt, Homo sapiens
gugaacuucuacucauuuc

SEQ ID NO: 1027084 - RNA, 19 nt, Homo sapiens
gggagcaacucuggccaau

SEQ ID NO: 1027085 - RNA, 19 nt, Homo sapiens
uuugaggcaucucucuuaa

SEQ ID NO: 1027086 - RNA, 19 nt, Homo sapiens
gaaaugagaucuccugaua

SEQ ID NO: 1027087 - RNA, 19 nt, Homo sapiens
gagcagaucuugugguaua

SEQ ID NO: 1027088 - RNA, 19 nt, Homo sapiens
caaaggagauggucauuau

SEQ ID NO: 1027089 - RNA, 19 nt, Homo sapiens
gcaaaugggugacuuagug

SEQ ID NO: 1027090 - RNA, 19 nt, Homo sapiens
gaagaagcuuuacauauuc

SEQ ID NO: 1027091 - RNA, 19 nt, Homo sapiens
gcaaaggacugaaagagau

SEQ ID NO: 1027092 - RNA, 19 nt, Homo sapiens
gaacagcuggcauuauaua

SEQ ID NO: 1027093 - RNA, 19 nt, Homo sapiens
gggcagauauuguuacuga

SEQ ID NO: 1027094 - RNA, 19 nt, Homo sapiens
gcacaaaucugagagaaag

SEQ ID NO: 1027095 - RNA, 19 nt, Homo sapiens
gaagauaucagaaggaaug

SEQ ID NO: 1027096 - RNA, 19 nt, Homo sapiens
acagaaaggucaaaugauu

SEQ ID NO: 1027097 - RNA, 19 nt, Homo sapiens
uaggaucucuuguucuuua

SEQ ID NO: 1027098 - RNA, 19 nt, Homo sapiens
gaucuuaauuggagaauca

SEQ ID NO: 1027099 - RNA, 19 nt, Homo sapiens
gaaagucaccugaagagaa

SEQ ID NO: 1027100 - RNA, 19 nt, Homo sapiens
cugaacagcuggcauuaua

SEQ ID NO: 1027101 - RNA, 19 nt, Homo sapiens
acaauuagcuguuugaagu

SEQ ID NO: 1027102 - RNA, 19 nt, Homo sapiens
ugaaagagauuuguagguu

SEQ ID NO: 1027103 - RNA, 19 nt, Homo sapiens
uggcaucucuucauuaauu

SEQ ID NO: 1027104 - RNA, 19 nt, Homo sapiens
gaggacaacuacccauauu

SEQ ID NO: 1027105 - RNA, 19 nt, Homo sapiens
gaaaauagcuuggaaaacu

SEQ ID NO: 1027106 - RNA, 19 nt, Homo sapiens
aaugagaucuccugauauu

SEQ ID NO: 1027107 - RNA, 19 nt, Homo sapiens
gaucuugcuugccucauuu

SEQ ID NO: 1027108 - RNA, 19 nt, Homo sapiens
ugacuaugcuugcuacuga

SEQ ID NO: 1027109 - RNA, 19 nt, Homo sapiens
gcaauacaccucaaggaaa

SEQ ID NO: 1027110 - RNA, 19 nt, Homo sapiens
cagcuggcauuauauauga

SEQ ID NO: 1027111 - RNA, 19 nt, Homo sapiens
agacuuaacuggcaaagau

SEQ ID NO: 1027112 - RNA, 19 nt, Homo sapiens
acucugagcuguuuccuuu

SEQ ID NO: 1027113 - RNA, 19 nt, Homo sapiens
cacaggaaguugaauauug

SEQ ID NO: 1027114 - RNA, 19 nt, Homo sapiens
gauauuagguuugguccuu

SEQ ID NO: 1027115 - RNA, 19 nt, Homo sapiens
caucggaaauuaucuacaa

SEQ ID NO: 1027116 - RNA, 19 nt, Homo sapiens
aaacagaaaggucaaauga

SEQ ID NO: 1027117 - RNA, 19 nt, Homo sapiens
gaaaugcaaaggacugaaa

SEQ ID NO: 1027118 - RNA, 19 nt, Homo sapiens
ggaaucaguuuagacuuga

SEQ ID NO: 1027119 - RNA, 19 nt, Homo sapiens
uauuugagcuccucuaguu

SEQ ID NO: 1027120 - RNA, 19 nt, Homo sapiens
gagaucuccugauauuuga

SEQ ID NO: 1027121 - RNA, 19 nt, Homo sapiens
gggaauacaacacuuauga

SEQ ID NO: 1027122 - RNA, 19 nt, Homo sapiens
caaccuccauuugaagaua

SEQ ID NO: 1027123 - RNA, 19 nt, Homo sapiens
caagaagaagcuuuacaua

SEQ ID NO: 1027124 - RNA, 19 nt, Homo sapiens
ggacucaaaucaguaacuu

SEQ ID NO: 1027125 - RNA, 19 nt, Homo sapiens
ugacuaggaucucuuguuc

SEQ ID NO: 1027126 - RNA, 19 nt, Homo sapiens
gggaagauaucagaaggaa

SEQ ID NO: 1027127 - RNA, 19 nt, Homo sapiens
gagagaaagucaccugaag

SEQ ID NO: 1027128 - RNA, 19 nt, Homo sapiens
aaaggaaggugcugucaau

SEQ ID NO: 1027129 - RNA, 19 nt, Homo sapiens
ggacugaaagagauuugua

SEQ ID NO: 1027130 - RNA, 19 nt, Homo sapiens
cauaagaaaugcccaaguc

SEQ ID NO: 1027131 - RNA, 19 nt, Homo sapiens
caucauagcauuccagaga

SEQ ID NO: 1027132 - RNA, 19 nt, Homo sapiens
acuaguacaucggaaauua

SEQ ID NO: 1027133 - RNA, 19 nt, Homo sapiens
gaaaguauuagaccucaga

SEQ ID NO: 1027134 - RNA, 19 nt, Homo sapiens
caggcgaccucaaucuaua

SEQ ID NO: 1027135 - RNA, 19 nt, Homo sapiens
gagcacaaaucugagagaa

SEQ ID NO: 1027136 - RNA, 19 nt, Homo sapiens
gaaguugaauauuggaucu

SEQ ID NO: 1027137 - RNA, 19 nt, Homo sapiens
ggaucuugcuugccucauu

SEQ ID NO: 1027138 - RNA, 19 nt, Homo sapiens
uuacugaucuaaacacuca

SEQ ID NO: 1027139 - RNA, 19 nt, Homo sapiens
uggcuuauaucuaucauug

SEQ ID NO: 1027140 - RNA, 19 nt, Homo sapiens
augaaucgcuggcuuauau

SEQ ID NO: 1027141 - RNA, 19 nt, Homo sapiens
aaaggaugcucuuauguuc

SEQ ID NO: 1027142 - RNA, 19 nt, Homo sapiens
cggaaauuaucuacaauga

SEQ ID NO: 1027143 - RNA, 19 nt, Homo sapiens
aagaacaauuggcaccuua

SEQ ID NO: 1027144 - RNA, 19 nt, Homo sapiens
gcauaaagcaccuugaaag

SEQ ID NO: 1027145 - RNA, 19 nt, Homo sapiens
caugggaaauugauaaauc

SEQ ID NO: 1027146 - RNA, 19 nt, Homo sapiens
aaagucaccugaagagaau

SEQ ID NO: 1027147 - RNA, 19 nt, Homo sapiens
guacugaagaugcauaaga

SEQ ID NO: 1027148 - RNA, 19 nt, Homo sapiens
uaacaguacugaagaugca

SEQ ID NO: 1027149 - RNA, 19 nt, Homo sapiens
ccugauauuugauugcuuu

SEQ ID NO: 1027150 - RNA, 19 nt, Homo sapiens
aagguuaucugugaaauga

SEQ ID NO: 1027151 - RNA, 19 nt, Homo sapiens
aaaguuaacccguggauug

SEQ ID NO: 1027152 - RNA, 19 nt, Homo sapiens
aaugaccacuuccauguaa

SEQ ID NO: 1027153 - RNA, 19 nt, Homo sapiens
ggagagggcaggcauaaag

SEQ ID NO: 1027154 - RNA, 19 nt, Homo sapiens
ugagaucuccugauauuug

SEQ ID NO: 1027155 - RNA, 19 nt, Homo sapiens
uguggcaucucuucauuaa

SEQ ID NO: 1027156 - RNA, 19 nt, Homo sapiens
gaaauggugagcacaaauc

SEQ ID NO: 1027157 - RNA, 19 nt, Homo sapiens
gaaacagaaaggucaaaug

SEQ ID NO: 1027158 - RNA, 19 nt, Homo sapiens
gaugugguuuguaauaauc

SEQ ID NO: 1027159 - RNA, 19 nt, Homo sapiens
gaagacaauauuuccaaga

SEQ ID NO: 1027160 - RNA, 19 nt, Homo sapiens
gagagugaagacaauauuu

SEQ ID NO: 1027161 - RNA, 19 nt, Homo sapiens
guaaaaggaugcucuuaug

SEQ ID NO: 1027162 - RNA, 19 nt, Homo sapiens
gaggugguuuagacaaauu

SEQ ID NO: 1027163 - RNA, 19 nt, Homo sapiens
aaagagauuuguagguugu

SEQ ID NO: 1027164 - RNA, 19 nt, Homo sapiens
gaaaugcccaagucacuca

SEQ ID NO: 1027165 - RNA, 19 nt, Homo sapiens
ggagucauauguugauaac

SEQ ID NO: 1027166 - RNA, 19 nt, Homo sapiens
gcacagauuauuguccuuu

SEQ ID NO: 1027167 - RNA, 19 nt, Homo sapiens
aaacacaaaucaggcaaug

SEQ ID NO: 1027168 - RNA, 19 nt, Homo sapiens
guacaucggaaauuaucua

SEQ ID NO: 1027169 - RNA, 19 nt, Homo sapiens
ucaagaaacagauagaguu

SEQ ID NO: 1027170 - RNA, 19 nt, Homo sapiens
gguuaucugugaaaugaga

SEQ ID NO: 1027171 - RNA, 19 nt, Homo sapiens
cuagaugacguuugccuua

SEQ ID NO: 1027172 - RNA, 19 nt, Homo sapiens
uugcuugccucauuuguuu

SEQ ID NO: 1027173 - RNA, 19 nt, Homo sapiens
ccuuguaguucuccagaua

SEQ ID NO: 1027174 - RNA, 19 nt, Homo sapiens
guauaaagacaguagaaga

SEQ ID NO: 1027175 - RNA, 19 nt, Homo sapiens
gaaaacauccugccauuca

SEQ ID NO: 1027176 - RNA, 19 nt, Homo sapiens
guuaacccguggauugaaa

SEQ ID NO: 1027177 - RNA, 19 nt, Homo sapiens
ggaaggugcugucaaugcu

SEQ ID NO: 1027178 - RNA, 19 nt, Homo sapiens
ucaucaagauacauuggua

SEQ ID NO: 1027179 - RNA, 19 nt, Homo sapiens
ggucaaaugauucuggaaa

SEQ ID NO: 1027180 - RNA, 19 nt, Homo sapiens
caagaaacagauagaguug

SEQ ID NO: 1027181 - RNA, 19 nt, Homo sapiens
gaaaggaaggugcugucaa

SEQ ID NO: 1027182 - RNA, 19 nt, Homo sapiens
guacaugccuagccuacag

SEQ ID NO: 1027183 - RNA, 19 nt, Homo sapiens
ggccagaggaaucaguuua

SEQ ID NO: 1027184 - RNA, 19 nt, Homo sapiens
uacccaagguuaucuguga

SEQ ID NO: 1027185 - RNA, 19 nt, Homo sapiens
uaaacagcggaaaguauua

SEQ ID NO: 1027186 - RNA, 19 nt, Homo sapiens
caaccgugcuucugagaua

SEQ ID NO: 1027187 - RNA, 19 nt, Homo sapiens
gagaaugccuggacuguuc

SEQ ID NO: 1027188 - RNA, 19 nt, Homo sapiens
gcaacagaagcuauuauua

SEQ ID NO: 1027189 - RNA, 19 nt, Homo sapiens
ggauauaauuucccucuuc

SEQ ID NO: 1027190 - RNA, 19 nt, Homo sapiens
gguuaaggaugauagaauu

SEQ ID NO: 1027191 - RNA, 19 nt, Homo sapiens
gucacaagcuuauugaauu

SEQ ID NO: 1027192 - RNA, 19 nt, Homo sapiens
uaauuucccucuucugauu

SEQ ID NO: 1027193 - RNA, 19 nt, Homo sapiens
ggaguucaaugaggacuuu

SEQ ID NO: 1027194 - RNA, 19 nt, Homo sapiens
gcagaaagaauuccuguuc

SEQ ID NO: 1027195 - RNA, 19 nt, Homo sapiens
guacaggaauuaccagauc

SEQ ID NO: 1027196 - RNA, 19 nt, Homo sapiens
uaugcacucuaccaaauua

SEQ ID NO: 1027197 - RNA, 19 nt, Homo sapiens
gaagaagacaagacaaugu

SEQ ID NO: 1027198 - RNA, 19 nt, Homo sapiens
ucacaagcuuauugaauug

SEQ ID NO: 1027199 - RNA, 19 nt, Homo sapiens
ggauauggcuucguguuca

SEQ ID NO: 1027200 - RNA, 19 nt, Homo sapiens
gggaagagauagaauucau

SEQ ID NO: 1027201 - RNA, 19 nt, Homo sapiens
cugcauaugcuucuaaaua

SEQ ID NO: 1027202 - RNA, 19 nt, Homo sapiens
aaacuaagcaccaggaaga

SEQ ID NO: 1027203 - RNA, 19 nt, Homo sapiens
ucaguucuuugcuugguua

SEQ ID NO: 1027204 - RNA, 19 nt, Homo sapiens
gcaauacggcucgcuauau

SEQ ID NO: 1027205 - RNA, 19 nt, Homo sapiens
gaaaccggcaguuacacua

SEQ ID NO: 1027206 - RNA, 19 nt, Homo sapiens
uuaaagagaugaugcaacu

SEQ ID NO: 1027207 - RNA, 19 nt, Homo sapiens
aagguaaacuuucguaauc

SEQ ID NO: 1027208 - RNA, 19 nt, Homo sapiens
gcacagaggagagugaaga

SEQ ID NO: 1027209 - RNA, 19 nt, Homo sapiens
gaggcguguuagucaauua

SEQ ID NO: 1027210 - RNA, 19 nt, Homo sapiens
cgaggugaauguggauaua

SEQ ID NO: 1027211 - RNA, 19 nt, Homo sapiens
acaggaagaugugaacaaa

SEQ ID NO: 1027212 - RNA, 19 nt, Homo sapiens
ggaauuaccagaucgucuu

SEQ ID NO: 1027213 - RNA, 19 nt, Homo sapiens
uuaaaugggcuuugagaaa

SEQ ID NO: 1027214 - RNA, 19 nt, Homo sapiens
gauauaauuucccucuucu

SEQ ID NO: 1027215 - RNA, 19 nt, Homo sapiens
guaaguggagggaaugaaa

SEQ ID NO: 1027216 - RNA, 19 nt, Homo sapiens
ggagcuacaguacauauug

SEQ ID NO: 1027217 - RNA, 19 nt, Homo sapiens
gcacugcauaugcuucuaa

SEQ ID NO: 1027218 - RNA, 19 nt, Homo sapiens
gaauuggcauggccugcuu

SEQ ID NO: 1027219 - RNA, 19 nt, Homo sapiens
gcguguuagucaauuauuu

SEQ ID NO: 1027220 - RNA, 19 nt, Homo sapiens
gagacaaccgugcuucuga

SEQ ID NO: 1027221 - RNA, 19 nt, Homo sapiens
ggaagaagacaagacaaug

SEQ ID NO: 1027222 - RNA, 19 nt, Homo sapiens
gaacuacaacccucuuugg

SEQ ID NO: 1027223 - RNA, 19 nt, Homo sapiens
uaaaugggcuuugagaaaa

SEQ ID NO: 1027224 - RNA, 19 nt, Homo sapiens
gggcagcaugcauuucuua

SEQ ID NO: 1027225 - RNA, 19 nt, Homo sapiens
caucaggguucuguacauu

SEQ ID NO: 1027226 - RNA, 19 nt, Homo sapiens
cuaaguaaguggagggaau

SEQ ID NO: 1027227 - RNA, 19 nt, Homo sapiens
caugaucggaggcguguua

SEQ ID NO: 1027228 - RNA, 19 nt, Homo sapiens
gaaaggaacaacucuacag

SEQ ID NO: 1027229 - RNA, 19 nt, Homo sapiens
ggaaauggaguucaaugag

SEQ ID NO: 1027230 - RNA, 19 nt, Homo sapiens
gggaaauggaguucaauga

SEQ ID NO: 1027231 - RNA, 19 nt, Homo sapiens
ggaagaacaggaagaugug

SEQ ID NO: 1027232 - RNA, 19 nt, Homo sapiens
ucaaugaggacuuucaguu

SEQ ID NO: 1027233 - RNA, 19 nt, Homo sapiens
cuucugagauacagccuuu

SEQ ID NO: 1027234 - RNA, 19 nt, Homo sapiens
ugaugcaacucacaagaga

SEQ ID NO: 1027235 - RNA, 19 nt, Homo sapiens
cgacuacacccacaucgaa

SEQ ID NO: 1027236 - RNA, 19 nt, Homo sapiens
uugguuagguuaaggauga

SEQ ID NO: 1027237 - RNA, 19 nt, Homo sapiens
cacaggagcuacaguacau

SEQ ID NO: 1027238 - RNA, 19 nt, Homo sapiens
ggaggcguguuagucaauu

SEQ ID NO: 1027239 - RNA, 19 nt, Homo sapiens
auacggcucgcuauauuua

SEQ ID NO: 1027240 - RNA, 19 nt, Homo sapiens
uauaauuucccucuucuga

SEQ ID NO: 1027241 - RNA, 19 nt, Homo sapiens
gaguugaaaccggcaguua

SEQ ID NO: 1027242 - RNA, 19 nt, Homo sapiens
gagcuacaguacauauugg

SEQ ID NO: 1027243 - RNA, 19 nt, Homo sapiens
ucuaugcacucuaccaaau

SEQ ID NO: 1027244 - RNA, 19 nt, Homo sapiens
gaauguggauauaauuucc

SEQ ID NO: 1027245 - RNA, 19 nt, Homo sapiens
ggagggaaugaaaguguuu

SEQ ID NO: 1027246 - RNA, 19 nt, Homo sapiens
acacacaggagcuacagua

SEQ ID NO: 1027247 - RNA, 19 nt, Homo sapiens
gagcacagcacugcauaug

SEQ ID NO: 1027248 - RNA, 19 nt, Homo sapiens
ggaacuacaacccucuuug

SEQ ID NO: 1027249 - RNA, 19 nt, Homo sapiens
gaccauggccuugaucguu

SEQ ID NO: 1027250 - RNA, 19 nt, Homo sapiens
ucccucuucugauuauuua

SEQ ID NO: 1027251 - RNA, 19 nt, Homo sapiens
ucauuaacauggaaacaca

SEQ ID NO: 1027252 - RNA, 19 nt, Homo sapiens
acagggaaauggaguucaa

SEQ ID NO: 1027253 - RNA, 19 nt, Homo sapiens
ggaauuacaacagggaaau

SEQ ID NO: 1027254 - RNA, 19 nt, Homo sapiens
gaagugcucaucgauggaa

SEQ ID NO: 1027255 - RNA, 19 nt, Homo sapiens
gaagaccucaauggaacua

SEQ ID NO: 1027256 - RNA, 19 nt, Homo sapiens
gcaccaggaagaacaggaa

SEQ ID NO: 1027257 - RNA, 19 nt, Homo sapiens
gagcaacagaagcuauuau

SEQ ID NO: 1027258 - RNA, 19 nt, Homo sapiens
gaggugaauguggauauaa

SEQ ID NO: 1027259 - RNA, 19 nt, Homo sapiens
caaugaggacuuucaguuc

SEQ ID NO: 1027260 - RNA, 19 nt, Homo sapiens
gagaugaugcaacucacaa

SEQ ID NO: 1027261 - RNA, 19 nt, Homo sapiens
gaagaacaggaagauguga

SEQ ID NO: 1027262 - RNA, 19 nt, Homo sapiens
aaagagaugaugcaacuca

SEQ ID NO: 1027263 - RNA, 19 nt, Homo sapiens
guucauggguuuuggauau

SEQ ID NO: 1027264 - RNA, 19 nt, Homo sapiens
uggcuugguucauggguuu

SEQ ID NO: 1027265 - RNA, 19 nt, Homo sapiens
ggaaaggaacaacucuaca

SEQ ID NO: 1027266 - RNA, 19 nt, Homo sapiens
cacaaacugggaagagaua

SEQ ID NO: 1027267 - RNA, 19 nt, Homo sapiens
ugaggacuuucaguucuuu

SEQ ID NO: 1027268 - RNA, 19 nt, Homo sapiens
gguaaacuuucguaaucuc

SEQ ID NO: 1027269 - RNA, 19 nt, Homo sapiens
gaugaugcaacucacaaga

SEQ ID NO: 1027270 - RNA, 19 nt, Homo sapiens
gaucguugccacucaguuc

SEQ ID NO: 1027271 - RNA, 19 nt, Homo sapiens
ggagaaugccuggacuguu

SEQ ID NO: 1027272 - RNA, 19 nt, Homo sapiens
ggugaauguggauauaauu

SEQ ID NO: 1027273 - RNA, 19 nt, Homo sapiens
caguacauauuggcagaaa

SEQ ID NO: 1027274 - RNA, 19 nt, Homo sapiens
cuaccaaauuaaagagaug

SEQ ID NO: 1027275 - RNA, 19 nt, Homo sapiens
caucugggcagcaugcauu

SEQ ID NO: 1027276 - RNA, 19 nt, Homo sapiens
uaacauggaaacacacaca

SEQ ID NO: 1027277 - RNA, 19 nt, Homo sapiens
cuaaacucauuaacaugga

SEQ ID NO: 1027278 - RNA, 19 nt, Homo sapiens
cgaugauucuaaagggaaa

SEQ ID NO: 1027279 - RNA, 19 nt, Homo sapiens
gaucggaggcguguuaguc

SEQ ID NO: 1027280 - RNA, 19 nt, Homo sapiens
ggaagagauagaauucauc

SEQ ID NO: 1027281 - RNA, 19 nt, Homo sapiens
ggagaucccgcagguggaa

SEQ ID NO: 1027282 - RNA, 19 nt, Homo sapiens
gcacucuaccaaauuaaag

SEQ ID NO: 1027283 - RNA, 19 nt, Homo sapiens
gacaauguuggcagaaaga

SEQ ID NO: 1027284 - RNA, 19 nt, Homo sapiens
gcauuuggaagaccucaau

SEQ ID NO: 1027285 - RNA, 19 nt, Homo sapiens
gacuuucaguucuuugcuu

SEQ ID NO: 1027286 - RNA, 19 nt, Homo sapiens
ggacaaauauccucacuuu

SEQ ID NO: 1027287 - RNA, 19 nt, Homo sapiens
gaaacuagcucuccaguau

SEQ ID NO: 1027288 - RNA, 19 nt, Homo sapiens
aaacagaggugaaaugaaa

SEQ ID NO: 1027289 - RNA, 19 nt, Homo sapiens
ucaaggagaugaaccaaua

SEQ ID NO: 1027290 - RNA, 19 nt, Homo sapiens
gacaagagcuguagggaaa

SEQ ID NO: 1027291 - RNA, 19 nt, Homo sapiens
aaacaaaccuacucuaaga

SEQ ID NO: 1027292 - RNA, 19 nt, Homo sapiens
aaacaagccucaaauguau

SEQ ID NO: 1027293 - RNA, 19 nt, Homo sapiens
gcagaaagauacucaaagu

SEQ ID NO: 1027294 - RNA, 19 nt, Homo sapiens
ucagugagguaucuaaaua

SEQ ID NO: 1027295 - RNA, 19 nt, Homo sapiens
gagaugaaccaauaaagua

SEQ ID NO: 1027296 - RNA, 19 nt, Homo sapiens
gaauguaaguugcucaguu

SEQ ID NO: 1027297 - RNA, 19 nt, Homo sapiens
caaauauccucacuuucua

SEQ ID NO: 1027298 - RNA, 19 nt, Homo sapiens
gcaugugcuucuuugauua

SEQ ID NO: 1027299 - RNA, 19 nt, Homo sapiens
cuaguucucucucuauaua

SEQ ID NO: 1027300 - RNA, 19 nt, Homo sapiens
cugaguagguggacaaaua

SEQ ID NO: 1027301 - RNA, 19 nt, Homo sapiens
gaaaugcugcuguuuaguu

SEQ ID NO: 1027302 - RNA, 19 nt, Homo sapiens
gaaagcagcauaagaguag

SEQ ID NO: 1027303 - RNA, 19 nt, Homo sapiens
gcaagucuguuccagcauu

SEQ ID NO: 1027304 - RNA, 19 nt, Homo sapiens
cccaagggauuuaaauaua

SEQ ID NO: 1027305 - RNA, 19 nt, Homo sapiens
gguggaaucugaucuugaa

SEQ ID NO: 1027306 - RNA, 19 nt, Homo sapiens
aauguaaguugcucaguua

SEQ ID NO: 1027307 - RNA, 19 nt, Homo sapiens
ggacugaaguggacuggau

SEQ ID NO: 1027308 - RNA, 19 nt, Homo sapiens
gcagugugaugaguguuua

SEQ ID NO: 1027309 - RNA, 19 nt, Homo sapiens
gcauaagaguagucacaaa

SEQ ID NO: 1027310 - RNA, 19 nt, Homo sapiens
gcaaugagacugaaacuac

SEQ ID NO: 1027311 - RNA, 19 nt, Homo sapiens
cagcauuucuccaagauga

SEQ ID NO: 1027312 - RNA, 19 nt, Homo sapiens
ggacuacucugccuuuaac

SEQ ID NO: 1027313 - RNA, 19 nt, Homo sapiens
gcaguguguuagugauaua

SEQ ID NO: 1027314 - RNA, 19 nt, Homo sapiens
cuaaaccgguggaaucuga

SEQ ID NO: 1027315 - RNA, 19 nt, Homo sapiens
gggagaagaugguaaacuc

SEQ ID NO: 1027316 - RNA, 19 nt, Homo sapiens
cuaaaccaauucacacuga

SEQ ID NO: 1027317 - RNA, 19 nt, Homo sapiens
cuaaacaaaccuacucuaa

SEQ ID NO: 1027318 - RNA, 19 nt, Homo sapiens
guaaguugcucaguuauac

SEQ ID NO: 1027319 - RNA, 19 nt, Homo sapiens
caaaugagcccaaauucca

SEQ ID NO: 1027320 - RNA, 19 nt, Homo sapiens
gaugacagagaaacagaua

SEQ ID NO: 1027321 - RNA, 19 nt, Homo sapiens
cugaagcucuguugugaaa

SEQ ID NO: 1027322 - RNA, 19 nt, Homo sapiens
cugggaccauuacaaauua

SEQ ID NO: 1027323 - RNA, 19 nt, Homo sapiens
agaaacagauacagcauca

SEQ ID NO: 1027324 - RNA, 19 nt, Homo sapiens
gggauaacaaacagaauaa

SEQ ID NO: 1027325 - RNA, 19 nt, Homo sapiens
gaacuugauuuggaaacau

SEQ ID NO: 1027326 - RNA, 19 nt, Homo sapiens
ggaaauauucaguuugcaa

SEQ ID NO: 1027327 - RNA, 19 nt, Homo sapiens
ggagaugaaccaauaaagu

SEQ ID NO: 1027328 - RNA, 19 nt, Homo sapiens
ggacugggauaacaaacag

SEQ ID NO: 1027329 - RNA, 19 nt, Homo sapiens
cauuuaagcgcaauaguuu

SEQ ID NO: 1027330 - RNA, 19 nt, Homo sapiens
aaaugcugcuguuuaguuu

SEQ ID NO: 1027331 - RNA, 19 nt, Homo sapiens
uauccucacuuucuaucua

SEQ ID NO: 1027332 - RNA, 19 nt, Homo sapiens
gaaauugaaccuguccauu

SEQ ID NO: 1027333 - RNA, 19 nt, Homo sapiens
gauggaagccuguguagag

SEQ ID NO: 1027334 - RNA, 19 nt, Homo sapiens
cugaaggaguugcauguuu

SEQ ID NO: 1027335 - RNA, 19 nt, Homo sapiens
ucaacaaccagaacaguuu

SEQ ID NO: 1027336 - RNA, 19 nt, Homo sapiens
gguggaacuugauuuggaa

SEQ ID NO: 1027337 - RNA, 19 nt, Homo sapiens
ggagguggaacuugauuug

SEQ ID NO: 1027338 - RNA, 19 nt, Homo sapiens
uguaaaggccuauuugcua

SEQ ID NO: 1027339 - RNA, 19 nt, Homo sapiens
ugagagugaugacagagaa

SEQ ID NO: 1027340 - RNA, 19 nt, Homo sapiens
caagucuguuccagcauuu

SEQ ID NO: 1027341 - RNA, 19 nt, Homo sapiens
gaagcaaaauguucuuguu

SEQ ID NO: 1027342 - RNA, 19 nt, Homo sapiens
acaaauauccucacuuucu

SEQ ID NO: 1027343 - RNA, 19 nt, Homo sapiens
gugcagcuccaguucaaua

SEQ ID NO: 1027344 - RNA, 19 nt, Homo sapiens
ugacuguccagaugaaaua

SEQ ID NO: 1027345 - RNA, 19 nt, Homo sapiens
gaagcaacacugccucuca

SEQ ID NO: 1027346 - RNA, 19 nt, Homo sapiens
ggaacuugauuuggaaaca

SEQ ID NO: 1027347 - RNA, 19 nt, Homo sapiens
aauugaaccuguccauuug

SEQ ID NO: 1027348 - RNA, 19 nt, Homo sapiens
ccuugaauccuguguauaa

SEQ ID NO: 1027349 - RNA, 19 nt, Homo sapiens
guucagacccauauguaaa

SEQ ID NO: 1027350 - RNA, 19 nt, Homo sapiens
gcccaagggauuuaaauau

SEQ ID NO: 1027351 - RNA, 19 nt, Homo sapiens
uuacaaggcccaagggauu

SEQ ID NO: 1027352 - RNA, 19 nt, Homo sapiens
caacacugccucucagaau

SEQ ID NO: 1027353 - RNA, 19 nt, Homo sapiens
ggaaugccuugaucuacca

SEQ ID NO: 1027354 - RNA, 19 nt, Homo sapiens
aaacagauacagcaucaga

SEQ ID NO: 1027355 - RNA, 19 nt, Homo sapiens
uggaaaugcugcuguuuag

SEQ ID NO: 1027356 - RNA, 19 nt, Homo sapiens
ugaaagcagcauaagagua

SEQ ID NO: 1027357 - RNA, 19 nt, Homo sapiens
gaaaacagaggugaaauga

SEQ ID NO: 1027358 - RNA, 19 nt, Homo sapiens
ggaagucaucuaaauucuu

SEQ ID NO: 1027359 - RNA, 19 nt, Homo sapiens
cuaagacacucaacaacca

SEQ ID NO: 1027360 - RNA, 19 nt, Homo sapiens
uaagaguagucacaaacau

SEQ ID NO: 1027361 - RNA, 19 nt, Homo sapiens
gaaucagugagguaucuaa

SEQ ID NO: 1027362 - RNA, 19 nt, Homo sapiens
aaacaugggacugggauaa

SEQ ID NO: 1027363 - RNA, 19 nt, Homo sapiens
gaauauguggagucacuga

SEQ ID NO: 1027364 - RNA, 19 nt, Homo sapiens
cuacucugccuuuaacuuu

SEQ ID NO: 1027365 - RNA, 19 nt, Homo sapiens
ggaauacuacacagcaugu

SEQ ID NO: 1027366 - RNA, 19 nt, Homo sapiens
gggaagucaucuaaauucu

SEQ ID NO: 1027367 - RNA, 19 nt, Homo sapiens
uggagucacugaaggaguu

SEQ ID NO: 1027368 - RNA, 19 nt, Homo sapiens
aaauggaaaugcugcuguu

SEQ ID NO: 1027369 - RNA, 19 nt, Homo sapiens
aaaacaagccucaaaugua

SEQ ID NO: 1027370 - RNA, 19 nt, Homo sapiens
ggcccaagggauuuaaaua

SEQ ID NO: 1027371 - RNA, 19 nt, Homo sapiens
ugcaugugcuucuuugauu

SEQ ID NO: 1027372 - RNA, 19 nt, Homo sapiens
ccaccaacccuaucuucaa

SEQ ID NO: 1027373 - RNA, 19 nt, Homo sapiens
uaacuuugccuugggauau

SEQ ID NO: 1027374 - RNA, 19 nt, Homo sapiens
uaaacaaaccuacucuaag

SEQ ID NO: 1027375 - RNA, 19 nt, Homo sapiens
ugaaggaguugcauguuuu

SEQ ID NO: 1027376 - RNA, 19 nt, Homo sapiens
guauuugguucaacuccuu

SEQ ID NO: 1027377 - RNA, 19 nt, Homo sapiens
gacugaaacuacugguguu

SEQ ID NO: 1027378 - RNA, 19 nt, Homo sapiens
ggaccuuaagaaacuauuu

SEQ ID NO: 1027379 - RNA, 19 nt, Homo sapiens
cuacuaaaccgguggaauc

SEQ ID NO: 1027380 - RNA, 19 nt, Homo sapiens
gcaacacugccucucagaa

SEQ ID NO: 1027381 - RNA, 19 nt, Homo sapiens
ugggauaacaaacagaaua

SEQ ID NO: 1027382 - RNA, 19 nt, Homo sapiens
gaaacaugggacugggaua

SEQ ID NO: 1027383 - RNA, 19 nt, Homo sapiens
guaauccucaugcucacua

SEQ ID NO: 1027384 - RNA, 19 nt, Homo sapiens
gaacaagcuaggaaaauug

SEQ ID NO: 1027385 - RNA, 19 nt, Homo sapiens
ggaaucugaucuugaaaau

SEQ ID NO: 1027386 - RNA, 19 nt, Homo sapiens
ggacaaauauccucacuuu

SEQ ID NO: 1027387 - RNA, 19 nt, Homo sapiens
gaaacuagcucuccaguau

SEQ ID NO: 1027388 - RNA, 19 nt, Homo sapiens
aaacagaggugaaaugaaa

SEQ ID NO: 1027389 - RNA, 19 nt, Homo sapiens
gacaagagcuguagggaaa

SEQ ID NO: 1027390 - RNA, 19 nt, Homo sapiens
uggaagaacugguuuauuu

SEQ ID NO: 1027391 - RNA, 19 nt, Homo sapiens
gaagacauuucaucagauu

SEQ ID NO: 1027392 - RNA, 19 nt, Homo sapiens
gagaauaaacugugucuaa

SEQ ID NO: 1027393 - RNA, 19 nt, Homo sapiens
aaacaagccucaaauguau

SEQ ID NO: 1027394 - RNA, 19 nt, Homo sapiens
gcagaaagauacucaaagu

SEQ ID NO: 1027395 - RNA, 19 nt, Homo sapiens
ggaagaauccguuuaauag

SEQ ID NO: 1027396 - RNA, 19 nt, Homo sapiens
gaagagagagucagacauu

SEQ ID NO: 1027397 - RNA, 19 nt, Homo sapiens
gcagauacuucaauccaaa

SEQ ID NO: 1027398 - RNA, 19 nt, Homo sapiens
gaauguaaguugcucaguu

SEQ ID NO: 1027399 - RNA, 19 nt, Homo sapiens
cagaaacccuucguuauaa

SEQ ID NO: 1027400 - RNA, 19 nt, Homo sapiens
caaauauccucacuuucua

SEQ ID NO: 1027401 - RNA, 19 nt, Homo sapiens
gaagaacccaguccuguuu

SEQ ID NO: 1027402 - RNA, 19 nt, Homo sapiens
cagaagaguuucagaguga

SEQ ID NO: 1027403 - RNA, 19 nt, Homo sapiens
gcaugugcuucuuugauua

SEQ ID NO: 1027404 - RNA, 19 nt, Homo sapiens
ucaaugaacccaaagauaa

SEQ ID NO: 1027405 - RNA, 19 nt, Homo sapiens
guaggagaauuuaguguuu

SEQ ID NO: 1027406 - RNA, 19 nt, Homo sapiens
ucagaaacccuucguuaua

SEQ ID NO: 1027407 - RNA, 19 nt, Homo sapiens
cugaguagguggacaaaua

SEQ ID NO: 1027408 - RNA, 19 nt, Homo sapiens
gaauacagcauccuucuga

SEQ ID NO: 1027409 - RNA, 19 nt, Homo sapiens
gaaagcagcauaagaguag

SEQ ID NO: 1027410 - RNA, 19 nt, Homo sapiens
gcaagucuguuccagcauu

SEQ ID NO: 1027411 - RNA, 19 nt, Homo sapiens
cccaagggauuuaaauaua

SEQ ID NO: 1027412 - RNA, 19 nt, Homo sapiens
gaaaaugccuuccaaaagu

SEQ ID NO: 1027413 - RNA, 19 nt, Homo sapiens
gaacugaacaagauauuuc

SEQ ID NO: 1027414 - RNA, 19 nt, Homo sapiens
gguggaaucugaucuugaa

SEQ ID NO: 1027415 - RNA, 19 nt, Homo sapiens
aaggaaagcugggugaaua

SEQ ID NO: 1027416 - RNA, 19 nt, Homo sapiens
aauguaaguugcucaguua

SEQ ID NO: 1027417 - RNA, 19 nt, Homo sapiens
ggacugaaguggacuggau

SEQ ID NO: 1027418 - RNA, 19 nt, Homo sapiens
gagcaucuaugagaaagaa

SEQ ID NO: 1027419 - RNA, 19 nt, Homo sapiens
gaacaagaggccaucauga

SEQ ID NO: 1027420 - RNA, 19 nt, Homo sapiens
uagaagacauuucaucaga

SEQ ID NO: 1027421 - RNA, 19 nt, Homo sapiens
gcagugugaugaguguuua

SEQ ID NO: 1027422 - RNA, 19 nt, Homo sapiens
gaauaugaguggccaaugg

SEQ ID NO: 1027423 - RNA, 19 nt, Homo sapiens
gaaggucacucaucacaac

SEQ ID NO: 1027424 - RNA, 19 nt, Homo sapiens
gcauaagaguagucacaaa

SEQ ID NO: 1027425 - RNA, 19 nt, Homo sapiens
gcaaugagacugaaacuac

SEQ ID NO: 1027426 - RNA, 19 nt, Homo sapiens
cagcauuucuccaagauga

SEQ ID NO: 1027427 - RNA, 19 nt, Homo sapiens
gaagagggccgaagaagag

SEQ ID NO: 1027428 - RNA, 19 nt, Homo sapiens
ccacauuuguugcuauuau

SEQ ID NO: 1027429 - RNA, 19 nt, Homo sapiens
cagaagcccugcugaugaa

SEQ ID NO: 1027430 - RNA, 19 nt, Homo sapiens
gcacuuaggaucuugcuau

SEQ ID NO: 1027431 - RNA, 19 nt, Homo sapiens
cuaaaccgguggaaucuga

SEQ ID NO: 1027432 - RNA, 19 nt, Homo sapiens
ucagcaagguucagaagaa

SEQ ID NO: 1027433 - RNA, 19 nt, Homo sapiens
caucagagcaucuaugaga

SEQ ID NO: 1027434 - RNA, 19 nt, Homo sapiens
gaauaaacugugucuaaga

SEQ ID NO: 1027435 - RNA, 19 nt, Homo sapiens
gaagaacugguuuauuuca

SEQ ID NO: 1027436 - RNA, 19 nt, Homo sapiens
gcuaucagcugcccuaaac

SEQ ID NO: 1027437 - RNA, 19 nt, Homo sapiens
gggagaagaugguaaacuc

SEQ ID NO: 1027438 - RNA, 19 nt, Homo sapiens
gccagaaggucacucauca

SEQ ID NO: 1027439 - RNA, 19 nt, Homo sapiens
gaaugcguaccaagaauuu

SEQ ID NO: 1027440 - RNA, 19 nt, Homo sapiens
gaagccaguuacaaaugaa

SEQ ID NO: 1027441 - RNA, 19 nt, Homo sapiens
ggaaguaggagaauuuagu

SEQ ID NO: 1027442 - RNA, 19 nt, Homo sapiens
ggugaauaaugucaacaaa

SEQ ID NO: 1027443 - RNA, 19 nt, Homo sapiens
guaaguugcucaguuauac

SEQ ID NO: 1027444 - RNA, 19 nt, Homo sapiens
caaaugagcccaaauucca

SEQ ID NO: 1027445 - RNA, 19 nt, Homo sapiens
cugggaccauuacaaauua

SEQ ID NO: 1027446 - RNA, 19 nt, Homo sapiens
gacgacaggugcagagaga

SEQ ID NO: 1027447 - RNA, 19 nt, Homo sapiens
gggauaacaaacagaauaa

SEQ ID NO: 1027448 - RNA, 19 nt, Homo sapiens
gaacuugauuuggaaacau

SEQ ID NO: 1027449 - RNA, 19 nt, Homo sapiens
ggaaauauucaguuugcaa

SEQ ID NO: 1027450 - RNA, 19 nt, Homo sapiens
gagagagaauaaacugugu

SEQ ID NO: 1027451 - RNA, 19 nt, Homo sapiens
gaggaugaauugucagagu

SEQ ID NO: 1027452 - RNA, 19 nt, Homo sapiens
gauagcagcugagcagagu

SEQ ID NO: 1027453 - RNA, 19 nt, Homo sapiens
ggacugggauaacaaacag

SEQ ID NO: 1027454 - RNA, 19 nt, Homo sapiens
cauuuaagcgcaauaguuu

SEQ ID NO: 1027455 - RNA, 19 nt, Homo sapiens
agaagccaguuacaaauga

SEQ ID NO: 1027456 - RNA, 19 nt, Homo sapiens
caaugaacccaaagauaaa

SEQ ID NO: 1027457 - RNA, 19 nt, Homo sapiens
cauuaaagcaugugagauu

SEQ ID NO: 1027458 - RNA, 19 nt, Homo sapiens
uauccucacuuucuaucua

SEQ ID NO: 1027459 - RNA, 19 nt, Homo sapiens
gaaauugaaccuguccauu

SEQ ID NO: 1027460 - RNA, 19 nt, Homo sapiens
gcaagguucagaagaagaa

SEQ ID NO: 1027461 - RNA, 19 nt, Homo sapiens
gaagaggaagaauccguuu

SEQ ID NO: 1027462 - RNA, 19 nt, Homo sapiens
uagaagagccagaagaaga

SEQ ID NO: 1027463 - RNA, 19 nt, Homo sapiens
gauggaagccuguguagag

SEQ ID NO: 1027464 - RNA, 19 nt, Homo sapiens
cugaaggaguugcauguuu

SEQ ID NO: 1027465 - RNA, 19 nt, Homo sapiens
gaaagagcacuuaggaucu

SEQ ID NO: 1027466 - RNA, 19 nt, Homo sapiens
aaagcugggugaauaaugu

SEQ ID NO: 1027467 - RNA, 19 nt, Homo sapiens
aaauggaccuuaagaaacu

SEQ ID NO: 1027468 - RNA, 19 nt, Homo sapiens
gguggaacuugauuuggaa

SEQ ID NO: 1027469 - RNA, 19 nt, Homo sapiens
ggagguggaacuugauuug

SEQ ID NO: 1027470 - RNA, 19 nt, Homo sapiens
uguaaaggccuauuugcua

SEQ ID NO: 1027471 - RNA, 19 nt, Homo sapiens
caagucuguuccagcauuu

SEQ ID NO: 1027472 - RNA, 19 nt, Homo sapiens
ccagaagcccugcugauga

SEQ ID NO: 1027473 - RNA, 19 nt, Homo sapiens
ggaagaacugguuuauuuc

SEQ ID NO: 1027474 - RNA, 19 nt, Homo sapiens
gcagauaucaucagagcau

SEQ ID NO: 1027475 - RNA, 19 nt, Homo sapiens
ggaacaagaggccaucaug

SEQ ID NO: 1027476 - RNA, 19 nt, Homo sapiens
gaagcaaaauguucuuguu

SEQ ID NO: 1027477 - RNA, 19 nt, Homo sapiens
acaaauauccucacuuucu

SEQ ID NO: 1027478 - RNA, 19 nt, Homo sapiens
gaucagaagccaguuacaa

SEQ ID NO: 1027479 - RNA, 19 nt, Homo sapiens
ugaacugucucauuguguu

SEQ ID NO: 1027480 - RNA, 19 nt, Homo sapiens
gaaguaggagaauuuagug

SEQ ID NO: 1027481 - RNA, 19 nt, Homo sapiens
ggucacucaucacaacaaa

SEQ ID NO: 1027482 - RNA, 19 nt, Homo sapiens
agagcuggcuggcguugua

SEQ ID NO: 1027483 - RNA, 19 nt, Homo sapiens
gcagagagagaauaaacug

SEQ ID NO: 1027484 - RNA, 19 nt, Homo sapiens
gaagcaacacugccucuca

SEQ ID NO: 1027485 - RNA, 19 nt, Homo sapiens
ggaacuugauuuggaaaca

SEQ ID NO: 1027486 - RNA, 19 nt, Homo sapiens
gaaaugugauuccuacuaa

SEQ ID NO: 1027487 - RNA, 19 nt, Homo sapiens
gaagagagacuauguggua

SEQ ID NO: 1027488 - RNA, 19 nt, Homo sapiens
gaacaaaugucaagaaggu

SEQ ID NO: 1027489 - RNA, 19 nt, Homo sapiens
guacugaccuucugaguug

SEQ ID NO: 1027490 - RNA, 19 nt, Homo sapiens
ggaagagccugcaauugaa

SEQ ID NO: 1027491 - RNA, 19 nt, Homo sapiens
caaggcagaugaacucuuu

SEQ ID NO: 1027492 - RNA, 19 nt, Homo sapiens
gaagguagcacucauaaau

SEQ ID NO: 1027493 - RNA, 19 nt, Homo sapiens
ggucaaaucucaccuucuu

SEQ ID NO: 1027494 - RNA, 19 nt, Homo sapiens
gaaaccagaucuccaguca

SEQ ID NO: 1027495 - RNA, 19 nt, Homo sapiens
ccuuaaggcuuucuaauuu

SEQ ID NO: 1027496 - RNA, 19 nt, Homo sapiens
gaggcaggaugauugcuua

SEQ ID NO: 1027497 - RNA, 19 nt, Homo sapiens
cagaggaccuucaggauau

SEQ ID NO: 1027498 - RNA, 19 nt, Homo sapiens
cuacccagcugguuaauau

SEQ ID NO: 1027499 - RNA, 19 nt, Homo sapiens
gaagagguuucaggcagua

SEQ ID NO: 1027500 - RNA, 19 nt, Homo sapiens
ccaggaaaguuaacaucua

SEQ ID NO: 1027501 - RNA, 19 nt, Homo sapiens
guacauagcccagacagaa

SEQ ID NO: 1027502 - RNA, 19 nt, Homo sapiens
guucuucccuagauuaauu

SEQ ID NO: 1027503 - RNA, 19 nt, Homo sapiens
gugcucaucuuacuuguga

SEQ ID NO: 1027504 - RNA, 19 nt, Homo sapiens
caaauggaguacuuguauu

SEQ ID NO: 1027505 - RNA, 19 nt, Homo sapiens
ggaaugggcuaaguacagu

SEQ ID NO: 1027506 - RNA, 19 nt, Homo sapiens
guucaugccugcacauuag

SEQ ID NO: 1027507 - RNA, 19 nt, Homo sapiens
uggaagagccugcaauuga

SEQ ID NO: 1027508 - RNA, 19 nt, Homo sapiens
ggacauagaauacucaaaa

SEQ ID NO: 1027509 - RNA, 19 nt, Homo sapiens
caagaagguagcacucaua

SEQ ID NO: 1027510 - RNA, 19 nt, Homo sapiens
gagagguucuucccuagau

SEQ ID NO: 1027511 - RNA, 19 nt, Homo sapiens
gaagcguccaggaaaguua

SEQ ID NO: 1027512 - RNA, 19 nt, Homo sapiens
gguuaaucuucaugacuua

SEQ ID NO: 1027513 - RNA, 19 nt, Homo sapiens
uggaucagguuaaauguga

SEQ ID NO: 1027514 - RNA, 19 nt, Homo sapiens
ccucuucacuuuaccagaa

SEQ ID NO: 1027515 - RNA, 19 nt, Homo sapiens
gaagagccugcaauugaaa

SEQ ID NO: 1027516 - RNA, 19 nt, Homo sapiens
gagguucuucccuagauua

SEQ ID NO: 1027517 - RNA, 19 nt, Homo sapiens
uagaacaauuggccauauu

SEQ ID NO: 1027518 - RNA, 19 nt, Homo sapiens
ucugaagugugaauuugua

SEQ ID NO: 1027519 - RNA, 19 nt, Homo sapiens
gaugaacucuuuucuacuu

SEQ ID NO: 1027520 - RNA, 19 nt, Homo sapiens
acaguaccuuucugaagua

SEQ ID NO: 1027521 - RNA, 19 nt, Homo sapiens
gguuaaaugugacuaaugc

SEQ ID NO: 1027522 - RNA, 19 nt, Homo sapiens
gaagaaccgaggugagaga

SEQ ID NO: 1027523 - RNA, 19 nt, Homo sapiens
guagcacucauaaaucuaa

SEQ ID NO: 1027524 - RNA, 19 nt, Homo sapiens
caagagagaaggugaugug

SEQ ID NO: 1027525 - RNA, 19 nt, Homo sapiens
gaagaagagagacuaugug

SEQ ID NO: 1027526 - RNA, 19 nt, Homo sapiens
agaacuaggugaugaagca

SEQ ID NO: 1027527 - RNA, 19 nt, Homo sapiens
uaacaaggcagaugaacuc

SEQ ID NO: 1027528 - RNA, 19 nt, Homo sapiens
acagaggaccuucaggaua

SEQ ID NO: 1027529 - RNA, 19 nt, Homo sapiens
gaugaagcauuugauugug

SEQ ID NO: 1027530 - RNA, 19 nt, Homo sapiens
aaacugauccacuccuuug

SEQ ID NO: 1027531 - RNA, 19 nt, Homo sapiens
agaagaagagagaguauga

SEQ ID NO: 1027532 - RNA, 19 nt, Homo sapiens
uaccagaacuaggugauga

SEQ ID NO: 1027533 - RNA, 19 nt, Homo sapiens
acaauuccaugauguucuu

SEQ ID NO: 1027534 - RNA, 19 nt, Homo sapiens
gaaucccucuucacuuuac

SEQ ID NO: 1027535 - RNA, 19 nt, Homo sapiens
uuggcaaacuucugcguua

SEQ ID NO: 1027536 - RNA, 19 nt, Homo sapiens
gcaggaugauugcuuaagc

SEQ ID NO: 1027537 - RNA, 19 nt, Homo sapiens
ucaaacaguaccuuucuga

SEQ ID NO: 1027538 - RNA, 19 nt, Homo sapiens
gcuaaguacagugaauaua

SEQ ID NO: 1027539 - RNA, 19 nt, Homo sapiens
gugugaauuuguaaacuga

SEQ ID NO: 1027540 - RNA, 19 nt, Homo sapiens
ccuacuaaguugugauuca

SEQ ID NO: 1027541 - RNA, 19 nt, Homo sapiens
gcacucauaaaucuaacaa

SEQ ID NO: 1027542 - RNA, 19 nt, Homo sapiens
caggaaaguuaacaucuac

SEQ ID NO: 1027543 - RNA, 19 nt, Homo sapiens
gauccacuccuuugaagau

SEQ ID NO: 1027544 - RNA, 19 nt, Homo sapiens
gggcuaaguacagugaaua

SEQ ID NO: 1027545 - RNA, 19 nt, Homo sapiens
gaggaucacucugaauacu

SEQ ID NO: 1027546 - RNA, 19 nt, Homo sapiens
acuaggugaugaagcauuu

SEQ ID NO: 1027547 - RNA, 19 nt, Homo sapiens
caucggaauccaaaucaaa

SEQ ID NO: 1027548 - RNA, 19 nt, Homo sapiens
ucacuuauuccuuuggauu

SEQ ID NO: 1027549 - RNA, 19 nt, Homo sapiens
ugaagaagagagacuaugu

SEQ ID NO: 1027550 - RNA, 19 nt, Homo sapiens
gugauuagaagaagagaga

SEQ ID NO: 1027551 - RNA, 19 nt, Homo sapiens
gaguuguccuuucuuucuu

SEQ ID NO: 1027552 - RNA, 19 nt, Homo sapiens
aacaguaccuuucugaagu

SEQ ID NO: 1027553 - RNA, 19 nt, Homo sapiens
gcuuucuaauuucagguua

SEQ ID NO: 1027554 - RNA, 19 nt, Homo sapiens
gcaaacuucugcguuacuc

SEQ ID NO: 1027555 - RNA, 19 nt, Homo sapiens
gagguuucaggcaguaaua

SEQ ID NO: 1027556 - RNA, 19 nt, Homo sapiens
aaacacggaccaagagaga

SEQ ID NO: 1027557 - RNA, 19 nt, Homo sapiens
gagaaacacggaccaagag

SEQ ID NO: 1027558 - RNA, 19 nt, Homo sapiens
gaagugugaauuuguaaac

SEQ ID NO: 1027559 - RNA, 19 nt, Homo sapiens
ucugaguuguccuuucuuu

SEQ ID NO: 1027560 - RNA, 19 nt, Homo sapiens
uccaugauguucuuagaga

SEQ ID NO: 1027561 - RNA, 19 nt, Homo sapiens
ucaaaucucaccuucuuca

SEQ ID NO: 1027562 - RNA, 19 nt, Homo sapiens
ugaugaagcauuugauugu

SEQ ID NO: 1027563 - RNA, 19 nt, Homo sapiens
ggugaugaagcauuugauu

SEQ ID NO: 1027564 - RNA, 19 nt, Homo sapiens
gguucaugccugcacauua

SEQ ID NO: 1027565 - RNA, 19 nt, Homo sapiens
ucaagaagguagcacucau

SEQ ID NO: 1027566 - RNA, 19 nt, Homo sapiens
gaccuucaggauaucaaua

SEQ ID NO: 1027567 - RNA, 19 nt, Homo sapiens
aaagcuuucuggucaaauc

SEQ ID NO: 1027568 - RNA, 19 nt, Homo sapiens
gcagcagccaccagagaaa

SEQ ID NO: 1027569 - RNA, 19 nt, Homo sapiens
ggugaagcguccaggaaag

SEQ ID NO: 1027570 - RNA, 19 nt, Homo sapiens
uauggacuuucucuucuga

SEQ ID NO: 1027571 - RNA, 19 nt, Homo sapiens
caucuacccagcugguuaa

SEQ ID NO: 1027572 - RNA, 19 nt, Homo sapiens
gagccaacauuuuguacuu

SEQ ID NO: 1027573 - RNA, 19 nt, Homo sapiens
uugaggaucacucugaaua

SEQ ID NO: 1027574 - RNA, 19 nt, Homo sapiens
gugaugaagcauuugauug

SEQ ID NO: 1027575 - RNA, 19 nt, Homo sapiens
aauuagagcuugggaacga

SEQ ID NO: 1027576 - RNA, 19 nt, Homo sapiens
aaacaguaccuuucugaag

SEQ ID NO: 1027577 - RNA, 19 nt, Homo sapiens
caaacaguaccuuucugaa

SEQ ID NO: 1027578 - RNA, 19 nt, Homo sapiens
ggugugcucaucuuacuug

SEQ ID NO: 1027579 - RNA, 19 nt, Homo sapiens
agagaaacacggaccaaga

SEQ ID NO: 1027580 - RNA, 19 nt, Homo sapiens
aagcagaagucaaaacuga

SEQ ID NO: 1027581 - RNA, 19 nt, Homo sapiens
ggucaaacaguaccuuucu

SEQ ID NO: 1027582 - RNA, 19 nt, Homo sapiens
gaucuggccacuggucaaa

SEQ ID NO: 1027583 - RNA, 19 nt, Homo sapiens
aagaagguagcacucauaa

SEQ ID NO: 1027584 - RNA, 19 nt, Homo sapiens
ggagagguucuucccuaga

SEQ ID NO: 1027585 - RNA, 19 nt, Homo sapiens
cuuaaggcuuucuaauuuc

SEQ ID NO: 1027586 - RNA, 19 nt, Homo sapiens
gaugugagcuauccagugu

SEQ ID NO: 1027587 - RNA, 19 nt, Homo sapiens
gggaugcuauggaauauga

SEQ ID NO: 1027588 - RNA, 19 nt, Homo sapiens
ggacgucacuccugaagag

SEQ ID NO: 1027589 - RNA, 19 nt, Homo sapiens
gcagaccugugacaagugu

SEQ ID NO: 1027590 - RNA, 19 nt, Homo sapiens
gccagucaaaguuaaauua

SEQ ID NO: 1027591 - RNA, 19 nt, Homo sapiens
ggugggaugcuauggaaua

SEQ ID NO: 1027592 - RNA, 19 nt, Homo sapiens
aaacauggccagucaaagu

SEQ ID NO: 1027593 - RNA, 19 nt, Homo sapiens
cagcagcccuagaggaaug

SEQ ID NO: 1027594 - RNA, 19 nt, Homo sapiens
gacgaggagugaggaauga

SEQ ID NO: 1027595 - RNA, 19 nt, Homo sapiens
ccaaugaggaugagccaaa

SEQ ID NO: 1027596 - RNA, 19 nt, Homo sapiens
gaauuccgcugcccugaac

SEQ ID NO: 1027597 - RNA, 19 nt, Homo sapiens
augagaagcuggcccguuu

SEQ ID NO: 1027598 - RNA, 19 nt, Homo sapiens
caggugggaugcuauggaa

SEQ ID NO: 1027599 - RNA, 19 nt, Homo sapiens
ccaaacauggccagucaaa

SEQ ID NO: 1027600 - RNA, 19 nt, Homo sapiens
ggaaugagagagaccaaag

SEQ ID NO: 1027601 - RNA, 19 nt, Homo sapiens
ggaauuccgcugcccugaa

SEQ ID NO: 1027602 - RNA, 19 nt, Homo sapiens
uauggaauaugaugagaag

SEQ ID NO: 1027603 - RNA, 19 nt, Homo sapiens
cauggccagucaaaguuaa

SEQ ID NO: 1027604 - RNA, 19 nt, Homo sapiens
aagcagaccugugacaagu

SEQ ID NO: 1027605 - RNA, 19 nt, Homo sapiens
gccagcagcccuagaggaa

SEQ ID NO: 1027606 - RNA, 19 nt, Homo sapiens
gcuauggaauaugaugaga

SEQ ID NO: 1027607 - RNA, 19 nt, Homo sapiens
gaaugagagagaccaaagu

SEQ ID NO: 1027608 - RNA, 19 nt, Homo sapiens
gcaggugggaugcuaugga

SEQ ID NO: 1027609 - RNA, 19 nt, Homo sapiens
ggaugagaaauuaaacuag

SEQ ID NO: 1027610 - RNA, 19 nt, Homo sapiens
gugggaugcuauggaauau

SEQ ID NO: 1027611 - RNA, 19 nt, Homo sapiens
gcgucaagcagaccuguga

SEQ ID NO: 1027612 - RNA, 19 nt, Homo sapiens
gaagagcaagagcgucaag

SEQ ID NO: 1027613 - RNA, 19 nt, Homo sapiens
aaugagagagaccaaaguu

SEQ ID NO: 1027614 - RNA, 19 nt, Homo sapiens
acauggccagucaaaguua

SEQ ID NO: 1027615 - RNA, 19 nt, Homo sapiens
ccgcugggcucacauucag

SEQ ID NO: 1027616 - RNA, 19 nt, Homo sapiens
gagugaggaaugagagaga

SEQ ID NO: 1027617 - RNA, 19 nt, Homo sapiens
caagcagaccugugacaag

SEQ ID NO: 1027618 - RNA, 19 nt, Homo sapiens
ggagugcaagcaggugauu

SEQ ID NO: 1027619 - RNA, 19 nt, Homo sapiens
caaugaggaugagccaaac

SEQ ID NO: 1027620 - RNA, 19 nt, Homo sapiens
gaugcuauggaauaugaug

SEQ ID NO: 1027621 - RNA, 19 nt, Homo sapiens
agacgaggagugaggaaug

SEQ ID NO: 1027622 - RNA, 19 nt, Homo sapiens
agaccugugacaaguguaa

SEQ ID NO: 1027623 - RNA, 19 nt, Homo sapiens
gcccugaacgcgugaugga

SEQ ID NO: 1027624 - RNA, 19 nt, Homo sapiens
gaacaggacggaugaagaa

SEQ ID NO: 1027625 - RNA, 19 nt, Homo sapiens
gaaauaaggaugaucauag

SEQ ID NO: 1027626 - RNA, 19 nt, Homo sapiens
cggagaagauccuguguaa

SEQ ID NO: 1027627 - RNA, 19 nt, Homo sapiens
caagagacgcggagagaua

SEQ ID NO: 1027628 - RNA, 19 nt, Homo sapiens
ggaaauaaggaugaucaua

SEQ ID NO: 1027629 - RNA, 19 nt, Homo sapiens
gagaagauccuguguaagg

SEQ ID NO: 1027630 - RNA, 19 nt, Homo sapiens
uugcaaagccuuacucuaa

SEQ ID NO: 1027631 - RNA, 19 nt, Homo sapiens
gaugcgaccuaaagucaug

SEQ ID NO: 1027632 - RNA, 19 nt, Homo sapiens
cgagaggaaggucaaauuu

SEQ ID NO: 1027633 - RNA, 19 nt, Homo sapiens
gggcagauaaucagacuug

SEQ ID NO: 1027634 - RNA, 19 nt, Homo sapiens
gaugcagacucgcgauuca

SEQ ID NO: 1027635 - RNA, 19 nt, Homo sapiens
ggaacaggacggaugaaga

SEQ ID NO: 1027636 - RNA, 19 nt, Homo sapiens
gcaaagccuuacucuaaaa

SEQ ID NO: 1027637 - RNA, 19 nt, Homo sapiens
ccacaagccuauacaccau

SEQ ID NO: 1027638 - RNA, 19 nt, Homo sapiens
gauaaucagacuugaggaa

SEQ ID NO: 1027639 - RNA, 19 nt, Homo sapiens
gaagagggcagauaaucag

SEQ ID NO: 1027640 - RNA, 19 nt, Homo sapiens
agaggaaggucaaauuucu

SEQ ID NO: 1027641 - RNA, 19 nt, Homo sapiens
gcgagaggaaggucaaauu

SEQ ID NO: 1027642 - RNA, 19 nt, Homo sapiens
ugcaaagccuuacucuaaa

SEQ ID NO: 1027643 - RNA, 19 nt, Homo sapiens
gagaggaaggucaaauuuc

SEQ ID NO: 1027644 - RNA, 19 nt, Homo sapiens
caagaaggacugucuaugc

SEQ ID NO: 1027645 - RNA, 19 nt, Homo sapiens
acaagccuauacaccauuu

SEQ ID NO: 1027646 - RNA, 19 nt, Homo sapiens
ccauuggaaucacuguuug

SEQ ID NO: 1027647 - RNA, 19 nt, Homo sapiens
aagaaggacugucuaugca

SEQ ID NO: 1027648 - RNA, 19 nt, Homo sapiens
gcgggaucauggcgacuuu

SEQ ID NO: 1027649 - RNA, 19 nt, Homo sapiens
ucuauggacugguggaugu

SEQ ID NO: 1027650 - RNA, 19 nt, Homo sapiens
ugaagagggcagauaauca

SEQ ID NO: 1027651 - RNA, 19 nt, Homo sapiens
gcggagaagauccugugua

SEQ ID NO: 1027652 - RNA, 19 nt, Homo sapiens
aaauaaggaugaucauagc

SEQ ID NO: 1027653 - RNA, 19 nt, Homo sapiens
cuagggaccuccagaccau

SEQ ID NO: 1027654 - RNA, 19 nt, Homo sapiens
ccucugagcagcaccuuga

SEQ ID NO: 1027655 - RNA, 19 nt, Homo sapiens
cauagcuaccucacgguua

SEQ ID NO: 1027656 - RNA, 19 nt, Homo sapiens
cagacucgcgauucaauga

SEQ ID NO: 1027657 - RNA, 19 nt, Homo sapiens
gcacacccacaagccuaua

SEQ ID NO: 1027658 - RNA, 19 nt, Homo sapiens
gagggcagauaaucagacu

SEQ ID NO: 1027659 - RNA, 19 nt, Homo sapiens
ucccacaucuggaaauaag

SEQ ID NO: 1027660 - RNA, 19 nt, Homo sapiens
ccacaucuggaaauaagga

SEQ ID NO: 1027661 - RNA, 19 nt, Homo sapiens
ggacugguggauguaacua

SEQ ID NO: 1027662 - RNA, 19 nt, Homo sapiens
ucaggaacaggacggauga

SEQ ID NO: 1027663 - RNA, 19 nt, Homo sapiens
gaagccuaguucccacauc

SEQ ID NO: 1027664 - RNA, 19 nt, Homo sapiens
uaaucagacuugaggaaac

SEQ ID NO: 1027665 - RNA, 19 nt, Homo sapiens
gcagauaaucagacuugag

SEQ ID NO: 1027666 - RNA, 19 nt, Homo sapiens
ccuuaugaguacccaagaa

SEQ ID NO: 1027667 - RNA, 19 nt, Homo sapiens
gcagacucgcgauucaaug

SEQ ID NO: 1027668 - RNA, 19 nt, Homo sapiens
auaaggaugaucauagcua

SEQ ID NO: 1027669 - RNA, 19 nt, Homo sapiens
ccaagaaggacugucuaug

SEQ ID NO: 1027670 - RNA, 19 nt, Homo sapiens
cuaccucacgguuacauug

SEQ ID NO: 1027671 - RNA, 19 nt, Homo sapiens
ccuugaagagggcagauaa

SEQ ID NO: 1027672 - RNA, 19 nt, Homo sapiens
gacucgcgauucaaugauc

SEQ ID NO: 1027673 - RNA, 19 nt, Homo sapiens
gcaagagacgcggagagau

SEQ ID NO: 1027674 - RNA, 19 nt, Homo sapiens
gauggguggcuaccuguuc

SEQ ID NO: 1027675 - RNA, 19 nt, Homo sapiens
ucuacacgaugcgaccuaa

SEQ ID NO: 1027676 - RNA, 19 nt, Homo sapiens
uggccuggcuccacaagca

SEQ ID NO: 1027677 - RNA, 19 nt, Homo sapiens
uaugaguacccaagaagga

SEQ ID NO: 1027678 - RNA, 19 nt, Homo sapiens
uguguggccuuggucauau

SEQ ID NO: 1027679 - RNA, 19 nt, Homo sapiens
uggcugugcuggagggaau

SEQ ID NO: 1027680 - RNA, 19 nt, Homo sapiens
cugcacagcugcgagaucu

SEQ ID NO: 1027681 - RNA, 19 nt, Homo sapiens
gucaggaggcggagaagau

SEQ ID NO: 1027682 - RNA, 19 nt, Homo sapiens
gaagaaggggugggguuaa

SEQ ID NO: 1027683 - RNA, 19 nt, Homo sapiens
aagccuaguucccacaucu

SEQ ID NO: 1027684 - RNA, 19 nt, Homo sapiens
aaucagacuugaggaaacu

SEQ ID NO: 1027685 - RNA, 19 nt, Homo sapiens
ggcagauaaucagacuuga

SEQ ID NO: 1027686 - RNA, 19 nt, Homo sapiens
ucauggucgucuucaggaa

SEQ ID NO: 1027687 - RNA, 19 nt, Homo sapiens
ccucacgguuacauugcaa

SEQ ID NO: 1027688 - RNA, 19 nt, Homo sapiens
gaacaaagcagucauaauu

SEQ ID NO: 1027689 - RNA, 19 nt, Homo sapiens
cagaguggcuucuuucuua

SEQ ID NO: 1027690 - RNA, 19 nt, Homo sapiens
gcaguuagcuaaguguuua

SEQ ID NO: 1027691 - RNA, 19 nt, Homo sapiens
ggacaaguaucuaucacua

SEQ ID NO: 1027692 - RNA, 19 nt, Homo sapiens
ggaagaaacugcauuugau

SEQ ID NO: 1027693 - RNA, 19 nt, Homo sapiens
gcacacaacuauaccuuug

SEQ ID NO: 1027694 - RNA, 19 nt, Homo sapiens
gcaaguaacauauuaguga

SEQ ID NO: 1027695 - RNA, 19 nt, Homo sapiens
gaagaaacugcauuugaua

SEQ ID NO: 1027696 - RNA, 19 nt, Homo sapiens
caaccuacaugauccuuaa

SEQ ID NO: 1027697 - RNA, 19 nt, Homo sapiens
guggaaggcuguacaaauu

SEQ ID NO: 1027698 - RNA, 19 nt, Homo sapiens
gaaacugcauuugauauug

SEQ ID NO: 1027699 - RNA, 19 nt, Homo sapiens
gcuuguaaguggaauaaua

SEQ ID NO: 1027700 - RNA, 19 nt, Homo sapiens
cagagcaaguaacauauua

SEQ ID NO: 1027701 - RNA, 19 nt, Homo sapiens
gaaucacgaugaccuugua

SEQ ID NO: 1027702 - RNA, 19 nt, Homo sapiens
gaaagcaguuagcuaagug

SEQ ID NO: 1027703 - RNA, 19 nt, Homo sapiens
ggaaacacauggacaccuu

SEQ ID NO: 1027704 - RNA, 19 nt, Homo sapiens
gaucuuuguuggguauuua

SEQ ID NO: 1027705 - RNA, 19 nt, Homo sapiens
gaacagagacagcaaggau

SEQ ID NO: 1027706 - RNA, 19 nt, Homo sapiens
ggaaagcaguuagcuaagu

SEQ ID NO: 1027707 - RNA, 19 nt, Homo sapiens
gaugaaccguuacgucaga

SEQ ID NO: 1027708 - RNA, 19 nt, Homo sapiens
cagcaaggauacccuagaa

SEQ ID NO: 1027709 - RNA, 19 nt, Homo sapiens
caggaaagcaguuagcuaa

SEQ ID NO: 1027710 - RNA, 19 nt, Homo sapiens
gcuaaguguuuaauucaug

SEQ ID NO: 1027711 - RNA, 19 nt, Homo sapiens
acaaagcagucauaauuca

SEQ ID NO: 1027712 - RNA, 19 nt, Homo sapiens
ugucagaucuugaugaaca

SEQ ID NO: 1027713 - RNA, 19 nt, Homo sapiens
ugacacggguuguacagaa

SEQ ID NO: 1027714 - RNA, 19 nt, Homo sapiens
gcaauucugaugaagauga

SEQ ID NO: 1027715 - RNA, 19 nt, Homo sapiens
gguaggcaauucugaugaa

SEQ ID NO: 1027716 - RNA, 19 nt, Homo sapiens
aggaaaugaugauggaaua

SEQ ID NO: 1027717 - RNA, 19 nt, Homo sapiens
aaaccuagaucuuugucuu

SEQ ID NO: 1027718 - RNA, 19 nt, Homo sapiens
gaaacacauggacaccuua

SEQ ID NO: 1027719 - RNA, 19 nt, Homo sapiens
ugagauguauucccauaau

SEQ ID NO: 1027720 - RNA, 19 nt, Homo sapiens
ggaaggcuguacaaauucu

SEQ ID NO: 1027721 - RNA, 19 nt, Homo sapiens
guaaggggaugauuauuau

SEQ ID NO: 1027722 - RNA, 19 nt, Homo sapiens
gccaguugcuuucauuuua

SEQ ID NO: 1027723 - RNA, 19 nt, Homo sapiens
ccacucacgugaacacuag

SEQ ID NO: 1027724 - RNA, 19 nt, Homo sapiens
gggcacugcuuguauaguc

SEQ ID NO: 1027725 - RNA, 19 nt, Homo sapiens
gaagagugguaucgauugc

SEQ ID NO: 1027726 - RNA, 19 nt, Homo sapiens
uguauagucucucaaguuc

SEQ ID NO: 1027727 - RNA, 19 nt, Homo sapiens
uacaugauccuuaagcuaa

SEQ ID NO: 1027728 - RNA, 19 nt, Homo sapiens
uaccauagccaguugcuuu

SEQ ID NO: 1027729 - RNA, 19 nt, Homo sapiens
gacacggguuguacagaaa

SEQ ID NO: 1027730 - RNA, 19 nt, Homo sapiens
ugugagauguauucccaua

SEQ ID NO: 1027731 - RNA, 19 nt, Homo sapiens
uaacauucuuccaagugaa

SEQ ID NO: 1027732 - RNA, 19 nt, Homo sapiens
cgucaaacaucuuacuaca

SEQ ID NO: 1027733 - RNA, 19 nt, Homo sapiens
aaccagagcaaguaacaua

SEQ ID NO: 1027734 - RNA, 19 nt, Homo sapiens
gaguauacaggcaaaguga

SEQ ID NO: 1027735 - RNA, 19 nt, Homo sapiens
gagauguauucccauaauc

SEQ ID NO: 1027736 - RNA, 19 nt, Homo sapiens
cuagaacuccuccugauga

SEQ ID NO: 1027737 - RNA, 19 nt, Homo sapiens
caaguucacaggaaauguu

SEQ ID NO: 1027738 - RNA, 19 nt, Homo sapiens
caacuauaccuuuguccaa

SEQ ID NO: 1027739 - RNA, 19 nt, Homo sapiens
guagacaugcacacaacua

SEQ ID NO: 1027740 - RNA, 19 nt, Homo sapiens
agauuuauauccuggcauu

SEQ ID NO: 1027741 - RNA, 19 nt, Homo sapiens
caauccagcugucuucucu

SEQ ID NO: 1027742 - RNA, 19 nt, Homo sapiens
ggaggacaaguaucuauca

SEQ ID NO: 1027743 - RNA, 19 nt, Homo sapiens
gcagauaucaaugcccaaa

SEQ ID NO: 1027744 - RNA, 19 nt, Homo sapiens
uggaagaaacugcauuuga

SEQ ID NO: 1027745 - RNA, 19 nt, Homo sapiens
gcaaggauacccuagaacu

SEQ ID NO: 1027746 - RNA, 19 nt, Homo sapiens
ugguaucgauugcaagaaa

SEQ ID NO: 1027747 - RNA, 19 nt, Homo sapiens
ggaucuuuguuggguauuu

SEQ ID NO: 1027748 - RNA, 19 nt, Homo sapiens
ucacuaccucuuugaaauu

SEQ ID NO: 1027749 - RNA, 19 nt, Homo sapiens
gaagaugaggagcaagaug

SEQ ID NO: 1027750 - RNA, 19 nt, Homo sapiens
ucaccucagucuuaacaau

SEQ ID NO: 1027751 - RNA, 19 nt, Homo sapiens
cauaauauaucugcuaucc

SEQ ID NO: 1027752 - RNA, 19 nt, Homo sapiens
cuaccacaauuuacacaau

SEQ ID NO: 1027753 - RNA, 19 nt, Homo sapiens
acacauggacaccuuauuc

SEQ ID NO: 1027754 - RNA, 19 nt, Homo sapiens
agucauaauucaucucuag

SEQ ID NO: 1027755 - RNA, 19 nt, Homo sapiens
ccagagcaaguaacauauu

SEQ ID NO: 1027756 - RNA, 19 nt, Homo sapiens
gagcaaguaacauauuagu

SEQ ID NO: 1027757 - RNA, 19 nt, Homo sapiens
uagaacuccuccugaugaa

SEQ ID NO: 1027758 - RNA, 19 nt, Homo sapiens
agacaugcacacaacuaua

SEQ ID NO: 1027759 - RNA, 19 nt, Homo sapiens
gagguaacucagaacuuaa

SEQ ID NO: 1027760 - RNA, 19 nt, Homo sapiens
auaacauucuuccaaguga

SEQ ID NO: 1027761 - RNA, 19 nt, Homo sapiens
gauauugccaggaggacaa

SEQ ID NO: 1027762 - RNA, 19 nt, Homo sapiens
auaccagaguggcuucuuu

SEQ ID NO: 1027763 - RNA, 19 nt, Homo sapiens
cauggacaccuuauuccua

SEQ ID NO: 1027764 - RNA, 19 nt, Homo sapiens
ccaagugaauugccugacu

SEQ ID NO: 1027765 - RNA, 19 nt, Homo sapiens
aagagaauuccuuggauuu

SEQ ID NO: 1027766 - RNA, 19 nt, Homo sapiens
agauaucaaugcccaaaca

SEQ ID NO: 1027767 - RNA, 19 nt, Homo sapiens
acacuuagauauuguucag

SEQ ID NO: 1027768 - RNA, 19 nt, Homo sapiens
gaacacuagggaugaagau

SEQ ID NO: 1027769 - RNA, 19 nt, Homo sapiens
uuugggcacugcuuguaua

SEQ ID NO: 1027770 - RNA, 19 nt, Homo sapiens
guacagaaacugguauuuu

SEQ ID NO: 1027771 - RNA, 19 nt, Homo sapiens
auucuucaccucagucuua

SEQ ID NO: 1027772 - RNA, 19 nt, Homo sapiens
ucucucaaguucacaggaa

SEQ ID NO: 1027773 - RNA, 19 nt, Homo sapiens
ggaauaccagaccaagaga

SEQ ID NO: 1027774 - RNA, 19 nt, Homo sapiens
cuacaugauccuuaagcua

SEQ ID NO: 1027775 - RNA, 19 nt, Homo sapiens
guaacauauuagugacuug

SEQ ID NO: 1027776 - RNA, 19 nt, Homo sapiens
gaauaccagaccaagagaa

SEQ ID NO: 1027777 - RNA, 19 nt, Homo sapiens
gauguauucccauaaucaa

SEQ ID NO: 1027778 - RNA, 19 nt, Homo sapiens
gaaauuguggaaggcugua

SEQ ID NO: 1027779 - RNA, 19 nt, Homo sapiens
acacuagggaugaagauga

SEQ ID NO: 1027780 - RNA, 19 nt, Homo sapiens
aagaugaggagcaagauga

SEQ ID NO: 1027781 - RNA, 19 nt, Homo sapiens
uuuauauccuggcauuuga

SEQ ID NO: 1027782 - RNA, 19 nt, Homo sapiens
aaaacacuguggauaauga

SEQ ID NO: 1027783 - RNA, 19 nt, Homo sapiens
gcuaauggcgaaucacgau

SEQ ID NO: 1027784 - RNA, 19 nt, Homo sapiens
aggcaauucugaugaagau

SEQ ID NO: 1027785 - RNA, 19 nt, Homo sapiens
aaaaggaaaugaugaugga

SEQ ID NO: 1027786 - RNA, 19 nt, Homo sapiens
auuagugacuugaaucuuc

SEQ ID NO: 1027787 - RNA, 19 nt, Homo sapiens
aaacugcauuugauauugc

SEQ ID NO: 1027788 - RNA, 19 nt, Homo sapiens
gcaacaaucugacauuauu

SEQ ID NO: 1027789 - RNA, 19 nt, Homo sapiens
gcagaacacugauuugaaa

SEQ ID NO: 1027790 - RNA, 19 nt, Homo sapiens
gagcuuccauuucaucuua

SEQ ID NO: 1027791 - RNA, 19 nt, Homo sapiens
ucagauagcuggagccaua

SEQ ID NO: 1027792 - RNA, 19 nt, Homo sapiens
uauaugggcugguaaauuu

SEQ ID NO: 1027793 - RNA, 19 nt, Homo sapiens
ugacagacaucaagaauga

SEQ ID NO: 1027794 - RNA, 19 nt, Homo sapiens
gagcaagucucccagauga

SEQ ID NO: 1027795 - RNA, 19 nt, Homo sapiens
gcacuugacuagucuuaaa

SEQ ID NO: 1027796 - RNA, 19 nt, Homo sapiens
ccaaagacauacaguguuu

SEQ ID NO: 1027797 - RNA, 19 nt, Homo sapiens
caacagggcuugugagcuu

SEQ ID NO: 1027798 - RNA, 19 nt, Homo sapiens
ucacaaagcuucucucaag

SEQ ID NO: 1027799 - RNA, 19 nt, Homo sapiens
guacugaaauaaugaguga

SEQ ID NO: 1027800 - RNA, 19 nt, Homo sapiens
ugagaguggucaagaaaua

SEQ ID NO: 1027801 - RNA, 19 nt, Homo sapiens
gaucugcacuugguaauga

SEQ ID NO: 1027802 - RNA, 19 nt, Homo sapiens
aaagaaaguuggucacuga

SEQ ID NO: 1027803 - RNA, 19 nt, Homo sapiens
cauaaugguuggugucuuu

SEQ ID NO: 1027804 - RNA, 19 nt, Homo sapiens
aaacaugacucagaccaua

SEQ ID NO: 1027805 - RNA, 19 nt, Homo sapiens
gaaggacaaguaacaauuu

SEQ ID NO: 1027806 - RNA, 19 nt, Homo sapiens
ggugucauguguucuguua

SEQ ID NO: 1027807 - RNA, 19 nt, Homo sapiens
gagaagggguucaaauaua

SEQ ID NO: 1027808 - RNA, 19 nt, Homo sapiens
cauaagaguugacugaguu

SEQ ID NO: 1027809 - RNA, 19 nt, Homo sapiens
ucacuacacuuaagacaug

SEQ ID NO: 1027810 - RNA, 19 nt, Homo sapiens
gggaggaccugugaaagaa

SEQ ID NO: 1027811 - RNA, 19 nt, Homo sapiens
gcgcacaccuucagcucua

SEQ ID NO: 1027812 - RNA, 19 nt, Homo sapiens
ugaccaauuugaaggauuu

SEQ ID NO: 1027813 - RNA, 19 nt, Homo sapiens
ccaauugguugugcucaua

SEQ ID NO: 1027814 - RNA, 19 nt, Homo sapiens
ggaugagaguggucaagaa

SEQ ID NO: 1027815 - RNA, 19 nt, Homo sapiens
cauuagaccuaucagcuuu

SEQ ID NO: 1027816 - RNA, 19 nt, Homo sapiens
gaucugcacuggagcaagu

SEQ ID NO: 1027817 - RNA, 19 nt, Homo sapiens
ggcaaacuauugauauuuc

SEQ ID NO: 1027818 - RNA, 19 nt, Homo sapiens
agaaagaacgaaugaauga

SEQ ID NO: 1027819 - RNA, 19 nt, Homo sapiens
uaccagaccuuacaacugu

SEQ ID NO: 1027820 - RNA, 19 nt, Homo sapiens
gaaucuugcuucauuugau

SEQ ID NO: 1027821 - RNA, 19 nt, Homo sapiens
uaagauccaguguuucaua

SEQ ID NO: 1027822 - RNA, 19 nt, Homo sapiens
gcaccacuuuccaugacua

SEQ ID NO: 1027823 - RNA, 19 nt, Homo sapiens
uggcaacaaucugacauua

SEQ ID NO: 1027824 - RNA, 19 nt, Homo sapiens
gcaagucucccagaugauu

SEQ ID NO: 1027825 - RNA, 19 nt, Homo sapiens
ccauaugcauaagaaguua

SEQ ID NO: 1027826 - RNA, 19 nt, Homo sapiens
gggacaguguuauaaauca

SEQ ID NO: 1027827 - RNA, 19 nt, Homo sapiens
gaugagaguggucaagaaa

SEQ ID NO: 1027828 - RNA, 19 nt, Homo sapiens
acuacugccucuaccauua

SEQ ID NO: 1027829 - RNA, 19 nt, Homo sapiens
cauuauggauuuggaguuu

SEQ ID NO: 1027830 - RNA, 19 nt, Homo sapiens
uguaaguucucaugucauu

SEQ ID NO: 1027831 - RNA, 19 nt, Homo sapiens
gcagucaguuauagaucaa

SEQ ID NO: 1027832 - RNA, 19 nt, Homo sapiens
uacauucucuccuuuauag

SEQ ID NO: 1027833 - RNA, 19 nt, Homo sapiens
gaacugcugguguuacaug

SEQ ID NO: 1027834 - RNA, 19 nt, Homo sapiens
guucuguuauguucuguuu

SEQ ID NO: 1027835 - RNA, 19 nt, Homo sapiens
cucaagagcucucguagug

SEQ ID NO: 1027836 - RNA, 19 nt, Homo sapiens
ggauuaagcauauuacucu

SEQ ID NO: 1027837 - RNA, 19 nt, Homo sapiens
gaguuaaucccaauugguu

SEQ ID NO: 1027838 - RNA, 19 nt, Homo sapiens
gucugaagguagugaguua

SEQ ID NO: 1027839 - RNA, 19 nt, Homo sapiens
gaggguggcacauuccuaa

SEQ ID NO: 1027840 - RNA, 19 nt, Homo sapiens
cuugugagcuuccauuuca

SEQ ID NO: 1027841 - RNA, 19 nt, Homo sapiens
cgaaggacaaguaacaauu

SEQ ID NO: 1027842 - RNA, 19 nt, Homo sapiens
ccaaggauuugacuggaau

SEQ ID NO: 1027843 - RNA, 19 nt, Homo sapiens
cggaggugguuacagcuua

SEQ ID NO: 1027844 - RNA, 19 nt, Homo sapiens
cuacugcacuugacuaguc

SEQ ID NO: 1027845 - RNA, 19 nt, Homo sapiens
gcuuaaugauggaaaugaa

SEQ ID NO: 1027846 - RNA, 19 nt, Homo sapiens
auaguguucucaagcuuua

SEQ ID NO: 1027847 - RNA, 19 nt, Homo sapiens
gugcucauaugccaccuuu

SEQ ID NO: 1027848 - RNA, 19 nt, Homo sapiens
ggaggugguuacagcuuau

SEQ ID NO: 1027849 - RNA, 19 nt, Homo sapiens
ccuccaagcccuucucuuu

SEQ ID NO: 1027850 - RNA, 19 nt, Homo sapiens
uaacuagcccagacauuug

SEQ ID NO: 1027851 - RNA, 19 nt, Homo sapiens
guauccauaugcauaagaa

SEQ ID NO: 1027852 - RNA, 19 nt, Homo sapiens
acaaagaaagaacgaauga

SEQ ID NO: 1027853 - RNA, 19 nt, Homo sapiens
gaacacugauuugaaagcu

SEQ ID NO: 1027854 - RNA, 19 nt, Homo sapiens
uuuagcaacucaccaacua

SEQ ID NO: 1027855 - RNA, 19 nt, Homo sapiens
ggacaccauuggagaaacu

SEQ ID NO: 1027856 - RNA, 19 nt, Homo sapiens
gaacgaaugaaugaaugaa

SEQ ID NO: 1027857 - RNA, 19 nt, Homo sapiens
gaaagaacgaaugaaugaa

SEQ ID NO: 1027858 - RNA, 19 nt, Homo sapiens
aagauccaguguuucauaa

SEQ ID NO: 1027859 - RNA, 19 nt, Homo sapiens
gaaauaaugagugaccaau

SEQ ID NO: 1027860 - RNA, 19 nt, Homo sapiens
ugaauggccuuguaaacag

SEQ ID NO: 1027861 - RNA, 19 nt, Homo sapiens
uuucucagcugcucuguau

SEQ ID NO: 1027862 - RNA, 19 nt, Homo sapiens
uaaauaccccuuucuagua

SEQ ID NO: 1027863 - RNA, 19 nt, Homo sapiens
cgccugaucucaaguuuua

SEQ ID NO: 1027864 - RNA, 19 nt, Homo sapiens
agaccuaucagcuuuguuu

SEQ ID NO: 1027865 - RNA, 19 nt, Homo sapiens
uugaagaacugcugguguu

SEQ ID NO: 1027866 - RNA, 19 nt, Homo sapiens
ggccaaacuugaagaacug

SEQ ID NO: 1027867 - RNA, 19 nt, Homo sapiens
ugacaaaugcagacuccua

SEQ ID NO: 1027868 - RNA, 19 nt, Homo sapiens
ucagaaacauccaguaagc

SEQ ID NO: 1027869 - RNA, 19 nt, Homo sapiens
aaucagaaacauccaguaa

SEQ ID NO: 1027870 - RNA, 19 nt, Homo sapiens
ugacugaguuaaucccaau

SEQ ID NO: 1027871 - RNA, 19 nt, Homo sapiens
gaaucuggccucauaccuu

SEQ ID NO: 1027872 - RNA, 19 nt, Homo sapiens
gaauggcaugcuuccuuua

SEQ ID NO: 1027873 - RNA, 19 nt, Homo sapiens
ggacuauggugccgucaac

SEQ ID NO: 1027874 - RNA, 19 nt, Homo sapiens
uuaacuagcccagacauuu

SEQ ID NO: 1027875 - RNA, 19 nt, Homo sapiens
ugucauguguucuguuaug

SEQ ID NO: 1027876 - RNA, 19 nt, Homo sapiens
ccacgcacaugcagaugga

SEQ ID NO: 1027877 - RNA, 19 nt, Homo sapiens
ugacacauucccauuggua

SEQ ID NO: 1027878 - RNA, 19 nt, Homo sapiens
aaacccagaucugcacuug

SEQ ID NO: 1027879 - RNA, 19 nt, Homo sapiens
cauguguucuguuauguuc

SEQ ID NO: 1027880 - RNA, 19 nt, Homo sapiens
uuaccucccuuuacccauu

SEQ ID NO: 1027881 - RNA, 19 nt, Homo sapiens
ugacuggaauggcaugcuu

SEQ ID NO: 1027882 - RNA, 19 nt, Homo sapiens
gcuuuacugugaaucagaa

SEQ ID NO: 1027883 - RNA, 19 nt, Homo sapiens
guucucaugucauuaugga

SEQ ID NO: 1027884 - RNA, 19 nt, Homo sapiens
caaaguguaaguucucaug

SEQ ID NO: 1027885 - RNA, 19 nt, Homo sapiens
gucaaccacuuucggagaa

SEQ ID NO: 1027886 - RNA, 19 nt, Homo sapiens
acucuggagcuuuguauua

SEQ ID NO: 1027887 - RNA, 19 nt, Homo sapiens
gcauauuacucuggagcuu

SEQ ID NO: 1027888 - RNA, 19 nt, Homo sapiens
ggacaacgagcucaagaaa

SEQ ID NO: 1027889 - RNA, 19 nt, Homo sapiens
acaacgagcucaagaaauc

SEQ ID NO: 1027890 - RNA, 19 nt, Homo sapiens
gaagggauguuugucacuu

SEQ ID NO: 1027891 - RNA, 19 nt, Homo sapiens
gaugcuacauucaaacuuc

SEQ ID NO: 1027892 - RNA, 19 nt, Homo sapiens
ccagaaacccucggucaua

SEQ ID NO: 1027893 - RNA, 19 nt, Homo sapiens
gaccccaucucuacaauua

SEQ ID NO: 1027894 - RNA, 19 nt, Homo sapiens
gaaguggacucccgaucuc

SEQ ID NO: 1027895 - RNA, 19 nt, Homo sapiens
gauccaggcugcccacaag

SEQ ID NO: 1027896 - RNA, 19 nt, Homo sapiens
gcagaagggauguuuguca

SEQ ID NO: 1027897 - RNA, 19 nt, Homo sapiens
ucauggacgucuucacuga

SEQ ID NO: 1027898 - RNA, 19 nt, Homo sapiens
cagaaacccucggucauag

SEQ ID NO: 1027899 - RNA, 19 nt, Homo sapiens
ggauguuugucacuuguuc

SEQ ID NO: 1027900 - RNA, 19 nt, Homo sapiens
ggaaguggacucccgaucu

SEQ ID NO: 1027901 - RNA, 19 nt, Homo sapiens
ccugcugacuggugaaauu

SEQ ID NO: 1027902 - RNA, 19 nt, Homo sapiens
ggacccagccucucacagu

SEQ ID NO: 1027903 - RNA, 19 nt, Homo sapiens
gcugacuggugaaauuguu

SEQ ID NO: 1027904 - RNA, 19 nt, Homo sapiens
uguaaucccugcacuuugg

SEQ ID NO: 1027905 - RNA, 19 nt, Homo sapiens
gcacuggaggcucuguuga

SEQ ID NO: 1027906 - RNA, 19 nt, Homo sapiens
ucaagcagaagggauguuu

SEQ ID NO: 1027907 - RNA, 19 nt, Homo sapiens
aacaggagcccaagccaaa

SEQ ID NO: 1027908 - RNA, 19 nt, Homo sapiens
ccuguaaucccugcacuuu

SEQ ID NO: 1027909 - RNA, 19 nt, Homo sapiens
ucacuuguucugcaacuug

SEQ ID NO: 1027910 - RNA, 19 nt, Homo sapiens
gcuaguggccguggucaug

SEQ ID NO: 1027911 - RNA, 19 nt, Homo sapiens
gaaacccucggucauaggu

SEQ ID NO: 1027912 - RNA, 19 nt, Homo sapiens
gacaacgagcucaagaaau

SEQ ID NO: 1027913 - RNA, 19 nt, Homo sapiens
gggacaacgagcucaagaa

SEQ ID NO: 1027914 - RNA, 19 nt, Homo sapiens
ggucauggacgucuucacu

SEQ ID NO: 1027915 - RNA, 19 nt, Homo sapiens
gugggaggguugcuuaagg

SEQ ID NO: 1027916 - RNA, 19 nt, Homo sapiens
ggagccauuuggacaucug

SEQ ID NO: 1027917 - RNA, 19 nt, Homo sapiens
caagagcccagaggcauca

SEQ ID NO: 1027918 - RNA, 19 nt, Homo sapiens
aagggauguuugucacuug

SEQ ID NO: 1027919 - RNA, 19 nt, Homo sapiens
aagcagaagggauguuugu

SEQ ID NO: 1027920 - RNA, 19 nt, Homo sapiens
aaggugggaggguugcuua

SEQ ID NO: 1027921 - RNA, 19 nt, Homo sapiens
ccaggcugcccacaagcua

SEQ ID NO: 1027922 - RNA, 19 nt, Homo sapiens
ucaggauccuacagcuuca

SEQ ID NO: 1027923 - RNA, 19 nt, Homo sapiens
aaggagcagugccggacaa

SEQ ID NO: 1027924 - RNA, 19 nt, Homo sapiens
gaaagugguuuaugguuua

SEQ ID NO: 1027925 - RNA, 19 nt, Homo sapiens
gauaaucucuucucuugua

SEQ ID NO: 1027926 - RNA, 19 nt, Homo sapiens
gcaaagaccuggaccuaau

SEQ ID NO: 1027927 - RNA, 19 nt, Homo sapiens
ggacuaaauugcuuauguu

SEQ ID NO: 1027928 - RNA, 19 nt, Homo sapiens
ccaccaacgucaccuguua

SEQ ID NO: 1027929 - RNA, 19 nt, Homo sapiens
gaauugagaucugguugaa

SEQ ID NO: 1027930 - RNA, 19 nt, Homo sapiens
ggaagaacguggagcugaa

SEQ ID NO: 1027931 - RNA, 19 nt, Homo sapiens
ugaaagugguuuaugguuu

SEQ ID NO: 1027932 - RNA, 19 nt, Homo sapiens
gcaguuacaugaaaguugu

SEQ ID NO: 1027933 - RNA, 19 nt, Homo sapiens
ccaauaaucccaucucuga

SEQ ID NO: 1027934 - RNA, 19 nt, Homo sapiens
ccucaaaggacccguauua

SEQ ID NO: 1027935 - RNA, 19 nt, Homo sapiens
caugaaaguugugcugaua

SEQ ID NO: 1027936 - RNA, 19 nt, Homo sapiens
gguccucacugaaguugua

SEQ ID NO: 1027937 - RNA, 19 nt, Homo sapiens
cuaccuggcugcccuguaa

SEQ ID NO: 1027938 - RNA, 19 nt, Homo sapiens
caacagaggcagaauuuca

SEQ ID NO: 1027939 - RNA, 19 nt, Homo sapiens
gggacuaaauugcuuaugu

SEQ ID NO: 1027940 - RNA, 19 nt, Homo sapiens
ucacugaaguuguaccuau

SEQ ID NO: 1027941 - RNA, 19 nt, Homo sapiens
cugauaaucucuucucuug

SEQ ID NO: 1027942 - RNA, 19 nt, Homo sapiens
caagauagacacuaacaug

SEQ ID NO: 1027943 - RNA, 19 nt, Homo sapiens
gaacguggagcugaaguuu

SEQ ID NO: 1027944 - RNA, 19 nt, Homo sapiens
gagaugugguucuguguuc

SEQ ID NO: 1027945 - RNA, 19 nt, Homo sapiens
ggaggaggcaggcaucaaa

SEQ ID NO: 1027946 - RNA, 19 nt, Homo sapiens
ccugaggaauugcgagaua

SEQ ID NO: 1027947 - RNA, 19 nt, Homo sapiens
gauguaggcauuuggcuuu

SEQ ID NO: 1027948 - RNA, 19 nt, Homo sapiens
gaacccagaagaaaucaga

SEQ ID NO: 1027949 - RNA, 19 nt, Homo sapiens
guugagcucugugcaguaa

SEQ ID NO: 1027950 - RNA, 19 nt, Homo sapiens
ccacagaccaggaagaaau

SEQ ID NO: 1027951 - RNA, 19 nt, Homo sapiens
agggugcucuugugacuua

SEQ ID NO: 1027952 - RNA, 19 nt, Homo sapiens
ucucagcaguuacaugaaa

SEQ ID NO: 1027953 - RNA, 19 nt, Homo sapiens
cgugagaagugcuaagcua

SEQ ID NO: 1027954 - RNA, 19 nt, Homo sapiens
gagccuccuucuagaugua

SEQ ID NO: 1027955 - RNA, 19 nt, Homo sapiens
caauaaaccaaagccaaua

SEQ ID NO: 1027956 - RNA, 19 nt, Homo sapiens
ucaagggacuaaauugcuu

SEQ ID NO: 1027957 - RNA, 19 nt, Homo sapiens
ugaaaguugugcugauaau

SEQ ID NO: 1027958 - RNA, 19 nt, Homo sapiens
caaaggacccguauuacag

SEQ ID NO: 1027959 - RNA, 19 nt, Homo sapiens
caagaacccagaagaaauc

SEQ ID NO: 1027960 - RNA, 19 nt, Homo sapiens
ccaagaacccagaagaaau

SEQ ID NO: 1027961 - RNA, 19 nt, Homo sapiens
ccauguggcucuuccaaca

SEQ ID NO: 1027962 - RNA, 19 nt, Homo sapiens
caacgucaccuguuacuac

SEQ ID NO: 1027963 - RNA, 19 nt, Homo sapiens
caaguacgacuaccucaug

SEQ ID NO: 1027964 - RNA, 19 nt, Homo sapiens
gguugaaagugguuuaugg

SEQ ID NO: 1027965 - RNA, 19 nt, Homo sapiens
uggaaugggucuacagugu

SEQ ID NO: 1027966 - RNA, 19 nt, Homo sapiens
gggcuagggcucucaggua

SEQ ID NO: 1027967 - RNA, 19 nt, Homo sapiens
gauggcaacuucagcaacu

SEQ ID NO: 1027968 - RNA, 19 nt, Homo sapiens
ccacggacgaggcaacuuu

SEQ ID NO: 1027969 - RNA, 19 nt, Homo sapiens
gugcuaagcuacuuguuuu

SEQ ID NO: 1027970 - RNA, 19 nt, Homo sapiens
gaagaagagagaagcaagu

SEQ ID NO: 1027971 - RNA, 19 nt, Homo sapiens
ggacgaggcaacuuuccaa

SEQ ID NO: 1027972 - RNA, 19 nt, Homo sapiens
caagggacuaaauugcuua

SEQ ID NO: 1027973 - RNA, 19 nt, Homo sapiens
ucaaaggacccguauuaca

SEQ ID NO: 1027974 - RNA, 19 nt, Homo sapiens
gaaguuugucgacuccauu

SEQ ID NO: 1027975 - RNA, 19 nt, Homo sapiens
uuuccaagauagacacuaa

SEQ ID NO: 1027976 - RNA, 19 nt, Homo sapiens
gaggagagcagcuguacca

SEQ ID NO: 1027977 - RNA, 19 nt, Homo sapiens
guacagcaaccuucuugug

SEQ ID NO: 1027978 - RNA, 19 nt, Homo sapiens
aauuucagcugguuagaga

SEQ ID NO: 1027979 - RNA, 19 nt, Homo sapiens
gcagaauuucagcugguua

SEQ ID NO: 1027980 - RNA, 19 nt, Homo sapiens
gaacgagagcaccgugugu

SEQ ID NO: 1027981 - RNA, 19 nt, Homo sapiens
guuggagacuuaccuucaa

SEQ ID NO: 1027982 - RNA, 19 nt, Homo sapiens
gcagaggagagcagcugua

SEQ ID NO: 1027983 - RNA, 19 nt, Homo sapiens
ucaauaaaccaaagccaau

SEQ ID NO: 1027984 - RNA, 19 nt, Homo sapiens
cgucagugauggcaacuuc

SEQ ID NO: 1027985 - RNA, 19 nt, Homo sapiens
gugcucuugugacuuaauu

SEQ ID NO: 1027986 - RNA, 19 nt, Homo sapiens
ucucuucucuuguaccaau

SEQ ID NO: 1027987 - RNA, 19 nt, Homo sapiens
ccucuucuauugcccaguu

SEQ ID NO: 1027988 - RNA, 19 nt, Homo sapiens
gaagaaaucaaaacucuag

SEQ ID NO: 1027989 - RNA, 19 nt, Homo sapiens
guucuguguucccuucuga

SEQ ID NO: 1027990 - RNA, 19 nt, Homo sapiens
ucaccuacagccagccuua

SEQ ID NO: 1027991 - RNA, 19 nt, Homo sapiens
uucuaugacuguuccaaua

SEQ ID NO: 1027992 - RNA, 19 nt, Homo sapiens
gaggcaacuuuccaaccuu

SEQ ID NO: 1027993 - RNA, 19 nt, Homo sapiens
cagaagcuagugaagguuu

SEQ ID NO: 1027994 - RNA, 19 nt, Homo sapiens
ggaggcaggcaucaaagug

SEQ ID NO: 1027995 - RNA, 19 nt, Homo sapiens
ggaggcauaugugcagaag

SEQ ID NO: 1027996 - RNA, 19 nt, Homo sapiens
ggaccuaaucuuccaugug

SEQ ID NO: 1027997 - RNA, 19 nt, Homo sapiens
gcaacuucagcaacuacua

SEQ ID NO: 1027998 - RNA, 19 nt, Homo sapiens
ccaccaagaacccagaaga

SEQ ID NO: 1027999 - RNA, 19 nt, Homo sapiens
agacugaucgccaccaaga

SEQ ID NO: 1028000 - RNA, 19 nt, Homo sapiens
ggagaauugagaucugguu

SEQ ID NO: 1028001 - RNA, 19 nt, Homo sapiens
guacgacuaccucaugauc

SEQ ID NO: 1028002 - RNA, 19 nt, Homo sapiens
ucuaugacuguuccaauaa

SEQ ID NO: 1028003 - RNA, 19 nt, Homo sapiens
gguuagagaugugguucug

SEQ ID NO: 1028004 - RNA, 19 nt, Homo sapiens
agauaacucugaaggacau

SEQ ID NO: 1028005 - RNA, 19 nt, Homo sapiens
acguggagcugaaguuugu

SEQ ID NO: 1028006 - RNA, 19 nt, Homo sapiens
uccaacagaggcagaauuu

SEQ ID NO: 1028007 - RNA, 19 nt, Homo sapiens
gaggaauugcgagauauug

SEQ ID NO: 1028008 - RNA, 19 nt, Homo sapiens
guaggcauuuggcuuuuaa

SEQ ID NO: 1028009 - RNA, 19 nt, Homo sapiens
ccuucuagauguaggcauu

SEQ ID NO: 1028010 - RNA, 19 nt, Homo sapiens
gagaagcaaguacgacuac

SEQ ID NO: 1028011 - RNA, 19 nt, Homo sapiens
aagaagagagaagcaagua

SEQ ID NO: 1028012 - RNA, 19 nt, Homo sapiens
caacugggaucagguuagc

SEQ ID NO: 1028013 - RNA, 19 nt, Homo sapiens
caccaagaacccagaagaa

SEQ ID NO: 1028014 - RNA, 19 nt, Homo sapiens
ugaucucccucuccaacaa

SEQ ID NO: 1028015 - RNA, 19 nt, Homo sapiens
auugagaucugguugaaag

SEQ ID NO: 1028016 - RNA, 19 nt, Homo sapiens
gcuggagaauugagaucug

SEQ ID NO: 1028017 - RNA, 19 nt, Homo sapiens
ucagcggaguggagaaugu

SEQ ID NO: 1028018 - RNA, 19 nt, Homo sapiens
gaaaguugugcugauaauc

SEQ ID NO: 1028019 - RNA, 19 nt, Homo sapiens
caugaccuauccacaucuu

SEQ ID NO: 1028020 - RNA, 19 nt, Homo sapiens
gcucaacugggaucagguu

SEQ ID NO: 1028021 - RNA, 19 nt, Homo sapiens
cuaugacuguuccaauaau

SEQ ID NO: 1028022 - RNA, 19 nt, Homo sapiens
ugcagaagcuagugaaggu

SEQ ID NO: 1028023 - RNA, 19 nt, Homo sapiens
gccaaggaccugccucugu

SEQ ID NO: 1028024 - RNA, 19 nt, Homo sapiens
caacaaauuugguguauug

SEQ ID NO: 1028025 - RNA, 19 nt, Homo sapiens
gcaaggauaugauggaaga

SEQ ID NO: 1028026 - RNA, 19 nt, Homo sapiens
ccacagaccuucaacauca

SEQ ID NO: 1028027 - RNA, 19 nt, Homo sapiens
gagaagcccuacaacauau

SEQ ID NO: 1028028 - RNA, 19 nt, Homo sapiens
ggccucagcuguugaaaga

SEQ ID NO: 1028029 - RNA, 19 nt, Homo sapiens
guagauggaugauuauucu

SEQ ID NO: 1028030 - RNA, 19 nt, Homo sapiens
gcacauauuuauuguucug

SEQ ID NO: 1028031 - RNA, 19 nt, Homo sapiens
cgagaagcccuacaacaua

SEQ ID NO: 1028032 - RNA, 19 nt, Homo sapiens
caucaaagcugcuggaaaa

SEQ ID NO: 1028033 - RNA, 19 nt, Homo sapiens
aagaggagcuggaugaaug

SEQ ID NO: 1028034 - RNA, 19 nt, Homo sapiens
gagcuccucugcaugaaga

SEQ ID NO: 1028035 - RNA, 19 nt, Homo sapiens
uaugaagacuuuacagaug

SEQ ID NO: 1028036 - RNA, 19 nt, Homo sapiens
gagauuugcuuugcagaga

SEQ ID NO: 1028037 - RNA, 19 nt, Homo sapiens
ggucugauggcacauauuu

SEQ ID NO: 1028038 - RNA, 19 nt, Homo sapiens
ucaccgagcucaagacaca

SEQ ID NO: 1028039 - RNA, 19 nt, Homo sapiens
ucacaguguuucuaaaugu

SEQ ID NO: 1028040 - RNA, 19 nt, Homo sapiens
ucacaccaccagaagauua

SEQ ID NO: 1028041 - RNA, 19 nt, Homo sapiens
ggaauugacaccucagaga

SEQ ID NO: 1028042 - RNA, 19 nt, Homo sapiens
gacagcaaauccuacaaga

SEQ ID NO: 1028043 - RNA, 19 nt, Homo sapiens
ccaagcugcuguugcugua

SEQ ID NO: 1028044 - RNA, 19 nt, Homo sapiens
gaaguggcccugccugaug

SEQ ID NO: 1028045 - RNA, 19 nt, Homo sapiens
gaaucuccaucaggaauug

SEQ ID NO: 1028046 - RNA, 19 nt, Homo sapiens
gaguucagcuccuuucucu

SEQ ID NO: 1028047 - RNA, 19 nt, Homo sapiens
cugagaagccuccuacuuu

SEQ ID NO: 1028048 - RNA, 19 nt, Homo sapiens
gaaugagacucugggaauc

SEQ ID NO: 1028049 - RNA, 19 nt, Homo sapiens
ggacgaagaggaacacagu

SEQ ID NO: 1028050 - RNA, 19 nt, Homo sapiens
caccagagacuccucaauu

SEQ ID NO: 1028051 - RNA, 19 nt, Homo sapiens
ggaaaaggaguaugaguuu

SEQ ID NO: 1028052 - RNA, 19 nt, Homo sapiens
acauaucccuggcaaguau

SEQ ID NO: 1028053 - RNA, 19 nt, Homo sapiens
caacauaucccuggcaagu

SEQ ID NO: 1028054 - RNA, 19 nt, Homo sapiens
gcgagaagcccuacaacau

SEQ ID NO: 1028055 - RNA, 19 nt, Homo sapiens
gcuggaggauggaguagga

SEQ ID NO: 1028056 - RNA, 19 nt, Homo sapiens
gcucugaggaugaggauga

SEQ ID NO: 1028057 - RNA, 19 nt, Homo sapiens
acugagaaauugccuggua

SEQ ID NO: 1028058 - RNA, 19 nt, Homo sapiens
caacuggagcuguacugua

SEQ ID NO: 1028059 - RNA, 19 nt, Homo sapiens
gcucuggccuguggauuau

SEQ ID NO: 1028060 - RNA, 19 nt, Homo sapiens
ggacucgccaaacugauaa

SEQ ID NO: 1028061 - RNA, 19 nt, Homo sapiens
gggacucgccaaacugaua

SEQ ID NO: 1028062 - RNA, 19 nt, Homo sapiens
uggcacauauuuauuguuc

SEQ ID NO: 1028063 - RNA, 19 nt, Homo sapiens
gauggcacauauuuauugu

SEQ ID NO: 1028064 - RNA, 19 nt, Homo sapiens
gacgugcccuguccaugaa

SEQ ID NO: 1028065 - RNA, 19 nt, Homo sapiens
gcagggagaagacaugugu

SEQ ID NO: 1028066 - RNA, 19 nt, Homo sapiens
accagagacuccucaauuu

SEQ ID NO: 1028067 - RNA, 19 nt, Homo sapiens
gagacugaauggccagaug

SEQ ID NO: 1028068 - RNA, 19 nt, Homo sapiens
agagauggcugcccucaag

SEQ ID NO: 1028069 - RNA, 19 nt, Homo sapiens
gggcaaggauaugauggaa

SEQ ID NO: 1028070 - RNA, 19 nt, Homo sapiens
ggagccauagggugaauaa

SEQ ID NO: 1028071 - RNA, 19 nt, Homo sapiens
ucgccaaacugauaaggaa

SEQ ID NO: 1028072 - RNA, 19 nt, Homo sapiens
accuguagauggaugauua

SEQ ID NO: 1028073 - RNA, 19 nt, Homo sapiens
cacaguguuucuaaaugua

SEQ ID NO: 1028074 - RNA, 19 nt, Homo sapiens
gaaaaggccggaacaauca

SEQ ID NO: 1028075 - RNA, 19 nt, Homo sapiens
gcaaggagccccaugaguu

SEQ ID NO: 1028076 - RNA, 19 nt, Homo sapiens
guaugaguuugauggcuuu

SEQ ID NO: 1028077 - RNA, 19 nt, Homo sapiens
ugagacugcuccagaagug

SEQ ID NO: 1028078 - RNA, 19 nt, Homo sapiens
ugaguuugauggcuuugaa

SEQ ID NO: 1028079 - RNA, 19 nt, Homo sapiens
ccggaugggugacuuugaa

SEQ ID NO: 1028080 - RNA, 19 nt, Homo sapiens
cagcuccuuucucuacuuu

SEQ ID NO: 1028081 - RNA, 19 nt, Homo sapiens
uaucuucuuugaccacuug

SEQ ID NO: 1028082 - RNA, 19 nt, Homo sapiens
gccauagggugaauaaagg

SEQ ID NO: 1028083 - RNA, 19 nt, Homo sapiens
agacuugauuguaaacuca

SEQ ID NO: 1028084 - RNA, 19 nt, Homo sapiens
ugaaugagacucugggaau

SEQ ID NO: 1028085 - RNA, 19 nt, Homo sapiens
gaagaggagcuggaugaau

SEQ ID NO: 1028086 - RNA, 19 nt, Homo sapiens
ggaaaccagacacucaaga

SEQ ID NO: 1028087 - RNA, 19 nt, Homo sapiens
caccaguacuccagaggaa

SEQ ID NO: 1028088 - RNA, 19 nt, Homo sapiens
cuaaucacaguguuucuaa

SEQ ID NO: 1028089 - RNA, 19 nt, Homo sapiens
gaaguggagaccagcagaa

SEQ ID NO: 1028090 - RNA, 19 nt, Homo sapiens
agacuggccucagcuguug

SEQ ID NO: 1028091 - RNA, 19 nt, Homo sapiens
ggaaguccaaccuuaguag

SEQ ID NO: 1028092 - RNA, 19 nt, Homo sapiens
gcugagaagccuccuacuu

SEQ ID NO: 1028093 - RNA, 19 nt, Homo sapiens
ggaaaaggccggaacaauc

SEQ ID NO: 1028094 - RNA, 19 nt, Homo sapiens
gaaguccaaccuuaguaga

SEQ ID NO: 1028095 - RNA, 19 nt, Homo sapiens
gagcccaguuuacagaucu

SEQ ID NO: 1028096 - RNA, 19 nt, Homo sapiens
gaaaccagacacucaagag

SEQ ID NO: 1028097 - RNA, 19 nt, Homo sapiens
gcaaauccuacaagagcaa

SEQ ID NO: 1028098 - RNA, 19 nt, Homo sapiens
ugaaggagguccagauucc

SEQ ID NO: 1028099 - RNA, 19 nt, Homo sapiens
gaaaaggaguaugaguuug

SEQ ID NO: 1028100 - RNA, 19 nt, Homo sapiens
ugagaagccuccuacuuuu

SEQ ID NO: 1028101 - RNA, 19 nt, Homo sapiens
ucaucgagcucgcaacaag

SEQ ID NO: 1028102 - RNA, 19 nt, Homo sapiens
acauugagcuccucugcau

SEQ ID NO: 1028103 - RNA, 19 nt, Homo sapiens
gcuagucccgcgacauuga

SEQ ID NO: 1028104 - RNA, 19 nt, Homo sapiens
gcuguaugaugaggacauu

SEQ ID NO: 1028105 - RNA, 19 nt, Homo sapiens
uguacacuguuaagagaaa

SEQ ID NO: 1028106 - RNA, 19 nt, Homo sapiens
ccagagacuccucaauuuc

SEQ ID NO: 1028107 - RNA, 19 nt, Homo sapiens
gggcagggcaaggauauga

SEQ ID NO: 1028108 - RNA, 19 nt, Homo sapiens
gcaaggacaccuccaagcu

SEQ ID NO: 1028109 - RNA, 19 nt, Homo sapiens
ugaagcaguuggagacucu

SEQ ID NO: 1028110 - RNA, 19 nt, Homo sapiens
ugauggcacauauuuauug

SEQ ID NO: 1028111 - RNA, 19 nt, Homo sapiens
gaggaugaugcaaccagua

SEQ ID NO: 1028112 - RNA, 19 nt, Homo sapiens
gcacagccacagaccuuca

SEQ ID NO: 1028113 - RNA, 19 nt, Homo sapiens
gggcacagccacagaccuu

SEQ ID NO: 1028114 - RNA, 19 nt, Homo sapiens
ggcccugccugauguggaa

SEQ ID NO: 1028115 - RNA, 19 nt, Homo sapiens
ggugaauaaaggaauguuu

SEQ ID NO: 1028116 - RNA, 19 nt, Homo sapiens
aaugacggaugaagcaguu

SEQ ID NO: 1028117 - RNA, 19 nt, Homo sapiens
gugcagggacgaagaggaa

SEQ ID NO: 1028118 - RNA, 19 nt, Homo sapiens
ggguuuggcuaaagacagu

SEQ ID NO: 1028119 - RNA, 19 nt, Homo sapiens
acuguacacuguuaagaga

SEQ ID NO: 1028120 - RNA, 19 nt, Homo sapiens
gcaucaaagcugcuggaaa

SEQ ID NO: 1028121 - RNA, 19 nt, Homo sapiens
ccaccucauucaccagaga

SEQ ID NO: 1028122 - RNA, 19 nt, Homo sapiens
ccucgagaagugacuguua

SEQ ID NO: 1028123 - RNA, 19 nt, Homo sapiens
ccgagaggcuaguccuaug

SEQ ID NO: 1028124 - RNA, 19 nt, Homo sapiens
gaacagagcuccugacaac

SEQ ID NO: 1028125 - RNA, 19 nt, Homo sapiens
gaaaugagauggaaaggau

SEQ ID NO: 1028126 - RNA, 19 nt, Homo sapiens
uaaaugagcugauggaaga

SEQ ID NO: 1028127 - RNA, 19 nt, Homo sapiens
ggugagagcuggagaauau

SEQ ID NO: 1028128 - RNA, 19 nt, Homo sapiens
ggacagaugugaacaaagg

SEQ ID NO: 1028129 - RNA, 19 nt, Homo sapiens
gaagauucauccaguguug

SEQ ID NO: 1028130 - RNA, 19 nt, Homo sapiens
caagaaggauugucagaga

SEQ ID NO: 1028131 - RNA, 19 nt, Homo sapiens
ucaagaaccucaacaugaa

SEQ ID NO: 1028132 - RNA, 19 nt, Homo sapiens
cgaaugaauuucccuguuu

SEQ ID NO: 1028133 - RNA, 19 nt, Homo sapiens
gaacaaaggaucaucaaag

SEQ ID NO: 1028134 - RNA, 19 nt, Homo sapiens
gagccgagaucacgucauu

SEQ ID NO: 1028135 - RNA, 19 nt, Homo sapiens
ugaagaagcuagagaggaa

SEQ ID NO: 1028136 - RNA, 19 nt, Homo sapiens
gcacacaugucagcauuga

SEQ ID NO: 1028137 - RNA, 19 nt, Homo sapiens
ccaaacagcugcaggaagu

SEQ ID NO: 1028138 - RNA, 19 nt, Homo sapiens
ggaacuaucuccucucucu

SEQ ID NO: 1028139 - RNA, 19 nt, Homo sapiens
ucacuacccucuugguuaa

SEQ ID NO: 1028140 - RNA, 19 nt, Homo sapiens
ggaaguaaaugagcugaug

SEQ ID NO: 1028141 - RNA, 19 nt, Homo sapiens
ggaacaugcuguggaauug

SEQ ID NO: 1028142 - RNA, 19 nt, Homo sapiens
gaaggauugucagagaaua

SEQ ID NO: 1028143 - RNA, 19 nt, Homo sapiens
gaaugaauuucccuguuug

SEQ ID NO: 1028144 - RNA, 19 nt, Homo sapiens
ugaaggagcuauuugaaca

SEQ ID NO: 1028145 - RNA, 19 nt, Homo sapiens
gaacaacaucggacaguga

SEQ ID NO: 1028146 - RNA, 19 nt, Homo sapiens
gaguugaggugaaaugaga

SEQ ID NO: 1028147 - RNA, 19 nt, Homo sapiens
ucaagaagacugcgaauga

SEQ ID NO: 1028148 - RNA, 19 nt, Homo sapiens
ggaagaugauggcccagaa

SEQ ID NO: 1028149 - RNA, 19 nt, Homo sapiens
ugaggaagaugaaauguca

SEQ ID NO: 1028150 - RNA, 19 nt, Homo sapiens
gaagacugcgaaugaauuu

SEQ ID NO: 1028151 - RNA, 19 nt, Homo sapiens
gggccuagaacccaaauua

SEQ ID NO: 1028152 - RNA, 19 nt, Homo sapiens
caagaagacugcgaaugaa

SEQ ID NO: 1028153 - RNA, 19 nt, Homo sapiens
ggacaugauuguggaguug

SEQ ID NO: 1028154 - RNA, 19 nt, Homo sapiens
gaagccaccuauagagaga

SEQ ID NO: 1028155 - RNA, 19 nt, Homo sapiens
caaaggaucaucaaagaau

SEQ ID NO: 1028156 - RNA, 19 nt, Homo sapiens
guucagcucuugacccaaa

SEQ ID NO: 1028157 - RNA, 19 nt, Homo sapiens
gaagagauccagccacauc

SEQ ID NO: 1028158 - RNA, 19 nt, Homo sapiens
uuucauguauccagaguua

SEQ ID NO: 1028159 - RNA, 19 nt, Homo sapiens
gcaaggcucugucucaaaa

SEQ ID NO: 1028160 - RNA, 19 nt, Homo sapiens
uggccaaccuguuaaauga

SEQ ID NO: 1028161 - RNA, 19 nt, Homo sapiens
uuaaagagcugggaaccuu

SEQ ID NO: 1028162 - RNA, 19 nt, Homo sapiens
ccaccaggauauuucuuaa

SEQ ID NO: 1028163 - RNA, 19 nt, Homo sapiens
ggcgguggcuguaacauga

SEQ ID NO: 1028164 - RNA, 19 nt, Homo sapiens
gcgaaugaauuucccuguu

SEQ ID NO: 1028165 - RNA, 19 nt, Homo sapiens
gaagaaugggccagaagaa

SEQ ID NO: 1028166 - RNA, 19 nt, Homo sapiens
aacaaaggaucaucaaaga

SEQ ID NO: 1028167 - RNA, 19 nt, Homo sapiens
ggaagaagaggacuuugau

SEQ ID NO: 1028168 - RNA, 19 nt, Homo sapiens
gauggaaccugaagaagcu

SEQ ID NO: 1028169 - RNA, 19 nt, Homo sapiens
caagauggaaccugaagaa

SEQ ID NO: 1028170 - RNA, 19 nt, Homo sapiens
cuagagagguaggaaauau

SEQ ID NO: 1028171 - RNA, 19 nt, Homo sapiens
uagaggaaauugucaagau

SEQ ID NO: 1028172 - RNA, 19 nt, Homo sapiens
cagcacacaugucagcauu

SEQ ID NO: 1028173 - RNA, 19 nt, Homo sapiens
uugaacagcugaagaugaa

SEQ ID NO: 1028174 - RNA, 19 nt, Homo sapiens
gaggugaaaugagauggaa

SEQ ID NO: 1028175 - RNA, 19 nt, Homo sapiens
ugaagcagaugaugaugau

SEQ ID NO: 1028176 - RNA, 19 nt, Homo sapiens
ccgaucaacucauucagaa

SEQ ID NO: 1028177 - RNA, 19 nt, Homo sapiens
gaacagcugaagaugaaga

SEQ ID NO: 1028178 - RNA, 19 nt, Homo sapiens
ccggauuccucacccaaua

SEQ ID NO: 1028179 - RNA, 19 nt, Homo sapiens
caagcaagguuuucaugua

SEQ ID NO: 1028180 - RNA, 19 nt, Homo sapiens
cuaugcagcugauugaaga

SEQ ID NO: 1028181 - RNA, 19 nt, Homo sapiens
ggaaguagagaagguuaaa

SEQ ID NO: 1028182 - RNA, 19 nt, Homo sapiens
ucuguuaucuucacuguuc

SEQ ID NO: 1028183 - RNA, 19 nt, Homo sapiens
gagaggagucagccaacua

SEQ ID NO: 1028184 - RNA, 19 nt, Homo sapiens
gucaaggccucucccugua

SEQ ID NO: 1028185 - RNA, 19 nt, Homo sapiens
gagccucguccuaacuuua

SEQ ID NO: 1028186 - RNA, 19 nt, Homo sapiens
gguaaaaccccaucuauau

SEQ ID NO: 1028187 - RNA, 19 nt, Homo sapiens
gaacaccggcucccauucu

SEQ ID NO: 1028188 - RNA, 19 nt, Homo sapiens
ggagaaguaacgaaacaga

SEQ ID NO: 1028189 - RNA, 19 nt, Homo sapiens
cggagacccucaaagagaa

SEQ ID NO: 1028190 - RNA, 19 nt, Homo sapiens
agacggagacccucaaaga

SEQ ID NO: 1028191 - RNA, 19 nt, Homo sapiens
ggaaaaugcugugaagaga

SEQ ID NO: 1028192 - RNA, 19 nt, Homo sapiens
cuuuaggacugaagcauuu

SEQ ID NO: 1028193 - RNA, 19 nt, Homo sapiens
ccaaggcugaggacaauuu

SEQ ID NO: 1028194 - RNA, 19 nt, Homo sapiens
ggacagugaaggagcuauu

SEQ ID NO: 1028195 - RNA, 19 nt, Homo sapiens
aagaagaggacuuugauga

SEQ ID NO: 1028196 - RNA, 19 nt, Homo sapiens
ugagaaaguucaucagacu

SEQ ID NO: 1028197 - RNA, 19 nt, Homo sapiens
ugaugaugauccagaauau

SEQ ID NO: 1028198 - RNA, 19 nt, Homo sapiens
gaagaagaggacuuugaug

SEQ ID NO: 1028199 - RNA, 19 nt, Homo sapiens
gguguaguccugaaacuga

SEQ ID NO: 1028200 - RNA, 19 nt, Homo sapiens
ccaccacccugcaucuguu

SEQ ID NO: 1028201 - RNA, 19 nt, Homo sapiens
caaggccucucccuguaug

SEQ ID NO: 1028202 - RNA, 19 nt, Homo sapiens
gacagaagcguucaucagu

SEQ ID NO: 1028203 - RNA, 19 nt, Homo sapiens
gcuauugccuaagggugua

SEQ ID NO: 1028204 - RNA, 19 nt, Homo sapiens
gaugaugauccagaauaua

SEQ ID NO: 1028205 - RNA, 19 nt, Homo sapiens
guaaugggcugggcuuggu

SEQ ID NO: 1028206 - RNA, 19 nt, Homo sapiens
ugaaucaccugaccauacu

SEQ ID NO: 1028207 - RNA, 19 nt, Homo sapiens
ccacugcuauugccuaagg

SEQ ID NO: 1028208 - RNA, 19 nt, Homo sapiens
gcuccugacaacaucauua

SEQ ID NO: 1028209 - RNA, 19 nt, Homo sapiens
caccaaggcugaggacaau

SEQ ID NO: 1028210 - RNA, 19 nt, Homo sapiens
ggcagaggcaggagaauug

SEQ ID NO: 1028211 - RNA, 19 nt, Homo sapiens
gaaaugucaucagcuucug

SEQ ID NO: 1028212 - RNA, 19 nt, Homo sapiens
uugaugaccucacccaaga

SEQ ID NO: 1028213 - RNA, 19 nt, Homo sapiens
gauccugaagugaggcuua

SEQ ID NO: 1028214 - RNA, 19 nt, Homo sapiens
agaggaaauugucaagaug

SEQ ID NO: 1028215 - RNA, 19 nt, Homo sapiens
ccaggagucucuaaacaac

SEQ ID NO: 1028216 - RNA, 19 nt, Homo sapiens
ugagguggguggaucacaa

SEQ ID NO: 1028217 - RNA, 19 nt, Homo sapiens
caccugaccauacuuuaaa

SEQ ID NO: 1028218 - RNA, 19 nt, Homo sapiens
gaagaugaagcagaugaug

SEQ ID NO: 1028219 - RNA, 19 nt, Homo sapiens
uagcugagccucguccuaa

SEQ ID NO: 1028220 - RNA, 19 nt, Homo sapiens
guuccaacccuguaacuug

SEQ ID NO: 1028221 - RNA, 19 nt, Homo sapiens
ucaccugaccauacuuuaa

SEQ ID NO: 1028222 - RNA, 19 nt, Homo sapiens
gauggaaaggaugaaauuu

SEQ ID NO: 1028223 - RNA, 19 nt, Homo sapiens
gggacaugauuguggaguu

SEQ ID NO: 1028224 - RNA, 19 nt, Homo sapiens
ugacaaggaucaacaauuu

SEQ ID NO: 1028225 - RNA, 19 nt, Homo sapiens
gagaguggcuuaaguggaa

SEQ ID NO: 1028226 - RNA, 19 nt, Homo sapiens
uacccuaucuggcuuauua

SEQ ID NO: 1028227 - RNA, 19 nt, Homo sapiens
ggacugaacugaagagacu

SEQ ID NO: 1028228 - RNA, 19 nt, Homo sapiens
ucaaugaccugcacaacuu

SEQ ID NO: 1028229 - RNA, 19 nt, Homo sapiens
ccgaagaggucccaagauu

SEQ ID NO: 1028230 - RNA, 19 nt, Homo sapiens
ccucaaaccuaccuaauca

SEQ ID NO: 1028231 - RNA, 19 nt, Homo sapiens
gaacugaagagacucaaug

SEQ ID NO: 1028232 - RNA, 19 nt, Homo sapiens
uggcauagcuugcgugugu

SEQ ID NO: 1028233 - RNA, 19 nt, Homo sapiens
uauggaaucugcucccuuu

SEQ ID NO: 1028234 - RNA, 19 nt, Homo sapiens
ggaaugcgccagauauaug

SEQ ID NO: 1028235 - RNA, 19 nt, Homo sapiens
aaaccuaccuaaucauaug

SEQ ID NO: 1028236 - RNA, 19 nt, Homo sapiens
gaaccuauuuguagugaac

SEQ ID NO: 1028237 - RNA, 19 nt, Homo sapiens
gaagaggucccaagauucu

SEQ ID NO: 1028238 - RNA, 19 nt, Homo sapiens
gaucugccacuauuggaua

SEQ ID NO: 1028239 - RNA, 19 nt, Homo sapiens
ggagauuuguuaagaagag

SEQ ID NO: 1028240 - RNA, 19 nt, Homo sapiens
ucaaaccuaccuaaucaua

SEQ ID NO: 1028241 - RNA, 19 nt, Homo sapiens
gcagaugcguuacccuauc

SEQ ID NO: 1028242 - RNA, 19 nt, Homo sapiens
cauggaacccagagacuua

SEQ ID NO: 1028243 - RNA, 19 nt, Homo sapiens
ucccuaagcugcuauggaa

SEQ ID NO: 1028244 - RNA, 19 nt, Homo sapiens
caaaugaaacuagaacaga

SEQ ID NO: 1028245 - RNA, 19 nt, Homo sapiens
gaaguuucuccucaaauga

SEQ ID NO: 1028246 - RNA, 19 nt, Homo sapiens
gauaucaaggcauugcaua

SEQ ID NO: 1028247 - RNA, 19 nt, Homo sapiens
agaaagaggcugagaguca

SEQ ID NO: 1028248 - RNA, 19 nt, Homo sapiens
ccacgaauguagccucugu

SEQ ID NO: 1028249 - RNA, 19 nt, Homo sapiens
gagcaaaggccuucaccau

SEQ ID NO: 1028250 - RNA, 19 nt, Homo sapiens
ucauaugggucauuaccaa

SEQ ID NO: 1028251 - RNA, 19 nt, Homo sapiens
ugaaugcccugcccugcuu

SEQ ID NO: 1028252 - RNA, 19 nt, Homo sapiens
augcggagcuacuguguuu

SEQ ID NO: 1028253 - RNA, 19 nt, Homo sapiens
gaguuguccuggucaucua

SEQ ID NO: 1028254 - RNA, 19 nt, Homo sapiens
ggaccuuccuccuccaaag

SEQ ID NO: 1028255 - RNA, 19 nt, Homo sapiens
ucaaggcauugcauaagga

SEQ ID NO: 1028256 - RNA, 19 nt, Homo sapiens
cuacuguguuugagacuga

SEQ ID NO: 1028257 - RNA, 19 nt, Homo sapiens
gugcugcugcuccucauua

SEQ ID NO: 1028258 - RNA, 19 nt, Homo sapiens
ucaacaauuucaugaugga

SEQ ID NO: 1028259 - RNA, 19 nt, Homo sapiens
gacgguaccagcauuagaa

SEQ ID NO: 1028260 - RNA, 19 nt, Homo sapiens
ccaauuguguuuccaccau

SEQ ID NO: 1028261 - RNA, 19 nt, Homo sapiens
cacagaaccacacauacua

SEQ ID NO: 1028262 - RNA, 19 nt, Homo sapiens
gggcugaaccgaggacuga

SEQ ID NO: 1028263 - RNA, 19 nt, Homo sapiens
gugaaccuauuuguaguga

SEQ ID NO: 1028264 - RNA, 19 nt, Homo sapiens
uauuggauaucaaggcauu

SEQ ID NO: 1028265 - RNA, 19 nt, Homo sapiens
ucucucuacuggucacaua

SEQ ID NO: 1028266 - RNA, 19 nt, Homo sapiens
gugcgacuguaucugguuu

SEQ ID NO: 1028267 - RNA, 19 nt, Homo sapiens
ggugaugggcauucccuaa

SEQ ID NO: 1028268 - RNA, 19 nt, Homo sapiens
uaugggucauuaccaauug

SEQ ID NO: 1028269 - RNA, 19 nt, Homo sapiens
aucaagaucugccacuauu

SEQ ID NO: 1028270 - RNA, 19 nt, Homo sapiens
caacgacgggcaccuggaa

SEQ ID NO: 1028271 - RNA, 19 nt, Homo sapiens
guuugagacugaugugaug

SEQ ID NO: 1028272 - RNA, 19 nt, Homo sapiens
gcggagcuacuguguuuga

SEQ ID NO: 1028273 - RNA, 19 nt, Homo sapiens
uggcuuaaguggaaugcuu

SEQ ID NO: 1028274 - RNA, 19 nt, Homo sapiens
gucauuaccaauuguguuu

SEQ ID NO: 1028275 - RNA, 19 nt, Homo sapiens
gcucuucucucugcuuugg

SEQ ID NO: 1028276 - RNA, 19 nt, Homo sapiens
ccucaaccuuuccaucaug

SEQ ID NO: 1028277 - RNA, 19 nt, Homo sapiens
agaacacccugauguccuu

SEQ ID NO: 1028278 - RNA, 19 nt, Homo sapiens
guacaucgggcucguccuu

SEQ ID NO: 1028279 - RNA, 19 nt, Homo sapiens
caaaccuaccuaaucauau

SEQ ID NO: 1028280 - RNA, 19 nt, Homo sapiens
ccacagaaccacacauacu

SEQ ID NO: 1028281 - RNA, 19 nt, Homo sapiens
acauaugcauccuugcuau

SEQ ID NO: 1028282 - RNA, 19 nt, Homo sapiens
ccugagauguuugggaaga

SEQ ID NO: 1028283 - RNA, 19 nt, Homo sapiens
gagauuuguuaagaagaga

SEQ ID NO: 1028284 - RNA, 19 nt, Homo sapiens
caagaucugccacuauugg

SEQ ID NO: 1028285 - RNA, 19 nt, Homo sapiens
ucagacgguaccagcauua

SEQ ID NO: 1028286 - RNA, 19 nt, Homo sapiens
gagaggccccaguuucuua

SEQ ID NO: 1028287 - RNA, 19 nt, Homo sapiens
cgaagaggucccaagauuc

SEQ ID NO: 1028288 - RNA, 19 nt, Homo sapiens
ccaccuguuugacucauag

SEQ ID NO: 1028289 - RNA, 19 nt, Homo sapiens
acaaggaucaacaauuuca

SEQ ID NO: 1028290 - RNA, 19 nt, Homo sapiens
aaggagauuuguuaagaag

SEQ ID NO: 1028291 - RNA, 19 nt, Homo sapiens
aggcauugcauaaggauaa

SEQ ID NO: 1028292 - RNA, 19 nt, Homo sapiens
cugcagcccucaaccuuuc

SEQ ID NO: 1028293 - RNA, 19 nt, Homo sapiens
aggauaaugucucggugaa

SEQ ID NO: 1028294 - RNA, 19 nt, Homo sapiens
gaacggagaggccccaguu

SEQ ID NO: 1028295 - RNA, 19 nt, Homo sapiens
gaacagaggaaguaaaagg

SEQ ID NO: 1028296 - RNA, 19 nt, Homo sapiens
ggcauucccuaagcugcua

SEQ ID NO: 1028297 - RNA, 19 nt, Homo sapiens
uggauucggucaccaccaa

SEQ ID NO: 1028298 - RNA, 19 nt, Homo sapiens
gaaugcgccagauauaugg

SEQ ID NO: 1028299 - RNA, 19 nt, Homo sapiens
gcccucaaccuuuccauca

SEQ ID NO: 1028300 - RNA, 19 nt, Homo sapiens
ugagauguuugggaagaga

SEQ ID NO: 1028301 - RNA, 19 nt, Homo sapiens
guuggagaguggcuuaagu

SEQ ID NO: 1028302 - RNA, 19 nt, Homo sapiens
ggucauuaccaauuguguu

SEQ ID NO: 1028303 - RNA, 19 nt, Homo sapiens
ucccugagcuggcuguaca

SEQ ID NO: 1028304 - RNA, 19 nt, Homo sapiens
gggcucguccuucucaaug

SEQ ID NO: 1028305 - RNA, 19 nt, Homo sapiens
gaaaacuggcuuagaaaca

SEQ ID NO: 1028306 - RNA, 19 nt, Homo sapiens
ugccuccacugccuguaua

SEQ ID NO: 1028307 - RNA, 19 nt, Homo sapiens
gcugaaccgaggacugaaa

SEQ ID NO: 1028308 - RNA, 19 nt, Homo sapiens
cuaucaagaucugccacua

SEQ ID NO: 1028309 - RNA, 19 nt, Homo sapiens
cagcaggaccacgaaugua

SEQ ID NO: 1028310 - RNA, 19 nt, Homo sapiens
cagcaggaguggcauagcu

SEQ ID NO: 1028311 - RNA, 19 nt, Homo sapiens
uaucaagaucugccacuau

SEQ ID NO: 1028312 - RNA, 19 nt, Homo sapiens
gcugcagcccucaaccuuu

SEQ ID NO: 1028313 - RNA, 19 nt, Homo sapiens
gucagacgguaccagcauu

SEQ ID NO: 1028314 - RNA, 19 nt, Homo sapiens
ggauccugguuccuagaga

SEQ ID NO: 1028315 - RNA, 19 nt, Homo sapiens
gccaccuguuugacucaua

SEQ ID NO: 1028316 - RNA, 19 nt, Homo sapiens
ggagcuacuguguuugaga

SEQ ID NO: 1028317 - RNA, 19 nt, Homo sapiens
uuccucaccuuccuccuuu

SEQ ID NO: 1028318 - RNA, 19 nt, Homo sapiens
ccagagagaggaugcaaac

SEQ ID NO: 1028319 - RNA, 19 nt, Homo sapiens
uggcucuucucucugcuuu

SEQ ID NO: 1028320 - RNA, 19 nt, Homo sapiens
caaccuuuccaucauguuc

SEQ ID NO: 1028321 - RNA, 19 nt, Homo sapiens
cgaauguagccucuguauu

SEQ ID NO: 1028322 - RNA, 19 nt, Homo sapiens
gaaugcggagcuacugugu

SEQ ID NO: 1028323 - RNA, 19 nt, Homo sapiens
ccaagccagucuacauugc

SEQ ID NO: 1028324 - RNA, 19 nt, Homo sapiens
ugacauagcuccuuagaga

SEQ ID NO: 1028325 - RNA, 19 nt, Homo sapiens
ggacgggccugaaagcauu

SEQ ID NO: 1028326 - RNA, 19 nt, Homo sapiens
gggaacaacugaagacuca

SEQ ID NO: 1028327 - RNA, 19 nt, Homo sapiens
ggaaagcaacuucagguuu

SEQ ID NO: 1028328 - RNA, 19 nt, Homo sapiens
gggaagcuguggccucuuu

SEQ ID NO: 1028329 - RNA, 19 nt, Homo sapiens
gcuccacacuuccaucuuu

SEQ ID NO: 1028330 - RNA, 19 nt, Homo sapiens
gcacugagagccaucauug

SEQ ID NO: 1028331 - RNA, 19 nt, Homo sapiens
gggcacagaguaauuuaua

SEQ ID NO: 1028332 - RNA, 19 nt, Homo sapiens
aaucaacuauugccacaaa

SEQ ID NO: 1028333 - RNA, 19 nt, Homo sapiens
ucuguuggguuucuagaua

SEQ ID NO: 1028334 - RNA, 19 nt, Homo sapiens
gcacccagcccaguucuuu

SEQ ID NO: 1028335 - RNA, 19 nt, Homo sapiens
gcaagcgagucaccacguu

SEQ ID NO: 1028336 - RNA, 19 nt, Homo sapiens
gcguggaccugcaugugua

SEQ ID NO: 1028337 - RNA, 19 nt, Homo sapiens
gaacgggguugauggguuu

SEQ ID NO: 1028338 - RNA, 19 nt, Homo sapiens
agauaucucugcgacuuua

SEQ ID NO: 1028339 - RNA, 19 nt, Homo sapiens
ccagcccaguucuuucuua

SEQ ID NO: 1028340 - RNA, 19 nt, Homo sapiens
gguuucaucuugcucuauu

SEQ ID NO: 1028341 - RNA, 19 nt, Homo sapiens
gcaggaugccggcagauau

SEQ ID NO: 1028342 - RNA, 19 nt, Homo sapiens
ccaguuggauugcaguuca

SEQ ID NO: 1028343 - RNA, 19 nt, Homo sapiens
ccuauugucugcucauugu

SEQ ID NO: 1028344 - RNA, 19 nt, Homo sapiens
acauagcuccuuagagaua

SEQ ID NO: 1028345 - RNA, 19 nt, Homo sapiens
cauuucaccucuguguuua

SEQ ID NO: 1028346 - RNA, 19 nt, Homo sapiens
guugauggguuucugugaa

SEQ ID NO: 1028347 - RNA, 19 nt, Homo sapiens
cagcccaguucuuucuuaa

SEQ ID NO: 1028348 - RNA, 19 nt, Homo sapiens
gggaaguggugaaaauuuu

SEQ ID NO: 1028349 - RNA, 19 nt, Homo sapiens
ccucaaaggucuggucugu

SEQ ID NO: 1028350 - RNA, 19 nt, Homo sapiens
ccugagaaauccagagugu

SEQ ID NO: 1028351 - RNA, 19 nt, Homo sapiens
ugugugacauagcuccuua

SEQ ID NO: 1028352 - RNA, 19 nt, Homo sapiens
uaaagcacugugugacaua

SEQ ID NO: 1028353 - RNA, 19 nt, Homo sapiens
guaccaaacaguccagaga

SEQ ID NO: 1028354 - RNA, 19 nt, Homo sapiens
ccuuagagauauaaccuau

SEQ ID NO: 1028355 - RNA, 19 nt, Homo sapiens
gacuuaagaugccaugucu

SEQ ID NO: 1028356 - RNA, 19 nt, Homo sapiens
gaauccaugagcugagaua

SEQ ID NO: 1028357 - RNA, 19 nt, Homo sapiens
ucauuucaccucuguguuu

SEQ ID NO: 1028358 - RNA, 19 nt, Homo sapiens
gcacuauuguucccuccau

SEQ ID NO: 1028359 - RNA, 19 nt, Homo sapiens
ggcacagaguaauuuauau

SEQ ID NO: 1028360 - RNA, 19 nt, Homo sapiens
uguacgagauuccgguuga

SEQ ID NO: 1028361 - RNA, 19 nt, Homo sapiens
guagcucuguguccugaga

SEQ ID NO: 1028362 - RNA, 19 nt, Homo sapiens
gcccaguucuuucuuaaaa

SEQ ID NO: 1028363 - RNA, 19 nt, Homo sapiens
ggacuuaagaugccauguc

SEQ ID NO: 1028364 - RNA, 19 nt, Homo sapiens
uggcuggcuuucuuucuuu

SEQ ID NO: 1028365 - RNA, 19 nt, Homo sapiens
acgcucaggucuccuaaga

SEQ ID NO: 1028366 - RNA, 19 nt, Homo sapiens
ucaacagccuggcccuuuc

SEQ ID NO: 1028367 - RNA, 19 nt, Homo sapiens
gugaauccaugagcugaga

SEQ ID NO: 1028368 - RNA, 19 nt, Homo sapiens
gaacgccaguuggauugca

SEQ ID NO: 1028369 - RNA, 19 nt, Homo sapiens
caacuucagguuucaucuu

SEQ ID NO: 1028370 - RNA, 19 nt, Homo sapiens
uaacugacagguggaaaug

SEQ ID NO: 1028371 - RNA, 19 nt, Homo sapiens
gaaaauuggacuuaagaug

SEQ ID NO: 1028372 - RNA, 19 nt, Homo sapiens
guccguuggugaaggaauu

SEQ ID NO: 1028373 - RNA, 19 nt, Homo sapiens
gaaagcauugacuccauca

SEQ ID NO: 1028374 - RNA, 19 nt, Homo sapiens
ugacagguggaaaugagua

SEQ ID NO: 1028375 - RNA, 19 nt, Homo sapiens
gaugcuggcgggugacuug

SEQ ID NO: 1028376 - RNA, 19 nt, Homo sapiens
caaaagcuccgguugauuc

SEQ ID NO: 1028377 - RNA, 19 nt, Homo sapiens
caccuccucuuccuucuuc

SEQ ID NO: 1028378 - RNA, 19 nt, Homo sapiens
gcaguucaggagcuagaaa

SEQ ID NO: 1028379 - RNA, 19 nt, Homo sapiens
gaaucuuggucuggugaau

SEQ ID NO: 1028380 - RNA, 19 nt, Homo sapiens
gauugcaguucaggagcua

SEQ ID NO: 1028381 - RNA, 19 nt, Homo sapiens
ccauggagcagccgaggaa

SEQ ID NO: 1028382 - RNA, 19 nt, Homo sapiens
uuaaagcacugugugacau

SEQ ID NO: 1028383 - RNA, 19 nt, Homo sapiens
guaacugacagguggaaau

SEQ ID NO: 1028384 - RNA, 19 nt, Homo sapiens
uggcuuucuuucuuucuuu

SEQ ID NO: 1028385 - RNA, 19 nt, Homo sapiens
gaggucugguggaaagcaa

SEQ ID NO: 1028386 - RNA, 19 nt, Homo sapiens
gaggaaggcggugguagug

SEQ ID NO: 1028387 - RNA, 19 nt, Homo sapiens
gcguucaccuuccuugucu

SEQ ID NO: 1028388 - RNA, 19 nt, Homo sapiens
cauagcuccuuagagauau

SEQ ID NO: 1028389 - RNA, 19 nt, Homo sapiens
uuucaccucuguguuuaaa

SEQ ID NO: 1028390 - RNA, 19 nt, Homo sapiens
ggguguggacuguaacuga

SEQ ID NO: 1028391 - RNA, 19 nt, Homo sapiens
cgagggaaguggugaaaau

SEQ ID NO: 1028392 - RNA, 19 nt, Homo sapiens
ugacgggauuuggcccuuu

SEQ ID NO: 1028393 - RNA, 19 nt, Homo sapiens
gagccaucauugaggagau

SEQ ID NO: 1028394 - RNA, 19 nt, Homo sapiens
ugucuuggcugggauuaca

SEQ ID NO: 1028395 - RNA, 19 nt, Homo sapiens
uuaaauagugcuaguuugg

SEQ ID NO: 1028396 - RNA, 19 nt, Homo sapiens
gagauauaaccuauugucu

SEQ ID NO: 1028397 - RNA, 19 nt, Homo sapiens
ggccugaacugagcuaagc

SEQ ID NO: 1028398 - RNA, 19 nt, Homo sapiens
aacuucagguuucaucuug

SEQ ID NO: 1028399 - RNA, 19 nt, Homo sapiens
gcuggacaacugccgcuuu

SEQ ID NO: 1028400 - RNA, 19 nt, Homo sapiens
gugaacgccaguuggauug

SEQ ID NO: 1028401 - RNA, 19 nt, Homo sapiens
uuucuugcuuucuuucuug

SEQ ID NO: 1028402 - RNA, 19 nt, Homo sapiens
uuucuugcuuucuuucuug

SEQ ID NO: 1028403 - RNA, 19 nt, Homo sapiens
ucugcgacuuuaccuacua

SEQ ID NO: 1028404 - RNA, 19 nt, Homo sapiens
cgugaacgccaguuggauu

SEQ ID NO: 1028405 - RNA, 19 nt, Homo sapiens
cagguuucaucuugcucua

SEQ ID NO: 1028406 - RNA, 19 nt, Homo sapiens
ucaccucuguguuuaaagc

SEQ ID NO: 1028407 - RNA, 19 nt, Homo sapiens
aaagcaacuucagguuuca

SEQ ID NO: 1028408 - RNA, 19 nt, Homo sapiens
guggaggacgggccugaaa

SEQ ID NO: 1028409 - RNA, 19 nt, Homo sapiens
gccauauguucaccugcuu

SEQ ID NO: 1028410 - RNA, 19 nt, Homo sapiens
gaucugcccaccuccucuu

SEQ ID NO: 1028411 - RNA, 19 nt, Homo sapiens
ggacgcucaggucuccuaa

SEQ ID NO: 1028412 - RNA, 19 nt, Homo sapiens
ggagacaucacugcaucug

SEQ ID NO: 1028413 - RNA, 19 nt, Homo sapiens
uuggguuucuagauaguuu

SEQ ID NO: 1028414 - RNA, 19 nt, Homo sapiens
uuucuucucucucucucuu

SEQ ID NO: 1028415 - RNA, 19 nt, Homo sapiens
cgaggaaggcggugguagu

SEQ ID NO: 1028416 - RNA, 19 nt, Homo sapiens
gcauugacuccaucaucga

SEQ ID NO: 1028417 - RNA, 19 nt, Homo sapiens
gcuguggccucuuuugaau

SEQ ID NO: 1028418 - RNA, 19 nt, Homo sapiens
uccaugagcugagauacca

SEQ ID NO: 1028419 - RNA, 19 nt, Homo sapiens
gaaaugaguaggggcacua

SEQ ID NO: 1028420 - RNA, 19 nt, Homo sapiens
cuggcuggcuuucuuucuu

SEQ ID NO: 1028421 - RNA, 19 nt, Homo sapiens
cugaaagcauugacuccau

SEQ ID NO: 1028422 - RNA, 19 nt, Homo sapiens
gggacgcucaggucuccua

SEQ ID NO: 1028423 - RNA, 19 nt, Homo sapiens
agagauauaaccuauuguc

SEQ ID NO: 1028424 - RNA, 19 nt, Homo sapiens
gaaacugacucuacucugu

SEQ ID NO: 1028425 - RNA, 19 nt, Homo sapiens
gagcacuccugacccaaua

SEQ ID NO: 1028426 - RNA, 19 nt, Homo sapiens
gggaaacacuggaaauugu

SEQ ID NO: 1028427 - RNA, 19 nt, Homo sapiens
gagggaagcuggauucuac

SEQ ID NO: 1028428 - RNA, 19 nt, Homo sapiens
gaacuuaauaaccugcuua

SEQ ID NO: 1028429 - RNA, 19 nt, Homo sapiens
uaauagaccugcuccagau

SEQ ID NO: 1028430 - RNA, 19 nt, Homo sapiens
gcugggaacuaaagggaaa

SEQ ID NO: 1028431 - RNA, 19 nt, Homo sapiens
ggacguacccggugcuguu

SEQ ID NO: 1028432 - RNA, 19 nt, Homo sapiens
gaaacauggugguccuugu

SEQ ID NO: 1028433 - RNA, 19 nt, Homo sapiens
cagcaggcgucgucuauuc

SEQ ID NO: 1028434 - RNA, 19 nt, Homo sapiens
ucaaacuucucuucuggaa

SEQ ID NO: 1028435 - RNA, 19 nt, Homo sapiens
gaugggaguuuccuuguac

SEQ ID NO: 1028436 - RNA, 19 nt, Homo sapiens
ccacucaccagaacaauug

SEQ ID NO: 1028437 - RNA, 19 nt, Homo sapiens
caagacagaugggaguuuc

SEQ ID NO: 1028438 - RNA, 19 nt, Homo sapiens
aaaccaugcuuagaagaaa

SEQ ID NO: 1028439 - RNA, 19 nt, Homo sapiens
gaagggaaacacuggaaau

SEQ ID NO: 1028440 - RNA, 19 nt, Homo sapiens
ggaggcagagguugcagua

SEQ ID NO: 1028441 - RNA, 19 nt, Homo sapiens
cagaacaauuggaguacuu

SEQ ID NO: 1028442 - RNA, 19 nt, Homo sapiens
agaaugacauccugcugaa

SEQ ID NO: 1028443 - RNA, 19 nt, Homo sapiens
gcugggaacuugaaaccau

SEQ ID NO: 1028444 - RNA, 19 nt, Homo sapiens
guacuugggcagaaacuga

SEQ ID NO: 1028445 - RNA, 19 nt, Homo sapiens
ugugagacuucagguaaua

SEQ ID NO: 1028446 - RNA, 19 nt, Homo sapiens
ggaacuaaagggaaacaug

SEQ ID NO: 1028447 - RNA, 19 nt, Homo sapiens
gaaacacuggaaauuguga

SEQ ID NO: 1028448 - RNA, 19 nt, Homo sapiens
ugaauggccucagucauca

SEQ ID NO: 1028449 - RNA, 19 nt, Homo sapiens
ccuucuaucucaaagcuaa

SEQ ID NO: 1028450 - RNA, 19 nt, Homo sapiens
gcauuguagucagcaguaa

SEQ ID NO: 1028451 - RNA, 19 nt, Homo sapiens
ggcaugccaucaaauaaca

SEQ ID NO: 1028452 - RNA, 19 nt, Homo sapiens
ggaagggaaacacuggaaa

SEQ ID NO: 1028453 - RNA, 19 nt, Homo sapiens
caaagcuaauuguaaaguc

SEQ ID NO: 1028454 - RNA, 19 nt, Homo sapiens
gcacucauccaguccuuca

SEQ ID NO: 1028455 - RNA, 19 nt, Homo sapiens
caccagaacaauuggagua

SEQ ID NO: 1028456 - RNA, 19 nt, Homo sapiens
ggagggaagcuggauucua

SEQ ID NO: 1028457 - RNA, 19 nt, Homo sapiens
gcaaaauuccuccgcagua

SEQ ID NO: 1028458 - RNA, 19 nt, Homo sapiens
gccaucaaauaacagcaaa

SEQ ID NO: 1028459 - RNA, 19 nt, Homo sapiens
ggaccaagcccagcaguac

SEQ ID NO: 1028460 - RNA, 19 nt, Homo sapiens
ggaaacacuggaaauugug

SEQ ID NO: 1028461 - RNA, 19 nt, Homo sapiens
gacaugacuucagguggaa

SEQ ID NO: 1028462 - RNA, 19 nt, Homo sapiens
ggaacuuaauaaccugcuu

SEQ ID NO: 1028463 - RNA, 19 nt, Homo sapiens
agaugggaguuuccuugua

SEQ ID NO: 1028464 - RNA, 19 nt, Homo sapiens
ggcugaagcaggagaauug

SEQ ID NO: 1028465 - RNA, 19 nt, Homo sapiens
cccaggagcucggaauguu

SEQ ID NO: 1028466 - RNA, 19 nt, Homo sapiens
gugcuagacuucauucacu

SEQ ID NO: 1028467 - RNA, 19 nt, Homo sapiens
cagcaguacuaugugugua

SEQ ID NO: 1028468 - RNA, 19 nt, Homo sapiens
ugugauucuugacuacaua

SEQ ID NO: 1028469 - RNA, 19 nt, Homo sapiens
uaccugugauucuugacua

SEQ ID NO: 1028470 - RNA, 19 nt, Homo sapiens
gcccagcaguacuaugugu

SEQ ID NO: 1028471 - RNA, 19 nt, Homo sapiens
ccaauaagaguggcuagga

SEQ ID NO: 1028472 - RNA, 19 nt, Homo sapiens
guggagaugcggaggauga

SEQ ID NO: 1028473 - RNA, 19 nt, Homo sapiens
gcaggggcaugccaucaaa

SEQ ID NO: 1028474 - RNA, 19 nt, Homo sapiens
gugagacucugcuucaaaa

SEQ ID NO: 1028475 - RNA, 19 nt, Homo sapiens
gggccucuguagugaaugu

SEQ ID NO: 1028476 - RNA, 19 nt, Homo sapiens
gagaggcucgguggacgua

SEQ ID NO: 1028477 - RNA, 19 nt, Homo sapiens
aggcagagguugcaguaag

SEQ ID NO: 1028478 - RNA, 19 nt, Homo sapiens
ccuguaaucccagcacuuu

SEQ ID NO: 1028479 - RNA, 19 nt, Homo sapiens
cggaggaugaggagaauga

SEQ ID NO: 1028480 - RNA, 19 nt, Homo sapiens
ggcuaaugcugggaacuug

SEQ ID NO: 1028481 - RNA, 19 nt, Homo sapiens
gugaugcgcacccauaauc

SEQ ID NO: 1028482 - RNA, 19 nt, Homo sapiens
gagcgugggcagcuugugu

SEQ ID NO: 1028483 - RNA, 19 nt, Homo sapiens
gaugugcacgggcagguau

SEQ ID NO: 1028484 - RNA, 19 nt, Homo sapiens
aaugacauccugcugaaug

SEQ ID NO: 1028485 - RNA, 19 nt, Homo sapiens
cccauaauccagcuacuug

SEQ ID NO: 1028486 - RNA, 19 nt, Homo sapiens
ccaagacagaugggaguuu

SEQ ID NO: 1028487 - RNA, 19 nt, Homo sapiens
acagcugucuagaguggaa

SEQ ID NO: 1028488 - RNA, 19 nt, Homo sapiens
acagcuuccugguuaacuu

SEQ ID NO: 1028489 - RNA, 19 nt, Homo sapiens
gggcaugccaucaaauaac

SEQ ID NO: 1028490 - RNA, 19 nt, Homo sapiens
guguaccugugauucuuga

SEQ ID NO: 1028491 - RNA, 19 nt, Homo sapiens
gcuaaugcugggaacuuga

SEQ ID NO: 1028492 - RNA, 19 nt, Homo sapiens
uggaguacuugggcagaaa

SEQ ID NO: 1028493 - RNA, 19 nt, Homo sapiens
gcucggaauguucguggaa

SEQ ID NO: 1028494 - RNA, 19 nt, Homo sapiens
cgucgucuauucaggucaa

SEQ ID NO: 1028495 - RNA, 19 nt, Homo sapiens
gcagcaggcgucgucuauu

SEQ ID NO: 1028496 - RNA, 19 nt, Homo sapiens
aaacauggugguccuugug

SEQ ID NO: 1028497 - RNA, 19 nt, Homo sapiens
ggaacuugaaaccauuguu

SEQ ID NO: 1028498 - RNA, 19 nt, Homo sapiens
aaccauuguuugaguuugu

SEQ ID NO: 1028499 - RNA, 19 nt, Homo sapiens
caaagggaccgggcacagu

SEQ ID NO: 1028500 - RNA, 19 nt, Homo sapiens
cagcaguaacaccaucaaa

SEQ ID NO: 1028501 - RNA, 19 nt, Homo sapiens
cugggaacuugaaaccauu

SEQ ID NO: 1028502 - RNA, 19 nt, Homo sapiens
ccacuuucucuccuucuau

SEQ ID NO: 1028503 - RNA, 19 nt, Homo sapiens
guacaaaaccaugcuuaga

SEQ ID NO: 1028504 - RNA, 19 nt, Homo sapiens
gcucugugccuucucaaac

SEQ ID NO: 1028505 - RNA, 19 nt, Homo sapiens
aagggaaacacuggaaauu

SEQ ID NO: 1028506 - RNA, 19 nt, Homo sapiens
ccugagggacugucugguu

SEQ ID NO: 1028507 - RNA, 19 nt, Homo sapiens
ggaugugcacgggcaggua

SEQ ID NO: 1028508 - RNA, 19 nt, Homo sapiens
ugcuagacuucauucacua

SEQ ID NO: 1028509 - RNA, 19 nt, Homo sapiens
cagccuggccaacauagug

SEQ ID NO: 1028510 - RNA, 19 nt, Homo sapiens
gccacucaccagaacaauu

SEQ ID NO: 1028511 - RNA, 19 nt, Homo sapiens
gggaaacugacucuacucu

SEQ ID NO: 1028512 - RNA, 19 nt, Homo sapiens
cuaaugcugggaacuugaa

SEQ ID NO: 1028513 - RNA, 19 nt, Homo sapiens
ggcagagguugcaguaagc

SEQ ID NO: 1028514 - RNA, 19 nt, Homo sapiens
caucaaaacagguaucuag

SEQ ID NO: 1028515 - RNA, 19 nt, Homo sapiens
auugugagacuucagguaa

SEQ ID NO: 1028516 - RNA, 19 nt, Homo sapiens
gaacaaagacauaaugaug

SEQ ID NO: 1028517 - RNA, 19 nt, Homo sapiens
gcaaacaccacaaccaaua

SEQ ID NO: 1028518 - RNA, 19 nt, Homo sapiens
gaacagcaguaaugaacuu

SEQ ID NO: 1028519 - RNA, 19 nt, Homo sapiens
caauaugucuguccugguu

SEQ ID NO: 1028520 - RNA, 19 nt, Homo sapiens
cagcaguaaugaacuuuaa

SEQ ID NO: 1028521 - RNA, 19 nt, Homo sapiens
gcacauugguuuuggaauu

SEQ ID NO: 1028522 - RNA, 19 nt, Homo sapiens
ccaaaggaacaaagacaua

SEQ ID NO: 1028523 - RNA, 19 nt, Homo sapiens
uggcaaaggugaaggauca

SEQ ID NO: 1028524 - RNA, 19 nt, Homo sapiens
caaaggaacaaagacauaa

SEQ ID NO: 1028525 - RNA, 19 nt, Homo sapiens
guggauaugugcaucaaug

SEQ ID NO: 1028526 - RNA, 19 nt, Homo sapiens
cuuuauggcuccuggauuu

SEQ ID NO: 1028527 - RNA, 19 nt, Homo sapiens
acauagaggugccaaagga

SEQ ID NO: 1028528 - RNA, 19 nt, Homo sapiens
ccaaauauguaugaaagca

SEQ ID NO: 1028529 - RNA, 19 nt, Homo sapiens
cagagaaagaggaaacaua

SEQ ID NO: 1028530 - RNA, 19 nt, Homo sapiens
aacaagccaugcugaagua

SEQ ID NO: 1028531 - RNA, 19 nt, Homo sapiens
caacaacuacucagcuaau

SEQ ID NO: 1028532 - RNA, 19 nt, Homo sapiens
ggucaaggaaauauacaaa

SEQ ID NO: 1028533 - RNA, 19 nt, Homo sapiens
cuacaaugauuucuagucu

SEQ ID NO: 1028534 - RNA, 19 nt, Homo sapiens
ggguaucagucuaaucuca

SEQ ID NO: 1028535 - RNA, 19 nt, Homo sapiens
gcaacaacuacucagcuaa

SEQ ID NO: 1028536 - RNA, 19 nt, Homo sapiens
caaaugauaaauccaagug

SEQ ID NO: 1028537 - RNA, 19 nt, Homo sapiens
caacaagccaugcugaagu

SEQ ID NO: 1028538 - RNA, 19 nt, Homo sapiens
uaugaaagcaacccuguga

SEQ ID NO: 1028539 - RNA, 19 nt, Homo sapiens
aaaccauacccaacccuua

SEQ ID NO: 1028540 - RNA, 19 nt, Homo sapiens
caucacaucuccgggaauc

SEQ ID NO: 1028541 - RNA, 19 nt, Homo sapiens
ggaacaaagacauaaugau

SEQ ID NO: 1028542 - RNA, 19 nt, Homo sapiens
caaacaccacaaccaauau

SEQ ID NO: 1028543 - RNA, 19 nt, Homo sapiens
gaugaucuucucccucuug

SEQ ID NO: 1028544 - RNA, 19 nt, Homo sapiens
ggccuucauuggagugauu

SEQ ID NO: 1028545 - RNA, 19 nt, Homo sapiens
gaacuuuaaagaagaagca

SEQ ID NO: 1028546 - RNA, 19 nt, Homo sapiens
gcaguaaugaacuuuaaag

SEQ ID NO: 1028547 - RNA, 19 nt, Homo sapiens
guaucagucuaaucucaug

SEQ ID NO: 1028548 - RNA, 19 nt, Homo sapiens
aagccaugcugaaguaaau

SEQ ID NO: 1028549 - RNA, 19 nt, Homo sapiens
cacugucucuuccuacauu

SEQ ID NO: 1028550 - RNA, 19 nt, Homo sapiens
gagaaagaggaaacauaga

SEQ ID NO: 1028551 - RNA, 19 nt, Homo sapiens
gcucagcccuacggcauca

SEQ ID NO: 1028552 - RNA, 19 nt, Homo sapiens
agagaaagaggaaacauag

SEQ ID NO: 1028553 - RNA, 19 nt, Homo sapiens
ugucuacaaugauuucuag

SEQ ID NO: 1028554 - RNA, 19 nt, Homo sapiens
ugcaacaacuacucagcua

SEQ ID NO: 1028555 - RNA, 19 nt, Homo sapiens
uaucuuggccuucauugga

SEQ ID NO: 1028556 - RNA, 19 nt, Homo sapiens
ggauugaugcacauugguu

SEQ ID NO: 1028557 - RNA, 19 nt, Homo sapiens
ccacaaccaauaugucugu

SEQ ID NO: 1028558 - RNA, 19 nt, Homo sapiens
gauugaugcacauugguuu

SEQ ID NO: 1028559 - RNA, 19 nt, Homo sapiens
gggaacagcaguaaugaac

SEQ ID NO: 1028560 - RNA, 19 nt, Homo sapiens
caaggagcuuucccguugu

SEQ ID NO: 1028561 - RNA, 19 nt, Homo sapiens
caaccgggucaaggaaaua

SEQ ID NO: 1028562 - RNA, 19 nt, Homo sapiens
ucaaccgggucaaggaaau

SEQ ID NO: 1028563 - RNA, 19 nt, Homo sapiens
gaaguaaaugaaaccauac

SEQ ID NO: 1028564 - RNA, 19 nt, Homo sapiens
cagcuaaugccccuaaaua

SEQ ID NO: 1028565 - RNA, 19 nt, Homo sapiens
gagcagagaaagaggaaac

SEQ ID NO: 1028566 - RNA, 19 nt, Homo sapiens
gaaacauagaggugccaaa

SEQ ID NO: 1028567 - RNA, 19 nt, Homo sapiens
cauuguuaguucuaucuug

SEQ ID NO: 1028568 - RNA, 19 nt, Homo sapiens
gguggccuuucuuuuauua

SEQ ID NO: 1028569 - RNA, 19 nt, Homo sapiens
guaucucccuucacugucu

SEQ ID NO: 1028570 - RNA, 19 nt, Homo sapiens
ccucuuggaguucuucgua

SEQ ID NO: 1028571 - RNA, 19 nt, Homo sapiens
cuaaugccccuaaauagua

SEQ ID NO: 1028572 - RNA, 19 nt, Homo sapiens
aaacauagaggugccaaag

SEQ ID NO: 1028573 - RNA, 19 nt, Homo sapiens
ugaaagcaacccugugaca

SEQ ID NO: 1028574 - RNA, 19 nt, Homo sapiens
caagccaugcugaaguaaa

SEQ ID NO: 1028575 - RNA, 19 nt, Homo sapiens
acuacuacaugcuggcaaa

SEQ ID NO: 1028576 - RNA, 19 nt, Homo sapiens
aagcaaacaccacaaccaa

SEQ ID NO: 1028577 - RNA, 19 nt, Homo sapiens
ccaccaggcagcuuuaugg

SEQ ID NO: 1028578 - RNA, 19 nt, Homo sapiens
uggguucaaucaacuuaga

SEQ ID NO: 1028579 - RNA, 19 nt, Homo sapiens
gcaaaggugaaggaucaga

SEQ ID NO: 1028580 - RNA, 19 nt, Homo sapiens
agaaagaggaaacauagag

SEQ ID NO: 1028581 - RNA, 19 nt, Homo sapiens
gggguggccuuucuuuuau

SEQ ID NO: 1028582 - RNA, 19 nt, Homo sapiens
agaagaagcaaaggcacua

SEQ ID NO: 1028583 - RNA, 19 nt, Homo sapiens
aaacaccacaaccaauaug

SEQ ID NO: 1028584 - RNA, 19 nt, Homo sapiens
ccagaucaugguuggauug

SEQ ID NO: 1028585 - RNA, 19 nt, Homo sapiens
ucacaucuccgggaaucuu

SEQ ID NO: 1028586 - RNA, 19 nt, Homo sapiens
ccgggaaucuuugcuagca

SEQ ID NO: 1028587 - RNA, 19 nt, Homo sapiens
ugacaccagcgucuucuuc

SEQ ID NO: 1028588 - RNA, 19 nt, Homo sapiens
ggaguucuucguagcuugu

SEQ ID NO: 1028589 - RNA, 19 nt, Homo sapiens
ucaacagccucuggguuca

SEQ ID NO: 1028590 - RNA, 19 nt, Homo sapiens
ggcuguaucucccuucacu

SEQ ID NO: 1028591 - RNA, 19 nt, Homo sapiens
caagcaaacaccacaacca

SEQ ID NO: 1028592 - RNA, 19 nt, Homo sapiens
gaagaagcaaaggcacuag

SEQ ID NO: 1028593 - RNA, 19 nt, Homo sapiens
aaucuuugcuagcagucaa

SEQ ID NO: 1028594 - RNA, 19 nt, Homo sapiens
gguucaaucaacuuagaaa

SEQ ID NO: 1028595 - RNA, 19 nt, Homo sapiens
uaaugccccuaaauaguaa

SEQ ID NO: 1028596 - RNA, 19 nt, Homo sapiens
gacaccagcgucuucuuca

SEQ ID NO: 1028597 - RNA, 19 nt, Homo sapiens
acagcaguaaugaacuuua

SEQ ID NO: 1028598 - RNA, 19 nt, Homo sapiens
gccaacaagccaugcugaa

SEQ ID NO: 1028599 - RNA, 19 nt, Homo sapiens
gcuaaugauggcuguaucu

SEQ ID NO: 1028600 - RNA, 19 nt, Homo sapiens
gcagagaaagaggaaacau

SEQ ID NO: 1028601 - RNA, 19 nt, Homo sapiens
gccaugcugaaguaaauga

SEQ ID NO: 1028602 - RNA, 19 nt, Homo sapiens
ugugggaacagcaguaaug

SEQ ID NO: 1028603 - RNA, 19 nt, Homo sapiens
ugauucugcaacucucuua

SEQ ID NO: 1028604 - RNA, 19 nt, Homo sapiens
cuucagcuccucccagaug

SEQ ID NO: 1028605 - RNA, 19 nt, Homo sapiens
ccaacaagccaugcugaag

SEQ ID NO: 1028606 - RNA, 19 nt, Homo sapiens
uacauuaccacuacuacau

SEQ ID NO: 1028607 - RNA, 19 nt, Homo sapiens
cuuccuacauuaccacuac

SEQ ID NO: 1028608 - RNA, 19 nt, Homo sapiens
cauagaggugccaaaggaa

SEQ ID NO: 1028609 - RNA, 19 nt, Homo sapiens
caacagccucuggguucaa

SEQ ID NO: 1028610 - RNA, 19 nt, Homo sapiens
aaggaacaaagacauaaug

SEQ ID NO: 1028611 - RNA, 19 nt, Homo sapiens
gaucauggauugcaaauau

SEQ ID NO: 1028612 - RNA, 19 nt, Homo sapiens
ggaagaagaugaagaggaa

SEQ ID NO: 1028613 - RNA, 19 nt, Homo sapiens
gaaaggauccugagagaaa

SEQ ID NO: 1028614 - RNA, 19 nt, Homo sapiens
ggaagaagcucacuacaag

SEQ ID NO: 1028615 - RNA, 19 nt, Homo sapiens
gagcguaacaucuguauua

SEQ ID NO: 1028616 - RNA, 19 nt, Homo sapiens
gcacacaaauguuggcaaa

SEQ ID NO: 1028617 - RNA, 19 nt, Homo sapiens
ggaccaaacuacuuacuug

SEQ ID NO: 1028618 - RNA, 19 nt, Homo sapiens
gauaaucccuaccaaguga

SEQ ID NO: 1028619 - RNA, 19 nt, Homo sapiens
ucacuucacuguuccauuu

SEQ ID NO: 1028620 - RNA, 19 nt, Homo sapiens
ggagagaaguuuauaaagg

SEQ ID NO: 1028621 - RNA, 19 nt, Homo sapiens
gagcagggaucuuauaaag

SEQ ID NO: 1028622 - RNA, 19 nt, Homo sapiens
ggaaucugaugaugaguuu

SEQ ID NO: 1028623 - RNA, 19 nt, Homo sapiens
guacagaauuaucaacuga

SEQ ID NO: 1028624 - RNA, 19 nt, Homo sapiens
uuaagaggguacagaauua

SEQ ID NO: 1028625 - RNA, 19 nt, Homo sapiens
gaagugagaugcaugaaac

SEQ ID NO: 1028626 - RNA, 19 nt, Homo sapiens
cugcauagcuguauuauag

SEQ ID NO: 1028627 - RNA, 19 nt, Homo sapiens
ggauauccaugacgacauu

SEQ ID NO: 1028628 - RNA, 19 nt, Homo sapiens
cagcaguguugaccauuua

SEQ ID NO: 1028629 - RNA, 19 nt, Homo sapiens
gaugaugucuuaacucuac

SEQ ID NO: 1028630 - RNA, 19 nt, Homo sapiens
gcauauaguuacaguagug

SEQ ID NO: 1028631 - RNA, 19 nt, Homo sapiens
ucagcuagcuuugaaauug

SEQ ID NO: 1028632 - RNA, 19 nt, Homo sapiens
agacagaaccaaagcaaua

SEQ ID NO: 1028633 - RNA, 19 nt, Homo sapiens
gaaucugccucccaaguug

SEQ ID NO: 1028634 - RNA, 19 nt, Homo sapiens
ggaguuugguaauuagauu

SEQ ID NO: 1028635 - RNA, 19 nt, Homo sapiens
gagaccgaauuaaagauaa

SEQ ID NO: 1028636 - RNA, 19 nt, Homo sapiens
cuacagcucuaguucauug

SEQ ID NO: 1028637 - RNA, 19 nt, Homo sapiens
guaaugugaugaagugaug

SEQ ID NO: 1028638 - RNA, 19 nt, Homo sapiens
acagagagaucccaagaga

SEQ ID NO: 1028639 - RNA, 19 nt, Homo sapiens
ggaugaaggagauauguuu

SEQ ID NO: 1028640 - RNA, 19 nt, Homo sapiens
gaauagaugugugggugaa

SEQ ID NO: 1028641 - RNA, 19 nt, Homo sapiens
guggaucucuugcauauuc

SEQ ID NO: 1028642 - RNA, 19 nt, Homo sapiens
gagaguguaugucugucua

SEQ ID NO: 1028643 - RNA, 19 nt, Homo sapiens
gaaaagaccaucucuguga

SEQ ID NO: 1028644 - RNA, 19 nt, Homo sapiens
gaauguagucuucuuugaa

SEQ ID NO: 1028645 - RNA, 19 nt, Homo sapiens
gcagauaccaccacugaau

SEQ ID NO: 1028646 - RNA, 19 nt, Homo sapiens
caacagguauaaccauauc

SEQ ID NO: 1028647 - RNA, 19 nt, Homo sapiens
uaaagaguguaaagaccua

SEQ ID NO: 1028648 - RNA, 19 nt, Homo sapiens
uggaaagauugcuggauua

SEQ ID NO: 1028649 - RNA, 19 nt, Homo sapiens
guguaaacauugacaggua

SEQ ID NO: 1028650 - RNA, 19 nt, Homo sapiens
ggauuuccauguagauaga

SEQ ID NO: 1028651 - RNA, 19 nt, Homo sapiens
gaaagauugcuggauuaua

SEQ ID NO: 1028652 - RNA, 19 nt, Homo sapiens
uauauauggugcucacuuu

SEQ ID NO: 1028653 - RNA, 19 nt, Homo sapiens
caagcaguguaaauacuuu

SEQ ID NO: 1028654 - RNA, 19 nt, Homo sapiens
uacagaaggugcacacaaa

SEQ ID NO: 1028655 - RNA, 19 nt, Homo sapiens
cgaaaagccuauuauguaa

SEQ ID NO: 1028656 - RNA, 19 nt, Homo sapiens
gucuuaagcuauaguguaa

SEQ ID NO: 1028657 - RNA, 19 nt, Homo sapiens
gcuuuaaccuauuccugua

SEQ ID NO: 1028658 - RNA, 19 nt, Homo sapiens
gaaccaaagcaauaacguu

SEQ ID NO: 1028659 - RNA, 19 nt, Homo sapiens
gcaccaaguacauuauuga

SEQ ID NO: 1028660 - RNA, 19 nt, Homo sapiens
gugaaacacugacaaugau

SEQ ID NO: 1028661 - RNA, 19 nt, Homo sapiens
ggcaauaaacucuuuguug

SEQ ID NO: 1028662 - RNA, 19 nt, Homo sapiens
cguaacaucuguauuaaac

SEQ ID NO: 1028663 - RNA, 19 nt, Homo sapiens
agacgcaucugguccugua

SEQ ID NO: 1028664 - RNA, 19 nt, Homo sapiens
ucuggaaccucuuauaaau

SEQ ID NO: 1028665 - RNA, 19 nt, Homo sapiens
gaacggauaaagagcaaga

SEQ ID NO: 1028666 - RNA, 19 nt, Homo sapiens
gaauuggaacggauaaaga

SEQ ID NO: 1028667 - RNA, 19 nt, Homo sapiens
ggaccagcauggcaggauu

SEQ ID NO: 1028668 - RNA, 19 nt, Homo sapiens
guuaagaggguacagaauu

SEQ ID NO: 1028669 - RNA, 19 nt, Homo sapiens
gcugugagaccgaauuaaa

SEQ ID NO: 1028670 - RNA, 19 nt, Homo sapiens
gcacaucaccaaagaacug

SEQ ID NO: 1028671 - RNA, 19 nt, Homo sapiens
gcaugcugcuagacacuuu

SEQ ID NO: 1028672 - RNA, 19 nt, Homo sapiens
aagaugaccucccugaguu

SEQ ID NO: 1028673 - RNA, 19 nt, Homo sapiens
uaaagggccagaaauaaga

SEQ ID NO: 1028674 - RNA, 19 nt, Homo sapiens
ugaggagggucuuaaugaa

SEQ ID NO: 1028675 - RNA, 19 nt, Homo sapiens
ggaagugagaugcaugaaa

SEQ ID NO: 1028676 - RNA, 19 nt, Homo sapiens
ugauuucccucauugugua

SEQ ID NO: 1028677 - RNA, 19 nt, Homo sapiens
gaucagcaguguugaccau

SEQ ID NO: 1028678 - RNA, 19 nt, Homo sapiens
uauaaagggccagaaauaa

SEQ ID NO: 1028679 - RNA, 19 nt, Homo sapiens
uuauaaagggccagaaaua

SEQ ID NO: 1028680 - RNA, 19 nt, Homo sapiens
gaagccauagaacauauuu

SEQ ID NO: 1028681 - RNA, 19 nt, Homo sapiens
augaagugaugaugucuua

SEQ ID NO: 1028682 - RNA, 19 nt, Homo sapiens
gaccuucugugauguggaa

SEQ ID NO: 1028683 - RNA, 19 nt, Homo sapiens
uagaagcccuggaaaccaa

SEQ ID NO: 1028684 - RNA, 19 nt, Homo sapiens
gagcacaacagcaucauuc

SEQ ID NO: 1028685 - RNA, 19 nt, Homo sapiens
gcuacaaaguauaacauuc

SEQ ID NO: 1028686 - RNA, 19 nt, Homo sapiens
gggaagaagcucacuacaa

SEQ ID NO: 1028687 - RNA, 19 nt, Homo sapiens
uaacuaacccauauguguu

SEQ ID NO: 1028688 - RNA, 19 nt, Homo sapiens
aagaugcucuguguaaauu

SEQ ID NO: 1028689 - RNA, 19 nt, Homo sapiens
gcacuuagaaauuuguugu

SEQ ID NO: 1028690 - RNA, 19 nt, Homo sapiens
cccaggaccuugaggauga

SEQ ID NO: 1028691 - RNA, 19 nt, Homo sapiens
gcucagauaguucaugcua

SEQ ID NO: 1028692 - RNA, 19 nt, Homo sapiens
uaacaucguccgccuuuau

SEQ ID NO: 1028693 - RNA, 19 nt, Homo sapiens
gugacaaucuugacaccaa

SEQ ID NO: 1028694 - RNA, 19 nt, Homo sapiens
cacuguauauugcaaauug

SEQ ID NO: 1028695 - RNA, 19 nt, Homo sapiens
ccacaccuguuugucuuaa

SEQ ID NO: 1028696 - RNA, 19 nt, Homo sapiens
ccaaagcaauaacguugug

SEQ ID NO: 1028697 - RNA, 19 nt, Homo sapiens
guccugaccuucugugaug

SEQ ID NO: 1028698 - RNA, 19 nt, Homo sapiens
guucugcacuuaaccuaga

SEQ ID NO: 1028699 - RNA, 19 nt, Homo sapiens
gggagcaccaaguacauua

SEQ ID NO: 1028700 - RNA, 19 nt, Homo sapiens
ggagaccagugaugaugau

SEQ ID NO: 1028701 - RNA, 19 nt, Homo sapiens
ggaucgagacgccauugua

SEQ ID NO: 1028702 - RNA, 19 nt, Homo sapiens
cagaccaaacuauaucuua

SEQ ID NO: 1028703 - RNA, 19 nt, Homo sapiens
gugaagccauagaacauau

SEQ ID NO: 1028704 - RNA, 19 nt, Homo sapiens
cacugacucugcuacuuua

SEQ ID NO: 1028705 - RNA, 19 nt, Homo sapiens
guaggacacuguauauugc

SEQ ID NO: 1028706 - RNA, 19 nt, Homo sapiens
acacaaauguuggcaaagu

SEQ ID NO: 1028707 - RNA, 19 nt, Homo sapiens
uguaauaggugagauaaag

SEQ ID NO: 1028708 - RNA, 19 nt, Homo sapiens
uaucuggaaccucuuauaa

SEQ ID NO: 1028709 - RNA, 19 nt, Homo sapiens
gaccaucucugugaacauc

SEQ ID NO: 1028710 - RNA, 19 nt, Homo sapiens
gggcggaagugucuguuca

SEQ ID NO: 1028711 - RNA, 19 nt, Homo sapiens
ggaagaagcucagaaagac

SEQ ID NO: 1028712 - RNA, 19 nt, Homo sapiens
gagcuuugaugcugucuug

SEQ ID NO: 1028713 - RNA, 19 nt, Homo sapiens
caaaggaggcgcucuauag

SEQ ID NO: 1028714 - RNA, 19 nt, Homo sapiens
gcaaaggaggcgcucuaua

SEQ ID NO: 1028715 - RNA, 19 nt, Homo sapiens
agagguggcuggucauuga

SEQ ID NO: 1028716 - RNA, 19 nt, Homo sapiens
gaagggccauccagaccaa

SEQ ID NO: 1028717 - RNA, 19 nt, Homo sapiens
ccaagggacuggagccuau

SEQ ID NO: 1028718 - RNA, 19 nt, Homo sapiens
ggaaucugguagagaguga

SEQ ID NO: 1028719 - RNA, 19 nt, Homo sapiens
gcauggacauucugaagca

SEQ ID NO: 1028720 - RNA, 19 nt, Homo sapiens
ggaugucuuuguucgguuu

SEQ ID NO: 1028721 - RNA, 19 nt, Homo sapiens
gcaacgacaugcuccucuu

SEQ ID NO: 1028722 - RNA, 19 nt, Homo sapiens
ucagugugcuggcguuuga

SEQ ID NO: 1028723 - RNA, 19 nt, Homo sapiens
gaaccacucaaaccaauuc

SEQ ID NO: 1028724 - RNA, 19 nt, Homo sapiens
aggaugaggugccuaagaa

SEQ ID NO: 1028725 - RNA, 19 nt, Homo sapiens
ucacugaaaccaccaaguu

SEQ ID NO: 1028726 - RNA, 19 nt, Homo sapiens
ccaugaagcuggccaacca

SEQ ID NO: 1028727 - RNA, 19 nt, Homo sapiens
uaucagacagcaauugaaa

SEQ ID NO: 1028728 - RNA, 19 nt, Homo sapiens
ggacggggcuaacgaugaa

SEQ ID NO: 1028729 - RNA, 19 nt, Homo sapiens
gagauccuguuuccucauc

SEQ ID NO: 1028730 - RNA, 19 nt, Homo sapiens
gaagugggacggccaagca

SEQ ID NO: 1028731 - RNA, 19 nt, Homo sapiens
gcaagggagucagggaaca

SEQ ID NO: 1028732 - RNA, 19 nt, Homo sapiens
agaccagugugaucaagaa

SEQ ID NO: 1028733 - RNA, 19 nt, Homo sapiens
gaacucaccaagcucauac

SEQ ID NO: 1028734 - RNA, 19 nt, Homo sapiens
ggagcuaaaugagguccuu

SEQ ID NO: 1028735 - RNA, 19 nt, Homo sapiens
aggcugaguucuuggcuuu

SEQ ID NO: 1028736 - RNA, 19 nt, Homo sapiens
ccaagggcaucaaguucga

SEQ ID NO: 1028737 - RNA, 19 nt, Homo sapiens
uggaagaagcucagaaaga

SEQ ID NO: 1028738 - RNA, 19 nt, Homo sapiens
ggacggaugaggacgacuu

SEQ ID NO: 1028739 - RNA, 19 nt, Homo sapiens
gaagaugcacaagaggaaa

SEQ ID NO: 1028740 - RNA, 19 nt, Homo sapiens
cgaucuggaugucuuuguu

SEQ ID NO: 1028741 - RNA, 19 nt, Homo sapiens
ccgcagcuucuuccucuua

SEQ ID NO: 1028742 - RNA, 19 nt, Homo sapiens
gagcauggacauucugaag

SEQ ID NO: 1028743 - RNA, 19 nt, Homo sapiens
ccaccaaguuugaaaaguu

SEQ ID NO: 1028744 - RNA, 19 nt, Homo sapiens
gaggaugaggugccuaaga

SEQ ID NO: 1028745 - RNA, 19 nt, Homo sapiens
cagaaguggcccagcagua

SEQ ID NO: 1028746 - RNA, 19 nt, Homo sapiens
gacaagaccagugugauca

SEQ ID NO: 1028747 - RNA, 19 nt, Homo sapiens
ggaugaaggcccagaggau

SEQ ID NO: 1028748 - RNA, 19 nt, Homo sapiens
gaaccagacaagcagacaa

SEQ ID NO: 1028749 - RNA, 19 nt, Homo sapiens
gaccaagggcaucaaguuc

SEQ ID NO: 1028750 - RNA, 19 nt, Homo sapiens
gaagaagcucagaaagaca

SEQ ID NO: 1028751 - RNA, 19 nt, Homo sapiens
cacuggagauagcauguga

SEQ ID NO: 1028752 - RNA, 19 nt, Homo sapiens
gcagcuggccuuccuagag

SEQ ID NO: 1028753 - RNA, 19 nt, Homo sapiens
ccgcguggcuaagagcuuu

SEQ ID NO: 1028754 - RNA, 19 nt, Homo sapiens
ggcuaacgaugaagaacug

SEQ ID NO: 1028755 - RNA, 19 nt, Homo sapiens
ggagguaaugguccggauu

SEQ ID NO: 1028756 - RNA, 19 nt, Homo sapiens
aaagacaagaccaguguga

SEQ ID NO: 1028757 - RNA, 19 nt, Homo sapiens
ggagaagcucaaaggcaaa

SEQ ID NO: 1028758 - RNA, 19 nt, Homo sapiens
gcaguaccaggacaucaug

SEQ ID NO: 1028759 - RNA, 19 nt, Homo sapiens
ugaagaugcacaagaggaa

SEQ ID NO: 1028760 - RNA, 19 nt, Homo sapiens
gagguaaugguccggauuc

SEQ ID NO: 1028761 - RNA, 19 nt, Homo sapiens
agaaagacaagaccagugu

SEQ ID NO: 1028762 - RNA, 19 nt, Homo sapiens
ccguggaugucgcugaauu

SEQ ID NO: 1028763 - RNA, 19 nt, Homo sapiens
gucaagcaauaccaagaug

SEQ ID NO: 1028764 - RNA, 19 nt, Homo sapiens
ccagacaagcagacaauca

SEQ ID NO: 1028765 - RNA, 19 nt, Homo sapiens
gagcgcaucgucaagcaau

SEQ ID NO: 1028766 - RNA, 19 nt, Homo sapiens
ggagucagggaacagauca

SEQ ID NO: 1028767 - RNA, 19 nt, Homo sapiens
gggcaucaaguucgaagug

SEQ ID NO: 1028768 - RNA, 19 nt, Homo sapiens
agaccaagggcaucaaguu

SEQ ID NO: 1028769 - RNA, 19 nt, Homo sapiens
gaaaucugccgggaguugu

SEQ ID NO: 1028770 - RNA, 19 nt, Homo sapiens
caagaccagugugaucaag

SEQ ID NO: 1028771 - RNA, 19 nt, Homo sapiens
cguggagggugccaagaug

SEQ ID NO: 1028772 - RNA, 19 nt, Homo sapiens
gccagcacauggaauaaaa

SEQ ID NO: 1028773 - RNA, 19 nt, Homo sapiens
caucaaguucgaagugguu

SEQ ID NO: 1028774 - RNA, 19 nt, Homo sapiens
cugaaccacucaaaccaau

SEQ ID NO: 1028775 - RNA, 19 nt, Homo sapiens
gagagacccggaugaggau

SEQ ID NO: 1028776 - RNA, 19 nt, Homo sapiens
gggcauccagccuugaaga

SEQ ID NO: 1028777 - RNA, 19 nt, Homo sapiens
ugacagcccagcaguugga

SEQ ID NO: 1028778 - RNA, 19 nt, Homo sapiens
guucaaggagcaguucaaa

SEQ ID NO: 1028779 - RNA, 19 nt, Homo sapiens
cguggaagaagcucagaaa

SEQ ID NO: 1028780 - RNA, 19 nt, Homo sapiens
gaucuggaugucuuuguuc

SEQ ID NO: 1028781 - RNA, 19 nt, Homo sapiens
ugucaacaaggacgacuuu

SEQ ID NO: 1028782 - RNA, 19 nt, Homo sapiens
caugugagguccgggagau

SEQ ID NO: 1028783 - RNA, 19 nt, Homo sapiens
ugaacucaccaagcucaua

SEQ ID NO: 1028784 - RNA, 19 nt, Homo sapiens
acuggaggcugaguucuug

SEQ ID NO: 1028785 - RNA, 19 nt, Homo sapiens
gcaugagagacccggauga

SEQ ID NO: 1028786 - RNA, 19 nt, Homo sapiens
ggaggccauugagaagaug

SEQ ID NO: 1028787 - RNA, 19 nt, Homo sapiens
uggaggccauugagaagau

SEQ ID NO: 1028788 - RNA, 19 nt, Homo sapiens
ggccagcacauggaauaaa

SEQ ID NO: 1028789 - RNA, 19 nt, Homo sapiens
cauuuuaucuuccccuuga

SEQ ID NO: 1028790 - RNA, 19 nt, Homo sapiens
gagagguggcuggucauug

SEQ ID NO: 1028791 - RNA, 19 nt, Homo sapiens
agacaagaccagugugauc

SEQ ID NO: 1028792 - RNA, 19 nt, Homo sapiens
cgacaugcuccucuucauc

SEQ ID NO: 1028793 - RNA, 19 nt, Homo sapiens
cagaggaugaagaggauga

SEQ ID NO: 1028794 - RNA, 19 nt, Homo sapiens
ugaaagcgccagacaagcu

SEQ ID NO: 1028795 - RNA, 19 nt, Homo sapiens
gacaaucagcggacaaucg

SEQ ID NO: 1028796 - RNA, 19 nt, Homo sapiens
cacaguugcugggcccaaa

SEQ ID NO: 1028797 - RNA, 19 nt, Homo sapiens
gcuggaugcacuggagaua

SEQ ID NO: 1028798 - RNA, 19 nt, Homo sapiens
gcugaguucuuggcuuugg

SEQ ID NO: 1028799 - RNA, 19 nt, Homo sapiens
caacgacaugcuccucuuc

SEQ ID NO: 1028800 - RNA, 19 nt, Homo sapiens
ccuggagacugccaugaag

SEQ ID NO: 1028801 - RNA, 19 nt, Homo sapiens
gcuaaaugagguccuugga

SEQ ID NO: 1028802 - RNA, 19 nt, Homo sapiens
gcagacaaucagcggacaa

SEQ ID NO: 1028803 - RNA, 19 nt, Homo sapiens
gagccgacacagccacgaa

SEQ ID NO: 1028804 - RNA, 19 nt, Homo sapiens
agcggcagcugcaguucua

SEQ ID NO: 1028805 - RNA, 19 nt, Homo sapiens
guaccaggacaucaugcaa

SEQ ID NO: 1028806 - RNA, 19 nt, Homo sapiens
aagaagcucagaaagacaa

SEQ ID NO: 1028807 - RNA, 19 nt, Homo sapiens
gagacccggaugaggauga

SEQ ID NO: 1028808 - RNA, 19 nt, Homo sapiens
cccagaggaugaagaggau

SEQ ID NO: 1028809 - RNA, 19 nt, Homo sapiens
ucuaucagacagcaauuga

SEQ ID NO: 1028810 - RNA, 19 nt, Homo sapiens
cgacuuggaggcugaugau

SEQ ID NO: 1028811 - RNA, 19 nt, Homo sapiens
ucgagaaccuggacgauaa

SEQ ID NO: 1028812 - RNA, 19 nt, Homo sapiens
gcucaaggcuggagugucu

SEQ ID NO: 1028813 - RNA, 19 nt, Homo sapiens
gcagccgccuggugcuuua

SEQ ID NO: 1028814 - RNA, 19 nt, Homo sapiens
ugagguuucuagugaauuu

SEQ ID NO: 1028815 - RNA, 19 nt, Homo sapiens
uaaacgaggccacaaauca

SEQ ID NO: 1028816 - RNA, 19 nt, Homo sapiens
gaaggugcuuugggcguuu

SEQ ID NO: 1028817 - RNA, 19 nt, Homo sapiens
ccaccucccucccaaacuu

SEQ ID NO: 1028818 - RNA, 19 nt, Homo sapiens
caaauucugcgcuuaagga

SEQ ID NO: 1028819 - RNA, 19 nt, Homo sapiens
ccaaagugcugggauuaca

SEQ ID NO: 1028820 - RNA, 19 nt, Homo sapiens
gaucucagggccaacaauu

SEQ ID NO: 1028821 - RNA, 19 nt, Homo sapiens
ggggaaauuuuaucucuuu

SEQ ID NO: 1028822 - RNA, 19 nt, Homo sapiens
gcuucaaggugguaacaga

SEQ ID NO: 1028823 - RNA, 19 nt, Homo sapiens
ccgaguagcugggauuaca

SEQ ID NO: 1028824 - RNA, 19 nt, Homo sapiens
gaccuaaggggaaauuuua

SEQ ID NO: 1028825 - RNA, 19 nt, Homo sapiens
ggagaccucgcgcaaguau

SEQ ID NO: 1028826 - RNA, 19 nt, Homo sapiens
gcgaugaccagucccgaaa

SEQ ID NO: 1028827 - RNA, 19 nt, Homo sapiens
ggccaaauucugcgcuuaa

SEQ ID NO: 1028828 - RNA, 19 nt, Homo sapiens
gcgcgcucgugcugcaaua

SEQ ID NO: 1028829 - RNA, 19 nt, Homo sapiens
caucgugggcuuccaaguu

SEQ ID NO: 1028830 - RNA, 19 nt, Homo sapiens
gagcaucggcuuguaucaa

SEQ ID NO: 1028831 - RNA, 19 nt, Homo sapiens
ucaggccgcuugaaagucu

SEQ ID NO: 1028832 - RNA, 19 nt, Homo sapiens
agcaucggcuuguaucaaa

SEQ ID NO: 1028833 - RNA, 19 nt, Homo sapiens
gaugaccagucccgaaagg

SEQ ID NO: 1028834 - RNA, 19 nt, Homo sapiens
cggugaaccuccuguagug

SEQ ID NO: 1028835 - RNA, 19 nt, Homo sapiens
gacgggacguuuggguuga

SEQ ID NO: 1028836 - RNA, 19 nt, Homo sapiens
caaaguucuucaccuucga

SEQ ID NO: 1028837 - RNA, 19 nt, Homo sapiens
uaaggagaaugugcaccaa

SEQ ID NO: 1028838 - RNA, 19 nt, Homo sapiens
cucccaaacuugcccauug

SEQ ID NO: 1028839 - RNA, 19 nt, Homo sapiens
uauaaacgaggccacaaau

SEQ ID NO: 1028840 - RNA, 19 nt, Homo sapiens
gcucuggucuggccuucgu

SEQ ID NO: 1028841 - RNA, 19 nt, Homo sapiens
gaaggagcugggagaagga

SEQ ID NO: 1028842 - RNA, 19 nt, Homo sapiens
gggcuaccaggaaaccuuu

SEQ ID NO: 1028843 - RNA, 19 nt, Homo sapiens
guugauggcggcaguagga

SEQ ID NO: 1028844 - RNA, 19 nt, Homo sapiens
ggagaaugugcaccaagug

SEQ ID NO: 1028845 - RNA, 19 nt, Homo sapiens
agccaaaguucuucaccuu

SEQ ID NO: 1028846 - RNA, 19 nt, Homo sapiens
cgaucucgguucacugcaa

SEQ ID NO: 1028847 - RNA, 19 nt, Homo sapiens
ccugagguuucuagugaau

SEQ ID NO: 1028848 - RNA, 19 nt, Homo sapiens
uccaaguucucaacgcuau

SEQ ID NO: 1028849 - RNA, 19 nt, Homo sapiens
aaacgaggccacaaaucau

SEQ ID NO: 1028850 - RNA, 19 nt, Homo sapiens
ucacucaggucguguuuuc

SEQ ID NO: 1028851 - RNA, 19 nt, Homo sapiens
uggccaggcuagucacgaa

SEQ ID NO: 1028852 - RNA, 19 nt, Homo sapiens
gacacgaucucgguucacu

SEQ ID NO: 1028853 - RNA, 19 nt, Homo sapiens
aggagaaugugcaccaagu

SEQ ID NO: 1028854 - RNA, 19 nt, Homo sapiens
gccaaauucugcgcuuaag

SEQ ID NO: 1028855 - RNA, 19 nt, Homo sapiens
gcugagcaucggcuuguau

SEQ ID NO: 1028856 - RNA, 19 nt, Homo sapiens
gcgcugccuucugcugcua

SEQ ID NO: 1028857 - RNA, 19 nt, Homo sapiens
ugccucagccucccgagua

SEQ ID NO: 1028858 - RNA, 19 nt, Homo sapiens
uuauaaacgaggccacaaa

SEQ ID NO: 1028859 - RNA, 19 nt, Homo sapiens
ccaggacgccacgcaagaa

SEQ ID NO: 1028860 - RNA, 19 nt, Homo sapiens
ccacggugaaccuccugua

SEQ ID NO: 1028861 - RNA, 19 nt, Homo sapiens
gggauguggucagcugcuu

SEQ ID NO: 1028862 - RNA, 19 nt, Homo sapiens
ccccugagguuucuaguga

SEQ ID NO: 1028863 - RNA, 19 nt, Homo sapiens
gaacuccugaccucgugau

SEQ ID NO: 1028864 - RNA, 19 nt, Homo sapiens
gaguucagcccagcucugu

SEQ ID NO: 1028865 - RNA, 19 nt, Homo sapiens
ccuggugguuggugucugu

SEQ ID NO: 1028866 - RNA, 19 nt, Homo sapiens
gaagugggguucucauucc

SEQ ID NO: 1028867 - RNA, 19 nt, Homo sapiens
ggacgacguggagcucaug

SEQ ID NO: 1028868 - RNA, 19 nt, Homo sapiens
aggccaaauucugcgcuua

SEQ ID NO: 1028869 - RNA, 19 nt, Homo sapiens
gagggcagcgaggagguuu

SEQ ID NO: 1028870 - RNA, 19 nt, Homo sapiens
ggagaaagcuggcuguugu

SEQ ID NO: 1028871 - RNA, 19 nt, Homo sapiens
caagaaauguggacaagga

SEQ ID NO: 1028872 - RNA, 19 nt, Homo sapiens
ggacaaggagggacauuug

SEQ ID NO: 1028873 - RNA, 19 nt, Homo sapiens
gcucagaacuggcgguuuu

SEQ ID NO: 1028874 - RNA, 19 nt, Homo sapiens
aaagcuggcuguuguccaa

SEQ ID NO: 1028875 - RNA, 19 nt, Homo sapiens
ccuggaagcucucauggau

SEQ ID NO: 1028876 - RNA, 19 nt, Homo sapiens
ggacauuugcauacuccua

SEQ ID NO: 1028877 - RNA, 19 nt, Homo sapiens
ggacacaaacaagaaaugu

SEQ ID NO: 1028878 - RNA, 19 nt, Homo sapiens
ucagucaacucaagaaacu

SEQ ID NO: 1028879 - RNA, 19 nt, Homo sapiens
cuucugagccugagauuga

SEQ ID NO: 1028880 - RNA, 19 nt, Homo sapiens
cagaggagcagaagacuca

SEQ ID NO: 1028881 - RNA, 19 nt, Homo sapiens
ggagaacccauguaagaag

SEQ ID NO: 1028882 - RNA, 19 nt, Homo sapiens
ggagggacauuugcauacu

SEQ ID NO: 1028883 - RNA, 19 nt, Homo sapiens
gccugacagugaaguauga

SEQ ID NO: 1028884 - RNA, 19 nt, Homo sapiens
ccaaguggauaaaaccuuu

SEQ ID NO: 1028885 - RNA, 19 nt, Homo sapiens
uggaagcucucauggaucu

SEQ ID NO: 1028886 - RNA, 19 nt, Homo sapiens
ggcuggagauggagcaaug

SEQ ID NO: 1028887 - RNA, 19 nt, Homo sapiens
gggagaacccauguaagaa

SEQ ID NO: 1028888 - RNA, 19 nt, Homo sapiens
gcuuggcacuucccucugu

SEQ ID NO: 1028889 - RNA, 19 nt, Homo sapiens
gcauacuccuacugucugu

SEQ ID NO: 1028890 - RNA, 19 nt, Homo sapiens
ugagagaccaucuuuagca

SEQ ID NO: 1028891 - RNA, 19 nt, Homo sapiens
ucaagaaacuccggagacu

SEQ ID NO: 1028892 - RNA, 19 nt, Homo sapiens
gaagcucucauggaucuau

SEQ ID NO: 1028893 - RNA, 19 nt, Homo sapiens
auacuuccaugcugucuuc

SEQ ID NO: 1028894 - RNA, 19 nt, Homo sapiens
aaacaagaaauguggacaa

SEQ ID NO: 1028895 - RNA, 19 nt, Homo sapiens
ccugagagaccaucuuuag

SEQ ID NO: 1028896 - RNA, 19 nt, Homo sapiens
gaaggacaucauccacaga

SEQ ID NO: 1028897 - RNA, 19 nt, Homo sapiens
aagaaacuccggagacuca

SEQ ID NO: 1028898 - RNA, 19 nt, Homo sapiens
ccacagaggagcagaagac

SEQ ID NO: 1028899 - RNA, 19 nt, Homo sapiens
gacaucauccacagacuca

SEQ ID NO: 1028900 - RNA, 19 nt, Homo sapiens
gggagaaagcuggcuguug

SEQ ID NO: 1028901 - RNA, 19 nt, Homo sapiens
gcucagucaacucaagaaa

SEQ ID NO: 1028902 - RNA, 19 nt, Homo sapiens
gagggacauuugcauacuc

SEQ ID NO: 1028903 - RNA, 19 nt, Homo sapiens
ggggagaacccauguaaga

SEQ ID NO: 1028904 - RNA, 19 nt, Homo sapiens
cacccggacuccuccaaga

SEQ ID NO: 1028905 - RNA, 19 nt, Homo sapiens
gcaauggguggaugcucaa

SEQ ID NO: 1028906 - RNA, 19 nt, Homo sapiens
aaggagggacauuugcaua

SEQ ID NO: 1028907 - RNA, 19 nt, Homo sapiens
ggaggagaaggacaucauc

SEQ ID NO: 1028908 - RNA, 19 nt, Homo sapiens
gguggaugcucaaguucag

SEQ ID NO: 1028909 - RNA, 19 nt, Homo sapiens
caucauccacagacucaga

SEQ ID NO: 1028910 - RNA, 19 nt, Homo sapiens
gggacacaaacaagaaaug

SEQ ID NO: 1028911 - RNA, 19 nt, Homo sapiens
ccagccgccugacagugaa

SEQ ID NO: 1028912 - RNA, 19 nt, Homo sapiens
aacaagaaauguggacaag

SEQ ID NO: 1028913 - RNA, 19 nt, Homo sapiens
gggaggagaaggacaucau

SEQ ID NO: 1028914 - RNA, 19 nt, Homo sapiens
cccggacuccuccaagaua

SEQ ID NO: 1028915 - RNA, 19 nt, Homo sapiens
gcugcucagucaacucaag

SEQ ID NO: 1028916 - RNA, 19 nt, Homo sapiens
auggguggaugcucaaguu

SEQ ID NO: 1028917 - RNA, 19 nt, Homo sapiens
caaggagggacauuugcau

SEQ ID NO: 1028918 - RNA, 19 nt, Homo sapiens
cagcuggaggccauucuug

SEQ ID NO: 1028919 - RNA, 19 nt, Homo sapiens
ccaaacagcucaucucuaa

SEQ ID NO: 1028920 - RNA, 19 nt, Homo sapiens
ggaggcagcuguacccuaa

SEQ ID NO: 1028921 - RNA, 19 nt, Homo sapiens
ggaaaugccucucacuuca

SEQ ID NO: 1028922 - RNA, 19 nt, Homo sapiens
gcagguggcuucuguguuc

SEQ ID NO: 1028923 - RNA, 19 nt, Homo sapiens
gggagucacuacaugguua

SEQ ID NO: 1028924 - RNA, 19 nt, Homo sapiens
ucgaucaucuggcuucuua

SEQ ID NO: 1028925 - RNA, 19 nt, Homo sapiens
gcuacaagcuccucuaagu

SEQ ID NO: 1028926 - RNA, 19 nt, Homo sapiens
ugaaggaccuggccagcua

SEQ ID NO: 1028927 - RNA, 19 nt, Homo sapiens
caauuccacugaacacuuu

SEQ ID NO: 1028928 - RNA, 19 nt, Homo sapiens
caaacggaguguggaaaua

SEQ ID NO: 1028929 - RNA, 19 nt, Homo sapiens
gugccaagcucuacuccua

SEQ ID NO: 1028930 - RNA, 19 nt, Homo sapiens
ccagcuaucucaacuacaa

SEQ ID NO: 1028931 - RNA, 19 nt, Homo sapiens
ccucaguucuuccaucuuu

SEQ ID NO: 1028932 - RNA, 19 nt, Homo sapiens
caaagugucucaccaucau

SEQ ID NO: 1028933 - RNA, 19 nt, Homo sapiens
ccacaagcacccuuuauga

SEQ ID NO: 1028934 - RNA, 19 nt, Homo sapiens
ccaagaagguacagaaguc

SEQ ID NO: 1028935 - RNA, 19 nt, Homo sapiens
ucaugaagcggcagaauaa

SEQ ID NO: 1028936 - RNA, 19 nt, Homo sapiens
acaagaagcagccaaagaa

SEQ ID NO: 1028937 - RNA, 19 nt, Homo sapiens
gacaagagccagagugugu

SEQ ID NO: 1028938 - RNA, 19 nt, Homo sapiens
agaaggaacuggacaagag

SEQ ID NO: 1028939 - RNA, 19 nt, Homo sapiens
gagacaggacucaguauau

SEQ ID NO: 1028940 - RNA, 19 nt, Homo sapiens
ggaacaagaagcagccaaa

SEQ ID NO: 1028941 - RNA, 19 nt, Homo sapiens
caagacaagcccaagauug

SEQ ID NO: 1028942 - RNA, 19 nt, Homo sapiens
gagcagagcacaggcaguu

SEQ ID NO: 1028943 - RNA, 19 nt, Homo sapiens
gccagcauacucaugauua

SEQ ID NO: 1028944 - RNA, 19 nt, Homo sapiens
agacaggacucaguauaug

SEQ ID NO: 1028945 - RNA, 19 nt, Homo sapiens
gcaagacaagcccaagauu

SEQ ID NO: 1028946 - RNA, 19 nt, Homo sapiens
aaaugccucucacuucaaa

SEQ ID NO: 1028947 - RNA, 19 nt, Homo sapiens
gaaaugccucucacuucaa

SEQ ID NO: 1028948 - RNA, 19 nt, Homo sapiens
gaauauagcaccgcauugg

SEQ ID NO: 1028949 - RNA, 19 nt, Homo sapiens
gcaaacggaguguggaaau

SEQ ID NO: 1028950 - RNA, 19 nt, Homo sapiens
gcaaagugucucaccauca

SEQ ID NO: 1028951 - RNA, 19 nt, Homo sapiens
ggaccuggcuuugccuaca

SEQ ID NO: 1028952 - RNA, 19 nt, Homo sapiens
cggcaaaccuaggcaaguu

SEQ ID NO: 1028953 - RNA, 19 nt, Homo sapiens
ccagcauacucaugauuau

SEQ ID NO: 1028954 - RNA, 19 nt, Homo sapiens
ggccugggcucacaccaau

SEQ ID NO: 1028955 - RNA, 19 nt, Homo sapiens
cagcuacuccgcuaucuga

SEQ ID NO: 1028956 - RNA, 19 nt, Homo sapiens
ccucucaccuugcgugguu

SEQ ID NO: 1028957 - RNA, 19 nt, Homo sapiens
gcaguaacaaccaggaugu

SEQ ID NO: 1028958 - RNA, 19 nt, Homo sapiens
auaccuacuucccuucuuu

SEQ ID NO: 1028959 - RNA, 19 nt, Homo sapiens
ugcaagagcuggauaagac

SEQ ID NO: 1028960 - RNA, 19 nt, Homo sapiens
guccaucccuccuaucauc

SEQ ID NO: 1028961 - RNA, 19 nt, Homo sapiens
ccuuccaucucauuucuaa

SEQ ID NO: 1028962 - RNA, 19 nt, Homo sapiens
acagucagcuuccuuucug

SEQ ID NO: 1028963 - RNA, 19 nt, Homo sapiens
ugaagacacagcucaguga

SEQ ID NO: 1028964 - RNA, 19 nt, Homo sapiens
accaggagcugcugaggaa

SEQ ID NO: 1028965 - RNA, 19 nt, Homo sapiens
caccagagccgaccagcaa

SEQ ID NO: 1028966 - RNA, 19 nt, Homo sapiens
uacaagcuccucuaaguga

SEQ ID NO: 1028967 - RNA, 19 nt, Homo sapiens
gcagagcacaggcaguugu

SEQ ID NO: 1028968 - RNA, 19 nt, Homo sapiens
ugacaaaugauuccugcuu

SEQ ID NO: 1028969 - RNA, 19 nt, Homo sapiens
cuaggcaaguggccaguug

SEQ ID NO: 1028970 - RNA, 19 nt, Homo sapiens
gcagauucccaagaaggua

SEQ ID NO: 1028971 - RNA, 19 nt, Homo sapiens
ggccagcuaucucaacuac

SEQ ID NO: 1028972 - RNA, 19 nt, Homo sapiens
cuucuggacuuugccuaua

SEQ ID NO: 1028973 - RNA, 19 nt, Homo sapiens
gcagccuccuguucccauu

SEQ ID NO: 1028974 - RNA, 19 nt, Homo sapiens
gaacaagaagcagccaaag

SEQ ID NO: 1028975 - RNA, 19 nt, Homo sapiens
ggagcuacgugggaucauc

SEQ ID NO: 1028976 - RNA, 19 nt, Homo sapiens
ucuguguucuucugacaaa

SEQ ID NO: 1028977 - RNA, 19 nt, Homo sapiens
gagccgaccagcaaagugu

SEQ ID NO: 1028978 - RNA, 19 nt, Homo sapiens
gcuuugagaauaucaugaa

SEQ ID NO: 1028979 - RNA, 19 nt, Homo sapiens
aaacagcucaucucuaaaa

SEQ ID NO: 1028980 - RNA, 19 nt, Homo sapiens
gccaagcucuacuccuaca

SEQ ID NO: 1028981 - RNA, 19 nt, Homo sapiens
acugaaagcucuggaugug

SEQ ID NO: 1028982 - RNA, 19 nt, Homo sapiens
ccuaccagguggaauaaag

SEQ ID NO: 1028983 - RNA, 19 nt, Homo sapiens
guguucuucugacaaauga

SEQ ID NO: 1028984 - RNA, 19 nt, Homo sapiens
gcugguagccucucacaac

SEQ ID NO: 1028985 - RNA, 19 nt, Homo sapiens
gugccugaguucucuccua

SEQ ID NO: 1028986 - RNA, 19 nt, Homo sapiens
gaggaaggguagcaguaac

SEQ ID NO: 1028987 - RNA, 19 nt, Homo sapiens
ugaggaaggguagcaguaa

SEQ ID NO: 1028988 - RNA, 19 nt, Homo sapiens
gaagguacagaagucuuug

SEQ ID NO: 1028989 - RNA, 19 nt, Homo sapiens
agaagguacagaagucuuu

SEQ ID NO: 1028990 - RNA, 19 nt, Homo sapiens
gggacugcaugaagacaca

SEQ ID NO: 1028991 - RNA, 19 nt, Homo sapiens
uguggcaccucuugcuuga

SEQ ID NO: 1028992 - RNA, 19 nt, Homo sapiens
ccacugugccucucaccuu

SEQ ID NO: 1028993 - RNA, 19 nt, Homo sapiens
ugaagcggcagaauaagga

SEQ ID NO: 1028994 - RNA, 19 nt, Homo sapiens
gaccacaagcacccuuuau

SEQ ID NO: 1028995 - RNA, 19 nt, Homo sapiens
gaaaccagggaacaagaag

SEQ ID NO: 1028996 - RNA, 19 nt, Homo sapiens
ggagcagauucccaagaag

SEQ ID NO: 1028997 - RNA, 19 nt, Homo sapiens
caagggcuucggcaugauu

SEQ ID NO: 1028998 - RNA, 19 nt, Homo sapiens
accaagggcuucggcauga

SEQ ID NO: 1028999 - RNA, 19 nt, Homo sapiens
gcaacuccucccaaccaaa

SEQ ID NO: 1029000 - RNA, 19 nt, Homo sapiens
cuacaugguuaccgcaucu

SEQ ID NO: 1029001 - RNA, 19 nt, Homo sapiens
aagaauauagcaccgcauu

SEQ ID NO: 1029002 - RNA, 19 nt, Homo sapiens
ggaaggguagcaguaacaa

SEQ ID NO: 1029003 - RNA, 19 nt, Homo sapiens
gagccagcauacucaugau

SEQ ID NO: 1029004 - RNA, 19 nt, Homo sapiens
acaaaugauuccugcuucu

SEQ ID NO: 1029005 - RNA, 19 nt, Homo sapiens
guucuucugacaaaugauu

SEQ ID NO: 1029006 - RNA, 19 nt, Homo sapiens
ggacauuacaguggcuuuc

SEQ ID NO: 1029007 - RNA, 19 nt, Homo sapiens
ggaggaagcacugaaagcu

SEQ ID NO: 1029008 - RNA, 19 nt, Homo sapiens
uaagaaaccagggaacaag

SEQ ID NO: 1029009 - RNA, 19 nt, Homo sapiens
cagggucucuggagcucuu

SEQ ID NO: 1029010 - RNA, 19 nt, Homo sapiens
acaagcuccucuaagugaa

SEQ ID NO: 1029011 - RNA, 19 nt, Homo sapiens
uggaaaugccucucacuuc

SEQ ID NO: 1029012 - RNA, 19 nt, Homo sapiens
ccugugacauggccugcaa

SEQ ID NO: 1029013 - RNA, 19 nt, Homo sapiens
ccugaugcaucccaaccuu

SEQ ID NO: 1029014 - RNA, 19 nt, Homo sapiens
ggcaacuccucccaaccaa

SEQ ID NO: 1029015 - RNA, 19 nt, Homo sapiens
caagaagcagccaaagaag

SEQ ID NO: 1029016 - RNA, 19 nt, Homo sapiens
gaccuggccagcuaucuca

SEQ ID NO: 1029017 - RNA, 19 nt, Homo sapiens
gcaagagcuggauaagaca

SEQ ID NO: 1029018 - RNA, 19 nt, Homo sapiens
gaaggaccuggccagcuau

SEQ ID NO: 1029019 - RNA, 19 nt, Homo sapiens
gaggaaagcuuaaacucaa

SEQ ID NO: 1029020 - RNA, 19 nt, Homo sapiens
ggaaauggcgggugaaauu

SEQ ID NO: 1029021 - RNA, 19 nt, Homo sapiens
gaaauggcgggugaaauua

SEQ ID NO: 1029022 - RNA, 19 nt, Homo sapiens
caucaucguuuaccuguau

SEQ ID NO: 1029023 - RNA, 19 nt, Homo sapiens
gaccuguccucccucauuu

SEQ ID NO: 1029024 - RNA, 19 nt, Homo sapiens
ccaaauacaaugacacuga

SEQ ID NO: 1029025 - RNA, 19 nt, Homo sapiens
gggcugguguacauguuua

SEQ ID NO: 1029026 - RNA, 19 nt, Homo sapiens
ggauuaaagugcugagcuu

SEQ ID NO: 1029027 - RNA, 19 nt, Homo sapiens
ccacacagcuguccucacu

SEQ ID NO: 1029028 - RNA, 19 nt, Homo sapiens
gaccaccaccuuugugaua

SEQ ID NO: 1029029 - RNA, 19 nt, Homo sapiens
ggaggaaagcuuaaacuca

SEQ ID NO: 1029030 - RNA, 19 nt, Homo sapiens
caaggugggaguaaacuuu

SEQ ID NO: 1029031 - RNA, 19 nt, Homo sapiens
gggucaacuuguucuauuu

SEQ ID NO: 1029032 - RNA, 19 nt, Homo sapiens
ggaagaggauggagaaccu

SEQ ID NO: 1029033 - RNA, 19 nt, Homo sapiens
gggaagagcagaagaggau

SEQ ID NO: 1029034 - RNA, 19 nt, Homo sapiens
uguccucccucauuuguaa

SEQ ID NO: 1029035 - RNA, 19 nt, Homo sapiens
ucaaggaggaggaagauga

SEQ ID NO: 1029036 - RNA, 19 nt, Homo sapiens
guacauguuuaaccucauc

SEQ ID NO: 1029037 - RNA, 19 nt, Homo sapiens
gcagacaccaaauacaaug

SEQ ID NO: 1029038 - RNA, 19 nt, Homo sapiens
ggaagcagacaccaaauac

SEQ ID NO: 1029039 - RNA, 19 nt, Homo sapiens
gauuaaagugcugagcuua

SEQ ID NO: 1029040 - RNA, 19 nt, Homo sapiens
ucacagaccggguggaaau

SEQ ID NO: 1029041 - RNA, 19 nt, Homo sapiens
gcauggcauuggguacuuu

SEQ ID NO: 1029042 - RNA, 19 nt, Homo sapiens
ccuccauguucuucaauaa

SEQ ID NO: 1029043 - RNA, 19 nt, Homo sapiens
ggauggagaaccucaagga

SEQ ID NO: 1029044 - RNA, 19 nt, Homo sapiens
ccaaguaccugcagauccu

SEQ ID NO: 1029045 - RNA, 19 nt, Homo sapiens
gauccugaccucucugaug

SEQ ID NO: 1029046 - RNA, 19 nt, Homo sapiens
gcggauggcaggugauaga

SEQ ID NO: 1029047 - RNA, 19 nt, Homo sapiens
acucuacucuuccuacguu

SEQ ID NO: 1029048 - RNA, 19 nt, Homo sapiens
acacagcuguccucacuac

SEQ ID NO: 1029049 - RNA, 19 nt, Homo sapiens
aagcagacaccaaauacaa

SEQ ID NO: 1029050 - RNA, 19 nt, Homo sapiens
gaagcagacaccaaauaca

SEQ ID NO: 1029051 - RNA, 19 nt, Homo sapiens
gcaucaucguuuaccugua

SEQ ID NO: 1029052 - RNA, 19 nt, Homo sapiens
ggcaaaggccagagucaga

SEQ ID NO: 1029053 - RNA, 19 nt, Homo sapiens
uggaagcagacaccaaaua

SEQ ID NO: 1029054 - RNA, 19 nt, Homo sapiens
ccaccaccuuugugauaga

SEQ ID NO: 1029055 - RNA, 19 nt, Homo sapiens
gcaucuacuuggcgaucuu

SEQ ID NO: 1029056 - RNA, 19 nt, Homo sapiens
uuaaagugcugagcuuagu

SEQ ID NO: 1029057 - RNA, 19 nt, Homo sapiens
gccuccauguucuucaaua

SEQ ID NO: 1029058 - RNA, 19 nt, Homo sapiens
ugaccuguccucccucauu

SEQ ID NO: 1029059 - RNA, 19 nt, Homo sapiens
caacaucugccaccugcau

SEQ ID NO: 1029060 - RNA, 19 nt, Homo sapiens
caacagccucuacccaaca

SEQ ID NO: 1029061 - RNA, 19 nt, Homo sapiens
auccugaccucucugauga

SEQ ID NO: 1029062 - RNA, 19 nt, Homo sapiens
ggagaccucgccaucuaug

SEQ ID NO: 1029063 - RNA, 19 nt, Homo sapiens
ccaaaaugcucaauaaagc

SEQ ID NO: 1029064 - RNA, 19 nt, Homo sapiens
gccagcccuuccucacuuu

SEQ ID NO: 1029065 - RNA, 19 nt, Homo sapiens
gguuaagggccacuggaaa

SEQ ID NO: 1029066 - RNA, 19 nt, Homo sapiens
ccgcugagggucauuaugu

SEQ ID NO: 1029067 - RNA, 19 nt, Homo sapiens
gggcggauggcaggugaua

SEQ ID NO: 1029068 - RNA, 19 nt, Homo sapiens
gggaguaaacuuucuuugc

SEQ ID NO: 1029069 - RNA, 19 nt, Homo sapiens
ggaaagcuuaaacucaaca

SEQ ID NO: 1029070 - RNA, 19 nt, Homo sapiens
ggucaacuuguucuauuuc

SEQ ID NO: 1029071 - RNA, 19 nt, Homo sapiens
caacccguuugaaaucaca

SEQ ID NO: 1029072 - RNA, 19 nt, Homo sapiens
ggaccguucaccuucuuug

SEQ ID NO: 1029073 - RNA, 19 nt, Homo sapiens
gacaccaaauacaaugaca

SEQ ID NO: 1029074 - RNA, 19 nt, Homo sapiens
guuaagggccacuggaaag

SEQ ID NO: 1029075 - RNA, 19 nt, Homo sapiens
ggugauagacugggaagca

SEQ ID NO: 1029076 - RNA, 19 nt, Homo sapiens
ggggucaacuuguucuauu

SEQ ID NO: 1029077 - RNA, 19 nt, Homo sapiens
gaccguucaccuucuuuga

SEQ ID NO: 1029078 - RNA, 19 nt, Homo sapiens
ugccagcccuuccucacuu

SEQ ID NO: 1029079 - RNA, 19 nt, Homo sapiens
ggguggaaaugggacaaau

SEQ ID NO: 1029080 - RNA, 19 nt, Homo sapiens
gaucucccaacccguuuga

SEQ ID NO: 1029081 - RNA, 19 nt, Homo sapiens
ccgccguccuugcaccuaa

SEQ ID NO: 1029082 - RNA, 19 nt, Homo sapiens
uguggaagcagacaccaaa

SEQ ID NO: 1029083 - RNA, 19 nt, Homo sapiens
ggcauggcauuggguacuu

SEQ ID NO: 1029084 - RNA, 19 nt, Homo sapiens
uccauguucuucaauaaag

SEQ ID NO: 1029085 - RNA, 19 nt, Homo sapiens
gguggaaaugggacaaaug

SEQ ID NO: 1029086 - RNA, 19 nt, Homo sapiens
cuucaugaccaccaccuuu

SEQ ID NO: 1029087 - RNA, 19 nt, Homo sapiens
uuggguacuuucugcauug

SEQ ID NO: 1029088 - RNA, 19 nt, Homo sapiens
ggacgccuaccgcaucuac

SEQ ID NO: 1029089 - RNA, 19 nt, Homo sapiens
gaugggaagagcagaagag

SEQ ID NO: 1029090 - RNA, 19 nt, Homo sapiens
ucaacuuguucuauuucug

SEQ ID NO: 1029091 - RNA, 19 nt, Homo sapiens
ccauguucuucaauaaagu

SEQ ID NO: 1029092 - RNA, 19 nt, Homo sapiens
guggaaaugggacaaaugg

SEQ ID NO: 1029093 - RNA, 19 nt, Homo sapiens
aggagcaggugucguugug

SEQ ID NO: 1029094 - RNA, 19 nt, Homo sapiens
cccaggagcaggugucguu

SEQ ID NO: 1029095 - RNA, 19 nt, Homo sapiens
ggucaaggugggaguaaac

SEQ ID NO: 1029096 - RNA, 19 nt, Homo sapiens
cguuguggaggaaagcuua

SEQ ID NO: 1029097 - RNA, 19 nt, Homo sapiens
ucucccaacccguuugaaa

SEQ ID NO: 1029098 - RNA, 19 nt, Homo sapiens
gaaaauggguccuguguaa

SEQ ID NO: 1029099 - RNA, 19 nt, Homo sapiens
gcagugagcugucggucaa

SEQ ID NO: 1029100 - RNA, 19 nt, Homo sapiens
gaacagaacauggccaaga

SEQ ID NO: 1029101 - RNA, 19 nt, Homo sapiens
guagagagcuuuguaucga

SEQ ID NO: 1029102 - RNA, 19 nt, Homo sapiens
uaaacagccuccgugcuua

SEQ ID NO: 1029103 - RNA, 19 nt, Homo sapiens
gaacauggccaagaaggau

SEQ ID NO: 1029104 - RNA, 19 nt, Homo sapiens
gaacaugaaggugggauga

SEQ ID NO: 1029105 - RNA, 19 nt, Homo sapiens
caagauagaacaugaaggu

SEQ ID NO: 1029106 - RNA, 19 nt, Homo sapiens
ggaggacccaguugagaaa

SEQ ID NO: 1029107 - RNA, 19 nt, Homo sapiens
uaucgaggcugcagaaguc

SEQ ID NO: 1029108 - RNA, 19 nt, Homo sapiens
cgacguagagagcuuugua

SEQ ID NO: 1029109 - RNA, 19 nt, Homo sapiens
gaugaggacaugaacagaa

SEQ ID NO: 1029110 - RNA, 19 nt, Homo sapiens
aauggguccuguguaauua

SEQ ID NO: 1029111 - RNA, 19 nt, Homo sapiens
ccaggucgcugucaauggu

SEQ ID NO: 1029112 - RNA, 19 nt, Homo sapiens
gggucaagauagaacauga

SEQ ID NO: 1029113 - RNA, 19 nt, Homo sapiens
gcccugagcauuguaauau

SEQ ID NO: 1029114 - RNA, 19 nt, Homo sapiens
aaauggguccuguguaauu

SEQ ID NO: 1029115 - RNA, 19 nt, Homo sapiens
aacagaacauggccaagaa

SEQ ID NO: 1029116 - RNA, 19 nt, Homo sapiens
ccagcgagaaggagaaauu

SEQ ID NO: 1029117 - RNA, 19 nt, Homo sapiens
gggaggacccaguugagaa

SEQ ID NO: 1029118 - RNA, 19 nt, Homo sapiens
ggaaggcgagguggaaaug

SEQ ID NO: 1029119 - RNA, 19 nt, Homo sapiens
acaaagagaaagugucaga

SEQ ID NO: 1029120 - RNA, 19 nt, Homo sapiens
acaccgacgugcugcagaa

SEQ ID NO: 1029121 - RNA, 19 nt, Homo sapiens
ggacagacuuaacgauccu

SEQ ID NO: 1029122 - RNA, 19 nt, Homo sapiens
gcagugauggagaagcaaa

SEQ ID NO: 1029123 - RNA, 19 nt, Homo sapiens
gcucgcugcuggaggacaa

SEQ ID NO: 1029124 - RNA, 19 nt, Homo sapiens
uacuggagguccuggauga

SEQ ID NO: 1029125 - RNA, 19 nt, Homo sapiens
auaaacagccuccgugcuu

SEQ ID NO: 1029126 - RNA, 19 nt, Homo sapiens
ucugaaggauggccaaucu

SEQ ID NO: 1029127 - RNA, 19 nt, Homo sapiens
ggauaugugcccuacaaca

SEQ ID NO: 1029128 - RNA, 19 nt, Homo sapiens
cuccggagcuguugcacuu

SEQ ID NO: 1029129 - RNA, 19 nt, Homo sapiens
gcuggaggacaaagagaaa

SEQ ID NO: 1029130 - RNA, 19 nt, Homo sapiens
gaaggugggaugaggacau

SEQ ID NO: 1029131 - RNA, 19 nt, Homo sapiens
gcagugggguuugagauug

SEQ ID NO: 1029132 - RNA, 19 nt, Homo sapiens
ggaaguggacauccugaac

SEQ ID NO: 1029133 - RNA, 19 nt, Homo sapiens
ggucaagauagaacaugaa

SEQ ID NO: 1029134 - RNA, 19 nt, Homo sapiens
agccucagcuggagucaga

SEQ ID NO: 1029135 - RNA, 19 nt, Homo sapiens
guggagcccugagcauugu

SEQ ID NO: 1029136 - RNA, 19 nt, Homo sapiens
uggaggcagugauggagaa

SEQ ID NO: 1029137 - RNA, 19 nt, Homo sapiens
ggaaggcagugggguuuga

SEQ ID NO: 1029138 - RNA, 19 nt, Homo sapiens
auacagacccgaguucuuc

SEQ ID NO: 1029139 - RNA, 19 nt, Homo sapiens
ggacccaguugagaaacag

SEQ ID NO: 1029140 - RNA, 19 nt, Homo sapiens
gagcuguugcacuuccuuu

SEQ ID NO: 1029141 - RNA, 19 nt, Homo sapiens
ggagcccugagcauuguaa

SEQ ID NO: 1029142 - RNA, 19 nt, Homo sapiens
cccaauagcggaagucgau

SEQ ID NO: 1029143 - RNA, 19 nt, Homo sapiens
ccgacgugcugcagaagau

SEQ ID NO: 1029144 - RNA, 19 nt, Homo sapiens
aaggcgagguggaaaugga

SEQ ID NO: 1029145 - RNA, 19 nt, Homo sapiens
guccugaccuggcgguucu

SEQ ID NO: 1029146 - RNA, 19 nt, Homo sapiens
gaggacaaagagaaagugu

SEQ ID NO: 1029147 - RNA, 19 nt, Homo sapiens
ggugggaugaggacaugaa

SEQ ID NO: 1029148 - RNA, 19 nt, Homo sapiens
gggaugaggacaugaacag

SEQ ID NO: 1029149 - RNA, 19 nt, Homo sapiens
ccuguguaauuaugacuuc

SEQ ID NO: 1029150 - RNA, 19 nt, Homo sapiens
agucagagacagcaggaaa

SEQ ID NO: 1029151 - RNA, 19 nt, Homo sapiens
gguggaaggcgagguggaa

SEQ ID NO: 1029152 - RNA, 19 nt, Homo sapiens
ggaaaauggguccugugua

SEQ ID NO: 1029153 - RNA, 19 nt, Homo sapiens
agaacggacuccucagacu

SEQ ID NO: 1029154 - RNA, 19 nt, Homo sapiens
cagcugcgauagccucaac

SEQ ID NO: 1029155 - RNA, 19 nt, Homo sapiens
ggucaagcagcgggacgua

SEQ ID NO: 1029156 - RNA, 19 nt, Homo sapiens
ggaggacaaagagaaagug

SEQ ID NO: 1029157 - RNA, 19 nt, Homo sapiens
gacguagagagcuuuguau

SEQ ID NO: 1029158 - RNA, 19 nt, Homo sapiens
gggaaguggacauccugaa

SEQ ID NO: 1029159 - RNA, 19 nt, Homo sapiens
ggaugaggacaugaacaga

SEQ ID NO: 1029160 - RNA, 19 nt, Homo sapiens
cauacagacccgaguucuu

SEQ ID NO: 1029161 - RNA, 19 nt, Homo sapiens
gaaaauggguccuguguaa

SEQ ID NO: 1029162 - RNA, 19 nt, Homo sapiens
gcagugagcugucggucaa

SEQ ID NO: 1029163 - RNA, 19 nt, Homo sapiens
guagagagcuuuguaucga

SEQ ID NO: 1029164 - RNA, 19 nt, Homo sapiens
uaaacagccuccgugcuua

SEQ ID NO: 1029165 - RNA, 19 nt, Homo sapiens
aggaggagcuggagucgua

SEQ ID NO: 1029166 - RNA, 19 nt, Homo sapiens
gaaguuggccgucauggau

SEQ ID NO: 1029167 - RNA, 19 nt, Homo sapiens
ggaggacccaguugagaaa

SEQ ID NO: 1029168 - RNA, 19 nt, Homo sapiens
uaucgaggcugcagaaguc

SEQ ID NO: 1029169 - RNA, 19 nt, Homo sapiens
cgacguagagagcuuugua

SEQ ID NO: 1029170 - RNA, 19 nt, Homo sapiens
gcgccaagucuaucuauga

SEQ ID NO: 1029171 - RNA, 19 nt, Homo sapiens
aauggguccuguguaauua

SEQ ID NO: 1029172 - RNA, 19 nt, Homo sapiens
ccaggucgcugucaauggu

SEQ ID NO: 1029173 - RNA, 19 nt, Homo sapiens
gcccugagcauuguaauau

SEQ ID NO: 1029174 - RNA, 19 nt, Homo sapiens
aaauggguccuguguaauu

SEQ ID NO: 1029175 - RNA, 19 nt, Homo sapiens
uggcugauguaucccagua

SEQ ID NO: 1029176 - RNA, 19 nt, Homo sapiens
ccagcgagaaggagaaauu

SEQ ID NO: 1029177 - RNA, 19 nt, Homo sapiens
gggaggacccaguugagaa

SEQ ID NO: 1029178 - RNA, 19 nt, Homo sapiens
ggaaggcgagguggaaaug

SEQ ID NO: 1029179 - RNA, 19 nt, Homo sapiens
acaaagagaaagugucaga

SEQ ID NO: 1029180 - RNA, 19 nt, Homo sapiens
aagcguuacuccacaguug

SEQ ID NO: 1029181 - RNA, 19 nt, Homo sapiens
acaccgacgugcugcagaa

SEQ ID NO: 1029182 - RNA, 19 nt, Homo sapiens
gcgagugucucccgaccau

SEQ ID NO: 1029183 - RNA, 19 nt, Homo sapiens
ggacagacuuaacgauccu

SEQ ID NO: 1029184 - RNA, 19 nt, Homo sapiens
gcagugauggagaagcaaa

SEQ ID NO: 1029185 - RNA, 19 nt, Homo sapiens
ggaaguuggccgucaugga

SEQ ID NO: 1029186 - RNA, 19 nt, Homo sapiens
gcucgcugcuggaggacaa

SEQ ID NO: 1029187 - RNA, 19 nt, Homo sapiens
uacuggagguccuggauga

SEQ ID NO: 1029188 - RNA, 19 nt, Homo sapiens
auaaacagccuccgugcuu

SEQ ID NO: 1029189 - RNA, 19 nt, Homo sapiens
ucugaaggauggccaaucu

SEQ ID NO: 1029190 - RNA, 19 nt, Homo sapiens
ggauaugugcccuacaaca

SEQ ID NO: 1029191 - RNA, 19 nt, Homo sapiens
cuccggagcuguugcacuu

SEQ ID NO: 1029192 - RNA, 19 nt, Homo sapiens
gagaugcugcugcgagugu

SEQ ID NO: 1029193 - RNA, 19 nt, Homo sapiens
gcuggaggacaaagagaaa

SEQ ID NO: 1029194 - RNA, 19 nt, Homo sapiens
gggcaggagcuaccacuca

SEQ ID NO: 1029195 - RNA, 19 nt, Homo sapiens
ggaaguggacauccugaac

SEQ ID NO: 1029196 - RNA, 19 nt, Homo sapiens
gaagcguuacuccacaguu

SEQ ID NO: 1029197 - RNA, 19 nt, Homo sapiens
agccucagcuggagucaga

SEQ ID NO: 1029198 - RNA, 19 nt, Homo sapiens
guggagcccugagcauugu

SEQ ID NO: 1029199 - RNA, 19 nt, Homo sapiens
uggaggcagugauggagaa

SEQ ID NO: 1029200 - RNA, 19 nt, Homo sapiens
auacagacccgaguucuuc

SEQ ID NO: 1029201 - RNA, 19 nt, Homo sapiens
ccaggaaguuggccgucau

SEQ ID NO: 1029202 - RNA, 19 nt, Homo sapiens
gagcagaggaagcguuacu

SEQ ID NO: 1029203 - RNA, 19 nt, Homo sapiens
ggacccaguugagaaacag

SEQ ID NO: 1029204 - RNA, 19 nt, Homo sapiens
gagcuguugcacuuccuuu

SEQ ID NO: 1029205 - RNA, 19 nt, Homo sapiens
ugaggacgauggcgugcau

SEQ ID NO: 1029206 - RNA, 19 nt, Homo sapiens
ggagcccugagcauuguaa

SEQ ID NO: 1029207 - RNA, 19 nt, Homo sapiens
cccaauagcggaagucgau

SEQ ID NO: 1029208 - RNA, 19 nt, Homo sapiens
ccgacgugcugcagaagau

SEQ ID NO: 1029209 - RNA, 19 nt, Homo sapiens
gagugucucccgaccaugu

SEQ ID NO: 1029210 - RNA, 19 nt, Homo sapiens
aaggcgagguggaaaugga

SEQ ID NO: 1029211 - RNA, 19 nt, Homo sapiens
guccugaccuggcgguucu

SEQ ID NO: 1029212 - RNA, 19 nt, Homo sapiens
uguuauggcugauguaucc

SEQ ID NO: 1029213 - RNA, 19 nt, Homo sapiens
gaggacaaagagaaagugu

SEQ ID NO: 1029214 - RNA, 19 nt, Homo sapiens
ccuguguaauuaugacuuc

SEQ ID NO: 1029215 - RNA, 19 nt, Homo sapiens
agucagagacagcaggaaa

SEQ ID NO: 1029216 - RNA, 19 nt, Homo sapiens
gguggaaggcgagguggaa

SEQ ID NO: 1029217 - RNA, 19 nt, Homo sapiens
ggaaaauggguccugugua

SEQ ID NO: 1029218 - RNA, 19 nt, Homo sapiens
cuaccacucagcaccauga

SEQ ID NO: 1029219 - RNA, 19 nt, Homo sapiens
agaacggacuccucagacu

SEQ ID NO: 1029220 - RNA, 19 nt, Homo sapiens
cagcugcgauagccucaac

SEQ ID NO: 1029221 - RNA, 19 nt, Homo sapiens
ggucaagcagcgggacgua

SEQ ID NO: 1029222 - RNA, 19 nt, Homo sapiens
cccaguacccagucaauca

SEQ ID NO: 1029223 - RNA, 19 nt, Homo sapiens
ggaggacaaagagaaagug

SEQ ID NO: 1029224 - RNA, 19 nt, Homo sapiens
caagcgccaagucuaucua

SEQ ID NO: 1029225 - RNA, 19 nt, Homo sapiens
gacguagagagcuuuguau

SEQ ID NO: 1029226 - RNA, 19 nt, Homo sapiens
gggaaguggacauccugaa

SEQ ID NO: 1029227 - RNA, 19 nt, Homo sapiens
cgccaagucuaucuaugag

SEQ ID NO: 1029228 - RNA, 19 nt, Homo sapiens
aagccaagcgccaagucua

SEQ ID NO: 1029229 - RNA, 19 nt, Homo sapiens
cauacagacccgaguucuu

SEQ ID NO: 1029230 - RNA, 19 nt, Homo sapiens
gaaaauggguccuguguaa

SEQ ID NO: 1029231 - RNA, 19 nt, Homo sapiens
gcagugagcugucggucaa

SEQ ID NO: 1029232 - RNA, 19 nt, Homo sapiens
guagagagcuuuguaucga

SEQ ID NO: 1029233 - RNA, 19 nt, Homo sapiens
uaaacagccuccgugcuua

SEQ ID NO: 1029234 - RNA, 19 nt, Homo sapiens
aggaggagcuggagucgua

SEQ ID NO: 1029235 - RNA, 19 nt, Homo sapiens
gaaguuggccgucauggau

SEQ ID NO: 1029236 - RNA, 19 nt, Homo sapiens
ggaggacccaguugagaaa

SEQ ID NO: 1029237 - RNA, 19 nt, Homo sapiens
uaucgaggcugcagaaguc

SEQ ID NO: 1029238 - RNA, 19 nt, Homo sapiens
cgacguagagagcuuugua

SEQ ID NO: 1029239 - RNA, 19 nt, Homo sapiens
aauggguccuguguaauua

SEQ ID NO: 1029240 - RNA, 19 nt, Homo sapiens
gaacaccccuaucuucuag

SEQ ID NO: 1029241 - RNA, 19 nt, Homo sapiens
ccaggucgcugucaauggu

SEQ ID NO: 1029242 - RNA, 19 nt, Homo sapiens
gcccugagcauuguaauau

SEQ ID NO: 1029243 - RNA, 19 nt, Homo sapiens
aaauggguccuguguaauu

SEQ ID NO: 1029244 - RNA, 19 nt, Homo sapiens
ccgacugucuuacuuccua

SEQ ID NO: 1029245 - RNA, 19 nt, Homo sapiens
uaacaccagccuugcguuu

SEQ ID NO: 1029246 - RNA, 19 nt, Homo sapiens
gggaggacccaguugagaa

SEQ ID NO: 1029247 - RNA, 19 nt, Homo sapiens
ggaaggcgagguggaaaug

SEQ ID NO: 1029248 - RNA, 19 nt, Homo sapiens
acaaagagaaagugucaga

SEQ ID NO: 1029249 - RNA, 19 nt, Homo sapiens
ugacccgacugucuuacuu

SEQ ID NO: 1029250 - RNA, 19 nt, Homo sapiens
acaccgacgugcugcagaa

SEQ ID NO: 1029251 - RNA, 19 nt, Homo sapiens
gcgagugucucccgaccau

SEQ ID NO: 1029252 - RNA, 19 nt, Homo sapiens
ggacagacuuaacgauccu

SEQ ID NO: 1029253 - RNA, 19 nt, Homo sapiens
gcagugauggagaagcaaa

SEQ ID NO: 1029254 - RNA, 19 nt, Homo sapiens
ggaaguuggccgucaugga

SEQ ID NO: 1029255 - RNA, 19 nt, Homo sapiens
auaaacagccuccgugcuu

SEQ ID NO: 1029256 - RNA, 19 nt, Homo sapiens
ucugaaggauggccaaucu

SEQ ID NO: 1029257 - RNA, 19 nt, Homo sapiens
cagcacgcaugggaagaaa

SEQ ID NO: 1029258 - RNA, 19 nt, Homo sapiens
cuccggagcuguugcacuu

SEQ ID NO: 1029259 - RNA, 19 nt, Homo sapiens
gagaugcugcugcgagugu

SEQ ID NO: 1029260 - RNA, 19 nt, Homo sapiens
gcagcacgcaugggaagaa

SEQ ID NO: 1029261 - RNA, 19 nt, Homo sapiens
ggaaguggacauccugaac

SEQ ID NO: 1029262 - RNA, 19 nt, Homo sapiens
agccucagcuggagucaga

SEQ ID NO: 1029263 - RNA, 19 nt, Homo sapiens
guggagcccugagcauugu

SEQ ID NO: 1029264 - RNA, 19 nt, Homo sapiens
uggaggcagugauggagaa

SEQ ID NO: 1029265 - RNA, 19 nt, Homo sapiens
agccuugcguuuccucuuu

SEQ ID NO: 1029266 - RNA, 19 nt, Homo sapiens
gcacgcaugggaagaaagg

SEQ ID NO: 1029267 - RNA, 19 nt, Homo sapiens
auacagacccgaguucuuc

SEQ ID NO: 1029268 - RNA, 19 nt, Homo sapiens
ccaggaaguuggccgucau

SEQ ID NO: 1029269 - RNA, 19 nt, Homo sapiens
ggacccaguugagaaacag

SEQ ID NO: 1029270 - RNA, 19 nt, Homo sapiens
ugaggacgauggcgugcau

SEQ ID NO: 1029271 - RNA, 19 nt, Homo sapiens
gagcuguugcacuuccuuu

SEQ ID NO: 1029272 - RNA, 19 nt, Homo sapiens
ggagcccugagcauuguaa

SEQ ID NO: 1029273 - RNA, 19 nt, Homo sapiens
cccaauagcggaagucgau

SEQ ID NO: 1029274 - RNA, 19 nt, Homo sapiens
ccgacgugcugcagaagau

SEQ ID NO: 1029275 - RNA, 19 nt, Homo sapiens
gagugucucccgaccaugu

SEQ ID NO: 1029276 - RNA, 19 nt, Homo sapiens
aaggcgagguggaaaugga

SEQ ID NO: 1029277 - RNA, 19 nt, Homo sapiens
guccugaccuggcgguucu

SEQ ID NO: 1029278 - RNA, 19 nt, Homo sapiens
gaggacaaagagaaagugu

SEQ ID NO: 1029279 - RNA, 19 nt, Homo sapiens
ccuguguaauuaugacuuc

SEQ ID NO: 1029280 - RNA, 19 nt, Homo sapiens
agucagagacagcaggaaa

SEQ ID NO: 1029281 - RNA, 19 nt, Homo sapiens
gguggaaggcgagguggaa

SEQ ID NO: 1029282 - RNA, 19 nt, Homo sapiens
ggccaucguccucgccauu

SEQ ID NO: 1029283 - RNA, 19 nt, Homo sapiens
ggaaaauggguccugugua

SEQ ID NO: 1029284 - RNA, 19 nt, Homo sapiens
gccuugcguuuccucuuug

SEQ ID NO: 1029285 - RNA, 19 nt, Homo sapiens
agaacggacuccucagacu

SEQ ID NO: 1029286 - RNA, 19 nt, Homo sapiens
ggucaagcagcgggacgua

SEQ ID NO: 1029287 - RNA, 19 nt, Homo sapiens
ggaggacaaagagaaagug

SEQ ID NO: 1029288 - RNA, 19 nt, Homo sapiens
gacguagagagcuuuguau

SEQ ID NO: 1029289 - RNA, 19 nt, Homo sapiens
gggaaguggacauccugaa

SEQ ID NO: 1029290 - RNA, 19 nt, Homo sapiens
cauacagacccgaguucuu

SEQ ID NO: 1029291 - RNA, 19 nt, Homo sapiens
caagagagauggaauuaau

SEQ ID NO: 1029292 - RNA, 19 nt, Homo sapiens
gaugugcucuacuauauuu

SEQ ID NO: 1029293 - RNA, 19 nt, Homo sapiens
gaacuucugcuuccaaauu

SEQ ID NO: 1029294 - RNA, 19 nt, Homo sapiens
gaaagggcuuggacuguga

SEQ ID NO: 1029295 - RNA, 19 nt, Homo sapiens
agacagacuuucacacuaa

SEQ ID NO: 1029296 - RNA, 19 nt, Homo sapiens
gaccaagaaugcugaacua

SEQ ID NO: 1029297 - RNA, 19 nt, Homo sapiens
cagaugugcucuacuauau

SEQ ID NO: 1029298 - RNA, 19 nt, Homo sapiens
gcaggcacguaccagaaua

SEQ ID NO: 1029299 - RNA, 19 nt, Homo sapiens
gaaggaugcucagaacaga

SEQ ID NO: 1029300 - RNA, 19 nt, Homo sapiens
caagaaugcugaacuagag

SEQ ID NO: 1029301 - RNA, 19 nt, Homo sapiens
caccacaucuguagugaaa

SEQ ID NO: 1029302 - RNA, 19 nt, Homo sapiens
gccagaaaguuacagauga

SEQ ID NO: 1029303 - RNA, 19 nt, Homo sapiens
ccacugggcugacagacuu

SEQ ID NO: 1029304 - RNA, 19 nt, Homo sapiens
ccaaguacuuccuauugaa

SEQ ID NO: 1029305 - RNA, 19 nt, Homo sapiens
gaacagauuggcacccauu

SEQ ID NO: 1029306 - RNA, 19 nt, Homo sapiens
gaagaagggcuugaaguau

SEQ ID NO: 1029307 - RNA, 19 nt, Homo sapiens
aaacuuagcaucuuaaugg

SEQ ID NO: 1029308 - RNA, 19 nt, Homo sapiens
gacauaaacuuagcaucuu

SEQ ID NO: 1029309 - RNA, 19 nt, Homo sapiens
uaugggcucugucuaauga

SEQ ID NO: 1029310 - RNA, 19 nt, Homo sapiens
gagaauccauugagauguc

SEQ ID NO: 1029311 - RNA, 19 nt, Homo sapiens
aagaagggcuugaaguaug

SEQ ID NO: 1029312 - RNA, 19 nt, Homo sapiens
gaaaguuacagaugacaug

SEQ ID NO: 1029313 - RNA, 19 nt, Homo sapiens
ccagguugcugaaguugaa

SEQ ID NO: 1029314 - RNA, 19 nt, Homo sapiens
aaacucccaugaagaggua

SEQ ID NO: 1029315 - RNA, 19 nt, Homo sapiens
ucaggcugcuucuguuuaa

SEQ ID NO: 1029316 - RNA, 19 nt, Homo sapiens
agaagaagggcuugaagua

SEQ ID NO: 1029317 - RNA, 19 nt, Homo sapiens
ggcucaaacuguccauaua

SEQ ID NO: 1029318 - RNA, 19 nt, Homo sapiens
cagacagacuuucacacua

SEQ ID NO: 1029319 - RNA, 19 nt, Homo sapiens
ucuccgaucuuuauuaugu

SEQ ID NO: 1029320 - RNA, 19 nt, Homo sapiens
uaaagaagaggccuccauu

SEQ ID NO: 1029321 - RNA, 19 nt, Homo sapiens
gagagcagaugggacaaau

SEQ ID NO: 1029322 - RNA, 19 nt, Homo sapiens
gaucagacauaaacuuagc

SEQ ID NO: 1029323 - RNA, 19 nt, Homo sapiens
cagacuggccagaaaguua

SEQ ID NO: 1029324 - RNA, 19 nt, Homo sapiens
cagcacaguucaugaaugg

SEQ ID NO: 1029325 - RNA, 19 nt, Homo sapiens
ccagaugugcucuacuaua

SEQ ID NO: 1029326 - RNA, 19 nt, Homo sapiens
gcucaaacuguccauauau

SEQ ID NO: 1029327 - RNA, 19 nt, Homo sapiens
uaaagauaccacucuguuu

SEQ ID NO: 1029328 - RNA, 19 nt, Homo sapiens
uggcagaguugaauuaugg

SEQ ID NO: 1029329 - RNA, 19 nt, Homo sapiens
cauauguccuagaaaguug

SEQ ID NO: 1029330 - RNA, 19 nt, Homo sapiens
gacagacuuucacacuaaa

SEQ ID NO: 1029331 - RNA, 19 nt, Homo sapiens
ggccauggcacaagagaaa

SEQ ID NO: 1029332 - RNA, 19 nt, Homo sapiens
caagcacuaugcacugaga

SEQ ID NO: 1029333 - RNA, 19 nt, Homo sapiens
acccucauguucuuuaaua

SEQ ID NO: 1029334 - RNA, 19 nt, Homo sapiens
ccacgugacugaggagaug

SEQ ID NO: 1029335 - RNA, 19 nt, Homo sapiens
uggagaaggugaacccuau

SEQ ID NO: 1029336 - RNA, 19 nt, Homo sapiens
ccacucuguuucucuuaaa

SEQ ID NO: 1029337 - RNA, 19 nt, Homo sapiens
guucaugaauggcaacauc

SEQ ID NO: 1029338 - RNA, 19 nt, Homo sapiens
gaggggaacuucaauuaug

SEQ ID NO: 1029339 - RNA, 19 nt, Homo sapiens
gaugguggcucuggguuuc

SEQ ID NO: 1029340 - RNA, 19 nt, Homo sapiens
uacaugaaguucugaagga

SEQ ID NO: 1029341 - RNA, 19 nt, Homo sapiens
ucuauuacacccuccuuua

SEQ ID NO: 1029342 - RNA, 19 nt, Homo sapiens
ugucauauguccuagaaag

SEQ ID NO: 1029343 - RNA, 19 nt, Homo sapiens
gagaaggugaacccuauga

SEQ ID NO: 1029344 - RNA, 19 nt, Homo sapiens
ccaagaaugcugaacuaga

SEQ ID NO: 1029345 - RNA, 19 nt, Homo sapiens
aaagauaccacucuguuuc

SEQ ID NO: 1029346 - RNA, 19 nt, Homo sapiens
ugacauguaugcagaacag

SEQ ID NO: 1029347 - RNA, 19 nt, Homo sapiens
acccagaugugcucuacua

SEQ ID NO: 1029348 - RNA, 19 nt, Homo sapiens
caagcucuaugauuucuac

SEQ ID NO: 1029349 - RNA, 19 nt, Homo sapiens
caaagaagaaccccucuaa

SEQ ID NO: 1029350 - RNA, 19 nt, Homo sapiens
ugaccacccucauguucuu

SEQ ID NO: 1029351 - RNA, 19 nt, Homo sapiens
cagagaauccauugagaug

SEQ ID NO: 1029352 - RNA, 19 nt, Homo sapiens
gcucuggguuuccuugagu

SEQ ID NO: 1029353 - RNA, 19 nt, Homo sapiens
aaagaagaggccuccauuu

SEQ ID NO: 1029354 - RNA, 19 nt, Homo sapiens
gugaaaggccggaaugaca

SEQ ID NO: 1029355 - RNA, 19 nt, Homo sapiens
ccacccucauguucuuuaa

SEQ ID NO: 1029356 - RNA, 19 nt, Homo sapiens
ugauggaauucuuguaaca

SEQ ID NO: 1029357 - RNA, 19 nt, Homo sapiens
ccugauggaauucuuguaa

SEQ ID NO: 1029358 - RNA, 19 nt, Homo sapiens
agacauaaacuuagcaucu

SEQ ID NO: 1029359 - RNA, 19 nt, Homo sapiens
agagagauggaauuaauga

SEQ ID NO: 1029360 - RNA, 19 nt, Homo sapiens
gagcagaugggacaaaugc

SEQ ID NO: 1029361 - RNA, 19 nt, Homo sapiens
gcagcaaacuccccaggaa

SEQ ID NO: 1029362 - RNA, 19 nt, Homo sapiens
ucacuccacuuggcuaugu

SEQ ID NO: 1029363 - RNA, 19 nt, Homo sapiens
ccagcacaguucaugaaug

SEQ ID NO: 1029364 - RNA, 19 nt, Homo sapiens
acgggaagcucgaaaugga

SEQ ID NO: 1029365 - RNA, 19 nt, Homo sapiens
agagaaaccagccaggaaa

SEQ ID NO: 1029366 - RNA, 19 nt, Homo sapiens
gguacucaguccagccuau

SEQ ID NO: 1029367 - RNA, 19 nt, Homo sapiens
uaccaaguacuuccuauug

SEQ ID NO: 1029368 - RNA, 19 nt, Homo sapiens
ucacggaguggcuacauga

SEQ ID NO: 1029369 - RNA, 19 nt, Homo sapiens
gcagacccuugcaaacucu

SEQ ID NO: 1029370 - RNA, 19 nt, Homo sapiens
ccaacagcccaaucuggua

SEQ ID NO: 1029371 - RNA, 19 nt, Homo sapiens
ggaaggguagaugacauuu

SEQ ID NO: 1029372 - RNA, 19 nt, Homo sapiens
auuacacccuccuuuauga

SEQ ID NO: 1029373 - RNA, 19 nt, Homo sapiens
ccagaaaguuacagaugac

SEQ ID NO: 1029374 - RNA, 19 nt, Homo sapiens
accaaguacuuccuauuga

SEQ ID NO: 1029375 - RNA, 19 nt, Homo sapiens
cggaguggcuacaugaagu

SEQ ID NO: 1029376 - RNA, 19 nt, Homo sapiens
agagaaggaugcucagaac

SEQ ID NO: 1029377 - RNA, 19 nt, Homo sapiens
ggccagaaaguuacagaug

SEQ ID NO: 1029378 - RNA, 19 nt, Homo sapiens
uagagaaggaugcucagaa

SEQ ID NO: 1029379 - RNA, 19 nt, Homo sapiens
auaaagauaccacucuguu

SEQ ID NO: 1029380 - RNA, 19 nt, Homo sapiens
agagauggaauuaaugaug

SEQ ID NO: 1029381 - RNA, 19 nt, Homo sapiens
ugacugaggagaugcuaug

SEQ ID NO: 1029382 - RNA, 19 nt, Homo sapiens
agaauacggcucaaacugu

SEQ ID NO: 1029383 - RNA, 19 nt, Homo sapiens
aauuaugggcucugucuaa

SEQ ID NO: 1029384 - RNA, 19 nt, Homo sapiens
ucauauguccuagaaaguu

SEQ ID NO: 1029385 - RNA, 19 nt, Homo sapiens
ggaguggcuacaugaaguu

SEQ ID NO: 1029386 - RNA, 19 nt, Homo sapiens
ggauccuggugauaagaga

SEQ ID NO: 1029387 - RNA, 19 nt, Homo sapiens
ccagagaauccauugagau

SEQ ID NO: 1029388 - RNA, 19 nt, Homo sapiens
gaauuaugggcucugucua

SEQ ID NO: 1029389 - RNA, 19 nt, Homo sapiens
agaagggcuugaaguaugg

SEQ ID NO: 1029390 - RNA, 19 nt, Homo sapiens
cagaauacggcucaaacug

SEQ ID NO: 1029391 - RNA, 19 nt, Homo sapiens
ggagauauauaguggauua

SEQ ID NO: 1029392 - RNA, 19 nt, Homo sapiens
acacagagguggauaauaa

SEQ ID NO: 1029393 - RNA, 19 nt, Homo sapiens
gcacuuggcuuaccgauuc

SEQ ID NO: 1029394 - RNA, 19 nt, Homo sapiens
gcacugauuuguucuauuc

SEQ ID NO: 1029395 - RNA, 19 nt, Homo sapiens
gcaaagccaccuacaguua

SEQ ID NO: 1029396 - RNA, 19 nt, Homo sapiens
caaagggugugaaauuuau

SEQ ID NO: 1029397 - RNA, 19 nt, Homo sapiens
gaaaggaaacccggugaua

SEQ ID NO: 1029398 - RNA, 19 nt, Homo sapiens
ugacagcgcuugggacgua

SEQ ID NO: 1029399 - RNA, 19 nt, Homo sapiens
caagaaaccuacagaaacu

SEQ ID NO: 1029400 - RNA, 19 nt, Homo sapiens
gaauacaccucugauuuua

SEQ ID NO: 1029401 - RNA, 19 nt, Homo sapiens
caacuuaccuuguggaaaa

SEQ ID NO: 1029402 - RNA, 19 nt, Homo sapiens
ggucaaagggugugaaauu

SEQ ID NO: 1029403 - RNA, 19 nt, Homo sapiens
gcauuuagccucuugauuc

SEQ ID NO: 1029404 - RNA, 19 nt, Homo sapiens
acucaagacuguagguuua

SEQ ID NO: 1029405 - RNA, 19 nt, Homo sapiens
ccaauuugcugguucuuug

SEQ ID NO: 1029406 - RNA, 19 nt, Homo sapiens
ggaagacagugugauaaga

SEQ ID NO: 1029407 - RNA, 19 nt, Homo sapiens
ggucaagcauucuucuauu

SEQ ID NO: 1029408 - RNA, 19 nt, Homo sapiens
ccaaagacuuacuuaaauc

SEQ ID NO: 1029409 - RNA, 19 nt, Homo sapiens
aagagaaugugccgucaua

SEQ ID NO: 1029410 - RNA, 19 nt, Homo sapiens
ugacaucucugcguuauca

SEQ ID NO: 1029411 - RNA, 19 nt, Homo sapiens
gagcuagaccuucuuauuc

SEQ ID NO: 1029412 - RNA, 19 nt, Homo sapiens
ucaaagggugugaaauuua

SEQ ID NO: 1029413 - RNA, 19 nt, Homo sapiens
uuaguaaacuguugcaaga

SEQ ID NO: 1029414 - RNA, 19 nt, Homo sapiens
cuuaaagucugcuguuauu

SEQ ID NO: 1029415 - RNA, 19 nt, Homo sapiens
ugacuaaauucaucuggaa

SEQ ID NO: 1029416 - RNA, 19 nt, Homo sapiens
ggaacuggaucagacugua

SEQ ID NO: 1029417 - RNA, 19 nt, Homo sapiens
ugagagagcaguugagauu

SEQ ID NO: 1029418 - RNA, 19 nt, Homo sapiens
ggcgauagcacuuggcuua

SEQ ID NO: 1029419 - RNA, 19 nt, Homo sapiens
gugaauacaccucugauuu

SEQ ID NO: 1029420 - RNA, 19 nt, Homo sapiens
gucaaagggugugaaauuu

SEQ ID NO: 1029421 - RNA, 19 nt, Homo sapiens
ugacugcucuaccugaauu

SEQ ID NO: 1029422 - RNA, 19 nt, Homo sapiens
gucaagcauucuucuauuu

SEQ ID NO: 1029423 - RNA, 19 nt, Homo sapiens
caccaaagacuuacuuaaa

SEQ ID NO: 1029424 - RNA, 19 nt, Homo sapiens
caccagcucugaccacaaa

SEQ ID NO: 1029425 - RNA, 19 nt, Homo sapiens
caccaccucucuucaguaa

SEQ ID NO: 1029426 - RNA, 19 nt, Homo sapiens
ggccuggcguuauugcuua

SEQ ID NO: 1029427 - RNA, 19 nt, Homo sapiens
agauuacugugaugcauua

SEQ ID NO: 1029428 - RNA, 19 nt, Homo sapiens
cagaaaggcugagcuggaa

SEQ ID NO: 1029429 - RNA, 19 nt, Homo sapiens
aagaggagauugggacaua

SEQ ID NO: 1029430 - RNA, 19 nt, Homo sapiens
ucacgaggcauuuggauaa

SEQ ID NO: 1029431 - RNA, 19 nt, Homo sapiens
uuacugugaugcauuauug

SEQ ID NO: 1029432 - RNA, 19 nt, Homo sapiens
gcaccaaagacuuacuuaa

SEQ ID NO: 1029433 - RNA, 19 nt, Homo sapiens
gugcacaaguggcccagua

SEQ ID NO: 1029434 - RNA, 19 nt, Homo sapiens
ggaccacauuggccacauu

SEQ ID NO: 1029435 - RNA, 19 nt, Homo sapiens
gcuacgcacugauuuguuc

SEQ ID NO: 1029436 - RNA, 19 nt, Homo sapiens
ucugauagaugccuugaga

SEQ ID NO: 1029437 - RNA, 19 nt, Homo sapiens
ggaaggaagaccaaugaga

SEQ ID NO: 1029438 - RNA, 19 nt, Homo sapiens
aaagucugcuguuauucua

SEQ ID NO: 1029439 - RNA, 19 nt, Homo sapiens
ccaccucucuucaguaaag

SEQ ID NO: 1029440 - RNA, 19 nt, Homo sapiens
guaaacuguugcaagagaa

SEQ ID NO: 1029441 - RNA, 19 nt, Homo sapiens
ggagagagagacgccuuua

SEQ ID NO: 1029442 - RNA, 19 nt, Homo sapiens
gccaagaaaccuacagaaa

SEQ ID NO: 1029443 - RNA, 19 nt, Homo sapiens
gcuggaagacagugugaua

SEQ ID NO: 1029444 - RNA, 19 nt, Homo sapiens
cagcugagauuacugugau

SEQ ID NO: 1029445 - RNA, 19 nt, Homo sapiens
ggagauugggacauauuaa

SEQ ID NO: 1029446 - RNA, 19 nt, Homo sapiens
gagagaugauuuuguguuu

SEQ ID NO: 1029447 - RNA, 19 nt, Homo sapiens
gggcaacuccaacaacauu

SEQ ID NO: 1029448 - RNA, 19 nt, Homo sapiens
ccaagguucucaggcagua

SEQ ID NO: 1029449 - RNA, 19 nt, Homo sapiens
agaaugugccgucauauga

SEQ ID NO: 1029450 - RNA, 19 nt, Homo sapiens
gagaaugugccgucauaug

SEQ ID NO: 1029451 - RNA, 19 nt, Homo sapiens
ggugauauccgacauccaa

SEQ ID NO: 1029452 - RNA, 19 nt, Homo sapiens
ggaucagacuguacuugga

SEQ ID NO: 1029453 - RNA, 19 nt, Homo sapiens
gaaugugccgucauaugaa

SEQ ID NO: 1029454 - RNA, 19 nt, Homo sapiens
gagacgccuuuacccaauu

SEQ ID NO: 1029455 - RNA, 19 nt, Homo sapiens
ugugaugcauuauugguuu

SEQ ID NO: 1029456 - RNA, 19 nt, Homo sapiens
ggugacaucucugcguuau

SEQ ID NO: 1029457 - RNA, 19 nt, Homo sapiens
cacauaaucuuccggucuu

SEQ ID NO: 1029458 - RNA, 19 nt, Homo sapiens
auagaugccuugagagaug

SEQ ID NO: 1029459 - RNA, 19 nt, Homo sapiens
guaccuggaugcucugaag

SEQ ID NO: 1029460 - RNA, 19 nt, Homo sapiens
ccaaagcacguccaacaga

SEQ ID NO: 1029461 - RNA, 19 nt, Homo sapiens
guucugcguuugaaaggaa

SEQ ID NO: 1029462 - RNA, 19 nt, Homo sapiens
gagauugggacauauuaau

SEQ ID NO: 1029463 - RNA, 19 nt, Homo sapiens
aaaggagcaucucacaguu

SEQ ID NO: 1029464 - RNA, 19 nt, Homo sapiens
gcugcagacuucaaacuca

SEQ ID NO: 1029465 - RNA, 19 nt, Homo sapiens
gguuuucucugcucuuuua

SEQ ID NO: 1029466 - RNA, 19 nt, Homo sapiens
ggaaaagcauucagaaguc

SEQ ID NO: 1029467 - RNA, 19 nt, Homo sapiens
ccaagaaaccuacagaaac

SEQ ID NO: 1029468 - RNA, 19 nt, Homo sapiens
uuuaaucaguucugcguuu

SEQ ID NO: 1029469 - RNA, 19 nt, Homo sapiens
ggacuuucgcuaccuguug

SEQ ID NO: 1029470 - RNA, 19 nt, Homo sapiens
cauuuagccucuugauuca

SEQ ID NO: 1029471 - RNA, 19 nt, Homo sapiens
uauaguggauuaguucuuc

SEQ ID NO: 1029472 - RNA, 19 nt, Homo sapiens
ccacaaagccgagcucucu

SEQ ID NO: 1029473 - RNA, 19 nt, Homo sapiens
gcauucagaaguccuauuc

SEQ ID NO: 1029474 - RNA, 19 nt, Homo sapiens
ggcagaagcugagcgagau

SEQ ID NO: 1029475 - RNA, 19 nt, Homo sapiens
gaggagauugggacauauu

SEQ ID NO: 1029476 - RNA, 19 nt, Homo sapiens
guugauggauaacuuucuu

SEQ ID NO: 1029477 - RNA, 19 nt, Homo sapiens
ugaauacagugcagcuuag

SEQ ID NO: 1029478 - RNA, 19 nt, Homo sapiens
acaccucacugcagucgaa

SEQ ID NO: 1029479 - RNA, 19 nt, Homo sapiens
gauuuguucuauuccaguu

SEQ ID NO: 1029480 - RNA, 19 nt, Homo sapiens
gagauuacugugaugcauu

SEQ ID NO: 1029481 - RNA, 19 nt, Homo sapiens
caaaaugucagaaagauug

SEQ ID NO: 1029482 - RNA, 19 nt, Homo sapiens
gcagcuuaguaaacuguug

SEQ ID NO: 1029483 - RNA, 19 nt, Homo sapiens
ucagaaacacgcagugguu

SEQ ID NO: 1029484 - RNA, 19 nt, Homo sapiens
cuuccggucuuagcauuua

SEQ ID NO: 1029485 - RNA, 19 nt, Homo sapiens
gcgcugcugugugugauug

SEQ ID NO: 1029486 - RNA, 19 nt, Homo sapiens
aguaaacuguugcaagaga

SEQ ID NO: 1029487 - RNA, 19 nt, Homo sapiens
auacagugcagcuuaguaa

SEQ ID NO: 1029488 - RNA, 19 nt, Homo sapiens
ccacauuggccacauuuca

SEQ ID NO: 1029489 - RNA, 19 nt, Homo sapiens
ucagagcuagaccuucuua

SEQ ID NO: 1029490 - RNA, 19 nt, Homo sapiens
ggaaacaccccaaggaaga

SEQ ID NO: 1029491 - RNA, 19 nt, Homo sapiens
ggaaacaacuucaaucaca

SEQ ID NO: 1029492 - RNA, 19 nt, Homo sapiens
ggaaggagauaaaugaaga

SEQ ID NO: 1029493 - RNA, 19 nt, Homo sapiens
caacaccacuuccuagaaa

SEQ ID NO: 1029494 - RNA, 19 nt, Homo sapiens
ucagaugacuuuaaaggua

SEQ ID NO: 1029495 - RNA, 19 nt, Homo sapiens
ggacaucuaugcuaauauc

SEQ ID NO: 1029496 - RNA, 19 nt, Homo sapiens
gaggacaucuaugcuaaua

SEQ ID NO: 1029497 - RNA, 19 nt, Homo sapiens
gcaaauuucucuucuggau

SEQ ID NO: 1029498 - RNA, 19 nt, Homo sapiens
cgaggaagaugucagauau

SEQ ID NO: 1029499 - RNA, 19 nt, Homo sapiens
uaacuggcauuguaauuug

SEQ ID NO: 1029500 - RNA, 19 nt, Homo sapiens
gaucauaacccgcacauuc

SEQ ID NO: 1029501 - RNA, 19 nt, Homo sapiens
gcaguaaguucuaaucaca

SEQ ID NO: 1029502 - RNA, 19 nt, Homo sapiens
ggaggaggaugaaggagaa

SEQ ID NO: 1029503 - RNA, 19 nt, Homo sapiens
acauucaucuccuuacuua

SEQ ID NO: 1029504 - RNA, 19 nt, Homo sapiens
guaaaugaauccauacaca

SEQ ID NO: 1029505 - RNA, 19 nt, Homo sapiens
gaaauggcuucuagaugga

SEQ ID NO: 1029506 - RNA, 19 nt, Homo sapiens
cagaagacauuauaagauc

SEQ ID NO: 1029507 - RNA, 19 nt, Homo sapiens
uaagccaugugaauaagua

SEQ ID NO: 1029508 - RNA, 19 nt, Homo sapiens
gacaacagaagacauuaua

SEQ ID NO: 1029509 - RNA, 19 nt, Homo sapiens
gaaaauagaggaagacaaa

SEQ ID NO: 1029510 - RNA, 19 nt, Homo sapiens
uaaggaaggagauaaauga

SEQ ID NO: 1029511 - RNA, 19 nt, Homo sapiens
gaaaguggaaagagaagaa

SEQ ID NO: 1029512 - RNA, 19 nt, Homo sapiens
uauaagaucugugaaagug

SEQ ID NO: 1029513 - RNA, 19 nt, Homo sapiens
gaagcuaguccucaugaaa

SEQ ID NO: 1029514 - RNA, 19 nt, Homo sapiens
gaaacaacuucaaucacau

SEQ ID NO: 1029515 - RNA, 19 nt, Homo sapiens
gagcagaagagucaauuga

SEQ ID NO: 1029516 - RNA, 19 nt, Homo sapiens
aaacauccuuugaagaaga

SEQ ID NO: 1029517 - RNA, 19 nt, Homo sapiens
caacuucaaucacaucagu

SEQ ID NO: 1029518 - RNA, 19 nt, Homo sapiens
gaaggaagaggccauuuua

SEQ ID NO: 1029519 - RNA, 19 nt, Homo sapiens
aggaagaugucagauauaa

SEQ ID NO: 1029520 - RNA, 19 nt, Homo sapiens
ggaagaaucgaaugucaug

SEQ ID NO: 1029521 - RNA, 19 nt, Homo sapiens
ccauggaaauuaaaguuga

SEQ ID NO: 1029522 - RNA, 19 nt, Homo sapiens
gaagagaugaagaagcaaa

SEQ ID NO: 1029523 - RNA, 19 nt, Homo sapiens
gaaccggugacaaugauuu

SEQ ID NO: 1029524 - RNA, 19 nt, Homo sapiens
gcaccagcauuugaagaaa

SEQ ID NO: 1029525 - RNA, 19 nt, Homo sapiens
uaugguagcuuuggacuug

SEQ ID NO: 1029526 - RNA, 19 nt, Homo sapiens
agaaagagcagaagaguca

SEQ ID NO: 1029527 - RNA, 19 nt, Homo sapiens
gaacaggaagagaugaaga

SEQ ID NO: 1029528 - RNA, 19 nt, Homo sapiens
ugacuguccuugacuucua

SEQ ID NO: 1029529 - RNA, 19 nt, Homo sapiens
ccaaagcauuucuaauaag

SEQ ID NO: 1029530 - RNA, 19 nt, Homo sapiens
ggaaagcauugcccuucau

SEQ ID NO: 1029531 - RNA, 19 nt, Homo sapiens
ccaguuacuugacacgauu

SEQ ID NO: 1029532 - RNA, 19 nt, Homo sapiens
cuuuaaagguacaggaaua

SEQ ID NO: 1029533 - RNA, 19 nt, Homo sapiens
caacagaagacauuauaag

SEQ ID NO: 1029534 - RNA, 19 nt, Homo sapiens
gaagaaacuaagaagcauu

SEQ ID NO: 1029535 - RNA, 19 nt, Homo sapiens
gaagacagugaagaagaua

SEQ ID NO: 1029536 - RNA, 19 nt, Homo sapiens
gcacauucaucuccuuacu

SEQ ID NO: 1029537 - RNA, 19 nt, Homo sapiens
gucgggaauuucucuauuu

SEQ ID NO: 1029538 - RNA, 19 nt, Homo sapiens
ugaaggagaagcagagaaa

SEQ ID NO: 1029539 - RNA, 19 nt, Homo sapiens
ggacgaggaagaugucaga

SEQ ID NO: 1029540 - RNA, 19 nt, Homo sapiens
gaagaaagagcagaagagu

SEQ ID NO: 1029541 - RNA, 19 nt, Homo sapiens
gacauuauaagaucuguga

SEQ ID NO: 1029542 - RNA, 19 nt, Homo sapiens
caauugagcggacaacaga

SEQ ID NO: 1029543 - RNA, 19 nt, Homo sapiens
aggaagaaaucucacagaa

SEQ ID NO: 1029544 - RNA, 19 nt, Homo sapiens
ucacagaaguauucaacuc

SEQ ID NO: 1029545 - RNA, 19 nt, Homo sapiens
agacaagccucagagagaa

SEQ ID NO: 1029546 - RNA, 19 nt, Homo sapiens
ccaaaguccuacauaccuu

SEQ ID NO: 1029547 - RNA, 19 nt, Homo sapiens
ggacaacagaagacauuau

SEQ ID NO: 1029548 - RNA, 19 nt, Homo sapiens
gaacugcaaaucucaacga

SEQ ID NO: 1029549 - RNA, 19 nt, Homo sapiens
gauaccaaagcauuucuaa

SEQ ID NO: 1029550 - RNA, 19 nt, Homo sapiens
gugaagaagauaagaaguu

SEQ ID NO: 1029551 - RNA, 19 nt, Homo sapiens
gaggaagaugucagauaua

SEQ ID NO: 1029552 - RNA, 19 nt, Homo sapiens
aggaagagaugaagaagca

SEQ ID NO: 1029553 - RNA, 19 nt, Homo sapiens
uccaaacccuugcacauau

SEQ ID NO: 1029554 - RNA, 19 nt, Homo sapiens
gauccauccuuaacagcuu

SEQ ID NO: 1029555 - RNA, 19 nt, Homo sapiens
ggguauugguguaaaugaa

SEQ ID NO: 1029556 - RNA, 19 nt, Homo sapiens
gagaagaaagagcagaaga

SEQ ID NO: 1029557 - RNA, 19 nt, Homo sapiens
gaaaagaacaggaagagau

SEQ ID NO: 1029558 - RNA, 19 nt, Homo sapiens
uaaagcaccagcauuugaa

SEQ ID NO: 1029559 - RNA, 19 nt, Homo sapiens
ggaagaaaucucacagaag

SEQ ID NO: 1029560 - RNA, 19 nt, Homo sapiens
guccuugacuucuagaaug

SEQ ID NO: 1029561 - RNA, 19 nt, Homo sapiens
ugaaagagcaagaagaaag

SEQ ID NO: 1029562 - RNA, 19 nt, Homo sapiens
agaagacagugaagaagau

SEQ ID NO: 1029563 - RNA, 19 nt, Homo sapiens
gggaauuucucuauuucuc

SEQ ID NO: 1029564 - RNA, 19 nt, Homo sapiens
gaagaggccauuuuaaaga

SEQ ID NO: 1029565 - RNA, 19 nt, Homo sapiens
cuaaagcaccagcauuuga

SEQ ID NO: 1029566 - RNA, 19 nt, Homo sapiens
guauucaacucugacaaau

SEQ ID NO: 1029567 - RNA, 19 nt, Homo sapiens
guucaaacuugucagucaa

SEQ ID NO: 1029568 - RNA, 19 nt, Homo sapiens
caaauuucucuucuggaua

SEQ ID NO: 1029569 - RNA, 19 nt, Homo sapiens
uugaggacaucuaugcuaa

SEQ ID NO: 1029570 - RNA, 19 nt, Homo sapiens
gaaacuaaagucaauugag

SEQ ID NO: 1029571 - RNA, 19 nt, Homo sapiens
gguaucagcaggcagaaga

SEQ ID NO: 1029572 - RNA, 19 nt, Homo sapiens
ugguguaaaugaauccaua

SEQ ID NO: 1029573 - RNA, 19 nt, Homo sapiens
ggacuggguauugguguaa

SEQ ID NO: 1029574 - RNA, 19 nt, Homo sapiens
ccugacaagucgggaauuu

SEQ ID NO: 1029575 - RNA, 19 nt, Homo sapiens
ggucugaguuuggauaguc

SEQ ID NO: 1029576 - RNA, 19 nt, Homo sapiens
cauauuaagccaugugaau

SEQ ID NO: 1029577 - RNA, 19 nt, Homo sapiens
cagaaccggugacaaugau

SEQ ID NO: 1029578 - RNA, 19 nt, Homo sapiens
gcggacaacagaagacauu

SEQ ID NO: 1029579 - RNA, 19 nt, Homo sapiens
gcaaaucucaacgaaggaa

SEQ ID NO: 1029580 - RNA, 19 nt, Homo sapiens
gaaagaucauaggaaagca

SEQ ID NO: 1029581 - RNA, 19 nt, Homo sapiens
cagaagacagugaagaaga

SEQ ID NO: 1029582 - RNA, 19 nt, Homo sapiens
auacagaaccggugacaau

SEQ ID NO: 1029583 - RNA, 19 nt, Homo sapiens
ggccagcgcacagaucaua

SEQ ID NO: 1029584 - RNA, 19 nt, Homo sapiens
agagcaagaagaaagcuua

SEQ ID NO: 1029585 - RNA, 19 nt, Homo sapiens
ggaggaggaggaugaagga

SEQ ID NO: 1029586 - RNA, 19 nt, Homo sapiens
ggcagaagacagugaagaa

SEQ ID NO: 1029587 - RNA, 19 nt, Homo sapiens
gaaggagauaaaugaagaa

SEQ ID NO: 1029588 - RNA, 19 nt, Homo sapiens
aaacuugucagucaacuca

SEQ ID NO: 1029589 - RNA, 19 nt, Homo sapiens
ccgcugccguucaaacuug

SEQ ID NO: 1029590 - RNA, 19 nt, Homo sapiens
aaaccaacaccacuuccua

SEQ ID NO: 1029591 - RNA, 19 nt, Homo sapiens
gaaaguuacugccuucaua

SEQ ID NO: 1029592 - RNA, 19 nt, Homo sapiens
gaaagaacgugaaaugguu

SEQ ID NO: 1029593 - RNA, 19 nt, Homo sapiens
gcacugaaauccuggcaua

SEQ ID NO: 1029594 - RNA, 19 nt, Homo sapiens
ggaaagacauuuguacuug

SEQ ID NO: 1029595 - RNA, 19 nt, Homo sapiens
gaaguucucuacauuauag

SEQ ID NO: 1029596 - RNA, 19 nt, Homo sapiens
gcugacauauaguguauua

SEQ ID NO: 1029597 - RNA, 19 nt, Homo sapiens
caacaauaguguaccauuu

SEQ ID NO: 1029598 - RNA, 19 nt, Homo sapiens
gaagaggguuucugaggaa

SEQ ID NO: 1029599 - RNA, 19 nt, Homo sapiens
gaucaagucaccacuguua

SEQ ID NO: 1029600 - RNA, 19 nt, Homo sapiens
gcacuaauguuuccaucuu

SEQ ID NO: 1029601 - RNA, 19 nt, Homo sapiens
gaaugacaauugugugaaa

SEQ ID NO: 1029602 - RNA, 19 nt, Homo sapiens
gaagauuacagucaacaua

SEQ ID NO: 1029603 - RNA, 19 nt, Homo sapiens
uuacacagcugacauauag

SEQ ID NO: 1029604 - RNA, 19 nt, Homo sapiens
ucaaacaucuccagcacua

SEQ ID NO: 1029605 - RNA, 19 nt, Homo sapiens
ccacagagggcaaaguuua

SEQ ID NO: 1029606 - RNA, 19 nt, Homo sapiens
gaugaucccuugccugcua

SEQ ID NO: 1029607 - RNA, 19 nt, Homo sapiens
uagcagagaccaugaauaa

SEQ ID NO: 1029608 - RNA, 19 nt, Homo sapiens
uaacagagaacuacagaaa

SEQ ID NO: 1029609 - RNA, 19 nt, Homo sapiens
ggagaaagaacgugaaaug

SEQ ID NO: 1029610 - RNA, 19 nt, Homo sapiens
acaaugaguuugaugauga

SEQ ID NO: 1029611 - RNA, 19 nt, Homo sapiens
acagagaacuacagaaaga

SEQ ID NO: 1029612 - RNA, 19 nt, Homo sapiens
aaagucagcugcuuccauu

SEQ ID NO: 1029613 - RNA, 19 nt, Homo sapiens
gaaccugaaguauuuauga

SEQ ID NO: 1029614 - RNA, 19 nt, Homo sapiens
gcauuuccauacauuguuu

SEQ ID NO: 1029615 - RNA, 19 nt, Homo sapiens
gaaaugggcaagauguuga

SEQ ID NO: 1029616 - RNA, 19 nt, Homo sapiens
gcagagaccaugaauaaca

SEQ ID NO: 1029617 - RNA, 19 nt, Homo sapiens
gcccagcacuagaagauuu

SEQ ID NO: 1029618 - RNA, 19 nt, Homo sapiens
ccaggagacuuuccauuug

SEQ ID NO: 1029619 - RNA, 19 nt, Homo sapiens
gaacgaaggacuauuaaac

SEQ ID NO: 1029620 - RNA, 19 nt, Homo sapiens
gacgaacgaaggacuauua

SEQ ID NO: 1029621 - RNA, 19 nt, Homo sapiens
cugaaauccuggcauaaua

SEQ ID NO: 1029622 - RNA, 19 nt, Homo sapiens
gaaucucguuacaggguua

SEQ ID NO: 1029623 - RNA, 19 nt, Homo sapiens
agauguaacucuagagaaa

SEQ ID NO: 1029624 - RNA, 19 nt, Homo sapiens
gauauugaaucucguuaca

SEQ ID NO: 1029625 - RNA, 19 nt, Homo sapiens
ugagaagaauccacaaaug

SEQ ID NO: 1029626 - RNA, 19 nt, Homo sapiens
gcaucaaacuaaagacaug

SEQ ID NO: 1029627 - RNA, 19 nt, Homo sapiens
gugaaguucucuacauuau

SEQ ID NO: 1029628 - RNA, 19 nt, Homo sapiens
cuaaagacauguccaaguc

SEQ ID NO: 1029629 - RNA, 19 nt, Homo sapiens
caguaaagguuccugaaga

SEQ ID NO: 1029630 - RNA, 19 nt, Homo sapiens
agacauagcagugacauaa

SEQ ID NO: 1029631 - RNA, 19 nt, Homo sapiens
ccaccuccgugcuugcuua

SEQ ID NO: 1029632 - RNA, 19 nt, Homo sapiens
ucacaguuauucccacaaa

SEQ ID NO: 1029633 - RNA, 19 nt, Homo sapiens
ggaguuugcagccuaaauu

SEQ ID NO: 1029634 - RNA, 19 nt, Homo sapiens
caaaguuauucccaucauu

SEQ ID NO: 1029635 - RNA, 19 nt, Homo sapiens
gaaauccuggcauaauaaa

SEQ ID NO: 1029636 - RNA, 19 nt, Homo sapiens
gcagugacauaaaucaucu

SEQ ID NO: 1029637 - RNA, 19 nt, Homo sapiens
caggagacuuuccauuuga

SEQ ID NO: 1029638 - RNA, 19 nt, Homo sapiens
uggugcaucuucaaauuua

SEQ ID NO: 1029639 - RNA, 19 nt, Homo sapiens
aaacuugagugccuaaauc

SEQ ID NO: 1029640 - RNA, 19 nt, Homo sapiens
gaagguacucuagcaauga

SEQ ID NO: 1029641 - RNA, 19 nt, Homo sapiens
gaauagugcaaccuguaua

SEQ ID NO: 1029642 - RNA, 19 nt, Homo sapiens
gcaaugaggaggaaaugug

SEQ ID NO: 1029643 - RNA, 19 nt, Homo sapiens
cagcugacauauaguguau

SEQ ID NO: 1029644 - RNA, 19 nt, Homo sapiens
cugugaaccugaaguauuu

SEQ ID NO: 1029645 - RNA, 19 nt, Homo sapiens
ggugaaguucucuacauua

SEQ ID NO: 1029646 - RNA, 19 nt, Homo sapiens
gcaaaguuauucccaucau

SEQ ID NO: 1029647 - RNA, 19 nt, Homo sapiens
cauacuacccguuauacua

SEQ ID NO: 1029648 - RNA, 19 nt, Homo sapiens
ugaaucauacuacccguua

SEQ ID NO: 1029649 - RNA, 19 nt, Homo sapiens
gaaacgugauacaucuuca

SEQ ID NO: 1029650 - RNA, 19 nt, Homo sapiens
gaaaacaucucugcuguag

SEQ ID NO: 1029651 - RNA, 19 nt, Homo sapiens
uacauuagcugucccaaca

SEQ ID NO: 1029652 - RNA, 19 nt, Homo sapiens
gaacuuaacagagaacuac

SEQ ID NO: 1029653 - RNA, 19 nt, Homo sapiens
gaaauggacgaacgaagga

SEQ ID NO: 1029654 - RNA, 19 nt, Homo sapiens
guagugauuccucagauuu

SEQ ID NO: 1029655 - RNA, 19 nt, Homo sapiens
ugacagacuacaugaagua

SEQ ID NO: 1029656 - RNA, 19 nt, Homo sapiens
gacaauugugugaaaguua

SEQ ID NO: 1029657 - RNA, 19 nt, Homo sapiens
ucaggcaugucuuuagauu

SEQ ID NO: 1029658 - RNA, 19 nt, Homo sapiens
gagggaaguuacacugaug

SEQ ID NO: 1029659 - RNA, 19 nt, Homo sapiens
ggaaaugggcaagauguug

SEQ ID NO: 1029660 - RNA, 19 nt, Homo sapiens
gaaugaggcuuggcucucu

SEQ ID NO: 1029661 - RNA, 19 nt, Homo sapiens
gaguuugcagccuaaauua

SEQ ID NO: 1029662 - RNA, 19 nt, Homo sapiens
ggugguagacuccuucaaa

SEQ ID NO: 1029663 - RNA, 19 nt, Homo sapiens
uaaagauaguguucucugu

SEQ ID NO: 1029664 - RNA, 19 nt, Homo sapiens
ugaagguacucuagcaaug

SEQ ID NO: 1029665 - RNA, 19 nt, Homo sapiens
gagaagaauccacaaaugg

SEQ ID NO: 1029666 - RNA, 19 nt, Homo sapiens
uugaugaacuuaacagaga

SEQ ID NO: 1029667 - RNA, 19 nt, Homo sapiens
ucuuagugguguuguaaua

SEQ ID NO: 1029668 - RNA, 19 nt, Homo sapiens
caaaugcugccuuaaacuu

SEQ ID NO: 1029669 - RNA, 19 nt, Homo sapiens
ugaaauccuggcauaauaa

SEQ ID NO: 1029670 - RNA, 19 nt, Homo sapiens
gcacauguugauuucuuaa

SEQ ID NO: 1029671 - RNA, 19 nt, Homo sapiens
cugugugacugcuuuaaua

SEQ ID NO: 1029672 - RNA, 19 nt, Homo sapiens
gcugugaaccugaaguauu

SEQ ID NO: 1029673 - RNA, 19 nt, Homo sapiens
acaagcaacuacaagaaau

SEQ ID NO: 1029674 - RNA, 19 nt, Homo sapiens
gaaaggccaagggcaaauu

SEQ ID NO: 1029675 - RNA, 19 nt, Homo sapiens
gugcacauguugauuucuu

SEQ ID NO: 1029676 - RNA, 19 nt, Homo sapiens
ggaauagugcaaccuguau

SEQ ID NO: 1029677 - RNA, 19 nt, Homo sapiens
uguauuaccuuugcagcua

SEQ ID NO: 1029678 - RNA, 19 nt, Homo sapiens
gauauucaccaccucaaga

SEQ ID NO: 1029679 - RNA, 19 nt, Homo sapiens
cacuaauguuuccaucuua

SEQ ID NO: 1029680 - RNA, 19 nt, Homo sapiens
cagaaagaaucagaccaaa

SEQ ID NO: 1029681 - RNA, 19 nt, Homo sapiens
aagauaguguucucuguug

SEQ ID NO: 1029682 - RNA, 19 nt, Homo sapiens
ugacaauugugugaaaguu

SEQ ID NO: 1029683 - RNA, 19 nt, Homo sapiens
cagaggauuugcugacuca

SEQ ID NO: 1029684 - RNA, 19 nt, Homo sapiens
caacacuaccacuacagua

SEQ ID NO: 1029685 - RNA, 19 nt, Homo sapiens
uagauucccuuguucuugu

SEQ ID NO: 1029686 - RNA, 19 nt, Homo sapiens
uaaugaagguacucuagca

SEQ ID NO: 1029687 - RNA, 19 nt, Homo sapiens
caaugaguuugaugaugaa

SEQ ID NO: 1029688 - RNA, 19 nt, Homo sapiens
guuacugccuucauaagau

SEQ ID NO: 1029689 - RNA, 19 nt, Homo sapiens
gacuaucagugcauccaaa

SEQ ID NO: 1029690 - RNA, 19 nt, Homo sapiens
guacugacagacuacauga

SEQ ID NO: 1029691 - RNA, 19 nt, Homo sapiens
ggaaugaacuggcauauuu

SEQ ID NO: 1029692 - RNA, 19 nt, Homo sapiens
gaaagaaguugaaguauca

SEQ ID NO: 1029693 - RNA, 19 nt, Homo sapiens
gcacagaccucucaaacuu

SEQ ID NO: 1029694 - RNA, 19 nt, Homo sapiens
caucauaacuugagcauuu

SEQ ID NO: 1029695 - RNA, 19 nt, Homo sapiens
caacagauuuguaguauga

SEQ ID NO: 1029696 - RNA, 19 nt, Homo sapiens
ucacacagcugaaaguaua

SEQ ID NO: 1029697 - RNA, 19 nt, Homo sapiens
gaacagauguaucagaaau

SEQ ID NO: 1029698 - RNA, 19 nt, Homo sapiens
gaaacuaguugaaggauau

SEQ ID NO: 1029699 - RNA, 19 nt, Homo sapiens
gaaagaaagugauccaaca

SEQ ID NO: 1029700 - RNA, 19 nt, Homo sapiens
gaacagcucuuuagaucug

SEQ ID NO: 1029701 - RNA, 19 nt, Homo sapiens
caucaaaugugaagacuuu

SEQ ID NO: 1029702 - RNA, 19 nt, Homo sapiens
acaaaucagugcaaacuua

SEQ ID NO: 1029703 - RNA, 19 nt, Homo sapiens
gcaagaaaaugcuaaguua

SEQ ID NO: 1029704 - RNA, 19 nt, Homo sapiens
gaaauaguguagcaucuga

SEQ ID NO: 1029705 - RNA, 19 nt, Homo sapiens
gcacucaacuuuccucaug

SEQ ID NO: 1029706 - RNA, 19 nt, Homo sapiens
ccacaaacccaauguauaa

SEQ ID NO: 1029707 - RNA, 19 nt, Homo sapiens
caaauuggccugagcauaa

SEQ ID NO: 1029708 - RNA, 19 nt, Homo sapiens
ggaaagaaguugaaguauc

SEQ ID NO: 1029709 - RNA, 19 nt, Homo sapiens
gcuaagagaugcccaugaa

SEQ ID NO: 1029710 - RNA, 19 nt, Homo sapiens
caucugaaaucacaaguuu

SEQ ID NO: 1029711 - RNA, 19 nt, Homo sapiens
gaucaacgauuucagacaa

SEQ ID NO: 1029712 - RNA, 19 nt, Homo sapiens
aaauauaacugcccagaaa

SEQ ID NO: 1029713 - RNA, 19 nt, Homo sapiens
gggagcaccucuuccuuua

SEQ ID NO: 1029714 - RNA, 19 nt, Homo sapiens
aaacagaacaguacacaua

SEQ ID NO: 1029715 - RNA, 19 nt, Homo sapiens
guaaagacauuaacugaag

SEQ ID NO: 1029716 - RNA, 19 nt, Homo sapiens
gaaaauaaguccuacagaa

SEQ ID NO: 1029717 - RNA, 19 nt, Homo sapiens
aaacauaucugccaacaag

SEQ ID NO: 1029718 - RNA, 19 nt, Homo sapiens
ggaaaugcaugaaaagaua

SEQ ID NO: 1029719 - RNA, 19 nt, Homo sapiens
cuaaugaacucacuaaaca

SEQ ID NO: 1029720 - RNA, 19 nt, Homo sapiens
ggcaaggguuggcagauua

SEQ ID NO: 1029721 - RNA, 19 nt, Homo sapiens
gaagaacacauaaaggaaa

SEQ ID NO: 1029722 - RNA, 19 nt, Homo sapiens
gaaagagcaucaugacaag

SEQ ID NO: 1029723 - RNA, 19 nt, Homo sapiens
agacugaacuuauccagaa

SEQ ID NO: 1029724 - RNA, 19 nt, Homo sapiens
gaaaagauaucucgaaugg

SEQ ID NO: 1029725 - RNA, 19 nt, Homo sapiens
ggcagaagcuaaugcauug

SEQ ID NO: 1029726 - RNA, 19 nt, Homo sapiens
gaaaaggucgagaaaauua

SEQ ID NO: 1029727 - RNA, 19 nt, Homo sapiens
uagaagaguucaccacauu

SEQ ID NO: 1029728 - RNA, 19 nt, Homo sapiens
ugaagcaauugcaguauaa

SEQ ID NO: 1029729 - RNA, 19 nt, Homo sapiens
ucagugagcuggagacaga

SEQ ID NO: 1029730 - RNA, 19 nt, Homo sapiens
acaagaagguaucaauuga

SEQ ID NO: 1029731 - RNA, 19 nt, Homo sapiens
gaauuagcauugcaaagug

SEQ ID NO: 1029732 - RNA, 19 nt, Homo sapiens
gcaaguauccgaucaacga

SEQ ID NO: 1029733 - RNA, 19 nt, Homo sapiens
gagaaggcacuacaacuaa

SEQ ID NO: 1029734 - RNA, 19 nt, Homo sapiens
uuacuaaucuucaggauca

SEQ ID NO: 1029735 - RNA, 19 nt, Homo sapiens
ggagagggauauaacuaug

SEQ ID NO: 1029736 - RNA, 19 nt, Homo sapiens
gugaagacuuugaaauuug

SEQ ID NO: 1029737 - RNA, 19 nt, Homo sapiens
gguaacauuuccacggaua

SEQ ID NO: 1029738 - RNA, 19 nt, Homo sapiens
gagaaaaggucgagaaaau

SEQ ID NO: 1029739 - RNA, 19 nt, Homo sapiens
gauagaggacuugaaauuu

SEQ ID NO: 1029740 - RNA, 19 nt, Homo sapiens
gagaaaagcugaaagaaag

SEQ ID NO: 1029741 - RNA, 19 nt, Homo sapiens
ucauugaugugcugguuua

SEQ ID NO: 1029742 - RNA, 19 nt, Homo sapiens
gagcaacagauuuguagua

SEQ ID NO: 1029743 - RNA, 19 nt, Homo sapiens
aaacugagcaggcuuggua

SEQ ID NO: 1029744 - RNA, 19 nt, Homo sapiens
ccaaagaguugcaaaauga

SEQ ID NO: 1029745 - RNA, 19 nt, Homo sapiens
aaacagucaucaaauguga

SEQ ID NO: 1029746 - RNA, 19 nt, Homo sapiens
gaagaaaauucccagguaa

SEQ ID NO: 1029747 - RNA, 19 nt, Homo sapiens
ucacuaaagcaaagacuua

SEQ ID NO: 1029748 - RNA, 19 nt, Homo sapiens
gcaauugcaguauaaacua

SEQ ID NO: 1029749 - RNA, 19 nt, Homo sapiens
ggagaaaucacaccaguca

SEQ ID NO: 1029750 - RNA, 19 nt, Homo sapiens
cgaaagagcaucaugacaa

SEQ ID NO: 1029751 - RNA, 19 nt, Homo sapiens
guauguaggucccaugaga

SEQ ID NO: 1029752 - RNA, 19 nt, Homo sapiens
ggaaauauuagacacagaa

SEQ ID NO: 1029753 - RNA, 19 nt, Homo sapiens
gaagaaggcaguggcauga

SEQ ID NO: 1029754 - RNA, 19 nt, Homo sapiens
ggucuucucucuuucuaga

SEQ ID NO: 1029755 - RNA, 19 nt, Homo sapiens
gaagugcaauggcgcaauc

SEQ ID NO: 1029756 - RNA, 19 nt, Homo sapiens
gagcuagaacagauaauaa

SEQ ID NO: 1029757 - RNA, 19 nt, Homo sapiens
caacaagaagguaucaauu

SEQ ID NO: 1029758 - RNA, 19 nt, Homo sapiens
aaagaagaauugcaagaug

SEQ ID NO: 1029759 - RNA, 19 nt, Homo sapiens
gaagacagccaaacacaag

SEQ ID NO: 1029760 - RNA, 19 nt, Homo sapiens
gcugaaaucuuuugagaaa

SEQ ID NO: 1029761 - RNA, 19 nt, Homo sapiens
cacagaagaucaaguggaa

SEQ ID NO: 1029762 - RNA, 19 nt, Homo sapiens
gaagaguucaccacauuug

SEQ ID NO: 1029763 - RNA, 19 nt, Homo sapiens
uaaacagacugaacuuauc

SEQ ID NO: 1029764 - RNA, 19 nt, Homo sapiens
caacuaaagagccaagaaa

SEQ ID NO: 1029765 - RNA, 19 nt, Homo sapiens
guugaaguaucacagagua

SEQ ID NO: 1029766 - RNA, 19 nt, Homo sapiens
ucaauagucagguucaaua

SEQ ID NO: 1029767 - RNA, 19 nt, Homo sapiens
ucacuaaacagucaucaaa

SEQ ID NO: 1029768 - RNA, 19 nt, Homo sapiens
gcaaaguguuacuaaucuu

SEQ ID NO: 1029769 - RNA, 19 nt, Homo sapiens
ucucuuaacuucacaauac

SEQ ID NO: 1029770 - RNA, 19 nt, Homo sapiens
gaagaucaaguggaaauug

SEQ ID NO: 1029771 - RNA, 19 nt, Homo sapiens
gugguaaggcgacaaauaa

SEQ ID NO: 1029772 - RNA, 19 nt, Homo sapiens
cagaagacauugcuguuag

SEQ ID NO: 1029773 - RNA, 19 nt, Homo sapiens
gaagaagaauuagaugaac

SEQ ID NO: 1029774 - RNA, 19 nt, Homo sapiens
ccaacaacuucgacaagaa

SEQ ID NO: 1029775 - RNA, 19 nt, Homo sapiens
agaaagugauccaacagaa

SEQ ID NO: 1029776 - RNA, 19 nt, Homo sapiens
caacuaugaccaagguuaa

SEQ ID NO: 1029777 - RNA, 19 nt, Homo sapiens
gaacuggcauauuucaaaa

SEQ ID NO: 1029778 - RNA, 19 nt, Homo sapiens
cagcugaaaguauaucaua

SEQ ID NO: 1029779 - RNA, 19 nt, Homo sapiens
ucaggaagauguucacaca

SEQ ID NO: 1029780 - RNA, 19 nt, Homo sapiens
gaaccacaaacccaaugua

SEQ ID NO: 1029781 - RNA, 19 nt, Homo sapiens
ggagagcuuuauugcaaau

SEQ ID NO: 1029782 - RNA, 19 nt, Homo sapiens
gacagaaaguaaauuugga

SEQ ID NO: 1029783 - RNA, 19 nt, Homo sapiens
uacagaaggucauugaguu

SEQ ID NO: 1029784 - RNA, 19 nt, Homo sapiens
caaaucagugcaaacuuaa

SEQ ID NO: 1029785 - RNA, 19 nt, Homo sapiens
gcaggcagacaauaaagaa

SEQ ID NO: 1029786 - RNA, 19 nt, Homo sapiens
gcccagaaaucaaguagca

SEQ ID NO: 1029787 - RNA, 19 nt, Homo sapiens
guagaaacaucccagaaaa

SEQ ID NO: 1029788 - RNA, 19 nt, Homo sapiens
aaaaucggcugaaaucuuu

SEQ ID NO: 1029789 - RNA, 19 nt, Homo sapiens
ggccugagcauaagaagaa

SEQ ID NO: 1029790 - RNA, 19 nt, Homo sapiens
gauggucgaauacaaauau

SEQ ID NO: 1029791 - RNA, 19 nt, Homo sapiens
ggaaacaacucguacugaa

SEQ ID NO: 1029792 - RNA, 19 nt, Homo sapiens
gaaacccugucucuacuaa

SEQ ID NO: 1029793 - RNA, 19 nt, Homo sapiens
ugacaaacccuguggauaa

SEQ ID NO: 1029794 - RNA, 19 nt, Homo sapiens
gguacaaaguuagucauua

SEQ ID NO: 1029795 - RNA, 19 nt, Homo sapiens
agaaagugguacaaaguua

SEQ ID NO: 1029796 - RNA, 19 nt, Homo sapiens
ccauauacuucgagagaua

SEQ ID NO: 1029797 - RNA, 19 nt, Homo sapiens
guaaagaucuaccauuugc

SEQ ID NO: 1029798 - RNA, 19 nt, Homo sapiens
gaagaacggcacaguggua

SEQ ID NO: 1029799 - RNA, 19 nt, Homo sapiens
ggaaaccuuuaaauccuaa

SEQ ID NO: 1029800 - RNA, 19 nt, Homo sapiens
guacaaaguuagucauuac

SEQ ID NO: 1029801 - RNA, 19 nt, Homo sapiens
gacaaacccuguggauaaa

SEQ ID NO: 1029802 - RNA, 19 nt, Homo sapiens
cagcuaagccgaacauuga

SEQ ID NO: 1029803 - RNA, 19 nt, Homo sapiens
gcucugauaucucugaugu

SEQ ID NO: 1029804 - RNA, 19 nt, Homo sapiens
gaucaugccacucuaaaug

SEQ ID NO: 1029805 - RNA, 19 nt, Homo sapiens
ucucugauguugcuaauug

SEQ ID NO: 1029806 - RNA, 19 nt, Homo sapiens
uaaaacagaucccuaauuc

SEQ ID NO: 1029807 - RNA, 19 nt, Homo sapiens
gaucuaccauuugcucuga

SEQ ID NO: 1029808 - RNA, 19 nt, Homo sapiens
cuguaaagaucuaccauuu

SEQ ID NO: 1029809 - RNA, 19 nt, Homo sapiens
guaacggacugaaagacaa

SEQ ID NO: 1029810 - RNA, 19 nt, Homo sapiens
cuaagacucucccauuguu

SEQ ID NO: 1029811 - RNA, 19 nt, Homo sapiens
ucaguguucugcuggcuua

SEQ ID NO: 1029812 - RNA, 19 nt, Homo sapiens
ucccauaccugaauaccua

SEQ ID NO: 1029813 - RNA, 19 nt, Homo sapiens
caaugaggauacccuuuga

SEQ ID NO: 1029814 - RNA, 19 nt, Homo sapiens
gagaaagugguacaaaguu

SEQ ID NO: 1029815 - RNA, 19 nt, Homo sapiens
acaaaucaaucuuggugaa

SEQ ID NO: 1029816 - RNA, 19 nt, Homo sapiens
caaaguuagucauuacaca

SEQ ID NO: 1029817 - RNA, 19 nt, Homo sapiens
caacacuacuuauucuuac

SEQ ID NO: 1029818 - RNA, 19 nt, Homo sapiens
ccacucccauaccugaaua

SEQ ID NO: 1029819 - RNA, 19 nt, Homo sapiens
aaacagaucccuaauucau

SEQ ID NO: 1029820 - RNA, 19 nt, Homo sapiens
uggcuuagauuauuaccuu

SEQ ID NO: 1029821 - RNA, 19 nt, Homo sapiens
gaaacaggagaaucacuug

SEQ ID NO: 1029822 - RNA, 19 nt, Homo sapiens
ucugauaucucugauguug

SEQ ID NO: 1029823 - RNA, 19 nt, Homo sapiens
caucaacacuacuuauucu

SEQ ID NO: 1029824 - RNA, 19 nt, Homo sapiens
caacuuggaaaccuuuaaa

SEQ ID NO: 1029825 - RNA, 19 nt, Homo sapiens
gcacaccaguccauauacu

SEQ ID NO: 1029826 - RNA, 19 nt, Homo sapiens
ccaaugaggauacccuuug

SEQ ID NO: 1029827 - RNA, 19 nt, Homo sapiens
gaaagugguacaaaguuag

SEQ ID NO: 1029828 - RNA, 19 nt, Homo sapiens
acagaucccuaauucaugu

SEQ ID NO: 1029829 - RNA, 19 nt, Homo sapiens
acuaaugccuucucaguca

SEQ ID NO: 1029830 - RNA, 19 nt, Homo sapiens
gagaucaugccacucuaaa

SEQ ID NO: 1029831 - RNA, 19 nt, Homo sapiens
cuacuuauucuuacacuga

SEQ ID NO: 1029832 - RNA, 19 nt, Homo sapiens
gaacccaucaacacuacuu

SEQ ID NO: 1029833 - RNA, 19 nt, Homo sapiens
cugcuggcuuagauuauua

SEQ ID NO: 1029834 - RNA, 19 nt, Homo sapiens
ggguggaucugcugaaguc

SEQ ID NO: 1029835 - RNA, 19 nt, Homo sapiens
ggacugaaagacaaaucaa

SEQ ID NO: 1029836 - RNA, 19 nt, Homo sapiens
aagcacaccaguccauaua

SEQ ID NO: 1029837 - RNA, 19 nt, Homo sapiens
guaucaugcuaaacuguug

SEQ ID NO: 1029838 - RNA, 19 nt, Homo sapiens
uggaaaccuuuaaauccua

SEQ ID NO: 1029839 - RNA, 19 nt, Homo sapiens
ccacuugucagaaucagaa

SEQ ID NO: 1029840 - RNA, 19 nt, Homo sapiens
cagcagugcacgccuguaa

SEQ ID NO: 1029841 - RNA, 19 nt, Homo sapiens
gcaucacuguaaagaucua

SEQ ID NO: 1029842 - RNA, 19 nt, Homo sapiens
cugcaucacuguaaagauc

SEQ ID NO: 1029843 - RNA, 19 nt, Homo sapiens
guucugcuggcuuagauua

SEQ ID NO: 1029844 - RNA, 19 nt, Homo sapiens
cuaacugcaucacuguaaa

SEQ ID NO: 1029845 - RNA, 19 nt, Homo sapiens
caacuuaucgccucuugag

SEQ ID NO: 1029846 - RNA, 19 nt, Homo sapiens
gaaagugaggaagaagaaa

SEQ ID NO: 1029847 - RNA, 19 nt, Homo sapiens
gcggugaguugagauuaug

SEQ ID NO: 1029848 - RNA, 19 nt, Homo sapiens
gcagugcacgccuguaauc

SEQ ID NO: 1029849 - RNA, 19 nt, Homo sapiens
uaaauggagcacugcaauu

SEQ ID NO: 1029850 - RNA, 19 nt, Homo sapiens
gaacggcacagugguaugg

SEQ ID NO: 1029851 - RNA, 19 nt, Homo sapiens
ugauguugcuaauugagaa

SEQ ID NO: 1029852 - RNA, 19 nt, Homo sapiens
ccaaaaggcaguuaacaaa

SEQ ID NO: 1029853 - RNA, 19 nt, Homo sapiens
guuaaggaaacaacucgua

SEQ ID NO: 1029854 - RNA, 19 nt, Homo sapiens
ucugauggguccuagaaau

SEQ ID NO: 1029855 - RNA, 19 nt, Homo sapiens
gcuaauugagaaaguggua

SEQ ID NO: 1029856 - RNA, 19 nt, Homo sapiens
guacugaacccaucaacac

SEQ ID NO: 1029857 - RNA, 19 nt, Homo sapiens
caaaucaaucuuggugaaa

SEQ ID NO: 1029858 - RNA, 19 nt, Homo sapiens
ccacaacuuggaaaccuuu

SEQ ID NO: 1029859 - RNA, 19 nt, Homo sapiens
ugacagagcgagacucagu

SEQ ID NO: 1029860 - RNA, 19 nt, Homo sapiens
ugaaacaggagaaucacuu

SEQ ID NO: 1029861 - RNA, 19 nt, Homo sapiens
ccacuaaugccuucucagu

SEQ ID NO: 1029862 - RNA, 19 nt, Homo sapiens
uuacacagcccacuaaugc

SEQ ID NO: 1029863 - RNA, 19 nt, Homo sapiens
gaaacaacucguacugaac

SEQ ID NO: 1029864 - RNA, 19 nt, Homo sapiens
gaccagccuugccaacaca

SEQ ID NO: 1029865 - RNA, 19 nt, Homo sapiens
gugaaacccugucucuacu

SEQ ID NO: 1029866 - RNA, 19 nt, Homo sapiens
ucuaccauuugcucugaua

SEQ ID NO: 1029867 - RNA, 19 nt, Homo sapiens
guccauauacuucgagaga

SEQ ID NO: 1029868 - RNA, 19 nt, Homo sapiens
ugagaaagugguacaaagu

SEQ ID NO: 1029869 - RNA, 19 nt, Homo sapiens
uaacggacugaaagacaaa

SEQ ID NO: 1029870 - RNA, 19 nt, Homo sapiens
ucaaaagccucuuacaagu

SEQ ID NO: 1029871 - RNA, 19 nt, Homo sapiens
ccuaauuccugguuguauc

SEQ ID NO: 1029872 - RNA, 19 nt, Homo sapiens
agaaagugaggaagaagaa

SEQ ID NO: 1029873 - RNA, 19 nt, Homo sapiens
cauuugcucugauaucucu

SEQ ID NO: 1029874 - RNA, 19 nt, Homo sapiens
ccuaacugcaucacuguaa

SEQ ID NO: 1029875 - RNA, 19 nt, Homo sapiens
gggccacaagcauacuuua

SEQ ID NO: 1029876 - RNA, 19 nt, Homo sapiens
cagucaaacucucuuaugc

SEQ ID NO: 1029877 - RNA, 19 nt, Homo sapiens
ccuguaaucccagcacuuu

SEQ ID NO: 1029878 - RNA, 19 nt, Homo sapiens
ucauuacacagcccacuaa

SEQ ID NO: 1029879 - RNA, 19 nt, Homo sapiens
ccaucaacacuacuuauuc

SEQ ID NO: 1029880 - RNA, 19 nt, Homo sapiens
caagcacaccaguccauau

SEQ ID NO: 1029881 - RNA, 19 nt, Homo sapiens
aaucagaaagugaggaaga

SEQ ID NO: 1029882 - RNA, 19 nt, Homo sapiens
ccaagcacaccaguccaua

SEQ ID NO: 1029883 - RNA, 19 nt, Homo sapiens
ugauaucucugauguugcu

SEQ ID NO: 1029884 - RNA, 19 nt, Homo sapiens
cagaaagugaggaagaaga

SEQ ID NO: 1029885 - RNA, 19 nt, Homo sapiens
ucugcuggcuuagauuauu

SEQ ID NO: 1029886 - RNA, 19 nt, Homo sapiens
cuaagccgaacauugagua

SEQ ID NO: 1029887 - RNA, 19 nt, Homo sapiens
gagauuaugccacuguacu

SEQ ID NO: 1029888 - RNA, 19 nt, Homo sapiens
aaaucaaucuuggugaaag

SEQ ID NO: 1029889 - RNA, 19 nt, Homo sapiens
ucaugccacucuaaaugga

SEQ ID NO: 1029890 - RNA, 19 nt, Homo sapiens
ggugacagagcgagacuca

SEQ ID NO: 1029891 - RNA, 19 nt, Homo sapiens
gcacagagcagaaaugaua

SEQ ID NO: 1029892 - RNA, 19 nt, Homo sapiens
ccacuaugcuugauuauaa

SEQ ID NO: 1029893 - RNA, 19 nt, Homo sapiens
gcacugagguuaucuggaa

SEQ ID NO: 1029894 - RNA, 19 nt, Homo sapiens
ggaaaggccacuuauauuu

SEQ ID NO: 1029895 - RNA, 19 nt, Homo sapiens
gaacagagcuauggguuuc

SEQ ID NO: 1029896 - RNA, 19 nt, Homo sapiens
caaauggacugguacauga

SEQ ID NO: 1029897 - RNA, 19 nt, Homo sapiens
ucugagagcugcacaguua

SEQ ID NO: 1029898 - RNA, 19 nt, Homo sapiens
gagauucuauccuguauau

SEQ ID NO: 1029899 - RNA, 19 nt, Homo sapiens
gaaauguuauguacuggaa

SEQ ID NO: 1029900 - RNA, 19 nt, Homo sapiens
aaacugcucugcauauaaa

SEQ ID NO: 1029901 - RNA, 19 nt, Homo sapiens
cuaaauugcuuccagguaa

SEQ ID NO: 1029902 - RNA, 19 nt, Homo sapiens
gaaagucuacagccaauuu

SEQ ID NO: 1029903 - RNA, 19 nt, Homo sapiens
guaaacugcucugcauaua

SEQ ID NO: 1029904 - RNA, 19 nt, Homo sapiens
caucagcaaugaacaguuu

SEQ ID NO: 1029905 - RNA, 19 nt, Homo sapiens
cagacaaacuuaaauguug

SEQ ID NO: 1029906 - RNA, 19 nt, Homo sapiens
gaagaagucaaccauauga

SEQ ID NO: 1029907 - RNA, 19 nt, Homo sapiens
gaaucgaacucccaaaaua

SEQ ID NO: 1029908 - RNA, 19 nt, Homo sapiens
ccacagggaucuucugaga

SEQ ID NO: 1029909 - RNA, 19 nt, Homo sapiens
gggaaugucucauguuaca

SEQ ID NO: 1029910 - RNA, 19 nt, Homo sapiens
acaacaggcuuauauguau

SEQ ID NO: 1029911 - RNA, 19 nt, Homo sapiens
uaagucagguuguuuguuc

SEQ ID NO: 1029912 - RNA, 19 nt, Homo sapiens
gaagagagaggaagaaguc

SEQ ID NO: 1029913 - RNA, 19 nt, Homo sapiens
gcacuuacagacugagaua

SEQ ID NO: 1029914 - RNA, 19 nt, Homo sapiens
gccaaucuauguacuaaau

SEQ ID NO: 1029915 - RNA, 19 nt, Homo sapiens
ccgagucccuucauucuuu

SEQ ID NO: 1029916 - RNA, 19 nt, Homo sapiens
uuaccacuaugcuugauua

SEQ ID NO: 1029917 - RNA, 19 nt, Homo sapiens
gaaugggaaugucucaugu

SEQ ID NO: 1029918 - RNA, 19 nt, Homo sapiens
gacagcaccucuuacauca

SEQ ID NO: 1029919 - RNA, 19 nt, Homo sapiens
caaauggugccucaaauug

SEQ ID NO: 1029920 - RNA, 19 nt, Homo sapiens
ucagaagccuaacagauug

SEQ ID NO: 1029921 - RNA, 19 nt, Homo sapiens
ggaaaccuucagcuaaaua

SEQ ID NO: 1029922 - RNA, 19 nt, Homo sapiens
ccacuuauauuucuagaac

SEQ ID NO: 1029923 - RNA, 19 nt, Homo sapiens
uauguuaccuucuccuuau

SEQ ID NO: 1029924 - RNA, 19 nt, Homo sapiens
ggaaaagcaccuugaguua

SEQ ID NO: 1029925 - RNA, 19 nt, Homo sapiens
guacuggaaaggccacuua

SEQ ID NO: 1029926 - RNA, 19 nt, Homo sapiens
uaaacagcgucacguaaau

SEQ ID NO: 1029927 - RNA, 19 nt, Homo sapiens
gcaaauggacugguacaug

SEQ ID NO: 1029928 - RNA, 19 nt, Homo sapiens
ggugucaugucacuaaguu

SEQ ID NO: 1029929 - RNA, 19 nt, Homo sapiens
ggaagaagucaaccauaug

SEQ ID NO: 1029930 - RNA, 19 nt, Homo sapiens
caacaacaggcuuauaugu

SEQ ID NO: 1029931 - RNA, 19 nt, Homo sapiens
aaagcuugccuacuuaaua

SEQ ID NO: 1029932 - RNA, 19 nt, Homo sapiens
gaacgcuaaugggacagua

SEQ ID NO: 1029933 - RNA, 19 nt, Homo sapiens
gaggaaaggaaagguauuu

SEQ ID NO: 1029934 - RNA, 19 nt, Homo sapiens
aggaagaagucaaccauau

SEQ ID NO: 1029935 - RNA, 19 nt, Homo sapiens
auacauauaugcagugcuu

SEQ ID NO: 1029936 - RNA, 19 nt, Homo sapiens
caacaggcuuauauguaug

SEQ ID NO: 1029937 - RNA, 19 nt, Homo sapiens
gcacaucagagcaauggaa

SEQ ID NO: 1029938 - RNA, 19 nt, Homo sapiens
gugaaaggcggaauucuga

SEQ ID NO: 1029939 - RNA, 19 nt, Homo sapiens
ccuaacagauugcuagaca

SEQ ID NO: 1029940 - RNA, 19 nt, Homo sapiens
uaaccugucucucguagca

SEQ ID NO: 1029941 - RNA, 19 nt, Homo sapiens
cuacuugagugaagauuuc

SEQ ID NO: 1029942 - RNA, 19 nt, Homo sapiens
ucagagagacacaaaguga

SEQ ID NO: 1029943 - RNA, 19 nt, Homo sapiens
gaaaguucaaguaaaggaa

SEQ ID NO: 1029944 - RNA, 19 nt, Homo sapiens
gaaugucucauguuacaau

SEQ ID NO: 1029945 - RNA, 19 nt, Homo sapiens
cgagucccuucauucuuua

SEQ ID NO: 1029946 - RNA, 19 nt, Homo sapiens
ugucaugucacuaaguuua

SEQ ID NO: 1029947 - RNA, 19 nt, Homo sapiens
gugcuuguguuuguaauga

SEQ ID NO: 1029948 - RNA, 19 nt, Homo sapiens
gaggaagaagucaaccaua

SEQ ID NO: 1029949 - RNA, 19 nt, Homo sapiens
uaaacugcucugcauauaa

SEQ ID NO: 1029950 - RNA, 19 nt, Homo sapiens
gggagauucuauccuguau

SEQ ID NO: 1029951 - RNA, 19 nt, Homo sapiens
ucaaauggugccucaaauu

SEQ ID NO: 1029952 - RNA, 19 nt, Homo sapiens
uaauaaacagcgucacgua

SEQ ID NO: 1029953 - RNA, 19 nt, Homo sapiens
guauguuaccuucuccuua

SEQ ID NO: 1029954 - RNA, 19 nt, Homo sapiens
uaaauugcuuccagguaau

SEQ ID NO: 1029955 - RNA, 19 nt, Homo sapiens
augggaaugucucauguua

SEQ ID NO: 1029956 - RNA, 19 nt, Homo sapiens
ucagagcaauggaaaccaa

SEQ ID NO: 1029957 - RNA, 19 nt, Homo sapiens
gcucaaagagacacuacuu

SEQ ID NO: 1029958 - RNA, 19 nt, Homo sapiens
aaacagcgucacguaaaua

SEQ ID NO: 1029959 - RNA, 19 nt, Homo sapiens
guaaagcuugccuacuuaa

SEQ ID NO: 1029960 - RNA, 19 nt, Homo sapiens
caaggcacuuacagacuga

SEQ ID NO: 1029961 - RNA, 19 nt, Homo sapiens
cagcaccucuuacaucagu

SEQ ID NO: 1029962 - RNA, 19 nt, Homo sapiens
accaaacacugccuuuauu

SEQ ID NO: 1029963 - RNA, 19 nt, Homo sapiens
ggaguaacguugguaugca

SEQ ID NO: 1029964 - RNA, 19 nt, Homo sapiens
caauggaaaccuucagcua

SEQ ID NO: 1029965 - RNA, 19 nt, Homo sapiens
aagccaaucuauguacuaa

SEQ ID NO: 1029966 - RNA, 19 nt, Homo sapiens
aagaaagaaugcaaugcuu

SEQ ID NO: 1029967 - RNA, 19 nt, Homo sapiens
ggaauucugaguguguuaa

SEQ ID NO: 1029968 - RNA, 19 nt, Homo sapiens
gauuucuucuuucccugua

SEQ ID NO: 1029969 - RNA, 19 nt, Homo sapiens
gcuuguguuuguaaugaaa

SEQ ID NO: 1029970 - RNA, 19 nt, Homo sapiens
ucaaccauaugaaacugaa

SEQ ID NO: 1029971 - RNA, 19 nt, Homo sapiens
gaagucaaccauaugaaac

SEQ ID NO: 1029972 - RNA, 19 nt, Homo sapiens
cuaaugauacguuggauuc

SEQ ID NO: 1029973 - RNA, 19 nt, Homo sapiens
ccaaucaacaaggcacuua

SEQ ID NO: 1029974 - RNA, 19 nt, Homo sapiens
ugacagcaccucuuacauc

SEQ ID NO: 1029975 - RNA, 19 nt, Homo sapiens
uggaaaggccacuuauauu

SEQ ID NO: 1029976 - RNA, 19 nt, Homo sapiens
caagugagaguuuugauaa

SEQ ID NO: 1029977 - RNA, 19 nt, Homo sapiens
ggugacugcugcauucauc

SEQ ID NO: 1029978 - RNA, 19 nt, Homo sapiens
gagcaucgcaucaccaaac

SEQ ID NO: 1029979 - RNA, 19 nt, Homo sapiens
ucauuucucuuguaccaau

SEQ ID NO: 1029980 - RNA, 19 nt, Homo sapiens
guuggauucugcagacuga

SEQ ID NO: 1029981 - RNA, 19 nt, Homo sapiens
gaagaaugggaaugucuca

SEQ ID NO: 1029982 - RNA, 19 nt, Homo sapiens
auggaaaccuucagcuaaa

SEQ ID NO: 1029983 - RNA, 19 nt, Homo sapiens
aauggaaaccuucagcuaa

SEQ ID NO: 1029984 - RNA, 19 nt, Homo sapiens
aaaggccacuuauauuucu

SEQ ID NO: 1029985 - RNA, 19 nt, Homo sapiens
caccaaacacugccuuuau

SEQ ID NO: 1029986 - RNA, 19 nt, Homo sapiens
uaccuucuccuuauuugua

SEQ ID NO: 1029987 - RNA, 19 nt, Homo sapiens
uaaagugcacugagguuau

SEQ ID NO: 1029988 - RNA, 19 nt, Homo sapiens
cuaaagugcacugagguua

SEQ ID NO: 1029989 - RNA, 19 nt, Homo sapiens
gaaaggcggaauucugagu

SEQ ID NO: 1029990 - RNA, 19 nt, Homo sapiens
cagguuguuuguucccuaa

SEQ ID NO: 1029991 - RNA, 19 nt, Homo sapiens
ucgcaaacauuaaagauga

SEQ ID NO: 1029992 - RNA, 19 nt, Homo sapiens
ggauauuuguugagcguuu

SEQ ID NO: 1029993 - RNA, 19 nt, Homo sapiens
gauauuuguugagcguuua

SEQ ID NO: 1029994 - RNA, 19 nt, Homo sapiens
guagagaccugcgaaugga

SEQ ID NO: 1029995 - RNA, 19 nt, Homo sapiens
acacuugucgcaaacauua

SEQ ID NO: 1029996 - RNA, 19 nt, Homo sapiens
guagagccgugcaaguuug

SEQ ID NO: 1029997 - RNA, 19 nt, Homo sapiens
gagcugcccuugucuuugg

SEQ ID NO: 1029998 - RNA, 19 nt, Homo sapiens
gaacugcugcugcucuuca

SEQ ID NO: 1029999 - RNA, 19 nt, Homo sapiens
acagaaugcucuagaaguc

SEQ ID NO: 1030000 - RNA, 19 nt, Homo sapiens
gguagagccgugcaaguuu

SEQ ID NO: 1030001 - RNA, 19 nt, Homo sapiens
gaauccagaugagacacuu

SEQ ID NO: 1030002 - RNA, 19 nt, Homo sapiens
gcucgcgccucaucgucua

SEQ ID NO: 1030003 - RNA, 19 nt, Homo sapiens
gcucugagggcuuguguuc

SEQ ID NO: 1030004 - RNA, 19 nt, Homo sapiens
gcgagcugcccuugucuuu

SEQ ID NO: 1030005 - RNA, 19 nt, Homo sapiens
guuccgggauauuuguuga

SEQ ID NO: 1030006 - RNA, 19 nt, Homo sapiens
gcgcaaggacuaccacuac

SEQ ID NO: 1030007 - RNA, 19 nt, Homo sapiens
uacgauaggcguuaauguu

SEQ ID NO: 1030008 - RNA, 19 nt, Homo sapiens
ccaaaagaaucacuuaaac

SEQ ID NO: 1030009 - RNA, 19 nt, Homo sapiens
ggaaaagugucgggacguu

SEQ ID NO: 1030010 - RNA, 19 nt, Homo sapiens
caucacagaaugcucuaga

SEQ ID NO: 1030011 - RNA, 19 nt, Homo sapiens
uagacgagaauccagauga

SEQ ID NO: 1030012 - RNA, 19 nt, Homo sapiens
uggaggaaccugugugaga

SEQ ID NO: 1030013 - RNA, 19 nt, Homo sapiens
ccagugugugccugaguua

SEQ ID NO: 1030014 - RNA, 19 nt, Homo sapiens
ccagagggcugagcuucgu

SEQ ID NO: 1030015 - RNA, 19 nt, Homo sapiens
acgcggagguggagguaga

SEQ ID NO: 1030016 - RNA, 19 nt, Homo sapiens
acgauaggcguuaauguug

SEQ ID NO: 1030017 - RNA, 19 nt, Homo sapiens
gcuggaggaaccuguguga

SEQ ID NO: 1030018 - RNA, 19 nt, Homo sapiens
agaaucacuuaaacaccaa

SEQ ID NO: 1030019 - RNA, 19 nt, Homo sapiens
cuugauuccugccuacaga

SEQ ID NO: 1030020 - RNA, 19 nt, Homo sapiens
cgcaaacauuaaagaugaa

SEQ ID NO: 1030021 - RNA, 19 nt, Homo sapiens
agacgagaauccagaugag

SEQ ID NO: 1030022 - RNA, 19 nt, Homo sapiens
gcguuaauguugcccaaaa

SEQ ID NO: 1030023 - RNA, 19 nt, Homo sapiens
guugagcguuuacgauagg

SEQ ID NO: 1030024 - RNA, 19 nt, Homo sapiens
ucacagaaugcucuagaag

SEQ ID NO: 1030025 - RNA, 19 nt, Homo sapiens
gaccugcgaauggaucuga

SEQ ID NO: 1030026 - RNA, 19 nt, Homo sapiens
uuguugagcguuuacgaua

SEQ ID NO: 1030027 - RNA, 19 nt, Homo sapiens
cccagugugugccugaguu

SEQ ID NO: 1030028 - RNA, 19 nt, Homo sapiens
gcgagcaggagcggguaua

SEQ ID NO: 1030029 - RNA, 19 nt, Homo sapiens
gcguuuacgauaggcguua

SEQ ID NO: 1030030 - RNA, 19 nt, Homo sapiens
cguagagaccugcgaaugg

SEQ ID NO: 1030031 - RNA, 19 nt, Homo sapiens
gacgagaauccagaugaga

SEQ ID NO: 1030032 - RNA, 19 nt, Homo sapiens
aaauguaguagacgagaau

SEQ ID NO: 1030033 - RNA, 19 nt, Homo sapiens
ggucguacggguccuugug

SEQ ID NO: 1030034 - RNA, 19 nt, Homo sapiens
cacagaaugcucuagaagu

SEQ ID NO: 1030035 - RNA, 19 nt, Homo sapiens
cacccgccaucacagaaug

SEQ ID NO: 1030036 - RNA, 19 nt, Homo sapiens
gaucucaccugaauuauuu

SEQ ID NO: 1030037 - RNA, 19 nt, Homo sapiens
ucagaaggcugguauauuu

SEQ ID NO: 1030038 - RNA, 19 nt, Homo sapiens
gguauacacuggcuauuua

SEQ ID NO: 1030039 - RNA, 19 nt, Homo sapiens
gaucauagaugucauagau

SEQ ID NO: 1030040 - RNA, 19 nt, Homo sapiens
gaacagggcuauuacuuag

SEQ ID NO: 1030041 - RNA, 19 nt, Homo sapiens
ggaagaagaugccagauca

SEQ ID NO: 1030042 - RNA, 19 nt, Homo sapiens
caauagagcagcagucuua

SEQ ID NO: 1030043 - RNA, 19 nt, Homo sapiens
ccaaggaaguggaacauuu

SEQ ID NO: 1030044 - RNA, 19 nt, Homo sapiens
gaucuaauauccaaguuga

SEQ ID NO: 1030045 - RNA, 19 nt, Homo sapiens
gaaaggagacucacuuaug

SEQ ID NO: 1030046 - RNA, 19 nt, Homo sapiens
ucacuuaugugcacaauga

SEQ ID NO: 1030047 - RNA, 19 nt, Homo sapiens
ggaaagaaauauccuacug

SEQ ID NO: 1030048 - RNA, 19 nt, Homo sapiens
cuacugugcuguucauaua

SEQ ID NO: 1030049 - RNA, 19 nt, Homo sapiens
gaagaggaaugauccagau

SEQ ID NO: 1030050 - RNA, 19 nt, Homo sapiens
gcacugugacuucuuuaua

SEQ ID NO: 1030051 - RNA, 19 nt, Homo sapiens
cuacaagccucaugaucua

SEQ ID NO: 1030052 - RNA, 19 nt, Homo sapiens
ggaauugcuucuuacgauu

SEQ ID NO: 1030053 - RNA, 19 nt, Homo sapiens
gaagaaaggagacucacuu

SEQ ID NO: 1030054 - RNA, 19 nt, Homo sapiens
uagcaacgauauuuggaua

SEQ ID NO: 1030055 - RNA, 19 nt, Homo sapiens
gaauugcuucuuacgauua

SEQ ID NO: 1030056 - RNA, 19 nt, Homo sapiens
gaaggaaggaucauagaug

SEQ ID NO: 1030057 - RNA, 19 nt, Homo sapiens
gaccguggcuacucacauu

SEQ ID NO: 1030058 - RNA, 19 nt, Homo sapiens
gaagaggaaauugaguuua

SEQ ID NO: 1030059 - RNA, 19 nt, Homo sapiens
aaucugagguggaaauuau

SEQ ID NO: 1030060 - RNA, 19 nt, Homo sapiens
aaaggagacucacuuaugu

SEQ ID NO: 1030061 - RNA, 19 nt, Homo sapiens
uuugauaccugccauguaa

SEQ ID NO: 1030062 - RNA, 19 nt, Homo sapiens
guugaucucaccugaauua

SEQ ID NO: 1030063 - RNA, 19 nt, Homo sapiens
caacauggcagcagcaaug

SEQ ID NO: 1030064 - RNA, 19 nt, Homo sapiens
ucgagaagaagaacuauua

SEQ ID NO: 1030065 - RNA, 19 nt, Homo sapiens
caaaugaggagguuuaauc

SEQ ID NO: 1030066 - RNA, 19 nt, Homo sapiens
gggagaacauuaugaacug

SEQ ID NO: 1030067 - RNA, 19 nt, Homo sapiens
ggagagacacagcauaaga

SEQ ID NO: 1030068 - RNA, 19 nt, Homo sapiens
ugaacagggcuauuacuua

SEQ ID NO: 1030069 - RNA, 19 nt, Homo sapiens
gaagaagaacuauuaagag

SEQ ID NO: 1030070 - RNA, 19 nt, Homo sapiens
agaaugaacagggcuauua

SEQ ID NO: 1030071 - RNA, 19 nt, Homo sapiens
gaaagaaauauccuacugu

SEQ ID NO: 1030072 - RNA, 19 nt, Homo sapiens
cacugugacuucuuuauaa

SEQ ID NO: 1030073 - RNA, 19 nt, Homo sapiens
gaaaggcagagacucauug

SEQ ID NO: 1030074 - RNA, 19 nt, Homo sapiens
gagguuuaaucaacagaaa

SEQ ID NO: 1030075 - RNA, 19 nt, Homo sapiens
gcauaagaguuccugaauc

SEQ ID NO: 1030076 - RNA, 19 nt, Homo sapiens
ccaaguugaugaagucaga

SEQ ID NO: 1030077 - RNA, 19 nt, Homo sapiens
guagaacucucugguauac

SEQ ID NO: 1030078 - RNA, 19 nt, Homo sapiens
gaagaugacccaacuugca

SEQ ID NO: 1030079 - RNA, 19 nt, Homo sapiens
ccaagaagaauuugauaga

SEQ ID NO: 1030080 - RNA, 19 nt, Homo sapiens
cauaagaguuccugaaucg

SEQ ID NO: 1030081 - RNA, 19 nt, Homo sapiens
uuacugcucuuacaugguu

SEQ ID NO: 1030082 - RNA, 19 nt, Homo sapiens
caggauacacggaacguua

SEQ ID NO: 1030083 - RNA, 19 nt, Homo sapiens
cagcagcaauggaaacaga

SEQ ID NO: 1030084 - RNA, 19 nt, Homo sapiens
acaaugagcuagccaacau

SEQ ID NO: 1030085 - RNA, 19 nt, Homo sapiens
uggaaagccauaugauuua

SEQ ID NO: 1030086 - RNA, 19 nt, Homo sapiens
ucaaguguccuaucaaaga

SEQ ID NO: 1030087 - RNA, 19 nt, Homo sapiens
gauuucaaguguccuauca

SEQ ID NO: 1030088 - RNA, 19 nt, Homo sapiens
ggaaagcaaauauaaacga

SEQ ID NO: 1030089 - RNA, 19 nt, Homo sapiens
gcagauucauuccguuauc

SEQ ID NO: 1030090 - RNA, 19 nt, Homo sapiens
guguagaacucucugguau

SEQ ID NO: 1030091 - RNA, 19 nt, Homo sapiens
cuguggaucuucuaugaua

SEQ ID NO: 1030092 - RNA, 19 nt, Homo sapiens
uaucaaguccugaagauga

SEQ ID NO: 1030093 - RNA, 19 nt, Homo sapiens
ccagaagaauccacacugu

SEQ ID NO: 1030094 - RNA, 19 nt, Homo sapiens
guaaguauaguaaccagaa

SEQ ID NO: 1030095 - RNA, 19 nt, Homo sapiens
gaagaugauguuauggaaa

SEQ ID NO: 1030096 - RNA, 19 nt, Homo sapiens
ugucauagauaaggaacua

SEQ ID NO: 1030097 - RNA, 19 nt, Homo sapiens
ccugagagacccagcaaua

SEQ ID NO: 1030098 - RNA, 19 nt, Homo sapiens
ugacuauacuccuccagaa

SEQ ID NO: 1030099 - RNA, 19 nt, Homo sapiens
gcuaucaaguccugaagau

SEQ ID NO: 1030100 - RNA, 19 nt, Homo sapiens
aguagaagaugauguuaug

SEQ ID NO: 1030101 - RNA, 19 nt, Homo sapiens
ggaaggaucauagauguca

SEQ ID NO: 1030102 - RNA, 19 nt, Homo sapiens
gaaacaaggagggcagauu

SEQ ID NO: 1030103 - RNA, 19 nt, Homo sapiens
ggaaguggaacauuucugu

SEQ ID NO: 1030104 - RNA, 19 nt, Homo sapiens
acagcuggguguugagaua

SEQ ID NO: 1030105 - RNA, 19 nt, Homo sapiens
ggccuaaauuggagccuuu

SEQ ID NO: 1030106 - RNA, 19 nt, Homo sapiens
gggcagauucauuccguua

SEQ ID NO: 1030107 - RNA, 19 nt, Homo sapiens
uuggauaucuaacaucgua

SEQ ID NO: 1030108 - RNA, 19 nt, Homo sapiens
caggagagacacagcauaa

SEQ ID NO: 1030109 - RNA, 19 nt, Homo sapiens
ggaaagccauaugauuuac

SEQ ID NO: 1030110 - RNA, 19 nt, Homo sapiens
agaagaugauguuauggaa

SEQ ID NO: 1030111 - RNA, 19 nt, Homo sapiens
gaagucagaaggcugguau

SEQ ID NO: 1030112 - RNA, 19 nt, Homo sapiens
ugacgccacuaauuaucua

SEQ ID NO: 1030113 - RNA, 19 nt, Homo sapiens
aaccuuggaucacguauug

SEQ ID NO: 1030114 - RNA, 19 nt, Homo sapiens
aaagaggagauagcaauua

SEQ ID NO: 1030115 - RNA, 19 nt, Homo sapiens
caaagaggagauagcaauu

SEQ ID NO: 1030116 - RNA, 19 nt, Homo sapiens
ggaaaggcagagacucauu

SEQ ID NO: 1030117 - RNA, 19 nt, Homo sapiens
gcuaaggcaccacaugauu

SEQ ID NO: 1030118 - RNA, 19 nt, Homo sapiens
caucguaaccagagaagaa

SEQ ID NO: 1030119 - RNA, 19 nt, Homo sapiens
cuggaaagccauaugauuu

SEQ ID NO: 1030120 - RNA, 19 nt, Homo sapiens
ucagcacugugacuucuuu

SEQ ID NO: 1030121 - RNA, 19 nt, Homo sapiens
ucugugacgccacuaauua

SEQ ID NO: 1030122 - RNA, 19 nt, Homo sapiens
gaaggaguugaauauauug

SEQ ID NO: 1030123 - RNA, 19 nt, Homo sapiens
ggaacuaauucaaccuuuu

SEQ ID NO: 1030124 - RNA, 19 nt, Homo sapiens
cggaauugcuucuuacgau

SEQ ID NO: 1030125 - RNA, 19 nt, Homo sapiens
gaaagaaaacgcauuggaa

SEQ ID NO: 1030126 - RNA, 19 nt, Homo sapiens
agacacagcauaagaguuc

SEQ ID NO: 1030127 - RNA, 19 nt, Homo sapiens
cgaagaggaaauugaguuu

SEQ ID NO: 1030128 - RNA, 19 nt, Homo sapiens
gaaucugagguggaaauua

SEQ ID NO: 1030129 - RNA, 19 nt, Homo sapiens
gcaauaccauaagaauuac

SEQ ID NO: 1030130 - RNA, 19 nt, Homo sapiens
gcuggaaagccauaugauu

SEQ ID NO: 1030131 - RNA, 19 nt, Homo sapiens
ugaggagaauauugaauca

SEQ ID NO: 1030132 - RNA, 19 nt, Homo sapiens
aaggaaggaucauagaugu

SEQ ID NO: 1030133 - RNA, 19 nt, Homo sapiens
cagucggaauugcuucuua

SEQ ID NO: 1030134 - RNA, 19 nt, Homo sapiens
ucaaagaggagauagcaau

SEQ ID NO: 1030135 - RNA, 19 nt, Homo sapiens
uuucaaguguccuaucaaa

SEQ ID NO: 1030136 - RNA, 19 nt, Homo sapiens
gaucucaccugaauuauuu

SEQ ID NO: 1030137 - RNA, 19 nt, Homo sapiens
ucagaaggcugguauauuu

SEQ ID NO: 1030138 - RNA, 19 nt, Homo sapiens
gguauacacuggcuauuua

SEQ ID NO: 1030139 - RNA, 19 nt, Homo sapiens
gaucauagaugucauagau

SEQ ID NO: 1030140 - RNA, 19 nt, Homo sapiens
gaacagggcuauuacuuag

SEQ ID NO: 1030141 - RNA, 19 nt, Homo sapiens
ggaagaagaugccagauca

SEQ ID NO: 1030142 - RNA, 19 nt, Homo sapiens
caauagagcagcagucuua

SEQ ID NO: 1030143 - RNA, 19 nt, Homo sapiens
ccaaggaaguggaacauuu

SEQ ID NO: 1030144 - RNA, 19 nt, Homo sapiens
gaucuaauauccaaguuga

SEQ ID NO: 1030145 - RNA, 19 nt, Homo sapiens
gaaaggagacucacuuaug

SEQ ID NO: 1030146 - RNA, 19 nt, Homo sapiens
ucacuuaugugcacaauga

SEQ ID NO: 1030147 - RNA, 19 nt, Homo sapiens
ggaaagaaauauccuacug

SEQ ID NO: 1030148 - RNA, 19 nt, Homo sapiens
cuacugugcuguucauaua

SEQ ID NO: 1030149 - RNA, 19 nt, Homo sapiens
gaagaggaaugauccagau

SEQ ID NO: 1030150 - RNA, 19 nt, Homo sapiens
gcacugugacuucuuuaua

SEQ ID NO: 1030151 - RNA, 19 nt, Homo sapiens
cuacaagccucaugaucua

SEQ ID NO: 1030152 - RNA, 19 nt, Homo sapiens
ggaauugcuucuuacgauu

SEQ ID NO: 1030153 - RNA, 19 nt, Homo sapiens
gaagaaaggagacucacuu

SEQ ID NO: 1030154 - RNA, 19 nt, Homo sapiens
uagcaacgauauuuggaua

SEQ ID NO: 1030155 - RNA, 19 nt, Homo sapiens
gaauugcuucuuacgauua

SEQ ID NO: 1030156 - RNA, 19 nt, Homo sapiens
gaaggaaggaucauagaug

SEQ ID NO: 1030157 - RNA, 19 nt, Homo sapiens
gaccguggcuacucacauu

SEQ ID NO: 1030158 - RNA, 19 nt, Homo sapiens
gaagaggaaauugaguuua

SEQ ID NO: 1030159 - RNA, 19 nt, Homo sapiens
aaucugagguggaaauuau

SEQ ID NO: 1030160 - RNA, 19 nt, Homo sapiens
aaaggagacucacuuaugu

SEQ ID NO: 1030161 - RNA, 19 nt, Homo sapiens
uuugauaccugccauguaa

SEQ ID NO: 1030162 - RNA, 19 nt, Homo sapiens
guugaucucaccugaauua

SEQ ID NO: 1030163 - RNA, 19 nt, Homo sapiens
caacauggcagcagcaaug

SEQ ID NO: 1030164 - RNA, 19 nt, Homo sapiens
ucgagaagaagaacuauua

SEQ ID NO: 1030165 - RNA, 19 nt, Homo sapiens
caaaugaggagguuuaauc

SEQ ID NO: 1030166 - RNA, 19 nt, Homo sapiens
gggagaacauuaugaacug

SEQ ID NO: 1030167 - RNA, 19 nt, Homo sapiens
ggagagacacagcauaaga

SEQ ID NO: 1030168 - RNA, 19 nt, Homo sapiens
ugaacagggcuauuacuua

SEQ ID NO: 1030169 - RNA, 19 nt, Homo sapiens
ggaaggacuccaauaucua

SEQ ID NO: 1030170 - RNA, 19 nt, Homo sapiens
gaagaagaacuauuaagag

SEQ ID NO: 1030171 - RNA, 19 nt, Homo sapiens
agaaugaacagggcuauua

SEQ ID NO: 1030172 - RNA, 19 nt, Homo sapiens
gaaagaaauauccuacugu

SEQ ID NO: 1030173 - RNA, 19 nt, Homo sapiens
cacugugacuucuuuauaa

SEQ ID NO: 1030174 - RNA, 19 nt, Homo sapiens
gaaaggcagagacucauug

SEQ ID NO: 1030175 - RNA, 19 nt, Homo sapiens
gagguuuaaucaacagaaa

SEQ ID NO: 1030176 - RNA, 19 nt, Homo sapiens
gcauaagaguuccugaauc

SEQ ID NO: 1030177 - RNA, 19 nt, Homo sapiens
ccaaguugaugaagucaga

SEQ ID NO: 1030178 - RNA, 19 nt, Homo sapiens
guagaacucucugguauac

SEQ ID NO: 1030179 - RNA, 19 nt, Homo sapiens
gaagaugacccaacuugca

SEQ ID NO: 1030180 - RNA, 19 nt, Homo sapiens
ccaagaagaauuugauaga

SEQ ID NO: 1030181 - RNA, 19 nt, Homo sapiens
cauaagaguuccugaaucg

SEQ ID NO: 1030182 - RNA, 19 nt, Homo sapiens
uuacugcucuuacaugguu

SEQ ID NO: 1030183 - RNA, 19 nt, Homo sapiens
caggauacacggaacguua

SEQ ID NO: 1030184 - RNA, 19 nt, Homo sapiens
cagcagcaauggaaacaga

SEQ ID NO: 1030185 - RNA, 19 nt, Homo sapiens
acaaugagcuagccaacau

SEQ ID NO: 1030186 - RNA, 19 nt, Homo sapiens
uggaaagccauaugauuua

SEQ ID NO: 1030187 - RNA, 19 nt, Homo sapiens
gcagaggucagauaucuuc

SEQ ID NO: 1030188 - RNA, 19 nt, Homo sapiens
ucaaguguccuaucaaaga

SEQ ID NO: 1030189 - RNA, 19 nt, Homo sapiens
gauuucaaguguccuauca

SEQ ID NO: 1030190 - RNA, 19 nt, Homo sapiens
ggaaagcaaauauaaacga

SEQ ID NO: 1030191 - RNA, 19 nt, Homo sapiens
gcagauucauuccguuauc

SEQ ID NO: 1030192 - RNA, 19 nt, Homo sapiens
guguagaacucucugguau

SEQ ID NO: 1030193 - RNA, 19 nt, Homo sapiens
cuguggaucuucuaugaua

SEQ ID NO: 1030194 - RNA, 19 nt, Homo sapiens
gaaggacuccaauaucuag

SEQ ID NO: 1030195 - RNA, 19 nt, Homo sapiens
ucaccgagggcuuaaauuu

SEQ ID NO: 1030196 - RNA, 19 nt, Homo sapiens
uaucaaguccugaagauga

SEQ ID NO: 1030197 - RNA, 19 nt, Homo sapiens
ccagaagaauccacacugu

SEQ ID NO: 1030198 - RNA, 19 nt, Homo sapiens
guaaguauaguaaccagaa

SEQ ID NO: 1030199 - RNA, 19 nt, Homo sapiens
gaagaugauguuauggaaa

SEQ ID NO: 1030200 - RNA, 19 nt, Homo sapiens
ugucauagauaaggaacua

SEQ ID NO: 1030201 - RNA, 19 nt, Homo sapiens
ccugagagacccagcaaua

SEQ ID NO: 1030202 - RNA, 19 nt, Homo sapiens
ugacuauacuccuccagaa

SEQ ID NO: 1030203 - RNA, 19 nt, Homo sapiens
gcuaucaaguccugaagau

SEQ ID NO: 1030204 - RNA, 19 nt, Homo sapiens
aguagaagaugauguuaug

SEQ ID NO: 1030205 - RNA, 19 nt, Homo sapiens
ggaaggaucauagauguca

SEQ ID NO: 1030206 - RNA, 19 nt, Homo sapiens
gaaacaaggagggcagauu

SEQ ID NO: 1030207 - RNA, 19 nt, Homo sapiens
ggaaguggaacauuucugu

SEQ ID NO: 1030208 - RNA, 19 nt, Homo sapiens
ggccuaaauuggagccuuu

SEQ ID NO: 1030209 - RNA, 19 nt, Homo sapiens
acagcuggguguugagaua

SEQ ID NO: 1030210 - RNA, 19 nt, Homo sapiens
gggcagauucauuccguua

SEQ ID NO: 1030211 - RNA, 19 nt, Homo sapiens
uuggauaucuaacaucgua

SEQ ID NO: 1030212 - RNA, 19 nt, Homo sapiens
caggagagacacagcauaa

SEQ ID NO: 1030213 - RNA, 19 nt, Homo sapiens
ggaaagccauaugauuuac

SEQ ID NO: 1030214 - RNA, 19 nt, Homo sapiens
agaagaugauguuauggaa

SEQ ID NO: 1030215 - RNA, 19 nt, Homo sapiens
gaagucagaaggcugguau

SEQ ID NO: 1030216 - RNA, 19 nt, Homo sapiens
ugacgccacuaauuaucua

SEQ ID NO: 1030217 - RNA, 19 nt, Homo sapiens
aaccuuggaucacguauug

SEQ ID NO: 1030218 - RNA, 19 nt, Homo sapiens
aaagaggagauagcaauua

SEQ ID NO: 1030219 - RNA, 19 nt, Homo sapiens
caaagaggagauagcaauu

SEQ ID NO: 1030220 - RNA, 19 nt, Homo sapiens
gcuaaggcaccacaugauu

SEQ ID NO: 1030221 - RNA, 19 nt, Homo sapiens
ggaaaggcagagacucauu

SEQ ID NO: 1030222 - RNA, 19 nt, Homo sapiens
caucguaaccagagaagaa

SEQ ID NO: 1030223 - RNA, 19 nt, Homo sapiens
cuggaaagccauaugauuu

SEQ ID NO: 1030224 - RNA, 19 nt, Homo sapiens
ggacuccaauaucuagcuu

SEQ ID NO: 1030225 - RNA, 19 nt, Homo sapiens
ucagcacugugacuucuuu

SEQ ID NO: 1030226 - RNA, 19 nt, Homo sapiens
ucugugacgccacuaauua

SEQ ID NO: 1030227 - RNA, 19 nt, Homo sapiens
gaaggaguugaauauauug

SEQ ID NO: 1030228 - RNA, 19 nt, Homo sapiens
ggaacuaauucaaccuuuu

SEQ ID NO: 1030229 - RNA, 19 nt, Homo sapiens
cggaauugcuucuuacgau

SEQ ID NO: 1030230 - RNA, 19 nt, Homo sapiens
gaaagaaaacgcauuggaa

SEQ ID NO: 1030231 - RNA, 19 nt, Homo sapiens
agacacagcauaagaguuc

SEQ ID NO: 1030232 - RNA, 19 nt, Homo sapiens
uuaugugguuguagugaua

SEQ ID NO: 1030233 - RNA, 19 nt, Homo sapiens
cgaagaggaaauugaguuu

SEQ ID NO: 1030234 - RNA, 19 nt, Homo sapiens
gaaucugagguggaaauua

SEQ ID NO: 1030235 - RNA, 19 nt, Homo sapiens
gcaauaccauaagaauuac

SEQ ID NO: 1030236 - RNA, 19 nt, Homo sapiens
gcaguaggcuuggcaguua

SEQ ID NO: 1030237 - RNA, 19 nt, Homo sapiens
caacauugcuucaaagaug

SEQ ID NO: 1030238 - RNA, 19 nt, Homo sapiens
aagcaucucuuucuuguua

SEQ ID NO: 1030239 - RNA, 19 nt, Homo sapiens
gaggagagauaccaaugua

SEQ ID NO: 1030240 - RNA, 19 nt, Homo sapiens
gugaagcucucccguauuu

SEQ ID NO: 1030241 - RNA, 19 nt, Homo sapiens
ucauagagcuguggaauuu

SEQ ID NO: 1030242 - RNA, 19 nt, Homo sapiens
ggacagggcauauuacuga

SEQ ID NO: 1030243 - RNA, 19 nt, Homo sapiens
gagaaacccucuaaaucuu

SEQ ID NO: 1030244 - RNA, 19 nt, Homo sapiens
gaaccagccuugcgaacuu

SEQ ID NO: 1030245 - RNA, 19 nt, Homo sapiens
ggaagcaucucuuucuugu

SEQ ID NO: 1030246 - RNA, 19 nt, Homo sapiens
gacaaggacuguuucagaa

SEQ ID NO: 1030247 - RNA, 19 nt, Homo sapiens
gauauaagccuuccaaagu

SEQ ID NO: 1030248 - RNA, 19 nt, Homo sapiens
cagcuuagccuuucuguuu

SEQ ID NO: 1030249 - RNA, 19 nt, Homo sapiens
ccaauguacugguauauau

SEQ ID NO: 1030250 - RNA, 19 nt, Homo sapiens
gaagucaagucaccgcauu

SEQ ID NO: 1030251 - RNA, 19 nt, Homo sapiens
ggacaacuguagaugaaau

SEQ ID NO: 1030252 - RNA, 19 nt, Homo sapiens
gcacagagacggcugauag

SEQ ID NO: 1030253 - RNA, 19 nt, Homo sapiens
gcugaaagguuauuuaaac

SEQ ID NO: 1030254 - RNA, 19 nt, Homo sapiens
gaagaagcaacaacuauug

SEQ ID NO: 1030255 - RNA, 19 nt, Homo sapiens
ggagaaacccucuaaaucu

SEQ ID NO: 1030256 - RNA, 19 nt, Homo sapiens
gaaaccagcagacagaauu

SEQ ID NO: 1030257 - RNA, 19 nt, Homo sapiens
ggaagaagcaacaacuauu

SEQ ID NO: 1030258 - RNA, 19 nt, Homo sapiens
ggaauuuaauccucauguu

SEQ ID NO: 1030259 - RNA, 19 nt, Homo sapiens
gaaacagccuccagaagag

SEQ ID NO: 1030260 - RNA, 19 nt, Homo sapiens
ccaccaaggccaucaauaa

SEQ ID NO: 1030261 - RNA, 19 nt, Homo sapiens
ugagagauuugaugaaaga

SEQ ID NO: 1030262 - RNA, 19 nt, Homo sapiens
gaacagcaucuauaaagug

SEQ ID NO: 1030263 - RNA, 19 nt, Homo sapiens
gagauaauauaagccauga

SEQ ID NO: 1030264 - RNA, 19 nt, Homo sapiens
gaacagagagcagcauuuc

SEQ ID NO: 1030265 - RNA, 19 nt, Homo sapiens
uguagaugcugaaagguua

SEQ ID NO: 1030266 - RNA, 19 nt, Homo sapiens
acagggaccucuucauuga

SEQ ID NO: 1030267 - RNA, 19 nt, Homo sapiens
agagaaaggacaucuauuu

SEQ ID NO: 1030268 - RNA, 19 nt, Homo sapiens
gaauauaggagauacacuu

SEQ ID NO: 1030269 - RNA, 19 nt, Homo sapiens
ggagaaugcuugccuugca

SEQ ID NO: 1030270 - RNA, 19 nt, Homo sapiens
ccaccgagaugcucagaga

SEQ ID NO: 1030271 - RNA, 19 nt, Homo sapiens
gcaggagaaacaauuuaua

SEQ ID NO: 1030272 - RNA, 19 nt, Homo sapiens
acacuugggugacugguaa

SEQ ID NO: 1030273 - RNA, 19 nt, Homo sapiens
gcucagagauaauauaagc

SEQ ID NO: 1030274 - RNA, 19 nt, Homo sapiens
gagaugcucagagauaaua

SEQ ID NO: 1030275 - RNA, 19 nt, Homo sapiens
gcacauccagaaugacuaa

SEQ ID NO: 1030276 - RNA, 19 nt, Homo sapiens
auccaaagcucuccaguuu

SEQ ID NO: 1030277 - RNA, 19 nt, Homo sapiens
cuaugugucuguauaugua

SEQ ID NO: 1030278 - RNA, 19 nt, Homo sapiens
gaaaggacaucuauuuuac

SEQ ID NO: 1030279 - RNA, 19 nt, Homo sapiens
caggauugcuuacggagaa

SEQ ID NO: 1030280 - RNA, 19 nt, Homo sapiens
uauccaacauugcuucaaa

SEQ ID NO: 1030281 - RNA, 19 nt, Homo sapiens
ccacaggucaugagcagua

SEQ ID NO: 1030282 - RNA, 19 nt, Homo sapiens
uuaccuaccuuucaucaug

SEQ ID NO: 1030283 - RNA, 19 nt, Homo sapiens
ggaaggcacuuuuagaaug

SEQ ID NO: 1030284 - RNA, 19 nt, Homo sapiens
ucagggacagggcauauua

SEQ ID NO: 1030285 - RNA, 19 nt, Homo sapiens
auagagcuguggaauuuaa

SEQ ID NO: 1030286 - RNA, 19 nt, Homo sapiens
uuccagugcuucucucuua

SEQ ID NO: 1030287 - RNA, 19 nt, Homo sapiens
gcacuggaaacgaauagaa

SEQ ID NO: 1030288 - RNA, 19 nt, Homo sapiens
agaaacagccuccagaaga

SEQ ID NO: 1030289 - RNA, 19 nt, Homo sapiens
gcaagaaaauuaggaagaa

SEQ ID NO: 1030290 - RNA, 19 nt, Homo sapiens
guacuggaucgaaaucuaa

SEQ ID NO: 1030291 - RNA, 19 nt, Homo sapiens
gauuaaagccagacccuau

SEQ ID NO: 1030292 - RNA, 19 nt, Homo sapiens
gcuauuaccuaccuuucau

SEQ ID NO: 1030293 - RNA, 19 nt, Homo sapiens
gaaggcacuuuuagaauga

SEQ ID NO: 1030294 - RNA, 19 nt, Homo sapiens
gaauuuaauccucauguuc

SEQ ID NO: 1030295 - RNA, 19 nt, Homo sapiens
gaagcucucccguauuuca

SEQ ID NO: 1030296 - RNA, 19 nt, Homo sapiens
gguaauucuucaccacuga

SEQ ID NO: 1030297 - RNA, 19 nt, Homo sapiens
ccacucugcuuugauggua

SEQ ID NO: 1030298 - RNA, 19 nt, Homo sapiens
gaugaaauugucuuccuuu

SEQ ID NO: 1030299 - RNA, 19 nt, Homo sapiens
ggauuaagcacagcagaaa

SEQ ID NO: 1030300 - RNA, 19 nt, Homo sapiens
gcaccaaaguccucagcau

SEQ ID NO: 1030301 - RNA, 19 nt, Homo sapiens
gagcagaauauaggagaua

SEQ ID NO: 1030302 - RNA, 19 nt, Homo sapiens
gaauguaagguauggagaa

SEQ ID NO: 1030303 - RNA, 19 nt, Homo sapiens
gagaggaggaugagcagaa

SEQ ID NO: 1030304 - RNA, 19 nt, Homo sapiens
gauaauauaagccaugagu

SEQ ID NO: 1030305 - RNA, 19 nt, Homo sapiens
aaggacaacuguagaugaa

SEQ ID NO: 1030306 - RNA, 19 nt, Homo sapiens
guugugaggauuacauaua

SEQ ID NO: 1030307 - RNA, 19 nt, Homo sapiens
ucauugauaucaggacuaa

SEQ ID NO: 1030308 - RNA, 19 nt, Homo sapiens
aagagccacuuacauacua

SEQ ID NO: 1030309 - RNA, 19 nt, Homo sapiens
gcucucccguauuucauuu

SEQ ID NO: 1030310 - RNA, 19 nt, Homo sapiens
gagaauacacaggauuuga

SEQ ID NO: 1030311 - RNA, 19 nt, Homo sapiens
caaauucuauguggcacuu

SEQ ID NO: 1030312 - RNA, 19 nt, Homo sapiens
ccaaaguccucagcaugaa

SEQ ID NO: 1030313 - RNA, 19 nt, Homo sapiens
gcaauugccuaugcuuucu

SEQ ID NO: 1030314 - RNA, 19 nt, Homo sapiens
ucaauucacuguagcaacu

SEQ ID NO: 1030315 - RNA, 19 nt, Homo sapiens
gaauggaagugagcaaagg

SEQ ID NO: 1030316 - RNA, 19 nt, Homo sapiens
cuccaucgauauacucaua

SEQ ID NO: 1030317 - RNA, 19 nt, Homo sapiens
uaucccagcugcacagaga

SEQ ID NO: 1030318 - RNA, 19 nt, Homo sapiens
cuucagcacuggaaacgaa

SEQ ID NO: 1030319 - RNA, 19 nt, Homo sapiens
gcagcacuguugaagacaa

SEQ ID NO: 1030320 - RNA, 19 nt, Homo sapiens
uuacaggccuauccagaug

SEQ ID NO: 1030321 - RNA, 19 nt, Homo sapiens
gaugcugaaagguuauuua

SEQ ID NO: 1030322 - RNA, 19 nt, Homo sapiens
gaggaagaagcaacaacua

SEQ ID NO: 1030323 - RNA, 19 nt, Homo sapiens
cagaauuugucagaaugua

SEQ ID NO: 1030324 - RNA, 19 nt, Homo sapiens
cuaauaaagccaccacuug

SEQ ID NO: 1030325 - RNA, 19 nt, Homo sapiens
uguagcaacugugauauau

SEQ ID NO: 1030326 - RNA, 19 nt, Homo sapiens
ccgagaugcucagagauaa

SEQ ID NO: 1030327 - RNA, 19 nt, Homo sapiens
agaaauuaaugccguggaa

SEQ ID NO: 1030328 - RNA, 19 nt, Homo sapiens
agggaccucuucauugaua

SEQ ID NO: 1030329 - RNA, 19 nt, Homo sapiens
caaggcaggagaaacaauu

SEQ ID NO: 1030330 - RNA, 19 nt, Homo sapiens
caaagcagccuaucaagcu

SEQ ID NO: 1030331 - RNA, 19 nt, Homo sapiens
ggaacagagagcagcauuu

SEQ ID NO: 1030332 - RNA, 19 nt, Homo sapiens
gaucgaaaucuaauugcuu

SEQ ID NO: 1030333 - RNA, 19 nt, Homo sapiens
uuacagggaccucuucauu

SEQ ID NO: 1030334 - RNA, 19 nt, Homo sapiens
gaggauuacauauaugcua

SEQ ID NO: 1030335 - RNA, 19 nt, Homo sapiens
gaagaccuagguuugaguu

SEQ ID NO: 1030336 - RNA, 19 nt, Homo sapiens
gcaguaggcuuggcaguua

SEQ ID NO: 1030337 - RNA, 19 nt, Homo sapiens
caacauugcuucaaagaug

SEQ ID NO: 1030338 - RNA, 19 nt, Homo sapiens
aagcaucucuuucuuguua

SEQ ID NO: 1030339 - RNA, 19 nt, Homo sapiens
gaggagagauaccaaugua

SEQ ID NO: 1030340 - RNA, 19 nt, Homo sapiens
gugaagcucucccguauuu

SEQ ID NO: 1030341 - RNA, 19 nt, Homo sapiens
ucauagagcuguggaauuu

SEQ ID NO: 1030342 - RNA, 19 nt, Homo sapiens
ggacagggcauauuacuga

SEQ ID NO: 1030343 - RNA, 19 nt, Homo sapiens
gagaaacccucuaaaucuu

SEQ ID NO: 1030344 - RNA, 19 nt, Homo sapiens
gaaccagccuugcgaacuu

SEQ ID NO: 1030345 - RNA, 19 nt, Homo sapiens
ggaagcaucucuuucuugu

SEQ ID NO: 1030346 - RNA, 19 nt, Homo sapiens
gacaaggacuguuucagaa

SEQ ID NO: 1030347 - RNA, 19 nt, Homo sapiens
gauauaagccuuccaaagu

SEQ ID NO: 1030348 - RNA, 19 nt, Homo sapiens
cagcuuagccuuucuguuu

SEQ ID NO: 1030349 - RNA, 19 nt, Homo sapiens
ccaauguacugguauauau

SEQ ID NO: 1030350 - RNA, 19 nt, Homo sapiens
gaagucaagucaccgcauu

SEQ ID NO: 1030351 - RNA, 19 nt, Homo sapiens
ggacaacuguagaugaaau

SEQ ID NO: 1030352 - RNA, 19 nt, Homo sapiens
gcacagagacggcugauag

SEQ ID NO: 1030353 - RNA, 19 nt, Homo sapiens
gcugaaagguuauuuaaac

SEQ ID NO: 1030354 - RNA, 19 nt, Homo sapiens
gaagaagcaacaacuauug

SEQ ID NO: 1030355 - RNA, 19 nt, Homo sapiens
ggagaaacccucuaaaucu

SEQ ID NO: 1030356 - RNA, 19 nt, Homo sapiens
gaaaccagcagacagaauu

SEQ ID NO: 1030357 - RNA, 19 nt, Homo sapiens
ggaagaagcaacaacuauu

SEQ ID NO: 1030358 - RNA, 19 nt, Homo sapiens
ggaauuuaauccucauguu

SEQ ID NO: 1030359 - RNA, 19 nt, Homo sapiens
gaaacagccuccagaagag

SEQ ID NO: 1030360 - RNA, 19 nt, Homo sapiens
ccaccaaggccaucaauaa

SEQ ID NO: 1030361 - RNA, 19 nt, Homo sapiens
ugagagauuugaugaaaga

SEQ ID NO: 1030362 - RNA, 19 nt, Homo sapiens
gaacagcaucuauaaagug

SEQ ID NO: 1030363 - RNA, 19 nt, Homo sapiens
gagauaauauaagccauga

SEQ ID NO: 1030364 - RNA, 19 nt, Homo sapiens
gaacagagagcagcauuuc

SEQ ID NO: 1030365 - RNA, 19 nt, Homo sapiens
uguagaugcugaaagguua

SEQ ID NO: 1030366 - RNA, 19 nt, Homo sapiens
agagaaaggacaucuauuu

SEQ ID NO: 1030367 - RNA, 19 nt, Homo sapiens
gaauauaggagauacacuu

SEQ ID NO: 1030368 - RNA, 19 nt, Homo sapiens
ggagaaugcuugccuugca

SEQ ID NO: 1030369 - RNA, 19 nt, Homo sapiens
ccaccgagaugcucagaga

SEQ ID NO: 1030370 - RNA, 19 nt, Homo sapiens
gcaggagaaacaauuuaua

SEQ ID NO: 1030371 - RNA, 19 nt, Homo sapiens
acacuugggugacugguaa

SEQ ID NO: 1030372 - RNA, 19 nt, Homo sapiens
gcucagagauaauauaagc

SEQ ID NO: 1030373 - RNA, 19 nt, Homo sapiens
gagaugcucagagauaaua

SEQ ID NO: 1030374 - RNA, 19 nt, Homo sapiens
gcacauccagaaugacuaa

SEQ ID NO: 1030375 - RNA, 19 nt, Homo sapiens
auccaaagcucuccaguuu

SEQ ID NO: 1030376 - RNA, 19 nt, Homo sapiens
cuaugugucuguauaugua

SEQ ID NO: 1030377 - RNA, 19 nt, Homo sapiens
gaaaggacaucuauuuuac

SEQ ID NO: 1030378 - RNA, 19 nt, Homo sapiens
caggauugcuuacggagaa

SEQ ID NO: 1030379 - RNA, 19 nt, Homo sapiens
uauccaacauugcuucaaa

SEQ ID NO: 1030380 - RNA, 19 nt, Homo sapiens
ccacaggucaugagcagua

SEQ ID NO: 1030381 - RNA, 19 nt, Homo sapiens
uuaccuaccuuucaucaug

SEQ ID NO: 1030382 - RNA, 19 nt, Homo sapiens
ggaaggcacuuuuagaaug

SEQ ID NO: 1030383 - RNA, 19 nt, Homo sapiens
ucagggacagggcauauua

SEQ ID NO: 1030384 - RNA, 19 nt, Homo sapiens
auagagcuguggaauuuaa

SEQ ID NO: 1030385 - RNA, 19 nt, Homo sapiens
uuccagugcuucucucuua

SEQ ID NO: 1030386 - RNA, 19 nt, Homo sapiens
gcacuggaaacgaauagaa

SEQ ID NO: 1030387 - RNA, 19 nt, Homo sapiens
agaaacagccuccagaaga

SEQ ID NO: 1030388 - RNA, 19 nt, Homo sapiens
gcaagaaaauuaggaagaa

SEQ ID NO: 1030389 - RNA, 19 nt, Homo sapiens
guacuggaucgaaaucuaa

SEQ ID NO: 1030390 - RNA, 19 nt, Homo sapiens
gauuaaagccagacccuau

SEQ ID NO: 1030391 - RNA, 19 nt, Homo sapiens
gcuauuaccuaccuuucau

SEQ ID NO: 1030392 - RNA, 19 nt, Homo sapiens
gaaggcacuuuuagaauga

SEQ ID NO: 1030393 - RNA, 19 nt, Homo sapiens
gaauuuaauccucauguuc

SEQ ID NO: 1030394 - RNA, 19 nt, Homo sapiens
gaagcucucccguauuuca

SEQ ID NO: 1030395 - RNA, 19 nt, Homo sapiens
gguaauucuucaccacuga

SEQ ID NO: 1030396 - RNA, 19 nt, Homo sapiens
ccacucugcuuugauggua

SEQ ID NO: 1030397 - RNA, 19 nt, Homo sapiens
gaugaaauugucuuccuuu

SEQ ID NO: 1030398 - RNA, 19 nt, Homo sapiens
ggauuaagcacagcagaaa

SEQ ID NO: 1030399 - RNA, 19 nt, Homo sapiens
gcaccaaaguccucagcau

SEQ ID NO: 1030400 - RNA, 19 nt, Homo sapiens
gagcagaauauaggagaua

SEQ ID NO: 1030401 - RNA, 19 nt, Homo sapiens
gaauguaagguauggagaa

SEQ ID NO: 1030402 - RNA, 19 nt, Homo sapiens
gagaggaggaugagcagaa

SEQ ID NO: 1030403 - RNA, 19 nt, Homo sapiens
gauaauauaagccaugagu

SEQ ID NO: 1030404 - RNA, 19 nt, Homo sapiens
aaggacaacuguagaugaa

SEQ ID NO: 1030405 - RNA, 19 nt, Homo sapiens
guugugaggauuacauaua

SEQ ID NO: 1030406 - RNA, 19 nt, Homo sapiens
ucauugauaucaggacuaa

SEQ ID NO: 1030407 - RNA, 19 nt, Homo sapiens
aagagccacuuacauacua

SEQ ID NO: 1030408 - RNA, 19 nt, Homo sapiens
gcucucccguauuucauuu

SEQ ID NO: 1030409 - RNA, 19 nt, Homo sapiens
gagaauacacaggauuuga

SEQ ID NO: 1030410 - RNA, 19 nt, Homo sapiens
ccaaaguccucagcaugaa

SEQ ID NO: 1030411 - RNA, 19 nt, Homo sapiens
gcaauugccuaugcuuucu

SEQ ID NO: 1030412 - RNA, 19 nt, Homo sapiens
ucaauucacuguagcaacu

SEQ ID NO: 1030413 - RNA, 19 nt, Homo sapiens
gaauggaagugagcaaagg

SEQ ID NO: 1030414 - RNA, 19 nt, Homo sapiens
cuccaucgauauacucaua

SEQ ID NO: 1030415 - RNA, 19 nt, Homo sapiens
uaucccagcugcacagaga

SEQ ID NO: 1030416 - RNA, 19 nt, Homo sapiens
cuucagcacuggaaacgaa

SEQ ID NO: 1030417 - RNA, 19 nt, Homo sapiens
gcagcacuguugaagacaa

SEQ ID NO: 1030418 - RNA, 19 nt, Homo sapiens
uuacaggccuauccagaug

SEQ ID NO: 1030419 - RNA, 19 nt, Homo sapiens
gaugcugaaagguuauuua

SEQ ID NO: 1030420 - RNA, 19 nt, Homo sapiens
gaggaagaagcaacaacua

SEQ ID NO: 1030421 - RNA, 19 nt, Homo sapiens
cagaauuugucagaaugua

SEQ ID NO: 1030422 - RNA, 19 nt, Homo sapiens
cuaauaaagccaccacuug

SEQ ID NO: 1030423 - RNA, 19 nt, Homo sapiens
uguagcaacugugauauau

SEQ ID NO: 1030424 - RNA, 19 nt, Homo sapiens
ccgagaugcucagagauaa

SEQ ID NO: 1030425 - RNA, 19 nt, Homo sapiens
agaaauuaaugccguggaa

SEQ ID NO: 1030426 - RNA, 19 nt, Homo sapiens
caaggcaggagaaacaauu

SEQ ID NO: 1030427 - RNA, 19 nt, Homo sapiens
ggaacagagagcagcauuu

SEQ ID NO: 1030428 - RNA, 19 nt, Homo sapiens
caaagcagccuaucaagcu

SEQ ID NO: 1030429 - RNA, 19 nt, Homo sapiens
gaucgaaaucuaauugcuu

SEQ ID NO: 1030430 - RNA, 19 nt, Homo sapiens
gaggauuacauauaugcua

SEQ ID NO: 1030431 - RNA, 19 nt, Homo sapiens
gaagaccuagguuugaguu

SEQ ID NO: 1030432 - RNA, 19 nt, Homo sapiens
cauucucacucaccaguuu

SEQ ID NO: 1030433 - RNA, 19 nt, Homo sapiens
agacaaggacuguuucaga

SEQ ID NO: 1030434 - RNA, 19 nt, Homo sapiens
gagcagcauuucagaacca

SEQ ID NO: 1030435 - RNA, 19 nt, Homo sapiens
cagcagcacuguugaagac

SEQ ID NO: 1030436 - RNA, 19 nt, Homo sapiens
gcaguaggcuuggcaguua

SEQ ID NO: 1030437 - RNA, 19 nt, Homo sapiens
caacauugcuucaaagaug

SEQ ID NO: 1030438 - RNA, 19 nt, Homo sapiens
aagcaucucuuucuuguua

SEQ ID NO: 1030439 - RNA, 19 nt, Homo sapiens
gaggagagauaccaaugua

SEQ ID NO: 1030440 - RNA, 19 nt, Homo sapiens
gugaagcucucccguauuu

SEQ ID NO: 1030441 - RNA, 19 nt, Homo sapiens
ucauagagcuguggaauuu

SEQ ID NO: 1030442 - RNA, 19 nt, Homo sapiens
ggacagggcauauuacuga

SEQ ID NO: 1030443 - RNA, 19 nt, Homo sapiens
gagaaacccucuaaaucuu

SEQ ID NO: 1030444 - RNA, 19 nt, Homo sapiens
gaaccagccuugcgaacuu

SEQ ID NO: 1030445 - RNA, 19 nt, Homo sapiens
ggaagcaucucuuucuugu

SEQ ID NO: 1030446 - RNA, 19 nt, Homo sapiens
gacaaggacuguuucagaa

SEQ ID NO: 1030447 - RNA, 19 nt, Homo sapiens
gauauaagccuuccaaagu

SEQ ID NO: 1030448 - RNA, 19 nt, Homo sapiens
cagcuuagccuuucuguuu

SEQ ID NO: 1030449 - RNA, 19 nt, Homo sapiens
ccaauguacugguauauau

SEQ ID NO: 1030450 - RNA, 19 nt, Homo sapiens
gaagucaagucaccgcauu

SEQ ID NO: 1030451 - RNA, 19 nt, Homo sapiens
ggacaacuguagaugaaau

SEQ ID NO: 1030452 - RNA, 19 nt, Homo sapiens
gcugaaagguuauuuaaac

SEQ ID NO: 1030453 - RNA, 19 nt, Homo sapiens
gaagaagcaacaacuauug

SEQ ID NO: 1030454 - RNA, 19 nt, Homo sapiens
ggagaaacccucuaaaucu

SEQ ID NO: 1030455 - RNA, 19 nt, Homo sapiens
gaaaccagcagacagaauu

SEQ ID NO: 1030456 - RNA, 19 nt, Homo sapiens
ggaagaagcaacaacuauu

SEQ ID NO: 1030457 - RNA, 19 nt, Homo sapiens
ggaauuuaauccucauguu

SEQ ID NO: 1030458 - RNA, 19 nt, Homo sapiens
gaaacagccuccagaagag

SEQ ID NO: 1030459 - RNA, 19 nt, Homo sapiens
ccaccaaggccaucaauaa

SEQ ID NO: 1030460 - RNA, 19 nt, Homo sapiens
ugagagauuugaugaaaga

SEQ ID NO: 1030461 - RNA, 19 nt, Homo sapiens
gaacagcaucuauaaagug

SEQ ID NO: 1030462 - RNA, 19 nt, Homo sapiens
gagauaauauaagccauga

SEQ ID NO: 1030463 - RNA, 19 nt, Homo sapiens
gaacagagagcagcauuuc

SEQ ID NO: 1030464 - RNA, 19 nt, Homo sapiens
uguagaugcugaaagguua

SEQ ID NO: 1030465 - RNA, 19 nt, Homo sapiens
acagggaccucuucauuga

SEQ ID NO: 1030466 - RNA, 19 nt, Homo sapiens
gaauauaggagauacacuu

SEQ ID NO: 1030467 - RNA, 19 nt, Homo sapiens
ggagaaugcuugccuugca

SEQ ID NO: 1030468 - RNA, 19 nt, Homo sapiens
ccaccgagaugcucagaga

SEQ ID NO: 1030469 - RNA, 19 nt, Homo sapiens
gcaggagaaacaauuuaua

SEQ ID NO: 1030470 - RNA, 19 nt, Homo sapiens
acacuugggugacugguaa

SEQ ID NO: 1030471 - RNA, 19 nt, Homo sapiens
gcucagagauaauauaagc

SEQ ID NO: 1030472 - RNA, 19 nt, Homo sapiens
gagaugcucagagauaaua

SEQ ID NO: 1030473 - RNA, 19 nt, Homo sapiens
gcacauccagaaugacuaa

SEQ ID NO: 1030474 - RNA, 19 nt, Homo sapiens
auccaaagcucuccaguuu

SEQ ID NO: 1030475 - RNA, 19 nt, Homo sapiens
cuaugugucuguauaugua

SEQ ID NO: 1030476 - RNA, 19 nt, Homo sapiens
caggauugcuuacggagaa

SEQ ID NO: 1030477 - RNA, 19 nt, Homo sapiens
uauccaacauugcuucaaa

SEQ ID NO: 1030478 - RNA, 19 nt, Homo sapiens
ccacaggucaugagcagua

SEQ ID NO: 1030479 - RNA, 19 nt, Homo sapiens
ucagggacagggcauauua

SEQ ID NO: 1030480 - RNA, 19 nt, Homo sapiens
auagagcuguggaauuuaa

SEQ ID NO: 1030481 - RNA, 19 nt, Homo sapiens
uuccagugcuucucucuua

SEQ ID NO: 1030482 - RNA, 19 nt, Homo sapiens
gcacuggaaacgaauagaa

SEQ ID NO: 1030483 - RNA, 19 nt, Homo sapiens
agaaacagccuccagaaga

SEQ ID NO: 1030484 - RNA, 19 nt, Homo sapiens
gcaagaaaauuaggaagaa

SEQ ID NO: 1030485 - RNA, 19 nt, Homo sapiens
guacuggaucgaaaucuaa

SEQ ID NO: 1030486 - RNA, 19 nt, Homo sapiens
gauuaaagccagacccuau

SEQ ID NO: 1030487 - RNA, 19 nt, Homo sapiens
gaauuuaauccucauguuc

SEQ ID NO: 1030488 - RNA, 19 nt, Homo sapiens
gaagcucucccguauuuca

SEQ ID NO: 1030489 - RNA, 19 nt, Homo sapiens
gguaauucuucaccacuga

SEQ ID NO: 1030490 - RNA, 19 nt, Homo sapiens
ccacucugcuuugauggua

SEQ ID NO: 1030491 - RNA, 19 nt, Homo sapiens
gaugaaauugucuuccuuu

SEQ ID NO: 1030492 - RNA, 19 nt, Homo sapiens
ggauuaagcacagcagaaa

SEQ ID NO: 1030493 - RNA, 19 nt, Homo sapiens
gcaccaaaguccucagcau

SEQ ID NO: 1030494 - RNA, 19 nt, Homo sapiens
gagcagaauauaggagaua

SEQ ID NO: 1030495 - RNA, 19 nt, Homo sapiens
gaauguaagguauggagaa

SEQ ID NO: 1030496 - RNA, 19 nt, Homo sapiens
gagaggaggaugagcagaa

SEQ ID NO: 1030497 - RNA, 19 nt, Homo sapiens
gauaauauaagccaugagu

SEQ ID NO: 1030498 - RNA, 19 nt, Homo sapiens
aaggacaacuguagaugaa

SEQ ID NO: 1030499 - RNA, 19 nt, Homo sapiens
guugugaggauuacauaua

SEQ ID NO: 1030500 - RNA, 19 nt, Homo sapiens
aagagccacuuacauacua

SEQ ID NO: 1030501 - RNA, 19 nt, Homo sapiens
ucauugauaucaggacuaa

SEQ ID NO: 1030502 - RNA, 19 nt, Homo sapiens
gcucucccguauuucauuu

SEQ ID NO: 1030503 - RNA, 19 nt, Homo sapiens
gagaauacacaggauuuga

SEQ ID NO: 1030504 - RNA, 19 nt, Homo sapiens
caaauucuauguggcacuu

SEQ ID NO: 1030505 - RNA, 19 nt, Homo sapiens
ccaaaguccucagcaugaa

SEQ ID NO: 1030506 - RNA, 19 nt, Homo sapiens
gcaauugccuaugcuuucu

SEQ ID NO: 1030507 - RNA, 19 nt, Homo sapiens
ucaauucacuguagcaacu

SEQ ID NO: 1030508 - RNA, 19 nt, Homo sapiens
gaauggaagugagcaaagg

SEQ ID NO: 1030509 - RNA, 19 nt, Homo sapiens
cuccaucgauauacucaua

SEQ ID NO: 1030510 - RNA, 19 nt, Homo sapiens
cuucagcacuggaaacgaa

SEQ ID NO: 1030511 - RNA, 19 nt, Homo sapiens
gcagcacuguugaagacaa

SEQ ID NO: 1030512 - RNA, 19 nt, Homo sapiens
uuacaggccuauccagaug

SEQ ID NO: 1030513 - RNA, 19 nt, Homo sapiens
gaugcugaaagguuauuua

SEQ ID NO: 1030514 - RNA, 19 nt, Homo sapiens
gaggaagaagcaacaacua

SEQ ID NO: 1030515 - RNA, 19 nt, Homo sapiens
cagaauuugucagaaugua

SEQ ID NO: 1030516 - RNA, 19 nt, Homo sapiens
cuaauaaagccaccacuug

SEQ ID NO: 1030517 - RNA, 19 nt, Homo sapiens
uguagcaacugugauauau

SEQ ID NO: 1030518 - RNA, 19 nt, Homo sapiens
ccgagaugcucagagauaa

SEQ ID NO: 1030519 - RNA, 19 nt, Homo sapiens
agaaauuaaugccguggaa

SEQ ID NO: 1030520 - RNA, 19 nt, Homo sapiens
caaggcaggagaaacaauu

SEQ ID NO: 1030521 - RNA, 19 nt, Homo sapiens
caaagcagccuaucaagcu

SEQ ID NO: 1030522 - RNA, 19 nt, Homo sapiens
agggaccucuucauugaua

SEQ ID NO: 1030523 - RNA, 19 nt, Homo sapiens
ggaacagagagcagcauuu

SEQ ID NO: 1030524 - RNA, 19 nt, Homo sapiens
uuacagggaccucuucauu

SEQ ID NO: 1030525 - RNA, 19 nt, Homo sapiens
gaucgaaaucuaauugcuu

SEQ ID NO: 1030526 - RNA, 19 nt, Homo sapiens
gaggauuacauauaugcua

SEQ ID NO: 1030527 - RNA, 19 nt, Homo sapiens
gaagaccuagguuugaguu

SEQ ID NO: 1030528 - RNA, 19 nt, Homo sapiens
cauucucacucaccaguuu

SEQ ID NO: 1030529 - RNA, 19 nt, Homo sapiens
agacaaggacuguuucaga

SEQ ID NO: 1030530 - RNA, 19 nt, Homo sapiens
cagcagcacuguugaagac

SEQ ID NO: 1030531 - RNA, 19 nt, Homo sapiens
gaaacccucuaaaucuuuu

SEQ ID NO: 1030532 - RNA, 19 nt, Homo sapiens
gagcagcauuucagaacca

SEQ ID NO: 1030533 - RNA, 19 nt, Homo sapiens
guucucuggugcuguaauu

SEQ ID NO: 1030534 - RNA, 19 nt, Homo sapiens
gauauuccuugauuaaagc

SEQ ID NO: 1030535 - RNA, 19 nt, Homo sapiens
cagccacucugcuuugaug

SEQ ID NO: 1030536 - RNA, 19 nt, Homo sapiens
ggacuuguguagauuauuu

SEQ ID NO: 1030537 - RNA, 19 nt, Homo sapiens
gaggagagauaccaaugua

SEQ ID NO: 1030538 - RNA, 19 nt, Homo sapiens
ucauagagcuguggaauuu

SEQ ID NO: 1030539 - RNA, 19 nt, Homo sapiens
gagaaacccucuaaaucuu

SEQ ID NO: 1030540 - RNA, 19 nt, Homo sapiens
guauauaguugcugccaua

SEQ ID NO: 1030541 - RNA, 19 nt, Homo sapiens
gacaaggacuguuucagaa

SEQ ID NO: 1030542 - RNA, 19 nt, Homo sapiens
gauauaagccuuccaaagu

SEQ ID NO: 1030543 - RNA, 19 nt, Homo sapiens
ccaauguacugguauauau

SEQ ID NO: 1030544 - RNA, 19 nt, Homo sapiens
gcacagagacggcugauag

SEQ ID NO: 1030545 - RNA, 19 nt, Homo sapiens
gcugaaagguuauuuaaac

SEQ ID NO: 1030546 - RNA, 19 nt, Homo sapiens
gaagaagcaacaacuauug

SEQ ID NO: 1030547 - RNA, 19 nt, Homo sapiens
ggagaaacccucuaaaucu

SEQ ID NO: 1030548 - RNA, 19 nt, Homo sapiens
gaaaccagcagacagaauu

SEQ ID NO: 1030549 - RNA, 19 nt, Homo sapiens
ggaagaagcaacaacuauu

SEQ ID NO: 1030550 - RNA, 19 nt, Homo sapiens
ggaauuuaauccucauguu

SEQ ID NO: 1030551 - RNA, 19 nt, Homo sapiens
gaaacagccuccagaagag

SEQ ID NO: 1030552 - RNA, 19 nt, Homo sapiens
ugagagauuugaugaaaga

SEQ ID NO: 1030553 - RNA, 19 nt, Homo sapiens
uaacccagcugaacaaugg

SEQ ID NO: 1030554 - RNA, 19 nt, Homo sapiens
gaacagagagcagcauuuc

SEQ ID NO: 1030555 - RNA, 19 nt, Homo sapiens
uguagaugcugaaagguua

SEQ ID NO: 1030556 - RNA, 19 nt, Homo sapiens
acagggaccucuucauuga

SEQ ID NO: 1030557 - RNA, 19 nt, Homo sapiens
gcugaacaauggaagauau

SEQ ID NO: 1030558 - RNA, 19 nt, Homo sapiens
agagaaaggacaucuauuu

SEQ ID NO: 1030559 - RNA, 19 nt, Homo sapiens
gaauauaggagauacacuu

SEQ ID NO: 1030560 - RNA, 19 nt, Homo sapiens
gaacaauggaagauauuug

SEQ ID NO: 1030561 - RNA, 19 nt, Homo sapiens
gcaggagaaacaauuuaua

SEQ ID NO: 1030562 - RNA, 19 nt, Homo sapiens
acacuugggugacugguaa

SEQ ID NO: 1030563 - RNA, 19 nt, Homo sapiens
uauaguugcugccauaaau

SEQ ID NO: 1030564 - RNA, 19 nt, Homo sapiens
gaaaggacaucuauuuuac

SEQ ID NO: 1030565 - RNA, 19 nt, Homo sapiens
uuaccuaccuuucaucaug

SEQ ID NO: 1030566 - RNA, 19 nt, Homo sapiens
ggaaggcacuuuuagaaug

SEQ ID NO: 1030567 - RNA, 19 nt, Homo sapiens
auagagcuguggaauuuaa

SEQ ID NO: 1030568 - RNA, 19 nt, Homo sapiens
caagaaaccaucucugauc

SEQ ID NO: 1030569 - RNA, 19 nt, Homo sapiens
gcacuggaaacgaauagaa

SEQ ID NO: 1030570 - RNA, 19 nt, Homo sapiens
agaaacagccuccagaaga

SEQ ID NO: 1030571 - RNA, 19 nt, Homo sapiens
gcaagaaaauuaggaagaa

SEQ ID NO: 1030572 - RNA, 19 nt, Homo sapiens
gcuauuaccuaccuuucau

SEQ ID NO: 1030573 - RNA, 19 nt, Homo sapiens
gaaggcacuuuuagaauga

SEQ ID NO: 1030574 - RNA, 19 nt, Homo sapiens
gaauuuaauccucauguuc

SEQ ID NO: 1030575 - RNA, 19 nt, Homo sapiens
ggauuaagcacagcagaaa

SEQ ID NO: 1030576 - RNA, 19 nt, Homo sapiens
gcaccaaaguccucagcau

SEQ ID NO: 1030577 - RNA, 19 nt, Homo sapiens
gagcagaauauaggagaua

SEQ ID NO: 1030578 - RNA, 19 nt, Homo sapiens
gaauguaagguauggagaa

SEQ ID NO: 1030579 - RNA, 19 nt, Homo sapiens
aagagccacuuacauacua

SEQ ID NO: 1030580 - RNA, 19 nt, Homo sapiens
ucauugauaucaggacuaa

SEQ ID NO: 1030581 - RNA, 19 nt, Homo sapiens
guaaguaugaucucaagga

SEQ ID NO: 1030582 - RNA, 19 nt, Homo sapiens
ccaaaguccucagcaugaa

SEQ ID NO: 1030583 - RNA, 19 nt, Homo sapiens
caaauucuauguggcacuu

SEQ ID NO: 1030584 - RNA, 19 nt, Homo sapiens
gcaauugccuaugcuuucu

SEQ ID NO: 1030585 - RNA, 19 nt, Homo sapiens
uaucccagcugcacagaga

SEQ ID NO: 1030586 - RNA, 19 nt, Homo sapiens
cuucagcacuggaaacgaa

SEQ ID NO: 1030587 - RNA, 19 nt, Homo sapiens
gcagcacuguugaagacaa

SEQ ID NO: 1030588 - RNA, 19 nt, Homo sapiens
uuacaggccuauccagaug

SEQ ID NO: 1030589 - RNA, 19 nt, Homo sapiens
gaugcugaaagguuauuua

SEQ ID NO: 1030590 - RNA, 19 nt, Homo sapiens
gaggaagaagcaacaacua

SEQ ID NO: 1030591 - RNA, 19 nt, Homo sapiens
cagaauuugucagaaugua

SEQ ID NO: 1030592 - RNA, 19 nt, Homo sapiens
cacaagaaaccaucucuga

SEQ ID NO: 1030593 - RNA, 19 nt, Homo sapiens
agaaauuaaugccguggaa

SEQ ID NO: 1030594 - RNA, 19 nt, Homo sapiens
caaggcaggagaaacaauu

SEQ ID NO: 1030595 - RNA, 19 nt, Homo sapiens
caaagcagccuaucaagcu

SEQ ID NO: 1030596 - RNA, 19 nt, Homo sapiens
ggaacagagagcagcauuu

SEQ ID NO: 1030597 - RNA, 19 nt, Homo sapiens
agggaccucuucauugaua

SEQ ID NO: 1030598 - RNA, 19 nt, Homo sapiens
aguaugaucucaaggacuu

SEQ ID NO: 1030599 - RNA, 19 nt, Homo sapiens
gcuaaagcuguaaguauga

SEQ ID NO: 1030600 - RNA, 19 nt, Homo sapiens
cauucucacucaccaguuu

SEQ ID NO: 1030601 - RNA, 19 nt, Homo sapiens
agacaaggacuguuucaga

SEQ ID NO: 1030602 - RNA, 19 nt, Homo sapiens
cagcagcacuguugaagac

SEQ ID NO: 1030603 - RNA, 19 nt, Homo sapiens
gaaacccucuaaaucuuuu

SEQ ID NO: 1030604 - RNA, 19 nt, Homo sapiens
gagcagcauuucagaacca

SEQ ID NO: 1030605 - RNA, 19 nt, Homo sapiens
uuacagggaccucuucauu

SEQ ID NO: 1030606 - RNA, 19 nt, Homo sapiens
caauggaagauauuuguug

SEQ ID NO: 1030607 - RNA, 19 nt, Homo sapiens
uggcagcggugacuguauu

SEQ ID NO: 1030608 - RNA, 19 nt, Homo sapiens
gagcgucuccugcaucugu

SEQ ID NO: 1030609 - RNA, 19 nt, Homo sapiens
gaagacaaggacuguuuca

SEQ ID NO: 1030610 - RNA, 19 nt, Homo sapiens
uauaagccuuccaaaguca

SEQ ID NO: 1030611 - RNA, 19 nt, Homo sapiens
gaugauauaagccuuccaa

SEQ ID NO: 1030612 - RNA, 19 nt, Homo sapiens
aagaauaagagaagcagua

SEQ ID NO: 1030613 - RNA, 19 nt, Homo sapiens
cagaaggcuuggagggaaa

SEQ ID NO: 1030614 - RNA, 19 nt, Homo sapiens
gaaacggggugauagugaa

SEQ ID NO: 1030615 - RNA, 19 nt, Homo sapiens
gaacauccaugaaaaucuc

SEQ ID NO: 1030616 - RNA, 19 nt, Homo sapiens
aaucaaagcagccuaucaa

SEQ ID NO: 1030617 - RNA, 19 nt, Homo sapiens
ugauagccauucucacuca

SEQ ID NO: 1030618 - RNA, 19 nt, Homo sapiens
gaaauccuccagcucgaau

SEQ ID NO: 1030619 - RNA, 19 nt, Homo sapiens
ugcuaaagcuguaaguaug

SEQ ID NO: 1030620 - RNA, 19 nt, Homo sapiens
gagaaaggacaucuauuuu

SEQ ID NO: 1030621 - RNA, 19 nt, Homo sapiens
gugaagcaauugccuaugc

SEQ ID NO: 1030622 - RNA, 19 nt, Homo sapiens
gaauaagagaagcaguaaa

SEQ ID NO: 1030623 - RNA, 19 nt, Homo sapiens
gaaucaaagcagccuauca

SEQ ID NO: 1030624 - RNA, 19 nt, Homo sapiens
cagacacaguuaugcagaa

SEQ ID NO: 1030625 - RNA, 19 nt, Homo sapiens
guauggagaaacccucuaa

SEQ ID NO: 1030626 - RNA, 19 nt, Homo sapiens
ggagagauaccaauguacu

SEQ ID NO: 1030627 - RNA, 19 nt, Homo sapiens
caggagaaacaauuuauag

SEQ ID NO: 1030628 - RNA, 19 nt, Homo sapiens
gagauacacuugggugacu

SEQ ID NO: 1030629 - RNA, 19 nt, Homo sapiens
guacaugggaaggcacuuu

SEQ ID NO: 1030630 - RNA, 19 nt, Homo sapiens
ggugguacuuccauaagca

SEQ ID NO: 1030631 - RNA, 19 nt, Homo sapiens
gcacuuacagggaccucuu

SEQ ID NO: 1030632 - RNA, 19 nt, Homo sapiens
ccauuucacagcaggauuu

SEQ ID NO: 1030633 - RNA, 19 nt, Homo sapiens
aagcacagcagaaauuaau

SEQ ID NO: 1030634 - RNA, 19 nt, Homo sapiens
ccagaaacagccuccagaa

SEQ ID NO: 1030635 - RNA, 19 nt, Homo sapiens
uuaagcacagcagaaauua

SEQ ID NO: 1030636 - RNA, 19 nt, Homo sapiens
ggacuuguguagauuauuu

SEQ ID NO: 1030637 - RNA, 19 nt, Homo sapiens
gaggagagauaccaaugua

SEQ ID NO: 1030638 - RNA, 19 nt, Homo sapiens
ucauagagcuguggaauuu

SEQ ID NO: 1030639 - RNA, 19 nt, Homo sapiens
gagaaacccucuaaaucuu

SEQ ID NO: 1030640 - RNA, 19 nt, Homo sapiens
guauauaguugcugccaua

SEQ ID NO: 1030641 - RNA, 19 nt, Homo sapiens
gacaaggacuguuucagaa

SEQ ID NO: 1030642 - RNA, 19 nt, Homo sapiens
ccaauguacugguauauau

SEQ ID NO: 1030643 - RNA, 19 nt, Homo sapiens
gcacagagacggcugauag

SEQ ID NO: 1030644 - RNA, 19 nt, Homo sapiens
gcugaaagguuauuuaaac

SEQ ID NO: 1030645 - RNA, 19 nt, Homo sapiens
gaagaagcaacaacuauug

SEQ ID NO: 1030646 - RNA, 19 nt, Homo sapiens
ggagaaacccucuaaaucu

SEQ ID NO: 1030647 - RNA, 19 nt, Homo sapiens
gaaaccagcagacagaauu

SEQ ID NO: 1030648 - RNA, 19 nt, Homo sapiens
ggaagaagcaacaacuauu

SEQ ID NO: 1030649 - RNA, 19 nt, Homo sapiens
ggaauuuaauccucauguu

SEQ ID NO: 1030650 - RNA, 19 nt, Homo sapiens
gaaacagccuccagaagag

SEQ ID NO: 1030651 - RNA, 19 nt, Homo sapiens
uaacccagcugaacaaugg

SEQ ID NO: 1030652 - RNA, 19 nt, Homo sapiens
gaacagagagcagcauuuc

SEQ ID NO: 1030653 - RNA, 19 nt, Homo sapiens
uguagaugcugaaagguua

SEQ ID NO: 1030654 - RNA, 19 nt, Homo sapiens
gcugaacaauggaagauau

SEQ ID NO: 1030655 - RNA, 19 nt, Homo sapiens
agagaaaggacaucuauuu

SEQ ID NO: 1030656 - RNA, 19 nt, Homo sapiens
gaauauaggagauacacuu

SEQ ID NO: 1030657 - RNA, 19 nt, Homo sapiens
gaacaauggaagauauuug

SEQ ID NO: 1030658 - RNA, 19 nt, Homo sapiens
gcaggagaaacaauuuaua

SEQ ID NO: 1030659 - RNA, 19 nt, Homo sapiens
acacuugggugacugguaa

SEQ ID NO: 1030660 - RNA, 19 nt, Homo sapiens
uauaguugcugccauaaau

SEQ ID NO: 1030661 - RNA, 19 nt, Homo sapiens
gaaaggacaucuauuuuac

SEQ ID NO: 1030662 - RNA, 19 nt, Homo sapiens
uuaccuaccuuucaucaug

SEQ ID NO: 1030663 - RNA, 19 nt, Homo sapiens
ggaaggcacuuuuagaaug

SEQ ID NO: 1030664 - RNA, 19 nt, Homo sapiens
uauauaagccuuccaaagu

SEQ ID NO: 1030665 - RNA, 19 nt, Homo sapiens
auagagcuguggaauuuaa

SEQ ID NO: 1030666 - RNA, 19 nt, Homo sapiens
caagaaaccaucucugauc

SEQ ID NO: 1030667 - RNA, 19 nt, Homo sapiens
gcacuggaaacgaauagaa

SEQ ID NO: 1030668 - RNA, 19 nt, Homo sapiens
agaaacagccuccagaaga

SEQ ID NO: 1030669 - RNA, 19 nt, Homo sapiens
gcaagaaaauuaggaagaa

SEQ ID NO: 1030670 - RNA, 19 nt, Homo sapiens
gcuauuaccuaccuuucau

SEQ ID NO: 1030671 - RNA, 19 nt, Homo sapiens
gaaggcacuuuuagaauga

SEQ ID NO: 1030672 - RNA, 19 nt, Homo sapiens
gaauuuaauccucauguuc

SEQ ID NO: 1030673 - RNA, 19 nt, Homo sapiens
ggauuaagcacagcagaaa

SEQ ID NO: 1030674 - RNA, 19 nt, Homo sapiens
gcaccaaaguccucagcau

SEQ ID NO: 1030675 - RNA, 19 nt, Homo sapiens
gagcagaauauaggagaua

SEQ ID NO: 1030676 - RNA, 19 nt, Homo sapiens
gaauguaagguauggagaa

SEQ ID NO: 1030677 - RNA, 19 nt, Homo sapiens
aagagccacuuacauacua

SEQ ID NO: 1030678 - RNA, 19 nt, Homo sapiens
guaaguaugaucucaagga

SEQ ID NO: 1030679 - RNA, 19 nt, Homo sapiens
ccaaaguccucagcaugaa

SEQ ID NO: 1030680 - RNA, 19 nt, Homo sapiens
gcaauugccuaugcuuucu

SEQ ID NO: 1030681 - RNA, 19 nt, Homo sapiens
uaucccagcugcacagaga

SEQ ID NO: 1030682 - RNA, 19 nt, Homo sapiens
cuucagcacuggaaacgaa

SEQ ID NO: 1030683 - RNA, 19 nt, Homo sapiens
gaauuuggcagcggauauu

SEQ ID NO: 1030684 - RNA, 19 nt, Homo sapiens
gcagcacuguugaagacaa

SEQ ID NO: 1030685 - RNA, 19 nt, Homo sapiens
gaugcugaaagguuauuua

SEQ ID NO: 1030686 - RNA, 19 nt, Homo sapiens
gaggaagaagcaacaacua

SEQ ID NO: 1030687 - RNA, 19 nt, Homo sapiens
cagaauuugucagaaugua

SEQ ID NO: 1030688 - RNA, 19 nt, Homo sapiens
cacaagaaaccaucucuga

SEQ ID NO: 1030689 - RNA, 19 nt, Homo sapiens
agaaauuaaugccguggaa

SEQ ID NO: 1030690 - RNA, 19 nt, Homo sapiens
caaggcaggagaaacaauu

SEQ ID NO: 1030691 - RNA, 19 nt, Homo sapiens
caaagcagccuaucaagcu

SEQ ID NO: 1030692 - RNA, 19 nt, Homo sapiens
ggaacagagagcagcauuu

SEQ ID NO: 1030693 - RNA, 19 nt, Homo sapiens
aguaugaucucaaggacuu

SEQ ID NO: 1030694 - RNA, 19 nt, Homo sapiens
gcuaaagcuguaaguauga

SEQ ID NO: 1030695 - RNA, 19 nt, Homo sapiens
cauucucacucaccaguuu

SEQ ID NO: 1030696 - RNA, 19 nt, Homo sapiens
agacaaggacuguuucaga

SEQ ID NO: 1030697 - RNA, 19 nt, Homo sapiens
cagcagcacuguugaagac

SEQ ID NO: 1030698 - RNA, 19 nt, Homo sapiens
gaaacccucuaaaucuuuu

SEQ ID NO: 1030699 - RNA, 19 nt, Homo sapiens
gagcagcauuucagaacca

SEQ ID NO: 1030700 - RNA, 19 nt, Homo sapiens
caauggaagauauuuguug

SEQ ID NO: 1030701 - RNA, 19 nt, Homo sapiens
gagcgucuccugcaucugu

SEQ ID NO: 1030702 - RNA, 19 nt, Homo sapiens
gaagacaaggacuguuuca

SEQ ID NO: 1030703 - RNA, 19 nt, Homo sapiens
uauaagccuuccaaaguca

SEQ ID NO: 1030704 - RNA, 19 nt, Homo sapiens
aagaauaagagaagcagua

SEQ ID NO: 1030705 - RNA, 19 nt, Homo sapiens
cagaaggcuuggagggaaa

SEQ ID NO: 1030706 - RNA, 19 nt, Homo sapiens
gaaacggggugauagugaa

SEQ ID NO: 1030707 - RNA, 19 nt, Homo sapiens
aaucaaagcagccuaucaa

SEQ ID NO: 1030708 - RNA, 19 nt, Homo sapiens
ugauagccauucucacuca

SEQ ID NO: 1030709 - RNA, 19 nt, Homo sapiens
gaaauccuccagcucgaau

SEQ ID NO: 1030710 - RNA, 19 nt, Homo sapiens
ugcuaaagcuguaaguaug

SEQ ID NO: 1030711 - RNA, 19 nt, Homo sapiens
gagaaaggacaucuauuuu

SEQ ID NO: 1030712 - RNA, 19 nt, Homo sapiens
gugaagcaauugccuaugc

SEQ ID NO: 1030713 - RNA, 19 nt, Homo sapiens
gaauaagagaagcaguaaa

SEQ ID NO: 1030714 - RNA, 19 nt, Homo sapiens
gaaucaaagcagccuauca

SEQ ID NO: 1030715 - RNA, 19 nt, Homo sapiens
cagacacaguuaugcagaa

SEQ ID NO: 1030716 - RNA, 19 nt, Homo sapiens
guauggagaaacccucuaa

SEQ ID NO: 1030717 - RNA, 19 nt, Homo sapiens
ggagagauaccaauguacu

SEQ ID NO: 1030718 - RNA, 19 nt, Homo sapiens
caggagaaacaauuuauag

SEQ ID NO: 1030719 - RNA, 19 nt, Homo sapiens
gagauacacuugggugacu

SEQ ID NO: 1030720 - RNA, 19 nt, Homo sapiens
guacaugggaaggcacuuu

SEQ ID NO: 1030721 - RNA, 19 nt, Homo sapiens
ggugguacuuccauaagca

SEQ ID NO: 1030722 - RNA, 19 nt, Homo sapiens
ccauuucacagcaggauuu

SEQ ID NO: 1030723 - RNA, 19 nt, Homo sapiens
aagcacagcagaaauuaau

SEQ ID NO: 1030724 - RNA, 19 nt, Homo sapiens
ccagaaacagccuccagaa

SEQ ID NO: 1030725 - RNA, 19 nt, Homo sapiens
uuaagcacagcagaaauua

SEQ ID NO: 1030726 - RNA, 19 nt, Homo sapiens
uauuguagaugcugaaagg

SEQ ID NO: 1030727 - RNA, 19 nt, Homo sapiens
uaaagagccacuuacauac

SEQ ID NO: 1030728 - RNA, 19 nt, Homo sapiens
ggagcagaauauaggagau

SEQ ID NO: 1030729 - RNA, 19 nt, Homo sapiens
aauguaagguauggagaaa

SEQ ID NO: 1030730 - RNA, 19 nt, Homo sapiens
gaauuugucagaauguaag

SEQ ID NO: 1030731 - RNA, 19 nt, Homo sapiens
gagagcagcauuucagaac

SEQ ID NO: 1030732 - RNA, 19 nt, Homo sapiens
aagaaaccaucucugaucu

SEQ ID NO: 1030733 - RNA, 19 nt, Homo sapiens
gaggcugugugagaauuug

SEQ ID NO: 1030734 - RNA, 19 nt, Homo sapiens
aaagucagcagcaaucugu

SEQ ID NO: 1030735 - RNA, 19 nt, Homo sapiens
cagcaugaagcucaacuga

SEQ ID NO: 1030736 - RNA, 19 nt, Homo sapiens
gcaguaggcuuggcaguua

SEQ ID NO: 1030737 - RNA, 19 nt, Homo sapiens
caacauugcuucaaagaug

SEQ ID NO: 1030738 - RNA, 19 nt, Homo sapiens
aagcaucucuuucuuguua

SEQ ID NO: 1030739 - RNA, 19 nt, Homo sapiens
gugaagcucucccguauuu

SEQ ID NO: 1030740 - RNA, 19 nt, Homo sapiens
ucauagagcuguggaauuu

SEQ ID NO: 1030741 - RNA, 19 nt, Homo sapiens
ggacagggcauauuacuga

SEQ ID NO: 1030742 - RNA, 19 nt, Homo sapiens
gagaaacccucuaaaucuu

SEQ ID NO: 1030743 - RNA, 19 nt, Homo sapiens
gaaccagccuugcgaacuu

SEQ ID NO: 1030744 - RNA, 19 nt, Homo sapiens
ggaagcaucucuuucuugu

SEQ ID NO: 1030745 - RNA, 19 nt, Homo sapiens
gacaaggacuguuucagaa

SEQ ID NO: 1030746 - RNA, 19 nt, Homo sapiens
cagcuuagccuuucuguuu

SEQ ID NO: 1030747 - RNA, 19 nt, Homo sapiens
gaagucaagucaccgcauu

SEQ ID NO: 1030748 - RNA, 19 nt, Homo sapiens
ggacaacuguagaugaaau

SEQ ID NO: 1030749 - RNA, 19 nt, Homo sapiens
gcacagagacggcugauag

SEQ ID NO: 1030750 - RNA, 19 nt, Homo sapiens
ggagaaacccucuaaaucu

SEQ ID NO: 1030751 - RNA, 19 nt, Homo sapiens
gaaaccagcagacagaauu

SEQ ID NO: 1030752 - RNA, 19 nt, Homo sapiens
ggaauuuaauccucauguu

SEQ ID NO: 1030753 - RNA, 19 nt, Homo sapiens
gaaacagccuccagaagag

SEQ ID NO: 1030754 - RNA, 19 nt, Homo sapiens
ccaccaaggccaucaauaa

SEQ ID NO: 1030755 - RNA, 19 nt, Homo sapiens
gaacagcaucuauaaagug

SEQ ID NO: 1030756 - RNA, 19 nt, Homo sapiens
gagauaauauaagccauga

SEQ ID NO: 1030757 - RNA, 19 nt, Homo sapiens
gaacagagagcagcauuuc

SEQ ID NO: 1030758 - RNA, 19 nt, Homo sapiens
agagaaaggacaucuauuu

SEQ ID NO: 1030759 - RNA, 19 nt, Homo sapiens
gaauauaggagauacacuu

SEQ ID NO: 1030760 - RNA, 19 nt, Homo sapiens
ggagaaugcuugccuugca

SEQ ID NO: 1030761 - RNA, 19 nt, Homo sapiens
ccaccgagaugcucagaga

SEQ ID NO: 1030762 - RNA, 19 nt, Homo sapiens
acacuugggugacugguaa

SEQ ID NO: 1030763 - RNA, 19 nt, Homo sapiens
gcucagagauaauauaagc

SEQ ID NO: 1030764 - RNA, 19 nt, Homo sapiens
gagaugcucagagauaaua

SEQ ID NO: 1030765 - RNA, 19 nt, Homo sapiens
gcacauccagaaugacuaa

SEQ ID NO: 1030766 - RNA, 19 nt, Homo sapiens
auccaaagcucuccaguuu

SEQ ID NO: 1030767 - RNA, 19 nt, Homo sapiens
cuaugugucuguauaugua

SEQ ID NO: 1030768 - RNA, 19 nt, Homo sapiens
gaaaggacaucuauuuuac

SEQ ID NO: 1030769 - RNA, 19 nt, Homo sapiens
gaauauaagccuuccaaag

SEQ ID NO: 1030770 - RNA, 19 nt, Homo sapiens
caggauugcuuacggagaa

SEQ ID NO: 1030771 - RNA, 19 nt, Homo sapiens
uauccaacauugcuucaaa

SEQ ID NO: 1030772 - RNA, 19 nt, Homo sapiens
ccacaggucaugagcagua

SEQ ID NO: 1030773 - RNA, 19 nt, Homo sapiens
uuaccuaccuuucaucaug

SEQ ID NO: 1030774 - RNA, 19 nt, Homo sapiens
ucagggacagggcauauua

SEQ ID NO: 1030775 - RNA, 19 nt, Homo sapiens
auagagcuguggaauuuaa

SEQ ID NO: 1030776 - RNA, 19 nt, Homo sapiens
uuccagugcuucucucuua

SEQ ID NO: 1030777 - RNA, 19 nt, Homo sapiens
agaaacagccuccagaaga

SEQ ID NO: 1030778 - RNA, 19 nt, Homo sapiens
guacuggaucgaaaucuaa

SEQ ID NO: 1030779 - RNA, 19 nt, Homo sapiens
gauuaaagccagacccuau

SEQ ID NO: 1030780 - RNA, 19 nt, Homo sapiens
gcuauuaccuaccuuucau

SEQ ID NO: 1030781 - RNA, 19 nt, Homo sapiens
gaauuuaauccucauguuc

SEQ ID NO: 1030782 - RNA, 19 nt, Homo sapiens
gaagcucucccguauuuca

SEQ ID NO: 1030783 - RNA, 19 nt, Homo sapiens
gguaauucuucaccacuga

SEQ ID NO: 1030784 - RNA, 19 nt, Homo sapiens
ccacucugcuuugauggua

SEQ ID NO: 1030785 - RNA, 19 nt, Homo sapiens
gaugaaauugucuuccuuu

SEQ ID NO: 1030786 - RNA, 19 nt, Homo sapiens
ggauuaagcacagcagaaa

SEQ ID NO: 1030787 - RNA, 19 nt, Homo sapiens
gagcagaauauaggagaua

SEQ ID NO: 1030788 - RNA, 19 nt, Homo sapiens
gaauguaagguauggagaa

SEQ ID NO: 1030789 - RNA, 19 nt, Homo sapiens
gagaggaggaugagcagaa

SEQ ID NO: 1030790 - RNA, 19 nt, Homo sapiens
gauaauauaagccaugagu

SEQ ID NO: 1030791 - RNA, 19 nt, Homo sapiens
aaggacaacuguagaugaa

SEQ ID NO: 1030792 - RNA, 19 nt, Homo sapiens
guugugaggauuacauaua

SEQ ID NO: 1030793 - RNA, 19 nt, Homo sapiens
aagagccacuuacauacua

SEQ ID NO: 1030794 - RNA, 19 nt, Homo sapiens
gcucucccguauuucauuu

SEQ ID NO: 1030795 - RNA, 19 nt, Homo sapiens
gagaauacacaggauuuga

SEQ ID NO: 1030796 - RNA, 19 nt, Homo sapiens
aauauaagccuuccaaagu

SEQ ID NO: 1030797 - RNA, 19 nt, Homo sapiens
gaauuuggcagcggauauu

SEQ ID NO: 1030798 - RNA, 19 nt, Homo sapiens
ucaauucacuguagcaacu

SEQ ID NO: 1030799 - RNA, 19 nt, Homo sapiens
gaauggaagugagcaaagg

SEQ ID NO: 1030800 - RNA, 19 nt, Homo sapiens
cuccaucgauauacucaua

SEQ ID NO: 1030801 - RNA, 19 nt, Homo sapiens
uaucccagcugcacagaga

SEQ ID NO: 1030802 - RNA, 19 nt, Homo sapiens
gcagcacuguugaagacaa

SEQ ID NO: 1030803 - RNA, 19 nt, Homo sapiens
cagaauuugucagaaugua

SEQ ID NO: 1030804 - RNA, 19 nt, Homo sapiens
cuaauaaagccaccacuug

SEQ ID NO: 1030805 - RNA, 19 nt, Homo sapiens
uguagcaacugugauauau

SEQ ID NO: 1030806 - RNA, 19 nt, Homo sapiens
ccgagaugcucagagauaa

SEQ ID NO: 1030807 - RNA, 19 nt, Homo sapiens
agaaauuaaugccguggaa

SEQ ID NO: 1030808 - RNA, 19 nt, Homo sapiens
caaagcagccuaucaagcu

SEQ ID NO: 1030809 - RNA, 19 nt, Homo sapiens
ggaacagagagcagcauuu

SEQ ID NO: 1030810 - RNA, 19 nt, Homo sapiens
gaucgaaaucuaauugcuu

SEQ ID NO: 1030811 - RNA, 19 nt, Homo sapiens
gaggauuacauauaugcua

SEQ ID NO: 1030812 - RNA, 19 nt, Homo sapiens
gaagaccuagguuugaguu

SEQ ID NO: 1030813 - RNA, 19 nt, Homo sapiens
cauucucacucaccaguuu

SEQ ID NO: 1030814 - RNA, 19 nt, Homo sapiens
agacaaggacuguuucaga

SEQ ID NO: 1030815 - RNA, 19 nt, Homo sapiens
cagcagcacuguugaagac

SEQ ID NO: 1030816 - RNA, 19 nt, Homo sapiens
gaaacccucuaaaucuuuu

SEQ ID NO: 1030817 - RNA, 19 nt, Homo sapiens
gagcagcauuucagaacca

SEQ ID NO: 1030818 - RNA, 19 nt, Homo sapiens
guucucuggugcuguaauu

SEQ ID NO: 1030819 - RNA, 19 nt, Homo sapiens
gauauuccuugauuaaagc

SEQ ID NO: 1030820 - RNA, 19 nt, Homo sapiens
cagccacucugcuuugaug

SEQ ID NO: 1030821 - RNA, 19 nt, Homo sapiens
ccaaagcucuccaguuuuc

SEQ ID NO: 1030822 - RNA, 19 nt, Homo sapiens
cagcugcuccaucgauaua

SEQ ID NO: 1030823 - RNA, 19 nt, Homo sapiens
ugaacagcaucuauaaagu

SEQ ID NO: 1030824 - RNA, 19 nt, Homo sapiens
caugugaccuuggacaaau

SEQ ID NO: 1030825 - RNA, 19 nt, Homo sapiens
gagcgucuccugcaucugu

SEQ ID NO: 1030826 - RNA, 19 nt, Homo sapiens
guaaugugacuuuguagau

SEQ ID NO: 1030827 - RNA, 19 nt, Homo sapiens
gcuaaagcauuuugcauau

SEQ ID NO: 1030828 - RNA, 19 nt, Homo sapiens
gaagacaaggacuguuuca

SEQ ID NO: 1030829 - RNA, 19 nt, Homo sapiens
uauaagccuuccaaaguca

SEQ ID NO: 1030830 - RNA, 19 nt, Homo sapiens
cagaaggcuuggagggaaa

SEQ ID NO: 1030831 - RNA, 19 nt, Homo sapiens
gagaaagaacucuaauguc

SEQ ID NO: 1030832 - RNA, 19 nt, Homo sapiens
cagcaucuauaaagugaca

SEQ ID NO: 1030833 - RNA, 19 nt, Homo sapiens
gaagucagaagaccuaggu

SEQ ID NO: 1030834 - RNA, 19 nt, Homo sapiens
aaucaaagcagccuaucaa

SEQ ID NO: 1030835 - RNA, 19 nt, Homo sapiens
ccaaggccaucaauaacca

SEQ ID NO: 1030836 - RNA, 19 nt, Homo sapiens
gaagugagauuccgaaaga

SEQ ID NO: 1030837 - RNA, 19 nt, Homo sapiens
gaaaggacacuauuacaua

SEQ ID NO: 1030838 - RNA, 19 nt, Homo sapiens
gaaaguggcuaugauguuu

SEQ ID NO: 1030839 - RNA, 19 nt, Homo sapiens
uaacaucacugaagagaaa

SEQ ID NO: 1030840 - RNA, 19 nt, Homo sapiens
ggaaagaaauccagagaug

SEQ ID NO: 1030841 - RNA, 19 nt, Homo sapiens
ccaaagacgucacagauaa

SEQ ID NO: 1030842 - RNA, 19 nt, Homo sapiens
gaaaggaaaucaggacaaa

SEQ ID NO: 1030843 - RNA, 19 nt, Homo sapiens
ccaaauggcuucagugcua

SEQ ID NO: 1030844 - RNA, 19 nt, Homo sapiens
ggacuaacaucacugaaga

SEQ ID NO: 1030845 - RNA, 19 nt, Homo sapiens
gaaggcacuuggugauaua

SEQ ID NO: 1030846 - RNA, 19 nt, Homo sapiens
guaaggagcuguuagaucu

SEQ ID NO: 1030847 - RNA, 19 nt, Homo sapiens
cuaaagggcuccauccuaa

SEQ ID NO: 1030848 - RNA, 19 nt, Homo sapiens
ccauagagauuacuaaaga

SEQ ID NO: 1030849 - RNA, 19 nt, Homo sapiens
ccaccaagcucuauauuuc

SEQ ID NO: 1030850 - RNA, 19 nt, Homo sapiens
ccaguaguguguaauauaa

SEQ ID NO: 1030851 - RNA, 19 nt, Homo sapiens
gaaccgaguuucaaagcaa

SEQ ID NO: 1030852 - RNA, 19 nt, Homo sapiens
ggauguagaugcuuccaaa

SEQ ID NO: 1030853 - RNA, 19 nt, Homo sapiens
gaacagaacgaaagugaga

SEQ ID NO: 1030854 - RNA, 19 nt, Homo sapiens
gaaauuguccgacuacuuc

SEQ ID NO: 1030855 - RNA, 19 nt, Homo sapiens
gagaagaaccagaugcuaa

SEQ ID NO: 1030856 - RNA, 19 nt, Homo sapiens
ggaaacaucgucuauucua

SEQ ID NO: 1030857 - RNA, 19 nt, Homo sapiens
ggaaggcacuuggugauau

SEQ ID NO: 1030858 - RNA, 19 nt, Homo sapiens
gcacacaugcuuugggaua

SEQ ID NO: 1030859 - RNA, 19 nt, Homo sapiens
ggaaaauccuuguaaauga

SEQ ID NO: 1030860 - RNA, 19 nt, Homo sapiens
gcacggagacuuauuguca

SEQ ID NO: 1030861 - RNA, 19 nt, Homo sapiens
gaaaccacaccauccguua

SEQ ID NO: 1030862 - RNA, 19 nt, Homo sapiens
caucuaagcuggcaaagag

SEQ ID NO: 1030863 - RNA, 19 nt, Homo sapiens
gggaaagguugaaaggaaa

SEQ ID NO: 1030864 - RNA, 19 nt, Homo sapiens
gguaaaugcuauuggaugu

SEQ ID NO: 1030865 - RNA, 19 nt, Homo sapiens
ugagaacgaucacuuggaa

SEQ ID NO: 1030866 - RNA, 19 nt, Homo sapiens
ggaaaugguugugcuaucu

SEQ ID NO: 1030867 - RNA, 19 nt, Homo sapiens
gaaacuagcagcaccaagu

SEQ ID NO: 1030868 - RNA, 19 nt, Homo sapiens
ggacugggcucagagaaag

SEQ ID NO: 1030869 - RNA, 19 nt, Homo sapiens
gcuuggaaauguacauaaa

SEQ ID NO: 1030870 - RNA, 19 nt, Homo sapiens
guaauccaguaguguguaa

SEQ ID NO: 1030871 - RNA, 19 nt, Homo sapiens
gaaaauguccucccgcaua

SEQ ID NO: 1030872 - RNA, 19 nt, Homo sapiens
gaaacaucgucuauucuag

SEQ ID NO: 1030873 - RNA, 19 nt, Homo sapiens
guaaagaaaggacacuauu

SEQ ID NO: 1030874 - RNA, 19 nt, Homo sapiens
gcacgaugcuguugagaac

SEQ ID NO: 1030875 - RNA, 19 nt, Homo sapiens
cuauagaucugaaaucauc

SEQ ID NO: 1030876 - RNA, 19 nt, Homo sapiens
cagcucaccuccucuguug

SEQ ID NO: 1030877 - RNA, 19 nt, Homo sapiens
caacaucaauggugcuagu

SEQ ID NO: 1030878 - RNA, 19 nt, Homo sapiens
gagguugcuuggaaaugua

SEQ ID NO: 1030879 - RNA, 19 nt, Homo sapiens
agaaauuacuccagucaga

SEQ ID NO: 1030880 - RNA, 19 nt, Homo sapiens
gcgcugaugucaacuguag

SEQ ID NO: 1030881 - RNA, 19 nt, Homo sapiens
caaugcagauggcaccaaa

SEQ ID NO: 1030882 - RNA, 19 nt, Homo sapiens
ccagguaaaugcuauugga

SEQ ID NO: 1030883 - RNA, 19 nt, Homo sapiens
cggauguccuuaagaaauu

SEQ ID NO: 1030884 - RNA, 19 nt, Homo sapiens
cagaagaccaggaugauga

SEQ ID NO: 1030885 - RNA, 19 nt, Homo sapiens
gaagcacggagacuuauug

SEQ ID NO: 1030886 - RNA, 19 nt, Homo sapiens
gcaccgugaucccuuugaa

SEQ ID NO: 1030887 - RNA, 19 nt, Homo sapiens
gcagauggaaggauuacaa

SEQ ID NO: 1030888 - RNA, 19 nt, Homo sapiens
ccacacacaacaacuaauu

SEQ ID NO: 1030889 - RNA, 19 nt, Homo sapiens
ggaagagaaucccuugaac

SEQ ID NO: 1030890 - RNA, 19 nt, Homo sapiens
auacaaagcucugaugaca

SEQ ID NO: 1030891 - RNA, 19 nt, Homo sapiens
gaaauuacuccagucagaa

SEQ ID NO: 1030892 - RNA, 19 nt, Homo sapiens
uguuagaucugguggaauu

SEQ ID NO: 1030893 - RNA, 19 nt, Homo sapiens
gcgauguguuugaauuuga

SEQ ID NO: 1030894 - RNA, 19 nt, Homo sapiens
ugggaaagguugaaaggaa

SEQ ID NO: 1030895 - RNA, 19 nt, Homo sapiens
ggagaucccggucccauga

SEQ ID NO: 1030896 - RNA, 19 nt, Homo sapiens
guccagaguuugugaccua

SEQ ID NO: 1030897 - RNA, 19 nt, Homo sapiens
gaagcagaccguuaccaaa

SEQ ID NO: 1030898 - RNA, 19 nt, Homo sapiens
cgggaaacaucgucuauuc

SEQ ID NO: 1030899 - RNA, 19 nt, Homo sapiens
caucaauggugcuaguuau

SEQ ID NO: 1030900 - RNA, 19 nt, Homo sapiens
gaacgaucacuuggaaauu

SEQ ID NO: 1030901 - RNA, 19 nt, Homo sapiens
cagccagucuucaccguaa

SEQ ID NO: 1030902 - RNA, 19 nt, Homo sapiens
gaaaugguugugcuaucua

SEQ ID NO: 1030903 - RNA, 19 nt, Homo sapiens
gaagacagcgguucaagac

SEQ ID NO: 1030904 - RNA, 19 nt, Homo sapiens
gcuguuagaucugguggaa

SEQ ID NO: 1030905 - RNA, 19 nt, Homo sapiens
aagaagacuuugagcuauu

SEQ ID NO: 1030906 - RNA, 19 nt, Homo sapiens
gcuccacacuuugacuuaa

SEQ ID NO: 1030907 - RNA, 19 nt, Homo sapiens
ugaaccagaugaugaaagu

SEQ ID NO: 1030908 - RNA, 19 nt, Homo sapiens
ggaaauuguccgacuacuu

SEQ ID NO: 1030909 - RNA, 19 nt, Homo sapiens
gagaagccauccgggaaga

SEQ ID NO: 1030910 - RNA, 19 nt, Homo sapiens
caagcaccgugaucccuuu

SEQ ID NO: 1030911 - RNA, 19 nt, Homo sapiens
ggagaugaaagaaagagaa

SEQ ID NO: 1030912 - RNA, 19 nt, Homo sapiens
caaagagaaucgccaacuc

SEQ ID NO: 1030913 - RNA, 19 nt, Homo sapiens
ggaagacagcgguucaaga

SEQ ID NO: 1030914 - RNA, 19 nt, Homo sapiens
caaaccauauccacacaca

SEQ ID NO: 1030915 - RNA, 19 nt, Homo sapiens
ugcgacaccuccuugaaua

SEQ ID NO: 1030916 - RNA, 19 nt, Homo sapiens
cagcugccaugcucaaguu

SEQ ID NO: 1030917 - RNA, 19 nt, Homo sapiens
ggaggaggccauugcagaa

SEQ ID NO: 1030918 - RNA, 19 nt, Homo sapiens
cuucagugcuauauacaaa

SEQ ID NO: 1030919 - RNA, 19 nt, Homo sapiens
agaagacuuugagcuauuu

SEQ ID NO: 1030920 - RNA, 19 nt, Homo sapiens
ccggauuguuuauauguuu

SEQ ID NO: 1030921 - RNA, 19 nt, Homo sapiens
ccaaacagcagaaaauuaa

SEQ ID NO: 1030922 - RNA, 19 nt, Homo sapiens
gagaacggccuuccaccaa

SEQ ID NO: 1030923 - RNA, 19 nt, Homo sapiens
uuccaaagcugaccacaug

SEQ ID NO: 1030924 - RNA, 19 nt, Homo sapiens
ggacacuauuacauaugaa

SEQ ID NO: 1030925 - RNA, 19 nt, Homo sapiens
cgaacgaaauucagacucu

SEQ ID NO: 1030926 - RNA, 19 nt, Homo sapiens
guuauaacauccaaguauc

SEQ ID NO: 1030927 - RNA, 19 nt, Homo sapiens
gaugaaaguggcuaugaug

SEQ ID NO: 1030928 - RNA, 19 nt, Homo sapiens
gaauauggcgcugauguca

SEQ ID NO: 1030929 - RNA, 19 nt, Homo sapiens
ccaagaggaucccaaacca

SEQ ID NO: 1030930 - RNA, 19 nt, Homo sapiens
gcagguaccaacaaagaga

SEQ ID NO: 1030931 - RNA, 19 nt, Homo sapiens
cuaaagugguggauguaga

SEQ ID NO: 1030932 - RNA, 19 nt, Homo sapiens
cagaaggacuuagaaacau

SEQ ID NO: 1030933 - RNA, 19 nt, Homo sapiens
acaguguguuauaguguua

SEQ ID NO: 1030934 - RNA, 19 nt, Homo sapiens
gaccagaagaccaggauga

SEQ ID NO: 1030935 - RNA, 19 nt, Homo sapiens
gcacuugggacuucuaugg

SEQ ID NO: 1030936 - RNA, 19 nt, Homo sapiens
gaagugagauuccgaaaga

SEQ ID NO: 1030937 - RNA, 19 nt, Homo sapiens
ggaaagaaauccagagaug

SEQ ID NO: 1030938 - RNA, 19 nt, Homo sapiens
ccaaagacgucacagauaa

SEQ ID NO: 1030939 - RNA, 19 nt, Homo sapiens
ccaaauggcuucagugcua

SEQ ID NO: 1030940 - RNA, 19 nt, Homo sapiens
gaaugaagcuugugguaau

SEQ ID NO: 1030941 - RNA, 19 nt, Homo sapiens
uagaaugccuuacuugaua

SEQ ID NO: 1030942 - RNA, 19 nt, Homo sapiens
ccauagagauuacuaaaga

SEQ ID NO: 1030943 - RNA, 19 nt, Homo sapiens
ccaccaagcucuauauuuc

SEQ ID NO: 1030944 - RNA, 19 nt, Homo sapiens
gcaaauauaccuagaagug

SEQ ID NO: 1030945 - RNA, 19 nt, Homo sapiens
gaaccgaguuucaaagcaa

SEQ ID NO: 1030946 - RNA, 19 nt, Homo sapiens
ggauguagaugcuuccaaa

SEQ ID NO: 1030947 - RNA, 19 nt, Homo sapiens
gagaagaaccagaugcuaa

SEQ ID NO: 1030948 - RNA, 19 nt, Homo sapiens
ggaaacaucgucuauucua

SEQ ID NO: 1030949 - RNA, 19 nt, Homo sapiens
ggaaaauccuuguaaauga

SEQ ID NO: 1030950 - RNA, 19 nt, Homo sapiens
uaagggaacuccacucaau

SEQ ID NO: 1030951 - RNA, 19 nt, Homo sapiens
gaaaccacaccauccguua

SEQ ID NO: 1030952 - RNA, 19 nt, Homo sapiens
caucuaagcuggcaaagag

SEQ ID NO: 1030953 - RNA, 19 nt, Homo sapiens
uaagagaacgugaguggua

SEQ ID NO: 1030954 - RNA, 19 nt, Homo sapiens
ggaaaugguugugcuaucu

SEQ ID NO: 1030955 - RNA, 19 nt, Homo sapiens
gcaugacguuuaccuauca

SEQ ID NO: 1030956 - RNA, 19 nt, Homo sapiens
gaaacuagcagcaccaagu

SEQ ID NO: 1030957 - RNA, 19 nt, Homo sapiens
ggacugggcucagagaaag

SEQ ID NO: 1030958 - RNA, 19 nt, Homo sapiens
gaaacaucgucuauucuag

SEQ ID NO: 1030959 - RNA, 19 nt, Homo sapiens
cuauagaucugaaaucauc

SEQ ID NO: 1030960 - RNA, 19 nt, Homo sapiens
cagcucaccuccucuguug

SEQ ID NO: 1030961 - RNA, 19 nt, Homo sapiens
caacaucaauggugcuagu

SEQ ID NO: 1030962 - RNA, 19 nt, Homo sapiens
uagaagugcugcuuagaau

SEQ ID NO: 1030963 - RNA, 19 nt, Homo sapiens
ccuguaagauagcaaauau

SEQ ID NO: 1030964 - RNA, 19 nt, Homo sapiens
caaugcagauggcaccaaa

SEQ ID NO: 1030965 - RNA, 19 nt, Homo sapiens
ucaguuacuuuaccaguug

SEQ ID NO: 1030966 - RNA, 19 nt, Homo sapiens
gauagcaaauauaccuaga

SEQ ID NO: 1030967 - RNA, 19 nt, Homo sapiens
gcugauaaccgauguuuua

SEQ ID NO: 1030968 - RNA, 19 nt, Homo sapiens
ggagaucccggucccauga

SEQ ID NO: 1030969 - RNA, 19 nt, Homo sapiens
guccagaguuugugaccua

SEQ ID NO: 1030970 - RNA, 19 nt, Homo sapiens
gaagcagaccguuaccaaa

SEQ ID NO: 1030971 - RNA, 19 nt, Homo sapiens
cgggaaacaucgucuauuc

SEQ ID NO: 1030972 - RNA, 19 nt, Homo sapiens
ggaagagaaucccuugaac

SEQ ID NO: 1030973 - RNA, 19 nt, Homo sapiens
caucaauggugcuaguuau

SEQ ID NO: 1030974 - RNA, 19 nt, Homo sapiens
cagccagucuucaccguaa

SEQ ID NO: 1030975 - RNA, 19 nt, Homo sapiens
gaaaugguugugcuaucua

SEQ ID NO: 1030976 - RNA, 19 nt, Homo sapiens
gaagacagcgguucaagac

SEQ ID NO: 1030977 - RNA, 19 nt, Homo sapiens
aggcagauuuggugaauga

SEQ ID NO: 1030978 - RNA, 19 nt, Homo sapiens
caaagagaaucgccaacuc

SEQ ID NO: 1030979 - RNA, 19 nt, Homo sapiens
ggaagacagcgguucaaga

SEQ ID NO: 1030980 - RNA, 19 nt, Homo sapiens
cuucagugcuauauacaaa

SEQ ID NO: 1030981 - RNA, 19 nt, Homo sapiens
uaugcaauguggccaguaa

SEQ ID NO: 1030982 - RNA, 19 nt, Homo sapiens
gagaacggccuuccaccaa

SEQ ID NO: 1030983 - RNA, 19 nt, Homo sapiens
uuccaaagcugaccacaug

SEQ ID NO: 1030984 - RNA, 19 nt, Homo sapiens
ccaagaggaucccaaacca

SEQ ID NO: 1030985 - RNA, 19 nt, Homo sapiens
gcagguaccaacaaagaga

SEQ ID NO: 1030986 - RNA, 19 nt, Homo sapiens
cuaaagugguggauguaga

SEQ ID NO: 1030987 - RNA, 19 nt, Homo sapiens
uagcaaauauaccuagaag

SEQ ID NO: 1030988 - RNA, 19 nt, Homo sapiens
agggaagacuguugucaaa

SEQ ID NO: 1030989 - RNA, 19 nt, Homo sapiens
gcucuccaauggcaaguau

SEQ ID NO: 1030990 - RNA, 19 nt, Homo sapiens
ggugaccgauucaaaugug

SEQ ID NO: 1030991 - RNA, 19 nt, Homo sapiens
ugaaaccgaagccaucuaa

SEQ ID NO: 1030992 - RNA, 19 nt, Homo sapiens
ccaaagauggagcugauga

SEQ ID NO: 1030993 - RNA, 19 nt, Homo sapiens
aaagacugcaugacguuua

SEQ ID NO: 1030994 - RNA, 19 nt, Homo sapiens
uuacgugggugaccgauuc

SEQ ID NO: 1030995 - RNA, 19 nt, Homo sapiens
cuauauuucugucuccaaa

SEQ ID NO: 1030996 - RNA, 19 nt, Homo sapiens
ugucaucacuaacguuuca

SEQ ID NO: 1030997 - RNA, 19 nt, Homo sapiens
gaaauccagagaugcaguu

SEQ ID NO: 1030998 - RNA, 19 nt, Homo sapiens
ugugaaggguaucuaaaga

SEQ ID NO: 1030999 - RNA, 19 nt, Homo sapiens
gcagcaccgugauuucauc

SEQ ID NO: 1031000 - RNA, 19 nt, Homo sapiens
gcaaaagcaugucgcugaa

SEQ ID NO: 1031001 - RNA, 19 nt, Homo sapiens
cagauaagccacuagacuu

SEQ ID NO: 1031002 - RNA, 19 nt, Homo sapiens
caaaacaccgccuggaaua

SEQ ID NO: 1031003 - RNA, 19 nt, Homo sapiens
gaagugcugcuuagaaugc

SEQ ID NO: 1031004 - RNA, 19 nt, Homo sapiens
gacguuuaccuaucaauug

SEQ ID NO: 1031005 - RNA, 19 nt, Homo sapiens
uaccaaagauggagcugau

SEQ ID NO: 1031006 - RNA, 19 nt, Homo sapiens
agaagaaccagaugcuaaa

SEQ ID NO: 1031007 - RNA, 19 nt, Homo sapiens
caaagcugaccacaugaaa

SEQ ID NO: 1031008 - RNA, 19 nt, Homo sapiens
gcuuuaaguuauucuguag

SEQ ID NO: 1031009 - RNA, 19 nt, Homo sapiens
ggaaucaagggaagacugu

SEQ ID NO: 1031010 - RNA, 19 nt, Homo sapiens
ggccaaguccuaacgaaga

SEQ ID NO: 1031011 - RNA, 19 nt, Homo sapiens
caaauggcuucagugcuau

SEQ ID NO: 1031012 - RNA, 19 nt, Homo sapiens
aggcgugucuggaugcuuu

SEQ ID NO: 1031013 - RNA, 19 nt, Homo sapiens
ugaaugaagcuugugguaa

SEQ ID NO: 1031014 - RNA, 19 nt, Homo sapiens
ggaagacuguugucaaaag

SEQ ID NO: 1031015 - RNA, 19 nt, Homo sapiens
ccacacacgcccauagaga

SEQ ID NO: 1031016 - RNA, 19 nt, Homo sapiens
gaacugagggaagagaauc

SEQ ID NO: 1031017 - RNA, 19 nt, Homo sapiens
ugaagcuugugguaauuug

SEQ ID NO: 1031018 - RNA, 19 nt, Homo sapiens
ccaggcagauuuggugaau

SEQ ID NO: 1031019 - RNA, 19 nt, Homo sapiens
gcccauagagauuacuaaa

SEQ ID NO: 1031020 - RNA, 19 nt, Homo sapiens
ugucuacccucacccaguu

SEQ ID NO: 1031021 - RNA, 19 nt, Homo sapiens
cagcaggagcucuguagaa

SEQ ID NO: 1031022 - RNA, 19 nt, Homo sapiens
gacagcgguucaagacaga

SEQ ID NO: 1031023 - RNA, 19 nt, Homo sapiens
ccucacauccagaacagua

SEQ ID NO: 1031024 - RNA, 19 nt, Homo sapiens
caauguggccaguaagaga

SEQ ID NO: 1031025 - RNA, 19 nt, Homo sapiens
gacuggaacugagggaaga

SEQ ID NO: 1031026 - RNA, 19 nt, Homo sapiens
aagaggaucccaaaccauu

SEQ ID NO: 1031027 - RNA, 19 nt, Homo sapiens
agcaggagcucuguagaaa

SEQ ID NO: 1031028 - RNA, 19 nt, Homo sapiens
gcugucaucacuaacguuu

SEQ ID NO: 1031029 - RNA, 19 nt, Homo sapiens
ccgcaugucugugggauuc

SEQ ID NO: 1031030 - RNA, 19 nt, Homo sapiens
gugaaugaagcuuguggua

SEQ ID NO: 1031031 - RNA, 19 nt, Homo sapiens
gaauuucaguuacuuuacc

SEQ ID NO: 1031032 - RNA, 19 nt, Homo sapiens
gcaaagagaaucgccaacu

SEQ ID NO: 1031033 - RNA, 19 nt, Homo sapiens
cuucuaaagugguggaugu

SEQ ID NO: 1031034 - RNA, 19 nt, Homo sapiens
cgccagccaucuacccuuu

SEQ ID NO: 1031035 - RNA, 19 nt, Homo sapiens
ucugugggauucaugcaaa

SEQ ID NO: 1031036 - RNA, 19 nt, Homo sapiens
uaacauagaucgucucuua

SEQ ID NO: 1031037 - RNA, 19 nt, Homo sapiens
gaagauggcucuaggcuaa

SEQ ID NO: 1031038 - RNA, 19 nt, Homo sapiens
gcacaguucucuccaauaa

SEQ ID NO: 1031039 - RNA, 19 nt, Homo sapiens
cgaaagaacuaccuuauug

SEQ ID NO: 1031040 - RNA, 19 nt, Homo sapiens
gaucauacuuguguaguua

SEQ ID NO: 1031041 - RNA, 19 nt, Homo sapiens
gaucgucucuuacugaauu

SEQ ID NO: 1031042 - RNA, 19 nt, Homo sapiens
ccaaaggacugauaaauag

SEQ ID NO: 1031043 - RNA, 19 nt, Homo sapiens
gcuaaagacugguugauga

SEQ ID NO: 1031044 - RNA, 19 nt, Homo sapiens
guaagcaacugaacagauu

SEQ ID NO: 1031045 - RNA, 19 nt, Homo sapiens
gcucuaggcuaaauaguaa

SEQ ID NO: 1031046 - RNA, 19 nt, Homo sapiens
gcuacagucuucuuuauuu

SEQ ID NO: 1031047 - RNA, 19 nt, Homo sapiens
cuacacagcuuaucgauau

SEQ ID NO: 1031048 - RNA, 19 nt, Homo sapiens
ggauagaaaugauaaggaa

SEQ ID NO: 1031049 - RNA, 19 nt, Homo sapiens
cauaguaccuccuguuuga

SEQ ID NO: 1031050 - RNA, 19 nt, Homo sapiens
uuaagucguugcuguauua

SEQ ID NO: 1031051 - RNA, 19 nt, Homo sapiens
gcagcaaguucuuaauauu

SEQ ID NO: 1031052 - RNA, 19 nt, Homo sapiens
ugaagugacugcuguguuu

SEQ ID NO: 1031053 - RNA, 19 nt, Homo sapiens
ucaagaauaucacgacauu

SEQ ID NO: 1031054 - RNA, 19 nt, Homo sapiens
ggaugaaacccauaaauug

SEQ ID NO: 1031055 - RNA, 19 nt, Homo sapiens
aauacgagcugaacaaauu

SEQ ID NO: 1031056 - RNA, 19 nt, Homo sapiens
ucacauuacugaaggaauu

SEQ ID NO: 1031057 - RNA, 19 nt, Homo sapiens
cagcagaucaucaagaaua

SEQ ID NO: 1031058 - RNA, 19 nt, Homo sapiens
ugagugauguagacuauuu

SEQ ID NO: 1031059 - RNA, 19 nt, Homo sapiens
ggaguauccuggagguuaa

SEQ ID NO: 1031060 - RNA, 19 nt, Homo sapiens
uaacagagacccuugaaga

SEQ ID NO: 1031061 - RNA, 19 nt, Homo sapiens
gcacaccuuucaaacauau

SEQ ID NO: 1031062 - RNA, 19 nt, Homo sapiens
caaagaggauggaacacuu

SEQ ID NO: 1031063 - RNA, 19 nt, Homo sapiens
ggacucauauguugaccaa

SEQ ID NO: 1031064 - RNA, 19 nt, Homo sapiens
gaaagaacuaccuuauuga

SEQ ID NO: 1031065 - RNA, 19 nt, Homo sapiens
gaugagugauguagacuau

SEQ ID NO: 1031066 - RNA, 19 nt, Homo sapiens
gcagauggauccaguaggu

SEQ ID NO: 1031067 - RNA, 19 nt, Homo sapiens
gaacaguacccagcucuaa

SEQ ID NO: 1031068 - RNA, 19 nt, Homo sapiens
gcaaauacagccaaacaga

SEQ ID NO: 1031069 - RNA, 19 nt, Homo sapiens
cuacugcccuccgaauuua

SEQ ID NO: 1031070 - RNA, 19 nt, Homo sapiens
ccucaggacucauauguug

SEQ ID NO: 1031071 - RNA, 19 nt, Homo sapiens
ggaagacucaguucaaguu

SEQ ID NO: 1031072 - RNA, 19 nt, Homo sapiens
ggaagcagaacaucuaaga

SEQ ID NO: 1031073 - RNA, 19 nt, Homo sapiens
cgaaagaggaguugacuug

SEQ ID NO: 1031074 - RNA, 19 nt, Homo sapiens
caucuuggcucccgaaauc

SEQ ID NO: 1031075 - RNA, 19 nt, Homo sapiens
ugguucagcuuguauauuu

SEQ ID NO: 1031076 - RNA, 19 nt, Homo sapiens
gaaacucucuaaacaacag

SEQ ID NO: 1031077 - RNA, 19 nt, Homo sapiens
gaacagauugcugggagua

SEQ ID NO: 1031078 - RNA, 19 nt, Homo sapiens
gaauucaggaggacucuuu

SEQ ID NO: 1031079 - RNA, 19 nt, Homo sapiens
uaaagaugcuaauguacga

SEQ ID NO: 1031080 - RNA, 19 nt, Homo sapiens
uaaacaaagugcucuucuu

SEQ ID NO: 1031081 - RNA, 19 nt, Homo sapiens
gcaguuggauagaaaugau

SEQ ID NO: 1031082 - RNA, 19 nt, Homo sapiens
caucaagcauugcacaguu

SEQ ID NO: 1031083 - RNA, 19 nt, Homo sapiens
gcagaacaucuaagaaaga

SEQ ID NO: 1031084 - RNA, 19 nt, Homo sapiens
ggaaguauucagcuaaaga

SEQ ID NO: 1031085 - RNA, 19 nt, Homo sapiens
guucggacuuuguuauuga

SEQ ID NO: 1031086 - RNA, 19 nt, Homo sapiens
gggaguauccuggagguua

SEQ ID NO: 1031087 - RNA, 19 nt, Homo sapiens
gauugcaguuggauagaaa

SEQ ID NO: 1031088 - RNA, 19 nt, Homo sapiens
acaaagugcucuucuugga

SEQ ID NO: 1031089 - RNA, 19 nt, Homo sapiens
uaaaggauuugcugucaca

SEQ ID NO: 1031090 - RNA, 19 nt, Homo sapiens
ggaaggaacaugccaacga

SEQ ID NO: 1031091 - RNA, 19 nt, Homo sapiens
aaacaaagugcucuucuug

SEQ ID NO: 1031092 - RNA, 19 nt, Homo sapiens
ugucacagaugcaucacua

SEQ ID NO: 1031093 - RNA, 19 nt, Homo sapiens
gaaguuguuuauucacauc

SEQ ID NO: 1031094 - RNA, 19 nt, Homo sapiens
gaguggaaguguucaggaa

SEQ ID NO: 1031095 - RNA, 19 nt, Homo sapiens
ggaucauacuuguguaguu

SEQ ID NO: 1031096 - RNA, 19 nt, Homo sapiens
aaaggaaagagccaaauaa

SEQ ID NO: 1031097 - RNA, 19 nt, Homo sapiens
cugaaaggauuuauugaga

SEQ ID NO: 1031098 - RNA, 19 nt, Homo sapiens
cauaaaggauuugcuguca

SEQ ID NO: 1031099 - RNA, 19 nt, Homo sapiens
gaacacuuccaacaaacaa

SEQ ID NO: 1031100 - RNA, 19 nt, Homo sapiens
ucagaacuuugacaucuug

SEQ ID NO: 1031101 - RNA, 19 nt, Homo sapiens
gaauuuaugauccacaaga

SEQ ID NO: 1031102 - RNA, 19 nt, Homo sapiens
guacccagcucuaauuacu

SEQ ID NO: 1031103 - RNA, 19 nt, Homo sapiens
ucuguaagcuccuggauca

SEQ ID NO: 1031104 - RNA, 19 nt, Homo sapiens
ggaaagagccaaauaaaag

SEQ ID NO: 1031105 - RNA, 19 nt, Homo sapiens
gcuacugcccuccgaauuu

SEQ ID NO: 1031106 - RNA, 19 nt, Homo sapiens
gaaggccugucaucuacug

SEQ ID NO: 1031107 - RNA, 19 nt, Homo sapiens
uccaaaggacugauaaaua

SEQ ID NO: 1031108 - RNA, 19 nt, Homo sapiens
gaagugacugcuguguuua

SEQ ID NO: 1031109 - RNA, 19 nt, Homo sapiens
aagaauaucacgacauuga

SEQ ID NO: 1031110 - RNA, 19 nt, Homo sapiens
aagcagaacaucuaagaaa

SEQ ID NO: 1031111 - RNA, 19 nt, Homo sapiens
agauucagauaucguagua

SEQ ID NO: 1031112 - RNA, 19 nt, Homo sapiens
acaguucucuccaauaaca

SEQ ID NO: 1031113 - RNA, 19 nt, Homo sapiens
uccaguagguugagagaaa

SEQ ID NO: 1031114 - RNA, 19 nt, Homo sapiens
acucauauguugaccaaug

SEQ ID NO: 1031115 - RNA, 19 nt, Homo sapiens
gaagacucaguucaaguuu

SEQ ID NO: 1031116 - RNA, 19 nt, Homo sapiens
ggauugcaguuggauagaa

SEQ ID NO: 1031117 - RNA, 19 nt, Homo sapiens
agucauggcuucgaaagaa

SEQ ID NO: 1031118 - RNA, 19 nt, Homo sapiens
gaugaaacccauaaauugg

SEQ ID NO: 1031119 - RNA, 19 nt, Homo sapiens
acaacuagcuacuccuguu

SEQ ID NO: 1031120 - RNA, 19 nt, Homo sapiens
guggaaguauucagcuaaa

SEQ ID NO: 1031121 - RNA, 19 nt, Homo sapiens
ggagguuaaugcaaauaca

SEQ ID NO: 1031122 - RNA, 19 nt, Homo sapiens
ccucaguagucgagaauga

SEQ ID NO: 1031123 - RNA, 19 nt, Homo sapiens
gaaauaaccaagcacaaaa

SEQ ID NO: 1031124 - RNA, 19 nt, Homo sapiens
uguggaaacucucuaaaca

SEQ ID NO: 1031125 - RNA, 19 nt, Homo sapiens
gcugaaagucuuagugaga

SEQ ID NO: 1031126 - RNA, 19 nt, Homo sapiens
ucacagacuuacauuacug

SEQ ID NO: 1031127 - RNA, 19 nt, Homo sapiens
gaacuuugacaucuugcaa

SEQ ID NO: 1031128 - RNA, 19 nt, Homo sapiens
gauuugcuuucucgguuaa

SEQ ID NO: 1031129 - RNA, 19 nt, Homo sapiens
ugauuugcuuucucgguua

SEQ ID NO: 1031130 - RNA, 19 nt, Homo sapiens
cauauuaagugaagugacu

SEQ ID NO: 1031131 - RNA, 19 nt, Homo sapiens
uauaauugaugcacaccuu

SEQ ID NO: 1031132 - RNA, 19 nt, Homo sapiens
gaagcagaacaucuaagaa

SEQ ID NO: 1031133 - RNA, 19 nt, Homo sapiens
gaguugacuuggcuucaga

SEQ ID NO: 1031134 - RNA, 19 nt, Homo sapiens
agaaauaaccaagcacaaa

SEQ ID NO: 1031135 - RNA, 19 nt, Homo sapiens
acagaugcaucacuacaau

SEQ ID NO: 1031136 - RNA, 19 nt, Homo sapiens
gaaauuugauugcccauug

SEQ ID NO: 1031137 - RNA, 19 nt, Homo sapiens
gaaacaugcaucucaaaua

SEQ ID NO: 1031138 - RNA, 19 nt, Homo sapiens
ccaaaucaauucaugcuaa

SEQ ID NO: 1031139 - RNA, 19 nt, Homo sapiens
guacgaaggucaaagaaau

SEQ ID NO: 1031140 - RNA, 19 nt, Homo sapiens
uagaaggucuuuacucuuu

SEQ ID NO: 1031141 - RNA, 19 nt, Homo sapiens
gcacagcuuucuucacaaa

SEQ ID NO: 1031142 - RNA, 19 nt, Homo sapiens
gaagaaggguggaaagaag

SEQ ID NO: 1031143 - RNA, 19 nt, Homo sapiens
ucaaagaaauugucuguuc

SEQ ID NO: 1031144 - RNA, 19 nt, Homo sapiens
ggaggaaccuucucaccuu

SEQ ID NO: 1031145 - RNA, 19 nt, Homo sapiens
gcacagaaucaacaagaua

SEQ ID NO: 1031146 - RNA, 19 nt, Homo sapiens
ucagaaggcuuaucagguu

SEQ ID NO: 1031147 - RNA, 19 nt, Homo sapiens
gaaacucacccauccagua

SEQ ID NO: 1031148 - RNA, 19 nt, Homo sapiens
gagagaaugaucacaauaa

SEQ ID NO: 1031149 - RNA, 19 nt, Homo sapiens
gcacauaaacccagcaaau

SEQ ID NO: 1031150 - RNA, 19 nt, Homo sapiens
caacaucacugcaauacag

SEQ ID NO: 1031151 - RNA, 19 nt, Homo sapiens
ccauuaagcucuccaaaca

SEQ ID NO: 1031152 - RNA, 19 nt, Homo sapiens
uccaaugcaucaacaauua

SEQ ID NO: 1031153 - RNA, 19 nt, Homo sapiens
acaaauagcucuccaaagc

SEQ ID NO: 1031154 - RNA, 19 nt, Homo sapiens
cauaugaccuuagugcuuu

SEQ ID NO: 1031155 - RNA, 19 nt, Homo sapiens
cuaaaggucugccaauuuc

SEQ ID NO: 1031156 - RNA, 19 nt, Homo sapiens
guagucaggugccagcuaa

SEQ ID NO: 1031157 - RNA, 19 nt, Homo sapiens
gaugugaauuccucuaaau

SEQ ID NO: 1031158 - RNA, 19 nt, Homo sapiens
uauguucucugguuaguuu

SEQ ID NO: 1031159 - RNA, 19 nt, Homo sapiens
caacaaauguacguucuuc

SEQ ID NO: 1031160 - RNA, 19 nt, Homo sapiens
guucucagaugcacauaaa

SEQ ID NO: 1031161 - RNA, 19 nt, Homo sapiens
cuaaggaacuggaagacuu

SEQ ID NO: 1031162 - RNA, 19 nt, Homo sapiens
cagucaagaucgaaagaua

SEQ ID NO: 1031163 - RNA, 19 nt, Homo sapiens
auuaagcucuccaaacaua

SEQ ID NO: 1031164 - RNA, 19 nt, Homo sapiens
ggaugugaauuccucuaaa

SEQ ID NO: 1031165 - RNA, 19 nt, Homo sapiens
caaauguacguucuucuuu

SEQ ID NO: 1031166 - RNA, 19 nt, Homo sapiens
gagaguagcagugguggua

SEQ ID NO: 1031167 - RNA, 19 nt, Homo sapiens
guaguucccugccuucugu

SEQ ID NO: 1031168 - RNA, 19 nt, Homo sapiens
cagcaacagugauuucuuc

SEQ ID NO: 1031169 - RNA, 19 nt, Homo sapiens
uaacuucucaucuggagua

SEQ ID NO: 1031170 - RNA, 19 nt, Homo sapiens
gacaagcgccucaaacuca

SEQ ID NO: 1031171 - RNA, 19 nt, Homo sapiens
ccacuguccucacgaguug

SEQ ID NO: 1031172 - RNA, 19 nt, Homo sapiens
cacagcagcuuccaguaaa

SEQ ID NO: 1031173 - RNA, 19 nt, Homo sapiens
ccacagcagcuuccaguaa

SEQ ID NO: 1031174 - RNA, 19 nt, Homo sapiens
guuagaaggucuuuacucu

SEQ ID NO: 1031175 - RNA, 19 nt, Homo sapiens
ucaguggugucgaggauaa

SEQ ID NO: 1031176 - RNA, 19 nt, Homo sapiens
gaaucucacuagcccuaaa

SEQ ID NO: 1031177 - RNA, 19 nt, Homo sapiens
uauaguggcucuacguaau

SEQ ID NO: 1031178 - RNA, 19 nt, Homo sapiens
gaaggucuuuacucuuuag

SEQ ID NO: 1031179 - RNA, 19 nt, Homo sapiens
gcuuggaacccuaugauaa

SEQ ID NO: 1031180 - RNA, 19 nt, Homo sapiens
acauaaacccagcaaauaa

SEQ ID NO: 1031181 - RNA, 19 nt, Homo sapiens
caacugugugucacuaaua

SEQ ID NO: 1031182 - RNA, 19 nt, Homo sapiens
gauuacauguuucaaccuu

SEQ ID NO: 1031183 - RNA, 19 nt, Homo sapiens
cacauaaacccagcaaaua

SEQ ID NO: 1031184 - RNA, 19 nt, Homo sapiens
gcaacugugugucacuaau

SEQ ID NO: 1031185 - RNA, 19 nt, Homo sapiens
ggaaacaugcaucucaaau

SEQ ID NO: 1031186 - RNA, 19 nt, Homo sapiens
aaaggcaccuggcuucaga

SEQ ID NO: 1031187 - RNA, 19 nt, Homo sapiens
uuacgaauccaguuacuuu

SEQ ID NO: 1031188 - RNA, 19 nt, Homo sapiens
ucaggacaccaguaauuua

SEQ ID NO: 1031189 - RNA, 19 nt, Homo sapiens
cauccagugugucugauuu

SEQ ID NO: 1031190 - RNA, 19 nt, Homo sapiens
gcgagagaaugaucacaau

SEQ ID NO: 1031191 - RNA, 19 nt, Homo sapiens
aauguagccuguauuaaug

SEQ ID NO: 1031192 - RNA, 19 nt, Homo sapiens
ucaugugacucuccuauuc

SEQ ID NO: 1031193 - RNA, 19 nt, Homo sapiens
ggaacuggaagacuugauu

SEQ ID NO: 1031194 - RNA, 19 nt, Homo sapiens
gaguagcaguggugguaaa

SEQ ID NO: 1031195 - RNA, 19 nt, Homo sapiens
uggcuaaacauacagaaua

SEQ ID NO: 1031196 - RNA, 19 nt, Homo sapiens
gaagaaccauggggauuuu

SEQ ID NO: 1031197 - RNA, 19 nt, Homo sapiens
gggaucaucuucaccucuu

SEQ ID NO: 1031198 - RNA, 19 nt, Homo sapiens
ugauuuaaguccuauguca

SEQ ID NO: 1031199 - RNA, 19 nt, Homo sapiens
gaaaagacaaguacugcua

SEQ ID NO: 1031200 - RNA, 19 nt, Homo sapiens
agaaggucuuuacucuuua

SEQ ID NO: 1031201 - RNA, 19 nt, Homo sapiens
gcacgugggcaccucauau

SEQ ID NO: 1031202 - RNA, 19 nt, Homo sapiens
gaaaacaugcacccugaua

SEQ ID NO: 1031203 - RNA, 19 nt, Homo sapiens
gguaccaaaugcaacuauu

SEQ ID NO: 1031204 - RNA, 19 nt, Homo sapiens
gauucggcauccucgcuua

SEQ ID NO: 1031205 - RNA, 19 nt, Homo sapiens
gaaggugaagugacuccua

SEQ ID NO: 1031206 - RNA, 19 nt, Homo sapiens
aguggaaucuggucauuug

SEQ ID NO: 1031207 - RNA, 19 nt, Homo sapiens
gaaugguugcugcugauaa

SEQ ID NO: 1031208 - RNA, 19 nt, Homo sapiens
gacaaguccuccagcaaca

SEQ ID NO: 1031209 - RNA, 19 nt, Homo sapiens
gaacuuaagaucauaugac

SEQ ID NO: 1031210 - RNA, 19 nt, Homo sapiens
ugauuauguucucugguua

SEQ ID NO: 1031211 - RNA, 19 nt, Homo sapiens
gauugcccauuguauaaga

SEQ ID NO: 1031212 - RNA, 19 nt, Homo sapiens
gcacugaugcccagcagau

SEQ ID NO: 1031213 - RNA, 19 nt, Homo sapiens
gauaaucaggacaccagua

SEQ ID NO: 1031214 - RNA, 19 nt, Homo sapiens
aaggugaagugacuccuaa

SEQ ID NO: 1031215 - RNA, 19 nt, Homo sapiens
ucuaaaggucugccaauuu

SEQ ID NO: 1031216 - RNA, 19 nt, Homo sapiens
cccaguuucucuacccuua

SEQ ID NO: 1031217 - RNA, 19 nt, Homo sapiens
aaauguacguucuucuuuc

SEQ ID NO: 1031218 - RNA, 19 nt, Homo sapiens
gaacuggaagacuugauuc

SEQ ID NO: 1031219 - RNA, 19 nt, Homo sapiens
ggucaaagaaauugucugu

SEQ ID NO: 1031220 - RNA, 19 nt, Homo sapiens
gagaagaaggguggaaaga

SEQ ID NO: 1031221 - RNA, 19 nt, Homo sapiens
cagcaacugugugucacua

SEQ ID NO: 1031222 - RNA, 19 nt, Homo sapiens
cagaagagaauuaguugau

SEQ ID NO: 1031223 - RNA, 19 nt, Homo sapiens
cugauuauguucucugguu

SEQ ID NO: 1031224 - RNA, 19 nt, Homo sapiens
ggcaagcucccaccacauu

SEQ ID NO: 1031225 - RNA, 19 nt, Homo sapiens
acacaagccgucuaccuaa

SEQ ID NO: 1031226 - RNA, 19 nt, Homo sapiens
aacaagauaugcaguucaa

SEQ ID NO: 1031227 - RNA, 19 nt, Homo sapiens
cgagagaaugaucacaaua

SEQ ID NO: 1031228 - RNA, 19 nt, Homo sapiens
uaaaaggggucagaaaaga

SEQ ID NO: 1031229 - RNA, 19 nt, Homo sapiens
uuaagaaaccuaugaccuu

SEQ ID NO: 1031230 - RNA, 19 nt, Homo sapiens
ucaacugaaugcacugaug

SEQ ID NO: 1031231 - RNA, 19 nt, Homo sapiens
ggaaccauccaaugcauca

SEQ ID NO: 1031232 - RNA, 19 nt, Homo sapiens
uaugaaugguucucagaug

SEQ ID NO: 1031233 - RNA, 19 nt, Homo sapiens
aaucaggacaccaguaauu

SEQ ID NO: 1031234 - RNA, 19 nt, Homo sapiens
cucagaaccugcuccauug

SEQ ID NO: 1031235 - RNA, 19 nt, Homo sapiens
ggaagaggaggaugcaaca

SEQ ID NO: 1031236 - RNA, 19 nt, Homo sapiens
gaauagauguuguagguaa

SEQ ID NO: 1031237 - RNA, 19 nt, Homo sapiens
gaacaugccugcagauuca

SEQ ID NO: 1031238 - RNA, 19 nt, Homo sapiens
gaacaaugcugacugauag

SEQ ID NO: 1031239 - RNA, 19 nt, Homo sapiens
gagaaagccugcuguguuu

SEQ ID NO: 1031240 - RNA, 19 nt, Homo sapiens
ggaaggacaugaagaaaug

SEQ ID NO: 1031241 - RNA, 19 nt, Homo sapiens
gcacaaggagcaaauauaa

SEQ ID NO: 1031242 - RNA, 19 nt, Homo sapiens
caaagaaagugcucuaaca

SEQ ID NO: 1031243 - RNA, 19 nt, Homo sapiens
gaaacacugcgcuaacuua

SEQ ID NO: 1031244 - RNA, 19 nt, Homo sapiens
guugcagacuuucuuauua

SEQ ID NO: 1031245 - RNA, 19 nt, Homo sapiens
ugaauuagcacaaguauug

SEQ ID NO: 1031246 - RNA, 19 nt, Homo sapiens
ggagaaagccugcuguguu

SEQ ID NO: 1031247 - RNA, 19 nt, Homo sapiens
gaugaaggcagaaguguaa

SEQ ID NO: 1031248 - RNA, 19 nt, Homo sapiens
ggauaugguucgcuuucua

SEQ ID NO: 1031249 - RNA, 19 nt, Homo sapiens
ggagguuacuuagauauug

SEQ ID NO: 1031250 - RNA, 19 nt, Homo sapiens
ggaaauccucuucaauuga

SEQ ID NO: 1031251 - RNA, 19 nt, Homo sapiens
caucaacacucauucuaau

SEQ ID NO: 1031252 - RNA, 19 nt, Homo sapiens
gcagaagcuuguucagaug

SEQ ID NO: 1031253 - RNA, 19 nt, Homo sapiens
gaauuggcagcucuacuua

SEQ ID NO: 1031254 - RNA, 19 nt, Homo sapiens
gcuagaagcagcaggaauu

SEQ ID NO: 1031255 - RNA, 19 nt, Homo sapiens
agaagaaacucaagaaacu

SEQ ID NO: 1031256 - RNA, 19 nt, Homo sapiens
gaugcacacugccuuaaug

SEQ ID NO: 1031257 - RNA, 19 nt, Homo sapiens
gaagaucgagggaauaaag

SEQ ID NO: 1031258 - RNA, 19 nt, Homo sapiens
aagaauagauguuguaggu

SEQ ID NO: 1031259 - RNA, 19 nt, Homo sapiens
gcagaaguguaaaugaaca

SEQ ID NO: 1031260 - RNA, 19 nt, Homo sapiens
gcacuacucuuagcacaag

SEQ ID NO: 1031261 - RNA, 19 nt, Homo sapiens
ggacauacucccuuaaugg

SEQ ID NO: 1031262 - RNA, 19 nt, Homo sapiens
gugcaaauauagaagauca

SEQ ID NO: 1031263 - RNA, 19 nt, Homo sapiens
guucguaaauugcuagaug

SEQ ID NO: 1031264 - RNA, 19 nt, Homo sapiens
uggaggacauguugaauug

SEQ ID NO: 1031265 - RNA, 19 nt, Homo sapiens
aaauggacauacucccuua

SEQ ID NO: 1031266 - RNA, 19 nt, Homo sapiens
cgaacaaugcugacugaua

SEQ ID NO: 1031267 - RNA, 19 nt, Homo sapiens
gaauaaaggagacauaacu

SEQ ID NO: 1031268 - RNA, 19 nt, Homo sapiens
agaaacugcucuuacuuug

SEQ ID NO: 1031269 - RNA, 19 nt, Homo sapiens
ggauaguggugcucaagug

SEQ ID NO: 1031270 - RNA, 19 nt, Homo sapiens
gcaucaacacucauucuaa

SEQ ID NO: 1031271 - RNA, 19 nt, Homo sapiens
agcaggguauuaugaauua

SEQ ID NO: 1031272 - RNA, 19 nt, Homo sapiens
cuuguaagcuacuacguaa

SEQ ID NO: 1031273 - RNA, 19 nt, Homo sapiens
gcuacuacguaaagaauag

SEQ ID NO: 1031274 - RNA, 19 nt, Homo sapiens
agacacagccuuaaccuau

SEQ ID NO: 1031275 - RNA, 19 nt, Homo sapiens
aaauauaaaugcccagaca

SEQ ID NO: 1031276 - RNA, 19 nt, Homo sapiens
gaggauuuguugacauugu

SEQ ID NO: 1031277 - RNA, 19 nt, Homo sapiens
ggacaccuggaauugguua

SEQ ID NO: 1031278 - RNA, 19 nt, Homo sapiens
uggcagcucuacuuauuga

SEQ ID NO: 1031279 - RNA, 19 nt, Homo sapiens
gggaauaaaggagacauaa

SEQ ID NO: 1031280 - RNA, 19 nt, Homo sapiens
gcauagauccggccaagca

SEQ ID NO: 1031281 - RNA, 19 nt, Homo sapiens
uguccgagguugaaucauu

SEQ ID NO: 1031282 - RNA, 19 nt, Homo sapiens
gagguuacuuagauauugu

SEQ ID NO: 1031283 - RNA, 19 nt, Homo sapiens
aggcagaaguguaaaugaa

SEQ ID NO: 1031284 - RNA, 19 nt, Homo sapiens
gcacugacacggaugaaag

SEQ ID NO: 1031285 - RNA, 19 nt, Homo sapiens
gaggacaugaagacuauuu

SEQ ID NO: 1031286 - RNA, 19 nt, Homo sapiens
guccgagguugaaucauuu

SEQ ID NO: 1031287 - RNA, 19 nt, Homo sapiens
ggagggacaccuggaauug

SEQ ID NO: 1031288 - RNA, 19 nt, Homo sapiens
gcagcucuacuuauugaaa

SEQ ID NO: 1031289 - RNA, 19 nt, Homo sapiens
ucauuugaaucuccauuga

SEQ ID NO: 1031290 - RNA, 19 nt, Homo sapiens
gaaggcagaaguguaaaug

SEQ ID NO: 1031291 - RNA, 19 nt, Homo sapiens
gagguacuccggagacuga

SEQ ID NO: 1031292 - RNA, 19 nt, Homo sapiens
ccaagaagaucuggauaac

SEQ ID NO: 1031293 - RNA, 19 nt, Homo sapiens
gugcaggcaucaacacuca

SEQ ID NO: 1031294 - RNA, 19 nt, Homo sapiens
caguggagguuacuuagau

SEQ ID NO: 1031295 - RNA, 19 nt, Homo sapiens
gacacagccuuaaccuaug

SEQ ID NO: 1031296 - RNA, 19 nt, Homo sapiens
gacagaagaaacucaagaa

SEQ ID NO: 1031297 - RNA, 19 nt, Homo sapiens
caacaucagagauauucuu

SEQ ID NO: 1031298 - RNA, 19 nt, Homo sapiens
gcacaaaacagaugagaug

SEQ ID NO: 1031299 - RNA, 19 nt, Homo sapiens
uaaaugcccagacagaaga

SEQ ID NO: 1031300 - RNA, 19 nt, Homo sapiens
aaugguggcacuacucuua

SEQ ID NO: 1031301 - RNA, 19 nt, Homo sapiens
uggaggauuuguugacauu

SEQ ID NO: 1031302 - RNA, 19 nt, Homo sapiens
gggaaggacaugaagaaau

SEQ ID NO: 1031303 - RNA, 19 nt, Homo sapiens
ugaauuggcagcucuacuu

SEQ ID NO: 1031304 - RNA, 19 nt, Homo sapiens
acacugcgcuaacuuaugc

SEQ ID NO: 1031305 - RNA, 19 nt, Homo sapiens
agauuuguauugcugguaa

SEQ ID NO: 1031306 - RNA, 19 nt, Homo sapiens
auacggauguugcagaugu

SEQ ID NO: 1031307 - RNA, 19 nt, Homo sapiens
ggaccaagaagaucuggau

SEQ ID NO: 1031308 - RNA, 19 nt, Homo sapiens
gauaguggugcucaaguga

SEQ ID NO: 1031309 - RNA, 19 nt, Homo sapiens
gcaggcaucaacacucauu

SEQ ID NO: 1031310 - RNA, 19 nt, Homo sapiens
ugcaugugcuggaggauuu

SEQ ID NO: 1031311 - RNA, 19 nt, Homo sapiens
ggaaacacugcgcuaacuu

SEQ ID NO: 1031312 - RNA, 19 nt, Homo sapiens
agacauaacuccccugaug

SEQ ID NO: 1031313 - RNA, 19 nt, Homo sapiens
gaauuccagccaagaaguu

SEQ ID NO: 1031314 - RNA, 19 nt, Homo sapiens
aggaggacaugaagacuau

SEQ ID NO: 1031315 - RNA, 19 nt, Homo sapiens
agaaguuaaugaugaagga

SEQ ID NO: 1031316 - RNA, 19 nt, Homo sapiens
ccacaaugcaggacaagug

SEQ ID NO: 1031317 - RNA, 19 nt, Homo sapiens
gucaacugcugaugguaaa

SEQ ID NO: 1031318 - RNA, 19 nt, Homo sapiens
gaacucuggauaucugaau

SEQ ID NO: 1031319 - RNA, 19 nt, Homo sapiens
gaaaugguggcacuacucu

SEQ ID NO: 1031320 - RNA, 19 nt, Homo sapiens
gagcagacuuacgcacugu

SEQ ID NO: 1031321 - RNA, 19 nt, Homo sapiens
gacauacucccuuaaugga

SEQ ID NO: 1031322 - RNA, 19 nt, Homo sapiens
ggauuuguugacauuguua

SEQ ID NO: 1031323 - RNA, 19 nt, Homo sapiens
guucagcaggguauuauga

SEQ ID NO: 1031324 - RNA, 19 nt, Homo sapiens
ggauaacccagugcuuaaa

SEQ ID NO: 1031325 - RNA, 19 nt, Homo sapiens
uaaugcuguucguaaauug

SEQ ID NO: 1031326 - RNA, 19 nt, Homo sapiens
guaagcuacuacguaaaga

SEQ ID NO: 1031327 - RNA, 19 nt, Homo sapiens
gaagaaaugguggcacuac

SEQ ID NO: 1031328 - RNA, 19 nt, Homo sapiens
gaaaggggagcaaaucuug

SEQ ID NO: 1031329 - RNA, 19 nt, Homo sapiens
gagguggcacguuugcuuu

SEQ ID NO: 1031330 - RNA, 19 nt, Homo sapiens
ugagaugcacacugccuua

SEQ ID NO: 1031331 - RNA, 19 nt, Homo sapiens
uaaagugcuccuuaaugaa

SEQ ID NO: 1031332 - RNA, 19 nt, Homo sapiens
cagcaggguauuaugaauu

SEQ ID NO: 1031333 - RNA, 19 nt, Homo sapiens
guaaaugaacauacagaag

SEQ ID NO: 1031334 - RNA, 19 nt, Homo sapiens
ggcgcuggauuucaaguug

SEQ ID NO: 1031335 - RNA, 19 nt, Homo sapiens
uguuaaugcuguucguaaa

SEQ ID NO: 1031336 - RNA, 19 nt, Homo sapiens
gcagggagaucacagaaga

SEQ ID NO: 1031337 - RNA, 19 nt, Homo sapiens
ugagacaaaugaacguuua

SEQ ID NO: 1031338 - RNA, 19 nt, Homo sapiens
agaagaagauggcaaauuc

SEQ ID NO: 1031339 - RNA, 19 nt, Homo sapiens
ugaaacagcucacuuccuu

SEQ ID NO: 1031340 - RNA, 19 nt, Homo sapiens
gaaucuggcugguuuagga

SEQ ID NO: 1031341 - RNA, 19 nt, Homo sapiens
gauggcaaguaauacaaua

SEQ ID NO: 1031342 - RNA, 19 nt, Homo sapiens
ucaaaugacuucuuucaca

SEQ ID NO: 1031343 - RNA, 19 nt, Homo sapiens
caaaugaacguuuacuuga

SEQ ID NO: 1031344 - RNA, 19 nt, Homo sapiens
ggagaagaacuuuaugaaa

SEQ ID NO: 1031345 - RNA, 19 nt, Homo sapiens
gcaaacugcacaacucuaa

SEQ ID NO: 1031346 - RNA, 19 nt, Homo sapiens
gguaauagaaccacauuga

SEQ ID NO: 1031347 - RNA, 19 nt, Homo sapiens
gaguucaaaugacuucuuu

SEQ ID NO: 1031348 - RNA, 19 nt, Homo sapiens
gcggagaccugaaucugaa

SEQ ID NO: 1031349 - RNA, 19 nt, Homo sapiens
gaaccacauugaaccuuga

SEQ ID NO: 1031350 - RNA, 19 nt, Homo sapiens
acagaaugaugucagguua

SEQ ID NO: 1031351 - RNA, 19 nt, Homo sapiens
gauagauugugcuuacuga

SEQ ID NO: 1031352 - RNA, 19 nt, Homo sapiens
cacagaagcucgaguagug

SEQ ID NO: 1031353 - RNA, 19 nt, Homo sapiens
ccagauagauugugcuuac

SEQ ID NO: 1031354 - RNA, 19 nt, Homo sapiens
gcaaauuccuccccuguuu

SEQ ID NO: 1031355 - RNA, 19 nt, Homo sapiens
ggaagaaggaggaggagaa

SEQ ID NO: 1031356 - RNA, 19 nt, Homo sapiens
ucaugccacuuccuucuua

SEQ ID NO: 1031357 - RNA, 19 nt, Homo sapiens
gaugucagguuaggucaaa

SEQ ID NO: 1031358 - RNA, 19 nt, Homo sapiens
gaagauaaugugacagaau

SEQ ID NO: 1031359 - RNA, 19 nt, Homo sapiens
caagaaacauaagcacaga

SEQ ID NO: 1031360 - RNA, 19 nt, Homo sapiens
gaacuauuucucuacguuu

SEQ ID NO: 1031361 - RNA, 19 nt, Homo sapiens
gagcuagugugacuugcuu

SEQ ID NO: 1031362 - RNA, 19 nt, Homo sapiens
aaagugacccugcuucauu

SEQ ID NO: 1031363 - RNA, 19 nt, Homo sapiens
ccaccaguguucaaaguga

SEQ ID NO: 1031364 - RNA, 19 nt, Homo sapiens
caagaggcaugcuaaggau

SEQ ID NO: 1031365 - RNA, 19 nt, Homo sapiens
gaagaaggaggaggagaaa

SEQ ID NO: 1031366 - RNA, 19 nt, Homo sapiens
cgaacuauuucucuacguu

SEQ ID NO: 1031367 - RNA, 19 nt, Homo sapiens
ggagaucacagaagaagau

SEQ ID NO: 1031368 - RNA, 19 nt, Homo sapiens
ccaauucccuucuugacau

SEQ ID NO: 1031369 - RNA, 19 nt, Homo sapiens
aagauaaugugacagaaug

SEQ ID NO: 1031370 - RNA, 19 nt, Homo sapiens
cggaauaucuacucuuuac

SEQ ID NO: 1031371 - RNA, 19 nt, Homo sapiens
gaagaagauugaggagcuu

SEQ ID NO: 1031372 - RNA, 19 nt, Homo sapiens
ggaagcugcugaccccuua

SEQ ID NO: 1031373 - RNA, 19 nt, Homo sapiens
gacccacucuucaucauca

SEQ ID NO: 1031374 - RNA, 19 nt, Homo sapiens
guaauagaaccacauugaa

SEQ ID NO: 1031375 - RNA, 19 nt, Homo sapiens
ggcaagagaugauggaaaa

SEQ ID NO: 1031376 - RNA, 19 nt, Homo sapiens
gaagagaugcagcgcuaug

SEQ ID NO: 1031377 - RNA, 19 nt, Homo sapiens
ucaggaauguggagaaagu

SEQ ID NO: 1031378 - RNA, 19 nt, Homo sapiens
gcacaacucuaaggugaac

SEQ ID NO: 1031379 - RNA, 19 nt, Homo sapiens
gacuagaucccgcgaggua

SEQ ID NO: 1031380 - RNA, 19 nt, Homo sapiens
acaaaugaacguuuacuug

SEQ ID NO: 1031381 - RNA, 19 nt, Homo sapiens
ucacuuccuuugagagcua

SEQ ID NO: 1031382 - RNA, 19 nt, Homo sapiens
gcaguguaaagguauagua

SEQ ID NO: 1031383 - RNA, 19 nt, Homo sapiens
ggaggagccuggguuuauc

SEQ ID NO: 1031384 - RNA, 19 nt, Homo sapiens
uguaggcaguguaaaggua

SEQ ID NO: 1031385 - RNA, 19 nt, Homo sapiens
ucuggaguaucuauucuuu

SEQ ID NO: 1031386 - RNA, 19 nt, Homo sapiens
agcccuaaaugaacuguua

SEQ ID NO: 1031387 - RNA, 19 nt, Homo sapiens
aaacagcucacuuccuuug

SEQ ID NO: 1031388 - RNA, 19 nt, Homo sapiens
gaucuggaguaucuauucu

SEQ ID NO: 1031389 - RNA, 19 nt, Homo sapiens
ugacuucuuucacagaugu

SEQ ID NO: 1031390 - RNA, 19 nt, Homo sapiens
cgguagcucuggagaagaa

SEQ ID NO: 1031391 - RNA, 19 nt, Homo sapiens
uugagaagauggaggagaa

SEQ ID NO: 1031392 - RNA, 19 nt, Homo sapiens
gaauaucuacucuuuacag

SEQ ID NO: 1031393 - RNA, 19 nt, Homo sapiens
gaagcggaauaucuacucu

SEQ ID NO: 1031394 - RNA, 19 nt, Homo sapiens
ucaagaggcaugcuaagga

SEQ ID NO: 1031395 - RNA, 19 nt, Homo sapiens
ccagcaaacugcacaacuc

SEQ ID NO: 1031396 - RNA, 19 nt, Homo sapiens
guaaugcguauauguacaa

SEQ ID NO: 1031397 - RNA, 19 nt, Homo sapiens
ggccggaagugaccucuag

SEQ ID NO: 1031398 - RNA, 19 nt, Homo sapiens
gaaacagcucacuuccuuu

SEQ ID NO: 1031399 - RNA, 19 nt, Homo sapiens
gggugaagcggaauaucua

SEQ ID NO: 1031400 - RNA, 19 nt, Homo sapiens
cagaggaauuagagcgaaa

SEQ ID NO: 1031401 - RNA, 19 nt, Homo sapiens
uaccuuguuuggucaauga

SEQ ID NO: 1031402 - RNA, 19 nt, Homo sapiens
agacugaacauccucaaga

SEQ ID NO: 1031403 - RNA, 19 nt, Homo sapiens
gagacaggccaaacuagga

SEQ ID NO: 1031404 - RNA, 19 nt, Homo sapiens
cagaagaagauggcaaauu

SEQ ID NO: 1031405 - RNA, 19 nt, Homo sapiens
aagaagcacaagaaacaua

SEQ ID NO: 1031406 - RNA, 19 nt, Homo sapiens
ggacuucucccaggcucua

SEQ ID NO: 1031407 - RNA, 19 nt, Homo sapiens
augcguauauguacaaaug

SEQ ID NO: 1031408 - RNA, 19 nt, Homo sapiens
uagaagauaaugugacaga

SEQ ID NO: 1031409 - RNA, 19 nt, Homo sapiens
gaacguuuacuugauuuag

SEQ ID NO: 1031410 - RNA, 19 nt, Homo sapiens
ccucaggaauguggagaaa

SEQ ID NO: 1031411 - RNA, 19 nt, Homo sapiens
guucaaaugacuucuuuca

SEQ ID NO: 1031412 - RNA, 19 nt, Homo sapiens
ccgcagacccucaggaaug

SEQ ID NO: 1031413 - RNA, 19 nt, Homo sapiens
cagaagcuccucccacuca

SEQ ID NO: 1031414 - RNA, 19 nt, Homo sapiens
caaagaauuguugcaaaug

SEQ ID NO: 1031415 - RNA, 19 nt, Homo sapiens
cuagagcgguggugaaacu

SEQ ID NO: 1031416 - RNA, 19 nt, Homo sapiens
caagacaugccagcaagaa

SEQ ID NO: 1031417 - RNA, 19 nt, Homo sapiens
ugaagaaccauuccagauc

SEQ ID NO: 1031418 - RNA, 19 nt, Homo sapiens
agaagcacaagaaacauaa

SEQ ID NO: 1031419 - RNA, 19 nt, Homo sapiens
ugacauggccagcaagauc

SEQ ID NO: 1031420 - RNA, 19 nt, Homo sapiens
agaaaccucucugguguca

SEQ ID NO: 1031421 - RNA, 19 nt, Homo sapiens
gaccugaaucugaagaaga

SEQ ID NO: 1031422 - RNA, 19 nt, Homo sapiens
gaucgggugaagcggaaua

SEQ ID NO: 1031423 - RNA, 19 nt, Homo sapiens
ggugaaccgugacgaguac

SEQ ID NO: 1031424 - RNA, 19 nt, Homo sapiens
gacaaaugaacguuuacuu

SEQ ID NO: 1031425 - RNA, 19 nt, Homo sapiens
gcggaauaucuacucuuua

SEQ ID NO: 1031426 - RNA, 19 nt, Homo sapiens
agcggaauaucuacucuuu

SEQ ID NO: 1031427 - RNA, 19 nt, Homo sapiens
agagagacaggccaaacua

SEQ ID NO: 1031428 - RNA, 19 nt, Homo sapiens
gcacagaagcucgaguagu

SEQ ID NO: 1031429 - RNA, 19 nt, Homo sapiens
caauguaggcaguguaaag

SEQ ID NO: 1031430 - RNA, 19 nt, Homo sapiens
ggugggcacuggaccaucu

SEQ ID NO: 1031431 - RNA, 19 nt, Homo sapiens
gcucuggagaagaacuuua

SEQ ID NO: 1031432 - RNA, 19 nt, Homo sapiens
agacaugccagcaagaaga

SEQ ID NO: 1031433 - RNA, 19 nt, Homo sapiens
caguguaaagguauaguaa

SEQ ID NO: 1031434 - RNA, 19 nt, Homo sapiens
ggcaugggaugaagaacca

SEQ ID NO: 1031435 - RNA, 19 nt, Homo sapiens
aggcugcucuucugaaaca

SEQ ID NO: 1031436 - RNA, 19 nt, Homo sapiens
gaagagaggccuaguuuaa

SEQ ID NO: 1031437 - RNA, 19 nt, Homo sapiens
gggcaucucccuugacuua

SEQ ID NO: 1031438 - RNA, 19 nt, Homo sapiens
gaaagaauggccuugaauu

SEQ ID NO: 1031439 - RNA, 19 nt, Homo sapiens
ggagggaagucacaucaga

SEQ ID NO: 1031440 - RNA, 19 nt, Homo sapiens
gagccucaaucaagccuua

SEQ ID NO: 1031441 - RNA, 19 nt, Homo sapiens
caacaccuaugaacaccua

SEQ ID NO: 1031442 - RNA, 19 nt, Homo sapiens
gaacacaucccucuucucu

SEQ ID NO: 1031443 - RNA, 19 nt, Homo sapiens
agaauggccuugaauuuga

SEQ ID NO: 1031444 - RNA, 19 nt, Homo sapiens
gaagcuggaugugguggua

SEQ ID NO: 1031445 - RNA, 19 nt, Homo sapiens
acacaucccucuucucuuc

SEQ ID NO: 1031446 - RNA, 19 nt, Homo sapiens
uaacaugccaucccuacua

SEQ ID NO: 1031447 - RNA, 19 nt, Homo sapiens
cugguaagaugaauacuuu

SEQ ID NO: 1031448 - RNA, 19 nt, Homo sapiens
ggcaugagcuggugaacau

SEQ ID NO: 1031449 - RNA, 19 nt, Homo sapiens
ggaggaagcuaucauugac

SEQ ID NO: 1031450 - RNA, 19 nt, Homo sapiens
ucaguuaugucuuugguau

SEQ ID NO: 1031451 - RNA, 19 nt, Homo sapiens
gcaguuaauuagcacaugu

SEQ ID NO: 1031452 - RNA, 19 nt, Homo sapiens
cuucugcucucauucauuu

SEQ ID NO: 1031453 - RNA, 19 nt, Homo sapiens
aaagaauggccuugaauuu

SEQ ID NO: 1031454 - RNA, 19 nt, Homo sapiens
gggcugcugucauaccuuu

SEQ ID NO: 1031455 - RNA, 19 nt, Homo sapiens
gaacuuguacucagaccuu

SEQ ID NO: 1031456 - RNA, 19 nt, Homo sapiens
gaaagccuguggugucagu

SEQ ID NO: 1031457 - RNA, 19 nt, Homo sapiens
ggaaagccacggaaugugu

SEQ ID NO: 1031458 - RNA, 19 nt, Homo sapiens
cagaugaucauauccaauu

SEQ ID NO: 1031459 - RNA, 19 nt, Homo sapiens
acucagaccuuaagaaucu

SEQ ID NO: 1031460 - RNA, 19 nt, Homo sapiens
ggagagaaagccuacauuc

SEQ ID NO: 1031461 - RNA, 19 nt, Homo sapiens
gagagaaagccuacauuca

SEQ ID NO: 1031462 - RNA, 19 nt, Homo sapiens
gaaugcaagcucaagguuu

SEQ ID NO: 1031463 - RNA, 19 nt, Homo sapiens
caggauccaucaguuagua

SEQ ID NO: 1031464 - RNA, 19 nt, Homo sapiens
agagaggccuaguuuaaau

SEQ ID NO: 1031465 - RNA, 19 nt, Homo sapiens
guacucagaccuuaagaau

SEQ ID NO: 1031466 - RNA, 19 nt, Homo sapiens
ggucaaccacuacaugaaa

SEQ ID NO: 1031467 - RNA, 19 nt, Homo sapiens
ggaaagaauggccuugaau

SEQ ID NO: 1031468 - RNA, 19 nt, Homo sapiens
ggcauggacugguaagaug

SEQ ID NO: 1031469 - RNA, 19 nt, Homo sapiens
ugacuuggauagcuugaug

SEQ ID NO: 1031470 - RNA, 19 nt, Homo sapiens
ggaggagucagaggaauuu

SEQ ID NO: 1031471 - RNA, 19 nt, Homo sapiens
gggaaagccugugguguca

SEQ ID NO: 1031472 - RNA, 19 nt, Homo sapiens
auauaaagcugguuaaggu

SEQ ID NO: 1031473 - RNA, 19 nt, Homo sapiens
cagcaggauccaucaguua

SEQ ID NO: 1031474 - RNA, 19 nt, Homo sapiens
auaaagcacucuaauuugg

SEQ ID NO: 1031475 - RNA, 19 nt, Homo sapiens
aggcggagcugaagggaaa

SEQ ID NO: 1031476 - RNA, 19 nt, Homo sapiens
ucccuugacuuacccauaa

SEQ ID NO: 1031477 - RNA, 19 nt, Homo sapiens
guaguucguguuaauguaa

SEQ ID NO: 1031478 - RNA, 19 nt, Homo sapiens
aaugcaagcucaagguuug

SEQ ID NO: 1031479 - RNA, 19 nt, Homo sapiens
cauguacaguggagagaaa

SEQ ID NO: 1031480 - RNA, 19 nt, Homo sapiens
ggaaaagggagacuaauga

SEQ ID NO: 1031481 - RNA, 19 nt, Homo sapiens
cagaggaauuugcccaaug

SEQ ID NO: 1031482 - RNA, 19 nt, Homo sapiens
aagcuaucauugacaagua

SEQ ID NO: 1031483 - RNA, 19 nt, Homo sapiens
gguggcagcugguucucaa

SEQ ID NO: 1031484 - RNA, 19 nt, Homo sapiens
aagcgaauauuccaucugu

SEQ ID NO: 1031485 - RNA, 19 nt, Homo sapiens
gaucaaagcgaauauucca

SEQ ID NO: 1031486 - RNA, 19 nt, Homo sapiens
caugccaucccuacuaaua

SEQ ID NO: 1031487 - RNA, 19 nt, Homo sapiens
cuucuucgcuuucccauca

SEQ ID NO: 1031488 - RNA, 19 nt, Homo sapiens
gccguccucugcaaaguuu

SEQ ID NO: 1031489 - RNA, 19 nt, Homo sapiens
acacaggaauccauuacau

SEQ ID NO: 1031490 - RNA, 19 nt, Homo sapiens
caugucagaugaucauauc

SEQ ID NO: 1031491 - RNA, 19 nt, Homo sapiens
ggagacuaaugaggcuuaa

SEQ ID NO: 1031492 - RNA, 19 nt, Homo sapiens
gauauugacuuggauagcu

SEQ ID NO: 1031493 - RNA, 19 nt, Homo sapiens
ggaagaggcugcggaacac

SEQ ID NO: 1031494 - RNA, 19 nt, Homo sapiens
gggaagaggcugcggaaca

SEQ ID NO: 1031495 - RNA, 19 nt, Homo sapiens
gcagcugguucucaaugug

SEQ ID NO: 1031496 - RNA, 19 nt, Homo sapiens
gggagacuaaugaggcuua

SEQ ID NO: 1031497 - RNA, 19 nt, Homo sapiens
aaagcacucuaauuugguu

SEQ ID NO: 1031498 - RNA, 19 nt, Homo sapiens
gcacguauaaagcacucua

SEQ ID NO: 1031499 - RNA, 19 nt, Homo sapiens
ggacugguaagaugaauac

SEQ ID NO: 1031500 - RNA, 19 nt, Homo sapiens
ugaagagaggccuaguuua

SEQ ID NO: 1031501 - RNA, 19 nt, Homo sapiens
ccaccaacuacuauguuua

SEQ ID NO: 1031502 - RNA, 19 nt, Homo sapiens
uggaaagaauggccuugaa

SEQ ID NO: 1031503 - RNA, 19 nt, Homo sapiens
gggucugucuuccuuauca

SEQ ID NO: 1031504 - RNA, 19 nt, Homo sapiens
ccaaccaagugccggagaa

SEQ ID NO: 1031505 - RNA, 19 nt, Homo sapiens
gaaaggaguaccccaugua

SEQ ID NO: 1031506 - RNA, 19 nt, Homo sapiens
ucucauucauuuagugcua

SEQ ID NO: 1031507 - RNA, 19 nt, Homo sapiens
aacaugccaucccuacuaa

SEQ ID NO: 1031508 - RNA, 19 nt, Homo sapiens
cugaagagaggccuaguuu

SEQ ID NO: 1031509 - RNA, 19 nt, Homo sapiens
cguauaaagcacucuaauu

SEQ ID NO: 1031510 - RNA, 19 nt, Homo sapiens
acaggaauccauuacauug

SEQ ID NO: 1031511 - RNA, 19 nt, Homo sapiens
aagaauggccuugaauuug

SEQ ID NO: 1031512 - RNA, 19 nt, Homo sapiens
uagggugcaugucagauga

SEQ ID NO: 1031513 - RNA, 19 nt, Homo sapiens
uguaguucguguuaaugua

SEQ ID NO: 1031514 - RNA, 19 nt, Homo sapiens
cgaauccuuucuccgaaga

SEQ ID NO: 1031515 - RNA, 19 nt, Homo sapiens
caaagcgaauauuccaucu

SEQ ID NO: 1031516 - RNA, 19 nt, Homo sapiens
ccucacccaugccuccuaa

SEQ ID NO: 1031517 - RNA, 19 nt, Homo sapiens
guaauuggcaguggcuuug

SEQ ID NO: 1031518 - RNA, 19 nt, Homo sapiens
ccaacuacuauguuuacua

SEQ ID NO: 1031519 - RNA, 19 nt, Homo sapiens
ccaauggccgaaaggagua

SEQ ID NO: 1031520 - RNA, 19 nt, Homo sapiens
uggcauuugcaguuaauua

SEQ ID NO: 1031521 - RNA, 19 nt, Homo sapiens
gcagggaggugugggguaa

SEQ ID NO: 1031522 - RNA, 19 nt, Homo sapiens
gucagggcauggacuggua

SEQ ID NO: 1031523 - RNA, 19 nt, Homo sapiens
uuaguuccuugcacguaua

SEQ ID NO: 1031524 - RNA, 19 nt, Homo sapiens
gggaggagucagaggaauu

SEQ ID NO: 1031525 - RNA, 19 nt, Homo sapiens
gcuuaggcaugaccucugu

SEQ ID NO: 1031526 - RNA, 19 nt, Homo sapiens
gguaauuggcaguggcuuu

SEQ ID NO: 1031527 - RNA, 19 nt, Homo sapiens
ccagugaaauugccuucca

SEQ ID NO: 1031528 - RNA, 19 nt, Homo sapiens
gaagcuaucauugacaagu

SEQ ID NO: 1031529 - RNA, 19 nt, Homo sapiens
gagggaagucacaucagaa

SEQ ID NO: 1031530 - RNA, 19 nt, Homo sapiens
gcauggacugguaagauga

SEQ ID NO: 1031531 - RNA, 19 nt, Homo sapiens
ugacuuacccauaaugucu

SEQ ID NO: 1031532 - RNA, 19 nt, Homo sapiens
ggaagucccgggucugucu

SEQ ID NO: 1031533 - RNA, 19 nt, Homo sapiens
gcaugucagaugaucauau

SEQ ID NO: 1031534 - RNA, 19 nt, Homo sapiens
acagcaggauccaucaguu

SEQ ID NO: 1031535 - RNA, 19 nt, Homo sapiens
ccuccuaacucagugauca

SEQ ID NO: 1031536 - RNA, 19 nt, Homo sapiens
gagaugaacuuuccaagga

SEQ ID NO: 1031537 - RNA, 19 nt, Homo sapiens
gggaauaugcuaaauguua

SEQ ID NO: 1031538 - RNA, 19 nt, Homo sapiens
ggaagaaguuggaaggaaa

SEQ ID NO: 1031539 - RNA, 19 nt, Homo sapiens
ccagucauguguuaauuua

SEQ ID NO: 1031540 - RNA, 19 nt, Homo sapiens
caaagacccucuauaacuu

SEQ ID NO: 1031541 - RNA, 19 nt, Homo sapiens
ggauuuaucuuguuaccaa

SEQ ID NO: 1031542 - RNA, 19 nt, Homo sapiens
cagaguagcuuaugacugu

SEQ ID NO: 1031543 - RNA, 19 nt, Homo sapiens
gaaccucaguggucauuug

SEQ ID NO: 1031544 - RNA, 19 nt, Homo sapiens
gagauaaugggcuuuguua

SEQ ID NO: 1031545 - RNA, 19 nt, Homo sapiens
ggaaauuacuagcuugugu

SEQ ID NO: 1031546 - RNA, 19 nt, Homo sapiens
gccaaaggauucucuggua

SEQ ID NO: 1031547 - RNA, 19 nt, Homo sapiens
guauaggucuuucauuaga

SEQ ID NO: 1031548 - RNA, 19 nt, Homo sapiens
gauaaacccuacuuuccaa

SEQ ID NO: 1031549 - RNA, 19 nt, Homo sapiens
cuguauaggucuuucauua

SEQ ID NO: 1031550 - RNA, 19 nt, Homo sapiens
gaguagggcucagggauuu

SEQ ID NO: 1031551 - RNA, 19 nt, Homo sapiens
uaacagaauugcugacauc

SEQ ID NO: 1031552 - RNA, 19 nt, Homo sapiens
gcugauaugucaugucaau

SEQ ID NO: 1031553 - RNA, 19 nt, Homo sapiens
ucagggauuuaucuuguua

SEQ ID NO: 1031554 - RNA, 19 nt, Homo sapiens
uugcaucgcuguugaauga

SEQ ID NO: 1031555 - RNA, 19 nt, Homo sapiens
aagaauggcuacacuaaga

SEQ ID NO: 1031556 - RNA, 19 nt, Homo sapiens
uaaagaauggcuacacuaa

SEQ ID NO: 1031557 - RNA, 19 nt, Homo sapiens
gcucagggauuuaucuugu

SEQ ID NO: 1031558 - RNA, 19 nt, Homo sapiens
aaacucugauugccuuaua

SEQ ID NO: 1031559 - RNA, 19 nt, Homo sapiens
gaaucagucucaguuuauu

SEQ ID NO: 1031560 - RNA, 19 nt, Homo sapiens
ggaauaugcuaaauguuac

SEQ ID NO: 1031561 - RNA, 19 nt, Homo sapiens
gaaugaaucagucucaguu

SEQ ID NO: 1031562 - RNA, 19 nt, Homo sapiens
ugaggacccugaagaagaa

SEQ ID NO: 1031563 - RNA, 19 nt, Homo sapiens
gagaaacccauagauguaa

SEQ ID NO: 1031564 - RNA, 19 nt, Homo sapiens
cgagacaucacuagaaauu

SEQ ID NO: 1031565 - RNA, 19 nt, Homo sapiens
gcuaagaaacaguucaauu

SEQ ID NO: 1031566 - RNA, 19 nt, Homo sapiens
ugagaaacccauagaugua

SEQ ID NO: 1031567 - RNA, 19 nt, Homo sapiens
gaaacuacauagcccuaca

SEQ ID NO: 1031568 - RNA, 19 nt, Homo sapiens
uuucaaagacccucuauaa

SEQ ID NO: 1031569 - RNA, 19 nt, Homo sapiens
uaaauucugggcugauaua

SEQ ID NO: 1031570 - RNA, 19 nt, Homo sapiens
cauuaaggauuuaccaaga

SEQ ID NO: 1031571 - RNA, 19 nt, Homo sapiens
gcaaauaaagacucacuag

SEQ ID NO: 1031572 - RNA, 19 nt, Homo sapiens
gcacugcuguuugugguau

SEQ ID NO: 1031573 - RNA, 19 nt, Homo sapiens
gaaauuacuagcuuguguu

SEQ ID NO: 1031574 - RNA, 19 nt, Homo sapiens
ucagucagcugcauguuuc

SEQ ID NO: 1031575 - RNA, 19 nt, Homo sapiens
ccaaggaagaauuacuuua

SEQ ID NO: 1031576 - RNA, 19 nt, Homo sapiens
aauaaagacucacuagcuu

SEQ ID NO: 1031577 - RNA, 19 nt, Homo sapiens
aacccuacuuuccaaauua

SEQ ID NO: 1031578 - RNA, 19 nt, Homo sapiens
guaaagaauggcuacacua

SEQ ID NO: 1031579 - RNA, 19 nt, Homo sapiens
caucauuccuuuguuguug

SEQ ID NO: 1031580 - RNA, 19 nt, Homo sapiens
ucaaagacccucuauaacu

SEQ ID NO: 1031581 - RNA, 19 nt, Homo sapiens
aaacccuacuuuccaaauu

SEQ ID NO: 1031582 - RNA, 19 nt, Homo sapiens
uaugucaugucaaucgaua

SEQ ID NO: 1031583 - RNA, 19 nt, Homo sapiens
gcacaagcauaucacuuuu

SEQ ID NO: 1031584 - RNA, 19 nt, Homo sapiens
ggcacaagcauaucacuuu

SEQ ID NO: 1031585 - RNA, 19 nt, Homo sapiens
aaagaauucuccucugcaa

SEQ ID NO: 1031586 - RNA, 19 nt, Homo sapiens
cuacauagcccuacaucau

SEQ ID NO: 1031587 - RNA, 19 nt, Homo sapiens
cauuacaccaguccauuua

SEQ ID NO: 1031588 - RNA, 19 nt, Homo sapiens
guaaugauugccaagguaa

SEQ ID NO: 1031589 - RNA, 19 nt, Homo sapiens
uuucaccagucauguguua

SEQ ID NO: 1031590 - RNA, 19 nt, Homo sapiens
gagaagggcuaagaaacag

SEQ ID NO: 1031591 - RNA, 19 nt, Homo sapiens
ccagagggcacaagcauau

SEQ ID NO: 1031592 - RNA, 19 nt, Homo sapiens
gggcucauucugcaaauaa

SEQ ID NO: 1031593 - RNA, 19 nt, Homo sapiens
ggagccacuuggagaaaga

SEQ ID NO: 1031594 - RNA, 19 nt, Homo sapiens
augaaucagucucaguuua

SEQ ID NO: 1031595 - RNA, 19 nt, Homo sapiens
cuaagucaauggcaagaug

SEQ ID NO: 1031596 - RNA, 19 nt, Homo sapiens
uguaaugauugccaaggua

SEQ ID NO: 1031597 - RNA, 19 nt, Homo sapiens
ucuaaauucugggcugaua

SEQ ID NO: 1031598 - RNA, 19 nt, Homo sapiens
ggucuagaaccaagaugua

SEQ ID NO: 1031599 - RNA, 19 nt, Homo sapiens
aagcauaucuaagucaaug

SEQ ID NO: 1031600 - RNA, 19 nt, Homo sapiens
ugccauauuuggaacagua

SEQ ID NO: 1031601 - RNA, 19 nt, Homo sapiens
gaagggcuaagaaacaguu

SEQ ID NO: 1031602 - RNA, 19 nt, Homo sapiens
aaagacccucuauaacuua

SEQ ID NO: 1031603 - RNA, 19 nt, Homo sapiens
cugauugccuuauaaacuu

SEQ ID NO: 1031604 - RNA, 19 nt, Homo sapiens
ucagagcguuguaucacuu

SEQ ID NO: 1031605 - RNA, 19 nt, Homo sapiens
guguuaugcuuggguguua

SEQ ID NO: 1031606 - RNA, 19 nt, Homo sapiens
ucaagcauaucuaagucaa

SEQ ID NO: 1031607 - RNA, 19 nt, Homo sapiens
acacuaagacugaauuauc

SEQ ID NO: 1031608 - RNA, 19 nt, Homo sapiens
uagugaggcugauauguca

SEQ ID NO: 1031609 - RNA, 19 nt, Homo sapiens
ucaguggucauuugcauuu

SEQ ID NO: 1031610 - RNA, 19 nt, Homo sapiens
ucaagccauugcuguugua

SEQ ID NO: 1031611 - RNA, 19 nt, Homo sapiens
acauucagauuguuagaug

SEQ ID NO: 1031612 - RNA, 19 nt, Homo sapiens
uuacaccaguccauuuaga

SEQ ID NO: 1031613 - RNA, 19 nt, Homo sapiens
gauaugucaugucaaucga

SEQ ID NO: 1031614 - RNA, 19 nt, Homo sapiens
agauguaaaucccuaggaa

SEQ ID NO: 1031615 - RNA, 19 nt, Homo sapiens
uggcaagcauauaaaguau

SEQ ID NO: 1031616 - RNA, 19 nt, Homo sapiens
gaccgagacaucacuagaa

SEQ ID NO: 1031617 - RNA, 19 nt, Homo sapiens
ucacacugcuaacucuguu

SEQ ID NO: 1031618 - RNA, 19 nt, Homo sapiens
guaaaucccuaggaauugc

SEQ ID NO: 1031619 - RNA, 19 nt, Homo sapiens
ugaaucagucucaguuuau

SEQ ID NO: 1031620 - RNA, 19 nt, Homo sapiens
ggauuuaccaagaaugaau

SEQ ID NO: 1031621 - RNA, 19 nt, Homo sapiens
gacuauccauuuagaugug

SEQ ID NO: 1031622 - RNA, 19 nt, Homo sapiens
cacuaagacugaauuaucu

SEQ ID NO: 1031623 - RNA, 19 nt, Homo sapiens
ugagaagggcuaagaaaca

SEQ ID NO: 1031624 - RNA, 19 nt, Homo sapiens
cucauucagucuucuagua

SEQ ID NO: 1031625 - RNA, 19 nt, Homo sapiens
agaaacccauagauguaaa

SEQ ID NO: 1031626 - RNA, 19 nt, Homo sapiens
aaucuaaggaugcuucaaa

SEQ ID NO: 1031627 - RNA, 19 nt, Homo sapiens
guaacagaauugcugacau

SEQ ID NO: 1031628 - RNA, 19 nt, Homo sapiens
uggaagaaguuggaaggaa

SEQ ID NO: 1031629 - RNA, 19 nt, Homo sapiens
gcaaaacacagcccugaaa

SEQ ID NO: 1031630 - RNA, 19 nt, Homo sapiens
ccucugcaauugacauaau

SEQ ID NO: 1031631 - RNA, 19 nt, Homo sapiens
gauaaugggcuuuguuagc

SEQ ID NO: 1031632 - RNA, 19 nt, Homo sapiens
accaguccauuuagagaua

SEQ ID NO: 1031633 - RNA, 19 nt, Homo sapiens
gauaaugggcuuuguuagc

SEQ ID NO: 1031634 - RNA, 19 nt, Homo sapiens
agaaagauccuuguuccuu

SEQ ID NO: 1031635 - RNA, 19 nt, Homo sapiens
caucaucagccaaaggauu

SEQ ID NO: 1031636 - RNA, 19 nt, Homo sapiens
ggacaauguugguuaauaa

SEQ ID NO: 1031637 - RNA, 19 nt, Homo sapiens
gaacaacaguuucacuuug

SEQ ID NO: 1031638 - RNA, 19 nt, Homo sapiens
ggugagaacuaauauguaa

SEQ ID NO: 1031639 - RNA, 19 nt, Homo sapiens
gaaggacaauguugguuaa

SEQ ID NO: 1031640 - RNA, 19 nt, Homo sapiens
gaaugugugugguucauaa

SEQ ID NO: 1031641 - RNA, 19 nt, Homo sapiens
gauaauggccucuacuaaa

SEQ ID NO: 1031642 - RNA, 19 nt, Homo sapiens
ggaaggacaauguugguua

SEQ ID NO: 1031643 - RNA, 19 nt, Homo sapiens
caacgaaguuauuccauca

SEQ ID NO: 1031644 - RNA, 19 nt, Homo sapiens
ggugagauauccauguauu

SEQ ID NO: 1031645 - RNA, 19 nt, Homo sapiens
aaacaacacucaacgaagu

SEQ ID NO: 1031646 - RNA, 19 nt, Homo sapiens
ggaaacaacacucaacgaa

SEQ ID NO: 1031647 - RNA, 19 nt, Homo sapiens
gcacuuaacgccauacuuc

SEQ ID NO: 1031648 - RNA, 19 nt, Homo sapiens
gagacuuaaugaagccuua

SEQ ID NO: 1031649 - RNA, 19 nt, Homo sapiens
acucugaucucuuaacaaa

SEQ ID NO: 1031650 - RNA, 19 nt, Homo sapiens
guugcacucugaucucuua

SEQ ID NO: 1031651 - RNA, 19 nt, Homo sapiens
ggacggagacuuaaugaag

SEQ ID NO: 1031652 - RNA, 19 nt, Homo sapiens
cagagaaucuacaacauag

SEQ ID NO: 1031653 - RNA, 19 nt, Homo sapiens
gcacucugaucucuuaaca

SEQ ID NO: 1031654 - RNA, 19 nt, Homo sapiens
caaacugugaugacaaaua

SEQ ID NO: 1031655 - RNA, 19 nt, Homo sapiens
ucagagaaucuacaacaua

SEQ ID NO: 1031656 - RNA, 19 nt, Homo sapiens
gaagaaccacauuuauuca

SEQ ID NO: 1031657 - RNA, 19 nt, Homo sapiens
ugaagaaccacauuuauuc

SEQ ID NO: 1031658 - RNA, 19 nt, Homo sapiens
acacacaguugcucaaugu

SEQ ID NO: 1031659 - RNA, 19 nt, Homo sapiens
agaaauggcuguaggaaac

SEQ ID NO: 1031660 - RNA, 19 nt, Homo sapiens
gagcauuuacuccgccuua

SEQ ID NO: 1031661 - RNA, 19 nt, Homo sapiens
auaauggccucuacuaaau

SEQ ID NO: 1031662 - RNA, 19 nt, Homo sapiens
gcauuuacuccgccuuaua

SEQ ID NO: 1031663 - RNA, 19 nt, Homo sapiens
uuaacaaagucaccuaguu

SEQ ID NO: 1031664 - RNA, 19 nt, Homo sapiens
aaagaauguugcacucuga

SEQ ID NO: 1031665 - RNA, 19 nt, Homo sapiens
gauagaaagcccucuggaa

SEQ ID NO: 1031666 - RNA, 19 nt, Homo sapiens
gcgcaccaccaguuuauaa

SEQ ID NO: 1031667 - RNA, 19 nt, Homo sapiens
cgaaggaucauaagauuca

SEQ ID NO: 1031668 - RNA, 19 nt, Homo sapiens
ggacagaggaagaaagcuu

SEQ ID NO: 1031669 - RNA, 19 nt, Homo sapiens
gguaaggcacuaugcagua

SEQ ID NO: 1031670 - RNA, 19 nt, Homo sapiens
ggacgugauugcugguuuc

SEQ ID NO: 1031671 - RNA, 19 nt, Homo sapiens
cauugaagaaccacauuua

SEQ ID NO: 1031672 - RNA, 19 nt, Homo sapiens
gagaaauggcuguaggaaa

SEQ ID NO: 1031673 - RNA, 19 nt, Homo sapiens
caagaucuuucuggaaugu

SEQ ID NO: 1031674 - RNA, 19 nt, Homo sapiens
gauguagcuugcccugauu

SEQ ID NO: 1031675 - RNA, 19 nt, Homo sapiens
ugaccgaaguuaccugaga

SEQ ID NO: 1031676 - RNA, 19 nt, Homo sapiens
caagcacaaucaagacgaa

SEQ ID NO: 1031677 - RNA, 19 nt, Homo sapiens
ggaaucagagaaucuacaa

SEQ ID NO: 1031678 - RNA, 19 nt, Homo sapiens
ugagacgacugauguguca

SEQ ID NO: 1031679 - RNA, 19 nt, Homo sapiens
caaauugggaggauuagga

SEQ ID NO: 1031680 - RNA, 19 nt, Homo sapiens
auucaugccuggacaguuu

SEQ ID NO: 1031681 - RNA, 19 nt, Homo sapiens
ggauuaggaacaaguaaga

SEQ ID NO: 1031682 - RNA, 19 nt, Homo sapiens
auagaaagcccucuggaaa

SEQ ID NO: 1031683 - RNA, 19 nt, Homo sapiens
ucaccuaguuauacaaaca

SEQ ID NO: 1031684 - RNA, 19 nt, Homo sapiens
ucaaccgggucucugagua

SEQ ID NO: 1031685 - RNA, 19 nt, Homo sapiens
cgaaugcacugacacuuuu

SEQ ID NO: 1031686 - RNA, 19 nt, Homo sapiens
aauggccucuacuaaauaa

SEQ ID NO: 1031687 - RNA, 19 nt, Homo sapiens
acaaagucaccuaguuaua

SEQ ID NO: 1031688 - RNA, 19 nt, Homo sapiens
ggugcagucuugcuauaug

SEQ ID NO: 1031689 - RNA, 19 nt, Homo sapiens
caugcaggauggacaagaa

SEQ ID NO: 1031690 - RNA, 19 nt, Homo sapiens
aaagucaccuaguuauaca

SEQ ID NO: 1031691 - RNA, 19 nt, Homo sapiens
caaagucaccuaguuauac

SEQ ID NO: 1031692 - RNA, 19 nt, Homo sapiens
ggaggauuaggaacaagua

SEQ ID NO: 1031693 - RNA, 19 nt, Homo sapiens
gcauugaagaaccacauuu

SEQ ID NO: 1031694 - RNA, 19 nt, Homo sapiens
ugauguagcuugcccugau

SEQ ID NO: 1031695 - RNA, 19 nt, Homo sapiens
guccguaccuaucagaaug

SEQ ID NO: 1031696 - RNA, 19 nt, Homo sapiens
uaauggccucuacuaaaua

SEQ ID NO: 1031697 - RNA, 19 nt, Homo sapiens
aggacaauguugguuaaua

SEQ ID NO: 1031698 - RNA, 19 nt, Homo sapiens
ggacaagaaagaaaaguuu

SEQ ID NO: 1031699 - RNA, 19 nt, Homo sapiens
gugugugguucauaacuuu

SEQ ID NO: 1031700 - RNA, 19 nt, Homo sapiens
gagauccuuucccuccaaa

SEQ ID NO: 1031701 - RNA, 19 nt, Homo sapiens
gaaaaggaaucagagaauc

SEQ ID NO: 1031702 - RNA, 19 nt, Homo sapiens
cucaagaucuuucuggaau

SEQ ID NO: 1031703 - RNA, 19 nt, Homo sapiens
agagaauucuggauuugga

SEQ ID NO: 1031704 - RNA, 19 nt, Homo sapiens
uaaaggaacgcaaggaucu

SEQ ID NO: 1031705 - RNA, 19 nt, Homo sapiens
uuacuucgaaggaucauaa

SEQ ID NO: 1031706 - RNA, 19 nt, Homo sapiens
gcugccuccuccagaauuu

SEQ ID NO: 1031707 - RNA, 19 nt, Homo sapiens
ccacugcucggacgugauu

SEQ ID NO: 1031708 - RNA, 19 nt, Homo sapiens
gcaguacuaggcaauuaga

SEQ ID NO: 1031709 - RNA, 19 nt, Homo sapiens
gcaggauggacaagaaaga

SEQ ID NO: 1031710 - RNA, 19 nt, Homo sapiens
cgugauugcugguuucauc

SEQ ID NO: 1031711 - RNA, 19 nt, Homo sapiens
gagauauccauguauuuca

SEQ ID NO: 1031712 - RNA, 19 nt, Homo sapiens
agaacaacaguuucacuuu

SEQ ID NO: 1031713 - RNA, 19 nt, Homo sapiens
ggaaugugugugguucaua

SEQ ID NO: 1031714 - RNA, 19 nt, Homo sapiens
gcuauauggugugagaaau

SEQ ID NO: 1031715 - RNA, 19 nt, Homo sapiens
guaacuccuuugauugaag

SEQ ID NO: 1031716 - RNA, 19 nt, Homo sapiens
cguucaaaguuuaaaguga

SEQ ID NO: 1031717 - RNA, 19 nt, Homo sapiens
cuaauggcuuucccaagga

SEQ ID NO: 1031718 - RNA, 19 nt, Homo sapiens
guaaggcacuaugcaguac

SEQ ID NO: 1031719 - RNA, 19 nt, Homo sapiens
uguaaacgccggacaagug

SEQ ID NO: 1031720 - RNA, 19 nt, Homo sapiens
uuggugagauauccaugua

SEQ ID NO: 1031721 - RNA, 19 nt, Homo sapiens
cagaacaacaguuucacuu

SEQ ID NO: 1031722 - RNA, 19 nt, Homo sapiens
guauugggguuauaugauu

SEQ ID NO: 1031723 - RNA, 19 nt, Homo sapiens
ucacagggguguuugcauu

SEQ ID NO: 1031724 - RNA, 19 nt, Homo sapiens
ccugauugcucgggagaaa

SEQ ID NO: 1031725 - RNA, 19 nt, Homo sapiens
ucgaaugcacugacacuuu

SEQ ID NO: 1031726 - RNA, 19 nt, Homo sapiens
aaccuuaagugcacagaau

SEQ ID NO: 1031727 - RNA, 19 nt, Homo sapiens
caaccgggucucugaguau

SEQ ID NO: 1031728 - RNA, 19 nt, Homo sapiens
cauuuacuccgccuuauau

SEQ ID NO: 1031729 - RNA, 19 nt, Homo sapiens
ggaccuggaagugauagaa

SEQ ID NO: 1031730 - RNA, 19 nt, Homo sapiens
ugagauauccauguauuuc

SEQ ID NO: 1031731 - RNA, 19 nt, Homo sapiens
ucuugacacuuccauguug

SEQ ID NO: 1031732 - RNA, 19 nt, Homo sapiens
aaaggaaucagagaaucua

SEQ ID NO: 1031733 - RNA, 19 nt, Homo sapiens
ucaagaucuuucuggaaug

SEQ ID NO: 1031734 - RNA, 19 nt, Homo sapiens
cacaguugcucaaugucaa

SEQ ID NO: 1031735 - RNA, 19 nt, Homo sapiens
gaccuggaagugauagaaa

SEQ ID NO: 1031736 - RNA, 19 nt, Homo sapiens
ggaaugugcugcugaauaa

SEQ ID NO: 1031737 - RNA, 19 nt, Homo sapiens
uaacagcggugaagaguuu

SEQ ID NO: 1031738 - RNA, 19 nt, Homo sapiens
ggaaaggccuccauucgaa

SEQ ID NO: 1031739 - RNA, 19 nt, Homo sapiens
gaccaggacugcuuucuuu

SEQ ID NO: 1031740 - RNA, 19 nt, Homo sapiens
gcagaaauuucaggucuuu

SEQ ID NO: 1031741 - RNA, 19 nt, Homo sapiens
gaagaugacccauuauuuc

SEQ ID NO: 1031742 - RNA, 19 nt, Homo sapiens
uaagaaagauggcgugugu

SEQ ID NO: 1031743 - RNA, 19 nt, Homo sapiens
gcacaggagggaauauaua

SEQ ID NO: 1031744 - RNA, 19 nt, Homo sapiens
ggaaguguguuauaagcuu

SEQ ID NO: 1031745 - RNA, 19 nt, Homo sapiens
ggaauaaacgucagccaaa

SEQ ID NO: 1031746 - RNA, 19 nt, Homo sapiens
ggaagguaaugacgaaaga

SEQ ID NO: 1031747 - RNA, 19 nt, Homo sapiens
cgaaugauguggacaacaa

SEQ ID NO: 1031748 - RNA, 19 nt, Homo sapiens
caagcugggucuaguguuu

SEQ ID NO: 1031749 - RNA, 19 nt, Homo sapiens
gaucauaggagccuucuga

SEQ ID NO: 1031750 - RNA, 19 nt, Homo sapiens
agaaauagcucaugcaacu

SEQ ID NO: 1031751 - RNA, 19 nt, Homo sapiens
ccagagggauuuguuauug

SEQ ID NO: 1031752 - RNA, 19 nt, Homo sapiens
gagaagaugaagguuauua

SEQ ID NO: 1031753 - RNA, 19 nt, Homo sapiens
ggacuuaugugcuuuuauu

SEQ ID NO: 1031754 - RNA, 19 nt, Homo sapiens
gaaguguguuauaagcuuu

SEQ ID NO: 1031755 - RNA, 19 nt, Homo sapiens
gcaucgugcugaaguauga

SEQ ID NO: 1031756 - RNA, 19 nt, Homo sapiens
cauagcaucuuuacuggaa

SEQ ID NO: 1031757 - RNA, 19 nt, Homo sapiens
gugagaagaugaagguuau

SEQ ID NO: 1031758 - RNA, 19 nt, Homo sapiens
ucaaagaccacacaguuaa

SEQ ID NO: 1031759 - RNA, 19 nt, Homo sapiens
aaagucugguguagaaaua

SEQ ID NO: 1031760 - RNA, 19 nt, Homo sapiens
caacugaggauuuagagaa

SEQ ID NO: 1031761 - RNA, 19 nt, Homo sapiens
gaauaacagugagaagaug

SEQ ID NO: 1031762 - RNA, 19 nt, Homo sapiens
agccaaagcuucaggguaa

SEQ ID NO: 1031763 - RNA, 19 nt, Homo sapiens
gcucaaagaccacacaguu

SEQ ID NO: 1031764 - RNA, 19 nt, Homo sapiens
gcagugagaccuacaguca

SEQ ID NO: 1031765 - RNA, 19 nt, Homo sapiens
gauccgaccuaccauguuc

SEQ ID NO: 1031766 - RNA, 19 nt, Homo sapiens
ccacacaguuaauugaaau

SEQ ID NO: 1031767 - RNA, 19 nt, Homo sapiens
gucuuaaggugcaguauuu

SEQ ID NO: 1031768 - RNA, 19 nt, Homo sapiens
gcagacuggugggaucaua

SEQ ID NO: 1031769 - RNA, 19 nt, Homo sapiens
gagggaauauauacauugu

SEQ ID NO: 1031770 - RNA, 19 nt, Homo sapiens
gaauaaacgucagccaaag

SEQ ID NO: 1031771 - RNA, 19 nt, Homo sapiens
ucagaauacuggaggguuu

SEQ ID NO: 1031772 - RNA, 19 nt, Homo sapiens
cagaugacuuugugccuuu

SEQ ID NO: 1031773 - RNA, 19 nt, Homo sapiens
cauaggagccuucugaaug

SEQ ID NO: 1031774 - RNA, 19 nt, Homo sapiens
ucaugcaacugaggauuua

SEQ ID NO: 1031775 - RNA, 19 nt, Homo sapiens
guggaaggaugguguauuc

SEQ ID NO: 1031776 - RNA, 19 nt, Homo sapiens
gagaauaauggcaguaaga

SEQ ID NO: 1031777 - RNA, 19 nt, Homo sapiens
ugaauggagugcuuuacaa

SEQ ID NO: 1031778 - RNA, 19 nt, Homo sapiens
ugaagaugacccauuauuu

SEQ ID NO: 1031779 - RNA, 19 nt, Homo sapiens
gcagugucccaucgucuua

SEQ ID NO: 1031780 - RNA, 19 nt, Homo sapiens
ggagguggacggucagaaa

SEQ ID NO: 1031781 - RNA, 19 nt, Homo sapiens
gauuuguuauugcgaauga

SEQ ID NO: 1031782 - RNA, 19 nt, Homo sapiens
ccucaguggugugucauua

SEQ ID NO: 1031783 - RNA, 19 nt, Homo sapiens
caacagcccagaugcagaa

SEQ ID NO: 1031784 - RNA, 19 nt, Homo sapiens
gaauaauggcaguaagaaa

SEQ ID NO: 1031785 - RNA, 19 nt, Homo sapiens
gaguugguauccugaagaa

SEQ ID NO: 1031786 - RNA, 19 nt, Homo sapiens
gcgaugccuuaggauauua

SEQ ID NO: 1031787 - RNA, 19 nt, Homo sapiens
gagcgaugccuuaggauau

SEQ ID NO: 1031788 - RNA, 19 nt, Homo sapiens
auaggagccuucugaauga

SEQ ID NO: 1031789 - RNA, 19 nt, Homo sapiens
gaaauaacagcggugaaga

SEQ ID NO: 1031790 - RNA, 19 nt, Homo sapiens
gaagggaaacccacagauc

SEQ ID NO: 1031791 - RNA, 19 nt, Homo sapiens
ggagcgaugccuuaggaua

SEQ ID NO: 1031792 - RNA, 19 nt, Homo sapiens
ggguuauccucacaaauga

SEQ ID NO: 1031793 - RNA, 19 nt, Homo sapiens
aaagaugggcagugguuua

SEQ ID NO: 1031794 - RNA, 19 nt, Homo sapiens
uaaacccuauugaggauga

SEQ ID NO: 1031795 - RNA, 19 nt, Homo sapiens
ggagacggcacuaugagaa

SEQ ID NO: 1031796 - RNA, 19 nt, Homo sapiens
auggagugcuuuacaauuu

SEQ ID NO: 1031797 - RNA, 19 nt, Homo sapiens
gaacuggugacacagaaau

SEQ ID NO: 1031798 - RNA, 19 nt, Homo sapiens
uugcugaugugucuaauga

SEQ ID NO: 1031799 - RNA, 19 nt, Homo sapiens
ccucuucuaugaucgaauu

SEQ ID NO: 1031800 - RNA, 19 nt, Homo sapiens
uaagagcuguaucgugaau

SEQ ID NO: 1031801 - RNA, 19 nt, Homo sapiens
ggagggaauauauacauug

SEQ ID NO: 1031802 - RNA, 19 nt, Homo sapiens
uccugaagaugacccauua

SEQ ID NO: 1031803 - RNA, 19 nt, Homo sapiens
ugaaguggaugccuggaau

SEQ ID NO: 1031804 - RNA, 19 nt, Homo sapiens
ggaaauauuagucgucaag

SEQ ID NO: 1031805 - RNA, 19 nt, Homo sapiens
ugggauccuuggaauauuu

SEQ ID NO: 1031806 - RNA, 19 nt, Homo sapiens
gaacuuuugugcccaagaa

SEQ ID NO: 1031807 - RNA, 19 nt, Homo sapiens
gaaguuccacagccacuga

SEQ ID NO: 1031808 - RNA, 19 nt, Homo sapiens
cugaggauuuagagaauaa

SEQ ID NO: 1031809 - RNA, 19 nt, Homo sapiens
gaauggagugcuuuacaau

SEQ ID NO: 1031810 - RNA, 19 nt, Homo sapiens
gcugaaguaugaaccagau

SEQ ID NO: 1031811 - RNA, 19 nt, Homo sapiens
aaaggcagcucuacauggu

SEQ ID NO: 1031812 - RNA, 19 nt, Homo sapiens
cacaggaacuggugacaca

SEQ ID NO: 1031813 - RNA, 19 nt, Homo sapiens
ggagcuugcugaugugucu

SEQ ID NO: 1031814 - RNA, 19 nt, Homo sapiens
gauguuaagauacuguuga

SEQ ID NO: 1031815 - RNA, 19 nt, Homo sapiens
cggaaugugcugcugaaua

SEQ ID NO: 1031816 - RNA, 19 nt, Homo sapiens
cuaaggaguugcggaaugu

SEQ ID NO: 1031817 - RNA, 19 nt, Homo sapiens
ccaaggaugaauuuguuaa

SEQ ID NO: 1031818 - RNA, 19 nt, Homo sapiens
ccacagaucccucuaagcu

SEQ ID NO: 1031819 - RNA, 19 nt, Homo sapiens
cgaaagaugggcagugguu

SEQ ID NO: 1031820 - RNA, 19 nt, Homo sapiens
gguggacggucagaaaguu

SEQ ID NO: 1031821 - RNA, 19 nt, Homo sapiens
gaacggcuucauuaucuca

SEQ ID NO: 1031822 - RNA, 19 nt, Homo sapiens
gggaaaggccuccauucga

SEQ ID NO: 1031823 - RNA, 19 nt, Homo sapiens
gaucaaagucugguguaga

SEQ ID NO: 1031824 - RNA, 19 nt, Homo sapiens
ucccaaggaugaauuuguu

SEQ ID NO: 1031825 - RNA, 19 nt, Homo sapiens
ggaaaguccgucauucaca

SEQ ID NO: 1031826 - RNA, 19 nt, Homo sapiens
ucagaaaguugaaguucca

SEQ ID NO: 1031827 - RNA, 19 nt, Homo sapiens
gcagcuacauggcuuacag

SEQ ID NO: 1031828 - RNA, 19 nt, Homo sapiens
ggccucagaugacuuugug

SEQ ID NO: 1031829 - RNA, 19 nt, Homo sapiens
gaaaaucgccacacuugga

SEQ ID NO: 1031830 - RNA, 19 nt, Homo sapiens
gaaagaugggcagugguuu

SEQ ID NO: 1031831 - RNA, 19 nt, Homo sapiens
guggaugccuggaaucaca

SEQ ID NO: 1031832 - RNA, 19 nt, Homo sapiens
agagcuguaucgugaauug

SEQ ID NO: 1031833 - RNA, 19 nt, Homo sapiens
gaaugaccaggacugcuuu

SEQ ID NO: 1031834 - RNA, 19 nt, Homo sapiens
gcaaaggaccuggcaaagg

SEQ ID NO: 1031835 - RNA, 19 nt, Homo sapiens
gaccuacagucaagcaaag

SEQ ID NO: 1031836 - RNA, 19 nt, Homo sapiens
gcucaugccugaaauucua

SEQ ID NO: 1031837 - RNA, 19 nt, Homo sapiens
gguggaagaugcaguuuau

SEQ ID NO: 1031838 - RNA, 19 nt, Homo sapiens
ggaagaugcaguuuaugua

SEQ ID NO: 1031839 - RNA, 19 nt, Homo sapiens
caagauaaggucaacauug

SEQ ID NO: 1031840 - RNA, 19 nt, Homo sapiens
gaagaugcaguuuauguag

SEQ ID NO: 1031841 - RNA, 19 nt, Homo sapiens
ucccagcacuuaaggagua

SEQ ID NO: 1031842 - RNA, 19 nt, Homo sapiens
ggacucccuugcaagaaga

SEQ ID NO: 1031843 - RNA, 19 nt, Homo sapiens
guaggggucugaagauuuu

SEQ ID NO: 1031844 - RNA, 19 nt, Homo sapiens
cccggacucugccaaauuu

SEQ ID NO: 1031845 - RNA, 19 nt, Homo sapiens
gagcgcgucuuccagaucu

SEQ ID NO: 1031846 - RNA, 19 nt, Homo sapiens
gucaagagaucgacagcau

SEQ ID NO: 1031847 - RNA, 19 nt, Homo sapiens
ccuguaaucccagcacuua

SEQ ID NO: 1031848 - RNA, 19 nt, Homo sapiens
gagaggaagcggcgaagau

SEQ ID NO: 1031849 - RNA, 19 nt, Homo sapiens
ggagguggaagaugcaguu

SEQ ID NO: 1031850 - RNA, 19 nt, Homo sapiens
cggcgaagauggcgagauc

SEQ ID NO: 1031851 - RNA, 19 nt, Homo sapiens
gaugcccacacaacacuua

SEQ ID NO: 1031852 - RNA, 19 nt, Homo sapiens
cugauugccucacucaaga

SEQ ID NO: 1031853 - RNA, 19 nt, Homo sapiens
gauggugggugccuguagu

SEQ ID NO: 1031854 - RNA, 19 nt, Homo sapiens
acaggccuauuguaugaaa

SEQ ID NO: 1031855 - RNA, 19 nt, Homo sapiens
gcagggagaaucgcuugaa

SEQ ID NO: 1031856 - RNA, 19 nt, Homo sapiens
guacgagacgggaggauca

SEQ ID NO: 1031857 - RNA, 19 nt, Homo sapiens
cgacagagcaagacuccau

SEQ ID NO: 1031858 - RNA, 19 nt, Homo sapiens
gauugccucacucaagaua

SEQ ID NO: 1031859 - RNA, 19 nt, Homo sapiens
aggcugcggugaaccauga

SEQ ID NO: 1031860 - RNA, 19 nt, Homo sapiens
gaggagaagguugcaguga

SEQ ID NO: 1031861 - RNA, 19 nt, Homo sapiens
gcaccuguaaucccagcua

SEQ ID NO: 1031862 - RNA, 19 nt, Homo sapiens
gaaaccccgucucuacuga

SEQ ID NO: 1031863 - RNA, 19 nt, Homo sapiens
gcggugaaccaugauugua

SEQ ID NO: 1031864 - RNA, 19 nt, Homo sapiens
cagcaguuuccuuuacuuu

SEQ ID NO: 1031865 - RNA, 19 nt, Homo sapiens
gaagguggagguggaagau

SEQ ID NO: 1031866 - RNA, 19 nt, Homo sapiens
gacccugucucaaacaaaa

SEQ ID NO: 1031867 - RNA, 19 nt, Homo sapiens
gagcucuacaggccuauug

SEQ ID NO: 1031868 - RNA, 19 nt, Homo sapiens
ccagcaguuuccuuuacuu

SEQ ID NO: 1031869 - RNA, 19 nt, Homo sapiens
ggugccagcaguuuccuuu

SEQ ID NO: 1031870 - RNA, 19 nt, Homo sapiens
gcaagacuccaucccaaaa

SEQ ID NO: 1031871 - RNA, 19 nt, Homo sapiens
cugaaauucuagcaguuug

SEQ ID NO: 1031872 - RNA, 19 nt, Homo sapiens
ccacuacaccacaccuaga

SEQ ID NO: 1031873 - RNA, 19 nt, Homo sapiens
uggaagaugcaguuuaugu

SEQ ID NO: 1031874 - RNA, 19 nt, Homo sapiens
gccugaaauucuagcaguu

SEQ ID NO: 1031875 - RNA, 19 nt, Homo sapiens
uuucuuuccucccacauau

SEQ ID NO: 1031876 - RNA, 19 nt, Homo sapiens
gggaggaucacgaggucaa

SEQ ID NO: 1031877 - RNA, 19 nt, Homo sapiens
gaaauucuagcaguuugag

SEQ ID NO: 1031878 - RNA, 19 nt, Homo sapiens
caucgaggcugcggugaac

SEQ ID NO: 1031879 - RNA, 19 nt, Homo sapiens
ggcuaaggcaggaggauug

SEQ ID NO: 1031880 - RNA, 19 nt, Homo sapiens
uguaguaccagcuauuuua

SEQ ID NO: 1031881 - RNA, 19 nt, Homo sapiens
ucaagauaaggucaacauu

SEQ ID NO: 1031882 - RNA, 19 nt, Homo sapiens
ccugaaauucuagcaguuu

SEQ ID NO: 1031883 - RNA, 19 nt, Homo sapiens
gugggugccuguaguacca

SEQ ID NO: 1031884 - RNA, 19 nt, Homo sapiens
ugaaauucuagcaguuuga

SEQ ID NO: 1031885 - RNA, 19 nt, Homo sapiens
ggaucacgaggucaagaga

SEQ ID NO: 1031886 - RNA, 19 nt, Homo sapiens
ccaugauuguaccacugua

SEQ ID NO: 1031887 - RNA, 19 nt, Homo sapiens
uaaggcaggaggauugcuu

SEQ ID NO: 1031888 - RNA, 19 nt, Homo sapiens
cccauugauucgcggguuu

SEQ ID NO: 1031889 - RNA, 19 nt, Homo sapiens
gccagcaguuuccuuuacu

SEQ ID NO: 1031890 - RNA, 19 nt, Homo sapiens
gaucacgaggucaagagau

SEQ ID NO: 1031891 - RNA, 19 nt, Homo sapiens
gugccagcaguuuccuuua

SEQ ID NO: 1031892 - RNA, 19 nt, Homo sapiens
gagaauccaaaauuaggua

SEQ ID NO: 1031893 - RNA, 19 nt, Homo sapiens
gcuccgacagcucaaguuc

SEQ ID NO: 1031894 - RNA, 19 nt, Homo sapiens
ggaccuagguucucauauu

SEQ ID NO: 1031895 - RNA, 19 nt, Homo sapiens
ugaaaucacucacugcaua

SEQ ID NO: 1031896 - RNA, 19 nt, Homo sapiens
gagcagagcagccaucuuu

SEQ ID NO: 1031897 - RNA, 19 nt, Homo sapiens
gagcauaugcgugugauua

SEQ ID NO: 1031898 - RNA, 19 nt, Homo sapiens
uaaacaaaguucagucuuc

SEQ ID NO: 1031899 - RNA, 19 nt, Homo sapiens
gaacucuggcucauccuua

SEQ ID NO: 1031900 - RNA, 19 nt, Homo sapiens
gaccuagguucucauauuc

SEQ ID NO: 1031901 - RNA, 19 nt, Homo sapiens
gcauaugcgugugauuauu

SEQ ID NO: 1031902 - RNA, 19 nt, Homo sapiens
guccugaccucucuuauca

SEQ ID NO: 1031903 - RNA, 19 nt, Homo sapiens
gaaaggcuguuggcaucaa

SEQ ID NO: 1031904 - RNA, 19 nt, Homo sapiens
gcacacuucuuugcugguu

SEQ ID NO: 1031905 - RNA, 19 nt, Homo sapiens
cggcagaguuguucagguu

SEQ ID NO: 1031906 - RNA, 19 nt, Homo sapiens
gugauuauuuggaacaguu

SEQ ID NO: 1031907 - RNA, 19 nt, Homo sapiens
ucacugaugucugcacuug

SEQ ID NO: 1031908 - RNA, 19 nt, Homo sapiens
gagaagcucaaguccauga

SEQ ID NO: 1031909 - RNA, 19 nt, Homo sapiens
caacagcgccgucaucaac

SEQ ID NO: 1031910 - RNA, 19 nt, Homo sapiens
guucucauauucuugguau

SEQ ID NO: 1031911 - RNA, 19 nt, Homo sapiens
gaacuacuggcgcaaguca

SEQ ID NO: 1031912 - RNA, 19 nt, Homo sapiens
cauaugcgugugauuauuu

SEQ ID NO: 1031913 - RNA, 19 nt, Homo sapiens
uguuagggcugaagaauag

SEQ ID NO: 1031914 - RNA, 19 nt, Homo sapiens
guaucaggcuggguuuauu

SEQ ID NO: 1031915 - RNA, 19 nt, Homo sapiens
aaacaaaguucagucuucu

SEQ ID NO: 1031916 - RNA, 19 nt, Homo sapiens
gcagagcagccaucuuuua

SEQ ID NO: 1031917 - RNA, 19 nt, Homo sapiens
agaagggccuguacaacga

SEQ ID NO: 1031918 - RNA, 19 nt, Homo sapiens
gggccaagcgcaaguauca

SEQ ID NO: 1031919 - RNA, 19 nt, Homo sapiens
gagaacuacuggcgcaagu

SEQ ID NO: 1031920 - RNA, 19 nt, Homo sapiens
ucccaaagcuauuguuaag

SEQ ID NO: 1031921 - RNA, 19 nt, Homo sapiens
gauaugcugcugaugaaau

SEQ ID NO: 1031922 - RNA, 19 nt, Homo sapiens
gcucugcuguucuccacuu

SEQ ID NO: 1031923 - RNA, 19 nt, Homo sapiens
guaaaucuucgcaguguuc

SEQ ID NO: 1031924 - RNA, 19 nt, Homo sapiens
gaagacaagauuagaugca

SEQ ID NO: 1031925 - RNA, 19 nt, Homo sapiens
uggauaugcugcugaugaa

SEQ ID NO: 1031926 - RNA, 19 nt, Homo sapiens
gggcugaagaauagaauug

SEQ ID NO: 1031927 - RNA, 19 nt, Homo sapiens
guggauaugcugcugauga

SEQ ID NO: 1031928 - RNA, 19 nt, Homo sapiens
caguuagacuugccacguu

SEQ ID NO: 1031929 - RNA, 19 nt, Homo sapiens
caucccaaagcuauuguua

SEQ ID NO: 1031930 - RNA, 19 nt, Homo sapiens
guguaaaucuucgcagugu

SEQ ID NO: 1031931 - RNA, 19 nt, Homo sapiens
ccuuuagucuccuggcuuu

SEQ ID NO: 1031932 - RNA, 19 nt, Homo sapiens
gcaaacacccuuucuuccu

SEQ ID NO: 1031933 - RNA, 19 nt, Homo sapiens
gagcagccaucuuuuaagu

SEQ ID NO: 1031934 - RNA, 19 nt, Homo sapiens
gcugcaaguuccaguucaa

SEQ ID NO: 1031935 - RNA, 19 nt, Homo sapiens
uaucaggcuggguuuauuu

SEQ ID NO: 1031936 - RNA, 19 nt, Homo sapiens
ccucaggaagacaagauua

SEQ ID NO: 1031937 - RNA, 19 nt, Homo sapiens
ggacgagugcgccaagauc

SEQ ID NO: 1031938 - RNA, 19 nt, Homo sapiens
ccuagguucucauauucuu

SEQ ID NO: 1031939 - RNA, 19 nt, Homo sapiens
gcucauccuuacguaguug

SEQ ID NO: 1031940 - RNA, 19 nt, Homo sapiens
gaaaauuguuguggugugu

SEQ ID NO: 1031941 - RNA, 19 nt, Homo sapiens
gaaaucacucacugcauac

SEQ ID NO: 1031942 - RNA, 19 nt, Homo sapiens
gcgcaacaaguacuucuuc

SEQ ID NO: 1031943 - RNA, 19 nt, Homo sapiens
gccaggaccuagguucuca

SEQ ID NO: 1031944 - RNA, 19 nt, Homo sapiens
aaucuucgcaguguucuaa

SEQ ID NO: 1031945 - RNA, 19 nt, Homo sapiens
ggccacggauccuggagau

SEQ ID NO: 1031946 - RNA, 19 nt, Homo sapiens
gcucaugcaaacacccuuu

SEQ ID NO: 1031947 - RNA, 19 nt, Homo sapiens
ccugaccucucuuaucaag

SEQ ID NO: 1031948 - RNA, 19 nt, Homo sapiens
gcgccgagcagucaucauc

SEQ ID NO: 1031949 - RNA, 19 nt, Homo sapiens
gcauacggccucaggacau

SEQ ID NO: 1031950 - RNA, 19 nt, Homo sapiens
gcgccgucaucaacgacua

SEQ ID NO: 1031951 - RNA, 19 nt, Homo sapiens
ccucaugucauccuucuag

SEQ ID NO: 1031952 - RNA, 19 nt, Homo sapiens
ccuuccaagucuagcauuu

SEQ ID NO: 1031953 - RNA, 19 nt, Homo sapiens
caggaccuagguucucaua

SEQ ID NO: 1031954 - RNA, 19 nt, Homo sapiens
gugcuucggcugcaaguuc

SEQ ID NO: 1031955 - RNA, 19 nt, Homo sapiens
gcggcugcaucgugucuca

SEQ ID NO: 1031956 - RNA, 19 nt, Homo sapiens
ggaaaggcuguuggcauca

SEQ ID NO: 1031957 - RNA, 19 nt, Homo sapiens
acuacuggcgcaagucaua

SEQ ID NO: 1031958 - RNA, 19 nt, Homo sapiens
gcgcugagaagggccugua

SEQ ID NO: 1031959 - RNA, 19 nt, Homo sapiens
ccgcaaagcagacccugau

SEQ ID NO: 1031960 - RNA, 19 nt, Homo sapiens
gaugucugcacuugguuga

SEQ ID NO: 1031961 - RNA, 19 nt, Homo sapiens
ggaacucuggcucauccuu

SEQ ID NO: 1031962 - RNA, 19 nt, Homo sapiens
ggagauggacaaggaagag

SEQ ID NO: 1031963 - RNA, 19 nt, Homo sapiens
cagagcagccaucuuuuaa

SEQ ID NO: 1031964 - RNA, 19 nt, Homo sapiens
ucaggaagacaagauuaga

SEQ ID NO: 1031965 - RNA, 19 nt, Homo sapiens
ucucauauucuugguauuc

SEQ ID NO: 1031966 - RNA, 19 nt, Homo sapiens
guguccguguccuucuuua

SEQ ID NO: 1031967 - RNA, 19 nt, Homo sapiens
ggcgaaggcuacacuuacg

SEQ ID NO: 1031968 - RNA, 19 nt, Homo sapiens
cuaaacaaaguucagucuu

SEQ ID NO: 1031969 - RNA, 19 nt, Homo sapiens
gagauggacaaggaagaga

SEQ ID NO: 1031970 - RNA, 19 nt, Homo sapiens
aggaagacaagauuagaug

SEQ ID NO: 1031971 - RNA, 19 nt, Homo sapiens
caggaagacaagauuagau

SEQ ID NO: 1031972 - RNA, 19 nt, Homo sapiens
ggauaugcugcugaugaaa

SEQ ID NO: 1031973 - RNA, 19 nt, Homo sapiens
caguggauaugcugcugau

SEQ ID NO: 1031974 - RNA, 19 nt, Homo sapiens
ucaggcuggguuuauuuaa

SEQ ID NO: 1031975 - RNA, 19 nt, Homo sapiens
aaaggcuguuggcaucaau

SEQ ID NO: 1031976 - RNA, 19 nt, Homo sapiens
ggcucauccuuacguaguu

SEQ ID NO: 1031977 - RNA, 19 nt, Homo sapiens
cauacggccucaggacauc

SEQ ID NO: 1031978 - RNA, 19 nt, Homo sapiens
uaacaaagcccuuccauuc

SEQ ID NO: 1031979 - RNA, 19 nt, Homo sapiens
ccacacuucucauguauaa

SEQ ID NO: 1031980 - RNA, 19 nt, Homo sapiens
gcacuuacuuucagcagaa

SEQ ID NO: 1031981 - RNA, 19 nt, Homo sapiens
ugacucaacuuugcacuua

SEQ ID NO: 1031982 - RNA, 19 nt, Homo sapiens
ccacaugacuuggaauuga

SEQ ID NO: 1031983 - RNA, 19 nt, Homo sapiens
cagcagcucuucucaaguu

SEQ ID NO: 1031984 - RNA, 19 nt, Homo sapiens
ucacugacauuccacauga

SEQ ID NO: 1031985 - RNA, 19 nt, Homo sapiens
ggaagaugaugaccuaaag

SEQ ID NO: 1031986 - RNA, 19 nt, Homo sapiens
ugaggaagaugaugaccua

SEQ ID NO: 1031987 - RNA, 19 nt, Homo sapiens
gcugagugcugaugaguug

SEQ ID NO: 1031988 - RNA, 19 nt, Homo sapiens
caaggcagaugaccuaauc

SEQ ID NO: 1031989 - RNA, 19 nt, Homo sapiens
gggaaacccucagauauca

SEQ ID NO: 1031990 - RNA, 19 nt, Homo sapiens
gagcaaggcagaugaccua

SEQ ID NO: 1031991 - RNA, 19 nt, Homo sapiens
agaaugauccuauagauga

SEQ ID NO: 1031992 - RNA, 19 nt, Homo sapiens
uacuggagcuucaggaaua

SEQ ID NO: 1031993 - RNA, 19 nt, Homo sapiens
ccugaugacuuacaagauu

SEQ ID NO: 1031994 - RNA, 19 nt, Homo sapiens
ccaaugagaucacugacau

SEQ ID NO: 1031995 - RNA, 19 nt, Homo sapiens
guuggacacugaucuguuu

SEQ ID NO: 1031996 - RNA, 19 nt, Homo sapiens
gaacagugcgcuaacaaag

SEQ ID NO: 1031997 - RNA, 19 nt, Homo sapiens
gccgagaggugaacacaga

SEQ ID NO: 1031998 - RNA, 19 nt, Homo sapiens
guccaggaguugucagaua

SEQ ID NO: 1031999 - RNA, 19 nt, Homo sapiens
gcacggcaguugucucaca

SEQ ID NO: 1032000 - RNA, 19 nt, Homo sapiens
gggcguauaguacaugaua

SEQ ID NO: 1032001 - RNA, 19 nt, Homo sapiens
guugucagauagaggaaua

SEQ ID NO: 1032002 - RNA, 19 nt, Homo sapiens
gaagacccauuugcuuuca

SEQ ID NO: 1032003 - RNA, 19 nt, Homo sapiens
gaaacccucagauaucaaa

SEQ ID NO: 1032004 - RNA, 19 nt, Homo sapiens
gaacaccagccuaccaaug

SEQ ID NO: 1032005 - RNA, 19 nt, Homo sapiens
ccuggaaacugaauuggaa

SEQ ID NO: 1032006 - RNA, 19 nt, Homo sapiens
gcagugcucugugccaguu

SEQ ID NO: 1032007 - RNA, 19 nt, Homo sapiens
gggcaacugugagaaagaa

SEQ ID NO: 1032008 - RNA, 19 nt, Homo sapiens
gucuagagcuggaugagaa

SEQ ID NO: 1032009 - RNA, 19 nt, Homo sapiens
gcuauugaaugggcguaua

SEQ ID NO: 1032010 - RNA, 19 nt, Homo sapiens
acggcuaccugaugacuua

SEQ ID NO: 1032011 - RNA, 19 nt, Homo sapiens
caccagacauuguuuccaa

SEQ ID NO: 1032012 - RNA, 19 nt, Homo sapiens
caugauaauuucucuaguc

SEQ ID NO: 1032013 - RNA, 19 nt, Homo sapiens
cgaagaggcugaggagcuu

SEQ ID NO: 1032014 - RNA, 19 nt, Homo sapiens
gaugaugaccuaaagaaag

SEQ ID NO: 1032015 - RNA, 19 nt, Homo sapiens
ugaauuggaagacccauuu

SEQ ID NO: 1032016 - RNA, 19 nt, Homo sapiens
gaaacugugcacccagaaa

SEQ ID NO: 1032017 - RNA, 19 nt, Homo sapiens
ggaagacccauuugcuuuc

SEQ ID NO: 1032018 - RNA, 19 nt, Homo sapiens
cggcauacguuuaggaaag

SEQ ID NO: 1032019 - RNA, 19 nt, Homo sapiens
gaagaugaugaccuaaaga

SEQ ID NO: 1032020 - RNA, 19 nt, Homo sapiens
ccucagauaucaaagacau

SEQ ID NO: 1032021 - RNA, 19 nt, Homo sapiens
ucuccacacuucucaugua

SEQ ID NO: 1032022 - RNA, 19 nt, Homo sapiens
ccaacggacuggauggaau

SEQ ID NO: 1032023 - RNA, 19 nt, Homo sapiens
ccagagagagacagagauu

SEQ ID NO: 1032024 - RNA, 19 nt, Homo sapiens
ucaaugaggaagaugauga

SEQ ID NO: 1032025 - RNA, 19 nt, Homo sapiens
gaaugggcguauaguacau

SEQ ID NO: 1032026 - RNA, 19 nt, Homo sapiens
cacaugacuuggaauugaa

SEQ ID NO: 1032027 - RNA, 19 nt, Homo sapiens
aaccaagccuccugcacua

SEQ ID NO: 1032028 - RNA, 19 nt, Homo sapiens
caacuuugcacuuacuuuc

SEQ ID NO: 1032029 - RNA, 19 nt, Homo sapiens
cugaugaguugccggauga

SEQ ID NO: 1032030 - RNA, 19 nt, Homo sapiens
gcacccaccacacacacua

SEQ ID NO: 1032031 - RNA, 19 nt, Homo sapiens
ugagaucacugacauucca

SEQ ID NO: 1032032 - RNA, 19 nt, Homo sapiens
uggaagacccauuugcuuu

SEQ ID NO: 1032033 - RNA, 19 nt, Homo sapiens
gcagaggaaacccaggaaa

SEQ ID NO: 1032034 - RNA, 19 nt, Homo sapiens
cugaugacuuacaagauuu

SEQ ID NO: 1032035 - RNA, 19 nt, Homo sapiens
gaccggauccucaugaaag

SEQ ID NO: 1032036 - RNA, 19 nt, Homo sapiens
gaaugauccuauagaugag

SEQ ID NO: 1032037 - RNA, 19 nt, Homo sapiens
ugacauuccacaugacuug

SEQ ID NO: 1032038 - RNA, 19 nt, Homo sapiens
gaaggucaggcaccagaug

SEQ ID NO: 1032039 - RNA, 19 nt, Homo sapiens
gaaagccacagccuucucu

SEQ ID NO: 1032040 - RNA, 19 nt, Homo sapiens
uccaacauauccucuugaa

SEQ ID NO: 1032041 - RNA, 19 nt, Homo sapiens
ggacugaccggauccucau

SEQ ID NO: 1032042 - RNA, 19 nt, Homo sapiens
gcagcacucccaccuguca

SEQ ID NO: 1032043 - RNA, 19 nt, Homo sapiens
caacggacuggauggaaug

SEQ ID NO: 1032044 - RNA, 19 nt, Homo sapiens
ggugaacagugcgcuaaca

SEQ ID NO: 1032045 - RNA, 19 nt, Homo sapiens
guucugcuaccuugucaaa

SEQ ID NO: 1032046 - RNA, 19 nt, Homo sapiens
ggcguauaguacaugauaa

SEQ ID NO: 1032047 - RNA, 19 nt, Homo sapiens
gcuaccugaugacuuacaa

SEQ ID NO: 1032048 - RNA, 19 nt, Homo sapiens
caaguugcacagccaaguu

SEQ ID NO: 1032049 - RNA, 19 nt, Homo sapiens
ccagcagcaugcaguggaa

SEQ ID NO: 1032050 - RNA, 19 nt, Homo sapiens
gguuuggacuggucugaag

SEQ ID NO: 1032051 - RNA, 19 nt, Homo sapiens
gaauuggaagacccauuug

SEQ ID NO: 1032052 - RNA, 19 nt, Homo sapiens
agagcaaguuggcccagaa

SEQ ID NO: 1032053 - RNA, 19 nt, Homo sapiens
gcaaggcagaugaccuaau

SEQ ID NO: 1032054 - RNA, 19 nt, Homo sapiens
ccgggaaacccucagauau

SEQ ID NO: 1032055 - RNA, 19 nt, Homo sapiens
gcacccagaaacaucaguu

SEQ ID NO: 1032056 - RNA, 19 nt, Homo sapiens
aagaugaugaccuaaagaa

SEQ ID NO: 1032057 - RNA, 19 nt, Homo sapiens
guacuggagcuucaggaau

SEQ ID NO: 1032058 - RNA, 19 nt, Homo sapiens
ugccacggcuaccugauga

SEQ ID NO: 1032059 - RNA, 19 nt, Homo sapiens
ugaguugccggaugacauu

SEQ ID NO: 1032060 - RNA, 19 nt, Homo sapiens
aaacacaagaagaagagaa

SEQ ID NO: 1032061 - RNA, 19 nt, Homo sapiens
acaaagcccuuccauucac

SEQ ID NO: 1032062 - RNA, 19 nt, Homo sapiens
gcaaguuggcccagaaucg

SEQ ID NO: 1032063 - RNA, 19 nt, Homo sapiens
ucaccucacgacagcaaua

SEQ ID NO: 1032064 - RNA, 19 nt, Homo sapiens
ugaaugggcguauaguaca

SEQ ID NO: 1032065 - RNA, 19 nt, Homo sapiens
ugaacagugcgcuaacaaa

SEQ ID NO: 1032066 - RNA, 19 nt, Homo sapiens
ggcagaaucucgucaaaag

SEQ ID NO: 1032067 - RNA, 19 nt, Homo sapiens
acucccaccugucaccuuu

SEQ ID NO: 1032068 - RNA, 19 nt, Homo sapiens
gcguauaguacaugauaau

SEQ ID NO: 1032069 - RNA, 19 nt, Homo sapiens
ucucucgagugccugagua

SEQ ID NO: 1032070 - RNA, 19 nt, Homo sapiens
cuaacaaagcccuuccauu

SEQ ID NO: 1032071 - RNA, 19 nt, Homo sapiens
cagggugacucaacuuugc

SEQ ID NO: 1032072 - RNA, 19 nt, Homo sapiens
cgggaaacccucagauauc

SEQ ID NO: 1032073 - RNA, 19 nt, Homo sapiens
gaaaggggcaacugugaga

SEQ ID NO: 1032074 - RNA, 19 nt, Homo sapiens
gagagagacagagauuuua

SEQ ID NO: 1032075 - RNA, 19 nt, Homo sapiens
uccaggaguugucagauag

SEQ ID NO: 1032076 - RNA, 19 nt, Homo sapiens
gagauaacucccguaaagu

SEQ ID NO: 1032077 - RNA, 19 nt, Homo sapiens
ugaagagagcggagaggaa

SEQ ID NO: 1032078 - RNA, 19 nt, Homo sapiens
ggcaaaggcugaagaauuu

SEQ ID NO: 1032079 - RNA, 19 nt, Homo sapiens
gaagagcucuauagccuuu

SEQ ID NO: 1032080 - RNA, 19 nt, Homo sapiens
ggaggaaaguggagaaauu

SEQ ID NO: 1032081 - RNA, 19 nt, Homo sapiens
ggaagaaacuuaaccaucu

SEQ ID NO: 1032082 - RNA, 19 nt, Homo sapiens
caacacagcuucuaaaggu

SEQ ID NO: 1032083 - RNA, 19 nt, Homo sapiens
caagaucccuuuauucaug

SEQ ID NO: 1032084 - RNA, 19 nt, Homo sapiens
guugaagcauuuccuauua

SEQ ID NO: 1032085 - RNA, 19 nt, Homo sapiens
uaagacaggugcagacgua

SEQ ID NO: 1032086 - RNA, 19 nt, Homo sapiens
gaagagaugcuuuauagau

SEQ ID NO: 1032087 - RNA, 19 nt, Homo sapiens
gaaagaagagggaagaaga

SEQ ID NO: 1032088 - RNA, 19 nt, Homo sapiens
ggauagcauugaaagauuu

SEQ ID NO: 1032089 - RNA, 19 nt, Homo sapiens
ggaagaggauagcauugaa

SEQ ID NO: 1032090 - RNA, 19 nt, Homo sapiens
cuaaagacauucauggaaa

SEQ ID NO: 1032091 - RNA, 19 nt, Homo sapiens
gcaauuacaucugugauuc

SEQ ID NO: 1032092 - RNA, 19 nt, Homo sapiens
ugacagauguguuguuaga

SEQ ID NO: 1032093 - RNA, 19 nt, Homo sapiens
gacaagagcuacugcacuu

SEQ ID NO: 1032094 - RNA, 19 nt, Homo sapiens
gcaaagcugauucacguua

SEQ ID NO: 1032095 - RNA, 19 nt, Homo sapiens
cauaaaagcucaaaaguga

SEQ ID NO: 1032096 - RNA, 19 nt, Homo sapiens
guaaagauguuguuauggu

SEQ ID NO: 1032097 - RNA, 19 nt, Homo sapiens
cuacuggaauguguuauua

SEQ ID NO: 1032098 - RNA, 19 nt, Homo sapiens
gaaguuccuugauucagaa

SEQ ID NO: 1032099 - RNA, 19 nt, Homo sapiens
ggagauaacucaaaacuuc

SEQ ID NO: 1032100 - RNA, 19 nt, Homo sapiens
uggaagagaugcuuuauag

SEQ ID NO: 1032101 - RNA, 19 nt, Homo sapiens
cuugagugcuucauaaaua

SEQ ID NO: 1032102 - RNA, 19 nt, Homo sapiens
ugagauaagucaccagcua

SEQ ID NO: 1032103 - RNA, 19 nt, Homo sapiens
gaggaaaguggagaaauua

SEQ ID NO: 1032104 - RNA, 19 nt, Homo sapiens
gaagggagaaggagaaugu

SEQ ID NO: 1032105 - RNA, 19 nt, Homo sapiens
gguauacauugcagaaauu

SEQ ID NO: 1032106 - RNA, 19 nt, Homo sapiens
gcagacguaugucggcuuu

SEQ ID NO: 1032107 - RNA, 19 nt, Homo sapiens
ggaaacagaaagaagaauu

SEQ ID NO: 1032108 - RNA, 19 nt, Homo sapiens
cagccuaaaugaauuacua

SEQ ID NO: 1032109 - RNA, 19 nt, Homo sapiens
ugugagggcugcuaaguuu

SEQ ID NO: 1032110 - RNA, 19 nt, Homo sapiens
ugaaauggauagugaaauc

SEQ ID NO: 1032111 - RNA, 19 nt, Homo sapiens
ggagcugguuggagaguuu

SEQ ID NO: 1032112 - RNA, 19 nt, Homo sapiens
ggaaaguggagaaauuaaa

SEQ ID NO: 1032113 - RNA, 19 nt, Homo sapiens
gcguauccaucaagcuuua

SEQ ID NO: 1032114 - RNA, 19 nt, Homo sapiens
gcugcaagaucccuuuauu

SEQ ID NO: 1032115 - RNA, 19 nt, Homo sapiens
gccaaacuuuacacgauua

SEQ ID NO: 1032116 - RNA, 19 nt, Homo sapiens
caacauagcaaagcugauu

SEQ ID NO: 1032117 - RNA, 19 nt, Homo sapiens
gaagagggaagaagauuuc

SEQ ID NO: 1032118 - RNA, 19 nt, Homo sapiens
uuacuugagugcuucauaa

SEQ ID NO: 1032119 - RNA, 19 nt, Homo sapiens
ggaaauuacuuuggaagag

SEQ ID NO: 1032120 - RNA, 19 nt, Homo sapiens
gauccaaaccuucaugcua

SEQ ID NO: 1032121 - RNA, 19 nt, Homo sapiens
caacuggaauaucaacuuc

SEQ ID NO: 1032122 - RNA, 19 nt, Homo sapiens
gccaacaucuccagacaug

SEQ ID NO: 1032123 - RNA, 19 nt, Homo sapiens
guguaaagauguuguuaug

SEQ ID NO: 1032124 - RNA, 19 nt, Homo sapiens
ccaggagguucuaucagua

SEQ ID NO: 1032125 - RNA, 19 nt, Homo sapiens
acagauguguuguuagaaa

SEQ ID NO: 1032126 - RNA, 19 nt, Homo sapiens
ccuagugccugcguaaaua

SEQ ID NO: 1032127 - RNA, 19 nt, Homo sapiens
cauggcagguuuacuagaa

SEQ ID NO: 1032128 - RNA, 19 nt, Homo sapiens
agaguucuauucaggauuu

SEQ ID NO: 1032129 - RNA, 19 nt, Homo sapiens
aaauugaaaugccugugua

SEQ ID NO: 1032130 - RNA, 19 nt, Homo sapiens
gaaggaaagguguauuugu

SEQ ID NO: 1032131 - RNA, 19 nt, Homo sapiens
gauacagucuccacgacaa

SEQ ID NO: 1032132 - RNA, 19 nt, Homo sapiens
caaggaaacagaaagaaga

SEQ ID NO: 1032133 - RNA, 19 nt, Homo sapiens
uauauaagcccauccuuug

SEQ ID NO: 1032134 - RNA, 19 nt, Homo sapiens
gaaaguggagaaauuaaag

SEQ ID NO: 1032135 - RNA, 19 nt, Homo sapiens
gaagaggauagcauugaaa

SEQ ID NO: 1032136 - RNA, 19 nt, Homo sapiens
gagcaacacagcuucuaaa

SEQ ID NO: 1032137 - RNA, 19 nt, Homo sapiens
ggccaaacuuuacacgauu

SEQ ID NO: 1032138 - RNA, 19 nt, Homo sapiens
cuagaugaauuaucaagga

SEQ ID NO: 1032139 - RNA, 19 nt, Homo sapiens
uuauugaccuccugaagaa

SEQ ID NO: 1032140 - RNA, 19 nt, Homo sapiens
gcugaagaauuuauugaca

SEQ ID NO: 1032141 - RNA, 19 nt, Homo sapiens
gauccuugguguuuguaaa

SEQ ID NO: 1032142 - RNA, 19 nt, Homo sapiens
cuacgaagcccuacuggaa

SEQ ID NO: 1032143 - RNA, 19 nt, Homo sapiens
ggaaucaugcaaacaguga

SEQ ID NO: 1032144 - RNA, 19 nt, Homo sapiens
gaaggagaaugugacuguu

SEQ ID NO: 1032145 - RNA, 19 nt, Homo sapiens
caaagcugauucacguuau

SEQ ID NO: 1032146 - RNA, 19 nt, Homo sapiens
gacaugcuguugaagauca

SEQ ID NO: 1032147 - RNA, 19 nt, Homo sapiens
ugcgggagguucugaguua

SEQ ID NO: 1032148 - RNA, 19 nt, Homo sapiens
gaggauagcauugaaagau

SEQ ID NO: 1032149 - RNA, 19 nt, Homo sapiens
cagaaggaaagguguauuu

SEQ ID NO: 1032150 - RNA, 19 nt, Homo sapiens
gaacuacgaagcccuacug

SEQ ID NO: 1032151 - RNA, 19 nt, Homo sapiens
gagcaucuuucugaucuuc

SEQ ID NO: 1032152 - RNA, 19 nt, Homo sapiens
ccauucagcugugguguga

SEQ ID NO: 1032153 - RNA, 19 nt, Homo sapiens
gccaggagguucuaucagu

SEQ ID NO: 1032154 - RNA, 19 nt, Homo sapiens
ccacgacaauucggagaaa

SEQ ID NO: 1032155 - RNA, 19 nt, Homo sapiens
gcauccaucuucagcacaa

SEQ ID NO: 1032156 - RNA, 19 nt, Homo sapiens
caaagaaccgcgagugcuu

SEQ ID NO: 1032157 - RNA, 19 nt, Homo sapiens
acaacuggcugcccacaga

SEQ ID NO: 1032158 - RNA, 19 nt, Homo sapiens
aaacugagccacccauugu

SEQ ID NO: 1032159 - RNA, 19 nt, Homo sapiens
uggcaaaggcugaagaauu

SEQ ID NO: 1032160 - RNA, 19 nt, Homo sapiens
gcaaaggcugaagaauuua

SEQ ID NO: 1032161 - RNA, 19 nt, Homo sapiens
auaaaggacuccagguaug

SEQ ID NO: 1032162 - RNA, 19 nt, Homo sapiens
gugcauauuauccugguua

SEQ ID NO: 1032163 - RNA, 19 nt, Homo sapiens
aggcauguguggcuucuaa

SEQ ID NO: 1032164 - RNA, 19 nt, Homo sapiens
ucaagguguuuaauaggaa

SEQ ID NO: 1032165 - RNA, 19 nt, Homo sapiens
uuucugaucuuccaccauu

SEQ ID NO: 1032166 - RNA, 19 nt, Homo sapiens
gguguacuuucuacucuga

SEQ ID NO: 1032167 - RNA, 19 nt, Homo sapiens
gcauuggucuacauugagu

SEQ ID NO: 1032168 - RNA, 19 nt, Homo sapiens
uaauaaagaggccaaacuu

SEQ ID NO: 1032169 - RNA, 19 nt, Homo sapiens
ugaguuacuuucaccauca

SEQ ID NO: 1032170 - RNA, 19 nt, Homo sapiens
ccaucaagcuuuauauugc

SEQ ID NO: 1032171 - RNA, 19 nt, Homo sapiens
gcuuggaaacuaugaguaa

SEQ ID NO: 1032172 - RNA, 19 nt, Homo sapiens
uggcauuggucuacauuga

SEQ ID NO: 1032173 - RNA, 19 nt, Homo sapiens
gugauucucuggaaaagua

SEQ ID NO: 1032174 - RNA, 19 nt, Homo sapiens
uaaacgauguugcaugcau

SEQ ID NO: 1032175 - RNA, 19 nt, Homo sapiens
ggaagacacaggaaagaca

SEQ ID NO: 1032176 - RNA, 19 nt, Homo sapiens
auucaggauuuguguguua

SEQ ID NO: 1032177 - RNA, 19 nt, Homo sapiens
caagagcuacugcacuuug

SEQ ID NO: 1032178 - RNA, 19 nt, Homo sapiens
gauaagaccuugccuaaua

SEQ ID NO: 1032179 - RNA, 19 nt, Homo sapiens
gaagugauguuuacaaauc

SEQ ID NO: 1032180 - RNA, 19 nt, Homo sapiens
ugaagaaacugaagagaaa

SEQ ID NO: 1032181 - RNA, 19 nt, Homo sapiens
ccacuugccuuccagaaua

SEQ ID NO: 1032182 - RNA, 19 nt, Homo sapiens
gagaagugauguuuacaaa

SEQ ID NO: 1032183 - RNA, 19 nt, Homo sapiens
gaaccaaagugccauuuca

SEQ ID NO: 1032184 - RNA, 19 nt, Homo sapiens
gagaaauugucguaaauga

SEQ ID NO: 1032185 - RNA, 19 nt, Homo sapiens
gaauggcccucaucaaaga

SEQ ID NO: 1032186 - RNA, 19 nt, Homo sapiens
gcaaacaucucucuguagu

SEQ ID NO: 1032187 - RNA, 19 nt, Homo sapiens
ggaagagacuugagcuguu

SEQ ID NO: 1032188 - RNA, 19 nt, Homo sapiens
guagaggauuuaugacuaa

SEQ ID NO: 1032189 - RNA, 19 nt, Homo sapiens
aaauggaucugucaaacua

SEQ ID NO: 1032190 - RNA, 19 nt, Homo sapiens
gaagagacuugagcuguug

SEQ ID NO: 1032191 - RNA, 19 nt, Homo sapiens
uguaugagguguaacauuu

SEQ ID NO: 1032192 - RNA, 19 nt, Homo sapiens
caacagaagcugacaaaug

SEQ ID NO: 1032193 - RNA, 19 nt, Homo sapiens
ggaaaauacucgaugguua

SEQ ID NO: 1032194 - RNA, 19 nt, Homo sapiens
gaaauuccauuacagaaac

SEQ ID NO: 1032195 - RNA, 19 nt, Homo sapiens
cagcagaacuuguauacau

SEQ ID NO: 1032196 - RNA, 19 nt, Homo sapiens
ugaacacgaugucccuuua

SEQ ID NO: 1032197 - RNA, 19 nt, Homo sapiens
gauaugcaguaacuucaaa

SEQ ID NO: 1032198 - RNA, 19 nt, Homo sapiens
gcgaauggcccucaucaaa

SEQ ID NO: 1032199 - RNA, 19 nt, Homo sapiens
gaggauuuguaaugcaaua

SEQ ID NO: 1032200 - RNA, 19 nt, Homo sapiens
ggaauucccucaggagaug

SEQ ID NO: 1032201 - RNA, 19 nt, Homo sapiens
ggaaagcugauaugcagua

SEQ ID NO: 1032202 - RNA, 19 nt, Homo sapiens
caacagaccuccagcuacu

SEQ ID NO: 1032203 - RNA, 19 nt, Homo sapiens
ccagaaaacuccacucuuu

SEQ ID NO: 1032204 - RNA, 19 nt, Homo sapiens
gagcaaauugucacaguaa

SEQ ID NO: 1032205 - RNA, 19 nt, Homo sapiens
caggagaaauugucguaaa

SEQ ID NO: 1032206 - RNA, 19 nt, Homo sapiens
gaaagcugauaugcaguaa

SEQ ID NO: 1032207 - RNA, 19 nt, Homo sapiens
gaaauugucguaaaugaag

SEQ ID NO: 1032208 - RNA, 19 nt, Homo sapiens
aagcaaacaucucucugua

SEQ ID NO: 1032209 - RNA, 19 nt, Homo sapiens
gcagugcucuugugcgaau

SEQ ID NO: 1032210 - RNA, 19 nt, Homo sapiens
uggagaguuuguucuauua

SEQ ID NO: 1032211 - RNA, 19 nt, Homo sapiens
gacuugagcuguuguguag

SEQ ID NO: 1032212 - RNA, 19 nt, Homo sapiens
gggcauuccuuaagcauuc

SEQ ID NO: 1032213 - RNA, 19 nt, Homo sapiens
ggauaucaguuucuagaca

SEQ ID NO: 1032214 - RNA, 19 nt, Homo sapiens
gaccagaggauuuguaaug

SEQ ID NO: 1032215 - RNA, 19 nt, Homo sapiens
caggaagccuuucuaggaa

SEQ ID NO: 1032216 - RNA, 19 nt, Homo sapiens
gcauucagcagaacuugua

SEQ ID NO: 1032217 - RNA, 19 nt, Homo sapiens
ccacagagaagugauguuu

SEQ ID NO: 1032218 - RNA, 19 nt, Homo sapiens
guggagaguuuguucuauu

SEQ ID NO: 1032219 - RNA, 19 nt, Homo sapiens
gaacacgaugucccuuuaa

SEQ ID NO: 1032220 - RNA, 19 nt, Homo sapiens
aaaccuaccuggcaguguu

SEQ ID NO: 1032221 - RNA, 19 nt, Homo sapiens
ugaagcagcuaugcguuaa

SEQ ID NO: 1032222 - RNA, 19 nt, Homo sapiens
cuaaagagaucagagaaag

SEQ ID NO: 1032223 - RNA, 19 nt, Homo sapiens
ugaaucaggucccgaaagu

SEQ ID NO: 1032224 - RNA, 19 nt, Homo sapiens
ggaagccuuucuaggaaga

SEQ ID NO: 1032225 - RNA, 19 nt, Homo sapiens
ucaggaagccuuucuagga

SEQ ID NO: 1032226 - RNA, 19 nt, Homo sapiens
uguagaggauuuaugacua

SEQ ID NO: 1032227 - RNA, 19 nt, Homo sapiens
ucauugauguagaggauuu

SEQ ID NO: 1032228 - RNA, 19 nt, Homo sapiens
cagcuacucuuugcauuug

SEQ ID NO: 1032229 - RNA, 19 nt, Homo sapiens
gaccuugccuaauauucaa

SEQ ID NO: 1032230 - RNA, 19 nt, Homo sapiens
ugaaguuucuggucacaau

SEQ ID NO: 1032231 - RNA, 19 nt, Homo sapiens
caacagacacaagccagua

SEQ ID NO: 1032232 - RNA, 19 nt, Homo sapiens
acacaagccaguacgauuu

SEQ ID NO: 1032233 - RNA, 19 nt, Homo sapiens
ugagcaaauugucacagua

SEQ ID NO: 1032234 - RNA, 19 nt, Homo sapiens
gaaaccauucugaaccaaa

SEQ ID NO: 1032235 - RNA, 19 nt, Homo sapiens
ggaggaaggaagagacuug

SEQ ID NO: 1032236 - RNA, 19 nt, Homo sapiens
acagagaagugauguuuac

SEQ ID NO: 1032237 - RNA, 19 nt, Homo sapiens
ccacaauucagcaaacaaa

SEQ ID NO: 1032238 - RNA, 19 nt, Homo sapiens
gaggauuuaugacuaagca

SEQ ID NO: 1032239 - RNA, 19 nt, Homo sapiens
gcacccggaucucacuguu

SEQ ID NO: 1032240 - RNA, 19 nt, Homo sapiens
cagaggauuuguaaugcaa

SEQ ID NO: 1032241 - RNA, 19 nt, Homo sapiens
uaacggcagugcucuugug

SEQ ID NO: 1032242 - RNA, 19 nt, Homo sapiens
aacagaagcugacaaaugc

SEQ ID NO: 1032243 - RNA, 19 nt, Homo sapiens
ugauguagaggauuuauga

SEQ ID NO: 1032244 - RNA, 19 nt, Homo sapiens
aacaauauccugcagcuuu

SEQ ID NO: 1032245 - RNA, 19 nt, Homo sapiens
ugucguaaaugaagucaau

SEQ ID NO: 1032246 - RNA, 19 nt, Homo sapiens
gaagauugaccagaggauu

SEQ ID NO: 1032247 - RNA, 19 nt, Homo sapiens
ggcaggauaucaguuucua

SEQ ID NO: 1032248 - RNA, 19 nt, Homo sapiens
ggagaguuuguucuauuaa

SEQ ID NO: 1032249 - RNA, 19 nt, Homo sapiens
caaaugccguggagaccau

SEQ ID NO: 1032250 - RNA, 19 nt, Homo sapiens
agaaguacaagcagcauuu

SEQ ID NO: 1032251 - RNA, 19 nt, Homo sapiens
uaaacgaccacaagaggaa

SEQ ID NO: 1032252 - RNA, 19 nt, Homo sapiens
uauuacagaugacccaaug

SEQ ID NO: 1032253 - RNA, 19 nt, Homo sapiens
gcaccuuccuguucaacuc

SEQ ID NO: 1032254 - RNA, 19 nt, Homo sapiens
ggagaaauugucguaaaug

SEQ ID NO: 1032255 - RNA, 19 nt, Homo sapiens
gacacaagccaguacgauu

SEQ ID NO: 1032256 - RNA, 19 nt, Homo sapiens
uaggacaauuacuggauuu

SEQ ID NO: 1032257 - RNA, 19 nt, Homo sapiens
uagaauauguaagggcauu

SEQ ID NO: 1032258 - RNA, 19 nt, Homo sapiens
aaacugaagagaaaugguu

SEQ ID NO: 1032259 - RNA, 19 nt, Homo sapiens
uggauaagaccuugccuaa

SEQ ID NO: 1032260 - RNA, 19 nt, Homo sapiens
gccuugcaauagcucauua

SEQ ID NO: 1032261 - RNA, 19 nt, Homo sapiens
uaacacuuaugccuuuagu

SEQ ID NO: 1032262 - RNA, 19 nt, Homo sapiens
gagaaaugguuaucuucac

SEQ ID NO: 1032263 - RNA, 19 nt, Homo sapiens
auaagaccuugccuaauau

SEQ ID NO: 1032264 - RNA, 19 nt, Homo sapiens
aaacuccacucuuugaaac

SEQ ID NO: 1032265 - RNA, 19 nt, Homo sapiens
aacuaacacuuaugccuuu

SEQ ID NO: 1032266 - RNA, 19 nt, Homo sapiens
aaacuugaaaccauucuga

SEQ ID NO: 1032267 - RNA, 19 nt, Homo sapiens
aagcaaagcacggucagua

SEQ ID NO: 1032268 - RNA, 19 nt, Homo sapiens
gacaauuacuggauuucag

SEQ ID NO: 1032269 - RNA, 19 nt, Homo sapiens
gauauccacuugccuucca

SEQ ID NO: 1032270 - RNA, 19 nt, Homo sapiens
gagaguuuguucuauuaac

SEQ ID NO: 1032271 - RNA, 19 nt, Homo sapiens
gcuacucuuugcauuugaa

SEQ ID NO: 1032272 - RNA, 19 nt, Homo sapiens
caaccagaaacugaaauuu

SEQ ID NO: 1032273 - RNA, 19 nt, Homo sapiens
gaaaacuuacugacgauaa

SEQ ID NO: 1032274 - RNA, 19 nt, Homo sapiens
caggauaucaguuucuaga

SEQ ID NO: 1032275 - RNA, 19 nt, Homo sapiens
uuaggacaauuacuggauu

SEQ ID NO: 1032276 - RNA, 19 nt, Homo sapiens
gaaguacaagcagcauuug

SEQ ID NO: 1032277 - RNA, 19 nt, Homo sapiens
gccaacagaccuccagcua

SEQ ID NO: 1032278 - RNA, 19 nt, Homo sapiens
gaaccugcauuugguauua

SEQ ID NO: 1032279 - RNA, 19 nt, Homo sapiens
ugaaauaacuccagcagaa

SEQ ID NO: 1032280 - RNA, 19 nt, Homo sapiens
gcacccagcuugccagauu

SEQ ID NO: 1032281 - RNA, 19 nt, Homo sapiens
ggcacuauguuaagaaaua

SEQ ID NO: 1032282 - RNA, 19 nt, Homo sapiens
gaagaggacuggugauggu

SEQ ID NO: 1032283 - RNA, 19 nt, Homo sapiens
gaucugagaaccugcauuu

SEQ ID NO: 1032284 - RNA, 19 nt, Homo sapiens
gcacaagucuggccucacu

SEQ ID NO: 1032285 - RNA, 19 nt, Homo sapiens
gcaccuagguacccacaug

SEQ ID NO: 1032286 - RNA, 19 nt, Homo sapiens
gaagauuuccugucucaga

SEQ ID NO: 1032287 - RNA, 19 nt, Homo sapiens
cagaacgcaugacaccuua

SEQ ID NO: 1032288 - RNA, 19 nt, Homo sapiens
cagcagcgguggagucuga

SEQ ID NO: 1032289 - RNA, 19 nt, Homo sapiens
ccacauggguauuuauauc

SEQ ID NO: 1032290 - RNA, 19 nt, Homo sapiens
gaggaaggauggaaugaag

SEQ ID NO: 1032291 - RNA, 19 nt, Homo sapiens
ugaaucaggcacuauguua

SEQ ID NO: 1032292 - RNA, 19 nt, Homo sapiens
ggugagcccugagcacuaa

SEQ ID NO: 1032293 - RNA, 19 nt, Homo sapiens
agaaagcuauugcacagaa

SEQ ID NO: 1032294 - RNA, 19 nt, Homo sapiens
cugagaagcugauggaguu

SEQ ID NO: 1032295 - RNA, 19 nt, Homo sapiens
gaaucaggcacuauguuaa

SEQ ID NO: 1032296 - RNA, 19 nt, Homo sapiens
gaaaggaccacagcaaaca

SEQ ID NO: 1032297 - RNA, 19 nt, Homo sapiens
caguaaggcugcuacauca

SEQ ID NO: 1032298 - RNA, 19 nt, Homo sapiens
gguggagucugaaagauca

SEQ ID NO: 1032299 - RNA, 19 nt, Homo sapiens
gcagaacgcaugacaccuu

SEQ ID NO: 1032300 - RNA, 19 nt, Homo sapiens
uaugauguguggauccuaa

SEQ ID NO: 1032301 - RNA, 19 nt, Homo sapiens
ccagugcuguccucuuuga

SEQ ID NO: 1032302 - RNA, 19 nt, Homo sapiens
gaaacggaagcauaaaugu

SEQ ID NO: 1032303 - RNA, 19 nt, Homo sapiens
gaaccagacagacgcuuga

SEQ ID NO: 1032304 - RNA, 19 nt, Homo sapiens
ggcauuaucccauuuggaa

SEQ ID NO: 1032305 - RNA, 19 nt, Homo sapiens
aacccuggcucuaucauuu

SEQ ID NO: 1032306 - RNA, 19 nt, Homo sapiens
gggcaacccuggcucuauc

SEQ ID NO: 1032307 - RNA, 19 nt, Homo sapiens
ccagcagucuguucaacuu

SEQ ID NO: 1032308 - RNA, 19 nt, Homo sapiens
ucacagagggagauucauu

SEQ ID NO: 1032309 - RNA, 19 nt, Homo sapiens
gccaguggguucagcagaa

SEQ ID NO: 1032310 - RNA, 19 nt, Homo sapiens
ccaagaaccaggucgaaga

SEQ ID NO: 1032311 - RNA, 19 nt, Homo sapiens
agaaagcuguuaucagagu

SEQ ID NO: 1032312 - RNA, 19 nt, Homo sapiens
ugaaugugguggcaaagug

SEQ ID NO: 1032313 - RNA, 19 nt, Homo sapiens
ccucaggcauuaucccauu

SEQ ID NO: 1032314 - RNA, 19 nt, Homo sapiens
gcacggacaucagccuaca

SEQ ID NO: 1032315 - RNA, 19 nt, Homo sapiens
ggaagcaguauguaugguu

SEQ ID NO: 1032316 - RNA, 19 nt, Homo sapiens
gagcaaggauggaaaaugg

SEQ ID NO: 1032317 - RNA, 19 nt, Homo sapiens
gcucugaacaccagcuuug

SEQ ID NO: 1032318 - RNA, 19 nt, Homo sapiens
gaacgcaugacaccuuauc

SEQ ID NO: 1032319 - RNA, 19 nt, Homo sapiens
ccaagagugugcuccagau

SEQ ID NO: 1032320 - RNA, 19 nt, Homo sapiens
gguagaaaaggcagaauua

SEQ ID NO: 1032321 - RNA, 19 nt, Homo sapiens
gcagcucccuaagcaguga

SEQ ID NO: 1032322 - RNA, 19 nt, Homo sapiens
uccaugaguuccaucguaa

SEQ ID NO: 1032323 - RNA, 19 nt, Homo sapiens
caggcacuauguuaagaaa

SEQ ID NO: 1032324 - RNA, 19 nt, Homo sapiens
gcagaggaaggauggaaug

SEQ ID NO: 1032325 - RNA, 19 nt, Homo sapiens
cccugaagcuuucccacua

SEQ ID NO: 1032326 - RNA, 19 nt, Homo sapiens
ggaagcauaaauguucuuu

SEQ ID NO: 1032327 - RNA, 19 nt, Homo sapiens
guagccagguguuacaaag

SEQ ID NO: 1032328 - RNA, 19 nt, Homo sapiens
gaccacagcaaacaccauu

SEQ ID NO: 1032329 - RNA, 19 nt, Homo sapiens
ggaaaggaccacagcaaac

SEQ ID NO: 1032330 - RNA, 19 nt, Homo sapiens
ugacaucacugaggaucga

SEQ ID NO: 1032331 - RNA, 19 nt, Homo sapiens
agccagugcuguccucuuu

SEQ ID NO: 1032332 - RNA, 19 nt, Homo sapiens
gaaucucacuuuggaaggu

SEQ ID NO: 1032333 - RNA, 19 nt, Homo sapiens
ugaaacggaagcauaaaug

SEQ ID NO: 1032334 - RNA, 19 nt, Homo sapiens
gaaauaacuccagcagaag

SEQ ID NO: 1032335 - RNA, 19 nt, Homo sapiens
aaacggaagcauaaauguu

SEQ ID NO: 1032336 - RNA, 19 nt, Homo sapiens
cugaagcuuucccacuaua

SEQ ID NO: 1032337 - RNA, 19 nt, Homo sapiens
gauguguggauccuaauga

SEQ ID NO: 1032338 - RNA, 19 nt, Homo sapiens
caaaaggaccaguagcaua

SEQ ID NO: 1032339 - RNA, 19 nt, Homo sapiens
gaaaacugaaucucacuuu

SEQ ID NO: 1032340 - RNA, 19 nt, Homo sapiens
aagaucagcagaacagaaa

SEQ ID NO: 1032341 - RNA, 19 nt, Homo sapiens
gcuaguggaagcaguaugu

SEQ ID NO: 1032342 - RNA, 19 nt, Homo sapiens
acagcaaacaccauucuuu

SEQ ID NO: 1032343 - RNA, 19 nt, Homo sapiens
gacaugcagccuaguguga

SEQ ID NO: 1032344 - RNA, 19 nt, Homo sapiens
ccagacagacgcuugaauc

SEQ ID NO: 1032345 - RNA, 19 nt, Homo sapiens
ucgaggagcugugugaaca

SEQ ID NO: 1032346 - RNA, 19 nt, Homo sapiens
cagaugggccagccaguga

SEQ ID NO: 1032347 - RNA, 19 nt, Homo sapiens
cuccaugaguuccaucgua

SEQ ID NO: 1032348 - RNA, 19 nt, Homo sapiens
ccaucugucuggaggaguu

SEQ ID NO: 1032349 - RNA, 19 nt, Homo sapiens
ugaaagaucagcagaacag

SEQ ID NO: 1032350 - RNA, 19 nt, Homo sapiens
ggguugagaauaagaauag

SEQ ID NO: 1032351 - RNA, 19 nt, Homo sapiens
cgaagacuccaccucauuc

SEQ ID NO: 1032352 - RNA, 19 nt, Homo sapiens
cauggguauuuauaucuga

SEQ ID NO: 1032353 - RNA, 19 nt, Homo sapiens
ggaaggauggaaugaaggu

SEQ ID NO: 1032354 - RNA, 19 nt, Homo sapiens
gagguagaaaggaggaauu

SEQ ID NO: 1032355 - RNA, 19 nt, Homo sapiens
uugaagauuuccugucuca

SEQ ID NO: 1032356 - RNA, 19 nt, Homo sapiens
gggcagaaagcuagcuaug

SEQ ID NO: 1032357 - RNA, 19 nt, Homo sapiens
gaaagcuauugcacagaac

SEQ ID NO: 1032358 - RNA, 19 nt, Homo sapiens
caucacagagggagauuca

SEQ ID NO: 1032359 - RNA, 19 nt, Homo sapiens
gaagcuuucccacuauagu

SEQ ID NO: 1032360 - RNA, 19 nt, Homo sapiens
agagugugcuccagaugug

SEQ ID NO: 1032361 - RNA, 19 nt, Homo sapiens
cacagagggagauucauuu

SEQ ID NO: 1032362 - RNA, 19 nt, Homo sapiens
ccacuguaccugugcaaug

SEQ ID NO: 1032363 - RNA, 19 nt, Homo sapiens
ccugaagcuuucccacuau

SEQ ID NO: 1032364 - RNA, 19 nt, Homo sapiens
ggaggggccuucugaaugg

SEQ ID NO: 1032365 - RNA, 19 nt, Homo sapiens
uggcagcaguucuacuuuc

SEQ ID NO: 1032366 - RNA, 19 nt, Homo sapiens
guccauggcagcaguucua

SEQ ID NO: 1032367 - RNA, 19 nt, Homo sapiens
caguauguaugguugaagu

SEQ ID NO: 1032368 - RNA, 19 nt, Homo sapiens
guaaugacgcugagaagcu

SEQ ID NO: 1032369 - RNA, 19 nt, Homo sapiens
cugagaaccugcauuuggu

SEQ ID NO: 1032370 - RNA, 19 nt, Homo sapiens
aaacuccuccuugaagauu

SEQ ID NO: 1032371 - RNA, 19 nt, Homo sapiens
caacaucacagagggagau

SEQ ID NO: 1032372 - RNA, 19 nt, Homo sapiens
gaaagaucagcagaacaga

SEQ ID NO: 1032373 - RNA, 19 nt, Homo sapiens
gaaggauggaaugaaggua

SEQ ID NO: 1032374 - RNA, 19 nt, Homo sapiens
ccuugaagauuuccugucu

SEQ ID NO: 1032375 - RNA, 19 nt, Homo sapiens
ggcagcaguucuacuuucu

SEQ ID NO: 1032376 - RNA, 19 nt, Homo sapiens
gagaaccugcauuugguau

SEQ ID NO: 1032377 - RNA, 19 nt, Homo sapiens
ggaaaauggggacaacaaa

SEQ ID NO: 1032378 - RNA, 19 nt, Homo sapiens
guaagugccugguaaauaa

SEQ ID NO: 1032379 - RNA, 19 nt, Homo sapiens
ugaaggagcuggugacauu

SEQ ID NO: 1032380 - RNA, 19 nt, Homo sapiens
gaacauagccgugaucaag

SEQ ID NO: 1032381 - RNA, 19 nt, Homo sapiens
caaggaggauucaaacugu

SEQ ID NO: 1032382 - RNA, 19 nt, Homo sapiens
gaggagguguggacaguga

SEQ ID NO: 1032383 - RNA, 19 nt, Homo sapiens
ccacagccauggucuggaa

SEQ ID NO: 1032384 - RNA, 19 nt, Homo sapiens
gagauuucaggauaaguua

SEQ ID NO: 1032385 - RNA, 19 nt, Homo sapiens
cacaguaagugccugguaa

SEQ ID NO: 1032386 - RNA, 19 nt, Homo sapiens
ggaagagugagaugggaua

SEQ ID NO: 1032387 - RNA, 19 nt, Homo sapiens
gaucuccauucucugcuuu

SEQ ID NO: 1032388 - RNA, 19 nt, Homo sapiens
guggauaugggauguguua

SEQ ID NO: 1032389 - RNA, 19 nt, Homo sapiens
gacccaggcucccuucuca

SEQ ID NO: 1032390 - RNA, 19 nt, Homo sapiens
cugccgagauuucaggaua

SEQ ID NO: 1032391 - RNA, 19 nt, Homo sapiens
gaacagucucagcacaauu

SEQ ID NO: 1032392 - RNA, 19 nt, Homo sapiens
aaacugggcucccgcaacu

SEQ ID NO: 1032393 - RNA, 19 nt, Homo sapiens
ucaaagugcugggauuaca

SEQ ID NO: 1032394 - RNA, 19 nt, Homo sapiens
ccacugagccuugugacuu

SEQ ID NO: 1032395 - RNA, 19 nt, Homo sapiens
caagugugguccugaacug

SEQ ID NO: 1032396 - RNA, 19 nt, Homo sapiens
gaagagugagaugggauaa

SEQ ID NO: 1032397 - RNA, 19 nt, Homo sapiens
cauccugaauagcgacuuu

SEQ ID NO: 1032398 - RNA, 19 nt, Homo sapiens
gcuccucccuccacaaucu

SEQ ID NO: 1032399 - RNA, 19 nt, Homo sapiens
agagugagaugggauaaca

SEQ ID NO: 1032400 - RNA, 19 nt, Homo sapiens
gcuaggagcagcagcaaca

SEQ ID NO: 1032401 - RNA, 19 nt, Homo sapiens
ccaaggaggauucaaacug

SEQ ID NO: 1032402 - RNA, 19 nt, Homo sapiens
cgagauuucaggauaaguu

SEQ ID NO: 1032403 - RNA, 19 nt, Homo sapiens
cacgagacccuccagcuuu

SEQ ID NO: 1032404 - RNA, 19 nt, Homo sapiens
gcacaguauagccacauga

SEQ ID NO: 1032405 - RNA, 19 nt, Homo sapiens
aguaagugccugguaaaua

SEQ ID NO: 1032406 - RNA, 19 nt, Homo sapiens
gggagugcccugugugaug

SEQ ID NO: 1032407 - RNA, 19 nt, Homo sapiens
uggaggcccuucucugaug

SEQ ID NO: 1032408 - RNA, 19 nt, Homo sapiens
caucaucuccauccaguuc

SEQ ID NO: 1032409 - RNA, 19 nt, Homo sapiens
ucucaaagugcugggauua

SEQ ID NO: 1032410 - RNA, 19 nt, Homo sapiens
ggcuguguauuaugucuug

SEQ ID NO: 1032411 - RNA, 19 nt, Homo sapiens
gccauggucuggaagaaac

SEQ ID NO: 1032412 - RNA, 19 nt, Homo sapiens
ggccaagaugggaguauuu

SEQ ID NO: 1032413 - RNA, 19 nt, Homo sapiens
gcuggucucgaacuccuua

SEQ ID NO: 1032414 - RNA, 19 nt, Homo sapiens
cuacaagacgggcaacaug

SEQ ID NO: 1032415 - RNA, 19 nt, Homo sapiens
ggcuugaucuccauucucu

SEQ ID NO: 1032416 - RNA, 19 nt, Homo sapiens
ccugguaaauaaacaaugg

SEQ ID NO: 1032417 - RNA, 19 nt, Homo sapiens
cacugagccuugugacuug

SEQ ID NO: 1032418 - RNA, 19 nt, Homo sapiens
cuggagcccuguugaagga

SEQ ID NO: 1032419 - RNA, 19 nt, Homo sapiens
acauagccgugaucaagau

SEQ ID NO: 1032420 - RNA, 19 nt, Homo sapiens
gaucuccuacucucuguuc

SEQ ID NO: 1032421 - RNA, 19 nt, Homo sapiens
agugagaugggauaacaua

SEQ ID NO: 1032422 - RNA, 19 nt, Homo sapiens
gcaccuggcacacaguaag

SEQ ID NO: 1032423 - RNA, 19 nt, Homo sapiens
cuucucaccauccugaaua

SEQ ID NO: 1032424 - RNA, 19 nt, Homo sapiens
acgagacccuccagcuuug

SEQ ID NO: 1032425 - RNA, 19 nt, Homo sapiens
aaacaauggcuauauuugc

SEQ ID NO: 1032426 - RNA, 19 nt, Homo sapiens
ugccgagauuucaggauaa

SEQ ID NO: 1032427 - RNA, 19 nt, Homo sapiens
agaacagucucagcacaau

SEQ ID NO: 1032428 - RNA, 19 nt, Homo sapiens
cggccaagaugggaguauu

SEQ ID NO: 1032429 - RNA, 19 nt, Homo sapiens
uaagugccugguaaauaaa

SEQ ID NO: 1032430 - RNA, 19 nt, Homo sapiens
uggcagaccuggugaugcu

SEQ ID NO: 1032431 - RNA, 19 nt, Homo sapiens
ggcuauauuugcuugucaa

SEQ ID NO: 1032432 - RNA, 19 nt, Homo sapiens
ucccaugagaccaguaaua

SEQ ID NO: 1032433 - RNA, 19 nt, Homo sapiens
ccuaccaccuaccucauuc

SEQ ID NO: 1032434 - RNA, 19 nt, Homo sapiens
gggaucuccuacucucugu

SEQ ID NO: 1032435 - RNA, 19 nt, Homo sapiens
gaugcugacgcuguacuuu

SEQ ID NO: 1032436 - RNA, 19 nt, Homo sapiens
ggauaugggauguguuagg

SEQ ID NO: 1032437 - RNA, 19 nt, Homo sapiens
aacaauggcuauauuugcu

SEQ ID NO: 1032438 - RNA, 19 nt, Homo sapiens
cagcacaauugagcagcuu

SEQ ID NO: 1032439 - RNA, 19 nt, Homo sapiens
acacaguaagugccuggua

SEQ ID NO: 1032440 - RNA, 19 nt, Homo sapiens
aaggaggauucaaacuguu

SEQ ID NO: 1032441 - RNA, 19 nt, Homo sapiens
cagccauggucuggaagaa

SEQ ID NO: 1032442 - RNA, 19 nt, Homo sapiens
ccucagauccgcaccaacu

SEQ ID NO: 1032443 - RNA, 19 nt, Homo sapiens
ccucaucggcuccuuccuu

SEQ ID NO: 1032444 - RNA, 19 nt, Homo sapiens
cagcaccuggcacacagua

SEQ ID NO: 1032445 - RNA, 19 nt, Homo sapiens
caucccaugagaccaguaa

SEQ ID NO: 1032446 - RNA, 19 nt, Homo sapiens
gccugcagcucauccaaac

SEQ ID NO: 1032447 - RNA, 19 nt, Homo sapiens
cuuggaggcccuucucuga

SEQ ID NO: 1032448 - RNA, 19 nt, Homo sapiens
acacgagacccuccagcuu

SEQ ID NO: 1032449 - RNA, 19 nt, Homo sapiens
aacagucucagcacaauug

SEQ ID NO: 1032450 - RNA, 19 nt, Homo sapiens
gguguggacagugauggua

SEQ ID NO: 1032451 - RNA, 19 nt, Homo sapiens
uggugaugcugacgcugua

SEQ ID NO: 1032452 - RNA, 19 nt, Homo sapiens
acaguaagugccugguaaa

SEQ ID NO: 1032453 - RNA, 19 nt, Homo sapiens
ccuugugacuugagcagau

SEQ ID NO: 1032454 - RNA, 19 nt, Homo sapiens
ggagcuggugacauucuga

SEQ ID NO: 1032455 - RNA, 19 nt, Homo sapiens
caguggauaugggaugugu

SEQ ID NO: 1032456 - RNA, 19 nt, Homo sapiens
ggcacaguauagccacaug

SEQ ID NO: 1032457 - RNA, 19 nt, Homo sapiens
gauguguuagggugaaugu

SEQ ID NO: 1032458 - RNA, 19 nt, Homo sapiens
gccucagccucucaaagug

SEQ ID NO: 1032459 - RNA, 19 nt, Homo sapiens
ggagguguggacagugaug

SEQ ID NO: 1032460 - RNA, 19 nt, Homo sapiens
ggagaacggugacuuugua

SEQ ID NO: 1032461 - RNA, 19 nt, Homo sapiens
gcagcuggcuuccaccaua

SEQ ID NO: 1032462 - RNA, 19 nt, Homo sapiens
gaacggugacuuuguauug

SEQ ID NO: 1032463 - RNA, 19 nt, Homo sapiens
gcacagcaguguccagaug

SEQ ID NO: 1032464 - RNA, 19 nt, Homo sapiens
guacaaaggacuucuguga

SEQ ID NO: 1032465 - RNA, 19 nt, Homo sapiens
agaaauauauugccagguu

SEQ ID NO: 1032466 - RNA, 19 nt, Homo sapiens
gaagugagucccucgauga

SEQ ID NO: 1032467 - RNA, 19 nt, Homo sapiens
uaccagagguucacgagua

SEQ ID NO: 1032468 - RNA, 19 nt, Homo sapiens
acaagaagccauccaagua

SEQ ID NO: 1032469 - RNA, 19 nt, Homo sapiens
cacaagagcuaccacauca

SEQ ID NO: 1032470 - RNA, 19 nt, Homo sapiens
aagaauacccagcucauua

SEQ ID NO: 1032471 - RNA, 19 nt, Homo sapiens
gcacauucacuuucaagaa

SEQ ID NO: 1032472 - RNA, 19 nt, Homo sapiens
ccaggaagaucagcuuuga

SEQ ID NO: 1032473 - RNA, 19 nt, Homo sapiens
cacgagaacuuccacaaga

SEQ ID NO: 1032474 - RNA, 19 nt, Homo sapiens
gcaugcaggugggcuguaa

SEQ ID NO: 1032475 - RNA, 19 nt, Homo sapiens
ucaaguaccugcaccucuu

SEQ ID NO: 1032476 - RNA, 19 nt, Homo sapiens
gaagaauacccagcucauu

SEQ ID NO: 1032477 - RNA, 19 nt, Homo sapiens
ggaagagcacccacuauca

SEQ ID NO: 1032478 - RNA, 19 nt, Homo sapiens
gaagaucagcuuugagaag

SEQ ID NO: 1032479 - RNA, 19 nt, Homo sapiens
gcacaagagcuaccacauc

SEQ ID NO: 1032480 - RNA, 19 nt, Homo sapiens
gcacgcaaacuuccacuuc

SEQ ID NO: 1032481 - RNA, 19 nt, Homo sapiens
gaaggagcccagcaacgaa

SEQ ID NO: 1032482 - RNA, 19 nt, Homo sapiens
caagcccucugccaccuuu

SEQ ID NO: 1032483 - RNA, 19 nt, Homo sapiens
agaauacccagcucauuaa

SEQ ID NO: 1032484 - RNA, 19 nt, Homo sapiens
cgacgaccuuguugacuuc

SEQ ID NO: 1032485 - RNA, 19 nt, Homo sapiens
ccuccgagccuccguauug

SEQ ID NO: 1032486 - RNA, 19 nt, Homo sapiens
ccaaggacggcuucaagaa

SEQ ID NO: 1032487 - RNA, 19 nt, Homo sapiens
gggaagagcacccacuauc

SEQ ID NO: 1032488 - RNA, 19 nt, Homo sapiens
gcaaggcuaccaaccacuu

SEQ ID NO: 1032489 - RNA, 19 nt, Homo sapiens
uaaaccagccgucacugaa

SEQ ID NO: 1032490 - RNA, 19 nt, Homo sapiens
gcgcgguucucuaaguaug

SEQ ID NO: 1032491 - RNA, 19 nt, Homo sapiens
gacagaagaccacgcacuu

SEQ ID NO: 1032492 - RNA, 19 nt, Homo sapiens
cagcaacgacgaccuuguu

SEQ ID NO: 1032493 - RNA, 19 nt, Homo sapiens
ccagccagaugaccucuca

SEQ ID NO: 1032494 - RNA, 19 nt, Homo sapiens
ggcaacgacuucucuagag

SEQ ID NO: 1032495 - RNA, 19 nt, Homo sapiens
auacccagcucauuaacga

SEQ ID NO: 1032496 - RNA, 19 nt, Homo sapiens
agaacggacugcccacaga

SEQ ID NO: 1032497 - RNA, 19 nt, Homo sapiens
ccgaguaccugaagucaac

SEQ ID NO: 1032498 - RNA, 19 nt, Homo sapiens
aguacgaccuggagaaugu

SEQ ID NO: 1032499 - RNA, 19 nt, Homo sapiens
ggcuuccuguucucaauaa

SEQ ID NO: 1032500 - RNA, 19 nt, Homo sapiens
acuacaacaugcacaagaa

SEQ ID NO: 1032501 - RNA, 19 nt, Homo sapiens
gccuugacccugaguguaa

SEQ ID NO: 1032502 - RNA, 19 nt, Homo sapiens
ggccaucgccuucaagaca

SEQ ID NO: 1032503 - RNA, 19 nt, Homo sapiens
guaccugcaccucuucaaa

SEQ ID NO: 1032504 - RNA, 19 nt, Homo sapiens
ucacacccauggcugaauc

SEQ ID NO: 1032505 - RNA, 19 nt, Homo sapiens
ccggcaaauucaucucuuu

SEQ ID NO: 1032506 - RNA, 19 nt, Homo sapiens
gucuagaccugacugugaa

SEQ ID NO: 1032507 - RNA, 19 nt, Homo sapiens
ccaaaccucccaacagcaa

SEQ ID NO: 1032508 - RNA, 19 nt, Homo sapiens
gagcuggccaggaagauca

SEQ ID NO: 1032509 - RNA, 19 nt, Homo sapiens
ucgagaagcacaagagcua

SEQ ID NO: 1032510 - RNA, 19 nt, Homo sapiens
gcaggugggcuguaacaag

SEQ ID NO: 1032511 - RNA, 19 nt, Homo sapiens
gaagagcacccacuaucac

SEQ ID NO: 1032512 - RNA, 19 nt, Homo sapiens
gaacggacugcccacagau

SEQ ID NO: 1032513 - RNA, 19 nt, Homo sapiens
caagaagccauccaaguac

SEQ ID NO: 1032514 - RNA, 19 nt, Homo sapiens
acaguggucugagcucuug

SEQ ID NO: 1032515 - RNA, 19 nt, Homo sapiens
cacauucacuuucaagaac

SEQ ID NO: 1032516 - RNA, 19 nt, Homo sapiens
acgagaacuuccacaagaa

SEQ ID NO: 1032517 - RNA, 19 nt, Homo sapiens
ggaagaucagcuuugagaa

SEQ ID NO: 1032518 - RNA, 19 nt, Homo sapiens
agccgucacugaagaugua

SEQ ID NO: 1032519 - RNA, 19 nt, Homo sapiens
ccaaguacgaccuggagaa

SEQ ID NO: 1032520 - RNA, 19 nt, Homo sapiens
caucaagcacgcaaacuuc

SEQ ID NO: 1032521 - RNA, 19 nt, Homo sapiens
ccagaugaccucucacaag

SEQ ID NO: 1032522 - RNA, 19 nt, Homo sapiens
caagagcuaccacaucaag

SEQ ID NO: 1032523 - RNA, 19 nt, Homo sapiens
ugaaggagcccagcaacga

SEQ ID NO: 1032524 - RNA, 19 nt, Homo sapiens
gggaccgucuccacuguca

SEQ ID NO: 1032525 - RNA, 19 nt, Homo sapiens
gaacgggagcaccuacaag

SEQ ID NO: 1032526 - RNA, 19 nt, Homo sapiens
caagaacaagugugacauc

SEQ ID NO: 1032527 - RNA, 19 nt, Homo sapiens
gacuuuguauugucaugug

SEQ ID NO: 1032528 - RNA, 19 nt, Homo sapiens
gcaguguccagaugcagaa

SEQ ID NO: 1032529 - RNA, 19 nt, Homo sapiens
aggaagaucagcuuugaga

SEQ ID NO: 1032530 - RNA, 19 nt, Homo sapiens
ucucuaaguaugaggagua

SEQ ID NO: 1032531 - RNA, 19 nt, Homo sapiens
gccaaggacggcuucaaga

SEQ ID NO: 1032532 - RNA, 19 nt, Homo sapiens
cgaguaagcaggacgugau

SEQ ID NO: 1032533 - RNA, 19 nt, Homo sapiens
gggagaacggugacuuugu

SEQ ID NO: 1032534 - RNA, 19 nt, Homo sapiens
cagggagaacggugacuuu

SEQ ID NO: 1032535 - RNA, 19 nt, Homo sapiens
ccaucaagcacgcaaacuu

SEQ ID NO: 1032536 - RNA, 19 nt, Homo sapiens
cucgggagcuggagacuca

SEQ ID NO: 1032537 - RNA, 19 nt, Homo sapiens
guacgacuucuucauccaa

SEQ ID NO: 1032538 - RNA, 19 nt, Homo sapiens
acgacgaccuuguugacuu

SEQ ID NO: 1032539 - RNA, 19 nt, Homo sapiens
acaagaagcgcgacaacuc

SEQ ID NO: 1032540 - RNA, 19 nt, Homo sapiens
gcacaagaagcgcgacaac

SEQ ID NO: 1032541 - RNA, 19 nt, Homo sapiens
gauccgccacuacaacaug

SEQ ID NO: 1032542 - RNA, 19 nt, Homo sapiens
accagagguucacgaguaa

SEQ ID NO: 1032543 - RNA, 19 nt, Homo sapiens
aaccagccgucacugaaga

SEQ ID NO: 1032544 - RNA, 19 nt, Homo sapiens
gagaacggugacuuuguau

SEQ ID NO: 1032545 - RNA, 19 nt, Homo sapiens
gcccagcaacgaaucaaau

SEQ ID NO: 1032546 - RNA, 19 nt, Homo sapiens
caaguacgaccuggagaau

SEQ ID NO: 1032547 - RNA, 19 nt, Homo sapiens
gcggcuuccuguucucaau

SEQ ID NO: 1032548 - RNA, 19 nt, Homo sapiens
gcagggagaacggugacuu

SEQ ID NO: 1032549 - RNA, 19 nt, Homo sapiens
ucugagcucuuggguggaa

SEQ ID NO: 1032550 - RNA, 19 nt, Homo sapiens
gagaagugagucccucgau

SEQ ID NO: 1032551 - RNA, 19 nt, Homo sapiens
cggcauguuuggcuaugau

SEQ ID NO: 1032552 - RNA, 19 nt, Homo sapiens
gcaagcaagggccucaucu

SEQ ID NO: 1032553 - RNA, 19 nt, Homo sapiens
ggacugcccacagauaaac

SEQ ID NO: 1032554 - RNA, 19 nt, Homo sapiens
ccaccaaaccucccaacag

SEQ ID NO: 1032555 - RNA, 19 nt, Homo sapiens
uacgacuucuucauccaaa

SEQ ID NO: 1032556 - RNA, 19 nt, Homo sapiens
gcauguuuggcuaugauga

SEQ ID NO: 1032557 - RNA, 19 nt, Homo sapiens
gaagaccggcgagaaucug

SEQ ID NO: 1032558 - RNA, 19 nt, Homo sapiens
ucccgagggugucuacaug

SEQ ID NO: 1032559 - RNA, 19 nt, Homo sapiens
ggcaaauucaucucuuuua

SEQ ID NO: 1032560 - RNA, 19 nt, Homo sapiens
ggaaggaggcuacaacuua

SEQ ID NO: 1032561 - RNA, 19 nt, Homo sapiens
gaacagaccugcucuuucu

SEQ ID NO: 1032562 - RNA, 19 nt, Homo sapiens
gccagaagcuguccuuaua

SEQ ID NO: 1032563 - RNA, 19 nt, Homo sapiens
ggaaagaagugaagaaugg

SEQ ID NO: 1032564 - RNA, 19 nt, Homo sapiens
gaacaagaaagcacaauaa

SEQ ID NO: 1032565 - RNA, 19 nt, Homo sapiens
cuacuaaacucuaccaaga

SEQ ID NO: 1032566 - RNA, 19 nt, Homo sapiens
caucaugcuucuauguuua

SEQ ID NO: 1032567 - RNA, 19 nt, Homo sapiens
gaauggaaaccaagaauau

SEQ ID NO: 1032568 - RNA, 19 nt, Homo sapiens
caaauggagugaugaacaa

SEQ ID NO: 1032569 - RNA, 19 nt, Homo sapiens
gaagaaagauaugcaagag

SEQ ID NO: 1032570 - RNA, 19 nt, Homo sapiens
ccagucaucuuauaugcua

SEQ ID NO: 1032571 - RNA, 19 nt, Homo sapiens
gcaggacuguuacucacua

SEQ ID NO: 1032572 - RNA, 19 nt, Homo sapiens
caucuuauaugcuaacguu

SEQ ID NO: 1032573 - RNA, 19 nt, Homo sapiens
gaaggaggcuacaacuuac

SEQ ID NO: 1032574 - RNA, 19 nt, Homo sapiens
ggaguagcuuggaaagauu

SEQ ID NO: 1032575 - RNA, 19 nt, Homo sapiens
gcuggaauauguauaaauc

SEQ ID NO: 1032576 - RNA, 19 nt, Homo sapiens
caaccacuccugauucuaa

SEQ ID NO: 1032577 - RNA, 19 nt, Homo sapiens
caauauggcuggguaacaa

SEQ ID NO: 1032578 - RNA, 19 nt, Homo sapiens
uauaugcgaucucuacuga

SEQ ID NO: 1032579 - RNA, 19 nt, Homo sapiens
cauaagugcaggacuguua

SEQ ID NO: 1032580 - RNA, 19 nt, Homo sapiens
gagcauuguuucucacaga

SEQ ID NO: 1032581 - RNA, 19 nt, Homo sapiens
gguaacaaguauaugaaga

SEQ ID NO: 1032582 - RNA, 19 nt, Homo sapiens
aaaucuggcugcccguuua

SEQ ID NO: 1032583 - RNA, 19 nt, Homo sapiens
caggaaacguggagcauug

SEQ ID NO: 1032584 - RNA, 19 nt, Homo sapiens
ucuguuaacugaaugcuuu

SEQ ID NO: 1032585 - RNA, 19 nt, Homo sapiens
gccagagucuugucuauca

SEQ ID NO: 1032586 - RNA, 19 nt, Homo sapiens
gcacugaauucgucaacuc

SEQ ID NO: 1032587 - RNA, 19 nt, Homo sapiens
caggguauguucuaaucua

SEQ ID NO: 1032588 - RNA, 19 nt, Homo sapiens
acaaguaucuuugguggaa

SEQ ID NO: 1032589 - RNA, 19 nt, Homo sapiens
guauuuccuuucuccauaa

SEQ ID NO: 1032590 - RNA, 19 nt, Homo sapiens
gcaaauggagugaugaaca

SEQ ID NO: 1032591 - RNA, 19 nt, Homo sapiens
aaacgagucagauuacuuu

SEQ ID NO: 1032592 - RNA, 19 nt, Homo sapiens
uauacuagccuaacagauu

SEQ ID NO: 1032593 - RNA, 19 nt, Homo sapiens
cuacuucacugcagcaaau

SEQ ID NO: 1032594 - RNA, 19 nt, Homo sapiens
ucagauaccuguugucacu

SEQ ID NO: 1032595 - RNA, 19 nt, Homo sapiens
gcaugcugcuggaauaugu

SEQ ID NO: 1032596 - RNA, 19 nt, Homo sapiens
aaacuucucuuucuguaag

SEQ ID NO: 1032597 - RNA, 19 nt, Homo sapiens
gcauaaucauuccauuugu

SEQ ID NO: 1032598 - RNA, 19 nt, Homo sapiens
gucauccucuucuuaaauu

SEQ ID NO: 1032599 - RNA, 19 nt, Homo sapiens
ucauguaucugcucucaau

SEQ ID NO: 1032600 - RNA, 19 nt, Homo sapiens
ggacuguuacucacuacua

SEQ ID NO: 1032601 - RNA, 19 nt, Homo sapiens
caugcaugcugcuggaaua

SEQ ID NO: 1032602 - RNA, 19 nt, Homo sapiens
gaucauacacagaagauag

SEQ ID NO: 1032603 - RNA, 19 nt, Homo sapiens
gaucauggaacaucuaaag

SEQ ID NO: 1032604 - RNA, 19 nt, Homo sapiens
gacuguuacucacuacuaa

SEQ ID NO: 1032605 - RNA, 19 nt, Homo sapiens
gcagagugaugggagcaaa

SEQ ID NO: 1032606 - RNA, 19 nt, Homo sapiens
gaauugaagguuacauguu

SEQ ID NO: 1032607 - RNA, 19 nt, Homo sapiens
ccagucagccuagguuaua

SEQ ID NO: 1032608 - RNA, 19 nt, Homo sapiens
guucaugucucccucuugu

SEQ ID NO: 1032609 - RNA, 19 nt, Homo sapiens
cagauuggcuuguuuuaaa

SEQ ID NO: 1032610 - RNA, 19 nt, Homo sapiens
ucaucaugcuucuauguuu

SEQ ID NO: 1032611 - RNA, 19 nt, Homo sapiens
aagacugaauugaagguua

SEQ ID NO: 1032612 - RNA, 19 nt, Homo sapiens
aagcaaagacugaauugaa

SEQ ID NO: 1032613 - RNA, 19 nt, Homo sapiens
cuucacagguuauuuaagu

SEQ ID NO: 1032614 - RNA, 19 nt, Homo sapiens
gugaauauuaccucagaua

SEQ ID NO: 1032615 - RNA, 19 nt, Homo sapiens
gagccuacuugugaauauu

SEQ ID NO: 1032616 - RNA, 19 nt, Homo sapiens
gguucacguuggacucuua

SEQ ID NO: 1032617 - RNA, 19 nt, Homo sapiens
caacuuacagugucaagau

SEQ ID NO: 1032618 - RNA, 19 nt, Homo sapiens
ggucaugagccacgauaaa

SEQ ID NO: 1032619 - RNA, 19 nt, Homo sapiens
aaucagaacuagcagaagu

SEQ ID NO: 1032620 - RNA, 19 nt, Homo sapiens
uaaaucagaacuagcagaa

SEQ ID NO: 1032621 - RNA, 19 nt, Homo sapiens
cagccuagguuauacagau

SEQ ID NO: 1032622 - RNA, 19 nt, Homo sapiens
caugagcgccgucgugaaa

SEQ ID NO: 1032623 - RNA, 19 nt, Homo sapiens
gaacaguuuuguccacauu

SEQ ID NO: 1032624 - RNA, 19 nt, Homo sapiens
cuauggacuuucuguguuu

SEQ ID NO: 1032625 - RNA, 19 nt, Homo sapiens
uggaguagcuuggaaagau

SEQ ID NO: 1032626 - RNA, 19 nt, Homo sapiens
auacuagccuaacagauug

SEQ ID NO: 1032627 - RNA, 19 nt, Homo sapiens
ugaacaagaaagcacaaua

SEQ ID NO: 1032628 - RNA, 19 nt, Homo sapiens
ggacacaauuuucuucguu

SEQ ID NO: 1032629 - RNA, 19 nt, Homo sapiens
acaaguauaugaagaacag

SEQ ID NO: 1032630 - RNA, 19 nt, Homo sapiens
aguauuuccuuucuccaua

SEQ ID NO: 1032631 - RNA, 19 nt, Homo sapiens
caaaauaggcacugaauuc

SEQ ID NO: 1032632 - RNA, 19 nt, Homo sapiens
guauaaaucagaacuagca

SEQ ID NO: 1032633 - RNA, 19 nt, Homo sapiens
caaaacuucucuuucugua

SEQ ID NO: 1032634 - RNA, 19 nt, Homo sapiens
gugcauaaucauuccauuu

SEQ ID NO: 1032635 - RNA, 19 nt, Homo sapiens
guuagucauccucuucuua

SEQ ID NO: 1032636 - RNA, 19 nt, Homo sapiens
aaacucagcacuccuguuc

SEQ ID NO: 1032637 - RNA, 19 nt, Homo sapiens
ccuaaucauucaucuguuc

SEQ ID NO: 1032638 - RNA, 19 nt, Homo sapiens
ccagaagcuguccuuauaa

SEQ ID NO: 1032639 - RNA, 19 nt, Homo sapiens
ggccuuugaugaugaaauc

SEQ ID NO: 1032640 - RNA, 19 nt, Homo sapiens
gcacaaaaguagaccaaag

SEQ ID NO: 1032641 - RNA, 19 nt, Homo sapiens
cugaauucgucaacucuuu

SEQ ID NO: 1032642 - RNA, 19 nt, Homo sapiens
gcugcuggaauauguauaa

SEQ ID NO: 1032643 - RNA, 19 nt, Homo sapiens
ccacaaccacuccugauuc

SEQ ID NO: 1032644 - RNA, 19 nt, Homo sapiens
uaaagcaaagacugaauug

SEQ ID NO: 1032645 - RNA, 19 nt, Homo sapiens
acucuuaccuuccuaccuu

SEQ ID NO: 1032646 - RNA, 19 nt, Homo sapiens
ggaagaaauaucucacaca

SEQ ID NO: 1032647 - RNA, 19 nt, Homo sapiens
agaauggaaaccaagaaua

SEQ ID NO: 1032648 - RNA, 19 nt, Homo sapiens
gagggugguucacguugga

SEQ ID NO: 1032649 - RNA, 19 nt, Homo sapiens
ugaagaaagauaugcaaga

SEQ ID NO: 1032650 - RNA, 19 nt, Homo sapiens
uuccaucuaugcacaagua

SEQ ID NO: 1032651 - RNA, 19 nt, Homo sapiens
gugguacuauuucuccaaa

SEQ ID NO: 1032652 - RNA, 19 nt, Homo sapiens
gugcuuuggugguacuauu

SEQ ID NO: 1032653 - RNA, 19 nt, Homo sapiens
gaccaaaguauuaaugagu

SEQ ID NO: 1032654 - RNA, 19 nt, Homo sapiens
acucuucacagguuauuua

SEQ ID NO: 1032655 - RNA, 19 nt, Homo sapiens
acuaaacucuaccaagaau

SEQ ID NO: 1032656 - RNA, 19 nt, Homo sapiens
gguauccucaccuuguaua

SEQ ID NO: 1032657 - RNA, 19 nt, Homo sapiens
cagaagcuguccuuauaac

SEQ ID NO: 1032658 - RNA, 19 nt, Homo sapiens
uaacugaaugcuuugauca

SEQ ID NO: 1032659 - RNA, 19 nt, Homo sapiens
aggcucagcuggugcaguu

SEQ ID NO: 1032660 - RNA, 19 nt, Homo sapiens
uaagaucccuacaaaguua

SEQ ID NO: 1032661 - RNA, 19 nt, Homo sapiens
uaacauggaucgugaauuc

SEQ ID NO: 1032662 - RNA, 19 nt, Homo sapiens
gaaaacagcuggcagauug

SEQ ID NO: 1032663 - RNA, 19 nt, Homo sapiens
agacauagguuggagaaua

SEQ ID NO: 1032664 - RNA, 19 nt, Homo sapiens
agaaaggucuucagaacua

SEQ ID NO: 1032665 - RNA, 19 nt, Homo sapiens
gacauagguuggagaauaa

SEQ ID NO: 1032666 - RNA, 19 nt, Homo sapiens
gaagauacagugacuuuga

SEQ ID NO: 1032667 - RNA, 19 nt, Homo sapiens
gcagaaaggucuucagaac

SEQ ID NO: 1032668 - RNA, 19 nt, Homo sapiens
ggcugaagcuuccuguuua

SEQ ID NO: 1032669 - RNA, 19 nt, Homo sapiens
aaagaggcauugagaauug

SEQ ID NO: 1032670 - RNA, 19 nt, Homo sapiens
ccacugcuuuggccacuua

SEQ ID NO: 1032671 - RNA, 19 nt, Homo sapiens
ggagaauaaggaagaaaua

SEQ ID NO: 1032672 - RNA, 19 nt, Homo sapiens
aacaacagcuuacagauug

SEQ ID NO: 1032673 - RNA, 19 nt, Homo sapiens
caaagaauguauagagaag

SEQ ID NO: 1032674 - RNA, 19 nt, Homo sapiens
gaucugaggaggaaagaaa

SEQ ID NO: 1032675 - RNA, 19 nt, Homo sapiens
uacagcaacuccaauaauu

SEQ ID NO: 1032676 - RNA, 19 nt, Homo sapiens
uaacaacagcuuacagauu

SEQ ID NO: 1032677 - RNA, 19 nt, Homo sapiens
cacaacaaaucauaucuug

SEQ ID NO: 1032678 - RNA, 19 nt, Homo sapiens
gccaaagaauguauagaga

SEQ ID NO: 1032679 - RNA, 19 nt, Homo sapiens
gagaauugccaaagaaugu

SEQ ID NO: 1032680 - RNA, 19 nt, Homo sapiens
aaagacccauuucuaaaga

SEQ ID NO: 1032681 - RNA, 19 nt, Homo sapiens
caucagggauaucugcauu

SEQ ID NO: 1032682 - RNA, 19 nt, Homo sapiens
ucaaacuucugccuucuug

SEQ ID NO: 1032683 - RNA, 19 nt, Homo sapiens
ucagcuccauccagaauuu

SEQ ID NO: 1032684 - RNA, 19 nt, Homo sapiens
agucuacgcugucuuguga

SEQ ID NO: 1032685 - RNA, 19 nt, Homo sapiens
uauuagagguacugaaguu

SEQ ID NO: 1032686 - RNA, 19 nt, Homo sapiens
aaaggaacggcuaguguua

SEQ ID NO: 1032687 - RNA, 19 nt, Homo sapiens
caacuauuccgcaaacuau

SEQ ID NO: 1032688 - RNA, 19 nt, Homo sapiens
gaaaggucuucagaacuau

SEQ ID NO: 1032689 - RNA, 19 nt, Homo sapiens
gccacaaacaguacuauuu

SEQ ID NO: 1032690 - RNA, 19 nt, Homo sapiens
gaucugcucuugaaaauag

SEQ ID NO: 1032691 - RNA, 19 nt, Homo sapiens
caaaggaacggcuaguguu

SEQ ID NO: 1032692 - RNA, 19 nt, Homo sapiens
guacagcaacuccaauaau

SEQ ID NO: 1032693 - RNA, 19 nt, Homo sapiens
ccuuacaucuaucggguua

SEQ ID NO: 1032694 - RNA, 19 nt, Homo sapiens
uagaagauacagugacuuu

SEQ ID NO: 1032695 - RNA, 19 nt, Homo sapiens
gaagagacuaauugaggaa

SEQ ID NO: 1032696 - RNA, 19 nt, Homo sapiens
auugugagcugguuaagaa

SEQ ID NO: 1032697 - RNA, 19 nt, Homo sapiens
ucaacgugaucacaacaaa

SEQ ID NO: 1032698 - RNA, 19 nt, Homo sapiens
cauggaucgugaauucaua

SEQ ID NO: 1032699 - RNA, 19 nt, Homo sapiens
ccaaagaauguauagagaa

SEQ ID NO: 1032700 - RNA, 19 nt, Homo sapiens
aaacaacuauuccgcaaac

SEQ ID NO: 1032701 - RNA, 19 nt, Homo sapiens
uuacuaaccacuucugaaa

SEQ ID NO: 1032702 - RNA, 19 nt, Homo sapiens
uguaugaaaugacuuaugg

SEQ ID NO: 1032703 - RNA, 19 nt, Homo sapiens
gaagagcauucagcgaagu

SEQ ID NO: 1032704 - RNA, 19 nt, Homo sapiens
gaaacagauucaccagcau

SEQ ID NO: 1032705 - RNA, 19 nt, Homo sapiens
ccaaaagacccauuucuaa

SEQ ID NO: 1032706 - RNA, 19 nt, Homo sapiens
gcagauuguuagaagauac

SEQ ID NO: 1032707 - RNA, 19 nt, Homo sapiens
gaacauugaaggaucugau

SEQ ID NO: 1032708 - RNA, 19 nt, Homo sapiens
gauacagugacuuugauuu

SEQ ID NO: 1032709 - RNA, 19 nt, Homo sapiens
gaagcuuccuguuuacacu

SEQ ID NO: 1032710 - RNA, 19 nt, Homo sapiens
uuacagaugccauuauuca

SEQ ID NO: 1032711 - RNA, 19 nt, Homo sapiens
ucuuacagaugccauuauu

SEQ ID NO: 1032712 - RNA, 19 nt, Homo sapiens
gcuggcagauuguuagaag

SEQ ID NO: 1032713 - RNA, 19 nt, Homo sapiens
ccauggaucugaggaggaa

SEQ ID NO: 1032714 - RNA, 19 nt, Homo sapiens
caaaagacccauuucuaaa

SEQ ID NO: 1032715 - RNA, 19 nt, Homo sapiens
gaucacaacaaaucauauc

SEQ ID NO: 1032716 - RNA, 19 nt, Homo sapiens
agaacuaucucaacgugau

SEQ ID NO: 1032717 - RNA, 19 nt, Homo sapiens
aguuuaagaucccuacaaa

SEQ ID NO: 1032718 - RNA, 19 nt, Homo sapiens
ccacuuacuguaugaaaug

SEQ ID NO: 1032719 - RNA, 19 nt, Homo sapiens
ggaccuugagaauuccuua

SEQ ID NO: 1032720 - RNA, 19 nt, Homo sapiens
ccucagcguugcuaauuag

SEQ ID NO: 1032721 - RNA, 19 nt, Homo sapiens
ggauggccuucauggagaa

SEQ ID NO: 1032722 - RNA, 19 nt, Homo sapiens
aguaauugcugagccagua

SEQ ID NO: 1032723 - RNA, 19 nt, Homo sapiens
ucacagugcuccgaagauc

SEQ ID NO: 1032724 - RNA, 19 nt, Homo sapiens
aagaggaauuucuguggaa

SEQ ID NO: 1032725 - RNA, 19 nt, Homo sapiens
cauugagaauugccaaaga

SEQ ID NO: 1032726 - RNA, 19 nt, Homo sapiens
gaucacagugcuccgaaga

SEQ ID NO: 1032727 - RNA, 19 nt, Homo sapiens
cagcaacuccaauaauuca

SEQ ID NO: 1032728 - RNA, 19 nt, Homo sapiens
cgaaagaagucaaaacgau

SEQ ID NO: 1032729 - RNA, 19 nt, Homo sapiens
ggcagauuguuagaagaua

SEQ ID NO: 1032730 - RNA, 19 nt, Homo sapiens
cggcugaagcuuccuguuu

SEQ ID NO: 1032731 - RNA, 19 nt, Homo sapiens
gauuuuagcucgaaagaag

SEQ ID NO: 1032732 - RNA, 19 nt, Homo sapiens
gcucuuacagaugccauua

SEQ ID NO: 1032733 - RNA, 19 nt, Homo sapiens
ccuugagaauuccuuauug

SEQ ID NO: 1032734 - RNA, 19 nt, Homo sapiens
cuucuuguuugcacccuua

SEQ ID NO: 1032735 - RNA, 19 nt, Homo sapiens
ccaaaggaacggcuagugu

SEQ ID NO: 1032736 - RNA, 19 nt, Homo sapiens
auacugagauugccuugca

SEQ ID NO: 1032737 - RNA, 19 nt, Homo sapiens
ccacaaacaguacuauuuu

SEQ ID NO: 1032738 - RNA, 19 nt, Homo sapiens
aaaacgaucugcucuugaa

SEQ ID NO: 1032739 - RNA, 19 nt, Homo sapiens
cgcaaacuauacugagauu

SEQ ID NO: 1032740 - RNA, 19 nt, Homo sapiens
guuagaagauacagugacu

SEQ ID NO: 1032741 - RNA, 19 nt, Homo sapiens
gugagcugguuaagaaguu

SEQ ID NO: 1032742 - RNA, 19 nt, Homo sapiens
uagagaagagacuaauuga

SEQ ID NO: 1032743 - RNA, 19 nt, Homo sapiens
gcaaauauuagagguacug

SEQ ID NO: 1032744 - RNA, 19 nt, Homo sapiens
cagcguugcuaauuaggau

SEQ ID NO: 1032745 - RNA, 19 nt, Homo sapiens
aaacuucugccuucuuguu

SEQ ID NO: 1032746 - RNA, 19 nt, Homo sapiens
gcucagcuccauccagaau

SEQ ID NO: 1032747 - RNA, 19 nt, Homo sapiens
caacuccacccucuacauc

SEQ ID NO: 1032748 - RNA, 19 nt, Homo sapiens
caucgaagacugacaagag

SEQ ID NO: 1032749 - RNA, 19 nt, Homo sapiens
auagagaagagacuaauug

SEQ ID NO: 1032750 - RNA, 19 nt, Homo sapiens
uaccaucucccggcucuua

SEQ ID NO: 1032751 - RNA, 19 nt, Homo sapiens
gaaguacagcaacuccaau

SEQ ID NO: 1032752 - RNA, 19 nt, Homo sapiens
gaauugccaaagaauguau

SEQ ID NO: 1032753 - RNA, 19 nt, Homo sapiens
uuuaagaucccuacaaagu

SEQ ID NO: 1032754 - RNA, 19 nt, Homo sapiens
gggccugccuuccuucuac

SEQ ID NO: 1032755 - RNA, 19 nt, Homo sapiens
gccacuuacuguaugaaau

SEQ ID NO: 1032756 - RNA, 19 nt, Homo sapiens
caaacuauacugagauugc

SEQ ID NO: 1032757 - RNA, 19 nt, Homo sapiens
caaacaacuauuccgcaaa

SEQ ID NO: 1032758 - RNA, 19 nt, Homo sapiens
gcugaagcuuccuguuuac

SEQ ID NO: 1032759 - RNA, 19 nt, Homo sapiens
cgaaguacagcaacuccaa

SEQ ID NO: 1032760 - RNA, 19 nt, Homo sapiens
gagaagagaugucaaauga

SEQ ID NO: 1032761 - RNA, 19 nt, Homo sapiens
gcacaguagucuaagauua

SEQ ID NO: 1032762 - RNA, 19 nt, Homo sapiens
gaaagaagcuaggccuaaa

SEQ ID NO: 1032763 - RNA, 19 nt, Homo sapiens
guaaaccugucucuaauuu

SEQ ID NO: 1032764 - RNA, 19 nt, Homo sapiens
uauagcagcuucauucaua

SEQ ID NO: 1032765 - RNA, 19 nt, Homo sapiens
gcaagaguauagauuauug

SEQ ID NO: 1032766 - RNA, 19 nt, Homo sapiens
gcagcuucauucauaauua

SEQ ID NO: 1032767 - RNA, 19 nt, Homo sapiens
gaagagagcaggaaaguag

SEQ ID NO: 1032768 - RNA, 19 nt, Homo sapiens
gaugagcagugaacuaaga

SEQ ID NO: 1032769 - RNA, 19 nt, Homo sapiens
gcacaugacuguuuauagc

SEQ ID NO: 1032770 - RNA, 19 nt, Homo sapiens
ugauggagcuguucuguau

SEQ ID NO: 1032771 - RNA, 19 nt, Homo sapiens
gagaugagcagugaacuaa

SEQ ID NO: 1032772 - RNA, 19 nt, Homo sapiens
gaacuaagaggccacacaa

SEQ ID NO: 1032773 - RNA, 19 nt, Homo sapiens
ggaaaguagugcacaguag

SEQ ID NO: 1032774 - RNA, 19 nt, Homo sapiens
caaaugaggacuccaguga

SEQ ID NO: 1032775 - RNA, 19 nt, Homo sapiens
agacaugagucgaggagua

SEQ ID NO: 1032776 - RNA, 19 nt, Homo sapiens
cacaagaacuauacacaug

SEQ ID NO: 1032777 - RNA, 19 nt, Homo sapiens
gacaauauccauuugcaaa

SEQ ID NO: 1032778 - RNA, 19 nt, Homo sapiens
ggacuccagugacuaugaa

SEQ ID NO: 1032779 - RNA, 19 nt, Homo sapiens
gaugagggcuguggagaug

SEQ ID NO: 1032780 - RNA, 19 nt, Homo sapiens
gaucaguuguugucagguu

SEQ ID NO: 1032781 - RNA, 19 nt, Homo sapiens
ggagggaaguuugcuacaa

SEQ ID NO: 1032782 - RNA, 19 nt, Homo sapiens
gcgcaagcguuucuucaga

SEQ ID NO: 1032783 - RNA, 19 nt, Homo sapiens
ggaguuuacugaggaaaga

SEQ ID NO: 1032784 - RNA, 19 nt, Homo sapiens
aaaccugucucuaauuugu

SEQ ID NO: 1032785 - RNA, 19 nt, Homo sapiens
gaaauugacccaagugaac

SEQ ID NO: 1032786 - RNA, 19 nt, Homo sapiens
ccaacaggcugcaaagcaa

SEQ ID NO: 1032787 - RNA, 19 nt, Homo sapiens
cuaagaauguuugcugaaa

SEQ ID NO: 1032788 - RNA, 19 nt, Homo sapiens
gaugaaacauagagaagag

SEQ ID NO: 1032789 - RNA, 19 nt, Homo sapiens
gacucuagcuucuaccaaa

SEQ ID NO: 1032790 - RNA, 19 nt, Homo sapiens
gaaacccugucucuacugu

SEQ ID NO: 1032791 - RNA, 19 nt, Homo sapiens
caugacccaucuuuacuaa

SEQ ID NO: 1032792 - RNA, 19 nt, Homo sapiens
caacaugacccaucuuuac

SEQ ID NO: 1032793 - RNA, 19 nt, Homo sapiens
gcuccuuccugaugaauga

SEQ ID NO: 1032794 - RNA, 19 nt, Homo sapiens
cuucucagaucucaaauga

SEQ ID NO: 1032795 - RNA, 19 nt, Homo sapiens
aagcagagguuugggaauu

SEQ ID NO: 1032796 - RNA, 19 nt, Homo sapiens
cagaggauucgcaugauua

SEQ ID NO: 1032797 - RNA, 19 nt, Homo sapiens
ucuacugucucuaacauuu

SEQ ID NO: 1032798 - RNA, 19 nt, Homo sapiens
gaggagggcagaucacuug

SEQ ID NO: 1032799 - RNA, 19 nt, Homo sapiens
uggauucacugguuagauu

SEQ ID NO: 1032800 - RNA, 19 nt, Homo sapiens
cauaaagccacauugagua

SEQ ID NO: 1032801 - RNA, 19 nt, Homo sapiens
gcaaacacaagaacuauac

SEQ ID NO: 1032802 - RNA, 19 nt, Homo sapiens
gaucucaaaugacuauguc

SEQ ID NO: 1032803 - RNA, 19 nt, Homo sapiens
gcaguuucuuauaagcaua

SEQ ID NO: 1032804 - RNA, 19 nt, Homo sapiens
guagugcacaguagucuaa

SEQ ID NO: 1032805 - RNA, 19 nt, Homo sapiens
caaaagcccuuccagaaau

SEQ ID NO: 1032806 - RNA, 19 nt, Homo sapiens
caaagcaagaguauagauu

SEQ ID NO: 1032807 - RNA, 19 nt, Homo sapiens
gaacacaaggucaggagau

SEQ ID NO: 1032808 - RNA, 19 nt, Homo sapiens
gccagggaauugcaagaaa

SEQ ID NO: 1032809 - RNA, 19 nt, Homo sapiens
aacccugucucucauauuu

SEQ ID NO: 1032810 - RNA, 19 nt, Homo sapiens
ugacccaagugaacugaaa

SEQ ID NO: 1032811 - RNA, 19 nt, Homo sapiens
ucagaggauucgcaugauu

SEQ ID NO: 1032812 - RNA, 19 nt, Homo sapiens
gucaggagaucaagacugu

SEQ ID NO: 1032813 - RNA, 19 nt, Homo sapiens
ccagggaauugcaagaaau

SEQ ID NO: 1032814 - RNA, 19 nt, Homo sapiens
acucuugguucacacaaua

SEQ ID NO: 1032815 - RNA, 19 nt, Homo sapiens
gauauccauuccuugaguu

SEQ ID NO: 1032816 - RNA, 19 nt, Homo sapiens
ggaugaagaagaacaggaa

SEQ ID NO: 1032817 - RNA, 19 nt, Homo sapiens
gaaaguagugcacaguagu

SEQ ID NO: 1032818 - RNA, 19 nt, Homo sapiens
gcagacccgugaucaccuu

SEQ ID NO: 1032819 - RNA, 19 nt, Homo sapiens
ggaauugcaagaaauaaag

SEQ ID NO: 1032820 - RNA, 19 nt, Homo sapiens
gcacacugcaucaauguca

SEQ ID NO: 1032821 - RNA, 19 nt, Homo sapiens
caauauccauuugcaaaca

SEQ ID NO: 1032822 - RNA, 19 nt, Homo sapiens
gggcgauucuauuuauaug

SEQ ID NO: 1032823 - RNA, 19 nt, Homo sapiens
gcaaccaaauguagguaag

SEQ ID NO: 1032824 - RNA, 19 nt, Homo sapiens
ggauucacugguuagauua

SEQ ID NO: 1032825 - RNA, 19 nt, Homo sapiens
acagucagaugaaacauag

SEQ ID NO: 1032826 - RNA, 19 nt, Homo sapiens
ucucagaucucaaaugacu

SEQ ID NO: 1032827 - RNA, 19 nt, Homo sapiens
ccacaaaccagacaaagag

SEQ ID NO: 1032828 - RNA, 19 nt, Homo sapiens
uaaacccugucucucauau

SEQ ID NO: 1032829 - RNA, 19 nt, Homo sapiens
gggaauugcaagaaauaaa

SEQ ID NO: 1032830 - RNA, 19 nt, Homo sapiens
gacagucagaugaaacaua

SEQ ID NO: 1032831 - RNA, 19 nt, Homo sapiens
ugaaagaagcuaggccuaa

SEQ ID NO: 1032832 - RNA, 19 nt, Homo sapiens
uaacccagauauccuucaa

SEQ ID NO: 1032833 - RNA, 19 nt, Homo sapiens
acucgcacaugacuguuua

SEQ ID NO: 1032834 - RNA, 19 nt, Homo sapiens
uucaacaggugauuggaua

SEQ ID NO: 1032835 - RNA, 19 nt, Homo sapiens
gaaauaacccagauauccu

SEQ ID NO: 1032836 - RNA, 19 nt, Homo sapiens
ccaacaugacccaucuuua

SEQ ID NO: 1032837 - RNA, 19 nt, Homo sapiens
gcaaagcaagaguauagau

SEQ ID NO: 1032838 - RNA, 19 nt, Homo sapiens
gaaacugcuuccuagaacu

SEQ ID NO: 1032839 - RNA, 19 nt, Homo sapiens
caacaucuuuuccggguuu

SEQ ID NO: 1032840 - RNA, 19 nt, Homo sapiens
gcaggagaaucgcuugaac

SEQ ID NO: 1032841 - RNA, 19 nt, Homo sapiens
ccagguacccagccauaaa

SEQ ID NO: 1032842 - RNA, 19 nt, Homo sapiens
guaaacccugucucucaua

SEQ ID NO: 1032843 - RNA, 19 nt, Homo sapiens
ggugaaacccugucucuac

SEQ ID NO: 1032844 - RNA, 19 nt, Homo sapiens
cgucagggcagcuuugaaa

SEQ ID NO: 1032845 - RNA, 19 nt, Homo sapiens
gcauacagcccacauccau

SEQ ID NO: 1032846 - RNA, 19 nt, Homo sapiens
guugauauccauuccuuga

SEQ ID NO: 1032847 - RNA, 19 nt, Homo sapiens
ggaguggggugggcaauuu

SEQ ID NO: 1032848 - RNA, 19 nt, Homo sapiens
ugaaacugcuuccuagaac

SEQ ID NO: 1032849 - RNA, 19 nt, Homo sapiens
cagggaauugcaagaaaua

SEQ ID NO: 1032850 - RNA, 19 nt, Homo sapiens
caaagggaauaggcugaug

SEQ ID NO: 1032851 - RNA, 19 nt, Homo sapiens
ggaaaaggcaaaacuauag

SEQ ID NO: 1032852 - RNA, 19 nt, Homo sapiens
guuuauagcagcuucauuc

SEQ ID NO: 1032853 - RNA, 19 nt, Homo sapiens
ccauaaagccacauugagu

SEQ ID NO: 1032854 - RNA, 19 nt, Homo sapiens
cuagaaauaacccagauau

SEQ ID NO: 1032855 - RNA, 19 nt, Homo sapiens
caaauguagguaaggauga

SEQ ID NO: 1032856 - RNA, 19 nt, Homo sapiens
guaccagccuaagaauguu

SEQ ID NO: 1032857 - RNA, 19 nt, Homo sapiens
gaugaagaacagaucaguu

SEQ ID NO: 1032858 - RNA, 19 nt, Homo sapiens
gcgauucuauuuauaugac

SEQ ID NO: 1032859 - RNA, 19 nt, Homo sapiens
cacaguagucuaagauuau

SEQ ID NO: 1032860 - RNA, 19 nt, Homo sapiens
gcagauagaucguguggua

SEQ ID NO: 1032861 - RNA, 19 nt, Homo sapiens
gaggaaauuuggccaguua

SEQ ID NO: 1032862 - RNA, 19 nt, Homo sapiens
gcacauccuucaaauuaaa

SEQ ID NO: 1032863 - RNA, 19 nt, Homo sapiens
gaaacugguugaagugauu

SEQ ID NO: 1032864 - RNA, 19 nt, Homo sapiens
ggaaacaucuauaaagaag

SEQ ID NO: 1032865 - RNA, 19 nt, Homo sapiens
uagcacauccuucaaauua

SEQ ID NO: 1032866 - RNA, 19 nt, Homo sapiens
caucauuggucuuuacuaa

SEQ ID NO: 1032867 - RNA, 19 nt, Homo sapiens
acaaaggacuucagaaaug

SEQ ID NO: 1032868 - RNA, 19 nt, Homo sapiens
gaagaccacuuuagaaacu

SEQ ID NO: 1032869 - RNA, 19 nt, Homo sapiens
ugacaaauccgcccuauau

SEQ ID NO: 1032870 - RNA, 19 nt, Homo sapiens
uaauuaaggugguagagaa

SEQ ID NO: 1032871 - RNA, 19 nt, Homo sapiens
gaaaugggcuugggaacca

SEQ ID NO: 1032872 - RNA, 19 nt, Homo sapiens
ggaagaauccacugauaga

SEQ ID NO: 1032873 - RNA, 19 nt, Homo sapiens
gccaguaucugaugccaaa

SEQ ID NO: 1032874 - RNA, 19 nt, Homo sapiens
gcagauaauuaagguggua

SEQ ID NO: 1032875 - RNA, 19 nt, Homo sapiens
cagcccagauuaaauguuu

SEQ ID NO: 1032876 - RNA, 19 nt, Homo sapiens
cagccacucuucuuaauga

SEQ ID NO: 1032877 - RNA, 19 nt, Homo sapiens
gaauacaacuaauggaaac

SEQ ID NO: 1032878 - RNA, 19 nt, Homo sapiens
uaggaagaauccacugaua

SEQ ID NO: 1032879 - RNA, 19 nt, Homo sapiens
ugacaaaggacuucagaaa

SEQ ID NO: 1032880 - RNA, 19 nt, Homo sapiens
caagauuggugaaagacaa

SEQ ID NO: 1032881 - RNA, 19 nt, Homo sapiens
gagaaacagaucaggauuu

SEQ ID NO: 1032882 - RNA, 19 nt, Homo sapiens
gaguugggcccauugguua

SEQ ID NO: 1032883 - RNA, 19 nt, Homo sapiens
ggaaagcgacaucuccauu

SEQ ID NO: 1032884 - RNA, 19 nt, Homo sapiens
ucccaagccuguuuauuaa

SEQ ID NO: 1032885 - RNA, 19 nt, Homo sapiens
gcacauaccaguccagucu

SEQ ID NO: 1032886 - RNA, 19 nt, Homo sapiens
gaaguggacaucuaugaau

SEQ ID NO: 1032887 - RNA, 19 nt, Homo sapiens
cagugaaacuuguugaaga

SEQ ID NO: 1032888 - RNA, 19 nt, Homo sapiens
ugaaacuuguugaagagua

SEQ ID NO: 1032889 - RNA, 19 nt, Homo sapiens
gaauugguauacuaagcaa

SEQ ID NO: 1032890 - RNA, 19 nt, Homo sapiens
guagauagagccaaacaau

SEQ ID NO: 1032891 - RNA, 19 nt, Homo sapiens
ccaguuauccaauugauga

SEQ ID NO: 1032892 - RNA, 19 nt, Homo sapiens
gugauacacuacuggauga

SEQ ID NO: 1032893 - RNA, 19 nt, Homo sapiens
uaccucagccucccuaaua

SEQ ID NO: 1032894 - RNA, 19 nt, Homo sapiens
caaauucccaagccuguuu

SEQ ID NO: 1032895 - RNA, 19 nt, Homo sapiens
gaaacuuguugaagaguac

SEQ ID NO: 1032896 - RNA, 19 nt, Homo sapiens
gaaagcgacaucuccauuc

SEQ ID NO: 1032897 - RNA, 19 nt, Homo sapiens
ggaaacugguugaagugau

SEQ ID NO: 1032898 - RNA, 19 nt, Homo sapiens
uccaauugaugaacuagua

SEQ ID NO: 1032899 - RNA, 19 nt, Homo sapiens
caaaggacuucagaaaugg

SEQ ID NO: 1032900 - RNA, 19 nt, Homo sapiens
gacaaaggacuucagaaau

SEQ ID NO: 1032901 - RNA, 19 nt, Homo sapiens
ucgaagauaucgugucuca

SEQ ID NO: 1032902 - RNA, 19 nt, Homo sapiens
ccaaagugcugggauuaca

SEQ ID NO: 1032903 - RNA, 19 nt, Homo sapiens
caacuaauggaaacaucua

SEQ ID NO: 1032904 - RNA, 19 nt, Homo sapiens
ucaagaggacuuuagacua

SEQ ID NO: 1032905 - RNA, 19 nt, Homo sapiens
uagagcaucuggaggaaau

SEQ ID NO: 1032906 - RNA, 19 nt, Homo sapiens
agaauccacugauagaaau

SEQ ID NO: 1032907 - RNA, 19 nt, Homo sapiens
gaagaauccacugauagaa

SEQ ID NO: 1032908 - RNA, 19 nt, Homo sapiens
caccaugcccaacuaauuu

SEQ ID NO: 1032909 - RNA, 19 nt, Homo sapiens
cauagcacauccuucaaau

SEQ ID NO: 1032910 - RNA, 19 nt, Homo sapiens
ucauuggucuuuacuaagu

SEQ ID NO: 1032911 - RNA, 19 nt, Homo sapiens
ccaccaugcccaacuaauu

SEQ ID NO: 1032912 - RNA, 19 nt, Homo sapiens
ccacaccucugcugcaucu

SEQ ID NO: 1032913 - RNA, 19 nt, Homo sapiens
uucccaagccuguuuauua

SEQ ID NO: 1032914 - RNA, 19 nt, Homo sapiens
ggagaaacagaucaggauu

SEQ ID NO: 1032915 - RNA, 19 nt, Homo sapiens
caagauaggcauuuuguaa

SEQ ID NO: 1032916 - RNA, 19 nt, Homo sapiens
caucgaagauaucgugucu

SEQ ID NO: 1032917 - RNA, 19 nt, Homo sapiens
gauagaucgugugguagaa

SEQ ID NO: 1032918 - RNA, 19 nt, Homo sapiens
gcugaagaccacuuuagaa

SEQ ID NO: 1032919 - RNA, 19 nt, Homo sapiens
ccaagggcaauaauuugua

SEQ ID NO: 1032920 - RNA, 19 nt, Homo sapiens
uuaaggugguagagaauau

SEQ ID NO: 1032921 - RNA, 19 nt, Homo sapiens
gaaagggcagccaguaucu

SEQ ID NO: 1032922 - RNA, 19 nt, Homo sapiens
ggugaaagacaacaagugu

SEQ ID NO: 1032923 - RNA, 19 nt, Homo sapiens
agaggguguuugugagaua

SEQ ID NO: 1032924 - RNA, 19 nt, Homo sapiens
gauuggauuugccgaagau

SEQ ID NO: 1032925 - RNA, 19 nt, Homo sapiens
caagggcaauaauuuguac

SEQ ID NO: 1032926 - RNA, 19 nt, Homo sapiens
ucaauucuaugagcagguu

SEQ ID NO: 1032927 - RNA, 19 nt, Homo sapiens
acuaguagauagagccaaa

SEQ ID NO: 1032928 - RNA, 19 nt, Homo sapiens
cugaagaccacuuuagaaa

SEQ ID NO: 1032929 - RNA, 19 nt, Homo sapiens
cgacaucuccauucuccaa

SEQ ID NO: 1032930 - RNA, 19 nt, Homo sapiens
ugccaaggcuacaucaaga

SEQ ID NO: 1032931 - RNA, 19 nt, Homo sapiens
uaucugaugccaaagugua

SEQ ID NO: 1032932 - RNA, 19 nt, Homo sapiens
gcacacaaucaauucuaug

SEQ ID NO: 1032933 - RNA, 19 nt, Homo sapiens
aagaaacagugaaacuugu

SEQ ID NO: 1032934 - RNA, 19 nt, Homo sapiens
cuucuggacucaucuuuca

SEQ ID NO: 1032935 - RNA, 19 nt, Homo sapiens
ccauagcacauccuucaaa

SEQ ID NO: 1032936 - RNA, 19 nt, Homo sapiens
gcaaacauuuuaugaaagg

SEQ ID NO: 1032937 - RNA, 19 nt, Homo sapiens
ucaaaagaguaguggauuu

SEQ ID NO: 1032938 - RNA, 19 nt, Homo sapiens
gacaaauccgcccuauauu

SEQ ID NO: 1032939 - RNA, 19 nt, Homo sapiens
gaagaaaacaguccaccaa

SEQ ID NO: 1032940 - RNA, 19 nt, Homo sapiens
ucuccaagggcaauaauuu

SEQ ID NO: 1032941 - RNA, 19 nt, Homo sapiens
caagaggguguuugugaga

SEQ ID NO: 1032942 - RNA, 19 nt, Homo sapiens
aagaauccacugauagaaa

SEQ ID NO: 1032943 - RNA, 19 nt, Homo sapiens
ggguuguucucauaauaau

SEQ ID NO: 1032944 - RNA, 19 nt, Homo sapiens
gaaaacaguccaccaagug

SEQ ID NO: 1032945 - RNA, 19 nt, Homo sapiens
caaguuccagcacaaguga

SEQ ID NO: 1032946 - RNA, 19 nt, Homo sapiens
agaaacagaucaggauuuu

SEQ ID NO: 1032947 - RNA, 19 nt, Homo sapiens
uguggaaacugguugaagu

SEQ ID NO: 1032948 - RNA, 19 nt, Homo sapiens
gcuuauggcagagauauug

SEQ ID NO: 1032949 - RNA, 19 nt, Homo sapiens
uugaugaacuaguagauag

SEQ ID NO: 1032950 - RNA, 19 nt, Homo sapiens
uaaacacgccagaggaaau

SEQ ID NO: 1032951 - RNA, 19 nt, Homo sapiens
ccacccagcccagauuaaa

SEQ ID NO: 1032952 - RNA, 19 nt, Homo sapiens
gcucugcugggucuucuuu

SEQ ID NO: 1032953 - RNA, 19 nt, Homo sapiens
ucaagaaacagugaaacuu

SEQ ID NO: 1032954 - RNA, 19 nt, Homo sapiens
cuguguggcugacuucaaa

SEQ ID NO: 1032955 - RNA, 19 nt, Homo sapiens
gaggguguuugugagauau

SEQ ID NO: 1032956 - RNA, 19 nt, Homo sapiens
ugccgaagauuaggaagaa

SEQ ID NO: 1032957 - RNA, 19 nt, Homo sapiens
uaagucagaaccuaauugu

SEQ ID NO: 1032958 - RNA, 19 nt, Homo sapiens
ucagcgaguuccagaaugg

SEQ ID NO: 1032959 - RNA, 19 nt, Homo sapiens
cagcaaaccgcuagcaaag

SEQ ID NO: 1032960 - RNA, 19 nt, Homo sapiens
ggaauuagcagaagacauu

SEQ ID NO: 1032961 - RNA, 19 nt, Homo sapiens
gcacaaaggauguaugaaa

SEQ ID NO: 1032962 - RNA, 19 nt, Homo sapiens
acacugggauucuuucuua

SEQ ID NO: 1032963 - RNA, 19 nt, Homo sapiens
ggagaauaaugucuaguaa

SEQ ID NO: 1032964 - RNA, 19 nt, Homo sapiens
ggaggacaaugcaauaauu

SEQ ID NO: 1032965 - RNA, 19 nt, Homo sapiens
gaagguauuugguuagaug

SEQ ID NO: 1032966 - RNA, 19 nt, Homo sapiens
guagaacuguagauucaua

SEQ ID NO: 1032967 - RNA, 19 nt, Homo sapiens
gcacaaguggaauuuaaua

SEQ ID NO: 1032968 - RNA, 19 nt, Homo sapiens
cuaguaauguggaagaaua

SEQ ID NO: 1032969 - RNA, 19 nt, Homo sapiens
acaagaaggccaucacuua

SEQ ID NO: 1032970 - RNA, 19 nt, Homo sapiens
uggcugagcugucaaagaa

SEQ ID NO: 1032971 - RNA, 19 nt, Homo sapiens
gcacccauuugaauuuaaa

SEQ ID NO: 1032972 - RNA, 19 nt, Homo sapiens
caaauucugucaagcucua

SEQ ID NO: 1032973 - RNA, 19 nt, Homo sapiens
gauaaaucauccugagcua

SEQ ID NO: 1032974 - RNA, 19 nt, Homo sapiens
caucagaucuggcaagaca

SEQ ID NO: 1032975 - RNA, 19 nt, Homo sapiens
agaagaggcugaguuaauu

SEQ ID NO: 1032976 - RNA, 19 nt, Homo sapiens
gcacagagaacgauauaca

SEQ ID NO: 1032977 - RNA, 19 nt, Homo sapiens
aagcacaaguggaauuuaa

SEQ ID NO: 1032978 - RNA, 19 nt, Homo sapiens
ggauuauggugaauuguug

SEQ ID NO: 1032979 - RNA, 19 nt, Homo sapiens
gaucuuaguccuagccuuu

SEQ ID NO: 1032980 - RNA, 19 nt, Homo sapiens
gaagaaauacaaggagaaa

SEQ ID NO: 1032981 - RNA, 19 nt, Homo sapiens
cgagccaaguugagcauua

SEQ ID NO: 1032982 - RNA, 19 nt, Homo sapiens
ggccaucacuuacacuuau

SEQ ID NO: 1032983 - RNA, 19 nt, Homo sapiens
gcaggaggacaaugcaaua

SEQ ID NO: 1032984 - RNA, 19 nt, Homo sapiens
ggaaacacugggauucuuu

SEQ ID NO: 1032985 - RNA, 19 nt, Homo sapiens
ggagaaagacacccacaga

SEQ ID NO: 1032986 - RNA, 19 nt, Homo sapiens
caucucaaguacucuuuaa

SEQ ID NO: 1032987 - RNA, 19 nt, Homo sapiens
gggagaauaaugucuagua

SEQ ID NO: 1032988 - RNA, 19 nt, Homo sapiens
gaagaggcugaguuaauuu

SEQ ID NO: 1032989 - RNA, 19 nt, Homo sapiens
caagugaugcuuucaguug

SEQ ID NO: 1032990 - RNA, 19 nt, Homo sapiens
cuacugaccuggaucuuag

SEQ ID NO: 1032991 - RNA, 19 nt, Homo sapiens
ggcaaacugaccagaauua

SEQ ID NO: 1032992 - RNA, 19 nt, Homo sapiens
gccagaagaggcugaguua

SEQ ID NO: 1032993 - RNA, 19 nt, Homo sapiens
gcauuucuaccauaaguuu

SEQ ID NO: 1032994 - RNA, 19 nt, Homo sapiens
uagcacccauuugaauuua

SEQ ID NO: 1032995 - RNA, 19 nt, Homo sapiens
cuuauagucuguuucauga

SEQ ID NO: 1032996 - RNA, 19 nt, Homo sapiens
cagcagucaugaauacauu

SEQ ID NO: 1032997 - RNA, 19 nt, Homo sapiens
gcaaagggcaucagaucug

SEQ ID NO: 1032998 - RNA, 19 nt, Homo sapiens
ccauugugcugaugaguga

SEQ ID NO: 1032999 - RNA, 19 nt, Homo sapiens
gaugugagugggacugaua

SEQ ID NO: 1033000 - RNA, 19 nt, Homo sapiens
ugaacacucuacuuccuuu

SEQ ID NO: 1033001 - RNA, 19 nt, Homo sapiens
caauuuagccuuagugaag

SEQ ID NO: 1033002 - RNA, 19 nt, Homo sapiens
cagaagaggcugaguuaau

SEQ ID NO: 1033003 - RNA, 19 nt, Homo sapiens
gagccaaguugagcauuau

SEQ ID NO: 1033004 - RNA, 19 nt, Homo sapiens
uugaugaggccuauauuua

SEQ ID NO: 1033005 - RNA, 19 nt, Homo sapiens
ggcuaugaauucugcauuu

SEQ ID NO: 1033006 - RNA, 19 nt, Homo sapiens
aaguagaacuguagauuca

SEQ ID NO: 1033007 - RNA, 19 nt, Homo sapiens
uaugaaagaugagccagaa

SEQ ID NO: 1033008 - RNA, 19 nt, Homo sapiens
gcagaacagacaggaauuu

SEQ ID NO: 1033009 - RNA, 19 nt, Homo sapiens
agacugcugugcugaaaga

SEQ ID NO: 1033010 - RNA, 19 nt, Homo sapiens
gggaagguauuugguuaga

SEQ ID NO: 1033011 - RNA, 19 nt, Homo sapiens
gggaaacacugggauucuu

SEQ ID NO: 1033012 - RNA, 19 nt, Homo sapiens
gacaguauagcacccauuu

SEQ ID NO: 1033013 - RNA, 19 nt, Homo sapiens
cauccagcaugaaguugua

SEQ ID NO: 1033014 - RNA, 19 nt, Homo sapiens
gaagcacaaguggaauuua

SEQ ID NO: 1033015 - RNA, 19 nt, Homo sapiens
gaagcaagcaaagcugaaa

SEQ ID NO: 1033016 - RNA, 19 nt, Homo sapiens
ugagugaccuggcuacuac

SEQ ID NO: 1033017 - RNA, 19 nt, Homo sapiens
agaaauacaaggagaaaga

SEQ ID NO: 1033018 - RNA, 19 nt, Homo sapiens
caguauagcacccauuuga

SEQ ID NO: 1033019 - RNA, 19 nt, Homo sapiens
cccuaaagcuggccaguau

SEQ ID NO: 1033020 - RNA, 19 nt, Homo sapiens
gagugggacugauaaacug

SEQ ID NO: 1033021 - RNA, 19 nt, Homo sapiens
gauugacccuguugguaug

SEQ ID NO: 1033022 - RNA, 19 nt, Homo sapiens
ugguauagcugaacuacug

SEQ ID NO: 1033023 - RNA, 19 nt, Homo sapiens
gauguaaccuuuugucugu

SEQ ID NO: 1033024 - RNA, 19 nt, Homo sapiens
gucaagcucuaaauccauu

SEQ ID NO: 1033025 - RNA, 19 nt, Homo sapiens
gaacagacaggaauuugcu

SEQ ID NO: 1033026 - RNA, 19 nt, Homo sapiens
ggugaauuguuguucuuau

SEQ ID NO: 1033027 - RNA, 19 nt, Homo sapiens
gcugcccugucuucucuua

SEQ ID NO: 1033028 - RNA, 19 nt, Homo sapiens
guagggagaauaaugucua

SEQ ID NO: 1033029 - RNA, 19 nt, Homo sapiens
cauuucaacucuagaggaa

SEQ ID NO: 1033030 - RNA, 19 nt, Homo sapiens
gcaugaagcaggaggacaa

SEQ ID NO: 1033031 - RNA, 19 nt, Homo sapiens
ucacacaacugagucaucu

SEQ ID NO: 1033032 - RNA, 19 nt, Homo sapiens
gcuaugaauucugcauuuc

SEQ ID NO: 1033033 - RNA, 19 nt, Homo sapiens
guauagcacccauuugaau

SEQ ID NO: 1033034 - RNA, 19 nt, Homo sapiens
cacuuacacuuaugauuug

SEQ ID NO: 1033035 - RNA, 19 nt, Homo sapiens
guuagaugacuuugaauga

SEQ ID NO: 1033036 - RNA, 19 nt, Homo sapiens
ucaguaucuucaucucuaa

SEQ ID NO: 1033037 - RNA, 19 nt, Homo sapiens
uuaggcacgugacaguaua

SEQ ID NO: 1033038 - RNA, 19 nt, Homo sapiens
ugaaagaugagccagaaga

SEQ ID NO: 1033039 - RNA, 19 nt, Homo sapiens
ugaugaggccuauauuuau

SEQ ID NO: 1033040 - RNA, 19 nt, Homo sapiens
caaguugagcauuaugaaa

SEQ ID NO: 1033041 - RNA, 19 nt, Homo sapiens
gaauuagcagaagacauua

SEQ ID NO: 1033042 - RNA, 19 nt, Homo sapiens
ugaaaaugcugaacaacuu

SEQ ID NO: 1033043 - RNA, 19 nt, Homo sapiens
guacauacuggaagaaucu

SEQ ID NO: 1033044 - RNA, 19 nt, Homo sapiens
ccugucuucucuuacuuua

SEQ ID NO: 1033045 - RNA, 19 nt, Homo sapiens
gaacuguagauucauaugg

SEQ ID NO: 1033046 - RNA, 19 nt, Homo sapiens
gcaagacagauaaaucauc

SEQ ID NO: 1033047 - RNA, 19 nt, Homo sapiens
gggauuauggugaauuguu

SEQ ID NO: 1033048 - RNA, 19 nt, Homo sapiens
auucagguuuccucaauuu

SEQ ID NO: 1033049 - RNA, 19 nt, Homo sapiens
ugaaauuucuguacaacac

SEQ ID NO: 1033050 - RNA, 19 nt, Homo sapiens
uaaucuagcugcaguuuug

SEQ ID NO: 1033051 - RNA, 19 nt, Homo sapiens
gcgcagaacagacaggaau

SEQ ID NO: 1033052 - RNA, 19 nt, Homo sapiens
gaagauugacccuguuggu

SEQ ID NO: 1033053 - RNA, 19 nt, Homo sapiens
uugguuagaugacuuugaa

SEQ ID NO: 1033054 - RNA, 19 nt, Homo sapiens
aauguguacugcugguaua

SEQ ID NO: 1033055 - RNA, 19 nt, Homo sapiens
cuaccagcauccagcauga

SEQ ID NO: 1033056 - RNA, 19 nt, Homo sapiens
uggcuuaaaucugucguuu

SEQ ID NO: 1033057 - RNA, 19 nt, Homo sapiens
gaugaaauuucuguacaac

SEQ ID NO: 1033058 - RNA, 19 nt, Homo sapiens
uaaaucauccugagcuaca

SEQ ID NO: 1033059 - RNA, 19 nt, Homo sapiens
gauggccaacuuagcauuu

SEQ ID NO: 1033060 - RNA, 19 nt, Homo sapiens
gaaucgagcucccuucaga

SEQ ID NO: 1033061 - RNA, 19 nt, Homo sapiens
ggaaauauacgaucgacaa

SEQ ID NO: 1033062 - RNA, 19 nt, Homo sapiens
ggaacaaccacgucauuaa

SEQ ID NO: 1033063 - RNA, 19 nt, Homo sapiens
gaggagcacugucagagaa

SEQ ID NO: 1033064 - RNA, 19 nt, Homo sapiens
cagaagaguuugucaggaa

SEQ ID NO: 1033065 - RNA, 19 nt, Homo sapiens
gaauucggguggcaagaaa

SEQ ID NO: 1033066 - RNA, 19 nt, Homo sapiens
caaaggacccuacaggauu

SEQ ID NO: 1033067 - RNA, 19 nt, Homo sapiens
caggagcuguggaaauaua

SEQ ID NO: 1033068 - RNA, 19 nt, Homo sapiens
gaacauguccuguguacuc

SEQ ID NO: 1033069 - RNA, 19 nt, Homo sapiens
cgacgaaucuuuaccuaca

SEQ ID NO: 1033070 - RNA, 19 nt, Homo sapiens
gaggaugaaucuucugaug

SEQ ID NO: 1033071 - RNA, 19 nt, Homo sapiens
cgaggugccuucauucuug

SEQ ID NO: 1033072 - RNA, 19 nt, Homo sapiens
ggaugaaucuucugaugca

SEQ ID NO: 1033073 - RNA, 19 nt, Homo sapiens
cagcagcucucaggaguaa

SEQ ID NO: 1033074 - RNA, 19 nt, Homo sapiens
ccagcgaggugccuucauu

SEQ ID NO: 1033075 - RNA, 19 nt, Homo sapiens
cagcagaguuccauucaca

SEQ ID NO: 1033076 - RNA, 19 nt, Homo sapiens
gagguugagauaugaguua

SEQ ID NO: 1033077 - RNA, 19 nt, Homo sapiens
ccaagucccuggcaaugga

SEQ ID NO: 1033078 - RNA, 19 nt, Homo sapiens
ucugauagauacaccaauu

SEQ ID NO: 1033079 - RNA, 19 nt, Homo sapiens
aauauacgaucgacaaugu

SEQ ID NO: 1033080 - RNA, 19 nt, Homo sapiens
agcaggagcuguggaaaua

SEQ ID NO: 1033081 - RNA, 19 nt, Homo sapiens
ggauagcaauggugugauc

SEQ ID NO: 1033082 - RNA, 19 nt, Homo sapiens
ugaaguagaucuguaccaa

SEQ ID NO: 1033083 - RNA, 19 nt, Homo sapiens
ggccugugcucuacuguga

SEQ ID NO: 1033084 - RNA, 19 nt, Homo sapiens
gaagguggauagcaauggu

SEQ ID NO: 1033085 - RNA, 19 nt, Homo sapiens
gaacaaccacgucauuaac

SEQ ID NO: 1033086 - RNA, 19 nt, Homo sapiens
guaugaacauguccugugu

SEQ ID NO: 1033087 - RNA, 19 nt, Homo sapiens
uaagaaguaugaacauguc

SEQ ID NO: 1033088 - RNA, 19 nt, Homo sapiens
aaaggacccuacaggauug

SEQ ID NO: 1033089 - RNA, 19 nt, Homo sapiens
gucagaguccuuuggauua

SEQ ID NO: 1033090 - RNA, 19 nt, Homo sapiens
gaaguagaucuguaccaaa

SEQ ID NO: 1033091 - RNA, 19 nt, Homo sapiens
cuagcugggugguaucuuu

SEQ ID NO: 1033092 - RNA, 19 nt, Homo sapiens
cagaaaagcugggaaauuc

SEQ ID NO: 1033093 - RNA, 19 nt, Homo sapiens
acacugacucugauagaua

SEQ ID NO: 1033094 - RNA, 19 nt, Homo sapiens
gcagagguaccguguggaa

SEQ ID NO: 1033095 - RNA, 19 nt, Homo sapiens
ggacaagguggcucacuuc

SEQ ID NO: 1033096 - RNA, 19 nt, Homo sapiens
gaaauauacgaucgacaau

SEQ ID NO: 1033097 - RNA, 19 nt, Homo sapiens
gcuauaagaaguaugaaca

SEQ ID NO: 1033098 - RNA, 19 nt, Homo sapiens
ggugagagggucuuaaauc

SEQ ID NO: 1033099 - RNA, 19 nt, Homo sapiens
gagcgaauggcaaauguca

SEQ ID NO: 1033100 - RNA, 19 nt, Homo sapiens
ucagaguccuuuggauuau

SEQ ID NO: 1033101 - RNA, 19 nt, Homo sapiens
aaauggagccuuucaucuu

SEQ ID NO: 1033102 - RNA, 19 nt, Homo sapiens
uugcugagguugagauaug

SEQ ID NO: 1033103 - RNA, 19 nt, Homo sapiens
ucccuacccuguggaaaua

SEQ ID NO: 1033104 - RNA, 19 nt, Homo sapiens
uggcugagcugaggagguu

SEQ ID NO: 1033105 - RNA, 19 nt, Homo sapiens
ggaguggccugugcucuac

SEQ ID NO: 1033106 - RNA, 19 nt, Homo sapiens
ucacuucuccuacccauuc

SEQ ID NO: 1033107 - RNA, 19 nt, Homo sapiens
gcuguucuccacccuuuaa

SEQ ID NO: 1033108 - RNA, 19 nt, Homo sapiens
gcagaguuccauucacaau

SEQ ID NO: 1033109 - RNA, 19 nt, Homo sapiens
ccagggaagccucauucua

SEQ ID NO: 1033110 - RNA, 19 nt, Homo sapiens
aauggagccuuucaucuuc

SEQ ID NO: 1033111 - RNA, 19 nt, Homo sapiens
ccucuccuauguacggaua

SEQ ID NO: 1033112 - RNA, 19 nt, Homo sapiens
uccugaagcuggagaauuc

SEQ ID NO: 1033113 - RNA, 19 nt, Homo sapiens
cuacguccacuucuuugua

SEQ ID NO: 1033114 - RNA, 19 nt, Homo sapiens
ucaaaggacccuacaggau

SEQ ID NO: 1033115 - RNA, 19 nt, Homo sapiens
aagcuuggcuauaagaagu

SEQ ID NO: 1033116 - RNA, 19 nt, Homo sapiens
ggaggagcacugucagaga

SEQ ID NO: 1033117 - RNA, 19 nt, Homo sapiens
gcccaaggcuaugaguaug

SEQ ID NO: 1033118 - RNA, 19 nt, Homo sapiens
ugacuucacgggccucaaa

SEQ ID NO: 1033119 - RNA, 19 nt, Homo sapiens
cagggaagccucauucuac

SEQ ID NO: 1033120 - RNA, 19 nt, Homo sapiens
cuggaacccuggucuccua

SEQ ID NO: 1033121 - RNA, 19 nt, Homo sapiens
guggagaccuguggagcuu

SEQ ID NO: 1033122 - RNA, 19 nt, Homo sapiens
guaaauggagaggucguuu

SEQ ID NO: 1033123 - RNA, 19 nt, Homo sapiens
cauguccuguguacucuga

SEQ ID NO: 1033124 - RNA, 19 nt, Homo sapiens
ggagcccucagaagaguuu

SEQ ID NO: 1033125 - RNA, 19 nt, Homo sapiens
ggagcacugucagagaaug

SEQ ID NO: 1033126 - RNA, 19 nt, Homo sapiens
ggacggugagagggucuua

SEQ ID NO: 1033127 - RNA, 19 nt, Homo sapiens
cauuggcgguucucuggaa

SEQ ID NO: 1033128 - RNA, 19 nt, Homo sapiens
gcuaugaguaugacaaucu

SEQ ID NO: 1033129 - RNA, 19 nt, Homo sapiens
gcaccgacuuugagaugac

SEQ ID NO: 1033130 - RNA, 19 nt, Homo sapiens
ccucguaggcaccgacuuu

SEQ ID NO: 1033131 - RNA, 19 nt, Homo sapiens
uauacgaucgacaauguuu

SEQ ID NO: 1033132 - RNA, 19 nt, Homo sapiens
ugauagauacaccaauuug

SEQ ID NO: 1033133 - RNA, 19 nt, Homo sapiens
gaaucuuuaccuacacuga

SEQ ID NO: 1033134 - RNA, 19 nt, Homo sapiens
ucacagcaaggcaggcuuu

SEQ ID NO: 1033135 - RNA, 19 nt, Homo sapiens
ccacguuggucugcugaga

SEQ ID NO: 1033136 - RNA, 19 nt, Homo sapiens
ucacacacccugacagucu

SEQ ID NO: 1033137 - RNA, 19 nt, Homo sapiens
ugucagaguccuuuggauu

SEQ ID NO: 1033138 - RNA, 19 nt, Homo sapiens
caggaacaaccacgucauu

SEQ ID NO: 1033139 - RNA, 19 nt, Homo sapiens
ccugggagcccucagaaga

SEQ ID NO: 1033140 - RNA, 19 nt, Homo sapiens
gugagagggucuuaaaucc

SEQ ID NO: 1033141 - RNA, 19 nt, Homo sapiens
gaacgccugagccgcuuug

SEQ ID NO: 1033142 - RNA, 19 nt, Homo sapiens
guagaucuguaccaaaaug

SEQ ID NO: 1033143 - RNA, 19 nt, Homo sapiens
gagcacugucagagaauga

SEQ ID NO: 1033144 - RNA, 19 nt, Homo sapiens
aggcagugcugaguccuuu

SEQ ID NO: 1033145 - RNA, 19 nt, Homo sapiens
gaacccuggucuccuagcu

SEQ ID NO: 1033146 - RNA, 19 nt, Homo sapiens
ccaugaggaugaaucuucu

SEQ ID NO: 1033147 - RNA, 19 nt, Homo sapiens
gcagcucucaggaguaaca

SEQ ID NO: 1033148 - RNA, 19 nt, Homo sapiens
gcccuccggcucuuuguaa

SEQ ID NO: 1033149 - RNA, 19 nt, Homo sapiens
gcgaggugccuucauucuu

SEQ ID NO: 1033150 - RNA, 19 nt, Homo sapiens
uuaccuacacugacucuga

SEQ ID NO: 1033151 - RNA, 19 nt, Homo sapiens
cugcuguucuccacccuuu

SEQ ID NO: 1033152 - RNA, 19 nt, Homo sapiens
cucuucgucuuucugauua

SEQ ID NO: 1033153 - RNA, 19 nt, Homo sapiens
uggacaagguggcucacuu

SEQ ID NO: 1033154 - RNA, 19 nt, Homo sapiens
aaguagaucuguaccaaaa

SEQ ID NO: 1033155 - RNA, 19 nt, Homo sapiens
ccucuucgucuuucugauu

SEQ ID NO: 1033156 - RNA, 19 nt, Homo sapiens
ucucuacguccacuucuuu

SEQ ID NO: 1033157 - RNA, 19 nt, Homo sapiens
guggauagcaaugguguga

SEQ ID NO: 1033158 - RNA, 19 nt, Homo sapiens
uaacaccccucuucagaca

SEQ ID NO: 1033159 - RNA, 19 nt, Homo sapiens
aggaacaaccacgucauua

SEQ ID NO: 1033160 - RNA, 19 nt, Homo sapiens
gaacacugauuguccauuu

SEQ ID NO: 1033161 - RNA, 19 nt, Homo sapiens
ccaaauaccagucauauaa

SEQ ID NO: 1033162 - RNA, 19 nt, Homo sapiens
caagacaggcuuauaauuu

SEQ ID NO: 1033163 - RNA, 19 nt, Homo sapiens
ucaagacucugaacaauug

SEQ ID NO: 1033164 - RNA, 19 nt, Homo sapiens
gaagagccaccgccuguua

SEQ ID NO: 1033165 - RNA, 19 nt, Homo sapiens
gcaaccaccucaacucauu

SEQ ID NO: 1033166 - RNA, 19 nt, Homo sapiens
gaacaauggauuucucuuu

SEQ ID NO: 1033167 - RNA, 19 nt, Homo sapiens
ugagauuccuguacaauuu

SEQ ID NO: 1033168 - RNA, 19 nt, Homo sapiens
ggacugagauuccuguaca

SEQ ID NO: 1033169 - RNA, 19 nt, Homo sapiens
ccaaggaagucucagauga

SEQ ID NO: 1033170 - RNA, 19 nt, Homo sapiens
agucucagaugaacaauua

SEQ ID NO: 1033171 - RNA, 19 nt, Homo sapiens
ccacugagguugugccaaa

SEQ ID NO: 1033172 - RNA, 19 nt, Homo sapiens
guaugaaacucaaaccaaa

SEQ ID NO: 1033173 - RNA, 19 nt, Homo sapiens
uaacaugucuccaguugug

SEQ ID NO: 1033174 - RNA, 19 nt, Homo sapiens
gcaggcacccucauuuaua

SEQ ID NO: 1033175 - RNA, 19 nt, Homo sapiens
gaucugugcugaauacuca

SEQ ID NO: 1033176 - RNA, 19 nt, Homo sapiens
caucguggcuguuucugua

SEQ ID NO: 1033177 - RNA, 19 nt, Homo sapiens
uaaauggcaugacauaugu

SEQ ID NO: 1033178 - RNA, 19 nt, Homo sapiens
gcaaugugccuucuaaaug

SEQ ID NO: 1033179 - RNA, 19 nt, Homo sapiens
caacaaagggaauugguaa

SEQ ID NO: 1033180 - RNA, 19 nt, Homo sapiens
gagaauaucauguccaguu

SEQ ID NO: 1033181 - RNA, 19 nt, Homo sapiens
ggguacagcuuaaaucaug

SEQ ID NO: 1033182 - RNA, 19 nt, Homo sapiens
cccaagagauuguugcuuu

SEQ ID NO: 1033183 - RNA, 19 nt, Homo sapiens
gggcaagacaggcuuauaa

SEQ ID NO: 1033184 - RNA, 19 nt, Homo sapiens
aaacugugauuccaaagaa

SEQ ID NO: 1033185 - RNA, 19 nt, Homo sapiens
gaagcaacaucugguucua

SEQ ID NO: 1033186 - RNA, 19 nt, Homo sapiens
caagaucugugcugaauac

SEQ ID NO: 1033187 - RNA, 19 nt, Homo sapiens
ggauuucucuuucucuuuc

SEQ ID NO: 1033188 - RNA, 19 nt, Homo sapiens
gaacaauuaugaacaucca

SEQ ID NO: 1033189 - RNA, 19 nt, Homo sapiens
gcaagacaggcuuauaauu

SEQ ID NO: 1033190 - RNA, 19 nt, Homo sapiens
ccaauacuaucuucuguuc

SEQ ID NO: 1033191 - RNA, 19 nt, Homo sapiens
ugagagaaagggaaaguua

SEQ ID NO: 1033192 - RNA, 19 nt, Homo sapiens
caaauuagaaccagaggaa

SEQ ID NO: 1033193 - RNA, 19 nt, Homo sapiens
guauaaaggucauaaacag

SEQ ID NO: 1033194 - RNA, 19 nt, Homo sapiens
guacccagcuacaacagaa

SEQ ID NO: 1033195 - RNA, 19 nt, Homo sapiens
gagauagauuuguguacuu

SEQ ID NO: 1033196 - RNA, 19 nt, Homo sapiens
aaagggaauugguaacaaa

SEQ ID NO: 1033197 - RNA, 19 nt, Homo sapiens
uaacgagguuccaguaauc

SEQ ID NO: 1033198 - RNA, 19 nt, Homo sapiens
gggcaggcacccucauuua

SEQ ID NO: 1033199 - RNA, 19 nt, Homo sapiens
caaugaaggagauagauuu

SEQ ID NO: 1033200 - RNA, 19 nt, Homo sapiens
gaaauccacugagguugug

SEQ ID NO: 1033201 - RNA, 19 nt, Homo sapiens
gaggaugccuuugauaaca

SEQ ID NO: 1033202 - RNA, 19 nt, Homo sapiens
ucagcaaugugccuucuaa

SEQ ID NO: 1033203 - RNA, 19 nt, Homo sapiens
aaucauggguccagccuaa

SEQ ID NO: 1033204 - RNA, 19 nt, Homo sapiens
cacaagaggugcccgagaa

SEQ ID NO: 1033205 - RNA, 19 nt, Homo sapiens
ggaagucucagaugaacaa

SEQ ID NO: 1033206 - RNA, 19 nt, Homo sapiens
caaugugccuucuaaaugg

SEQ ID NO: 1033207 - RNA, 19 nt, Homo sapiens
ugaaggagauagauuugug

SEQ ID NO: 1033208 - RNA, 19 nt, Homo sapiens
ccacugguguuaaguuuca

SEQ ID NO: 1033209 - RNA, 19 nt, Homo sapiens
gagagaaagggaaaguuaa

SEQ ID NO: 1033210 - RNA, 19 nt, Homo sapiens
caagugagcacacgaaauc

SEQ ID NO: 1033211 - RNA, 19 nt, Homo sapiens
acuguggguugaaauauua

SEQ ID NO: 1033212 - RNA, 19 nt, Homo sapiens
caaacuguggguugaaaua

SEQ ID NO: 1033213 - RNA, 19 nt, Homo sapiens
ggagauagauuuguguacu

SEQ ID NO: 1033214 - RNA, 19 nt, Homo sapiens
gcaaugaaggagauagauu

SEQ ID NO: 1033215 - RNA, 19 nt, Homo sapiens
ugaggaaacuguggacuga

SEQ ID NO: 1033216 - RNA, 19 nt, Homo sapiens
caaagggaauugguaacaa

SEQ ID NO: 1033217 - RNA, 19 nt, Homo sapiens
gggaagaaccaguacuaaa

SEQ ID NO: 1033218 - RNA, 19 nt, Homo sapiens
gcccaaacuguauacauua

SEQ ID NO: 1033219 - RNA, 19 nt, Homo sapiens
gaacaauugcuuuaacagu

SEQ ID NO: 1033220 - RNA, 19 nt, Homo sapiens
gaagaaagaauagaacagu

SEQ ID NO: 1033221 - RNA, 19 nt, Homo sapiens
cacaagaccacaugaaauu

SEQ ID NO: 1033222 - RNA, 19 nt, Homo sapiens
ugauuuggcugcacuugaa

SEQ ID NO: 1033223 - RNA, 19 nt, Homo sapiens
gcacaaauuccacauagag

SEQ ID NO: 1033224 - RNA, 19 nt, Homo sapiens
agagauuguugcuuuguaa

SEQ ID NO: 1033225 - RNA, 19 nt, Homo sapiens
uggcucaccugaaauuaaa

SEQ ID NO: 1033226 - RNA, 19 nt, Homo sapiens
cccagaaacuccagacuug

SEQ ID NO: 1033227 - RNA, 19 nt, Homo sapiens
ggagcagguugaaacaguu

SEQ ID NO: 1033228 - RNA, 19 nt, Homo sapiens
agaauaucauguccaguuu

SEQ ID NO: 1033229 - RNA, 19 nt, Homo sapiens
ggaagaaccaguacuaaaa

SEQ ID NO: 1033230 - RNA, 19 nt, Homo sapiens
ugagaggguugacacugua

SEQ ID NO: 1033231 - RNA, 19 nt, Homo sapiens
guggagaccuuuuaaauga

SEQ ID NO: 1033232 - RNA, 19 nt, Homo sapiens
cacaauaaaugccacuuca

SEQ ID NO: 1033233 - RNA, 19 nt, Homo sapiens
gaucaugggaaacacaauu

SEQ ID NO: 1033234 - RNA, 19 nt, Homo sapiens
cuagaugucuguuuguugu

SEQ ID NO: 1033235 - RNA, 19 nt, Homo sapiens
gcagaaguguaacaugucu

SEQ ID NO: 1033236 - RNA, 19 nt, Homo sapiens
caaaauagaccaaaugaga

SEQ ID NO: 1033237 - RNA, 19 nt, Homo sapiens
gggaauuguuugagucuuc

SEQ ID NO: 1033238 - RNA, 19 nt, Homo sapiens
gggcaauaaucaacugaau

SEQ ID NO: 1033239 - RNA, 19 nt, Homo sapiens
gcacuccuguuccucuguu

SEQ ID NO: 1033240 - RNA, 19 nt, Homo sapiens
ccauuuaacuuacacugau

SEQ ID NO: 1033241 - RNA, 19 nt, Homo sapiens
gaagacuggauuacagaaa

SEQ ID NO: 1033242 - RNA, 19 nt, Homo sapiens
aagacaggcuuauaauuuc

SEQ ID NO: 1033243 - RNA, 19 nt, Homo sapiens
guacugaaauucggagaca

SEQ ID NO: 1033244 - RNA, 19 nt, Homo sapiens
ggguauccaucaucaauca

SEQ ID NO: 1033245 - RNA, 19 nt, Homo sapiens
ugacauugcugaagauggu

SEQ ID NO: 1033246 - RNA, 19 nt, Homo sapiens
gauaacaacagugacauug

SEQ ID NO: 1033247 - RNA, 19 nt, Homo sapiens
agaugucucugcaaccaua

SEQ ID NO: 1033248 - RNA, 19 nt, Homo sapiens
caaggaagucucagaugaa

SEQ ID NO: 1033249 - RNA, 19 nt, Homo sapiens
cuaaauggcaugacauaug

SEQ ID NO: 1033250 - RNA, 19 nt, Homo sapiens
ccaagagauuguugcuuug

SEQ ID NO: 1033251 - RNA, 19 nt, Homo sapiens
gguugacacuguaucagaa

SEQ ID NO: 1033252 - RNA, 19 nt, Homo sapiens
gaagagcgcaagucacaca

SEQ ID NO: 1033253 - RNA, 19 nt, Homo sapiens
gaauggcagggaauuguuu

SEQ ID NO: 1033254 - RNA, 19 nt, Homo sapiens
aagacuggcucaccugaaa

SEQ ID NO: 1033255 - RNA, 19 nt, Homo sapiens
ccagucauauaaucaguau

SEQ ID NO: 1033256 - RNA, 19 nt, Homo sapiens
caucaucaaucagugugua

SEQ ID NO: 1033257 - RNA, 19 nt, Homo sapiens
guacgaaucgaauacaaau

SEQ ID NO: 1033258 - RNA, 19 nt, Homo sapiens
cugcagcgcuuguuaaugg

SEQ ID NO: 1033259 - RNA, 19 nt, Homo sapiens
gauaacgagguuccaguaa

SEQ ID NO: 1033260 - RNA, 19 nt, Homo sapiens
caucggaacugccuuauua

SEQ ID NO: 1033261 - RNA, 19 nt, Homo sapiens
caucaaagcuaacaaagua

SEQ ID NO: 1033262 - RNA, 19 nt, Homo sapiens
ggagaaagauauccacaaa

SEQ ID NO: 1033263 - RNA, 19 nt, Homo sapiens
gcaagaaacuacauuacaa

SEQ ID NO: 1033264 - RNA, 19 nt, Homo sapiens
ccaaauaccagucauauaa

SEQ ID NO: 1033265 - RNA, 19 nt, Homo sapiens
uaagaagggugaauuugua

SEQ ID NO: 1033266 - RNA, 19 nt, Homo sapiens
gggauggaguuaacauuua

SEQ ID NO: 1033267 - RNA, 19 nt, Homo sapiens
ggacuucccuguauucuuc

SEQ ID NO: 1033268 - RNA, 19 nt, Homo sapiens
caagacaggcuuauaauuu

SEQ ID NO: 1033269 - RNA, 19 nt, Homo sapiens
gaagauugcucugcuguga

SEQ ID NO: 1033270 - RNA, 19 nt, Homo sapiens
caagaaguguaguucaaua

SEQ ID NO: 1033271 - RNA, 19 nt, Homo sapiens
uaaagaagcccuagagauu

SEQ ID NO: 1033272 - RNA, 19 nt, Homo sapiens
gaaggcugcuggaauugua

SEQ ID NO: 1033273 - RNA, 19 nt, Homo sapiens
gaaaggguaugauaagcuu

SEQ ID NO: 1033274 - RNA, 19 nt, Homo sapiens
ugagaaagguggaagauug

SEQ ID NO: 1033275 - RNA, 19 nt, Homo sapiens
gaagagccaccgccuguua

SEQ ID NO: 1033276 - RNA, 19 nt, Homo sapiens
gcaaccaccucaacucauu

SEQ ID NO: 1033277 - RNA, 19 nt, Homo sapiens
gaacaauggauuucucuuu

SEQ ID NO: 1033278 - RNA, 19 nt, Homo sapiens
caaagcagaugcaugaaga

SEQ ID NO: 1033279 - RNA, 19 nt, Homo sapiens
gaugagauguuuaagaugu

SEQ ID NO: 1033280 - RNA, 19 nt, Homo sapiens
gaagggcagacuaguauua

SEQ ID NO: 1033281 - RNA, 19 nt, Homo sapiens
gaagggcucuauggaagua

SEQ ID NO: 1033282 - RNA, 19 nt, Homo sapiens
uaaagugucugguaaagau

SEQ ID NO: 1033283 - RNA, 19 nt, Homo sapiens
ccacugagguugugccaaa

SEQ ID NO: 1033284 - RNA, 19 nt, Homo sapiens
guaugaaacucaaaccaaa

SEQ ID NO: 1033285 - RNA, 19 nt, Homo sapiens
gcaaguagauagcccuuca

SEQ ID NO: 1033286 - RNA, 19 nt, Homo sapiens
uaacaugucuccaguugug

SEQ ID NO: 1033287 - RNA, 19 nt, Homo sapiens
gaucugugcugaauacuca

SEQ ID NO: 1033288 - RNA, 19 nt, Homo sapiens
gugcugaguugaugaaauu

SEQ ID NO: 1033289 - RNA, 19 nt, Homo sapiens
acaaacacaucaaagcuaa

SEQ ID NO: 1033290 - RNA, 19 nt, Homo sapiens
caacaaagggaauugguaa

SEQ ID NO: 1033291 - RNA, 19 nt, Homo sapiens
gagaauaucauguccaguu

SEQ ID NO: 1033292 - RNA, 19 nt, Homo sapiens
gcacuggaaugaguaagaa

SEQ ID NO: 1033293 - RNA, 19 nt, Homo sapiens
ugaauacgucggugaauua

SEQ ID NO: 1033294 - RNA, 19 nt, Homo sapiens
gaacauccagggccuuaaa

SEQ ID NO: 1033295 - RNA, 19 nt, Homo sapiens
ggaauuguaaugacuguaa

SEQ ID NO: 1033296 - RNA, 19 nt, Homo sapiens
gaagaagaaugcagauugc

SEQ ID NO: 1033297 - RNA, 19 nt, Homo sapiens
ccagagggcugauaguuca

SEQ ID NO: 1033298 - RNA, 19 nt, Homo sapiens
gggcaagacaggcuuauaa

SEQ ID NO: 1033299 - RNA, 19 nt, Homo sapiens
aaacugugauuccaaagaa

SEQ ID NO: 1033300 - RNA, 19 nt, Homo sapiens
uaagauguguuccuugguu

SEQ ID NO: 1033301 - RNA, 19 nt, Homo sapiens
gcagaugcaugaagauuac

SEQ ID NO: 1033302 - RNA, 19 nt, Homo sapiens
gagaacaguguaacuaauu

SEQ ID NO: 1033303 - RNA, 19 nt, Homo sapiens
gcacaaagagaaaguaaag

SEQ ID NO: 1033304 - RNA, 19 nt, Homo sapiens
gaagcaacaucugguucua

SEQ ID NO: 1033305 - RNA, 19 nt, Homo sapiens
caagaucugugcugaauac

SEQ ID NO: 1033306 - RNA, 19 nt, Homo sapiens
ggauuucucuuucucuuuc

SEQ ID NO: 1033307 - RNA, 19 nt, Homo sapiens
gagaaagcccucuaggaaa

SEQ ID NO: 1033308 - RNA, 19 nt, Homo sapiens
auacgucggugaauuaauu

SEQ ID NO: 1033309 - RNA, 19 nt, Homo sapiens
gcagaguguucccuuaugu

SEQ ID NO: 1033310 - RNA, 19 nt, Homo sapiens
gcaagacaggcuuauaauu

SEQ ID NO: 1033311 - RNA, 19 nt, Homo sapiens
ugagagaaagggaaaguua

SEQ ID NO: 1033312 - RNA, 19 nt, Homo sapiens
ccaauacuaucuucuguuc

SEQ ID NO: 1033313 - RNA, 19 nt, Homo sapiens
caaauuagaaccagaggaa

SEQ ID NO: 1033314 - RNA, 19 nt, Homo sapiens
ugagaaagcccucuaggaa

SEQ ID NO: 1033315 - RNA, 19 nt, Homo sapiens
gauuucagauuccuguaaa

SEQ ID NO: 1033316 - RNA, 19 nt, Homo sapiens
gaaaggugccagcgagauu

SEQ ID NO: 1033317 - RNA, 19 nt, Homo sapiens
guauaaaggucauaaacag

SEQ ID NO: 1033318 - RNA, 19 nt, Homo sapiens
guacccagcuacaacagaa

SEQ ID NO: 1033319 - RNA, 19 nt, Homo sapiens
ccaaggaccguauaauuga

SEQ ID NO: 1033320 - RNA, 19 nt, Homo sapiens
aaagggaauugguaacaaa

SEQ ID NO: 1033321 - RNA, 19 nt, Homo sapiens
ucaauagucuaaucaagug

SEQ ID NO: 1033322 - RNA, 19 nt, Homo sapiens
guggagagcuggucaugug

SEQ ID NO: 1033323 - RNA, 19 nt, Homo sapiens
gcaugugcgucaacaaaug

SEQ ID NO: 1033324 - RNA, 19 nt, Homo sapiens
gcaaguaaaggccgcauga

SEQ ID NO: 1033325 - RNA, 19 nt, Homo sapiens
gaaauccacugagguugug

SEQ ID NO: 1033326 - RNA, 19 nt, Homo sapiens
gaggaugccuuugauaaca

SEQ ID NO: 1033327 - RNA, 19 nt, Homo sapiens
gaaguguaguucaauaguc

SEQ ID NO: 1033328 - RNA, 19 nt, Homo sapiens
gaacugccuuauuaaagca

SEQ ID NO: 1033329 - RNA, 19 nt, Homo sapiens
ggaacugccuuauuaaagc

SEQ ID NO: 1033330 - RNA, 19 nt, Homo sapiens
cacaagaggugcccgagaa

SEQ ID NO: 1033331 - RNA, 19 nt, Homo sapiens
gcaugaagauuacuguuuu

SEQ ID NO: 1033332 - RNA, 19 nt, Homo sapiens
cuguaaagcuggcaagaaa

SEQ ID NO: 1033333 - RNA, 19 nt, Homo sapiens
gugaagcguuguucuguug

SEQ ID NO: 1033334 - RNA, 19 nt, Homo sapiens
ccagcgagauuucagauuc

SEQ ID NO: 1033335 - RNA, 19 nt, Homo sapiens
gagagaaagggaaaguuaa

SEQ ID NO: 1033336 - RNA, 19 nt, Homo sapiens
ccacugguguuaaguuuca

SEQ ID NO: 1033337 - RNA, 19 nt, Homo sapiens
caagugagcacacgaaauc

SEQ ID NO: 1033338 - RNA, 19 nt, Homo sapiens
cagaagagacgaaagauca

SEQ ID NO: 1033339 - RNA, 19 nt, Homo sapiens
ggaaauuauucucgcuuca

SEQ ID NO: 1033340 - RNA, 19 nt, Homo sapiens
ggaauugaaagcacaaaga

SEQ ID NO: 1033341 - RNA, 19 nt, Homo sapiens
guuaguauccuccuacauu

SEQ ID NO: 1033342 - RNA, 19 nt, Homo sapiens
ugaaagcucuggugacucu

SEQ ID NO: 1033343 - RNA, 19 nt, Homo sapiens
gagaagaggcacuggaaug

SEQ ID NO: 1033344 - RNA, 19 nt, Homo sapiens
caaagggaauugguaacaa

SEQ ID NO: 1033345 - RNA, 19 nt, Homo sapiens
gggaagaaccaguacuaaa

SEQ ID NO: 1033346 - RNA, 19 nt, Homo sapiens
ucacuucucuuucccuuca

SEQ ID NO: 1033347 - RNA, 19 nt, Homo sapiens
ggagcaagauaaaauguaa

SEQ ID NO: 1033348 - RNA, 19 nt, Homo sapiens
gaagaaagaauagaacagu

SEQ ID NO: 1033349 - RNA, 19 nt, Homo sapiens
cacaagaccacaugaaauu

SEQ ID NO: 1033350 - RNA, 19 nt, Homo sapiens
aaacagaagagacgaaaga

SEQ ID NO: 1033351 - RNA, 19 nt, Homo sapiens
ggaagaagcugcaaaacgu

SEQ ID NO: 1033352 - RNA, 19 nt, Homo sapiens
cuguaaaccucuaaagaaa

SEQ ID NO: 1033353 - RNA, 19 nt, Homo sapiens
uggcucaccugaaauuaaa

SEQ ID NO: 1033354 - RNA, 19 nt, Homo sapiens
gagagcuggucauguguga

SEQ ID NO: 1033355 - RNA, 19 nt, Homo sapiens
caaaugaagagaaggcaaa

SEQ ID NO: 1033356 - RNA, 19 nt, Homo sapiens
gacagugaauggagauguu

SEQ ID NO: 1033357 - RNA, 19 nt, Homo sapiens
ugaagaagaaugcagauug

SEQ ID NO: 1033358 - RNA, 19 nt, Homo sapiens
gaugugcaguccauggauu

SEQ ID NO: 1033359 - RNA, 19 nt, Homo sapiens
ggagcagguugaaacaguu

SEQ ID NO: 1033360 - RNA, 19 nt, Homo sapiens
ugaaaccugucucuacuaa

SEQ ID NO: 1033361 - RNA, 19 nt, Homo sapiens
gcagcuggauggcuacaga

SEQ ID NO: 1033362 - RNA, 19 nt, Homo sapiens
gccgguggcugacaagauu

SEQ ID NO: 1033363 - RNA, 19 nt, Homo sapiens
ggacgcgaaugggcacuuu

SEQ ID NO: 1033364 - RNA, 19 nt, Homo sapiens
ggaggcaucuucuucucau

SEQ ID NO: 1033365 - RNA, 19 nt, Homo sapiens
ggugaaaccugucucuacu

SEQ ID NO: 1033366 - RNA, 19 nt, Homo sapiens
gcgaaugggcacuuuguga

SEQ ID NO: 1033367 - RNA, 19 nt, Homo sapiens
ccucggugcuccuggauga

SEQ ID NO: 1033368 - RNA, 19 nt, Homo sapiens
aaaccugucucuacuaaaa

SEQ ID NO: 1033369 - RNA, 19 nt, Homo sapiens
gacaacggguggcugcaau

SEQ ID NO: 1033370 - RNA, 19 nt, Homo sapiens
gcacccaccuccugaucuc

SEQ ID NO: 1033371 - RNA, 19 nt, Homo sapiens
cgaaugggcacuuugugaa

SEQ ID NO: 1033372 - RNA, 19 nt, Homo sapiens
ggagguccgugccauucug

SEQ ID NO: 1033373 - RNA, 19 nt, Homo sapiens
gcugggcucccuccaauau

SEQ ID NO: 1033374 - RNA, 19 nt, Homo sapiens
gagaccagccugcccaaca

SEQ ID NO: 1033375 - RNA, 19 nt, Homo sapiens
gaaaccugucucuacuaaa

SEQ ID NO: 1033376 - RNA, 19 nt, Homo sapiens
gaaugggcacuuugugaag

SEQ ID NO: 1033377 - RNA, 19 nt, Homo sapiens
ccuguaaucccagcacuuu

SEQ ID NO: 1033378 - RNA, 19 nt, Homo sapiens
gaggagguccgugccauuc

SEQ ID NO: 1033379 - RNA, 19 nt, Homo sapiens
gagcucuuccugcuguuug

SEQ ID NO: 1033380 - RNA, 19 nt, Homo sapiens
gugaaaccugucucuacua

SEQ ID NO: 1033381 - RNA, 19 nt, Homo sapiens
agaccagccugcccaacau

SEQ ID NO: 1033382 - RNA, 19 nt, Homo sapiens
ggaggcaaggcccacauuc

SEQ ID NO: 1033383 - RNA, 19 nt, Homo sapiens
gaggugcagcgguucauca

SEQ ID NO: 1033384 - RNA, 19 nt, Homo sapiens
gguucgaggcggucaaaga

SEQ ID NO: 1033385 - RNA, 19 nt, Homo sapiens
gcaacugcuuccgguuaca

SEQ ID NO: 1033386 - RNA, 19 nt, Homo sapiens
ugggcucccuccaauauca

SEQ ID NO: 1033387 - RNA, 19 nt, Homo sapiens
gaggcaaggcccacauucu

SEQ ID NO: 1033388 - RNA, 19 nt, Homo sapiens
gggaggcaaggcccacauu

SEQ ID NO: 1033389 - RNA, 19 nt, Homo sapiens
gccugcagcuguucaacgu

SEQ ID NO: 1033390 - RNA, 19 nt, Homo sapiens
gcccacauucuccuucaga

SEQ ID NO: 1033391 - RNA, 19 nt, Homo sapiens
cgaggagguccgugccauu

SEQ ID NO: 1033392 - RNA, 19 nt, Homo sapiens
caccuucgcgcuccucuuc

SEQ ID NO: 1033393 - RNA, 19 nt, Homo sapiens
uaaacaagaugccuucuaa

SEQ ID NO: 1033394 - RNA, 19 nt, Homo sapiens
acuagaagcuguaacauua

SEQ ID NO: 1033395 - RNA, 19 nt, Homo sapiens
ggaggauucuuauacuuua

SEQ ID NO: 1033396 - RNA, 19 nt, Homo sapiens
agagagagauguagucaua

SEQ ID NO: 1033397 - RNA, 19 nt, Homo sapiens
gcaguugucuguuagcuuu

SEQ ID NO: 1033398 - RNA, 19 nt, Homo sapiens
caagaugccuucuaagcua

SEQ ID NO: 1033399 - RNA, 19 nt, Homo sapiens
gcauugcaguugucuguua

SEQ ID NO: 1033400 - RNA, 19 nt, Homo sapiens
gaaaggaggccauacagaa

SEQ ID NO: 1033401 - RNA, 19 nt, Homo sapiens
acaaagagcuaaaugaugu

SEQ ID NO: 1033402 - RNA, 19 nt, Homo sapiens
gcacauaagaagaacauaa

SEQ ID NO: 1033403 - RNA, 19 nt, Homo sapiens
auacacaugugaagucuua

SEQ ID NO: 1033404 - RNA, 19 nt, Homo sapiens
uaagaaguguugugaaaga

SEQ ID NO: 1033405 - RNA, 19 nt, Homo sapiens
gcaggaggcuuugugauau

SEQ ID NO: 1033406 - RNA, 19 nt, Homo sapiens
gaaagaggcuuguaaaagu

SEQ ID NO: 1033407 - RNA, 19 nt, Homo sapiens
ucaacaaggugaugaagaa

SEQ ID NO: 1033408 - RNA, 19 nt, Homo sapiens
gaaggaaucucggaaugau

SEQ ID NO: 1033409 - RNA, 19 nt, Homo sapiens
ucaaagaaaucacacuguu

SEQ ID NO: 1033410 - RNA, 19 nt, Homo sapiens
uaacagcuguggagucaga

SEQ ID NO: 1033411 - RNA, 19 nt, Homo sapiens
gcacuucugucaagcuuuc

SEQ ID NO: 1033412 - RNA, 19 nt, Homo sapiens
ggauauggaugaugccaau

SEQ ID NO: 1033413 - RNA, 19 nt, Homo sapiens
gguaacagcuguggaguca

SEQ ID NO: 1033414 - RNA, 19 nt, Homo sapiens
gaagcugaguuacauaaag

SEQ ID NO: 1033415 - RNA, 19 nt, Homo sapiens
caaaagaacucaaagauac

SEQ ID NO: 1033416 - RNA, 19 nt, Homo sapiens
ccacagagcacguagaaau

SEQ ID NO: 1033417 - RNA, 19 nt, Homo sapiens
aaacagaccauaaagaaug

SEQ ID NO: 1033418 - RNA, 19 nt, Homo sapiens
caacugcacauaagaagaa

SEQ ID NO: 1033419 - RNA, 19 nt, Homo sapiens
acuaagaaguguugugaaa

SEQ ID NO: 1033420 - RNA, 19 nt, Homo sapiens
ugugaagucuuacauuuga

SEQ ID NO: 1033421 - RNA, 19 nt, Homo sapiens
agacagcccuggagauguu

SEQ ID NO: 1033422 - RNA, 19 nt, Homo sapiens
caaugaguaugcugaauuc

SEQ ID NO: 1033423 - RNA, 19 nt, Homo sapiens
caaagaaaucacacuguuu

SEQ ID NO: 1033424 - RNA, 19 nt, Homo sapiens
gagauguagucauaauaga

SEQ ID NO: 1033425 - RNA, 19 nt, Homo sapiens
agaagugugugccgccuua

SEQ ID NO: 1033426 - RNA, 19 nt, Homo sapiens
uaacagacaagccuacuau

SEQ ID NO: 1033427 - RNA, 19 nt, Homo sapiens
ggauucaacugcacauaag

SEQ ID NO: 1033428 - RNA, 19 nt, Homo sapiens
cagagagaaugauacacua

SEQ ID NO: 1033429 - RNA, 19 nt, Homo sapiens
cgaaacagaagacaaauca

SEQ ID NO: 1033430 - RNA, 19 nt, Homo sapiens
ccaguuugcuuaagaaugg

SEQ ID NO: 1033431 - RNA, 19 nt, Homo sapiens
gaacucaaagauaccauga

SEQ ID NO: 1033432 - RNA, 19 nt, Homo sapiens
ggacugcugcgguaaagaa

SEQ ID NO: 1033433 - RNA, 19 nt, Homo sapiens
cuacuauuaugcucuguuu

SEQ ID NO: 1033434 - RNA, 19 nt, Homo sapiens
ggaaauggaagauggaagu

SEQ ID NO: 1033435 - RNA, 19 nt, Homo sapiens
gaucacaccuaccaagaac

SEQ ID NO: 1033436 - RNA, 19 nt, Homo sapiens
gagagauguagucauaaua

SEQ ID NO: 1033437 - RNA, 19 nt, Homo sapiens
cagacgaccucacccagaa

SEQ ID NO: 1033438 - RNA, 19 nt, Homo sapiens
aaagauaccaugagaacuu

SEQ ID NO: 1033439 - RNA, 19 nt, Homo sapiens
caacugaaggaaauuauca

SEQ ID NO: 1033440 - RNA, 19 nt, Homo sapiens
gaugaagaauagcaaccaa

SEQ ID NO: 1033441 - RNA, 19 nt, Homo sapiens
cagaauccuuugauacuuc

SEQ ID NO: 1033442 - RNA, 19 nt, Homo sapiens
ggaaaggaggccauacaga

SEQ ID NO: 1033443 - RNA, 19 nt, Homo sapiens
gugaaggaaucucggaaug

SEQ ID NO: 1033444 - RNA, 19 nt, Homo sapiens
caacccagaucuccauugg

SEQ ID NO: 1033445 - RNA, 19 nt, Homo sapiens
gcacauaaacuaaaacaga

SEQ ID NO: 1033446 - RNA, 19 nt, Homo sapiens
gaauacacaugugaagucu

SEQ ID NO: 1033447 - RNA, 19 nt, Homo sapiens
ccagagaagucuuugaaaa

SEQ ID NO: 1033448 - RNA, 19 nt, Homo sapiens
ugcaucagauuccuucuuu

SEQ ID NO: 1033449 - RNA, 19 nt, Homo sapiens
gcaccaauuugcacgucaa

SEQ ID NO: 1033450 - RNA, 19 nt, Homo sapiens
acaaggugaugaagaauag

SEQ ID NO: 1033451 - RNA, 19 nt, Homo sapiens
aagcugaguuacauaaaga

SEQ ID NO: 1033452 - RNA, 19 nt, Homo sapiens
aaaaucagcuuuccgagaa

SEQ ID NO: 1033453 - RNA, 19 nt, Homo sapiens
gagaagccacugcucaaga

SEQ ID NO: 1033454 - RNA, 19 nt, Homo sapiens
uacgccaacuucucuauaa

SEQ ID NO: 1033455 - RNA, 19 nt, Homo sapiens
aauaguggaauccuuguua

SEQ ID NO: 1033456 - RNA, 19 nt, Homo sapiens
cagguuugcuguccuccua

SEQ ID NO: 1033457 - RNA, 19 nt, Homo sapiens
caagauacuagaagcugua

SEQ ID NO: 1033458 - RNA, 19 nt, Homo sapiens
ugaagaauagcaaccaauu

SEQ ID NO: 1033459 - RNA, 19 nt, Homo sapiens
agaauggccaguuugcuua

SEQ ID NO: 1033460 - RNA, 19 nt, Homo sapiens
agagagauguagucauaau

SEQ ID NO: 1033461 - RNA, 19 nt, Homo sapiens
gauacuagaagcuguaaca

SEQ ID NO: 1033462 - RNA, 19 nt, Homo sapiens
gacaaagagcuaaaugaug

SEQ ID NO: 1033463 - RNA, 19 nt, Homo sapiens
ucaaugaguaugcugaauu

SEQ ID NO: 1033464 - RNA, 19 nt, Homo sapiens
gauguagucauaauagaga

SEQ ID NO: 1033465 - RNA, 19 nt, Homo sapiens
gccaacuucucuauaacaa

SEQ ID NO: 1033466 - RNA, 19 nt, Homo sapiens
cagagcacguagaaauuga

SEQ ID NO: 1033467 - RNA, 19 nt, Homo sapiens
gcagugcuagauauuguuu

SEQ ID NO: 1033468 - RNA, 19 nt, Homo sapiens
guggaauccuuguuacaga

SEQ ID NO: 1033469 - RNA, 19 nt, Homo sapiens
caacaccacaucuucucua

SEQ ID NO: 1033470 - RNA, 19 nt, Homo sapiens
aaacuaagaaguguuguga

SEQ ID NO: 1033471 - RNA, 19 nt, Homo sapiens
caaauucagcauauugaug

SEQ ID NO: 1033472 - RNA, 19 nt, Homo sapiens
ugucaucuuugcuggagua

SEQ ID NO: 1033473 - RNA, 19 nt, Homo sapiens
acacuaaucaucaucauca

SEQ ID NO: 1033474 - RNA, 19 nt, Homo sapiens
ccucagcacuucugucaag

SEQ ID NO: 1033475 - RNA, 19 nt, Homo sapiens
aaaggaggccauacagaaa

SEQ ID NO: 1033476 - RNA, 19 nt, Homo sapiens
gaauggccaguuugcuuaa

SEQ ID NO: 1033477 - RNA, 19 nt, Homo sapiens
caccacaucuucucuaaaa

SEQ ID NO: 1033478 - RNA, 19 nt, Homo sapiens
gcuaugagucgucguugaa

SEQ ID NO: 1033479 - RNA, 19 nt, Homo sapiens
ggagaggucggugugaauu

SEQ ID NO: 1033480 - RNA, 19 nt, Homo sapiens
ccuuuggccuccuuuguuu

SEQ ID NO: 1033481 - RNA, 19 nt, Homo sapiens
uauggaugaugccaauaaa

SEQ ID NO: 1033482 - RNA, 19 nt, Homo sapiens
gaagaugaaagaguggauu

SEQ ID NO: 1033483 - RNA, 19 nt, Homo sapiens
aaaguaccuuccuguucua

SEQ ID NO: 1033484 - RNA, 19 nt, Homo sapiens
aaaucacacuguuucauuc

SEQ ID NO: 1033485 - RNA, 19 nt, Homo sapiens
gagugcaaauaucauugaa

SEQ ID NO: 1033486 - RNA, 19 nt, Homo sapiens
cggaaugauauuucacuua

SEQ ID NO: 1033487 - RNA, 19 nt, Homo sapiens
ucagaauccuuugauacuu

SEQ ID NO: 1033488 - RNA, 19 nt, Homo sapiens
aaaccaauguucuacaacu

SEQ ID NO: 1033489 - RNA, 19 nt, Homo sapiens
caacaugugaaacaaagga

SEQ ID NO: 1033490 - RNA, 19 nt, Homo sapiens
guagacagcccuggagaug

SEQ ID NO: 1033491 - RNA, 19 nt, Homo sapiens
caucacauuugcaucagau

SEQ ID NO: 1033492 - RNA, 19 nt, Homo sapiens
gauauaucaucacauuugc

SEQ ID NO: 1033493 - RNA, 19 nt, Homo sapiens
gcagaagaauggugaaaua

SEQ ID NO: 1033494 - RNA, 19 nt, Homo sapiens
gggagaaguuuaucgauua

SEQ ID NO: 1033495 - RNA, 19 nt, Homo sapiens
gaacuccucucuuguaaau

SEQ ID NO: 1033496 - RNA, 19 nt, Homo sapiens
gaacauggaggcagauaua

SEQ ID NO: 1033497 - RNA, 19 nt, Homo sapiens
gagcuaaacuagaugaauu

SEQ ID NO: 1033498 - RNA, 19 nt, Homo sapiens
gaaagggucucaaacugaa

SEQ ID NO: 1033499 - RNA, 19 nt, Homo sapiens
gauaacaacuugcaauuag

SEQ ID NO: 1033500 - RNA, 19 nt, Homo sapiens
gaacagaugcagagaauga

SEQ ID NO: 1033501 - RNA, 19 nt, Homo sapiens
gaccaaguguucagaauuu

SEQ ID NO: 1033502 - RNA, 19 nt, Homo sapiens
ugagaaugcuucaaucaua

SEQ ID NO: 1033503 - RNA, 19 nt, Homo sapiens
gaaagcaugucuucagaga

SEQ ID NO: 1033504 - RNA, 19 nt, Homo sapiens
aaucaaagcuucaaacaga

SEQ ID NO: 1033505 - RNA, 19 nt, Homo sapiens
ggauaaaugucguaaugaa

SEQ ID NO: 1033506 - RNA, 19 nt, Homo sapiens
gaaauuggaagaacaacua

SEQ ID NO: 1033507 - RNA, 19 nt, Homo sapiens
gaugcuggcucuucaaauu

SEQ ID NO: 1033508 - RNA, 19 nt, Homo sapiens
gagaacagaugcagagaau

SEQ ID NO: 1033509 - RNA, 19 nt, Homo sapiens
ugacagaaauggagaguau

SEQ ID NO: 1033510 - RNA, 19 nt, Homo sapiens
agaauuugcuugacucuaa

SEQ ID NO: 1033511 - RNA, 19 nt, Homo sapiens
uauaucaccuucuggguua

SEQ ID NO: 1033512 - RNA, 19 nt, Homo sapiens
gaacgucagcuuaucagua

SEQ ID NO: 1033513 - RNA, 19 nt, Homo sapiens
cagguuagcugcugaauca

SEQ ID NO: 1033514 - RNA, 19 nt, Homo sapiens
gagaaugcuucaaucauau

SEQ ID NO: 1033515 - RNA, 19 nt, Homo sapiens
caaguaaucuacccucaga

SEQ ID NO: 1033516 - RNA, 19 nt, Homo sapiens
gcugaggccuuaagugaaa

SEQ ID NO: 1033517 - RNA, 19 nt, Homo sapiens
gaagcaguuucuuacuaua

SEQ ID NO: 1033518 - RNA, 19 nt, Homo sapiens
ccagugcccucaacaguaa

SEQ ID NO: 1033519 - RNA, 19 nt, Homo sapiens
ugaagugccuguacugaaa

SEQ ID NO: 1033520 - RNA, 19 nt, Homo sapiens
gcaauggaacgucagcuua

SEQ ID NO: 1033521 - RNA, 19 nt, Homo sapiens
gaaaguggaauuagaugaa

SEQ ID NO: 1033522 - RNA, 19 nt, Homo sapiens
gaagaccacccucaaagaa

SEQ ID NO: 1033523 - RNA, 19 nt, Homo sapiens
aaauugagcugacagaaau

SEQ ID NO: 1033524 - RNA, 19 nt, Homo sapiens
ccaaguagaucaucagaag

SEQ ID NO: 1033525 - RNA, 19 nt, Homo sapiens
gaagaacaacuaagcagaa

SEQ ID NO: 1033526 - RNA, 19 nt, Homo sapiens
guaugaaagucaaguauca

SEQ ID NO: 1033527 - RNA, 19 nt, Homo sapiens
agagaaagcucguguagca

SEQ ID NO: 1033528 - RNA, 19 nt, Homo sapiens
gaacuacaauacagacaag

SEQ ID NO: 1033529 - RNA, 19 nt, Homo sapiens
ggaguuagcguccucaaug

SEQ ID NO: 1033530 - RNA, 19 nt, Homo sapiens
ggaagugaaugaacuaaaa

SEQ ID NO: 1033531 - RNA, 19 nt, Homo sapiens
aaaucaagaucuucaggua

SEQ ID NO: 1033532 - RNA, 19 nt, Homo sapiens
aaaugcaccuggagaaauu

SEQ ID NO: 1033533 - RNA, 19 nt, Homo sapiens
guaaugaaaugaugaccau

SEQ ID NO: 1033534 - RNA, 19 nt, Homo sapiens
gaagauaacaacuugcaau

SEQ ID NO: 1033535 - RNA, 19 nt, Homo sapiens
gcagauauaaucacaaauc

SEQ ID NO: 1033536 - RNA, 19 nt, Homo sapiens
ccagcgggcucuagauauu

SEQ ID NO: 1033537 - RNA, 19 nt, Homo sapiens
agaugaagcuggauaacuu

SEQ ID NO: 1033538 - RNA, 19 nt, Homo sapiens
uggaagauaacaccuauua

SEQ ID NO: 1033539 - RNA, 19 nt, Homo sapiens
gcucaaagaggcugaagaa

SEQ ID NO: 1033540 - RNA, 19 nt, Homo sapiens
ugacauauaucaccuucug

SEQ ID NO: 1033541 - RNA, 19 nt, Homo sapiens
ggaagguuguaaacuaugu

SEQ ID NO: 1033542 - RNA, 19 nt, Homo sapiens
gagcuucuaugacagugaa

SEQ ID NO: 1033543 - RNA, 19 nt, Homo sapiens
ugaaagcacuaaaggugaa

SEQ ID NO: 1033544 - RNA, 19 nt, Homo sapiens
gaaauggagaguaugaaga

SEQ ID NO: 1033545 - RNA, 19 nt, Homo sapiens
caaauugagcugacagaaa

SEQ ID NO: 1033546 - RNA, 19 nt, Homo sapiens
cuggagagcuucuuaagug

SEQ ID NO: 1033547 - RNA, 19 nt, Homo sapiens
gaaacugagagcuaaacua

SEQ ID NO: 1033548 - RNA, 19 nt, Homo sapiens
gaaagucaaguaucaguca

SEQ ID NO: 1033549 - RNA, 19 nt, Homo sapiens
ggaggcagauauaaucaca

SEQ ID NO: 1033550 - RNA, 19 nt, Homo sapiens
gaaaugugugaaacucaua

SEQ ID NO: 1033551 - RNA, 19 nt, Homo sapiens
ggauauaaccaccgcuaaa

SEQ ID NO: 1033552 - RNA, 19 nt, Homo sapiens
gaaauugaaagcacuaaag

SEQ ID NO: 1033553 - RNA, 19 nt, Homo sapiens
gaaagcucguguagcaaau

SEQ ID NO: 1033554 - RNA, 19 nt, Homo sapiens
gaagcuggauaacuuaaac

SEQ ID NO: 1033555 - RNA, 19 nt, Homo sapiens
gaugaagcuggauaacuua

SEQ ID NO: 1033556 - RNA, 19 nt, Homo sapiens
aagcaugucuucagagaug

SEQ ID NO: 1033557 - RNA, 19 nt, Homo sapiens
gaccaugacugagaguuau

SEQ ID NO: 1033558 - RNA, 19 nt, Homo sapiens
ggaaauguggcuuaaaaua

SEQ ID NO: 1033559 - RNA, 19 nt, Homo sapiens
ccacguugcuacagaugaa

SEQ ID NO: 1033560 - RNA, 19 nt, Homo sapiens
aauauacccuucaaagaga

SEQ ID NO: 1033561 - RNA, 19 nt, Homo sapiens
gagagcuucuuaagugaug

SEQ ID NO: 1033562 - RNA, 19 nt, Homo sapiens
gucuugaucugacauauau

SEQ ID NO: 1033563 - RNA, 19 nt, Homo sapiens
gaaugaaguuacaaauugc

SEQ ID NO: 1033564 - RNA, 19 nt, Homo sapiens
ugagaguuaugaacaagaa

SEQ ID NO: 1033565 - RNA, 19 nt, Homo sapiens
ugaaugaacuacaauacag

SEQ ID NO: 1033566 - RNA, 19 nt, Homo sapiens
agaagugaaugaacuacaa

SEQ ID NO: 1033567 - RNA, 19 nt, Homo sapiens
ucaaagaagaagugaauga

SEQ ID NO: 1033568 - RNA, 19 nt, Homo sapiens
cagaagccauggacaggaa

SEQ ID NO: 1033569 - RNA, 19 nt, Homo sapiens
ucuauuugcugcauuguau

SEQ ID NO: 1033570 - RNA, 19 nt, Homo sapiens
gaaaagaaacuucaagcaa

SEQ ID NO: 1033571 - RNA, 19 nt, Homo sapiens
ucaaguaucagucacuaaa

SEQ ID NO: 1033572 - RNA, 19 nt, Homo sapiens
acaguaugguuuacaacua

SEQ ID NO: 1033573 - RNA, 19 nt, Homo sapiens
ggagaaauuggaagaacaa

SEQ ID NO: 1033574 - RNA, 19 nt, Homo sapiens
gugaagcuauuaaacaaca

SEQ ID NO: 1033575 - RNA, 19 nt, Homo sapiens
gggacuagcgugaaaguug

SEQ ID NO: 1033576 - RNA, 19 nt, Homo sapiens
guccugcccuaacaguuua

SEQ ID NO: 1033577 - RNA, 19 nt, Homo sapiens
caaagaagaagugaaugaa

SEQ ID NO: 1033578 - RNA, 19 nt, Homo sapiens
gauuaccgccucagaaaga

SEQ ID NO: 1033579 - RNA, 19 nt, Homo sapiens
ugaaagggucucaaacuga

SEQ ID NO: 1033580 - RNA, 19 nt, Homo sapiens
aggcagauauaaucacaaa

SEQ ID NO: 1033581 - RNA, 19 nt, Homo sapiens
ggagaaguuuaucgauuac

SEQ ID NO: 1033582 - RNA, 19 nt, Homo sapiens
acugagagcuaaacuagau

SEQ ID NO: 1033583 - RNA, 19 nt, Homo sapiens
cuggauaacuuaaacaaag

SEQ ID NO: 1033584 - RNA, 19 nt, Homo sapiens
cugguacucuggaagauaa

SEQ ID NO: 1033585 - RNA, 19 nt, Homo sapiens
gcaguuucuuacuauaaug

SEQ ID NO: 1033586 - RNA, 19 nt, Homo sapiens
gcccugagcucccauuagg

SEQ ID NO: 1033587 - RNA, 19 nt, Homo sapiens
guaucuauuugcugcauug

SEQ ID NO: 1033588 - RNA, 19 nt, Homo sapiens
uaaccuggagagcuucuua

SEQ ID NO: 1033589 - RNA, 19 nt, Homo sapiens
gaguuagcguccucaaugu

SEQ ID NO: 1033590 - RNA, 19 nt, Homo sapiens
ggccuuaagugaaagaagu

SEQ ID NO: 1033591 - RNA, 19 nt, Homo sapiens
aaacugagagcuaaacuag

SEQ ID NO: 1033592 - RNA, 19 nt, Homo sapiens
aauaggaaauguggcuuaa

SEQ ID NO: 1033593 - RNA, 19 nt, Homo sapiens
caacgaaccucacuuugua

SEQ ID NO: 1033594 - RNA, 19 nt, Homo sapiens
ucagauggcucccuuaaga

SEQ ID NO: 1033595 - RNA, 19 nt, Homo sapiens
gggaagagcuggagaaagg

SEQ ID NO: 1033596 - RNA, 19 nt, Homo sapiens
gcacaacaccaccuucuuu

SEQ ID NO: 1033597 - RNA, 19 nt, Homo sapiens
gggcagcgauguacauaug

SEQ ID NO: 1033598 - RNA, 19 nt, Homo sapiens
gaacucaaaugccaauggu

SEQ ID NO: 1033599 - RNA, 19 nt, Homo sapiens
uggcauagccuuccuguuu

SEQ ID NO: 1033600 - RNA, 19 nt, Homo sapiens
cggccuggcucgugcauua

SEQ ID NO: 1033601 - RNA, 19 nt, Homo sapiens
gcagaaguuucaagaugug

SEQ ID NO: 1033602 - RNA, 19 nt, Homo sapiens
gcucaacgaaccucacuuu

SEQ ID NO: 1033603 - RNA, 19 nt, Homo sapiens
ggcagaaguuucaagaugu

SEQ ID NO: 1033604 - RNA, 19 nt, Homo sapiens
gauguguguuugucuguau

SEQ ID NO: 1033605 - RNA, 19 nt, Homo sapiens
ugccugagcucgcggauga

SEQ ID NO: 1033606 - RNA, 19 nt, Homo sapiens
gaacuggcagcucuacuuc

SEQ ID NO: 1033607 - RNA, 19 nt, Homo sapiens
acucaaaugccaaugguua

SEQ ID NO: 1033608 - RNA, 19 nt, Homo sapiens
cuaacaguguaacuuauug

SEQ ID NO: 1033609 - RNA, 19 nt, Homo sapiens
gcagcgauguacauaugga

SEQ ID NO: 1033610 - RNA, 19 nt, Homo sapiens
gcucgcggaugaacugaga

SEQ ID NO: 1033611 - RNA, 19 nt, Homo sapiens
aggcagaaguuucaagaug

SEQ ID NO: 1033612 - RNA, 19 nt, Homo sapiens
gcucgugcauuaacaacug

SEQ ID NO: 1033613 - RNA, 19 nt, Homo sapiens
gcccaucggugaccuugga

SEQ ID NO: 1033614 - RNA, 19 nt, Homo sapiens
cuacugauccagcauguga

SEQ ID NO: 1033615 - RNA, 19 nt, Homo sapiens
cgacaaggucuacuucuuc

SEQ ID NO: 1033616 - RNA, 19 nt, Homo sapiens
ggcauagccuuccuguuuc

SEQ ID NO: 1033617 - RNA, 19 nt, Homo sapiens
gaagccuggugcuaucuca

SEQ ID NO: 1033618 - RNA, 19 nt, Homo sapiens
gacaaggucuacuucuucu

SEQ ID NO: 1033619 - RNA, 19 nt, Homo sapiens
ugagaagccuggugcuauc

SEQ ID NO: 1033620 - RNA, 19 nt, Homo sapiens
gcccuggguucaccugauu

SEQ ID NO: 1033621 - RNA, 19 nt, Homo sapiens
cgugcgcgcuuguggcaua

SEQ ID NO: 1033622 - RNA, 19 nt, Homo sapiens
gaaccagaugagaaacuuu

SEQ ID NO: 1033623 - RNA, 19 nt, Homo sapiens
ggagcuacccgacaacauc

SEQ ID NO: 1033624 - RNA, 19 nt, Homo sapiens
gggguucagugguauuuua

SEQ ID NO: 1033625 - RNA, 19 nt, Homo sapiens
caaggcagaaguuucaaga

SEQ ID NO: 1033626 - RNA, 19 nt, Homo sapiens
gacaauggcauacucucuu

SEQ ID NO: 1033627 - RNA, 19 nt, Homo sapiens
cagaguaccuggccuuuug

SEQ ID NO: 1033628 - RNA, 19 nt, Homo sapiens
ugaagaagggcaccaacuu

SEQ ID NO: 1033629 - RNA, 19 nt, Homo sapiens
ccuauaaggaguaccauga

SEQ ID NO: 1033630 - RNA, 19 nt, Homo sapiens
caaggucuacuucuucuuc

SEQ ID NO: 1033631 - RNA, 19 nt, Homo sapiens
ucaacgaaccucacuuugu

SEQ ID NO: 1033632 - RNA, 19 nt, Homo sapiens
gcauagccuuccuguuucu

SEQ ID NO: 1033633 - RNA, 19 nt, Homo sapiens
ugaaccagaugagaaacuu

SEQ ID NO: 1033634 - RNA, 19 nt, Homo sapiens
ccaccucuccuccaacuug

SEQ ID NO: 1033635 - RNA, 19 nt, Homo sapiens
gugaugaccucggacacuu

SEQ ID NO: 1033636 - RNA, 19 nt, Homo sapiens
gaaggggucguaucacuuu

SEQ ID NO: 1033637 - RNA, 19 nt, Homo sapiens
uacgugcgcuuacaacuag

SEQ ID NO: 1033638 - RNA, 19 nt, Homo sapiens
agauggcucccuuaagaua

SEQ ID NO: 1033639 - RNA, 19 nt, Homo sapiens
ccgacaacauccucaacuu

SEQ ID NO: 1033640 - RNA, 19 nt, Homo sapiens
acaauggcauacucucuuc

SEQ ID NO: 1033641 - RNA, 19 nt, Homo sapiens
gcaucuuccuccucucugu

SEQ ID NO: 1033642 - RNA, 19 nt, Homo sapiens
gggauccugucgguuacua

SEQ ID NO: 1033643 - RNA, 19 nt, Homo sapiens
cgacaacauccucaacuuc

SEQ ID NO: 1033644 - RNA, 19 nt, Homo sapiens
gugaguaccaguuggaaga

SEQ ID NO: 1033645 - RNA, 19 nt, Homo sapiens
ggacaauggcauacucucu

SEQ ID NO: 1033646 - RNA, 19 nt, Homo sapiens
gaccaggagcccaugagaa

SEQ ID NO: 1033647 - RNA, 19 nt, Homo sapiens
gaaguuucaagaugugugu

SEQ ID NO: 1033648 - RNA, 19 nt, Homo sapiens
uaaggaguaccaugaggaa

SEQ ID NO: 1033649 - RNA, 19 nt, Homo sapiens
cgaacuggcagcucuacuu

SEQ ID NO: 1033650 - RNA, 19 nt, Homo sapiens
ccuaacaguguaacuuauu

SEQ ID NO: 1033651 - RNA, 19 nt, Homo sapiens
gagggcuccuaacagugua

SEQ ID NO: 1033652 - RNA, 19 nt, Homo sapiens
uguauuugcacauguguuu

SEQ ID NO: 1033653 - RNA, 19 nt, Homo sapiens
uuacgugcgcuuacaacua

SEQ ID NO: 1033654 - RNA, 19 nt, Homo sapiens
uuugggauccugucgguua

SEQ ID NO: 1033655 - RNA, 19 nt, Homo sapiens
ggccugcuguggacaaugg

SEQ ID NO: 1033656 - RNA, 19 nt, Homo sapiens
cacggacccugcagaggaa

SEQ ID NO: 1033657 - RNA, 19 nt, Homo sapiens
caaccuccguggcaguaag

SEQ ID NO: 1033658 - RNA, 19 nt, Homo sapiens
ucaagaagcacccgcugau

SEQ ID NO: 1033659 - RNA, 19 nt, Homo sapiens
cuccuaacaguguaacuua

SEQ ID NO: 1033660 - RNA, 19 nt, Homo sapiens
gcugggaaaggcuguguga

SEQ ID NO: 1033661 - RNA, 19 nt, Homo sapiens
acuggcagcucuacuucaa

SEQ ID NO: 1033662 - RNA, 19 nt, Homo sapiens
ggaacucaaaugccaaugg

SEQ ID NO: 1033663 - RNA, 19 nt, Homo sapiens
gggaagcgugggaggugua

SEQ ID NO: 1033664 - RNA, 19 nt, Homo sapiens
caugcccgcuggaccuuug

SEQ ID NO: 1033665 - RNA, 19 nt, Homo sapiens
acgacaaggucuacuucuu

SEQ ID NO: 1033666 - RNA, 19 nt, Homo sapiens
cccgaggagucaucaguau

SEQ ID NO: 1033667 - RNA, 19 nt, Homo sapiens
gguuacuacuauucagaug

SEQ ID NO: 1033668 - RNA, 19 nt, Homo sapiens
gaguaccaguuggaagaga

SEQ ID NO: 1033669 - RNA, 19 nt, Homo sapiens
cacaacaccaccuucuuug

SEQ ID NO: 1033670 - RNA, 19 nt, Homo sapiens
gugagucauuggagcuaug

SEQ ID NO: 1033671 - RNA, 19 nt, Homo sapiens
guguuugucuguauuugca

SEQ ID NO: 1033672 - RNA, 19 nt, Homo sapiens
gcccuguccugaaccagau

SEQ ID NO: 1033673 - RNA, 19 nt, Homo sapiens
uggccacucuggaucucua

SEQ ID NO: 1033674 - RNA, 19 nt, Homo sapiens
cgacgacaaggucuacuuc

SEQ ID NO: 1033675 - RNA, 19 nt, Homo sapiens
ccgcguauuuauuuguugu

SEQ ID NO: 1033676 - RNA, 19 nt, Homo sapiens
guuucaagauguguguuug

SEQ ID NO: 1033677 - RNA, 19 nt, Homo sapiens
guaccugucggccaucugu

SEQ ID NO: 1033678 - RNA, 19 nt, Homo sapiens
guccugaaccagaugagaa

SEQ ID NO: 1033679 - RNA, 19 nt, Homo sapiens
cacucuggaucucuacuga

SEQ ID NO: 1033680 - RNA, 19 nt, Homo sapiens
ugucggccaucugugagua

SEQ ID NO: 1033681 - RNA, 19 nt, Homo sapiens
caagaagcacccgcugaug

SEQ ID NO: 1033682 - RNA, 19 nt, Homo sapiens
gcuccuaacaguguaacuu

SEQ ID NO: 1033683 - RNA, 19 nt, Homo sapiens
ggugagucauuggagcuau

SEQ ID NO: 1033684 - RNA, 19 nt, Homo sapiens
uuucaaggcagaaguuuca

SEQ ID NO: 1033685 - RNA, 19 nt, Homo sapiens
gcgggaagagcuggagaaa

SEQ ID NO: 1033686 - RNA, 19 nt, Homo sapiens
gaugaccucggacacuuca

SEQ ID NO: 1033687 - RNA, 19 nt, Homo sapiens
caugagaagccuggugcua

SEQ ID NO: 1033688 - RNA, 19 nt, Homo sapiens
caucugugaguaccaguug

SEQ ID NO: 1033689 - RNA, 19 nt, Homo sapiens
ugauggagccaccuauaca

SEQ ID NO: 1033690 - RNA, 19 nt, Homo sapiens
cgaccggguuacaggacuu

SEQ ID NO: 1033691 - RNA, 19 nt, Homo sapiens
agaagcacccgcugaugga

SEQ ID NO: 1033692 - RNA, 19 nt, Homo sapiens
ccagcuaccucagggacau

SEQ ID NO: 1033693 - RNA, 19 nt, Homo sapiens
gaacaaaggauguggcaua

SEQ ID NO: 1033694 - RNA, 19 nt, Homo sapiens
gaacugaauugaauccauu

SEQ ID NO: 1033695 - RNA, 19 nt, Homo sapiens
gcagacaggugguuacauu

SEQ ID NO: 1033696 - RNA, 19 nt, Homo sapiens
caaaggauguggcauaaug

SEQ ID NO: 1033697 - RNA, 19 nt, Homo sapiens
ucacaguccugccaucuua

SEQ ID NO: 1033698 - RNA, 19 nt, Homo sapiens
ccacaggacuuuaguuaga

SEQ ID NO: 1033699 - RNA, 19 nt, Homo sapiens
ggagugcucuuccaaacaa

SEQ ID NO: 1033700 - RNA, 19 nt, Homo sapiens
ccacagaagugccaauaug

SEQ ID NO: 1033701 - RNA, 19 nt, Homo sapiens
uaacuugucuacuguguau

SEQ ID NO: 1033702 - RNA, 19 nt, Homo sapiens
gaguaacccuuucuguauu

SEQ ID NO: 1033703 - RNA, 19 nt, Homo sapiens
guacauaucaagagaagaa

SEQ ID NO: 1033704 - RNA, 19 nt, Homo sapiens
gggcuuaaguuacugaaau

SEQ ID NO: 1033705 - RNA, 19 nt, Homo sapiens
ugaauugaauccauuguug

SEQ ID NO: 1033706 - RNA, 19 nt, Homo sapiens
gaagaaaugcucaaugucu

SEQ ID NO: 1033707 - RNA, 19 nt, Homo sapiens
gaaauuggaacacccuuug

SEQ ID NO: 1033708 - RNA, 19 nt, Homo sapiens
cuacaaacaucugguaaga

SEQ ID NO: 1033709 - RNA, 19 nt, Homo sapiens
ucagagcuuucacaaguaa

SEQ ID NO: 1033710 - RNA, 19 nt, Homo sapiens
gaaaggcacagguggagaa

SEQ ID NO: 1033711 - RNA, 19 nt, Homo sapiens
acaaacaucugguaagaca

SEQ ID NO: 1033712 - RNA, 19 nt, Homo sapiens
cagugaaguuucuccguua

SEQ ID NO: 1033713 - RNA, 19 nt, Homo sapiens
caaagccgccuacugguuu

SEQ ID NO: 1033714 - RNA, 19 nt, Homo sapiens
gauauuaccgucucaggaa

SEQ ID NO: 1033715 - RNA, 19 nt, Homo sapiens
guaguaacuucuccacaga

SEQ ID NO: 1033716 - RNA, 19 nt, Homo sapiens
guggugaacugaauugaau

SEQ ID NO: 1033717 - RNA, 19 nt, Homo sapiens
gucuguaagucaaauguua

SEQ ID NO: 1033718 - RNA, 19 nt, Homo sapiens
agucagagcuuucacaagu

SEQ ID NO: 1033719 - RNA, 19 nt, Homo sapiens
ggucuuaacauuauccaaa

SEQ ID NO: 1033720 - RNA, 19 nt, Homo sapiens
ggagaaggcagagaacaaa

SEQ ID NO: 1033721 - RNA, 19 nt, Homo sapiens
acaaguacauccacucaug

SEQ ID NO: 1033722 - RNA, 19 nt, Homo sapiens
gcagggacccagugaaguu

SEQ ID NO: 1033723 - RNA, 19 nt, Homo sapiens
gaaaggaucaggacuccau

SEQ ID NO: 1033724 - RNA, 19 nt, Homo sapiens
ugucuacuguguauuauga

SEQ ID NO: 1033725 - RNA, 19 nt, Homo sapiens
guacauccacucaugaaug

SEQ ID NO: 1033726 - RNA, 19 nt, Homo sapiens
gacaggugguuacauuaga

SEQ ID NO: 1033727 - RNA, 19 nt, Homo sapiens
gcacucuggugguguuugu

SEQ ID NO: 1033728 - RNA, 19 nt, Homo sapiens
guguauaccuguaaagaca

SEQ ID NO: 1033729 - RNA, 19 nt, Homo sapiens
uguauugagugcaguguuu

SEQ ID NO: 1033730 - RNA, 19 nt, Homo sapiens
gcacagguggagaacagua

SEQ ID NO: 1033731 - RNA, 19 nt, Homo sapiens
aaacacagcagccauuugu

SEQ ID NO: 1033732 - RNA, 19 nt, Homo sapiens
gcaaugcacuaaaacuauu

SEQ ID NO: 1033733 - RNA, 19 nt, Homo sapiens
gaggagugcucuuccaaac

SEQ ID NO: 1033734 - RNA, 19 nt, Homo sapiens
gaacacccuuuguccuucu

SEQ ID NO: 1033735 - RNA, 19 nt, Homo sapiens
gaguggaaauaacugcauu

SEQ ID NO: 1033736 - RNA, 19 nt, Homo sapiens
ggagucgucgaaauguuua

SEQ ID NO: 1033737 - RNA, 19 nt, Homo sapiens
gggagucgucgaaauguuu

SEQ ID NO: 1033738 - RNA, 19 nt, Homo sapiens
ggaauuaccaagugcuuag

SEQ ID NO: 1033739 - RNA, 19 nt, Homo sapiens
gagcuacaaacaucuggua

SEQ ID NO: 1033740 - RNA, 19 nt, Homo sapiens
gcucucuuguucucuguuu

SEQ ID NO: 1033741 - RNA, 19 nt, Homo sapiens
uagcacacuuacccuaauu

SEQ ID NO: 1033742 - RNA, 19 nt, Homo sapiens
agaguaacccuuucuguau

SEQ ID NO: 1033743 - RNA, 19 nt, Homo sapiens
ggcuuaaguuacugaaauu

SEQ ID NO: 1033744 - RNA, 19 nt, Homo sapiens
aacaaaggauguggcauaa

SEQ ID NO: 1033745 - RNA, 19 nt, Homo sapiens
guagcacacuuacccuaau

SEQ ID NO: 1033746 - RNA, 19 nt, Homo sapiens
cuaaugcgcaccacauauu

SEQ ID NO: 1033747 - RNA, 19 nt, Homo sapiens
caaguaauaaccuuucugu

SEQ ID NO: 1033748 - RNA, 19 nt, Homo sapiens
gaaguuucuccguuaaaga

SEQ ID NO: 1033749 - RNA, 19 nt, Homo sapiens
gaagcuccaugucuguaag

SEQ ID NO: 1033750 - RNA, 19 nt, Homo sapiens
gaaggcagagaacaaagga

SEQ ID NO: 1033751 - RNA, 19 nt, Homo sapiens
gcuuuaaccucagucauca

SEQ ID NO: 1033752 - RNA, 19 nt, Homo sapiens
gugcuaacuugucuacugu

SEQ ID NO: 1033753 - RNA, 19 nt, Homo sapiens
gucagagcuuucacaagua

SEQ ID NO: 1033754 - RNA, 19 nt, Homo sapiens
gugggcagaugucuuugaa

SEQ ID NO: 1033755 - RNA, 19 nt, Homo sapiens
aaaagaagauggaaaugga

SEQ ID NO: 1033756 - RNA, 19 nt, Homo sapiens
caucuuacuuuccucuugu

SEQ ID NO: 1033757 - RNA, 19 nt, Homo sapiens
gcagacugguggcaaguac

SEQ ID NO: 1033758 - RNA, 19 nt, Homo sapiens
gcucaaugucugaugcuaa

SEQ ID NO: 1033759 - RNA, 19 nt, Homo sapiens
cgccacaggacuuuaguua

SEQ ID NO: 1033760 - RNA, 19 nt, Homo sapiens
gaagauggaaauggauguu

SEQ ID NO: 1033761 - RNA, 19 nt, Homo sapiens
aaaugcaaaugguguuuca

SEQ ID NO: 1033762 - RNA, 19 nt, Homo sapiens
gggagaaggcagagaacaa

SEQ ID NO: 1033763 - RNA, 19 nt, Homo sapiens
gcuaacuugucuacugugu

SEQ ID NO: 1033764 - RNA, 19 nt, Homo sapiens
aaacaguauugcaaugaca

SEQ ID NO: 1033765 - RNA, 19 nt, Homo sapiens
gauugggagucgucgaaau

SEQ ID NO: 1033766 - RNA, 19 nt, Homo sapiens
ccaaagccgccuacugguu

SEQ ID NO: 1033767 - RNA, 19 nt, Homo sapiens
caaguacauccacucauga

SEQ ID NO: 1033768 - RNA, 19 nt, Homo sapiens
gaaaacaguauugcaauga

SEQ ID NO: 1033769 - RNA, 19 nt, Homo sapiens
gucgaaauguuuagauucu

SEQ ID NO: 1033770 - RNA, 19 nt, Homo sapiens
acaggugguuacauuagaa

SEQ ID NO: 1033771 - RNA, 19 nt, Homo sapiens
cuuagaacuugcuggcuuu

SEQ ID NO: 1033772 - RNA, 19 nt, Homo sapiens
cacccacucugaccucuug

SEQ ID NO: 1033773 - RNA, 19 nt, Homo sapiens
gcagccauuuguaccuguu

SEQ ID NO: 1033774 - RNA, 19 nt, Homo sapiens
ccaucuuacuuuccucuug

SEQ ID NO: 1033775 - RNA, 19 nt, Homo sapiens
cagacaggugguuacauua

SEQ ID NO: 1033776 - RNA, 19 nt, Homo sapiens
ugaaguuucuccguuaaag

SEQ ID NO: 1033777 - RNA, 19 nt, Homo sapiens
gaguugcuauagcuugaug

SEQ ID NO: 1033778 - RNA, 19 nt, Homo sapiens
cacaggacuuuaguuagaa

SEQ ID NO: 1033779 - RNA, 19 nt, Homo sapiens
uaaugcgcaccacauauuu

SEQ ID NO: 1033780 - RNA, 19 nt, Homo sapiens
gagcuuucacaaguaauaa

SEQ ID NO: 1033781 - RNA, 19 nt, Homo sapiens
ugacaccauuacauaagga

SEQ ID NO: 1033782 - RNA, 19 nt, Homo sapiens
ugaaacaugccacagugaa

SEQ ID NO: 1033783 - RNA, 19 nt, Homo sapiens
guaauacaaaugacaacug

SEQ ID NO: 1033784 - RNA, 19 nt, Homo sapiens
gguagcagacaggugguua

SEQ ID NO: 1033785 - RNA, 19 nt, Homo sapiens
caagcucccguaaggauau

SEQ ID NO: 1033786 - RNA, 19 nt, Homo sapiens
aguaacccuuucuguauug

SEQ ID NO: 1033787 - RNA, 19 nt, Homo sapiens
gcagagaacaaaggaugug

SEQ ID NO: 1033788 - RNA, 19 nt, Homo sapiens
cauuauggcugcuuuaacc

SEQ ID NO: 1033789 - RNA, 19 nt, Homo sapiens
gauguggcauaauggucuu

SEQ ID NO: 1033790 - RNA, 19 nt, Homo sapiens
cgaguucugaguggaaaua

SEQ ID NO: 1033791 - RNA, 19 nt, Homo sapiens
ucacaaguaauaaccuuuc

SEQ ID NO: 1033792 - RNA, 19 nt, Homo sapiens
ugaacugaauugaauccau

SEQ ID NO: 1033793 - RNA, 19 nt, Homo sapiens
gaagcugacuuucuaguuu

SEQ ID NO: 1033794 - RNA, 19 nt, Homo sapiens
ggacacagcuccucaagac

SEQ ID NO: 1033795 - RNA, 19 nt, Homo sapiens
uauggaagcugacuuucua

SEQ ID NO: 1033796 - RNA, 19 nt, Homo sapiens
ggagucuuguuuccaauaa

SEQ ID NO: 1033797 - RNA, 19 nt, Homo sapiens
gaagagcaccugaaguaug

SEQ ID NO: 1033798 - RNA, 19 nt, Homo sapiens
gaaacuucgugcgauaauu

SEQ ID NO: 1033799 - RNA, 19 nt, Homo sapiens
ggaacagccuggcccaaag

SEQ ID NO: 1033800 - RNA, 19 nt, Homo sapiens
agauguaccuccagccuuu

SEQ ID NO: 1033801 - RNA, 19 nt, Homo sapiens
acgaagagcaccugaagua

SEQ ID NO: 1033802 - RNA, 19 nt, Homo sapiens
gcauggagaacuuccguaa

SEQ ID NO: 1033803 - RNA, 19 nt, Homo sapiens
gugcgauaauugcugcuua

SEQ ID NO: 1033804 - RNA, 19 nt, Homo sapiens
gggcucggauaccggauuu

SEQ ID NO: 1033805 - RNA, 19 nt, Homo sapiens
ggaagcugacuuucuaguu

SEQ ID NO: 1033806 - RNA, 19 nt, Homo sapiens
gcacaugcgggucaaggaa

SEQ ID NO: 1033807 - RNA, 19 nt, Homo sapiens
gagcgcugauggcgauuau

SEQ ID NO: 1033808 - RNA, 19 nt, Homo sapiens
gcuagucucagcguacuua

SEQ ID NO: 1033809 - RNA, 19 nt, Homo sapiens
gagcaucucugaggguucu

SEQ ID NO: 1033810 - RNA, 19 nt, Homo sapiens
gacccagacucgccaggaa

SEQ ID NO: 1033811 - RNA, 19 nt, Homo sapiens
acacggaacuucaccuuuu

SEQ ID NO: 1033812 - RNA, 19 nt, Homo sapiens
aaacuucgugcgauaauug

SEQ ID NO: 1033813 - RNA, 19 nt, Homo sapiens
aagagcaccugaaguaugg

SEQ ID NO: 1033814 - RNA, 19 nt, Homo sapiens
gggaacagccuggcccaaa

SEQ ID NO: 1033815 - RNA, 19 nt, Homo sapiens
gugggauucuggaaacuug

SEQ ID NO: 1033816 - RNA, 19 nt, Homo sapiens
ggaaacuucgugcgauaau

SEQ ID NO: 1033817 - RNA, 19 nt, Homo sapiens
ggacagugggauucuggaa

SEQ ID NO: 1033818 - RNA, 19 nt, Homo sapiens
agggaaacuucgugcgaua

SEQ ID NO: 1033819 - RNA, 19 nt, Homo sapiens
ggccuucaguugcaaaugg

SEQ ID NO: 1033820 - RNA, 19 nt, Homo sapiens
uaguggaacuucaccuuca

SEQ ID NO: 1033821 - RNA, 19 nt, Homo sapiens
gagucuuguuuccaauaaa

SEQ ID NO: 1033822 - RNA, 19 nt, Homo sapiens
caaggaaggcagcaagauc

SEQ ID NO: 1033823 - RNA, 19 nt, Homo sapiens
guaaggugcgcuccgaaga

SEQ ID NO: 1033824 - RNA, 19 nt, Homo sapiens
gcugauggcgauuauagug

SEQ ID NO: 1033825 - RNA, 19 nt, Homo sapiens
gcgcugauggcgauuauag

SEQ ID NO: 1033826 - RNA, 19 nt, Homo sapiens
ggaacccgcagcuggagaa

SEQ ID NO: 1033827 - RNA, 19 nt, Homo sapiens
uauuuagacugccgguuug

SEQ ID NO: 1033828 - RNA, 19 nt, Homo sapiens
gcucggauaccggauuuga

SEQ ID NO: 1033829 - RNA, 19 nt, Homo sapiens
guuaaagccacccagcauu

SEQ ID NO: 1033830 - RNA, 19 nt, Homo sapiens
gacagugggauucuggaaa

SEQ ID NO: 1033831 - RNA, 19 nt, Homo sapiens
uuauuuagacugccgguuu

SEQ ID NO: 1033832 - RNA, 19 nt, Homo sapiens
gggaaacuucgugcgauaa

SEQ ID NO: 1033833 - RNA, 19 nt, Homo sapiens
gccuccaccuucagaugua

SEQ ID NO: 1033834 - RNA, 19 nt, Homo sapiens
gagggagacccaggacuga

SEQ ID NO: 1033835 - RNA, 19 nt, Homo sapiens
gguucuagcucuuuuaaca

SEQ ID NO: 1033836 - RNA, 19 nt, Homo sapiens
gacacggaacuucaccuuu

SEQ ID NO: 1033837 - RNA, 19 nt, Homo sapiens
ucacgaagagcaccugaag

SEQ ID NO: 1033838 - RNA, 19 nt, Homo sapiens
agucucagcguacuuaaga

SEQ ID NO: 1033839 - RNA, 19 nt, Homo sapiens
gauggcgauuauaguggaa

SEQ ID NO: 1033840 - RNA, 19 nt, Homo sapiens
uuaaagccacccagcauuc

SEQ ID NO: 1033841 - RNA, 19 nt, Homo sapiens
acagugggauucuggaaac

SEQ ID NO: 1033842 - RNA, 19 nt, Homo sapiens
cgaagagcaccugaaguau

SEQ ID NO: 1033843 - RNA, 19 nt, Homo sapiens
gcagcaagauccggaaccu

SEQ ID NO: 1033844 - RNA, 19 nt, Homo sapiens
gacggcgcauggagaacuu

SEQ ID NO: 1033845 - RNA, 19 nt, Homo sapiens
gacgacggcgcauggagaa

SEQ ID NO: 1033846 - RNA, 19 nt, Homo sapiens
uuagacugccgguuuguga

SEQ ID NO: 1033847 - RNA, 19 nt, Homo sapiens
gaacagccuggcccaaagc

SEQ ID NO: 1033848 - RNA, 19 nt, Homo sapiens
cgcacuagcuguccuugag

SEQ ID NO: 1033849 - RNA, 19 nt, Homo sapiens
auggagaacuuccguaagg

SEQ ID NO: 1033850 - RNA, 19 nt, Homo sapiens
gcgauuauaguggaacuuc

SEQ ID NO: 1033851 - RNA, 19 nt, Homo sapiens
cgauuauaguggaacuuca

SEQ ID NO: 1033852 - RNA, 19 nt, Homo sapiens
cacccagcauucacgaaga

SEQ ID NO: 1033853 - RNA, 19 nt, Homo sapiens
gguuaaagccacccagcau

SEQ ID NO: 1033854 - RNA, 19 nt, Homo sapiens
caagauccggaaccugaug

SEQ ID NO: 1033855 - RNA, 19 nt, Homo sapiens
ggauaccggauuugaagca

SEQ ID NO: 1033856 - RNA, 19 nt, Homo sapiens
guauggaagcugacuuucu

SEQ ID NO: 1033857 - RNA, 19 nt, Homo sapiens
uaaagccacccagcauuca

SEQ ID NO: 1033858 - RNA, 19 nt, Homo sapiens
gccugaaacuccggacugu

SEQ ID NO: 1033859 - RNA, 19 nt, Homo sapiens
ggccucgccauccuacuuu

SEQ ID NO: 1033860 - RNA, 19 nt, Homo sapiens
gcaagauccggaaccugau

SEQ ID NO: 1033861 - RNA, 19 nt, Homo sapiens
cggauuugaagcaguguuu

SEQ ID NO: 1033862 - RNA, 19 nt, Homo sapiens
gagcaccugaaguauggaa

SEQ ID NO: 1033863 - RNA, 19 nt, Homo sapiens
gaccuuaaggcgacaagag

SEQ ID NO: 1033864 - RNA, 19 nt, Homo sapiens
gaagucagcuuaaagauaa

SEQ ID NO: 1033865 - RNA, 19 nt, Homo sapiens
gcaacuaacuccauucuua

SEQ ID NO: 1033866 - RNA, 19 nt, Homo sapiens
gcacuucucucuccacuua

SEQ ID NO: 1033867 - RNA, 19 nt, Homo sapiens
gaacugauggguuauauua

SEQ ID NO: 1033868 - RNA, 19 nt, Homo sapiens
gaaaggaucuagagcugua

SEQ ID NO: 1033869 - RNA, 19 nt, Homo sapiens
gaagagaaacucagugaua

SEQ ID NO: 1033870 - RNA, 19 nt, Homo sapiens
caaggucacuacagaauua

SEQ ID NO: 1033871 - RNA, 19 nt, Homo sapiens
gaauaugccucgugggaua

SEQ ID NO: 1033872 - RNA, 19 nt, Homo sapiens
gaaaggcaaugcgcuguua

SEQ ID NO: 1033873 - RNA, 19 nt, Homo sapiens
gcagugcccugaaagguua

SEQ ID NO: 1033874 - RNA, 19 nt, Homo sapiens
ggagaaagcuaccaauauc

SEQ ID NO: 1033875 - RNA, 19 nt, Homo sapiens
aaaugaagcugcacacaua

SEQ ID NO: 1033876 - RNA, 19 nt, Homo sapiens
caaauaagauucggagaaa

SEQ ID NO: 1033877 - RNA, 19 nt, Homo sapiens
aaagauaacuggugaaugu

SEQ ID NO: 1033878 - RNA, 19 nt, Homo sapiens
gaaaucauccucauccuuu

SEQ ID NO: 1033879 - RNA, 19 nt, Homo sapiens
ggaaugcucucucuccaaa

SEQ ID NO: 1033880 - RNA, 19 nt, Homo sapiens
ugacaaagaucaaccauca

SEQ ID NO: 1033881 - RNA, 19 nt, Homo sapiens
gcuaugauguuuccaugua

SEQ ID NO: 1033882 - RNA, 19 nt, Homo sapiens
gggagaaacugauugcaaa

SEQ ID NO: 1033883 - RNA, 19 nt, Homo sapiens
gaagaccacuggaaccuau

SEQ ID NO: 1033884 - RNA, 19 nt, Homo sapiens
uggaauagcuuuacuacuu

SEQ ID NO: 1033885 - RNA, 19 nt, Homo sapiens
caaauucucuuauccaauc

SEQ ID NO: 1033886 - RNA, 19 nt, Homo sapiens
gaccggagcuguuccuauu

SEQ ID NO: 1033887 - RNA, 19 nt, Homo sapiens
gcaguuggcucuaaaccuu

SEQ ID NO: 1033888 - RNA, 19 nt, Homo sapiens
caacugugccuugaaauua

SEQ ID NO: 1033889 - RNA, 19 nt, Homo sapiens
gaaguauguuuaagccuuu

SEQ ID NO: 1033890 - RNA, 19 nt, Homo sapiens
gaaguuucaugcauucaaa

SEQ ID NO: 1033891 - RNA, 19 nt, Homo sapiens
ggagugcauugcuuuagua

SEQ ID NO: 1033892 - RNA, 19 nt, Homo sapiens
gagaugaaccuucuucuga

SEQ ID NO: 1033893 - RNA, 19 nt, Homo sapiens
ugugaaagcuugaagauau

SEQ ID NO: 1033894 - RNA, 19 nt, Homo sapiens
gaacugggcugcacuucuc

SEQ ID NO: 1033895 - RNA, 19 nt, Homo sapiens
gaaacucagugauauaucu

SEQ ID NO: 1033896 - RNA, 19 nt, Homo sapiens
aaacacagcuagugccauu

SEQ ID NO: 1033897 - RNA, 19 nt, Homo sapiens
gcagauacuucaacugugu

SEQ ID NO: 1033898 - RNA, 19 nt, Homo sapiens
gcagauauguuggcagcua

SEQ ID NO: 1033899 - RNA, 19 nt, Homo sapiens
gaaacaggaacuuggauuu

SEQ ID NO: 1033900 - RNA, 19 nt, Homo sapiens
uaacucaggucauuagugu

SEQ ID NO: 1033901 - RNA, 19 nt, Homo sapiens
guucagugcuggaauuauu

SEQ ID NO: 1033902 - RNA, 19 nt, Homo sapiens
gaacuggucauaauuggaa

SEQ ID NO: 1033903 - RNA, 19 nt, Homo sapiens
gaagagauccagcaacugu

SEQ ID NO: 1033904 - RNA, 19 nt, Homo sapiens
ccacaugggccuugcuuua

SEQ ID NO: 1033905 - RNA, 19 nt, Homo sapiens
gagcuggaguugcaguuaa

SEQ ID NO: 1033906 - RNA, 19 nt, Homo sapiens
ggaauagcuuuacuacuuc

SEQ ID NO: 1033907 - RNA, 19 nt, Homo sapiens
gagacaugcugacugauga

SEQ ID NO: 1033908 - RNA, 19 nt, Homo sapiens
aaauacacauggcuugaua

SEQ ID NO: 1033909 - RNA, 19 nt, Homo sapiens
gaacacaccauucuucauc

SEQ ID NO: 1033910 - RNA, 19 nt, Homo sapiens
acuaagagcugucacuuug

SEQ ID NO: 1033911 - RNA, 19 nt, Homo sapiens
gcaggaauguuacagagau

SEQ ID NO: 1033912 - RNA, 19 nt, Homo sapiens
ccacacagauuagcaguug

SEQ ID NO: 1033913 - RNA, 19 nt, Homo sapiens
caacauccuuucacaauac

SEQ ID NO: 1033914 - RNA, 19 nt, Homo sapiens
caacacgggcuguauauug

SEQ ID NO: 1033915 - RNA, 19 nt, Homo sapiens
ggauguggaucuuucaguu

SEQ ID NO: 1033916 - RNA, 19 nt, Homo sapiens
ucaacauccuuucacaaua

SEQ ID NO: 1033917 - RNA, 19 nt, Homo sapiens
gcacagucaucccagaaug

SEQ ID NO: 1033918 - RNA, 19 nt, Homo sapiens
caaaucagacuccugcuuu

SEQ ID NO: 1033919 - RNA, 19 nt, Homo sapiens
acacaugccuccuaagaga

SEQ ID NO: 1033920 - RNA, 19 nt, Homo sapiens
gagaauagccagcagacuu

SEQ ID NO: 1033921 - RNA, 19 nt, Homo sapiens
gaagcugucugcgcacgua

SEQ ID NO: 1033922 - RNA, 19 nt, Homo sapiens
acacuagucuugaauacaa

SEQ ID NO: 1033923 - RNA, 19 nt, Homo sapiens
gaaaauugcugcuuugaca

SEQ ID NO: 1033924 - RNA, 19 nt, Homo sapiens
gauauaucacucugcauua

SEQ ID NO: 1033925 - RNA, 19 nt, Homo sapiens
ggaaggaacagacccagaa

SEQ ID NO: 1033926 - RNA, 19 nt, Homo sapiens
gaaagacuguagcaggaau

SEQ ID NO: 1033927 - RNA, 19 nt, Homo sapiens
caagaccucucauucugaa

SEQ ID NO: 1033928 - RNA, 19 nt, Homo sapiens
uuacagagaugaccaccaa

SEQ ID NO: 1033929 - RNA, 19 nt, Homo sapiens
caucucaguuacaagaaua

SEQ ID NO: 1033930 - RNA, 19 nt, Homo sapiens
ccugaaagguuagaaguuu

SEQ ID NO: 1033931 - RNA, 19 nt, Homo sapiens
caacuaacuccauucuuaa

SEQ ID NO: 1033932 - RNA, 19 nt, Homo sapiens
cagcaacugugccuugaaa

SEQ ID NO: 1033933 - RNA, 19 nt, Homo sapiens
gcaggaauccccaauuuua

SEQ ID NO: 1033934 - RNA, 19 nt, Homo sapiens
ugauacagcaggaauguua

SEQ ID NO: 1033935 - RNA, 19 nt, Homo sapiens
guuagaaguuucaugcauu

SEQ ID NO: 1033936 - RNA, 19 nt, Homo sapiens
ggauauaucacucugcauu

SEQ ID NO: 1033937 - RNA, 19 nt, Homo sapiens
agaguuagaugacgaugaa

SEQ ID NO: 1033938 - RNA, 19 nt, Homo sapiens
cagaggcgaugauguuuau

SEQ ID NO: 1033939 - RNA, 19 nt, Homo sapiens
gacaugaugcagagaguua

SEQ ID NO: 1033940 - RNA, 19 nt, Homo sapiens
uuagagacaugcugacuga

SEQ ID NO: 1033941 - RNA, 19 nt, Homo sapiens
caaaaugccucuuagaaau

SEQ ID NO: 1033942 - RNA, 19 nt, Homo sapiens
gauacacucuuggucauug

SEQ ID NO: 1033943 - RNA, 19 nt, Homo sapiens
ugugguaucuguauuguga

SEQ ID NO: 1033944 - RNA, 19 nt, Homo sapiens
gcaacugugccuugaaauu

SEQ ID NO: 1033945 - RNA, 19 nt, Homo sapiens
ugaagucauuagaaccuua

SEQ ID NO: 1033946 - RNA, 19 nt, Homo sapiens
guccuugccuacacacuua

SEQ ID NO: 1033947 - RNA, 19 nt, Homo sapiens
caaccuaauuuccuuucaa

SEQ ID NO: 1033948 - RNA, 19 nt, Homo sapiens
caauacaacugaauaugag

SEQ ID NO: 1033949 - RNA, 19 nt, Homo sapiens
ggaggauucuugaaguaau

SEQ ID NO: 1033950 - RNA, 19 nt, Homo sapiens
guauaucuguggaugaaga

SEQ ID NO: 1033951 - RNA, 19 nt, Homo sapiens
cuaacuccauucuuaauug

SEQ ID NO: 1033952 - RNA, 19 nt, Homo sapiens
ccacuuaugaggcuaaauu

SEQ ID NO: 1033953 - RNA, 19 nt, Homo sapiens
gagccucuguuccuacuga

SEQ ID NO: 1033954 - RNA, 19 nt, Homo sapiens
guucauggguugucugugu

SEQ ID NO: 1033955 - RNA, 19 nt, Homo sapiens
gagaaacucagugauauau

SEQ ID NO: 1033956 - RNA, 19 nt, Homo sapiens
caacuuuagugcaggagaa

SEQ ID NO: 1033957 - RNA, 19 nt, Homo sapiens
agaauuagcccaaguagau

SEQ ID NO: 1033958 - RNA, 19 nt, Homo sapiens
gaaaugauacagcaggaau

SEQ ID NO: 1033959 - RNA, 19 nt, Homo sapiens
ugaagucagcuuaaagaua

SEQ ID NO: 1033960 - RNA, 19 nt, Homo sapiens
gugaaagcuugaagauauu

SEQ ID NO: 1033961 - RNA, 19 nt, Homo sapiens
ucuuggaacugauggguua

SEQ ID NO: 1033962 - RNA, 19 nt, Homo sapiens
guacuuagucucucaagga

SEQ ID NO: 1033963 - RNA, 19 nt, Homo sapiens
gaugaaccuucuucugaug

SEQ ID NO: 1033964 - RNA, 19 nt, Homo sapiens
gagaauacaagccuuaaua

SEQ ID NO: 1033965 - RNA, 19 nt, Homo sapiens
ugaauuugcugucauguuu

SEQ ID NO: 1033966 - RNA, 19 nt, Homo sapiens
cgaaagaguuugaguggaa

SEQ ID NO: 1033967 - RNA, 19 nt, Homo sapiens
gauagcaacucuccuggaa

SEQ ID NO: 1033968 - RNA, 19 nt, Homo sapiens
caaaagacccucugaguua

SEQ ID NO: 1033969 - RNA, 19 nt, Homo sapiens
caucgugugugucuaauuu

SEQ ID NO: 1033970 - RNA, 19 nt, Homo sapiens
cguuucagcuguaucauua

SEQ ID NO: 1033971 - RNA, 19 nt, Homo sapiens
gaagaugaauuugcuguca

SEQ ID NO: 1033972 - RNA, 19 nt, Homo sapiens
caauaaugcugagcuuuaa

SEQ ID NO: 1033973 - RNA, 19 nt, Homo sapiens
ccaauaaugcugagcuuua

SEQ ID NO: 1033974 - RNA, 19 nt, Homo sapiens
agacugaucuaaugugaaa

SEQ ID NO: 1033975 - RNA, 19 nt, Homo sapiens
gaauucuaaugccgucuua

SEQ ID NO: 1033976 - RNA, 19 nt, Homo sapiens
gcacacaaccuccaucuuc

SEQ ID NO: 1033977 - RNA, 19 nt, Homo sapiens
uuaaggauguacccaauaa

SEQ ID NO: 1033978 - RNA, 19 nt, Homo sapiens
cuaaugccgucuuaaguuu

SEQ ID NO: 1033979 - RNA, 19 nt, Homo sapiens
gaaccaguuucuuacaugu

SEQ ID NO: 1033980 - RNA, 19 nt, Homo sapiens
ggaaacguccagccuaauu

SEQ ID NO: 1033981 - RNA, 19 nt, Homo sapiens
gaacaugccaguuucaaag

SEQ ID NO: 1033982 - RNA, 19 nt, Homo sapiens
ggauacaguucaugacaau

SEQ ID NO: 1033983 - RNA, 19 nt, Homo sapiens
ggaucugcauuuauuugua

SEQ ID NO: 1033984 - RNA, 19 nt, Homo sapiens
gcacagagcacggcaacaa

SEQ ID NO: 1033985 - RNA, 19 nt, Homo sapiens
ggaacuggaaggugcuuua

SEQ ID NO: 1033986 - RNA, 19 nt, Homo sapiens
acaucaggcuggagaauaa

SEQ ID NO: 1033987 - RNA, 19 nt, Homo sapiens
ggucgggcauucuuuguug

SEQ ID NO: 1033988 - RNA, 19 nt, Homo sapiens
cuguagaagucacuaauaa

SEQ ID NO: 1033989 - RNA, 19 nt, Homo sapiens
augcugagcuuuaagugua

SEQ ID NO: 1033990 - RNA, 19 nt, Homo sapiens
ucauauuucucaucccuuu

SEQ ID NO: 1033991 - RNA, 19 nt, Homo sapiens
agaagucacuaauaaagga

SEQ ID NO: 1033992 - RNA, 19 nt, Homo sapiens
gacauccaccgcuccauua

SEQ ID NO: 1033993 - RNA, 19 nt, Homo sapiens
gaguuugaguggaaucuga

SEQ ID NO: 1033994 - RNA, 19 nt, Homo sapiens
gaaaacuacuugcuccaaa

SEQ ID NO: 1033995 - RNA, 19 nt, Homo sapiens
gaacaaaaggacaagauaa

SEQ ID NO: 1033996 - RNA, 19 nt, Homo sapiens
ggagaauaacgacaacaaa

SEQ ID NO: 1033997 - RNA, 19 nt, Homo sapiens
gaaagaguuugaguggaau

SEQ ID NO: 1033998 - RNA, 19 nt, Homo sapiens
uaaauuucaucgugugugu

SEQ ID NO: 1033999 - RNA, 19 nt, Homo sapiens
caaauuuggcagacacuuu

SEQ ID NO: 1034000 - RNA, 19 nt, Homo sapiens
ucugugagacuucauauuu

SEQ ID NO: 1034001 - RNA, 19 nt, Homo sapiens
gaucugcauuuauuuguac

SEQ ID NO: 1034002 - RNA, 19 nt, Homo sapiens
gguugaguguugcaucuuu

SEQ ID NO: 1034003 - RNA, 19 nt, Homo sapiens
gacauuggcaccugggaua

SEQ ID NO: 1034004 - RNA, 19 nt, Homo sapiens
cauaagaaaccaugaguca

SEQ ID NO: 1034005 - RNA, 19 nt, Homo sapiens
ucucaucccuuuauugcuu

SEQ ID NO: 1034006 - RNA, 19 nt, Homo sapiens
cgaaccaguuucuuacaug

SEQ ID NO: 1034007 - RNA, 19 nt, Homo sapiens
caacaaaccggucacaaac

SEQ ID NO: 1034008 - RNA, 19 nt, Homo sapiens
gggcguguguucaucauca

SEQ ID NO: 1034009 - RNA, 19 nt, Homo sapiens
ggaugaugcugcugguugu

SEQ ID NO: 1034010 - RNA, 19 nt, Homo sapiens
cauuugauauucugugaga

SEQ ID NO: 1034011 - RNA, 19 nt, Homo sapiens
guagaagucacuaauaaag

SEQ ID NO: 1034012 - RNA, 19 nt, Homo sapiens
gaacuguuacugccugaau

SEQ ID NO: 1034013 - RNA, 19 nt, Homo sapiens
cacuuccucugaacuguua

SEQ ID NO: 1034014 - RNA, 19 nt, Homo sapiens
uuugucagcuuaucaauca

SEQ ID NO: 1034015 - RNA, 19 nt, Homo sapiens
gaacggcagagucgaaaca

SEQ ID NO: 1034016 - RNA, 19 nt, Homo sapiens
gaaacguccagccuaauuc

SEQ ID NO: 1034017 - RNA, 19 nt, Homo sapiens
guacagacagugugaugga

SEQ ID NO: 1034018 - RNA, 19 nt, Homo sapiens
gugcuaauuuacccauuug

SEQ ID NO: 1034019 - RNA, 19 nt, Homo sapiens
gauauucugugagacuuca

SEQ ID NO: 1034020 - RNA, 19 nt, Homo sapiens
acaacaaaccggucacaaa

SEQ ID NO: 1034021 - RNA, 19 nt, Homo sapiens
gcuacaacccgaaagaguu

SEQ ID NO: 1034022 - RNA, 19 nt, Homo sapiens
uaacggagaccaucauuuu

SEQ ID NO: 1034023 - RNA, 19 nt, Homo sapiens
cagacagugugauggauga

SEQ ID NO: 1034024 - RNA, 19 nt, Homo sapiens
guucuaacguuugacuuug

SEQ ID NO: 1034025 - RNA, 19 nt, Homo sapiens
gggcauucuuuguuguuug

SEQ ID NO: 1034026 - RNA, 19 nt, Homo sapiens
gcgaaccaguuucuuacau

SEQ ID NO: 1034027 - RNA, 19 nt, Homo sapiens
ggacagucaaaucagagua

SEQ ID NO: 1034028 - RNA, 19 nt, Homo sapiens
gacagucaaaucagaguaa

SEQ ID NO: 1034029 - RNA, 19 nt, Homo sapiens
cuacaacccgaaagaguuu

SEQ ID NO: 1034030 - RNA, 19 nt, Homo sapiens
uuccauaccucaccaccua

SEQ ID NO: 1034031 - RNA, 19 nt, Homo sapiens
gagaauaacgacaacaaac

SEQ ID NO: 1034032 - RNA, 19 nt, Homo sapiens
gggcaugguuggccugaag

SEQ ID NO: 1034033 - RNA, 19 nt, Homo sapiens
uaucagcacagguucaauu

SEQ ID NO: 1034034 - RNA, 19 nt, Homo sapiens
caaaaugguucguuacauc

SEQ ID NO: 1034035 - RNA, 19 nt, Homo sapiens
uagcaacucuccuggaaac

SEQ ID NO: 1034036 - RNA, 19 nt, Homo sapiens
uaacguuucagcuguauca

SEQ ID NO: 1034037 - RNA, 19 nt, Homo sapiens
ccucugaguuaacguuuca

SEQ ID NO: 1034038 - RNA, 19 nt, Homo sapiens
cgacauccaccgcuccauu

SEQ ID NO: 1034039 - RNA, 19 nt, Homo sapiens
agaaggauacaguucauga

SEQ ID NO: 1034040 - RNA, 19 nt, Homo sapiens
gcgucuaguuguucaugaa

SEQ ID NO: 1034041 - RNA, 19 nt, Homo sapiens
cccaggaggugcccuuaga

SEQ ID NO: 1034042 - RNA, 19 nt, Homo sapiens
ucaaaucagaguaacaguu

SEQ ID NO: 1034043 - RNA, 19 nt, Homo sapiens
guaacggagaccaucauuu

SEQ ID NO: 1034044 - RNA, 19 nt, Homo sapiens
gcgugucacuuccucugaa

SEQ ID NO: 1034045 - RNA, 19 nt, Homo sapiens
cuagagagcagacgcuuuc

SEQ ID NO: 1034046 - RNA, 19 nt, Homo sapiens
gcugcugguuguaaauuuc

SEQ ID NO: 1034047 - RNA, 19 nt, Homo sapiens
ggcaugauguguggaggaa

SEQ ID NO: 1034048 - RNA, 19 nt, Homo sapiens
guuaaggauguacccaaua

SEQ ID NO: 1034049 - RNA, 19 nt, Homo sapiens
uaggagaauacaagccuua

SEQ ID NO: 1034050 - RNA, 19 nt, Homo sapiens
gucauuugauauucuguga

SEQ ID NO: 1034051 - RNA, 19 nt, Homo sapiens
ucagaaggauacaguucau

SEQ ID NO: 1034052 - RNA, 19 nt, Homo sapiens
acaaaccggucacaaacuc

SEQ ID NO: 1034053 - RNA, 19 nt, Homo sapiens
gcaaaaccacagccuaaaa

SEQ ID NO: 1034054 - RNA, 19 nt, Homo sapiens
ucuaaugccgucuuaaguu

SEQ ID NO: 1034055 - RNA, 19 nt, Homo sapiens
gcacugacugguguccuuu

SEQ ID NO: 1034056 - RNA, 19 nt, Homo sapiens
ucaagacggugggcucugu

SEQ ID NO: 1034057 - RNA, 19 nt, Homo sapiens
gguaguacagacaguguga

SEQ ID NO: 1034058 - RNA, 19 nt, Homo sapiens
gaacuggaaggugcuuuag

SEQ ID NO: 1034059 - RNA, 19 nt, Homo sapiens
uacauguucuaacguuuga

SEQ ID NO: 1034060 - RNA, 19 nt, Homo sapiens
gagucgaaacaaacaauga

SEQ ID NO: 1034061 - RNA, 19 nt, Homo sapiens
cgacgacuuugcucacuac

SEQ ID NO: 1034062 - RNA, 19 nt, Homo sapiens
ggucuggucucaggacaag

SEQ ID NO: 1034063 - RNA, 19 nt, Homo sapiens
gcaacggugggacaaaugu

SEQ ID NO: 1034064 - RNA, 19 nt, Homo sapiens
gaaauaggauccaguaugu

SEQ ID NO: 1034065 - RNA, 19 nt, Homo sapiens
gaaggaauauuaccuagug

SEQ ID NO: 1034066 - RNA, 19 nt, Homo sapiens
cgaagaauauggaagguuu

SEQ ID NO: 1034067 - RNA, 19 nt, Homo sapiens
ccaacuaugugauugauaa

SEQ ID NO: 1034068 - RNA, 19 nt, Homo sapiens
gcaaugggcuucagugucu

SEQ ID NO: 1034069 - RNA, 19 nt, Homo sapiens
ggccaaaucugaaauagga

SEQ ID NO: 1034070 - RNA, 19 nt, Homo sapiens
gaagugcuguuaucggaaa

SEQ ID NO: 1034071 - RNA, 19 nt, Homo sapiens
ggaccgaacucucauucaa

SEQ ID NO: 1034072 - RNA, 19 nt, Homo sapiens
gaaaagaacugcaaagucu

SEQ ID NO: 1034073 - RNA, 19 nt, Homo sapiens
gggaaucuguggccaauga

SEQ ID NO: 1034074 - RNA, 19 nt, Homo sapiens
gaaauucucuccguuacau

SEQ ID NO: 1034075 - RNA, 19 nt, Homo sapiens
guacuucucugcugguuug

SEQ ID NO: 1034076 - RNA, 19 nt, Homo sapiens
gcagagcaaugcaguagug

SEQ ID NO: 1034077 - RNA, 19 nt, Homo sapiens
ccaaagacauuuucuguuu

SEQ ID NO: 1034078 - RNA, 19 nt, Homo sapiens
cagaauccaucauuaguau

SEQ ID NO: 1034079 - RNA, 19 nt, Homo sapiens
cagacagaauccaucauua

SEQ ID NO: 1034080 - RNA, 19 nt, Homo sapiens
agacaacacugcaaggauu

SEQ ID NO: 1034081 - RNA, 19 nt, Homo sapiens
uaacuggaccgaagaauau

SEQ ID NO: 1034082 - RNA, 19 nt, Homo sapiens
uggauucucuuucaacuuu

SEQ ID NO: 1034083 - RNA, 19 nt, Homo sapiens
gaggaauggauuaaacuua

SEQ ID NO: 1034084 - RNA, 19 nt, Homo sapiens
gaggagauuugccaggaaa

SEQ ID NO: 1034085 - RNA, 19 nt, Homo sapiens
caucucaucuuaccuuaau

SEQ ID NO: 1034086 - RNA, 19 nt, Homo sapiens
ucaagcauaugaccuuuau

SEQ ID NO: 1034087 - RNA, 19 nt, Homo sapiens
ugacugcacuggauuagau

SEQ ID NO: 1034088 - RNA, 19 nt, Homo sapiens
gaucaaagguagcuaaaau

SEQ ID NO: 1034089 - RNA, 19 nt, Homo sapiens
caaaggaccaacuauguga

SEQ ID NO: 1034090 - RNA, 19 nt, Homo sapiens
ugaauuggcacaagaacua

SEQ ID NO: 1034091 - RNA, 19 nt, Homo sapiens
gggaucaguuuuaaaguua

SEQ ID NO: 1034092 - RNA, 19 nt, Homo sapiens
cugcaaagucugagaaaua

SEQ ID NO: 1034093 - RNA, 19 nt, Homo sapiens
gaacugcaaagucugagaa

SEQ ID NO: 1034094 - RNA, 19 nt, Homo sapiens
acaccguucuucaucuuua

SEQ ID NO: 1034095 - RNA, 19 nt, Homo sapiens
ggagagcaaauuuagauau

SEQ ID NO: 1034096 - RNA, 19 nt, Homo sapiens
cagcaguacuguuuaaugg

SEQ ID NO: 1034097 - RNA, 19 nt, Homo sapiens
aauauuaccuaguggaaug

SEQ ID NO: 1034098 - RNA, 19 nt, Homo sapiens
caacaaaggacagacagaa

SEQ ID NO: 1034099 - RNA, 19 nt, Homo sapiens
gauccaguaugucugaaau

SEQ ID NO: 1034100 - RNA, 19 nt, Homo sapiens
ggaauggauuaaacuuaca

SEQ ID NO: 1034101 - RNA, 19 nt, Homo sapiens
acucuacgcucaagcauau

SEQ ID NO: 1034102 - RNA, 19 nt, Homo sapiens
guugaggccugacauuuca

SEQ ID NO: 1034103 - RNA, 19 nt, Homo sapiens
ggacagacagaauccauca

SEQ ID NO: 1034104 - RNA, 19 nt, Homo sapiens
ccagugaauuggcacaaga

SEQ ID NO: 1034105 - RNA, 19 nt, Homo sapiens
uaaccagcacacaauaaua

SEQ ID NO: 1034106 - RNA, 19 nt, Homo sapiens
gaauauggaagguuugauc

SEQ ID NO: 1034107 - RNA, 19 nt, Homo sapiens
caggaaauucucuccguua

SEQ ID NO: 1034108 - RNA, 19 nt, Homo sapiens
cggaaaccaucagacauuu

SEQ ID NO: 1034109 - RNA, 19 nt, Homo sapiens
agugaaagcucaacucuac

SEQ ID NO: 1034110 - RNA, 19 nt, Homo sapiens
gcucaagcauaugaccuuu

SEQ ID NO: 1034111 - RNA, 19 nt, Homo sapiens
aaacaccguucuucaucuu

SEQ ID NO: 1034112 - RNA, 19 nt, Homo sapiens
ggaauauuaccuaguggaa

SEQ ID NO: 1034113 - RNA, 19 nt, Homo sapiens
ucaccucuaugccucauga

SEQ ID NO: 1034114 - RNA, 19 nt, Homo sapiens
ugaaauaggauccaguaug

SEQ ID NO: 1034115 - RNA, 19 nt, Homo sapiens
guccagcaguacuguuuaa

SEQ ID NO: 1034116 - RNA, 19 nt, Homo sapiens
uugauaaguucgcaaagaa

SEQ ID NO: 1034117 - RNA, 19 nt, Homo sapiens
cauaauaccuuggauucuc

SEQ ID NO: 1034118 - RNA, 19 nt, Homo sapiens
ggccugacauuucauuagu

SEQ ID NO: 1034119 - RNA, 19 nt, Homo sapiens
cuaauuacaguguuuguga

SEQ ID NO: 1034120 - RNA, 19 nt, Homo sapiens
gcucuaaagcaccuaagaa

SEQ ID NO: 1034121 - RNA, 19 nt, Homo sapiens
gcacacaauaauacucuau

SEQ ID NO: 1034122 - RNA, 19 nt, Homo sapiens
ggaccaacuaugugauuga

SEQ ID NO: 1034123 - RNA, 19 nt, Homo sapiens
caaagucugagaaauagga

SEQ ID NO: 1034124 - RNA, 19 nt, Homo sapiens
gagcggaugcugcgucuuc

SEQ ID NO: 1034125 - RNA, 19 nt, Homo sapiens
guaaccagcacacaauaau

SEQ ID NO: 1034126 - RNA, 19 nt, Homo sapiens
gaccaaaggaccaacuaug

SEQ ID NO: 1034127 - RNA, 19 nt, Homo sapiens
ggaauggcuuucugcaacu

SEQ ID NO: 1034128 - RNA, 19 nt, Homo sapiens
ugacuuacgagugguauuu

SEQ ID NO: 1034129 - RNA, 19 nt, Homo sapiens
uaccuuggauucucuuuca

SEQ ID NO: 1034130 - RNA, 19 nt, Homo sapiens
ucacaugccuucaaaagug

SEQ ID NO: 1034131 - RNA, 19 nt, Homo sapiens
gcuguggccuuaguuuaug

SEQ ID NO: 1034132 - RNA, 19 nt, Homo sapiens
aaauauuggucaugaacug

SEQ ID NO: 1034133 - RNA, 19 nt, Homo sapiens
guaucaugguccagcagua

SEQ ID NO: 1034134 - RNA, 19 nt, Homo sapiens
gaccaacuaugugauugau

SEQ ID NO: 1034135 - RNA, 19 nt, Homo sapiens
gggcuucagugucuggaau

SEQ ID NO: 1034136 - RNA, 19 nt, Homo sapiens
acagaauccaucauuagua

SEQ ID NO: 1034137 - RNA, 19 nt, Homo sapiens
gagaucaaagguagcuaaa

SEQ ID NO: 1034138 - RNA, 19 nt, Homo sapiens
gugacaaauuaguuccuuu

SEQ ID NO: 1034139 - RNA, 19 nt, Homo sapiens
ccaaaggaccaacuaugug

SEQ ID NO: 1034140 - RNA, 19 nt, Homo sapiens
gacaacacugcaaggauuu

SEQ ID NO: 1034141 - RNA, 19 nt, Homo sapiens
ucccugggcucuuuguuga

SEQ ID NO: 1034142 - RNA, 19 nt, Homo sapiens
gacagaauccaucauuagu

SEQ ID NO: 1034143 - RNA, 19 nt, Homo sapiens
aaauacugcuuucucaagu

SEQ ID NO: 1034144 - RNA, 19 nt, Homo sapiens
uaaggagagaucaaaggua

SEQ ID NO: 1034145 - RNA, 19 nt, Homo sapiens
gauauuaauaccagaccaa

SEQ ID NO: 1034146 - RNA, 19 nt, Homo sapiens
ggauuagauuccagaagag

SEQ ID NO: 1034147 - RNA, 19 nt, Homo sapiens
uaucccguguuaccaaauu

SEQ ID NO: 1034148 - RNA, 19 nt, Homo sapiens
gaaaacaccguucuucauc

SEQ ID NO: 1034149 - RNA, 19 nt, Homo sapiens
gguuugauccaucuucuug

SEQ ID NO: 1034150 - RNA, 19 nt, Homo sapiens
gaagaauauggaagguuug

SEQ ID NO: 1034151 - RNA, 19 nt, Homo sapiens
aaagaacugcaaagucuga

SEQ ID NO: 1034152 - RNA, 19 nt, Homo sapiens
uggcugcaguugugucuga

SEQ ID NO: 1034153 - RNA, 19 nt, Homo sapiens
acagacagaauccaucauu

SEQ ID NO: 1034154 - RNA, 19 nt, Homo sapiens
ugcaaagucugagaaauag

SEQ ID NO: 1034155 - RNA, 19 nt, Homo sapiens
gcucaacucuacgcucaag

SEQ ID NO: 1034156 - RNA, 19 nt, Homo sapiens
auaacuggaccgaagaaua

SEQ ID NO: 1034157 - RNA, 19 nt, Homo sapiens
agacagaauccaucauuag

SEQ ID NO: 1034158 - RNA, 19 nt, Homo sapiens
gcaacaaaggacagacaga

SEQ ID NO: 1034159 - RNA, 19 nt, Homo sapiens
agaugcagauccugaagug

SEQ ID NO: 1034160 - RNA, 19 nt, Homo sapiens
ggcaagagaugcagauccu

SEQ ID NO: 1034161 - RNA, 19 nt, Homo sapiens
gcuuucugcuguggccuua

SEQ ID NO: 1034162 - RNA, 19 nt, Homo sapiens
cugcucacaugccuucaaa

SEQ ID NO: 1034163 - RNA, 19 nt, Homo sapiens
caccguucuucaucuuuaa

SEQ ID NO: 1034164 - RNA, 19 nt, Homo sapiens
aggcuuagcuuccaaauua

SEQ ID NO: 1034165 - RNA, 19 nt, Homo sapiens
gcaauuguguuuggauuua

SEQ ID NO: 1034166 - RNA, 19 nt, Homo sapiens
gggagcagauguuaccuaa

SEQ ID NO: 1034167 - RNA, 19 nt, Homo sapiens
gagcagauguuaccuaagg

SEQ ID NO: 1034168 - RNA, 19 nt, Homo sapiens
cuacuugacuuuaucacua

SEQ ID NO: 1034169 - RNA, 19 nt, Homo sapiens
ccucuucucugucuccuua

SEQ ID NO: 1034170 - RNA, 19 nt, Homo sapiens
gaaggcaguuuuaucaaua

SEQ ID NO: 1034171 - RNA, 19 nt, Homo sapiens
ccacaaaguaggccagaua

SEQ ID NO: 1034172 - RNA, 19 nt, Homo sapiens
gcaacaauaucagcaacuu

SEQ ID NO: 1034173 - RNA, 19 nt, Homo sapiens
ggcagaagcucuuguaaaa

SEQ ID NO: 1034174 - RNA, 19 nt, Homo sapiens
uuaccaggcuuuacuguau

SEQ ID NO: 1034175 - RNA, 19 nt, Homo sapiens
ggaccaaagauaagaaaga

SEQ ID NO: 1034176 - RNA, 19 nt, Homo sapiens
aaacugauaccacaccuaa

SEQ ID NO: 1034177 - RNA, 19 nt, Homo sapiens
cagaagcucuuguaaaauu

SEQ ID NO: 1034178 - RNA, 19 nt, Homo sapiens
gcaccuugguuguugaugu

SEQ ID NO: 1034179 - RNA, 19 nt, Homo sapiens
uaugggagauguugguauu

SEQ ID NO: 1034180 - RNA, 19 nt, Homo sapiens
ucacucagccuuaaauguu

SEQ ID NO: 1034181 - RNA, 19 nt, Homo sapiens
aacaagcuuugaccacuua

SEQ ID NO: 1034182 - RNA, 19 nt, Homo sapiens
guauuucacucagccuuaa

SEQ ID NO: 1034183 - RNA, 19 nt, Homo sapiens
cggccucgcugccuacuuu

SEQ ID NO: 1034184 - RNA, 19 nt, Homo sapiens
ccaagacagugaaaguaau

SEQ ID NO: 1034185 - RNA, 19 nt, Homo sapiens
gcuuccaaauuaugcuuua

SEQ ID NO: 1034186 - RNA, 19 nt, Homo sapiens
agauagaaauggagucaug

SEQ ID NO: 1034187 - RNA, 19 nt, Homo sapiens
aaacaagcuuugaccacuu

SEQ ID NO: 1034188 - RNA, 19 nt, Homo sapiens
cacucagccuuaaauguua

SEQ ID NO: 1034189 - RNA, 19 nt, Homo sapiens
caaaguaggccagauaagu

SEQ ID NO: 1034190 - RNA, 19 nt, Homo sapiens
caagacagugaaaguaauu

SEQ ID NO: 1034191 - RNA, 19 nt, Homo sapiens
ccaaagauaagaaagacuu

SEQ ID NO: 1034192 - RNA, 19 nt, Homo sapiens
caccuaaggaccaaagaua

SEQ ID NO: 1034193 - RNA, 19 nt, Homo sapiens
uaucagcaacuucguguuu

SEQ ID NO: 1034194 - RNA, 19 nt, Homo sapiens
cauaggcauugcucuaguu

SEQ ID NO: 1034195 - RNA, 19 nt, Homo sapiens
gagaguccuuguucuuaca

SEQ ID NO: 1034196 - RNA, 19 nt, Homo sapiens
aaaguaggccagauaaguu

SEQ ID NO: 1034197 - RNA, 19 nt, Homo sapiens
gcauugcucuaguuugucu

SEQ ID NO: 1034198 - RNA, 19 nt, Homo sapiens
guagugacccugcauugug

SEQ ID NO: 1034199 - RNA, 19 nt, Homo sapiens
gaccaaagauaagaaagac

SEQ ID NO: 1034200 - RNA, 19 nt, Homo sapiens
ucacuaugcuguaugaaaa

SEQ ID NO: 1034201 - RNA, 19 nt, Homo sapiens
guagcaggaucuugagagu

SEQ ID NO: 1034202 - RNA, 19 nt, Homo sapiens
ugaaacuuaucucaaaugg

SEQ ID NO: 1034203 - RNA, 19 nt, Homo sapiens
aggcauugcucuaguuugu

SEQ ID NO: 1034204 - RNA, 19 nt, Homo sapiens
ucagcaacuucguguuuau

SEQ ID NO: 1034205 - RNA, 19 nt, Homo sapiens
gggagauguugguauuuua

SEQ ID NO: 1034206 - RNA, 19 nt, Homo sapiens
ugcagugccuuucuucuga

SEQ ID NO: 1034207 - RNA, 19 nt, Homo sapiens
ucacugagccacuuaaugc

SEQ ID NO: 1034208 - RNA, 19 nt, Homo sapiens
uuacauaggcauugcucua

SEQ ID NO: 1034209 - RNA, 19 nt, Homo sapiens
uuuagaaagugguucgauu

SEQ ID NO: 1034210 - RNA, 19 nt, Homo sapiens
gaaacugauaccacaccua

SEQ ID NO: 1034211 - RNA, 19 nt, Homo sapiens
gcucugugggucuuccuua

SEQ ID NO: 1034212 - RNA, 19 nt, Homo sapiens
gcccaagacagugaaagua

SEQ ID NO: 1034213 - RNA, 19 nt, Homo sapiens
caagaaggcaguuuuauca

SEQ ID NO: 1034214 - RNA, 19 nt, Homo sapiens
gauugugaauacuguguag

SEQ ID NO: 1034215 - RNA, 19 nt, Homo sapiens
cccaagacagugaaaguaa

SEQ ID NO: 1034216 - RNA, 19 nt, Homo sapiens
caacuucguguuuauacug

SEQ ID NO: 1034217 - RNA, 19 nt, Homo sapiens
aaguaggccagauaaguua

SEQ ID NO: 1034218 - RNA, 19 nt, Homo sapiens
guguuuggauuuauagcaa

SEQ ID NO: 1034219 - RNA, 19 nt, Homo sapiens
gacaggacuucagcugaga

SEQ ID NO: 1034220 - RNA, 19 nt, Homo sapiens
ccacaaaaguaaaaucauc

SEQ ID NO: 1034221 - RNA, 19 nt, Homo sapiens
gaucuugagaguccuuguu

SEQ ID NO: 1034222 - RNA, 19 nt, Homo sapiens
gcaacuucguguuuauacu

SEQ ID NO: 1034223 - RNA, 19 nt, Homo sapiens
uugcuuagcuguuuguuuu

SEQ ID NO: 1034224 - RNA, 19 nt, Homo sapiens
gaguccuuguucuuacaua

SEQ ID NO: 1034225 - RNA, 19 nt, Homo sapiens
ugagaguccuuguucuuac

SEQ ID NO: 1034226 - RNA, 19 nt, Homo sapiens
guauugcacuccauuuuau

SEQ ID NO: 1034227 - RNA, 19 nt, Homo sapiens
cagcaacuucguguuuaua

SEQ ID NO: 1034228 - RNA, 19 nt, Homo sapiens
cacaaaguaggccagauaa

SEQ ID NO: 1034229 - RNA, 19 nt, Homo sapiens
uaccaggcuuuacuguauu

SEQ ID NO: 1034230 - RNA, 19 nt, Homo sapiens
uggcagaagcucuuguaaa

SEQ ID NO: 1034231 - RNA, 19 nt, Homo sapiens
gagaaaaccugaaaauacc

SEQ ID NO: 1034232 - RNA, 19 nt, Homo sapiens
uuaucacuaugcuguauga

SEQ ID NO: 1034233 - RNA, 19 nt, Homo sapiens
gaaacuuaucucaaaugga

SEQ ID NO: 1034234 - RNA, 19 nt, Homo sapiens
ggacuucagcugagauugc

SEQ ID NO: 1034235 - RNA, 19 nt, Homo sapiens
caucugugaagaaguugua

SEQ ID NO: 1034236 - RNA, 19 nt, Homo sapiens
gccacuuaaugccuaaaga

SEQ ID NO: 1034237 - RNA, 19 nt, Homo sapiens
guuccuacuugacuuuauc

SEQ ID NO: 1034238 - RNA, 19 nt, Homo sapiens
gagaguugauaccacaaaa

SEQ ID NO: 1034239 - RNA, 19 nt, Homo sapiens
uaggugguccugaaucuug

SEQ ID NO: 1034240 - RNA, 19 nt, Homo sapiens
ccuguuggcauaugauuau

SEQ ID NO: 1034241 - RNA, 19 nt, Homo sapiens
uaccaaguaucugaagaga

SEQ ID NO: 1034242 - RNA, 19 nt, Homo sapiens
cugagucuccuuauacuga

SEQ ID NO: 1034243 - RNA, 19 nt, Homo sapiens
ggucaagaaggcaguuuua

SEQ ID NO: 1034244 - RNA, 19 nt, Homo sapiens
cuuaaugccuaaagacucu

SEQ ID NO: 1034245 - RNA, 19 nt, Homo sapiens
gucaugugcugcugcuuca

SEQ ID NO: 1034246 - RNA, 19 nt, Homo sapiens
cuuugaagccaaucuguuu

SEQ ID NO: 1034247 - RNA, 19 nt, Homo sapiens
ucuuugagaccuucguaua

SEQ ID NO: 1034248 - RNA, 19 nt, Homo sapiens
uaauuugcuuagcuguuug

SEQ ID NO: 1034249 - RNA, 19 nt, Homo sapiens
caucgugauuauauucauc

SEQ ID NO: 1034250 - RNA, 19 nt, Homo sapiens
cugcaauuguguuuggauu

SEQ ID NO: 1034251 - RNA, 19 nt, Homo sapiens
uugagaguccuuguucuua

SEQ ID NO: 1034252 - RNA, 19 nt, Homo sapiens
caacaauaucagcaacuuc

SEQ ID NO: 1034253 - RNA, 19 nt, Homo sapiens
augcuuagauuauguucug

SEQ ID NO: 1034254 - RNA, 19 nt, Homo sapiens
ugucagucaccacaaagua

SEQ ID NO: 1034255 - RNA, 19 nt, Homo sapiens
guugauaccacaaaaguaa

SEQ ID NO: 1034256 - RNA, 19 nt, Homo sapiens
gucuuuaggugguccugaa

SEQ ID NO: 1034257 - RNA, 19 nt, Homo sapiens
uuagaaagugguucgauuc

SEQ ID NO: 1034258 - RNA, 19 nt, Homo sapiens
uaaggaccaaagauaagaa

SEQ ID NO: 1034259 - RNA, 19 nt, Homo sapiens
cuaaggaccaaagauaaga

SEQ ID NO: 1034260 - RNA, 19 nt, Homo sapiens
uaaaauguaugggagaugu

SEQ ID NO: 1034261 - RNA, 19 nt, Homo sapiens
cauauauuaccaggcuuua

SEQ ID NO: 1034262 - RNA, 19 nt, Homo sapiens
gagucuccuuauacugauu

SEQ ID NO: 1034263 - RNA, 19 nt, Homo sapiens
guaggccagauaaguuaaa

SEQ ID NO: 1034264 - RNA, 19 nt, Homo sapiens
gaaagaagccaaagugauu

SEQ ID NO: 1034265 - RNA, 19 nt, Homo sapiens
gauuuauccugaacucuua

SEQ ID NO: 1034266 - RNA, 19 nt, Homo sapiens
gagaaacucaucaggauuu

SEQ ID NO: 1034267 - RNA, 19 nt, Homo sapiens
ccuaacaacuuaccagauu

SEQ ID NO: 1034268 - RNA, 19 nt, Homo sapiens
gugcgcagcugguucauga

SEQ ID NO: 1034269 - RNA, 19 nt, Homo sapiens
ccaaagugauuagaaagaa

SEQ ID NO: 1034270 - RNA, 19 nt, Homo sapiens
gggaaaugccguauauauu

SEQ ID NO: 1034271 - RNA, 19 nt, Homo sapiens
ggaaaguaaaguugcauuu

SEQ ID NO: 1034272 - RNA, 19 nt, Homo sapiens
cagagaaacucaucaggau

SEQ ID NO: 1034273 - RNA, 19 nt, Homo sapiens
gaggaggauucgaagauga

SEQ ID NO: 1034274 - RNA, 19 nt, Homo sapiens
cgagagggcucccaaacau

SEQ ID NO: 1034275 - RNA, 19 nt, Homo sapiens
ccaaacaucugcagcugau

SEQ ID NO: 1034276 - RNA, 19 nt, Homo sapiens
ucaggaaccucuccaagau

SEQ ID NO: 1034277 - RNA, 19 nt, Homo sapiens
uaccagauuucuccuguuu

SEQ ID NO: 1034278 - RNA, 19 nt, Homo sapiens
cauguuaugugauuuguuc

SEQ ID NO: 1034279 - RNA, 19 nt, Homo sapiens
ggaggaggauucgaagaug

SEQ ID NO: 1034280 - RNA, 19 nt, Homo sapiens
ccuaaaagaucucauugua

SEQ ID NO: 1034281 - RNA, 19 nt, Homo sapiens
ccagauuucuccuguuuua

SEQ ID NO: 1034282 - RNA, 19 nt, Homo sapiens
cagaguuuguggcauuuaa

SEQ ID NO: 1034283 - RNA, 19 nt, Homo sapiens
gaagaugacgcgacugauc

SEQ ID NO: 1034284 - RNA, 19 nt, Homo sapiens
gcccugagguguuucugaa

SEQ ID NO: 1034285 - RNA, 19 nt, Homo sapiens
gaguggauucugcauguua

SEQ ID NO: 1034286 - RNA, 19 nt, Homo sapiens
caugacggauccagagaaa

SEQ ID NO: 1034287 - RNA, 19 nt, Homo sapiens
gcaggaaaguaaaguugca

SEQ ID NO: 1034288 - RNA, 19 nt, Homo sapiens
ccacuucagcagcaucuua

SEQ ID NO: 1034289 - RNA, 19 nt, Homo sapiens
ucaccuggcugcagugugu

SEQ ID NO: 1034290 - RNA, 19 nt, Homo sapiens
aagccaaagugauuagaaa

SEQ ID NO: 1034291 - RNA, 19 nt, Homo sapiens
aaacaucugcagcugauuu

SEQ ID NO: 1034292 - RNA, 19 nt, Homo sapiens
cuaacaacuuaccagauuu

SEQ ID NO: 1034293 - RNA, 19 nt, Homo sapiens
aaagaaagaagccaaagug

SEQ ID NO: 1034294 - RNA, 19 nt, Homo sapiens
gcucagcgacuguuugaug

SEQ ID NO: 1034295 - RNA, 19 nt, Homo sapiens
gaagccaaagugauuagaa

SEQ ID NO: 1034296 - RNA, 19 nt, Homo sapiens
gauucugcauguuauguga

SEQ ID NO: 1034297 - RNA, 19 nt, Homo sapiens
agaaacucaucaggauuua

SEQ ID NO: 1034298 - RNA, 19 nt, Homo sapiens
ugacgcgacugaucucaug

SEQ ID NO: 1034299 - RNA, 19 nt, Homo sapiens
auagguagcaggaaaguaa

SEQ ID NO: 1034300 - RNA, 19 nt, Homo sapiens
gcaaaauccuacuaucaga

SEQ ID NO: 1034301 - RNA, 19 nt, Homo sapiens
gcauuucccucucgcacau

SEQ ID NO: 1034302 - RNA, 19 nt, Homo sapiens
gguucugucuacugaaauu

SEQ ID NO: 1034303 - RNA, 19 nt, Homo sapiens
ggaauaacagccucugagu

SEQ ID NO: 1034304 - RNA, 19 nt, Homo sapiens
aaagaagccaaagugauua

SEQ ID NO: 1034305 - RNA, 19 nt, Homo sapiens
uagaugacguguccaacga

SEQ ID NO: 1034306 - RNA, 19 nt, Homo sapiens
guccaaaguuguaccagau

SEQ ID NO: 1034307 - RNA, 19 nt, Homo sapiens
gaaggacaagcuggacuuu

SEQ ID NO: 1034308 - RNA, 19 nt, Homo sapiens
acugggacuuuaaagguua

SEQ ID NO: 1034309 - RNA, 19 nt, Homo sapiens
uaucgacgcugaagaagac

SEQ ID NO: 1034310 - RNA, 19 nt, Homo sapiens
uaugugauuuguucuguuc

SEQ ID NO: 1034311 - RNA, 19 nt, Homo sapiens
ggacaccugcccgcucuuu

SEQ ID NO: 1034312 - RNA, 19 nt, Homo sapiens
ggacuuuaaagguuauaug

SEQ ID NO: 1034313 - RNA, 19 nt, Homo sapiens
cugaucucaugccguauua

SEQ ID NO: 1034314 - RNA, 19 nt, Homo sapiens
caggcgcagugauccauuu

SEQ ID NO: 1034315 - RNA, 19 nt, Homo sapiens
ucgagacggugacaaagga

SEQ ID NO: 1034316 - RNA, 19 nt, Homo sapiens
gaucucaugccguauuauc

SEQ ID NO: 1034317 - RNA, 19 nt, Homo sapiens
aggaggaccugaaggacaa

SEQ ID NO: 1034318 - RNA, 19 nt, Homo sapiens
aaaguaaaguugcauuucc

SEQ ID NO: 1034319 - RNA, 19 nt, Homo sapiens
uaacaacuuaccagauuuc

SEQ ID NO: 1034320 - RNA, 19 nt, Homo sapiens
gccaaagugauuagaaaga

SEQ ID NO: 1034321 - RNA, 19 nt, Homo sapiens
acgacgugcuuucccauuu

SEQ ID NO: 1034322 - RNA, 19 nt, Homo sapiens
ucagagcaguguccaguac

SEQ ID NO: 1034323 - RNA, 19 nt, Homo sapiens
gaacagacuaaaaggaauu

SEQ ID NO: 1034324 - RNA, 19 nt, Homo sapiens
gauuuguucuguucaucga

SEQ ID NO: 1034325 - RNA, 19 nt, Homo sapiens
gcaguguccaguaccugua

SEQ ID NO: 1034326 - RNA, 19 nt, Homo sapiens
aaacucaucaggauuuauc

SEQ ID NO: 1034327 - RNA, 19 nt, Homo sapiens
gccugaagcuguucuccau

SEQ ID NO: 1034328 - RNA, 19 nt, Homo sapiens
ggacgugcugcugacaaua

SEQ ID NO: 1034329 - RNA, 19 nt, Homo sapiens
cccauuacccuccacauga

SEQ ID NO: 1034330 - RNA, 19 nt, Homo sapiens
cagccgugguccaaaguug

SEQ ID NO: 1034331 - RNA, 19 nt, Homo sapiens
uggguucugucuacugaaa

SEQ ID NO: 1034332 - RNA, 19 nt, Homo sapiens
cugaguggauucugcaugu

SEQ ID NO: 1034333 - RNA, 19 nt, Homo sapiens
ccaaaguuguaccagaucu

SEQ ID NO: 1034334 - RNA, 19 nt, Homo sapiens
uagcaggaaaguaaaguug

SEQ ID NO: 1034335 - RNA, 19 nt, Homo sapiens
gcaugacggauccagagaa

SEQ ID NO: 1034336 - RNA, 19 nt, Homo sapiens
uucaugagaucuaauugug

SEQ ID NO: 1034337 - RNA, 19 nt, Homo sapiens
agaaagaagccaaagugau

SEQ ID NO: 1034338 - RNA, 19 nt, Homo sapiens
guuaugugauuuguucugu

SEQ ID NO: 1034339 - RNA, 19 nt, Homo sapiens
caucugcagcugauuugaa

SEQ ID NO: 1034340 - RNA, 19 nt, Homo sapiens
caccugagccagaguuugu

SEQ ID NO: 1034341 - RNA, 19 nt, Homo sapiens
gaaugaggaggaccugaag

SEQ ID NO: 1034342 - RNA, 19 nt, Homo sapiens
aaagaucucauuguaagug

SEQ ID NO: 1034343 - RNA, 19 nt, Homo sapiens
cgacgugcuuucccauuuu

SEQ ID NO: 1034344 - RNA, 19 nt, Homo sapiens
ccauuacccuccacaugag

SEQ ID NO: 1034345 - RNA, 19 nt, Homo sapiens
cccuauagguagcaggaaa

SEQ ID NO: 1034346 - RNA, 19 nt, Homo sapiens
uacugggacuuuaaagguu

SEQ ID NO: 1034347 - RNA, 19 nt, Homo sapiens
aagaaagaagccaaaguga

SEQ ID NO: 1034348 - RNA, 19 nt, Homo sapiens
agaaugaggaggaccugaa

SEQ ID NO: 1034349 - RNA, 19 nt, Homo sapiens
ucaagggugccaacgcaaa

SEQ ID NO: 1034350 - RNA, 19 nt, Homo sapiens
gaaacucaucaggauuuau

SEQ ID NO: 1034351 - RNA, 19 nt, Homo sapiens
ugacggauccagagaaacu

SEQ ID NO: 1034352 - RNA, 19 nt, Homo sapiens
uaacagccucugaguggau

SEQ ID NO: 1034353 - RNA, 19 nt, Homo sapiens
gaguuuguggcauuuaaau

SEQ ID NO: 1034354 - RNA, 19 nt, Homo sapiens
ccacggacaccaucaacuc

SEQ ID NO: 1034355 - RNA, 19 nt, Homo sapiens
ggggaaaugccguauauau

SEQ ID NO: 1034356 - RNA, 19 nt, Homo sapiens
uaauaucucagugaacaga

SEQ ID NO: 1034357 - RNA, 19 nt, Homo sapiens
gggagcucgucuucaggaa

SEQ ID NO: 1034358 - RNA, 19 nt, Homo sapiens
cucagcgacuguuugauga

SEQ ID NO: 1034359 - RNA, 19 nt, Homo sapiens
gccguauuaucaacacguu

SEQ ID NO: 1034360 - RNA, 19 nt, Homo sapiens
ucgaagaugacgcgacuga

SEQ ID NO: 1034361 - RNA, 19 nt, Homo sapiens
guagcaggaaaguaaaguu

SEQ ID NO: 1034362 - RNA, 19 nt, Homo sapiens
guaccgagaguugcugguu

SEQ ID NO: 1034363 - RNA, 19 nt, Homo sapiens
aggacaagcuggacuuugc

SEQ ID NO: 1034364 - RNA, 19 nt, Homo sapiens
uaagauggcugucaaguuu

SEQ ID NO: 1034365 - RNA, 19 nt, Homo sapiens
gcaagagaguuguuaauga

SEQ ID NO: 1034366 - RNA, 19 nt, Homo sapiens
gaagauaccucugguguca

SEQ ID NO: 1034367 - RNA, 19 nt, Homo sapiens
ucaaaguaauccugaagua

SEQ ID NO: 1034368 - RNA, 19 nt, Homo sapiens
ccucagcacucuuguuaaa

SEQ ID NO: 1034369 - RNA, 19 nt, Homo sapiens
gagcugcccugcugucaga

SEQ ID NO: 1034370 - RNA, 19 nt, Homo sapiens
gagcggacauuguuuacug

SEQ ID NO: 1034371 - RNA, 19 nt, Homo sapiens
gaacaaaaguaucagucua

SEQ ID NO: 1034372 - RNA, 19 nt, Homo sapiens
ggaaauuugugaggccuuu

SEQ ID NO: 1034373 - RNA, 19 nt, Homo sapiens
caagagaguuguuaaugag

SEQ ID NO: 1034374 - RNA, 19 nt, Homo sapiens
gguagggacucuuccaaug

SEQ ID NO: 1034375 - RNA, 19 nt, Homo sapiens
gaauuacucuguacaaagc

SEQ ID NO: 1034376 - RNA, 19 nt, Homo sapiens
ggacauagaggacuuucga

SEQ ID NO: 1034377 - RNA, 19 nt, Homo sapiens
ccagaacacauauaucaaa

SEQ ID NO: 1034378 - RNA, 19 nt, Homo sapiens
guacaaagccagaacacau

SEQ ID NO: 1034379 - RNA, 19 nt, Homo sapiens
cgagauaucaaacaaagaa

SEQ ID NO: 1034380 - RNA, 19 nt, Homo sapiens
ccuaagaugugccuacuag

SEQ ID NO: 1034381 - RNA, 19 nt, Homo sapiens
ccaacaguauucggacaua

SEQ ID NO: 1034382 - RNA, 19 nt, Homo sapiens
gcugauacccucuccauuc

SEQ ID NO: 1034383 - RNA, 19 nt, Homo sapiens
gaguucagcugcgagauau

SEQ ID NO: 1034384 - RNA, 19 nt, Homo sapiens
uaacagaggaggaaaugau

SEQ ID NO: 1034385 - RNA, 19 nt, Homo sapiens
ucaaagccauugcugauac

SEQ ID NO: 1034386 - RNA, 19 nt, Homo sapiens
ugaaccagaugccguugaa

SEQ ID NO: 1034387 - RNA, 19 nt, Homo sapiens
ucagauacgcggugcagua

SEQ ID NO: 1034388 - RNA, 19 nt, Homo sapiens
gcagaaauacaucagauac

SEQ ID NO: 1034389 - RNA, 19 nt, Homo sapiens
uggaggaggucaugcagaa

SEQ ID NO: 1034390 - RNA, 19 nt, Homo sapiens
ccugugaccugcaagauuc

SEQ ID NO: 1034391 - RNA, 19 nt, Homo sapiens
guagggacucuuccaauga

SEQ ID NO: 1034392 - RNA, 19 nt, Homo sapiens
gcugcgagauaucaaacaa

SEQ ID NO: 1034393 - RNA, 19 nt, Homo sapiens
cagaugccguugaacaguu

SEQ ID NO: 1034394 - RNA, 19 nt, Homo sapiens
ucaagaugauucagugcaa

SEQ ID NO: 1034395 - RNA, 19 nt, Homo sapiens
gaucgccuguucuccucua

SEQ ID NO: 1034396 - RNA, 19 nt, Homo sapiens
gagcauacccagcccagau

SEQ ID NO: 1034397 - RNA, 19 nt, Homo sapiens
caaaguaauccugaaguau

SEQ ID NO: 1034398 - RNA, 19 nt, Homo sapiens
gaaggcuggugacuacucu

SEQ ID NO: 1034399 - RNA, 19 nt, Homo sapiens
ucauuaagauggcugucaa

SEQ ID NO: 1034400 - RNA, 19 nt, Homo sapiens
agauaccucuggugucauu

SEQ ID NO: 1034401 - RNA, 19 nt, Homo sapiens
uacaaagccagaacacaua

SEQ ID NO: 1034402 - RNA, 19 nt, Homo sapiens
cagaacacauauaucaaag

SEQ ID NO: 1034403 - RNA, 19 nt, Homo sapiens
gaccacauccaacaguauu

SEQ ID NO: 1034404 - RNA, 19 nt, Homo sapiens
ugauguggcugguauugau

SEQ ID NO: 1034405 - RNA, 19 nt, Homo sapiens
gagcugaucgaccucaaga

SEQ ID NO: 1034406 - RNA, 19 nt, Homo sapiens
gacaaccacuacaccaaca

SEQ ID NO: 1034407 - RNA, 19 nt, Homo sapiens
ugacauugguacugugcaa

SEQ ID NO: 1034408 - RNA, 19 nt, Homo sapiens
guucaacgcccucuagauc

SEQ ID NO: 1034409 - RNA, 19 nt, Homo sapiens
acaaagaauuacucuguac

SEQ ID NO: 1034410 - RNA, 19 nt, Homo sapiens
ucucuguguuaccauaaua

SEQ ID NO: 1034411 - RNA, 19 nt, Homo sapiens
gaggaggucaugcagaaau

SEQ ID NO: 1034412 - RNA, 19 nt, Homo sapiens
aaaguaauccugaaguauc

SEQ ID NO: 1034413 - RNA, 19 nt, Homo sapiens
gaagucaucaaagccauug

SEQ ID NO: 1034414 - RNA, 19 nt, Homo sapiens
gcucagcacaguggacuuu

SEQ ID NO: 1034415 - RNA, 19 nt, Homo sapiens
ggagcaccgugaggaagaa

SEQ ID NO: 1034416 - RNA, 19 nt, Homo sapiens
gcugaucgaccucaagaug

SEQ ID NO: 1034417 - RNA, 19 nt, Homo sapiens
aggaggucaugcagaaaua

SEQ ID NO: 1034418 - RNA, 19 nt, Homo sapiens
uugaauagccucucucugu

SEQ ID NO: 1034419 - RNA, 19 nt, Homo sapiens
caacaugggcuguccaaaa

SEQ ID NO: 1034420 - RNA, 19 nt, Homo sapiens
gggaaguggugaagaaagc

SEQ ID NO: 1034421 - RNA, 19 nt, Homo sapiens
gaauagccucucucugugu

SEQ ID NO: 1034422 - RNA, 19 nt, Homo sapiens
gcugugaagucaucaaagc

SEQ ID NO: 1034423 - RNA, 19 nt, Homo sapiens
cugacaagauugagaagau

SEQ ID NO: 1034424 - RNA, 19 nt, Homo sapiens
caaagccagaacacauaua

SEQ ID NO: 1034425 - RNA, 19 nt, Homo sapiens
cgccuguucuccucuauug

SEQ ID NO: 1034426 - RNA, 19 nt, Homo sapiens
ccucuggugucauuaagau

SEQ ID NO: 1034427 - RNA, 19 nt, Homo sapiens
caacaguauucggacauag

SEQ ID NO: 1034428 - RNA, 19 nt, Homo sapiens
cuugggaaguggugaagaa

SEQ ID NO: 1034429 - RNA, 19 nt, Homo sapiens
auagaggacuuucgacaag

SEQ ID NO: 1034430 - RNA, 19 nt, Homo sapiens
aaguaauccugaaguauca

SEQ ID NO: 1034431 - RNA, 19 nt, Homo sapiens
ccucuccauuccugucaua

SEQ ID NO: 1034432 - RNA, 19 nt, Homo sapiens
ggcagccucuuccgugaug

SEQ ID NO: 1034433 - RNA, 19 nt, Homo sapiens
ucagcacucuuguuaaagg

SEQ ID NO: 1034434 - RNA, 19 nt, Homo sapiens
ggagccagcugaagauacc

SEQ ID NO: 1034435 - RNA, 19 nt, Homo sapiens
gggacacgcagaccuguga

SEQ ID NO: 1034436 - RNA, 19 nt, Homo sapiens
aaaaugauguggcugguau

SEQ ID NO: 1034437 - RNA, 19 nt, Homo sapiens
ugaucgaccucaagaugau

SEQ ID NO: 1034438 - RNA, 19 nt, Homo sapiens
cauagaggacuuucgacaa

SEQ ID NO: 1034439 - RNA, 19 nt, Homo sapiens
ugacaagauugagaagauc

SEQ ID NO: 1034440 - RNA, 19 nt, Homo sapiens
agaguucagcugcgagaua

SEQ ID NO: 1034441 - RNA, 19 nt, Homo sapiens
gaacaguuugcuggucuug

SEQ ID NO: 1034442 - RNA, 19 nt, Homo sapiens
aaagccagaacacauauau

SEQ ID NO: 1034443 - RNA, 19 nt, Homo sapiens
ugucagcugugaagucauc

SEQ ID NO: 1034444 - RNA, 19 nt, Homo sapiens
ccugucagcugugaaguca

SEQ ID NO: 1034445 - RNA, 19 nt, Homo sapiens
agaugccguugaacaguuu

SEQ ID NO: 1034446 - RNA, 19 nt, Homo sapiens
cuggaaggcuggugacuac

SEQ ID NO: 1034447 - RNA, 19 nt, Homo sapiens
uaagaugugccuacuagag

SEQ ID NO: 1034448 - RNA, 19 nt, Homo sapiens
caaagaauuacucuguaca

SEQ ID NO: 1034449 - RNA, 19 nt, Homo sapiens
caaguucucuuugaaaaca

SEQ ID NO: 1034450 - RNA, 19 nt, Homo sapiens
gcuccaugcugcccagucu

SEQ ID NO: 1034451 - RNA, 19 nt, Homo sapiens
aauagccucucucuguguu

SEQ ID NO: 1034452 - RNA, 19 nt, Homo sapiens
ugucaccguugcugaacaa

SEQ ID NO: 1034453 - RNA, 19 nt, Homo sapiens
ugccaucgcuagaagauac

SEQ ID NO: 1034454 - RNA, 19 nt, Homo sapiens
guacugugcaauaaagaca

SEQ ID NO: 1034455 - RNA, 19 nt, Homo sapiens
gacuacucuuccugccuua

SEQ ID NO: 1034456 - RNA, 19 nt, Homo sapiens
uuaagauggcugucaaguu

SEQ ID NO: 1034457 - RNA, 19 nt, Homo sapiens
caacggaggaucucaugac

SEQ ID NO: 1034458 - RNA, 19 nt, Homo sapiens
guguuaccauaauaagcua

SEQ ID NO: 1034459 - RNA, 19 nt, Homo sapiens
ugcgagauaucaaacaaag

SEQ ID NO: 1034460 - RNA, 19 nt, Homo sapiens
gaggaucucaugaccacau

SEQ ID NO: 1034461 - RNA, 19 nt, Homo sapiens
ucagcacaguggacuuugu

SEQ ID NO: 1034462 - RNA, 19 nt, Homo sapiens
cggacauuguuuacuguga

SEQ ID NO: 1034463 - RNA, 19 nt, Homo sapiens
agccagaacacauauauca

SEQ ID NO: 1034464 - RNA, 19 nt, Homo sapiens
gaacauagcuugggcucaa

SEQ ID NO: 1034465 - RNA, 19 nt, Homo sapiens
gagagccgguguucuguua

SEQ ID NO: 1034466 - RNA, 19 nt, Homo sapiens
ugacagcacucaucaaaga

SEQ ID NO: 1034467 - RNA, 19 nt, Homo sapiens
gcacaaacccagcugcuuu

SEQ ID NO: 1034468 - RNA, 19 nt, Homo sapiens
ggaauaauccugcccuuga

SEQ ID NO: 1034469 - RNA, 19 nt, Homo sapiens
gacaaccacuucaaagaaa

SEQ ID NO: 1034470 - RNA, 19 nt, Homo sapiens
ggacaaccacuucaaagaa

SEQ ID NO: 1034471 - RNA, 19 nt, Homo sapiens
gaacucggaucccuuccuu

SEQ ID NO: 1034472 - RNA, 19 nt, Homo sapiens
uaauucagcucauuucuca

SEQ ID NO: 1034473 - RNA, 19 nt, Homo sapiens
gcucacugcucucuagaaa

SEQ ID NO: 1034474 - RNA, 19 nt, Homo sapiens
gacugaaggugagauguua

SEQ ID NO: 1034475 - RNA, 19 nt, Homo sapiens
caacccagcuccuuucaca

SEQ ID NO: 1034476 - RNA, 19 nt, Homo sapiens
gcaagaguuucgucccauu

SEQ ID NO: 1034477 - RNA, 19 nt, Homo sapiens
ccaaauccaucucccaugu

SEQ ID NO: 1034478 - RNA, 19 nt, Homo sapiens
aaauucagcuucuuucuca

SEQ ID NO: 1034479 - RNA, 19 nt, Homo sapiens
guacccaaauggaauguug

SEQ ID NO: 1034480 - RNA, 19 nt, Homo sapiens
gagcaaauucagcuucuuu

SEQ ID NO: 1034481 - RNA, 19 nt, Homo sapiens
gaauuguucuuguggacuu

SEQ ID NO: 1034482 - RNA, 19 nt, Homo sapiens
ccaagaaaguaugaaagaa

SEQ ID NO: 1034483 - RNA, 19 nt, Homo sapiens
gaaagcucauggugcaaau

SEQ ID NO: 1034484 - RNA, 19 nt, Homo sapiens
gaaggugagauguuauuug

SEQ ID NO: 1034485 - RNA, 19 nt, Homo sapiens
gcaauguacccaaauggaa

SEQ ID NO: 1034486 - RNA, 19 nt, Homo sapiens
cagaaugggugcugaugga

SEQ ID NO: 1034487 - RNA, 19 nt, Homo sapiens
gggcucaaauccaaccauu

SEQ ID NO: 1034488 - RNA, 19 nt, Homo sapiens
gcacuggauuagcuggaaa

SEQ ID NO: 1034489 - RNA, 19 nt, Homo sapiens
ggugacagcacucaucaaa

SEQ ID NO: 1034490 - RNA, 19 nt, Homo sapiens
gaauaauccugcccuugag

SEQ ID NO: 1034491 - RNA, 19 nt, Homo sapiens
guucaaaugagccaucuuu

SEQ ID NO: 1034492 - RNA, 19 nt, Homo sapiens
gguaaaugccaaucccuuu

SEQ ID NO: 1034493 - RNA, 19 nt, Homo sapiens
aaggugagauguuauuugu

SEQ ID NO: 1034494 - RNA, 19 nt, Homo sapiens
caacccagcuuccuuucca

SEQ ID NO: 1034495 - RNA, 19 nt, Homo sapiens
ggcacaggaucuggucuua

SEQ ID NO: 1034496 - RNA, 19 nt, Homo sapiens
gaugggaauaugggaauua

SEQ ID NO: 1034497 - RNA, 19 nt, Homo sapiens
ggagauggacaaccacuuc

SEQ ID NO: 1034498 - RNA, 19 nt, Homo sapiens
aagaauggcuggaccucaa

SEQ ID NO: 1034499 - RNA, 19 nt, Homo sapiens
gcucaccauuggagaauca

SEQ ID NO: 1034500 - RNA, 19 nt, Homo sapiens
caaggaugguuggugguuu

SEQ ID NO: 1034501 - RNA, 19 nt, Homo sapiens
gcuacagucugaagaacau

SEQ ID NO: 1034502 - RNA, 19 nt, Homo sapiens
aaacccagcuaccuuccaa

SEQ ID NO: 1034503 - RNA, 19 nt, Homo sapiens
cuacagcacuggauuagcu

SEQ ID NO: 1034504 - RNA, 19 nt, Homo sapiens
aaagaaagacccaccgaau

SEQ ID NO: 1034505 - RNA, 19 nt, Homo sapiens
gauggacaaccacuucaaa

SEQ ID NO: 1034506 - RNA, 19 nt, Homo sapiens
gaacacagaacagggagau

SEQ ID NO: 1034507 - RNA, 19 nt, Homo sapiens
gcucugaccugggcagcuu

SEQ ID NO: 1034508 - RNA, 19 nt, Homo sapiens
ggaccaugcuuccguagcu

SEQ ID NO: 1034509 - RNA, 19 nt, Homo sapiens
gcacaggaucuggucuuaa

SEQ ID NO: 1034510 - RNA, 19 nt, Homo sapiens
gauguuauuuguggcaugu

SEQ ID NO: 1034511 - RNA, 19 nt, Homo sapiens
ggagcuacagucugaagaa

SEQ ID NO: 1034512 - RNA, 19 nt, Homo sapiens
aggaucuggucuuaacuua

SEQ ID NO: 1034513 - RNA, 19 nt, Homo sapiens
ucacugcucucuagaaacg

SEQ ID NO: 1034514 - RNA, 19 nt, Homo sapiens
gcugcaauguacccaaaug

SEQ ID NO: 1034515 - RNA, 19 nt, Homo sapiens
acuuagagguggccagauu

SEQ ID NO: 1034516 - RNA, 19 nt, Homo sapiens
gcaggucccaguucacaug

SEQ ID NO: 1034517 - RNA, 19 nt, Homo sapiens
caagaguuucgucccauuu

SEQ ID NO: 1034518 - RNA, 19 nt, Homo sapiens
gcccauuguuucuuacuag

SEQ ID NO: 1034519 - RNA, 19 nt, Homo sapiens
uccaauggcugcaauguac

SEQ ID NO: 1034520 - RNA, 19 nt, Homo sapiens
caucaaacccagcuaccuu

SEQ ID NO: 1034521 - RNA, 19 nt, Homo sapiens
cacaggaucuggucuuaac

SEQ ID NO: 1034522 - RNA, 19 nt, Homo sapiens
acccaaguauggcuucuuu

SEQ ID NO: 1034523 - RNA, 19 nt, Homo sapiens
ggaugggaauaugggaauu

SEQ ID NO: 1034524 - RNA, 19 nt, Homo sapiens
ccacagcuuucugcccauu

SEQ ID NO: 1034525 - RNA, 19 nt, Homo sapiens
aaggucuacuggcccauua

SEQ ID NO: 1034526 - RNA, 19 nt, Homo sapiens
gcacaagcccauccuccau

SEQ ID NO: 1034527 - RNA, 19 nt, Homo sapiens
ggaccaaaccccaaucuga

SEQ ID NO: 1034528 - RNA, 19 nt, Homo sapiens
ggaaugguccucccaaucc

SEQ ID NO: 1034529 - RNA, 19 nt, Homo sapiens
caagaaaguaugaaagaac

SEQ ID NO: 1034530 - RNA, 19 nt, Homo sapiens
gcaaggaugguuggugguu

SEQ ID NO: 1034531 - RNA, 19 nt, Homo sapiens
uuagagguggccagauuua

SEQ ID NO: 1034532 - RNA, 19 nt, Homo sapiens
ggucccaguucacauguag

SEQ ID NO: 1034533 - RNA, 19 nt, Homo sapiens
ucagucuucuggcacauug

SEQ ID NO: 1034534 - RNA, 19 nt, Homo sapiens
guaaaugccaaucccuuuc

SEQ ID NO: 1034535 - RNA, 19 nt, Homo sapiens
cuucaaauccagcaccuuu

SEQ ID NO: 1034536 - RNA, 19 nt, Homo sapiens
acagggagauggacaacca

SEQ ID NO: 1034537 - RNA, 19 nt, Homo sapiens
ucagcucacugcucucuag

SEQ ID NO: 1034538 - RNA, 19 nt, Homo sapiens
gagccucccuggcacaaac

SEQ ID NO: 1034539 - RNA, 19 nt, Homo sapiens
cuccagggcucaaauccaa

SEQ ID NO: 1034540 - RNA, 19 nt, Homo sapiens
aaauccaucucccauguca

SEQ ID NO: 1034541 - RNA, 19 nt, Homo sapiens
gcucauggugcaaauuguu

SEQ ID NO: 1034542 - RNA, 19 nt, Homo sapiens
gcucgugacccaaguaugg

SEQ ID NO: 1034543 - RNA, 19 nt, Homo sapiens
ucggaucccuuccuuaugg

SEQ ID NO: 1034544 - RNA, 19 nt, Homo sapiens
uaugaaagaaccucggauu

SEQ ID NO: 1034545 - RNA, 19 nt, Homo sapiens
gggaugaagggaagaaauc

SEQ ID NO: 1034546 - RNA, 19 nt, Homo sapiens
guacucccaaucaaucaaa

SEQ ID NO: 1034547 - RNA, 19 nt, Homo sapiens
ucacugguacucccaauca

SEQ ID NO: 1034548 - RNA, 19 nt, Homo sapiens
ggcccaaacucggguccua

SEQ ID NO: 1034549 - RNA, 19 nt, Homo sapiens
ggagcaaauucagcuucuu

SEQ ID NO: 1034550 - RNA, 19 nt, Homo sapiens
ucaggacugugaugagcuu

SEQ ID NO: 1034551 - RNA, 19 nt, Homo sapiens
gucauccucuacugccaua

SEQ ID NO: 1034552 - RNA, 19 nt, Homo sapiens
ugacugaaggugagauguu

SEQ ID NO: 1034553 - RNA, 19 nt, Homo sapiens
caauguacccaaauggaau

SEQ ID NO: 1034554 - RNA, 19 nt, Homo sapiens
gcacucaucaaagacaaga

SEQ ID NO: 1034555 - RNA, 19 nt, Homo sapiens
aagaaagacccaccgaaug

SEQ ID NO: 1034556 - RNA, 19 nt, Homo sapiens
gcaaauucagcuucuuucu

SEQ ID NO: 1034557 - RNA, 19 nt, Homo sapiens
guggaaaucugaccccauu

SEQ ID NO: 1034558 - RNA, 19 nt, Homo sapiens
ugaaagaaccucggauuuu

SEQ ID NO: 1034559 - RNA, 19 nt, Homo sapiens
uuuccugcauuguaucuuu

SEQ ID NO: 1034560 - RNA, 19 nt, Homo sapiens
ggacuuuuccucagggaua

SEQ ID NO: 1034561 - RNA, 19 nt, Homo sapiens
uggcugcaauguacccaaa

SEQ ID NO: 1034562 - RNA, 19 nt, Homo sapiens
ucacaggcuucuggaaaca

SEQ ID NO: 1034563 - RNA, 19 nt, Homo sapiens
cccaagaaaguaugaaaga

SEQ ID NO: 1034564 - RNA, 19 nt, Homo sapiens
gcaaugacuuggaauuaug

SEQ ID NO: 1034565 - RNA, 19 nt, Homo sapiens
gaaggaggcugaccaagag

SEQ ID NO: 1034566 - RNA, 19 nt, Homo sapiens
ggccaugccuccaggauug

SEQ ID NO: 1034567 - RNA, 19 nt, Homo sapiens
gcgcgaaccuugaaauguc

SEQ ID NO: 1034568 - RNA, 19 nt, Homo sapiens
gcaaagcuuucugggaguu

SEQ ID NO: 1034569 - RNA, 19 nt, Homo sapiens
caccaagacucucuauuca

SEQ ID NO: 1034570 - RNA, 19 nt, Homo sapiens
gggaaaagauuaaggaaau

SEQ ID NO: 1034571 - RNA, 19 nt, Homo sapiens
gcucugcaaugacuuggaa

SEQ ID NO: 1034572 - RNA, 19 nt, Homo sapiens
gagcaugggcuuaggaugu

SEQ ID NO: 1034573 - RNA, 19 nt, Homo sapiens
ccaagacucucuauucaac

SEQ ID NO: 1034574 - RNA, 19 nt, Homo sapiens
ccacagcucugcaaugacu

SEQ ID NO: 1034575 - RNA, 19 nt, Homo sapiens
ccagggagcaauaaaggua

SEQ ID NO: 1034576 - RNA, 19 nt, Homo sapiens
gucccgagcuguucaaauc

SEQ ID NO: 1034577 - RNA, 19 nt, Homo sapiens
ucaccaagacucucuauuc

SEQ ID NO: 1034578 - RNA, 19 nt, Homo sapiens
ccauggcccuccuggauga

SEQ ID NO: 1034579 - RNA, 19 nt, Homo sapiens
gagaaccaauaccaaacga

SEQ ID NO: 1034580 - RNA, 19 nt, Homo sapiens
caaccuggaccucgucuug

SEQ ID NO: 1034581 - RNA, 19 nt, Homo sapiens
agaaggugcuggaaaugga

SEQ ID NO: 1034582 - RNA, 19 nt, Homo sapiens
guucuuaucccgcguggaa

SEQ ID NO: 1034583 - RNA, 19 nt, Homo sapiens
agaaggaggcugaccaaga

SEQ ID NO: 1034584 - RNA, 19 nt, Homo sapiens
ggagaaggaggcugaccaa

SEQ ID NO: 1034585 - RNA, 19 nt, Homo sapiens
ucauggagcagccuaagaa

SEQ ID NO: 1034586 - RNA, 19 nt, Homo sapiens
cgacauugccacugaguuc

SEQ ID NO: 1034587 - RNA, 19 nt, Homo sapiens
acccacagcucugcaauga

SEQ ID NO: 1034588 - RNA, 19 nt, Homo sapiens
aggagaaggugcuggaaau

SEQ ID NO: 1034589 - RNA, 19 nt, Homo sapiens
ugaaugccagggagcaaua

SEQ ID NO: 1034590 - RNA, 19 nt, Homo sapiens
gacuuggaauuaugugaug

SEQ ID NO: 1034591 - RNA, 19 nt, Homo sapiens
ccuccaggauugagaccua

SEQ ID NO: 1034592 - RNA, 19 nt, Homo sapiens
gaaaugucacgggcuucua

SEQ ID NO: 1034593 - RNA, 19 nt, Homo sapiens
ugcaaugacuuggaauuau

SEQ ID NO: 1034594 - RNA, 19 nt, Homo sapiens
caacgcaucccuucucaac

SEQ ID NO: 1034595 - RNA, 19 nt, Homo sapiens
ccagcagucugucuacuac

SEQ ID NO: 1034596 - RNA, 19 nt, Homo sapiens
cugcaaugacuuggaauua

SEQ ID NO: 1034597 - RNA, 19 nt, Homo sapiens
ggagaccgucagccagaaa

SEQ ID NO: 1034598 - RNA, 19 nt, Homo sapiens
ggagaaggugcuggaaaug

SEQ ID NO: 1034599 - RNA, 19 nt, Homo sapiens
cguggaauguugggagauu

SEQ ID NO: 1034600 - RNA, 19 nt, Homo sapiens
cgccugagcgcaaagcuuu

SEQ ID NO: 1034601 - RNA, 19 nt, Homo sapiens
gaccuacccugggcguguu

SEQ ID NO: 1034602 - RNA, 19 nt, Homo sapiens
gggcuuaggaugugaaugc

SEQ ID NO: 1034603 - RNA, 19 nt, Homo sapiens
ucaauggucccgagcuguu

SEQ ID NO: 1034604 - RNA, 19 nt, Homo sapiens
aauaaagguauccguggua

SEQ ID NO: 1034605 - RNA, 19 nt, Homo sapiens
gaaugccagggagcaauaa

SEQ ID NO: 1034606 - RNA, 19 nt, Homo sapiens
gagaaggugcuggaaaugg

SEQ ID NO: 1034607 - RNA, 19 nt, Homo sapiens
cugcucuccuggauaguaa

SEQ ID NO: 1034608 - RNA, 19 nt, Homo sapiens
auaaagguauccgugguau

SEQ ID NO: 1034609 - RNA, 19 nt, Homo sapiens
acccugaccucgugucuca

SEQ ID NO: 1034610 - RNA, 19 nt, Homo sapiens
ucugggaguuguaguucuu

SEQ ID NO: 1034611 - RNA, 19 nt, Homo sapiens
caggagaaggugcuggaaa

SEQ ID NO: 1034612 - RNA, 19 nt, Homo sapiens
acgcaucccuucucaacuc

SEQ ID NO: 1034613 - RNA, 19 nt, Homo sapiens
cuugagaaccaauaccaaa

SEQ ID NO: 1034614 - RNA, 19 nt, Homo sapiens
gcaugggcuuaggauguga

SEQ ID NO: 1034615 - RNA, 19 nt, Homo sapiens
guugggagauugaguuuuc

SEQ ID NO: 1034616 - RNA, 19 nt, Homo sapiens
ggacacaggggacaucuuc

SEQ ID NO: 1034617 - RNA, 19 nt, Homo sapiens
ugggcgacauugccacuga

SEQ ID NO: 1034618 - RNA, 19 nt, Homo sapiens
ggauaguaacccuuucaca

SEQ ID NO: 1034619 - RNA, 19 nt, Homo sapiens
ucuacuaccucaccaagac

SEQ ID NO: 1034620 - RNA, 19 nt, Homo sapiens
cugugaaccugcucugugu

SEQ ID NO: 1034621 - RNA, 19 nt, Homo sapiens
guggaauguugggagauug

SEQ ID NO: 1034622 - RNA, 19 nt, Homo sapiens
uaucccgcguggaauguug

SEQ ID NO: 1034623 - RNA, 19 nt, Homo sapiens
gggccaugccuccaggauu

SEQ ID NO: 1034624 - RNA, 19 nt, Homo sapiens
ugccugcucuccuggauag

SEQ ID NO: 1034625 - RNA, 19 nt, Homo sapiens
ugacuuggaauuaugugau

SEQ ID NO: 1034626 - RNA, 19 nt, Homo sapiens
caaugacuuggaauuaugu

SEQ ID NO: 1034627 - RNA, 19 nt, Homo sapiens
ggaguuguaguucuuaucc

SEQ ID NO: 1034628 - RNA, 19 nt, Homo sapiens
gcggaagcgucccuacuga

SEQ ID NO: 1034629 - RNA, 19 nt, Homo sapiens
gcuccuuccuccagaguga

SEQ ID NO: 1034630 - RNA, 19 nt, Homo sapiens
ggccucggcuucacaggau

SEQ ID NO: 1034631 - RNA, 19 nt, Homo sapiens
ucccugcccugaacacuca

SEQ ID NO: 1034632 - RNA, 19 nt, Homo sapiens
caagggccagggagcgauu

SEQ ID NO: 1034633 - RNA, 19 nt, Homo sapiens
gaaggaaacuggacucuua

SEQ ID NO: 1034634 - RNA, 19 nt, Homo sapiens
gaaacuccgucucuacuaa

SEQ ID NO: 1034635 - RNA, 19 nt, Homo sapiens
gacaagugauaccuaauua

SEQ ID NO: 1034636 - RNA, 19 nt, Homo sapiens
gaaaaugucugcaaacuau

SEQ ID NO: 1034637 - RNA, 19 nt, Homo sapiens
acaugaagcugcacacaua

SEQ ID NO: 1034638 - RNA, 19 nt, Homo sapiens
ccacagaccuugucagaag

SEQ ID NO: 1034639 - RNA, 19 nt, Homo sapiens
gauagauggugcugggaua

SEQ ID NO: 1034640 - RNA, 19 nt, Homo sapiens
gcaagacgucaaacuauaa

SEQ ID NO: 1034641 - RNA, 19 nt, Homo sapiens
gagcagagacauugauuug

SEQ ID NO: 1034642 - RNA, 19 nt, Homo sapiens
gcagagacauugauuuggu

SEQ ID NO: 1034643 - RNA, 19 nt, Homo sapiens
aaagaacgcuggcuaaguc

SEQ ID NO: 1034644 - RNA, 19 nt, Homo sapiens
caaaagcaauugcaacaaa

SEQ ID NO: 1034645 - RNA, 19 nt, Homo sapiens
gacaacgucuucuugacuu

SEQ ID NO: 1034646 - RNA, 19 nt, Homo sapiens
ugcaagacgucaaacuaua

SEQ ID NO: 1034647 - RNA, 19 nt, Homo sapiens
gcaccugaauucucaccaa

SEQ ID NO: 1034648 - RNA, 19 nt, Homo sapiens
aaacagacacccuacagaa

SEQ ID NO: 1034649 - RNA, 19 nt, Homo sapiens
gaaacagacacccuacaga

SEQ ID NO: 1034650 - RNA, 19 nt, Homo sapiens
cuauaaacauccuggaaga

SEQ ID NO: 1034651 - RNA, 19 nt, Homo sapiens
gggauaagcagcucaguca

SEQ ID NO: 1034652 - RNA, 19 nt, Homo sapiens
gaacucaaucccugcaaau

SEQ ID NO: 1034653 - RNA, 19 nt, Homo sapiens
auagacaagugauaccuaa

SEQ ID NO: 1034654 - RNA, 19 nt, Homo sapiens
ggaagcaauauccuuuaaa

SEQ ID NO: 1034655 - RNA, 19 nt, Homo sapiens
ccaccuugcuccuugguau

SEQ ID NO: 1034656 - RNA, 19 nt, Homo sapiens
uuacacaaaucaacaagca

SEQ ID NO: 1034657 - RNA, 19 nt, Homo sapiens
ccuaauauccagcaucuau

SEQ ID NO: 1034658 - RNA, 19 nt, Homo sapiens
aaacuaugcaucugacaaa

SEQ ID NO: 1034659 - RNA, 19 nt, Homo sapiens
auaggacgcuuacacaaau

SEQ ID NO: 1034660 - RNA, 19 nt, Homo sapiens
uaaacauccuggaagacaa

SEQ ID NO: 1034661 - RNA, 19 nt, Homo sapiens
caaaugcugacccuacaaa

SEQ ID NO: 1034662 - RNA, 19 nt, Homo sapiens
gaacaaugggacugacuca

SEQ ID NO: 1034663 - RNA, 19 nt, Homo sapiens
caaggagcaggaagcaaua

SEQ ID NO: 1034664 - RNA, 19 nt, Homo sapiens
guccuuauuucaccuagaa

SEQ ID NO: 1034665 - RNA, 19 nt, Homo sapiens
gauuaaagacucaaaugca

SEQ ID NO: 1034666 - RNA, 19 nt, Homo sapiens
gggacugacucaccugugu

SEQ ID NO: 1034667 - RNA, 19 nt, Homo sapiens
ggaagagaaugagcugucu

SEQ ID NO: 1034668 - RNA, 19 nt, Homo sapiens
gugaaacucugucucaaaa

SEQ ID NO: 1034669 - RNA, 19 nt, Homo sapiens
acacaaaucaacaagcaaa

SEQ ID NO: 1034670 - RNA, 19 nt, Homo sapiens
agacaagugauaccuaauu

SEQ ID NO: 1034671 - RNA, 19 nt, Homo sapiens
uauaggacgcuuacacaaa

SEQ ID NO: 1034672 - RNA, 19 nt, Homo sapiens
cagagacauugauuugguu

SEQ ID NO: 1034673 - RNA, 19 nt, Homo sapiens
caagacgucaaacuauaaa

SEQ ID NO: 1034674 - RNA, 19 nt, Homo sapiens
ucaaaugcaagacgucaaa

SEQ ID NO: 1034675 - RNA, 19 nt, Homo sapiens
gauaagcagcucagucaca

SEQ ID NO: 1034676 - RNA, 19 nt, Homo sapiens
ggcgggugcugugcuauuu

SEQ ID NO: 1034677 - RNA, 19 nt, Homo sapiens
ggccuaauauccagcaucu

SEQ ID NO: 1034678 - RNA, 19 nt, Homo sapiens
gacaaaggccuaauaucca

SEQ ID NO: 1034679 - RNA, 19 nt, Homo sapiens
ugacaaaggccuaauaucc

SEQ ID NO: 1034680 - RNA, 19 nt, Homo sapiens
agacauugauuugguuuca

SEQ ID NO: 1034681 - RNA, 19 nt, Homo sapiens
ucaaggagcaggaagcaau

SEQ ID NO: 1034682 - RNA, 19 nt, Homo sapiens
ccagagaagcccagacguu

SEQ ID NO: 1034683 - RNA, 19 nt, Homo sapiens
gcaggagaauggcgugaac

SEQ ID NO: 1034684 - RNA, 19 nt, Homo sapiens
uaaagacucaaaugcaaga

SEQ ID NO: 1034685 - RNA, 19 nt, Homo sapiens
gagugcagcagacccagua

SEQ ID NO: 1034686 - RNA, 19 nt, Homo sapiens
gagaaugagcugucuuugg

SEQ ID NO: 1034687 - RNA, 19 nt, Homo sapiens
ggaaacagacacccuacag

SEQ ID NO: 1034688 - RNA, 19 nt, Homo sapiens
gcaaagaacgcuggcuaag

SEQ ID NO: 1034689 - RNA, 19 nt, Homo sapiens
ccugaauucucaccaacuu

SEQ ID NO: 1034690 - RNA, 19 nt, Homo sapiens
cucaaucccugcaaaugaa

SEQ ID NO: 1034691 - RNA, 19 nt, Homo sapiens
acucuuacccuuccgcaua

SEQ ID NO: 1034692 - RNA, 19 nt, Homo sapiens
acacccgucuggucuuuga

SEQ ID NO: 1034693 - RNA, 19 nt, Homo sapiens
gaacagaauagaaaacuca

SEQ ID NO: 1034694 - RNA, 19 nt, Homo sapiens
gggagaaaaugucugcaaa

SEQ ID NO: 1034695 - RNA, 19 nt, Homo sapiens
caaagaacgcuggcuaagu

SEQ ID NO: 1034696 - RNA, 19 nt, Homo sapiens
ggcaaagaacgcuggcuaa

SEQ ID NO: 1034697 - RNA, 19 nt, Homo sapiens
auaggcaccugaauucuca

SEQ ID NO: 1034698 - RNA, 19 nt, Homo sapiens
gaucggccauacauuucug

SEQ ID NO: 1034699 - RNA, 19 nt, Homo sapiens
agaacucaaucccugcaaa

SEQ ID NO: 1034700 - RNA, 19 nt, Homo sapiens
ucgagaccauccuggcuaa

SEQ ID NO: 1034701 - RNA, 19 nt, Homo sapiens
gccgauaggcaccugaauu

SEQ ID NO: 1034702 - RNA, 19 nt, Homo sapiens
gcuauuuucuguccuuauu

SEQ ID NO: 1034703 - RNA, 19 nt, Homo sapiens
cuaauauccagcaucuaua

SEQ ID NO: 1034704 - RNA, 19 nt, Homo sapiens
caaacuaugcaucugacaa

SEQ ID NO: 1034705 - RNA, 19 nt, Homo sapiens
acagacacccuacagaaug

SEQ ID NO: 1034706 - RNA, 19 nt, Homo sapiens
aaaaucaacucuagaugga

SEQ ID NO: 1034707 - RNA, 19 nt, Homo sapiens
ggacaaagccccaggaacu

SEQ ID NO: 1034708 - RNA, 19 nt, Homo sapiens
gagccuccguucagucagu

SEQ ID NO: 1034709 - RNA, 19 nt, Homo sapiens
ccauacauuucugcucauu

SEQ ID NO: 1034710 - RNA, 19 nt, Homo sapiens
uaacgccccuuuucaguau

SEQ ID NO: 1034711 - RNA, 19 nt, Homo sapiens
gcaaaugcugacccuacaa

SEQ ID NO: 1034712 - RNA, 19 nt, Homo sapiens
ugaaggccguggugucuac

SEQ ID NO: 1034713 - RNA, 19 nt, Homo sapiens
gccguucacuucuguaagg

SEQ ID NO: 1034714 - RNA, 19 nt, Homo sapiens
ccgauaggcaccugaauuc

SEQ ID NO: 1034715 - RNA, 19 nt, Homo sapiens
ugaaacuccgucucuacua

SEQ ID NO: 1034716 - RNA, 19 nt, Homo sapiens
gaucacaaggucaggagau

SEQ ID NO: 1034717 - RNA, 19 nt, Homo sapiens
uaauauccagcaucuauag

SEQ ID NO: 1034718 - RNA, 19 nt, Homo sapiens
gauaggcaccugaauucuc

SEQ ID NO: 1034719 - RNA, 19 nt, Homo sapiens
gucaggagaucgagaccau

SEQ ID NO: 1034720 - RNA, 19 nt, Homo sapiens
cagacacccuacagaaugg

SEQ ID NO: 1034721 - RNA, 19 nt, Homo sapiens
acaacgucuucuugacuuu

SEQ ID NO: 1034722 - RNA, 19 nt, Homo sapiens
aaugcaagacgucaaacua

SEQ ID NO: 1034723 - RNA, 19 nt, Homo sapiens
ggauuaaagacucaaaugc

SEQ ID NO: 1034724 - RNA, 19 nt, Homo sapiens
gaggaggagcuugcaguga

SEQ ID NO: 1034725 - RNA, 19 nt, Homo sapiens
gccguggugucuacugaga

SEQ ID NO: 1034726 - RNA, 19 nt, Homo sapiens
ucagacacacggaacaaug

SEQ ID NO: 1034727 - RNA, 19 nt, Homo sapiens
acucaaucccugcaaauga

SEQ ID NO: 1034728 - RNA, 19 nt, Homo sapiens
auacacccgucuggucuuu

SEQ ID NO: 1034729 - RNA, 19 nt, Homo sapiens
agaggcagaugacaaacca

SEQ ID NO: 1034730 - RNA, 19 nt, Homo sapiens
gagcggagaaagcuugaag

SEQ ID NO: 1034731 - RNA, 19 nt, Homo sapiens
cauacauuucugcucauua

SEQ ID NO: 1034732 - RNA, 19 nt, Homo sapiens
aaacuccgucucuacuaaa

SEQ ID NO: 1034733 - RNA, 19 nt, Homo sapiens
ggaaagagauucaacaaca

SEQ ID NO: 1034734 - RNA, 19 nt, Homo sapiens
gacaaagccuguacacaua

SEQ ID NO: 1034735 - RNA, 19 nt, Homo sapiens
gagagaggcuucacuaaga

SEQ ID NO: 1034736 - RNA, 19 nt, Homo sapiens
aaacaaggcuuuacagaga

SEQ ID NO: 1034737 - RNA, 19 nt, Homo sapiens
gggaaaaucuucaacaaua

SEQ ID NO: 1034738 - RNA, 19 nt, Homo sapiens
ucgguaaacugucagauua

SEQ ID NO: 1034739 - RNA, 19 nt, Homo sapiens
caacagaccuacugacuac

SEQ ID NO: 1034740 - RNA, 19 nt, Homo sapiens
ggacaaagccuguacacau

SEQ ID NO: 1034741 - RNA, 19 nt, Homo sapiens
gcuguaggauccauaaauu

SEQ ID NO: 1034742 - RNA, 19 nt, Homo sapiens
caacaacaguucccaguuc

SEQ ID NO: 1034743 - RNA, 19 nt, Homo sapiens
ggaaggaagagaugcguua

SEQ ID NO: 1034744 - RNA, 19 nt, Homo sapiens
gaagaugagucaccagagu

SEQ ID NO: 1034745 - RNA, 19 nt, Homo sapiens
guuaagccauuggauaaua

SEQ ID NO: 1034746 - RNA, 19 nt, Homo sapiens
cugauugucucuuaaagua

SEQ ID NO: 1034747 - RNA, 19 nt, Homo sapiens
gaaagcacauguaaaaguu

SEQ ID NO: 1034748 - RNA, 19 nt, Homo sapiens
acacagggcugagaaagaa

SEQ ID NO: 1034749 - RNA, 19 nt, Homo sapiens
agaaggcaauguagaaauu

SEQ ID NO: 1034750 - RNA, 19 nt, Homo sapiens
gaagagaugcguuaugagu

SEQ ID NO: 1034751 - RNA, 19 nt, Homo sapiens
caaccucacugcccaccua

SEQ ID NO: 1034752 - RNA, 19 nt, Homo sapiens
ggauaauacugaaucuguu

SEQ ID NO: 1034753 - RNA, 19 nt, Homo sapiens
cagaggaaguagaaauaaa

SEQ ID NO: 1034754 - RNA, 19 nt, Homo sapiens
gaaagagauucaacaacag

SEQ ID NO: 1034755 - RNA, 19 nt, Homo sapiens
gcgagaagccucacaagug

SEQ ID NO: 1034756 - RNA, 19 nt, Homo sapiens
gggccugaaucucuucuaa

SEQ ID NO: 1034757 - RNA, 19 nt, Homo sapiens
gcaacagaccuacugacua

SEQ ID NO: 1034758 - RNA, 19 nt, Homo sapiens
aaagaaggaaggaugguua

SEQ ID NO: 1034759 - RNA, 19 nt, Homo sapiens
aaaguuugauggagagaaa

SEQ ID NO: 1034760 - RNA, 19 nt, Homo sapiens
aacaauagcucccacuuca

SEQ ID NO: 1034761 - RNA, 19 nt, Homo sapiens
aggaagagaugcguuauga

SEQ ID NO: 1034762 - RNA, 19 nt, Homo sapiens
ggaccaggagucagcauaa

SEQ ID NO: 1034763 - RNA, 19 nt, Homo sapiens
agagaugcguuaugaguga

SEQ ID NO: 1034764 - RNA, 19 nt, Homo sapiens
ggagaggcccuaucagugu

SEQ ID NO: 1034765 - RNA, 19 nt, Homo sapiens
gaaagcaguacucucauca

SEQ ID NO: 1034766 - RNA, 19 nt, Homo sapiens
guaagugguuuauagacau

SEQ ID NO: 1034767 - RNA, 19 nt, Homo sapiens
ucaagaaggcaauguagaa

SEQ ID NO: 1034768 - RNA, 19 nt, Homo sapiens
ugacuuaaccuuagagcaa

SEQ ID NO: 1034769 - RNA, 19 nt, Homo sapiens
ggaaguagaaauaaacaag

SEQ ID NO: 1034770 - RNA, 19 nt, Homo sapiens
gagaaaguccagaggaguu

SEQ ID NO: 1034771 - RNA, 19 nt, Homo sapiens
caugaaagcaguacucuca

SEQ ID NO: 1034772 - RNA, 19 nt, Homo sapiens
ccgaaguucuuaucuuguu

SEQ ID NO: 1034773 - RNA, 19 nt, Homo sapiens
gaaagaaggaaggaugguu

SEQ ID NO: 1034774 - RNA, 19 nt, Homo sapiens
caucagacaguacacauga

SEQ ID NO: 1034775 - RNA, 19 nt, Homo sapiens
ggagagcccauacaagugu

SEQ ID NO: 1034776 - RNA, 19 nt, Homo sapiens
gaaaguccagaggaguuua

SEQ ID NO: 1034777 - RNA, 19 nt, Homo sapiens
aagcacaacauccagguua

SEQ ID NO: 1034778 - RNA, 19 nt, Homo sapiens
gaaucuguuucccuaagug

SEQ ID NO: 1034779 - RNA, 19 nt, Homo sapiens
caagaaggcaauguagaaa

SEQ ID NO: 1034780 - RNA, 19 nt, Homo sapiens
agagaggcuucacuaagaa

SEQ ID NO: 1034781 - RNA, 19 nt, Homo sapiens
gaaagcuguaggauccaua

SEQ ID NO: 1034782 - RNA, 19 nt, Homo sapiens
ugaaagcaguacucucauc

SEQ ID NO: 1034783 - RNA, 19 nt, Homo sapiens
gccauuggauaauacugaa

SEQ ID NO: 1034784 - RNA, 19 nt, Homo sapiens
gguaaacugucagauuaag

SEQ ID NO: 1034785 - RNA, 19 nt, Homo sapiens
caacaauagcucccacuuc

SEQ ID NO: 1034786 - RNA, 19 nt, Homo sapiens
gugagucgguaaacuguca

SEQ ID NO: 1034787 - RNA, 19 nt, Homo sapiens
ggaaaaucuucaacaauag

SEQ ID NO: 1034788 - RNA, 19 nt, Homo sapiens
auacaagugugcagugugu

SEQ ID NO: 1034789 - RNA, 19 nt, Homo sapiens
cuaggcacccaccguaaua

SEQ ID NO: 1034790 - RNA, 19 nt, Homo sapiens
guuaagggccugaaucucu

SEQ ID NO: 1034791 - RNA, 19 nt, Homo sapiens
caaagccuguacacauauc

SEQ ID NO: 1034792 - RNA, 19 nt, Homo sapiens
gcgggaagggcuuuaguga

SEQ ID NO: 1034793 - RNA, 19 nt, Homo sapiens
gccugaaucucuucuaaac

SEQ ID NO: 1034794 - RNA, 19 nt, Homo sapiens
uuaagggccugaaucucuu

SEQ ID NO: 1034795 - RNA, 19 nt, Homo sapiens
ccagaguccuaucuuacug

SEQ ID NO: 1034796 - RNA, 19 nt, Homo sapiens
gcauguaugagcuuucuuc

SEQ ID NO: 1034797 - RNA, 19 nt, Homo sapiens
gaaggaagagaugcguuau

SEQ ID NO: 1034798 - RNA, 19 nt, Homo sapiens
cugaaucucuucuaaacca

SEQ ID NO: 1034799 - RNA, 19 nt, Homo sapiens
acaaggcuuuacagagaaa

SEQ ID NO: 1034800 - RNA, 19 nt, Homo sapiens
ggagagugagccaacauca

SEQ ID NO: 1034801 - RNA, 19 nt, Homo sapiens
uagccgaaguucuuaucuu

SEQ ID NO: 1034802 - RNA, 19 nt, Homo sapiens
guuccugauugucucuuaa

SEQ ID NO: 1034803 - RNA, 19 nt, Homo sapiens
caacauccagguuaauuuu

SEQ ID NO: 1034804 - RNA, 19 nt, Homo sapiens
uaacccagccaccaccaaa

SEQ ID NO: 1034805 - RNA, 19 nt, Homo sapiens
caauagcucccacuucagu

SEQ ID NO: 1034806 - RNA, 19 nt, Homo sapiens
gcacaacauccagguuaau

SEQ ID NO: 1034807 - RNA, 19 nt, Homo sapiens
gcacccagugguccaagaa

SEQ ID NO: 1034808 - RNA, 19 nt, Homo sapiens
ccauaaauucuaccaggaa

SEQ ID NO: 1034809 - RNA, 19 nt, Homo sapiens
guaggauccauaaauucua

SEQ ID NO: 1034810 - RNA, 19 nt, Homo sapiens
aagcaguacucucaucaca

SEQ ID NO: 1034811 - RNA, 19 nt, Homo sapiens
gagagugagccaacaucaa

SEQ ID NO: 1034812 - RNA, 19 nt, Homo sapiens
agccgaaguucuuaucuug

SEQ ID NO: 1034813 - RNA, 19 nt, Homo sapiens
ugguuaagccauuggauaa

SEQ ID NO: 1034814 - RNA, 19 nt, Homo sapiens
ggaaagcacauguaaaagu

SEQ ID NO: 1034815 - RNA, 19 nt, Homo sapiens
ccacaagccagcgcucaaa

SEQ ID NO: 1034816 - RNA, 19 nt, Homo sapiens
ucagacaguacacaugaaa

SEQ ID NO: 1034817 - RNA, 19 nt, Homo sapiens
gaaaagccuuacagguguu

SEQ ID NO: 1034818 - RNA, 19 nt, Homo sapiens
guaucucaauguccugaau

SEQ ID NO: 1034819 - RNA, 19 nt, Homo sapiens
agaaagaaagugucuccuu

SEQ ID NO: 1034820 - RNA, 19 nt, Homo sapiens
gaaggcaauguagaaauuc

SEQ ID NO: 1034821 - RNA, 19 nt, Homo sapiens
acaacauccagguuaauuu

SEQ ID NO: 1034822 - RNA, 19 nt, Homo sapiens
ugagagaggcuucacuaag

SEQ ID NO: 1034823 - RNA, 19 nt, Homo sapiens
cauugucuguggaaagaga

SEQ ID NO: 1034824 - RNA, 19 nt, Homo sapiens
aguaagugguuuauagaca

SEQ ID NO: 1034825 - RNA, 19 nt, Homo sapiens
gaaggaaggaugguuaagc

SEQ ID NO: 1034826 - RNA, 19 nt, Homo sapiens
gggcugagaaagaaagugu

SEQ ID NO: 1034827 - RNA, 19 nt, Homo sapiens
gaccaggagucagcauaag

SEQ ID NO: 1034828 - RNA, 19 nt, Homo sapiens
gaggaaguagaaauaaaca

SEQ ID NO: 1034829 - RNA, 19 nt, Homo sapiens
cgaaguucuuaucuuguuc

SEQ ID NO: 1034830 - RNA, 19 nt, Homo sapiens
cacaacauccagguuaauu

SEQ ID NO: 1034831 - RNA, 19 nt, Homo sapiens
ggagagaaagcuguaggau

SEQ ID NO: 1034832 - RNA, 19 nt, Homo sapiens
cagcauguaugagcuuucu

SEQ ID NO: 1034833 - RNA, 19 nt, Homo sapiens
ccacaacccuggcggaaua

SEQ ID NO: 1034834 - RNA, 19 nt, Homo sapiens
gaaaugugcuccuucaauc

SEQ ID NO: 1034835 - RNA, 19 nt, Homo sapiens
ggaggaagaugccgacugu

SEQ ID NO: 1034836 - RNA, 19 nt, Homo sapiens
gaucucaguuugcuccuuu

SEQ ID NO: 1034837 - RNA, 19 nt, Homo sapiens
ggagagaaaucagacuuug

SEQ ID NO: 1034838 - RNA, 19 nt, Homo sapiens
ggaaauggagagacaguaa

SEQ ID NO: 1034839 - RNA, 19 nt, Homo sapiens
agguuuagcugcucauuua

SEQ ID NO: 1034840 - RNA, 19 nt, Homo sapiens
gaucgaaagccugaaauaa

SEQ ID NO: 1034841 - RNA, 19 nt, Homo sapiens
guacugcccugccaucuca

SEQ ID NO: 1034842 - RNA, 19 nt, Homo sapiens
caaggcgcauauuaaauuu

SEQ ID NO: 1034843 - RNA, 19 nt, Homo sapiens
cgacauugaugaugaagau

SEQ ID NO: 1034844 - RNA, 19 nt, Homo sapiens
uaaucucacugcuuaauga

SEQ ID NO: 1034845 - RNA, 19 nt, Homo sapiens
ggacuauccuauuaagugu

SEQ ID NO: 1034846 - RNA, 19 nt, Homo sapiens
ucaaggcgcauauuaaauu

SEQ ID NO: 1034847 - RNA, 19 nt, Homo sapiens
ucgaaagccugaaauaaau

SEQ ID NO: 1034848 - RNA, 19 nt, Homo sapiens
gagaguaacccuccacaga

SEQ ID NO: 1034849 - RNA, 19 nt, Homo sapiens
aaacuaaagugccuuccaa

SEQ ID NO: 1034850 - RNA, 19 nt, Homo sapiens
ggagauguaugcauuucga

SEQ ID NO: 1034851 - RNA, 19 nt, Homo sapiens
gcucagauuugcuuuacga

SEQ ID NO: 1034852 - RNA, 19 nt, Homo sapiens
cuaaagugccuuccaauga

SEQ ID NO: 1034853 - RNA, 19 nt, Homo sapiens
gaguaacccuccacagaau

SEQ ID NO: 1034854 - RNA, 19 nt, Homo sapiens
ggagagacaguaaaggaaa

SEQ ID NO: 1034855 - RNA, 19 nt, Homo sapiens
caaugucgaugcuucaguu

SEQ ID NO: 1034856 - RNA, 19 nt, Homo sapiens
gaaauggagagacaguaaa

SEQ ID NO: 1034857 - RNA, 19 nt, Homo sapiens
ucugaaagguggaauccua

SEQ ID NO: 1034858 - RNA, 19 nt, Homo sapiens
guucacaagugcugcauau

SEQ ID NO: 1034859 - RNA, 19 nt, Homo sapiens
ggaagaugccgacuguuau

SEQ ID NO: 1034860 - RNA, 19 nt, Homo sapiens
ucaguuauguucaggaaau

SEQ ID NO: 1034861 - RNA, 19 nt, Homo sapiens
uagcugcucauuuacauua

SEQ ID NO: 1034862 - RNA, 19 nt, Homo sapiens
ccaccuaccuucagauucu

SEQ ID NO: 1034863 - RNA, 19 nt, Homo sapiens
ggaucgaaagccugaaaua

SEQ ID NO: 1034864 - RNA, 19 nt, Homo sapiens
gugcuaagccugaugaaau

SEQ ID NO: 1034865 - RNA, 19 nt, Homo sapiens
guggagggcuuccggauca

SEQ ID NO: 1034866 - RNA, 19 nt, Homo sapiens
gaagaugccgacuguuaug

SEQ ID NO: 1034867 - RNA, 19 nt, Homo sapiens
ggugaauucuguuucuuuc

SEQ ID NO: 1034868 - RNA, 19 nt, Homo sapiens
caacagcucagauuugcuu

SEQ ID NO: 1034869 - RNA, 19 nt, Homo sapiens
gacaaagaauaugcugaaa

SEQ ID NO: 1034870 - RNA, 19 nt, Homo sapiens
cgaaagccugaaauaaaua

SEQ ID NO: 1034871 - RNA, 19 nt, Homo sapiens
caucagggacuuugugcua

SEQ ID NO: 1034872 - RNA, 19 nt, Homo sapiens
aggaagaugccgacuguua

SEQ ID NO: 1034873 - RNA, 19 nt, Homo sapiens
gacaacagcucagauuugc

SEQ ID NO: 1034874 - RNA, 19 nt, Homo sapiens
ggaauccuacucagaaugu

SEQ ID NO: 1034875 - RNA, 19 nt, Homo sapiens
gguggaauccuacucagaa

SEQ ID NO: 1034876 - RNA, 19 nt, Homo sapiens
ugacaacagcucagauuug

SEQ ID NO: 1034877 - RNA, 19 nt, Homo sapiens
uaaagugccuuccaaugac

SEQ ID NO: 1034878 - RNA, 19 nt, Homo sapiens
ugacgacauugaugaugaa

SEQ ID NO: 1034879 - RNA, 19 nt, Homo sapiens
agacaaagaauaugcugaa

SEQ ID NO: 1034880 - RNA, 19 nt, Homo sapiens
uuaaugagcccaacaccuu

SEQ ID NO: 1034881 - RNA, 19 nt, Homo sapiens
agagaaaucagacuuuguu

SEQ ID NO: 1034882 - RNA, 19 nt, Homo sapiens
gaugccgacuguuaugaug

SEQ ID NO: 1034883 - RNA, 19 nt, Homo sapiens
gaccuuuaauggagagaga

SEQ ID NO: 1034884 - RNA, 19 nt, Homo sapiens
gagaaaucagacuuuguuu

SEQ ID NO: 1034885 - RNA, 19 nt, Homo sapiens
gaauucuguuucuuuccuu

SEQ ID NO: 1034886 - RNA, 19 nt, Homo sapiens
ugucgaugcuucaguuaug

SEQ ID NO: 1034887 - RNA, 19 nt, Homo sapiens
ccuuauggaucucaguuug

SEQ ID NO: 1034888 - RNA, 19 nt, Homo sapiens
cuucaaggcgcauauuaaa

SEQ ID NO: 1034889 - RNA, 19 nt, Homo sapiens
gcauauacuggguagcaaa

SEQ ID NO: 1034890 - RNA, 19 nt, Homo sapiens
uacagaauguucacagcaa

SEQ ID NO: 1034891 - RNA, 19 nt, Homo sapiens
cgacuguuaugaugaugau

SEQ ID NO: 1034892 - RNA, 19 nt, Homo sapiens
guaugcauuucgauucuuc

SEQ ID NO: 1034893 - RNA, 19 nt, Homo sapiens
gauguaugcauuucgauuc

SEQ ID NO: 1034894 - RNA, 19 nt, Homo sapiens
uuaugagaauggagaugua

SEQ ID NO: 1034895 - RNA, 19 nt, Homo sapiens
gaggagagaaaucagacuu

SEQ ID NO: 1034896 - RNA, 19 nt, Homo sapiens
acagaauguucacagcaaa

SEQ ID NO: 1034897 - RNA, 19 nt, Homo sapiens
agaguaacccuccacagaa

SEQ ID NO: 1034898 - RNA, 19 nt, Homo sapiens
ucacaagugcugcauauac

SEQ ID NO: 1034899 - RNA, 19 nt, Homo sapiens
gcgcauauuaaauuuccua

SEQ ID NO: 1034900 - RNA, 19 nt, Homo sapiens
gagagaaaucagacuuugu

SEQ ID NO: 1034901 - RNA, 19 nt, Homo sapiens
gguggugaauucuguuucu

SEQ ID NO: 1034902 - RNA, 19 nt, Homo sapiens
cacaagugcugcauauacu

SEQ ID NO: 1034903 - RNA, 19 nt, Homo sapiens
cuucgucucuacagaaugu

SEQ ID NO: 1034904 - RNA, 19 nt, Homo sapiens
ucacuucgucucuacagaa

SEQ ID NO: 1034905 - RNA, 19 nt, Homo sapiens
gagagacaguaaaggaaaa

SEQ ID NO: 1034906 - RNA, 19 nt, Homo sapiens
guuaugaugaugaugauuc

SEQ ID NO: 1034907 - RNA, 19 nt, Homo sapiens
uacgacgacuuguaugaug

SEQ ID NO: 1034908 - RNA, 19 nt, Homo sapiens
cagcucagauuugcuuuac

SEQ ID NO: 1034909 - RNA, 19 nt, Homo sapiens
ggcggaauacugcaucaaa

SEQ ID NO: 1034910 - RNA, 19 nt, Homo sapiens
ccaugguggugaauucugu

SEQ ID NO: 1034911 - RNA, 19 nt, Homo sapiens
caaacucccgccucacuuc

SEQ ID NO: 1034912 - RNA, 19 nt, Homo sapiens
gcggaauacugcaucaaaa

SEQ ID NO: 1034913 - RNA, 19 nt, Homo sapiens
ccaugaaaccaucguaaca

SEQ ID NO: 1034914 - RNA, 19 nt, Homo sapiens
ugcuaagccugaugaaaug

SEQ ID NO: 1034915 - RNA, 19 nt, Homo sapiens
caaauuugccaagguuuag

SEQ ID NO: 1034916 - RNA, 19 nt, Homo sapiens
gcuuuacgacgacuuguau

SEQ ID NO: 1034917 - RNA, 19 nt, Homo sapiens
guaaucucacugcuuaaug

SEQ ID NO: 1034918 - RNA, 19 nt, Homo sapiens
aucgaaagccugaaauaaa

SEQ ID NO: 1034919 - RNA, 19 nt, Homo sapiens
cuucaguuauguucaggaa

SEQ ID NO: 1034920 - RNA, 19 nt, Homo sapiens
guggaauccuacucagaau

SEQ ID NO: 1034921 - RNA, 19 nt, Homo sapiens
aaagugccuuccaaugaca

SEQ ID NO: 1034922 - RNA, 19 nt, Homo sapiens
augaaaccaucguaacaug

SEQ ID NO: 1034923 - RNA, 19 nt, Homo sapiens
augacgacauugaugauga

SEQ ID NO: 1034924 - RNA, 19 nt, Homo sapiens
cuuguaugaugacgacauu

SEQ ID NO: 1034925 - RNA, 19 nt, Homo sapiens
aaugacaacagcucagauu

SEQ ID NO: 1034926 - RNA, 19 nt, Homo sapiens
gaauacugcaucaaaacua

SEQ ID NO: 1034927 - RNA, 19 nt, Homo sapiens
gaaaagacaaagaauaugc

SEQ ID NO: 1034928 - RNA, 19 nt, Homo sapiens
acgacgacuuguaugauga

SEQ ID NO: 1034929 - RNA, 19 nt, Homo sapiens
acccuuccaucacuauauu

SEQ ID NO: 1034930 - RNA, 19 nt, Homo sapiens
uguaugaugacgacauuga

SEQ ID NO: 1034931 - RNA, 19 nt, Homo sapiens
aguccgaccucuacaacug

SEQ ID NO: 1034932 - RNA, 19 nt, Homo sapiens
aaagguggaauccuacuca

SEQ ID NO: 1034933 - RNA, 19 nt, Homo sapiens
caagugagauaagguauuu

SEQ ID NO: 1034934 - RNA, 19 nt, Homo sapiens
gauaaaaccucuauaguga

SEQ ID NO: 1034935 - RNA, 19 nt, Homo sapiens
gaagaccacuaaagagaga

SEQ ID NO: 1034936 - RNA, 19 nt, Homo sapiens
gcagaaucauuucacguuu

SEQ ID NO: 1034937 - RNA, 19 nt, Homo sapiens
gaagagaagaccacuaaug

SEQ ID NO: 1034938 - RNA, 19 nt, Homo sapiens
aagcaaaguucaagcgaua

SEQ ID NO: 1034939 - RNA, 19 nt, Homo sapiens
gagaagaccacuaaagaga

SEQ ID NO: 1034940 - RNA, 19 nt, Homo sapiens
gagaagaccacuaaugaga

SEQ ID NO: 1034941 - RNA, 19 nt, Homo sapiens
ccaaaauucuucaguguua

SEQ ID NO: 1034942 - RNA, 19 nt, Homo sapiens
aaacagagcaugcuugaga

SEQ ID NO: 1034943 - RNA, 19 nt, Homo sapiens
gaagaccacuaaugagaag

SEQ ID NO: 1034944 - RNA, 19 nt, Homo sapiens
caacuugcacugaccauaa

SEQ ID NO: 1034945 - RNA, 19 nt, Homo sapiens
gcucagaguucuacagagu

SEQ ID NO: 1034946 - RNA, 19 nt, Homo sapiens
gaagaucagaaacgacuaa

SEQ ID NO: 1034947 - RNA, 19 nt, Homo sapiens
gaaagaauccgaagaucag

SEQ ID NO: 1034948 - RNA, 19 nt, Homo sapiens
gaaccuccacccuaacaaa

SEQ ID NO: 1034949 - RNA, 19 nt, Homo sapiens
caagaaagaauccgaagau

SEQ ID NO: 1034950 - RNA, 19 nt, Homo sapiens
cuaaugagaagaccacuaa

SEQ ID NO: 1034951 - RNA, 19 nt, Homo sapiens
gaacaagccccaucauuug

SEQ ID NO: 1034952 - RNA, 19 nt, Homo sapiens
uuaguaaacccucuuauga

SEQ ID NO: 1034953 - RNA, 19 nt, Homo sapiens
cugaagagguggaagcaaa

SEQ ID NO: 1034954 - RNA, 19 nt, Homo sapiens
gagaggagcucagaguucu

SEQ ID NO: 1034955 - RNA, 19 nt, Homo sapiens
gagaaagaccgagugcuaa

SEQ ID NO: 1034956 - RNA, 19 nt, Homo sapiens
cuaggcagcuggaagagaa

SEQ ID NO: 1034957 - RNA, 19 nt, Homo sapiens
aaauguaccucuucuacug

SEQ ID NO: 1034958 - RNA, 19 nt, Homo sapiens
agagagacaucaagaaugg

SEQ ID NO: 1034959 - RNA, 19 nt, Homo sapiens
aagagaagaccacuaauga

SEQ ID NO: 1034960 - RNA, 19 nt, Homo sapiens
gcaggaugcauucuacaaa

SEQ ID NO: 1034961 - RNA, 19 nt, Homo sapiens
uuacuucacucacuaucaa

SEQ ID NO: 1034962 - RNA, 19 nt, Homo sapiens
aguaaacccucuuaugaug

SEQ ID NO: 1034963 - RNA, 19 nt, Homo sapiens
ggacgagaaugagaacauc

SEQ ID NO: 1034964 - RNA, 19 nt, Homo sapiens
caaaacaccaucaacguua

SEQ ID NO: 1034965 - RNA, 19 nt, Homo sapiens
agucaccacugaacaauau

SEQ ID NO: 1034966 - RNA, 19 nt, Homo sapiens
gaacagcagcaguuugaag

SEQ ID NO: 1034967 - RNA, 19 nt, Homo sapiens
caacguuaauuccagagau

SEQ ID NO: 1034968 - RNA, 19 nt, Homo sapiens
ccaaacagagcaugcuuga

SEQ ID NO: 1034969 - RNA, 19 nt, Homo sapiens
agagaaagaccgagugcua

SEQ ID NO: 1034970 - RNA, 19 nt, Homo sapiens
agagagggcugcugccaau

SEQ ID NO: 1034971 - RNA, 19 nt, Homo sapiens
ggagcaagccaagaaagaa

SEQ ID NO: 1034972 - RNA, 19 nt, Homo sapiens
ccuccacccuaacaaagua

SEQ ID NO: 1034973 - RNA, 19 nt, Homo sapiens
uaaacccucuuaugaugau

SEQ ID NO: 1034974 - RNA, 19 nt, Homo sapiens
ucagggaucagucauuaaa

SEQ ID NO: 1034975 - RNA, 19 nt, Homo sapiens
aaagagagacaucaagaau

SEQ ID NO: 1034976 - RNA, 19 nt, Homo sapiens
ggagaggagcucagaguuc

SEQ ID NO: 1034977 - RNA, 19 nt, Homo sapiens
gaucagaaacgacuaaagc

SEQ ID NO: 1034978 - RNA, 19 nt, Homo sapiens
uaaagagagacaucaagaa

SEQ ID NO: 1034979 - RNA, 19 nt, Homo sapiens
gaaaacaacccauuugaag

SEQ ID NO: 1034980 - RNA, 19 nt, Homo sapiens
cugaggagcuggcauugga

SEQ ID NO: 1034981 - RNA, 19 nt, Homo sapiens
guaaacccucuuaugauga

SEQ ID NO: 1034982 - RNA, 19 nt, Homo sapiens
gagcucagaguucuacaga

SEQ ID NO: 1034983 - RNA, 19 nt, Homo sapiens
gugaagggcauccggcuuu

SEQ ID NO: 1034984 - RNA, 19 nt, Homo sapiens
gacuaaagcaagccaaaga

SEQ ID NO: 1034985 - RNA, 19 nt, Homo sapiens
cuaaagagagacaucaaga

SEQ ID NO: 1034986 - RNA, 19 nt, Homo sapiens
gcaaaguucaagcgauaug

SEQ ID NO: 1034987 - RNA, 19 nt, Homo sapiens
aagaacagcuggcuagacu

SEQ ID NO: 1034988 - RNA, 19 nt, Homo sapiens
auacucacaucuuuacuuc

SEQ ID NO: 1034989 - RNA, 19 nt, Homo sapiens
gauuauacaggcaagaaga

SEQ ID NO: 1034990 - RNA, 19 nt, Homo sapiens
ggaacgcgcuaaggcaaag

SEQ ID NO: 1034991 - RNA, 19 nt, Homo sapiens
gagcaagccaagaaagaau

SEQ ID NO: 1034992 - RNA, 19 nt, Homo sapiens
gcgguauucuggugcuuau

SEQ ID NO: 1034993 - RNA, 19 nt, Homo sapiens
gguacuuucuauucaacuu

SEQ ID NO: 1034994 - RNA, 19 nt, Homo sapiens
ucagaguucuacagaguca

SEQ ID NO: 1034995 - RNA, 19 nt, Homo sapiens
gcauguugguuuugucuuu

SEQ ID NO: 1034996 - RNA, 19 nt, Homo sapiens
gcacugaccauaaaauguu

SEQ ID NO: 1034997 - RNA, 19 nt, Homo sapiens
ggcaggaaccggaaucaug

SEQ ID NO: 1034998 - RNA, 19 nt, Homo sapiens
uugaagagaagaccacuaa

SEQ ID NO: 1034999 - RNA, 19 nt, Homo sapiens
caggaugcauucuacaaag

SEQ ID NO: 1035000 - RNA, 19 nt, Homo sapiens
aggcaaccuuggcugauaa

SEQ ID NO: 1035001 - RNA, 19 nt, Homo sapiens
uuacaagugagauaaggua

SEQ ID NO: 1035002 - RNA, 19 nt, Homo sapiens
caacccauuugaagagaag

SEQ ID NO: 1035003 - RNA, 19 nt, Homo sapiens
aaacaacccauuugaagag

SEQ ID NO: 1035004 - RNA, 19 nt, Homo sapiens
agaaagaccgagugcuaaa

SEQ ID NO: 1035005 - RNA, 19 nt, Homo sapiens
agaaagaauccgaagauca

SEQ ID NO: 1035006 - RNA, 19 nt, Homo sapiens
guauuaguaaacccucuua

SEQ ID NO: 1035007 - RNA, 19 nt, Homo sapiens
aaaccucuauagugaauac

SEQ ID NO: 1035008 - RNA, 19 nt, Homo sapiens
gcgaggagagagccagaaa

SEQ ID NO: 1035009 - RNA, 19 nt, Homo sapiens
ugaacaagccccaucauuu

SEQ ID NO: 1035010 - RNA, 19 nt, Homo sapiens
gaggagaggagcucagagu

SEQ ID NO: 1035011 - RNA, 19 nt, Homo sapiens
ucuaggcuguggcauguug

SEQ ID NO: 1035012 - RNA, 19 nt, Homo sapiens
uauaugcacugugucaauc

SEQ ID NO: 1035013 - RNA, 19 nt, Homo sapiens
gaaaauguaccucuucuac

SEQ ID NO: 1035014 - RNA, 19 nt, Homo sapiens
gagagagccagaaaacaua

SEQ ID NO: 1035015 - RNA, 19 nt, Homo sapiens
cauuaaaggacacucuuga

SEQ ID NO: 1035016 - RNA, 19 nt, Homo sapiens
gagaaaacaacccauuuga

SEQ ID NO: 1035017 - RNA, 19 nt, Homo sapiens
gcaaaacaccaucaacguu

SEQ ID NO: 1035018 - RNA, 19 nt, Homo sapiens
gagucaccacugaacaaua

SEQ ID NO: 1035019 - RNA, 19 nt, Homo sapiens
gauuacaagugagauaagg

SEQ ID NO: 1035020 - RNA, 19 nt, Homo sapiens
guauaugcacugugucaau

SEQ ID NO: 1035021 - RNA, 19 nt, Homo sapiens
aaaugugauugaucgaaug

SEQ ID NO: 1035022 - RNA, 19 nt, Homo sapiens
caucuuuacuucacucacu

SEQ ID NO: 1035023 - RNA, 19 nt, Homo sapiens
ccaagaaagaauccgaaga

SEQ ID NO: 1035024 - RNA, 19 nt, Homo sapiens
ccucuauagugaauacuca

SEQ ID NO: 1035025 - RNA, 19 nt, Homo sapiens
uaccucuucuacuggaaua

SEQ ID NO: 1035026 - RNA, 19 nt, Homo sapiens
ugucuaggcuguggcaugu

SEQ ID NO: 1035027 - RNA, 19 nt, Homo sapiens
ggagagagccagaaaacau

SEQ ID NO: 1035028 - RNA, 19 nt, Homo sapiens
ucagaaacgacuaaagcaa

SEQ ID NO: 1035029 - RNA, 19 nt, Homo sapiens
agaagaccacuaaugagaa

SEQ ID NO: 1035030 - RNA, 19 nt, Homo sapiens
ugaauacucacaucuuuac

SEQ ID NO: 1035031 - RNA, 19 nt, Homo sapiens
cuccuuugauuauguaaga

SEQ ID NO: 1035032 - RNA, 19 nt, Homo sapiens
uugaacagcagcaguuuga

SEQ ID NO: 1035033 - RNA, 19 nt, Homo sapiens
ggaaaccagacuacaauua

SEQ ID NO: 1035034 - RNA, 19 nt, Homo sapiens
cagaggaucuucgaaagua

SEQ ID NO: 1035035 - RNA, 19 nt, Homo sapiens
gaaaccagacuacaauuau

SEQ ID NO: 1035036 - RNA, 19 nt, Homo sapiens
ggauauaugugcugguaau

SEQ ID NO: 1035037 - RNA, 19 nt, Homo sapiens
gcuggaagcuucaaaggau

SEQ ID NO: 1035038 - RNA, 19 nt, Homo sapiens
gauggugguucaaauguga

SEQ ID NO: 1035039 - RNA, 19 nt, Homo sapiens
ggacauaaaugagcauaac

SEQ ID NO: 1035040 - RNA, 19 nt, Homo sapiens
gaaaauggguugcuuugug

SEQ ID NO: 1035041 - RNA, 19 nt, Homo sapiens
acacaaggcgcauauauau

SEQ ID NO: 1035042 - RNA, 19 nt, Homo sapiens
ucaaacaggucgcucuuca

SEQ ID NO: 1035043 - RNA, 19 nt, Homo sapiens
aaagacaggacauaaauga

SEQ ID NO: 1035044 - RNA, 19 nt, Homo sapiens
gcaacguccuccacgagaa

SEQ ID NO: 1035045 - RNA, 19 nt, Homo sapiens
ggaugugccugauaagagu

SEQ ID NO: 1035046 - RNA, 19 nt, Homo sapiens
uggagacuaugcaugguua

SEQ ID NO: 1035047 - RNA, 19 nt, Homo sapiens
gcauaugacuacccugagu

SEQ ID NO: 1035048 - RNA, 19 nt, Homo sapiens
ugaaaugguuagccugaga

SEQ ID NO: 1035049 - RNA, 19 nt, Homo sapiens
gaaaagacaggacauaaau

SEQ ID NO: 1035050 - RNA, 19 nt, Homo sapiens
gguagauggugguucaaau

SEQ ID NO: 1035051 - RNA, 19 nt, Homo sapiens
ucacuacuauggugugugu

SEQ ID NO: 1035052 - RNA, 19 nt, Homo sapiens
gcagaaaguguuacugucu

SEQ ID NO: 1035053 - RNA, 19 nt, Homo sapiens
gcguccagauuaauacuga

SEQ ID NO: 1035054 - RNA, 19 nt, Homo sapiens
ggugcugguuauaaaguuu

SEQ ID NO: 1035055 - RNA, 19 nt, Homo sapiens
aaacaggucgcucuucaga

SEQ ID NO: 1035056 - RNA, 19 nt, Homo sapiens
ugucucaaguauugucuuu

SEQ ID NO: 1035057 - RNA, 19 nt, Homo sapiens
aaaccagacuacaauuauc

SEQ ID NO: 1035058 - RNA, 19 nt, Homo sapiens
guagauggugguucaaaug

SEQ ID NO: 1035059 - RNA, 19 nt, Homo sapiens
uacacaaggcgcauauaua

SEQ ID NO: 1035060 - RNA, 19 nt, Homo sapiens
aagcaucagagacuuauuu

SEQ ID NO: 1035061 - RNA, 19 nt, Homo sapiens
cauaaaugagcauaacuga

SEQ ID NO: 1035062 - RNA, 19 nt, Homo sapiens
ugggauauaugugcuggua

SEQ ID NO: 1035063 - RNA, 19 nt, Homo sapiens
ccagauuaauacugaggaa

SEQ ID NO: 1035064 - RNA, 19 nt, Homo sapiens
gccguaggcuaacguggaa

SEQ ID NO: 1035065 - RNA, 19 nt, Homo sapiens
guaccagcagaaaguguua

SEQ ID NO: 1035066 - RNA, 19 nt, Homo sapiens
cuugugggaucauaagauu

SEQ ID NO: 1035067 - RNA, 19 nt, Homo sapiens
cuuugugucucaaguauug

SEQ ID NO: 1035068 - RNA, 19 nt, Homo sapiens
aaugguagauggugguuca

SEQ ID NO: 1035069 - RNA, 19 nt, Homo sapiens
auacagaggaucuucgaaa

SEQ ID NO: 1035070 - RNA, 19 nt, Homo sapiens
cacaaggcgcauauauaua

SEQ ID NO: 1035071 - RNA, 19 nt, Homo sapiens
agacuuauuuucccuguaa

SEQ ID NO: 1035072 - RNA, 19 nt, Homo sapiens
uuaaggccaucccgaacuu

SEQ ID NO: 1035073 - RNA, 19 nt, Homo sapiens
cagcagaaaguguuacugu

SEQ ID NO: 1035074 - RNA, 19 nt, Homo sapiens
aaggauugguggagacuau

SEQ ID NO: 1035075 - RNA, 19 nt, Homo sapiens
guggugaagaaaucaguua

SEQ ID NO: 1035076 - RNA, 19 nt, Homo sapiens
gaaaugguuagccugagau

SEQ ID NO: 1035077 - RNA, 19 nt, Homo sapiens
aaacccaugcuaggaguua

SEQ ID NO: 1035078 - RNA, 19 nt, Homo sapiens
gaucaggagguuaucuugu

SEQ ID NO: 1035079 - RNA, 19 nt, Homo sapiens
cagcugaucaggagguuau

SEQ ID NO: 1035080 - RNA, 19 nt, Homo sapiens
ccugaguggugaagaaauc

SEQ ID NO: 1035081 - RNA, 19 nt, Homo sapiens
gaauauacagaggaucuuc

SEQ ID NO: 1035082 - RNA, 19 nt, Homo sapiens
ccugauaagagucaagaaa

SEQ ID NO: 1035083 - RNA, 19 nt, Homo sapiens
acaggucgcucuucagacu

SEQ ID NO: 1035084 - RNA, 19 nt, Homo sapiens
uaaagagguaccagcagaa

SEQ ID NO: 1035085 - RNA, 19 nt, Homo sapiens
auucagggauggucaaaca

SEQ ID NO: 1035086 - RNA, 19 nt, Homo sapiens
gaugcuacacaggaauaua

SEQ ID NO: 1035087 - RNA, 19 nt, Homo sapiens
acacguggaugcagcugau

SEQ ID NO: 1035088 - RNA, 19 nt, Homo sapiens
ucagaaaacucccagaucu

SEQ ID NO: 1035089 - RNA, 19 nt, Homo sapiens
auauacagcuugggcaaug

SEQ ID NO: 1035090 - RNA, 19 nt, Homo sapiens
uacagaggaucuucgaaag

SEQ ID NO: 1035091 - RNA, 19 nt, Homo sapiens
acaggaauauacagaggau

SEQ ID NO: 1035092 - RNA, 19 nt, Homo sapiens
cuacacaggaauauacaga

SEQ ID NO: 1035093 - RNA, 19 nt, Homo sapiens
ugguggugcugguuauaaa

SEQ ID NO: 1035094 - RNA, 19 nt, Homo sapiens
gcugguaaugccaucuuaa

SEQ ID NO: 1035095 - RNA, 19 nt, Homo sapiens
guuaucuugugggaucaua

SEQ ID NO: 1035096 - RNA, 19 nt, Homo sapiens
auacacaaggcgcauauau

SEQ ID NO: 1035097 - RNA, 19 nt, Homo sapiens
cuugcuagcaucagaauga

SEQ ID NO: 1035098 - RNA, 19 nt, Homo sapiens
gugaagaaaucaguuacac

SEQ ID NO: 1035099 - RNA, 19 nt, Homo sapiens
gguaccagcagaaaguguu

SEQ ID NO: 1035100 - RNA, 19 nt, Homo sapiens
aaagagguaccagcagaaa

SEQ ID NO: 1035101 - RNA, 19 nt, Homo sapiens
ggucaaacaggucgcucuu

SEQ ID NO: 1035102 - RNA, 19 nt, Homo sapiens
guguguggcuguaaauggu

SEQ ID NO: 1035103 - RNA, 19 nt, Homo sapiens
uacccugaguggugaagaa

SEQ ID NO: 1035104 - RNA, 19 nt, Homo sapiens
ggaauauacagaggaucuu

SEQ ID NO: 1035105 - RNA, 19 nt, Homo sapiens
guguggcuguaaaugguaa

SEQ ID NO: 1035106 - RNA, 19 nt, Homo sapiens
aaaauggguugcuuugugu

SEQ ID NO: 1035107 - RNA, 19 nt, Homo sapiens
uaugaagcaucagagacuu

SEQ ID NO: 1035108 - RNA, 19 nt, Homo sapiens
guauuuaugaagcaucaga

SEQ ID NO: 1035109 - RNA, 19 nt, Homo sapiens
agagguaccagcagaaagu

SEQ ID NO: 1035110 - RNA, 19 nt, Homo sapiens
gaagcaucagagacuuauu

SEQ ID NO: 1035111 - RNA, 19 nt, Homo sapiens
ggagacuaugcaugguuaa

SEQ ID NO: 1035112 - RNA, 19 nt, Homo sapiens
cccagcguccagauuaaua

SEQ ID NO: 1035113 - RNA, 19 nt, Homo sapiens
ccucuacucgggcuucuug

SEQ ID NO: 1035114 - RNA, 19 nt, Homo sapiens
uggauugacccacuugaug

SEQ ID NO: 1035115 - RNA, 19 nt, Homo sapiens
aaucuguagcugagucuaa

SEQ ID NO: 1035116 - RNA, 19 nt, Homo sapiens
ggugaagaaaucaguuaca

SEQ ID NO: 1035117 - RNA, 19 nt, Homo sapiens
cugguaaugccaucuuaaa

SEQ ID NO: 1035118 - RNA, 19 nt, Homo sapiens
augcuaggaguuauacaua

SEQ ID NO: 1035119 - RNA, 19 nt, Homo sapiens
ucauacaguugucauacac

SEQ ID NO: 1035120 - RNA, 19 nt, Homo sapiens
gagacuauuuucauacagu

SEQ ID NO: 1035121 - RNA, 19 nt, Homo sapiens
cuggaagcuucaaaggauu

SEQ ID NO: 1035122 - RNA, 19 nt, Homo sapiens
ggacuccuugcuagcauca

SEQ ID NO: 1035123 - RNA, 19 nt, Homo sapiens
aggucgcucuucagacuuu

SEQ ID NO: 1035124 - RNA, 19 nt, Homo sapiens
uagauggugguucaaaugu

SEQ ID NO: 1035125 - RNA, 19 nt, Homo sapiens
uaugguguguguggcugua

SEQ ID NO: 1035126 - RNA, 19 nt, Homo sapiens
ugaagcaucagagacuuau

SEQ ID NO: 1035127 - RNA, 19 nt, Homo sapiens
gauauaugugcugguaaug

SEQ ID NO: 1035128 - RNA, 19 nt, Homo sapiens
gcucuuccuacaaugagaa

SEQ ID NO: 1035129 - RNA, 19 nt, Homo sapiens
caacguccuccacgagaag

SEQ ID NO: 1035130 - RNA, 19 nt, Homo sapiens
gcaaugguagauggugguu

SEQ ID NO: 1035131 - RNA, 19 nt, Homo sapiens
cauaagccauuuuccgaau

SEQ ID NO: 1035132 - RNA, 19 nt, Homo sapiens
cuucgaaaguacgucacua

SEQ ID NO: 1035133 - RNA, 19 nt, Homo sapiens
uaaaggagcaugccgauuu

SEQ ID NO: 1035134 - RNA, 19 nt, Homo sapiens
ucacagaggccuacuacua

SEQ ID NO: 1035135 - RNA, 19 nt, Homo sapiens
gggcccagcuccucuacua

SEQ ID NO: 1035136 - RNA, 19 nt, Homo sapiens
gauacaagcacccgucuga

SEQ ID NO: 1035137 - RNA, 19 nt, Homo sapiens
gaacuuagagccacuucug

SEQ ID NO: 1035138 - RNA, 19 nt, Homo sapiens
cagcaugacccagaacuua

SEQ ID NO: 1035139 - RNA, 19 nt, Homo sapiens
acagugaccuucuccauca

SEQ ID NO: 1035140 - RNA, 19 nt, Homo sapiens
gcguguaccucuucacaga

SEQ ID NO: 1035141 - RNA, 19 nt, Homo sapiens
caucgaagcccgugaaauc

SEQ ID NO: 1035142 - RNA, 19 nt, Homo sapiens
aagcguaugugccagguuu

SEQ ID NO: 1035143 - RNA, 19 nt, Homo sapiens
gcacacuucugcucaagac

SEQ ID NO: 1035144 - RNA, 19 nt, Homo sapiens
cugcucuucugaacaaaua

SEQ ID NO: 1035145 - RNA, 19 nt, Homo sapiens
cgagucuacugcuauguga

SEQ ID NO: 1035146 - RNA, 19 nt, Homo sapiens
gaugcuggcugcucuucug

SEQ ID NO: 1035147 - RNA, 19 nt, Homo sapiens
uggcugcucuucugaacaa

SEQ ID NO: 1035148 - RNA, 19 nt, Homo sapiens
gaccagccaaggagacuaa

SEQ ID NO: 1035149 - RNA, 19 nt, Homo sapiens
ugacacggcuguacuucag

SEQ ID NO: 1035150 - RNA, 19 nt, Homo sapiens
aaagagcggugggccaaug

SEQ ID NO: 1035151 - RNA, 19 nt, Homo sapiens
ccaaggagacuaacauugc

SEQ ID NO: 1035152 - RNA, 19 nt, Homo sapiens
ccagugguuuguggacuuu

SEQ ID NO: 1035153 - RNA, 19 nt, Homo sapiens
gcaugacccagaacuuaga

SEQ ID NO: 1035154 - RNA, 19 nt, Homo sapiens
cgcgcuggcugcucuguaa

SEQ ID NO: 1035155 - RNA, 19 nt, Homo sapiens
caaggagacuaacauugcu

SEQ ID NO: 1035156 - RNA, 19 nt, Homo sapiens
gcacaccagcuuccugucu

SEQ ID NO: 1035157 - RNA, 19 nt, Homo sapiens
gggacgcacugaccauguc

SEQ ID NO: 1035158 - RNA, 19 nt, Homo sapiens
gcucuucugaacaaauaaa

SEQ ID NO: 1035159 - RNA, 19 nt, Homo sapiens
acagacccaugcugcaguu

SEQ ID NO: 1035160 - RNA, 19 nt, Homo sapiens
ucaagauguuccugacagu

SEQ ID NO: 1035161 - RNA, 19 nt, Homo sapiens
gagacuaacauugcugugu

SEQ ID NO: 1035162 - RNA, 19 nt, Homo sapiens
gccaaggagacuaacauug

SEQ ID NO: 1035163 - RNA, 19 nt, Homo sapiens
acagaggccuacuacuaca

SEQ ID NO: 1035164 - RNA, 19 nt, Homo sapiens
aaaggagcaugccgauuuu

SEQ ID NO: 1035165 - RNA, 19 nt, Homo sapiens
gguccgagucuacugcuau

SEQ ID NO: 1035166 - RNA, 19 nt, Homo sapiens
aagauguuccugacaguga

SEQ ID NO: 1035167 - RNA, 19 nt, Homo sapiens
cacagaggccuacuacuac

SEQ ID NO: 1035168 - RNA, 19 nt, Homo sapiens
gcccagcuccucuacuauc

SEQ ID NO: 1035169 - RNA, 19 nt, Homo sapiens
acccucaacugcacacuuc

SEQ ID NO: 1035170 - RNA, 19 nt, Homo sapiens
guccgagucuacugcuaug

SEQ ID NO: 1035171 - RNA, 19 nt, Homo sapiens
gaaagagcggugggccaau

SEQ ID NO: 1035172 - RNA, 19 nt, Homo sapiens
caccuuugccuuccucuuc

SEQ ID NO: 1035173 - RNA, 19 nt, Homo sapiens
gugaccuucuccaucaaga

SEQ ID NO: 1035174 - RNA, 19 nt, Homo sapiens
ggcaguuuguuccgauaca

SEQ ID NO: 1035175 - RNA, 19 nt, Homo sapiens
gcucacugccacccucaug

SEQ ID NO: 1035176 - RNA, 19 nt, Homo sapiens
cuucugaacaaauaaagga

SEQ ID NO: 1035177 - RNA, 19 nt, Homo sapiens
gcuggcugcucuucugaac

SEQ ID NO: 1035178 - RNA, 19 nt, Homo sapiens
aggagaagccacugucugu

SEQ ID NO: 1035179 - RNA, 19 nt, Homo sapiens
ggacuacuaugugaagaua

SEQ ID NO: 1035180 - RNA, 19 nt, Homo sapiens
gaaguucaucgucugauua

SEQ ID NO: 1035181 - RNA, 19 nt, Homo sapiens
gaaguucgacugcauaaga

SEQ ID NO: 1035182 - RNA, 19 nt, Homo sapiens
gaguaaagaggaccuguua

SEQ ID NO: 1035183 - RNA, 19 nt, Homo sapiens
gaaacacugcagucauuua

SEQ ID NO: 1035184 - RNA, 19 nt, Homo sapiens
agacauggcuucugcauag

SEQ ID NO: 1035185 - RNA, 19 nt, Homo sapiens
ggaaguucaucgucugauu

SEQ ID NO: 1035186 - RNA, 19 nt, Homo sapiens
acacaaauguaacuucuga

SEQ ID NO: 1035187 - RNA, 19 nt, Homo sapiens
gaagauacaagacacaaau

SEQ ID NO: 1035188 - RNA, 19 nt, Homo sapiens
gaaggaaguucgacugcau

SEQ ID NO: 1035189 - RNA, 19 nt, Homo sapiens
ggagggagccauucaccua

SEQ ID NO: 1035190 - RNA, 19 nt, Homo sapiens
gaagaagagugcugcuuac

SEQ ID NO: 1035191 - RNA, 19 nt, Homo sapiens
gagaagggauggaaauacu

SEQ ID NO: 1035192 - RNA, 19 nt, Homo sapiens
gcaagggaguguggaaaug

SEQ ID NO: 1035193 - RNA, 19 nt, Homo sapiens
gcuuguaacugaacugaug

SEQ ID NO: 1035194 - RNA, 19 nt, Homo sapiens
gaagucaagugcggugcua

SEQ ID NO: 1035195 - RNA, 19 nt, Homo sapiens
gaaagcggaccuucuggaa

SEQ ID NO: 1035196 - RNA, 19 nt, Homo sapiens
gaacugaugcggcucuuag

SEQ ID NO: 1035197 - RNA, 19 nt, Homo sapiens
ugucagcccuguauuguau

SEQ ID NO: 1035198 - RNA, 19 nt, Homo sapiens
agaagaagagugcugcuua

SEQ ID NO: 1035199 - RNA, 19 nt, Homo sapiens
gaaaugcuuacgcuugaaa

SEQ ID NO: 1035200 - RNA, 19 nt, Homo sapiens
caagugcggugcuaugauc

SEQ ID NO: 1035201 - RNA, 19 nt, Homo sapiens
caacaagugugcagcaaac

SEQ ID NO: 1035202 - RNA, 19 nt, Homo sapiens
caagaacaccggcugaaga

SEQ ID NO: 1035203 - RNA, 19 nt, Homo sapiens
gcaagcuucuccugaaucu

SEQ ID NO: 1035204 - RNA, 19 nt, Homo sapiens
ggacauggagaacucaaga

SEQ ID NO: 1035205 - RNA, 19 nt, Homo sapiens
gcggugcuaugauccuuaa

SEQ ID NO: 1035206 - RNA, 19 nt, Homo sapiens
uugaaacacugcagucauu

SEQ ID NO: 1035207 - RNA, 19 nt, Homo sapiens
uggaaaugcuuacgcuuga

SEQ ID NO: 1035208 - RNA, 19 nt, Homo sapiens
ggauggaaauacuucaaca

SEQ ID NO: 1035209 - RNA, 19 nt, Homo sapiens
gagcuagaccgcaucaaug

SEQ ID NO: 1035210 - RNA, 19 nt, Homo sapiens
ggaaaugcuuacgcuugaa

SEQ ID NO: 1035211 - RNA, 19 nt, Homo sapiens
cauagcugcugccuccuaa

SEQ ID NO: 1035212 - RNA, 19 nt, Homo sapiens
gaacuccuaugagguccuu

SEQ ID NO: 1035213 - RNA, 19 nt, Homo sapiens
aagaguugcuuguggacua

SEQ ID NO: 1035214 - RNA, 19 nt, Homo sapiens
cagagucauucaagaguug

SEQ ID NO: 1035215 - RNA, 19 nt, Homo sapiens
cagcaaagguguggaaacu

SEQ ID NO: 1035216 - RNA, 19 nt, Homo sapiens
cuacuaugaucccaauuca

SEQ ID NO: 1035217 - RNA, 19 nt, Homo sapiens
uuacagaacccauacuuca

SEQ ID NO: 1035218 - RNA, 19 nt, Homo sapiens
gcacucuccugguuucucu

SEQ ID NO: 1035219 - RNA, 19 nt, Homo sapiens
gggcucggcuacagcaaga

SEQ ID NO: 1035220 - RNA, 19 nt, Homo sapiens
gauggaggagcuaaagauu

SEQ ID NO: 1035221 - RNA, 19 nt, Homo sapiens
gcagaaggagcagauguug

SEQ ID NO: 1035222 - RNA, 19 nt, Homo sapiens
ucacucugcucugcuacua

SEQ ID NO: 1035223 - RNA, 19 nt, Homo sapiens
cacuuacacuguugagaaa

SEQ ID NO: 1035224 - RNA, 19 nt, Homo sapiens
acacuuacacuguugagaa

SEQ ID NO: 1035225 - RNA, 19 nt, Homo sapiens
gaugagggcucggcuacag

SEQ ID NO: 1035226 - RNA, 19 nt, Homo sapiens
agacacaaauguaacuucu

SEQ ID NO: 1035227 - RNA, 19 nt, Homo sapiens
cagcaagcuucuccugaau

SEQ ID NO: 1035228 - RNA, 19 nt, Homo sapiens
gcauagcugcugccuccua

SEQ ID NO: 1035229 - RNA, 19 nt, Homo sapiens
gagacauggcuucugcaua

SEQ ID NO: 1035230 - RNA, 19 nt, Homo sapiens
ggauggaggagcuaaagau

SEQ ID NO: 1035231 - RNA, 19 nt, Homo sapiens
gacugggccucuucuggaa

SEQ ID NO: 1035232 - RNA, 19 nt, Homo sapiens
gaaaguggaaguucaucgu

SEQ ID NO: 1035233 - RNA, 19 nt, Homo sapiens
uggaggagcuaaagauuuu

SEQ ID NO: 1035234 - RNA, 19 nt, Homo sapiens
cuuguaaccugaguaaaga

SEQ ID NO: 1035235 - RNA, 19 nt, Homo sapiens
guugaggucugagauuuua

SEQ ID NO: 1035236 - RNA, 19 nt, Homo sapiens
uugacaggcuggugaaaga

SEQ ID NO: 1035237 - RNA, 19 nt, Homo sapiens
acagagucauucaagaguu

SEQ ID NO: 1035238 - RNA, 19 nt, Homo sapiens
ucagcccuguauuguauuu

SEQ ID NO: 1035239 - RNA, 19 nt, Homo sapiens
cuagcaaggagauuuauau

SEQ ID NO: 1035240 - RNA, 19 nt, Homo sapiens
guccgacacuuacacuguu

SEQ ID NO: 1035241 - RNA, 19 nt, Homo sapiens
gcugcugccuccuaaucuu

SEQ ID NO: 1035242 - RNA, 19 nt, Homo sapiens
gauggaaauacuucaacaa

SEQ ID NO: 1035243 - RNA, 19 nt, Homo sapiens
gggaguguggaaaugcuua

SEQ ID NO: 1035244 - RNA, 19 nt, Homo sapiens
agauguugcugcuggagaa

SEQ ID NO: 1035245 - RNA, 19 nt, Homo sapiens
ccaagagccagcagaagga

SEQ ID NO: 1035246 - RNA, 19 nt, Homo sapiens
acuaugaucccaauucaga

SEQ ID NO: 1035247 - RNA, 19 nt, Homo sapiens
gcuacuaugaucccaauuc

SEQ ID NO: 1035248 - RNA, 19 nt, Homo sapiens
ggagaagggauggaaauac

SEQ ID NO: 1035249 - RNA, 19 nt, Homo sapiens
ugguugaggucugagauuu

SEQ ID NO: 1035250 - RNA, 19 nt, Homo sapiens
cagcaaggucuaccguuga

SEQ ID NO: 1035251 - RNA, 19 nt, Homo sapiens
acaggcuggugaaagagua

SEQ ID NO: 1035252 - RNA, 19 nt, Homo sapiens
gaagacucaauccgagcua

SEQ ID NO: 1035253 - RNA, 19 nt, Homo sapiens
ggaugagaguggcuuaagc

SEQ ID NO: 1035254 - RNA, 19 nt, Homo sapiens
aagcggaccuucuggaacu

SEQ ID NO: 1035255 - RNA, 19 nt, Homo sapiens
uuuaggcacucuccugguu

SEQ ID NO: 1035256 - RNA, 19 nt, Homo sapiens
aaacacugcagucauuuag

SEQ ID NO: 1035257 - RNA, 19 nt, Homo sapiens
cgagcuagaccgcaucaau

SEQ ID NO: 1035258 - RNA, 19 nt, Homo sapiens
cuuguggacuacuauguga

SEQ ID NO: 1035259 - RNA, 19 nt, Homo sapiens
ucaagcaggcaacagagaa

SEQ ID NO: 1035260 - RNA, 19 nt, Homo sapiens
gagaagaagagugcugcuu

SEQ ID NO: 1035261 - RNA, 19 nt, Homo sapiens
ucuccugguuucucuuuau

SEQ ID NO: 1035262 - RNA, 19 nt, Homo sapiens
acucugcucugcuacuaug

SEQ ID NO: 1035263 - RNA, 19 nt, Homo sapiens
guuucacucugcucugcua

SEQ ID NO: 1035264 - RNA, 19 nt, Homo sapiens
uugagaaaguggaaguuca

SEQ ID NO: 1035265 - RNA, 19 nt, Homo sapiens
uguaacuucugaggacaaa

SEQ ID NO: 1035266 - RNA, 19 nt, Homo sapiens
ucaacaagugugcagcaaa

SEQ ID NO: 1035267 - RNA, 19 nt, Homo sapiens
ugaaacacugcagucauuu

SEQ ID NO: 1035268 - RNA, 19 nt, Homo sapiens
ugaagauacaagacacaaa

SEQ ID NO: 1035269 - RNA, 19 nt, Homo sapiens
uacacagagucauucaaga

SEQ ID NO: 1035270 - RNA, 19 nt, Homo sapiens
uggagaagggauggaaaua

SEQ ID NO: 1035271 - RNA, 19 nt, Homo sapiens
acuacuaugugaagauaca

SEQ ID NO: 1035272 - RNA, 19 nt, Homo sapiens
acacagagucauucaagag

SEQ ID NO: 1035273 - RNA, 19 nt, Homo sapiens
ggagacauggcuucugcau

SEQ ID NO: 1035274 - RNA, 19 nt, Homo sapiens
cuucuccgcugccucacuu

SEQ ID NO: 1035275 - RNA, 19 nt, Homo sapiens
uuacacagagucauucaag

SEQ ID NO: 1035276 - RNA, 19 nt, Homo sapiens
gugcuaugauccuuaagcu

SEQ ID NO: 1035277 - RNA, 19 nt, Homo sapiens
uaggcacucuccugguuuc

SEQ ID NO: 1035278 - RNA, 19 nt, Homo sapiens
uacaggagcaggacaugga

SEQ ID NO: 1035279 - RNA, 19 nt, Homo sapiens
gaagaaauguugauccuuu

SEQ ID NO: 1035280 - RNA, 19 nt, Homo sapiens
gagaacauuugauggcuua

SEQ ID NO: 1035281 - RNA, 19 nt, Homo sapiens
gcacagagaguuaguuaaa

SEQ ID NO: 1035282 - RNA, 19 nt, Homo sapiens
uaaagaaggcaaagacuua

SEQ ID NO: 1035283 - RNA, 19 nt, Homo sapiens
ggcaaagacuuaauucauu

SEQ ID NO: 1035284 - RNA, 19 nt, Homo sapiens
ucaacaaucucaagcagua

SEQ ID NO: 1035285 - RNA, 19 nt, Homo sapiens
gcaauucguucccaagaga

SEQ ID NO: 1035286 - RNA, 19 nt, Homo sapiens
gcagaacuuugggauuaua

SEQ ID NO: 1035287 - RNA, 19 nt, Homo sapiens
cugcagaacuuugggauua

SEQ ID NO: 1035288 - RNA, 19 nt, Homo sapiens
ccaauguuaugacuacuuu

SEQ ID NO: 1035289 - RNA, 19 nt, Homo sapiens
ugaggaagauaaacagaaa

SEQ ID NO: 1035290 - RNA, 19 nt, Homo sapiens
gcaagaagaauguguuuca

SEQ ID NO: 1035291 - RNA, 19 nt, Homo sapiens
guuaaacgguaucaagaaa

SEQ ID NO: 1035292 - RNA, 19 nt, Homo sapiens
gaacacguggcucaaauga

SEQ ID NO: 1035293 - RNA, 19 nt, Homo sapiens
gaaaagaauugcagaauac

SEQ ID NO: 1035294 - RNA, 19 nt, Homo sapiens
gcagagaaguaccagaaca

SEQ ID NO: 1035295 - RNA, 19 nt, Homo sapiens
ggagauugcuuggcagaga

SEQ ID NO: 1035296 - RNA, 19 nt, Homo sapiens
guugauccuuuccauauuu

SEQ ID NO: 1035297 - RNA, 19 nt, Homo sapiens
cgaaaagaauugcagaaua

SEQ ID NO: 1035298 - RNA, 19 nt, Homo sapiens
guaaaugcguuagaaauac

SEQ ID NO: 1035299 - RNA, 19 nt, Homo sapiens
caaaggacaguauuaucua

SEQ ID NO: 1035300 - RNA, 19 nt, Homo sapiens
ccagagaguucauugagau

SEQ ID NO: 1035301 - RNA, 19 nt, Homo sapiens
gcagauucucccaauguua

SEQ ID NO: 1035302 - RNA, 19 nt, Homo sapiens
cagaacacaucacugaaga

SEQ ID NO: 1035303 - RNA, 19 nt, Homo sapiens
caugaaaucuagugugcaa

SEQ ID NO: 1035304 - RNA, 19 nt, Homo sapiens
aaacuaccaugaaaucuag

SEQ ID NO: 1035305 - RNA, 19 nt, Homo sapiens
gaaaucuagugugcaagaa

SEQ ID NO: 1035306 - RNA, 19 nt, Homo sapiens
gaagagcuagaguuggaua

SEQ ID NO: 1035307 - RNA, 19 nt, Homo sapiens
ggauggaacagaagaaaug

SEQ ID NO: 1035308 - RNA, 19 nt, Homo sapiens
ugacauggcuuacgaaaau

SEQ ID NO: 1035309 - RNA, 19 nt, Homo sapiens
acacaucacugaagaagag

SEQ ID NO: 1035310 - RNA, 19 nt, Homo sapiens
gagauugcuuggcagagaa

SEQ ID NO: 1035311 - RNA, 19 nt, Homo sapiens
agagauacaugucuuccaa

SEQ ID NO: 1035312 - RNA, 19 nt, Homo sapiens
gguagucuuucccaacuga

SEQ ID NO: 1035313 - RNA, 19 nt, Homo sapiens
guaauugggucuuuuguug

SEQ ID NO: 1035314 - RNA, 19 nt, Homo sapiens
caagaagaauguguuucaa

SEQ ID NO: 1035315 - RNA, 19 nt, Homo sapiens
cagaacacguggcucaaau

SEQ ID NO: 1035316 - RNA, 19 nt, Homo sapiens
gaguuuaucaacagacuaa

SEQ ID NO: 1035317 - RNA, 19 nt, Homo sapiens
ucagcauucucaagaguuu

SEQ ID NO: 1035318 - RNA, 19 nt, Homo sapiens
gaacacaucacugaagaag

SEQ ID NO: 1035319 - RNA, 19 nt, Homo sapiens
cugaagagcuagaguugga

SEQ ID NO: 1035320 - RNA, 19 nt, Homo sapiens
gaacauuugauggcuuaaa

SEQ ID NO: 1035321 - RNA, 19 nt, Homo sapiens
ggcugaaccuggcaacuga

SEQ ID NO: 1035322 - RNA, 19 nt, Homo sapiens
ucauugagauguggagauu

SEQ ID NO: 1035323 - RNA, 19 nt, Homo sapiens
aauaccagcuguuacuuau

SEQ ID NO: 1035324 - RNA, 19 nt, Homo sapiens
gaacuuugggauuauacuu

SEQ ID NO: 1035325 - RNA, 19 nt, Homo sapiens
ccaaaggacaguauuaucu

SEQ ID NO: 1035326 - RNA, 19 nt, Homo sapiens
guagauuuauuuccaaagg

SEQ ID NO: 1035327 - RNA, 19 nt, Homo sapiens
gaaagugaaggauggaaca

SEQ ID NO: 1035328 - RNA, 19 nt, Homo sapiens
gaaggcaaagacuuaauuc

SEQ ID NO: 1035329 - RNA, 19 nt, Homo sapiens
gcuagaaaccacugaggaa

SEQ ID NO: 1035330 - RNA, 19 nt, Homo sapiens
gagcuagaguuggauaagu

SEQ ID NO: 1035331 - RNA, 19 nt, Homo sapiens
cauuuacccuucauaggaa

SEQ ID NO: 1035332 - RNA, 19 nt, Homo sapiens
gaauugcagaauacuguuu

SEQ ID NO: 1035333 - RNA, 19 nt, Homo sapiens
gaaaugaaagcagcagcaa

SEQ ID NO: 1035334 - RNA, 19 nt, Homo sapiens
gagaguucauugagaugug

SEQ ID NO: 1035335 - RNA, 19 nt, Homo sapiens
aaauaccagcuguuacuua

SEQ ID NO: 1035336 - RNA, 19 nt, Homo sapiens
gcaacugaaugccuuccau

SEQ ID NO: 1035337 - RNA, 19 nt, Homo sapiens
gcaugacaaaguuuaugua

SEQ ID NO: 1035338 - RNA, 19 nt, Homo sapiens
cuauuuaacugcagauucu

SEQ ID NO: 1035339 - RNA, 19 nt, Homo sapiens
ccauuuacccuucauagga

SEQ ID NO: 1035340 - RNA, 19 nt, Homo sapiens
ucaaaacccuuauggaaug

SEQ ID NO: 1035341 - RNA, 19 nt, Homo sapiens
gaauacuguuucccagcuu

SEQ ID NO: 1035342 - RNA, 19 nt, Homo sapiens
gaagagcucaaaacccuua

SEQ ID NO: 1035343 - RNA, 19 nt, Homo sapiens
cauggcugcuuuccucaaa

SEQ ID NO: 1035344 - RNA, 19 nt, Homo sapiens
gggauuauacuuuguuuac

SEQ ID NO: 1035345 - RNA, 19 nt, Homo sapiens
acuguaggguugugucuuu

SEQ ID NO: 1035346 - RNA, 19 nt, Homo sapiens
agaguuaguuaaacgguau

SEQ ID NO: 1035347 - RNA, 19 nt, Homo sapiens
uaccagaacacaucacuga

SEQ ID NO: 1035348 - RNA, 19 nt, Homo sapiens
ucaagaguuuaucaacaga

SEQ ID NO: 1035349 - RNA, 19 nt, Homo sapiens
ucucaagaguuuaucaaca

SEQ ID NO: 1035350 - RNA, 19 nt, Homo sapiens
uuucaggcaugacaaaguu

SEQ ID NO: 1035351 - RNA, 19 nt, Homo sapiens
cagauucucccaauguuau

SEQ ID NO: 1035352 - RNA, 19 nt, Homo sapiens
gaaggauggaacagaagaa

SEQ ID NO: 1035353 - RNA, 19 nt, Homo sapiens
aaucuagugugcaagaaga

SEQ ID NO: 1035354 - RNA, 19 nt, Homo sapiens
caauuaaguaucugcagaa

SEQ ID NO: 1035355 - RNA, 19 nt, Homo sapiens
gaaccuggcaacugaaugc

SEQ ID NO: 1035356 - RNA, 19 nt, Homo sapiens
agugaaggauggaacagaa

SEQ ID NO: 1035357 - RNA, 19 nt, Homo sapiens
ccacugaggaagauaaaca

SEQ ID NO: 1035358 - RNA, 19 nt, Homo sapiens
gucaauuucuucagaccuu

SEQ ID NO: 1035359 - RNA, 19 nt, Homo sapiens
ugacuacuuucaggcauga

SEQ ID NO: 1035360 - RNA, 19 nt, Homo sapiens
agaaaagucucauguagau

SEQ ID NO: 1035361 - RNA, 19 nt, Homo sapiens
cagaagaaauguugauccu

SEQ ID NO: 1035362 - RNA, 19 nt, Homo sapiens
agaaaccacugaggaagau

SEQ ID NO: 1035363 - RNA, 19 nt, Homo sapiens
gcucaaaacccuuauggaa

SEQ ID NO: 1035364 - RNA, 19 nt, Homo sapiens
ugaaaucuagugugcaaga

SEQ ID NO: 1035365 - RNA, 19 nt, Homo sapiens
agaaggcaaagacuuaauu

SEQ ID NO: 1035366 - RNA, 19 nt, Homo sapiens
gaguguuagugucaauuuc

SEQ ID NO: 1035367 - RNA, 19 nt, Homo sapiens
ucaggcaugacaaaguuua

SEQ ID NO: 1035368 - RNA, 19 nt, Homo sapiens
cgacuuugggauaggaaua

SEQ ID NO: 1035369 - RNA, 19 nt, Homo sapiens
gaaguaccagaacacauca

SEQ ID NO: 1035370 - RNA, 19 nt, Homo sapiens
guggaaaacuaccaugaaa

SEQ ID NO: 1035371 - RNA, 19 nt, Homo sapiens
aaagaaggcaaagacuuaa

SEQ ID NO: 1035372 - RNA, 19 nt, Homo sapiens
cuaaagaaggcaaagacuu

SEQ ID NO: 1035373 - RNA, 19 nt, Homo sapiens
uuuguuacauggcugcuuu

SEQ ID NO: 1035374 - RNA, 19 nt, Homo sapiens
ggaaaacuaccaugaaauc

SEQ ID NO: 1035375 - RNA, 19 nt, Homo sapiens
ggaagagaaauaacuuaac

SEQ ID NO: 1035376 - RNA, 19 nt, Homo sapiens
ucaaaagguucucugaaug

SEQ ID NO: 1035377 - RNA, 19 nt, Homo sapiens
aaaccacugaggaagauaa

SEQ ID NO: 1035378 - RNA, 19 nt, Homo sapiens
gagauacaugucuuccaaa

SEQ ID NO: 1035379 - RNA, 19 nt, Homo sapiens
gaggacagccagacaauaa

SEQ ID NO: 1035380 - RNA, 19 nt, Homo sapiens
gggaagaccugaccagaca

SEQ ID NO: 1035381 - RNA, 19 nt, Homo sapiens
gcacagcccuggacaagac

SEQ ID NO: 1035382 - RNA, 19 nt, Homo sapiens
gaacuggaccgaccaugug

SEQ ID NO: 1035383 - RNA, 19 nt, Homo sapiens
ggccagcagucccuucuga

SEQ ID NO: 1035384 - RNA, 19 nt, Homo sapiens
ucaaggacguugccagaca

SEQ ID NO: 1035385 - RNA, 19 nt, Homo sapiens
ccagggacaugaugaagca

SEQ ID NO: 1035386 - RNA, 19 nt, Homo sapiens
gagggcagguucagagaag

SEQ ID NO: 1035387 - RNA, 19 nt, Homo sapiens
ccugagggcugcaccuaug

SEQ ID NO: 1035388 - RNA, 19 nt, Homo sapiens
ggccaaggcugugcucaag

SEQ ID NO: 1035389 - RNA, 19 nt, Homo sapiens
agucggagcuuggcguuga

SEQ ID NO: 1035390 - RNA, 19 nt, Homo sapiens
gaggauggacccaggagau

SEQ ID NO: 1035391 - RNA, 19 nt, Homo sapiens
ggacguugccagacaguac

SEQ ID NO: 1035392 - RNA, 19 nt, Homo sapiens
ucauguggcucagcaguca

SEQ ID NO: 1035393 - RNA, 19 nt, Homo sapiens
acucgaggcuggaggugaa

SEQ ID NO: 1035394 - RNA, 19 nt, Homo sapiens
ccgcagauccucguuccua

SEQ ID NO: 1035395 - RNA, 19 nt, Homo sapiens
ggacaugaaggaccguuac

SEQ ID NO: 1035396 - RNA, 19 nt, Homo sapiens
acaauaaacauggaaagug

SEQ ID NO: 1035397 - RNA, 19 nt, Homo sapiens
gacaauaaacauggaaagu

SEQ ID NO: 1035398 - RNA, 19 nt, Homo sapiens
ggacagccagacaauaaac

SEQ ID NO: 1035399 - RNA, 19 nt, Homo sapiens
gccagacaauaaacaugga

SEQ ID NO: 1035400 - RNA, 19 nt, Homo sapiens
gcacgcaugcugggcaaug

SEQ ID NO: 1035401 - RNA, 19 nt, Homo sapiens
ugaaggaccguuacuacca

SEQ ID NO: 1035402 - RNA, 19 nt, Homo sapiens
gggcugcggugcuucuacu

SEQ ID NO: 1035403 - RNA, 19 nt, Homo sapiens
acgaggagcaggucaucua

SEQ ID NO: 1035404 - RNA, 19 nt, Homo sapiens
caugaaggaccguuacuac

SEQ ID NO: 1035405 - RNA, 19 nt, Homo sapiens
ugaggacagccagacaaua

SEQ ID NO: 1035406 - RNA, 19 nt, Homo sapiens
cggucaaaguccucacuga

SEQ ID NO: 1035407 - RNA, 19 nt, Homo sapiens
uguggugugugacaacaug

SEQ ID NO: 1035408 - RNA, 19 nt, Homo sapiens
ggaggugaaggacaugaag

SEQ ID NO: 1035409 - RNA, 19 nt, Homo sapiens
gcugggcaauggugaagac

SEQ ID NO: 1035410 - RNA, 19 nt, Homo sapiens
ggcuggaggugaaggacau

SEQ ID NO: 1035411 - RNA, 19 nt, Homo sapiens
ggagagagaugaaagaaga

SEQ ID NO: 1035412 - RNA, 19 nt, Homo sapiens
gaggaagccuggagguuua

SEQ ID NO: 1035413 - RNA, 19 nt, Homo sapiens
gcugaaagauccaagguuu

SEQ ID NO: 1035414 - RNA, 19 nt, Homo sapiens
guguuuagcugcuuugaua

SEQ ID NO: 1035415 - RNA, 19 nt, Homo sapiens
ugaauguucuggugaauuu

SEQ ID NO: 1035416 - RNA, 19 nt, Homo sapiens
aagaagagcuggaggaaga

SEQ ID NO: 1035417 - RNA, 19 nt, Homo sapiens
ggaagacucuaugaagaaa

SEQ ID NO: 1035418 - RNA, 19 nt, Homo sapiens
gggauuugcucucuauaga

SEQ ID NO: 1035419 - RNA, 19 nt, Homo sapiens
ggaggaagccuggagguuu

SEQ ID NO: 1035420 - RNA, 19 nt, Homo sapiens
gacaauggcugcuguucau

SEQ ID NO: 1035421 - RNA, 19 nt, Homo sapiens
gagagucccuuuaucuaca

SEQ ID NO: 1035422 - RNA, 19 nt, Homo sapiens
gagcaugaaucugaauaug

SEQ ID NO: 1035423 - RNA, 19 nt, Homo sapiens
gaaagaagagcuggaggaa

SEQ ID NO: 1035424 - RNA, 19 nt, Homo sapiens
gcagguggauuugcuggaa

SEQ ID NO: 1035425 - RNA, 19 nt, Homo sapiens
gagcuggcaguguuuauuu

SEQ ID NO: 1035426 - RNA, 19 nt, Homo sapiens
agaaaugauuccugccuuu

SEQ ID NO: 1035427 - RNA, 19 nt, Homo sapiens
ggaggagucuaugcucuga

SEQ ID NO: 1035428 - RNA, 19 nt, Homo sapiens
ugucuuauuugcuguguuu

SEQ ID NO: 1035429 - RNA, 19 nt, Homo sapiens
ucacauugcagguggauuu

SEQ ID NO: 1035430 - RNA, 19 nt, Homo sapiens
cagaaaaggcuaacaauuu

SEQ ID NO: 1035431 - RNA, 19 nt, Homo sapiens
gcugguacaugcuggaguu

SEQ ID NO: 1035432 - RNA, 19 nt, Homo sapiens
aaggaagacucuaugaaga

SEQ ID NO: 1035433 - RNA, 19 nt, Homo sapiens
gauuugcucucuauagaag

SEQ ID NO: 1035434 - RNA, 19 nt, Homo sapiens
gaaaugauuccugccuuug

SEQ ID NO: 1035435 - RNA, 19 nt, Homo sapiens
ccuggagguuuaucucaua

SEQ ID NO: 1035436 - RNA, 19 nt, Homo sapiens
guaaagaucgggccaagag

SEQ ID NO: 1035437 - RNA, 19 nt, Homo sapiens
ggacaauggcugcuguuca

SEQ ID NO: 1035438 - RNA, 19 nt, Homo sapiens
ggagguuuaucucauacau

SEQ ID NO: 1035439 - RNA, 19 nt, Homo sapiens
uggcaguguuuauuuacua

SEQ ID NO: 1035440 - RNA, 19 nt, Homo sapiens
gagagcaugaaucugaaua

SEQ ID NO: 1035441 - RNA, 19 nt, Homo sapiens
caugggauuugcucucuau

SEQ ID NO: 1035442 - RNA, 19 nt, Homo sapiens
aaagaucgggccaagagua

SEQ ID NO: 1035443 - RNA, 19 nt, Homo sapiens
aaacagcauuaaacucauc

SEQ ID NO: 1035444 - RNA, 19 nt, Homo sapiens
caaaacagcauuaaacuca

SEQ ID NO: 1035445 - RNA, 19 nt, Homo sapiens
aaacugaccugccccuauu

SEQ ID NO: 1035446 - RNA, 19 nt, Homo sapiens
ggagagucccuuuaucuac

SEQ ID NO: 1035447 - RNA, 19 nt, Homo sapiens
aaaggaagacucuaugaag

SEQ ID NO: 1035448 - RNA, 19 nt, Homo sapiens
ggagauggagagcaugaau

SEQ ID NO: 1035449 - RNA, 19 nt, Homo sapiens
aaagagccaucuggaggaa

SEQ ID NO: 1035450 - RNA, 19 nt, Homo sapiens
ggauuugcucucuauagaa

SEQ ID NO: 1035451 - RNA, 19 nt, Homo sapiens
ggacaaaacagcauuaaac

SEQ ID NO: 1035452 - RNA, 19 nt, Homo sapiens
gcaauugcugcauauuuag

SEQ ID NO: 1035453 - RNA, 19 nt, Homo sapiens
ucucauacaugcugguaca

SEQ ID NO: 1035454 - RNA, 19 nt, Homo sapiens
ggcaguguuuauuuacuau

SEQ ID NO: 1035455 - RNA, 19 nt, Homo sapiens
acucaucaguugcaaagau

SEQ ID NO: 1035456 - RNA, 19 nt, Homo sapiens
ccagacagcccagggaaga

SEQ ID NO: 1035457 - RNA, 19 nt, Homo sapiens
caauggcugcuguucauga

SEQ ID NO: 1035458 - RNA, 19 nt, Homo sapiens
uggccgagcuggcaguguu

SEQ ID NO: 1035459 - RNA, 19 nt, Homo sapiens
ccacaggauugucucaaaa

SEQ ID NO: 1035460 - RNA, 19 nt, Homo sapiens
gacaugggauuugcucucu

SEQ ID NO: 1035461 - RNA, 19 nt, Homo sapiens
ggaggacccaggacaaugg

SEQ ID NO: 1035462 - RNA, 19 nt, Homo sapiens
uuaugaauguucuggugaa

SEQ ID NO: 1035463 - RNA, 19 nt, Homo sapiens
agagccaucuggaggaaau

SEQ ID NO: 1035464 - RNA, 19 nt, Homo sapiens
uaucuacaguccugagaag

SEQ ID NO: 1035465 - RNA, 19 nt, Homo sapiens
uguggaagccucagaaaca

SEQ ID NO: 1035466 - RNA, 19 nt, Homo sapiens
gacccacucagauaucuug

SEQ ID NO: 1035467 - RNA, 19 nt, Homo sapiens
aagacucuaugaagaaaca

SEQ ID NO: 1035468 - RNA, 19 nt, Homo sapiens
uccacaggauugucucaaa

SEQ ID NO: 1035469 - RNA, 19 nt, Homo sapiens
cucaucaguugcaaagauu

SEQ ID NO: 1035470 - RNA, 19 nt, Homo sapiens
cugcauauuuagcuugugu

SEQ ID NO: 1035471 - RNA, 19 nt, Homo sapiens
aaugauuccugccuuugga

SEQ ID NO: 1035472 - RNA, 19 nt, Homo sapiens
uggagagucccuuuaucua

SEQ ID NO: 1035473 - RNA, 19 nt, Homo sapiens
aggaagacucuaugaagaa

SEQ ID NO: 1035474 - RNA, 19 nt, Homo sapiens
uagcuugugucuuauuugc

SEQ ID NO: 1035475 - RNA, 19 nt, Homo sapiens
gagggaggacccaggacaa

SEQ ID NO: 1035476 - RNA, 19 nt, Homo sapiens
uggagagcaugaaucugaa

SEQ ID NO: 1035477 - RNA, 19 nt, Homo sapiens
aagaucgggccaagaguaa

SEQ ID NO: 1035478 - RNA, 19 nt, Homo sapiens
agaaacaguggaucacguu

SEQ ID NO: 1035479 - RNA, 19 nt, Homo sapiens
auggagagcaugaaucuga

SEQ ID NO: 1035480 - RNA, 19 nt, Homo sapiens
gagauggagagcaugaauc

SEQ ID NO: 1035481 - RNA, 19 nt, Homo sapiens
gaggcuauuuuaugaaugu

SEQ ID NO: 1035482 - RNA, 19 nt, Homo sapiens
cuugccagcuccaucuuug

SEQ ID NO: 1035483 - RNA, 19 nt, Homo sapiens
aacaguggaucacguugga

SEQ ID NO: 1035484 - RNA, 19 nt, Homo sapiens
ccucagaaacaguggauca

SEQ ID NO: 1035485 - RNA, 19 nt, Homo sapiens
agcuggcaguguuuauuua

SEQ ID NO: 1035486 - RNA, 19 nt, Homo sapiens
gggaggcuauuuuaugaau

SEQ ID NO: 1035487 - RNA, 19 nt, Homo sapiens
gaugggaggcuauuuuaug

SEQ ID NO: 1035488 - RNA, 19 nt, Homo sapiens
aggagucuaugcucugaug

SEQ ID NO: 1035489 - RNA, 19 nt, Homo sapiens
ucuuugacccacucagaua

SEQ ID NO: 1035490 - RNA, 19 nt, Homo sapiens
caucuuugacccacucaga

SEQ ID NO: 1035491 - RNA, 19 nt, Homo sapiens
caucuuggagagucccuuu

SEQ ID NO: 1035492 - RNA, 19 nt, Homo sapiens
aaauggaugcugcccgaaa

SEQ ID NO: 1035493 - RNA, 19 nt, Homo sapiens
ggagagcaugaaucugaau

SEQ ID NO: 1035494 - RNA, 19 nt, Homo sapiens
gguacaugcuggaguucag

SEQ ID NO: 1035495 - RNA, 19 nt, Homo sapiens
gggaggacccaggacaaug

SEQ ID NO: 1035496 - RNA, 19 nt, Homo sapiens
ugaagaaacagagaagucu

SEQ ID NO: 1035497 - RNA, 19 nt, Homo sapiens
gauaauuguguuggacaug

SEQ ID NO: 1035498 - RNA, 19 nt, Homo sapiens
gggaggaagccuggagguu

SEQ ID NO: 1035499 - RNA, 19 nt, Homo sapiens
guuggacacaggcaucuug

SEQ ID NO: 1035500 - RNA, 19 nt, Homo sapiens
cgagcuggcaguguuuauu

SEQ ID NO: 1035501 - RNA, 19 nt, Homo sapiens
gccuggagguuuaucucau

SEQ ID NO: 1035502 - RNA, 19 nt, Homo sapiens
gaaagccucugcaccauug

SEQ ID NO: 1035503 - RNA, 19 nt, Homo sapiens
gaagaagcgccgauacuua

SEQ ID NO: 1035504 - RNA, 19 nt, Homo sapiens
gaacauguccguaggaaug

SEQ ID NO: 1035505 - RNA, 19 nt, Homo sapiens
ucaaagaaauugcugaaga

SEQ ID NO: 1035506 - RNA, 19 nt, Homo sapiens
gaagaaguggcccugauua

SEQ ID NO: 1035507 - RNA, 19 nt, Homo sapiens
ggagaaugcuggccacaga

SEQ ID NO: 1035508 - RNA, 19 nt, Homo sapiens
gaacccacuucuauuaguu

SEQ ID NO: 1035509 - RNA, 19 nt, Homo sapiens
agacagcacucgacugaaa

SEQ ID NO: 1035510 - RNA, 19 nt, Homo sapiens
ccacuucuauuaguugaua

SEQ ID NO: 1035511 - RNA, 19 nt, Homo sapiens
gaaauccacuuaaguagcu

SEQ ID NO: 1035512 - RNA, 19 nt, Homo sapiens
aaagagagauaaucccuau

SEQ ID NO: 1035513 - RNA, 19 nt, Homo sapiens
ggagacagcacucgacuga

SEQ ID NO: 1035514 - RNA, 19 nt, Homo sapiens
guggaagccuuacugcaua

SEQ ID NO: 1035515 - RNA, 19 nt, Homo sapiens
gaagacacaguggauauuu

SEQ ID NO: 1035516 - RNA, 19 nt, Homo sapiens
ggugggagcugucuuugug

SEQ ID NO: 1035517 - RNA, 19 nt, Homo sapiens
caaagaacgagagaacuua

SEQ ID NO: 1035518 - RNA, 19 nt, Homo sapiens
guaguuauauaucgacgaa

SEQ ID NO: 1035519 - RNA, 19 nt, Homo sapiens
gcauuaagcauauccuuga

SEQ ID NO: 1035520 - RNA, 19 nt, Homo sapiens
caagcaguguaguuauaua

SEQ ID NO: 1035521 - RNA, 19 nt, Homo sapiens
gaaaguagucgcagugaag

SEQ ID NO: 1035522 - RNA, 19 nt, Homo sapiens
ggacguggaccguggguuu

SEQ ID NO: 1035523 - RNA, 19 nt, Homo sapiens
ggugaccuguuaacucuuu

SEQ ID NO: 1035524 - RNA, 19 nt, Homo sapiens
gagagaacuuaaagcgauu

SEQ ID NO: 1035525 - RNA, 19 nt, Homo sapiens
cagcgcagcuccugagguu

SEQ ID NO: 1035526 - RNA, 19 nt, Homo sapiens
agaaauugcugaagacaca

SEQ ID NO: 1035527 - RNA, 19 nt, Homo sapiens
gaagagaaagagagauaau

SEQ ID NO: 1035528 - RNA, 19 nt, Homo sapiens
ccagggaucucgaaauucu

SEQ ID NO: 1035529 - RNA, 19 nt, Homo sapiens
gugaaaagcuaauucguuu

SEQ ID NO: 1035530 - RNA, 19 nt, Homo sapiens
gaagccagccgaauacuag

SEQ ID NO: 1035531 - RNA, 19 nt, Homo sapiens
gcucauaugcuaagacaga

SEQ ID NO: 1035532 - RNA, 19 nt, Homo sapiens
gagcucauaugcuaagaca

SEQ ID NO: 1035533 - RNA, 19 nt, Homo sapiens
gaagaucauuuagucaaag

SEQ ID NO: 1035534 - RNA, 19 nt, Homo sapiens
gggcaggaguuuugcauua

SEQ ID NO: 1035535 - RNA, 19 nt, Homo sapiens
gaucaucucucacaaaaca

SEQ ID NO: 1035536 - RNA, 19 nt, Homo sapiens
caaagaaauugcugaagac

SEQ ID NO: 1035537 - RNA, 19 nt, Homo sapiens
ccuguuaacucuuuacugu

SEQ ID NO: 1035538 - RNA, 19 nt, Homo sapiens
caaacagucaccugaauug

SEQ ID NO: 1035539 - RNA, 19 nt, Homo sapiens
gaaccucugucuugugcau

SEQ ID NO: 1035540 - RNA, 19 nt, Homo sapiens
cugaagaccugcaguuuag

SEQ ID NO: 1035541 - RNA, 19 nt, Homo sapiens
gguuaucucuaucugaaga

SEQ ID NO: 1035542 - RNA, 19 nt, Homo sapiens
ucuucuggauugaguauua

SEQ ID NO: 1035543 - RNA, 19 nt, Homo sapiens
ugccauuggugaccuguua

SEQ ID NO: 1035544 - RNA, 19 nt, Homo sapiens
gaaagaugcgacugccauu

SEQ ID NO: 1035545 - RNA, 19 nt, Homo sapiens
gacacugccuuacccagaa

SEQ ID NO: 1035546 - RNA, 19 nt, Homo sapiens
caaucagucucuuccaaug

SEQ ID NO: 1035547 - RNA, 19 nt, Homo sapiens
ccaaagaacgagagaacuu

SEQ ID NO: 1035548 - RNA, 19 nt, Homo sapiens
gaaguggcccugauuaugc

SEQ ID NO: 1035549 - RNA, 19 nt, Homo sapiens
ggaagagaaagagagauaa

SEQ ID NO: 1035550 - RNA, 19 nt, Homo sapiens
ggacccagacucuaguuga

SEQ ID NO: 1035551 - RNA, 19 nt, Homo sapiens
gauguucguuguuccaauc

SEQ ID NO: 1035552 - RNA, 19 nt, Homo sapiens
uaaaaugucugcgacgaua

SEQ ID NO: 1035553 - RNA, 19 nt, Homo sapiens
acagucaccugaauugaau

SEQ ID NO: 1035554 - RNA, 19 nt, Homo sapiens
gauagaaauccacuuaagu

SEQ ID NO: 1035555 - RNA, 19 nt, Homo sapiens
caaagcuucugggaucauu

SEQ ID NO: 1035556 - RNA, 19 nt, Homo sapiens
uuaagcauauccuugaaga

SEQ ID NO: 1035557 - RNA, 19 nt, Homo sapiens
gagaaagccucugcaccau

SEQ ID NO: 1035558 - RNA, 19 nt, Homo sapiens
cuucaccucuacuuaauug

SEQ ID NO: 1035559 - RNA, 19 nt, Homo sapiens
cuacacagcagaagaagug

SEQ ID NO: 1035560 - RNA, 19 nt, Homo sapiens
gcaguguaguuauauaucg

SEQ ID NO: 1035561 - RNA, 19 nt, Homo sapiens
caccugaauugaaugcaaa

SEQ ID NO: 1035562 - RNA, 19 nt, Homo sapiens
ucgguuaucucuaucugaa

SEQ ID NO: 1035563 - RNA, 19 nt, Homo sapiens
cuaguugacuuggauguug

SEQ ID NO: 1035564 - RNA, 19 nt, Homo sapiens
cagaagaaguggcccugau

SEQ ID NO: 1035565 - RNA, 19 nt, Homo sapiens
ucugaagaccugcaguuua

SEQ ID NO: 1035566 - RNA, 19 nt, Homo sapiens
gggaucauuugggacuaua

SEQ ID NO: 1035567 - RNA, 19 nt, Homo sapiens
ggauugaguauuauaguca

SEQ ID NO: 1035568 - RNA, 19 nt, Homo sapiens
caacccagacuaccuuguu

SEQ ID NO: 1035569 - RNA, 19 nt, Homo sapiens
gguaugcaguguccuccuu

SEQ ID NO: 1035570 - RNA, 19 nt, Homo sapiens
cagugaagccagccgaaua

SEQ ID NO: 1035571 - RNA, 19 nt, Homo sapiens
uucaagcaguguaguuaua

SEQ ID NO: 1035572 - RNA, 19 nt, Homo sapiens
caaggaagagaaagagaga

SEQ ID NO: 1035573 - RNA, 19 nt, Homo sapiens
caaacguaaagccaaauuu

SEQ ID NO: 1035574 - RNA, 19 nt, Homo sapiens
aagcgccgauacuuacaua

SEQ ID NO: 1035575 - RNA, 19 nt, Homo sapiens
gauacugauggcccuaaua

SEQ ID NO: 1035576 - RNA, 19 nt, Homo sapiens
uuaaacgacuucagcaucu

SEQ ID NO: 1035577 - RNA, 19 nt, Homo sapiens
ucaaacagucaccugaauu

SEQ ID NO: 1035578 - RNA, 19 nt, Homo sapiens
agucaaacguaaagccaaa

SEQ ID NO: 1035579 - RNA, 19 nt, Homo sapiens
uggauuggcuacugcaaau

SEQ ID NO: 1035580 - RNA, 19 nt, Homo sapiens
ucaccugaauugaaugcaa

SEQ ID NO: 1035581 - RNA, 19 nt, Homo sapiens
aaauuucugugguugcuau

SEQ ID NO: 1035582 - RNA, 19 nt, Homo sapiens
cacuaacccuugaagauca

SEQ ID NO: 1035583 - RNA, 19 nt, Homo sapiens
aaagaacgagagaacuuaa

SEQ ID NO: 1035584 - RNA, 19 nt, Homo sapiens
cguuguauauugaucaguu

SEQ ID NO: 1035585 - RNA, 19 nt, Homo sapiens
ucaggaaccucugucuugu

SEQ ID NO: 1035586 - RNA, 19 nt, Homo sapiens
ccuugaagaucauuuaguc

SEQ ID NO: 1035587 - RNA, 19 nt, Homo sapiens
ggauucggauucacgucuu

SEQ ID NO: 1035588 - RNA, 19 nt, Homo sapiens
aggaagagaaagagagaua

SEQ ID NO: 1035589 - RNA, 19 nt, Homo sapiens
gagaagaagcgccgauacu

SEQ ID NO: 1035590 - RNA, 19 nt, Homo sapiens
ugguugcuaucuuauguaa

SEQ ID NO: 1035591 - RNA, 19 nt, Homo sapiens
gcccuaauaucgguuaucu

SEQ ID NO: 1035592 - RNA, 19 nt, Homo sapiens
agaaaguagucgcagugaa

SEQ ID NO: 1035593 - RNA, 19 nt, Homo sapiens
caaagccagagaagaaaga

SEQ ID NO: 1035594 - RNA, 19 nt, Homo sapiens
cauuaagcauauccuugaa

SEQ ID NO: 1035595 - RNA, 19 nt, Homo sapiens
ugaaggacccagacucuag

SEQ ID NO: 1035596 - RNA, 19 nt, Homo sapiens
aguuauauaucgacgaaga

SEQ ID NO: 1035597 - RNA, 19 nt, Homo sapiens
uugcagucguuguauauug

SEQ ID NO: 1035598 - RNA, 19 nt, Homo sapiens
ccuaauaucgguuaucucu

SEQ ID NO: 1035599 - RNA, 19 nt, Homo sapiens
ugaguggugucuuugagau

SEQ ID NO: 1035600 - RNA, 19 nt, Homo sapiens
cccaagucauggauagaaa

SEQ ID NO: 1035601 - RNA, 19 nt, Homo sapiens
caagaaugcacccuucaag

SEQ ID NO: 1035602 - RNA, 19 nt, Homo sapiens
gaaguggacuaaaguauua

SEQ ID NO: 1035603 - RNA, 19 nt, Homo sapiens
gcaccaugcuggccuguua

SEQ ID NO: 1035604 - RNA, 19 nt, Homo sapiens
guacugcuuuguugaauaa

SEQ ID NO: 1035605 - RNA, 19 nt, Homo sapiens
gaagggaaguggacuaaag

SEQ ID NO: 1035606 - RNA, 19 nt, Homo sapiens
ggaaguggacuaaaguauu

SEQ ID NO: 1035607 - RNA, 19 nt, Homo sapiens
gaaagcagucuuccaguuc

SEQ ID NO: 1035608 - RNA, 19 nt, Homo sapiens
gagaugccauugcugaaau

SEQ ID NO: 1035609 - RNA, 19 nt, Homo sapiens
agaaagcagucuuccaguu

SEQ ID NO: 1035610 - RNA, 19 nt, Homo sapiens
gggcuuggcugcaggagau

SEQ ID NO: 1035611 - RNA, 19 nt, Homo sapiens
ccuguuaccuggugaagga

SEQ ID NO: 1035612 - RNA, 19 nt, Homo sapiens
ggagaugccauugcugaaa

SEQ ID NO: 1035613 - RNA, 19 nt, Homo sapiens
gcugaaauccgacgacuac

SEQ ID NO: 1035614 - RNA, 19 nt, Homo sapiens
uguacugcuuuguugaaua

SEQ ID NO: 1035615 - RNA, 19 nt, Homo sapiens
gggaaguggacuaaaguau

SEQ ID NO: 1035616 - RNA, 19 nt, Homo sapiens
gaugaagggaaguggacua

SEQ ID NO: 1035617 - RNA, 19 nt, Homo sapiens
ccacuaccaguuccuguug

SEQ ID NO: 1035618 - RNA, 19 nt, Homo sapiens
ggcugaagacacugaagua

SEQ ID NO: 1035619 - RNA, 19 nt, Homo sapiens
caacuucuccugggugcuu

SEQ ID NO: 1035620 - RNA, 19 nt, Homo sapiens
gcaggagaaagcagucuuc

SEQ ID NO: 1035621 - RNA, 19 nt, Homo sapiens
ggcuuguacugcuuuguug

SEQ ID NO: 1035622 - RNA, 19 nt, Homo sapiens
cugcuuuguugaauaaaug

SEQ ID NO: 1035623 - RNA, 19 nt, Homo sapiens
ucuaccagcgaacgaaaua

SEQ ID NO: 1035624 - RNA, 19 nt, Homo sapiens
ggaggcuuguacugcuuug

SEQ ID NO: 1035625 - RNA, 19 nt, Homo sapiens
aaagcagucuuccaguucu

SEQ ID NO: 1035626 - RNA, 19 nt, Homo sapiens
cccauuggcugaagacacu

SEQ ID NO: 1035627 - RNA, 19 nt, Homo sapiens
aagcagucuuccaguucua

SEQ ID NO: 1035628 - RNA, 19 nt, Homo sapiens
ugaaauccgacgacuacga

SEQ ID NO: 1035629 - RNA, 19 nt, Homo sapiens
gggaggcuuguacugcuuu

SEQ ID NO: 1035630 - RNA, 19 nt, Homo sapiens
ccuaugagcaggagaaagc

SEQ ID NO: 1035631 - RNA, 19 nt, Homo sapiens
ggacauggcucacagauuu

SEQ ID NO: 1035632 - RNA, 19 nt, Homo sapiens
ccaaaggacucucauuuau

SEQ ID NO: 1035633 - RNA, 19 nt, Homo sapiens
ggacagaagccuuguacua

SEQ ID NO: 1035634 - RNA, 19 nt, Homo sapiens
aaaggacucucauuuauuc

SEQ ID NO: 1035635 - RNA, 19 nt, Homo sapiens
gaagaagauuggagagcuu

SEQ ID NO: 1035636 - RNA, 19 nt, Homo sapiens
gggaggaaguggugucuga

SEQ ID NO: 1035637 - RNA, 19 nt, Homo sapiens
gaugagggcuacagcuguu

SEQ ID NO: 1035638 - RNA, 19 nt, Homo sapiens
gaaaggcuccuauggcaau

SEQ ID NO: 1035639 - RNA, 19 nt, Homo sapiens
caaaggacucucauuuauu

SEQ ID NO: 1035640 - RNA, 19 nt, Homo sapiens
gaaaugaugagcaguagca

SEQ ID NO: 1035641 - RNA, 19 nt, Homo sapiens
gggcuauggugcuggagua

SEQ ID NO: 1035642 - RNA, 19 nt, Homo sapiens
gcacuugcauccagcugau

SEQ ID NO: 1035643 - RNA, 19 nt, Homo sapiens
gcaucucccuggccuauag

SEQ ID NO: 1035644 - RNA, 19 nt, Homo sapiens
caaaugucgcgaugucuuu

SEQ ID NO: 1035645 - RNA, 19 nt, Homo sapiens
uccaaaggacucucauuua

SEQ ID NO: 1035646 - RNA, 19 nt, Homo sapiens
caguggaagucgcaauaaa

SEQ ID NO: 1035647 - RNA, 19 nt, Homo sapiens
ggaagucgcaauaaacagu

SEQ ID NO: 1035648 - RNA, 19 nt, Homo sapiens
ggugcugggucucugguuu

SEQ ID NO: 1035649 - RNA, 19 nt, Homo sapiens
cuacagcuccaaucagaaa

SEQ ID NO: 1035650 - RNA, 19 nt, Homo sapiens
ggaaguggugucugagcua

SEQ ID NO: 1035651 - RNA, 19 nt, Homo sapiens
ccauguggcuuauuaacag

SEQ ID NO: 1035652 - RNA, 19 nt, Homo sapiens
uuguggagcugacugagua

SEQ ID NO: 1035653 - RNA, 19 nt, Homo sapiens
gacgcaggcggguuuauuu

SEQ ID NO: 1035654 - RNA, 19 nt, Homo sapiens
gacagacgcaggcggguuu

SEQ ID NO: 1035655 - RNA, 19 nt, Homo sapiens
gcucaggaguacaagaaag

SEQ ID NO: 1035656 - RNA, 19 nt, Homo sapiens
gaagucgcaauaaacaguu

SEQ ID NO: 1035657 - RNA, 19 nt, Homo sapiens
gacagaagccuuguacuac

SEQ ID NO: 1035658 - RNA, 19 nt, Homo sapiens
guggaaaugaugagcagua

SEQ ID NO: 1035659 - RNA, 19 nt, Homo sapiens
guacuacacagaugacaca

SEQ ID NO: 1035660 - RNA, 19 nt, Homo sapiens
ggacucucauuuauuccau

SEQ ID NO: 1035661 - RNA, 19 nt, Homo sapiens
aacuacagcuccaaucaga

SEQ ID NO: 1035662 - RNA, 19 nt, Homo sapiens
uccaggaugugcagaaguu

SEQ ID NO: 1035663 - RNA, 19 nt, Homo sapiens
gaucccuucugccuucaau

SEQ ID NO: 1035664 - RNA, 19 nt, Homo sapiens
ucucauuuauuccaucuca

SEQ ID NO: 1035665 - RNA, 19 nt, Homo sapiens
ccaacuacagcuccaauca

SEQ ID NO: 1035666 - RNA, 19 nt, Homo sapiens
ccaaaugucgcgaugucuu

SEQ ID NO: 1035667 - RNA, 19 nt, Homo sapiens
gaagggacaggcacuugca

SEQ ID NO: 1035668 - RNA, 19 nt, Homo sapiens
uucaauagccuccaaagga

SEQ ID NO: 1035669 - RNA, 19 nt, Homo sapiens
ccaccgccaucuacugcuu

SEQ ID NO: 1035670 - RNA, 19 nt, Homo sapiens
gcgagcacuuucucaagca

SEQ ID NO: 1035671 - RNA, 19 nt, Homo sapiens
cuccaaaggacucucauuu

SEQ ID NO: 1035672 - RNA, 19 nt, Homo sapiens
ugucugagcuagggaaugg

SEQ ID NO: 1035673 - RNA, 19 nt, Homo sapiens
cagauuugcucaggaguac

SEQ ID NO: 1035674 - RNA, 19 nt, Homo sapiens
gauuugcucaggaguacaa

SEQ ID NO: 1035675 - RNA, 19 nt, Homo sapiens
ccagccgccugaagaagau

SEQ ID NO: 1035676 - RNA, 19 nt, Homo sapiens
ccagggaguugggcaugga

SEQ ID NO: 1035677 - RNA, 19 nt, Homo sapiens
aguagucacugucuucaag

SEQ ID NO: 1035678 - RNA, 19 nt, Homo sapiens
guggaagucgcaauaaaca

SEQ ID NO: 1035679 - RNA, 19 nt, Homo sapiens
ccaguggaagucgcaauaa

SEQ ID NO: 1035680 - RNA, 19 nt, Homo sapiens
gcauuguggagcugacuga

SEQ ID NO: 1035681 - RNA, 19 nt, Homo sapiens
ggagccagacccugagauc

SEQ ID NO: 1035682 - RNA, 19 nt, Homo sapiens
gugcuggaguagucacugu

SEQ ID NO: 1035683 - RNA, 19 nt, Homo sapiens
acuccuggcuccucaguag

SEQ ID NO: 1035684 - RNA, 19 nt, Homo sapiens
acagauuugcucaggagua

SEQ ID NO: 1035685 - RNA, 19 nt, Homo sapiens
uaacgggaaaggcuccuau

SEQ ID NO: 1035686 - RNA, 19 nt, Homo sapiens
cuauggugcuggaguaguc

SEQ ID NO: 1035687 - RNA, 19 nt, Homo sapiens
cuauagcaguguccaggau

SEQ ID NO: 1035688 - RNA, 19 nt, Homo sapiens
ggaguagucacugucuuca

SEQ ID NO: 1035689 - RNA, 19 nt, Homo sapiens
ccagcgagcacuuucucaa

SEQ ID NO: 1035690 - RNA, 19 nt, Homo sapiens
cagcagguuguguggauga

SEQ ID NO: 1035691 - RNA, 19 nt, Homo sapiens
cgagcacuuucucaagcaa

SEQ ID NO: 1035692 - RNA, 19 nt, Homo sapiens
uggaaaugaugagcaguag

SEQ ID NO: 1035693 - RNA, 19 nt, Homo sapiens
cgucaguccugcgucaugu

SEQ ID NO: 1035694 - RNA, 19 nt, Homo sapiens
agacgcaggcggguuuauu

SEQ ID NO: 1035695 - RNA, 19 nt, Homo sapiens
caacuacagcuccaaucag

SEQ ID NO: 1035696 - RNA, 19 nt, Homo sapiens
gaccaacuacagcuccaau

SEQ ID NO: 1035697 - RNA, 19 nt, Homo sapiens
gcaaugggcuugaauuaaa

SEQ ID NO: 1035698 - RNA, 19 nt, Homo sapiens
gcagagagaugcugaaaga

SEQ ID NO: 1035699 - RNA, 19 nt, Homo sapiens
guacagauauuacaacuug

SEQ ID NO: 1035700 - RNA, 19 nt, Homo sapiens
ccaaagaccuaauaucaaa

SEQ ID NO: 1035701 - RNA, 19 nt, Homo sapiens
gaauuacugucacucauuu

SEQ ID NO: 1035702 - RNA, 19 nt, Homo sapiens
gggaaagaaucaaauauug

SEQ ID NO: 1035703 - RNA, 19 nt, Homo sapiens
gaacaaauggccucaguga

SEQ ID NO: 1035704 - RNA, 19 nt, Homo sapiens
gcgaacaccugggauauuu

SEQ ID NO: 1035705 - RNA, 19 nt, Homo sapiens
gaagggaaagaaucaaaua

SEQ ID NO: 1035706 - RNA, 19 nt, Homo sapiens
ggccauggcuuccucaauu

SEQ ID NO: 1035707 - RNA, 19 nt, Homo sapiens
gaagccaucaaguuaauua

SEQ ID NO: 1035708 - RNA, 19 nt, Homo sapiens
ggauauugcuuuaacugaa

SEQ ID NO: 1035709 - RNA, 19 nt, Homo sapiens
gaccuuaaguuacagacua

SEQ ID NO: 1035710 - RNA, 19 nt, Homo sapiens
gcuaauacgugcuggaaug

SEQ ID NO: 1035711 - RNA, 19 nt, Homo sapiens
gcuggaagccaucaaguua

SEQ ID NO: 1035712 - RNA, 19 nt, Homo sapiens
ggaugaagcugugagaguu

SEQ ID NO: 1035713 - RNA, 19 nt, Homo sapiens
uaaggaagauccauguaga

SEQ ID NO: 1035714 - RNA, 19 nt, Homo sapiens
ccagagagcuacaagaaca

SEQ ID NO: 1035715 - RNA, 19 nt, Homo sapiens
gugaaacgauggcuaauag

SEQ ID NO: 1035716 - RNA, 19 nt, Homo sapiens
cacaaucccuugagugaaa

SEQ ID NO: 1035717 - RNA, 19 nt, Homo sapiens
caacugcuguaacaaauca

SEQ ID NO: 1035718 - RNA, 19 nt, Homo sapiens
caacaugguucucuugaag

SEQ ID NO: 1035719 - RNA, 19 nt, Homo sapiens
gccauggcuuccucaauua

SEQ ID NO: 1035720 - RNA, 19 nt, Homo sapiens
uggaauggauauugcuuua

SEQ ID NO: 1035721 - RNA, 19 nt, Homo sapiens
gaauggauauugcuuuaac

SEQ ID NO: 1035722 - RNA, 19 nt, Homo sapiens
guacagaaacuauuugcaa

SEQ ID NO: 1035723 - RNA, 19 nt, Homo sapiens
ggguuuaccuccucacuug

SEQ ID NO: 1035724 - RNA, 19 nt, Homo sapiens
ugaaauauauccgggagaa

SEQ ID NO: 1035725 - RNA, 19 nt, Homo sapiens
cuaccuggcugauacugua

SEQ ID NO: 1035726 - RNA, 19 nt, Homo sapiens
ucacucaucuucauacaca

SEQ ID NO: 1035727 - RNA, 19 nt, Homo sapiens
gugcagcgcugucucugaa

SEQ ID NO: 1035728 - RNA, 19 nt, Homo sapiens
ucugauaaaugcacucaaa

SEQ ID NO: 1035729 - RNA, 19 nt, Homo sapiens
aaacuaagauaugcagaga

SEQ ID NO: 1035730 - RNA, 19 nt, Homo sapiens
ucacugaguacagauauua

SEQ ID NO: 1035731 - RNA, 19 nt, Homo sapiens
caaagcuucugcagauaga

SEQ ID NO: 1035732 - RNA, 19 nt, Homo sapiens
acucaaagcuucugcagau

SEQ ID NO: 1035733 - RNA, 19 nt, Homo sapiens
gcagcgcugucucugaauu

SEQ ID NO: 1035734 - RNA, 19 nt, Homo sapiens
caaaagaguuggcaugguu

SEQ ID NO: 1035735 - RNA, 19 nt, Homo sapiens
uuagagaguuuccuucuuc

SEQ ID NO: 1035736 - RNA, 19 nt, Homo sapiens
gagaguuuccuucuucauu

SEQ ID NO: 1035737 - RNA, 19 nt, Homo sapiens
gaagucaccaucaccauca

SEQ ID NO: 1035738 - RNA, 19 nt, Homo sapiens
gggcuugaauuaaaugcuu

SEQ ID NO: 1035739 - RNA, 19 nt, Homo sapiens
ugccugcucugaaucuuua

SEQ ID NO: 1035740 - RNA, 19 nt, Homo sapiens
gcacuucagagcaacauga

SEQ ID NO: 1035741 - RNA, 19 nt, Homo sapiens
uaacugaaccacugacaau

SEQ ID NO: 1035742 - RNA, 19 nt, Homo sapiens
gaaaggacaguugaaaaua

SEQ ID NO: 1035743 - RNA, 19 nt, Homo sapiens
gaugugugcuuuugcauuu

SEQ ID NO: 1035744 - RNA, 19 nt, Homo sapiens
acuaagauaugcagagaga

SEQ ID NO: 1035745 - RNA, 19 nt, Homo sapiens
ccuccucacuugacaacua

SEQ ID NO: 1035746 - RNA, 19 nt, Homo sapiens
uuaguaucccugugaauua

SEQ ID NO: 1035747 - RNA, 19 nt, Homo sapiens
ucucugaauuccuugcaua

SEQ ID NO: 1035748 - RNA, 19 nt, Homo sapiens
cagcagcgcuuuuggauga

SEQ ID NO: 1035749 - RNA, 19 nt, Homo sapiens
caaugggcuugaauuaaau

SEQ ID NO: 1035750 - RNA, 19 nt, Homo sapiens
gccaucaaguuaauuagau

SEQ ID NO: 1035751 - RNA, 19 nt, Homo sapiens
aacgauggcuaauagguaa

SEQ ID NO: 1035752 - RNA, 19 nt, Homo sapiens
guugauaccuugugucacu

SEQ ID NO: 1035753 - RNA, 19 nt, Homo sapiens
cgaugcaacugcuguaaca

SEQ ID NO: 1035754 - RNA, 19 nt, Homo sapiens
gaaacaacaaacacccauu

SEQ ID NO: 1035755 - RNA, 19 nt, Homo sapiens
cagaaacuauuugcaaaca

SEQ ID NO: 1035756 - RNA, 19 nt, Homo sapiens
gaauggcaaugggcuugaa

SEQ ID NO: 1035757 - RNA, 19 nt, Homo sapiens
aaacgauggcuaauaggua

SEQ ID NO: 1035758 - RNA, 19 nt, Homo sapiens
ugaaagcuccacccaaaga

SEQ ID NO: 1035759 - RNA, 19 nt, Homo sapiens
ugcauacugucagauauua

SEQ ID NO: 1035760 - RNA, 19 nt, Homo sapiens
gaaacgauggcuaauaggu

SEQ ID NO: 1035761 - RNA, 19 nt, Homo sapiens
agaaagaccagcagcgaaa

SEQ ID NO: 1035762 - RNA, 19 nt, Homo sapiens
ugguuuggcuucugauaaa

SEQ ID NO: 1035763 - RNA, 19 nt, Homo sapiens
gaaccacugacaauggaaa

SEQ ID NO: 1035764 - RNA, 19 nt, Homo sapiens
uaagauaugcagagagaug

SEQ ID NO: 1035765 - RNA, 19 nt, Homo sapiens
gggcgcaguuugacaaucu

SEQ ID NO: 1035766 - RNA, 19 nt, Homo sapiens
gcacuacacaucccaacug

SEQ ID NO: 1035767 - RNA, 19 nt, Homo sapiens
ugagagagggcuccaauuc

SEQ ID NO: 1035768 - RNA, 19 nt, Homo sapiens
aaacaacaaacacccauug

SEQ ID NO: 1035769 - RNA, 19 nt, Homo sapiens
gcagcugcguacucucuug

SEQ ID NO: 1035770 - RNA, 19 nt, Homo sapiens
gauauugcuuuaacugaac

SEQ ID NO: 1035771 - RNA, 19 nt, Homo sapiens
guuacagacuagcagguuu

SEQ ID NO: 1035772 - RNA, 19 nt, Homo sapiens
ugagugaaacgauggcuaa

SEQ ID NO: 1035773 - RNA, 19 nt, Homo sapiens
uaccuugugucacugagua

SEQ ID NO: 1035774 - RNA, 19 nt, Homo sapiens
ugaauuccuugcauacugu

SEQ ID NO: 1035775 - RNA, 19 nt, Homo sapiens
ggaaagaaucaaauauugc

SEQ ID NO: 1035776 - RNA, 19 nt, Homo sapiens
ggcaaugggcuugaauuaa

SEQ ID NO: 1035777 - RNA, 19 nt, Homo sapiens
caacugggccugaagaacu

SEQ ID NO: 1035778 - RNA, 19 nt, Homo sapiens
gaugauugcauauucaaca

SEQ ID NO: 1035779 - RNA, 19 nt, Homo sapiens
aagcacauguuugaaauuc

SEQ ID NO: 1035780 - RNA, 19 nt, Homo sapiens
gaaugaugcggcuucaguu

SEQ ID NO: 1035781 - RNA, 19 nt, Homo sapiens
uggcaaugggcuugaauua

SEQ ID NO: 1035782 - RNA, 19 nt, Homo sapiens
gcucugaaucuuuaaggaa

SEQ ID NO: 1035783 - RNA, 19 nt, Homo sapiens
ggaauggauauugcuuuaa

SEQ ID NO: 1035784 - RNA, 19 nt, Homo sapiens
acacauucacuguuuguuu

SEQ ID NO: 1035785 - RNA, 19 nt, Homo sapiens
gggcauggaauggauauug

SEQ ID NO: 1035786 - RNA, 19 nt, Homo sapiens
gcaaacauagcagaaguca

SEQ ID NO: 1035787 - RNA, 19 nt, Homo sapiens
agaguuuccuucuucauuc

SEQ ID NO: 1035788 - RNA, 19 nt, Homo sapiens
gaguacagauauuacaacu

SEQ ID NO: 1035789 - RNA, 19 nt, Homo sapiens
caacaugucccucaaacac

SEQ ID NO: 1035790 - RNA, 19 nt, Homo sapiens
uggaagccaucaaguuaau

SEQ ID NO: 1035791 - RNA, 19 nt, Homo sapiens
gauggcuaauagguaaaua

SEQ ID NO: 1035792 - RNA, 19 nt, Homo sapiens
ggcaugguuuggcuucuga

SEQ ID NO: 1035793 - RNA, 19 nt, Homo sapiens
gccguuauggcccagauua

SEQ ID NO: 1035794 - RNA, 19 nt, Homo sapiens
aaacgcaacugggccugaa

SEQ ID NO: 1035795 - RNA, 19 nt, Homo sapiens
caggagcacugccagaucu

SEQ ID NO: 1035796 - RNA, 19 nt, Homo sapiens
cauucaccauccaaacuaa

SEQ ID NO: 1035797 - RNA, 19 nt, Homo sapiens
ggagaaguuucacuacaga

SEQ ID NO: 1035798 - RNA, 19 nt, Homo sapiens
gccaacccaucccaaauuu

SEQ ID NO: 1035799 - RNA, 19 nt, Homo sapiens
ggaaccuccuguacgagua

SEQ ID NO: 1035800 - RNA, 19 nt, Homo sapiens
ccaaggagaaguuucacua

SEQ ID NO: 1035801 - RNA, 19 nt, Homo sapiens
gaagagaaggcagcuguga

SEQ ID NO: 1035802 - RNA, 19 nt, Homo sapiens
ggacacagacgacgauugg

SEQ ID NO: 1035803 - RNA, 19 nt, Homo sapiens
ugacagagcugggcuugca

SEQ ID NO: 1035804 - RNA, 19 nt, Homo sapiens
gcugugggaugacaccaaa

SEQ ID NO: 1035805 - RNA, 19 nt, Homo sapiens
ccacgugccucuccaguac

SEQ ID NO: 1035806 - RNA, 19 nt, Homo sapiens
ggauaugcccacccaagaa

SEQ ID NO: 1035807 - RNA, 19 nt, Homo sapiens
gaaguuucacuacagagaa

SEQ ID NO: 1035808 - RNA, 19 nt, Homo sapiens
cagguucgcugccuugcaa

SEQ ID NO: 1035809 - RNA, 19 nt, Homo sapiens
ggcugcaucuccaacgaua

SEQ ID NO: 1035810 - RNA, 19 nt, Homo sapiens
caacuucacauucaacaag

SEQ ID NO: 1035811 - RNA, 19 nt, Homo sapiens
ccaggacaguggugaagug

SEQ ID NO: 1035812 - RNA, 19 nt, Homo sapiens
gauaguccaaggagaaguu

SEQ ID NO: 1035813 - RNA, 19 nt, Homo sapiens
gcaggacgucugggcuuua

SEQ ID NO: 1035814 - RNA, 19 nt, Homo sapiens
ggagaggucaccagugcuu

SEQ ID NO: 1035815 - RNA, 19 nt, Homo sapiens
gacaaacacgggacaggaa

SEQ ID NO: 1035816 - RNA, 19 nt, Homo sapiens
gaaaccggaaccuccugua

SEQ ID NO: 1035817 - RNA, 19 nt, Homo sapiens
aauaaauggucaggacaaa

SEQ ID NO: 1035818 - RNA, 19 nt, Homo sapiens
gacaggagaagcagaggaa

SEQ ID NO: 1035819 - RNA, 19 nt, Homo sapiens
caucccuccuuccuucuuu

SEQ ID NO: 1035820 - RNA, 19 nt, Homo sapiens
cacugacccuguuaucauu

SEQ ID NO: 1035821 - RNA, 19 nt, Homo sapiens
caacccaucccaaauuuac

SEQ ID NO: 1035822 - RNA, 19 nt, Homo sapiens
ccuggaaauuggcgagaaa

SEQ ID NO: 1035823 - RNA, 19 nt, Homo sapiens
ucccucagcuggacauaga

SEQ ID NO: 1035824 - RNA, 19 nt, Homo sapiens
caauaaauggucaggacaa

SEQ ID NO: 1035825 - RNA, 19 nt, Homo sapiens
gaucucaaccuggcuggaa

SEQ ID NO: 1035826 - RNA, 19 nt, Homo sapiens
ucacugacccuguuaucau

SEQ ID NO: 1035827 - RNA, 19 nt, Homo sapiens
gaaccuccuguacgaguau

SEQ ID NO: 1035828 - RNA, 19 nt, Homo sapiens
ccugacaucuguguucuuc

SEQ ID NO: 1035829 - RNA, 19 nt, Homo sapiens
caucccaaauuuacaacau

SEQ ID NO: 1035830 - RNA, 19 nt, Homo sapiens
ccaacccaucccaaauuua

SEQ ID NO: 1035831 - RNA, 19 nt, Homo sapiens
uuugaaggcugugggauga

SEQ ID NO: 1035832 - RNA, 19 nt, Homo sapiens
aaggagaaguuucacuaca

SEQ ID NO: 1035833 - RNA, 19 nt, Homo sapiens
gggcgacgaaggacucuau

SEQ ID NO: 1035834 - RNA, 19 nt, Homo sapiens
gaguuccugucccuucaga

SEQ ID NO: 1035835 - RNA, 19 nt, Homo sapiens
gaggcugcaucuccaacga

SEQ ID NO: 1035836 - RNA, 19 nt, Homo sapiens
cuggucaacuucacauuca

SEQ ID NO: 1035837 - RNA, 19 nt, Homo sapiens
agaguaaccagcagaagga

SEQ ID NO: 1035838 - RNA, 19 nt, Homo sapiens
ggaaauuggcgagaaacuc

SEQ ID NO: 1035839 - RNA, 19 nt, Homo sapiens
ccacauggucggagacaag

SEQ ID NO: 1035840 - RNA, 19 nt, Homo sapiens
agaaggcagcugugacuga

SEQ ID NO: 1035841 - RNA, 19 nt, Homo sapiens
gaguacaccacuucaccaa

SEQ ID NO: 1035842 - RNA, 19 nt, Homo sapiens
ggagcuuguucaccuguac

SEQ ID NO: 1035843 - RNA, 19 nt, Homo sapiens
ucacuacagagaaacgaaa

SEQ ID NO: 1035844 - RNA, 19 nt, Homo sapiens
ugacaucuguguucuuccu

SEQ ID NO: 1035845 - RNA, 19 nt, Homo sapiens
gcacggccuggucaacuuc

SEQ ID NO: 1035846 - RNA, 19 nt, Homo sapiens
caggagaagcagaggaaga

SEQ ID NO: 1035847 - RNA, 19 nt, Homo sapiens
ccaccucuccucuguccuu

SEQ ID NO: 1035848 - RNA, 19 nt, Homo sapiens
uaccgcaaguuugacauug

SEQ ID NO: 1035849 - RNA, 19 nt, Homo sapiens
gcacuuccggguccuggau

SEQ ID NO: 1035850 - RNA, 19 nt, Homo sapiens
ggguccaccucuccucugu

SEQ ID NO: 1035851 - RNA, 19 nt, Homo sapiens
aguccuaccucggcacuga

SEQ ID NO: 1035852 - RNA, 19 nt, Homo sapiens
gauaugcccacccaagaac

SEQ ID NO: 1035853 - RNA, 19 nt, Homo sapiens
ugccaacccaucccaaauu

SEQ ID NO: 1035854 - RNA, 19 nt, Homo sapiens
ugaaggcugugggaugaca

SEQ ID NO: 1035855 - RNA, 19 nt, Homo sapiens
ccgccuaccgcaaguuuga

SEQ ID NO: 1035856 - RNA, 19 nt, Homo sapiens
cgacccugcccgcuucaaa

SEQ ID NO: 1035857 - RNA, 19 nt, Homo sapiens
cgacaucauccgucagaag

SEQ ID NO: 1035858 - RNA, 19 nt, Homo sapiens
ggucggagacaagccaguu

SEQ ID NO: 1035859 - RNA, 19 nt, Homo sapiens
caaggagaaguuucacuac

SEQ ID NO: 1035860 - RNA, 19 nt, Homo sapiens
gcuugcaggcuacuucaug

SEQ ID NO: 1035861 - RNA, 19 nt, Homo sapiens
guuccugucccuucagaug

SEQ ID NO: 1035862 - RNA, 19 nt, Homo sapiens
agaaguuucacuacagaga

SEQ ID NO: 1035863 - RNA, 19 nt, Homo sapiens
ggacgaagugccgccuugu

SEQ ID NO: 1035864 - RNA, 19 nt, Homo sapiens
aggagaaguuucacuacag

SEQ ID NO: 1035865 - RNA, 19 nt, Homo sapiens
ccgcaaguuugacauugag

SEQ ID NO: 1035866 - RNA, 19 nt, Homo sapiens
ccgcggagcaguguuugaa

SEQ ID NO: 1035867 - RNA, 19 nt, Homo sapiens
ccgcgaucaucucgacaug

SEQ ID NO: 1035868 - RNA, 19 nt, Homo sapiens
gugcuaacauucaugauua

SEQ ID NO: 1035869 - RNA, 19 nt, Homo sapiens
gaagaauaauggcuuguuc

SEQ ID NO: 1035870 - RNA, 19 nt, Homo sapiens
uaaggaaccuaucgaagaa

SEQ ID NO: 1035871 - RNA, 19 nt, Homo sapiens
ggaagagaguggaauggaa

SEQ ID NO: 1035872 - RNA, 19 nt, Homo sapiens
caaaagagauacuuacuga

SEQ ID NO: 1035873 - RNA, 19 nt, Homo sapiens
gacaauugcuuuagaccuu

SEQ ID NO: 1035874 - RNA, 19 nt, Homo sapiens
gaagagaguggaauggaaa

SEQ ID NO: 1035875 - RNA, 19 nt, Homo sapiens
gccaagauguccucuguga

SEQ ID NO: 1035876 - RNA, 19 nt, Homo sapiens
ggccaaagaugggacaauu

SEQ ID NO: 1035877 - RNA, 19 nt, Homo sapiens
agaaaucucuaugguguaa

SEQ ID NO: 1035878 - RNA, 19 nt, Homo sapiens
gcaccuugaucuugaacuu

SEQ ID NO: 1035879 - RNA, 19 nt, Homo sapiens
gaaaguagagaugagguuu

SEQ ID NO: 1035880 - RNA, 19 nt, Homo sapiens
gcgaauccuuguccaguga

SEQ ID NO: 1035881 - RNA, 19 nt, Homo sapiens
gcuggcaccuugaucuuga

SEQ ID NO: 1035882 - RNA, 19 nt, Homo sapiens
gaugagguuucuccauguu

SEQ ID NO: 1035883 - RNA, 19 nt, Homo sapiens
agaaagaaaucucuauggu

SEQ ID NO: 1035884 - RNA, 19 nt, Homo sapiens
ccagaacugugagaaagaa

SEQ ID NO: 1035885 - RNA, 19 nt, Homo sapiens
cgagguggcugucuacaag

SEQ ID NO: 1035886 - RNA, 19 nt, Homo sapiens
ccacugccaucaucuuuag

SEQ ID NO: 1035887 - RNA, 19 nt, Homo sapiens
gaacgguguuauggacuga

SEQ ID NO: 1035888 - RNA, 19 nt, Homo sapiens
gcagccagguacuaaagga

SEQ ID NO: 1035889 - RNA, 19 nt, Homo sapiens
ccaaagugcugggauuaca

SEQ ID NO: 1035890 - RNA, 19 nt, Homo sapiens
gcaacuggccugagcaaca

SEQ ID NO: 1035891 - RNA, 19 nt, Homo sapiens
ugacuccacuccugacuuc

SEQ ID NO: 1035892 - RNA, 19 nt, Homo sapiens
gauguccucugugaaguug

SEQ ID NO: 1035893 - RNA, 19 nt, Homo sapiens
gcgaugagguuccgguucu

SEQ ID NO: 1035894 - RNA, 19 nt, Homo sapiens
uuaaggaaccuaucgaaga

SEQ ID NO: 1035895 - RNA, 19 nt, Homo sapiens
gacaggggauugauuauga

SEQ ID NO: 1035896 - RNA, 19 nt, Homo sapiens
aggaaccuaucgaagaaua

SEQ ID NO: 1035897 - RNA, 19 nt, Homo sapiens
caagauguccucugugaag

SEQ ID NO: 1035898 - RNA, 19 nt, Homo sapiens
gaacugugagaaagaaauc

SEQ ID NO: 1035899 - RNA, 19 nt, Homo sapiens
caagaggaacgguguuaug

SEQ ID NO: 1035900 - RNA, 19 nt, Homo sapiens
gaagugaccaugccugaac

SEQ ID NO: 1035901 - RNA, 19 nt, Homo sapiens
ggaggcagcccugguucua

SEQ ID NO: 1035902 - RNA, 19 nt, Homo sapiens
gaaccuaucgaagaauaau

SEQ ID NO: 1035903 - RNA, 19 nt, Homo sapiens
ggaggaagagaguggaaug

SEQ ID NO: 1035904 - RNA, 19 nt, Homo sapiens
uauagcagcucgagaagac

SEQ ID NO: 1035905 - RNA, 19 nt, Homo sapiens
aaaauuagccgaucaugaa

SEQ ID NO: 1035906 - RNA, 19 nt, Homo sapiens
aaagaugggacaauuugaa

SEQ ID NO: 1035907 - RNA, 19 nt, Homo sapiens
gaggugggacaauugcuuu

SEQ ID NO: 1035908 - RNA, 19 nt, Homo sapiens
uaccuucccuucccuugaa

SEQ ID NO: 1035909 - RNA, 19 nt, Homo sapiens
ugaagccucuguccacaca

SEQ ID NO: 1035910 - RNA, 19 nt, Homo sapiens
ucauguuccuccagaauuc

SEQ ID NO: 1035911 - RNA, 19 nt, Homo sapiens
ggcaagaggaacgguguua

SEQ ID NO: 1035912 - RNA, 19 nt, Homo sapiens
gaaccagucauuggcaaga

SEQ ID NO: 1035913 - RNA, 19 nt, Homo sapiens
gaggaccuuucccagcauu

SEQ ID NO: 1035914 - RNA, 19 nt, Homo sapiens
caguggcagugcugaguuu

SEQ ID NO: 1035915 - RNA, 19 nt, Homo sapiens
gugggacaauugcuuuaga

SEQ ID NO: 1035916 - RNA, 19 nt, Homo sapiens
ccagucagguuacacaaaa

SEQ ID NO: 1035917 - RNA, 19 nt, Homo sapiens
gccaaagaugggacaauuu

SEQ ID NO: 1035918 - RNA, 19 nt, Homo sapiens
ggaaccuaucgaagaauaa

SEQ ID NO: 1035919 - RNA, 19 nt, Homo sapiens
acacagggagacucaguuu

SEQ ID NO: 1035920 - RNA, 19 nt, Homo sapiens
cacacgagguggcugucua

SEQ ID NO: 1035921 - RNA, 19 nt, Homo sapiens
ggaggugggacaauugcuu

SEQ ID NO: 1035922 - RNA, 19 nt, Homo sapiens
ccuggaguaucuuaaggaa

SEQ ID NO: 1035923 - RNA, 19 nt, Homo sapiens
uggccaagauguccucugu

SEQ ID NO: 1035924 - RNA, 19 nt, Homo sapiens
gcaagaggaacgguguuau

SEQ ID NO: 1035925 - RNA, 19 nt, Homo sapiens
ccauggcccagucagguua

SEQ ID NO: 1035926 - RNA, 19 nt, Homo sapiens
cgagaagacuaaggcagau

SEQ ID NO: 1035927 - RNA, 19 nt, Homo sapiens
gccacugccaucaucuuua

SEQ ID NO: 1035928 - RNA, 19 nt, Homo sapiens
aaagugcuaacauucauga

SEQ ID NO: 1035929 - RNA, 19 nt, Homo sapiens
aaagagauacuuacugacu

SEQ ID NO: 1035930 - RNA, 19 nt, Homo sapiens
ccagaaagagggcugucaa

SEQ ID NO: 1035931 - RNA, 19 nt, Homo sapiens
cugccucacuucucucuug

SEQ ID NO: 1035932 - RNA, 19 nt, Homo sapiens
caacacagggagacucagu

SEQ ID NO: 1035933 - RNA, 19 nt, Homo sapiens
caacuggccugagcaacac

SEQ ID NO: 1035934 - RNA, 19 nt, Homo sapiens
ccuguaaucccagcacuuu

SEQ ID NO: 1035935 - RNA, 19 nt, Homo sapiens
gaagguaaggaggaagaga

SEQ ID NO: 1035936 - RNA, 19 nt, Homo sapiens
caaaagugcuaacauucau

SEQ ID NO: 1035937 - RNA, 19 nt, Homo sapiens
ggauugauuaugagaagau

SEQ ID NO: 1035938 - RNA, 19 nt, Homo sapiens
ccagcugccucacuucucu

SEQ ID NO: 1035939 - RNA, 19 nt, Homo sapiens
gaugggacaauuugaacau

SEQ ID NO: 1035940 - RNA, 19 nt, Homo sapiens
ccagggcuccuuguagaaa

SEQ ID NO: 1035941 - RNA, 19 nt, Homo sapiens
cggcugacgccaaguuuga

SEQ ID NO: 1035942 - RNA, 19 nt, Homo sapiens
acacaugcacaccagauga

SEQ ID NO: 1035943 - RNA, 19 nt, Homo sapiens
guagaacuauacaaaagug

SEQ ID NO: 1035944 - RNA, 19 nt, Homo sapiens
cuauuccucccacuaagua

SEQ ID NO: 1035945 - RNA, 19 nt, Homo sapiens
cgaagaauaauggcuuguu

SEQ ID NO: 1035946 - RNA, 19 nt, Homo sapiens
ucccuucccuugaaaguag

SEQ ID NO: 1035947 - RNA, 19 nt, Homo sapiens
ccacuaaguacaguuaaca

SEQ ID NO: 1035948 - RNA, 19 nt, Homo sapiens
cagaagguaaggaggaaga

SEQ ID NO: 1035949 - RNA, 19 nt, Homo sapiens
ugggacaauuugaacauca

SEQ ID NO: 1035950 - RNA, 19 nt, Homo sapiens
uguuauagcagcucgagaa

SEQ ID NO: 1035951 - RNA, 19 nt, Homo sapiens
acuagucuguggcauuguu

SEQ ID NO: 1035952 - RNA, 19 nt, Homo sapiens
gggauugauuaugagaaga

SEQ ID NO: 1035953 - RNA, 19 nt, Homo sapiens
ccucucagcagacaaguuc

SEQ ID NO: 1035954 - RNA, 19 nt, Homo sapiens
agacucaguuucuccaaaa

SEQ ID NO: 1035955 - RNA, 19 nt, Homo sapiens
gcaguggcccaugccugua

SEQ ID NO: 1035956 - RNA, 19 nt, Homo sapiens
ggaccugaggcuccacaga

SEQ ID NO: 1035957 - RNA, 19 nt, Homo sapiens
guuaugaggagaagcaaag

SEQ ID NO: 1035958 - RNA, 19 nt, Homo sapiens
auuagggucucagaaggua

SEQ ID NO: 1035959 - RNA, 19 nt, Homo sapiens
uagcagcucgagaagacua

SEQ ID NO: 1035960 - RNA, 19 nt, Homo sapiens
agaugagguuucuccaugu

SEQ ID NO: 1035961 - RNA, 19 nt, Homo sapiens
gcucugcagccagguacua

SEQ ID NO: 1035962 - RNA, 19 nt, Homo sapiens
gguguuauggacugaaugu

SEQ ID NO: 1035963 - RNA, 19 nt, Homo sapiens
aaauuagccgaucaugaaa

SEQ ID NO: 1035964 - RNA, 19 nt, Homo sapiens
uuugggaggugggacaauu

SEQ ID NO: 1035965 - RNA, 19 nt, Homo sapiens
gaacuauacaaaagugcua

SEQ ID NO: 1035966 - RNA, 19 nt, Homo sapiens
ugaaaguagagaugagguu

SEQ ID NO: 1035967 - RNA, 19 nt, Homo sapiens
acagggagacucaguuucu

SEQ ID NO: 1035968 - RNA, 19 nt, Homo sapiens
gaacagagagucauaugaa

SEQ ID NO: 1035969 - RNA, 19 nt, Homo sapiens
guaaacaaguauggagaua

SEQ ID NO: 1035970 - RNA, 19 nt, Homo sapiens
aaauaugacucaaguguga

SEQ ID NO: 1035971 - RNA, 19 nt, Homo sapiens
uuacaaugcucuagaauca

SEQ ID NO: 1035972 - RNA, 19 nt, Homo sapiens
caagagaaauucaagaaac

SEQ ID NO: 1035973 - RNA, 19 nt, Homo sapiens
cauagggccugauuacauu

SEQ ID NO: 1035974 - RNA, 19 nt, Homo sapiens
gcagcagucuucauaaaca

SEQ ID NO: 1035975 - RNA, 19 nt, Homo sapiens
aaugauaucugcauguuga

SEQ ID NO: 1035976 - RNA, 19 nt, Homo sapiens
cagcagcagucuucauaaa

SEQ ID NO: 1035977 - RNA, 19 nt, Homo sapiens
uggagaagcuuuacgauca

SEQ ID NO: 1035978 - RNA, 19 nt, Homo sapiens
gcucuagaaucagcauaua

SEQ ID NO: 1035979 - RNA, 19 nt, Homo sapiens
ccacugguauuacugauca

SEQ ID NO: 1035980 - RNA, 19 nt, Homo sapiens
ccauucaguucuucuauga

SEQ ID NO: 1035981 - RNA, 19 nt, Homo sapiens
guacucaccuuagggauuc

SEQ ID NO: 1035982 - RNA, 19 nt, Homo sapiens
guucagaucugugccuuug

SEQ ID NO: 1035983 - RNA, 19 nt, Homo sapiens
gaagaaaguccuaaaagaa

SEQ ID NO: 1035984 - RNA, 19 nt, Homo sapiens
ccaauuccauucaguucuu

SEQ ID NO: 1035985 - RNA, 19 nt, Homo sapiens
cagagagucauaugaagua

SEQ ID NO: 1035986 - RNA, 19 nt, Homo sapiens
ugacuucuaugguguuuua

SEQ ID NO: 1035987 - RNA, 19 nt, Homo sapiens
caacauccagcuucaucua

SEQ ID NO: 1035988 - RNA, 19 nt, Homo sapiens
gaccugaucccaaccuuga

SEQ ID NO: 1035989 - RNA, 19 nt, Homo sapiens
ggacaagcacgacgaucuu

SEQ ID NO: 1035990 - RNA, 19 nt, Homo sapiens
augauuaccugcaugcuuu

SEQ ID NO: 1035991 - RNA, 19 nt, Homo sapiens
ggagauacuugggaugagu

SEQ ID NO: 1035992 - RNA, 19 nt, Homo sapiens
caagucaucccaaauaugg

SEQ ID NO: 1035993 - RNA, 19 nt, Homo sapiens
gagcucagcagcagucuuc

SEQ ID NO: 1035994 - RNA, 19 nt, Homo sapiens
ggagagucuucgcagaaug

SEQ ID NO: 1035995 - RNA, 19 nt, Homo sapiens
gauaucugcauguugaauu

SEQ ID NO: 1035996 - RNA, 19 nt, Homo sapiens
gugaagcuuugcaucaaga

SEQ ID NO: 1035997 - RNA, 19 nt, Homo sapiens
uaaauguacucaccuuagg

SEQ ID NO: 1035998 - RNA, 19 nt, Homo sapiens
guaaauguacucaccuuag

SEQ ID NO: 1035999 - RNA, 19 nt, Homo sapiens
gaauaagaacagagaguca

SEQ ID NO: 1036000 - RNA, 19 nt, Homo sapiens
ugaagaaaguccuaaaaga

SEQ ID NO: 1036001 - RNA, 19 nt, Homo sapiens
gccaagagaaauucaagaa

SEQ ID NO: 1036002 - RNA, 19 nt, Homo sapiens
guucuucuaugaaugaauc

SEQ ID NO: 1036003 - RNA, 19 nt, Homo sapiens
ccaagagaaauucaagaaa

SEQ ID NO: 1036004 - RNA, 19 nt, Homo sapiens
uuccaucccuaaacuuaua

SEQ ID NO: 1036005 - RNA, 19 nt, Homo sapiens
gguuccaucccuaaacuua

SEQ ID NO: 1036006 - RNA, 19 nt, Homo sapiens
ugaaugggagggcugauuu

SEQ ID NO: 1036007 - RNA, 19 nt, Homo sapiens
cugauuacauuccaacaga

SEQ ID NO: 1036008 - RNA, 19 nt, Homo sapiens
gaaugcagagguuccaaga

SEQ ID NO: 1036009 - RNA, 19 nt, Homo sapiens
gagauuacaaugcucuaga

SEQ ID NO: 1036010 - RNA, 19 nt, Homo sapiens
gaaggaguuucaacaucca

SEQ ID NO: 1036011 - RNA, 19 nt, Homo sapiens
gaagucaaaguaaacaagu

SEQ ID NO: 1036012 - RNA, 19 nt, Homo sapiens
uuucaagucaucccaaaua

SEQ ID NO: 1036013 - RNA, 19 nt, Homo sapiens
ccacauagggccugauuac

SEQ ID NO: 1036014 - RNA, 19 nt, Homo sapiens
agauuacaaugcucuagaa

SEQ ID NO: 1036015 - RNA, 19 nt, Homo sapiens
gauuguauacaguuuguga

SEQ ID NO: 1036016 - RNA, 19 nt, Homo sapiens
cauuggacaugaaggaguu

SEQ ID NO: 1036017 - RNA, 19 nt, Homo sapiens
uaaggaauaagaacagaga

SEQ ID NO: 1036018 - RNA, 19 nt, Homo sapiens
ccugggcacuauuaucaaa

SEQ ID NO: 1036019 - RNA, 19 nt, Homo sapiens
gcagaaugcaaugaugaaa

SEQ ID NO: 1036020 - RNA, 19 nt, Homo sapiens
gaucccaaccuugaagaaa

SEQ ID NO: 1036021 - RNA, 19 nt, Homo sapiens
gguauuacugaucauauug

SEQ ID NO: 1036022 - RNA, 19 nt, Homo sapiens
ccaugauuguauacaguuu

SEQ ID NO: 1036023 - RNA, 19 nt, Homo sapiens
agagucauaugaaguaucu

SEQ ID NO: 1036024 - RNA, 19 nt, Homo sapiens
cagcagacaacauagaaau

SEQ ID NO: 1036025 - RNA, 19 nt, Homo sapiens
ggagaagcuuuacgaucag

SEQ ID NO: 1036026 - RNA, 19 nt, Homo sapiens
gaggaauuaaggaauaaga

SEQ ID NO: 1036027 - RNA, 19 nt, Homo sapiens
cauaugaggaauuaaggaa

SEQ ID NO: 1036028 - RNA, 19 nt, Homo sapiens
gcacuauuaucaaaaguca

SEQ ID NO: 1036029 - RNA, 19 nt, Homo sapiens
gugugaagcuuugcaucaa

SEQ ID NO: 1036030 - RNA, 19 nt, Homo sapiens
ggaauuaaggaauaagaac

SEQ ID NO: 1036031 - RNA, 19 nt, Homo sapiens
ucaguucuucuaugaauga

SEQ ID NO: 1036032 - RNA, 19 nt, Homo sapiens
gagccaauuccauucaguu

SEQ ID NO: 1036033 - RNA, 19 nt, Homo sapiens
gcagcagacaacauagaaa

SEQ ID NO: 1036034 - RNA, 19 nt, Homo sapiens
ugggauacuuugcuggaaa

SEQ ID NO: 1036035 - RNA, 19 nt, Homo sapiens
gcagagguuccaagaccaa

SEQ ID NO: 1036036 - RNA, 19 nt, Homo sapiens
caaaguaaacaaguaugga

SEQ ID NO: 1036037 - RNA, 19 nt, Homo sapiens
cccagcagcagacaacaua

SEQ ID NO: 1036038 - RNA, 19 nt, Homo sapiens
caccaccugggcacuauua

SEQ ID NO: 1036039 - RNA, 19 nt, Homo sapiens
gaagcuuugcaucaagaaa

SEQ ID NO: 1036040 - RNA, 19 nt, Homo sapiens
gcagacaacauagaaaugc

SEQ ID NO: 1036041 - RNA, 19 nt, Homo sapiens
ggucaaucaucuuuuguga

SEQ ID NO: 1036042 - RNA, 19 nt, Homo sapiens
ugaguggucaaucaucuuu

SEQ ID NO: 1036043 - RNA, 19 nt, Homo sapiens
caccugggcacuauuauca

SEQ ID NO: 1036044 - RNA, 19 nt, Homo sapiens
gccuuuggcugcaacaagu

SEQ ID NO: 1036045 - RNA, 19 nt, Homo sapiens
agaaugcaaugaugaaagc

SEQ ID NO: 1036046 - RNA, 19 nt, Homo sapiens
guguaaauguacucaccuu

SEQ ID NO: 1036047 - RNA, 19 nt, Homo sapiens
auaagaacagagagucaua

SEQ ID NO: 1036048 - RNA, 19 nt, Homo sapiens
gaaucugcucccacuggua

SEQ ID NO: 1036049 - RNA, 19 nt, Homo sapiens
ucaaucaucuuuugugaca

SEQ ID NO: 1036050 - RNA, 19 nt, Homo sapiens
gagguuccaagaccaauuc

SEQ ID NO: 1036051 - RNA, 19 nt, Homo sapiens
caaaauaugacucaagugu

SEQ ID NO: 1036052 - RNA, 19 nt, Homo sapiens
caucuagguggucaugauu

SEQ ID NO: 1036053 - RNA, 19 nt, Homo sapiens
uaccaugauuguauacagu

SEQ ID NO: 1036054 - RNA, 19 nt, Homo sapiens
caccuuagggauucauuug

SEQ ID NO: 1036055 - RNA, 19 nt, Homo sapiens
uaagaacagagagucauau

SEQ ID NO: 1036056 - RNA, 19 nt, Homo sapiens
acauagggccugauuacau

SEQ ID NO: 1036057 - RNA, 19 nt, Homo sapiens
auaucugcauguugaauug

SEQ ID NO: 1036058 - RNA, 19 nt, Homo sapiens
uguaaauguacucaccuua

SEQ ID NO: 1036059 - RNA, 19 nt, Homo sapiens
cucagcagcagucuucaua

SEQ ID NO: 1036060 - RNA, 19 nt, Homo sapiens
auacuugggaugagugaaa

SEQ ID NO: 1036061 - RNA, 19 nt, Homo sapiens
cagcagcagacaacauaga

SEQ ID NO: 1036062 - RNA, 19 nt, Homo sapiens
ucaagucaucccaaauaug

SEQ ID NO: 1036063 - RNA, 19 nt, Homo sapiens
agaacagagagucauauga

SEQ ID NO: 1036064 - RNA, 19 nt, Homo sapiens
aaggagagucuucgcagaa

SEQ ID NO: 1036065 - RNA, 19 nt, Homo sapiens
ucgcagaaugcaaugauga

SEQ ID NO: 1036066 - RNA, 19 nt, Homo sapiens
cagucaggccuaugcauga

SEQ ID NO: 1036067 - RNA, 19 nt, Homo sapiens
auuaugagccaauuccauu

SEQ ID NO: 1036068 - RNA, 19 nt, Homo sapiens
gaaacaaagugcagacauu

SEQ ID NO: 1036069 - RNA, 19 nt, Homo sapiens
gaucucgguuugcaaauua

SEQ ID NO: 1036070 - RNA, 19 nt, Homo sapiens
ggagggaaguugucaauga

SEQ ID NO: 1036071 - RNA, 19 nt, Homo sapiens
uaagaaaucugcuccaaug

SEQ ID NO: 1036072 - RNA, 19 nt, Homo sapiens
gggcauaucuuccuucaga

SEQ ID NO: 1036073 - RNA, 19 nt, Homo sapiens
gaaaugagggcacauauuc

SEQ ID NO: 1036074 - RNA, 19 nt, Homo sapiens
gaaacuccgucucuacuga

SEQ ID NO: 1036075 - RNA, 19 nt, Homo sapiens
gcaaguagguggaggaucu

SEQ ID NO: 1036076 - RNA, 19 nt, Homo sapiens
gugcagacauucaaagaaa

SEQ ID NO: 1036077 - RNA, 19 nt, Homo sapiens
ccacugaauugcaccauuu

SEQ ID NO: 1036078 - RNA, 19 nt, Homo sapiens
uaacagagcuagacuccau

SEQ ID NO: 1036079 - RNA, 19 nt, Homo sapiens
gaaagcagcugugugugau

SEQ ID NO: 1036080 - RNA, 19 nt, Homo sapiens
gcagacauucaaagaaaua

SEQ ID NO: 1036081 - RNA, 19 nt, Homo sapiens
ugucagaaguacauagaua

SEQ ID NO: 1036082 - RNA, 19 nt, Homo sapiens
ggaaagcagcuguguguga

SEQ ID NO: 1036083 - RNA, 19 nt, Homo sapiens
uaagacaucugcaaguuag

SEQ ID NO: 1036084 - RNA, 19 nt, Homo sapiens
guucuaaucucuaauaggu

SEQ ID NO: 1036085 - RNA, 19 nt, Homo sapiens
ccaaugcucuuguucuaau

SEQ ID NO: 1036086 - RNA, 19 nt, Homo sapiens
agagggaacuguaugaaga

SEQ ID NO: 1036087 - RNA, 19 nt, Homo sapiens
gagcuagacuccaucucaa

SEQ ID NO: 1036088 - RNA, 19 nt, Homo sapiens
ggucacuucuugaauaugu

SEQ ID NO: 1036089 - RNA, 19 nt, Homo sapiens
cagcggcaauuuaauaaga

SEQ ID NO: 1036090 - RNA, 19 nt, Homo sapiens
caguugagguuucagguuu

SEQ ID NO: 1036091 - RNA, 19 nt, Homo sapiens
gaaaagggaccacugaauu

SEQ ID NO: 1036092 - RNA, 19 nt, Homo sapiens
gagggaaguugucaaugau

SEQ ID NO: 1036093 - RNA, 19 nt, Homo sapiens
cauuuaagaugcugcuuga

SEQ ID NO: 1036094 - RNA, 19 nt, Homo sapiens
caacacuggucucugugaa

SEQ ID NO: 1036095 - RNA, 19 nt, Homo sapiens
ggccaacacuggucucugu

SEQ ID NO: 1036096 - RNA, 19 nt, Homo sapiens
ggaucucgguuugcaaauu

SEQ ID NO: 1036097 - RNA, 19 nt, Homo sapiens
gaaaucagaguauaagaac

SEQ ID NO: 1036098 - RNA, 19 nt, Homo sapiens
cacgauaacuaaucuuugu

SEQ ID NO: 1036099 - RNA, 19 nt, Homo sapiens
aauaagacaucugcaaguu

SEQ ID NO: 1036100 - RNA, 19 nt, Homo sapiens
gggcacauauucggacuug

SEQ ID NO: 1036101 - RNA, 19 nt, Homo sapiens
ugugauagcuuggaagguu

SEQ ID NO: 1036102 - RNA, 19 nt, Homo sapiens
cagcuucagcggcaauuua

SEQ ID NO: 1036103 - RNA, 19 nt, Homo sapiens
cuaccagucugaagaacaa

SEQ ID NO: 1036104 - RNA, 19 nt, Homo sapiens
ucaagaaaguccauuuagg

SEQ ID NO: 1036105 - RNA, 19 nt, Homo sapiens
gguggaggaucucgguuug

SEQ ID NO: 1036106 - RNA, 19 nt, Homo sapiens
caucagucauuguuacaug

SEQ ID NO: 1036107 - RNA, 19 nt, Homo sapiens
gaauugcaccauuuaagau

SEQ ID NO: 1036108 - RNA, 19 nt, Homo sapiens
gcacauauucggacuuguc

SEQ ID NO: 1036109 - RNA, 19 nt, Homo sapiens
uauaagaacugcgcugagu

SEQ ID NO: 1036110 - RNA, 19 nt, Homo sapiens
aagauuggcuggacguguu

SEQ ID NO: 1036111 - RNA, 19 nt, Homo sapiens
gcacgauaacuaaucuuug

SEQ ID NO: 1036112 - RNA, 19 nt, Homo sapiens
gaggaucucgguuugcaaa

SEQ ID NO: 1036113 - RNA, 19 nt, Homo sapiens
gaacaaaugggagggaagu

SEQ ID NO: 1036114 - RNA, 19 nt, Homo sapiens
ugaauugcaccauuuaaga

SEQ ID NO: 1036115 - RNA, 19 nt, Homo sapiens
uaugggaguuggaaaggaa

SEQ ID NO: 1036116 - RNA, 19 nt, Homo sapiens
guauggaccacuacaagaa

SEQ ID NO: 1036117 - RNA, 19 nt, Homo sapiens
uuaagaugcugcuugaaca

SEQ ID NO: 1036118 - RNA, 19 nt, Homo sapiens
uuagaccggucacuucuug

SEQ ID NO: 1036119 - RNA, 19 nt, Homo sapiens
cuucagcggcaauuuaaua

SEQ ID NO: 1036120 - RNA, 19 nt, Homo sapiens
ccacuuugccguuuaauac

SEQ ID NO: 1036121 - RNA, 19 nt, Homo sapiens
ccaaaagaaugaaaucaga

SEQ ID NO: 1036122 - RNA, 19 nt, Homo sapiens
gaugcugcuugaacaaaug

SEQ ID NO: 1036123 - RNA, 19 nt, Homo sapiens
agauaaguauggaccacua

SEQ ID NO: 1036124 - RNA, 19 nt, Homo sapiens
gugauagcuuggaagguuu

SEQ ID NO: 1036125 - RNA, 19 nt, Homo sapiens
cuacaucagucauuguuac

SEQ ID NO: 1036126 - RNA, 19 nt, Homo sapiens
ccuguguucuguccacuuu

SEQ ID NO: 1036127 - RNA, 19 nt, Homo sapiens
gcagcaagguguguauguc

SEQ ID NO: 1036128 - RNA, 19 nt, Homo sapiens
ugaaaugagggcacauauu

SEQ ID NO: 1036129 - RNA, 19 nt, Homo sapiens
aauaagaaaucugcuccaa

SEQ ID NO: 1036130 - RNA, 19 nt, Homo sapiens
caaagugcagacauucaaa

SEQ ID NO: 1036131 - RNA, 19 nt, Homo sapiens
cuccaaugcucuuguucua

SEQ ID NO: 1036132 - RNA, 19 nt, Homo sapiens
gacaggugguaggcaagua

SEQ ID NO: 1036133 - RNA, 19 nt, Homo sapiens
accggucacuucuugaaua

SEQ ID NO: 1036134 - RNA, 19 nt, Homo sapiens
agucaagaaaguccauuua

SEQ ID NO: 1036135 - RNA, 19 nt, Homo sapiens
auaagacaucugcaaguua

SEQ ID NO: 1036136 - RNA, 19 nt, Homo sapiens
gucagaaguacauagauaa

SEQ ID NO: 1036137 - RNA, 19 nt, Homo sapiens
gcaguugagguuucagguu

SEQ ID NO: 1036138 - RNA, 19 nt, Homo sapiens
caaaugggagggaaguugu

SEQ ID NO: 1036139 - RNA, 19 nt, Homo sapiens
uuuaauacccgaugagaau

SEQ ID NO: 1036140 - RNA, 19 nt, Homo sapiens
uaagaacugcgcugagugu

SEQ ID NO: 1036141 - RNA, 19 nt, Homo sapiens
aaacaaagugcagacauuc

SEQ ID NO: 1036142 - RNA, 19 nt, Homo sapiens
ggcacgauaacuaaucuuu

SEQ ID NO: 1036143 - RNA, 19 nt, Homo sapiens
acucgaacaccacauaauu

SEQ ID NO: 1036144 - RNA, 19 nt, Homo sapiens
guuauguguuuguccaugu

SEQ ID NO: 1036145 - RNA, 19 nt, Homo sapiens
ccggucacuucuugaauau

SEQ ID NO: 1036146 - RNA, 19 nt, Homo sapiens
caacugauguagccaaaag

SEQ ID NO: 1036147 - RNA, 19 nt, Homo sapiens
aucaauaacuaccaucaug

SEQ ID NO: 1036148 - RNA, 19 nt, Homo sapiens
gaucacagggucgggaguu

SEQ ID NO: 1036149 - RNA, 19 nt, Homo sapiens
gagcaccgacagcggcaaa

SEQ ID NO: 1036150 - RNA, 19 nt, Homo sapiens
gaucauuguauuacucauc

SEQ ID NO: 1036151 - RNA, 19 nt, Homo sapiens
cauauucggacuugucaga

SEQ ID NO: 1036152 - RNA, 19 nt, Homo sapiens
acaaagugcagacauucaa

SEQ ID NO: 1036153 - RNA, 19 nt, Homo sapiens
acuaaucuuuguucugugu

SEQ ID NO: 1036154 - RNA, 19 nt, Homo sapiens
cccaauaccacaagacaga

SEQ ID NO: 1036155 - RNA, 19 nt, Homo sapiens
guaugggaguuggaaagga

SEQ ID NO: 1036156 - RNA, 19 nt, Homo sapiens
ccucuucucugcaguugag

SEQ ID NO: 1036157 - RNA, 19 nt, Homo sapiens
guuuguccauguuuauugu

SEQ ID NO: 1036158 - RNA, 19 nt, Homo sapiens
uaauaagacaucugcaagu

SEQ ID NO: 1036159 - RNA, 19 nt, Homo sapiens
gcugagaucgcgccaguac

SEQ ID NO: 1036160 - RNA, 19 nt, Homo sapiens
gcucuuguucuaaucucua

SEQ ID NO: 1036161 - RNA, 19 nt, Homo sapiens
cgugugccuugagguguua

SEQ ID NO: 1036162 - RNA, 19 nt, Homo sapiens
uguccacuuugccguuuaa

SEQ ID NO: 1036163 - RNA, 19 nt, Homo sapiens
uauggagagugaaacaaag

SEQ ID NO: 1036164 - RNA, 19 nt, Homo sapiens
cgauaacuaaucuuuguuc

SEQ ID NO: 1036165 - RNA, 19 nt, Homo sapiens
gguuucaauccucccaaua

SEQ ID NO: 1036166 - RNA, 19 nt, Homo sapiens
uaagaugcugcuugaacaa

SEQ ID NO: 1036167 - RNA, 19 nt, Homo sapiens
ucacucgaacaccacauaa

SEQ ID NO: 1036168 - RNA, 19 nt, Homo sapiens
gcaaagaaguuacugagaa

SEQ ID NO: 1036169 - RNA, 19 nt, Homo sapiens
gcaacacugugacuucuua

SEQ ID NO: 1036170 - RNA, 19 nt, Homo sapiens
gcaccucucuguaagauuu

SEQ ID NO: 1036171 - RNA, 19 nt, Homo sapiens
gaacaaaugcuuucacauc

SEQ ID NO: 1036172 - RNA, 19 nt, Homo sapiens
gaucuggccugcccaugua

SEQ ID NO: 1036173 - RNA, 19 nt, Homo sapiens
gaagaaccaguauauguaa

SEQ ID NO: 1036174 - RNA, 19 nt, Homo sapiens
caaagugggauucuuguua

SEQ ID NO: 1036175 - RNA, 19 nt, Homo sapiens
caaggucucugggaaauuu

SEQ ID NO: 1036176 - RNA, 19 nt, Homo sapiens
ggaaauguguuauaaugca

SEQ ID NO: 1036177 - RNA, 19 nt, Homo sapiens
ccuaacaguuugaaguuua

SEQ ID NO: 1036178 - RNA, 19 nt, Homo sapiens
guacaaaccggaugucaaa

SEQ ID NO: 1036179 - RNA, 19 nt, Homo sapiens
gagaagaaccaguauaugu

SEQ ID NO: 1036180 - RNA, 19 nt, Homo sapiens
caaagaaguuacugagaau

SEQ ID NO: 1036181 - RNA, 19 nt, Homo sapiens
gaacaaggucucugggaaa

SEQ ID NO: 1036182 - RNA, 19 nt, Homo sapiens
gcgggaagcuaauucuuga

SEQ ID NO: 1036183 - RNA, 19 nt, Homo sapiens
uaaaggagaagaaccagua

SEQ ID NO: 1036184 - RNA, 19 nt, Homo sapiens
gcucagauggugaagaaua

SEQ ID NO: 1036185 - RNA, 19 nt, Homo sapiens
ggcagaaucucauccaguu

SEQ ID NO: 1036186 - RNA, 19 nt, Homo sapiens
ccuaggaaauguguuauaa

SEQ ID NO: 1036187 - RNA, 19 nt, Homo sapiens
cuacauugcaguuguguua

SEQ ID NO: 1036188 - RNA, 19 nt, Homo sapiens
gcaguuguguuacccaaau

SEQ ID NO: 1036189 - RNA, 19 nt, Homo sapiens
gggcacaguuucuaacaga

SEQ ID NO: 1036190 - RNA, 19 nt, Homo sapiens
ggaagaggccggaguguag

SEQ ID NO: 1036191 - RNA, 19 nt, Homo sapiens
cauaagccaucuauucuuc

SEQ ID NO: 1036192 - RNA, 19 nt, Homo sapiens
gcucguggaucgauacuuc

SEQ ID NO: 1036193 - RNA, 19 nt, Homo sapiens
uccaacaacugugaauuua

SEQ ID NO: 1036194 - RNA, 19 nt, Homo sapiens
agggauaacuacuacauuu

SEQ ID NO: 1036195 - RNA, 19 nt, Homo sapiens
gaaccaauccccuauguaa

SEQ ID NO: 1036196 - RNA, 19 nt, Homo sapiens
gaauauacugugucuaguu

SEQ ID NO: 1036197 - RNA, 19 nt, Homo sapiens
guagcagacuucagaacaa

SEQ ID NO: 1036198 - RNA, 19 nt, Homo sapiens
agaagaaccaguauaugua

SEQ ID NO: 1036199 - RNA, 19 nt, Homo sapiens
ggaagcuaauucuugaaau

SEQ ID NO: 1036200 - RNA, 19 nt, Homo sapiens
caaaccggaugucaaagga

SEQ ID NO: 1036201 - RNA, 19 nt, Homo sapiens
caaacacgaaacccacuua

SEQ ID NO: 1036202 - RNA, 19 nt, Homo sapiens
gaggaccacuguauacuac

SEQ ID NO: 1036203 - RNA, 19 nt, Homo sapiens
acacgaaacccacuuauag

SEQ ID NO: 1036204 - RNA, 19 nt, Homo sapiens
gagccuugguucccauuug

SEQ ID NO: 1036205 - RNA, 19 nt, Homo sapiens
gaaggguuacugacacaaa

SEQ ID NO: 1036206 - RNA, 19 nt, Homo sapiens
gaaaagccaucuacugaag

SEQ ID NO: 1036207 - RNA, 19 nt, Homo sapiens
aauauacugugucuaguug

SEQ ID NO: 1036208 - RNA, 19 nt, Homo sapiens
cacaacagcuacgucauga

SEQ ID NO: 1036209 - RNA, 19 nt, Homo sapiens
aacaaaugcuuucacauca

SEQ ID NO: 1036210 - RNA, 19 nt, Homo sapiens
gaaguuacugagaauaugu

SEQ ID NO: 1036211 - RNA, 19 nt, Homo sapiens
guaaaccaagggauaacua

SEQ ID NO: 1036212 - RNA, 19 nt, Homo sapiens
ucuaacaacuggcaugcaa

SEQ ID NO: 1036213 - RNA, 19 nt, Homo sapiens
gggaagcuaauucuugaaa

SEQ ID NO: 1036214 - RNA, 19 nt, Homo sapiens
ggauugacauggaacaaaa

SEQ ID NO: 1036215 - RNA, 19 nt, Homo sapiens
ugaagaauauacugugucu

SEQ ID NO: 1036216 - RNA, 19 nt, Homo sapiens
ggugaagaauauacugugu

SEQ ID NO: 1036217 - RNA, 19 nt, Homo sapiens
acagcacucuaaccgaaua

SEQ ID NO: 1036218 - RNA, 19 nt, Homo sapiens
uguaagggcuauaacauac

SEQ ID NO: 1036219 - RNA, 19 nt, Homo sapiens
gaauggaacaaaugcuuuc

SEQ ID NO: 1036220 - RNA, 19 nt, Homo sapiens
ucuaguuacuggcaaagaa

SEQ ID NO: 1036221 - RNA, 19 nt, Homo sapiens
uaaccuacuucuguuugaa

SEQ ID NO: 1036222 - RNA, 19 nt, Homo sapiens
acuuaugcauggacuauuu

SEQ ID NO: 1036223 - RNA, 19 nt, Homo sapiens
cugcucagauggugaagaa

SEQ ID NO: 1036224 - RNA, 19 nt, Homo sapiens
gagcuugcaccucucugua

SEQ ID NO: 1036225 - RNA, 19 nt, Homo sapiens
gcccaucugcccaaacuuu

SEQ ID NO: 1036226 - RNA, 19 nt, Homo sapiens
uaaaugagggauaugugaa

SEQ ID NO: 1036227 - RNA, 19 nt, Homo sapiens
gggaagaggccggagugua

SEQ ID NO: 1036228 - RNA, 19 nt, Homo sapiens
ccucaacuccucucccuuu

SEQ ID NO: 1036229 - RNA, 19 nt, Homo sapiens
uacccagucuucuauaaug

SEQ ID NO: 1036230 - RNA, 19 nt, Homo sapiens
uuauagagcagguucauau

SEQ ID NO: 1036231 - RNA, 19 nt, Homo sapiens
gaacugcaaggguccacuu

SEQ ID NO: 1036232 - RNA, 19 nt, Homo sapiens
ccacaacagcuacgucaug

SEQ ID NO: 1036233 - RNA, 19 nt, Homo sapiens
uaagccaucuauucuucaa

SEQ ID NO: 1036234 - RNA, 19 nt, Homo sapiens
acugugacuucuuaaauga

SEQ ID NO: 1036235 - RNA, 19 nt, Homo sapiens
cacugugacuucuuaaaug

SEQ ID NO: 1036236 - RNA, 19 nt, Homo sapiens
ucuauaaugugccuaccaa

SEQ ID NO: 1036237 - RNA, 19 nt, Homo sapiens
aaagugggauucuuguuac

SEQ ID NO: 1036238 - RNA, 19 nt, Homo sapiens
gcaaagugggauucuuguu

SEQ ID NO: 1036239 - RNA, 19 nt, Homo sapiens
uaaugcagcgggaagcuaa

SEQ ID NO: 1036240 - RNA, 19 nt, Homo sapiens
caacuauaaacgagucaaa

SEQ ID NO: 1036241 - RNA, 19 nt, Homo sapiens
cugcaaggguccacuuaug

SEQ ID NO: 1036242 - RNA, 19 nt, Homo sapiens
ggagaagaaccaguauaug

SEQ ID NO: 1036243 - RNA, 19 nt, Homo sapiens
ggaagugaaugaaaacauc

SEQ ID NO: 1036244 - RNA, 19 nt, Homo sapiens
gcuaauucuugaaauaugc

SEQ ID NO: 1036245 - RNA, 19 nt, Homo sapiens
uagaggacguuugauggaa

SEQ ID NO: 1036246 - RNA, 19 nt, Homo sapiens
aagaauauacugugucuag

SEQ ID NO: 1036247 - RNA, 19 nt, Homo sapiens
aagauuuacugcucagaug

SEQ ID NO: 1036248 - RNA, 19 nt, Homo sapiens
uaagggcuauaacauacau

SEQ ID NO: 1036249 - RNA, 19 nt, Homo sapiens
uggaacaaaugcuuucaca

SEQ ID NO: 1036250 - RNA, 19 nt, Homo sapiens
aaccggaugucaaaggaaa

SEQ ID NO: 1036251 - RNA, 19 nt, Homo sapiens
cggaguguagaguauauua

SEQ ID NO: 1036252 - RNA, 19 nt, Homo sapiens
gaagaggccggaguguaga

SEQ ID NO: 1036253 - RNA, 19 nt, Homo sapiens
gacguuugauggaagugaa

SEQ ID NO: 1036254 - RNA, 19 nt, Homo sapiens
ugaauggaacaaaugcuuu

SEQ ID NO: 1036255 - RNA, 19 nt, Homo sapiens
agaaguuacugagaauaug

SEQ ID NO: 1036256 - RNA, 19 nt, Homo sapiens
uuaaaugagggauauguga

SEQ ID NO: 1036257 - RNA, 19 nt, Homo sapiens
cauauacucagguuccaaa

SEQ ID NO: 1036258 - RNA, 19 nt, Homo sapiens
uaaaccaucaggguacuaa

SEQ ID NO: 1036259 - RNA, 19 nt, Homo sapiens
cagaaggguuacugacaca

SEQ ID NO: 1036260 - RNA, 19 nt, Homo sapiens
gcacucuaaccgaauaugu

SEQ ID NO: 1036261 - RNA, 19 nt, Homo sapiens
cuucuuaaaugagggauau

SEQ ID NO: 1036262 - RNA, 19 nt, Homo sapiens
ugaggaccacuguauacua

SEQ ID NO: 1036263 - RNA, 19 nt, Homo sapiens
cuauguaaaccaagggaua

SEQ ID NO: 1036264 - RNA, 19 nt, Homo sapiens
gcaaggguccacuuaugca

SEQ ID NO: 1036265 - RNA, 19 nt, Homo sapiens
gaaaacauccuccauaagc

SEQ ID NO: 1036266 - RNA, 19 nt, Homo sapiens
ggaguguagaguauauuau

SEQ ID NO: 1036267 - RNA, 19 nt, Homo sapiens
gccggaguguagaguauau

SEQ ID NO: 1036268 - RNA, 19 nt, Homo sapiens
gaugauggcucagaucuua

SEQ ID NO: 1036269 - RNA, 19 nt, Homo sapiens
gauaaaggcuacagugauu

SEQ ID NO: 1036270 - RNA, 19 nt, Homo sapiens
gaguaaaggugaagaagaa

SEQ ID NO: 1036271 - RNA, 19 nt, Homo sapiens
gaaaggugcucucccaugu

SEQ ID NO: 1036272 - RNA, 19 nt, Homo sapiens
cuuaagaucucaccugaua

SEQ ID NO: 1036273 - RNA, 19 nt, Homo sapiens
ggaugaaucuguggaaauu

SEQ ID NO: 1036274 - RNA, 19 nt, Homo sapiens
caaccagaauggauccuua

SEQ ID NO: 1036275 - RNA, 19 nt, Homo sapiens
gaagaacucuggguacaau

SEQ ID NO: 1036276 - RNA, 19 nt, Homo sapiens
gaaauagaaugaugucaac

SEQ ID NO: 1036277 - RNA, 19 nt, Homo sapiens
gaauggauccuuaagcaaa

SEQ ID NO: 1036278 - RNA, 19 nt, Homo sapiens
agaaugaugucaacccaua

SEQ ID NO: 1036279 - RNA, 19 nt, Homo sapiens
gaaaacaccugaaaucaag

SEQ ID NO: 1036280 - RNA, 19 nt, Homo sapiens
aaagauaacgcaagcuaua

SEQ ID NO: 1036281 - RNA, 19 nt, Homo sapiens
caacaccgacauuauuuaa

SEQ ID NO: 1036282 - RNA, 19 nt, Homo sapiens
gaaggaugcucugcagaug

SEQ ID NO: 1036283 - RNA, 19 nt, Homo sapiens
gaauacugaucgauaaugg

SEQ ID NO: 1036284 - RNA, 19 nt, Homo sapiens
ugaagaagaagaagaugua

SEQ ID NO: 1036285 - RNA, 19 nt, Homo sapiens
cagaauggauccuuaagca

SEQ ID NO: 1036286 - RNA, 19 nt, Homo sapiens
cugaacaagugauggaaua

SEQ ID NO: 1036287 - RNA, 19 nt, Homo sapiens
ccaaugacaccaacugaaa

SEQ ID NO: 1036288 - RNA, 19 nt, Homo sapiens
acagauagaaacccaaaua

SEQ ID NO: 1036289 - RNA, 19 nt, Homo sapiens
caaaagaagucacagauag

SEQ ID NO: 1036290 - RNA, 19 nt, Homo sapiens
uaagaucucaccugauaaa

SEQ ID NO: 1036291 - RNA, 19 nt, Homo sapiens
uaagccacuuccaguauuu

SEQ ID NO: 1036292 - RNA, 19 nt, Homo sapiens
ccugauaguguaauuguua

SEQ ID NO: 1036293 - RNA, 19 nt, Homo sapiens
caaaugccagucagaguaa

SEQ ID NO: 1036294 - RNA, 19 nt, Homo sapiens
gaagcauuauaggcaauuu

SEQ ID NO: 1036295 - RNA, 19 nt, Homo sapiens
gcaauaucauccugacagu

SEQ ID NO: 1036296 - RNA, 19 nt, Homo sapiens
ucaaggagaaggagagaaa

SEQ ID NO: 1036297 - RNA, 19 nt, Homo sapiens
gaaacuacaaagccaguau

SEQ ID NO: 1036298 - RNA, 19 nt, Homo sapiens
agaagaagaagauguagaa

SEQ ID NO: 1036299 - RNA, 19 nt, Homo sapiens
gcguuuauauaucccaauu

SEQ ID NO: 1036300 - RNA, 19 nt, Homo sapiens
gaucgauaauggauaccaa

SEQ ID NO: 1036301 - RNA, 19 nt, Homo sapiens
ggaaggaugcucugcagau

SEQ ID NO: 1036302 - RNA, 19 nt, Homo sapiens
caacgagagaagcauuaua

SEQ ID NO: 1036303 - RNA, 19 nt, Homo sapiens
acaccgacauuauuuaagu

SEQ ID NO: 1036304 - RNA, 19 nt, Homo sapiens
acaaaugccagucagagua

SEQ ID NO: 1036305 - RNA, 19 nt, Homo sapiens
cagauagaaacccaaauaa

SEQ ID NO: 1036306 - RNA, 19 nt, Homo sapiens
agacagagcaaacagcaaa

SEQ ID NO: 1036307 - RNA, 19 nt, Homo sapiens
ccaacaccgacauuauuua

SEQ ID NO: 1036308 - RNA, 19 nt, Homo sapiens
gcucuaauacugcugauuc

SEQ ID NO: 1036309 - RNA, 19 nt, Homo sapiens
gagaccauguuauugcaau

SEQ ID NO: 1036310 - RNA, 19 nt, Homo sapiens
ugacuguucuuacauugau

SEQ ID NO: 1036311 - RNA, 19 nt, Homo sapiens
gagaagcauuauaggcaau

SEQ ID NO: 1036312 - RNA, 19 nt, Homo sapiens
gaccucccuugccaugaua

SEQ ID NO: 1036313 - RNA, 19 nt, Homo sapiens
gagcaaacagcaaaagaua

SEQ ID NO: 1036314 - RNA, 19 nt, Homo sapiens
ucuauucaauccaguauca

SEQ ID NO: 1036315 - RNA, 19 nt, Homo sapiens
caacucagagaggcaauuu

SEQ ID NO: 1036316 - RNA, 19 nt, Homo sapiens
gaaaggaaaaccucugaaa

SEQ ID NO: 1036317 - RNA, 19 nt, Homo sapiens
gauaacgcaagcuauagaa

SEQ ID NO: 1036318 - RNA, 19 nt, Homo sapiens
uuaagccacuuccaguauu

SEQ ID NO: 1036319 - RNA, 19 nt, Homo sapiens
gaagaagaagauguagaaa

SEQ ID NO: 1036320 - RNA, 19 nt, Homo sapiens
ucacaauucaucaugguuu

SEQ ID NO: 1036321 - RNA, 19 nt, Homo sapiens
gauagaaacccaaauaacc

SEQ ID NO: 1036322 - RNA, 19 nt, Homo sapiens
gaacaagugauggaauauc

SEQ ID NO: 1036323 - RNA, 19 nt, Homo sapiens
uaaaggugaagaagaagaa

SEQ ID NO: 1036324 - RNA, 19 nt, Homo sapiens
ggugcucucccaugugaua

SEQ ID NO: 1036325 - RNA, 19 nt, Homo sapiens
aaggugcucucccauguga

SEQ ID NO: 1036326 - RNA, 19 nt, Homo sapiens
ucagaaagaaauugucaga

SEQ ID NO: 1036327 - RNA, 19 nt, Homo sapiens
gaaugaugucaacccauaa

SEQ ID NO: 1036328 - RNA, 19 nt, Homo sapiens
gagugaaaaugcuuccaua

SEQ ID NO: 1036329 - RNA, 19 nt, Homo sapiens
cgaccucccuugccaugau

SEQ ID NO: 1036330 - RNA, 19 nt, Homo sapiens
gaacucuggguacaauaau

SEQ ID NO: 1036331 - RNA, 19 nt, Homo sapiens
caccugaaaucaagaaagg

SEQ ID NO: 1036332 - RNA, 19 nt, Homo sapiens
gcucagaaagaaauuguca

SEQ ID NO: 1036333 - RNA, 19 nt, Homo sapiens
ggaagaacucuggguacaa

SEQ ID NO: 1036334 - RNA, 19 nt, Homo sapiens
gaaacccaaauaaccuuga

SEQ ID NO: 1036335 - RNA, 19 nt, Homo sapiens
agaccgugcugcugaacaa

SEQ ID NO: 1036336 - RNA, 19 nt, Homo sapiens
ucacagauagaaacccaaa

SEQ ID NO: 1036337 - RNA, 19 nt, Homo sapiens
ugggaggccucacaauuca

SEQ ID NO: 1036338 - RNA, 19 nt, Homo sapiens
gcgauacuauugagcaacu

SEQ ID NO: 1036339 - RNA, 19 nt, Homo sapiens
uaauggauaccaaccagaa

SEQ ID NO: 1036340 - RNA, 19 nt, Homo sapiens
guaaaggugaagaagaaga

SEQ ID NO: 1036341 - RNA, 19 nt, Homo sapiens
guugggaggccucacaauu

SEQ ID NO: 1036342 - RNA, 19 nt, Homo sapiens
aaagaagucacagauagaa

SEQ ID NO: 1036343 - RNA, 19 nt, Homo sapiens
aaccugaaccgaauacuga

SEQ ID NO: 1036344 - RNA, 19 nt, Homo sapiens
cgcaagcuauagaacguuu

SEQ ID NO: 1036345 - RNA, 19 nt, Homo sapiens
gcucucccaugugauagaa

SEQ ID NO: 1036346 - RNA, 19 nt, Homo sapiens
aggaugcucugcagaugaa

SEQ ID NO: 1036347 - RNA, 19 nt, Homo sapiens
aggcuacagugauuccuaa

SEQ ID NO: 1036348 - RNA, 19 nt, Homo sapiens
gacaccaacugaaaagaaa

SEQ ID NO: 1036349 - RNA, 19 nt, Homo sapiens
ggucucaggagcuccguuu

SEQ ID NO: 1036350 - RNA, 19 nt, Homo sapiens
gcaagcuauagaacguuua

SEQ ID NO: 1036351 - RNA, 19 nt, Homo sapiens
cagaugaagucagggaauc

SEQ ID NO: 1036352 - RNA, 19 nt, Homo sapiens
uuuggacacuugauucuau

SEQ ID NO: 1036353 - RNA, 19 nt, Homo sapiens
caaaaggaaauaagcgaua

SEQ ID NO: 1036354 - RNA, 19 nt, Homo sapiens
accgaauacugaucgauaa

SEQ ID NO: 1036355 - RNA, 19 nt, Homo sapiens
aaggagacuuugacaaucu

SEQ ID NO: 1036356 - RNA, 19 nt, Homo sapiens
ccucuucgagaccauguua

SEQ ID NO: 1036357 - RNA, 19 nt, Homo sapiens
caaaagauaacgcaagcua

SEQ ID NO: 1036358 - RNA, 19 nt, Homo sapiens
gcugauucugcaacauuua

SEQ ID NO: 1036359 - RNA, 19 nt, Homo sapiens
ccugacaguggcucuaaua

SEQ ID NO: 1036360 - RNA, 19 nt, Homo sapiens
gcagaugaagucagggaau

SEQ ID NO: 1036361 - RNA, 19 nt, Homo sapiens
ggagagaaaacaccugaaa

SEQ ID NO: 1036362 - RNA, 19 nt, Homo sapiens
ggacacuugauucuauuca

SEQ ID NO: 1036363 - RNA, 19 nt, Homo sapiens
ucugcaacauuuauaagga

SEQ ID NO: 1036364 - RNA, 19 nt, Homo sapiens
ugucagagcccagaaaaua

SEQ ID NO: 1036365 - RNA, 19 nt, Homo sapiens
caccgacauuauuuaaguu

SEQ ID NO: 1036366 - RNA, 19 nt, Homo sapiens
cccaacaccgacauuauuu

SEQ ID NO: 1036367 - RNA, 19 nt, Homo sapiens
caaacaaaugccagucaga

SEQ ID NO: 1036368 - RNA, 19 nt, Homo sapiens
gcacaugccuguaaucuca

SEQ ID NO: 1036369 - RNA, 19 nt, Homo sapiens
gcaaagaggcagcgaagua

SEQ ID NO: 1036370 - RNA, 19 nt, Homo sapiens
aaacugagcgcuuccauua

SEQ ID NO: 1036371 - RNA, 19 nt, Homo sapiens
gguauuagcaugcaaauga

SEQ ID NO: 1036372 - RNA, 19 nt, Homo sapiens
caggagaucuguguucuaa

SEQ ID NO: 1036373 - RNA, 19 nt, Homo sapiens
cggaagagcuggagagaug

SEQ ID NO: 1036374 - RNA, 19 nt, Homo sapiens
cagacucacugucaccuua

SEQ ID NO: 1036375 - RNA, 19 nt, Homo sapiens
gagccgagaucgugccauu

SEQ ID NO: 1036376 - RNA, 19 nt, Homo sapiens
gagccgagaucgcgccauu

SEQ ID NO: 1036377 - RNA, 19 nt, Homo sapiens
gaacuggcacguuuuauuu

SEQ ID NO: 1036378 - RNA, 19 nt, Homo sapiens
aaaguucccuggacacgaa

SEQ ID NO: 1036379 - RNA, 19 nt, Homo sapiens
cuaccacgcuagaguugua

SEQ ID NO: 1036380 - RNA, 19 nt, Homo sapiens
ggagaucuguguucuaagc

SEQ ID NO: 1036381 - RNA, 19 nt, Homo sapiens
guacauugaucgaucugau

SEQ ID NO: 1036382 - RNA, 19 nt, Homo sapiens
gagcgaaacuccgucucaa

SEQ ID NO: 1036383 - RNA, 19 nt, Homo sapiens
cgaaguauguguuccaaac

SEQ ID NO: 1036384 - RNA, 19 nt, Homo sapiens
guauuagcaugcaaaugaa

SEQ ID NO: 1036385 - RNA, 19 nt, Homo sapiens
ccuguaaucucagcuacua

SEQ ID NO: 1036386 - RNA, 19 nt, Homo sapiens
ggaaaagcauucuggguau

SEQ ID NO: 1036387 - RNA, 19 nt, Homo sapiens
ugaauuagaggcaugaaga

SEQ ID NO: 1036388 - RNA, 19 nt, Homo sapiens
gaauuagaggcaugaagaa

SEQ ID NO: 1036389 - RNA, 19 nt, Homo sapiens
gcaggagaaucacuugaac

SEQ ID NO: 1036390 - RNA, 19 nt, Homo sapiens
gaaaccccaucucuacuaa

SEQ ID NO: 1036391 - RNA, 19 nt, Homo sapiens
cauaguacaugccaaacuc

SEQ ID NO: 1036392 - RNA, 19 nt, Homo sapiens
ucacuuggccucccugaga

SEQ ID NO: 1036393 - RNA, 19 nt, Homo sapiens
caaagaggcagcgaaguau

SEQ ID NO: 1036394 - RNA, 19 nt, Homo sapiens
gcaggagaaucgcuugaac

SEQ ID NO: 1036395 - RNA, 19 nt, Homo sapiens
gaaaccccgucucuacuaa

SEQ ID NO: 1036396 - RNA, 19 nt, Homo sapiens
gaagagcuggagagaugaa

SEQ ID NO: 1036397 - RNA, 19 nt, Homo sapiens
uuugggaacuggcacguuu

SEQ ID NO: 1036398 - RNA, 19 nt, Homo sapiens
uuagaggcaugaagaaagu

SEQ ID NO: 1036399 - RNA, 19 nt, Homo sapiens
gaaaagcauucuggguauu

SEQ ID NO: 1036400 - RNA, 19 nt, Homo sapiens
gaagccaggagaucugugu

SEQ ID NO: 1036401 - RNA, 19 nt, Homo sapiens
caaacugagcgcuuccauu

SEQ ID NO: 1036402 - RNA, 19 nt, Homo sapiens
aguauguguuccaaacuuu

SEQ ID NO: 1036403 - RNA, 19 nt, Homo sapiens
ggcaggagaaucacuugaa

SEQ ID NO: 1036404 - RNA, 19 nt, Homo sapiens
gaaugaauuagaggcauga

SEQ ID NO: 1036405 - RNA, 19 nt, Homo sapiens
uguuggagagaaugaauua

SEQ ID NO: 1036406 - RNA, 19 nt, Homo sapiens
gaccucugccuucugguuu

SEQ ID NO: 1036407 - RNA, 19 nt, Homo sapiens
acugagcgcuuccauuaag

SEQ ID NO: 1036408 - RNA, 19 nt, Homo sapiens
gaaguucccacaguugcaa

SEQ ID NO: 1036409 - RNA, 19 nt, Homo sapiens
gagagcugcugggaacauc

SEQ ID NO: 1036410 - RNA, 19 nt, Homo sapiens
ccuguaaucccagcacuuu

SEQ ID NO: 1036411 - RNA, 19 nt, Homo sapiens
ccuguuaucccagcacuuu

SEQ ID NO: 1036412 - RNA, 19 nt, Homo sapiens
ggaacuggcacguuuuauu

SEQ ID NO: 1036413 - RNA, 19 nt, Homo sapiens
gcgaaacuccgucucaaaa

SEQ ID NO: 1036414 - RNA, 19 nt, Homo sapiens
agaccagccugaccaacau

SEQ ID NO: 1036415 - RNA, 19 nt, Homo sapiens
uggagagaaugaauuagag

SEQ ID NO: 1036416 - RNA, 19 nt, Homo sapiens
gccgggugcucugguaaug

SEQ ID NO: 1036417 - RNA, 19 nt, Homo sapiens
gccaggagaucuguguucu

SEQ ID NO: 1036418 - RNA, 19 nt, Homo sapiens
ggacacgaagccaggagau

SEQ ID NO: 1036419 - RNA, 19 nt, Homo sapiens
ggaagagcuggagagauga

SEQ ID NO: 1036420 - RNA, 19 nt, Homo sapiens
cagcaauccucagggaagu

SEQ ID NO: 1036421 - RNA, 19 nt, Homo sapiens
gcgugaaauucccagaagu

SEQ ID NO: 1036422 - RNA, 19 nt, Homo sapiens
caacuccgcucgggauucc

SEQ ID NO: 1036423 - RNA, 19 nt, Homo sapiens
gaaguauguguuccaaacu

SEQ ID NO: 1036424 - RNA, 19 nt, Homo sapiens
gaguuguacaccaagguuu

SEQ ID NO: 1036425 - RNA, 19 nt, Homo sapiens
gcaacaagagcaaaacugu

SEQ ID NO: 1036426 - RNA, 19 nt, Homo sapiens
ugaccaacauggagaaacc

SEQ ID NO: 1036427 - RNA, 19 nt, Homo sapiens
gaugcuaccacgcuagagu

SEQ ID NO: 1036428 - RNA, 19 nt, Homo sapiens
ccaggagaucuguguucua

SEQ ID NO: 1036429 - RNA, 19 nt, Homo sapiens
uguaaucucagcuacuaga

SEQ ID NO: 1036430 - RNA, 19 nt, Homo sapiens
caguggcucaugccuguaa

SEQ ID NO: 1036431 - RNA, 19 nt, Homo sapiens
gggaugcuaccacgcuaga

SEQ ID NO: 1036432 - RNA, 19 nt, Homo sapiens
ucucugagccacagcuuuc

SEQ ID NO: 1036433 - RNA, 19 nt, Homo sapiens
gcucuagggcauaguacau

SEQ ID NO: 1036434 - RNA, 19 nt, Homo sapiens
cgcuagaguuguacaccaa

SEQ ID NO: 1036435 - RNA, 19 nt, Homo sapiens
gagcgcuuccauuaagaga

SEQ ID NO: 1036436 - RNA, 19 nt, Homo sapiens
ccgggaggcgacaauauga

SEQ ID NO: 1036437 - RNA, 19 nt, Homo sapiens
gauccgaguucaaaaucga

SEQ ID NO: 1036438 - RNA, 19 nt, Homo sapiens
guacaccaagguuugucuu

SEQ ID NO: 1036439 - RNA, 19 nt, Homo sapiens
uuggagagaaugaauuaga

SEQ ID NO: 1036440 - RNA, 19 nt, Homo sapiens
cugcacaccuccgcucuag

SEQ ID NO: 1036441 - RNA, 19 nt, Homo sapiens
aaagcauucuggguauuag

SEQ ID NO: 1036442 - RNA, 19 nt, Homo sapiens
caucugcacucaacauuua

SEQ ID NO: 1036443 - RNA, 19 nt, Homo sapiens
gagcauggcuugagugugu

SEQ ID NO: 1036444 - RNA, 19 nt, Homo sapiens
gaagaggcauguccaguau

SEQ ID NO: 1036445 - RNA, 19 nt, Homo sapiens
ggaaggagcucuuuucugu

SEQ ID NO: 1036446 - RNA, 19 nt, Homo sapiens
caaccuaccugcacaugug

SEQ ID NO: 1036447 - RNA, 19 nt, Homo sapiens
gcaugcuucuggacuauuu

SEQ ID NO: 1036448 - RNA, 19 nt, Homo sapiens
acacaaagauagucgguau

SEQ ID NO: 1036449 - RNA, 19 nt, Homo sapiens
caauagagcccugaaauca

SEQ ID NO: 1036450 - RNA, 19 nt, Homo sapiens
agaaaucaauuccauguca

SEQ ID NO: 1036451 - RNA, 19 nt, Homo sapiens
acaaaggcauggcgauauu

SEQ ID NO: 1036452 - RNA, 19 nt, Homo sapiens
ccaagccacuggagacuga

SEQ ID NO: 1036453 - RNA, 19 nt, Homo sapiens
guacaaaggcauggcgaua

SEQ ID NO: 1036454 - RNA, 19 nt, Homo sapiens
gugaagauccugaaguuug

SEQ ID NO: 1036455 - RNA, 19 nt, Homo sapiens
gauggucuguauagugauu

SEQ ID NO: 1036456 - RNA, 19 nt, Homo sapiens
ugccaacacuggacaaauu

SEQ ID NO: 1036457 - RNA, 19 nt, Homo sapiens
gcacuggccuguguuugug

SEQ ID NO: 1036458 - RNA, 19 nt, Homo sapiens
gagggucagucagucauaa

SEQ ID NO: 1036459 - RNA, 19 nt, Homo sapiens
gcaaucugguggccauuca

SEQ ID NO: 1036460 - RNA, 19 nt, Homo sapiens
gcaauagagcccugaaauc

SEQ ID NO: 1036461 - RNA, 19 nt, Homo sapiens
guuagcagcuucuucuaca

SEQ ID NO: 1036462 - RNA, 19 nt, Homo sapiens
ggucaacccagacaacauu

SEQ ID NO: 1036463 - RNA, 19 nt, Homo sapiens
ucagugggauacagaauuc

SEQ ID NO: 1036464 - RNA, 19 nt, Homo sapiens
cugauggucuguauaguga

SEQ ID NO: 1036465 - RNA, 19 nt, Homo sapiens
agaauuuccucucacauca

SEQ ID NO: 1036466 - RNA, 19 nt, Homo sapiens
agaagaggcauguccagua

SEQ ID NO: 1036467 - RNA, 19 nt, Homo sapiens
cgucagaaaucaauuccau

SEQ ID NO: 1036468 - RNA, 19 nt, Homo sapiens
aaaggcauggcgauauuua

SEQ ID NO: 1036469 - RNA, 19 nt, Homo sapiens
gcacgucagaaaucaauuc

SEQ ID NO: 1036470 - RNA, 19 nt, Homo sapiens
ggccugagaagguaaagaa

SEQ ID NO: 1036471 - RNA, 19 nt, Homo sapiens
uuaaugagcgugcaagugu

SEQ ID NO: 1036472 - RNA, 19 nt, Homo sapiens
gugugcacaugcuuaauga

SEQ ID NO: 1036473 - RNA, 19 nt, Homo sapiens
ggauacagaauucaguuuc

SEQ ID NO: 1036474 - RNA, 19 nt, Homo sapiens
ugaagauccugaaguuugg

SEQ ID NO: 1036475 - RNA, 19 nt, Homo sapiens
ucgugaagauccugaaguu

SEQ ID NO: 1036476 - RNA, 19 nt, Homo sapiens
gcagcaaccuggcccucau

SEQ ID NO: 1036477 - RNA, 19 nt, Homo sapiens
uaccugagccugcaauaga

SEQ ID NO: 1036478 - RNA, 19 nt, Homo sapiens
ucauuagaauuuccucuca

SEQ ID NO: 1036479 - RNA, 19 nt, Homo sapiens
guaccuggcagaagugaug

SEQ ID NO: 1036480 - RNA, 19 nt, Homo sapiens
cgucauaugugguguuggu

SEQ ID NO: 1036481 - RNA, 19 nt, Homo sapiens
cccauuugcucauuagaau

SEQ ID NO: 1036482 - RNA, 19 nt, Homo sapiens
ggagggucagucagucaua

SEQ ID NO: 1036483 - RNA, 19 nt, Homo sapiens
ucagaaaucaauuccaugu

SEQ ID NO: 1036484 - RNA, 19 nt, Homo sapiens
cuaaacagcaguacaaagg

SEQ ID NO: 1036485 - RNA, 19 nt, Homo sapiens
ggagaccucaucacacugu

SEQ ID NO: 1036486 - RNA, 19 nt, Homo sapiens
caggguguguuugcucuuu

SEQ ID NO: 1036487 - RNA, 19 nt, Homo sapiens
uggcuugagugugugaaua

SEQ ID NO: 1036488 - RNA, 19 nt, Homo sapiens
caacccguguucuacuuuc

SEQ ID NO: 1036489 - RNA, 19 nt, Homo sapiens
gcacucaacauuuaaucgu

SEQ ID NO: 1036490 - RNA, 19 nt, Homo sapiens
gcccugaaaucaagagcau

SEQ ID NO: 1036491 - RNA, 19 nt, Homo sapiens
auagagcccugaaaucaag

SEQ ID NO: 1036492 - RNA, 19 nt, Homo sapiens
caaaggcauggcgauauuu

SEQ ID NO: 1036493 - RNA, 19 nt, Homo sapiens
cguggugucucgagaggaa

SEQ ID NO: 1036494 - RNA, 19 nt, Homo sapiens
ucaauaaucagagaagugu

SEQ ID NO: 1036495 - RNA, 19 nt, Homo sapiens
gcaguagccuuuugugagu

SEQ ID NO: 1036496 - RNA, 19 nt, Homo sapiens
gggauacagaauucaguuu

SEQ ID NO: 1036497 - RNA, 19 nt, Homo sapiens
auaaacagccagaccuuug

SEQ ID NO: 1036498 - RNA, 19 nt, Homo sapiens
caacauugccacgcccauu

SEQ ID NO: 1036499 - RNA, 19 nt, Homo sapiens
gcugauggucuguauagug

SEQ ID NO: 1036500 - RNA, 19 nt, Homo sapiens
gagcagcacagagucauca

SEQ ID NO: 1036501 - RNA, 19 nt, Homo sapiens
ggucccaggccaucugauu

SEQ ID NO: 1036502 - RNA, 19 nt, Homo sapiens
uggcuuacuugcugucuuc

SEQ ID NO: 1036503 - RNA, 19 nt, Homo sapiens
cauaaacagccagaccuuu

SEQ ID NO: 1036504 - RNA, 19 nt, Homo sapiens
gcccacccaucgugaagau

SEQ ID NO: 1036505 - RNA, 19 nt, Homo sapiens
acacuggacaaauugauga

SEQ ID NO: 1036506 - RNA, 19 nt, Homo sapiens
ggucccauuugcucauuag

SEQ ID NO: 1036507 - RNA, 19 nt, Homo sapiens
ugacaauccugcuguaccu

SEQ ID NO: 1036508 - RNA, 19 nt, Homo sapiens
ugggagaccucaucacacu

SEQ ID NO: 1036509 - RNA, 19 nt, Homo sapiens
cugagaagguaaagaagag

SEQ ID NO: 1036510 - RNA, 19 nt, Homo sapiens
uaaacagccagaccuuugu

SEQ ID NO: 1036511 - RNA, 19 nt, Homo sapiens
ccagccgaaucucaaccua

SEQ ID NO: 1036512 - RNA, 19 nt, Homo sapiens
cuacagacacaaagauagu

SEQ ID NO: 1036513 - RNA, 19 nt, Homo sapiens
gccaacacuggacaaauug

SEQ ID NO: 1036514 - RNA, 19 nt, Homo sapiens
gauaccugagccugcaaua

SEQ ID NO: 1036515 - RNA, 19 nt, Homo sapiens
uucacugacuggcuacuaa

SEQ ID NO: 1036516 - RNA, 19 nt, Homo sapiens
gugcugauggucuguauag

SEQ ID NO: 1036517 - RNA, 19 nt, Homo sapiens
uugugagucugcuaaggua

SEQ ID NO: 1036518 - RNA, 19 nt, Homo sapiens
agagcuggguggcaucuca

SEQ ID NO: 1036519 - RNA, 19 nt, Homo sapiens
cuugagcuguggcuuacuu

SEQ ID NO: 1036520 - RNA, 19 nt, Homo sapiens
caacacuggacaaauugau

SEQ ID NO: 1036521 - RNA, 19 nt, Homo sapiens
ucacaucagugggauacag

SEQ ID NO: 1036522 - RNA, 19 nt, Homo sapiens
uagaauuuccucucacauc

SEQ ID NO: 1036523 - RNA, 19 nt, Homo sapiens
ccggcaugcuucuggacua

SEQ ID NO: 1036524 - RNA, 19 nt, Homo sapiens
ccugagaagguaaagaaga

SEQ ID NO: 1036525 - RNA, 19 nt, Homo sapiens
ccauggucaucagcaguuu

SEQ ID NO: 1036526 - RNA, 19 nt, Homo sapiens
cacuguccauucuggcuuu

SEQ ID NO: 1036527 - RNA, 19 nt, Homo sapiens
acucuugagcuguggcuua

SEQ ID NO: 1036528 - RNA, 19 nt, Homo sapiens
gcccaugcaacccagauug

SEQ ID NO: 1036529 - RNA, 19 nt, Homo sapiens
aauagagcccugaaaucaa

SEQ ID NO: 1036530 - RNA, 19 nt, Homo sapiens
ccuguagccucagaagaug

SEQ ID NO: 1036531 - RNA, 19 nt, Homo sapiens
cccuccagaugaagaaauu

SEQ ID NO: 1036532 - RNA, 19 nt, Homo sapiens
gcagcuucuucuacagaca

SEQ ID NO: 1036533 - RNA, 19 nt, Homo sapiens
gcuugagugugugaauaug

SEQ ID NO: 1036534 - RNA, 19 nt, Homo sapiens
cggcaugcuucuggacuau

SEQ ID NO: 1036535 - RNA, 19 nt, Homo sapiens
ggucagucagucauaaaca

SEQ ID NO: 1036536 - RNA, 19 nt, Homo sapiens
gucccaggccaucugauuu

SEQ ID NO: 1036537 - RNA, 19 nt, Homo sapiens
gccauggucaucagcaguu

SEQ ID NO: 1036538 - RNA, 19 nt, Homo sapiens
uagcagcuucuucuacaga

SEQ ID NO: 1036539 - RNA, 19 nt, Homo sapiens
caucuggaccucccuaacu

SEQ ID NO: 1036540 - RNA, 19 nt, Homo sapiens
ccaacccguguucuacuuu

SEQ ID NO: 1036541 - RNA, 19 nt, Homo sapiens
cccaacccguguucuacuu

SEQ ID NO: 1036542 - RNA, 19 nt, Homo sapiens
gcaaggauauacauucauu

SEQ ID NO: 1036543 - RNA, 19 nt, Homo sapiens
caaacaagcuggauacugu

SEQ ID NO: 1036544 - RNA, 19 nt, Homo sapiens
gaagaguucuccaccauuc

SEQ ID NO: 1036545 - RNA, 19 nt, Homo sapiens
guaagcauuuggaugaaua

SEQ ID NO: 1036546 - RNA, 19 nt, Homo sapiens
ccaauaaaguccggaauuu

SEQ ID NO: 1036547 - RNA, 19 nt, Homo sapiens
guaaaggcacuuauugaua

SEQ ID NO: 1036548 - RNA, 19 nt, Homo sapiens
gcacaagucccucugauug

SEQ ID NO: 1036549 - RNA, 19 nt, Homo sapiens
ucaaugggauuuauaguug

SEQ ID NO: 1036550 - RNA, 19 nt, Homo sapiens
gaaauuagauugggauggu

SEQ ID NO: 1036551 - RNA, 19 nt, Homo sapiens
ucacaaagguagaaguuga

SEQ ID NO: 1036552 - RNA, 19 nt, Homo sapiens
guacuaaucguuccuguuu

SEQ ID NO: 1036553 - RNA, 19 nt, Homo sapiens
gggauuaucuugcuuccaa

SEQ ID NO: 1036554 - RNA, 19 nt, Homo sapiens
gaaaugagaaugcacaagu

SEQ ID NO: 1036555 - RNA, 19 nt, Homo sapiens
ggaauugccuguguuguag

SEQ ID NO: 1036556 - RNA, 19 nt, Homo sapiens
uaugaagacugcagauuga

SEQ ID NO: 1036557 - RNA, 19 nt, Homo sapiens
gacugcagauugaugauuu

SEQ ID NO: 1036558 - RNA, 19 nt, Homo sapiens
gaaauuguaaaggcacuua

SEQ ID NO: 1036559 - RNA, 19 nt, Homo sapiens
gggacucaauuuccuauga

SEQ ID NO: 1036560 - RNA, 19 nt, Homo sapiens
ugaugaggauggcuacaua

SEQ ID NO: 1036561 - RNA, 19 nt, Homo sapiens
gaagacugcagauugauga

SEQ ID NO: 1036562 - RNA, 19 nt, Homo sapiens
uccagaauaugcuaagaua

SEQ ID NO: 1036563 - RNA, 19 nt, Homo sapiens
gaagaauucgccaaguauu

SEQ ID NO: 1036564 - RNA, 19 nt, Homo sapiens
aagcugggcugguggaauu

SEQ ID NO: 1036565 - RNA, 19 nt, Homo sapiens
aaagguagaaguugaguuu

SEQ ID NO: 1036566 - RNA, 19 nt, Homo sapiens
gaauaccaguaacagauca

SEQ ID NO: 1036567 - RNA, 19 nt, Homo sapiens
gguagaaguugaguuuaug

SEQ ID NO: 1036568 - RNA, 19 nt, Homo sapiens
guagcuggguuaccuucua

SEQ ID NO: 1036569 - RNA, 19 nt, Homo sapiens
gaagagaguaccucagaca

SEQ ID NO: 1036570 - RNA, 19 nt, Homo sapiens
cuuaaagcauccagaauau

SEQ ID NO: 1036571 - RNA, 19 nt, Homo sapiens
ccuuaaagcauccagaaua

SEQ ID NO: 1036572 - RNA, 19 nt, Homo sapiens
uaaaguugccuguuucaga

SEQ ID NO: 1036573 - RNA, 19 nt, Homo sapiens
cagcuaacauugccuaugg

SEQ ID NO: 1036574 - RNA, 19 nt, Homo sapiens
agaauucgccaaguauuua

SEQ ID NO: 1036575 - RNA, 19 nt, Homo sapiens
uugaagaauucgccaagua

SEQ ID NO: 1036576 - RNA, 19 nt, Homo sapiens
gcauugacuuccgagagua

SEQ ID NO: 1036577 - RNA, 19 nt, Homo sapiens
gugcaacccuuccaacaca

SEQ ID NO: 1036578 - RNA, 19 nt, Homo sapiens
aaaguugccuguuucagau

SEQ ID NO: 1036579 - RNA, 19 nt, Homo sapiens
cgccaaguauuuaaaguug

SEQ ID NO: 1036580 - RNA, 19 nt, Homo sapiens
ggaaagauugcaaguccuu

SEQ ID NO: 1036581 - RNA, 19 nt, Homo sapiens
gagaguaccucagacaaaa

SEQ ID NO: 1036582 - RNA, 19 nt, Homo sapiens
aguaacagaucauaccuau

SEQ ID NO: 1036583 - RNA, 19 nt, Homo sapiens
gggaauaccaguaacagau

SEQ ID NO: 1036584 - RNA, 19 nt, Homo sapiens
gauugcaaguccuuuggaa

SEQ ID NO: 1036585 - RNA, 19 nt, Homo sapiens
uuacuugcauggccauuug

SEQ ID NO: 1036586 - RNA, 19 nt, Homo sapiens
ucauccagguggcauuuaa

SEQ ID NO: 1036587 - RNA, 19 nt, Homo sapiens
gaauucgccaaguauuuaa

SEQ ID NO: 1036588 - RNA, 19 nt, Homo sapiens
acuaaucguuccuguuuga

SEQ ID NO: 1036589 - RNA, 19 nt, Homo sapiens
guuccuguuugauuacuuu

SEQ ID NO: 1036590 - RNA, 19 nt, Homo sapiens
ggauuuauaguugcuguaa

SEQ ID NO: 1036591 - RNA, 19 nt, Homo sapiens
aagcugacccacccaauaa

SEQ ID NO: 1036592 - RNA, 19 nt, Homo sapiens
gcugcaauuucaacaguau

SEQ ID NO: 1036593 - RNA, 19 nt, Homo sapiens
gcuuccaauucgugucuua

SEQ ID NO: 1036594 - RNA, 19 nt, Homo sapiens
ggaagaguucuccaccauu

SEQ ID NO: 1036595 - RNA, 19 nt, Homo sapiens
cagcaggacagcuaacauu

SEQ ID NO: 1036596 - RNA, 19 nt, Homo sapiens
gccaauaaaguccggaauu

SEQ ID NO: 1036597 - RNA, 19 nt, Homo sapiens
ggacauggcaaggauauac

SEQ ID NO: 1036598 - RNA, 19 nt, Homo sapiens
ucuaugguaucucgaaaug

SEQ ID NO: 1036599 - RNA, 19 nt, Homo sapiens
gaugaggauggcuacauaa

SEQ ID NO: 1036600 - RNA, 19 nt, Homo sapiens
uggcaaggauauacauuca

SEQ ID NO: 1036601 - RNA, 19 nt, Homo sapiens
uaauaaagcgaacaacauc

SEQ ID NO: 1036602 - RNA, 19 nt, Homo sapiens
aaagcugacccacccaaua

SEQ ID NO: 1036603 - RNA, 19 nt, Homo sapiens
gaucauccagguggcauuu

SEQ ID NO: 1036604 - RNA, 19 nt, Homo sapiens
ucaaguaccaaaugaugaa

SEQ ID NO: 1036605 - RNA, 19 nt, Homo sapiens
uaugguaucucgaaaugag

SEQ ID NO: 1036606 - RNA, 19 nt, Homo sapiens
uggaauugccuguguugua

SEQ ID NO: 1036607 - RNA, 19 nt, Homo sapiens
cacaguagcuuuugcuuga

SEQ ID NO: 1036608 - RNA, 19 nt, Homo sapiens
ugaagaauucgccaaguau

SEQ ID NO: 1036609 - RNA, 19 nt, Homo sapiens
ggaauaccaguaacagauc

SEQ ID NO: 1036610 - RNA, 19 nt, Homo sapiens
ucugccagcucuucacaaa

SEQ ID NO: 1036611 - RNA, 19 nt, Homo sapiens
auucagcuuuguaugcuua

SEQ ID NO: 1036612 - RNA, 19 nt, Homo sapiens
gauuucagcaggacagcua

SEQ ID NO: 1036613 - RNA, 19 nt, Homo sapiens
ucuggucucuucaaggaaa

SEQ ID NO: 1036614 - RNA, 19 nt, Homo sapiens
aagaauucgccaaguauuu

SEQ ID NO: 1036615 - RNA, 19 nt, Homo sapiens
caguucaaguaccaaauga

SEQ ID NO: 1036616 - RNA, 19 nt, Homo sapiens
guuuaugccaguucaagua

SEQ ID NO: 1036617 - RNA, 19 nt, Homo sapiens
gauacuaguuuucccagaa

SEQ ID NO: 1036618 - RNA, 19 nt, Homo sapiens
ccagacgugccauguguuu

SEQ ID NO: 1036619 - RNA, 19 nt, Homo sapiens
gauuguccuucuugggauu

SEQ ID NO: 1036620 - RNA, 19 nt, Homo sapiens
cuaugaagacugcagauug

SEQ ID NO: 1036621 - RNA, 19 nt, Homo sapiens
guucaaguaccaaaugaug

SEQ ID NO: 1036622 - RNA, 19 nt, Homo sapiens
auacauucauucagcuuug

SEQ ID NO: 1036623 - RNA, 19 nt, Homo sapiens
gcccuaggcugggacucua

SEQ ID NO: 1036624 - RNA, 19 nt, Homo sapiens
uaaaccaggagccuucauu

SEQ ID NO: 1036625 - RNA, 19 nt, Homo sapiens
agguagaaguugaguuuau

SEQ ID NO: 1036626 - RNA, 19 nt, Homo sapiens
agccaguccuccucagaua

SEQ ID NO: 1036627 - RNA, 19 nt, Homo sapiens
uuucuggucucuucaagga

SEQ ID NO: 1036628 - RNA, 19 nt, Homo sapiens
ugccugaccuugauguuuc

SEQ ID NO: 1036629 - RNA, 19 nt, Homo sapiens
uagcuggguuaccuucuau

SEQ ID NO: 1036630 - RNA, 19 nt, Homo sapiens
cgaggcggguccagauugu

SEQ ID NO: 1036631 - RNA, 19 nt, Homo sapiens
cuuauugguugcguuaauu

SEQ ID NO: 1036632 - RNA, 19 nt, Homo sapiens
gauggaauugccuguguug

SEQ ID NO: 1036633 - RNA, 19 nt, Homo sapiens
agagaguaccucagacaaa

SEQ ID NO: 1036634 - RNA, 19 nt, Homo sapiens
ugauguuucuggucucuuc

SEQ ID NO: 1036635 - RNA, 19 nt, Homo sapiens
caacacagaggagaucauc

SEQ ID NO: 1036636 - RNA, 19 nt, Homo sapiens
ucuacaggcuucccuugga

SEQ ID NO: 1036637 - RNA, 19 nt, Homo sapiens
ggaggaaaauuacucaaac

SEQ ID NO: 1036638 - RNA, 19 nt, Homo sapiens
aaaugagaaugcacaaguc

SEQ ID NO: 1036639 - RNA, 19 nt, Homo sapiens
aaaggaggaagaauuggaa

SEQ ID NO: 1036640 - RNA, 19 nt, Homo sapiens
aguaccaaaugaugaagaa

SEQ ID NO: 1036641 - RNA, 19 nt, Homo sapiens
gauuaucuugcuuccaauu

SEQ ID NO: 1036642 - RNA, 19 nt, Homo sapiens
ggagauaacuguauauagg

SEQ ID NO: 1036643 - RNA, 19 nt, Homo sapiens
gaaggauucugcauuucua

SEQ ID NO: 1036644 - RNA, 19 nt, Homo sapiens
gaacauguuugccauaugg

SEQ ID NO: 1036645 - RNA, 19 nt, Homo sapiens
ggaaaguacugagcccaua

SEQ ID NO: 1036646 - RNA, 19 nt, Homo sapiens
uaacuaaggagcagcauuu

SEQ ID NO: 1036647 - RNA, 19 nt, Homo sapiens
ggguagcucuuaagccaua

SEQ ID NO: 1036648 - RNA, 19 nt, Homo sapiens
uauauaggcuacugaaaga

SEQ ID NO: 1036649 - RNA, 19 nt, Homo sapiens
gcucuuaagccauaacuaa

SEQ ID NO: 1036650 - RNA, 19 nt, Homo sapiens
gaaaugaugcgccugacaa

SEQ ID NO: 1036651 - RNA, 19 nt, Homo sapiens
gagcagcauuugaguagau

SEQ ID NO: 1036652 - RNA, 19 nt, Homo sapiens
uguaggagauaacuguaua

SEQ ID NO: 1036653 - RNA, 19 nt, Homo sapiens
aaacaucacuucaggaaaa

SEQ ID NO: 1036654 - RNA, 19 nt, Homo sapiens
ggaaagagaacguaacaac

SEQ ID NO: 1036655 - RNA, 19 nt, Homo sapiens
gcgaaaagaucaagaggaa

SEQ ID NO: 1036656 - RNA, 19 nt, Homo sapiens
aaacccaagcuuagauuua

SEQ ID NO: 1036657 - RNA, 19 nt, Homo sapiens
gcccaaacguguguaguga

SEQ ID NO: 1036658 - RNA, 19 nt, Homo sapiens
guacugagcccauaugacu

SEQ ID NO: 1036659 - RNA, 19 nt, Homo sapiens
uugaagaagugcaagguuu

SEQ ID NO: 1036660 - RNA, 19 nt, Homo sapiens
gggugggcguugugaauuu

SEQ ID NO: 1036661 - RNA, 19 nt, Homo sapiens
gaaaguacugagcccauau

SEQ ID NO: 1036662 - RNA, 19 nt, Homo sapiens
ggugguggcuaccugcauu

SEQ ID NO: 1036663 - RNA, 19 nt, Homo sapiens
guauauaggcuacugaaag

SEQ ID NO: 1036664 - RNA, 19 nt, Homo sapiens
caagaacauguuugccaua

SEQ ID NO: 1036665 - RNA, 19 nt, Homo sapiens
ccaaacguguguagugagu

SEQ ID NO: 1036666 - RNA, 19 nt, Homo sapiens
cauaugacuugacccacaa

SEQ ID NO: 1036667 - RNA, 19 nt, Homo sapiens
gaggaaagagaacguaaca

SEQ ID NO: 1036668 - RNA, 19 nt, Homo sapiens
ccacugaagcuacggaguu

SEQ ID NO: 1036669 - RNA, 19 nt, Homo sapiens
ccuacccacugaagucuuu

SEQ ID NO: 1036670 - RNA, 19 nt, Homo sapiens
guagugaguguaggagaua

SEQ ID NO: 1036671 - RNA, 19 nt, Homo sapiens
aaacguguguagugagugu

SEQ ID NO: 1036672 - RNA, 19 nt, Homo sapiens
aacccaagcuuagauuuau

SEQ ID NO: 1036673 - RNA, 19 nt, Homo sapiens
uuaaacaucacuucaggaa

SEQ ID NO: 1036674 - RNA, 19 nt, Homo sapiens
gaauagccacugccaacau

SEQ ID NO: 1036675 - RNA, 19 nt, Homo sapiens
gcgggacucuagagaagau

SEQ ID NO: 1036676 - RNA, 19 nt, Homo sapiens
aagaacauguuugccauau

SEQ ID NO: 1036677 - RNA, 19 nt, Homo sapiens
ugaaagggcaccacuugug

SEQ ID NO: 1036678 - RNA, 19 nt, Homo sapiens
ccagguugcccacaaguug

SEQ ID NO: 1036679 - RNA, 19 nt, Homo sapiens
cacugaagcuacggaguuu

SEQ ID NO: 1036680 - RNA, 19 nt, Homo sapiens
aaagagaacguaacaacca

SEQ ID NO: 1036681 - RNA, 19 nt, Homo sapiens
caagaggaaagagaacgua

SEQ ID NO: 1036682 - RNA, 19 nt, Homo sapiens
gaaaagaucaagaggaaag

SEQ ID NO: 1036683 - RNA, 19 nt, Homo sapiens
gcauuugaguagauuucug

SEQ ID NO: 1036684 - RNA, 19 nt, Homo sapiens
ggauucugcauuucuauuc

SEQ ID NO: 1036685 - RNA, 19 nt, Homo sapiens
gagaacguaacaaccagaa

SEQ ID NO: 1036686 - RNA, 19 nt, Homo sapiens
gaguguaggagauaacugu

SEQ ID NO: 1036687 - RNA, 19 nt, Homo sapiens
aauagccacugccaacaug

SEQ ID NO: 1036688 - RNA, 19 nt, Homo sapiens
guugugaauuugaagaagu

SEQ ID NO: 1036689 - RNA, 19 nt, Homo sapiens
ggugggcguugugaauuug

SEQ ID NO: 1036690 - RNA, 19 nt, Homo sapiens
gggccacuuugaaaugaug

SEQ ID NO: 1036691 - RNA, 19 nt, Homo sapiens
guaagaagagaaccuaaaa

SEQ ID NO: 1036692 - RNA, 19 nt, Homo sapiens
ggagcagcauuugaguaga

SEQ ID NO: 1036693 - RNA, 19 nt, Homo sapiens
gaggcaaaggugcuauuga

SEQ ID NO: 1036694 - RNA, 19 nt, Homo sapiens
gacaaucaaccgcucuaug

SEQ ID NO: 1036695 - RNA, 19 nt, Homo sapiens
gcuacggaguuuacagaag

SEQ ID NO: 1036696 - RNA, 19 nt, Homo sapiens
aaaguaagaagagaaccua

SEQ ID NO: 1036697 - RNA, 19 nt, Homo sapiens
gcuuagauuuauugaaagg

SEQ ID NO: 1036698 - RNA, 19 nt, Homo sapiens
aaggugcuauugaccacua

SEQ ID NO: 1036699 - RNA, 19 nt, Homo sapiens
ggaggcaaaggugcuauug

SEQ ID NO: 1036700 - RNA, 19 nt, Homo sapiens
acaaucaaccgcucuaugg

SEQ ID NO: 1036701 - RNA, 19 nt, Homo sapiens
cuaaggagcagcauuugag

SEQ ID NO: 1036702 - RNA, 19 nt, Homo sapiens
ggaguggacccgagugaac

SEQ ID NO: 1036703 - RNA, 19 nt, Homo sapiens
cagaaccccuggacauuug

SEQ ID NO: 1036704 - RNA, 19 nt, Homo sapiens
ggacccgagugaacacaac

SEQ ID NO: 1036705 - RNA, 19 nt, Homo sapiens
ugaagaagugcaagguuuc

SEQ ID NO: 1036706 - RNA, 19 nt, Homo sapiens
aggcaaaggugcuauugac

SEQ ID NO: 1036707 - RNA, 19 nt, Homo sapiens
cauuugaguagauuucuga

SEQ ID NO: 1036708 - RNA, 19 nt, Homo sapiens
uagagaagaugcgaaaaga

SEQ ID NO: 1036709 - RNA, 19 nt, Homo sapiens
ggaguuuacagaaggcaau

SEQ ID NO: 1036710 - RNA, 19 nt, Homo sapiens
uaaacaucacuucaggaaa

SEQ ID NO: 1036711 - RNA, 19 nt, Homo sapiens
gagaagaugcgaaaagauc

SEQ ID NO: 1036712 - RNA, 19 nt, Homo sapiens
agaacauguuugccauaug

SEQ ID NO: 1036713 - RNA, 19 nt, Homo sapiens
gcccaucacucgcaaaagu

SEQ ID NO: 1036714 - RNA, 19 nt, Homo sapiens
uguagugaguguaggagau

SEQ ID NO: 1036715 - RNA, 19 nt, Homo sapiens
gggcauacggaaaguacug

SEQ ID NO: 1036716 - RNA, 19 nt, Homo sapiens
cuggacauuugagcgaaua

SEQ ID NO: 1036717 - RNA, 19 nt, Homo sapiens
aguaagaagagaaccuaaa

SEQ ID NO: 1036718 - RNA, 19 nt, Homo sapiens
caaucaaccgcucuaugga

SEQ ID NO: 1036719 - RNA, 19 nt, Homo sapiens
gucuuuggguagcucuuaa

SEQ ID NO: 1036720 - RNA, 19 nt, Homo sapiens
guaggagauaacuguauau

SEQ ID NO: 1036721 - RNA, 19 nt, Homo sapiens
ugaccagguugcccacaag

SEQ ID NO: 1036722 - RNA, 19 nt, Homo sapiens
guaccaaguuuugaagaug

SEQ ID NO: 1036723 - RNA, 19 nt, Homo sapiens
gaaauacuggggcaaguuc

SEQ ID NO: 1036724 - RNA, 19 nt, Homo sapiens
agagaugggugggcguugu

SEQ ID NO: 1036725 - RNA, 19 nt, Homo sapiens
gcgguguccugagccgauu

SEQ ID NO: 1036726 - RNA, 19 nt, Homo sapiens
ugaauuugaagaagugcaa

SEQ ID NO: 1036727 - RNA, 19 nt, Homo sapiens
gggaggcaaaggugcuauu

SEQ ID NO: 1036728 - RNA, 19 nt, Homo sapiens
aagaggaaagagaacguaa

SEQ ID NO: 1036729 - RNA, 19 nt, Homo sapiens
gagaacugaugaauccaua

SEQ ID NO: 1036730 - RNA, 19 nt, Homo sapiens
ggagagaacugaugaaucc

SEQ ID NO: 1036731 - RNA, 19 nt, Homo sapiens
ucauugggcuuucuuuaaa

SEQ ID NO: 1036732 - RNA, 19 nt, Homo sapiens
guaaugacugggauauuua

SEQ ID NO: 1036733 - RNA, 19 nt, Homo sapiens
gaacaucugcagcacauga

SEQ ID NO: 1036734 - RNA, 19 nt, Homo sapiens
gucaacaucuucaucauug

SEQ ID NO: 1036735 - RNA, 19 nt, Homo sapiens
gaugguaacuacuuaugau

SEQ ID NO: 1036736 - RNA, 19 nt, Homo sapiens
gaaaacugcauucuucuua

SEQ ID NO: 1036737 - RNA, 19 nt, Homo sapiens
gcacacugcuuaggaguca

SEQ ID NO: 1036738 - RNA, 19 nt, Homo sapiens
aguaaugacugggauauuu

SEQ ID NO: 1036739 - RNA, 19 nt, Homo sapiens
gaacugaugaauccauaga

SEQ ID NO: 1036740 - RNA, 19 nt, Homo sapiens
ggugacagcccaacagauu

SEQ ID NO: 1036741 - RNA, 19 nt, Homo sapiens
gcugagagacuuugcuaaa

SEQ ID NO: 1036742 - RNA, 19 nt, Homo sapiens
gaucuugaguaccucuuug

SEQ ID NO: 1036743 - RNA, 19 nt, Homo sapiens
aaacgugcacuuuguaauu

SEQ ID NO: 1036744 - RNA, 19 nt, Homo sapiens
gcgcuggcaugcaggcuuu

SEQ ID NO: 1036745 - RNA, 19 nt, Homo sapiens
ccaaguguacucaaagaaa

SEQ ID NO: 1036746 - RNA, 19 nt, Homo sapiens
gguaacuacuuaugaugga

SEQ ID NO: 1036747 - RNA, 19 nt, Homo sapiens
ggagucaacaucuucauca

SEQ ID NO: 1036748 - RNA, 19 nt, Homo sapiens
gcccaaguguacucaaaga

SEQ ID NO: 1036749 - RNA, 19 nt, Homo sapiens
gguccugccucaagugaug

SEQ ID NO: 1036750 - RNA, 19 nt, Homo sapiens
caucauugggcuuucuuua

SEQ ID NO: 1036751 - RNA, 19 nt, Homo sapiens
acauaacccucuccuagga

SEQ ID NO: 1036752 - RNA, 19 nt, Homo sapiens
uuaacgagccuaguaauga

SEQ ID NO: 1036753 - RNA, 19 nt, Homo sapiens
uaaaccagccccagaaaua

SEQ ID NO: 1036754 - RNA, 19 nt, Homo sapiens
ugacugggauauuuacuac

SEQ ID NO: 1036755 - RNA, 19 nt, Homo sapiens
cagcccaaguguacucaaa

SEQ ID NO: 1036756 - RNA, 19 nt, Homo sapiens
caguugugcuugcucauug

SEQ ID NO: 1036757 - RNA, 19 nt, Homo sapiens
ugacucauucucauacuuu

SEQ ID NO: 1036758 - RNA, 19 nt, Homo sapiens
gaaaucccuuugccuccau

SEQ ID NO: 1036759 - RNA, 19 nt, Homo sapiens
gggcuuuguugaaguggaa

SEQ ID NO: 1036760 - RNA, 19 nt, Homo sapiens
ggaugguaacuacuuauga

SEQ ID NO: 1036761 - RNA, 19 nt, Homo sapiens
caaguguacucaaagaaaa

SEQ ID NO: 1036762 - RNA, 19 nt, Homo sapiens
cuacaguguucucgacuuc

SEQ ID NO: 1036763 - RNA, 19 nt, Homo sapiens
ucuaugaccgccugauuaa

SEQ ID NO: 1036764 - RNA, 19 nt, Homo sapiens
aaaagcagcugaaccucua

SEQ ID NO: 1036765 - RNA, 19 nt, Homo sapiens
acugaugaauccauagaaa

SEQ ID NO: 1036766 - RNA, 19 nt, Homo sapiens
caaaaggacaugauugaaa

SEQ ID NO: 1036767 - RNA, 19 nt, Homo sapiens
aacgugcacuuuguaauuu

SEQ ID NO: 1036768 - RNA, 19 nt, Homo sapiens
gcugaugcuugcucuguca

SEQ ID NO: 1036769 - RNA, 19 nt, Homo sapiens
uguggaugguaacuacuua

SEQ ID NO: 1036770 - RNA, 19 nt, Homo sapiens
aaacugcauucuucuuagu

SEQ ID NO: 1036771 - RNA, 19 nt, Homo sapiens
gcuuaggagucaacaucuu

SEQ ID NO: 1036772 - RNA, 19 nt, Homo sapiens
aagaacaucugcagcacau

SEQ ID NO: 1036773 - RNA, 19 nt, Homo sapiens
cuacuuaugauggacguua

SEQ ID NO: 1036774 - RNA, 19 nt, Homo sapiens
ucauggcccugcugagaga

SEQ ID NO: 1036775 - RNA, 19 nt, Homo sapiens
uaacgagccuaguaaugac

SEQ ID NO: 1036776 - RNA, 19 nt, Homo sapiens
ccagggcuuuguugaagug

SEQ ID NO: 1036777 - RNA, 19 nt, Homo sapiens
gcaguugugcuugcucauu

SEQ ID NO: 1036778 - RNA, 19 nt, Homo sapiens
ugauuaacgagccuaguaa

SEQ ID NO: 1036779 - RNA, 19 nt, Homo sapiens
gcuuccggcuucuuagaug

SEQ ID NO: 1036780 - RNA, 19 nt, Homo sapiens
aaauggcggugucuacagu

SEQ ID NO: 1036781 - RNA, 19 nt, Homo sapiens
gagucaacaucuucaucau

SEQ ID NO: 1036782 - RNA, 19 nt, Homo sapiens
cugauuaacgagccuagua

SEQ ID NO: 1036783 - RNA, 19 nt, Homo sapiens
gaggugacagcccaacaga

SEQ ID NO: 1036784 - RNA, 19 nt, Homo sapiens
ggcggugucuacaguguuc

SEQ ID NO: 1036785 - RNA, 19 nt, Homo sapiens
ggcaggagagaacugauga

SEQ ID NO: 1036786 - RNA, 19 nt, Homo sapiens
ccacugguccugccucaag

SEQ ID NO: 1036787 - RNA, 19 nt, Homo sapiens
gugacucauucucauacuu

SEQ ID NO: 1036788 - RNA, 19 nt, Homo sapiens
caacagauucccaaaagga

SEQ ID NO: 1036789 - RNA, 19 nt, Homo sapiens
ggcuuugccuggcugcuau

SEQ ID NO: 1036790 - RNA, 19 nt, Homo sapiens
uugaguaccucuuugaaaa

SEQ ID NO: 1036791 - RNA, 19 nt, Homo sapiens
acugggauauuuacuacug

SEQ ID NO: 1036792 - RNA, 19 nt, Homo sapiens
cugcagcacaugacagaaa

SEQ ID NO: 1036793 - RNA, 19 nt, Homo sapiens
gcaggagagaacugaugaa

SEQ ID NO: 1036794 - RNA, 19 nt, Homo sapiens
cgugcacuuuguaauuuga

SEQ ID NO: 1036795 - RNA, 19 nt, Homo sapiens
cucuaugaccgccugauua

SEQ ID NO: 1036796 - RNA, 19 nt, Homo sapiens
ccccagaaauauuugaaaa

SEQ ID NO: 1036797 - RNA, 19 nt, Homo sapiens
caggagagaacugaugaau

SEQ ID NO: 1036798 - RNA, 19 nt, Homo sapiens
gaaaauggcggugucuaca

SEQ ID NO: 1036799 - RNA, 19 nt, Homo sapiens
ccucaagugauggacauaa

SEQ ID NO: 1036800 - RNA, 19 nt, Homo sapiens
uucagucuguggaugguaa

SEQ ID NO: 1036801 - RNA, 19 nt, Homo sapiens
agucaacaucuucaucauu

SEQ ID NO: 1036802 - RNA, 19 nt, Homo sapiens
cuugaguaccucuuugaaa

SEQ ID NO: 1036803 - RNA, 19 nt, Homo sapiens
gaaagcagcaauauugaua

SEQ ID NO: 1036804 - RNA, 19 nt, Homo sapiens
gagaggagcugcagaaucu

SEQ ID NO: 1036805 - RNA, 19 nt, Homo sapiens
ugacaagauugcugcauua

SEQ ID NO: 1036806 - RNA, 19 nt, Homo sapiens
gggaaacauugcucugaua

SEQ ID NO: 1036807 - RNA, 19 nt, Homo sapiens
caacaagcauucugaucaa

SEQ ID NO: 1036808 - RNA, 19 nt, Homo sapiens
ugagaaagcagcaauauug

SEQ ID NO: 1036809 - RNA, 19 nt, Homo sapiens
caagauugcugcauuacga

SEQ ID NO: 1036810 - RNA, 19 nt, Homo sapiens
gaauucacuucaucaagaa

SEQ ID NO: 1036811 - RNA, 19 nt, Homo sapiens
aaacuuaccugaugaagag

SEQ ID NO: 1036812 - RNA, 19 nt, Homo sapiens
ugucagagauaaacaagaa

SEQ ID NO: 1036813 - RNA, 19 nt, Homo sapiens
ggaaacauugcucugauaa

SEQ ID NO: 1036814 - RNA, 19 nt, Homo sapiens
cuucugcgcuucuauguuu

SEQ ID NO: 1036815 - RNA, 19 nt, Homo sapiens
gaauaccaguccuaucaga

SEQ ID NO: 1036816 - RNA, 19 nt, Homo sapiens
gaaauaacuggaaaugaug

SEQ ID NO: 1036817 - RNA, 19 nt, Homo sapiens
ucaaagccauaguugguaa

SEQ ID NO: 1036818 - RNA, 19 nt, Homo sapiens
ucagaaaccuugugauguc

SEQ ID NO: 1036819 - RNA, 19 nt, Homo sapiens
cugcacagcuacaggauuu

SEQ ID NO: 1036820 - RNA, 19 nt, Homo sapiens
ggaaagaugaaaucaaaca

SEQ ID NO: 1036821 - RNA, 19 nt, Homo sapiens
gaagaauggaugcacguuu

SEQ ID NO: 1036822 - RNA, 19 nt, Homo sapiens
ccaugucuuucucauauuu

SEQ ID NO: 1036823 - RNA, 19 nt, Homo sapiens
gaaaccuugugaugucuug

SEQ ID NO: 1036824 - RNA, 19 nt, Homo sapiens
guaccaagauuaucacacu

SEQ ID NO: 1036825 - RNA, 19 nt, Homo sapiens
gaauguauaagcugcauau

SEQ ID NO: 1036826 - RNA, 19 nt, Homo sapiens
gagaaagcagcaauauuga

SEQ ID NO: 1036827 - RNA, 19 nt, Homo sapiens
gugacaagauugcugcauu

SEQ ID NO: 1036828 - RNA, 19 nt, Homo sapiens
gaaacauugcucugauaaa

SEQ ID NO: 1036829 - RNA, 19 nt, Homo sapiens
gcaccaggcugagaaagca

SEQ ID NO: 1036830 - RNA, 19 nt, Homo sapiens
gagaggaaaugcauaaaau

SEQ ID NO: 1036831 - RNA, 19 nt, Homo sapiens
ugugaugucuugacuguug

SEQ ID NO: 1036832 - RNA, 19 nt, Homo sapiens
gcccgcagcuucuucacaa

SEQ ID NO: 1036833 - RNA, 19 nt, Homo sapiens
gcaguugaaucaguugaau

SEQ ID NO: 1036834 - RNA, 19 nt, Homo sapiens
guagagaggagcugcagaa

SEQ ID NO: 1036835 - RNA, 19 nt, Homo sapiens
gagcuuauccuguguacca

SEQ ID NO: 1036836 - RNA, 19 nt, Homo sapiens
agaauugugugaauagcaa

SEQ ID NO: 1036837 - RNA, 19 nt, Homo sapiens
gaggagcugcagaaucuaa

SEQ ID NO: 1036838 - RNA, 19 nt, Homo sapiens
uaccaguccuaucagauuu

SEQ ID NO: 1036839 - RNA, 19 nt, Homo sapiens
caggagauuccaugucuuu

SEQ ID NO: 1036840 - RNA, 19 nt, Homo sapiens
guucagaaaccuugugaug

SEQ ID NO: 1036841 - RNA, 19 nt, Homo sapiens
gaauacugcguguucagaa

SEQ ID NO: 1036842 - RNA, 19 nt, Homo sapiens
gagauaagacuauguacac

SEQ ID NO: 1036843 - RNA, 19 nt, Homo sapiens
guugagaggaaaugcauaa

SEQ ID NO: 1036844 - RNA, 19 nt, Homo sapiens
ggaaauuacaugguugaga

SEQ ID NO: 1036845 - RNA, 19 nt, Homo sapiens
ccaagauuaucacacuguu

SEQ ID NO: 1036846 - RNA, 19 nt, Homo sapiens
caucaagaaacuaucauga

SEQ ID NO: 1036847 - RNA, 19 nt, Homo sapiens
agagauauuucagcaguug

SEQ ID NO: 1036848 - RNA, 19 nt, Homo sapiens
aacaggaaauuacaugguu

SEQ ID NO: 1036849 - RNA, 19 nt, Homo sapiens
ggagcugcagaaucuaaua

SEQ ID NO: 1036850 - RNA, 19 nt, Homo sapiens
uuccaugucuuucucauau

SEQ ID NO: 1036851 - RNA, 19 nt, Homo sapiens
acaacaagcauucugauca

SEQ ID NO: 1036852 - RNA, 19 nt, Homo sapiens
cuuuggagauacauaguuu

SEQ ID NO: 1036853 - RNA, 19 nt, Homo sapiens
uuacaugguugagaggaaa

SEQ ID NO: 1036854 - RNA, 19 nt, Homo sapiens
gcagguaaagcuugcacuu

SEQ ID NO: 1036855 - RNA, 19 nt, Homo sapiens
acucuaaacuuaugugaac

SEQ ID NO: 1036856 - RNA, 19 nt, Homo sapiens
aauacugcguguucagaaa

SEQ ID NO: 1036857 - RNA, 19 nt, Homo sapiens
caagauuaucacacuguuu

SEQ ID NO: 1036858 - RNA, 19 nt, Homo sapiens
guaggaaagaugaaaucaa

SEQ ID NO: 1036859 - RNA, 19 nt, Homo sapiens
aaauagcugucauuaugca

SEQ ID NO: 1036860 - RNA, 19 nt, Homo sapiens
aagauuaucacacuguuug

SEQ ID NO: 1036861 - RNA, 19 nt, Homo sapiens
gaggaaaugcauaaaauga

SEQ ID NO: 1036862 - RNA, 19 nt, Homo sapiens
uaucaugaaaugcgugaaa

SEQ ID NO: 1036863 - RNA, 19 nt, Homo sapiens
gagugaauacugcguguuc

SEQ ID NO: 1036864 - RNA, 19 nt, Homo sapiens
cuauugaaaugaguagaga

SEQ ID NO: 1036865 - RNA, 19 nt, Homo sapiens
gugaacaguuuugaguuua

SEQ ID NO: 1036866 - RNA, 19 nt, Homo sapiens
ggagauuccaugucuuucu

SEQ ID NO: 1036867 - RNA, 19 nt, Homo sapiens
gugugaauagcaacauaua

SEQ ID NO: 1036868 - RNA, 19 nt, Homo sapiens
uuauauggcagagugaaua

SEQ ID NO: 1036869 - RNA, 19 nt, Homo sapiens
aagaauggaugcacguuuu

SEQ ID NO: 1036870 - RNA, 19 nt, Homo sapiens
uauccuguguaccaagauu

SEQ ID NO: 1036871 - RNA, 19 nt, Homo sapiens
gcagcuucuucacaaaaua

SEQ ID NO: 1036872 - RNA, 19 nt, Homo sapiens
uaacaacaagcauucugau

SEQ ID NO: 1036873 - RNA, 19 nt, Homo sapiens
gaacaguuuugaguuuaug

SEQ ID NO: 1036874 - RNA, 19 nt, Homo sapiens
uaucaacauuccuuaacag

SEQ ID NO: 1036875 - RNA, 19 nt, Homo sapiens
gcauuuguggucgagcuua

SEQ ID NO: 1036876 - RNA, 19 nt, Homo sapiens
gaaagaugaaaucaaacag

SEQ ID NO: 1036877 - RNA, 19 nt, Homo sapiens
ugaaaugcgugaaaaguag

SEQ ID NO: 1036878 - RNA, 19 nt, Homo sapiens
ucacacuguuugggaauca

SEQ ID NO: 1036879 - RNA, 19 nt, Homo sapiens
uaacaggaaauuacauggu

SEQ ID NO: 1036880 - RNA, 19 nt, Homo sapiens
cuugugaugucuugacugu

SEQ ID NO: 1036881 - RNA, 19 nt, Homo sapiens
auaaggugguccugcaguu

SEQ ID NO: 1036882 - RNA, 19 nt, Homo sapiens
ucuaauacaguccuuggaa

SEQ ID NO: 1036883 - RNA, 19 nt, Homo sapiens
uauuuccucugcacagcua

SEQ ID NO: 1036884 - RNA, 19 nt, Homo sapiens
gcaguguguauauucaaau

SEQ ID NO: 1036885 - RNA, 19 nt, Homo sapiens
uaugcaguguguauauuca

SEQ ID NO: 1036886 - RNA, 19 nt, Homo sapiens
ggucgagcuuauccugugu

SEQ ID NO: 1036887 - RNA, 19 nt, Homo sapiens
uuaacaacaagcauucuga

SEQ ID NO: 1036888 - RNA, 19 nt, Homo sapiens
ugcaguguguauauucaaa

SEQ ID NO: 1036889 - RNA, 19 nt, Homo sapiens
cauuaugcaguguguauau

SEQ ID NO: 1036890 - RNA, 19 nt, Homo sapiens
ugggaaacauugcucugau

SEQ ID NO: 1036891 - RNA, 19 nt, Homo sapiens
cuuaccugaugaagagaua

SEQ ID NO: 1036892 - RNA, 19 nt, Homo sapiens
ggaugcacguuuuagaaga

SEQ ID NO: 1036893 - RNA, 19 nt, Homo sapiens
caggaaauuacaugguuga

SEQ ID NO: 1036894 - RNA, 19 nt, Homo sapiens
auaccaguccuaucagauu

SEQ ID NO: 1036895 - RNA, 19 nt, Homo sapiens
augaauaccaguccuauca

SEQ ID NO: 1036896 - RNA, 19 nt, Homo sapiens
guacacauccacuuuuguu

SEQ ID NO: 1036897 - RNA, 19 nt, Homo sapiens
ugagauaagacuauguaca

SEQ ID NO: 1036898 - RNA, 19 nt, Homo sapiens
guugaaauaacuggaaaug

SEQ ID NO: 1036899 - RNA, 19 nt, Homo sapiens
gguccugcaguugaaauaa

SEQ ID NO: 1036900 - RNA, 19 nt, Homo sapiens
aacaagcauucugaucaaa

SEQ ID NO: 1036901 - RNA, 19 nt, Homo sapiens
cauuuguggucgagcuuau

SEQ ID NO: 1036902 - RNA, 19 nt, Homo sapiens
cucaggagauuccaugucu

SEQ ID NO: 1036903 - RNA, 19 nt, Homo sapiens
gcagacauaugaagaaguu

SEQ ID NO: 1036904 - RNA, 19 nt, Homo sapiens
ccaguuggccuaagaauua

SEQ ID NO: 1036905 - RNA, 19 nt, Homo sapiens
caacacugcugcauucauu

SEQ ID NO: 1036906 - RNA, 19 nt, Homo sapiens
gcugagaaguguuugcaua

SEQ ID NO: 1036907 - RNA, 19 nt, Homo sapiens
gaaggcagcucagaaagga

SEQ ID NO: 1036908 - RNA, 19 nt, Homo sapiens
uguaggaccugccauauuu

SEQ ID NO: 1036909 - RNA, 19 nt, Homo sapiens
cagaugaacuggaacagaa

SEQ ID NO: 1036910 - RNA, 19 nt, Homo sapiens
cagaaaggauuaaggaaga

SEQ ID NO: 1036911 - RNA, 19 nt, Homo sapiens
gcauucauccuacaucaua

SEQ ID NO: 1036912 - RNA, 19 nt, Homo sapiens
ccagguaguuauccacaua

SEQ ID NO: 1036913 - RNA, 19 nt, Homo sapiens
ggagaaggcagcucagaaa

SEQ ID NO: 1036914 - RNA, 19 nt, Homo sapiens
auagucagauguacaguua

SEQ ID NO: 1036915 - RNA, 19 nt, Homo sapiens
uaaacaagguucaaauugg

SEQ ID NO: 1036916 - RNA, 19 nt, Homo sapiens
ccaguucggucucuacaaa

SEQ ID NO: 1036917 - RNA, 19 nt, Homo sapiens
cuacaacacugcugcauuc

SEQ ID NO: 1036918 - RNA, 19 nt, Homo sapiens
ggaauccuuuguccaggua

SEQ ID NO: 1036919 - RNA, 19 nt, Homo sapiens
gaucaugaauguuucuaca

SEQ ID NO: 1036920 - RNA, 19 nt, Homo sapiens
caaauugguuuccuucaca

SEQ ID NO: 1036921 - RNA, 19 nt, Homo sapiens
guucaagguuucucaguug

SEQ ID NO: 1036922 - RNA, 19 nt, Homo sapiens
gcaaagcauucauccuaca

SEQ ID NO: 1036923 - RNA, 19 nt, Homo sapiens
caacaaggaguucauggaa

SEQ ID NO: 1036924 - RNA, 19 nt, Homo sapiens
agucagauguacaguuaua

SEQ ID NO: 1036925 - RNA, 19 nt, Homo sapiens
gauaacagcccugaguauu

SEQ ID NO: 1036926 - RNA, 19 nt, Homo sapiens
gcauucauuugaccauuug

SEQ ID NO: 1036927 - RNA, 19 nt, Homo sapiens
uaaagccaguggaauauag

SEQ ID NO: 1036928 - RNA, 19 nt, Homo sapiens
gcaccaugcagacauauga

SEQ ID NO: 1036929 - RNA, 19 nt, Homo sapiens
uaaggaagauagcucaaag

SEQ ID NO: 1036930 - RNA, 19 nt, Homo sapiens
gaaaggauuaaggaagaua

SEQ ID NO: 1036931 - RNA, 19 nt, Homo sapiens
ugaagaaguuggagaugau

SEQ ID NO: 1036932 - RNA, 19 nt, Homo sapiens
guguaaagccaguggaaua

SEQ ID NO: 1036933 - RNA, 19 nt, Homo sapiens
ugucauguguugggacuua

SEQ ID NO: 1036934 - RNA, 19 nt, Homo sapiens
caagccagguugcaugaug

SEQ ID NO: 1036935 - RNA, 19 nt, Homo sapiens
cuacauggaugagaacuuc

SEQ ID NO: 1036936 - RNA, 19 nt, Homo sapiens
aaacaagguucaaauuggu

SEQ ID NO: 1036937 - RNA, 19 nt, Homo sapiens
gggaacaacuuuuaaacaa

SEQ ID NO: 1036938 - RNA, 19 nt, Homo sapiens
agagaucccugccaugaug

SEQ ID NO: 1036939 - RNA, 19 nt, Homo sapiens
aggguucucuggaguauuu

SEQ ID NO: 1036940 - RNA, 19 nt, Homo sapiens
ugagaaguguuugcauaaa

SEQ ID NO: 1036941 - RNA, 19 nt, Homo sapiens
guaaagccaguggaauaua

SEQ ID NO: 1036942 - RNA, 19 nt, Homo sapiens
gagaaguguuugcauaaaa

SEQ ID NO: 1036943 - RNA, 19 nt, Homo sapiens
ccacagcugagaaguguuu

SEQ ID NO: 1036944 - RNA, 19 nt, Homo sapiens
gcucagaaaggauuaagga

SEQ ID NO: 1036945 - RNA, 19 nt, Homo sapiens
ggccacagcugagaagugu

SEQ ID NO: 1036946 - RNA, 19 nt, Homo sapiens
uguagaauuugcagauuug

SEQ ID NO: 1036947 - RNA, 19 nt, Homo sapiens
ugacugaggccaacaagga

SEQ ID NO: 1036948 - RNA, 19 nt, Homo sapiens
gcuacaaccaguauuauca

SEQ ID NO: 1036949 - RNA, 19 nt, Homo sapiens
ggaaacaaccagauaacag

SEQ ID NO: 1036950 - RNA, 19 nt, Homo sapiens
aaacugaacuaugccacuu

SEQ ID NO: 1036951 - RNA, 19 nt, Homo sapiens
gagaugaugcauuggaaga

SEQ ID NO: 1036952 - RNA, 19 nt, Homo sapiens
gaugauggcaugcuguaug

SEQ ID NO: 1036953 - RNA, 19 nt, Homo sapiens
aagcagacccuccguguga

SEQ ID NO: 1036954 - RNA, 19 nt, Homo sapiens
gggauaauucacacacuaa

SEQ ID NO: 1036955 - RNA, 19 nt, Homo sapiens
gaauauagucagauguaca

SEQ ID NO: 1036956 - RNA, 19 nt, Homo sapiens
cauuugaccauuugaguuu

SEQ ID NO: 1036957 - RNA, 19 nt, Homo sapiens
aggcaaagcauucauccua

SEQ ID NO: 1036958 - RNA, 19 nt, Homo sapiens
ugggauaauucacacacua

SEQ ID NO: 1036959 - RNA, 19 nt, Homo sapiens
gaugagcagcuugggauaa

SEQ ID NO: 1036960 - RNA, 19 nt, Homo sapiens
ccagcuggcuacugcuuug

SEQ ID NO: 1036961 - RNA, 19 nt, Homo sapiens
ucagagaucccugccauga

SEQ ID NO: 1036962 - RNA, 19 nt, Homo sapiens
agagcaccaugcagacaua

SEQ ID NO: 1036963 - RNA, 19 nt, Homo sapiens
ccaguggaauauagucaga

SEQ ID NO: 1036964 - RNA, 19 nt, Homo sapiens
gggcaugguggcucacuuu

SEQ ID NO: 1036965 - RNA, 19 nt, Homo sapiens
uacaaggccuggaucacuu

SEQ ID NO: 1036966 - RNA, 19 nt, Homo sapiens
ggauaauucacacacuaaa

SEQ ID NO: 1036967 - RNA, 19 nt, Homo sapiens
ggaauauagucagauguac

SEQ ID NO: 1036968 - RNA, 19 nt, Homo sapiens
uggaauauagucagaugua

SEQ ID NO: 1036969 - RNA, 19 nt, Homo sapiens
guugacagguagguaugua

SEQ ID NO: 1036970 - RNA, 19 nt, Homo sapiens
auaggacaguuugggauua

SEQ ID NO: 1036971 - RNA, 19 nt, Homo sapiens
cacagugucuucagagauc

SEQ ID NO: 1036972 - RNA, 19 nt, Homo sapiens
agagugaggagcuguauga

SEQ ID NO: 1036973 - RNA, 19 nt, Homo sapiens
gagcguggcaaucccuaaa

SEQ ID NO: 1036974 - RNA, 19 nt, Homo sapiens
guaugaauucuucgucaaa

SEQ ID NO: 1036975 - RNA, 19 nt, Homo sapiens
cagauaacagcccugagua

SEQ ID NO: 1036976 - RNA, 19 nt, Homo sapiens
gagcagcuugggauaauuc

SEQ ID NO: 1036977 - RNA, 19 nt, Homo sapiens
aaacugggaugagcagcuu

SEQ ID NO: 1036978 - RNA, 19 nt, Homo sapiens
ccacaccugcgaaacguuu

SEQ ID NO: 1036979 - RNA, 19 nt, Homo sapiens
gggagaaggcagcucagaa

SEQ ID NO: 1036980 - RNA, 19 nt, Homo sapiens
aguacuugcucuaauaaug

SEQ ID NO: 1036981 - RNA, 19 nt, Homo sapiens
gaaacuguccaaccuuguc

SEQ ID NO: 1036982 - RNA, 19 nt, Homo sapiens
gacccuccgugugaacuuu

SEQ ID NO: 1036983 - RNA, 19 nt, Homo sapiens
gacaagccagguugcauga

SEQ ID NO: 1036984 - RNA, 19 nt, Homo sapiens
ugacagguagguauguaaa

SEQ ID NO: 1036985 - RNA, 19 nt, Homo sapiens
caagguuucucaguugaca

SEQ ID NO: 1036986 - RNA, 19 nt, Homo sapiens
aguuggagaugaugcauug

SEQ ID NO: 1036987 - RNA, 19 nt, Homo sapiens
ugucuaaggguuaugguuu

SEQ ID NO: 1036988 - RNA, 19 nt, Homo sapiens
uaacagcccugaguauucc

SEQ ID NO: 1036989 - RNA, 19 nt, Homo sapiens
ccagauaacagcccugagu

SEQ ID NO: 1036990 - RNA, 19 nt, Homo sapiens
uguccaaccuugucaugug

SEQ ID NO: 1036991 - RNA, 19 nt, Homo sapiens
guacuugcucuaauaaugg

SEQ ID NO: 1036992 - RNA, 19 nt, Homo sapiens
acagguagguauguaaauc

SEQ ID NO: 1036993 - RNA, 19 nt, Homo sapiens
uuggagaucaugaauguuu

SEQ ID NO: 1036994 - RNA, 19 nt, Homo sapiens
auagcuacaaccaguauua

SEQ ID NO: 1036995 - RNA, 19 nt, Homo sapiens
guacaguuauagcuacaac

SEQ ID NO: 1036996 - RNA, 19 nt, Homo sapiens
aagcauucauccuacauca

SEQ ID NO: 1036997 - RNA, 19 nt, Homo sapiens
ggaccugccauauuugagu

SEQ ID NO: 1036998 - RNA, 19 nt, Homo sapiens
ggaugagcagcuugggaua

SEQ ID NO: 1036999 - RNA, 19 nt, Homo sapiens
ugcauucauuugaccauuu

SEQ ID NO: 1037000 - RNA, 19 nt, Homo sapiens
ccaaaggacaagccagguu

SEQ ID NO: 1037001 - RNA, 19 nt, Homo sapiens
caugcuguaugaauucuuc

SEQ ID NO: 1037002 - RNA, 19 nt, Homo sapiens
gcauauacaaggccuggau

SEQ ID NO: 1037003 - RNA, 19 nt, Homo sapiens
caacacagaugaugaacaa

SEQ ID NO: 1037004 - RNA, 19 nt, Homo sapiens
agaaagagauuguggaauu

SEQ ID NO: 1037005 - RNA, 19 nt, Homo sapiens
gaaagagauuguggaauuu

SEQ ID NO: 1037006 - RNA, 19 nt, Homo sapiens
aaacauaaaucuccaagga

SEQ ID NO: 1037007 - RNA, 19 nt, Homo sapiens
gcaguaaacccaaaguuaa

SEQ ID NO: 1037008 - RNA, 19 nt, Homo sapiens
gaacuuaugauauccauga

SEQ ID NO: 1037009 - RNA, 19 nt, Homo sapiens
ugaagauugugaccuauua

SEQ ID NO: 1037010 - RNA, 19 nt, Homo sapiens
aaacacagcuuguaugagu

SEQ ID NO: 1037011 - RNA, 19 nt, Homo sapiens
gauguuggaucacacaauu

SEQ ID NO: 1037012 - RNA, 19 nt, Homo sapiens
ggacaguguucgucacaaa

SEQ ID NO: 1037013 - RNA, 19 nt, Homo sapiens
gcggguaucuccuuucauu

SEQ ID NO: 1037014 - RNA, 19 nt, Homo sapiens
ccucauggcuuucuuuaga

SEQ ID NO: 1037015 - RNA, 19 nt, Homo sapiens
uaacuuggaugaagaaugg

SEQ ID NO: 1037016 - RNA, 19 nt, Homo sapiens
guaaagagggauauauuga

SEQ ID NO: 1037017 - RNA, 19 nt, Homo sapiens
ggacaacacagaugaugaa

SEQ ID NO: 1037018 - RNA, 19 nt, Homo sapiens
uguaugaguucuucuauga

SEQ ID NO: 1037019 - RNA, 19 nt, Homo sapiens
acauaaaucuccaaggaaa

SEQ ID NO: 1037020 - RNA, 19 nt, Homo sapiens
caugauggcucacacguau

SEQ ID NO: 1037021 - RNA, 19 nt, Homo sapiens
gaagcugcauguaacaaau

SEQ ID NO: 1037022 - RNA, 19 nt, Homo sapiens
ugagucagcugaagaaauc

SEQ ID NO: 1037023 - RNA, 19 nt, Homo sapiens
gaacacaguugcugaucgu

SEQ ID NO: 1037024 - RNA, 19 nt, Homo sapiens
ucaaacaucccaaagcuaa

SEQ ID NO: 1037025 - RNA, 19 nt, Homo sapiens
ccaaagaggagcaaaguga

SEQ ID NO: 1037026 - RNA, 19 nt, Homo sapiens
gaagaaaucagggaccauu

SEQ ID NO: 1037027 - RNA, 19 nt, Homo sapiens
gauggaagcugcauguaac

SEQ ID NO: 1037028 - RNA, 19 nt, Homo sapiens
gccaguaucuuucaaacau

SEQ ID NO: 1037029 - RNA, 19 nt, Homo sapiens
gcucacacguauaauccua

SEQ ID NO: 1037030 - RNA, 19 nt, Homo sapiens
cuuuagaacuggcaaauga

SEQ ID NO: 1037031 - RNA, 19 nt, Homo sapiens
cguauaauccuaaugcuuu

SEQ ID NO: 1037032 - RNA, 19 nt, Homo sapiens
gaguguacaguucacauua

SEQ ID NO: 1037033 - RNA, 19 nt, Homo sapiens
guaucaaaguggauuauca

SEQ ID NO: 1037034 - RNA, 19 nt, Homo sapiens
aaacauaggugugauugca

SEQ ID NO: 1037035 - RNA, 19 nt, Homo sapiens
ccacuguaauguuguguga

SEQ ID NO: 1037036 - RNA, 19 nt, Homo sapiens
ccacagcaguaaacccaaa

SEQ ID NO: 1037037 - RNA, 19 nt, Homo sapiens
gaaauacucaagcaacuag

SEQ ID NO: 1037038 - RNA, 19 nt, Homo sapiens
agaugaagauugugaccua

SEQ ID NO: 1037039 - RNA, 19 nt, Homo sapiens
gaaguaucaaaguggauua

SEQ ID NO: 1037040 - RNA, 19 nt, Homo sapiens
gaucacacaauucaaauag

SEQ ID NO: 1037041 - RNA, 19 nt, Homo sapiens
ccaguaucuuucaaacaua

SEQ ID NO: 1037042 - RNA, 19 nt, Homo sapiens
ggaaauacucaagcaacua

SEQ ID NO: 1037043 - RNA, 19 nt, Homo sapiens
cagccuggaugacauaaug

SEQ ID NO: 1037044 - RNA, 19 nt, Homo sapiens
ggaagcugcauguaacaaa

SEQ ID NO: 1037045 - RNA, 19 nt, Homo sapiens
cagagaacauugacagaca

SEQ ID NO: 1037046 - RNA, 19 nt, Homo sapiens
uaacgcaguugcuccugaa

SEQ ID NO: 1037047 - RNA, 19 nt, Homo sapiens
gcuuauauccacagcagua

SEQ ID NO: 1037048 - RNA, 19 nt, Homo sapiens
gaaaugcagagcuuauauc

SEQ ID NO: 1037049 - RNA, 19 nt, Homo sapiens
gauuggaaguaucaaagug

SEQ ID NO: 1037050 - RNA, 19 nt, Homo sapiens
gauucugucucuacuggaa

SEQ ID NO: 1037051 - RNA, 19 nt, Homo sapiens
guauaauccuaaugcuuug

SEQ ID NO: 1037052 - RNA, 19 nt, Homo sapiens
ggaucacacaauucaaaua

SEQ ID NO: 1037053 - RNA, 19 nt, Homo sapiens
gcugugaaaugcagagcuu

SEQ ID NO: 1037054 - RNA, 19 nt, Homo sapiens
ucagagugcuaacgcaguu

SEQ ID NO: 1037055 - RNA, 19 nt, Homo sapiens
uggaugacauaaugagauu

SEQ ID NO: 1037056 - RNA, 19 nt, Homo sapiens
ggaaauugcagaggaaaca

SEQ ID NO: 1037057 - RNA, 19 nt, Homo sapiens
gcaguaaagagggauauau

SEQ ID NO: 1037058 - RNA, 19 nt, Homo sapiens
ggaaguaucaaaguggauu

SEQ ID NO: 1037059 - RNA, 19 nt, Homo sapiens
uuugguguguuucugauua

SEQ ID NO: 1037060 - RNA, 19 nt, Homo sapiens
ggaggaagucucagaacga

SEQ ID NO: 1037061 - RNA, 19 nt, Homo sapiens
gaaccucaaacaucccaaa

SEQ ID NO: 1037062 - RNA, 19 nt, Homo sapiens
caaccaaaacaaccaauua

SEQ ID NO: 1037063 - RNA, 19 nt, Homo sapiens
uuauggagauguuggauca

SEQ ID NO: 1037064 - RNA, 19 nt, Homo sapiens
ccuuaagggugcugugaaa

SEQ ID NO: 1037065 - RNA, 19 nt, Homo sapiens
ccagguauccagaaugcua

SEQ ID NO: 1037066 - RNA, 19 nt, Homo sapiens
caguaaacccaaaguuaaa

SEQ ID NO: 1037067 - RNA, 19 nt, Homo sapiens
ucaagcaacuagucauucu

SEQ ID NO: 1037068 - RNA, 19 nt, Homo sapiens
gcagauuggaaguaucaaa

SEQ ID NO: 1037069 - RNA, 19 nt, Homo sapiens
ccaaagaguucagcaagac

SEQ ID NO: 1037070 - RNA, 19 nt, Homo sapiens
gaucauccagagaacauug

SEQ ID NO: 1037071 - RNA, 19 nt, Homo sapiens
gaauagucaagcuucauug

SEQ ID NO: 1037072 - RNA, 19 nt, Homo sapiens
acuguaauguugugugauu

SEQ ID NO: 1037073 - RNA, 19 nt, Homo sapiens
uggauccacuguaauguug

SEQ ID NO: 1037074 - RNA, 19 nt, Homo sapiens
aaagagggauauauugaac

SEQ ID NO: 1037075 - RNA, 19 nt, Homo sapiens
caguaaagagggauauauu

SEQ ID NO: 1037076 - RNA, 19 nt, Homo sapiens
ccuauuagaaggacagaaa

SEQ ID NO: 1037077 - RNA, 19 nt, Homo sapiens
cagaucugcugccaugaug

SEQ ID NO: 1037078 - RNA, 19 nt, Homo sapiens
gauugcagcauuuacaguu

SEQ ID NO: 1037079 - RNA, 19 nt, Homo sapiens
gaugaagauugugaccuau

SEQ ID NO: 1037080 - RNA, 19 nt, Homo sapiens
cagcuauacucuggagaaa

SEQ ID NO: 1037081 - RNA, 19 nt, Homo sapiens
cuagaacgccacccaaaga

SEQ ID NO: 1037082 - RNA, 19 nt, Homo sapiens
cuuccuggauccacuguaa

SEQ ID NO: 1037083 - RNA, 19 nt, Homo sapiens
cagcaagaccagcagauug

SEQ ID NO: 1037084 - RNA, 19 nt, Homo sapiens
gcaugauggcucacacgua

SEQ ID NO: 1037085 - RNA, 19 nt, Homo sapiens
cgcaguugcuccugaauuc

SEQ ID NO: 1037086 - RNA, 19 nt, Homo sapiens
aguguacaguucacauuaa

SEQ ID NO: 1037087 - RNA, 19 nt, Homo sapiens
uggauaacuuggaugaaga

SEQ ID NO: 1037088 - RNA, 19 nt, Homo sapiens
gaucugcuuuugaaugaaa

SEQ ID NO: 1037089 - RNA, 19 nt, Homo sapiens
ugaaaugcagagcuuauau

SEQ ID NO: 1037090 - RNA, 19 nt, Homo sapiens
gugaaaugcagagcuuaua

SEQ ID NO: 1037091 - RNA, 19 nt, Homo sapiens
aauauucacaucccacuuu

SEQ ID NO: 1037092 - RNA, 19 nt, Homo sapiens
ggauaacuuggaugaagaa

SEQ ID NO: 1037093 - RNA, 19 nt, Homo sapiens
ugauggcucacacguauaa

SEQ ID NO: 1037094 - RNA, 19 nt, Homo sapiens
ggugaggcacaaagaguuu

SEQ ID NO: 1037095 - RNA, 19 nt, Homo sapiens
gauccacuguaauguugug

SEQ ID NO: 1037096 - RNA, 19 nt, Homo sapiens
auauguagcgguucuguaa

SEQ ID NO: 1037097 - RNA, 19 nt, Homo sapiens
gauauguagcgguucugua

SEQ ID NO: 1037098 - RNA, 19 nt, Homo sapiens
ccagauauguagcgguucu

SEQ ID NO: 1037099 - RNA, 19 nt, Homo sapiens
uagaggaaauacucaagca

SEQ ID NO: 1037100 - RNA, 19 nt, Homo sapiens
uacaaagaauggacuuaca

SEQ ID NO: 1037101 - RNA, 19 nt, Homo sapiens
ccucaaacaucccaaagcu

SEQ ID NO: 1037102 - RNA, 19 nt, Homo sapiens
guaaacccaaaguuaaaga

SEQ ID NO: 1037103 - RNA, 19 nt, Homo sapiens
caagcaagcugccauguug

SEQ ID NO: 1037104 - RNA, 19 nt, Homo sapiens
cuacagauacuaugagaua

SEQ ID NO: 1037105 - RNA, 19 nt, Homo sapiens
gcuaagccaugccuacaga

SEQ ID NO: 1037106 - RNA, 19 nt, Homo sapiens
guugugagcugcccuaugg

SEQ ID NO: 1037107 - RNA, 19 nt, Homo sapiens
acacagaaauagauaacug

SEQ ID NO: 1037108 - RNA, 19 nt, Homo sapiens
gauaacugaaacaccauua

SEQ ID NO: 1037109 - RNA, 19 nt, Homo sapiens
gcagacagcgcaacugauc

SEQ ID NO: 1037110 - RNA, 19 nt, Homo sapiens
guccagggcuuccaagagu

SEQ ID NO: 1037111 - RNA, 19 nt, Homo sapiens
gcuggcaccuugauugaag

SEQ ID NO: 1037112 - RNA, 19 nt, Homo sapiens
uaagccaugccuacagaua

SEQ ID NO: 1037113 - RNA, 19 nt, Homo sapiens
cuacuuuguuacacagaaa

SEQ ID NO: 1037114 - RNA, 19 nt, Homo sapiens
gcuacuuuguuacacagaa

SEQ ID NO: 1037115 - RNA, 19 nt, Homo sapiens
guacgugagugagcuugga

SEQ ID NO: 1037116 - RNA, 19 nt, Homo sapiens
gccuacagauacuaugaga

SEQ ID NO: 1037117 - RNA, 19 nt, Homo sapiens
ccagacggauugggugugu

SEQ ID NO: 1037118 - RNA, 19 nt, Homo sapiens
gcaagcugccauguuguga

SEQ ID NO: 1037119 - RNA, 19 nt, Homo sapiens
caacuacagccugcaagga

SEQ ID NO: 1037120 - RNA, 19 nt, Homo sapiens
ucaagcaagcugccauguu

SEQ ID NO: 1037121 - RNA, 19 nt, Homo sapiens
cggcagacagcgcaacuga

SEQ ID NO: 1037122 - RNA, 19 nt, Homo sapiens
uggagaggcccacaggaaa

SEQ ID NO: 1037123 - RNA, 19 nt, Homo sapiens
cacagaaauagauaacuga

SEQ ID NO: 1037124 - RNA, 19 nt, Homo sapiens
gcggcuaccagacggauug

SEQ ID NO: 1037125 - RNA, 19 nt, Homo sapiens
ggagaggcccacaggaaaa

SEQ ID NO: 1037126 - RNA, 19 nt, Homo sapiens
gccuggagcucguggucau

SEQ ID NO: 1037127 - RNA, 19 nt, Homo sapiens
ggagcucguggucauguuc

SEQ ID NO: 1037128 - RNA, 19 nt, Homo sapiens
gaaagacggugcugaagaa

SEQ ID NO: 1037129 - RNA, 19 nt, Homo sapiens
gaacaaacgugcuaucauc

SEQ ID NO: 1037130 - RNA, 19 nt, Homo sapiens
gcgccuagaugucugauuu

SEQ ID NO: 1037131 - RNA, 19 nt, Homo sapiens
caagauauccuauugaaug

SEQ ID NO: 1037132 - RNA, 19 nt, Homo sapiens
ggaaguggauggagcuaga

SEQ ID NO: 1037133 - RNA, 19 nt, Homo sapiens
aaauauagcucaacacagu

SEQ ID NO: 1037134 - RNA, 19 nt, Homo sapiens
ggauggagcuagagagaca

SEQ ID NO: 1037135 - RNA, 19 nt, Homo sapiens
gaacccugauguuucuaaa

SEQ ID NO: 1037136 - RNA, 19 nt, Homo sapiens
guaaagggacuuaguaaag

SEQ ID NO: 1037137 - RNA, 19 nt, Homo sapiens
gcaucugacuugccacauu

SEQ ID NO: 1037138 - RNA, 19 nt, Homo sapiens
ggaaagacggugcugaaga

SEQ ID NO: 1037139 - RNA, 19 nt, Homo sapiens
ggaaguaacugggcauggu

SEQ ID NO: 1037140 - RNA, 19 nt, Homo sapiens
gcucaacacaguuauauuc

SEQ ID NO: 1037141 - RNA, 19 nt, Homo sapiens
ggaggguucucacgcuuug

SEQ ID NO: 1037142 - RNA, 19 nt, Homo sapiens
agucguaccugaagagaaa

SEQ ID NO: 1037143 - RNA, 19 nt, Homo sapiens
ugagagacauuaucgaaag

SEQ ID NO: 1037144 - RNA, 19 nt, Homo sapiens
guaaauauagcucaacaca

SEQ ID NO: 1037145 - RNA, 19 nt, Homo sapiens
cuaaagaaacgucaguauu

SEQ ID NO: 1037146 - RNA, 19 nt, Homo sapiens
uguacaagauauccuauug

SEQ ID NO: 1037147 - RNA, 19 nt, Homo sapiens
uggcaaacauacaagcuuu

SEQ ID NO: 1037148 - RNA, 19 nt, Homo sapiens
gacauuaucgaaagucgua

SEQ ID NO: 1037149 - RNA, 19 nt, Homo sapiens
ccacugcuccugaccaauu

SEQ ID NO: 1037150 - RNA, 19 nt, Homo sapiens
guaaggaagcuaugcguau

SEQ ID NO: 1037151 - RNA, 19 nt, Homo sapiens
uaauauagauagggucuca

SEQ ID NO: 1037152 - RNA, 19 nt, Homo sapiens
uaaagggacuuaguaaagg

SEQ ID NO: 1037153 - RNA, 19 nt, Homo sapiens
gcaacacgcagacacaguu

SEQ ID NO: 1037154 - RNA, 19 nt, Homo sapiens
ugaaugcuuugucuuugaa

SEQ ID NO: 1037155 - RNA, 19 nt, Homo sapiens
gagcgaguguuucagaucu

SEQ ID NO: 1037156 - RNA, 19 nt, Homo sapiens
gcugguggcuggugacauc

SEQ ID NO: 1037157 - RNA, 19 nt, Homo sapiens
gaaauguaccguuauccau

SEQ ID NO: 1037158 - RNA, 19 nt, Homo sapiens
uugccuaucuguaaaggua

SEQ ID NO: 1037159 - RNA, 19 nt, Homo sapiens
gugggaaucuuggucauug

SEQ ID NO: 1037160 - RNA, 19 nt, Homo sapiens
caucugacuugccacauuc

SEQ ID NO: 1037161 - RNA, 19 nt, Homo sapiens
guacaagauauccuauuga

SEQ ID NO: 1037162 - RNA, 19 nt, Homo sapiens
ugaccaauugcaauaguua

SEQ ID NO: 1037163 - RNA, 19 nt, Homo sapiens
caaacgugcuaucaucgau

SEQ ID NO: 1037164 - RNA, 19 nt, Homo sapiens
ggacuuaguaaaggguaua

SEQ ID NO: 1037165 - RNA, 19 nt, Homo sapiens
aaacaucagugccuugaac

SEQ ID NO: 1037166 - RNA, 19 nt, Homo sapiens
acaccaggaucuuguacaa

SEQ ID NO: 1037167 - RNA, 19 nt, Homo sapiens
uggaaugguugcaggauau

SEQ ID NO: 1037168 - RNA, 19 nt, Homo sapiens
uccagaagaugacucaaga

SEQ ID NO: 1037169 - RNA, 19 nt, Homo sapiens
uaaggaagcuaugcguauc

SEQ ID NO: 1037170 - RNA, 19 nt, Homo sapiens
gagagacauuaucgaaagu

SEQ ID NO: 1037171 - RNA, 19 nt, Homo sapiens
ggaagaguaaggaagcuau

SEQ ID NO: 1037172 - RNA, 19 nt, Homo sapiens
cgaaagucguaccugaaga

SEQ ID NO: 1037173 - RNA, 19 nt, Homo sapiens
agacacaguuggcauugau

SEQ ID NO: 1037174 - RNA, 19 nt, Homo sapiens
uuaaagaacaaacgugcua

SEQ ID NO: 1037175 - RNA, 19 nt, Homo sapiens
guugaagacugacauucug

SEQ ID NO: 1037176 - RNA, 19 nt, Homo sapiens
gagacugcccuauccagaa

SEQ ID NO: 1037177 - RNA, 19 nt, Homo sapiens
gaaagucguaccugaagag

SEQ ID NO: 1037178 - RNA, 19 nt, Homo sapiens
uggcugacauguuggaaug

SEQ ID NO: 1037179 - RNA, 19 nt, Homo sapiens
agacggugcugaagaacau

SEQ ID NO: 1037180 - RNA, 19 nt, Homo sapiens
gaauguaaagggacuuagu

SEQ ID NO: 1037181 - RNA, 19 nt, Homo sapiens
cugaaugcuuugucuuuga

SEQ ID NO: 1037182 - RNA, 19 nt, Homo sapiens
cuagagagacaacaggaaa

SEQ ID NO: 1037183 - RNA, 19 nt, Homo sapiens
aggaggcgcugaagaagug

SEQ ID NO: 1037184 - RNA, 19 nt, Homo sapiens
acccugauguuucuaaaga

SEQ ID NO: 1037185 - RNA, 19 nt, Homo sapiens
ucagcaaccuggcggaaca

SEQ ID NO: 1037186 - RNA, 19 nt, Homo sapiens
cuucgggccuucccagauu

SEQ ID NO: 1037187 - RNA, 19 nt, Homo sapiens
caggaaagacggugcugaa

SEQ ID NO: 1037188 - RNA, 19 nt, Homo sapiens
gaucauaggaaaacuagaa

SEQ ID NO: 1037189 - RNA, 19 nt, Homo sapiens
gagaaugccagcccagagu

SEQ ID NO: 1037190 - RNA, 19 nt, Homo sapiens
aucagugccuugaaccuua

SEQ ID NO: 1037191 - RNA, 19 nt, Homo sapiens
gaagaguaaggaagcuaug

SEQ ID NO: 1037192 - RNA, 19 nt, Homo sapiens
gcgaguguuucagaucuau

SEQ ID NO: 1037193 - RNA, 19 nt, Homo sapiens
guaaagguaauacauucug

SEQ ID NO: 1037194 - RNA, 19 nt, Homo sapiens
ucaucgauacauacuguua

SEQ ID NO: 1037195 - RNA, 19 nt, Homo sapiens
uaauggccguguuacuuuc

SEQ ID NO: 1037196 - RNA, 19 nt, Homo sapiens
aauguaaagggacuuagua

SEQ ID NO: 1037197 - RNA, 19 nt, Homo sapiens
ggucugcugccuucaucua

SEQ ID NO: 1037198 - RNA, 19 nt, Homo sapiens
gggagacuuggcaaacaua

SEQ ID NO: 1037199 - RNA, 19 nt, Homo sapiens
gcagacacaguuggcauug

SEQ ID NO: 1037200 - RNA, 19 nt, Homo sapiens
gaguguuucagaucuauga

SEQ ID NO: 1037201 - RNA, 19 nt, Homo sapiens
auagaaauguaccguuauc

SEQ ID NO: 1037202 - RNA, 19 nt, Homo sapiens
cgauacauacuguuagguu

SEQ ID NO: 1037203 - RNA, 19 nt, Homo sapiens
gacuguaugucagagaaga

SEQ ID NO: 1037204 - RNA, 19 nt, Homo sapiens
gaaacaucagugccuugaa

SEQ ID NO: 1037205 - RNA, 19 nt, Homo sapiens
uguguuugccuaucuguaa

SEQ ID NO: 1037206 - RNA, 19 nt, Homo sapiens
gggaaaggcuagccauccu

SEQ ID NO: 1037207 - RNA, 19 nt, Homo sapiens
aaagcuggcaucugacuug

SEQ ID NO: 1037208 - RNA, 19 nt, Homo sapiens
caaagcauugucugguuga

SEQ ID NO: 1037209 - RNA, 19 nt, Homo sapiens
uccaaagcauugucugguu

SEQ ID NO: 1037210 - RNA, 19 nt, Homo sapiens
ggcaucauccaaagcauug

SEQ ID NO: 1037211 - RNA, 19 nt, Homo sapiens
ucugaacccugauguuucu

SEQ ID NO: 1037212 - RNA, 19 nt, Homo sapiens
ggauauugagagacauuau

SEQ ID NO: 1037213 - RNA, 19 nt, Homo sapiens
guguuugccuaucuguaaa

SEQ ID NO: 1037214 - RNA, 19 nt, Homo sapiens
ucugaaugcuuugucuuug

SEQ ID NO: 1037215 - RNA, 19 nt, Homo sapiens
uagugucuuuccucuauug

SEQ ID NO: 1037216 - RNA, 19 nt, Homo sapiens
aagagcggcugaggcguaa

SEQ ID NO: 1037217 - RNA, 19 nt, Homo sapiens
agacugcccuauccagaag

SEQ ID NO: 1037218 - RNA, 19 nt, Homo sapiens
agacuuggcaaacauacaa

SEQ ID NO: 1037219 - RNA, 19 nt, Homo sapiens
uuggaaugguugcaggaua

SEQ ID NO: 1037220 - RNA, 19 nt, Homo sapiens
ccauguggagcgaguguuu

SEQ ID NO: 1037221 - RNA, 19 nt, Homo sapiens
guuauccucaagccaauuu

SEQ ID NO: 1037222 - RNA, 19 nt, Homo sapiens
ugaaacaucagugccuuga

SEQ ID NO: 1037223 - RNA, 19 nt, Homo sapiens
gaacaccaggaucuuguac

SEQ ID NO: 1037224 - RNA, 19 nt, Homo sapiens
auagauaccuuuucagugu

SEQ ID NO: 1037225 - RNA, 19 nt, Homo sapiens
uguaaagggacuuaguaaa

SEQ ID NO: 1037226 - RNA, 19 nt, Homo sapiens
cguguuacuuucagaucuu

SEQ ID NO: 1037227 - RNA, 19 nt, Homo sapiens
ccucuauuguggaccuaaa

SEQ ID NO: 1037228 - RNA, 19 nt, Homo sapiens
gaaagggauuugagcuaua

SEQ ID NO: 1037229 - RNA, 19 nt, Homo sapiens
gaaauggaaccaaauguuu

SEQ ID NO: 1037230 - RNA, 19 nt, Homo sapiens
ggagugacauuucuguaaa

SEQ ID NO: 1037231 - RNA, 19 nt, Homo sapiens
gauuacagcugaaauggaa

SEQ ID NO: 1037232 - RNA, 19 nt, Homo sapiens
caaacagccuucuccuaua

SEQ ID NO: 1037233 - RNA, 19 nt, Homo sapiens
ugaaguaccuccuggugua

SEQ ID NO: 1037234 - RNA, 19 nt, Homo sapiens
gaauaugugggaacuauaa

SEQ ID NO: 1037235 - RNA, 19 nt, Homo sapiens
ucacaaagcugccuugacu

SEQ ID NO: 1037236 - RNA, 19 nt, Homo sapiens
uaugguaacuuguucugua

SEQ ID NO: 1037237 - RNA, 19 nt, Homo sapiens
gagcgagaaucaaacauag

SEQ ID NO: 1037238 - RNA, 19 nt, Homo sapiens
ggaaauuucuaaaccuagu

SEQ ID NO: 1037239 - RNA, 19 nt, Homo sapiens
cagcugaaauggaaccaaa

SEQ ID NO: 1037240 - RNA, 19 nt, Homo sapiens
caacuccucugcuuuccaa

SEQ ID NO: 1037241 - RNA, 19 nt, Homo sapiens
acagucauguuucucauaa

SEQ ID NO: 1037242 - RNA, 19 nt, Homo sapiens
gagaaagggauuugagcua

SEQ ID NO: 1037243 - RNA, 19 nt, Homo sapiens
aaacagccuucuccuauag

SEQ ID NO: 1037244 - RNA, 19 nt, Homo sapiens
caucagccuuuguauguga

SEQ ID NO: 1037245 - RNA, 19 nt, Homo sapiens
gggagugacauuucuguaa

SEQ ID NO: 1037246 - RNA, 19 nt, Homo sapiens
acaaacagccuucuccuau

SEQ ID NO: 1037247 - RNA, 19 nt, Homo sapiens
ucauauggccuaaauguau

SEQ ID NO: 1037248 - RNA, 19 nt, Homo sapiens
agaaagggauuugagcuau

SEQ ID NO: 1037249 - RNA, 19 nt, Homo sapiens
ucaacuaugugccuuaugg

SEQ ID NO: 1037250 - RNA, 19 nt, Homo sapiens
agacaucccucccaaguac

SEQ ID NO: 1037251 - RNA, 19 nt, Homo sapiens
cgagcgagaaucaaacaua

SEQ ID NO: 1037252 - RNA, 19 nt, Homo sapiens
ggaauaugugggaacuaua

SEQ ID NO: 1037253 - RNA, 19 nt, Homo sapiens
cggaauaugugggaacuau

SEQ ID NO: 1037254 - RNA, 19 nt, Homo sapiens
gagguuggcccuuucucua

SEQ ID NO: 1037255 - RNA, 19 nt, Homo sapiens
gaaggauuccaaggagaua

SEQ ID NO: 1037256 - RNA, 19 nt, Homo sapiens
ugaaauggaaccaaauguu

SEQ ID NO: 1037257 - RNA, 19 nt, Homo sapiens
ucacagaagccacccaaga

SEQ ID NO: 1037258 - RNA, 19 nt, Homo sapiens
gagcccugcuugcuguauu

SEQ ID NO: 1037259 - RNA, 19 nt, Homo sapiens
uggcagagguuggcccuuu

SEQ ID NO: 1037260 - RNA, 19 nt, Homo sapiens
gagacaucccucccaagua

SEQ ID NO: 1037261 - RNA, 19 nt, Homo sapiens
gaugauguucccagccaua

SEQ ID NO: 1037262 - RNA, 19 nt, Homo sapiens
gagaaucaaacauagugaa

SEQ ID NO: 1037263 - RNA, 19 nt, Homo sapiens
ccaagaagaaggauuccaa

SEQ ID NO: 1037264 - RNA, 19 nt, Homo sapiens
ucagugguguguuuacaau

SEQ ID NO: 1037265 - RNA, 19 nt, Homo sapiens
gagccuggcccucauauac

SEQ ID NO: 1037266 - RNA, 19 nt, Homo sapiens
ggucuucuguggccuacug

SEQ ID NO: 1037267 - RNA, 19 nt, Homo sapiens
gucccucacucuuagguuu

SEQ ID NO: 1037268 - RNA, 19 nt, Homo sapiens
aaagggauuugagcuauag

SEQ ID NO: 1037269 - RNA, 19 nt, Homo sapiens
aaccauggaugagaaagaa

SEQ ID NO: 1037270 - RNA, 19 nt, Homo sapiens
cauauggccuaaauguauc

SEQ ID NO: 1037271 - RNA, 19 nt, Homo sapiens
caucaacuccucugcuuuc

SEQ ID NO: 1037272 - RNA, 19 nt, Homo sapiens
gcgagaaucaaacauagug

SEQ ID NO: 1037273 - RNA, 19 nt, Homo sapiens
ugaauuccaucagccuuug

SEQ ID NO: 1037274 - RNA, 19 nt, Homo sapiens
agaagaaggauuccaagga

SEQ ID NO: 1037275 - RNA, 19 nt, Homo sapiens
aaaccaagaagaaggauuc

SEQ ID NO: 1037276 - RNA, 19 nt, Homo sapiens
gagugacauuucuguaaag

SEQ ID NO: 1037277 - RNA, 19 nt, Homo sapiens
gucaucaacuccucugcuu

SEQ ID NO: 1037278 - RNA, 19 nt, Homo sapiens
cagacgagcgagaaucaaa

SEQ ID NO: 1037279 - RNA, 19 nt, Homo sapiens
gcugaaauggaaccaaaug

SEQ ID NO: 1037280 - RNA, 19 nt, Homo sapiens
gguuggcccuuucucuaau

SEQ ID NO: 1037281 - RNA, 19 nt, Homo sapiens
ggggaaauuucuaaaccua

SEQ ID NO: 1037282 - RNA, 19 nt, Homo sapiens
auacagacuuaaugagcaa

SEQ ID NO: 1037283 - RNA, 19 nt, Homo sapiens
ugggaacuauaaaucacua

SEQ ID NO: 1037284 - RNA, 19 nt, Homo sapiens
uugaagcccugacauccuu

SEQ ID NO: 1037285 - RNA, 19 nt, Homo sapiens
ggaaucgugcgaaaagaua

SEQ ID NO: 1037286 - RNA, 19 nt, Homo sapiens
cauagugagugucaucaac

SEQ ID NO: 1037287 - RNA, 19 nt, Homo sapiens
gaaguaccuccugguguau

SEQ ID NO: 1037288 - RNA, 19 nt, Homo sapiens
ucaagugccaaaccaagaa

SEQ ID NO: 1037289 - RNA, 19 nt, Homo sapiens
gcuuuaauguguaggaaaa

SEQ ID NO: 1037290 - RNA, 19 nt, Homo sapiens
gggcuuuaauguguaggaa

SEQ ID NO: 1037291 - RNA, 19 nt, Homo sapiens
caaaguguccaagcuguca

SEQ ID NO: 1037292 - RNA, 19 nt, Homo sapiens
ccucaacuaugugccuuau

SEQ ID NO: 1037293 - RNA, 19 nt, Homo sapiens
aagcccugcugcauuuaaa

SEQ ID NO: 1037294 - RNA, 19 nt, Homo sapiens
caucugcuccuucuuaaac

SEQ ID NO: 1037295 - RNA, 19 nt, Homo sapiens
ccacaggacaauuuucaua

SEQ ID NO: 1037296 - RNA, 19 nt, Homo sapiens
gguuuaccgucaugauauc

SEQ ID NO: 1037297 - RNA, 19 nt, Homo sapiens
ggacuuugaagcccugaca

SEQ ID NO: 1037298 - RNA, 19 nt, Homo sapiens
acaaagcugccuugacugu

SEQ ID NO: 1037299 - RNA, 19 nt, Homo sapiens
gaaauuucuaaaccuagug

SEQ ID NO: 1037300 - RNA, 19 nt, Homo sapiens
aaauuagucuuugcugagu

SEQ ID NO: 1037301 - RNA, 19 nt, Homo sapiens
ggccgugugugaggucauu

SEQ ID NO: 1037302 - RNA, 19 nt, Homo sapiens
uccaucugcuccuucuuaa

SEQ ID NO: 1037303 - RNA, 19 nt, Homo sapiens
ccauugccuuugaugaugu

SEQ ID NO: 1037304 - RNA, 19 nt, Homo sapiens
auuagucuuugcugaguaa

SEQ ID NO: 1037305 - RNA, 19 nt, Homo sapiens
gguugucauuccauuguca

SEQ ID NO: 1037306 - RNA, 19 nt, Homo sapiens
uccaucagccuuuguaugu

SEQ ID NO: 1037307 - RNA, 19 nt, Homo sapiens
acuaugugccuuaugguaa

SEQ ID NO: 1037308 - RNA, 19 nt, Homo sapiens
gauuugggagugacauuuc

SEQ ID NO: 1037309 - RNA, 19 nt, Homo sapiens
aauuaccaacugcugauua

SEQ ID NO: 1037310 - RNA, 19 nt, Homo sapiens
ggcagagguuggcccuuuc

SEQ ID NO: 1037311 - RNA, 19 nt, Homo sapiens
ucuggaaggcggaauaugu

SEQ ID NO: 1037312 - RNA, 19 nt, Homo sapiens
ucucuaaugccuucuggaa

SEQ ID NO: 1037313 - RNA, 19 nt, Homo sapiens
uuccaucugcuccuucuua

SEQ ID NO: 1037314 - RNA, 19 nt, Homo sapiens
acuagucccucacucuuag

SEQ ID NO: 1037315 - RNA, 19 nt, Homo sapiens
uacuagucccucacucuua

SEQ ID NO: 1037316 - RNA, 19 nt, Homo sapiens
ggggcuaccucaacuaugu

SEQ ID NO: 1037317 - RNA, 19 nt, Homo sapiens
gacgucaagugccaaacca

SEQ ID NO: 1037318 - RNA, 19 nt, Homo sapiens
aagagccacuaccacaguu

SEQ ID NO: 1037319 - RNA, 19 nt, Homo sapiens
gcgguugucauuccauugu

SEQ ID NO: 1037320 - RNA, 19 nt, Homo sapiens
ccacgagugccaugcuuuc

SEQ ID NO: 1037321 - RNA, 19 nt, Homo sapiens
gccaaaccaagaagaagga

SEQ ID NO: 1037322 - RNA, 19 nt, Homo sapiens
cggcgacuguaaggacuuu

SEQ ID NO: 1037323 - RNA, 19 nt, Homo sapiens
ccgcgguugucauuccauu

SEQ ID NO: 1037324 - RNA, 19 nt, Homo sapiens
aaaccauggaugagaaaga

SEQ ID NO: 1037325 - RNA, 19 nt, Homo sapiens
cuacuagucccucacucuu

SEQ ID NO: 1037326 - RNA, 19 nt, Homo sapiens
uuucauauggccuaaaugu

SEQ ID NO: 1037327 - RNA, 19 nt, Homo sapiens
aaagagccacuaccacagu

SEQ ID NO: 1037328 - RNA, 19 nt, Homo sapiens
gaaaguggauuauggaucu

SEQ ID NO: 1037329 - RNA, 19 nt, Homo sapiens
caagugaacuggaaaguca

SEQ ID NO: 1037330 - RNA, 19 nt, Homo sapiens
ugucaaagaugaagaagaa

SEQ ID NO: 1037331 - RNA, 19 nt, Homo sapiens
gcagcuagaugauauucuu

SEQ ID NO: 1037332 - RNA, 19 nt, Homo sapiens
aauaugaccuucucuauca

SEQ ID NO: 1037333 - RNA, 19 nt, Homo sapiens
ggauuugccuguuuuaaua

SEQ ID NO: 1037334 - RNA, 19 nt, Homo sapiens
ggaaguagaccaggcgaua

SEQ ID NO: 1037335 - RNA, 19 nt, Homo sapiens
uaaaagagaugucagcauu

SEQ ID NO: 1037336 - RNA, 19 nt, Homo sapiens
uaauugagcagacaaguuu

SEQ ID NO: 1037337 - RNA, 19 nt, Homo sapiens
uguagguucucuucaaaua

SEQ ID NO: 1037338 - RNA, 19 nt, Homo sapiens
uuauugagcuccugcauga

SEQ ID NO: 1037339 - RNA, 19 nt, Homo sapiens
gcagaaaauuggauuacua

SEQ ID NO: 1037340 - RNA, 19 nt, Homo sapiens
aaacaucgauaugcuaaga

SEQ ID NO: 1037341 - RNA, 19 nt, Homo sapiens
uaaaauggcugcuauauac

SEQ ID NO: 1037342 - RNA, 19 nt, Homo sapiens
caaacaagacuucauagau

SEQ ID NO: 1037343 - RNA, 19 nt, Homo sapiens
cccaaucucugauguuauu

SEQ ID NO: 1037344 - RNA, 19 nt, Homo sapiens
gaccaccucuccaacagaa

SEQ ID NO: 1037345 - RNA, 19 nt, Homo sapiens
ccaccacucuauucaggua

SEQ ID NO: 1037346 - RNA, 19 nt, Homo sapiens
cugguuggcucauuuaauu

SEQ ID NO: 1037347 - RNA, 19 nt, Homo sapiens
gcaaguuacugcuccucuu

SEQ ID NO: 1037348 - RNA, 19 nt, Homo sapiens
uaauugcugucaaagauga

SEQ ID NO: 1037349 - RNA, 19 nt, Homo sapiens
cuauauaccugguggaugu

SEQ ID NO: 1037350 - RNA, 19 nt, Homo sapiens
cagcauuguuggauagaaa

SEQ ID NO: 1037351 - RNA, 19 nt, Homo sapiens
caaauaugaccuucucuau

SEQ ID NO: 1037352 - RNA, 19 nt, Homo sapiens
guaaggaauucuugcucuu

SEQ ID NO: 1037353 - RNA, 19 nt, Homo sapiens
gaaguagaccaggcgauaa

SEQ ID NO: 1037354 - RNA, 19 nt, Homo sapiens
guacauuaauugcugucaa

SEQ ID NO: 1037355 - RNA, 19 nt, Homo sapiens
gguguugguucucagguuu

SEQ ID NO: 1037356 - RNA, 19 nt, Homo sapiens
ggagaagagguuugacuug

SEQ ID NO: 1037357 - RNA, 19 nt, Homo sapiens
ucaguuauauuccaucuac

SEQ ID NO: 1037358 - RNA, 19 nt, Homo sapiens
caucaccucuggccucuuc

SEQ ID NO: 1037359 - RNA, 19 nt, Homo sapiens
aaagagaugucagcauugu

SEQ ID NO: 1037360 - RNA, 19 nt, Homo sapiens
caaugaaugagccaccuua

SEQ ID NO: 1037361 - RNA, 19 nt, Homo sapiens
ccaaauaugaccuucucua

SEQ ID NO: 1037362 - RNA, 19 nt, Homo sapiens
guucagagcagcacuguca

SEQ ID NO: 1037363 - RNA, 19 nt, Homo sapiens
uuucugcgcuugugcguuu

SEQ ID NO: 1037364 - RNA, 19 nt, Homo sapiens
auacacaagugaacuggaa

SEQ ID NO: 1037365 - RNA, 19 nt, Homo sapiens
gaccugggaugccuaacug

SEQ ID NO: 1037366 - RNA, 19 nt, Homo sapiens
gaccuucucuaucaagaca

SEQ ID NO: 1037367 - RNA, 19 nt, Homo sapiens
caaguuacugcuccucuuu

SEQ ID NO: 1037368 - RNA, 19 nt, Homo sapiens
caccaugcccagcuaauuu

SEQ ID NO: 1037369 - RNA, 19 nt, Homo sapiens
gccgguuccucgacucaua

SEQ ID NO: 1037370 - RNA, 19 nt, Homo sapiens
gcgcaaccgugggcaaguu

SEQ ID NO: 1037371 - RNA, 19 nt, Homo sapiens
auacaucccucgugcuuuc

SEQ ID NO: 1037372 - RNA, 19 nt, Homo sapiens
ggaguccuuuggaaacaug

SEQ ID NO: 1037373 - RNA, 19 nt, Homo sapiens
ucaaugggcagcauaugaa

SEQ ID NO: 1037374 - RNA, 19 nt, Homo sapiens
ugacaucaguuauauucca

SEQ ID NO: 1037375 - RNA, 19 nt, Homo sapiens
agaugaagauccugucugu

SEQ ID NO: 1037376 - RNA, 19 nt, Homo sapiens
acagaacccucccaaacau

SEQ ID NO: 1037377 - RNA, 19 nt, Homo sapiens
ggagugacagugaggauuc

SEQ ID NO: 1037378 - RNA, 19 nt, Homo sapiens
gauaugcuaagaagaacaa

SEQ ID NO: 1037379 - RNA, 19 nt, Homo sapiens
ugaaugagccaccuuagca

SEQ ID NO: 1037380 - RNA, 19 nt, Homo sapiens
uauggaaagugagaauuug

SEQ ID NO: 1037381 - RNA, 19 nt, Homo sapiens
gaagcuuauuguccaaagu

SEQ ID NO: 1037382 - RNA, 19 nt, Homo sapiens
ggaagcuuauuguccaaag

SEQ ID NO: 1037383 - RNA, 19 nt, Homo sapiens
ccaaacaagacuucauaga

SEQ ID NO: 1037384 - RNA, 19 nt, Homo sapiens
ccagaucacacuaaguuug

SEQ ID NO: 1037385 - RNA, 19 nt, Homo sapiens
gcucaaaacuaaaagagau

SEQ ID NO: 1037386 - RNA, 19 nt, Homo sapiens
gaguaaggagugacaguga

SEQ ID NO: 1037387 - RNA, 19 nt, Homo sapiens
guagguucucuucaaauaa

SEQ ID NO: 1037388 - RNA, 19 nt, Homo sapiens
ccucagagcagccaaguca

SEQ ID NO: 1037389 - RNA, 19 nt, Homo sapiens
ggauucacauuuggguuau

SEQ ID NO: 1037390 - RNA, 19 nt, Homo sapiens
guaaaauggcugcuauaua

SEQ ID NO: 1037391 - RNA, 19 nt, Homo sapiens
gcaccccauuuaauuauuu

SEQ ID NO: 1037392 - RNA, 19 nt, Homo sapiens
gcuaguacaacuugauuuc

SEQ ID NO: 1037393 - RNA, 19 nt, Homo sapiens
agcccaaucucugauguua

SEQ ID NO: 1037394 - RNA, 19 nt, Homo sapiens
gcacacacacacacacaca

SEQ ID NO: 1037395 - RNA, 19 nt, Homo sapiens
aaccaaacaagacuucaua

SEQ ID NO: 1037396 - RNA, 19 nt, Homo sapiens
gaccucuucugacuuaagu

SEQ ID NO: 1037397 - RNA, 19 nt, Homo sapiens
uagccaagauggucucgau

SEQ ID NO: 1037398 - RNA, 19 nt, Homo sapiens
caagaugagcuuccuacug

SEQ ID NO: 1037399 - RNA, 19 nt, Homo sapiens
ugacagccacaaagugaaa

SEQ ID NO: 1037400 - RNA, 19 nt, Homo sapiens
ggaaaagaccccacugguu

SEQ ID NO: 1037401 - RNA, 19 nt, Homo sapiens
agaaaugucaccuauaugg

SEQ ID NO: 1037402 - RNA, 19 nt, Homo sapiens
agagaugucagcauuguug

SEQ ID NO: 1037403 - RNA, 19 nt, Homo sapiens
ucagagcagccaagucauu

SEQ ID NO: 1037404 - RNA, 19 nt, Homo sapiens
uauauuccaucuacugucu

SEQ ID NO: 1037405 - RNA, 19 nt, Homo sapiens
gcuagaugauauucuuucu

SEQ ID NO: 1037406 - RNA, 19 nt, Homo sapiens
ggaauucuugcucuucuag

SEQ ID NO: 1037407 - RNA, 19 nt, Homo sapiens
uaaguaaaauggcugcuau

SEQ ID NO: 1037408 - RNA, 19 nt, Homo sapiens
gccaggcacugcuuguauc

SEQ ID NO: 1037409 - RNA, 19 nt, Homo sapiens
uguccugguuggcucauuu

SEQ ID NO: 1037410 - RNA, 19 nt, Homo sapiens
ccaucuccagucuguauua

SEQ ID NO: 1037411 - RNA, 19 nt, Homo sapiens
uauuccaucuacugucuuu

SEQ ID NO: 1037412 - RNA, 19 nt, Homo sapiens
uauaugggauuugccuguu

SEQ ID NO: 1037413 - RNA, 19 nt, Homo sapiens
acauuuggguuauuucaag

SEQ ID NO: 1037414 - RNA, 19 nt, Homo sapiens
gacaucaguuauauuccau

SEQ ID NO: 1037415 - RNA, 19 nt, Homo sapiens
ucuggccucuuccaucgua

SEQ ID NO: 1037416 - RNA, 19 nt, Homo sapiens
aguuacugcuccucuuuaa

SEQ ID NO: 1037417 - RNA, 19 nt, Homo sapiens
ugcccaagcugacuagcaa

SEQ ID NO: 1037418 - RNA, 19 nt, Homo sapiens
uacuaaggcucaaaacuaa

SEQ ID NO: 1037419 - RNA, 19 nt, Homo sapiens
gcgcaguuucaccguguua

SEQ ID NO: 1037420 - RNA, 19 nt, Homo sapiens
aggauucacauuuggguua

SEQ ID NO: 1037421 - RNA, 19 nt, Homo sapiens
ggacgaguaaggagugaca

SEQ ID NO: 1037422 - RNA, 19 nt, Homo sapiens
ccucuuccaucguacacuu

SEQ ID NO: 1037423 - RNA, 19 nt, Homo sapiens
ugaagaagaaggcacaucu

SEQ ID NO: 1037424 - RNA, 19 nt, Homo sapiens
gaccgacggccaggaguuu

SEQ ID NO: 1037425 - RNA, 19 nt, Homo sapiens
cuuccugucucugguuuaa

SEQ ID NO: 1037426 - RNA, 19 nt, Homo sapiens
ugucagcauuguuggauag

SEQ ID NO: 1037427 - RNA, 19 nt, Homo sapiens
ccaccaugcccagcuaauu

SEQ ID NO: 1037428 - RNA, 19 nt, Homo sapiens
cccgaggacugggacauua

SEQ ID NO: 1037429 - RNA, 19 nt, Homo sapiens
ugacaugggucgggaagca

SEQ ID NO: 1037430 - RNA, 19 nt, Homo sapiens
cagccuuccucuccugguu

SEQ ID NO: 1037431 - RNA, 19 nt, Homo sapiens
cgaggacugggacauuaaa

SEQ ID NO: 1037432 - RNA, 19 nt, Homo sapiens
acgccuggcuccuccgaaa

SEQ ID NO: 1037433 - RNA, 19 nt, Homo sapiens
ggacugggacauuaaaccu

SEQ ID NO: 1037434 - RNA, 19 nt, Homo sapiens
gaccuccccuccuccaaaa

SEQ ID NO: 1037435 - RNA, 19 nt, Homo sapiens
ccgaggacugggacauuaa

SEQ ID NO: 1037436 - RNA, 19 nt, Homo sapiens
gauuggaacugaugaagua

SEQ ID NO: 1037437 - RNA, 19 nt, Homo sapiens
ugaaauaucuugacucuuc

SEQ ID NO: 1037438 - RNA, 19 nt, Homo sapiens
ggacagauguuucaauacu

SEQ ID NO: 1037439 - RNA, 19 nt, Homo sapiens
uguaaugagucuugucuua

SEQ ID NO: 1037440 - RNA, 19 nt, Homo sapiens
ggccaugccuuggauauaa

SEQ ID NO: 1037441 - RNA, 19 nt, Homo sapiens
aaggacagauguuucaaua

SEQ ID NO: 1037442 - RNA, 19 nt, Homo sapiens
gcgaucaacuuuagacaug

SEQ ID NO: 1037443 - RNA, 19 nt, Homo sapiens
ugacucuucuccuaaauuu

SEQ ID NO: 1037444 - RNA, 19 nt, Homo sapiens
ggaacaaccucagcaaaca

SEQ ID NO: 1037445 - RNA, 19 nt, Homo sapiens
aggcacagcuccugaaauu

SEQ ID NO: 1037446 - RNA, 19 nt, Homo sapiens
gaaguugcccugaucauuc

SEQ ID NO: 1037447 - RNA, 19 nt, Homo sapiens
gcuguagaccaaacuauua

SEQ ID NO: 1037448 - RNA, 19 nt, Homo sapiens
caagacagcaacaguauga

SEQ ID NO: 1037449 - RNA, 19 nt, Homo sapiens
uaucuugacucuucuccua

SEQ ID NO: 1037450 - RNA, 19 nt, Homo sapiens
aaacaagacagcaacagua

SEQ ID NO: 1037451 - RNA, 19 nt, Homo sapiens
gacagauguuucaauacua

SEQ ID NO: 1037452 - RNA, 19 nt, Homo sapiens
ugaaauugcugugauguca

SEQ ID NO: 1037453 - RNA, 19 nt, Homo sapiens
gagcagauaccauucuaug

SEQ ID NO: 1037454 - RNA, 19 nt, Homo sapiens
uaaaugaugccucugcaaa

SEQ ID NO: 1037455 - RNA, 19 nt, Homo sapiens
uaugaugaguguugugauu

SEQ ID NO: 1037456 - RNA, 19 nt, Homo sapiens
caugaaauaucuugacucu

SEQ ID NO: 1037457 - RNA, 19 nt, Homo sapiens
aagaagcgaucaacuuuag

SEQ ID NO: 1037458 - RNA, 19 nt, Homo sapiens
cagaauaaagcuaguauca

SEQ ID NO: 1037459 - RNA, 19 nt, Homo sapiens
gcacagcuccugaaauugc

SEQ ID NO: 1037460 - RNA, 19 nt, Homo sapiens
uaaugagucuugucuuaca

SEQ ID NO: 1037461 - RNA, 19 nt, Homo sapiens
caaaaugccucaagagcaa

SEQ ID NO: 1037462 - RNA, 19 nt, Homo sapiens
cauaagaaguugcccugau

SEQ ID NO: 1037463 - RNA, 19 nt, Homo sapiens
gaaauaucuugacucuucu

SEQ ID NO: 1037464 - RNA, 19 nt, Homo sapiens
ucaauacuauccaguuuac

SEQ ID NO: 1037465 - RNA, 19 nt, Homo sapiens
ggauguaugaugaguguug

SEQ ID NO: 1037466 - RNA, 19 nt, Homo sapiens
guaguacccaugaagauau

SEQ ID NO: 1037467 - RNA, 19 nt, Homo sapiens
accauucuaugcucaauuu

SEQ ID NO: 1037468 - RNA, 19 nt, Homo sapiens
gagcaaggacagauguuuc

SEQ ID NO: 1037469 - RNA, 19 nt, Homo sapiens
gcagauaccauucuaugcu

SEQ ID NO: 1037470 - RNA, 19 nt, Homo sapiens
caaccaauguuuucacuuc

SEQ ID NO: 1037471 - RNA, 19 nt, Homo sapiens
gacagcagcaacuagcuuu

SEQ ID NO: 1037472 - RNA, 19 nt, Homo sapiens
ggacagcagcaacuagcuu

SEQ ID NO: 1037473 - RNA, 19 nt, Homo sapiens
uaguaucaguucuuuggaa

SEQ ID NO: 1037474 - RNA, 19 nt, Homo sapiens
auaagaaguugcccugauc

SEQ ID NO: 1037475 - RNA, 19 nt, Homo sapiens
uaucaguucuuuggaauac

SEQ ID NO: 1037476 - RNA, 19 nt, Homo sapiens
uaagggaaccauaagaagu

SEQ ID NO: 1037477 - RNA, 19 nt, Homo sapiens
ccuaagggaaccauaagaa

SEQ ID NO: 1037478 - RNA, 19 nt, Homo sapiens
caaacaagacagcaacagu

SEQ ID NO: 1037479 - RNA, 19 nt, Homo sapiens
gaaauugcugugaugucaa

SEQ ID NO: 1037480 - RNA, 19 nt, Homo sapiens
aagagaaggacaagacuga

SEQ ID NO: 1037481 - RNA, 19 nt, Homo sapiens
caagagcaaggacagaugu

SEQ ID NO: 1037482 - RNA, 19 nt, Homo sapiens
gagaaggacaagacugaca

SEQ ID NO: 1037483 - RNA, 19 nt, Homo sapiens
gggaacaaccucagcaaac

SEQ ID NO: 1037484 - RNA, 19 nt, Homo sapiens
cagccuaagggaaccauaa

SEQ ID NO: 1037485 - RNA, 19 nt, Homo sapiens
aaacccagcacaaccaaug

SEQ ID NO: 1037486 - RNA, 19 nt, Homo sapiens
ggauacauuccacaacuag

SEQ ID NO: 1037487 - RNA, 19 nt, Homo sapiens
gaugaguguugugauugga

SEQ ID NO: 1037488 - RNA, 19 nt, Homo sapiens
gauguaugaugaguguugu

SEQ ID NO: 1037489 - RNA, 19 nt, Homo sapiens
gccaugccuuggauauaau

SEQ ID NO: 1037490 - RNA, 19 nt, Homo sapiens
gaucaacuuuagacaugac

SEQ ID NO: 1037491 - RNA, 19 nt, Homo sapiens
gaacaaccucagcaaacag

SEQ ID NO: 1037492 - RNA, 19 nt, Homo sapiens
gacaagacugacagccuaa

SEQ ID NO: 1037493 - RNA, 19 nt, Homo sapiens
gcccucaacuucaccaaaa

SEQ ID NO: 1037494 - RNA, 19 nt, Homo sapiens
ucuugacucuucuccuaaa

SEQ ID NO: 1037495 - RNA, 19 nt, Homo sapiens
ucaguucuuuggaauacau

SEQ ID NO: 1037496 - RNA, 19 nt, Homo sapiens
guaucaguucuuuggaaua

SEQ ID NO: 1037497 - RNA, 19 nt, Homo sapiens
aagggaaccauaagaaguu

SEQ ID NO: 1037498 - RNA, 19 nt, Homo sapiens
gaagcgaucaacuuuagac

SEQ ID NO: 1037499 - RNA, 19 nt, Homo sapiens
caaggacagauguuucaau

SEQ ID NO: 1037500 - RNA, 19 nt, Homo sapiens
aggagcagauaccauucua

SEQ ID NO: 1037501 - RNA, 19 nt, Homo sapiens
guaaaugaugccucugcaa

SEQ ID NO: 1037502 - RNA, 19 nt, Homo sapiens
ccagagcucccagaagaga

SEQ ID NO: 1037503 - RNA, 19 nt, Homo sapiens
cgaucaacuuuagacauga

SEQ ID NO: 1037504 - RNA, 19 nt, Homo sapiens
guacccaugaagauaugua

SEQ ID NO: 1037505 - RNA, 19 nt, Homo sapiens
cagaagagaaggacaagac

SEQ ID NO: 1037506 - RNA, 19 nt, Homo sapiens
ccccagagcucccagaaga

SEQ ID NO: 1037507 - RNA, 19 nt, Homo sapiens
aaguugcccugaucauuca

SEQ ID NO: 1037508 - RNA, 19 nt, Homo sapiens
agaaguugcccugaucauu

SEQ ID NO: 1037509 - RNA, 19 nt, Homo sapiens
cagcaaacaguuccaaggu

SEQ ID NO: 1037510 - RNA, 19 nt, Homo sapiens
acacagaauaaagcuagua

SEQ ID NO: 1037511 - RNA, 19 nt, Homo sapiens
gcaaggacagauguuucaa

SEQ ID NO: 1037512 - RNA, 19 nt, Homo sapiens
gaugucaacaggagaagag

SEQ ID NO: 1037513 - RNA, 19 nt, Homo sapiens
cuauguauucuccuucaaa

SEQ ID NO: 1037514 - RNA, 19 nt, Homo sapiens
caaccucagcaaacaguuc

SEQ ID NO: 1037515 - RNA, 19 nt, Homo sapiens
acaugacagugcaggaguu

SEQ ID NO: 1037516 - RNA, 19 nt, Homo sapiens
gguccuacccugggaacaa

SEQ ID NO: 1037517 - RNA, 19 nt, Homo sapiens
auucuaugcucaauuugga

SEQ ID NO: 1037518 - RNA, 19 nt, Homo sapiens
ggaggacagcagcaacuag

SEQ ID NO: 1037519 - RNA, 19 nt, Homo sapiens
ugaugaguguugugauugg

SEQ ID NO: 1037520 - RNA, 19 nt, Homo sapiens
uaguacccaugaagauaug

SEQ ID NO: 1037521 - RNA, 19 nt, Homo sapiens
aguaucaguucuuuggaau

SEQ ID NO: 1037522 - RNA, 19 nt, Homo sapiens
gauguggccaugccuugga

SEQ ID NO: 1037523 - RNA, 19 nt, Homo sapiens
ucuaugcucaauuuggaua

SEQ ID NO: 1037524 - RNA, 19 nt, Homo sapiens
uuggauguaugaugagugu

SEQ ID NO: 1037525 - RNA, 19 nt, Homo sapiens
aacaagacagcaacaguau

SEQ ID NO: 1037526 - RNA, 19 nt, Homo sapiens
uaagaaguugcccugauca

SEQ ID NO: 1037527 - RNA, 19 nt, Homo sapiens
acucuucuccuaaauuugu

SEQ ID NO: 1037528 - RNA, 19 nt, Homo sapiens
uuagcuuccucaauacuag

SEQ ID NO: 1037529 - RNA, 19 nt, Homo sapiens
ggagcagauaccauucuau

SEQ ID NO: 1037530 - RNA, 19 nt, Homo sapiens
ucaacaaacaagacagcaa

SEQ ID NO: 1037531 - RNA, 19 nt, Homo sapiens
aaauugcugugaugucaac

SEQ ID NO: 1037532 - RNA, 19 nt, Homo sapiens
ucaagagcaaggacagaug

SEQ ID NO: 1037533 - RNA, 19 nt, Homo sapiens
gaggagcagauaccauucu

SEQ ID NO: 1037534 - RNA, 19 nt, Homo sapiens
cacagaauaaagcuaguau

SEQ ID NO: 1037535 - RNA, 19 nt, Homo sapiens
caacuuuagacaugacagu

SEQ ID NO: 1037536 - RNA, 19 nt, Homo sapiens
ggaaugaaagaucgaauua

SEQ ID NO: 1037537 - RNA, 19 nt, Homo sapiens
gcaagauacuggcaacauu

SEQ ID NO: 1037538 - RNA, 19 nt, Homo sapiens
gguaacaguucaauucauu

SEQ ID NO: 1037539 - RNA, 19 nt, Homo sapiens
ccaaagcucuuacgauaau

SEQ ID NO: 1037540 - RNA, 19 nt, Homo sapiens
ggacagugcugccaagauc

SEQ ID NO: 1037541 - RNA, 19 nt, Homo sapiens
gaaugugaccugagcaaua

SEQ ID NO: 1037542 - RNA, 19 nt, Homo sapiens
gaaagcagcccaaguacug

SEQ ID NO: 1037543 - RNA, 19 nt, Homo sapiens
cuacacaaaugccuuuaaa

SEQ ID NO: 1037544 - RNA, 19 nt, Homo sapiens
caagauacuggcaacauua

SEQ ID NO: 1037545 - RNA, 19 nt, Homo sapiens
gacaguaaguaaacaaaug

SEQ ID NO: 1037546 - RNA, 19 nt, Homo sapiens
ccugaaggcuugugccaua

SEQ ID NO: 1037547 - RNA, 19 nt, Homo sapiens
gaacuacacaaaugccuuu

SEQ ID NO: 1037548 - RNA, 19 nt, Homo sapiens
gcaauggcuuggaugcaaa

SEQ ID NO: 1037549 - RNA, 19 nt, Homo sapiens
ugagucagaugcagaggua

SEQ ID NO: 1037550 - RNA, 19 nt, Homo sapiens
ccagggaggugaggaauga

SEQ ID NO: 1037551 - RNA, 19 nt, Homo sapiens
gcagagaccgagaggcaua

SEQ ID NO: 1037552 - RNA, 19 nt, Homo sapiens
aggaagagauggagacuga

SEQ ID NO: 1037553 - RNA, 19 nt, Homo sapiens
gcaucaacaucgaaagcua

SEQ ID NO: 1037554 - RNA, 19 nt, Homo sapiens
ggaauccuguuucaaucuu

SEQ ID NO: 1037555 - RNA, 19 nt, Homo sapiens
ggagagggaugcauguucu

SEQ ID NO: 1037556 - RNA, 19 nt, Homo sapiens
guaaaggcaucaacaucga

SEQ ID NO: 1037557 - RNA, 19 nt, Homo sapiens
gcaaccaucagcucucuuu

SEQ ID NO: 1037558 - RNA, 19 nt, Homo sapiens
cugaagagcuccgccagua

SEQ ID NO: 1037559 - RNA, 19 nt, Homo sapiens
gaccaaagggcaucuaaau

SEQ ID NO: 1037560 - RNA, 19 nt, Homo sapiens
acucaacccucccuuugua

SEQ ID NO: 1037561 - RNA, 19 nt, Homo sapiens
acaaauaccacuaccugua

SEQ ID NO: 1037562 - RNA, 19 nt, Homo sapiens
ugucugaacuacacaaaug

SEQ ID NO: 1037563 - RNA, 19 nt, Homo sapiens
caucagcucucuuuucuuu

SEQ ID NO: 1037564 - RNA, 19 nt, Homo sapiens
cgagaggcauagagaagaa

SEQ ID NO: 1037565 - RNA, 19 nt, Homo sapiens
caaagggcaucuaaaucug

SEQ ID NO: 1037566 - RNA, 19 nt, Homo sapiens
ccaaagggcaucuaaaucu

SEQ ID NO: 1037567 - RNA, 19 nt, Homo sapiens
ggguguggcuguguucuaa

SEQ ID NO: 1037568 - RNA, 19 nt, Homo sapiens
guuucaaucuuccauggua

SEQ ID NO: 1037569 - RNA, 19 nt, Homo sapiens
guguggcuguguucuaaua

SEQ ID NO: 1037570 - RNA, 19 nt, Homo sapiens
guaccagccucuccuucuu

SEQ ID NO: 1037571 - RNA, 19 nt, Homo sapiens
gcacccauuuggacuuuca

SEQ ID NO: 1037572 - RNA, 19 nt, Homo sapiens
ggagaaaaguuacuguuca

SEQ ID NO: 1037573 - RNA, 19 nt, Homo sapiens
gguauucucauccgguaua

SEQ ID NO: 1037574 - RNA, 19 nt, Homo sapiens
ccagagagugaauaucuuu

SEQ ID NO: 1037575 - RNA, 19 nt, Homo sapiens
gauauccucucugacucua

SEQ ID NO: 1037576 - RNA, 19 nt, Homo sapiens
gaccugagcaauauggaaa

SEQ ID NO: 1037577 - RNA, 19 nt, Homo sapiens
aaugugaccugagcaauau

SEQ ID NO: 1037578 - RNA, 19 nt, Homo sapiens
ccccaaagcucuuacgaua

SEQ ID NO: 1037579 - RNA, 19 nt, Homo sapiens
gcaacauuaucaucaagca

SEQ ID NO: 1037580 - RNA, 19 nt, Homo sapiens
ggaugcauguucuauagag

SEQ ID NO: 1037581 - RNA, 19 nt, Homo sapiens
gagggaugcauguucuaua

SEQ ID NO: 1037582 - RNA, 19 nt, Homo sapiens
gcaauauggaaaucacuga

SEQ ID NO: 1037583 - RNA, 19 nt, Homo sapiens
guacuaugccagccacuug

SEQ ID NO: 1037584 - RNA, 19 nt, Homo sapiens
cagcacccauuuggacuuu

SEQ ID NO: 1037585 - RNA, 19 nt, Homo sapiens
gguacacgcucuuuaucuc

SEQ ID NO: 1037586 - RNA, 19 nt, Homo sapiens
cagagcgccuggacagcua

SEQ ID NO: 1037587 - RNA, 19 nt, Homo sapiens
augcagagguagaauguga

SEQ ID NO: 1037588 - RNA, 19 nt, Homo sapiens
gaagagauggagacugagu

SEQ ID NO: 1037589 - RNA, 19 nt, Homo sapiens
gagauacugccugguguuu

SEQ ID NO: 1037590 - RNA, 19 nt, Homo sapiens
uaacguucuugccuagaga

SEQ ID NO: 1037591 - RNA, 19 nt, Homo sapiens
guugguaacaguucaauuc

SEQ ID NO: 1037592 - RNA, 19 nt, Homo sapiens
gaagagcuccgccaguacu

SEQ ID NO: 1037593 - RNA, 19 nt, Homo sapiens
ccaaagaggaagagaugga

SEQ ID NO: 1037594 - RNA, 19 nt, Homo sapiens
gccagagagugaauaucuu

SEQ ID NO: 1037595 - RNA, 19 nt, Homo sapiens
ccaaguguguagugagaca

SEQ ID NO: 1037596 - RNA, 19 nt, Homo sapiens
gauacugccugguguuuug

SEQ ID NO: 1037597 - RNA, 19 nt, Homo sapiens
ugcaggacauguucuguug

SEQ ID NO: 1037598 - RNA, 19 nt, Homo sapiens
cuuuaucucuccuucugua

SEQ ID NO: 1037599 - RNA, 19 nt, Homo sapiens
aggccgagaugaagcguuu

SEQ ID NO: 1037600 - RNA, 19 nt, Homo sapiens
cauuuggacuuucacaauc

SEQ ID NO: 1037601 - RNA, 19 nt, Homo sapiens
ggccagagagugaauaucu

SEQ ID NO: 1037602 - RNA, 19 nt, Homo sapiens
uaaccugucugaacuacac

SEQ ID NO: 1037603 - RNA, 19 nt, Homo sapiens
cauccacguuacagcagua

SEQ ID NO: 1037604 - RNA, 19 nt, Homo sapiens
guggaauccuguuucaauc

SEQ ID NO: 1037605 - RNA, 19 nt, Homo sapiens
guggcuguguucuaauaaa

SEQ ID NO: 1037606 - RNA, 19 nt, Homo sapiens
guacacuucuuagggaaag

SEQ ID NO: 1037607 - RNA, 19 nt, Homo sapiens
gagcuccgccaguacuuug

SEQ ID NO: 1037608 - RNA, 19 nt, Homo sapiens
cugcaguucuucacauuuc

SEQ ID NO: 1037609 - RNA, 19 nt, Homo sapiens
gcaucuaaaucugcagcaa

SEQ ID NO: 1037610 - RNA, 19 nt, Homo sapiens
gaaggcuugugccauaaaa

SEQ ID NO: 1037611 - RNA, 19 nt, Homo sapiens
gaauccuguuucaaucuuc

SEQ ID NO: 1037612 - RNA, 19 nt, Homo sapiens
cuacucaacccucccuuug

SEQ ID NO: 1037613 - RNA, 19 nt, Homo sapiens
auauggaaaucacugaaga

SEQ ID NO: 1037614 - RNA, 19 nt, Homo sapiens
ggacuuucacaaucagaga

SEQ ID NO: 1037615 - RNA, 19 nt, Homo sapiens
ggaggugaggaaugaaaga

SEQ ID NO: 1037616 - RNA, 19 nt, Homo sapiens
caagcacugugaccgaaag

SEQ ID NO: 1037617 - RNA, 19 nt, Homo sapiens
guccaaagaggaagagaug

SEQ ID NO: 1037618 - RNA, 19 nt, Homo sapiens
gagaguuucagcacccauu

SEQ ID NO: 1037619 - RNA, 19 nt, Homo sapiens
gagcuccaccagcccauug

SEQ ID NO: 1037620 - RNA, 19 nt, Homo sapiens
guagacaguaaguaaacaa

SEQ ID NO: 1037621 - RNA, 19 nt, Homo sapiens
ucaguguugugacuacuca

SEQ ID NO: 1037622 - RNA, 19 nt, Homo sapiens
agggaugcauguucuauag

SEQ ID NO: 1037623 - RNA, 19 nt, Homo sapiens
accgaaagcagcccaagua

SEQ ID NO: 1037624 - RNA, 19 nt, Homo sapiens
cguggaauccuguuucaau

SEQ ID NO: 1037625 - RNA, 19 nt, Homo sapiens
gccguggaauccuguuuca

SEQ ID NO: 1037626 - RNA, 19 nt, Homo sapiens
uaaaagagugggagacauu

SEQ ID NO: 1037627 - RNA, 19 nt, Homo sapiens
ccauuuggacuuucacaau

SEQ ID NO: 1037628 - RNA, 19 nt, Homo sapiens
auagagggccagagaguga

SEQ ID NO: 1037629 - RNA, 19 nt, Homo sapiens
gagagggaugcauguucua

SEQ ID NO: 1037630 - RNA, 19 nt, Homo sapiens
caauauggaaaucacugaa

SEQ ID NO: 1037631 - RNA, 19 nt, Homo sapiens
aaauggguguggcuguguu

SEQ ID NO: 1037632 - RNA, 19 nt, Homo sapiens
guguguagugagacaaaua

SEQ ID NO: 1037633 - RNA, 19 nt, Homo sapiens
guucuugccuagagauacu

SEQ ID NO: 1037634 - RNA, 19 nt, Homo sapiens
cugaaggcuugugccauaa

SEQ ID NO: 1037635 - RNA, 19 nt, Homo sapiens
augcaaagccaucacaaug

SEQ ID NO: 1037636 - RNA, 19 nt, Homo sapiens
gaacagagcugccucaaug

SEQ ID NO: 1037637 - RNA, 19 nt, Homo sapiens
gcagaucgcuucccucauc

SEQ ID NO: 1037638 - RNA, 19 nt, Homo sapiens
gaaacacccucacgucugu

SEQ ID NO: 1037639 - RNA, 19 nt, Homo sapiens
gcucaagacuuucuaacug

SEQ ID NO: 1037640 - RNA, 19 nt, Homo sapiens
caacagcacccuaguuuca

SEQ ID NO: 1037641 - RNA, 19 nt, Homo sapiens
uccaagggcucaagacuuu

SEQ ID NO: 1037642 - RNA, 19 nt, Homo sapiens
gggcaaagccggaucuuca

SEQ ID NO: 1037643 - RNA, 19 nt, Homo sapiens
uggaggagcugcagaggaa

SEQ ID NO: 1037644 - RNA, 19 nt, Homo sapiens
ucagugaccuggagagugu

SEQ ID NO: 1037645 - RNA, 19 nt, Homo sapiens
ggcaacagcacccuaguuu

SEQ ID NO: 1037646 - RNA, 19 nt, Homo sapiens
ugaagucucuacaccauuc

SEQ ID NO: 1037647 - RNA, 19 nt, Homo sapiens
ccacagugcuggccuaugc

SEQ ID NO: 1037648 - RNA, 19 nt, Homo sapiens
gcaguaccgugacuucauc

SEQ ID NO: 1037649 - RNA, 19 nt, Homo sapiens
ggccagagauagucuucuu

SEQ ID NO: 1037650 - RNA, 19 nt, Homo sapiens
uuucauagccuuacaguau

SEQ ID NO: 1037651 - RNA, 19 nt, Homo sapiens
gugcugagcuguggaaagu

SEQ ID NO: 1037652 - RNA, 19 nt, Homo sapiens
agacugaacuccgaacaga

SEQ ID NO: 1037653 - RNA, 19 nt, Homo sapiens
gcuuuguacugagaaauaa

SEQ ID NO: 1037654 - RNA, 19 nt, Homo sapiens
guaucuggcuuuguacuga

SEQ ID NO: 1037655 - RNA, 19 nt, Homo sapiens
ccuaugccaugaagcagua

SEQ ID NO: 1037656 - RNA, 19 nt, Homo sapiens
gcugagcuguggaaagugu

SEQ ID NO: 1037657 - RNA, 19 nt, Homo sapiens
gggccacacuccagguauu

SEQ ID NO: 1037658 - RNA, 19 nt, Homo sapiens
gcaccugcaccucauggua

SEQ ID NO: 1037659 - RNA, 19 nt, Homo sapiens
ugaagaggauccacaacuc

SEQ ID NO: 1037660 - RNA, 19 nt, Homo sapiens
gagacgcaccgcuucauug

SEQ ID NO: 1037661 - RNA, 19 nt, Homo sapiens
ggagagcccugcauuuccu

SEQ ID NO: 1037662 - RNA, 19 nt, Homo sapiens
uaacugggaugugguagag

SEQ ID NO: 1037663 - RNA, 19 nt, Homo sapiens
ggagacgcaccgcuucauu

SEQ ID NO: 1037664 - RNA, 19 nt, Homo sapiens
ccaugaagcaguacgaaug

SEQ ID NO: 1037665 - RNA, 19 nt, Homo sapiens
cacccuaguuucauucuca

SEQ ID NO: 1037666 - RNA, 19 nt, Homo sapiens
gcgcuucaccuaccacaau

SEQ ID NO: 1037667 - RNA, 19 nt, Homo sapiens
gaaaguguuggaugucagu

SEQ ID NO: 1037668 - RNA, 19 nt, Homo sapiens
ggcuuuguacugagaaaua

SEQ ID NO: 1037669 - RNA, 19 nt, Homo sapiens
gccucuggcuagucaguuu

SEQ ID NO: 1037670 - RNA, 19 nt, Homo sapiens
gcaccaggccagagauagu

SEQ ID NO: 1037671 - RNA, 19 nt, Homo sapiens
acagcacccuaguuucauu

SEQ ID NO: 1037672 - RNA, 19 nt, Homo sapiens
gcaccucagagaccaguga

SEQ ID NO: 1037673 - RNA, 19 nt, Homo sapiens
cccgggagauugacaacuu

SEQ ID NO: 1037674 - RNA, 19 nt, Homo sapiens
ggucugagccaggaugaga

SEQ ID NO: 1037675 - RNA, 19 nt, Homo sapiens
uguggaaaguguuggaugu

SEQ ID NO: 1037676 - RNA, 19 nt, Homo sapiens
gggcaccaggccagagaua

SEQ ID NO: 1037677 - RNA, 19 nt, Homo sapiens
gcaacagcacccuaguuuc

SEQ ID NO: 1037678 - RNA, 19 nt, Homo sapiens
gggcaacagcacccuaguu

SEQ ID NO: 1037679 - RNA, 19 nt, Homo sapiens
gaagguuguaggcauggaa

SEQ ID NO: 1037680 - RNA, 19 nt, Homo sapiens
ccugaagucucuacaccau

SEQ ID NO: 1037681 - RNA, 19 nt, Homo sapiens
ggagauugacaacuucuac

SEQ ID NO: 1037682 - RNA, 19 nt, Homo sapiens
agacgcaccgcuucauuga

SEQ ID NO: 1037683 - RNA, 19 nt, Homo sapiens
ucacccacaucuugaacau

SEQ ID NO: 1037684 - RNA, 19 nt, Homo sapiens
gguauugcaccaagcaugu

SEQ ID NO: 1037685 - RNA, 19 nt, Homo sapiens
ccauggcccuggucacagu

SEQ ID NO: 1037686 - RNA, 19 nt, Homo sapiens
cagcgaaggcagagcuuug

SEQ ID NO: 1037687 - RNA, 19 nt, Homo sapiens
ucaaugaguggacggcuau

SEQ ID NO: 1037688 - RNA, 19 nt, Homo sapiens
gcaaagccggaucuucaag

SEQ ID NO: 1037689 - RNA, 19 nt, Homo sapiens
gguagagggacugaaggua

SEQ ID NO: 1037690 - RNA, 19 nt, Homo sapiens
acuacagccucaccuccua

SEQ ID NO: 1037691 - RNA, 19 nt, Homo sapiens
uggaaaguguuggauguca

SEQ ID NO: 1037692 - RNA, 19 nt, Homo sapiens
cagaacaggagcagaugga

SEQ ID NO: 1037693 - RNA, 19 nt, Homo sapiens
ccucagaacaggagcagau

SEQ ID NO: 1037694 - RNA, 19 nt, Homo sapiens
cagaguggaacgcagcaaa

SEQ ID NO: 1037695 - RNA, 19 nt, Homo sapiens
ggcaaagccggaucuucaa

SEQ ID NO: 1037696 - RNA, 19 nt, Homo sapiens
cuggagagcaccucagaga

SEQ ID NO: 1037697 - RNA, 19 nt, Homo sapiens
ccagguguacuuagaugga

SEQ ID NO: 1037698 - RNA, 19 nt, Homo sapiens
gacaggccagcgugcauga

SEQ ID NO: 1037699 - RNA, 19 nt, Homo sapiens
ugacaugccagaggucuuc

SEQ ID NO: 1037700 - RNA, 19 nt, Homo sapiens
gccagagauagucuucuuu

SEQ ID NO: 1037701 - RNA, 19 nt, Homo sapiens
cccggaagguggugagaca

SEQ ID NO: 1037702 - RNA, 19 nt, Homo sapiens
ggccaguucugagccaaca

SEQ ID NO: 1037703 - RNA, 19 nt, Homo sapiens
ccagagauagucuucuuuu

SEQ ID NO: 1037704 - RNA, 19 nt, Homo sapiens
ggucaugagguccaucagu

SEQ ID NO: 1037705 - RNA, 19 nt, Homo sapiens
uggccgaccuggagucucu

SEQ ID NO: 1037706 - RNA, 19 nt, Homo sapiens
ucauagccuuacaguaucu

SEQ ID NO: 1037707 - RNA, 19 nt, Homo sapiens
guccaagggcucaagacuu

SEQ ID NO: 1037708 - RNA, 19 nt, Homo sapiens
ccugaagucccgccaguca

SEQ ID NO: 1037709 - RNA, 19 nt, Homo sapiens
ugcgccagcugcagaucua

SEQ ID NO: 1037710 - RNA, 19 nt, Homo sapiens
gcugguccacugcaagaug

SEQ ID NO: 1037711 - RNA, 19 nt, Homo sapiens
cgaacagagcugccucaau

SEQ ID NO: 1037712 - RNA, 19 nt, Homo sapiens
gaacagagcugccucaaug

SEQ ID NO: 1037713 - RNA, 19 nt, Homo sapiens
ggacaaugaugaugcagua

SEQ ID NO: 1037714 - RNA, 19 nt, Homo sapiens
gcagaucgcuucccucauc

SEQ ID NO: 1037715 - RNA, 19 nt, Homo sapiens
gaaacacccucacgucugu

SEQ ID NO: 1037716 - RNA, 19 nt, Homo sapiens
gcucaagacuuucuaacug

SEQ ID NO: 1037717 - RNA, 19 nt, Homo sapiens
caacagcacccuaguuuca

SEQ ID NO: 1037718 - RNA, 19 nt, Homo sapiens
uccaagggcucaagacuuu

SEQ ID NO: 1037719 - RNA, 19 nt, Homo sapiens
gggcaaagccggaucuuca

SEQ ID NO: 1037720 - RNA, 19 nt, Homo sapiens
uggaggagcugcagaggaa

SEQ ID NO: 1037721 - RNA, 19 nt, Homo sapiens
ucagugaccuggagagugu

SEQ ID NO: 1037722 - RNA, 19 nt, Homo sapiens
ggcaacagcacccuaguuu

SEQ ID NO: 1037723 - RNA, 19 nt, Homo sapiens
ccacagugcuggccuaugc

SEQ ID NO: 1037724 - RNA, 19 nt, Homo sapiens
gcaguaccgugacuucauc

SEQ ID NO: 1037725 - RNA, 19 nt, Homo sapiens
ggccagagauagucuucuu

SEQ ID NO: 1037726 - RNA, 19 nt, Homo sapiens
uuucauagccuuacaguau

SEQ ID NO: 1037727 - RNA, 19 nt, Homo sapiens
gugcugagcuguggaaagu

SEQ ID NO: 1037728 - RNA, 19 nt, Homo sapiens
agacugaacuccgaacaga

SEQ ID NO: 1037729 - RNA, 19 nt, Homo sapiens
gcuuuguacugagaaauaa

SEQ ID NO: 1037730 - RNA, 19 nt, Homo sapiens
guaucuggcuuuguacuga

SEQ ID NO: 1037731 - RNA, 19 nt, Homo sapiens
ccuaugccaugaagcagua

SEQ ID NO: 1037732 - RNA, 19 nt, Homo sapiens
gcugagcuguggaaagugu

SEQ ID NO: 1037733 - RNA, 19 nt, Homo sapiens
gggccacacuccagguauu

SEQ ID NO: 1037734 - RNA, 19 nt, Homo sapiens
gcaccugcaccucauggua

SEQ ID NO: 1037735 - RNA, 19 nt, Homo sapiens
ugaagaggauccacaacuc

SEQ ID NO: 1037736 - RNA, 19 nt, Homo sapiens
gagacgcaccgcuucauug

SEQ ID NO: 1037737 - RNA, 19 nt, Homo sapiens
ggagagcccugcauuuccu

SEQ ID NO: 1037738 - RNA, 19 nt, Homo sapiens
uaacugggaugugguagag

SEQ ID NO: 1037739 - RNA, 19 nt, Homo sapiens
ggagacgcaccgcuucauu

SEQ ID NO: 1037740 - RNA, 19 nt, Homo sapiens
ccaugaagcaguacgaaug

SEQ ID NO: 1037741 - RNA, 19 nt, Homo sapiens
cacccuaguuucauucuca

SEQ ID NO: 1037742 - RNA, 19 nt, Homo sapiens
gcgcuucaccuaccacaau

SEQ ID NO: 1037743 - RNA, 19 nt, Homo sapiens
caaugaugaugcaguagag

SEQ ID NO: 1037744 - RNA, 19 nt, Homo sapiens
gaaaguguuggaugucagu

SEQ ID NO: 1037745 - RNA, 19 nt, Homo sapiens
ggcuuuguacugagaaaua

SEQ ID NO: 1037746 - RNA, 19 nt, Homo sapiens
gccucuggcuagucaguuu

SEQ ID NO: 1037747 - RNA, 19 nt, Homo sapiens
gcaccaggccagagauagu

SEQ ID NO: 1037748 - RNA, 19 nt, Homo sapiens
acagcacccuaguuucauu

SEQ ID NO: 1037749 - RNA, 19 nt, Homo sapiens
gcaccucagagaccaguga

SEQ ID NO: 1037750 - RNA, 19 nt, Homo sapiens
cccgggagauugacaacuu

SEQ ID NO: 1037751 - RNA, 19 nt, Homo sapiens
ggucugagccaggaugaga

SEQ ID NO: 1037752 - RNA, 19 nt, Homo sapiens
uguggaaaguguuggaugu

SEQ ID NO: 1037753 - RNA, 19 nt, Homo sapiens
gggcaccaggccagagaua

SEQ ID NO: 1037754 - RNA, 19 nt, Homo sapiens
gcaacagcacccuaguuuc

SEQ ID NO: 1037755 - RNA, 19 nt, Homo sapiens
gggcaacagcacccuaguu

SEQ ID NO: 1037756 - RNA, 19 nt, Homo sapiens
gaagguuguaggcauggaa

SEQ ID NO: 1037757 - RNA, 19 nt, Homo sapiens
ggagauugacaacuucuac

SEQ ID NO: 1037758 - RNA, 19 nt, Homo sapiens
agacgcaccgcuucauuga

SEQ ID NO: 1037759 - RNA, 19 nt, Homo sapiens
ucacccacaucuugaacau

SEQ ID NO: 1037760 - RNA, 19 nt, Homo sapiens
gguauugcaccaagcaugu

SEQ ID NO: 1037761 - RNA, 19 nt, Homo sapiens
cagcgaaggcagagcuuug

SEQ ID NO: 1037762 - RNA, 19 nt, Homo sapiens
ucaaugaguggacggcuau

SEQ ID NO: 1037763 - RNA, 19 nt, Homo sapiens
gcaaagccggaucuucaag

SEQ ID NO: 1037764 - RNA, 19 nt, Homo sapiens
gguagagggacugaaggua

SEQ ID NO: 1037765 - RNA, 19 nt, Homo sapiens
caguagaggccaguucuga

SEQ ID NO: 1037766 - RNA, 19 nt, Homo sapiens
acuacagccucaccuccua

SEQ ID NO: 1037767 - RNA, 19 nt, Homo sapiens
uggaaaguguuggauguca

SEQ ID NO: 1037768 - RNA, 19 nt, Homo sapiens
cagaacaggagcagaugga

SEQ ID NO: 1037769 - RNA, 19 nt, Homo sapiens
ccucagaacaggagcagau

SEQ ID NO: 1037770 - RNA, 19 nt, Homo sapiens
cagaguggaacgcagcaaa

SEQ ID NO: 1037771 - RNA, 19 nt, Homo sapiens
acaaugaugaugcaguaga

SEQ ID NO: 1037772 - RNA, 19 nt, Homo sapiens
ggcaaagccggaucuucaa

SEQ ID NO: 1037773 - RNA, 19 nt, Homo sapiens
cuggagagcaccucagaga

SEQ ID NO: 1037774 - RNA, 19 nt, Homo sapiens
gacaggccagcgugcauga

SEQ ID NO: 1037775 - RNA, 19 nt, Homo sapiens
ugacaugccagaggucuuc

SEQ ID NO: 1037776 - RNA, 19 nt, Homo sapiens
ccagguguacuuagaugga

SEQ ID NO: 1037777 - RNA, 19 nt, Homo sapiens
gccagagauagucuucuuu

SEQ ID NO: 1037778 - RNA, 19 nt, Homo sapiens
ggccaguucugagccaaca

SEQ ID NO: 1037779 - RNA, 19 nt, Homo sapiens
ccagagauagucuucuuuu

SEQ ID NO: 1037780 - RNA, 19 nt, Homo sapiens
ggucaugagguccaucagu

SEQ ID NO: 1037781 - RNA, 19 nt, Homo sapiens
uggccgaccuggagucucu

SEQ ID NO: 1037782 - RNA, 19 nt, Homo sapiens
ucauagccuuacaguaucu

SEQ ID NO: 1037783 - RNA, 19 nt, Homo sapiens
guccaagggcucaagacuu

SEQ ID NO: 1037784 - RNA, 19 nt, Homo sapiens
ccugaagucccgccaguca

SEQ ID NO: 1037785 - RNA, 19 nt, Homo sapiens
ugcgccagcugcagaucua

SEQ ID NO: 1037786 - RNA, 19 nt, Homo sapiens
gcugguccacugcaagaug

SEQ ID NO: 1037787 - RNA, 19 nt, Homo sapiens
cgaacagagcugccucaau

SEQ ID NO: 1037788 - RNA, 19 nt, Homo sapiens
gauguuugcuucugaguua

SEQ ID NO: 1037789 - RNA, 19 nt, Homo sapiens
gaacugagccugaugaaga

SEQ ID NO: 1037790 - RNA, 19 nt, Homo sapiens
gcaaagcugcugaguaaua

SEQ ID NO: 1037791 - RNA, 19 nt, Homo sapiens
ccuaggaaaugauauguua

SEQ ID NO: 1037792 - RNA, 19 nt, Homo sapiens
aggcaaagcugcugaguaa

SEQ ID NO: 1037793 - RNA, 19 nt, Homo sapiens
gagaggacuuccagccuua

SEQ ID NO: 1037794 - RNA, 19 nt, Homo sapiens
gagauuaauuucagagaga

SEQ ID NO: 1037795 - RNA, 19 nt, Homo sapiens
ugauugaccuaccagauua

SEQ ID NO: 1037796 - RNA, 19 nt, Homo sapiens
gagacaagauggugaagga

SEQ ID NO: 1037797 - RNA, 19 nt, Homo sapiens
caacuggccuuggaaagaa

SEQ ID NO: 1037798 - RNA, 19 nt, Homo sapiens
gagcaacaacgaagaauug

SEQ ID NO: 1037799 - RNA, 19 nt, Homo sapiens
gacaauccauguaaugaug

SEQ ID NO: 1037800 - RNA, 19 nt, Homo sapiens
guagaagccuaacagaaga

SEQ ID NO: 1037801 - RNA, 19 nt, Homo sapiens
uugaagagguuaauacuga

SEQ ID NO: 1037802 - RNA, 19 nt, Homo sapiens
ggaggagucaaauggauua

SEQ ID NO: 1037803 - RNA, 19 nt, Homo sapiens
gcuggaugcucagagauua

SEQ ID NO: 1037804 - RNA, 19 nt, Homo sapiens
gaaguucagaccuguuuaa

SEQ ID NO: 1037805 - RNA, 19 nt, Homo sapiens
gcucagagauuaauuucag

SEQ ID NO: 1037806 - RNA, 19 nt, Homo sapiens
caacaacgaagaauugaga

SEQ ID NO: 1037807 - RNA, 19 nt, Homo sapiens
gaagagcaacaacgaagaa

SEQ ID NO: 1037808 - RNA, 19 nt, Homo sapiens
ugaauuagaucccuuucug

SEQ ID NO: 1037809 - RNA, 19 nt, Homo sapiens
ggagucaaauggauuaaac

SEQ ID NO: 1037810 - RNA, 19 nt, Homo sapiens
ucaugaggcugaagacuug

SEQ ID NO: 1037811 - RNA, 19 nt, Homo sapiens
ggaaauggagcaccuguuc

SEQ ID NO: 1037812 - RNA, 19 nt, Homo sapiens
ugucacuucuacugaauua

SEQ ID NO: 1037813 - RNA, 19 nt, Homo sapiens
ggagaauaaugaacaugau

SEQ ID NO: 1037814 - RNA, 19 nt, Homo sapiens
gaugaagagucaggaaaug

SEQ ID NO: 1037815 - RNA, 19 nt, Homo sapiens
caaauggauuaaacgaaga

SEQ ID NO: 1037816 - RNA, 19 nt, Homo sapiens
uugaauaccugggaaguaa

SEQ ID NO: 1037817 - RNA, 19 nt, Homo sapiens
caaagcugcugaguaauag

SEQ ID NO: 1037818 - RNA, 19 nt, Homo sapiens
cugacaaacuuaucugaaa

SEQ ID NO: 1037819 - RNA, 19 nt, Homo sapiens
gcuacauccagaaauauua

SEQ ID NO: 1037820 - RNA, 19 nt, Homo sapiens
caagcuggaugcucagaga

SEQ ID NO: 1037821 - RNA, 19 nt, Homo sapiens
cgaagaauugagagaaaua

SEQ ID NO: 1037822 - RNA, 19 nt, Homo sapiens
gccaauacuuuaaaugaag

SEQ ID NO: 1037823 - RNA, 19 nt, Homo sapiens
ugagagaaauaaacaacug

SEQ ID NO: 1037824 - RNA, 19 nt, Homo sapiens
gaaagugagauguuugcuu

SEQ ID NO: 1037825 - RNA, 19 nt, Homo sapiens
cgacuugaucucccuauuu

SEQ ID NO: 1037826 - RNA, 19 nt, Homo sapiens
gagugaaaauccuuagaua

SEQ ID NO: 1037827 - RNA, 19 nt, Homo sapiens
uuagaucccuuucugacaa

SEQ ID NO: 1037828 - RNA, 19 nt, Homo sapiens
auaaacaacuggccuugga

SEQ ID NO: 1037829 - RNA, 19 nt, Homo sapiens
caacgaagaauugagagaa

SEQ ID NO: 1037830 - RNA, 19 nt, Homo sapiens
gcuagauaaguuuccauua

SEQ ID NO: 1037831 - RNA, 19 nt, Homo sapiens
ugacaaacuuaucugaaag

SEQ ID NO: 1037832 - RNA, 19 nt, Homo sapiens
gaauuagaucccuuucuga

SEQ ID NO: 1037833 - RNA, 19 nt, Homo sapiens
uacugaagcuagauaaguu

SEQ ID NO: 1037834 - RNA, 19 nt, Homo sapiens
gaugucacuucuacugaau

SEQ ID NO: 1037835 - RNA, 19 nt, Homo sapiens
ggacaauccauguaaugau

SEQ ID NO: 1037836 - RNA, 19 nt, Homo sapiens
ugaagaugcuaaucagaca

SEQ ID NO: 1037837 - RNA, 19 nt, Homo sapiens
gaaguugcggagaauaaug

SEQ ID NO: 1037838 - RNA, 19 nt, Homo sapiens
gaugcucagagauuaauuu

SEQ ID NO: 1037839 - RNA, 19 nt, Homo sapiens
uggagcaccuguuccugua

SEQ ID NO: 1037840 - RNA, 19 nt, Homo sapiens
gugauugaccuaccagauu

SEQ ID NO: 1037841 - RNA, 19 nt, Homo sapiens
ugaugucacuucuacugaa

SEQ ID NO: 1037842 - RNA, 19 nt, Homo sapiens
gagaauaaugaacaugaug

SEQ ID NO: 1037843 - RNA, 19 nt, Homo sapiens
gacuugaucucccuauuuu

SEQ ID NO: 1037844 - RNA, 19 nt, Homo sapiens
ggaaguucagaccuguuua

SEQ ID NO: 1037845 - RNA, 19 nt, Homo sapiens
acacacgguugaagagguu

SEQ ID NO: 1037846 - RNA, 19 nt, Homo sapiens
gugagauguuugcuucuga

SEQ ID NO: 1037847 - RNA, 19 nt, Homo sapiens
acaggagaauggcgugauu

SEQ ID NO: 1037848 - RNA, 19 nt, Homo sapiens
aaagaaauauacccaagcu

SEQ ID NO: 1037849 - RNA, 19 nt, Homo sapiens
gaagcuagauaaguuucca

SEQ ID NO: 1037850 - RNA, 19 nt, Homo sapiens
acgaagacauucuggacaa

SEQ ID NO: 1037851 - RNA, 19 nt, Homo sapiens
aacgaagaauugagagaaa

SEQ ID NO: 1037852 - RNA, 19 nt, Homo sapiens
gaguuaaguagaagccuaa

SEQ ID NO: 1037853 - RNA, 19 nt, Homo sapiens
ugaaggaacugagccugau

SEQ ID NO: 1037854 - RNA, 19 nt, Homo sapiens
gguuaauacugaugaggau

SEQ ID NO: 1037855 - RNA, 19 nt, Homo sapiens
gaagagguuaauacugaug

SEQ ID NO: 1037856 - RNA, 19 nt, Homo sapiens
uggauuaaacgaagacauu

SEQ ID NO: 1037857 - RNA, 19 nt, Homo sapiens
gggcacacacgguugaaga

SEQ ID NO: 1037858 - RNA, 19 nt, Homo sapiens
gcauguagaagaugaaacu

SEQ ID NO: 1037859 - RNA, 19 nt, Homo sapiens
ccuccaaagagaacaguua

SEQ ID NO: 1037860 - RNA, 19 nt, Homo sapiens
aaacaacuggccuuggaaa

SEQ ID NO: 1037861 - RNA, 19 nt, Homo sapiens
gaaagaaggcaggcaaagc

SEQ ID NO: 1037862 - RNA, 19 nt, Homo sapiens
ggaaagaaggcaggcaaag

SEQ ID NO: 1037863 - RNA, 19 nt, Homo sapiens
cggagaauaaugaacauga

SEQ ID NO: 1037864 - RNA, 19 nt, Homo sapiens
gaagacauucuggacaauc

SEQ ID NO: 1037865 - RNA, 19 nt, Homo sapiens
gucagacccuaggaaauga

SEQ ID NO: 1037866 - RNA, 19 nt, Homo sapiens
uagaucccuuucugacaaa

SEQ ID NO: 1037867 - RNA, 19 nt, Homo sapiens
gaagacuugaagaugcuaa

SEQ ID NO: 1037868 - RNA, 19 nt, Homo sapiens
cuuaaggcauguauuugau

SEQ ID NO: 1037869 - RNA, 19 nt, Homo sapiens
ccuuaaggcauguauuuga

SEQ ID NO: 1037870 - RNA, 19 nt, Homo sapiens
ccaaagagaacaguuaaaa

SEQ ID NO: 1037871 - RNA, 19 nt, Homo sapiens
aagcuuggcguuacuaugu

SEQ ID NO: 1037872 - RNA, 19 nt, Homo sapiens
cgaagacauucuggacaau

SEQ ID NO: 1037873 - RNA, 19 nt, Homo sapiens
gaaggaacugagccugaug

SEQ ID NO: 1037874 - RNA, 19 nt, Homo sapiens
aaacgaauucgacuugauc

SEQ ID NO: 1037875 - RNA, 19 nt, Homo sapiens
gcuuggcguuacuauguau

SEQ ID NO: 1037876 - RNA, 19 nt, Homo sapiens
ugaagagguuaauacugau

SEQ ID NO: 1037877 - RNA, 19 nt, Homo sapiens
gagcauguagaagaugaaa

SEQ ID NO: 1037878 - RNA, 19 nt, Homo sapiens
gaugaaguugcggagaaua

SEQ ID NO: 1037879 - RNA, 19 nt, Homo sapiens
uaaaugaagaggaaacacu

SEQ ID NO: 1037880 - RNA, 19 nt, Homo sapiens
ggauuaaacgaagacauuc

SEQ ID NO: 1037881 - RNA, 19 nt, Homo sapiens
aguagaagccuaacagaag

SEQ ID NO: 1037882 - RNA, 19 nt, Homo sapiens
uaaguagaagccuaacaga

SEQ ID NO: 1037883 - RNA, 19 nt, Homo sapiens
ugaagagucaggaaaugga

SEQ ID NO: 1037884 - RNA, 19 nt, Homo sapiens
gauaaguuuccauuaagag

SEQ ID NO: 1037885 - RNA, 19 nt, Homo sapiens
cagauuaugagcauguaga

SEQ ID NO: 1037886 - RNA, 19 nt, Homo sapiens
gcuagaaccacaggagaau

SEQ ID NO: 1037887 - RNA, 19 nt, Homo sapiens
gaauggcgugauugaccua

SEQ ID NO: 1037888 - RNA, 19 nt, Homo sapiens
cggguuagcugcccaguga

SEQ ID NO: 1037889 - RNA, 19 nt, Homo sapiens
gcaacacgguggccaucaa

SEQ ID NO: 1037890 - RNA, 19 nt, Homo sapiens
gaacaggccgcacacaaca

SEQ ID NO: 1037891 - RNA, 19 nt, Homo sapiens
gcgacgaguucaucuucua

SEQ ID NO: 1037892 - RNA, 19 nt, Homo sapiens
ggacacagacuccgacauc

SEQ ID NO: 1037893 - RNA, 19 nt, Homo sapiens
gugucaaggugcccauuua

SEQ ID NO: 1037894 - RNA, 19 nt, Homo sapiens
gugcaaacgucaucaucuu

SEQ ID NO: 1037895 - RNA, 19 nt, Homo sapiens
ucaaggugcccauuuauga

SEQ ID NO: 1037896 - RNA, 19 nt, Homo sapiens
caagcaagcguaccaucua

SEQ ID NO: 1037897 - RNA, 19 nt, Homo sapiens
ccaggacuguugaauacaa

SEQ ID NO: 1037898 - RNA, 19 nt, Homo sapiens
gaucaccgguguguccauu

SEQ ID NO: 1037899 - RNA, 19 nt, Homo sapiens
gaagagcacgccgcaggua

SEQ ID NO: 1037900 - RNA, 19 nt, Homo sapiens
gacccaggacuguugaaua

SEQ ID NO: 1037901 - RNA, 19 nt, Homo sapiens
ugacuucgaccucaucauu

SEQ ID NO: 1037902 - RNA, 19 nt, Homo sapiens
ucuacaaggugcugacuga

SEQ ID NO: 1037903 - RNA, 19 nt, Homo sapiens
caucgagggugucaucaag

SEQ ID NO: 1037904 - RNA, 19 nt, Homo sapiens
caacuucgaccacccagau

SEQ ID NO: 1037905 - RNA, 19 nt, Homo sapiens
gaacacggcacgcaaucca

SEQ ID NO: 1037906 - RNA, 19 nt, Homo sapiens
ggccuuugcugacaagaca

SEQ ID NO: 1037907 - RNA, 19 nt, Homo sapiens
ggacaugaagaucuuugug

SEQ ID NO: 1037908 - RNA, 19 nt, Homo sapiens
acacaacaacuucaacuuc

SEQ ID NO: 1037909 - RNA, 19 nt, Homo sapiens
caggacuguugaauacaaa

SEQ ID NO: 1037910 - RNA, 19 nt, Homo sapiens
caagcaguacaacaaguuu

SEQ ID NO: 1037911 - RNA, 19 nt, Homo sapiens
gcacacaacaacuucaacu

SEQ ID NO: 1037912 - RNA, 19 nt, Homo sapiens
ggaacaggccgcacacaac

SEQ ID NO: 1037913 - RNA, 19 nt, Homo sapiens
uggacaagcgggucaauga

SEQ ID NO: 1037914 - RNA, 19 nt, Homo sapiens
gaucaucgaggcccuggau

SEQ ID NO: 1037915 - RNA, 19 nt, Homo sapiens
ggacuguugaauacaaaga

SEQ ID NO: 1037916 - RNA, 19 nt, Homo sapiens
cgacgugccugaggacaag

SEQ ID NO: 1037917 - RNA, 19 nt, Homo sapiens
gcugcgcgcugugugcaaa

SEQ ID NO: 1037918 - RNA, 19 nt, Homo sapiens
ucaagcaguacaacaaguu

SEQ ID NO: 1037919 - RNA, 19 nt, Homo sapiens
cucaguggccuaugcauuu

SEQ ID NO: 1037920 - RNA, 19 nt, Homo sapiens
gacuucgaccucaucauuu

SEQ ID NO: 1037921 - RNA, 19 nt, Homo sapiens
acccaggacuguugaauac

SEQ ID NO: 1037922 - RNA, 19 nt, Homo sapiens
cgaccacccagaugccuuu

SEQ ID NO: 1037923 - RNA, 19 nt, Homo sapiens
gcagugacgaggaggaagu

SEQ ID NO: 1037924 - RNA, 19 nt, Homo sapiens
ucaucaagcaguacaacaa

SEQ ID NO: 1037925 - RNA, 19 nt, Homo sapiens
ucaguggccuaugcauuuc

SEQ ID NO: 1037926 - RNA, 19 nt, Homo sapiens
acaacaacuucaacuucga

SEQ ID NO: 1037927 - RNA, 19 nt, Homo sapiens
gaagaaggacuggaaaaca

SEQ ID NO: 1037928 - RNA, 19 nt, Homo sapiens
ccacccagaugccuuugac

SEQ ID NO: 1037929 - RNA, 19 nt, Homo sapiens
acacggcacgcaauccaaa

SEQ ID NO: 1037930 - RNA, 19 nt, Homo sapiens
cagaugccuuugacuucga

SEQ ID NO: 1037931 - RNA, 19 nt, Homo sapiens
ucaccgguguguccauucu

SEQ ID NO: 1037932 - RNA, 19 nt, Homo sapiens
uguuggagcuccuggacau

SEQ ID NO: 1037933 - RNA, 19 nt, Homo sapiens
ggcaugcacaccaucauca

SEQ ID NO: 1037934 - RNA, 19 nt, Homo sapiens
ucauuuccacccucaagaa

SEQ ID NO: 1037935 - RNA, 19 nt, Homo sapiens
gccggaagaaggacuggaa

SEQ ID NO: 1037936 - RNA, 19 nt, Homo sapiens
aagcaagcguaccaucuac

SEQ ID NO: 1037937 - RNA, 19 nt, Homo sapiens
cauggacuccuucuacaag

SEQ ID NO: 1037938 - RNA, 19 nt, Homo sapiens
caucaagcaguacaacaag

SEQ ID NO: 1037939 - RNA, 19 nt, Homo sapiens
ucgagggugucaucaagca

SEQ ID NO: 1037940 - RNA, 19 nt, Homo sapiens
gucaaggugcccauuuaug

SEQ ID NO: 1037941 - RNA, 19 nt, Homo sapiens
acuucgaccucaucauuuc

SEQ ID NO: 1037942 - RNA, 19 nt, Homo sapiens
ccauggacuccuucuacaa

SEQ ID NO: 1037943 - RNA, 19 nt, Homo sapiens
gaugguagcauacauauua

SEQ ID NO: 1037944 - RNA, 19 nt, Homo sapiens
gaauguaugaccaaucuua

SEQ ID NO: 1037945 - RNA, 19 nt, Homo sapiens
gcaacaagcuggguuacuu

SEQ ID NO: 1037946 - RNA, 19 nt, Homo sapiens
ggaauagccucucuucagu

SEQ ID NO: 1037947 - RNA, 19 nt, Homo sapiens
acacacaccugcaaugauu

SEQ ID NO: 1037948 - RNA, 19 nt, Homo sapiens
ggaguuaucuucauuagcu

SEQ ID NO: 1037949 - RNA, 19 nt, Homo sapiens
ucacagagaugcaaccaau

SEQ ID NO: 1037950 - RNA, 19 nt, Homo sapiens
caagagagcaccaaaggaa

SEQ ID NO: 1037951 - RNA, 19 nt, Homo sapiens
gagaguaaauugggaaugu

SEQ ID NO: 1037952 - RNA, 19 nt, Homo sapiens
ggauuggccuggaggauau

SEQ ID NO: 1037953 - RNA, 19 nt, Homo sapiens
caaagaacagguauuagaa

SEQ ID NO: 1037954 - RNA, 19 nt, Homo sapiens
ccaaagaacagguauuaga

SEQ ID NO: 1037955 - RNA, 19 nt, Homo sapiens
gaacagguauuagaaugag

SEQ ID NO: 1037956 - RNA, 19 nt, Homo sapiens
gaguugagcccuugaaaga

SEQ ID NO: 1037957 - RNA, 19 nt, Homo sapiens
agacauaaaucccuucauc

SEQ ID NO: 1037958 - RNA, 19 nt, Homo sapiens
agacugaacuauguaacua

SEQ ID NO: 1037959 - RNA, 19 nt, Homo sapiens
acacaagucucuguacuga

SEQ ID NO: 1037960 - RNA, 19 nt, Homo sapiens
gggaauguaugaccaaucu

SEQ ID NO: 1037961 - RNA, 19 nt, Homo sapiens
cuaggagucucuaaccuuu

SEQ ID NO: 1037962 - RNA, 19 nt, Homo sapiens
caaccucucuugcccuuuc

SEQ ID NO: 1037963 - RNA, 19 nt, Homo sapiens
guccaaagaacagguauua

SEQ ID NO: 1037964 - RNA, 19 nt, Homo sapiens
caacacacaccugcaauga

SEQ ID NO: 1037965 - RNA, 19 nt, Homo sapiens
guugagcccuugaaagaug

SEQ ID NO: 1037966 - RNA, 19 nt, Homo sapiens
ggacacaagucucuguacu

SEQ ID NO: 1037967 - RNA, 19 nt, Homo sapiens
caacaagcuggguuacuuu

SEQ ID NO: 1037968 - RNA, 19 nt, Homo sapiens
uaaaucccuucaucccuaa

SEQ ID NO: 1037969 - RNA, 19 nt, Homo sapiens
guaaauugggaauguauga

SEQ ID NO: 1037970 - RNA, 19 nt, Homo sapiens
gaggaguuaucuucauuag

SEQ ID NO: 1037971 - RNA, 19 nt, Homo sapiens
ggucuuguguuucuuuaca

SEQ ID NO: 1037972 - RNA, 19 nt, Homo sapiens
aagaacagguauuagaaug

SEQ ID NO: 1037973 - RNA, 19 nt, Homo sapiens
gcgggucaguuuacgcuuu

SEQ ID NO: 1037974 - RNA, 19 nt, Homo sapiens
ucucagagcaccaccagua

SEQ ID NO: 1037975 - RNA, 19 nt, Homo sapiens
acaagucucuguacugaca

SEQ ID NO: 1037976 - RNA, 19 nt, Homo sapiens
ggaaacgggucaggauugg

SEQ ID NO: 1037977 - RNA, 19 nt, Homo sapiens
ugacuggaacugagaguaa

SEQ ID NO: 1037978 - RNA, 19 nt, Homo sapiens
uauuagugaugguagcaua

SEQ ID NO: 1037979 - RNA, 19 nt, Homo sapiens
uuagcuauauccauccuuu

SEQ ID NO: 1037980 - RNA, 19 nt, Homo sapiens
guaggaagaacaaggaguu

SEQ ID NO: 1037981 - RNA, 19 nt, Homo sapiens
ggaguaggaagaacaagga

SEQ ID NO: 1037982 - RNA, 19 nt, Homo sapiens
gaaaugcagcgggucaguu

SEQ ID NO: 1037983 - RNA, 19 nt, Homo sapiens
gacuggaacugagaguaaa

SEQ ID NO: 1037984 - RNA, 19 nt, Homo sapiens
cuauauccauccuuuaauc

SEQ ID NO: 1037985 - RNA, 19 nt, Homo sapiens
ucgaggaguuaucuucauu

SEQ ID NO: 1037986 - RNA, 19 nt, Homo sapiens
agaaugaggccgaagauca

SEQ ID NO: 1037987 - RNA, 19 nt, Homo sapiens
agaguaaauugggaaugua

SEQ ID NO: 1037988 - RNA, 19 nt, Homo sapiens
uagagaagguagcuaaagg

SEQ ID NO: 1037989 - RNA, 19 nt, Homo sapiens
cgaggaguuaucuucauua

SEQ ID NO: 1037990 - RNA, 19 nt, Homo sapiens
gaugacaguggucuucuug

SEQ ID NO: 1037991 - RNA, 19 nt, Homo sapiens
gcaagagagcaccaaagga

SEQ ID NO: 1037992 - RNA, 19 nt, Homo sapiens
uagccucucuucaguguuc

SEQ ID NO: 1037993 - RNA, 19 nt, Homo sapiens
aaaugcagcgggucaguuu

SEQ ID NO: 1037994 - RNA, 19 nt, Homo sapiens
ccauucccaucacuuuauu

SEQ ID NO: 1037995 - RNA, 19 nt, Homo sapiens
ugauuacugugcaacuauu

SEQ ID NO: 1037996 - RNA, 19 nt, Homo sapiens
agacagaaaccagagguaa

SEQ ID NO: 1037997 - RNA, 19 nt, Homo sapiens
ccuauccuguuaacccuuu

SEQ ID NO: 1037998 - RNA, 19 nt, Homo sapiens
uuuccacccuauccuguua

SEQ ID NO: 1037999 - RNA, 19 nt, Homo sapiens
gaguaaauugggaauguau

SEQ ID NO: 1038000 - RNA, 19 nt, Homo sapiens
aaugauuacugugcaacua

SEQ ID NO: 1038001 - RNA, 19 nt, Homo sapiens
gagaugcaaccaauagaca

SEQ ID NO: 1038002 - RNA, 19 nt, Homo sapiens
caccugcaaugauuacugu

SEQ ID NO: 1038003 - RNA, 19 nt, Homo sapiens
ggaagaacaaggaguugag

SEQ ID NO: 1038004 - RNA, 19 nt, Homo sapiens
gaguuaucuucauuagcua

SEQ ID NO: 1038005 - RNA, 19 nt, Homo sapiens
gaaaagggaguaggaagaa

SEQ ID NO: 1038006 - RNA, 19 nt, Homo sapiens
cccuaagacugaacuaugu

SEQ ID NO: 1038007 - RNA, 19 nt, Homo sapiens
aaacaaaacuggaaaacac

SEQ ID NO: 1038008 - RNA, 19 nt, Homo sapiens
gacagaaaccagagguaau

SEQ ID NO: 1038009 - RNA, 19 nt, Homo sapiens
ucucuucaguguucacaga

SEQ ID NO: 1038010 - RNA, 19 nt, Homo sapiens
gggaggagagacauaaauc

SEQ ID NO: 1038011 - RNA, 19 nt, Homo sapiens
aauagccucucuucagugu

SEQ ID NO: 1038012 - RNA, 19 nt, Homo sapiens
gauuaaugccggaaaggau

SEQ ID NO: 1038013 - RNA, 19 nt, Homo sapiens
ugagggaggagagacauaa

SEQ ID NO: 1038014 - RNA, 19 nt, Homo sapiens
cgagguuuauagccaauag

SEQ ID NO: 1038015 - RNA, 19 nt, Homo sapiens
caagcuggguuacuuucag

SEQ ID NO: 1038016 - RNA, 19 nt, Homo sapiens
uaaauuacgacucucaaac

SEQ ID NO: 1038017 - RNA, 19 nt, Homo sapiens
uauccauccuuuaauccaa

SEQ ID NO: 1038018 - RNA, 19 nt, Homo sapiens
ggaggaugggucuucagaa

SEQ ID NO: 1038019 - RNA, 19 nt, Homo sapiens
aaagggcaauguugguaca

SEQ ID NO: 1038020 - RNA, 19 nt, Homo sapiens
ggaguugagcccuugaaag

SEQ ID NO: 1038021 - RNA, 19 nt, Homo sapiens
gagggaggagagacauaaa

SEQ ID NO: 1038022 - RNA, 19 nt, Homo sapiens
cagagguaauggccacuuc

SEQ ID NO: 1038023 - RNA, 19 nt, Homo sapiens
acagaaaccagagguaaug

SEQ ID NO: 1038024 - RNA, 19 nt, Homo sapiens
gauuacugugcaacuauuu

SEQ ID NO: 1038025 - RNA, 19 nt, Homo sapiens
ggaguuccagcacgagguu

SEQ ID NO: 1038026 - RNA, 19 nt, Homo sapiens
cuaagacugaacuauguaa

SEQ ID NO: 1038027 - RNA, 19 nt, Homo sapiens
gaugcaaccaauagacaga

SEQ ID NO: 1038028 - RNA, 19 nt, Homo sapiens
acagagaugcaaccaauag

SEQ ID NO: 1038029 - RNA, 19 nt, Homo sapiens
cgaggaggaugggucuuca

SEQ ID NO: 1038030 - RNA, 19 nt, Homo sapiens
gggcaauguugguacaaaa

SEQ ID NO: 1038031 - RNA, 19 nt, Homo sapiens
uagcacccacuagauauuu

SEQ ID NO: 1038032 - RNA, 19 nt, Homo sapiens
ccagugcgacucccaauac

SEQ ID NO: 1038033 - RNA, 19 nt, Homo sapiens
ccuguuaacccuuuagauc

SEQ ID NO: 1038034 - RNA, 19 nt, Homo sapiens
gaaugaggccgaagaucac

SEQ ID NO: 1038035 - RNA, 19 nt, Homo sapiens
agaacagguauuagaauga

SEQ ID NO: 1038036 - RNA, 19 nt, Homo sapiens
gcuauauccauccuuuaau

SEQ ID NO: 1038037 - RNA, 19 nt, Homo sapiens
gguacaaaauuccaucuca

SEQ ID NO: 1038038 - RNA, 19 nt, Homo sapiens
aagcuggguuacuuucaga

SEQ ID NO: 1038039 - RNA, 19 nt, Homo sapiens
uugcaccuaucaacaaugu

SEQ ID NO: 1038040 - RNA, 19 nt, Homo sapiens
ggcaagagagcaccaaagg

SEQ ID NO: 1038041 - RNA, 19 nt, Homo sapiens
gcaagucgggcaccaugag

SEQ ID NO: 1038042 - RNA, 19 nt, Homo sapiens
cgggucaguuuacgcuuug

SEQ ID NO: 1038043 - RNA, 19 nt, Homo sapiens
ggaacaagaugaaguauaa

SEQ ID NO: 1038044 - RNA, 19 nt, Homo sapiens
gcaaaggacuugaugaaac

SEQ ID NO: 1038045 - RNA, 19 nt, Homo sapiens
gaaacccugucucuacuaa

SEQ ID NO: 1038046 - RNA, 19 nt, Homo sapiens
caccagaggucaagaguuu

SEQ ID NO: 1038047 - RNA, 19 nt, Homo sapiens
gaaacugaguacuaagauu

SEQ ID NO: 1038048 - RNA, 19 nt, Homo sapiens
uaggacagcuaagaaauua

SEQ ID NO: 1038049 - RNA, 19 nt, Homo sapiens
guuaaaugcuuccuagaaa

SEQ ID NO: 1038050 - RNA, 19 nt, Homo sapiens
gacgagagguguucuucua

SEQ ID NO: 1038051 - RNA, 19 nt, Homo sapiens
gaccaagaguucccgauuu

SEQ ID NO: 1038052 - RNA, 19 nt, Homo sapiens
gaggauauaugccaaugga

SEQ ID NO: 1038053 - RNA, 19 nt, Homo sapiens
agucugaaguucucauuua

SEQ ID NO: 1038054 - RNA, 19 nt, Homo sapiens
ggccauguguucugaaauu

SEQ ID NO: 1038055 - RNA, 19 nt, Homo sapiens
ggaaagcauugaggacuug

SEQ ID NO: 1038056 - RNA, 19 nt, Homo sapiens
uuaaagaugugccagaguu

SEQ ID NO: 1038057 - RNA, 19 nt, Homo sapiens
caacucagauugccauuuu

SEQ ID NO: 1038058 - RNA, 19 nt, Homo sapiens
ugaugaaacugaguacuaa

SEQ ID NO: 1038059 - RNA, 19 nt, Homo sapiens
gaggaaauuugggaucauu

SEQ ID NO: 1038060 - RNA, 19 nt, Homo sapiens
caaaggacuugaugaaacu

SEQ ID NO: 1038061 - RNA, 19 nt, Homo sapiens
ugaguuggcuucauuacga

SEQ ID NO: 1038062 - RNA, 19 nt, Homo sapiens
ccuagaaaccuaaauaaga

SEQ ID NO: 1038063 - RNA, 19 nt, Homo sapiens
ggacagcuaagaaauuaau

SEQ ID NO: 1038064 - RNA, 19 nt, Homo sapiens
guacagaguaugucaggaa

SEQ ID NO: 1038065 - RNA, 19 nt, Homo sapiens
gggaaagcauugaggacuu

SEQ ID NO: 1038066 - RNA, 19 nt, Homo sapiens
gccauguguucugaaauua

SEQ ID NO: 1038067 - RNA, 19 nt, Homo sapiens
guaggacagcuaagaaauu

SEQ ID NO: 1038068 - RNA, 19 nt, Homo sapiens
uauaugaauuggcaaagga

SEQ ID NO: 1038069 - RNA, 19 nt, Homo sapiens
gacccugucuccaaaggaa

SEQ ID NO: 1038070 - RNA, 19 nt, Homo sapiens
cgagagguguucuucuaga

SEQ ID NO: 1038071 - RNA, 19 nt, Homo sapiens
caauaacccagauuuguug

SEQ ID NO: 1038072 - RNA, 19 nt, Homo sapiens
ugacucugcucauuacaau

SEQ ID NO: 1038073 - RNA, 19 nt, Homo sapiens
ucaauaacccagauuuguu

SEQ ID NO: 1038074 - RNA, 19 nt, Homo sapiens
gcacagugaagauggagaa

SEQ ID NO: 1038075 - RNA, 19 nt, Homo sapiens
gcauaagggccauguguuc

SEQ ID NO: 1038076 - RNA, 19 nt, Homo sapiens
gcacuccauucuccuuuua

SEQ ID NO: 1038077 - RNA, 19 nt, Homo sapiens
gucaugagacuauuaaaga

SEQ ID NO: 1038078 - RNA, 19 nt, Homo sapiens
uugcauggauccuugguaa

SEQ ID NO: 1038079 - RNA, 19 nt, Homo sapiens
gaaaugcugggcucacuca

SEQ ID NO: 1038080 - RNA, 19 nt, Homo sapiens
uaacccagauuuguugaug

SEQ ID NO: 1038081 - RNA, 19 nt, Homo sapiens
uaaaguaggacagcuaaga

SEQ ID NO: 1038082 - RNA, 19 nt, Homo sapiens
ggaaacuuaauucugcuaa

SEQ ID NO: 1038083 - RNA, 19 nt, Homo sapiens
ggaucauucucagcuaauu

SEQ ID NO: 1038084 - RNA, 19 nt, Homo sapiens
caaggagucugaaguucuc

SEQ ID NO: 1038085 - RNA, 19 nt, Homo sapiens
ucucuaguauguucuguga

SEQ ID NO: 1038086 - RNA, 19 nt, Homo sapiens
ggcaagaaguuuugaaaga

SEQ ID NO: 1038087 - RNA, 19 nt, Homo sapiens
uaagggccauguguucuga

SEQ ID NO: 1038088 - RNA, 19 nt, Homo sapiens
cuaacuauuuguccaagga

SEQ ID NO: 1038089 - RNA, 19 nt, Homo sapiens
gcaagaaguuuugaaagau

SEQ ID NO: 1038090 - RNA, 19 nt, Homo sapiens
guaaugucaugagacuauu

SEQ ID NO: 1038091 - RNA, 19 nt, Homo sapiens
caucuguagucccagcuaa

SEQ ID NO: 1038092 - RNA, 19 nt, Homo sapiens
ggugaaacccugucucuac

SEQ ID NO: 1038093 - RNA, 19 nt, Homo sapiens
gcauggauccuugguaauc

SEQ ID NO: 1038094 - RNA, 19 nt, Homo sapiens
uagaggaaauuugggauca

SEQ ID NO: 1038095 - RNA, 19 nt, Homo sapiens
gagauucacagugcauuga

SEQ ID NO: 1038096 - RNA, 19 nt, Homo sapiens
gagagagaaacauaacaga

SEQ ID NO: 1038097 - RNA, 19 nt, Homo sapiens
cacgugccgucucuuaauu

SEQ ID NO: 1038098 - RNA, 19 nt, Homo sapiens
ggucaauaacccagauuug

SEQ ID NO: 1038099 - RNA, 19 nt, Homo sapiens
uaagauuugguacagagua

SEQ ID NO: 1038100 - RNA, 19 nt, Homo sapiens
gauauaugccaauggaaca

SEQ ID NO: 1038101 - RNA, 19 nt, Homo sapiens
uaacagaggcagugauggu

SEQ ID NO: 1038102 - RNA, 19 nt, Homo sapiens
cgugccgucucuuaauuaa

SEQ ID NO: 1038103 - RNA, 19 nt, Homo sapiens
ggcaaaggacuugaugaaa

SEQ ID NO: 1038104 - RNA, 19 nt, Homo sapiens
uaaagaugugccagaguuu

SEQ ID NO: 1038105 - RNA, 19 nt, Homo sapiens
gcucuacauugauccuugu

SEQ ID NO: 1038106 - RNA, 19 nt, Homo sapiens
aaaguaggacagcuaagaa

SEQ ID NO: 1038107 - RNA, 19 nt, Homo sapiens
acagagaccuuuuaaucaa

SEQ ID NO: 1038108 - RNA, 19 nt, Homo sapiens
ccacagagaccuuuuaauc

SEQ ID NO: 1038109 - RNA, 19 nt, Homo sapiens
cagaggcagugaugguuuc

SEQ ID NO: 1038110 - RNA, 19 nt, Homo sapiens
cauaacagaggcagugaug

SEQ ID NO: 1038111 - RNA, 19 nt, Homo sapiens
ggaagacaacucagauugc

SEQ ID NO: 1038112 - RNA, 19 nt, Homo sapiens
gugaaacccugucucuacu

SEQ ID NO: 1038113 - RNA, 19 nt, Homo sapiens
gugacuuuaucuucauuug

SEQ ID NO: 1038114 - RNA, 19 nt, Homo sapiens
gccaauggaacaagaugaa

SEQ ID NO: 1038115 - RNA, 19 nt, Homo sapiens
gucugaaguucucauuuau

SEQ ID NO: 1038116 - RNA, 19 nt, Homo sapiens
caagaaguuuugaaagaug

SEQ ID NO: 1038117 - RNA, 19 nt, Homo sapiens
auucucagcuaauuccaaa

SEQ ID NO: 1038118 - RNA, 19 nt, Homo sapiens
ugaguacuaagauuuggua

SEQ ID NO: 1038119 - RNA, 19 nt, Homo sapiens
uggcaaaggacuugaugaa

SEQ ID NO: 1038120 - RNA, 19 nt, Homo sapiens
ugggaucauucucagcuaa

SEQ ID NO: 1038121 - RNA, 19 nt, Homo sapiens
ggaaauuugggaucauucu

SEQ ID NO: 1038122 - RNA, 19 nt, Homo sapiens
gacuguacauaccucucua

SEQ ID NO: 1038123 - RNA, 19 nt, Homo sapiens
aauggaacaagaugaagua

SEQ ID NO: 1038124 - RNA, 19 nt, Homo sapiens
uuacgagagagaaacauaa

SEQ ID NO: 1038125 - RNA, 19 nt, Homo sapiens
aagauuugguacagaguau

SEQ ID NO: 1038126 - RNA, 19 nt, Homo sapiens
ucugugacucugcucauua

SEQ ID NO: 1038127 - RNA, 19 nt, Homo sapiens
augcugggcucacucagaa

SEQ ID NO: 1038128 - RNA, 19 nt, Homo sapiens
ccuguaaucccagcacuuu

SEQ ID NO: 1038129 - RNA, 19 nt, Homo sapiens
aaaauguagugcucuauug

SEQ ID NO: 1038130 - RNA, 19 nt, Homo sapiens
gaucauucucagcuaauuc

SEQ ID NO: 1038131 - RNA, 19 nt, Homo sapiens
ugaccaagaguucccgauu

SEQ ID NO: 1038132 - RNA, 19 nt, Homo sapiens
ggagucugaaguucucauu

SEQ ID NO: 1038133 - RNA, 19 nt, Homo sapiens
aggcagugaugguuucaga

SEQ ID NO: 1038134 - RNA, 19 nt, Homo sapiens
uugaugaaacugaguacua

SEQ ID NO: 1038135 - RNA, 19 nt, Homo sapiens
cuuccuagaaaccuaaaua

SEQ ID NO: 1038136 - RNA, 19 nt, Homo sapiens
uggaacaagaugaaguaua

SEQ ID NO: 1038137 - RNA, 19 nt, Homo sapiens
cuugugcuuuggauaauga

SEQ ID NO: 1038138 - RNA, 19 nt, Homo sapiens
gucaauaacccagauuugu

SEQ ID NO: 1038139 - RNA, 19 nt, Homo sapiens
gauggagaagccucgauug

SEQ ID NO: 1038140 - RNA, 19 nt, Homo sapiens
cugaaguucucauuuaugc

SEQ ID NO: 1038141 - RNA, 19 nt, Homo sapiens
uuaaaugcuuccuagaaac

SEQ ID NO: 1038142 - RNA, 19 nt, Homo sapiens
ccagauuuguugauguuuu

SEQ ID NO: 1038143 - RNA, 19 nt, Homo sapiens
ggaaaggaguucuuaauua

SEQ ID NO: 1038144 - RNA, 19 nt, Homo sapiens
gaagaggucugcauuacua

SEQ ID NO: 1038145 - RNA, 19 nt, Homo sapiens
gaacacggccauuaaauuu

SEQ ID NO: 1038146 - RNA, 19 nt, Homo sapiens
gaaauggggugauagauua

SEQ ID NO: 1038147 - RNA, 19 nt, Homo sapiens
ccacauaacuugcgguguu

SEQ ID NO: 1038148 - RNA, 19 nt, Homo sapiens
gauguaaacuccacaaugg

SEQ ID NO: 1038149 - RNA, 19 nt, Homo sapiens
caaccuguauuguuccaua

SEQ ID NO: 1038150 - RNA, 19 nt, Homo sapiens
ccaaagcauuuaacugaaa

SEQ ID NO: 1038151 - RNA, 19 nt, Homo sapiens
gaacccagcuuagggaaau

SEQ ID NO: 1038152 - RNA, 19 nt, Homo sapiens
uuauaagggugacuuguua

SEQ ID NO: 1038153 - RNA, 19 nt, Homo sapiens
ggaagaagauaaaccacau

SEQ ID NO: 1038154 - RNA, 19 nt, Homo sapiens
uaaaccacauuauggauug

SEQ ID NO: 1038155 - RNA, 19 nt, Homo sapiens
uagaugauaucgucaaugu

SEQ ID NO: 1038156 - RNA, 19 nt, Homo sapiens
gaaacuuccugauggauac

SEQ ID NO: 1038157 - RNA, 19 nt, Homo sapiens
caucagggacagcauguua

SEQ ID NO: 1038158 - RNA, 19 nt, Homo sapiens
gcauaaaucguaaugacaa

SEQ ID NO: 1038159 - RNA, 19 nt, Homo sapiens
ccaggcaucucaaacauca

SEQ ID NO: 1038160 - RNA, 19 nt, Homo sapiens
auucaucacugguuccuua

SEQ ID NO: 1038161 - RNA, 19 nt, Homo sapiens
ccauagccauuguuucuga

SEQ ID NO: 1038162 - RNA, 19 nt, Homo sapiens
acacggccauuaaauuuga

SEQ ID NO: 1038163 - RNA, 19 nt, Homo sapiens
auacguaccucaaguagau

SEQ ID NO: 1038164 - RNA, 19 nt, Homo sapiens
caccuuggauucugugaaa

SEQ ID NO: 1038165 - RNA, 19 nt, Homo sapiens
ggaccaggaacccagcuua

SEQ ID NO: 1038166 - RNA, 19 nt, Homo sapiens
caacgugccucuaaaaguu

SEQ ID NO: 1038167 - RNA, 19 nt, Homo sapiens
gaggaaaggaguucuuaau

SEQ ID NO: 1038168 - RNA, 19 nt, Homo sapiens
gccaaagcauuuaacugaa

SEQ ID NO: 1038169 - RNA, 19 nt, Homo sapiens
gcuagucacuggaggaaag

SEQ ID NO: 1038170 - RNA, 19 nt, Homo sapiens
uagcguacauggaagaaau

SEQ ID NO: 1038171 - RNA, 19 nt, Homo sapiens
cauagccucuuucaucuuc

SEQ ID NO: 1038172 - RNA, 19 nt, Homo sapiens
cgucggagccaaagcauuu

SEQ ID NO: 1038173 - RNA, 19 nt, Homo sapiens
ggagagcgauuucuaucac

SEQ ID NO: 1038174 - RNA, 19 nt, Homo sapiens
gauuauggcaugauugaug

SEQ ID NO: 1038175 - RNA, 19 nt, Homo sapiens
caaucaagguggauguugu

SEQ ID NO: 1038176 - RNA, 19 nt, Homo sapiens
ggauguaaacuccacaaug

SEQ ID NO: 1038177 - RNA, 19 nt, Homo sapiens
ugaacacggccauuaaauu

SEQ ID NO: 1038178 - RNA, 19 nt, Homo sapiens
gcauucaguucugcuuuau

SEQ ID NO: 1038179 - RNA, 19 nt, Homo sapiens
gaagaagauaaaccacauu

SEQ ID NO: 1038180 - RNA, 19 nt, Homo sapiens
gaacgucggagccaaagca

SEQ ID NO: 1038181 - RNA, 19 nt, Homo sapiens
gcagcggauuccaggauga

SEQ ID NO: 1038182 - RNA, 19 nt, Homo sapiens
ggaggaaaggaguucuuaa

SEQ ID NO: 1038183 - RNA, 19 nt, Homo sapiens
ucaccaagcacuuagaaga

SEQ ID NO: 1038184 - RNA, 19 nt, Homo sapiens
ggauguguuacuucuauaa

SEQ ID NO: 1038185 - RNA, 19 nt, Homo sapiens
cauuauggauugagagcaa

SEQ ID NO: 1038186 - RNA, 19 nt, Homo sapiens
ugaaacuuccugauggaua

SEQ ID NO: 1038187 - RNA, 19 nt, Homo sapiens
caauuugacuucaguuuug

SEQ ID NO: 1038188 - RNA, 19 nt, Homo sapiens
gugcauaaaucguaaugac

SEQ ID NO: 1038189 - RNA, 19 nt, Homo sapiens
uuaaugugguuguggaaga

SEQ ID NO: 1038190 - RNA, 19 nt, Homo sapiens
acaaguuucuguggugauu

SEQ ID NO: 1038191 - RNA, 19 nt, Homo sapiens
uaacuugcgguguuuguug

SEQ ID NO: 1038192 - RNA, 19 nt, Homo sapiens
caucuucucucacccacau

SEQ ID NO: 1038193 - RNA, 19 nt, Homo sapiens
ggacgaugcucaggcuucu

SEQ ID NO: 1038194 - RNA, 19 nt, Homo sapiens
gugaagcccauccguugua

SEQ ID NO: 1038195 - RNA, 19 nt, Homo sapiens
gggccagcaaugauacuua

SEQ ID NO: 1038196 - RNA, 19 nt, Homo sapiens
cacauaacuugcgguguuu

SEQ ID NO: 1038197 - RNA, 19 nt, Homo sapiens
agccaaagcauuuaacuga

SEQ ID NO: 1038198 - RNA, 19 nt, Homo sapiens
cccauccguuguauucaua

SEQ ID NO: 1038199 - RNA, 19 nt, Homo sapiens
gagccaggcaucucaaaca

SEQ ID NO: 1038200 - RNA, 19 nt, Homo sapiens
gugauuauggcaugauuga

SEQ ID NO: 1038201 - RNA, 19 nt, Homo sapiens
uaaugugguuguggaagaa

SEQ ID NO: 1038202 - RNA, 19 nt, Homo sapiens
cggaagaggucugcauuac

SEQ ID NO: 1038203 - RNA, 19 nt, Homo sapiens
gcaaucaagguggauguug

SEQ ID NO: 1038204 - RNA, 19 nt, Homo sapiens
ucaaugagcagauaaaaug

SEQ ID NO: 1038205 - RNA, 19 nt, Homo sapiens
aagcaucaccaagcacuua

SEQ ID NO: 1038206 - RNA, 19 nt, Homo sapiens
aggaaaggaguucuuaauu

SEQ ID NO: 1038207 - RNA, 19 nt, Homo sapiens
gaagaaauggggugauaga

SEQ ID NO: 1038208 - RNA, 19 nt, Homo sapiens
guuagaaguugaauauucc

SEQ ID NO: 1038209 - RNA, 19 nt, Homo sapiens
gaaccagaguuuuaauugg

SEQ ID NO: 1038210 - RNA, 19 nt, Homo sapiens
ggccagcaaugauacuuac

SEQ ID NO: 1038211 - RNA, 19 nt, Homo sapiens
ggcaugauuuaaaguuaca

SEQ ID NO: 1038212 - RNA, 19 nt, Homo sapiens
ucagggacagcauguuaaa

SEQ ID NO: 1038213 - RNA, 19 nt, Homo sapiens
cagcuuagggaaauaacuu

SEQ ID NO: 1038214 - RNA, 19 nt, Homo sapiens
gcccauccguuguauucau

SEQ ID NO: 1038215 - RNA, 19 nt, Homo sapiens
gaggagaagcaggaaguga

SEQ ID NO: 1038216 - RNA, 19 nt, Homo sapiens
acaauggcaggaugucuuu

SEQ ID NO: 1038217 - RNA, 19 nt, Homo sapiens
guuacaauuugacuucagu

SEQ ID NO: 1038218 - RNA, 19 nt, Homo sapiens
caaaucuaauugagacacu

SEQ ID NO: 1038219 - RNA, 19 nt, Homo sapiens
guaccucaaguagaugaua

SEQ ID NO: 1038220 - RNA, 19 nt, Homo sapiens
ggaagaggucugcauuacu

SEQ ID NO: 1038221 - RNA, 19 nt, Homo sapiens
gccauuguuucugaagauu

SEQ ID NO: 1038222 - RNA, 19 nt, Homo sapiens
uuggauguguuacuucuau

SEQ ID NO: 1038223 - RNA, 19 nt, Homo sapiens
ggaaccagaguuuuaauug

SEQ ID NO: 1038224 - RNA, 19 nt, Homo sapiens
auuauggcaugauugauga

SEQ ID NO: 1038225 - RNA, 19 nt, Homo sapiens
uaccucaaguagaugauau

SEQ ID NO: 1038226 - RNA, 19 nt, Homo sapiens
ggagaagcaggaagugagu

SEQ ID NO: 1038227 - RNA, 19 nt, Homo sapiens
ccacagugucugaggagaa

SEQ ID NO: 1038228 - RNA, 19 nt, Homo sapiens
ggaacccagcuuagggaaa

SEQ ID NO: 1038229 - RNA, 19 nt, Homo sapiens
cugaagauuuugugccuua

SEQ ID NO: 1038230 - RNA, 19 nt, Homo sapiens
cccagugcauaaaucguaa

SEQ ID NO: 1038231 - RNA, 19 nt, Homo sapiens
ggauacguaccucaaguag

SEQ ID NO: 1038232 - RNA, 19 nt, Homo sapiens
ugugaaacuuccugaugga

SEQ ID NO: 1038233 - RNA, 19 nt, Homo sapiens
aagggugacuuguuagaag

SEQ ID NO: 1038234 - RNA, 19 nt, Homo sapiens
ccucuuucaucuucucuca

SEQ ID NO: 1038235 - RNA, 19 nt, Homo sapiens
gagccaaagcauuuaacug

SEQ ID NO: 1038236 - RNA, 19 nt, Homo sapiens
uaucgucaauguggucaug

SEQ ID NO: 1038237 - RNA, 19 nt, Homo sapiens
gauacguaccucaaguaga

SEQ ID NO: 1038238 - RNA, 19 nt, Homo sapiens
ugaagcccauccguuguau

SEQ ID NO: 1038239 - RNA, 19 nt, Homo sapiens
gguuguggaagaagauaaa

SEQ ID NO: 1038240 - RNA, 19 nt, Homo sapiens
uggauguguuacuucuaua

SEQ ID NO: 1038241 - RNA, 19 nt, Homo sapiens
auacuuaccugugguucau

SEQ ID NO: 1038242 - RNA, 19 nt, Homo sapiens
caucaccaagcacuuagaa

SEQ ID NO: 1038243 - RNA, 19 nt, Homo sapiens
gcauaaagaugacaaauga

SEQ ID NO: 1038244 - RNA, 19 nt, Homo sapiens
gagaguugcuuuauucuuu

SEQ ID NO: 1038245 - RNA, 19 nt, Homo sapiens
gaagauggaaggcuaauuu

SEQ ID NO: 1038246 - RNA, 19 nt, Homo sapiens
ggaaggauauguucgauuc

SEQ ID NO: 1038247 - RNA, 19 nt, Homo sapiens
gagcgcagaucccuguuua

SEQ ID NO: 1038248 - RNA, 19 nt, Homo sapiens
guauaagaguucuguguua

SEQ ID NO: 1038249 - RNA, 19 nt, Homo sapiens
gauggaaggcuaauuuaua

SEQ ID NO: 1038250 - RNA, 19 nt, Homo sapiens
gaaaggaccaguuugaaug

SEQ ID NO: 1038251 - RNA, 19 nt, Homo sapiens
gcagaucccuguuuauugg

SEQ ID NO: 1038252 - RNA, 19 nt, Homo sapiens
ucaggaagcuggcuaggaa

SEQ ID NO: 1038253 - RNA, 19 nt, Homo sapiens
guuagugacugauuguuaa

SEQ ID NO: 1038254 - RNA, 19 nt, Homo sapiens
gaagagaaacggcauaaag

SEQ ID NO: 1038255 - RNA, 19 nt, Homo sapiens
gaacuggugguuagcuaua

SEQ ID NO: 1038256 - RNA, 19 nt, Homo sapiens
gaaaugguaaguaguguug

SEQ ID NO: 1038257 - RNA, 19 nt, Homo sapiens
ucuaauggguuaugacaaa

SEQ ID NO: 1038258 - RNA, 19 nt, Homo sapiens
gcagauuacuuccaucagu

SEQ ID NO: 1038259 - RNA, 19 nt, Homo sapiens
gaagaaaccagugaagaga

SEQ ID NO: 1038260 - RNA, 19 nt, Homo sapiens
ccacaacagacacuuauaa

SEQ ID NO: 1038261 - RNA, 19 nt, Homo sapiens
guacaguguuucaccagaa

SEQ ID NO: 1038262 - RNA, 19 nt, Homo sapiens
gagaaucacuacaagaaaa

SEQ ID NO: 1038263 - RNA, 19 nt, Homo sapiens
uaaggugugugcugacuug

SEQ ID NO: 1038264 - RNA, 19 nt, Homo sapiens
cuaacgaguugcaacguaa

SEQ ID NO: 1038265 - RNA, 19 nt, Homo sapiens
gaagauuccagaugcuaaa

SEQ ID NO: 1038266 - RNA, 19 nt, Homo sapiens
uuacugugguugacucuaa

SEQ ID NO: 1038267 - RNA, 19 nt, Homo sapiens
agaaaccagugaagagaaa

SEQ ID NO: 1038268 - RNA, 19 nt, Homo sapiens
gcgcagaucccuguuuauu

SEQ ID NO: 1038269 - RNA, 19 nt, Homo sapiens
gaucugaggagcaaaggaa

SEQ ID NO: 1038270 - RNA, 19 nt, Homo sapiens
ucacugcucuuugcuguug

SEQ ID NO: 1038271 - RNA, 19 nt, Homo sapiens
ggaagaaaccagugaagag

SEQ ID NO: 1038272 - RNA, 19 nt, Homo sapiens
ggaaaaccacuguuauuaa

SEQ ID NO: 1038273 - RNA, 19 nt, Homo sapiens
gguaaguaguguugucuuc

SEQ ID NO: 1038274 - RNA, 19 nt, Homo sapiens
caaauuaugggagcaguuu

SEQ ID NO: 1038275 - RNA, 19 nt, Homo sapiens
ggaagucaccauugcaaau

SEQ ID NO: 1038276 - RNA, 19 nt, Homo sapiens
gaugacaaaugagccuauu

SEQ ID NO: 1038277 - RNA, 19 nt, Homo sapiens
gagaaacggcauaaagaug

SEQ ID NO: 1038278 - RNA, 19 nt, Homo sapiens
caacagacacuuauaaagc

SEQ ID NO: 1038279 - RNA, 19 nt, Homo sapiens
ugaggaagacacagucaua

SEQ ID NO: 1038280 - RNA, 19 nt, Homo sapiens
gaaggaggacugcauugug

SEQ ID NO: 1038281 - RNA, 19 nt, Homo sapiens
gagccuauuuguuaguguu

SEQ ID NO: 1038282 - RNA, 19 nt, Homo sapiens
ugaagacuauauccaucua

SEQ ID NO: 1038283 - RNA, 19 nt, Homo sapiens
ccagaaugaugugaagauu

SEQ ID NO: 1038284 - RNA, 19 nt, Homo sapiens
ucagauaguuaagcagauu

SEQ ID NO: 1038285 - RNA, 19 nt, Homo sapiens
agucagagguggcaauuca

SEQ ID NO: 1038286 - RNA, 19 nt, Homo sapiens
ggaccaagucugucaggaa

SEQ ID NO: 1038287 - RNA, 19 nt, Homo sapiens
ugggagaguugcuuuauuc

SEQ ID NO: 1038288 - RNA, 19 nt, Homo sapiens
cagagaaugauguuuguuu

SEQ ID NO: 1038289 - RNA, 19 nt, Homo sapiens
ugacaaaucagaagaugga

SEQ ID NO: 1038290 - RNA, 19 nt, Homo sapiens
gcagaaacgaguacagugu

SEQ ID NO: 1038291 - RNA, 19 nt, Homo sapiens
guaguguugucuucaguau

SEQ ID NO: 1038292 - RNA, 19 nt, Homo sapiens
gcgcaguccucagauaguu

SEQ ID NO: 1038293 - RNA, 19 nt, Homo sapiens
ggauauguucgauucuuaa

SEQ ID NO: 1038294 - RNA, 19 nt, Homo sapiens
auaaagccauuaccuacaa

SEQ ID NO: 1038295 - RNA, 19 nt, Homo sapiens
gaaugccuaccaagacuuu

SEQ ID NO: 1038296 - RNA, 19 nt, Homo sapiens
uaaauacgccaucugacaa

SEQ ID NO: 1038297 - RNA, 19 nt, Homo sapiens
aaacacccguggagucaga

SEQ ID NO: 1038298 - RNA, 19 nt, Homo sapiens
agaaacggcauaaagauga

SEQ ID NO: 1038299 - RNA, 19 nt, Homo sapiens
cugcuucacuuuauuacaa

SEQ ID NO: 1038300 - RNA, 19 nt, Homo sapiens
augcuuaagucaacuguuu

SEQ ID NO: 1038301 - RNA, 19 nt, Homo sapiens
gcaguccucagauaguuaa

SEQ ID NO: 1038302 - RNA, 19 nt, Homo sapiens
gaauucauaucacucuaac

SEQ ID NO: 1038303 - RNA, 19 nt, Homo sapiens
caaaugggagaguugcuuu

SEQ ID NO: 1038304 - RNA, 19 nt, Homo sapiens
aggauauguucgauucuua

SEQ ID NO: 1038305 - RNA, 19 nt, Homo sapiens
ggaagacacagucauaggu

SEQ ID NO: 1038306 - RNA, 19 nt, Homo sapiens
guaucuaccauucguguuu

SEQ ID NO: 1038307 - RNA, 19 nt, Homo sapiens
ggugugugcugacuugauc

SEQ ID NO: 1038308 - RNA, 19 nt, Homo sapiens
ucuaacgaguugcaacgua

SEQ ID NO: 1038309 - RNA, 19 nt, Homo sapiens
gaagacuauauccaucuaa

SEQ ID NO: 1038310 - RNA, 19 nt, Homo sapiens
gcuaugucauucgauugua

SEQ ID NO: 1038311 - RNA, 19 nt, Homo sapiens
uuacauuucugccauacau

SEQ ID NO: 1038312 - RNA, 19 nt, Homo sapiens
cgaauucauaucacucuaa

SEQ ID NO: 1038313 - RNA, 19 nt, Homo sapiens
ggaaggcuaauuuauacug

SEQ ID NO: 1038314 - RNA, 19 nt, Homo sapiens
ugaaaggaccaguuugaau

SEQ ID NO: 1038315 - RNA, 19 nt, Homo sapiens
ggaaggaggacugcauugu

SEQ ID NO: 1038316 - RNA, 19 nt, Homo sapiens
uaagaguucuguguuacug

SEQ ID NO: 1038317 - RNA, 19 nt, Homo sapiens
gcauuccguuagugacuga

SEQ ID NO: 1038318 - RNA, 19 nt, Homo sapiens
aaggaggacugcauugugu

SEQ ID NO: 1038319 - RNA, 19 nt, Homo sapiens
ggaaaugguaaguaguguu

SEQ ID NO: 1038320 - RNA, 19 nt, Homo sapiens
acaagcgacucauugacuu

SEQ ID NO: 1038321 - RNA, 19 nt, Homo sapiens
ucagugaaaggaccaguuu

SEQ ID NO: 1038322 - RNA, 19 nt, Homo sapiens
aagagaaacggcauaaaga

SEQ ID NO: 1038323 - RNA, 19 nt, Homo sapiens
gugcugcuucacuuuauua

SEQ ID NO: 1038324 - RNA, 19 nt, Homo sapiens
uuaagcagauuacuuccau

SEQ ID NO: 1038325 - RNA, 19 nt, Homo sapiens
ugggaucguuuccagauga

SEQ ID NO: 1038326 - RNA, 19 nt, Homo sapiens
cacaacagacacuuauaaa

SEQ ID NO: 1038327 - RNA, 19 nt, Homo sapiens
gcuaauuuauacuggcaau

SEQ ID NO: 1038328 - RNA, 19 nt, Homo sapiens
ggagaguugcuuuauucuu

SEQ ID NO: 1038329 - RNA, 19 nt, Homo sapiens
gaaacggcauaaagaugac

SEQ ID NO: 1038330 - RNA, 19 nt, Homo sapiens
gaugugaagauuccagaug

SEQ ID NO: 1038331 - RNA, 19 nt, Homo sapiens
aagauggaaggcuaauuua

SEQ ID NO: 1038332 - RNA, 19 nt, Homo sapiens
gccaggaguugagauggaa

SEQ ID NO: 1038333 - RNA, 19 nt, Homo sapiens
cuaccaagacuuugagaau

SEQ ID NO: 1038334 - RNA, 19 nt, Homo sapiens
ggcauaaagaugacaaaug

SEQ ID NO: 1038335 - RNA, 19 nt, Homo sapiens
gagcaguguuuggugugaa

SEQ ID NO: 1038336 - RNA, 19 nt, Homo sapiens
gauuccagaugcuaaacau

SEQ ID NO: 1038337 - RNA, 19 nt, Homo sapiens
gcuauacgggaaaugguaa

SEQ ID NO: 1038338 - RNA, 19 nt, Homo sapiens
gauaaggugugugcugacu

SEQ ID NO: 1038339 - RNA, 19 nt, Homo sapiens
cguuagugacugauuguua

SEQ ID NO: 1038340 - RNA, 19 nt, Homo sapiens
gaucguuuccagaugagaa

SEQ ID NO: 1038341 - RNA, 19 nt, Homo sapiens
accaagacuuugagaauca

SEQ ID NO: 1038342 - RNA, 19 nt, Homo sapiens
uguuuggugugaaauguuu

SEQ ID NO: 1038343 - RNA, 19 nt, Homo sapiens
caacaggccugaauuuuaa

SEQ ID NO: 1038344 - RNA, 19 nt, Homo sapiens
ggacuaguauuaaacuugu

SEQ ID NO: 1038345 - RNA, 19 nt, Homo sapiens
gcaguuugcuaaugaugaa

SEQ ID NO: 1038346 - RNA, 19 nt, Homo sapiens
cauauaaucuguugaagag

SEQ ID NO: 1038347 - RNA, 19 nt, Homo sapiens
gaacagagaaccgugaaga

SEQ ID NO: 1038348 - RNA, 19 nt, Homo sapiens
ucaauuaguugguccuuau

SEQ ID NO: 1038349 - RNA, 19 nt, Homo sapiens
caagagaauuugcaagaca

SEQ ID NO: 1038350 - RNA, 19 nt, Homo sapiens
gaaacagagagauaagaaa

SEQ ID NO: 1038351 - RNA, 19 nt, Homo sapiens
gaagaggaaucuguuugca

SEQ ID NO: 1038352 - RNA, 19 nt, Homo sapiens
gcauauaaucuguugaaga

SEQ ID NO: 1038353 - RNA, 19 nt, Homo sapiens
acagagagauaagaaaguu

SEQ ID NO: 1038354 - RNA, 19 nt, Homo sapiens
aagcugaugucuccaguga

SEQ ID NO: 1038355 - RNA, 19 nt, Homo sapiens
ugaagaacuugauccugaa

SEQ ID NO: 1038356 - RNA, 19 nt, Homo sapiens
uaaauucugugaagcugau

SEQ ID NO: 1038357 - RNA, 19 nt, Homo sapiens
cagagaaccgugaagauga

SEQ ID NO: 1038358 - RNA, 19 nt, Homo sapiens
ccaaauggagauaauguau

SEQ ID NO: 1038359 - RNA, 19 nt, Homo sapiens
aaacaacugaugugaagaa

SEQ ID NO: 1038360 - RNA, 19 nt, Homo sapiens
agaagcagccagagaauug

SEQ ID NO: 1038361 - RNA, 19 nt, Homo sapiens
cugaugaauuuccuguaua

SEQ ID NO: 1038362 - RNA, 19 nt, Homo sapiens
ccugaugaauuuccuguau

SEQ ID NO: 1038363 - RNA, 19 nt, Homo sapiens
agagaaccgugaagaugaa

SEQ ID NO: 1038364 - RNA, 19 nt, Homo sapiens
caacugaugugaagaaaag

SEQ ID NO: 1038365 - RNA, 19 nt, Homo sapiens
gaagaacuugauccugaaa

SEQ ID NO: 1038366 - RNA, 19 nt, Homo sapiens
ugaaacagagagauaagaa

SEQ ID NO: 1038367 - RNA, 19 nt, Homo sapiens
guauaauuguuccaaaugg

SEQ ID NO: 1038368 - RNA, 19 nt, Homo sapiens
aaagccaucugauucacuu

SEQ ID NO: 1038369 - RNA, 19 nt, Homo sapiens
ugcuauggcucacauuauu

SEQ ID NO: 1038370 - RNA, 19 nt, Homo sapiens
uucaggaaaugaugacuuu

SEQ ID NO: 1038371 - RNA, 19 nt, Homo sapiens
guacucgcuugaacagaga

SEQ ID NO: 1038372 - RNA, 19 nt, Homo sapiens
uaagcuuucuuuaccugaa

SEQ ID NO: 1038373 - RNA, 19 nt, Homo sapiens
gaauuuccuguauauguug

SEQ ID NO: 1038374 - RNA, 19 nt, Homo sapiens
gaguuccagaccauuauua

SEQ ID NO: 1038375 - RNA, 19 nt, Homo sapiens
gcuauggcucacauuauuu

SEQ ID NO: 1038376 - RNA, 19 nt, Homo sapiens
gagaauuugcaagacaaua

SEQ ID NO: 1038377 - RNA, 19 nt, Homo sapiens
aaacagaugcugaccucaa

SEQ ID NO: 1038378 - RNA, 19 nt, Homo sapiens
aaacagagagauaagaaag

SEQ ID NO: 1038379 - RNA, 19 nt, Homo sapiens
aagaugaaacagagagaua

SEQ ID NO: 1038380 - RNA, 19 nt, Homo sapiens
gaaccgugaagaugaaaca

SEQ ID NO: 1038381 - RNA, 19 nt, Homo sapiens
ucaacaggccugaauuuua

SEQ ID NO: 1038382 - RNA, 19 nt, Homo sapiens
aaucaacaggccugaauuu

SEQ ID NO: 1038383 - RNA, 19 nt, Homo sapiens
gcugaccucaagagaauuu

SEQ ID NO: 1038384 - RNA, 19 nt, Homo sapiens
cugaagauuucuaucacuu

SEQ ID NO: 1038385 - RNA, 19 nt, Homo sapiens
aagagaauuugcaagacaa

SEQ ID NO: 1038386 - RNA, 19 nt, Homo sapiens
uuaguugguccuuaugaua

SEQ ID NO: 1038387 - RNA, 19 nt, Homo sapiens
gaugcugaccucaagagaa

SEQ ID NO: 1038388 - RNA, 19 nt, Homo sapiens
aggcuugguuguuccagua

SEQ ID NO: 1038389 - RNA, 19 nt, Homo sapiens
cacagaagcagccagagaa

SEQ ID NO: 1038390 - RNA, 19 nt, Homo sapiens
ucacagaagcagccagaga

SEQ ID NO: 1038391 - RNA, 19 nt, Homo sapiens
caaaggacuaguauuaaac

SEQ ID NO: 1038392 - RNA, 19 nt, Homo sapiens
gcuuuuaccucuugcauau

SEQ ID NO: 1038393 - RNA, 19 nt, Homo sapiens
ggugcaggcuugguuguuc

SEQ ID NO: 1038394 - RNA, 19 nt, Homo sapiens
augcugaccucaagagaau

SEQ ID NO: 1038395 - RNA, 19 nt, Homo sapiens
uugcugcagucaaauuauu

SEQ ID NO: 1038396 - RNA, 19 nt, Homo sapiens
uaugauauccuugcuggaa

SEQ ID NO: 1038397 - RNA, 19 nt, Homo sapiens
gaagaugaaacagagagau

SEQ ID NO: 1038398 - RNA, 19 nt, Homo sapiens
ccuuggacuucaauuaguu

SEQ ID NO: 1038399 - RNA, 19 nt, Homo sapiens
gcaugaguaagguggcuuu

SEQ ID NO: 1038400 - RNA, 19 nt, Homo sapiens
ccagugaccuucgaaaaga

SEQ ID NO: 1038401 - RNA, 19 nt, Homo sapiens
ccugaguuccagaccauua

SEQ ID NO: 1038402 - RNA, 19 nt, Homo sapiens
ccucuugcauauaaucugu

SEQ ID NO: 1038403 - RNA, 19 nt, Homo sapiens
gaauuugcaagacaauagu

SEQ ID NO: 1038404 - RNA, 19 nt, Homo sapiens
acagagaaccgugaagaug

SEQ ID NO: 1038405 - RNA, 19 nt, Homo sapiens
gcuaaugaugaaugugauu

SEQ ID NO: 1038406 - RNA, 19 nt, Homo sapiens
guaccgagagcucccugaa

SEQ ID NO: 1038407 - RNA, 19 nt, Homo sapiens
ugguauaaaugaagcaaag

SEQ ID NO: 1038408 - RNA, 19 nt, Homo sapiens
acuaugauccuccugaguu

SEQ ID NO: 1038409 - RNA, 19 nt, Homo sapiens
uaguugaggcugcaaguga

SEQ ID NO: 1038410 - RNA, 19 nt, Homo sapiens
gagagcucccugaaacaga

SEQ ID NO: 1038411 - RNA, 19 nt, Homo sapiens
gaugaaacagagagauaag

SEQ ID NO: 1038412 - RNA, 19 nt, Homo sapiens
aagccuuggacuucaauua

SEQ ID NO: 1038413 - RNA, 19 nt, Homo sapiens
gccuuggacuucaauuagu

SEQ ID NO: 1038414 - RNA, 19 nt, Homo sapiens
agaugaaacagagagauaa

SEQ ID NO: 1038415 - RNA, 19 nt, Homo sapiens
cagaagcagccagagaauu

SEQ ID NO: 1038416 - RNA, 19 nt, Homo sapiens
agagcucccugaaacagau

SEQ ID NO: 1038417 - RNA, 19 nt, Homo sapiens
cuaugauccuccugaguuc

SEQ ID NO: 1038418 - RNA, 19 nt, Homo sapiens
uaguugguccuuaugauau

SEQ ID NO: 1038419 - RNA, 19 nt, Homo sapiens
agaauuugcaagacaauag

SEQ ID NO: 1038420 - RNA, 19 nt, Homo sapiens
uaccugaagauuucuauca

SEQ ID NO: 1038421 - RNA, 19 nt, Homo sapiens
guugaagaggaaucuguuu

SEQ ID NO: 1038422 - RNA, 19 nt, Homo sapiens
ucaagagaauuugcaagac

SEQ ID NO: 1038423 - RNA, 19 nt, Homo sapiens
agagagauaagaaaguugu

SEQ ID NO: 1038424 - RNA, 19 nt, Homo sapiens
gaccauuauuaucggagau

SEQ ID NO: 1038425 - RNA, 19 nt, Homo sapiens
cucaagagaauuugcaaga

SEQ ID NO: 1038426 - RNA, 19 nt, Homo sapiens
ucuggaaguucugugaaga

SEQ ID NO: 1038427 - RNA, 19 nt, Homo sapiens
uugugcaguuugcuaauga

SEQ ID NO: 1038428 - RNA, 19 nt, Homo sapiens
accgagagcucccugaaac

SEQ ID NO: 1038429 - RNA, 19 nt, Homo sapiens
aacagaugcugaccucaag

SEQ ID NO: 1038430 - RNA, 19 nt, Homo sapiens
gccaucugauucacuuucu

SEQ ID NO: 1038431 - RNA, 19 nt, Homo sapiens
auaaucuguugaagaggaa

SEQ ID NO: 1038432 - RNA, 19 nt, Homo sapiens
aacaacugaugugaagaaa

SEQ ID NO: 1038433 - RNA, 19 nt, Homo sapiens
augauauccuugcuggaaa

SEQ ID NO: 1038434 - RNA, 19 nt, Homo sapiens
agacgaaccugcuuugaaa

SEQ ID NO: 1038435 - RNA, 19 nt, Homo sapiens
uaaagucauuccuguauuc

SEQ ID NO: 1038436 - RNA, 19 nt, Homo sapiens
guugaacucuuucguguug

SEQ ID NO: 1038437 - RNA, 19 nt, Homo sapiens
ggauagcauugaagccaaa

SEQ ID NO: 1038438 - RNA, 19 nt, Homo sapiens
gcucuuaaacacuguaauu

SEQ ID NO: 1038439 - RNA, 19 nt, Homo sapiens
ggagaaucauguagugaca

SEQ ID NO: 1038440 - RNA, 19 nt, Homo sapiens
gggaacagcauccuaugaa

SEQ ID NO: 1038441 - RNA, 19 nt, Homo sapiens
ugaggcagguguuugcaaa

SEQ ID NO: 1038442 - RNA, 19 nt, Homo sapiens
cgacaaacaccacgagaau

SEQ ID NO: 1038443 - RNA, 19 nt, Homo sapiens
ggguauugcugaccuacuu

SEQ ID NO: 1038444 - RNA, 19 nt, Homo sapiens
ucacagaauccgacuggua

SEQ ID NO: 1038445 - RNA, 19 nt, Homo sapiens
gcagcgacauccagguuca

SEQ ID NO: 1038446 - RNA, 19 nt, Homo sapiens
ggauccaucuauaaaguca

SEQ ID NO: 1038447 - RNA, 19 nt, Homo sapiens
gggaaaugcucuuaaacac

SEQ ID NO: 1038448 - RNA, 19 nt, Homo sapiens
caggauccaucuauaaagu

SEQ ID NO: 1038449 - RNA, 19 nt, Homo sapiens
gaagaggacuaccccaaug

SEQ ID NO: 1038450 - RNA, 19 nt, Homo sapiens
agaaaucaauugccaggau

SEQ ID NO: 1038451 - RNA, 19 nt, Homo sapiens
ggagaccccuuucguuuga

SEQ ID NO: 1038452 - RNA, 19 nt, Homo sapiens
gaaacgccagcgacuagaa

SEQ ID NO: 1038453 - RNA, 19 nt, Homo sapiens
ggaacagcauccuaugaac

SEQ ID NO: 1038454 - RNA, 19 nt, Homo sapiens
gcgguuggauagcauugaa

SEQ ID NO: 1038455 - RNA, 19 nt, Homo sapiens
gccaggauccaucuauaaa

SEQ ID NO: 1038456 - RNA, 19 nt, Homo sapiens
gaacagcauccuaugaacu

SEQ ID NO: 1038457 - RNA, 19 nt, Homo sapiens
acaaacaccacgagaauuc

SEQ ID NO: 1038458 - RNA, 19 nt, Homo sapiens
gaagacgaaccugcuuuga

SEQ ID NO: 1038459 - RNA, 19 nt, Homo sapiens
gggaaaucaagaacuauga

SEQ ID NO: 1038460 - RNA, 19 nt, Homo sapiens
cgcgggaaaucaagaacua

SEQ ID NO: 1038461 - RNA, 19 nt, Homo sapiens
ccuggaggcuacuuguaaa

SEQ ID NO: 1038462 - RNA, 19 nt, Homo sapiens
agaaucauguagugacaga

SEQ ID NO: 1038463 - RNA, 19 nt, Homo sapiens
ggaaaugcucuuaaacacu

SEQ ID NO: 1038464 - RNA, 19 nt, Homo sapiens
agugacagaugaagacgaa

SEQ ID NO: 1038465 - RNA, 19 nt, Homo sapiens
cgaccuggccgaugugguu

SEQ ID NO: 1038466 - RNA, 19 nt, Homo sapiens
cuauaaauuuggcaucaca

SEQ ID NO: 1038467 - RNA, 19 nt, Homo sapiens
gacaaacaccacgagaauu

SEQ ID NO: 1038468 - RNA, 19 nt, Homo sapiens
cgcuaacgcugcuggacua

SEQ ID NO: 1038469 - RNA, 19 nt, Homo sapiens
uaaauuuggcaucacagaa

SEQ ID NO: 1038470 - RNA, 19 nt, Homo sapiens
uagcauugaagccaaauug

SEQ ID NO: 1038471 - RNA, 19 nt, Homo sapiens
caggagcccuuugcugugu

SEQ ID NO: 1038472 - RNA, 19 nt, Homo sapiens
ggaggcuacuuguaaaucc

SEQ ID NO: 1038473 - RNA, 19 nt, Homo sapiens
gcggagagcgucgcauaug

SEQ ID NO: 1038474 - RNA, 19 nt, Homo sapiens
gggcagcgacauccagguu

SEQ ID NO: 1038475 - RNA, 19 nt, Homo sapiens
gcauugaagccaaauugca

SEQ ID NO: 1038476 - RNA, 19 nt, Homo sapiens
uugccaggauccaucuaua

SEQ ID NO: 1038477 - RNA, 19 nt, Homo sapiens
gcacguguucugcugaagu

SEQ ID NO: 1038478 - RNA, 19 nt, Homo sapiens
aaauuuggcaucacagaau

SEQ ID NO: 1038479 - RNA, 19 nt, Homo sapiens
gcaagcacgggaagaagca

SEQ ID NO: 1038480 - RNA, 19 nt, Homo sapiens
ugaagacgaaccugcuuug

SEQ ID NO: 1038481 - RNA, 19 nt, Homo sapiens
gggcaacccagacgugcaa

SEQ ID NO: 1038482 - RNA, 19 nt, Homo sapiens
cauugaagccaaauugcaa

SEQ ID NO: 1038483 - RNA, 19 nt, Homo sapiens
cuauaaagucauuccugua

SEQ ID NO: 1038484 - RNA, 19 nt, Homo sapiens
aaacgccagcgacuagaaa

SEQ ID NO: 1038485 - RNA, 19 nt, Homo sapiens
ugugugcucuguccagugu

SEQ ID NO: 1038486 - RNA, 19 nt, Homo sapiens
ugugugcucuguccagugu

SEQ ID NO: 1038487 - RNA, 19 nt, Homo sapiens
uggacccgcucaccaucua

SEQ ID NO: 1038488 - RNA, 19 nt, Homo sapiens
aagacgaaccugcuuugaa

SEQ ID NO: 1038489 - RNA, 19 nt, Homo sapiens
gaugaagacgaaccugcuu

SEQ ID NO: 1038490 - RNA, 19 nt, Homo sapiens
ggacgccauuaucgcaucu

SEQ ID NO: 1038491 - RNA, 19 nt, Homo sapiens
gaggacggacgccauuauc

SEQ ID NO: 1038492 - RNA, 19 nt, Homo sapiens
gacggacaggugcaaguaa

SEQ ID NO: 1038493 - RNA, 19 nt, Homo sapiens
ccgagaagauggcgcuaac

SEQ ID NO: 1038494 - RNA, 19 nt, Homo sapiens
caacccagacgugcaacaa

SEQ ID NO: 1038495 - RNA, 19 nt, Homo sapiens
gccagcgacuagaaaucaa

SEQ ID NO: 1038496 - RNA, 19 nt, Homo sapiens
gcgaggacggacgccauua

SEQ ID NO: 1038497 - RNA, 19 nt, Homo sapiens
agacggacaggugcaagua

SEQ ID NO: 1038498 - RNA, 19 nt, Homo sapiens
cuucagagccgaugaugag

SEQ ID NO: 1038499 - RNA, 19 nt, Homo sapiens
gaaucaagcagagcaucga

SEQ ID NO: 1038500 - RNA, 19 nt, Homo sapiens
uaacgcugcuggacuaccu

SEQ ID NO: 1038501 - RNA, 19 nt, Homo sapiens
ggcuacuuguaaauccuua

SEQ ID NO: 1038502 - RNA, 19 nt, Homo sapiens
aacacgaccuggccgaugu

SEQ ID NO: 1038503 - RNA, 19 nt, Homo sapiens
cgaggacggacgccauuau

SEQ ID NO: 1038504 - RNA, 19 nt, Homo sapiens
cacguguucugcugaagug

SEQ ID NO: 1038505 - RNA, 19 nt, Homo sapiens
cgacauccagguucaguac

SEQ ID NO: 1038506 - RNA, 19 nt, Homo sapiens
cgacugguaccgaaucaag

SEQ ID NO: 1038507 - RNA, 19 nt, Homo sapiens
ugccaggauccaucuauaa

SEQ ID NO: 1038508 - RNA, 19 nt, Homo sapiens
uaggggaaaugcucuuaaa

SEQ ID NO: 1038509 - RNA, 19 nt, Homo sapiens
gguauugcugaccuacuuu

SEQ ID NO: 1038510 - RNA, 19 nt, Homo sapiens
cgggagcccuuugcugugu

SEQ ID NO: 1038511 - RNA, 19 nt, Homo sapiens
ggaguagcaggagcccuuu

SEQ ID NO: 1038512 - RNA, 19 nt, Homo sapiens
acggacaggugcaaguaau

SEQ ID NO: 1038513 - RNA, 19 nt, Homo sapiens
gaacucggaagaggacuac

SEQ ID NO: 1038514 - RNA, 19 nt, Homo sapiens
gcgacauccagguucagua

SEQ ID NO: 1038515 - RNA, 19 nt, Homo sapiens
cauccuaugaacugaaaga

SEQ ID NO: 1038516 - RNA, 19 nt, Homo sapiens
cccuggaggcuacuuguaa

SEQ ID NO: 1038517 - RNA, 19 nt, Homo sapiens
agucauuccuguauuccau

SEQ ID NO: 1038518 - RNA, 19 nt, Homo sapiens
cagcgacuagaaaucaauu

SEQ ID NO: 1038519 - RNA, 19 nt, Homo sapiens
aaucauguagugacagaug

SEQ ID NO: 1038520 - RNA, 19 nt, Homo sapiens
acccagacgugcaacaaag

SEQ ID NO: 1038521 - RNA, 19 nt, Homo sapiens
gcccuggaggcuacuugua

SEQ ID NO: 1038522 - RNA, 19 nt, Homo sapiens
gccgaugugguucagauug

SEQ ID NO: 1038523 - RNA, 19 nt, Homo sapiens
agacgaaccugcuuugaaa

SEQ ID NO: 1038524 - RNA, 19 nt, Homo sapiens
uaaagucauuccuguauuc

SEQ ID NO: 1038525 - RNA, 19 nt, Homo sapiens
guugaacucuuucguguug

SEQ ID NO: 1038526 - RNA, 19 nt, Homo sapiens
ggauagcauugaagccaaa

SEQ ID NO: 1038527 - RNA, 19 nt, Homo sapiens
gcucuuaaacacuguaauu

SEQ ID NO: 1038528 - RNA, 19 nt, Homo sapiens
ggagaaucauguagugaca

SEQ ID NO: 1038529 - RNA, 19 nt, Homo sapiens
gggaacagcauccuaugaa

SEQ ID NO: 1038530 - RNA, 19 nt, Homo sapiens
ugaggcagguguuugcaaa

SEQ ID NO: 1038531 - RNA, 19 nt, Homo sapiens
cgacaaacaccacgagaau

SEQ ID NO: 1038532 - RNA, 19 nt, Homo sapiens
ggguauugcugaccuacuu

SEQ ID NO: 1038533 - RNA, 19 nt, Homo sapiens
ucacagaauccgacuggua

SEQ ID NO: 1038534 - RNA, 19 nt, Homo sapiens
gcagcgacauccagguuca

SEQ ID NO: 1038535 - RNA, 19 nt, Homo sapiens
ggauccaucuauaaaguca

SEQ ID NO: 1038536 - RNA, 19 nt, Homo sapiens
gggaaaugcucuuaaacac

SEQ ID NO: 1038537 - RNA, 19 nt, Homo sapiens
caggauccaucuauaaagu

SEQ ID NO: 1038538 - RNA, 19 nt, Homo sapiens
gaagaggacuaccccaaug

SEQ ID NO: 1038539 - RNA, 19 nt, Homo sapiens
agaaaucaauugccaggau

SEQ ID NO: 1038540 - RNA, 19 nt, Homo sapiens
ggagaccccuuucguuuga

SEQ ID NO: 1038541 - RNA, 19 nt, Homo sapiens
gaaacgccagcgacuagaa

SEQ ID NO: 1038542 - RNA, 19 nt, Homo sapiens
ggaacagcauccuaugaac

SEQ ID NO: 1038543 - RNA, 19 nt, Homo sapiens
gcgguuggauagcauugaa

SEQ ID NO: 1038544 - RNA, 19 nt, Homo sapiens
gccaggauccaucuauaaa

SEQ ID NO: 1038545 - RNA, 19 nt, Homo sapiens
gaacagcauccuaugaacu

SEQ ID NO: 1038546 - RNA, 19 nt, Homo sapiens
acaaacaccacgagaauuc

SEQ ID NO: 1038547 - RNA, 19 nt, Homo sapiens
gaagacgaaccugcuuuga

SEQ ID NO: 1038548 - RNA, 19 nt, Homo sapiens
gggaaaucaagaacuauga

SEQ ID NO: 1038549 - RNA, 19 nt, Homo sapiens
cgcgggaaaucaagaacua

SEQ ID NO: 1038550 - RNA, 19 nt, Homo sapiens
ccuggaggcuacuuguaaa

SEQ ID NO: 1038551 - RNA, 19 nt, Homo sapiens
agaaucauguagugacaga

SEQ ID NO: 1038552 - RNA, 19 nt, Homo sapiens
ggaaaugcucuuaaacacu

SEQ ID NO: 1038553 - RNA, 19 nt, Homo sapiens
agugacagaugaagacgaa

SEQ ID NO: 1038554 - RNA, 19 nt, Homo sapiens
cgaccuggccgaugugguu

SEQ ID NO: 1038555 - RNA, 19 nt, Homo sapiens
cuauaaauuuggcaucaca

SEQ ID NO: 1038556 - RNA, 19 nt, Homo sapiens
gacaaacaccacgagaauu

SEQ ID NO: 1038557 - RNA, 19 nt, Homo sapiens
cgcuaacgcugcuggacua

SEQ ID NO: 1038558 - RNA, 19 nt, Homo sapiens
uaaauuuggcaucacagaa

SEQ ID NO: 1038559 - RNA, 19 nt, Homo sapiens
uagcauugaagccaaauug

SEQ ID NO: 1038560 - RNA, 19 nt, Homo sapiens
caggagcccuuugcugugu

SEQ ID NO: 1038561 - RNA, 19 nt, Homo sapiens
ggaggcuacuuguaaaucc

SEQ ID NO: 1038562 - RNA, 19 nt, Homo sapiens
gcggagagcgucgcauaug

SEQ ID NO: 1038563 - RNA, 19 nt, Homo sapiens
gggcagcgacauccagguu

SEQ ID NO: 1038564 - RNA, 19 nt, Homo sapiens
gcauugaagccaaauugca

SEQ ID NO: 1038565 - RNA, 19 nt, Homo sapiens
uugccaggauccaucuaua

SEQ ID NO: 1038566 - RNA, 19 nt, Homo sapiens
gcacguguucugcugaagu

SEQ ID NO: 1038567 - RNA, 19 nt, Homo sapiens
aaauuuggcaucacagaau

SEQ ID NO: 1038568 - RNA, 19 nt, Homo sapiens
gcaagcacgggaagaagca

SEQ ID NO: 1038569 - RNA, 19 nt, Homo sapiens
ugaagacgaaccugcuuug

SEQ ID NO: 1038570 - RNA, 19 nt, Homo sapiens
gggcaacccagacgugcaa

SEQ ID NO: 1038571 - RNA, 19 nt, Homo sapiens
cauugaagccaaauugcaa

SEQ ID NO: 1038572 - RNA, 19 nt, Homo sapiens
cuauaaagucauuccugua

SEQ ID NO: 1038573 - RNA, 19 nt, Homo sapiens
aaacgccagcgacuagaaa

SEQ ID NO: 1038574 - RNA, 19 nt, Homo sapiens
ugugugcucuguccagugu

SEQ ID NO: 1038575 - RNA, 19 nt, Homo sapiens
ugugugcucuguccagugu

SEQ ID NO: 1038576 - RNA, 19 nt, Homo sapiens
uggacccgcucaccaucua

SEQ ID NO: 1038577 - RNA, 19 nt, Homo sapiens
aagacgaaccugcuuugaa

SEQ ID NO: 1038578 - RNA, 19 nt, Homo sapiens
gaugaagacgaaccugcuu

SEQ ID NO: 1038579 - RNA, 19 nt, Homo sapiens
ggacgccauuaucgcaucu

SEQ ID NO: 1038580 - RNA, 19 nt, Homo sapiens
gaggacggacgccauuauc

SEQ ID NO: 1038581 - RNA, 19 nt, Homo sapiens
ccgagaagauggcgcuaac

SEQ ID NO: 1038582 - RNA, 19 nt, Homo sapiens
caacccagacgugcaacaa

SEQ ID NO: 1038583 - RNA, 19 nt, Homo sapiens
gccagcgacuagaaaucaa

SEQ ID NO: 1038584 - RNA, 19 nt, Homo sapiens
gcgaggacggacgccauua

SEQ ID NO: 1038585 - RNA, 19 nt, Homo sapiens
agacggacaggugcaagua

SEQ ID NO: 1038586 - RNA, 19 nt, Homo sapiens
cuucagagccgaugaugag

SEQ ID NO: 1038587 - RNA, 19 nt, Homo sapiens
gaaucaagcagagcaucga

SEQ ID NO: 1038588 - RNA, 19 nt, Homo sapiens
uaacgcugcuggacuaccu

SEQ ID NO: 1038589 - RNA, 19 nt, Homo sapiens
ggcuacuuguaaauccuua

SEQ ID NO: 1038590 - RNA, 19 nt, Homo sapiens
aacacgaccuggccgaugu

SEQ ID NO: 1038591 - RNA, 19 nt, Homo sapiens
cgaggacggacgccauuau

SEQ ID NO: 1038592 - RNA, 19 nt, Homo sapiens
cacguguucugcugaagug

SEQ ID NO: 1038593 - RNA, 19 nt, Homo sapiens
cgacauccagguucaguac

SEQ ID NO: 1038594 - RNA, 19 nt, Homo sapiens
cgacugguaccgaaucaag

SEQ ID NO: 1038595 - RNA, 19 nt, Homo sapiens
ugccaggauccaucuauaa

SEQ ID NO: 1038596 - RNA, 19 nt, Homo sapiens
uaggggaaaugcucuuaaa

SEQ ID NO: 1038597 - RNA, 19 nt, Homo sapiens
gguauugcugaccuacuuu

SEQ ID NO: 1038598 - RNA, 19 nt, Homo sapiens
cgggagcccuuugcugugu

SEQ ID NO: 1038599 - RNA, 19 nt, Homo sapiens
ggaguagcaggagcccuuu

SEQ ID NO: 1038600 - RNA, 19 nt, Homo sapiens
gaacucggaagaggacuac

SEQ ID NO: 1038601 - RNA, 19 nt, Homo sapiens
gcgacauccagguucagua

SEQ ID NO: 1038602 - RNA, 19 nt, Homo sapiens
cauccuaugaacugaaaga

SEQ ID NO: 1038603 - RNA, 19 nt, Homo sapiens
cccuggaggcuacuuguaa

SEQ ID NO: 1038604 - RNA, 19 nt, Homo sapiens
agucauuccuguauuccau

SEQ ID NO: 1038605 - RNA, 19 nt, Homo sapiens
cagcgacuagaaaucaauu

SEQ ID NO: 1038606 - RNA, 19 nt, Homo sapiens
aaucauguagugacagaug

SEQ ID NO: 1038607 - RNA, 19 nt, Homo sapiens
acccagacgugcaacaaag

SEQ ID NO: 1038608 - RNA, 19 nt, Homo sapiens
gcccuggaggcuacuugua

SEQ ID NO: 1038609 - RNA, 19 nt, Homo sapiens
gccgaugugguucagauug

SEQ ID NO: 1038610 - RNA, 19 nt, Homo sapiens
gaguagaguuugugacauu

SEQ ID NO: 1038611 - RNA, 19 nt, Homo sapiens
caaagaaccucccgacagu

SEQ ID NO: 1038612 - RNA, 19 nt, Homo sapiens
gggaaauccuggugucuga

SEQ ID NO: 1038613 - RNA, 19 nt, Homo sapiens
ggccagcucuuuagugcua

SEQ ID NO: 1038614 - RNA, 19 nt, Homo sapiens
gggaaccauuucauucuaa

SEQ ID NO: 1038615 - RNA, 19 nt, Homo sapiens
gcaacuacauggagaggau

SEQ ID NO: 1038616 - RNA, 19 nt, Homo sapiens
gaauaaaccgagaaggaaa

SEQ ID NO: 1038617 - RNA, 19 nt, Homo sapiens
gaaggacccugaggagcuu

SEQ ID NO: 1038618 - RNA, 19 nt, Homo sapiens
cugaggagcuucgcaacua

SEQ ID NO: 1038619 - RNA, 19 nt, Homo sapiens
cugaggagcuggugaauac

SEQ ID NO: 1038620 - RNA, 19 nt, Homo sapiens
cagaauaaaccgagaagga

SEQ ID NO: 1038621 - RNA, 19 nt, Homo sapiens
caagcacccuggcccgaaa

SEQ ID NO: 1038622 - RNA, 19 nt, Homo sapiens
ggaagcgaguagaguuugu

SEQ ID NO: 1038623 - RNA, 19 nt, Homo sapiens
ucacguggcagcuggagua

SEQ ID NO: 1038624 - RNA, 19 nt, Homo sapiens
gaauacagcaccacugacu

SEQ ID NO: 1038625 - RNA, 19 nt, Homo sapiens
ccacucgucuggugcuugu

SEQ ID NO: 1038626 - RNA, 19 nt, Homo sapiens
ggucaaugguguggucuuc

SEQ ID NO: 1038627 - RNA, 19 nt, Homo sapiens
gugcuggacucgcguguag

SEQ ID NO: 1038628 - RNA, 19 nt, Homo sapiens
gugaauacagcaccacuga

SEQ ID NO: 1038629 - RNA, 19 nt, Homo sapiens
ucucugagcucccgaucug

SEQ ID NO: 1038630 - RNA, 19 nt, Homo sapiens
ugggaaccauuucauucua

SEQ ID NO: 1038631 - RNA, 19 nt, Homo sapiens
gcaucucgcugaccuugag

SEQ ID NO: 1038632 - RNA, 19 nt, Homo sapiens
ggacaucagagcccuuauc

SEQ ID NO: 1038633 - RNA, 19 nt, Homo sapiens
gcacugaccaggaggaacu

SEQ ID NO: 1038634 - RNA, 19 nt, Homo sapiens
agaauaaaccgagaaggaa

SEQ ID NO: 1038635 - RNA, 19 nt, Homo sapiens
uaacagaauaaaccgagaa

SEQ ID NO: 1038636 - RNA, 19 nt, Homo sapiens
gcgaguagaguuugugaca

SEQ ID NO: 1038637 - RNA, 19 nt, Homo sapiens
gcaugucacugagcuagag

SEQ ID NO: 1038638 - RNA, 19 nt, Homo sapiens
acucuggacugccaagcua

SEQ ID NO: 1038639 - RNA, 19 nt, Homo sapiens
gggaggaggaggaggaaga

SEQ ID NO: 1038640 - RNA, 19 nt, Homo sapiens
gauggccggucgcacaaca

SEQ ID NO: 1038641 - RNA, 19 nt, Homo sapiens
gcggaagcgaguagaguuu

SEQ ID NO: 1038642 - RNA, 19 nt, Homo sapiens
ggaaccauuucauucuaac

SEQ ID NO: 1038643 - RNA, 19 nt, Homo sapiens
ggacauccgcugggugugu

SEQ ID NO: 1038644 - RNA, 19 nt, Homo sapiens
cugcagaggcgucggauga

SEQ ID NO: 1038645 - RNA, 19 nt, Homo sapiens
gcugaggagcuggugaaua

SEQ ID NO: 1038646 - RNA, 19 nt, Homo sapiens
ggaagaggaggaggagaug

SEQ ID NO: 1038647 - RNA, 19 nt, Homo sapiens
ccugccaacuccucucuga

SEQ ID NO: 1038648 - RNA, 19 nt, Homo sapiens
ggccugugaugccguguuc

SEQ ID NO: 1038649 - RNA, 19 nt, Homo sapiens
cagaggaggaggccaggaa

SEQ ID NO: 1038650 - RNA, 19 nt, Homo sapiens
gcucaugccccuuauuuau

SEQ ID NO: 1038651 - RNA, 19 nt, Homo sapiens
gcaccacaccacccucauc

SEQ ID NO: 1038652 - RNA, 19 nt, Homo sapiens
gaaccauuucauucuaaca

SEQ ID NO: 1038653 - RNA, 19 nt, Homo sapiens
ccacaaggacucccaucca

SEQ ID NO: 1038654 - RNA, 19 nt, Homo sapiens
gagcccaccagccacagaa

SEQ ID NO: 1038655 - RNA, 19 nt, Homo sapiens
ucaaugguguggucuucgu

SEQ ID NO: 1038656 - RNA, 19 nt, Homo sapiens
guagaguuugugacauuug

SEQ ID NO: 1038657 - RNA, 19 nt, Homo sapiens
aguagaguuugugacauuu

SEQ ID NO: 1038658 - RNA, 19 nt, Homo sapiens
gcguggccaucuucaucuu

SEQ ID NO: 1038659 - RNA, 19 nt, Homo sapiens
guccuucucugaucacacu

SEQ ID NO: 1038660 - RNA, 19 nt, Homo sapiens
cugcgagucugccaacaca

SEQ ID NO: 1038661 - RNA, 19 nt, Homo sapiens
gaagcgaguagaguuugug

SEQ ID NO: 1038662 - RNA, 19 nt, Homo sapiens
ggcggaagcgaguagaguu

SEQ ID NO: 1038663 - RNA, 19 nt, Homo sapiens
gcaugucggcugcgagucu

SEQ ID NO: 1038664 - RNA, 19 nt, Homo sapiens
cgaguagaguuugugacau

SEQ ID NO: 1038665 - RNA, 19 nt, Homo sapiens
ggccaucuucaucuucuug

SEQ ID NO: 1038666 - RNA, 19 nt, Homo sapiens
ugagaccuuucugcuccua

SEQ ID NO: 1038667 - RNA, 19 nt, Homo sapiens
uggcuguccuucucugauc

SEQ ID NO: 1038668 - RNA, 19 nt, Homo sapiens
gcgagucugccaacacaca

SEQ ID NO: 1038669 - RNA, 19 nt, Homo sapiens
caccacaccacccucauca

SEQ ID NO: 1038670 - RNA, 19 nt, Homo sapiens
ucacaucucugcugaagaa

SEQ ID NO: 1038671 - RNA, 19 nt, Homo sapiens
agacagcaguuuccaguaa

SEQ ID NO: 1038672 - RNA, 19 nt, Homo sapiens
gaucaaagacugcaugaag

SEQ ID NO: 1038673 - RNA, 19 nt, Homo sapiens
gacagcaguuuccaguaaa

SEQ ID NO: 1038674 - RNA, 19 nt, Homo sapiens
cuuaggagcugccuggauu

SEQ ID NO: 1038675 - RNA, 19 nt, Homo sapiens
cugcagaucuuccggaaau

SEQ ID NO: 1038676 - RNA, 19 nt, Homo sapiens
caagaucgccguagacaag

SEQ ID NO: 1038677 - RNA, 19 nt, Homo sapiens
gaagauggaguuccugaag

SEQ ID NO: 1038678 - RNA, 19 nt, Homo sapiens
agaggaacauguuugaguu

SEQ ID NO: 1038679 - RNA, 19 nt, Homo sapiens
ggagcugccuggauugaca

SEQ ID NO: 1038680 - RNA, 19 nt, Homo sapiens
cagaagauccgcaagacuu

SEQ ID NO: 1038681 - RNA, 19 nt, Homo sapiens
caccagacgguccagauua

SEQ ID NO: 1038682 - RNA, 19 nt, Homo sapiens
gcacccugaucaugaagga

SEQ ID NO: 1038683 - RNA, 19 nt, Homo sapiens
ucaaagacugcaugaagaa

SEQ ID NO: 1038684 - RNA, 19 nt, Homo sapiens
ccucccagaugaucaaaga

SEQ ID NO: 1038685 - RNA, 19 nt, Homo sapiens
gaccgacgcuucccugacu

SEQ ID NO: 1038686 - RNA, 19 nt, Homo sapiens
ccaagaagauggaguuccu

SEQ ID NO: 1038687 - RNA, 19 nt, Homo sapiens
ccaaccugcucaucacaga

SEQ ID NO: 1038688 - RNA, 19 nt, Homo sapiens
gcacaugggcuucaaugac

SEQ ID NO: 1038689 - RNA, 19 nt, Homo sapiens
gcagguggaguacauguca

SEQ ID NO: 1038690 - RNA, 19 nt, Homo sapiens
gaaaagaacauggucauca

SEQ ID NO: 1038691 - RNA, 19 nt, Homo sapiens
gcacggcacccugaucaug

SEQ ID NO: 1038692 - RNA, 19 nt, Homo sapiens
gaaugcacaugggcuucaa

SEQ ID NO: 1038693 - RNA, 19 nt, Homo sapiens
ucaagaugcagguggagua

SEQ ID NO: 1038694 - RNA, 19 nt, Homo sapiens
ggucuacacgggugauuau

SEQ ID NO: 1038695 - RNA, 19 nt, Homo sapiens
ggagcuuccucacaucucu

SEQ ID NO: 1038696 - RNA, 19 nt, Homo sapiens
ugaaggugcccaucuacuu

SEQ ID NO: 1038697 - RNA, 19 nt, Homo sapiens
cuacacgggugauuauaac

SEQ ID NO: 1038698 - RNA, 19 nt, Homo sapiens
accagacgguccagauuaa

SEQ ID NO: 1038699 - RNA, 19 nt, Homo sapiens
ccaucuugcuggaggacua

SEQ ID NO: 1038700 - RNA, 19 nt, Homo sapiens
ccgagaaggccaaccacua

SEQ ID NO: 1038701 - RNA, 19 nt, Homo sapiens
caggaccgaugguuguguu

SEQ ID NO: 1038702 - RNA, 19 nt, Homo sapiens
uaaagugggcucagagucu

SEQ ID NO: 1038703 - RNA, 19 nt, Homo sapiens
gggcgaggccaacuucuuc

SEQ ID NO: 1038704 - RNA, 19 nt, Homo sapiens
cagaggaacauguuugagu

SEQ ID NO: 1038705 - RNA, 19 nt, Homo sapiens
agacuuucgugcagaggaa

SEQ ID NO: 1038706 - RNA, 19 nt, Homo sapiens
ucuccuacaucacccagaa

SEQ ID NO: 1038707 - RNA, 19 nt, Homo sapiens
cggagacgaugccugagau

SEQ ID NO: 1038708 - RNA, 19 nt, Homo sapiens
cagagcaagcccucaaaga

SEQ ID NO: 1038709 - RNA, 19 nt, Homo sapiens
uggaguuccugaagcagaa

SEQ ID NO: 1038710 - RNA, 19 nt, Homo sapiens
gugcagaggaacauguuug

SEQ ID NO: 1038711 - RNA, 19 nt, Homo sapiens
agaagauccgcaagacuuu

SEQ ID NO: 1038712 - RNA, 19 nt, Homo sapiens
cgagaaggccaaccacuac

SEQ ID NO: 1038713 - RNA, 19 nt, Homo sapiens
gggagcgcaugaaccugaa

SEQ ID NO: 1038714 - RNA, 19 nt, Homo sapiens
gcaagaucgccguagacaa

SEQ ID NO: 1038715 - RNA, 19 nt, Homo sapiens
ggaggacuaccgcaagauc

SEQ ID NO: 1038716 - RNA, 19 nt, Homo sapiens
ccucacaucucugcugaag

SEQ ID NO: 1038717 - RNA, 19 nt, Homo sapiens
ccaccagacgguccagauu

SEQ ID NO: 1038718 - RNA, 19 nt, Homo sapiens
aucaaagacugcaugaaga

SEQ ID NO: 1038719 - RNA, 19 nt, Homo sapiens
cagacuuccuggacugugu

SEQ ID NO: 1038720 - RNA, 19 nt, Homo sapiens
ggaaugcacaugggcuuca

SEQ ID NO: 1038721 - RNA, 19 nt, Homo sapiens
ggcaggugcuggaggucaa

SEQ ID NO: 1038722 - RNA, 19 nt, Homo sapiens
gaagauccgcaagacuuuc

SEQ ID NO: 1038723 - RNA, 19 nt, Homo sapiens
gaaggccaaccacuacuac

SEQ ID NO: 1038724 - RNA, 19 nt, Homo sapiens
ucuacacgggugauuauaa

SEQ ID NO: 1038725 - RNA, 19 nt, Homo sapiens
gaccgaugguuguguuugc

SEQ ID NO: 1038726 - RNA, 19 nt, Homo sapiens
cacgggugauuauaacaug

SEQ ID NO: 1038727 - RNA, 19 nt, Homo sapiens
gcggagacgaugccugaga

SEQ ID NO: 1038728 - RNA, 19 nt, Homo sapiens
agauggaguuccugaagca

SEQ ID NO: 1038729 - RNA, 19 nt, Homo sapiens
ggaccgaugguuguguuug

SEQ ID NO: 1038730 - RNA, 19 nt, Homo sapiens
ccugacuucuccuacauca

SEQ ID NO: 1038731 - RNA, 19 nt, Homo sapiens
gcugguguccucagagcaa

SEQ ID NO: 1038732 - RNA, 19 nt, Homo sapiens
ggacgccaagggcaucaug

SEQ ID NO: 1038733 - RNA, 19 nt, Homo sapiens
agcggaagcucgagaugga

SEQ ID NO: 1038734 - RNA, 19 nt, Homo sapiens
agaaggccaaccacuacua

SEQ ID NO: 1038735 - RNA, 19 nt, Homo sapiens
agauuaaagugggcucaga

SEQ ID NO: 1038736 - RNA, 19 nt, Homo sapiens
gagacgaugccugagauca

SEQ ID NO: 1038737 - RNA, 19 nt, Homo sapiens
gguccuagacagcaguuuc

SEQ ID NO: 1038738 - RNA, 19 nt, Homo sapiens
gagcaccagcugcgcuuca

SEQ ID NO: 1038739 - RNA, 19 nt, Homo sapiens
agagcaagcccucaaagag

SEQ ID NO: 1038740 - RNA, 19 nt, Homo sapiens
agaugcagguggaguacau

SEQ ID NO: 1038741 - RNA, 19 nt, Homo sapiens
cuggaggacuaccgcaaga

SEQ ID NO: 1038742 - RNA, 19 nt, Homo sapiens
gcagaucuuccggaaaugg

SEQ ID NO: 1038743 - RNA, 19 nt, Homo sapiens
cugccuggauugacaagug

SEQ ID NO: 1038744 - RNA, 19 nt, Homo sapiens
uugccuuuauuccugguua

SEQ ID NO: 1038745 - RNA, 19 nt, Homo sapiens
ccuggacugugugaucauu

SEQ ID NO: 1038746 - RNA, 19 nt, Homo sapiens
cacggcacccugaucauga

SEQ ID NO: 1038747 - RNA, 19 nt, Homo sapiens
aaaagaacauggucaucau

SEQ ID NO: 1038748 - RNA, 19 nt, Homo sapiens
gcgagauggugggcuacga

SEQ ID NO: 1038749 - RNA, 19 nt, Homo sapiens
ccacguacgccacgaccau

SEQ ID NO: 1038750 - RNA, 19 nt, Homo sapiens
uggacugugugaucauuag

SEQ ID NO: 1038751 - RNA, 19 nt, Homo sapiens
uggaguacaugucauucag

SEQ ID NO: 1038752 - RNA, 19 nt, Homo sapiens
gaaagggacuguguugaua

SEQ ID NO: 1038753 - RNA, 19 nt, Homo sapiens
gaaggaacauccagagauu

SEQ ID NO: 1038754 - RNA, 19 nt, Homo sapiens
caacagaaauggaaggaaa

SEQ ID NO: 1038755 - RNA, 19 nt, Homo sapiens
gaagguggaugaagugaug

SEQ ID NO: 1038756 - RNA, 19 nt, Homo sapiens
gggaauagguggugagaga

SEQ ID NO: 1038757 - RNA, 19 nt, Homo sapiens
gaagacagcugacccuuuu

SEQ ID NO: 1038758 - RNA, 19 nt, Homo sapiens
cagaggaggcauaauauua

SEQ ID NO: 1038759 - RNA, 19 nt, Homo sapiens
gagccaagauugugccauu

SEQ ID NO: 1038760 - RNA, 19 nt, Homo sapiens
aaauuaagcugccaacaga

SEQ ID NO: 1038761 - RNA, 19 nt, Homo sapiens
uggcagaccucaagauaaa

SEQ ID NO: 1038762 - RNA, 19 nt, Homo sapiens
gcagaccucaagauaaaua

SEQ ID NO: 1038763 - RNA, 19 nt, Homo sapiens
cagcagggaucaucacaug

SEQ ID NO: 1038764 - RNA, 19 nt, Homo sapiens
ccaguaaguucaugacuca

SEQ ID NO: 1038765 - RNA, 19 nt, Homo sapiens
uggaagaacuagaggauau

SEQ ID NO: 1038766 - RNA, 19 nt, Homo sapiens
ggaaagggacuguguugau

SEQ ID NO: 1038767 - RNA, 19 nt, Homo sapiens
acaacaaucuggacuaaca

SEQ ID NO: 1038768 - RNA, 19 nt, Homo sapiens
ggguaaacauccucugcua

SEQ ID NO: 1038769 - RNA, 19 nt, Homo sapiens
ucacguggccucccaguuu

SEQ ID NO: 1038770 - RNA, 19 nt, Homo sapiens
ugucagaggaggcauaaua

SEQ ID NO: 1038771 - RNA, 19 nt, Homo sapiens
gaaauuaagcugccaacag

SEQ ID NO: 1038772 - RNA, 19 nt, Homo sapiens
gaacuagaggauauuguga

SEQ ID NO: 1038773 - RNA, 19 nt, Homo sapiens
ggagggaaaggauuauuug

SEQ ID NO: 1038774 - RNA, 19 nt, Homo sapiens
gaggaggcauaauauuaau

SEQ ID NO: 1038775 - RNA, 19 nt, Homo sapiens
guaaacauccucugcuaau

SEQ ID NO: 1038776 - RNA, 19 nt, Homo sapiens
gcaaccagacuuuaaagga

SEQ ID NO: 1038777 - RNA, 19 nt, Homo sapiens
ccuauuagacuucuugaaa

SEQ ID NO: 1038778 - RNA, 19 nt, Homo sapiens
ggaaggaacauccagagau

SEQ ID NO: 1038779 - RNA, 19 nt, Homo sapiens
uggaugaagugaugacaaa

SEQ ID NO: 1038780 - RNA, 19 nt, Homo sapiens
caaggccauuuaccucuuu

SEQ ID NO: 1038781 - RNA, 19 nt, Homo sapiens
ggauugauuuaauggaguu

SEQ ID NO: 1038782 - RNA, 19 nt, Homo sapiens
gaguacagcuuuguguuca

SEQ ID NO: 1038783 - RNA, 19 nt, Homo sapiens
ggagaaucauuugaacuca

SEQ ID NO: 1038784 - RNA, 19 nt, Homo sapiens
gaacauccagagauucuag

SEQ ID NO: 1038785 - RNA, 19 nt, Homo sapiens
gcaggagaaucauuugaac

SEQ ID NO: 1038786 - RNA, 19 nt, Homo sapiens
agaggaggcauaauauuaa

SEQ ID NO: 1038787 - RNA, 19 nt, Homo sapiens
ggcagaagguggaugaagu

SEQ ID NO: 1038788 - RNA, 19 nt, Homo sapiens
auacaacaaucuggacuaa

SEQ ID NO: 1038789 - RNA, 19 nt, Homo sapiens
ccauuuaccucuuucuaag

SEQ ID NO: 1038790 - RNA, 19 nt, Homo sapiens
ggaggcauaauauuaauag

SEQ ID NO: 1038791 - RNA, 19 nt, Homo sapiens
ccacccaucuacuugcauu

SEQ ID NO: 1038792 - RNA, 19 nt, Homo sapiens
gaagaacuagaggauauug

SEQ ID NO: 1038793 - RNA, 19 nt, Homo sapiens
ggaguugucagcaugauca

SEQ ID NO: 1038794 - RNA, 19 nt, Homo sapiens
auccagagauucuagauga

SEQ ID NO: 1038795 - RNA, 19 nt, Homo sapiens
gaagagucgugguguaucc

SEQ ID NO: 1038796 - RNA, 19 nt, Homo sapiens
aagaagagccaguaaguuc

SEQ ID NO: 1038797 - RNA, 19 nt, Homo sapiens
gaacucaggaggcggaagu

SEQ ID NO: 1038798 - RNA, 19 nt, Homo sapiens
gaagguagugggaauaggu

SEQ ID NO: 1038799 - RNA, 19 nt, Homo sapiens
gguaaacauccucugcuaa

SEQ ID NO: 1038800 - RNA, 19 nt, Homo sapiens
caugaugccucugaauuca

SEQ ID NO: 1038801 - RNA, 19 nt, Homo sapiens
gagaagaggagcccaaacu

SEQ ID NO: 1038802 - RNA, 19 nt, Homo sapiens
gcacuuauacaacaaucug

SEQ ID NO: 1038803 - RNA, 19 nt, Homo sapiens
gcaacgagcgaaacuacau

SEQ ID NO: 1038804 - RNA, 19 nt, Homo sapiens
gccauuuaccucuuucuaa

SEQ ID NO: 1038805 - RNA, 19 nt, Homo sapiens
ccaaggccauuuaccucuu

SEQ ID NO: 1038806 - RNA, 19 nt, Homo sapiens
cagagauucuagaugaaga

SEQ ID NO: 1038807 - RNA, 19 nt, Homo sapiens
gcagaagguggaugaagug

SEQ ID NO: 1038808 - RNA, 19 nt, Homo sapiens
ggaagaacuagaggauauu

SEQ ID NO: 1038809 - RNA, 19 nt, Homo sapiens
aaguuaagguucacgauuc

SEQ ID NO: 1038810 - RNA, 19 nt, Homo sapiens
ucacuuuccuauuagacuu

SEQ ID NO: 1038811 - RNA, 19 nt, Homo sapiens
ccacugacuuuggaaaucu

SEQ ID NO: 1038812 - RNA, 19 nt, Homo sapiens
ccagcaaccagacuuuaaa

SEQ ID NO: 1038813 - RNA, 19 nt, Homo sapiens
gagaagcacaacuuugcaa

SEQ ID NO: 1038814 - RNA, 19 nt, Homo sapiens
gaagugaugacaaaagaaa

SEQ ID NO: 1038815 - RNA, 19 nt, Homo sapiens
caagcagauugucacauca

SEQ ID NO: 1038816 - RNA, 19 nt, Homo sapiens
ccaaaugugcgcagacugu

SEQ ID NO: 1038817 - RNA, 19 nt, Homo sapiens
ugaggcaggagaaucauuu

SEQ ID NO: 1038818 - RNA, 19 nt, Homo sapiens
gcagggaucaucacaugca

SEQ ID NO: 1038819 - RNA, 19 nt, Homo sapiens
acucaagacauuucaguuu

SEQ ID NO: 1038820 - RNA, 19 nt, Homo sapiens
ccuguaaaguuaagguuca

SEQ ID NO: 1038821 - RNA, 19 nt, Homo sapiens
gcagacaagaaugagauuu

SEQ ID NO: 1038822 - RNA, 19 nt, Homo sapiens
ggacuaacaccaguacaag

SEQ ID NO: 1038823 - RNA, 19 nt, Homo sapiens
guacagcuuuguguucaag

SEQ ID NO: 1038824 - RNA, 19 nt, Homo sapiens
gaucgcguauggacagagu

SEQ ID NO: 1038825 - RNA, 19 nt, Homo sapiens
ggcaggagaaucauuugaa

SEQ ID NO: 1038826 - RNA, 19 nt, Homo sapiens
ucacaugcagccaaacuug

SEQ ID NO: 1038827 - RNA, 19 nt, Homo sapiens
uaaacauccucugcuaauc

SEQ ID NO: 1038828 - RNA, 19 nt, Homo sapiens
gagagaagaggagcccaaa

SEQ ID NO: 1038829 - RNA, 19 nt, Homo sapiens
ugaagacagcugacccuuu

SEQ ID NO: 1038830 - RNA, 19 nt, Homo sapiens
gauggaagaacuagaggau

SEQ ID NO: 1038831 - RNA, 19 nt, Homo sapiens
ccagcuauguguuuuauug

SEQ ID NO: 1038832 - RNA, 19 nt, Homo sapiens
gaagagccaguaaguucau

SEQ ID NO: 1038833 - RNA, 19 nt, Homo sapiens
uagccucuauguaaucaga

SEQ ID NO: 1038834 - RNA, 19 nt, Homo sapiens
uaauagcgccaccuucugu

SEQ ID NO: 1038835 - RNA, 19 nt, Homo sapiens
aaaguuaagguucacgauu

SEQ ID NO: 1038836 - RNA, 19 nt, Homo sapiens
acagguagcaggugucaga

SEQ ID NO: 1038837 - RNA, 19 nt, Homo sapiens
cuacuugcauucgucuuug

SEQ ID NO: 1038838 - RNA, 19 nt, Homo sapiens
gcugagaagcacaacuuug

SEQ ID NO: 1038839 - RNA, 19 nt, Homo sapiens
ucagaggaggcauaauauu

SEQ ID NO: 1038840 - RNA, 19 nt, Homo sapiens
gguguaucuuacucuguuu

SEQ ID NO: 1038841 - RNA, 19 nt, Homo sapiens
ugguguaucuuacucuguu

SEQ ID NO: 1038842 - RNA, 19 nt, Homo sapiens
caaagccagugcccuugca

SEQ ID NO: 1038843 - RNA, 19 nt, Homo sapiens
gaccaaaugugcgcagacu

SEQ ID NO: 1038844 - RNA, 19 nt, Homo sapiens
gagauuacagggaacucuu

SEQ ID NO: 1038845 - RNA, 19 nt, Homo sapiens
uaccucagcuggcgacaag

SEQ ID NO: 1038846 - RNA, 19 nt, Homo sapiens
cggagggaaaggauuauuu

SEQ ID NO: 1038847 - RNA, 19 nt, Homo sapiens
guaaucagacaaaugacau

SEQ ID NO: 1038848 - RNA, 19 nt, Homo sapiens
cagaaaacccacugacuuu

SEQ ID NO: 1038849 - RNA, 19 nt, Homo sapiens
gaugaguacagcuuugugu

SEQ ID NO: 1038850 - RNA, 19 nt, Homo sapiens
ggaauagguggugagagaa

SEQ ID NO: 1038851 - RNA, 19 nt, Homo sapiens
ccaguuugccuccagcuau

SEQ ID NO: 1038852 - RNA, 19 nt, Homo sapiens
ggauagaacccuaaagaaa

SEQ ID NO: 1038853 - RNA, 19 nt, Homo sapiens
gauagaacccuaaagaaau

SEQ ID NO: 1038854 - RNA, 19 nt, Homo sapiens
ccacugcuguccaccauga

SEQ ID NO: 1038855 - RNA, 19 nt, Homo sapiens
gcgccgagcuggaauacga

SEQ ID NO: 1038856 - RNA, 19 nt, Homo sapiens
guuauagugucaaguguga

SEQ ID NO: 1038857 - RNA, 19 nt, Homo sapiens
ccacagccacguccacuuu

SEQ ID NO: 1038858 - RNA, 19 nt, Homo sapiens
cugcacagguaugagauua

SEQ ID NO: 1038859 - RNA, 19 nt, Homo sapiens
ucucaccucugccuucauu

SEQ ID NO: 1038860 - RNA, 19 nt, Homo sapiens
gggauagaacccuaaagaa

SEQ ID NO: 1038861 - RNA, 19 nt, Homo sapiens
gcccgucccugaagguuau

SEQ ID NO: 1038862 - RNA, 19 nt, Homo sapiens
caaagaggagauacugcua

SEQ ID NO: 1038863 - RNA, 19 nt, Homo sapiens
ggagagugacagcagcuuu

SEQ ID NO: 1038864 - RNA, 19 nt, Homo sapiens
ccucaggucuguguuacuu

SEQ ID NO: 1038865 - RNA, 19 nt, Homo sapiens
ggucuguguuacuugguuu

SEQ ID NO: 1038866 - RNA, 19 nt, Homo sapiens
gcagcuuucuggucaaggu

SEQ ID NO: 1038867 - RNA, 19 nt, Homo sapiens
gcuggauggugucaagugu

SEQ ID NO: 1038868 - RNA, 19 nt, Homo sapiens
cggaagaaauggguugauc

SEQ ID NO: 1038869 - RNA, 19 nt, Homo sapiens
gagagugacagcagcuuuc

SEQ ID NO: 1038870 - RNA, 19 nt, Homo sapiens
gcgacugguugggauagaa

SEQ ID NO: 1038871 - RNA, 19 nt, Homo sapiens
gaugagaagcugcaugacu

SEQ ID NO: 1038872 - RNA, 19 nt, Homo sapiens
ugggauagaacccuaaaga

SEQ ID NO: 1038873 - RNA, 19 nt, Homo sapiens
ccgaaaggaggcugucuga

SEQ ID NO: 1038874 - RNA, 19 nt, Homo sapiens
ccugaagguuauaguguca

SEQ ID NO: 1038875 - RNA, 19 nt, Homo sapiens
acagccacguccacuuuga

SEQ ID NO: 1038876 - RNA, 19 nt, Homo sapiens
uggauggugucaagugugu

SEQ ID NO: 1038877 - RNA, 19 nt, Homo sapiens
gcugcuggauggugucaag

SEQ ID NO: 1038878 - RNA, 19 nt, Homo sapiens
cauuacugcugccuugcuu

SEQ ID NO: 1038879 - RNA, 19 nt, Homo sapiens
guacucggcgcacaaagag

SEQ ID NO: 1038880 - RNA, 19 nt, Homo sapiens
ucaccucugccuucauuug

SEQ ID NO: 1038881 - RNA, 19 nt, Homo sapiens
ucagucuccugccggaaga

SEQ ID NO: 1038882 - RNA, 19 nt, Homo sapiens
uaagcgacugguugggaua

SEQ ID NO: 1038883 - RNA, 19 nt, Homo sapiens
ugaagguuauagugucaag

SEQ ID NO: 1038884 - RNA, 19 nt, Homo sapiens
uugaugagaagcugcauga

SEQ ID NO: 1038885 - RNA, 19 nt, Homo sapiens
ccucucaccucugccuuca

SEQ ID NO: 1038886 - RNA, 19 nt, Homo sapiens
gaacagaugcccuucuuua

SEQ ID NO: 1038887 - RNA, 19 nt, Homo sapiens
gcaguaagaugaaguccua

SEQ ID NO: 1038888 - RNA, 19 nt, Homo sapiens
gaucaaggcuuuccugugu

SEQ ID NO: 1038889 - RNA, 19 nt, Homo sapiens
gauguuggcuguacucuug

SEQ ID NO: 1038890 - RNA, 19 nt, Homo sapiens
aaacucauaugcagcuuua

SEQ ID NO: 1038891 - RNA, 19 nt, Homo sapiens
cagaugcccuucuuuaauu

SEQ ID NO: 1038892 - RNA, 19 nt, Homo sapiens
gaaucuaccugauguuuua

SEQ ID NO: 1038893 - RNA, 19 nt, Homo sapiens
gaggagucaucaauucaua

SEQ ID NO: 1038894 - RNA, 19 nt, Homo sapiens
ggagagagcuuugcauacu

SEQ ID NO: 1038895 - RNA, 19 nt, Homo sapiens
gguggaaacgcuuauguua

SEQ ID NO: 1038896 - RNA, 19 nt, Homo sapiens
gaaauuguguugccuuugc

SEQ ID NO: 1038897 - RNA, 19 nt, Homo sapiens
aaagaggagucaucaauuc

SEQ ID NO: 1038898 - RNA, 19 nt, Homo sapiens
cacagaaccucaucuccua

SEQ ID NO: 1038899 - RNA, 19 nt, Homo sapiens
gauauuugcugguauucug

SEQ ID NO: 1038900 - RNA, 19 nt, Homo sapiens
gaaaauauauggaccugau

SEQ ID NO: 1038901 - RNA, 19 nt, Homo sapiens
caagggcugcugcuucuua

SEQ ID NO: 1038902 - RNA, 19 nt, Homo sapiens
aaauauggcuaugagagua

SEQ ID NO: 1038903 - RNA, 19 nt, Homo sapiens
gcuaugagagugggaaaua

SEQ ID NO: 1038904 - RNA, 19 nt, Homo sapiens
uggaaacgcuuauguuaca

SEQ ID NO: 1038905 - RNA, 19 nt, Homo sapiens
cagaaauuguguugccuuu

SEQ ID NO: 1038906 - RNA, 19 nt, Homo sapiens
auugaaagcuguuuggaaa

SEQ ID NO: 1038907 - RNA, 19 nt, Homo sapiens
gaugaaguccuaccuggaa

SEQ ID NO: 1038908 - RNA, 19 nt, Homo sapiens
gggaacgggugaaaucugu

SEQ ID NO: 1038909 - RNA, 19 nt, Homo sapiens
gaaauauggcuaugagagu

SEQ ID NO: 1038910 - RNA, 19 nt, Homo sapiens
gaugcaacccuuauuccua

SEQ ID NO: 1038911 - RNA, 19 nt, Homo sapiens
gaacucuaauggcagcaau

SEQ ID NO: 1038912 - RNA, 19 nt, Homo sapiens
caaagacuauggacuacgu

SEQ ID NO: 1038913 - RNA, 19 nt, Homo sapiens
gcaacccuuauuccuauua

SEQ ID NO: 1038914 - RNA, 19 nt, Homo sapiens
gaugcgcccuucucaggaa

SEQ ID NO: 1038915 - RNA, 19 nt, Homo sapiens
gaacgggugaaaucuguug

SEQ ID NO: 1038916 - RNA, 19 nt, Homo sapiens
gaagagaugauggccaaga

SEQ ID NO: 1038917 - RNA, 19 nt, Homo sapiens
gacagcaacucuccuucga

SEQ ID NO: 1038918 - RNA, 19 nt, Homo sapiens
caaccgcccuggagucagu

SEQ ID NO: 1038919 - RNA, 19 nt, Homo sapiens
uaggagagagcuuugcaua

SEQ ID NO: 1038920 - RNA, 19 nt, Homo sapiens
gccaagggcugcugcuucu

SEQ ID NO: 1038921 - RNA, 19 nt, Homo sapiens
gacgguguaugaagagaug

SEQ ID NO: 1038922 - RNA, 19 nt, Homo sapiens
caucuccaaugauucagaa

SEQ ID NO: 1038923 - RNA, 19 nt, Homo sapiens
ggagucaucaauucauaga

SEQ ID NO: 1038924 - RNA, 19 nt, Homo sapiens
uaugucaccuaucacugua

SEQ ID NO: 1038925 - RNA, 19 nt, Homo sapiens
ccucugaauguuccaaaua

SEQ ID NO: 1038926 - RNA, 19 nt, Homo sapiens
gggcugcugcuucuuacua

SEQ ID NO: 1038927 - RNA, 19 nt, Homo sapiens
ggccugaaguccugaccaa

SEQ ID NO: 1038928 - RNA, 19 nt, Homo sapiens
uuucaaagacuauggacua

SEQ ID NO: 1038929 - RNA, 19 nt, Homo sapiens
ggcacucucuacucuuuga

SEQ ID NO: 1038930 - RNA, 19 nt, Homo sapiens
ggugggcucucgcucuguu

SEQ ID NO: 1038931 - RNA, 19 nt, Homo sapiens
ucacaaagccagagaagcu

SEQ ID NO: 1038932 - RNA, 19 nt, Homo sapiens
ggacugggaacgggugaaa

SEQ ID NO: 1038933 - RNA, 19 nt, Homo sapiens
uuucagcugugggauauuu

SEQ ID NO: 1038934 - RNA, 19 nt, Homo sapiens
gaccugcucuacccuccuu

SEQ ID NO: 1038935 - RNA, 19 nt, Homo sapiens
cucugaauguuccaaauaa

SEQ ID NO: 1038936 - RNA, 19 nt, Homo sapiens
ggaacagaugcccuucuuu

SEQ ID NO: 1038937 - RNA, 19 nt, Homo sapiens
cugagaggcuacuuggaaa

SEQ ID NO: 1038938 - RNA, 19 nt, Homo sapiens
gagagagcuuugcauacuc

SEQ ID NO: 1038939 - RNA, 19 nt, Homo sapiens
guucucaguuaacuucuca

SEQ ID NO: 1038940 - RNA, 19 nt, Homo sapiens
ggaaaaccaggcagaaauu

SEQ ID NO: 1038941 - RNA, 19 nt, Homo sapiens
cguggacgguguaugaaga

SEQ ID NO: 1038942 - RNA, 19 nt, Homo sapiens
ugggauauuugcugguauu

SEQ ID NO: 1038943 - RNA, 19 nt, Homo sapiens
acagaugcccuucuuuaau

SEQ ID NO: 1038944 - RNA, 19 nt, Homo sapiens
augcaacccuuauuccuau

SEQ ID NO: 1038945 - RNA, 19 nt, Homo sapiens
gaacgggacaguggcuuuc

SEQ ID NO: 1038946 - RNA, 19 nt, Homo sapiens
caaaagaggagucaucaau

SEQ ID NO: 1038947 - RNA, 19 nt, Homo sapiens
guaauccccuuaaggagaa

SEQ ID NO: 1038948 - RNA, 19 nt, Homo sapiens
gccuuugccuucaguaauc

SEQ ID NO: 1038949 - RNA, 19 nt, Homo sapiens
caaccucuggaucuccuua

SEQ ID NO: 1038950 - RNA, 19 nt, Homo sapiens
gcaauuaaagugcuguacu

SEQ ID NO: 1038951 - RNA, 19 nt, Homo sapiens
aggaacagaugcccuucuu

SEQ ID NO: 1038952 - RNA, 19 nt, Homo sapiens
gcaaucacaaagccagaga

SEQ ID NO: 1038953 - RNA, 19 nt, Homo sapiens
guaugucaccuaucacugu

SEQ ID NO: 1038954 - RNA, 19 nt, Homo sapiens
gcccuccgcagaacucuaa

SEQ ID NO: 1038955 - RNA, 19 nt, Homo sapiens
auucuggccucacugguaa

SEQ ID NO: 1038956 - RNA, 19 nt, Homo sapiens
ugugggauauuugcuggua

SEQ ID NO: 1038957 - RNA, 19 nt, Homo sapiens
ggaugaggaggaacagaug

SEQ ID NO: 1038958 - RNA, 19 nt, Homo sapiens
ucugagaggcuacuuggaa

SEQ ID NO: 1038959 - RNA, 19 nt, Homo sapiens
uaaucaagacgcgcuauga

SEQ ID NO: 1038960 - RNA, 19 nt, Homo sapiens
gucuguaugucaccuauca

SEQ ID NO: 1038961 - RNA, 19 nt, Homo sapiens
aacagaugcccuucuuuaa

SEQ ID NO: 1038962 - RNA, 19 nt, Homo sapiens
gcagcuuuauccacugaag

SEQ ID NO: 1038963 - RNA, 19 nt, Homo sapiens
aaauuucagcugugggaua

SEQ ID NO: 1038964 - RNA, 19 nt, Homo sapiens
cagacugacugaggugaug

SEQ ID NO: 1038965 - RNA, 19 nt, Homo sapiens
caaagccagagaagcugua

SEQ ID NO: 1038966 - RNA, 19 nt, Homo sapiens
aauuucagcugugggauau

SEQ ID NO: 1038967 - RNA, 19 nt, Homo sapiens
cagggaagacuggauguga

SEQ ID NO: 1038968 - RNA, 19 nt, Homo sapiens
gguguuaggagagagcuuu

SEQ ID NO: 1038969 - RNA, 19 nt, Homo sapiens
aaaccaggcagaaauugug

SEQ ID NO: 1038970 - RNA, 19 nt, Homo sapiens
aagagaugauggccaagau

SEQ ID NO: 1038971 - RNA, 19 nt, Homo sapiens
uggcguggacgguguauga

SEQ ID NO: 1038972 - RNA, 19 nt, Homo sapiens
uauaggcgcagacgucaga

SEQ ID NO: 1038973 - RNA, 19 nt, Homo sapiens
ucaccuaucacuguaauca

SEQ ID NO: 1038974 - RNA, 19 nt, Homo sapiens
uuggcacucucuacucuuu

SEQ ID NO: 1038975 - RNA, 19 nt, Homo sapiens
gaaucuacuuuggcacucu

SEQ ID NO: 1038976 - RNA, 19 nt, Homo sapiens
gcugcugcuucuuacuauu

SEQ ID NO: 1038977 - RNA, 19 nt, Homo sapiens
ccugaaguccugaccaaga

SEQ ID NO: 1038978 - RNA, 19 nt, Homo sapiens
uggacuacguggcuucuuc

SEQ ID NO: 1038979 - RNA, 19 nt, Homo sapiens
uggccucacugguaacuca

SEQ ID NO: 1038980 - RNA, 19 nt, Homo sapiens
cuaugagagugggaaauau

SEQ ID NO: 1038981 - RNA, 19 nt, Homo sapiens
caacccuuauuccuauuac

SEQ ID NO: 1038982 - RNA, 19 nt, Homo sapiens
ugggaaauauggcuaugag

SEQ ID NO: 1038983 - RNA, 19 nt, Homo sapiens
uaugagagugggaaauaug

SEQ ID NO: 1038984 - RNA, 19 nt, Homo sapiens
cauugaaagcuguuuggaa

SEQ ID NO: 1038985 - RNA, 19 nt, Homo sapiens
gaugugaggagaggaguca

SEQ ID NO: 1038986 - RNA, 19 nt, Homo sapiens
gcacugcccucuacaaugg

SEQ ID NO: 1038987 - RNA, 19 nt, Homo sapiens
ggaccagccucauguaugu

SEQ ID NO: 1038988 - RNA, 19 nt, Homo sapiens
cauauucacuggccuguuc

SEQ ID NO: 1038989 - RNA, 19 nt, Homo sapiens
ucaacacgcucucggcaaa

SEQ ID NO: 1038990 - RNA, 19 nt, Homo sapiens
ggaagagauuacagggaaa

SEQ ID NO: 1038991 - RNA, 19 nt, Homo sapiens
ggagaaguucgucuacaaa

SEQ ID NO: 1038992 - RNA, 19 nt, Homo sapiens
ccaaagugcugggauuaca

SEQ ID NO: 1038993 - RNA, 19 nt, Homo sapiens
caacacccaaguccucuuu

SEQ ID NO: 1038994 - RNA, 19 nt, Homo sapiens
gauccuuggcuuccucaua

SEQ ID NO: 1038995 - RNA, 19 nt, Homo sapiens
gcauugccuucuucaacuu

SEQ ID NO: 1038996 - RNA, 19 nt, Homo sapiens
gacauggccuggaccaagu

SEQ ID NO: 1038997 - RNA, 19 nt, Homo sapiens
gcauguuccugggagaauu

SEQ ID NO: 1038998 - RNA, 19 nt, Homo sapiens
cagcagcauugccuucuuc

SEQ ID NO: 1038999 - RNA, 19 nt, Homo sapiens
gaggagaaguucgucuaca

SEQ ID NO: 1039000 - RNA, 19 nt, Homo sapiens
gcacgacagucagcacaag

SEQ ID NO: 1039001 - RNA, 19 nt, Homo sapiens
gaagagauuacagggaaau

SEQ ID NO: 1039002 - RNA, 19 nt, Homo sapiens
caucucagccucccaaagu

SEQ ID NO: 1039003 - RNA, 19 nt, Homo sapiens
uggcugaccuccugagcaa

SEQ ID NO: 1039004 - RNA, 19 nt, Homo sapiens
agugaaaccugucccuguu

SEQ ID NO: 1039005 - RNA, 19 nt, Homo sapiens
gcaucagcgucaccaagga

SEQ ID NO: 1039006 - RNA, 19 nt, Homo sapiens
ggcaacaucagcagcauug

SEQ ID NO: 1039007 - RNA, 19 nt, Homo sapiens
aggagaaguucgucuacaa

SEQ ID NO: 1039008 - RNA, 19 nt, Homo sapiens
ucauguauguggcucugaa

SEQ ID NO: 1039009 - RNA, 19 nt, Homo sapiens
gcacugcugggcaacauca

SEQ ID NO: 1039010 - RNA, 19 nt, Homo sapiens
ccagcgcucugugacauga

SEQ ID NO: 1039011 - RNA, 19 nt, Homo sapiens
guugucaucugggcacuga

SEQ ID NO: 1039012 - RNA, 19 nt, Homo sapiens
ggacacuggaggaugcauu

SEQ ID NO: 1039013 - RNA, 19 nt, Homo sapiens
agaaguucgucuacaaaca

SEQ ID NO: 1039014 - RNA, 19 nt, Homo sapiens
gcacaagcucagcgaagug

SEQ ID NO: 1039015 - RNA, 19 nt, Homo sapiens
ggaccaaguaccagcuguu

SEQ ID NO: 1039016 - RNA, 19 nt, Homo sapiens
ggagagcgagcaggagaga

SEQ ID NO: 1039017 - RNA, 19 nt, Homo sapiens
gcaugguguuggacagcuu

SEQ ID NO: 1039018 - RNA, 19 nt, Homo sapiens
gaaguucgucuacaaacac

SEQ ID NO: 1039019 - RNA, 19 nt, Homo sapiens
gcaaggagcacagcuucca

SEQ ID NO: 1039020 - RNA, 19 nt, Homo sapiens
caucauggcccagaucauc

SEQ ID NO: 1039021 - RNA, 19 nt, Homo sapiens
ggagcaaggagcacagcuu

SEQ ID NO: 1039022 - RNA, 19 nt, Homo sapiens
guuaccggcuccaucaaca

SEQ ID NO: 1039023 - RNA, 19 nt, Homo sapiens
gggaccagccucauguaug

SEQ ID NO: 1039024 - RNA, 19 nt, Homo sapiens
ugagcaagcacgacaguca

SEQ ID NO: 1039025 - RNA, 19 nt, Homo sapiens
gagcugcagggcaaucaga

SEQ ID NO: 1039026 - RNA, 19 nt, Homo sapiens
aagcgauccucccaucuca

SEQ ID NO: 1039027 - RNA, 19 nt, Homo sapiens
cacccgcacucccaucaau

SEQ ID NO: 1039028 - RNA, 19 nt, Homo sapiens
gacacuggaggaugcauug

SEQ ID NO: 1039029 - RNA, 19 nt, Homo sapiens
gagaaguucgucuacaaac

SEQ ID NO: 1039030 - RNA, 19 nt, Homo sapiens
cagcauugccuucuucaac

SEQ ID NO: 1039031 - RNA, 19 nt, Homo sapiens
ccacagaagauaacaacac

SEQ ID NO: 1039032 - RNA, 19 nt, Homo sapiens
agauggugcuagaggagaa

SEQ ID NO: 1039033 - RNA, 19 nt, Homo sapiens
gacagggaccagccucaug

SEQ ID NO: 1039034 - RNA, 19 nt, Homo sapiens
gaccaaguaccagcuguuc

SEQ ID NO: 1039035 - RNA, 19 nt, Homo sapiens
caucagcgucaccaaggaa

SEQ ID NO: 1039036 - RNA, 19 nt, Homo sapiens
ucagcagcauugccuucuu

SEQ ID NO: 1039037 - RNA, 19 nt, Homo sapiens
caagcgauccucccaucuc

SEQ ID NO: 1039038 - RNA, 19 nt, Homo sapiens
gggccucuuuggcuuugug

SEQ ID NO: 1039039 - RNA, 19 nt, Homo sapiens
caccugggcaacagaguga

SEQ ID NO: 1039040 - RNA, 19 nt, Homo sapiens
aaagugcugggauuacaga

SEQ ID NO: 1039041 - RNA, 19 nt, Homo sapiens
gggcaacaucagcagcauu

SEQ ID NO: 1039042 - RNA, 19 nt, Homo sapiens
ggggugcagugaucauauu

SEQ ID NO: 1039043 - RNA, 19 nt, Homo sapiens
caacaaccaccaauucuua

SEQ ID NO: 1039044 - RNA, 19 nt, Homo sapiens
gaaaugcagcuuaguauga

SEQ ID NO: 1039045 - RNA, 19 nt, Homo sapiens
ggaguuugguuuacugauu

SEQ ID NO: 1039046 - RNA, 19 nt, Homo sapiens
ggcaauaaauccaagaaau

SEQ ID NO: 1039047 - RNA, 19 nt, Homo sapiens
caacaaagccauagugaag

SEQ ID NO: 1039048 - RNA, 19 nt, Homo sapiens
gaguuugguuuacugauuu

SEQ ID NO: 1039049 - RNA, 19 nt, Homo sapiens
agaaggaacugcugucugu

SEQ ID NO: 1039050 - RNA, 19 nt, Homo sapiens
cuuauucgcugaccaguga

SEQ ID NO: 1039051 - RNA, 19 nt, Homo sapiens
acaaagccauagugaagaa

SEQ ID NO: 1039052 - RNA, 19 nt, Homo sapiens
ccaagaaauugucccaaca

SEQ ID NO: 1039053 - RNA, 19 nt, Homo sapiens
ggaaaggcaauaaauccaa

SEQ ID NO: 1039054 - RNA, 19 nt, Homo sapiens
ggacacagagucagcaaca

SEQ ID NO: 1039055 - RNA, 19 nt, Homo sapiens
uaacaagcacgaugacaga

SEQ ID NO: 1039056 - RNA, 19 nt, Homo sapiens
aaaugcagcuuaguaugaa

SEQ ID NO: 1039057 - RNA, 19 nt, Homo sapiens
ggaaaugcagcuuaguaug

SEQ ID NO: 1039058 - RNA, 19 nt, Homo sapiens
caagcacgaugacagauac

SEQ ID NO: 1039059 - RNA, 19 nt, Homo sapiens
ucaauaacaagcacgauga

SEQ ID NO: 1039060 - RNA, 19 nt, Homo sapiens
acacaccacugccuuccaa

SEQ ID NO: 1039061 - RNA, 19 nt, Homo sapiens
acaacuacagggucaauaa

SEQ ID NO: 1039062 - RNA, 19 nt, Homo sapiens
cagcuuaguaugaauucua

SEQ ID NO: 1039063 - RNA, 19 nt, Homo sapiens
caacacacaagacaucauc

SEQ ID NO: 1039064 - RNA, 19 nt, Homo sapiens
gagaccugauugagauuuc

SEQ ID NO: 1039065 - RNA, 19 nt, Homo sapiens
ugucugcccugaccaacaa

SEQ ID NO: 1039066 - RNA, 19 nt, Homo sapiens
ggaguggaguuugguuuac

SEQ ID NO: 1039067 - RNA, 19 nt, Homo sapiens
cagcaggaguggaguuugg

SEQ ID NO: 1039068 - RNA, 19 nt, Homo sapiens
cgugggagauggcuaugug

SEQ ID NO: 1039069 - RNA, 19 nt, Homo sapiens
acaagcacgaugacagaua

SEQ ID NO: 1039070 - RNA, 19 nt, Homo sapiens
gaaggaaggauggcuuugg

SEQ ID NO: 1039071 - RNA, 19 nt, Homo sapiens
ggagaccugauugagauuu

SEQ ID NO: 1039072 - RNA, 19 nt, Homo sapiens
ccaacaaccaccaauucuu

SEQ ID NO: 1039073 - RNA, 19 nt, Homo sapiens
gaagaaggaacugcugucu

SEQ ID NO: 1039074 - RNA, 19 nt, Homo sapiens
ccaacaaagccauagugaa

SEQ ID NO: 1039075 - RNA, 19 nt, Homo sapiens
uuggagaccugauugagau

SEQ ID NO: 1039076 - RNA, 19 nt, Homo sapiens
gcaagcgggaaaggcaaua

SEQ ID NO: 1039077 - RNA, 19 nt, Homo sapiens
gcacgaugacagauacaca

SEQ ID NO: 1039078 - RNA, 19 nt, Homo sapiens
gaccaacaaagccauagug

SEQ ID NO: 1039079 - RNA, 19 nt, Homo sapiens
uaaaagcacaggaaaaugu

SEQ ID NO: 1039080 - RNA, 19 nt, Homo sapiens
gccagaagcaagcgggaaa

SEQ ID NO: 1039081 - RNA, 19 nt, Homo sapiens
cagcaacacacaagacauc

SEQ ID NO: 1039082 - RNA, 19 nt, Homo sapiens
acuacagggucaauaacaa

SEQ ID NO: 1039083 - RNA, 19 nt, Homo sapiens
auuuaaggcuggacacaga

SEQ ID NO: 1039084 - RNA, 19 nt, Homo sapiens
uggaaaugcagcuuaguau

SEQ ID NO: 1039085 - RNA, 19 nt, Homo sapiens
aggaguggaguuugguuua

SEQ ID NO: 1039086 - RNA, 19 nt, Homo sapiens
gcgggaaaggcaauaaauc

SEQ ID NO: 1039087 - RNA, 19 nt, Homo sapiens
gagacuuggagaccugauu

SEQ ID NO: 1039088 - RNA, 19 nt, Homo sapiens
gacaacuacagggucaaua

SEQ ID NO: 1039089 - RNA, 19 nt, Homo sapiens
uuggaaaugcagcuuagua

SEQ ID NO: 1039090 - RNA, 19 nt, Homo sapiens
gggaaaggcaauaaaucca

SEQ ID NO: 1039091 - RNA, 19 nt, Homo sapiens
acacagagucagcaacaca

SEQ ID NO: 1039092 - RNA, 19 nt, Homo sapiens
ccacugccuuccaacaaaa

SEQ ID NO: 1039093 - RNA, 19 nt, Homo sapiens
gcaggaguggaguuugguu

SEQ ID NO: 1039094 - RNA, 19 nt, Homo sapiens
caagcgggaaaggcaauaa

SEQ ID NO: 1039095 - RNA, 19 nt, Homo sapiens
gcgagcacuucgugaacca

SEQ ID NO: 1039096 - RNA, 19 nt, Homo sapiens
accacugccuuccaacaaa

SEQ ID NO: 1039097 - RNA, 19 nt, Homo sapiens
gaguggaguuugguuuacu

SEQ ID NO: 1039098 - RNA, 19 nt, Homo sapiens
caggaguggaguuugguuu

SEQ ID NO: 1039099 - RNA, 19 nt, Homo sapiens
ggauccugcuggccagaag

SEQ ID NO: 1039100 - RNA, 19 nt, Homo sapiens
caagcgggcagaggaguug

SEQ ID NO: 1039101 - RNA, 19 nt, Homo sapiens
caacuacagggucaauaac

SEQ ID NO: 1039102 - RNA, 19 nt, Homo sapiens
agacuuggagaccugauug

SEQ ID NO: 1039103 - RNA, 19 nt, Homo sapiens
ugacaacugcgagcacuuc

SEQ ID NO: 1039104 - RNA, 19 nt, Homo sapiens
cuacgugggagauggcuau

SEQ ID NO: 1039105 - RNA, 19 nt, Homo sapiens
caccacugccuuccaacaa

SEQ ID NO: 1039106 - RNA, 19 nt, Homo sapiens
ggacugagcuguaagaaca

SEQ ID NO: 1039107 - RNA, 19 nt, Homo sapiens
ggacucaucuuuagcguuu

SEQ ID NO: 1039108 - RNA, 19 nt, Homo sapiens
gaaaucacccguagcuuua

SEQ ID NO: 1039109 - RNA, 19 nt, Homo sapiens
gcagugagcaguaaucuaa

SEQ ID NO: 1039110 - RNA, 19 nt, Homo sapiens
caaauucucugaggacuaa

SEQ ID NO: 1039111 - RNA, 19 nt, Homo sapiens
guaaacugcucuuagcuaa

SEQ ID NO: 1039112 - RNA, 19 nt, Homo sapiens
gcacuuagauggcccuguu

SEQ ID NO: 1039113 - RNA, 19 nt, Homo sapiens
ggaaaucacccguagcuuu

SEQ ID NO: 1039114 - RNA, 19 nt, Homo sapiens
gagaaaggaugaaguaucu

SEQ ID NO: 1039115 - RNA, 19 nt, Homo sapiens
caagacauguggaaccaua

SEQ ID NO: 1039116 - RNA, 19 nt, Homo sapiens
gcccagagaugcauucauu

SEQ ID NO: 1039117 - RNA, 19 nt, Homo sapiens
ggacuuaugagcuauuuaa

SEQ ID NO: 1039118 - RNA, 19 nt, Homo sapiens
gagaugcauucauuucuuu

SEQ ID NO: 1039119 - RNA, 19 nt, Homo sapiens
gagaagagacuaucaagau

SEQ ID NO: 1039120 - RNA, 19 nt, Homo sapiens
gaaccgagaugggacuuau

SEQ ID NO: 1039121 - RNA, 19 nt, Homo sapiens
gaauucagguuacacuguu

SEQ ID NO: 1039122 - RNA, 19 nt, Homo sapiens
acuaauauccugcaaguua

SEQ ID NO: 1039123 - RNA, 19 nt, Homo sapiens
ucucagacuuccuaaauuu

SEQ ID NO: 1039124 - RNA, 19 nt, Homo sapiens
ggaagugggaaucuuauuu

SEQ ID NO: 1039125 - RNA, 19 nt, Homo sapiens
cuaucaagaucuccacuua

SEQ ID NO: 1039126 - RNA, 19 nt, Homo sapiens
uaaaugcccuaaaguggaa

SEQ ID NO: 1039127 - RNA, 19 nt, Homo sapiens
ccacauuccucagucauuu

SEQ ID NO: 1039128 - RNA, 19 nt, Homo sapiens
ccaguuagguugccauuca

SEQ ID NO: 1039129 - RNA, 19 nt, Homo sapiens
gagcaguaaucuaaggaaa

SEQ ID NO: 1039130 - RNA, 19 nt, Homo sapiens
gaggagaaaggaugaagua

SEQ ID NO: 1039131 - RNA, 19 nt, Homo sapiens
gaagugggaaucuuauuug

SEQ ID NO: 1039132 - RNA, 19 nt, Homo sapiens
gagaugcccuuggaaauca

SEQ ID NO: 1039133 - RNA, 19 nt, Homo sapiens
guggucagcuguuagauga

SEQ ID NO: 1039134 - RNA, 19 nt, Homo sapiens
ugaaaucgcacaagucaaa

SEQ ID NO: 1039135 - RNA, 19 nt, Homo sapiens
guagaaagcauagcagaaa

SEQ ID NO: 1039136 - RNA, 19 nt, Homo sapiens
ccauacagcucaaacuuca

SEQ ID NO: 1039137 - RNA, 19 nt, Homo sapiens
cuaauauccugcaaguuaa

SEQ ID NO: 1039138 - RNA, 19 nt, Homo sapiens
gaagagcucgguccugaau

SEQ ID NO: 1039139 - RNA, 19 nt, Homo sapiens
gcaagcagccuaguguuga

SEQ ID NO: 1039140 - RNA, 19 nt, Homo sapiens
gccaacaccuuucaucauc

SEQ ID NO: 1039141 - RNA, 19 nt, Homo sapiens
ucacuaauauccugcaagu

SEQ ID NO: 1039142 - RNA, 19 nt, Homo sapiens
guuaagcaguuaucauuag

SEQ ID NO: 1039143 - RNA, 19 nt, Homo sapiens
uagcuaagaugcaaauucu

SEQ ID NO: 1039144 - RNA, 19 nt, Homo sapiens
gcacucagccauacaccaa

SEQ ID NO: 1039145 - RNA, 19 nt, Homo sapiens
gcagaaagucaguggcaaa

SEQ ID NO: 1039146 - RNA, 19 nt, Homo sapiens
gaaggaggaggcagaaugu

SEQ ID NO: 1039147 - RNA, 19 nt, Homo sapiens
ccugaaagcugccacucaa

SEQ ID NO: 1039148 - RNA, 19 nt, Homo sapiens
ggagaaaggaugaaguauc

SEQ ID NO: 1039149 - RNA, 19 nt, Homo sapiens
cagcuuauuuuccuucuua

SEQ ID NO: 1039150 - RNA, 19 nt, Homo sapiens
ucacagaacgcauccauca

SEQ ID NO: 1039151 - RNA, 19 nt, Homo sapiens
gacacuggcucaggaauuc

SEQ ID NO: 1039152 - RNA, 19 nt, Homo sapiens
gguaaacugcucuuagcua

SEQ ID NO: 1039153 - RNA, 19 nt, Homo sapiens
gcagaagcuuugccauugg

SEQ ID NO: 1039154 - RNA, 19 nt, Homo sapiens
ccacuauuacuuucccuua

SEQ ID NO: 1039155 - RNA, 19 nt, Homo sapiens
ugugguugcuuccucguua

SEQ ID NO: 1039156 - RNA, 19 nt, Homo sapiens
ccagcuuucuuaucugauu

SEQ ID NO: 1039157 - RNA, 19 nt, Homo sapiens
gguuaagcaguuaucauua

SEQ ID NO: 1039158 - RNA, 19 nt, Homo sapiens
ggguuaagcaguuaucauu

SEQ ID NO: 1039159 - RNA, 19 nt, Homo sapiens
caagaugcagugagcagua

SEQ ID NO: 1039160 - RNA, 19 nt, Homo sapiens
gcuaagaugcaaauucuca

SEQ ID NO: 1039161 - RNA, 19 nt, Homo sapiens
ggaaguagaaagcauagca

SEQ ID NO: 1039162 - RNA, 19 nt, Homo sapiens
gcccuaaaguggaaguaga

SEQ ID NO: 1039163 - RNA, 19 nt, Homo sapiens
auacuuggcauaucacuaa

SEQ ID NO: 1039164 - RNA, 19 nt, Homo sapiens
caagcagccuaguguugaa

SEQ ID NO: 1039165 - RNA, 19 nt, Homo sapiens
gaacgcauccaucaaacca

SEQ ID NO: 1039166 - RNA, 19 nt, Homo sapiens
caaagaagaggagaaagga

SEQ ID NO: 1039167 - RNA, 19 nt, Homo sapiens
gaagagacuaucaagaucu

SEQ ID NO: 1039168 - RNA, 19 nt, Homo sapiens
gguuagggcagaauguuaa

SEQ ID NO: 1039169 - RNA, 19 nt, Homo sapiens
ccagagaugcccuuggaaa

SEQ ID NO: 1039170 - RNA, 19 nt, Homo sapiens
acagaacgcauccaucaaa

SEQ ID NO: 1039171 - RNA, 19 nt, Homo sapiens
gaagagagaagagacuauc

SEQ ID NO: 1039172 - RNA, 19 nt, Homo sapiens
gcuguuagaugaggcacaa

SEQ ID NO: 1039173 - RNA, 19 nt, Homo sapiens
ggccuguggucagcuguua

SEQ ID NO: 1039174 - RNA, 19 nt, Homo sapiens
agagaugcauucauuucuu

SEQ ID NO: 1039175 - RNA, 19 nt, Homo sapiens
caaaugccuccaaggauga

SEQ ID NO: 1039176 - RNA, 19 nt, Homo sapiens
agacaacaauccagacagu

SEQ ID NO: 1039177 - RNA, 19 nt, Homo sapiens
cagccacgcucuuuauucu

SEQ ID NO: 1039178 - RNA, 19 nt, Homo sapiens
ucgaguggaucccagauau

SEQ ID NO: 1039179 - RNA, 19 nt, Homo sapiens
caacaccuuucaucaucga

SEQ ID NO: 1039180 - RNA, 19 nt, Homo sapiens
agaugggacuuaugagcua

SEQ ID NO: 1039181 - RNA, 19 nt, Homo sapiens
agaagagacuaucaagauc

SEQ ID NO: 1039182 - RNA, 19 nt, Homo sapiens
caacaguaucugcuuguga

SEQ ID NO: 1039183 - RNA, 19 nt, Homo sapiens
gcucaggaauucucagacu

SEQ ID NO: 1039184 - RNA, 19 nt, Homo sapiens
gccacgcucuuuauucugu

SEQ ID NO: 1039185 - RNA, 19 nt, Homo sapiens
gaaaguuaacacccugguu

SEQ ID NO: 1039186 - RNA, 19 nt, Homo sapiens
cacuauuacuuucccuuaa

SEQ ID NO: 1039187 - RNA, 19 nt, Homo sapiens
gagccaacaccuuucauca

SEQ ID NO: 1039188 - RNA, 19 nt, Homo sapiens
uagggaagugggaaucuua

SEQ ID NO: 1039189 - RNA, 19 nt, Homo sapiens
gaaagaaaaccagcuuauu

SEQ ID NO: 1039190 - RNA, 19 nt, Homo sapiens
guucacuacugccucaaga

SEQ ID NO: 1039191 - RNA, 19 nt, Homo sapiens
caagccagaagcacaguuu

SEQ ID NO: 1039192 - RNA, 19 nt, Homo sapiens
gagcugcggaucaaguuug

SEQ ID NO: 1039193 - RNA, 19 nt, Homo sapiens
uggcaaaccagaaccauug

SEQ ID NO: 1039194 - RNA, 19 nt, Homo sapiens
ccagagaugcauucauuuc

SEQ ID NO: 1039195 - RNA, 19 nt, Homo sapiens
gcucgguccugaaugcaau

SEQ ID NO: 1039196 - RNA, 19 nt, Homo sapiens
gcuguaagaacaagacaug

SEQ ID NO: 1039197 - RNA, 19 nt, Homo sapiens
gcagaauguuaaagaccau

SEQ ID NO: 1039198 - RNA, 19 nt, Homo sapiens
guacagucuucauuaugca

SEQ ID NO: 1039199 - RNA, 19 nt, Homo sapiens
ccauugguguuccacauuc

SEQ ID NO: 1039200 - RNA, 19 nt, Homo sapiens
caaauucucagugcuuuca

SEQ ID NO: 1039201 - RNA, 19 nt, Homo sapiens
gugagucuacugccucuaa

SEQ ID NO: 1039202 - RNA, 19 nt, Homo sapiens
gaagcugucaaaaucauua

SEQ ID NO: 1039203 - RNA, 19 nt, Homo sapiens
cagcuuucuuaucugauuu

SEQ ID NO: 1039204 - RNA, 19 nt, Homo sapiens
cauuaugcauugggcagua

SEQ ID NO: 1039205 - RNA, 19 nt, Homo sapiens
gagagaagagacuaucaag

SEQ ID NO: 1039206 - RNA, 19 nt, Homo sapiens
gcaaguauaugaagaucua

SEQ ID NO: 1039207 - RNA, 19 nt, Homo sapiens
ggaaagugcugaggaaauu

SEQ ID NO: 1039208 - RNA, 19 nt, Homo sapiens
aaacaacacuggcuaagaa

SEQ ID NO: 1039209 - RNA, 19 nt, Homo sapiens
ugacagccauuguuucaua

SEQ ID NO: 1039210 - RNA, 19 nt, Homo sapiens
agaaacaccucccaaauug

SEQ ID NO: 1039211 - RNA, 19 nt, Homo sapiens
gagcucagaguaagaaaua

SEQ ID NO: 1039212 - RNA, 19 nt, Homo sapiens
gaagcuauuuccugacuau

SEQ ID NO: 1039213 - RNA, 19 nt, Homo sapiens
uuaagaaccuucaccaaga

SEQ ID NO: 1039214 - RNA, 19 nt, Homo sapiens
gcaagacacucugugguau

SEQ ID NO: 1039215 - RNA, 19 nt, Homo sapiens
caacacuggcuaagaauuu

SEQ ID NO: 1039216 - RNA, 19 nt, Homo sapiens
gcaagugacagcauaaaga

SEQ ID NO: 1039217 - RNA, 19 nt, Homo sapiens
cagaaacaccucccaaauu

SEQ ID NO: 1039218 - RNA, 19 nt, Homo sapiens
gcauaaagacggaacacaa

SEQ ID NO: 1039219 - RNA, 19 nt, Homo sapiens
gcaguacgaugugcuugaa

SEQ ID NO: 1039220 - RNA, 19 nt, Homo sapiens
gcagaaacaccucccaaau

SEQ ID NO: 1039221 - RNA, 19 nt, Homo sapiens
gccauuguuucauauguuu

SEQ ID NO: 1039222 - RNA, 19 nt, Homo sapiens
ccaggaaagugcugaggaa

SEQ ID NO: 1039223 - RNA, 19 nt, Homo sapiens
uaacuggagcucagaguaa

SEQ ID NO: 1039224 - RNA, 19 nt, Homo sapiens
gacaagaaaugcaggacau

SEQ ID NO: 1039225 - RNA, 19 nt, Homo sapiens
ggacaucacaugggaaguu

SEQ ID NO: 1039226 - RNA, 19 nt, Homo sapiens
cuaagaauuugcagaaaca

SEQ ID NO: 1039227 - RNA, 19 nt, Homo sapiens
gcuaagaauuugcagaaac

SEQ ID NO: 1039228 - RNA, 19 nt, Homo sapiens
uaagaaccuucaccaagau

SEQ ID NO: 1039229 - RNA, 19 nt, Homo sapiens
gacuguaccuuagcaaguu

SEQ ID NO: 1039230 - RNA, 19 nt, Homo sapiens
gcucagaguaagaaauaaa

SEQ ID NO: 1039231 - RNA, 19 nt, Homo sapiens
uacaagaacuagcaaagca

SEQ ID NO: 1039232 - RNA, 19 nt, Homo sapiens
ggaaagcgcaagacacucu

SEQ ID NO: 1039233 - RNA, 19 nt, Homo sapiens
ugagauagagacagauaaa

SEQ ID NO: 1039234 - RNA, 19 nt, Homo sapiens
ccaaggaguaauuuaagaa

SEQ ID NO: 1039235 - RNA, 19 nt, Homo sapiens
caagaacuagcaaagcaaa

SEQ ID NO: 1039236 - RNA, 19 nt, Homo sapiens
gacaucacaugggaaguug

SEQ ID NO: 1039237 - RNA, 19 nt, Homo sapiens
gcccauguaucuaaaguac

SEQ ID NO: 1039238 - RNA, 19 nt, Homo sapiens
gaagaucuaauacaagaac

SEQ ID NO: 1039239 - RNA, 19 nt, Homo sapiens
ggaguaauuuaagaaccuu

SEQ ID NO: 1039240 - RNA, 19 nt, Homo sapiens
ggacuguaccuuagcaagu

SEQ ID NO: 1039241 - RNA, 19 nt, Homo sapiens
gcacaugguuuucccaaca

SEQ ID NO: 1039242 - RNA, 19 nt, Homo sapiens
gacagccauuguuucauau

SEQ ID NO: 1039243 - RNA, 19 nt, Homo sapiens
ggaguacaagggucuauca

SEQ ID NO: 1039244 - RNA, 19 nt, Homo sapiens
gaagugaauuaggaaacuc

SEQ ID NO: 1039245 - RNA, 19 nt, Homo sapiens
cuaaaguacagacaagaaa

SEQ ID NO: 1039246 - RNA, 19 nt, Homo sapiens
guaccuggauggaacaaaa

SEQ ID NO: 1039247 - RNA, 19 nt, Homo sapiens
uugaagcacuuaacaugga

SEQ ID NO: 1039248 - RNA, 19 nt, Homo sapiens
ccaaauugcagugucauau

SEQ ID NO: 1039249 - RNA, 19 nt, Homo sapiens
agacggaacacaacaaauc

SEQ ID NO: 1039250 - RNA, 19 nt, Homo sapiens
guuugcaagugacagcaua

SEQ ID NO: 1039251 - RNA, 19 nt, Homo sapiens
uaucuaaaguacagacaag

SEQ ID NO: 1039252 - RNA, 19 nt, Homo sapiens
cuaccuggcaucccucuaa

SEQ ID NO: 1039253 - RNA, 19 nt, Homo sapiens
gguaucaacagaccaggaa

SEQ ID NO: 1039254 - RNA, 19 nt, Homo sapiens
ugaagcacuuaacauggaa

SEQ ID NO: 1039255 - RNA, 19 nt, Homo sapiens
aaauugcagugucauaucu

SEQ ID NO: 1039256 - RNA, 19 nt, Homo sapiens
ccagggagcgcauagauac

SEQ ID NO: 1039257 - RNA, 19 nt, Homo sapiens
uccaaggaguaauuuaaga

SEQ ID NO: 1039258 - RNA, 19 nt, Homo sapiens
aaagacggaacacaacaaa

SEQ ID NO: 1039259 - RNA, 19 nt, Homo sapiens
cgcaagacacucuguggua

SEQ ID NO: 1039260 - RNA, 19 nt, Homo sapiens
caaauugcagugucauauc

SEQ ID NO: 1039261 - RNA, 19 nt, Homo sapiens
gaaucaguggugugacaaa

SEQ ID NO: 1039262 - RNA, 19 nt, Homo sapiens
uaaagacggaacacaacaa

SEQ ID NO: 1039263 - RNA, 19 nt, Homo sapiens
gaucuaauacaagaacuag

SEQ ID NO: 1039264 - RNA, 19 nt, Homo sapiens
uagaagcuauuuccugacu

SEQ ID NO: 1039265 - RNA, 19 nt, Homo sapiens
ucaggaugauuucuucaag

SEQ ID NO: 1039266 - RNA, 19 nt, Homo sapiens
cagccauuguuucauaugu

SEQ ID NO: 1039267 - RNA, 19 nt, Homo sapiens
caagaaaugcaggacauca

SEQ ID NO: 1039268 - RNA, 19 nt, Homo sapiens
gaaccuucaccaagauaca

SEQ ID NO: 1039269 - RNA, 19 nt, Homo sapiens
ggcuaagaauuugcagaaa

SEQ ID NO: 1039270 - RNA, 19 nt, Homo sapiens
uggaaucaguggugugaca

SEQ ID NO: 1039271 - RNA, 19 nt, Homo sapiens
gcaaaacaacacuggcuaa

SEQ ID NO: 1039272 - RNA, 19 nt, Homo sapiens
ugaagugaauuaggaaacu

SEQ ID NO: 1039273 - RNA, 19 nt, Homo sapiens
uagcaaagcaaaaguguuu

SEQ ID NO: 1039274 - RNA, 19 nt, Homo sapiens
aaaguacagacaagaaaug

SEQ ID NO: 1039275 - RNA, 19 nt, Homo sapiens
gacaaacaguggcaaaaca

SEQ ID NO: 1039276 - RNA, 19 nt, Homo sapiens
caggaaauauuaggaagcu

SEQ ID NO: 1039277 - RNA, 19 nt, Homo sapiens
uggcuaagaauuugcagaa

SEQ ID NO: 1039278 - RNA, 19 nt, Homo sapiens
aaacaccucccaaauugca

SEQ ID NO: 1039279 - RNA, 19 nt, Homo sapiens
ugacuauuccauaugaaga

SEQ ID NO: 1039280 - RNA, 19 nt, Homo sapiens
gcuauuuccugacuauucc

SEQ ID NO: 1039281 - RNA, 19 nt, Homo sapiens
cuaacuggagcucagagua

SEQ ID NO: 1039282 - RNA, 19 nt, Homo sapiens
gaaaugcaggacaucacau

SEQ ID NO: 1039283 - RNA, 19 nt, Homo sapiens
gacuauuccauaugaagaa

SEQ ID NO: 1039284 - RNA, 19 nt, Homo sapiens
gaaagugcugaggaaauuc

SEQ ID NO: 1039285 - RNA, 19 nt, Homo sapiens
aagacacucugugguauca

SEQ ID NO: 1039286 - RNA, 19 nt, Homo sapiens
gcuuggcugucgccucuuc

SEQ ID NO: 1039287 - RNA, 19 nt, Homo sapiens
gcugugauuuucaaagcua

SEQ ID NO: 1039288 - RNA, 19 nt, Homo sapiens
ucuaaaguacagacaagaa

SEQ ID NO: 1039289 - RNA, 19 nt, Homo sapiens
caagugacagcauaaagac

SEQ ID NO: 1039290 - RNA, 19 nt, Homo sapiens
auacuuugauggccaugug

SEQ ID NO: 1039291 - RNA, 19 nt, Homo sapiens
ggauggaaagcgcaagaca

SEQ ID NO: 1039292 - RNA, 19 nt, Homo sapiens
ggagcucagaguaagaaau

SEQ ID NO: 1039293 - RNA, 19 nt, Homo sapiens
gaaacaccucccaaauugc

SEQ ID NO: 1039294 - RNA, 19 nt, Homo sapiens
cauaaagacggaacacaac

SEQ ID NO: 1039295 - RNA, 19 nt, Homo sapiens
ggaaucaguggugugacaa

SEQ ID NO: 1039296 - RNA, 19 nt, Homo sapiens
gacacucugugguaucaac

SEQ ID NO: 1039297 - RNA, 19 nt, Homo sapiens
ucaguggugugacaaacag

SEQ ID NO: 1039298 - RNA, 19 nt, Homo sapiens
uccugacuauuccauauga

SEQ ID NO: 1039299 - RNA, 19 nt, Homo sapiens
uuuccugacuauuccauau

SEQ ID NO: 1039300 - RNA, 19 nt, Homo sapiens
ucuaauacaagaacuagca

SEQ ID NO: 1039301 - RNA, 19 nt, Homo sapiens
ggaaguuguguaccuggau

SEQ ID NO: 1039302 - RNA, 19 nt, Homo sapiens
caugggaaguuguguaccu

SEQ ID NO: 1039303 - RNA, 19 nt, Homo sapiens
agaagcuauuuccugacua

SEQ ID NO: 1039304 - RNA, 19 nt, Homo sapiens
caagacacucugugguauc

SEQ ID NO: 1039305 - RNA, 19 nt, Homo sapiens
ucuccacuuucugaacaua

SEQ ID NO: 1039306 - RNA, 19 nt, Homo sapiens
caaaguaggucaguagguu

SEQ ID NO: 1039307 - RNA, 19 nt, Homo sapiens
gagcaaagcauuucuccuu

SEQ ID NO: 1039308 - RNA, 19 nt, Homo sapiens
gagcugaaccggucucuuc

SEQ ID NO: 1039309 - RNA, 19 nt, Homo sapiens
gcaacggccucuuccucuu

SEQ ID NO: 1039310 - RNA, 19 nt, Homo sapiens
ggccuguggucccaaagua

SEQ ID NO: 1039311 - RNA, 19 nt, Homo sapiens
ggacagcaacggccucuuc

SEQ ID NO: 1039312 - RNA, 19 nt, Homo sapiens
ugaaguaaauacagucaca

SEQ ID NO: 1039313 - RNA, 19 nt, Homo sapiens
gaagggacccacaggaagu

SEQ ID NO: 1039314 - RNA, 19 nt, Homo sapiens
gaguggcucuguccuguca

SEQ ID NO: 1039315 - RNA, 19 nt, Homo sapiens
gcaucugaauacaggagua

SEQ ID NO: 1039316 - RNA, 19 nt, Homo sapiens
ugaccacacucccuacuca

SEQ ID NO: 1039317 - RNA, 19 nt, Homo sapiens
gggaagggacccacaggaa

SEQ ID NO: 1039318 - RNA, 19 nt, Homo sapiens
gagcuccucucaucaaagc

SEQ ID NO: 1039319 - RNA, 19 nt, Homo sapiens
ccagagaccgagagcauga

SEQ ID NO: 1039320 - RNA, 19 nt, Homo sapiens
gaaguacccgggugucauc

SEQ ID NO: 1039321 - RNA, 19 nt, Homo sapiens
gcucuacuauuaugaugag

SEQ ID NO: 1039322 - RNA, 19 nt, Homo sapiens
acucagggcuagucuguuc

SEQ ID NO: 1039323 - RNA, 19 nt, Homo sapiens
caucacgcccuuucucuug

SEQ ID NO: 1039324 - RNA, 19 nt, Homo sapiens
ucccggacaucuucuggua

SEQ ID NO: 1039325 - RNA, 19 nt, Homo sapiens
ccauugccaugcugguauu

SEQ ID NO: 1039326 - RNA, 19 nt, Homo sapiens
gcaggugacccuccucuac

SEQ ID NO: 1039327 - RNA, 19 nt, Homo sapiens
ccacccugacccuacauua

SEQ ID NO: 1039328 - RNA, 19 nt, Homo sapiens
cauggagggcaucugaaua

SEQ ID NO: 1039329 - RNA, 19 nt, Homo sapiens
gcuguggaaugacccuguu

SEQ ID NO: 1039330 - RNA, 19 nt, Homo sapiens
ucgccuggcuguggaauga

SEQ ID NO: 1039331 - RNA, 19 nt, Homo sapiens
gaggggaccugguguguca

SEQ ID NO: 1039332 - RNA, 19 nt, Homo sapiens
gccaaaggcccugagcaaa

SEQ ID NO: 1039333 - RNA, 19 nt, Homo sapiens
guacccgggugucaucuac

SEQ ID NO: 1039334 - RNA, 19 nt, Homo sapiens
gcuuugagcgccugcauuc

SEQ ID NO: 1039335 - RNA, 19 nt, Homo sapiens
gcuguugagcaaagcauuu

SEQ ID NO: 1039336 - RNA, 19 nt, Homo sapiens
ggccauggagggcaucuga

SEQ ID NO: 1039337 - RNA, 19 nt, Homo sapiens
caucaucaucuucaucaug

SEQ ID NO: 1039338 - RNA, 19 nt, Homo sapiens
gaccucugguucuacuuca

SEQ ID NO: 1039339 - RNA, 19 nt, Homo sapiens
ccaaaggcccugagcaaaa

SEQ ID NO: 1039340 - RNA, 19 nt, Homo sapiens
ggccucauuugcacuagau

SEQ ID NO: 1039341 - RNA, 19 nt, Homo sapiens
caacggccucuuccucuuc

SEQ ID NO: 1039342 - RNA, 19 nt, Homo sapiens
gaucuucauccucuucauc

SEQ ID NO: 1039343 - RNA, 19 nt, Homo sapiens
gugcgcagagugcaucauu

SEQ ID NO: 1039344 - RNA, 19 nt, Homo sapiens
gagcaucaucaucuucauc

SEQ ID NO: 1039345 - RNA, 19 nt, Homo sapiens
ugacccuccucuacccaaa

SEQ ID NO: 1039346 - RNA, 19 nt, Homo sapiens
gcgcagagugcaucauuuu

SEQ ID NO: 1039347 - RNA, 19 nt, Homo sapiens
guauaugugugcgcagagu

SEQ ID NO: 1039348 - RNA, 19 nt, Homo sapiens
gggccucauuugcacuaga

SEQ ID NO: 1039349 - RNA, 19 nt, Homo sapiens
uacuguggcuguugagcaa

SEQ ID NO: 1039350 - RNA, 19 nt, Homo sapiens
caaaggcccugagcaaaag

SEQ ID NO: 1039351 - RNA, 19 nt, Homo sapiens
guacgugagcaucaucauc

SEQ ID NO: 1039352 - RNA, 19 nt, Homo sapiens
ggcuuugccuugacagagu

SEQ ID NO: 1039353 - RNA, 19 nt, Homo sapiens
guucuucccggacaucuuc

SEQ ID NO: 1039354 - RNA, 19 nt, Homo sapiens
aggaucggauucuguuuua

SEQ ID NO: 1039355 - RNA, 19 nt, Homo sapiens
caaguuucuguuugauuug

SEQ ID NO: 1039356 - RNA, 19 nt, Homo sapiens
ccauggagggcaucugaau

SEQ ID NO: 1039357 - RNA, 19 nt, Homo sapiens
gcugaucgacuccuuugag

SEQ ID NO: 1039358 - RNA, 19 nt, Homo sapiens
acagaguggcccaggguuu

SEQ ID NO: 1039359 - RNA, 19 nt, Homo sapiens
gcagagugcaucauuuuca

SEQ ID NO: 1039360 - RNA, 19 nt, Homo sapiens
guggguguguaaccagaga

SEQ ID NO: 1039361 - RNA, 19 nt, Homo sapiens
cuacucagggcuagucugu

SEQ ID NO: 1039362 - RNA, 19 nt, Homo sapiens
uacuauuuccgucaaguuu

SEQ ID NO: 1039363 - RNA, 19 nt, Homo sapiens
ggacccacaggaagucaca

SEQ ID NO: 1039364 - RNA, 19 nt, Homo sapiens
cuauuuccgucaaguuucu

SEQ ID NO: 1039365 - RNA, 19 nt, Homo sapiens
agacgcugaucgacuccuu

SEQ ID NO: 1039366 - RNA, 19 nt, Homo sapiens
gugagcaucaucaucuuca

SEQ ID NO: 1039367 - RNA, 19 nt, Homo sapiens
gaagaaagauuccaaauga

SEQ ID NO: 1039368 - RNA, 19 nt, Homo sapiens
guaaagauguggaaaguua

SEQ ID NO: 1039369 - RNA, 19 nt, Homo sapiens
gagcuaccaucaauaauga

SEQ ID NO: 1039370 - RNA, 19 nt, Homo sapiens
aaaguuaccuccagccuaa

SEQ ID NO: 1039371 - RNA, 19 nt, Homo sapiens
uaaugacgauuccaaguuu

SEQ ID NO: 1039372 - RNA, 19 nt, Homo sapiens
aaacagaucuugacugcau

SEQ ID NO: 1039373 - RNA, 19 nt, Homo sapiens
ccacagaucauauuaaagu

SEQ ID NO: 1039374 - RNA, 19 nt, Homo sapiens
gaagaagaaagauuccaaa

SEQ ID NO: 1039375 - RNA, 19 nt, Homo sapiens
agacgcagguggaacguaa

SEQ ID NO: 1039376 - RNA, 19 nt, Homo sapiens
ggagcuaccaucaauaaug

SEQ ID NO: 1039377 - RNA, 19 nt, Homo sapiens
guaaugacgauuccaaguu

SEQ ID NO: 1039378 - RNA, 19 nt, Homo sapiens
agaggacgcuacacuagaa

SEQ ID NO: 1039379 - RNA, 19 nt, Homo sapiens
uaaagaggccacagguaaa

SEQ ID NO: 1039380 - RNA, 19 nt, Homo sapiens
auaaagaggccacagguaa

SEQ ID NO: 1039381 - RNA, 19 nt, Homo sapiens
gcaaggagccacagaucau

SEQ ID NO: 1039382 - RNA, 19 nt, Homo sapiens
agaagaaacgcuagugaaa

SEQ ID NO: 1039383 - RNA, 19 nt, Homo sapiens
uggcagcucugaagaacaa

SEQ ID NO: 1039384 - RNA, 19 nt, Homo sapiens
ggagccacagaucauauua

SEQ ID NO: 1039385 - RNA, 19 nt, Homo sapiens
agccacagaucauauuaaa

SEQ ID NO: 1039386 - RNA, 19 nt, Homo sapiens
gcagaggacgcuacacuag

SEQ ID NO: 1039387 - RNA, 19 nt, Homo sapiens
uggccgaacugaacacuug

SEQ ID NO: 1039388 - RNA, 19 nt, Homo sapiens
gcucucagacacaaauaaa

SEQ ID NO: 1039389 - RNA, 19 nt, Homo sapiens
agaagaagaagaaagauuc

SEQ ID NO: 1039390 - RNA, 19 nt, Homo sapiens
gagccacagaucauauuaa

SEQ ID NO: 1039391 - RNA, 19 nt, Homo sapiens
caaggagccacagaucaua

SEQ ID NO: 1039392 - RNA, 19 nt, Homo sapiens
ggaguaaugacgauuccaa

SEQ ID NO: 1039393 - RNA, 19 nt, Homo sapiens
caaggccucugcucaggau

SEQ ID NO: 1039394 - RNA, 19 nt, Homo sapiens
gaggaaaaguccaaaaucu

SEQ ID NO: 1039395 - RNA, 19 nt, Homo sapiens
acaacuggauugcccauca

SEQ ID NO: 1039396 - RNA, 19 nt, Homo sapiens
acucggagcuaccaucaau

SEQ ID NO: 1039397 - RNA, 19 nt, Homo sapiens
gaacacugccuggaguaau

SEQ ID NO: 1039398 - RNA, 19 nt, Homo sapiens
agaagaaagauuccaaaug

SEQ ID NO: 1039399 - RNA, 19 nt, Homo sapiens
guuccagggucugacauuu

SEQ ID NO: 1039400 - RNA, 19 nt, Homo sapiens
gaagaaacgcuagugaaaa

SEQ ID NO: 1039401 - RNA, 19 nt, Homo sapiens
ggacgcuacacuagaagaa

SEQ ID NO: 1039402 - RNA, 19 nt, Homo sapiens
gauggcagcucugaagaac

SEQ ID NO: 1039403 - RNA, 19 nt, Homo sapiens
uagaagaaacgcuagugaa

SEQ ID NO: 1039404 - RNA, 19 nt, Homo sapiens
ggauggcagcucugaagaa

SEQ ID NO: 1039405 - RNA, 19 nt, Homo sapiens
uaaugaagacaacuggauu

SEQ ID NO: 1039406 - RNA, 19 nt, Homo sapiens
gaagugggcuguggauccu

SEQ ID NO: 1039407 - RNA, 19 nt, Homo sapiens
gagcaaggagccacagauc

SEQ ID NO: 1039408 - RNA, 19 nt, Homo sapiens
ccacagauuccucggacaa

SEQ ID NO: 1039409 - RNA, 19 nt, Homo sapiens
gccagcggaugcuagagaa

SEQ ID NO: 1039410 - RNA, 19 nt, Homo sapiens
agacaccucuggccugaag

SEQ ID NO: 1039411 - RNA, 19 nt, Homo sapiens
gggcaggaaaccacagauu

SEQ ID NO: 1039412 - RNA, 19 nt, Homo sapiens
ggacucggagcuaccauca

SEQ ID NO: 1039413 - RNA, 19 nt, Homo sapiens
ggucuaaaggaaaggguuu

SEQ ID NO: 1039414 - RNA, 19 nt, Homo sapiens
ccucuggccugaagucaca

SEQ ID NO: 1039415 - RNA, 19 nt, Homo sapiens
ggacaagaaggaaaagaaa

SEQ ID NO: 1039416 - RNA, 19 nt, Homo sapiens
ucggagcuaccaucaauaa

SEQ ID NO: 1039417 - RNA, 19 nt, Homo sapiens
aaaccguguucacuauaug

SEQ ID NO: 1039418 - RNA, 19 nt, Homo sapiens
caucaauaaugaagacaac

SEQ ID NO: 1039419 - RNA, 19 nt, Homo sapiens
ugaagucacagcagaguuc

SEQ ID NO: 1039420 - RNA, 19 nt, Homo sapiens
ggaaaagacagaguaagaa

SEQ ID NO: 1039421 - RNA, 19 nt, Homo sapiens
gggaaaagacagaguaaga

SEQ ID NO: 1039422 - RNA, 19 nt, Homo sapiens
ggcaggaaaccacagauuc

SEQ ID NO: 1039423 - RNA, 19 nt, Homo sapiens
aacacugccuggaguaaug

SEQ ID NO: 1039424 - RNA, 19 nt, Homo sapiens
gagcgaguggccaagaaga

SEQ ID NO: 1039425 - RNA, 19 nt, Homo sapiens
acagauuccucggacaaga

SEQ ID NO: 1039426 - RNA, 19 nt, Homo sapiens
cagaggacgcuacacuaga

SEQ ID NO: 1039427 - RNA, 19 nt, Homo sapiens
aauaaagaggccacaggua

SEQ ID NO: 1039428 - RNA, 19 nt, Homo sapiens
caacuggauugcccaucag

SEQ ID NO: 1039429 - RNA, 19 nt, Homo sapiens
gcagaagugggcuguggau

SEQ ID NO: 1039430 - RNA, 19 nt, Homo sapiens
ggagcaaggagccacagau

SEQ ID NO: 1039431 - RNA, 19 nt, Homo sapiens
agaagaagaaagauuccaa

SEQ ID NO: 1039432 - RNA, 19 nt, Homo sapiens
cagaacacugccuggagua

SEQ ID NO: 1039433 - RNA, 19 nt, Homo sapiens
gcggauggcagcucugaag

SEQ ID NO: 1039434 - RNA, 19 nt, Homo sapiens
gaaaagacagaguaagaag

SEQ ID NO: 1039435 - RNA, 19 nt, Homo sapiens
uuacgcacguccugauucu

SEQ ID NO: 1039436 - RNA, 19 nt, Homo sapiens
gagaacgaaaccacgacaa

SEQ ID NO: 1039437 - RNA, 19 nt, Homo sapiens
cagauuccucggacaagaa

SEQ ID NO: 1039438 - RNA, 19 nt, Homo sapiens
cacaggcucuccgacaugu

SEQ ID NO: 1039439 - RNA, 19 nt, Homo sapiens
ggccagcggaugcuagaga

SEQ ID NO: 1039440 - RNA, 19 nt, Homo sapiens
gguaaagauguggaaaguu

SEQ ID NO: 1039441 - RNA, 19 nt, Homo sapiens
ucaauaaugaagacaacug

SEQ ID NO: 1039442 - RNA, 19 nt, Homo sapiens
ucacaggcucuccgacaug

SEQ ID NO: 1039443 - RNA, 19 nt, Homo sapiens
gaagucacagcagaguuca

SEQ ID NO: 1039444 - RNA, 19 nt, Homo sapiens
gaagaagaagaaagauucc

SEQ ID NO: 1039445 - RNA, 19 nt, Homo sapiens
agguaaagauguggaaagu

SEQ ID NO: 1039446 - RNA, 19 nt, Homo sapiens
aaagacagaguaagaagac

SEQ ID NO: 1039447 - RNA, 19 nt, Homo sapiens
cagcggaugcuagagaaga

SEQ ID NO: 1039448 - RNA, 19 nt, Homo sapiens
ucugucaucucggagcaaa

SEQ ID NO: 1039449 - RNA, 19 nt, Homo sapiens
gacgcuacacuagaagaaa

SEQ ID NO: 1039450 - RNA, 19 nt, Homo sapiens
aaugacgauuccaaguuug

SEQ ID NO: 1039451 - RNA, 19 nt, Homo sapiens
cagaagaacugaauaaaga

SEQ ID NO: 1039452 - RNA, 19 nt, Homo sapiens
gcaagcaguuucugucuga

SEQ ID NO: 1039453 - RNA, 19 nt, Homo sapiens
gaacauggccacccacuuc

SEQ ID NO: 1039454 - RNA, 19 nt, Homo sapiens
caacucagccugcacaaug

SEQ ID NO: 1039455 - RNA, 19 nt, Homo sapiens
ggacauaauggagcucuga

SEQ ID NO: 1039456 - RNA, 19 nt, Homo sapiens
gaccagcgacucccgcaaa

SEQ ID NO: 1039457 - RNA, 19 nt, Homo sapiens
ccagaagaacugaauaaag

SEQ ID NO: 1039458 - RNA, 19 nt, Homo sapiens
guaggcaucugggcaccaa

SEQ ID NO: 1039459 - RNA, 19 nt, Homo sapiens
ccaagaccuucccucaaca

SEQ ID NO: 1039460 - RNA, 19 nt, Homo sapiens
gaggagcugugcccaugag

SEQ ID NO: 1039461 - RNA, 19 nt, Homo sapiens
ccucccaccuuccuucuuc

SEQ ID NO: 1039462 - RNA, 19 nt, Homo sapiens
accaagaccuucccucaac

SEQ ID NO: 1039463 - RNA, 19 nt, Homo sapiens
caccaagaccuucccucaa

SEQ ID NO: 1039464 - RNA, 19 nt, Homo sapiens
aacucagccugcacaauga

SEQ ID NO: 1039465 - RNA, 19 nt, Homo sapiens
ucaaagagauccucagaaa

SEQ ID NO: 1039466 - RNA, 19 nt, Homo sapiens
caaguggacuggacucuuu

SEQ ID NO: 1039467 - RNA, 19 nt, Homo sapiens
caaguggacuggacucuuu

SEQ ID NO: 1039468 - RNA, 19 nt, Homo sapiens
gaaaagaucuuaugugaag

SEQ ID NO: 1039469 - RNA, 19 nt, Homo sapiens
gaagauccuuugccaccua

SEQ ID NO: 1039470 - RNA, 19 nt, Homo sapiens
gagcugaucuaucuuguag

SEQ ID NO: 1039471 - RNA, 19 nt, Homo sapiens
caaguaaugucauguuugu

SEQ ID NO: 1039472 - RNA, 19 nt, Homo sapiens
caagguugcucacgugauu

SEQ ID NO: 1039473 - RNA, 19 nt, Homo sapiens
cagaagauguugugagaga

SEQ ID NO: 1039474 - RNA, 19 nt, Homo sapiens
ggaagagcguguugugaau

SEQ ID NO: 1039475 - RNA, 19 nt, Homo sapiens
caacauauucaguggauaa

SEQ ID NO: 1039476 - RNA, 19 nt, Homo sapiens
ggauaugacucacuguuca

SEQ ID NO: 1039477 - RNA, 19 nt, Homo sapiens
ggaagggaacaaucaauuu

SEQ ID NO: 1039478 - RNA, 19 nt, Homo sapiens
ggacucagaucuuguuguc

SEQ ID NO: 1039479 - RNA, 19 nt, Homo sapiens
ggaauugaccugauuagug

SEQ ID NO: 1039480 - RNA, 19 nt, Homo sapiens
gaaaauguccugaagaaaa

SEQ ID NO: 1039481 - RNA, 19 nt, Homo sapiens
gaaucuuccuuugcuauuu

SEQ ID NO: 1039482 - RNA, 19 nt, Homo sapiens
caauuguucucuuaacuga

SEQ ID NO: 1039483 - RNA, 19 nt, Homo sapiens
ugaggcaauuguucucuua

SEQ ID NO: 1039484 - RNA, 19 nt, Homo sapiens
cauauucaguggauaaguu

SEQ ID NO: 1039485 - RNA, 19 nt, Homo sapiens
gaaacagccaccaguuaaa

SEQ ID NO: 1039486 - RNA, 19 nt, Homo sapiens
ggacuggacucuuuucuug

SEQ ID NO: 1039487 - RNA, 19 nt, Homo sapiens
ggacuggacucuuuucuug

SEQ ID NO: 1039488 - RNA, 19 nt, Homo sapiens
cugcacaggugguuccuua

SEQ ID NO: 1039489 - RNA, 19 nt, Homo sapiens
ugaaacagccaccaguuaa

SEQ ID NO: 1039490 - RNA, 19 nt, Homo sapiens
ugagagagcuuaucuacac

SEQ ID NO: 1039491 - RNA, 19 nt, Homo sapiens
gcacaggugguuccuuaaa

SEQ ID NO: 1039492 - RNA, 19 nt, Homo sapiens
ccaccaggcuccuccauuc

SEQ ID NO: 1039493 - RNA, 19 nt, Homo sapiens
ccaaggagcuuuugcagaa

SEQ ID NO: 1039494 - RNA, 19 nt, Homo sapiens
uaauuugcuugauggguua

SEQ ID NO: 1039495 - RNA, 19 nt, Homo sapiens
ggaaggaggaggugauaau

SEQ ID NO: 1039496 - RNA, 19 nt, Homo sapiens
aaacaguuauugcucaaga

SEQ ID NO: 1039497 - RNA, 19 nt, Homo sapiens
gccauucuuuguacugaua

SEQ ID NO: 1039498 - RNA, 19 nt, Homo sapiens
gaauccauguuucuucuca

SEQ ID NO: 1039499 - RNA, 19 nt, Homo sapiens
gggaagagcguguugugaa

SEQ ID NO: 1039500 - RNA, 19 nt, Homo sapiens
gagggucaauugaaugaau

SEQ ID NO: 1039501 - RNA, 19 nt, Homo sapiens
cacaaguaaugucauguuu

SEQ ID NO: 1039502 - RNA, 19 nt, Homo sapiens
gaaaagguuugacuuagau

SEQ ID NO: 1039503 - RNA, 19 nt, Homo sapiens
ugaaucacauggcagcaaa

SEQ ID NO: 1039504 - RNA, 19 nt, Homo sapiens
gaggagaucggaagaggaa

SEQ ID NO: 1039505 - RNA, 19 nt, Homo sapiens
caaagacuaauccaagaaa

SEQ ID NO: 1039506 - RNA, 19 nt, Homo sapiens
gagcagaucaggaaucaag

SEQ ID NO: 1039507 - RNA, 19 nt, Homo sapiens
guaaugucauguuuguaga

SEQ ID NO: 1039508 - RNA, 19 nt, Homo sapiens
gcauacacagugcuaauga

SEQ ID NO: 1039509 - RNA, 19 nt, Homo sapiens
gggaaaauguccugaagaa

SEQ ID NO: 1039510 - RNA, 19 nt, Homo sapiens
caagaaaagguuugacuua

SEQ ID NO: 1039511 - RNA, 19 nt, Homo sapiens
guaucggccuuguguagaa

SEQ ID NO: 1039512 - RNA, 19 nt, Homo sapiens
ugaaagaucaagauuggaa

SEQ ID NO: 1039513 - RNA, 19 nt, Homo sapiens
gagaugcuguuguucuauc

SEQ ID NO: 1039514 - RNA, 19 nt, Homo sapiens
ugaccugauuaguggauua

SEQ ID NO: 1039515 - RNA, 19 nt, Homo sapiens
caagcugaaucuuccuuug

SEQ ID NO: 1039516 - RNA, 19 nt, Homo sapiens
ccuaaagcuucuucagauu

SEQ ID NO: 1039517 - RNA, 19 nt, Homo sapiens
gaagaggaagcaagacugu

SEQ ID NO: 1039518 - RNA, 19 nt, Homo sapiens
guuguucuaucguauguga

SEQ ID NO: 1039519 - RNA, 19 nt, Homo sapiens
cuuauucacugccauguug

SEQ ID NO: 1039520 - RNA, 19 nt, Homo sapiens
uauugcaucuaccaacaua

SEQ ID NO: 1039521 - RNA, 19 nt, Homo sapiens
ggaaucaagcgucgaagau

SEQ ID NO: 1039522 - RNA, 19 nt, Homo sapiens
cccagaagauguugugaga

SEQ ID NO: 1039523 - RNA, 19 nt, Homo sapiens
gaaaauacaccuguuguug

SEQ ID NO: 1039524 - RNA, 19 nt, Homo sapiens
gaucaagauuggaaugacu

SEQ ID NO: 1039525 - RNA, 19 nt, Homo sapiens
ccaguuaaauuugaugcaa

SEQ ID NO: 1039526 - RNA, 19 nt, Homo sapiens
cuaaagcuucuucagauuu

SEQ ID NO: 1039527 - RNA, 19 nt, Homo sapiens
gcuccaaacugggauauac

SEQ ID NO: 1039528 - RNA, 19 nt, Homo sapiens
ucugaaagaucaagauugg

SEQ ID NO: 1039529 - RNA, 19 nt, Homo sapiens
gaugagagagcuuaucuac

SEQ ID NO: 1039530 - RNA, 19 nt, Homo sapiens
ugucauguuuguagaauuc

SEQ ID NO: 1039531 - RNA, 19 nt, Homo sapiens
cagaucgacuccacugaga

SEQ ID NO: 1039532 - RNA, 19 nt, Homo sapiens
gcugucugcuuuaugaaau

SEQ ID NO: 1039533 - RNA, 19 nt, Homo sapiens
gaaggaggaggugauaaug

SEQ ID NO: 1039534 - RNA, 19 nt, Homo sapiens
gaagauguugugagagaau

SEQ ID NO: 1039535 - RNA, 19 nt, Homo sapiens
gaagggaacaaucaauuuu

SEQ ID NO: 1039536 - RNA, 19 nt, Homo sapiens
guucagcaguacauguuga

SEQ ID NO: 1039537 - RNA, 19 nt, Homo sapiens
gacaauccaaagauaauga

SEQ ID NO: 1039538 - RNA, 19 nt, Homo sapiens
gaucucagucucagcagaa

SEQ ID NO: 1039539 - RNA, 19 nt, Homo sapiens
cagaaaagauugacuugga

SEQ ID NO: 1039540 - RNA, 19 nt, Homo sapiens
gaggaaggaggaggugaua

SEQ ID NO: 1039541 - RNA, 19 nt, Homo sapiens
gcaaaguucagcaguacau

SEQ ID NO: 1039542 - RNA, 19 nt, Homo sapiens
gcaauuguucucuuaacug

SEQ ID NO: 1039543 - RNA, 19 nt, Homo sapiens
caaggcuacugcagcauuc

SEQ ID NO: 1039544 - RNA, 19 nt, Homo sapiens
ccacaaguaaugucauguu

SEQ ID NO: 1039545 - RNA, 19 nt, Homo sapiens
aaauacaccuguuguugag

SEQ ID NO: 1039546 - RNA, 19 nt, Homo sapiens
ggauauacgggccaagguu

SEQ ID NO: 1039547 - RNA, 19 nt, Homo sapiens
cgacggaagggaacaauca

SEQ ID NO: 1039548 - RNA, 19 nt, Homo sapiens
cugaaaagaucuuauguga

SEQ ID NO: 1039549 - RNA, 19 nt, Homo sapiens
ggauuacaucaucuucaua

SEQ ID NO: 1039550 - RNA, 19 nt, Homo sapiens
ggacucuuuucuugacuua

SEQ ID NO: 1039551 - RNA, 19 nt, Homo sapiens
gauuuuaccuguuacucua

SEQ ID NO: 1039552 - RNA, 19 nt, Homo sapiens
ccauguuucuucucaguuc

SEQ ID NO: 1039553 - RNA, 19 nt, Homo sapiens
gaaugaauccauguuucuu

SEQ ID NO: 1039554 - RNA, 19 nt, Homo sapiens
ggacucuuuucuugacuua

SEQ ID NO: 1039555 - RNA, 19 nt, Homo sapiens
ucuuugggcugucugcuuu

SEQ ID NO: 1039556 - RNA, 19 nt, Homo sapiens
cuacugccuuccagaaugu

SEQ ID NO: 1039557 - RNA, 19 nt, Homo sapiens
aaucuuccuuugcuauuug

SEQ ID NO: 1039558 - RNA, 19 nt, Homo sapiens
gcugaaucuuccuuugcua

SEQ ID NO: 1039559 - RNA, 19 nt, Homo sapiens
gaggauaugacucacuguu

SEQ ID NO: 1039560 - RNA, 19 nt, Homo sapiens
gcccagagauggaaaacuu

SEQ ID NO: 1039561 - RNA, 19 nt, Homo sapiens
caguacauguugaccuuau

SEQ ID NO: 1039562 - RNA, 19 nt, Homo sapiens
ggagcugaucuaucuugua

SEQ ID NO: 1039563 - RNA, 19 nt, Homo sapiens
gaaagaucaagauuggaau

SEQ ID NO: 1039564 - RNA, 19 nt, Homo sapiens
ugggcugucugcuuuauga

SEQ ID NO: 1039565 - RNA, 19 nt, Homo sapiens
gcuacucccuccacaaaua

SEQ ID NO: 1039566 - RNA, 19 nt, Homo sapiens
ggacuggacugacuaugau

SEQ ID NO: 1039567 - RNA, 19 nt, Homo sapiens
gaugaaauguggcaacugu

SEQ ID NO: 1039568 - RNA, 19 nt, Homo sapiens
gcagcaccaucaagccuua

SEQ ID NO: 1039569 - RNA, 19 nt, Homo sapiens
ggugguaccugaagaugaa

SEQ ID NO: 1039570 - RNA, 19 nt, Homo sapiens
gcaugaaggugaaguaagg

SEQ ID NO: 1039571 - RNA, 19 nt, Homo sapiens
cacagaggcucguuccuuu

SEQ ID NO: 1039572 - RNA, 19 nt, Homo sapiens
uuacaaugcugaagacaau

SEQ ID NO: 1039573 - RNA, 19 nt, Homo sapiens
gagaaggacuggacugacu

SEQ ID NO: 1039574 - RNA, 19 nt, Homo sapiens
aaugagaacuucaagacaa

SEQ ID NO: 1039575 - RNA, 19 nt, Homo sapiens
aaauacaccugaguuaguu

SEQ ID NO: 1039576 - RNA, 19 nt, Homo sapiens
acauuaaucugcaggagaa

SEQ ID NO: 1039577 - RNA, 19 nt, Homo sapiens
agacaauaguggaguuuga

SEQ ID NO: 1039578 - RNA, 19 nt, Homo sapiens
aaaccuuuccuccugauua

SEQ ID NO: 1039579 - RNA, 19 nt, Homo sapiens
caauggugacguacuguua

SEQ ID NO: 1039580 - RNA, 19 nt, Homo sapiens
ggauuaggaauuagguuaa

SEQ ID NO: 1039581 - RNA, 19 nt, Homo sapiens
cuuaagaacugagaaagga

SEQ ID NO: 1039582 - RNA, 19 nt, Homo sapiens
gaacuucaagacaauagug

SEQ ID NO: 1039583 - RNA, 19 nt, Homo sapiens
uaaauacaccugaguuagu

SEQ ID NO: 1039584 - RNA, 19 nt, Homo sapiens
caagcugugugcaagagaa

SEQ ID NO: 1039585 - RNA, 19 nt, Homo sapiens
guggugagauuucggacaa

SEQ ID NO: 1039586 - RNA, 19 nt, Homo sapiens
guacuguuaccugaacuua

SEQ ID NO: 1039587 - RNA, 19 nt, Homo sapiens
ucaagacaauaguggaguu

SEQ ID NO: 1039588 - RNA, 19 nt, Homo sapiens
uggcaacuguggugagauu

SEQ ID NO: 1039589 - RNA, 19 nt, Homo sapiens
caauaaauacaccugaguu

SEQ ID NO: 1039590 - RNA, 19 nt, Homo sapiens
agaagccaauggugacgua

SEQ ID NO: 1039591 - RNA, 19 nt, Homo sapiens
cagcagcaguucacuccuu

SEQ ID NO: 1039592 - RNA, 19 nt, Homo sapiens
gggcaaguuuacagagaug

SEQ ID NO: 1039593 - RNA, 19 nt, Homo sapiens
cagcuacucccuccacaaa

SEQ ID NO: 1039594 - RNA, 19 nt, Homo sapiens
caauuugcaugcuggacuu

SEQ ID NO: 1039595 - RNA, 19 nt, Homo sapiens
gcgaggacuuccgguggua

SEQ ID NO: 1039596 - RNA, 19 nt, Homo sapiens
caucaagccuuacaaugcu

SEQ ID NO: 1039597 - RNA, 19 nt, Homo sapiens
aaccuuuccuccugauuaa

SEQ ID NO: 1039598 - RNA, 19 nt, Homo sapiens
ugaacuugcuguuggaaag

SEQ ID NO: 1039599 - RNA, 19 nt, Homo sapiens
gaugguaucuccccaguca

SEQ ID NO: 1039600 - RNA, 19 nt, Homo sapiens
gggacagccuucagugaca

SEQ ID NO: 1039601 - RNA, 19 nt, Homo sapiens
gugcuuccaugguccagaa

SEQ ID NO: 1039602 - RNA, 19 nt, Homo sapiens
gaacuugcuguuggaaaga

SEQ ID NO: 1039603 - RNA, 19 nt, Homo sapiens
gaacugagaaaggacaaag

SEQ ID NO: 1039604 - RNA, 19 nt, Homo sapiens
ccagucaagggcaaguuua

SEQ ID NO: 1039605 - RNA, 19 nt, Homo sapiens
uaccugaacuuacugaacu

SEQ ID NO: 1039606 - RNA, 19 nt, Homo sapiens
ccacagaggcucguuccuu

SEQ ID NO: 1039607 - RNA, 19 nt, Homo sapiens
gaaggacuggacugacuau

SEQ ID NO: 1039608 - RNA, 19 nt, Homo sapiens
ucaaagccacgcuggagaa

SEQ ID NO: 1039609 - RNA, 19 nt, Homo sapiens
uugugaggauuaggaauua

SEQ ID NO: 1039610 - RNA, 19 nt, Homo sapiens
gcaaguuuacagagaugaa

SEQ ID NO: 1039611 - RNA, 19 nt, Homo sapiens
ggacagccuucagugacau

SEQ ID NO: 1039612 - RNA, 19 nt, Homo sapiens
cagaggcucguuccuuuga

SEQ ID NO: 1039613 - RNA, 19 nt, Homo sapiens
gugcugaucccucuuccuu

SEQ ID NO: 1039614 - RNA, 19 nt, Homo sapiens
aggauuaggaauuagguua

SEQ ID NO: 1039615 - RNA, 19 nt, Homo sapiens
agcagcaguucacuccuua

SEQ ID NO: 1039616 - RNA, 19 nt, Homo sapiens
gcaacuguggugagauuuc

SEQ ID NO: 1039617 - RNA, 19 nt, Homo sapiens
gccuugaaccaguugauuu

SEQ ID NO: 1039618 - RNA, 19 nt, Homo sapiens
ccaggagucugugggaauc

SEQ ID NO: 1039619 - RNA, 19 nt, Homo sapiens
caagacaauaguggaguuu

SEQ ID NO: 1039620 - RNA, 19 nt, Homo sapiens
gaaccaucuucaagcaaaa

SEQ ID NO: 1039621 - RNA, 19 nt, Homo sapiens
acugagaaaggacaaagua

SEQ ID NO: 1039622 - RNA, 19 nt, Homo sapiens
cuacucccuccacaaauaa

SEQ ID NO: 1039623 - RNA, 19 nt, Homo sapiens
ggugagauuucggacaagu

SEQ ID NO: 1039624 - RNA, 19 nt, Homo sapiens
aaaucgcgcugcaacucaa

SEQ ID NO: 1039625 - RNA, 19 nt, Homo sapiens
caaguuuacagagaugaaa

SEQ ID NO: 1039626 - RNA, 19 nt, Homo sapiens
aagggcaaguuuacagaga

SEQ ID NO: 1039627 - RNA, 19 nt, Homo sapiens
aagccacgcuggagaacau

SEQ ID NO: 1039628 - RNA, 19 nt, Homo sapiens
gagaacuucaagacaauag

SEQ ID NO: 1039629 - RNA, 19 nt, Homo sapiens
ccaucaagccuuacaaugc

SEQ ID NO: 1039630 - RNA, 19 nt, Homo sapiens
caacuguggugagauuucg

SEQ ID NO: 1039631 - RNA, 19 nt, Homo sapiens
ccaaaccuuuccuccugau

SEQ ID NO: 1039632 - RNA, 19 nt, Homo sapiens
ggacaaguggcaguacauc

SEQ ID NO: 1039633 - RNA, 19 nt, Homo sapiens
gacaaugagaacuucaaga

SEQ ID NO: 1039634 - RNA, 19 nt, Homo sapiens
ggacugacuaugaugaaaa

SEQ ID NO: 1039635 - RNA, 19 nt, Homo sapiens
gacguacuguuaccugaac

SEQ ID NO: 1039636 - RNA, 19 nt, Homo sapiens
gugcaugaaggugaaguaa

SEQ ID NO: 1039637 - RNA, 19 nt, Homo sapiens
ucaagggcaaguuuacaga

SEQ ID NO: 1039638 - RNA, 19 nt, Homo sapiens
gcccuuaagaacugagaaa

SEQ ID NO: 1039639 - RNA, 19 nt, Homo sapiens
caaugagaacuucaagaca

SEQ ID NO: 1039640 - RNA, 19 nt, Homo sapiens
acaaugcugaagacaauga

SEQ ID NO: 1039641 - RNA, 19 nt, Homo sapiens
acuguuaccugaacuuacu

SEQ ID NO: 1039642 - RNA, 19 nt, Homo sapiens
gcagcuacucccuccacaa

SEQ ID NO: 1039643 - RNA, 19 nt, Homo sapiens
ugagaacuucaagacaaua

SEQ ID NO: 1039644 - RNA, 19 nt, Homo sapiens
acaaugagaacuucaagac

SEQ ID NO: 1039645 - RNA, 19 nt, Homo sapiens
cugaagacaaugagaacuu

SEQ ID NO: 1039646 - RNA, 19 nt, Homo sapiens
ccaauggugacguacuguu

SEQ ID NO: 1039647 - RNA, 19 nt, Homo sapiens
ggugcaugaaggugaagua

SEQ ID NO: 1039648 - RNA, 19 nt, Homo sapiens
uggacugacuaugaugaaa

SEQ ID NO: 1039649 - RNA, 19 nt, Homo sapiens
agaaggacuggacugacua

SEQ ID NO: 1039650 - RNA, 19 nt, Homo sapiens
gcaccaucaagccuuacaa

SEQ ID NO: 1039651 - RNA, 19 nt, Homo sapiens
ugacguacuguuaccugaa

SEQ ID NO: 1039652 - RNA, 19 nt, Homo sapiens
gcaagcugugugcaagaga

SEQ ID NO: 1039653 - RNA, 19 nt, Homo sapiens
ugcaugcuggacuuuauua

SEQ ID NO: 1039654 - RNA, 19 nt, Homo sapiens
ccugguggcuauacgaaac

SEQ ID NO: 1039655 - RNA, 19 nt, Homo sapiens
ugagaaaggacaaaguacu

SEQ ID NO: 1039656 - RNA, 19 nt, Homo sapiens
augagaacuucaagacaau

SEQ ID NO: 1039657 - RNA, 19 nt, Homo sapiens
ggacaaggauggcuacuuu

SEQ ID NO: 1039658 - RNA, 19 nt, Homo sapiens
gaagacagcugcaucagaa

SEQ ID NO: 1039659 - RNA, 19 nt, Homo sapiens
gcacuaagaugaucacaca

SEQ ID NO: 1039660 - RNA, 19 nt, Homo sapiens
acuaagagcuuucagauuu

SEQ ID NO: 1039661 - RNA, 19 nt, Homo sapiens
ggaaagauccaaaggagua

SEQ ID NO: 1039662 - RNA, 19 nt, Homo sapiens
ugaauacucucuccaaauu

SEQ ID NO: 1039663 - RNA, 19 nt, Homo sapiens
ugagggagcugaguguuua

SEQ ID NO: 1039664 - RNA, 19 nt, Homo sapiens
gaccgaaucugacaucuuc

SEQ ID NO: 1039665 - RNA, 19 nt, Homo sapiens
ugacucagcugacagagaa

SEQ ID NO: 1039666 - RNA, 19 nt, Homo sapiens
gaucgggccuguugaagug

SEQ ID NO: 1039667 - RNA, 19 nt, Homo sapiens
gaaaauguguggugcacua

SEQ ID NO: 1039668 - RNA, 19 nt, Homo sapiens
acagagaccuuuugcauua

SEQ ID NO: 1039669 - RNA, 19 nt, Homo sapiens
acaagaaacuaauggauca

SEQ ID NO: 1039670 - RNA, 19 nt, Homo sapiens
uuucagaacuugccaaaga

SEQ ID NO: 1039671 - RNA, 19 nt, Homo sapiens
gagaucaaguggagcuuug

SEQ ID NO: 1039672 - RNA, 19 nt, Homo sapiens
ugacugcuccauacaaaua

SEQ ID NO: 1039673 - RNA, 19 nt, Homo sapiens
ggaaagagcaaaagaauau

SEQ ID NO: 1039674 - RNA, 19 nt, Homo sapiens
ggugacugcuccauacaaa

SEQ ID NO: 1039675 - RNA, 19 nt, Homo sapiens
cauuggcccugaucacaua

SEQ ID NO: 1039676 - RNA, 19 nt, Homo sapiens
ggacaauccugagaagaca

SEQ ID NO: 1039677 - RNA, 19 nt, Homo sapiens
gaauguugcuguccguauc

SEQ ID NO: 1039678 - RNA, 19 nt, Homo sapiens
gagacccgcuggccaucua

SEQ ID NO: 1039679 - RNA, 19 nt, Homo sapiens
caacuucgcccaugaugug

SEQ ID NO: 1039680 - RNA, 19 nt, Homo sapiens
ccacuggucucacuaagag

SEQ ID NO: 1039681 - RNA, 19 nt, Homo sapiens
ccacucggcccuucuguuu

SEQ ID NO: 1039682 - RNA, 19 nt, Homo sapiens
aggaggaucugaccaggua

SEQ ID NO: 1039683 - RNA, 19 nt, Homo sapiens
ccaaaguuauccugaauac

SEQ ID NO: 1039684 - RNA, 19 nt, Homo sapiens
cagagaaggaccucaagua

SEQ ID NO: 1039685 - RNA, 19 nt, Homo sapiens
ggaguaaauugcgaaguca

SEQ ID NO: 1039686 - RNA, 19 nt, Homo sapiens
uaggacagguuaccauaga

SEQ ID NO: 1039687 - RNA, 19 nt, Homo sapiens
gcauuacuuugguucaaga

SEQ ID NO: 1039688 - RNA, 19 nt, Homo sapiens
gcacuuguggguacucauu

SEQ ID NO: 1039689 - RNA, 19 nt, Homo sapiens
aaucugacaucuucuggaa

SEQ ID NO: 1039690 - RNA, 19 nt, Homo sapiens
gaugaucacacagcauuaa

SEQ ID NO: 1039691 - RNA, 19 nt, Homo sapiens
cuucauccuuuguauguaa

SEQ ID NO: 1039692 - RNA, 19 nt, Homo sapiens
ggaagaaacgacgauguga

SEQ ID NO: 1039693 - RNA, 19 nt, Homo sapiens
ccaagcugcuggugucaga

SEQ ID NO: 1039694 - RNA, 19 nt, Homo sapiens
ccaaagacgguuucuggaa

SEQ ID NO: 1039695 - RNA, 19 nt, Homo sapiens
gagaggugguaaaggcauu

SEQ ID NO: 1039696 - RNA, 19 nt, Homo sapiens
aaacgacgaugugaucaau

SEQ ID NO: 1039697 - RNA, 19 nt, Homo sapiens
gaaacgacgaugugaucaa

SEQ ID NO: 1039698 - RNA, 19 nt, Homo sapiens
gaagaaacgacgaugugau

SEQ ID NO: 1039699 - RNA, 19 nt, Homo sapiens
ugaaacgguugucaucugu

SEQ ID NO: 1039700 - RNA, 19 nt, Homo sapiens
uuucagauuucccuccaua

SEQ ID NO: 1039701 - RNA, 19 nt, Homo sapiens
gaaagauccaaaggaguaa

SEQ ID NO: 1039702 - RNA, 19 nt, Homo sapiens
gagcucgcauggacaagga

SEQ ID NO: 1039703 - RNA, 19 nt, Homo sapiens
gcaaaaguaugcaggaaca

SEQ ID NO: 1039704 - RNA, 19 nt, Homo sapiens
caaaaggcaugaaaaucaa

SEQ ID NO: 1039705 - RNA, 19 nt, Homo sapiens
agacugguguggagcugua

SEQ ID NO: 1039706 - RNA, 19 nt, Homo sapiens
cauaggacagguuaccaua

SEQ ID NO: 1039707 - RNA, 19 nt, Homo sapiens
gauccaaaggaguaaauug

SEQ ID NO: 1039708 - RNA, 19 nt, Homo sapiens
gggaagaaacgacgaugug

SEQ ID NO: 1039709 - RNA, 19 nt, Homo sapiens
gcccuucuguuucuucaau

SEQ ID NO: 1039710 - RNA, 19 nt, Homo sapiens
cuaagagcuuucagauuuc

SEQ ID NO: 1039711 - RNA, 19 nt, Homo sapiens
ccugaauacucucuccaaa

SEQ ID NO: 1039712 - RNA, 19 nt, Homo sapiens
ccgaguugaugccaaaguu

SEQ ID NO: 1039713 - RNA, 19 nt, Homo sapiens
gccagcaccucuaccuguu

SEQ ID NO: 1039714 - RNA, 19 nt, Homo sapiens
aaaguuauccugaauacuc

SEQ ID NO: 1039715 - RNA, 19 nt, Homo sapiens
ggacagaaugaugcuggua

SEQ ID NO: 1039716 - RNA, 19 nt, Homo sapiens
gcacaggagcagagaucaa

SEQ ID NO: 1039717 - RNA, 19 nt, Homo sapiens
uccgaagacuccacaagaa

SEQ ID NO: 1039718 - RNA, 19 nt, Homo sapiens
caaggggacuuuuacauca

SEQ ID NO: 1039719 - RNA, 19 nt, Homo sapiens
cgaguugaugccaaaguua

SEQ ID NO: 1039720 - RNA, 19 nt, Homo sapiens
ucacacagcauuaaaacua

SEQ ID NO: 1039721 - RNA, 19 nt, Homo sapiens
gaugugaucaauucuucaa

SEQ ID NO: 1039722 - RNA, 19 nt, Homo sapiens
cgaaggcuauggccagucu

SEQ ID NO: 1039723 - RNA, 19 nt, Homo sapiens
uaaccacccucugcugugu

SEQ ID NO: 1039724 - RNA, 19 nt, Homo sapiens
cuacagagcacaacugcau

SEQ ID NO: 1039725 - RNA, 19 nt, Homo sapiens
ucacuaagagcuuucagau

SEQ ID NO: 1039726 - RNA, 19 nt, Homo sapiens
ggaauguugcuguccguau

SEQ ID NO: 1039727 - RNA, 19 nt, Homo sapiens
ccaaaaggcaugaaaauca

SEQ ID NO: 1039728 - RNA, 19 nt, Homo sapiens
gccaaaguuauccugaaua

SEQ ID NO: 1039729 - RNA, 19 nt, Homo sapiens
ucugacaucuucuggaaca

SEQ ID NO: 1039730 - RNA, 19 nt, Homo sapiens
gguaccaguuucagagcuu

SEQ ID NO: 1039731 - RNA, 19 nt, Homo sapiens
gaguugaugccaaaguuau

SEQ ID NO: 1039732 - RNA, 19 nt, Homo sapiens
gaacuccagggcauucugu

SEQ ID NO: 1039733 - RNA, 19 nt, Homo sapiens
gcuggugccugaguacuuc

SEQ ID NO: 1039734 - RNA, 19 nt, Homo sapiens
ccgaagacuccacaagaaa

SEQ ID NO: 1039735 - RNA, 19 nt, Homo sapiens
ccgcuggccaucuacuuua

SEQ ID NO: 1039736 - RNA, 19 nt, Homo sapiens
ugacagagaaggaccucaa

SEQ ID NO: 1039737 - RNA, 19 nt, Homo sapiens
ccaggaaggcagccaaugu

SEQ ID NO: 1039738 - RNA, 19 nt, Homo sapiens
acgacgaugugaucaauuc

SEQ ID NO: 1039739 - RNA, 19 nt, Homo sapiens
ccuacgaugugcagauugu

SEQ ID NO: 1039740 - RNA, 19 nt, Homo sapiens
ggccuuuguuucagaacuu

SEQ ID NO: 1039741 - RNA, 19 nt, Homo sapiens
aagaugaucacacagcauu

SEQ ID NO: 1039742 - RNA, 19 nt, Homo sapiens
aauguguggugcacuaaga

SEQ ID NO: 1039743 - RNA, 19 nt, Homo sapiens
ccacaagaaacuaauggau

SEQ ID NO: 1039744 - RNA, 19 nt, Homo sapiens
aaagggugacugcuccaua

SEQ ID NO: 1039745 - RNA, 19 nt, Homo sapiens
cccaugaugugcuggaugu

SEQ ID NO: 1039746 - RNA, 19 nt, Homo sapiens
cuucgggagucaccacaaa

SEQ ID NO: 1039747 - RNA, 19 nt, Homo sapiens
aggaguaaauugcgaaguc

SEQ ID NO: 1039748 - RNA, 19 nt, Homo sapiens
ugagaagacagcugcauca

SEQ ID NO: 1039749 - RNA, 19 nt, Homo sapiens
ugccaaaguuauccugaau

SEQ ID NO: 1039750 - RNA, 19 nt, Homo sapiens
gaagacuccacaagaaacu

SEQ ID NO: 1039751 - RNA, 19 nt, Homo sapiens
cugaaacgguugucaucug

SEQ ID NO: 1039752 - RNA, 19 nt, Homo sapiens
gcagaaaacagagaccuuu

SEQ ID NO: 1039753 - RNA, 19 nt, Homo sapiens
gugggaggcuguuuucuga

SEQ ID NO: 1039754 - RNA, 19 nt, Homo sapiens
acaacugcaugaggacaaa

SEQ ID NO: 1039755 - RNA, 19 nt, Homo sapiens
gcauuuauaguccuuacuc

SEQ ID NO: 1039756 - RNA, 19 nt, Homo sapiens
ggaucgggccuguugaagu

SEQ ID NO: 1039757 - RNA, 19 nt, Homo sapiens
guacaaacaugccuuaaua

SEQ ID NO: 1039758 - RNA, 19 nt, Homo sapiens
gcauaaaggucaagaguua

SEQ ID NO: 1039759 - RNA, 19 nt, Homo sapiens
gaccuuacuugucauaaua

SEQ ID NO: 1039760 - RNA, 19 nt, Homo sapiens
uuaccaggauccuuuauua

SEQ ID NO: 1039761 - RNA, 19 nt, Homo sapiens
gaauugcucuuuacuaugg

SEQ ID NO: 1039762 - RNA, 19 nt, Homo sapiens
gaucgugcauucauggaua

SEQ ID NO: 1039763 - RNA, 19 nt, Homo sapiens
ucagcaagcucgaguuaaa

SEQ ID NO: 1039764 - RNA, 19 nt, Homo sapiens
gcagaaugcuauacaguag

SEQ ID NO: 1039765 - RNA, 19 nt, Homo sapiens
caugaaagcugugguucua

SEQ ID NO: 1039766 - RNA, 19 nt, Homo sapiens
gauaugcuaggaaacauua

SEQ ID NO: 1039767 - RNA, 19 nt, Homo sapiens
caaacaugccuuaauauug

SEQ ID NO: 1039768 - RNA, 19 nt, Homo sapiens
ggaacaggaacugaaauua

SEQ ID NO: 1039769 - RNA, 19 nt, Homo sapiens
gugaaucgcuacaucaaga

SEQ ID NO: 1039770 - RNA, 19 nt, Homo sapiens
gaagaugaaacaagaauag

SEQ ID NO: 1039771 - RNA, 19 nt, Homo sapiens
gauacaggaugaccaugaa

SEQ ID NO: 1039772 - RNA, 19 nt, Homo sapiens
gaacaggaacugaaauuac

SEQ ID NO: 1039773 - RNA, 19 nt, Homo sapiens
uagaggaccuuacuuguca

SEQ ID NO: 1039774 - RNA, 19 nt, Homo sapiens
ggaccuuacuugucauaau

SEQ ID NO: 1039775 - RNA, 19 nt, Homo sapiens
aaaccuaaauuccaagaug

SEQ ID NO: 1039776 - RNA, 19 nt, Homo sapiens
auacaaauguuccuucaga

SEQ ID NO: 1039777 - RNA, 19 nt, Homo sapiens
uuacauggcuccuccacuu

SEQ ID NO: 1039778 - RNA, 19 nt, Homo sapiens
uggaauugcucuuuacuau

SEQ ID NO: 1039779 - RNA, 19 nt, Homo sapiens
ggacaaaacuggguucaga

SEQ ID NO: 1039780 - RNA, 19 nt, Homo sapiens
gaucaacaacugccuaugu

SEQ ID NO: 1039781 - RNA, 19 nt, Homo sapiens
uaucacagaucaacaacug

SEQ ID NO: 1039782 - RNA, 19 nt, Homo sapiens
caaguuugcuuugcauuca

SEQ ID NO: 1039783 - RNA, 19 nt, Homo sapiens
gaaggauccuauuguuucu

SEQ ID NO: 1039784 - RNA, 19 nt, Homo sapiens
uaaagaaggcgaaauagag

SEQ ID NO: 1039785 - RNA, 19 nt, Homo sapiens
aaaagaugcuggagucaua

SEQ ID NO: 1039786 - RNA, 19 nt, Homo sapiens
ucagaacucgucuucauuu

SEQ ID NO: 1039787 - RNA, 19 nt, Homo sapiens
ugaaagcugugguucuaau

SEQ ID NO: 1039788 - RNA, 19 nt, Homo sapiens
uacaguaggugaauuaugg

SEQ ID NO: 1039789 - RNA, 19 nt, Homo sapiens
gaucuacagcuuucacuau

SEQ ID NO: 1039790 - RNA, 19 nt, Homo sapiens
ugaaggauccuauuguuuc

SEQ ID NO: 1039791 - RNA, 19 nt, Homo sapiens
caacuuggaauugcucuuu

SEQ ID NO: 1039792 - RNA, 19 nt, Homo sapiens
gaaugccagugguaaaaua

SEQ ID NO: 1039793 - RNA, 19 nt, Homo sapiens
ggauacaggaugaccauga

SEQ ID NO: 1039794 - RNA, 19 nt, Homo sapiens
caucaaccaugcaucaaca

SEQ ID NO: 1039795 - RNA, 19 nt, Homo sapiens
ccaggauccuuuauuauac

SEQ ID NO: 1039796 - RNA, 19 nt, Homo sapiens
ggauauuucugcaacugau

SEQ ID NO: 1039797 - RNA, 19 nt, Homo sapiens
uaaguggacauauucauga

SEQ ID NO: 1039798 - RNA, 19 nt, Homo sapiens
ugccugcaauugugaguua

SEQ ID NO: 1039799 - RNA, 19 nt, Homo sapiens
agaguuauauucacagcaa

SEQ ID NO: 1039800 - RNA, 19 nt, Homo sapiens
gaaagcugugguucuaauu

SEQ ID NO: 1039801 - RNA, 19 nt, Homo sapiens
cauuacagguucugaagau

SEQ ID NO: 1039802 - RNA, 19 nt, Homo sapiens
gaaauagaggaccuuacuu

SEQ ID NO: 1039803 - RNA, 19 nt, Homo sapiens
gcgguacucuggcgucuuc

SEQ ID NO: 1039804 - RNA, 19 nt, Homo sapiens
uccuacagauccugacuua

SEQ ID NO: 1039805 - RNA, 19 nt, Homo sapiens
gaaacuuaaggaugggaua

SEQ ID NO: 1039806 - RNA, 19 nt, Homo sapiens
cuauacaguaggugaauua

SEQ ID NO: 1039807 - RNA, 19 nt, Homo sapiens
uuaaugagcuaugugaauc

SEQ ID NO: 1039808 - RNA, 19 nt, Homo sapiens
gaaacaagaauagauaugc

SEQ ID NO: 1039809 - RNA, 19 nt, Homo sapiens
aaauagaggaccuuacuug

SEQ ID NO: 1039810 - RNA, 19 nt, Homo sapiens
gaacucgucuucauuuuac

SEQ ID NO: 1039811 - RNA, 19 nt, Homo sapiens
cugccuauguuuauucgua

SEQ ID NO: 1039812 - RNA, 19 nt, Homo sapiens
gauuagacgaguuguaaau

SEQ ID NO: 1039813 - RNA, 19 nt, Homo sapiens
guuuauaucucuagcaacu

SEQ ID NO: 1039814 - RNA, 19 nt, Homo sapiens
ggaacgauccugcaucaac

SEQ ID NO: 1039815 - RNA, 19 nt, Homo sapiens
guacaguuugucuugauaa

SEQ ID NO: 1039816 - RNA, 19 nt, Homo sapiens
gugcauucauggauauuuc

SEQ ID NO: 1039817 - RNA, 19 nt, Homo sapiens
caaaggcaacggugacuuc

SEQ ID NO: 1039818 - RNA, 19 nt, Homo sapiens
ggaauugcucuuuacuaug

SEQ ID NO: 1039819 - RNA, 19 nt, Homo sapiens
accaggauccuuuauuaua

SEQ ID NO: 1039820 - RNA, 19 nt, Homo sapiens
aagaugauaucguccuuuc

SEQ ID NO: 1039821 - RNA, 19 nt, Homo sapiens
aaaguuggaugugcuggaa

SEQ ID NO: 1039822 - RNA, 19 nt, Homo sapiens
gucaagaguuauauucaca

SEQ ID NO: 1039823 - RNA, 19 nt, Homo sapiens
gcucuuuacuauggagaaa

SEQ ID NO: 1039824 - RNA, 19 nt, Homo sapiens
cuucagaacucgucuucau

SEQ ID NO: 1039825 - RNA, 19 nt, Homo sapiens
gcuauacaguaggugaauu

SEQ ID NO: 1039826 - RNA, 19 nt, Homo sapiens
gaagaugauaucguccuuu

SEQ ID NO: 1039827 - RNA, 19 nt, Homo sapiens
gacgaguuguaaauaaugu

SEQ ID NO: 1039828 - RNA, 19 nt, Homo sapiens
ugacuuaccaccagguuau

SEQ ID NO: 1039829 - RNA, 19 nt, Homo sapiens
ucaauacuauggaaugcau

SEQ ID NO: 1039830 - RNA, 19 nt, Homo sapiens
ucuaacaguucuuacuuca

SEQ ID NO: 1039831 - RNA, 19 nt, Homo sapiens
cgucggaucuacagcuuuc

SEQ ID NO: 1039832 - RNA, 19 nt, Homo sapiens
uauauucacagcaagauga

SEQ ID NO: 1039833 - RNA, 19 nt, Homo sapiens
cgaaauagaggaccuuacu

SEQ ID NO: 1039834 - RNA, 19 nt, Homo sapiens
caacugccuauguuuauuc

SEQ ID NO: 1039835 - RNA, 19 nt, Homo sapiens
ggaacugaaauuaccauuc

SEQ ID NO: 1039836 - RNA, 19 nt, Homo sapiens
gguguacaaacaugccuua

SEQ ID NO: 1039837 - RNA, 19 nt, Homo sapiens
caagcucgaguuaaaguug

SEQ ID NO: 1039838 - RNA, 19 nt, Homo sapiens
uuaaagaaggcgaaauaga

SEQ ID NO: 1039839 - RNA, 19 nt, Homo sapiens
gaugcuggagucauaugua

SEQ ID NO: 1039840 - RNA, 19 nt, Homo sapiens
uguacaguuugucuugaua

SEQ ID NO: 1039841 - RNA, 19 nt, Homo sapiens
gcugagaaagguuaucaau

SEQ ID NO: 1039842 - RNA, 19 nt, Homo sapiens
ucauucaguugguguacaa

SEQ ID NO: 1039843 - RNA, 19 nt, Homo sapiens
uuugaaggauccuauuguu

SEQ ID NO: 1039844 - RNA, 19 nt, Homo sapiens
caggauccuuuauuauaca

SEQ ID NO: 1039845 - RNA, 19 nt, Homo sapiens
ugggaacgauccugcauca

SEQ ID NO: 1039846 - RNA, 19 nt, Homo sapiens
ucaugggccugguccuuug

SEQ ID NO: 1039847 - RNA, 19 nt, Homo sapiens
ggucaagaguuauauucac

SEQ ID NO: 1039848 - RNA, 19 nt, Homo sapiens
cuaggaaacauuacagguu

SEQ ID NO: 1039849 - RNA, 19 nt, Homo sapiens
aaacggaaugccaguggua

SEQ ID NO: 1039850 - RNA, 19 nt, Homo sapiens
cagguuaugugcagagucu

SEQ ID NO: 1039851 - RNA, 19 nt, Homo sapiens
aagcacagacuuugaagga

SEQ ID NO: 1039852 - RNA, 19 nt, Homo sapiens
gcuggaacaggaacugaaa

SEQ ID NO: 1039853 - RNA, 19 nt, Homo sapiens
aaagauaugcuaggaaaca

SEQ ID NO: 1039854 - RNA, 19 nt, Homo sapiens
uacaaauguuccuucagaa

SEQ ID NO: 1039855 - RNA, 19 nt, Homo sapiens
ugaagaugauaucguccuu

SEQ ID NO: 1039856 - RNA, 19 nt, Homo sapiens
uacagguucugaagaugaa

SEQ ID NO: 1039857 - RNA, 19 nt, Homo sapiens
ccacagccaucucguuuau

SEQ ID NO: 1039858 - RNA, 19 nt, Homo sapiens
ccucagagcuucagaucga

SEQ ID NO: 1039859 - RNA, 19 nt, Homo sapiens
cgaagccgcugcaaugauc

SEQ ID NO: 1039860 - RNA, 19 nt, Homo sapiens
gauauaaagucggcauuac

SEQ ID NO: 1039861 - RNA, 19 nt, Homo sapiens
gaaccagcacaaaguguug

SEQ ID NO: 1039862 - RNA, 19 nt, Homo sapiens
ggaaccagcacaaaguguu

SEQ ID NO: 1039863 - RNA, 19 nt, Homo sapiens
ggacacagccuaggaacca

SEQ ID NO: 1039864 - RNA, 19 nt, Homo sapiens
gugccgcucugccuagaaa

SEQ ID NO: 1039865 - RNA, 19 nt, Homo sapiens
gcaaguccauggagaacac

SEQ ID NO: 1039866 - RNA, 19 nt, Homo sapiens
cugggcacguucuucauua

SEQ ID NO: 1039867 - RNA, 19 nt, Homo sapiens
ugauauaaagucggcauua

SEQ ID NO: 1039868 - RNA, 19 nt, Homo sapiens
ggaggacacagccuaggaa

SEQ ID NO: 1039869 - RNA, 19 nt, Homo sapiens
ggagcaggcauccaugaga

SEQ ID NO: 1039870 - RNA, 19 nt, Homo sapiens
caccacagccaucucguuu

SEQ ID NO: 1039871 - RNA, 19 nt, Homo sapiens
aaagucggcauuacucaaa

SEQ ID NO: 1039872 - RNA, 19 nt, Homo sapiens
ccaaagcuggcacgaucua

SEQ ID NO: 1039873 - RNA, 19 nt, Homo sapiens
cacugggugugcugauaua

SEQ ID NO: 1039874 - RNA, 19 nt, Homo sapiens
cuacaacggcuccgagugu

SEQ ID NO: 1039875 - RNA, 19 nt, Homo sapiens
uggcgaagccgcugcaaug

SEQ ID NO: 1039876 - RNA, 19 nt, Homo sapiens
uuccggagcugcaggauag

SEQ ID NO: 1039877 - RNA, 19 nt, Homo sapiens
cucaagcgcuccaguaaac

SEQ ID NO: 1039878 - RNA, 19 nt, Homo sapiens
uaaagucggcauuacucaa

SEQ ID NO: 1039879 - RNA, 19 nt, Homo sapiens
ugggugugcugauauaaag

SEQ ID NO: 1039880 - RNA, 19 nt, Homo sapiens
caacggcuccgaguguaga

SEQ ID NO: 1039881 - RNA, 19 nt, Homo sapiens
gcgggaaccagcacaaagu

SEQ ID NO: 1039882 - RNA, 19 nt, Homo sapiens
ccagcaaguccauggagaa

SEQ ID NO: 1039883 - RNA, 19 nt, Homo sapiens
ggaggcccguaucagcaau

SEQ ID NO: 1039884 - RNA, 19 nt, Homo sapiens
cuccguagcuggguucuuc

SEQ ID NO: 1039885 - RNA, 19 nt, Homo sapiens
caccggcaccgucugcuuu

SEQ ID NO: 1039886 - RNA, 19 nt, Homo sapiens
gggaggacacagccuagga

SEQ ID NO: 1039887 - RNA, 19 nt, Homo sapiens
gcgaagccgcugcaaugau

SEQ ID NO: 1039888 - RNA, 19 nt, Homo sapiens
acagccaucucguuuaucg

SEQ ID NO: 1039889 - RNA, 19 nt, Homo sapiens
ccucaagcgcuccaguaaa

SEQ ID NO: 1039890 - RNA, 19 nt, Homo sapiens
uauaaagucggcauuacuc

SEQ ID NO: 1039891 - RNA, 19 nt, Homo sapiens
gaccucagagcuucagauc

SEQ ID NO: 1039892 - RNA, 19 nt, Homo sapiens
gaacccucccagccuacaa

SEQ ID NO: 1039893 - RNA, 19 nt, Homo sapiens
gggaggcccguaucagcaa

SEQ ID NO: 1039894 - RNA, 19 nt, Homo sapiens
cgagugcuguguggaugug

SEQ ID NO: 1039895 - RNA, 19 nt, Homo sapiens
cacugugggugccaucaug

SEQ ID NO: 1039896 - RNA, 19 nt, Homo sapiens
caggagcaggcauccauga

SEQ ID NO: 1039897 - RNA, 19 nt, Homo sapiens
ccaccacagccaucucguu

SEQ ID NO: 1039898 - RNA, 19 nt, Homo sapiens
gcccguaucagcaaugucu

SEQ ID NO: 1039899 - RNA, 19 nt, Homo sapiens
ggaagugucuuaccugaga

SEQ ID NO: 1039900 - RNA, 19 nt, Homo sapiens
gcagacaucccgagaguga

SEQ ID NO: 1039901 - RNA, 19 nt, Homo sapiens
ggagaggccucagguuguu

SEQ ID NO: 1039902 - RNA, 19 nt, Homo sapiens
gagcgggacuacuuguuga

SEQ ID NO: 1039903 - RNA, 19 nt, Homo sapiens
ggaggugaccaguuuguaa

SEQ ID NO: 1039904 - RNA, 19 nt, Homo sapiens
gaccagagguacacaccaa

SEQ ID NO: 1039905 - RNA, 19 nt, Homo sapiens
ggagaagacugagguccaa

SEQ ID NO: 1039906 - RNA, 19 nt, Homo sapiens
ggccucagguuguuauuug

SEQ ID NO: 1039907 - RNA, 19 nt, Homo sapiens
ccucugagauugucuuugu

SEQ ID NO: 1039908 - RNA, 19 nt, Homo sapiens
uaaccaugcugccaaagga

SEQ ID NO: 1039909 - RNA, 19 nt, Homo sapiens
gggacuacuuguugauauu

SEQ ID NO: 1039910 - RNA, 19 nt, Homo sapiens
ggacuacuuguugauauuu

SEQ ID NO: 1039911 - RNA, 19 nt, Homo sapiens
uaacugggcaccugagaug

SEQ ID NO: 1039912 - RNA, 19 nt, Homo sapiens
ggugaccaguuuguaauga

SEQ ID NO: 1039913 - RNA, 19 nt, Homo sapiens
cgguggaggugaccaguuu

SEQ ID NO: 1039914 - RNA, 19 nt, Homo sapiens
gaggaggucaccaccauga

SEQ ID NO: 1039915 - RNA, 19 nt, Homo sapiens
gcaagagcaucggccugaa

SEQ ID NO: 1039916 - RNA, 19 nt, Homo sapiens
ggagggaagugucuuaccu

SEQ ID NO: 1039917 - RNA, 19 nt, Homo sapiens
ggucucagcaggugucaga

SEQ ID NO: 1039918 - RNA, 19 nt, Homo sapiens
caagagcaucggccugaaa

SEQ ID NO: 1039919 - RNA, 19 nt, Homo sapiens
ccaaggagcagauguuaac

SEQ ID NO: 1039920 - RNA, 19 nt, Homo sapiens
cuuugugccuuucaucuuu

SEQ ID NO: 1039921 - RNA, 19 nt, Homo sapiens
gugaccaguuuguaaugaa

SEQ ID NO: 1039922 - RNA, 19 nt, Homo sapiens
gaggugaccaguuuguaau

SEQ ID NO: 1039923 - RNA, 19 nt, Homo sapiens
gcacagagcagagguucag

SEQ ID NO: 1039924 - RNA, 19 nt, Homo sapiens
ugaggagggaagugucuua

SEQ ID NO: 1039925 - RNA, 19 nt, Homo sapiens
caccaaggagcagauguua

SEQ ID NO: 1039926 - RNA, 19 nt, Homo sapiens
ccacuccgcugagcuccuu

SEQ ID NO: 1039927 - RNA, 19 nt, Homo sapiens
gcaggugucagaggugauu

SEQ ID NO: 1039928 - RNA, 19 nt, Homo sapiens
gacuacuuguugauauuug

SEQ ID NO: 1039929 - RNA, 19 nt, Homo sapiens
cgggacuacuuguugauau

SEQ ID NO: 1039930 - RNA, 19 nt, Homo sapiens
cuuuguuggucuuuguuua

SEQ ID NO: 1039931 - RNA, 19 nt, Homo sapiens
caccugagaugggaaccaa

SEQ ID NO: 1039932 - RNA, 19 nt, Homo sapiens
uuacagcccuucccaucca

SEQ ID NO: 1039933 - RNA, 19 nt, Homo sapiens
cccaagagcgggacuacuu

SEQ ID NO: 1039934 - RNA, 19 nt, Homo sapiens
ggaggucaccaccaugauc

SEQ ID NO: 1039935 - RNA, 19 nt, Homo sapiens
gagcaucggccugaaagca

SEQ ID NO: 1039936 - RNA, 19 nt, Homo sapiens
gagaggccucagguuguua

SEQ ID NO: 1039937 - RNA, 19 nt, Homo sapiens
uuugugccuuucaucuuua

SEQ ID NO: 1039938 - RNA, 19 nt, Homo sapiens
gcgggacuacuuguugaua

SEQ ID NO: 1039939 - RNA, 19 nt, Homo sapiens
cugcagacaucccgagagu

SEQ ID NO: 1039940 - RNA, 19 nt, Homo sapiens
gauugucuuuguuggucuu

SEQ ID NO: 1039941 - RNA, 19 nt, Homo sapiens
ggaccaucccagacacaug

SEQ ID NO: 1039942 - RNA, 19 nt, Homo sapiens
gcaggggcuuugugccuuu

SEQ ID NO: 1039943 - RNA, 19 nt, Homo sapiens
uguuaaccaugcugccaaa

SEQ ID NO: 1039944 - RNA, 19 nt, Homo sapiens
cuugaagccuaagugauug

SEQ ID NO: 1039945 - RNA, 19 nt, Homo sapiens
gccccgaccuuccucauga

SEQ ID NO: 1039946 - RNA, 19 nt, Homo sapiens
acaccaaggagcagauguu

SEQ ID NO: 1039947 - RNA, 19 nt, Homo sapiens
ugucuuuguuggucuuugu

SEQ ID NO: 1039948 - RNA, 19 nt, Homo sapiens
aggaggaggucaccaccau

SEQ ID NO: 1039949 - RNA, 19 nt, Homo sapiens
ugacuucugccucugagau

SEQ ID NO: 1039950 - RNA, 19 nt, Homo sapiens
aggagcagauguuaaccau

SEQ ID NO: 1039951 - RNA, 19 nt, Homo sapiens
ggaggauggcccugagucu

SEQ ID NO: 1039952 - RNA, 19 nt, Homo sapiens
gcauugaguuugauuuguu

SEQ ID NO: 1039953 - RNA, 19 nt, Homo sapiens
acacaaaccgguaucuuua

SEQ ID NO: 1039954 - RNA, 19 nt, Homo sapiens
ggaaacacuugaugaacga

SEQ ID NO: 1039955 - RNA, 19 nt, Homo sapiens
ggagaaguuucgaauggaa

SEQ ID NO: 1039956 - RNA, 19 nt, Homo sapiens
uaaccaagcugugcuagau

SEQ ID NO: 1039957 - RNA, 19 nt, Homo sapiens
ugaacuaccuggucacaga

SEQ ID NO: 1039958 - RNA, 19 nt, Homo sapiens
uaacuugcauguccagaga

SEQ ID NO: 1039959 - RNA, 19 nt, Homo sapiens
cagaaugaguuaugcagaa

SEQ ID NO: 1039960 - RNA, 19 nt, Homo sapiens
ggaagcagcggagaaguuu

SEQ ID NO: 1039961 - RNA, 19 nt, Homo sapiens
gaugaaaucacgaaagaug

SEQ ID NO: 1039962 - RNA, 19 nt, Homo sapiens
gagagugccucacagagau

SEQ ID NO: 1039963 - RNA, 19 nt, Homo sapiens
gacacaaaccgguaucuuu

SEQ ID NO: 1039964 - RNA, 19 nt, Homo sapiens
aaagaugaguggauggaaa

SEQ ID NO: 1039965 - RNA, 19 nt, Homo sapiens
ccgaugaaaucacgaaaga

SEQ ID NO: 1039966 - RNA, 19 nt, Homo sapiens
gcggagaaguuucgaaugg

SEQ ID NO: 1039967 - RNA, 19 nt, Homo sapiens
gcagguuccgcacgaaaua

SEQ ID NO: 1039968 - RNA, 19 nt, Homo sapiens
aauggaaucuggaaucgaa

SEQ ID NO: 1039969 - RNA, 19 nt, Homo sapiens
cgaaauaaaucagaaugag

SEQ ID NO: 1039970 - RNA, 19 nt, Homo sapiens
aagcugugcuagauuauga

SEQ ID NO: 1039971 - RNA, 19 nt, Homo sapiens
accaagcugugcuagauua

SEQ ID NO: 1039972 - RNA, 19 nt, Homo sapiens
ggcagaagguguggaguga

SEQ ID NO: 1039973 - RNA, 19 nt, Homo sapiens
ucacagagggcuuuaagga

SEQ ID NO: 1039974 - RNA, 19 nt, Homo sapiens
gugagggcauugaguuuga

SEQ ID NO: 1039975 - RNA, 19 nt, Homo sapiens
acggagggcugugcuguua

SEQ ID NO: 1039976 - RNA, 19 nt, Homo sapiens
ggccuucaccuacaaguuu

SEQ ID NO: 1039977 - RNA, 19 nt, Homo sapiens
aaggaaagcugccgucucu

SEQ ID NO: 1039978 - RNA, 19 nt, Homo sapiens
aaaccgguaucuuuacuuc

SEQ ID NO: 1039979 - RNA, 19 nt, Homo sapiens
uggaaaagcucaauaacuu

SEQ ID NO: 1039980 - RNA, 19 nt, Homo sapiens
gaaucaagauccgggagau

SEQ ID NO: 1039981 - RNA, 19 nt, Homo sapiens
agaaugaguuaugcagaaa

SEQ ID NO: 1039982 - RNA, 19 nt, Homo sapiens
ggcacucgcugaagaaucu

SEQ ID NO: 1039983 - RNA, 19 nt, Homo sapiens
ccagagcucuuggacacaa

SEQ ID NO: 1039984 - RNA, 19 nt, Homo sapiens
gacauugggccuucaccua

SEQ ID NO: 1039985 - RNA, 19 nt, Homo sapiens
ggaaaagcacgaaucauga

SEQ ID NO: 1039986 - RNA, 19 nt, Homo sapiens
cagaagguguggagugaag

SEQ ID NO: 1039987 - RNA, 19 nt, Homo sapiens
gggcauugaguuugauuug

SEQ ID NO: 1039988 - RNA, 19 nt, Homo sapiens
gaagguguggagugaaguu

SEQ ID NO: 1039989 - RNA, 19 nt, Homo sapiens
cgagagugccucacagaga

SEQ ID NO: 1039990 - RNA, 19 nt, Homo sapiens
caagauccgggagaugaua

SEQ ID NO: 1039991 - RNA, 19 nt, Homo sapiens
gcacgaaauaaaucagaau

SEQ ID NO: 1039992 - RNA, 19 nt, Homo sapiens
gguuugcucuuccaguguu

SEQ ID NO: 1039993 - RNA, 19 nt, Homo sapiens
ucuggaagguugcgguuug

SEQ ID NO: 1039994 - RNA, 19 nt, Homo sapiens
ugauugaggagcccaagua

SEQ ID NO: 1039995 - RNA, 19 nt, Homo sapiens
gaaagaugaguggauggaa

SEQ ID NO: 1039996 - RNA, 19 nt, Homo sapiens
uggcacugcuggccuuuga

SEQ ID NO: 1039997 - RNA, 19 nt, Homo sapiens
ggacacaaaccgguaucuu

SEQ ID NO: 1039998 - RNA, 19 nt, Homo sapiens
ccagagagcagacaugaac

SEQ ID NO: 1039999 - RNA, 19 nt, Homo sapiens
ggagggcugugcuguuagg

SEQ ID NO: 1040000 - RNA, 19 nt, Homo sapiens
guggaaaacuugcaaggaa

SEQ ID NO: 1040001 - RNA, 19 nt, Homo sapiens
aaucgaaccuaguguggau

SEQ ID NO: 1040002 - RNA, 19 nt, Homo sapiens
ucugcuuucuguuagcuua

SEQ ID NO: 1040003 - RNA, 19 nt, Homo sapiens
gaucuggaaacacuugaug

SEQ ID NO: 1040004 - RNA, 19 nt, Homo sapiens
gcugaaggauucggucuac

SEQ ID NO: 1040005 - RNA, 19 nt, Homo sapiens
caucucuucugggcaguuu

SEQ ID NO: 1040006 - RNA, 19 nt, Homo sapiens
gcgcuggaguuugcacaga

SEQ ID NO: 1040007 - RNA, 19 nt, Homo sapiens
guggaucaaugaaccaucu

SEQ ID NO: 1040008 - RNA, 19 nt, Homo sapiens
ucaugauucugcuuucugu

SEQ ID NO: 1040009 - RNA, 19 nt, Homo sapiens
gccaucgccuugaucaaca

SEQ ID NO: 1040010 - RNA, 19 nt, Homo sapiens
guuccuaguggaucaauga

SEQ ID NO: 1040011 - RNA, 19 nt, Homo sapiens
cacccaaacuggcaaaauu

SEQ ID NO: 1040012 - RNA, 19 nt, Homo sapiens
ggcauugaguuugauuugu

SEQ ID NO: 1040013 - RNA, 19 nt, Homo sapiens
ggauggaaaagcucaauaa

SEQ ID NO: 1040014 - RNA, 19 nt, Homo sapiens
uacugaaacuacuacuuug

SEQ ID NO: 1040015 - RNA, 19 nt, Homo sapiens
gaucaaugaaccaucucuu

SEQ ID NO: 1040016 - RNA, 19 nt, Homo sapiens
ucagcaagggugugauuga

SEQ ID NO: 1040017 - RNA, 19 nt, Homo sapiens
gcacugcuggccuuugaca

SEQ ID NO: 1040018 - RNA, 19 nt, Homo sapiens
uaucuuuacuuccauuugc

SEQ ID NO: 1040019 - RNA, 19 nt, Homo sapiens
gggagaugauacugaaagg

SEQ ID NO: 1040020 - RNA, 19 nt, Homo sapiens
cgaauggaaucuggaaucg

SEQ ID NO: 1040021 - RNA, 19 nt, Homo sapiens
ggucacagagggcuuuaag

SEQ ID NO: 1040022 - RNA, 19 nt, Homo sapiens
gcugaagaaucuggaaggu

SEQ ID NO: 1040023 - RNA, 19 nt, Homo sapiens
cagcaagggugugauugag

SEQ ID NO: 1040024 - RNA, 19 nt, Homo sapiens
gcagcaacagcauuugauc

SEQ ID NO: 1040025 - RNA, 19 nt, Homo sapiens
caaugaaccaucucuucug

SEQ ID NO: 1040026 - RNA, 19 nt, Homo sapiens
ucaaugaaccaucucuucu

SEQ ID NO: 1040027 - RNA, 19 nt, Homo sapiens
cggagaaguuucgaaugga

SEQ ID NO: 1040028 - RNA, 19 nt, Homo sapiens
augauucugcuuucuguua

SEQ ID NO: 1040029 - RNA, 19 nt, Homo sapiens
gccucuggcugcugaagga

SEQ ID NO: 1040030 - RNA, 19 nt, Homo sapiens
cacagagggcuuuaaggaa

SEQ ID NO: 1040031 - RNA, 19 nt, Homo sapiens
cagcggagaaguuucgaau

SEQ ID NO: 1040032 - RNA, 19 nt, Homo sapiens
gagugaaguuaaccaagcu

SEQ ID NO: 1040033 - RNA, 19 nt, Homo sapiens
gguguggagugaaguuaac

SEQ ID NO: 1040034 - RNA, 19 nt, Homo sapiens
gaaaagcacgaaucaugau

SEQ ID NO: 1040035 - RNA, 19 nt, Homo sapiens
cgaaagaugaguggaugga

SEQ ID NO: 1040036 - RNA, 19 nt, Homo sapiens
gagccgagagugccucaca

SEQ ID NO: 1040037 - RNA, 19 nt, Homo sapiens
acaaaccgguaucuuuacu

SEQ ID NO: 1040038 - RNA, 19 nt, Homo sapiens
uccgggagaugauacugaa

SEQ ID NO: 1040039 - RNA, 19 nt, Homo sapiens
ugauucugcuuucuguuag

SEQ ID NO: 1040040 - RNA, 19 nt, Homo sapiens
gaaucuggaaucgaaccua

SEQ ID NO: 1040041 - RNA, 19 nt, Homo sapiens
gagaaguuucgaauggaau

SEQ ID NO: 1040042 - RNA, 19 nt, Homo sapiens
caacacccaaacuggcaaa

SEQ ID NO: 1040043 - RNA, 19 nt, Homo sapiens
cgcacgaaauaaaucagaa

SEQ ID NO: 1040044 - RNA, 19 nt, Homo sapiens
uaaggaagcagcggagaag

SEQ ID NO: 1040045 - RNA, 19 nt, Homo sapiens
ucacgaaagaugaguggau

SEQ ID NO: 1040046 - RNA, 19 nt, Homo sapiens
ggaaaagcucaauaacuug

SEQ ID NO: 1040047 - RNA, 19 nt, Homo sapiens
guccagagagcagacauga

SEQ ID NO: 1040048 - RNA, 19 nt, Homo sapiens
cuacuacuuugggcucaga

SEQ ID NO: 1040049 - RNA, 19 nt, Homo sapiens
gaaaucacgaaagaugagu

SEQ ID NO: 1040050 - RNA, 19 nt, Homo sapiens
ccucagcaagggugugauu

SEQ ID NO: 1040051 - RNA, 19 nt, Homo sapiens
cagagcucuuggacacaaa

SEQ ID NO: 1040052 - RNA, 19 nt, Homo sapiens
ggagacucauuuagauuua

SEQ ID NO: 1040053 - RNA, 19 nt, Homo sapiens
caauaaaguuagcccauuu

SEQ ID NO: 1040054 - RNA, 19 nt, Homo sapiens
gcacucgucuucuauguuc

SEQ ID NO: 1040055 - RNA, 19 nt, Homo sapiens
ggagagaguggaauuguuu

SEQ ID NO: 1040056 - RNA, 19 nt, Homo sapiens
guguauggcugcugcuuua

SEQ ID NO: 1040057 - RNA, 19 nt, Homo sapiens
ggucagcauucgauauaaa

SEQ ID NO: 1040058 - RNA, 19 nt, Homo sapiens
gcaauuggcaugggaauga

SEQ ID NO: 1040059 - RNA, 19 nt, Homo sapiens
cuaagauucuggucaauau

SEQ ID NO: 1040060 - RNA, 19 nt, Homo sapiens
ggaagaauaugaacaugcu

SEQ ID NO: 1040061 - RNA, 19 nt, Homo sapiens
gaaccagaauuugaucuca

SEQ ID NO: 1040062 - RNA, 19 nt, Homo sapiens
gccaagagguagugaugaa

SEQ ID NO: 1040063 - RNA, 19 nt, Homo sapiens
ggugaagaguauaagagua

SEQ ID NO: 1040064 - RNA, 19 nt, Homo sapiens
aaagagagaugguuuugua

SEQ ID NO: 1040065 - RNA, 19 nt, Homo sapiens
ucaacuauguuccacuaaa

SEQ ID NO: 1040066 - RNA, 19 nt, Homo sapiens
ccacauuagcuuguuauua

SEQ ID NO: 1040067 - RNA, 19 nt, Homo sapiens
aagauuaugccaacaguua

SEQ ID NO: 1040068 - RNA, 19 nt, Homo sapiens
gggagacucauuuagauuu

SEQ ID NO: 1040069 - RNA, 19 nt, Homo sapiens
gaguaucccuugcaguguu

SEQ ID NO: 1040070 - RNA, 19 nt, Homo sapiens
caacuauguuccacuaaag

SEQ ID NO: 1040071 - RNA, 19 nt, Homo sapiens
aaacuaccaccuacuuuaa

SEQ ID NO: 1040072 - RNA, 19 nt, Homo sapiens
uacaagcacucgucuucua

SEQ ID NO: 1040073 - RNA, 19 nt, Homo sapiens
cugaucaucugaaucuuaa

SEQ ID NO: 1040074 - RNA, 19 nt, Homo sapiens
gauaucaaguccaugucuu

SEQ ID NO: 1040075 - RNA, 19 nt, Homo sapiens
gcauaugcccuugcaguuu

SEQ ID NO: 1040076 - RNA, 19 nt, Homo sapiens
gaugguggcuggagguaca

SEQ ID NO: 1040077 - RNA, 19 nt, Homo sapiens
ucaaguggcuacugguguu

SEQ ID NO: 1040078 - RNA, 19 nt, Homo sapiens
ugccaacaguuaagaagua

SEQ ID NO: 1040079 - RNA, 19 nt, Homo sapiens
gggcccaaaucaugcagua

SEQ ID NO: 1040080 - RNA, 19 nt, Homo sapiens
cauaugcccuugcaguuuc

SEQ ID NO: 1040081 - RNA, 19 nt, Homo sapiens
gaauuagccaugaaggauu

SEQ ID NO: 1040082 - RNA, 19 nt, Homo sapiens
ucucaacuauguuccacua

SEQ ID NO: 1040083 - RNA, 19 nt, Homo sapiens
caggucagcauucgauaua

SEQ ID NO: 1040084 - RNA, 19 nt, Homo sapiens
ccaacugccugcaaaauuu

SEQ ID NO: 1040085 - RNA, 19 nt, Homo sapiens
acaaagcuaucaaacaucu

SEQ ID NO: 1040086 - RNA, 19 nt, Homo sapiens
acaauaaaguuagcccauu

SEQ ID NO: 1040087 - RNA, 19 nt, Homo sapiens
cauuggggcugcagaauua

SEQ ID NO: 1040088 - RNA, 19 nt, Homo sapiens
guacuaaugcaacacuuug

SEQ ID NO: 1040089 - RNA, 19 nt, Homo sapiens
gaagagcccggaucuaugc

SEQ ID NO: 1040090 - RNA, 19 nt, Homo sapiens
guuggcaugucgaccauuu

SEQ ID NO: 1040091 - RNA, 19 nt, Homo sapiens
aaugauuccucuugaaguu

SEQ ID NO: 1040092 - RNA, 19 nt, Homo sapiens
ggaauguguuucugaucau

SEQ ID NO: 1040093 - RNA, 19 nt, Homo sapiens
uuucggaacugugccaaua

SEQ ID NO: 1040094 - RNA, 19 nt, Homo sapiens
gccaacaguuaagaaguaa

SEQ ID NO: 1040095 - RNA, 19 nt, Homo sapiens
uaaaggcacaggaauggaa

SEQ ID NO: 1040096 - RNA, 19 nt, Homo sapiens
cuuuaaaccuggauuguuc

SEQ ID NO: 1040097 - RNA, 19 nt, Homo sapiens
cuucaaagaccaugcauau

SEQ ID NO: 1040098 - RNA, 19 nt, Homo sapiens
ccggaucuaugcagaaguu

SEQ ID NO: 1040099 - RNA, 19 nt, Homo sapiens
gugggagacucauuuagau

SEQ ID NO: 1040100 - RNA, 19 nt, Homo sapiens
cugaaacugcuuugaauuu

SEQ ID NO: 1040101 - RNA, 19 nt, Homo sapiens
gugaagaguauaagaguau

SEQ ID NO: 1040102 - RNA, 19 nt, Homo sapiens
ucaaagaccaugcauaugc

SEQ ID NO: 1040103 - RNA, 19 nt, Homo sapiens
aaucagauaucaaguccau

SEQ ID NO: 1040104 - RNA, 19 nt, Homo sapiens
gcacaggaauggaaaacug

SEQ ID NO: 1040105 - RNA, 19 nt, Homo sapiens
uuaccacauuagcuuguua

SEQ ID NO: 1040106 - RNA, 19 nt, Homo sapiens
gaaucuuaaucauguccaa

SEQ ID NO: 1040107 - RNA, 19 nt, Homo sapiens
gcuggacuguagaacauau

SEQ ID NO: 1040108 - RNA, 19 nt, Homo sapiens
aagaagagcccggaucuau

SEQ ID NO: 1040109 - RNA, 19 nt, Homo sapiens
caaagaagagcccggaucu

SEQ ID NO: 1040110 - RNA, 19 nt, Homo sapiens
cauaggcgaguugucauua

SEQ ID NO: 1040111 - RNA, 19 nt, Homo sapiens
gagagaugguuuuguaaug

SEQ ID NO: 1040112 - RNA, 19 nt, Homo sapiens
gcugugggagacucauuua

SEQ ID NO: 1040113 - RNA, 19 nt, Homo sapiens
gaucaucugaaucuuaauc

SEQ ID NO: 1040114 - RNA, 19 nt, Homo sapiens
gcauaggcgaguugucauu

SEQ ID NO: 1040115 - RNA, 19 nt, Homo sapiens
aggaauguguuucugauca

SEQ ID NO: 1040116 - RNA, 19 nt, Homo sapiens
gaauguguuucugaucauc

SEQ ID NO: 1040117 - RNA, 19 nt, Homo sapiens
caucugaaucuuaaucaug

SEQ ID NO: 1040118 - RNA, 19 nt, Homo sapiens
ccuaagauucuggucaaua

SEQ ID NO: 1040119 - RNA, 19 nt, Homo sapiens
cauuacaggcauuggcuua

SEQ ID NO: 1040120 - RNA, 19 nt, Homo sapiens
gguacuaaugcaacacuuu

SEQ ID NO: 1040121 - RNA, 19 nt, Homo sapiens
ggaaaacugagaaaagauu

SEQ ID NO: 1040122 - RNA, 19 nt, Homo sapiens
gcaugucgaccauuucauc

SEQ ID NO: 1040123 - RNA, 19 nt, Homo sapiens
ucugaucaucugaaucuua

SEQ ID NO: 1040124 - RNA, 19 nt, Homo sapiens
gguuugggaucgucuuauc

SEQ ID NO: 1040125 - RNA, 19 nt, Homo sapiens
ucaaugcacaugcuacuuc

SEQ ID NO: 1040126 - RNA, 19 nt, Homo sapiens
uauuagcccuuuaucucuu

SEQ ID NO: 1040127 - RNA, 19 nt, Homo sapiens
cuacugguguugcaauugg

SEQ ID NO: 1040128 - RNA, 19 nt, Homo sapiens
ucagauaucaaguccaugu

SEQ ID NO: 1040129 - RNA, 19 nt, Homo sapiens
ccaaaucagauaucaaguc

SEQ ID NO: 1040130 - RNA, 19 nt, Homo sapiens
gcuuaugugccaagaggua

SEQ ID NO: 1040131 - RNA, 19 nt, Homo sapiens
gaggagagaguggaauugu

SEQ ID NO: 1040132 - RNA, 19 nt, Homo sapiens
acaggaauguguuucugau

SEQ ID NO: 1040133 - RNA, 19 nt, Homo sapiens
uguuggaacucaccugguu

SEQ ID NO: 1040134 - RNA, 19 nt, Homo sapiens
ucaagauuaugccaacagu

SEQ ID NO: 1040135 - RNA, 19 nt, Homo sapiens
uggaauuguuucacugguu

SEQ ID NO: 1040136 - RNA, 19 nt, Homo sapiens
guauggcugcugcuuuaaa

SEQ ID NO: 1040137 - RNA, 19 nt, Homo sapiens
gcuggcauccucagucaga

SEQ ID NO: 1040138 - RNA, 19 nt, Homo sapiens
ucacauaacugccccugau

SEQ ID NO: 1040139 - RNA, 19 nt, Homo sapiens
gcuggaagaauaugaacau

SEQ ID NO: 1040140 - RNA, 19 nt, Homo sapiens
ggaggagagaguggaauug

SEQ ID NO: 1040141 - RNA, 19 nt, Homo sapiens
aaaacuaccaccuacuuua

SEQ ID NO: 1040142 - RNA, 19 nt, Homo sapiens
gcccaaaucaugcaguauc

SEQ ID NO: 1040143 - RNA, 19 nt, Homo sapiens
ucccuaagauucuggucaa

SEQ ID NO: 1040144 - RNA, 19 nt, Homo sapiens
ccacuaaaggcacaggaau

SEQ ID NO: 1040145 - RNA, 19 nt, Homo sapiens
aauuagccaugaaggauuc

SEQ ID NO: 1040146 - RNA, 19 nt, Homo sapiens
cugcagaauuagccaugaa

SEQ ID NO: 1040147 - RNA, 19 nt, Homo sapiens
gcugcagaauuagccauga

SEQ ID NO: 1040148 - RNA, 19 nt, Homo sapiens
guccaaaucagauaucaag

SEQ ID NO: 1040149 - RNA, 19 nt, Homo sapiens
caguguugcugcuuaugug

SEQ ID NO: 1040150 - RNA, 19 nt, Homo sapiens
aaugcaacacuuuguauug

SEQ ID NO: 1040151 - RNA, 19 nt, Homo sapiens
cuaaugcaacacuuuguau

SEQ ID NO: 1040152 - RNA, 19 nt, Homo sapiens
gagaauaacugccugaucu

SEQ ID NO: 1040153 - RNA, 19 nt, Homo sapiens
gggauugacugagaucuua

SEQ ID NO: 1040154 - RNA, 19 nt, Homo sapiens
gcaagcagccuuccucaaa

SEQ ID NO: 1040155 - RNA, 19 nt, Homo sapiens
caaacaaacuccacaacug

SEQ ID NO: 1040156 - RNA, 19 nt, Homo sapiens
uaaggaagauggacacaug

SEQ ID NO: 1040157 - RNA, 19 nt, Homo sapiens
gaugaacuccuaauuggua

SEQ ID NO: 1040158 - RNA, 19 nt, Homo sapiens
gugcucaucuccaucauuu

SEQ ID NO: 1040159 - RNA, 19 nt, Homo sapiens
caucagcaaauccuuauua

SEQ ID NO: 1040160 - RNA, 19 nt, Homo sapiens
gggaugaacuccuaauugg

SEQ ID NO: 1040161 - RNA, 19 nt, Homo sapiens
uaucauggcuauuacacuu

SEQ ID NO: 1040162 - RNA, 19 nt, Homo sapiens
gaucuauuauucaguggaa

SEQ ID NO: 1040163 - RNA, 19 nt, Homo sapiens
gcaaugaggcagcuaagug

SEQ ID NO: 1040164 - RNA, 19 nt, Homo sapiens
ugacugagaucuuaacaac

SEQ ID NO: 1040165 - RNA, 19 nt, Homo sapiens
aaacugaagcguauagauu

SEQ ID NO: 1040166 - RNA, 19 nt, Homo sapiens
gagagggaauuguacaagu

SEQ ID NO: 1040167 - RNA, 19 nt, Homo sapiens
uauuuggccuugacauuaa

SEQ ID NO: 1040168 - RNA, 19 nt, Homo sapiens
caggagggauugacugaga

SEQ ID NO: 1040169 - RNA, 19 nt, Homo sapiens
gaagagcuaccgccugugu

SEQ ID NO: 1040170 - RNA, 19 nt, Homo sapiens
gauauuuggccuugacauu

SEQ ID NO: 1040171 - RNA, 19 nt, Homo sapiens
gcucaucuccaucauuuau

SEQ ID NO: 1040172 - RNA, 19 nt, Homo sapiens
cuuccugacuuuaauauug

SEQ ID NO: 1040173 - RNA, 19 nt, Homo sapiens
cuucagggcuccagacaug

SEQ ID NO: 1040174 - RNA, 19 nt, Homo sapiens
agagggaauuguacaaguu

SEQ ID NO: 1040175 - RNA, 19 nt, Homo sapiens
gaggauaccugggaugaac

SEQ ID NO: 1040176 - RNA, 19 nt, Homo sapiens
uggcgaagcucuggaucua

SEQ ID NO: 1040177 - RNA, 19 nt, Homo sapiens
gaagggaagaacaucaaga

SEQ ID NO: 1040178 - RNA, 19 nt, Homo sapiens
gcaacgauacaucagcaaa

SEQ ID NO: 1040179 - RNA, 19 nt, Homo sapiens
ccuaauugguaguguagaa

SEQ ID NO: 1040180 - RNA, 19 nt, Homo sapiens
ggaagaacaucaagaaaac

SEQ ID NO: 1040181 - RNA, 19 nt, Homo sapiens
gacagaugccucccuggua

SEQ ID NO: 1040182 - RNA, 19 nt, Homo sapiens
ugaauguuaucauggcuau

SEQ ID NO: 1040183 - RNA, 19 nt, Homo sapiens
cagcaaauccuuauuaucc

SEQ ID NO: 1040184 - RNA, 19 nt, Homo sapiens
ccacaacugcaggauauuu

SEQ ID NO: 1040185 - RNA, 19 nt, Homo sapiens
uaccugggaugaacuccua

SEQ ID NO: 1040186 - RNA, 19 nt, Homo sapiens
gcagagacuguggcaauga

SEQ ID NO: 1040187 - RNA, 19 nt, Homo sapiens
uguguaugcuccagguuaa

SEQ ID NO: 1040188 - RNA, 19 nt, Homo sapiens
gguuuuggcuggugauuaa

SEQ ID NO: 1040189 - RNA, 19 nt, Homo sapiens
auaccaggauggagaagaa

SEQ ID NO: 1040190 - RNA, 19 nt, Homo sapiens
ggaucuacccggugaaauc

SEQ ID NO: 1040191 - RNA, 19 nt, Homo sapiens
ccagguuaaugcaaggaaa

SEQ ID NO: 1040192 - RNA, 19 nt, Homo sapiens
cuccacaacugcaggauau

SEQ ID NO: 1040193 - RNA, 19 nt, Homo sapiens
gaauaacugccugaucuuc

SEQ ID NO: 1040194 - RNA, 19 nt, Homo sapiens
auacaucagcaaauccuua

SEQ ID NO: 1040195 - RNA, 19 nt, Homo sapiens
gugagaggguccguaguug

SEQ ID NO: 1040196 - RNA, 19 nt, Homo sapiens
caacgauacaucagcaaau

SEQ ID NO: 1040197 - RNA, 19 nt, Homo sapiens
aacaacagcagcaacgaua

SEQ ID NO: 1040198 - RNA, 19 nt, Homo sapiens
gagggaauuguacaaguug

SEQ ID NO: 1040199 - RNA, 19 nt, Homo sapiens
gggaagaacaucaagaaaa

SEQ ID NO: 1040200 - RNA, 19 nt, Homo sapiens
caagcagccuuccucaaac

SEQ ID NO: 1040201 - RNA, 19 nt, Homo sapiens
acugagaucuuaacaacag

SEQ ID NO: 1040202 - RNA, 19 nt, Homo sapiens
ugaagcguauagauugguu

SEQ ID NO: 1040203 - RNA, 19 nt, Homo sapiens
guuaaugcaaggaaaguau

SEQ ID NO: 1040204 - RNA, 19 nt, Homo sapiens
cagcagcaacgauacauca

SEQ ID NO: 1040205 - RNA, 19 nt, Homo sapiens
caacagcagcaacgauaca

SEQ ID NO: 1040206 - RNA, 19 nt, Homo sapiens
ccacuggacacccugaaga

SEQ ID NO: 1040207 - RNA, 19 nt, Homo sapiens
gaaaacuucuccccacucu

SEQ ID NO: 1040208 - RNA, 19 nt, Homo sapiens
ggcagagacuguggcaaug

SEQ ID NO: 1040209 - RNA, 19 nt, Homo sapiens
auauuuggccuugacauua

SEQ ID NO: 1040210 - RNA, 19 nt, Homo sapiens
uggacacccugaagagcua

SEQ ID NO: 1040211 - RNA, 19 nt, Homo sapiens
uuuagguacugaaggcuuu

SEQ ID NO: 1040212 - RNA, 19 nt, Homo sapiens
cuucugagagggaauugua

SEQ ID NO: 1040213 - RNA, 19 nt, Homo sapiens
ccacucuugaucagaauuu

SEQ ID NO: 1040214 - RNA, 19 nt, Homo sapiens
ggauugacugagaucuuaa

SEQ ID NO: 1040215 - RNA, 19 nt, Homo sapiens
ggugauauggcuucagcaa

SEQ ID NO: 1040216 - RNA, 19 nt, Homo sapiens
uguaucggaugguguagug

SEQ ID NO: 1040217 - RNA, 19 nt, Homo sapiens
gaacuccuaauugguagug

SEQ ID NO: 1040218 - RNA, 19 nt, Homo sapiens
aaacaugaagggaagaaca

SEQ ID NO: 1040219 - RNA, 19 nt, Homo sapiens
gcagccuuccucaaacaaa

SEQ ID NO: 1040220 - RNA, 19 nt, Homo sapiens
aagcagccuuccucaaaca

SEQ ID NO: 1040221 - RNA, 19 nt, Homo sapiens
uauccagccuucaacuauc

SEQ ID NO: 1040222 - RNA, 19 nt, Homo sapiens
uaacaacagcagcaacgau

SEQ ID NO: 1040223 - RNA, 19 nt, Homo sapiens
aagggaagaacaucaagaa

SEQ ID NO: 1040224 - RNA, 19 nt, Homo sapiens
gcaggauauuuggccuuga

SEQ ID NO: 1040225 - RNA, 19 nt, Homo sapiens
ugggaugaacuccuaauug

SEQ ID NO: 1040226 - RNA, 19 nt, Homo sapiens
augccucccugguagauuu

SEQ ID NO: 1040227 - RNA, 19 nt, Homo sapiens
ccggugaaauccugcaaag

SEQ ID NO: 1040228 - RNA, 19 nt, Homo sapiens
gagaagaaaaugaaaaugg

SEQ ID NO: 1040229 - RNA, 19 nt, Homo sapiens
ugugagaggguccguaguu

SEQ ID NO: 1040230 - RNA, 19 nt, Homo sapiens
acuccuaauugguagugua

SEQ ID NO: 1040231 - RNA, 19 nt, Homo sapiens
ggaggauaccugggaugaa

SEQ ID NO: 1040232 - RNA, 19 nt, Homo sapiens
ugaauaccaggauggagaa

SEQ ID NO: 1040233 - RNA, 19 nt, Homo sapiens
cagagacuguggcaaugag

SEQ ID NO: 1040234 - RNA, 19 nt, Homo sapiens
cauuaaaggcagagacugu

SEQ ID NO: 1040235 - RNA, 19 nt, Homo sapiens
uggauccacuagggugaua

SEQ ID NO: 1040236 - RNA, 19 nt, Homo sapiens
ucaaacaaacuccacaacu

SEQ ID NO: 1040237 - RNA, 19 nt, Homo sapiens
aacgauacaucagcaaauc

SEQ ID NO: 1040238 - RNA, 19 nt, Homo sapiens
auuggaagccugagaguug

SEQ ID NO: 1040239 - RNA, 19 nt, Homo sapiens
gaccggcugugaugcuuuu

SEQ ID NO: 1040240 - RNA, 19 nt, Homo sapiens
gcaaguuuaaugaaucaac

SEQ ID NO: 1040241 - RNA, 19 nt, Homo sapiens
gcuauuacacuuuuacuuc

SEQ ID NO: 1040242 - RNA, 19 nt, Homo sapiens
cacaacugcaggauauuug

SEQ ID NO: 1040243 - RNA, 19 nt, Homo sapiens
gauauggcuucagcaacca

SEQ ID NO: 1040244 - RNA, 19 nt, Homo sapiens
gauccacuagggugauaug

SEQ ID NO: 1040245 - RNA, 19 nt, Homo sapiens
caggauauuuggccuugac

SEQ ID NO: 1040246 - RNA, 19 nt, Homo sapiens
ggcuggugauuaaggaaga

SEQ ID NO: 1040247 - RNA, 19 nt, Homo sapiens
gguuaaugcaaggaaagua

SEQ ID NO: 1040248 - RNA, 19 nt, Homo sapiens
uggagaauuucaggccaaa

SEQ ID NO: 1040249 - RNA, 19 nt, Homo sapiens
ucgccugcccggauccuua

SEQ ID NO: 1040250 - RNA, 19 nt, Homo sapiens
ucagcaaccaggagggauu

SEQ ID NO: 1040251 - RNA, 19 nt, Homo sapiens
agagcuaccgccuguguga

SEQ ID NO: 1040252 - RNA, 19 nt, Homo sapiens
ggaagaauaucgaaaugua

SEQ ID NO: 1040253 - RNA, 19 nt, Homo sapiens
gcaucacucuggaagaaua

SEQ ID NO: 1040254 - RNA, 19 nt, Homo sapiens
ggaaggagaagcugagauu

SEQ ID NO: 1040255 - RNA, 19 nt, Homo sapiens
gggaaacccucacaucuag

SEQ ID NO: 1040256 - RNA, 19 nt, Homo sapiens
gcaaggagaacuucaacaa

SEQ ID NO: 1040257 - RNA, 19 nt, Homo sapiens
aaggagaacuucaacaaug

SEQ ID NO: 1040258 - RNA, 19 nt, Homo sapiens
gaaacccucacaucuagaa

SEQ ID NO: 1040259 - RNA, 19 nt, Homo sapiens
ggagaucagccuaccauuc

SEQ ID NO: 1040260 - RNA, 19 nt, Homo sapiens
gcggagagacugcacuuug

SEQ ID NO: 1040261 - RNA, 19 nt, Homo sapiens
ggaucgacauugagaccaa

SEQ ID NO: 1040262 - RNA, 19 nt, Homo sapiens
ccgcaucacucuggaagaa

SEQ ID NO: 1040263 - RNA, 19 nt, Homo sapiens
gaaggagaagcugagauuu

SEQ ID NO: 1040264 - RNA, 19 nt, Homo sapiens
gggcaagaccggcuucuca

SEQ ID NO: 1040265 - RNA, 19 nt, Homo sapiens
gcccuccgccguuauauga

SEQ ID NO: 1040266 - RNA, 19 nt, Homo sapiens
cgggaaacccucacaucua

SEQ ID NO: 1040267 - RNA, 19 nt, Homo sapiens
gagaucagccuaccauucg

SEQ ID NO: 1040268 - RNA, 19 nt, Homo sapiens
cugcgcaccuugugucuug

SEQ ID NO: 1040269 - RNA, 19 nt, Homo sapiens
caaggagaacuucaacaau

SEQ ID NO: 1040270 - RNA, 19 nt, Homo sapiens
gauuucuguuccacaugua

SEQ ID NO: 1040271 - RNA, 19 nt, Homo sapiens
ugagauuucuguuccacau

SEQ ID NO: 1040272 - RNA, 19 nt, Homo sapiens
gaagcugagauuucuguuc

SEQ ID NO: 1040273 - RNA, 19 nt, Homo sapiens
aggagaacuucaacaaugu

SEQ ID NO: 1040274 - RNA, 19 nt, Homo sapiens
cacguccgcuuccuuaaca

SEQ ID NO: 1040275 - RNA, 19 nt, Homo sapiens
gguaugguaugugggacuu

SEQ ID NO: 1040276 - RNA, 19 nt, Homo sapiens
gcaagaccggcuucucauc

SEQ ID NO: 1040277 - RNA, 19 nt, Homo sapiens
cuggaagaauaucgaaaug

SEQ ID NO: 1040278 - RNA, 19 nt, Homo sapiens
ugaccaucauguccuacuu

SEQ ID NO: 1040279 - RNA, 19 nt, Homo sapiens
gcacguccgcuuccuuaac

SEQ ID NO: 1040280 - RNA, 19 nt, Homo sapiens
agauuucuguuccacaugu

SEQ ID NO: 1040281 - RNA, 19 nt, Homo sapiens
uggccuggcugaugagauc

SEQ ID NO: 1040282 - RNA, 19 nt, Homo sapiens
cggagagacugcacuuugc

SEQ ID NO: 1040283 - RNA, 19 nt, Homo sapiens
aaggagaagcugagauuuc

SEQ ID NO: 1040284 - RNA, 19 nt, Homo sapiens
ggaaacccucacaucuaga

SEQ ID NO: 1040285 - RNA, 19 nt, Homo sapiens
cgacauugagaccaagaug

SEQ ID NO: 1040286 - RNA, 19 nt, Homo sapiens
ggaucaccuucgaggacuu

SEQ ID NO: 1040287 - RNA, 19 nt, Homo sapiens
ggcaggggaucgacauuga

SEQ ID NO: 1040288 - RNA, 19 nt, Homo sapiens
gcagauggagccugaucag

SEQ ID NO: 1040289 - RNA, 19 nt, Homo sapiens
gaccaucauguccuacuuc

SEQ ID NO: 1040290 - RNA, 19 nt, Homo sapiens
gcgcaccuugugucuugua

SEQ ID NO: 1040291 - RNA, 19 nt, Homo sapiens
ggacuuccugaccaucaug

SEQ ID NO: 1040292 - RNA, 19 nt, Homo sapiens
ggagaacuucaacaauguc

SEQ ID NO: 1040293 - RNA, 19 nt, Homo sapiens
ucccggaccuggagcucaa

SEQ ID NO: 1040294 - RNA, 19 nt, Homo sapiens
gcugugauccguaguaaua

SEQ ID NO: 1040295 - RNA, 19 nt, Homo sapiens
gcaagcagaucaaguucga

SEQ ID NO: 1040296 - RNA, 19 nt, Homo sapiens
ucagaggacucagccuuua

SEQ ID NO: 1040297 - RNA, 19 nt, Homo sapiens
gcagaucaaguucgagaaa

SEQ ID NO: 1040298 - RNA, 19 nt, Homo sapiens
gaagaugaaccaccacaag

SEQ ID NO: 1040299 - RNA, 19 nt, Homo sapiens
gauccguaguaauaaauuc

SEQ ID NO: 1040300 - RNA, 19 nt, Homo sapiens
ccgcagaacggucaauuug

SEQ ID NO: 1040301 - RNA, 19 nt, Homo sapiens
gacgcaagcagaucaaguu

SEQ ID NO: 1040302 - RNA, 19 nt, Homo sapiens
accggaagcuggugaagaa

SEQ ID NO: 1040303 - RNA, 19 nt, Homo sapiens
agaucaaguucgagaaaga

SEQ ID NO: 1040304 - RNA, 19 nt, Homo sapiens
ggaagcuggugaagaagac

SEQ ID NO: 1040305 - RNA, 19 nt, Homo sapiens
agaugaaccaccacaagua

SEQ ID NO: 1040306 - RNA, 19 nt, Homo sapiens
ugugauccguaguaauaaa

SEQ ID NO: 1040307 - RNA, 19 nt, Homo sapiens
gcccguugcugcugugauc

SEQ ID NO: 1040308 - RNA, 19 nt, Homo sapiens
ggaagaugaaccaccacaa

SEQ ID NO: 1040309 - RNA, 19 nt, Homo sapiens
cggaugcgccucaaauuca

SEQ ID NO: 1040310 - RNA, 19 nt, Homo sapiens
gcggaugcgccucaaauuc

SEQ ID NO: 1040311 - RNA, 19 nt, Homo sapiens
gaugaaccaccacaaguac

SEQ ID NO: 1040312 - RNA, 19 nt, Homo sapiens
cagaggacucagccuuuaa

SEQ ID NO: 1040313 - RNA, 19 nt, Homo sapiens
uaaauucucagaggacuca

SEQ ID NO: 1040314 - RNA, 19 nt, Homo sapiens
agaggacucagccuuuaaa

SEQ ID NO: 1040315 - RNA, 19 nt, Homo sapiens
ggaugcgccucaaauucag

SEQ ID NO: 1040316 - RNA, 19 nt, Homo sapiens
cagaucaaguucgagaaag

SEQ ID NO: 1040317 - RNA, 19 nt, Homo sapiens
cugcugugauccguaguaa

SEQ ID NO: 1040318 - RNA, 19 nt, Homo sapiens
gccgcagaacggucaauuu

SEQ ID NO: 1040319 - RNA, 19 nt, Homo sapiens
cgccucaaauucagugcaa

SEQ ID NO: 1040320 - RNA, 19 nt, Homo sapiens
gcugcugugauccguagua

SEQ ID NO: 1040321 - RNA, 19 nt, Homo sapiens
gcagauaacuuucagugua

SEQ ID NO: 1040322 - RNA, 19 nt, Homo sapiens
gcacagcccuuuauaguga

SEQ ID NO: 1040323 - RNA, 19 nt, Homo sapiens
cgaaagagcuugucacgau

SEQ ID NO: 1040324 - RNA, 19 nt, Homo sapiens
cuacaacuaucuuccuuua

SEQ ID NO: 1040325 - RNA, 19 nt, Homo sapiens
guaauuaaauccggaugua

SEQ ID NO: 1040326 - RNA, 19 nt, Homo sapiens
uagagcaacuuguacauuu

SEQ ID NO: 1040327 - RNA, 19 nt, Homo sapiens
gaaaaggcuucucuugaua

SEQ ID NO: 1040328 - RNA, 19 nt, Homo sapiens
gaugauuccuaccaccuua

SEQ ID NO: 1040329 - RNA, 19 nt, Homo sapiens
ucaauugacuauucccuuu

SEQ ID NO: 1040330 - RNA, 19 nt, Homo sapiens
ggauauagccagagaacaa

SEQ ID NO: 1040331 - RNA, 19 nt, Homo sapiens
gcacagugaacuccucaua

SEQ ID NO: 1040332 - RNA, 19 nt, Homo sapiens
gcacaguucauguucagua

SEQ ID NO: 1040333 - RNA, 19 nt, Homo sapiens
ucacaaggcugcaccagau

SEQ ID NO: 1040334 - RNA, 19 nt, Homo sapiens
cauagcaucuucuuuggaa

SEQ ID NO: 1040335 - RNA, 19 nt, Homo sapiens
caugagauguccaggauug

SEQ ID NO: 1040336 - RNA, 19 nt, Homo sapiens
uaacuacuguuuccaagau

SEQ ID NO: 1040337 - RNA, 19 nt, Homo sapiens
gaacacuggagguagauuu

SEQ ID NO: 1040338 - RNA, 19 nt, Homo sapiens
ccauugggaucaaaucaaa

SEQ ID NO: 1040339 - RNA, 19 nt, Homo sapiens
gcaauauguuugaccugaa

SEQ ID NO: 1040340 - RNA, 19 nt, Homo sapiens
gcacuguuacugggaauua

SEQ ID NO: 1040341 - RNA, 19 nt, Homo sapiens
cauccaaagugaauuaugu

SEQ ID NO: 1040342 - RNA, 19 nt, Homo sapiens
gaaaagagacaacgacuga

SEQ ID NO: 1040343 - RNA, 19 nt, Homo sapiens
cuaagcaagugaacacaaa

SEQ ID NO: 1040344 - RNA, 19 nt, Homo sapiens
cauauuagagcaacuugua

SEQ ID NO: 1040345 - RNA, 19 nt, Homo sapiens
ugaagauggugucaaguga

SEQ ID NO: 1040346 - RNA, 19 nt, Homo sapiens
uaaaggggcucaauaucua

SEQ ID NO: 1040347 - RNA, 19 nt, Homo sapiens
guuaaagccuucagagaca

SEQ ID NO: 1040348 - RNA, 19 nt, Homo sapiens
gaacacaaacacauuuaag

SEQ ID NO: 1040349 - RNA, 19 nt, Homo sapiens
ggaauuagaagaccugagu

SEQ ID NO: 1040350 - RNA, 19 nt, Homo sapiens
ccaguuaugcuauuucauu

SEQ ID NO: 1040351 - RNA, 19 nt, Homo sapiens
gcauuucauuucuucaguu

SEQ ID NO: 1040352 - RNA, 19 nt, Homo sapiens
gaaauucuguggcaaaaca

SEQ ID NO: 1040353 - RNA, 19 nt, Homo sapiens
gauuagauguuagccaguu

SEQ ID NO: 1040354 - RNA, 19 nt, Homo sapiens
ucaagugaaccuagauuaa

SEQ ID NO: 1040355 - RNA, 19 nt, Homo sapiens
gaaauacugugugugaacu

SEQ ID NO: 1040356 - RNA, 19 nt, Homo sapiens
gugcagaagcccagaguaa

SEQ ID NO: 1040357 - RNA, 19 nt, Homo sapiens
guacagcccuaagcaagug

SEQ ID NO: 1040358 - RNA, 19 nt, Homo sapiens
ccucauagcaucuucuuug

SEQ ID NO: 1040359 - RNA, 19 nt, Homo sapiens
uuaaugcucucugaagaaa

SEQ ID NO: 1040360 - RNA, 19 nt, Homo sapiens
cuucagagacacacaauaa

SEQ ID NO: 1040361 - RNA, 19 nt, Homo sapiens
caauauguuugaccugaau

SEQ ID NO: 1040362 - RNA, 19 nt, Homo sapiens
aaacauauucugacccauu

SEQ ID NO: 1040363 - RNA, 19 nt, Homo sapiens
cagagacacacaauaaauu

SEQ ID NO: 1040364 - RNA, 19 nt, Homo sapiens
cagauaacuuucaguguag

SEQ ID NO: 1040365 - RNA, 19 nt, Homo sapiens
gaagauggugucaagugaa

SEQ ID NO: 1040366 - RNA, 19 nt, Homo sapiens
ucagaguccucaagccaaa

SEQ ID NO: 1040367 - RNA, 19 nt, Homo sapiens
ccacuccugucuuguucua

SEQ ID NO: 1040368 - RNA, 19 nt, Homo sapiens
caaaucaaaggcacaguga

SEQ ID NO: 1040369 - RNA, 19 nt, Homo sapiens
caggaacacuggagguaga

SEQ ID NO: 1040370 - RNA, 19 nt, Homo sapiens
ugcaagagauaacuaugaa

SEQ ID NO: 1040371 - RNA, 19 nt, Homo sapiens
uaucagccaugguacucua

SEQ ID NO: 1040372 - RNA, 19 nt, Homo sapiens
cauuugaccucuuguuauc

SEQ ID NO: 1040373 - RNA, 19 nt, Homo sapiens
uauuaaugcucucugaaga

SEQ ID NO: 1040374 - RNA, 19 nt, Homo sapiens
ccuaccaccuuacuacuga

SEQ ID NO: 1040375 - RNA, 19 nt, Homo sapiens
gaaagccaaauucaaauac

SEQ ID NO: 1040376 - RNA, 19 nt, Homo sapiens
gagcaacuuguacauuuga

SEQ ID NO: 1040377 - RNA, 19 nt, Homo sapiens
uuagaaauacuguguguga

SEQ ID NO: 1040378 - RNA, 19 nt, Homo sapiens
caugaagcccuuugaguga

SEQ ID NO: 1040379 - RNA, 19 nt, Homo sapiens
acaguguucugcaauaguu

SEQ ID NO: 1040380 - RNA, 19 nt, Homo sapiens
gagaaaugacuuggagaaa

SEQ ID NO: 1040381 - RNA, 19 nt, Homo sapiens
caagagauaacuaugaaag

SEQ ID NO: 1040382 - RNA, 19 nt, Homo sapiens
ucuugacccuccaugaaua

SEQ ID NO: 1040383 - RNA, 19 nt, Homo sapiens
gugaacacaaacacauuua

SEQ ID NO: 1040384 - RNA, 19 nt, Homo sapiens
cagcacagcccuuuauagu

SEQ ID NO: 1040385 - RNA, 19 nt, Homo sapiens
ucaaaagacuuaagacugu

SEQ ID NO: 1040386 - RNA, 19 nt, Homo sapiens
ggaccuggaacccgaaaga

SEQ ID NO: 1040387 - RNA, 19 nt, Homo sapiens
agacuguggugauaagaug

SEQ ID NO: 1040388 - RNA, 19 nt, Homo sapiens
cuguaugacucaaccagua

SEQ ID NO: 1040389 - RNA, 19 nt, Homo sapiens
gugcaagagauaacuauga

SEQ ID NO: 1040390 - RNA, 19 nt, Homo sapiens
aauacugugugugaacuua

SEQ ID NO: 1040391 - RNA, 19 nt, Homo sapiens
caucuaggaucccgugaag

SEQ ID NO: 1040392 - RNA, 19 nt, Homo sapiens
ggccuaguuuguuccauga

SEQ ID NO: 1040393 - RNA, 19 nt, Homo sapiens
ggauauccagugauuccua

SEQ ID NO: 1040394 - RNA, 19 nt, Homo sapiens
ccagacagcaauauguuug

SEQ ID NO: 1040395 - RNA, 19 nt, Homo sapiens
ugugaccgacuuauucuua

SEQ ID NO: 1040396 - RNA, 19 nt, Homo sapiens
ucagagacacacaauaaau

SEQ ID NO: 1040397 - RNA, 19 nt, Homo sapiens
gacuccagauuuccagauu

SEQ ID NO: 1040398 - RNA, 19 nt, Homo sapiens
gcaauaguuggagcagaua

SEQ ID NO: 1040399 - RNA, 19 nt, Homo sapiens
acacaaacacauuuaagug

SEQ ID NO: 1040400 - RNA, 19 nt, Homo sapiens
caacuggaacucaaagcuu

SEQ ID NO: 1040401 - RNA, 19 nt, Homo sapiens
gcaagagauaacuaugaaa

SEQ ID NO: 1040402 - RNA, 19 nt, Homo sapiens
uacauuugaccucuuguua

SEQ ID NO: 1040403 - RNA, 19 nt, Homo sapiens
ugaagcuggugccucauug

SEQ ID NO: 1040404 - RNA, 19 nt, Homo sapiens
uacaacaccuugaacucuu

SEQ ID NO: 1040405 - RNA, 19 nt, Homo sapiens
ugaagcccuuugagugaaa

SEQ ID NO: 1040406 - RNA, 19 nt, Homo sapiens
uaaagggcagagacagaua

SEQ ID NO: 1040407 - RNA, 19 nt, Homo sapiens
cagacucccuuaagcaaca

SEQ ID NO: 1040408 - RNA, 19 nt, Homo sapiens
gucaagugaaccuagauua

SEQ ID NO: 1040409 - RNA, 19 nt, Homo sapiens
ggugucaagugaaccuaga

SEQ ID NO: 1040410 - RNA, 19 nt, Homo sapiens
gaacucuuccgaacacagu

SEQ ID NO: 1040411 - RNA, 19 nt, Homo sapiens
gaaauucaugaacaucuag

SEQ ID NO: 1040412 - RNA, 19 nt, Homo sapiens
gagacacacaauaaauuug

SEQ ID NO: 1040413 - RNA, 19 nt, Homo sapiens
agagcaacuuguacauuug

SEQ ID NO: 1040414 - RNA, 19 nt, Homo sapiens
gaagcuggugccucauuga

SEQ ID NO: 1040415 - RNA, 19 nt, Homo sapiens
ucacaacaaaggccuaguu

SEQ ID NO: 1040416 - RNA, 19 nt, Homo sapiens
acuacaguguucugcaaua

SEQ ID NO: 1040417 - RNA, 19 nt, Homo sapiens
caagugaacacaaacacau

SEQ ID NO: 1040418 - RNA, 19 nt, Homo sapiens
ucauugaggccauauuaga

SEQ ID NO: 1040419 - RNA, 19 nt, Homo sapiens
gacagacucccuuaagcaa

SEQ ID NO: 1040420 - RNA, 19 nt, Homo sapiens
gcaagugaacacaaacaca

SEQ ID NO: 1040421 - RNA, 19 nt, Homo sapiens
caguagaggucauuuaaua

SEQ ID NO: 1040422 - RNA, 19 nt, Homo sapiens
acucggagcucccaguuua

SEQ ID NO: 1040423 - RNA, 19 nt, Homo sapiens
ccauugagauugccaagaa

SEQ ID NO: 1040424 - RNA, 19 nt, Homo sapiens
ggaguuguuaugagaauua

SEQ ID NO: 1040425 - RNA, 19 nt, Homo sapiens
gcaggaaucccuucuacaa

SEQ ID NO: 1040426 - RNA, 19 nt, Homo sapiens
caacagacacagugaggua

SEQ ID NO: 1040427 - RNA, 19 nt, Homo sapiens
cauaagagacugacugcua

SEQ ID NO: 1040428 - RNA, 19 nt, Homo sapiens
acagugagguagcaucuaa

SEQ ID NO: 1040429 - RNA, 19 nt, Homo sapiens
gacgaggucucacuauguu

SEQ ID NO: 1040430 - RNA, 19 nt, Homo sapiens
ggucucaguggcuuaauua

SEQ ID NO: 1040431 - RNA, 19 nt, Homo sapiens
guacgaggcaggagugaaa

SEQ ID NO: 1040432 - RNA, 19 nt, Homo sapiens
aggaaucccuucuacaauu

SEQ ID NO: 1040433 - RNA, 19 nt, Homo sapiens
ggaugugguuauuauucua

SEQ ID NO: 1040434 - RNA, 19 nt, Homo sapiens
gagacugacugcuacuaau

SEQ ID NO: 1040435 - RNA, 19 nt, Homo sapiens
gccaguagaggucauuuaa

SEQ ID NO: 1040436 - RNA, 19 nt, Homo sapiens
gcaucgcgcucuacgacaa

SEQ ID NO: 1040437 - RNA, 19 nt, Homo sapiens
gagccucaauuucuuuauc

SEQ ID NO: 1040438 - RNA, 19 nt, Homo sapiens
gcaaaucuacucccagucu

SEQ ID NO: 1040439 - RNA, 19 nt, Homo sapiens
cacaugaccuaguggcaaa

SEQ ID NO: 1040440 - RNA, 19 nt, Homo sapiens
gacuggaguuguuaugaga

SEQ ID NO: 1040441 - RNA, 19 nt, Homo sapiens
gaacacagacagccuuggu

SEQ ID NO: 1040442 - RNA, 19 nt, Homo sapiens
uacaauuccugcucaguga

SEQ ID NO: 1040443 - RNA, 19 nt, Homo sapiens
ucauucagcucugcaaguu

SEQ ID NO: 1040444 - RNA, 19 nt, Homo sapiens
acugacugcuacuaauuua

SEQ ID NO: 1040445 - RNA, 19 nt, Homo sapiens
ucaguggcuuaauuacuuu

SEQ ID NO: 1040446 - RNA, 19 nt, Homo sapiens
gaggucauuuaauauagug

SEQ ID NO: 1040447 - RNA, 19 nt, Homo sapiens
cucaguggcuuaauuacuu

SEQ ID NO: 1040448 - RNA, 19 nt, Homo sapiens
caaaucuacucccagucuu

SEQ ID NO: 1040449 - RNA, 19 nt, Homo sapiens
aaaaggggcugguauuuca

SEQ ID NO: 1040450 - RNA, 19 nt, Homo sapiens
agacagccuugguucaaau

SEQ ID NO: 1040451 - RNA, 19 nt, Homo sapiens
ccugggcgcuuucgcauuc

SEQ ID NO: 1040452 - RNA, 19 nt, Homo sapiens
cagacagccuugguucaaa

SEQ ID NO: 1040453 - RNA, 19 nt, Homo sapiens
cggcaaggccauugagauu

SEQ ID NO: 1040454 - RNA, 19 nt, Homo sapiens
gacugacugcuacuaauuu

SEQ ID NO: 1040455 - RNA, 19 nt, Homo sapiens
gagacugccugccuucaac

SEQ ID NO: 1040456 - RNA, 19 nt, Homo sapiens
cagcaucaagcacacagua

SEQ ID NO: 1040457 - RNA, 19 nt, Homo sapiens
ugagguagcaucuaaagca

SEQ ID NO: 1040458 - RNA, 19 nt, Homo sapiens
acccagcccuguaagguuu

SEQ ID NO: 1040459 - RNA, 19 nt, Homo sapiens
gcagugaggagcagaagag

SEQ ID NO: 1040460 - RNA, 19 nt, Homo sapiens
ggcagcagaucccgaugga

SEQ ID NO: 1040461 - RNA, 19 nt, Homo sapiens
ucuguagacuggaguuguu

SEQ ID NO: 1040462 - RNA, 19 nt, Homo sapiens
agacugacugcuacuaauu

SEQ ID NO: 1040463 - RNA, 19 nt, Homo sapiens
caucaagcacacaguaaga

SEQ ID NO: 1040464 - RNA, 19 nt, Homo sapiens
gaaagccaguagaggucau

SEQ ID NO: 1040465 - RNA, 19 nt, Homo sapiens
ugucguggaugugguuauu

SEQ ID NO: 1040466 - RNA, 19 nt, Homo sapiens
ucaguucccaaaucuguaa

SEQ ID NO: 1040467 - RNA, 19 nt, Homo sapiens
ggagcucccaguuuacuuc

SEQ ID NO: 1040468 - RNA, 19 nt, Homo sapiens
uggcacggguggaaucaga

SEQ ID NO: 1040469 - RNA, 19 nt, Homo sapiens
ccacuacuauccacaugac

SEQ ID NO: 1040470 - RNA, 19 nt, Homo sapiens
agacugaccagaguugaaa

SEQ ID NO: 1040471 - RNA, 19 nt, Homo sapiens
ucguggaugugguuauuau

SEQ ID NO: 1040472 - RNA, 19 nt, Homo sapiens
gagaaaaggggcugguauu

SEQ ID NO: 1040473 - RNA, 19 nt, Homo sapiens
cauuggaaccugcaacaug

SEQ ID NO: 1040474 - RNA, 19 nt, Homo sapiens
caggauauggccauuggaa

SEQ ID NO: 1040475 - RNA, 19 nt, Homo sapiens
agacuggaguuguuaugag

SEQ ID NO: 1040476 - RNA, 19 nt, Homo sapiens
ugaccuaguggcaaaucua

SEQ ID NO: 1040477 - RNA, 19 nt, Homo sapiens
uuaucucacugucucuuga

SEQ ID NO: 1040478 - RNA, 19 nt, Homo sapiens
agagacugacugcuacuaa

SEQ ID NO: 1040479 - RNA, 19 nt, Homo sapiens
gcaucaagcacacaguaag

SEQ ID NO: 1040480 - RNA, 19 nt, Homo sapiens
aaaauacucuugcccagau

SEQ ID NO: 1040481 - RNA, 19 nt, Homo sapiens
guggaugugguuauuauuc

SEQ ID NO: 1040482 - RNA, 19 nt, Homo sapiens
cacagugccuuggacauag

SEQ ID NO: 1040483 - RNA, 19 nt, Homo sapiens
caaccucccauccugaauc

SEQ ID NO: 1040484 - RNA, 19 nt, Homo sapiens
uggcaacacucuacaucag

SEQ ID NO: 1040485 - RNA, 19 nt, Homo sapiens
caggaaucccuucuacaau

SEQ ID NO: 1040486 - RNA, 19 nt, Homo sapiens
uggaugugguuauuauucu

SEQ ID NO: 1040487 - RNA, 19 nt, Homo sapiens
gcucccaguuuacuucacu

SEQ ID NO: 1040488 - RNA, 19 nt, Homo sapiens
acagagcccaugugcuuga

SEQ ID NO: 1040489 - RNA, 19 nt, Homo sapiens
ggcaaggccauugagauug

SEQ ID NO: 1040490 - RNA, 19 nt, Homo sapiens
cuacuauccacaugaccua

SEQ ID NO: 1040491 - RNA, 19 nt, Homo sapiens
ugaguucugccuccugcua

SEQ ID NO: 1040492 - RNA, 19 nt, Homo sapiens
acagacagccuugguucaa

SEQ ID NO: 1040493 - RNA, 19 nt, Homo sapiens
gaguugaaaucuggcuucu

SEQ ID NO: 1040494 - RNA, 19 nt, Homo sapiens
cucccaaagugcuggaauu

SEQ ID NO: 1040495 - RNA, 19 nt, Homo sapiens
gaugugguuauuauucuag

SEQ ID NO: 1040496 - RNA, 19 nt, Homo sapiens
guuacacacuuaggugagu

SEQ ID NO: 1040497 - RNA, 19 nt, Homo sapiens
aaauacucuugcccagauu

SEQ ID NO: 1040498 - RNA, 19 nt, Homo sapiens
gugaggagcagaagagacu

SEQ ID NO: 1040499 - RNA, 19 nt, Homo sapiens
ccaguagaggucauuuaau

SEQ ID NO: 1040500 - RNA, 19 nt, Homo sapiens
cugcaggaaucccuucuac

SEQ ID NO: 1040501 - RNA, 19 nt, Homo sapiens
gagcagagggagcagucau

SEQ ID NO: 1040502 - RNA, 19 nt, Homo sapiens
guagacuggaguuguuaug

SEQ ID NO: 1040503 - RNA, 19 nt, Homo sapiens
aaagcaggauauggccauu

SEQ ID NO: 1040504 - RNA, 19 nt, Homo sapiens
ggcuguggccgacgaucua

SEQ ID NO: 1040505 - RNA, 19 nt, Homo sapiens
gaggaugacuugggucuua

SEQ ID NO: 1040506 - RNA, 19 nt, Homo sapiens
gcagaucaccacuuuauaa

SEQ ID NO: 1040507 - RNA, 19 nt, Homo sapiens
gggaauaucugccuuuauc

SEQ ID NO: 1040508 - RNA, 19 nt, Homo sapiens
gagagaggcugcaauaaag

SEQ ID NO: 1040509 - RNA, 19 nt, Homo sapiens
agaaagagcugaaugaaag

SEQ ID NO: 1040510 - RNA, 19 nt, Homo sapiens
ggaagaaacagaauauaug

SEQ ID NO: 1040511 - RNA, 19 nt, Homo sapiens
agaaagguguggaagauuu

SEQ ID NO: 1040512 - RNA, 19 nt, Homo sapiens
gaacaaagaaauccugauc

SEQ ID NO: 1040513 - RNA, 19 nt, Homo sapiens
gggcaucucuugcggauca

SEQ ID NO: 1040514 - RNA, 19 nt, Homo sapiens
uaagaaagguguggaagau

SEQ ID NO: 1040515 - RNA, 19 nt, Homo sapiens
cagaacaaccaguauauuu

SEQ ID NO: 1040516 - RNA, 19 nt, Homo sapiens
gaaaucuugugauccauuc

SEQ ID NO: 1040517 - RNA, 19 nt, Homo sapiens
ggucuuagcaugcugauug

SEQ ID NO: 1040518 - RNA, 19 nt, Homo sapiens
caagggccguguuacauga

SEQ ID NO: 1040519 - RNA, 19 nt, Homo sapiens
ggacauuguuaccauagga

SEQ ID NO: 1040520 - RNA, 19 nt, Homo sapiens
gugcacacguuugaaauuu

SEQ ID NO: 1040521 - RNA, 19 nt, Homo sapiens
ggagacauuaggagaauuu

SEQ ID NO: 1040522 - RNA, 19 nt, Homo sapiens
uaaaggacauuguuaccau

SEQ ID NO: 1040523 - RNA, 19 nt, Homo sapiens
gccuuuaucuucuuaaugu

SEQ ID NO: 1040524 - RNA, 19 nt, Homo sapiens
gaagaaacagaauauaugg

SEQ ID NO: 1040525 - RNA, 19 nt, Homo sapiens
ugagagaggcugcaauaaa

SEQ ID NO: 1040526 - RNA, 19 nt, Homo sapiens
ugacaaagaaggcgacauu

SEQ ID NO: 1040527 - RNA, 19 nt, Homo sapiens
aaagaaguaucucauugga

SEQ ID NO: 1040528 - RNA, 19 nt, Homo sapiens
aaaggacauuguuaccaua

SEQ ID NO: 1040529 - RNA, 19 nt, Homo sapiens
uuacaaagaugucgugaac

SEQ ID NO: 1040530 - RNA, 19 nt, Homo sapiens
caguacaucuucuagcauu

SEQ ID NO: 1040531 - RNA, 19 nt, Homo sapiens
gaauaucugccuuuaucuu

SEQ ID NO: 1040532 - RNA, 19 nt, Homo sapiens
aaggagaggccaauucuaa

SEQ ID NO: 1040533 - RNA, 19 nt, Homo sapiens
gauccauucuuuaccuuuc

SEQ ID NO: 1040534 - RNA, 19 nt, Homo sapiens
ccuacaauguuugguuaua

SEQ ID NO: 1040535 - RNA, 19 nt, Homo sapiens
ggaccuucaggacuaaaua

SEQ ID NO: 1040536 - RNA, 19 nt, Homo sapiens
gugcagaucaccacuuuau

SEQ ID NO: 1040537 - RNA, 19 nt, Homo sapiens
cagaaagagcugaaugaaa

SEQ ID NO: 1040538 - RNA, 19 nt, Homo sapiens
ccacgugucuguccuuguc

SEQ ID NO: 1040539 - RNA, 19 nt, Homo sapiens
ccuuguggcuggcuaugua

SEQ ID NO: 1040540 - RNA, 19 nt, Homo sapiens
gaaggagaggccaauucua

SEQ ID NO: 1040541 - RNA, 19 nt, Homo sapiens
ggaaggagaggccaauucu

SEQ ID NO: 1040542 - RNA, 19 nt, Homo sapiens
ggaggaagagauagaggaa

SEQ ID NO: 1040543 - RNA, 19 nt, Homo sapiens
gccaguacaucuucuagca

SEQ ID NO: 1040544 - RNA, 19 nt, Homo sapiens
ucugggaccuucaggacua

SEQ ID NO: 1040545 - RNA, 19 nt, Homo sapiens
ugccuacaauguuugguua

SEQ ID NO: 1040546 - RNA, 19 nt, Homo sapiens
gaacaaccaguauauuuug

SEQ ID NO: 1040547 - RNA, 19 nt, Homo sapiens
caauaaaggaagaaacaga

SEQ ID NO: 1040548 - RNA, 19 nt, Homo sapiens
acaaagaaggcgacauuga

SEQ ID NO: 1040549 - RNA, 19 nt, Homo sapiens
gcaaguggagacauuagga

SEQ ID NO: 1040550 - RNA, 19 nt, Homo sapiens
cagaucaccacuuuauaaa

SEQ ID NO: 1040551 - RNA, 19 nt, Homo sapiens
ccugagagaggcugcaaua

SEQ ID NO: 1040552 - RNA, 19 nt, Homo sapiens
uacaugacacuguuaauga

SEQ ID NO: 1040553 - RNA, 19 nt, Homo sapiens
uaacgguaauucucaaacu

SEQ ID NO: 1040554 - RNA, 19 nt, Homo sapiens
aacgagaaguggaggauga

SEQ ID NO: 1040555 - RNA, 19 nt, Homo sapiens
gaagagauagaggaacaug

SEQ ID NO: 1040556 - RNA, 19 nt, Homo sapiens
caaagaaggcgacauugac

SEQ ID NO: 1040557 - RNA, 19 nt, Homo sapiens
cuccggaccuggaucauga

SEQ ID NO: 1040558 - RNA, 19 nt, Homo sapiens
uaaagaaguaucucauugg

SEQ ID NO: 1040559 - RNA, 19 nt, Homo sapiens
gaggccaauucuaagcaaa

SEQ ID NO: 1040560 - RNA, 19 nt, Homo sapiens
gagcugaaugaaagugaaa

SEQ ID NO: 1040561 - RNA, 19 nt, Homo sapiens
gggcagagacccguggauu

SEQ ID NO: 1040562 - RNA, 19 nt, Homo sapiens
guggagacauuaggagaau

SEQ ID NO: 1040563 - RNA, 19 nt, Homo sapiens
uuaagucuauugugcaagu

SEQ ID NO: 1040564 - RNA, 19 nt, Homo sapiens
aggaagagauagaggaaca

SEQ ID NO: 1040565 - RNA, 19 nt, Homo sapiens
ccagaaagagcugaaugaa

SEQ ID NO: 1040566 - RNA, 19 nt, Homo sapiens
gaccaagcccagagauuca

SEQ ID NO: 1040567 - RNA, 19 nt, Homo sapiens
ccugucggaugaagagaaa

SEQ ID NO: 1040568 - RNA, 19 nt, Homo sapiens
guaauucucaaacuaugug

SEQ ID NO: 1040569 - RNA, 19 nt, Homo sapiens
aacgguaauucucaaacua

SEQ ID NO: 1040570 - RNA, 19 nt, Homo sapiens
gaaagagcugaaugaaagu

SEQ ID NO: 1040571 - RNA, 19 nt, Homo sapiens
cgucaugccgacucucaua

SEQ ID NO: 1040572 - RNA, 19 nt, Homo sapiens
acaugacacuguuaaugau

SEQ ID NO: 1040573 - RNA, 19 nt, Homo sapiens
ccagaacaaccaguauauu

SEQ ID NO: 1040574 - RNA, 19 nt, Homo sapiens
cggaucgucuggaggaaga

SEQ ID NO: 1040575 - RNA, 19 nt, Homo sapiens
ggugcacacguuugaaauu

SEQ ID NO: 1040576 - RNA, 19 nt, Homo sapiens
ggcagagacccguggauug

SEQ ID NO: 1040577 - RNA, 19 nt, Homo sapiens
gcagagacccguggauugc

SEQ ID NO: 1040578 - RNA, 19 nt, Homo sapiens
ugaccaagcccagagauuc

SEQ ID NO: 1040579 - RNA, 19 nt, Homo sapiens
gagaggcugcaauaaagga

SEQ ID NO: 1040580 - RNA, 19 nt, Homo sapiens
cuaagaaagguguggaaga

SEQ ID NO: 1040581 - RNA, 19 nt, Homo sapiens
uaucugccuuuaucuucuu

SEQ ID NO: 1040582 - RNA, 19 nt, Homo sapiens
uugggaauaucugccuuua

SEQ ID NO: 1040583 - RNA, 19 nt, Homo sapiens
ugaaaucuugugauccauu

SEQ ID NO: 1040584 - RNA, 19 nt, Homo sapiens
acugaaaucuugugaucca

SEQ ID NO: 1040585 - RNA, 19 nt, Homo sapiens
cguggaaguucuccgaauc

SEQ ID NO: 1040586 - RNA, 19 nt, Homo sapiens
uuacaugacacuguuaaug

SEQ ID NO: 1040587 - RNA, 19 nt, Homo sapiens
cugauugacucccagaaca

SEQ ID NO: 1040588 - RNA, 19 nt, Homo sapiens
uauccaugcuugacgagau

SEQ ID NO: 1040589 - RNA, 19 nt, Homo sapiens
acgugcagaucaccacuuu

SEQ ID NO: 1040590 - RNA, 19 nt, Homo sapiens
ggaagcugcacauggaaag

SEQ ID NO: 1040591 - RNA, 19 nt, Homo sapiens
guacaucuucuagcauugu

SEQ ID NO: 1040592 - RNA, 19 nt, Homo sapiens
caggugcacacguuugaaa

SEQ ID NO: 1040593 - RNA, 19 nt, Homo sapiens
uuggagcaguggagaaaga

SEQ ID NO: 1040594 - RNA, 19 nt, Homo sapiens
gaaagugaaaauuccguuu

SEQ ID NO: 1040595 - RNA, 19 nt, Homo sapiens
uuacaagggccguguuaca

SEQ ID NO: 1040596 - RNA, 19 nt, Homo sapiens
agauagaggaacaugcuuu

SEQ ID NO: 1040597 - RNA, 19 nt, Homo sapiens
cgguaauucucaaacuaug

SEQ ID NO: 1040598 - RNA, 19 nt, Homo sapiens
auccugaucuugggaauau

SEQ ID NO: 1040599 - RNA, 19 nt, Homo sapiens
gcagcucgggcucuucaug

SEQ ID NO: 1040600 - RNA, 19 nt, Homo sapiens
cagaaaagcuaagaaaggu

SEQ ID NO: 1040601 - RNA, 19 nt, Homo sapiens
gacaaagaaggcgacauug

SEQ ID NO: 1040602 - RNA, 19 nt, Homo sapiens
cagagcgucuucauuucca

SEQ ID NO: 1040603 - RNA, 19 nt, Homo sapiens
caugacacuguuaaugauu

SEQ ID NO: 1040604 - RNA, 19 nt, Homo sapiens
agagcugaaugaaagugaa

SEQ ID NO: 1040605 - RNA, 19 nt, Homo sapiens
gagcaaagaugaaacaauu

SEQ ID NO: 1040606 - RNA, 19 nt, Homo sapiens
uaaaggacauguucaguuu

SEQ ID NO: 1040607 - RNA, 19 nt, Homo sapiens
uaacuugccugaaauucua

SEQ ID NO: 1040608 - RNA, 19 nt, Homo sapiens
ucacagaugucuccugaaa

SEQ ID NO: 1040609 - RNA, 19 nt, Homo sapiens
gaaggaagaucagcauuca

SEQ ID NO: 1040610 - RNA, 19 nt, Homo sapiens
gaaaguggccugauaucaa

SEQ ID NO: 1040611 - RNA, 19 nt, Homo sapiens
ggagagcaguauguaguua

SEQ ID NO: 1040612 - RNA, 19 nt, Homo sapiens
uacaauaacuugccugaaa

SEQ ID NO: 1040613 - RNA, 19 nt, Homo sapiens
gaaaagcggucaaaaccua

SEQ ID NO: 1040614 - RNA, 19 nt, Homo sapiens
gcagagccuucuccuguaa

SEQ ID NO: 1040615 - RNA, 19 nt, Homo sapiens
gggaaugccugaagucaau

SEQ ID NO: 1040616 - RNA, 19 nt, Homo sapiens
caacaggcauuuaaucagu

SEQ ID NO: 1040617 - RNA, 19 nt, Homo sapiens
caaaguggcagacaugaaa

SEQ ID NO: 1040618 - RNA, 19 nt, Homo sapiens
gaagaucagcauucauaaa

SEQ ID NO: 1040619 - RNA, 19 nt, Homo sapiens
acagaugucuccugaaaga

SEQ ID NO: 1040620 - RNA, 19 nt, Homo sapiens
gagaauuuccucuguuaaa

SEQ ID NO: 1040621 - RNA, 19 nt, Homo sapiens
aauuaaagcucacaaagga

SEQ ID NO: 1040622 - RNA, 19 nt, Homo sapiens
gcaucacagugguacaaua

SEQ ID NO: 1040623 - RNA, 19 nt, Homo sapiens
cuacucaaauguaccuuaa

SEQ ID NO: 1040624 - RNA, 19 nt, Homo sapiens
uaucugggaugcaaagaaa

SEQ ID NO: 1040625 - RNA, 19 nt, Homo sapiens
guaaaggacauguucaguu

SEQ ID NO: 1040626 - RNA, 19 nt, Homo sapiens
gaacguggaaucuuguaga

SEQ ID NO: 1040627 - RNA, 19 nt, Homo sapiens
gagcaucauguuauuguuu

SEQ ID NO: 1040628 - RNA, 19 nt, Homo sapiens
acaaaaugcucacauagua

SEQ ID NO: 1040629 - RNA, 19 nt, Homo sapiens
ggccugauaucaaccaaga

SEQ ID NO: 1040630 - RNA, 19 nt, Homo sapiens
aaaagaaaguggccugaua

SEQ ID NO: 1040631 - RNA, 19 nt, Homo sapiens
ucacccaucuggcaaguug

SEQ ID NO: 1040632 - RNA, 19 nt, Homo sapiens
caucacagugguacaauaa

SEQ ID NO: 1040633 - RNA, 19 nt, Homo sapiens
ggaagaucagcauucauaa

SEQ ID NO: 1040634 - RNA, 19 nt, Homo sapiens
ggcuggagaugaagaaguu

SEQ ID NO: 1040635 - RNA, 19 nt, Homo sapiens
gaaaugggaaugccugaag

SEQ ID NO: 1040636 - RNA, 19 nt, Homo sapiens
gaguguggcuagacaaagu

SEQ ID NO: 1040637 - RNA, 19 nt, Homo sapiens
ggagaugaagaaguuauaa

SEQ ID NO: 1040638 - RNA, 19 nt, Homo sapiens
aggaagaucagcauucaua

SEQ ID NO: 1040639 - RNA, 19 nt, Homo sapiens
gaaugccugaagucaauua

SEQ ID NO: 1040640 - RNA, 19 nt, Homo sapiens
acaauaacuugccugaaau

SEQ ID NO: 1040641 - RNA, 19 nt, Homo sapiens
ggucaaaaccuaacacaaa

SEQ ID NO: 1040642 - RNA, 19 nt, Homo sapiens
gcuugacacugcauccauu

SEQ ID NO: 1040643 - RNA, 19 nt, Homo sapiens
gaggagagcaguauguagu

SEQ ID NO: 1040644 - RNA, 19 nt, Homo sapiens
gaaaaugguagaaauguug

SEQ ID NO: 1040645 - RNA, 19 nt, Homo sapiens
gaaauuccagagcaucaug

SEQ ID NO: 1040646 - RNA, 19 nt, Homo sapiens
ggaaaaugguagaaauguu

SEQ ID NO: 1040647 - RNA, 19 nt, Homo sapiens
aaagaaaguggccugauau

SEQ ID NO: 1040648 - RNA, 19 nt, Homo sapiens
aaaggagccuggugacaca

SEQ ID NO: 1040649 - RNA, 19 nt, Homo sapiens
aaagaacaguccaaaauug

SEQ ID NO: 1040650 - RNA, 19 nt, Homo sapiens
gcacgugcgcugcugaaug

SEQ ID NO: 1040651 - RNA, 19 nt, Homo sapiens
guagaaauguuggaaaaga

SEQ ID NO: 1040652 - RNA, 19 nt, Homo sapiens
guaaagaacaguccaaaau

SEQ ID NO: 1040653 - RNA, 19 nt, Homo sapiens
ugaccuuccuuucuauuca

SEQ ID NO: 1040654 - RNA, 19 nt, Homo sapiens
aaaguggccugauaucaac

SEQ ID NO: 1040655 - RNA, 19 nt, Homo sapiens
ugacacagugcacaaagaa

SEQ ID NO: 1040656 - RNA, 19 nt, Homo sapiens
agcaguagcuguaaauagu

SEQ ID NO: 1040657 - RNA, 19 nt, Homo sapiens
cacgagcaauggacucuug

SEQ ID NO: 1040658 - RNA, 19 nt, Homo sapiens
gugacacagugcacaaaga

SEQ ID NO: 1040659 - RNA, 19 nt, Homo sapiens
uaagcaggauaagaaaguu

SEQ ID NO: 1040660 - RNA, 19 nt, Homo sapiens
caagaggagagcaguaugu

SEQ ID NO: 1040661 - RNA, 19 nt, Homo sapiens
ggcaacaggcauuuaauca

SEQ ID NO: 1040662 - RNA, 19 nt, Homo sapiens
caauaacuugccugaaauu

SEQ ID NO: 1040663 - RNA, 19 nt, Homo sapiens
ggacucuuguggcugacuu

SEQ ID NO: 1040664 - RNA, 19 nt, Homo sapiens
ucacugggagcaaagauga

SEQ ID NO: 1040665 - RNA, 19 nt, Homo sapiens
ggaagcuuaagcaggauaa

SEQ ID NO: 1040666 - RNA, 19 nt, Homo sapiens
ugcaguggcuggagaugaa

SEQ ID NO: 1040667 - RNA, 19 nt, Homo sapiens
guggcaccaucacaaauga

SEQ ID NO: 1040668 - RNA, 19 nt, Homo sapiens
ucacagugguacaauaacu

SEQ ID NO: 1040669 - RNA, 19 nt, Homo sapiens
ggagcaaagaugaaacaau

SEQ ID NO: 1040670 - RNA, 19 nt, Homo sapiens
cacgugcgcugcugaaugg

SEQ ID NO: 1040671 - RNA, 19 nt, Homo sapiens
uaacaggugacaguaagaa

SEQ ID NO: 1040672 - RNA, 19 nt, Homo sapiens
caucuuuacucugugaaau

SEQ ID NO: 1040673 - RNA, 19 nt, Homo sapiens
acacagugcacaaagaaga

SEQ ID NO: 1040674 - RNA, 19 nt, Homo sapiens
gagagcaguauguaguuau

SEQ ID NO: 1040675 - RNA, 19 nt, Homo sapiens
agacaaaguggcagacaug

SEQ ID NO: 1040676 - RNA, 19 nt, Homo sapiens
gugugccucugcgaauuua

SEQ ID NO: 1040677 - RNA, 19 nt, Homo sapiens
caucacaaaugaaaagaga

SEQ ID NO: 1040678 - RNA, 19 nt, Homo sapiens
ugacuucacucaccaugcu

SEQ ID NO: 1040679 - RNA, 19 nt, Homo sapiens
ugcagagccuucuccugua

SEQ ID NO: 1040680 - RNA, 19 nt, Homo sapiens
gaugaagaaguuauaaggu

SEQ ID NO: 1040681 - RNA, 19 nt, Homo sapiens
caauuaaagcucacaaagg

SEQ ID NO: 1040682 - RNA, 19 nt, Homo sapiens
ugccugaagucaauuaaag

SEQ ID NO: 1040683 - RNA, 19 nt, Homo sapiens
uauggcaacaggcauuuaa

SEQ ID NO: 1040684 - RNA, 19 nt, Homo sapiens
acaguaagaaagcaacaaa

SEQ ID NO: 1040685 - RNA, 19 nt, Homo sapiens
gaagaaaagcggucaaaac

SEQ ID NO: 1040686 - RNA, 19 nt, Homo sapiens
uccagagcaucauguuauu

SEQ ID NO: 1040687 - RNA, 19 nt, Homo sapiens
ucacacugccuccuuguca

SEQ ID NO: 1040688 - RNA, 19 nt, Homo sapiens
gcaacaggcauuuaaucag

SEQ ID NO: 1040689 - RNA, 19 nt, Homo sapiens
cagagcaucauguuauugu

SEQ ID NO: 1040690 - RNA, 19 nt, Homo sapiens
gagaugaagaaguuauaag

SEQ ID NO: 1040691 - RNA, 19 nt, Homo sapiens
ucaauuaaagcucacaaag

SEQ ID NO: 1040692 - RNA, 19 nt, Homo sapiens
ggcagacaguguuuuauga

SEQ ID NO: 1040693 - RNA, 19 nt, Homo sapiens
cuacgagcagguccucuuu

SEQ ID NO: 1040694 - RNA, 19 nt, Homo sapiens
gcaucauguuauuguuuca

SEQ ID NO: 1040695 - RNA, 19 nt, Homo sapiens
agaaggaagaucagcauuc

SEQ ID NO: 1040696 - RNA, 19 nt, Homo sapiens
aacguggaaucuuguagaa

SEQ ID NO: 1040697 - RNA, 19 nt, Homo sapiens
gaaagcaacaaaagaaagu

SEQ ID NO: 1040698 - RNA, 19 nt, Homo sapiens
guaagaaagcaacaaaaga

SEQ ID NO: 1040699 - RNA, 19 nt, Homo sapiens
guagaaggaagaucagcau

SEQ ID NO: 1040700 - RNA, 19 nt, Homo sapiens
gaugucuccugaaagaacu

SEQ ID NO: 1040701 - RNA, 19 nt, Homo sapiens
uaucaaccaagaagaggaa

SEQ ID NO: 1040702 - RNA, 19 nt, Homo sapiens
uuuaacaggugacaguaag

SEQ ID NO: 1040703 - RNA, 19 nt, Homo sapiens
aaaccuaacacaaagaaac

SEQ ID NO: 1040704 - RNA, 19 nt, Homo sapiens
gacaaaguggcagacauga

SEQ ID NO: 1040705 - RNA, 19 nt, Homo sapiens
uggaugagcuugaauuuga

SEQ ID NO: 1040706 - RNA, 19 nt, Homo sapiens
ggagcugguuguacaguuu

SEQ ID NO: 1040707 - RNA, 19 nt, Homo sapiens
uaccaaagcucucaaugga

SEQ ID NO: 1040708 - RNA, 19 nt, Homo sapiens
gcagcagccugacccauug

SEQ ID NO: 1040709 - RNA, 19 nt, Homo sapiens
gagcuugaauuugaaugaa

SEQ ID NO: 1040710 - RNA, 19 nt, Homo sapiens
cagcaggucuccaggauag

SEQ ID NO: 1040711 - RNA, 19 nt, Homo sapiens
gcuagaagccugagcaagu

SEQ ID NO: 1040712 - RNA, 19 nt, Homo sapiens
ggaugagcuugaauuugaa

SEQ ID NO: 1040713 - RNA, 19 nt, Homo sapiens
aagaggagcugguuguaca

SEQ ID NO: 1040714 - RNA, 19 nt, Homo sapiens
caagacagccagcaacauc

SEQ ID NO: 1040715 - RNA, 19 nt, Homo sapiens
gagaagaggaaggcuagaa

SEQ ID NO: 1040716 - RNA, 19 nt, Homo sapiens
cgauaaaggaaguauauuc

SEQ ID NO: 1040717 - RNA, 19 nt, Homo sapiens
ccaccgcugccgucucuua

SEQ ID NO: 1040718 - RNA, 19 nt, Homo sapiens
gcaccucacuaggguuugu

SEQ ID NO: 1040719 - RNA, 19 nt, Homo sapiens
acaguacccuaaccugcua

SEQ ID NO: 1040720 - RNA, 19 nt, Homo sapiens
cuagaagccugagcaagug

SEQ ID NO: 1040721 - RNA, 19 nt, Homo sapiens
acagugcacuuucucagau

SEQ ID NO: 1040722 - RNA, 19 nt, Homo sapiens
gcagcaggucuccaggaua

SEQ ID NO: 1040723 - RNA, 19 nt, Homo sapiens
uacccuaaccugcuacuaa

SEQ ID NO: 1040724 - RNA, 19 nt, Homo sapiens
ucuccaggauagcugcuua

SEQ ID NO: 1040725 - RNA, 19 nt, Homo sapiens
gagccgagcccaacuacca

SEQ ID NO: 1040726 - RNA, 19 nt, Homo sapiens
gaauguggagauaccaguu

SEQ ID NO: 1040727 - RNA, 19 nt, Homo sapiens
gaguuuguauuucuagaac

SEQ ID NO: 1040728 - RNA, 19 nt, Homo sapiens
agaaggaggagaagaggaa

SEQ ID NO: 1040729 - RNA, 19 nt, Homo sapiens
gcucacaugcaccucacua

SEQ ID NO: 1040730 - RNA, 19 nt, Homo sapiens
accaagugcuggccaguga

SEQ ID NO: 1040731 - RNA, 19 nt, Homo sapiens
cagcucuucuccucucuuc

SEQ ID NO: 1040732 - RNA, 19 nt, Homo sapiens
ccaucccguucucugauuu

SEQ ID NO: 1040733 - RNA, 19 nt, Homo sapiens
ugaagaaggaggagaagag

SEQ ID NO: 1040734 - RNA, 19 nt, Homo sapiens
gaagagagggguccuugga

SEQ ID NO: 1040735 - RNA, 19 nt, Homo sapiens
gcuacuaaucacagagaaa

SEQ ID NO: 1040736 - RNA, 19 nt, Homo sapiens
acccuaaccugcuacuaau

SEQ ID NO: 1040737 - RNA, 19 nt, Homo sapiens
caagugaggguagaaccuu

SEQ ID NO: 1040738 - RNA, 19 nt, Homo sapiens
gcucuucuccucucuucau

SEQ ID NO: 1040739 - RNA, 19 nt, Homo sapiens
guuugucacccucgauaaa

SEQ ID NO: 1040740 - RNA, 19 nt, Homo sapiens
ccuaaccugcuacuaauca

SEQ ID NO: 1040741 - RNA, 19 nt, Homo sapiens
gagcugguuguacaguuug

SEQ ID NO: 1040742 - RNA, 19 nt, Homo sapiens
aagugaggguagaaccuuu

SEQ ID NO: 1040743 - RNA, 19 nt, Homo sapiens
ugagcuugaauuugaauga

SEQ ID NO: 1040744 - RNA, 19 nt, Homo sapiens
cuaccaaagcucucaaugg

SEQ ID NO: 1040745 - RNA, 19 nt, Homo sapiens
caaaagaggagcugguugu

SEQ ID NO: 1040746 - RNA, 19 nt, Homo sapiens
cuucauagucauugagaau

SEQ ID NO: 1040747 - RNA, 19 nt, Homo sapiens
ccugcucucuuccauccuu

SEQ ID NO: 1040748 - RNA, 19 nt, Homo sapiens
cccaucccguucucugauu

SEQ ID NO: 1040749 - RNA, 19 nt, Homo sapiens
gaugagcuugaauuugaau

SEQ ID NO: 1040750 - RNA, 19 nt, Homo sapiens
gccaagacagccagcaaca

SEQ ID NO: 1040751 - RNA, 19 nt, Homo sapiens
ggaaggagcugcuguguuu

SEQ ID NO: 1040752 - RNA, 19 nt, Homo sapiens
gaaacuaucucaugaagaa

SEQ ID NO: 1040753 - RNA, 19 nt, Homo sapiens
ggccagaucucaucauaua

SEQ ID NO: 1040754 - RNA, 19 nt, Homo sapiens
ggaaucaccugaaugagaa

SEQ ID NO: 1040755 - RNA, 19 nt, Homo sapiens
ccacggauauguugaagua

SEQ ID NO: 1040756 - RNA, 19 nt, Homo sapiens
gaaaaucggugaacucuuu

SEQ ID NO: 1040757 - RNA, 19 nt, Homo sapiens
ggauuuagaugaugccauu

SEQ ID NO: 1040758 - RNA, 19 nt, Homo sapiens
gaaguuugcuuucuccaau

SEQ ID NO: 1040759 - RNA, 19 nt, Homo sapiens
ggaagaaagugaaacuauc

SEQ ID NO: 1040760 - RNA, 19 nt, Homo sapiens
aagcaucacuggauaaauu

SEQ ID NO: 1040761 - RNA, 19 nt, Homo sapiens
ggaacaauauucuucuuca

SEQ ID NO: 1040762 - RNA, 19 nt, Homo sapiens
uggaaggacuuuacgauaa

SEQ ID NO: 1040763 - RNA, 19 nt, Homo sapiens
guaacaagcuugccuagag

SEQ ID NO: 1040764 - RNA, 19 nt, Homo sapiens
ccauagagguaauguuuga

SEQ ID NO: 1040765 - RNA, 19 nt, Homo sapiens
ggugaacucuuugcucuaa

SEQ ID NO: 1040766 - RNA, 19 nt, Homo sapiens
cgaagaaucggucaucuaa

SEQ ID NO: 1040767 - RNA, 19 nt, Homo sapiens
ggaacuaacagaucuaaug

SEQ ID NO: 1040768 - RNA, 19 nt, Homo sapiens
caagagauauucaaguucu

SEQ ID NO: 1040769 - RNA, 19 nt, Homo sapiens
gcucuaaggcaccguauaa

SEQ ID NO: 1040770 - RNA, 19 nt, Homo sapiens
aagaaucggucaucuaaug

SEQ ID NO: 1040771 - RNA, 19 nt, Homo sapiens
uaacaagcuugccuagaga

SEQ ID NO: 1040772 - RNA, 19 nt, Homo sapiens
ggaccaaccuuccaguucu

SEQ ID NO: 1040773 - RNA, 19 nt, Homo sapiens
gcucuaugccuuucuguaa

SEQ ID NO: 1040774 - RNA, 19 nt, Homo sapiens
auucagagcuggauuuaga

SEQ ID NO: 1040775 - RNA, 19 nt, Homo sapiens
ccacaaaccaaaucuguug

SEQ ID NO: 1040776 - RNA, 19 nt, Homo sapiens
ugggaaaucugucucaaga

SEQ ID NO: 1040777 - RNA, 19 nt, Homo sapiens
gcauggaacuaacagaucu

SEQ ID NO: 1040778 - RNA, 19 nt, Homo sapiens
gaagaaagugaaacuaucu

SEQ ID NO: 1040779 - RNA, 19 nt, Homo sapiens
gcuagugguuugaauaagu

SEQ ID NO: 1040780 - RNA, 19 nt, Homo sapiens
aaucggucaucuaauguua

SEQ ID NO: 1040781 - RNA, 19 nt, Homo sapiens
ugcaagagauauucaaguu

SEQ ID NO: 1040782 - RNA, 19 nt, Homo sapiens
gcggagagcuugggaugug

SEQ ID NO: 1040783 - RNA, 19 nt, Homo sapiens
gggaagaaagugaaacuau

SEQ ID NO: 1040784 - RNA, 19 nt, Homo sapiens
ccagaucucaucauauauu

SEQ ID NO: 1040785 - RNA, 19 nt, Homo sapiens
gcacacgcccgucaucuca

SEQ ID NO: 1040786 - RNA, 19 nt, Homo sapiens
ugaagaaguuaugcagaaa

SEQ ID NO: 1040787 - RNA, 19 nt, Homo sapiens
ugaagcaugugaugaaagu

SEQ ID NO: 1040788 - RNA, 19 nt, Homo sapiens
gaacaauauucuucuucag

SEQ ID NO: 1040789 - RNA, 19 nt, Homo sapiens
guggccagaucucaucaua

SEQ ID NO: 1040790 - RNA, 19 nt, Homo sapiens
ggaagcaucacuggauaaa

SEQ ID NO: 1040791 - RNA, 19 nt, Homo sapiens
agacaagccuggccaacau

SEQ ID NO: 1040792 - RNA, 19 nt, Homo sapiens
gaacuaacagaucuaaugc

SEQ ID NO: 1040793 - RNA, 19 nt, Homo sapiens
gaugaugccauucuagaga

SEQ ID NO: 1040794 - RNA, 19 nt, Homo sapiens
gccuagagaugcagcaaau

SEQ ID NO: 1040795 - RNA, 19 nt, Homo sapiens
uaaagaggcauuucucauc

SEQ ID NO: 1040796 - RNA, 19 nt, Homo sapiens
caaaucuguuggguucuaa

SEQ ID NO: 1040797 - RNA, 19 nt, Homo sapiens
gcauuucucaucuguauca

SEQ ID NO: 1040798 - RNA, 19 nt, Homo sapiens
caugcugucuccauuaaau

SEQ ID NO: 1040799 - RNA, 19 nt, Homo sapiens
gaaaccccaucucuacuaa

SEQ ID NO: 1040800 - RNA, 19 nt, Homo sapiens
gugaaacuaucucaugaag

SEQ ID NO: 1040801 - RNA, 19 nt, Homo sapiens
gcacaccuuccaaccauga

SEQ ID NO: 1040802 - RNA, 19 nt, Homo sapiens
gauuuguuccuuccugaua

SEQ ID NO: 1040803 - RNA, 19 nt, Homo sapiens
gaagaguuaaggucaugaa

SEQ ID NO: 1040804 - RNA, 19 nt, Homo sapiens
gucaauuccugaggcuuua

SEQ ID NO: 1040805 - RNA, 19 nt, Homo sapiens
aaagaggcauuucucaucu

SEQ ID NO: 1040806 - RNA, 19 nt, Homo sapiens
cagcuagugguuugaauaa

SEQ ID NO: 1040807 - RNA, 19 nt, Homo sapiens
ccacuuaaggaauuugaaa

SEQ ID NO: 1040808 - RNA, 19 nt, Homo sapiens
gaucaggagcucaagacaa

SEQ ID NO: 1040809 - RNA, 19 nt, Homo sapiens
agagaugcagcaaauauuu

SEQ ID NO: 1040810 - RNA, 19 nt, Homo sapiens
ucucagauccuggaaauga

SEQ ID NO: 1040811 - RNA, 19 nt, Homo sapiens
aagugaaacuaucucauga

SEQ ID NO: 1040812 - RNA, 19 nt, Homo sapiens
aaagugaaacuaucucaug

SEQ ID NO: 1040813 - RNA, 19 nt, Homo sapiens
augaagaaguuaugcagaa

SEQ ID NO: 1040814 - RNA, 19 nt, Homo sapiens
ugggaagcaucacuggaua

SEQ ID NO: 1040815 - RNA, 19 nt, Homo sapiens
caagugauaaccaaagugu

SEQ ID NO: 1040816 - RNA, 19 nt, Homo sapiens
gagcuggauuuagaugaug

SEQ ID NO: 1040817 - RNA, 19 nt, Homo sapiens
gugaugaaaguucuagaaa

SEQ ID NO: 1040818 - RNA, 19 nt, Homo sapiens
uaugaagcaugugaugaaa

SEQ ID NO: 1040819 - RNA, 19 nt, Homo sapiens
cuagagaugcagcaaauau

SEQ ID NO: 1040820 - RNA, 19 nt, Homo sapiens
gcgcuuccuucuucucuuc

SEQ ID NO: 1040821 - RNA, 19 nt, Homo sapiens
caacggcagaugaguauca

SEQ ID NO: 1040822 - RNA, 19 nt, Homo sapiens
aggcauuucucaucuguau

SEQ ID NO: 1040823 - RNA, 19 nt, Homo sapiens
gaaggguggcuugagauga

SEQ ID NO: 1040824 - RNA, 19 nt, Homo sapiens
gcaagagauauucaaguuc

SEQ ID NO: 1040825 - RNA, 19 nt, Homo sapiens
agcauuggccgaagaguua

SEQ ID NO: 1040826 - RNA, 19 nt, Homo sapiens
gcacugguacacugggaaa

SEQ ID NO: 1040827 - RNA, 19 nt, Homo sapiens
uuucucaucuguaucaaug

SEQ ID NO: 1040828 - RNA, 19 nt, Homo sapiens
ucggucaucuaauguuaaa

SEQ ID NO: 1040829 - RNA, 19 nt, Homo sapiens
cggaaucaccugaaugaga

SEQ ID NO: 1040830 - RNA, 19 nt, Homo sapiens
ccugauuacuccugauuuc

SEQ ID NO: 1040831 - RNA, 19 nt, Homo sapiens
gaaucggucaucuaauguu

SEQ ID NO: 1040832 - RNA, 19 nt, Homo sapiens
ugaaauccuuugguacuca

SEQ ID NO: 1040833 - RNA, 19 nt, Homo sapiens
uaaggcaccguauaaacuu

SEQ ID NO: 1040834 - RNA, 19 nt, Homo sapiens
gcaucacuggauaaauuua

SEQ ID NO: 1040835 - RNA, 19 nt, Homo sapiens
uggguuggcugcaguagug

SEQ ID NO: 1040836 - RNA, 19 nt, Homo sapiens
gggaagcaucacuggauaa

SEQ ID NO: 1040837 - RNA, 19 nt, Homo sapiens
gaagagaccacuaaaagca

SEQ ID NO: 1040838 - RNA, 19 nt, Homo sapiens
gauuacuccugauuucuac

SEQ ID NO: 1040839 - RNA, 19 nt, Homo sapiens
gaaagugaaacuaucucau

SEQ ID NO: 1040840 - RNA, 19 nt, Homo sapiens
ccaaugcucuaugccuuuc

SEQ ID NO: 1040841 - RNA, 19 nt, Homo sapiens
gggaaaucaaguuaaauuc

SEQ ID NO: 1040842 - RNA, 19 nt, Homo sapiens
aaauagagggacagucaaa

SEQ ID NO: 1040843 - RNA, 19 nt, Homo sapiens
guuggguucuaaaugguuu

SEQ ID NO: 1040844 - RNA, 19 nt, Homo sapiens
ugauuacuccugauuucua

SEQ ID NO: 1040845 - RNA, 19 nt, Homo sapiens
gcagcacacugacaauacg

SEQ ID NO: 1040846 - RNA, 19 nt, Homo sapiens
gaagaaucggucaucuaau

SEQ ID NO: 1040847 - RNA, 19 nt, Homo sapiens
cuaugaagcaugugaugaa

SEQ ID NO: 1040848 - RNA, 19 nt, Homo sapiens
gagagugacccacaaacca

SEQ ID NO: 1040849 - RNA, 19 nt, Homo sapiens
ggagguugcagugagcuaa

SEQ ID NO: 1040850 - RNA, 19 nt, Homo sapiens
caggugaagagaccacuaa

SEQ ID NO: 1040851 - RNA, 19 nt, Homo sapiens
caacacagauguacaacua

SEQ ID NO: 1040852 - RNA, 19 nt, Homo sapiens
gaacaacuucggacucuua

SEQ ID NO: 1040853 - RNA, 19 nt, Homo sapiens
gaaaaucacugcuuccaua

SEQ ID NO: 1040854 - RNA, 19 nt, Homo sapiens
guaaaccacuccauagauu

SEQ ID NO: 1040855 - RNA, 19 nt, Homo sapiens
guaaacaucacacagguua

SEQ ID NO: 1040856 - RNA, 19 nt, Homo sapiens
gcaguuaguuugacauuuu

SEQ ID NO: 1040857 - RNA, 19 nt, Homo sapiens
ucaagaggaugaccaugaa

SEQ ID NO: 1040858 - RNA, 19 nt, Homo sapiens
caaagcaguuggaucacaa

SEQ ID NO: 1040859 - RNA, 19 nt, Homo sapiens
aaggugagcuguuucaaga

SEQ ID NO: 1040860 - RNA, 19 nt, Homo sapiens
uaacugacuugaagaugga

SEQ ID NO: 1040861 - RNA, 19 nt, Homo sapiens
uguaugugcuguauaugua

SEQ ID NO: 1040862 - RNA, 19 nt, Homo sapiens
cauguuacuuugccuguuu

SEQ ID NO: 1040863 - RNA, 19 nt, Homo sapiens
gcgaaacacuaugcuaaug

SEQ ID NO: 1040864 - RNA, 19 nt, Homo sapiens
uacaaacacuggcgugauu

SEQ ID NO: 1040865 - RNA, 19 nt, Homo sapiens
caacccaggugauacuguu

SEQ ID NO: 1040866 - RNA, 19 nt, Homo sapiens
ucacacagguuauugaacu

SEQ ID NO: 1040867 - RNA, 19 nt, Homo sapiens
caacuucggacucuuaaau

SEQ ID NO: 1040868 - RNA, 19 nt, Homo sapiens
acacagauguacaacuaga

SEQ ID NO: 1040869 - RNA, 19 nt, Homo sapiens
ucacaaggacgagucauaa

SEQ ID NO: 1040870 - RNA, 19 nt, Homo sapiens
gaaaagagggacugccaua

SEQ ID NO: 1040871 - RNA, 19 nt, Homo sapiens
guagaagaguggccagaca

SEQ ID NO: 1040872 - RNA, 19 nt, Homo sapiens
ggagcucggucacuguguu

SEQ ID NO: 1040873 - RNA, 19 nt, Homo sapiens
ccauagauuugucuuucuu

SEQ ID NO: 1040874 - RNA, 19 nt, Homo sapiens
acaacuagauucucaagag

SEQ ID NO: 1040875 - RNA, 19 nt, Homo sapiens
cgugauucauggaaauuaa

SEQ ID NO: 1040876 - RNA, 19 nt, Homo sapiens
acacuugucuugcaguuag

SEQ ID NO: 1040877 - RNA, 19 nt, Homo sapiens
ugucagagauugguugguu

SEQ ID NO: 1040878 - RNA, 19 nt, Homo sapiens
gaacuugcucuuucaugug

SEQ ID NO: 1040879 - RNA, 19 nt, Homo sapiens
caaggacgagucauaaguu

SEQ ID NO: 1040880 - RNA, 19 nt, Homo sapiens
uaacauucccaaaggauau

SEQ ID NO: 1040881 - RNA, 19 nt, Homo sapiens
gcaguagcuuuggauaugu

SEQ ID NO: 1040882 - RNA, 19 nt, Homo sapiens
ggccagacaauguggauuu

SEQ ID NO: 1040883 - RNA, 19 nt, Homo sapiens
accaugaucuggcuaagaa

SEQ ID NO: 1040884 - RNA, 19 nt, Homo sapiens
gaaggucaaaccacaacuu

SEQ ID NO: 1040885 - RNA, 19 nt, Homo sapiens
gcucggaaccaauucauuc

SEQ ID NO: 1040886 - RNA, 19 nt, Homo sapiens
ccugugaacuugcucuuuc

SEQ ID NO: 1040887 - RNA, 19 nt, Homo sapiens
ggaauucgcaccugugaac

SEQ ID NO: 1040888 - RNA, 19 nt, Homo sapiens
cgcaguagcuuuggauaug

SEQ ID NO: 1040889 - RNA, 19 nt, Homo sapiens
ggaaauuaagucauguaga

SEQ ID NO: 1040890 - RNA, 19 nt, Homo sapiens
ccugcgagauggagaaaga

SEQ ID NO: 1040891 - RNA, 19 nt, Homo sapiens
gccauaacauucccaaagg

SEQ ID NO: 1040892 - RNA, 19 nt, Homo sapiens
uaacugaguacuccagaug

SEQ ID NO: 1040893 - RNA, 19 nt, Homo sapiens
aaacaucacacagguuauu

SEQ ID NO: 1040894 - RNA, 19 nt, Homo sapiens
uaagcauggugguguaugu

SEQ ID NO: 1040895 - RNA, 19 nt, Homo sapiens
aaggacgagucauaaguuu

SEQ ID NO: 1040896 - RNA, 19 nt, Homo sapiens
aagagggacugccauaaca

SEQ ID NO: 1040897 - RNA, 19 nt, Homo sapiens
uaaaccacuccauagauuu

SEQ ID NO: 1040898 - RNA, 19 nt, Homo sapiens
aaucacugcuuccauagau

SEQ ID NO: 1040899 - RNA, 19 nt, Homo sapiens
ggaugaccaugaagaaucg

SEQ ID NO: 1040900 - RNA, 19 nt, Homo sapiens
gaaaagaccaccaugaucu

SEQ ID NO: 1040901 - RNA, 19 nt, Homo sapiens
ccauaacauucccaaagga

SEQ ID NO: 1040902 - RNA, 19 nt, Homo sapiens
caaaccacaacuuaacuga

SEQ ID NO: 1040903 - RNA, 19 nt, Homo sapiens
aaagauaagcgaggucauu

SEQ ID NO: 1040904 - RNA, 19 nt, Homo sapiens
gagcaaccgaagacauaaa

SEQ ID NO: 1040905 - RNA, 19 nt, Homo sapiens
gaagaguggccagacaaug

SEQ ID NO: 1040906 - RNA, 19 nt, Homo sapiens
gagggacugccauaacauu

SEQ ID NO: 1040907 - RNA, 19 nt, Homo sapiens
ggccagccuuggaagacua

SEQ ID NO: 1040908 - RNA, 19 nt, Homo sapiens
ggucaaaccacaacuuaac

SEQ ID NO: 1040909 - RNA, 19 nt, Homo sapiens
cuauguugcuagaccagua

SEQ ID NO: 1040910 - RNA, 19 nt, Homo sapiens
aguuaaaggugagcuguuu

SEQ ID NO: 1040911 - RNA, 19 nt, Homo sapiens
gcgaggucauugucagaga

SEQ ID NO: 1040912 - RNA, 19 nt, Homo sapiens
uuuaacauuugacgcagua

SEQ ID NO: 1040913 - RNA, 19 nt, Homo sapiens
ggccagauacugaggaguu

SEQ ID NO: 1040914 - RNA, 19 nt, Homo sapiens
uucggacucuuaaauagua

SEQ ID NO: 1040915 - RNA, 19 nt, Homo sapiens
ggagggagaaacaaaauuu

SEQ ID NO: 1040916 - RNA, 19 nt, Homo sapiens
aaccacaacuuaacugagu

SEQ ID NO: 1040917 - RNA, 19 nt, Homo sapiens
ugguguaugugcuguauau

SEQ ID NO: 1040918 - RNA, 19 nt, Homo sapiens
guuaaauccucauguuacu

SEQ ID NO: 1040919 - RNA, 19 nt, Homo sapiens
gauaagcgaggucauuguc

SEQ ID NO: 1040920 - RNA, 19 nt, Homo sapiens
ggagcaaccgaagacauaa

SEQ ID NO: 1040921 - RNA, 19 nt, Homo sapiens
aaggucaaaccacaacuua

SEQ ID NO: 1040922 - RNA, 19 nt, Homo sapiens
agauuugucuuucuucaag

SEQ ID NO: 1040923 - RNA, 19 nt, Homo sapiens
aaaccacuccauagauuug

SEQ ID NO: 1040924 - RNA, 19 nt, Homo sapiens
gcuuaaacaucccauuuug

SEQ ID NO: 1040925 - RNA, 19 nt, Homo sapiens
caagagaaaauuggaguua

SEQ ID NO: 1040926 - RNA, 19 nt, Homo sapiens
ucgcgaaacacuaugcuaa

SEQ ID NO: 1040927 - RNA, 19 nt, Homo sapiens
auucuucacuuccuguaaa

SEQ ID NO: 1040928 - RNA, 19 nt, Homo sapiens
ggugguguaugugcuguau

SEQ ID NO: 1040929 - RNA, 19 nt, Homo sapiens
aggagcaaccgaagacaua

SEQ ID NO: 1040930 - RNA, 19 nt, Homo sapiens
uuugauugauggucauuga

SEQ ID NO: 1040931 - RNA, 19 nt, Homo sapiens
aaucaacacagauguacaa

SEQ ID NO: 1040932 - RNA, 19 nt, Homo sapiens
gucagagauugguugguuu

SEQ ID NO: 1040933 - RNA, 19 nt, Homo sapiens
caucacacagguuauugaa

SEQ ID NO: 1040934 - RNA, 19 nt, Homo sapiens
agucauaaguuuugaggua

SEQ ID NO: 1040935 - RNA, 19 nt, Homo sapiens
ggacgagucauaaguuuug

SEQ ID NO: 1040936 - RNA, 19 nt, Homo sapiens
ccagagagagacccuuuca

SEQ ID NO: 1040937 - RNA, 19 nt, Homo sapiens
caguagcuuuggauauguu

SEQ ID NO: 1040938 - RNA, 19 nt, Homo sapiens
ucacugcuuccauagauug

SEQ ID NO: 1040939 - RNA, 19 nt, Homo sapiens
uggcuaagaagaauuacaa

SEQ ID NO: 1040940 - RNA, 19 nt, Homo sapiens
gcagucccguucggcaaga

SEQ ID NO: 1040941 - RNA, 19 nt, Homo sapiens
aacuugcucuuucauguga

SEQ ID NO: 1040942 - RNA, 19 nt, Homo sapiens
cuccauagauuugucuuuc

SEQ ID NO: 1040943 - RNA, 19 nt, Homo sapiens
uuaguugggccaucucauu

SEQ ID NO: 1040944 - RNA, 19 nt, Homo sapiens
gcaaaacugcuuaaacauc

SEQ ID NO: 1040945 - RNA, 19 nt, Homo sapiens
acagauguacaacuagauu

SEQ ID NO: 1040946 - RNA, 19 nt, Homo sapiens
cgaggucauugucagagau

SEQ ID NO: 1040947 - RNA, 19 nt, Homo sapiens
ggaguuccuucgguaagca

SEQ ID NO: 1040948 - RNA, 19 nt, Homo sapiens
ucauuucccuauguugcua

SEQ ID NO: 1040949 - RNA, 19 nt, Homo sapiens
gaggaugaccaugaagaau

SEQ ID NO: 1040950 - RNA, 19 nt, Homo sapiens
ucuuaagcaugguggugua

SEQ ID NO: 1040951 - RNA, 19 nt, Homo sapiens
ggacagcaccacauuauug

SEQ ID NO: 1040952 - RNA, 19 nt, Homo sapiens
gaaucaaaguuguauccua

SEQ ID NO: 1040953 - RNA, 19 nt, Homo sapiens
ggaggaaagugacaaagga

SEQ ID NO: 1040954 - RNA, 19 nt, Homo sapiens
caagagggcacaugaagua

SEQ ID NO: 1040955 - RNA, 19 nt, Homo sapiens
cgaauaagguggauuugga

SEQ ID NO: 1040956 - RNA, 19 nt, Homo sapiens
ccacguggaucucugauug

SEQ ID NO: 1040957 - RNA, 19 nt, Homo sapiens
gggagacccuucaugauca

SEQ ID NO: 1040958 - RNA, 19 nt, Homo sapiens
ggagggucuugaaaucuuu

SEQ ID NO: 1040959 - RNA, 19 nt, Homo sapiens
gagaauggaauugaaguuu

SEQ ID NO: 1040960 - RNA, 19 nt, Homo sapiens
gaaggagaaugaagaccau

SEQ ID NO: 1040961 - RNA, 19 nt, Homo sapiens
auaaagacgucacucaaga

SEQ ID NO: 1040962 - RNA, 19 nt, Homo sapiens
gcacggaaucaaaguugua

SEQ ID NO: 1040963 - RNA, 19 nt, Homo sapiens
acagauggauucaguggaa

SEQ ID NO: 1040964 - RNA, 19 nt, Homo sapiens
gcaaagaggaaguuagaag

SEQ ID NO: 1040965 - RNA, 19 nt, Homo sapiens
gcaccacauuauuggguaa

SEQ ID NO: 1040966 - RNA, 19 nt, Homo sapiens
agaagagaauggaauugaa

SEQ ID NO: 1040967 - RNA, 19 nt, Homo sapiens
caaagaggaaguuagaaga

SEQ ID NO: 1040968 - RNA, 19 nt, Homo sapiens
caccaaguccuuucuguuu

SEQ ID NO: 1040969 - RNA, 19 nt, Homo sapiens
gacaacaaauagaagugaa

SEQ ID NO: 1040970 - RNA, 19 nt, Homo sapiens
gcuggagggucuugaaauc

SEQ ID NO: 1040971 - RNA, 19 nt, Homo sapiens
gaagagaauggaauugaag

SEQ ID NO: 1040972 - RNA, 19 nt, Homo sapiens
ccacucagaucugcaaaca

SEQ ID NO: 1040973 - RNA, 19 nt, Homo sapiens
uccaggcccucuuucuuua

SEQ ID NO: 1040974 - RNA, 19 nt, Homo sapiens
gacccuucaugaucagaua

SEQ ID NO: 1040975 - RNA, 19 nt, Homo sapiens
gaaguuagaagagaaugga

SEQ ID NO: 1040976 - RNA, 19 nt, Homo sapiens
gauauuccaggcccucuuu

SEQ ID NO: 1040977 - RNA, 19 nt, Homo sapiens
ccaaguccuuucuguuugu

SEQ ID NO: 1040978 - RNA, 19 nt, Homo sapiens
gcccuuugcucguggagaa

SEQ ID NO: 1040979 - RNA, 19 nt, Homo sapiens
caaacgaagaggaauguau

SEQ ID NO: 1040980 - RNA, 19 nt, Homo sapiens
aaacgcacacaaucagaua

SEQ ID NO: 1040981 - RNA, 19 nt, Homo sapiens
agaauggaauugaaguuuc

SEQ ID NO: 1040982 - RNA, 19 nt, Homo sapiens
gugcaaagaggaaguuaga

SEQ ID NO: 1040983 - RNA, 19 nt, Homo sapiens
gcaccaaguccuuucuguu

SEQ ID NO: 1040984 - RNA, 19 nt, Homo sapiens
caaaggaccgggaccuguu

SEQ ID NO: 1040985 - RNA, 19 nt, Homo sapiens
guauaaagacgucacucaa

SEQ ID NO: 1040986 - RNA, 19 nt, Homo sapiens
caucugacaggcucucuuu

SEQ ID NO: 1040987 - RNA, 19 nt, Homo sapiens
aaacgaagaggaauguaug

SEQ ID NO: 1040988 - RNA, 19 nt, Homo sapiens
agaggaaguuagaagagaa

SEQ ID NO: 1040989 - RNA, 19 nt, Homo sapiens
gcaaagcccagaugcugau

SEQ ID NO: 1040990 - RNA, 19 nt, Homo sapiens
gaacugcuccugguuaucg

SEQ ID NO: 1040991 - RNA, 19 nt, Homo sapiens
ucaagacgcagaagucaug

SEQ ID NO: 1040992 - RNA, 19 nt, Homo sapiens
guacggcguccuccacauu

SEQ ID NO: 1040993 - RNA, 19 nt, Homo sapiens
uagaagagaauggaauuga

SEQ ID NO: 1040994 - RNA, 19 nt, Homo sapiens
aaacuagccuucuguaacc

SEQ ID NO: 1040995 - RNA, 19 nt, Homo sapiens
guuagaagagaauggaauu

SEQ ID NO: 1040996 - RNA, 19 nt, Homo sapiens
gcaagagggcacaugaagu

SEQ ID NO: 1040997 - RNA, 19 nt, Homo sapiens
ugcaaggacugauggauag

SEQ ID NO: 1040998 - RNA, 19 nt, Homo sapiens
uggagggucuugaaaucuu

SEQ ID NO: 1040999 - RNA, 19 nt, Homo sapiens
gguauaaagacgucacuca

SEQ ID NO: 1041000 - RNA, 19 nt, Homo sapiens
gaaaacuagccuucuguaa

SEQ ID NO: 1041001 - RNA, 19 nt, Homo sapiens
aagaggaaguuagaagaga

SEQ ID NO: 1041002 - RNA, 19 nt, Homo sapiens
ugaccacuuuccaggauau

SEQ ID NO: 1041003 - RNA, 19 nt, Homo sapiens
ggacuguuuugaccacuuu

SEQ ID NO: 1041004 - RNA, 19 nt, Homo sapiens
gggugacgcggacacauuu

SEQ ID NO: 1041005 - RNA, 19 nt, Homo sapiens
ggauuuggagcacuacaug

SEQ ID NO: 1041006 - RNA, 19 nt, Homo sapiens
gcgaaaccgucacauacac

SEQ ID NO: 1041007 - RNA, 19 nt, Homo sapiens
cagguggacuuugcaagga

SEQ ID NO: 1041008 - RNA, 19 nt, Homo sapiens
uuuacuccgugccgaauaa

SEQ ID NO: 1041009 - RNA, 19 nt, Homo sapiens
acgcagaagucauggaagu

SEQ ID NO: 1041010 - RNA, 19 nt, Homo sapiens
uugcaaggacugauggaua

SEQ ID NO: 1041011 - RNA, 19 nt, Homo sapiens
caacaaauagaagugaaca

SEQ ID NO: 1041012 - RNA, 19 nt, Homo sapiens
aguaaaaccugcaacuuga

SEQ ID NO: 1041013 - RNA, 19 nt, Homo sapiens
cggaaucccugcccuuugc

SEQ ID NO: 1041014 - RNA, 19 nt, Homo sapiens
aaacagcaaagcccagaug

SEQ ID NO: 1041015 - RNA, 19 nt, Homo sapiens
ggaaaagacaacaaauaga

SEQ ID NO: 1041016 - RNA, 19 nt, Homo sapiens
gagggucuugaaaucuuua

SEQ ID NO: 1041017 - RNA, 19 nt, Homo sapiens
ugccaggacugugcaaaga

SEQ ID NO: 1041018 - RNA, 19 nt, Homo sapiens
uuaagcaucaggcagauau

SEQ ID NO: 1041019 - RNA, 19 nt, Homo sapiens
ggaccgggaccuguugguu

SEQ ID NO: 1041020 - RNA, 19 nt, Homo sapiens
gggcaagagggcacaugaa

SEQ ID NO: 1041021 - RNA, 19 nt, Homo sapiens
aaggacugauggauagcua

SEQ ID NO: 1041022 - RNA, 19 nt, Homo sapiens
cagauggauucaguggaaa

SEQ ID NO: 1041023 - RNA, 19 nt, Homo sapiens
auucacagauggauucagu

SEQ ID NO: 1041024 - RNA, 19 nt, Homo sapiens
uauaaagacgucacucaag

SEQ ID NO: 1041025 - RNA, 19 nt, Homo sapiens
ggcaagagggcacaugaag

SEQ ID NO: 1041026 - RNA, 19 nt, Homo sapiens
aauaaaaggggaagaguaa

SEQ ID NO: 1041027 - RNA, 19 nt, Homo sapiens
agacaacaaauagaaguga

SEQ ID NO: 1041028 - RNA, 19 nt, Homo sapiens
guggaaaagacaacaaaua

SEQ ID NO: 1041029 - RNA, 19 nt, Homo sapiens
gaggaaguuagaagagaau

SEQ ID NO: 1041030 - RNA, 19 nt, Homo sapiens
ggaaacagccccaggaacu

SEQ ID NO: 1041031 - RNA, 19 nt, Homo sapiens
uaaccacagugcccaaacg

SEQ ID NO: 1041032 - RNA, 19 nt, Homo sapiens
ggagacccuucaugaucag

SEQ ID NO: 1041033 - RNA, 19 nt, Homo sapiens
accaaguccuuucuguuug

SEQ ID NO: 1041034 - RNA, 19 nt, Homo sapiens
agacgcagaagucauggaa

SEQ ID NO: 1041035 - RNA, 19 nt, Homo sapiens
gacagcaccacauuauugg

SEQ ID NO: 1041036 - RNA, 19 nt, Homo sapiens
ggggaagaguaaagacaaa

SEQ ID NO: 1041037 - RNA, 19 nt, Homo sapiens
gucuugaaaucuuuacagu

SEQ ID NO: 1041038 - RNA, 19 nt, Homo sapiens
uuccaggcccucuuucuuu

SEQ ID NO: 1041039 - RNA, 19 nt, Homo sapiens
gaucucugauugcgaaacc

SEQ ID NO: 1041040 - RNA, 19 nt, Homo sapiens
gccgcagaauucacagaug

SEQ ID NO: 1041041 - RNA, 19 nt, Homo sapiens
aggaauguauggagaacuc

SEQ ID NO: 1041042 - RNA, 19 nt, Homo sapiens
gaugcuggagggucuugaa

SEQ ID NO: 1041043 - RNA, 19 nt, Homo sapiens
gcagaauucacagauggau

SEQ ID NO: 1041044 - RNA, 19 nt, Homo sapiens
ugaaggacaagaccaaggu

SEQ ID NO: 1041045 - RNA, 19 nt, Homo sapiens
ggaaguuagaagagaaugg

SEQ ID NO: 1041046 - RNA, 19 nt, Homo sapiens
uaauaaaaggggaagagua

SEQ ID NO: 1041047 - RNA, 19 nt, Homo sapiens
cauuucagguggacuuugc

SEQ ID NO: 1041048 - RNA, 19 nt, Homo sapiens
gcccaaacgaagaggaaug

SEQ ID NO: 1041049 - RNA, 19 nt, Homo sapiens
aaagaggaaguuagaagag

SEQ ID NO: 1041050 - RNA, 19 nt, Homo sapiens
ccacuuuccaggauaugug

SEQ ID NO: 1041051 - RNA, 19 nt, Homo sapiens
gaacagaauucaaaguaug

SEQ ID NO: 1041052 - RNA, 19 nt, Homo sapiens
gagacuauguuucuaagua

SEQ ID NO: 1041053 - RNA, 19 nt, Homo sapiens
uaaaugaacucuccaacuu

SEQ ID NO: 1041054 - RNA, 19 nt, Homo sapiens
ucacccagauuuauacuua

SEQ ID NO: 1041055 - RNA, 19 nt, Homo sapiens
gcaagcugauucacauaua

SEQ ID NO: 1041056 - RNA, 19 nt, Homo sapiens
gaagucgccugguuaaaga

SEQ ID NO: 1041057 - RNA, 19 nt, Homo sapiens
agacagcucuuucgggaua

SEQ ID NO: 1041058 - RNA, 19 nt, Homo sapiens
ggacucuccuuauucaauu

SEQ ID NO: 1041059 - RNA, 19 nt, Homo sapiens
ugaaagagaucacccaaca

SEQ ID NO: 1041060 - RNA, 19 nt, Homo sapiens
caacaucaauaacuuguca

SEQ ID NO: 1041061 - RNA, 19 nt, Homo sapiens
ggagauacuuagacauuuc

SEQ ID NO: 1041062 - RNA, 19 nt, Homo sapiens
gauguugacuuaauuccaa

SEQ ID NO: 1041063 - RNA, 19 nt, Homo sapiens
gaaauguguuccugcaugu

SEQ ID NO: 1041064 - RNA, 19 nt, Homo sapiens
caagcugauucacauauaa

SEQ ID NO: 1041065 - RNA, 19 nt, Homo sapiens
agaauaggguacagagaua

SEQ ID NO: 1041066 - RNA, 19 nt, Homo sapiens
caacagaggauuugucuca

SEQ ID NO: 1041067 - RNA, 19 nt, Homo sapiens
ccaaaaugauguugacuua

SEQ ID NO: 1041068 - RNA, 19 nt, Homo sapiens
caaaguaugagcaaggaua

SEQ ID NO: 1041069 - RNA, 19 nt, Homo sapiens
caacaacaacagaggauuu

SEQ ID NO: 1041070 - RNA, 19 nt, Homo sapiens
ucaauuaagucaagcugaa

SEQ ID NO: 1041071 - RNA, 19 nt, Homo sapiens
gugagucagucuuucauuu

SEQ ID NO: 1041072 - RNA, 19 nt, Homo sapiens
gggaagaguuugcaagaag

SEQ ID NO: 1041073 - RNA, 19 nt, Homo sapiens
ugaacucuccaacuuauua

SEQ ID NO: 1041074 - RNA, 19 nt, Homo sapiens
ccacaccagucuuggauug

SEQ ID NO: 1041075 - RNA, 19 nt, Homo sapiens
gaacuaaugacagcaauca

SEQ ID NO: 1041076 - RNA, 19 nt, Homo sapiens
gcuuaugcaugaaacaauu

SEQ ID NO: 1041077 - RNA, 19 nt, Homo sapiens
gaucacccaacaucaauaa

SEQ ID NO: 1041078 - RNA, 19 nt, Homo sapiens
caagagagacuauguuucu

SEQ ID NO: 1041079 - RNA, 19 nt, Homo sapiens
gaauauggaauguucaugu

SEQ ID NO: 1041080 - RNA, 19 nt, Homo sapiens
gccagaauauggaauguuc

SEQ ID NO: 1041081 - RNA, 19 nt, Homo sapiens
ggaauguacuuucacuuuu

SEQ ID NO: 1041082 - RNA, 19 nt, Homo sapiens
ucaccucagucucuaauug

SEQ ID NO: 1041083 - RNA, 19 nt, Homo sapiens
gaauagugguuagaaguag

SEQ ID NO: 1041084 - RNA, 19 nt, Homo sapiens
ggaagaguuugcaagaagu

SEQ ID NO: 1041085 - RNA, 19 nt, Homo sapiens
ucagaguucuuccacugua

SEQ ID NO: 1041086 - RNA, 19 nt, Homo sapiens
gcaaaguauuagugguuga

SEQ ID NO: 1041087 - RNA, 19 nt, Homo sapiens
ugagucagucuuucauuua

SEQ ID NO: 1041088 - RNA, 19 nt, Homo sapiens
gagaauaggguacagagau

SEQ ID NO: 1041089 - RNA, 19 nt, Homo sapiens
ggaccaaaccaacaagaga

SEQ ID NO: 1041090 - RNA, 19 nt, Homo sapiens
aagcuaaccuuggaugaaa

SEQ ID NO: 1041091 - RNA, 19 nt, Homo sapiens
gaacucuccaacuuauuaa

SEQ ID NO: 1041092 - RNA, 19 nt, Homo sapiens
gaagaacuaaugacagcaa

SEQ ID NO: 1041093 - RNA, 19 nt, Homo sapiens
agaaggagauacuuagaca

SEQ ID NO: 1041094 - RNA, 19 nt, Homo sapiens
gagagacuauguuucuaag

SEQ ID NO: 1041095 - RNA, 19 nt, Homo sapiens
gccuaaaccugagaagaaa

SEQ ID NO: 1041096 - RNA, 19 nt, Homo sapiens
gaucuaaggaugacuugga

SEQ ID NO: 1041097 - RNA, 19 nt, Homo sapiens
aaugaacucuccaacuuau

SEQ ID NO: 1041098 - RNA, 19 nt, Homo sapiens
agacgaagucgccugguua

SEQ ID NO: 1041099 - RNA, 19 nt, Homo sapiens
ggacauucauuugcauaag

SEQ ID NO: 1041100 - RNA, 19 nt, Homo sapiens
ugaauagugguuagaagua

SEQ ID NO: 1041101 - RNA, 19 nt, Homo sapiens
acacuuggauccuucuguu

SEQ ID NO: 1041102 - RNA, 19 nt, Homo sapiens
aaaugaacucuccaacuua

SEQ ID NO: 1041103 - RNA, 19 nt, Homo sapiens
gaauguacuuucacuuuug

SEQ ID NO: 1041104 - RNA, 19 nt, Homo sapiens
ucugaacacuggccuguga

SEQ ID NO: 1041105 - RNA, 19 nt, Homo sapiens
gaacacuggccugugauug

SEQ ID NO: 1041106 - RNA, 19 nt, Homo sapiens
gcacugaagagucugaaca

SEQ ID NO: 1041107 - RNA, 19 nt, Homo sapiens
caauaaauccacuccuuca

SEQ ID NO: 1041108 - RNA, 19 nt, Homo sapiens
uaaagaugcagaugucaga

SEQ ID NO: 1041109 - RNA, 19 nt, Homo sapiens
gauagggaucuaaggauga

SEQ ID NO: 1041110 - RNA, 19 nt, Homo sapiens
gcuacugacuucugcaaag

SEQ ID NO: 1041111 - RNA, 19 nt, Homo sapiens
caauucaccucagucucua

SEQ ID NO: 1041112 - RNA, 19 nt, Homo sapiens
gcaagaggcauacagaaaa

SEQ ID NO: 1041113 - RNA, 19 nt, Homo sapiens
gaagaguuugcaagaaguu

SEQ ID NO: 1041114 - RNA, 19 nt, Homo sapiens
uggaauguacuuucacuuu

SEQ ID NO: 1041115 - RNA, 19 nt, Homo sapiens
gagaucacccaacaucaau

SEQ ID NO: 1041116 - RNA, 19 nt, Homo sapiens
uguguggacucuccuuauu

SEQ ID NO: 1041117 - RNA, 19 nt, Homo sapiens
ggaaugcuguguggacucu

SEQ ID NO: 1041118 - RNA, 19 nt, Homo sapiens
guucuuccacuguauguuu

SEQ ID NO: 1041119 - RNA, 19 nt, Homo sapiens
cacccaacaucaauaacuu

SEQ ID NO: 1041120 - RNA, 19 nt, Homo sapiens
ggaauuucagagaggauuu

SEQ ID NO: 1041121 - RNA, 19 nt, Homo sapiens
uagaugaugcugcugauga

SEQ ID NO: 1041122 - RNA, 19 nt, Homo sapiens
uaaagaugcucugcgucaa

SEQ ID NO: 1041123 - RNA, 19 nt, Homo sapiens
ccaaguagccaucaacaac

SEQ ID NO: 1041124 - RNA, 19 nt, Homo sapiens
aaagagaucacccaacauc

SEQ ID NO: 1041125 - RNA, 19 nt, Homo sapiens
caacgucucuguaaaagca

SEQ ID NO: 1041126 - RNA, 19 nt, Homo sapiens
cauguauccugaaaugugu

SEQ ID NO: 1041127 - RNA, 19 nt, Homo sapiens
gagaugaccaagccagaau

SEQ ID NO: 1041128 - RNA, 19 nt, Homo sapiens
gaugcucugcgucaauuaa

SEQ ID NO: 1041129 - RNA, 19 nt, Homo sapiens
cagacgaagucgccugguu

SEQ ID NO: 1041130 - RNA, 19 nt, Homo sapiens
gagucagucuuucauuuac

SEQ ID NO: 1041131 - RNA, 19 nt, Homo sapiens
ccugcacucuggccaauga

SEQ ID NO: 1041132 - RNA, 19 nt, Homo sapiens
aaggagauacuuagacauu

SEQ ID NO: 1041133 - RNA, 19 nt, Homo sapiens
agagagacuauguuucuaa

SEQ ID NO: 1041134 - RNA, 19 nt, Homo sapiens
ugaaauuuguccugagucu

SEQ ID NO: 1041135 - RNA, 19 nt, Homo sapiens
aagaugcucugcgucaauu

SEQ ID NO: 1041136 - RNA, 19 nt, Homo sapiens
gacgaagucgccugguuaa

SEQ ID NO: 1041137 - RNA, 19 nt, Homo sapiens
uccaauaaauccacuccuu

SEQ ID NO: 1041138 - RNA, 19 nt, Homo sapiens
gccuugugcuccaauaaau

SEQ ID NO: 1041139 - RNA, 19 nt, Homo sapiens
gacauucauuugcauaagg

SEQ ID NO: 1041140 - RNA, 19 nt, Homo sapiens
ugaugcugcugaugacauu

SEQ ID NO: 1041141 - RNA, 19 nt, Homo sapiens
caugaaacaauucugcaaa

SEQ ID NO: 1041142 - RNA, 19 nt, Homo sapiens
gcagaugucagaaaagaaa

SEQ ID NO: 1041143 - RNA, 19 nt, Homo sapiens
ggguguaaccaucaagaaa

SEQ ID NO: 1041144 - RNA, 19 nt, Homo sapiens
ucaaaccacaccagucuug

SEQ ID NO: 1041145 - RNA, 19 nt, Homo sapiens
gaauucaaaguaugagcaa

SEQ ID NO: 1041146 - RNA, 19 nt, Homo sapiens
ugaccaagccagaauaugg

SEQ ID NO: 1041147 - RNA, 19 nt, Homo sapiens
ccaauucaccucagucucu

SEQ ID NO: 1041148 - RNA, 19 nt, Homo sapiens
auauaaagaugcagauguc

SEQ ID NO: 1041149 - RNA, 19 nt, Homo sapiens
agacugaggcaggagaaua

SEQ ID NO: 1041150 - RNA, 19 nt, Homo sapiens
gaggaagcacuccaaguag

SEQ ID NO: 1041151 - RNA, 19 nt, Homo sapiens
gggcugggaacaauaaaug

SEQ ID NO: 1041152 - RNA, 19 nt, Homo sapiens
uaaaugcagccaugucucu

SEQ ID NO: 1041153 - RNA, 19 nt, Homo sapiens
gggcaggugacccaaggaa

SEQ ID NO: 1041154 - RNA, 19 nt, Homo sapiens
caauaaaugcagccauguc

SEQ ID NO: 1041155 - RNA, 19 nt, Homo sapiens
gagggaaggacaggagaug

SEQ ID NO: 1041156 - RNA, 19 nt, Homo sapiens
ccaaagacaugcuuaauuu

SEQ ID NO: 1041157 - RNA, 19 nt, Homo sapiens
ccacacaggugaauaauuu

SEQ ID NO: 1041158 - RNA, 19 nt, Homo sapiens
guaaagggauugucuaauu

SEQ ID NO: 1041159 - RNA, 19 nt, Homo sapiens
ggaaauacuugcuccauga

SEQ ID NO: 1041160 - RNA, 19 nt, Homo sapiens
ggacgugacugaccauuau

SEQ ID NO: 1041161 - RNA, 19 nt, Homo sapiens
ggaaacagguggauuugga

SEQ ID NO: 1041162 - RNA, 19 nt, Homo sapiens
ggacaugauuaaagaguuu

SEQ ID NO: 1041163 - RNA, 19 nt, Homo sapiens
cauggaacgucuauucuua

SEQ ID NO: 1041164 - RNA, 19 nt, Homo sapiens
caacaucaccaacaaguaa

SEQ ID NO: 1041165 - RNA, 19 nt, Homo sapiens
gagaucaagguguaaauua

SEQ ID NO: 1041166 - RNA, 19 nt, Homo sapiens
ggacacauguaaagggauu

SEQ ID NO: 1041167 - RNA, 19 nt, Homo sapiens
agaacuaccuggcauguaa

SEQ ID NO: 1041168 - RNA, 19 nt, Homo sapiens
ggaaguugcucaggauuug

SEQ ID NO: 1041169 - RNA, 19 nt, Homo sapiens
ccaauuugcuuguacuuau

SEQ ID NO: 1041170 - RNA, 19 nt, Homo sapiens
gcaaggauaauuggaauaa

SEQ ID NO: 1041171 - RNA, 19 nt, Homo sapiens
gugaaagccuuauuaguuc

SEQ ID NO: 1041172 - RNA, 19 nt, Homo sapiens
gauuuggauuugaggauua

SEQ ID NO: 1041173 - RNA, 19 nt, Homo sapiens
gaaaugaaccaccucaaca

SEQ ID NO: 1041174 - RNA, 19 nt, Homo sapiens
gaacgucuauucuuacacu

SEQ ID NO: 1041175 - RNA, 19 nt, Homo sapiens
cauaauggcuguguuuaau

SEQ ID NO: 1041176 - RNA, 19 nt, Homo sapiens
gaacgcaucugugugucaa

SEQ ID NO: 1041177 - RNA, 19 nt, Homo sapiens
ugaaccaccucaacauaaa

SEQ ID NO: 1041178 - RNA, 19 nt, Homo sapiens
gcaaagcaauagaggaagu

SEQ ID NO: 1041179 - RNA, 19 nt, Homo sapiens
uuuaagagaucaaggugua

SEQ ID NO: 1041180 - RNA, 19 nt, Homo sapiens
uaaaucugcuagugaauuc

SEQ ID NO: 1041181 - RNA, 19 nt, Homo sapiens
guagggcuuugacuucuaa

SEQ ID NO: 1041182 - RNA, 19 nt, Homo sapiens
guaaauacaaccgugauaa

SEQ ID NO: 1041183 - RNA, 19 nt, Homo sapiens
aacaaacaguggagaauuu

SEQ ID NO: 1041184 - RNA, 19 nt, Homo sapiens
uggcagagauacugugaaa

SEQ ID NO: 1041185 - RNA, 19 nt, Homo sapiens
ugugaaagccuuauuaguu

SEQ ID NO: 1041186 - RNA, 19 nt, Homo sapiens
ugaaauaaacgacaaguca

SEQ ID NO: 1041187 - RNA, 19 nt, Homo sapiens
gccaaaaucucaugccaua

SEQ ID NO: 1041188 - RNA, 19 nt, Homo sapiens
gagagaaacaaaugucuau

SEQ ID NO: 1041189 - RNA, 19 nt, Homo sapiens
aaaggaaacagguggauuu

SEQ ID NO: 1041190 - RNA, 19 nt, Homo sapiens
ucucggacaugauuaaaga

SEQ ID NO: 1041191 - RNA, 19 nt, Homo sapiens
ggauuuggauuugaggauu

SEQ ID NO: 1041192 - RNA, 19 nt, Homo sapiens
uaauggcuguguuuaauca

SEQ ID NO: 1041193 - RNA, 19 nt, Homo sapiens
caacaaacaguggagaauu

SEQ ID NO: 1041194 - RNA, 19 nt, Homo sapiens
uauugugacuguuugcaua

SEQ ID NO: 1041195 - RNA, 19 nt, Homo sapiens
ucaagaagguguuguagcu

SEQ ID NO: 1041196 - RNA, 19 nt, Homo sapiens
uaagagaacgcaucugugu

SEQ ID NO: 1041197 - RNA, 19 nt, Homo sapiens
ggacgaagaagcagcuaau

SEQ ID NO: 1041198 - RNA, 19 nt, Homo sapiens
gaucaagguguaaauuaug

SEQ ID NO: 1041199 - RNA, 19 nt, Homo sapiens
gaauagauuguacggcaaa

SEQ ID NO: 1041200 - RNA, 19 nt, Homo sapiens
ugauaaagaugcaacugau

SEQ ID NO: 1041201 - RNA, 19 nt, Homo sapiens
auacaaccgugauaaugaa

SEQ ID NO: 1041202 - RNA, 19 nt, Homo sapiens
gaauuuacagucucucuca

SEQ ID NO: 1041203 - RNA, 19 nt, Homo sapiens
gauaaaaccccuaagagaa

SEQ ID NO: 1041204 - RNA, 19 nt, Homo sapiens
gaagguguuguagcucuua

SEQ ID NO: 1041205 - RNA, 19 nt, Homo sapiens
gcucaggauuuggauuuga

SEQ ID NO: 1041206 - RNA, 19 nt, Homo sapiens
gauaaagaugcaacugauu

SEQ ID NO: 1041207 - RNA, 19 nt, Homo sapiens
aaacugaucuuucuauacc

SEQ ID NO: 1041208 - RNA, 19 nt, Homo sapiens
uguuagaucugauugaugu

SEQ ID NO: 1041209 - RNA, 19 nt, Homo sapiens
caugagaaauugaacuuac

SEQ ID NO: 1041210 - RNA, 19 nt, Homo sapiens
gugaaaauauucucuguga

SEQ ID NO: 1041211 - RNA, 19 nt, Homo sapiens
gaagacacaauccaucauc

SEQ ID NO: 1041212 - RNA, 19 nt, Homo sapiens
caaacaguaugcaguaggu

SEQ ID NO: 1041213 - RNA, 19 nt, Homo sapiens
cacaguaucuccuagucaa

SEQ ID NO: 1041214 - RNA, 19 nt, Homo sapiens
gggcuuugacuucuaauug

SEQ ID NO: 1041215 - RNA, 19 nt, Homo sapiens
gcagagaacaacaaacagu

SEQ ID NO: 1041216 - RNA, 19 nt, Homo sapiens
uauaaaccauucaccaaag

SEQ ID NO: 1041217 - RNA, 19 nt, Homo sapiens
ucagaggauuuguaagaau

SEQ ID NO: 1041218 - RNA, 19 nt, Homo sapiens
uaaugcauauugugacugu

SEQ ID NO: 1041219 - RNA, 19 nt, Homo sapiens
gcagagauacugugaaagc

SEQ ID NO: 1041220 - RNA, 19 nt, Homo sapiens
caucauggaacgucuauuc

SEQ ID NO: 1041221 - RNA, 19 nt, Homo sapiens
gcucuuagcaccacugaca

SEQ ID NO: 1041222 - RNA, 19 nt, Homo sapiens
gagaaacaaaugucuaucu

SEQ ID NO: 1041223 - RNA, 19 nt, Homo sapiens
gaagaacuaccuggcaugu

SEQ ID NO: 1041224 - RNA, 19 nt, Homo sapiens
uaaacgacaagucacauug

SEQ ID NO: 1041225 - RNA, 19 nt, Homo sapiens
caacaauuggaacgaguuu

SEQ ID NO: 1041226 - RNA, 19 nt, Homo sapiens
acaaacaguggagaauuua

SEQ ID NO: 1041227 - RNA, 19 nt, Homo sapiens
ggguguaaauccaucuguu

SEQ ID NO: 1041228 - RNA, 19 nt, Homo sapiens
ugucuuauaugcuuuaggu

SEQ ID NO: 1041229 - RNA, 19 nt, Homo sapiens
ccaaggacaaguugauuuc

SEQ ID NO: 1041230 - RNA, 19 nt, Homo sapiens
gccaaggacaaguugauuu

SEQ ID NO: 1041231 - RNA, 19 nt, Homo sapiens
uaagcaaggauaauuggaa

SEQ ID NO: 1041232 - RNA, 19 nt, Homo sapiens
caaaaucucaugccauaaa

SEQ ID NO: 1041233 - RNA, 19 nt, Homo sapiens
cgagagaaacaaaugucua

SEQ ID NO: 1041234 - RNA, 19 nt, Homo sapiens
aauacaaccgugauaauga

SEQ ID NO: 1041235 - RNA, 19 nt, Homo sapiens
cggcaaacuagcuaaagua

SEQ ID NO: 1041236 - RNA, 19 nt, Homo sapiens
aagcaaggauaauuggaau

SEQ ID NO: 1041237 - RNA, 19 nt, Homo sapiens
uguaagaaauaucgucagu

SEQ ID NO: 1041238 - RNA, 19 nt, Homo sapiens
cuauaaaccauucaccaaa

SEQ ID NO: 1041239 - RNA, 19 nt, Homo sapiens
guacugccaaggacaaguu

SEQ ID NO: 1041240 - RNA, 19 nt, Homo sapiens
caaccagucagacaggaaa

SEQ ID NO: 1041241 - RNA, 19 nt, Homo sapiens
ggaagaucaacaauuggaa

SEQ ID NO: 1041242 - RNA, 19 nt, Homo sapiens
gauaagcaaggauaauugg

SEQ ID NO: 1041243 - RNA, 19 nt, Homo sapiens
gcagagcuuuuauaugaug

SEQ ID NO: 1041244 - RNA, 19 nt, Homo sapiens
gugauaaagaugcaacuga

SEQ ID NO: 1041245 - RNA, 19 nt, Homo sapiens
ugaccuggcuguggcuuau

SEQ ID NO: 1041246 - RNA, 19 nt, Homo sapiens
auaccaacaucaccaacaa

SEQ ID NO: 1041247 - RNA, 19 nt, Homo sapiens
aauacuugcuccaugagaa

SEQ ID NO: 1041248 - RNA, 19 nt, Homo sapiens
ggcuuugacuucuaauugu

SEQ ID NO: 1041249 - RNA, 19 nt, Homo sapiens
aaacgacaagucacauuga

SEQ ID NO: 1041250 - RNA, 19 nt, Homo sapiens
ucagucguccuaaugcaua

SEQ ID NO: 1041251 - RNA, 19 nt, Homo sapiens
cuaccuggcauguaagaaa

SEQ ID NO: 1041252 - RNA, 19 nt, Homo sapiens
gguguuugcugggauggaa

SEQ ID NO: 1041253 - RNA, 19 nt, Homo sapiens
guauguaagguuaguaugu

SEQ ID NO: 1041254 - RNA, 19 nt, Homo sapiens
auaaaccauucaccaaaga

SEQ ID NO: 1041255 - RNA, 19 nt, Homo sapiens
aaugaaccaccucaacaua

SEQ ID NO: 1041256 - RNA, 19 nt, Homo sapiens
gaauggaaauguagucuua

SEQ ID NO: 1041257 - RNA, 19 nt, Homo sapiens
gaagagaaagcaauuaaug

SEQ ID NO: 1041258 - RNA, 19 nt, Homo sapiens
ggucuugaauggaaaugua

SEQ ID NO: 1041259 - RNA, 19 nt, Homo sapiens
gggcaaaguuucccacguu

SEQ ID NO: 1041260 - RNA, 19 nt, Homo sapiens
gggagagccucaugcagaa

SEQ ID NO: 1041261 - RNA, 19 nt, Homo sapiens
uguaucaucuagacgcuua

SEQ ID NO: 1041262 - RNA, 19 nt, Homo sapiens
gaauggcgcaugaugaaga

SEQ ID NO: 1041263 - RNA, 19 nt, Homo sapiens
cagccugguuucugcauaa

SEQ ID NO: 1041264 - RNA, 19 nt, Homo sapiens
gaagaaccggccauucaug

SEQ ID NO: 1041265 - RNA, 19 nt, Homo sapiens
gggagggccuugaggacaa

SEQ ID NO: 1041266 - RNA, 19 nt, Homo sapiens
gguguucggucuugaaugg

SEQ ID NO: 1041267 - RNA, 19 nt, Homo sapiens
ggaagagaaagcaauuaau

SEQ ID NO: 1041268 - RNA, 19 nt, Homo sapiens
cggaagagaaagcaauuaa

SEQ ID NO: 1041269 - RNA, 19 nt, Homo sapiens
agaccagaaucgacacaaa

SEQ ID NO: 1041270 - RNA, 19 nt, Homo sapiens
aggaggagcugcuucagau

SEQ ID NO: 1041271 - RNA, 19 nt, Homo sapiens
ggagggccuugaggacaaa

SEQ ID NO: 1041272 - RNA, 19 nt, Homo sapiens
gaccagaaucgacacaaau

SEQ ID NO: 1041273 - RNA, 19 nt, Homo sapiens
gcaaaguuucccacguuga

SEQ ID NO: 1041274 - RNA, 19 nt, Homo sapiens
ccugguuucugcauaaaga

SEQ ID NO: 1041275 - RNA, 19 nt, Homo sapiens
gaggaggagcugcuucaga

SEQ ID NO: 1041276 - RNA, 19 nt, Homo sapiens
gcagcuguaucaucuagac

SEQ ID NO: 1041277 - RNA, 19 nt, Homo sapiens
cggaauggcgcaugaugaa

SEQ ID NO: 1041278 - RNA, 19 nt, Homo sapiens
ggaggaccaagcuggguuu

SEQ ID NO: 1041279 - RNA, 19 nt, Homo sapiens
ccagacaaccagaccagaa

SEQ ID NO: 1041280 - RNA, 19 nt, Homo sapiens
gcagaucaacucucaugag

SEQ ID NO: 1041281 - RNA, 19 nt, Homo sapiens
gaggacgccuagaucucuu

SEQ ID NO: 1041282 - RNA, 19 nt, Homo sapiens
ggaugcagaacagcgauuu

SEQ ID NO: 1041283 - RNA, 19 nt, Homo sapiens
gcaaaaggccagggaugua

SEQ ID NO: 1041284 - RNA, 19 nt, Homo sapiens
ggagcugcuucagaugcua

SEQ ID NO: 1041285 - RNA, 19 nt, Homo sapiens
gcagcugaauccggaaugg

SEQ ID NO: 1041286 - RNA, 19 nt, Homo sapiens
uuaggccagucuuagguuu

SEQ ID NO: 1041287 - RNA, 19 nt, Homo sapiens
gaucagggugucuccuugu

SEQ ID NO: 1041288 - RNA, 19 nt, Homo sapiens
ggagaaccgccuggugaug

SEQ ID NO: 1041289 - RNA, 19 nt, Homo sapiens
ucagccugguuucugcaua

SEQ ID NO: 1041290 - RNA, 19 nt, Homo sapiens
aauccggaauggcgcauga

SEQ ID NO: 1041291 - RNA, 19 nt, Homo sapiens
gguauccggagucgauuga

SEQ ID NO: 1041292 - RNA, 19 nt, Homo sapiens
agagaaagcaauuaauggu

SEQ ID NO: 1041293 - RNA, 19 nt, Homo sapiens
caaaguuucccacguugag

SEQ ID NO: 1041294 - RNA, 19 nt, Homo sapiens
ugaggacaaauacaacuug

SEQ ID NO: 1041295 - RNA, 19 nt, Homo sapiens
gaagggaagguuuucauca

SEQ ID NO: 1041296 - RNA, 19 nt, Homo sapiens
gaugguguucggucuugaa

SEQ ID NO: 1041297 - RNA, 19 nt, Homo sapiens
gaugaagaaccggccauuc

SEQ ID NO: 1041298 - RNA, 19 nt, Homo sapiens
aauggcgcaugaugaagaa

SEQ ID NO: 1041299 - RNA, 19 nt, Homo sapiens
ggaggguagugcgucuaga

SEQ ID NO: 1041300 - RNA, 19 nt, Homo sapiens
guucggucuugaauggaaa

SEQ ID NO: 1041301 - RNA, 19 nt, Homo sapiens
cagacaaccagaccagaau

SEQ ID NO: 1041302 - RNA, 19 nt, Homo sapiens
aauacaacuugcagcugaa

SEQ ID NO: 1041303 - RNA, 19 nt, Homo sapiens
ggcgaucggugcugauucg

SEQ ID NO: 1041304 - RNA, 19 nt, Homo sapiens
gaggcgaucggugcugauu

SEQ ID NO: 1041305 - RNA, 19 nt, Homo sapiens
uaucaucuagacgcuuaua

SEQ ID NO: 1041306 - RNA, 19 nt, Homo sapiens
gggagaaccgccuggugau

SEQ ID NO: 1041307 - RNA, 19 nt, Homo sapiens
ugaaaagccucaccugaac

SEQ ID NO: 1041308 - RNA, 19 nt, Homo sapiens
ggaggagcugcuucagaug

SEQ ID NO: 1041309 - RNA, 19 nt, Homo sapiens
aagagaaagcaauuaaugg

SEQ ID NO: 1041310 - RNA, 19 nt, Homo sapiens
gaggguagugcgucuagag

SEQ ID NO: 1041311 - RNA, 19 nt, Homo sapiens
gcagagaacuguuagauaa

SEQ ID NO: 1041312 - RNA, 19 nt, Homo sapiens
gaauaggacucaguuuaua

SEQ ID NO: 1041313 - RNA, 19 nt, Homo sapiens
gaugauacaugaucucuga

SEQ ID NO: 1041314 - RNA, 19 nt, Homo sapiens
gaagaacucucacgcuaug

SEQ ID NO: 1041315 - RNA, 19 nt, Homo sapiens
gaacaaaggauaccugaau

SEQ ID NO: 1041316 - RNA, 19 nt, Homo sapiens
gaugaagucuuacuacaga

SEQ ID NO: 1041317 - RNA, 19 nt, Homo sapiens
aggaagcgaugaucaauua

SEQ ID NO: 1041318 - RNA, 19 nt, Homo sapiens
ggacucaguuuauaugaug

SEQ ID NO: 1041319 - RNA, 19 nt, Homo sapiens
gacaagauccuguuucauu

SEQ ID NO: 1041320 - RNA, 19 nt, Homo sapiens
caacaccuguccaaacaaa

SEQ ID NO: 1041321 - RNA, 19 nt, Homo sapiens
ugucaaggaugaaaucuuu

SEQ ID NO: 1041322 - RNA, 19 nt, Homo sapiens
gcaugcagcuuccuagaug

SEQ ID NO: 1041323 - RNA, 19 nt, Homo sapiens
acaauuagauggucuggaa

SEQ ID NO: 1041324 - RNA, 19 nt, Homo sapiens
gagcuugggucgccucuga

SEQ ID NO: 1041325 - RNA, 19 nt, Homo sapiens
ugaaaucuuugacauggua

SEQ ID NO: 1041326 - RNA, 19 nt, Homo sapiens
caugaucucugaaagacua

SEQ ID NO: 1041327 - RNA, 19 nt, Homo sapiens
gaauuuccaucaugcaguu

SEQ ID NO: 1041328 - RNA, 19 nt, Homo sapiens
caugaccaaugucuucuua

SEQ ID NO: 1041329 - RNA, 19 nt, Homo sapiens
ggaaacagcaaaugcagaa

SEQ ID NO: 1041330 - RNA, 19 nt, Homo sapiens
gcagugacaguaauuguuu

SEQ ID NO: 1041331 - RNA, 19 nt, Homo sapiens
ccucagaaauggucuaaau

SEQ ID NO: 1041332 - RNA, 19 nt, Homo sapiens
gaaaaucucucuucaggau

SEQ ID NO: 1041333 - RNA, 19 nt, Homo sapiens
acaagauccuguuucauuu

SEQ ID NO: 1041334 - RNA, 19 nt, Homo sapiens
guacagcaguuaggaaguu

SEQ ID NO: 1041335 - RNA, 19 nt, Homo sapiens
gaacagcuaccaugaccaa

SEQ ID NO: 1041336 - RNA, 19 nt, Homo sapiens
aaaggaaccugcagcucua

SEQ ID NO: 1041337 - RNA, 19 nt, Homo sapiens
gagcaaagugcaagcaauu

SEQ ID NO: 1041338 - RNA, 19 nt, Homo sapiens
gaaauuaagagaggaauca

SEQ ID NO: 1041339 - RNA, 19 nt, Homo sapiens
acaauggcaugcucaguaa

SEQ ID NO: 1041340 - RNA, 19 nt, Homo sapiens
gagaacuguuagauaauga

SEQ ID NO: 1041341 - RNA, 19 nt, Homo sapiens
gaaaauccauggacaagau

SEQ ID NO: 1041342 - RNA, 19 nt, Homo sapiens
cuuccuagaugauuuauug

SEQ ID NO: 1041343 - RNA, 19 nt, Homo sapiens
gcagcuuccuagaugauuu

SEQ ID NO: 1041344 - RNA, 19 nt, Homo sapiens
aagaauaggacucaguuua

SEQ ID NO: 1041345 - RNA, 19 nt, Homo sapiens
ggagaaauggacuauaaga

SEQ ID NO: 1041346 - RNA, 19 nt, Homo sapiens
ggccaguacuugaaucuug

SEQ ID NO: 1041347 - RNA, 19 nt, Homo sapiens
caaggagagucaagaaaca

SEQ ID NO: 1041348 - RNA, 19 nt, Homo sapiens
ugaccaaugucuucuuaga

SEQ ID NO: 1041349 - RNA, 19 nt, Homo sapiens
ggacuuacgagaacagaga

SEQ ID NO: 1041350 - RNA, 19 nt, Homo sapiens
ccaccauucuaaucgauuu

SEQ ID NO: 1041351 - RNA, 19 nt, Homo sapiens
ugaauggcuucuggacuua

SEQ ID NO: 1041352 - RNA, 19 nt, Homo sapiens
auggagaaauggacuauaa

SEQ ID NO: 1041353 - RNA, 19 nt, Homo sapiens
ggagcaaagugcaagcaau

SEQ ID NO: 1041354 - RNA, 19 nt, Homo sapiens
gcagcucuacaauauauuu

SEQ ID NO: 1041355 - RNA, 19 nt, Homo sapiens
gaugauuuauuggagcuaa

SEQ ID NO: 1041356 - RNA, 19 nt, Homo sapiens
cugcagcucuacaauauau

SEQ ID NO: 1041357 - RNA, 19 nt, Homo sapiens
cagcuaccaugaccaaugu

SEQ ID NO: 1041358 - RNA, 19 nt, Homo sapiens
gccaaaggcacacgauaaa

SEQ ID NO: 1041359 - RNA, 19 nt, Homo sapiens
cuaaacuccuucauacaga

SEQ ID NO: 1041360 - RNA, 19 nt, Homo sapiens
ggucgccucugaaggagaa

SEQ ID NO: 1041361 - RNA, 19 nt, Homo sapiens
agagcugucuuucuacaaa

SEQ ID NO: 1041362 - RNA, 19 nt, Homo sapiens
ggacggccuuccuaaccuu

SEQ ID NO: 1041363 - RNA, 19 nt, Homo sapiens
acaguaaccaccauucuaa

SEQ ID NO: 1041364 - RNA, 19 nt, Homo sapiens
gccaguacuugaaucuuga

SEQ ID NO: 1041365 - RNA, 19 nt, Homo sapiens
gggcuuaucguggccuuua

SEQ ID NO: 1041366 - RNA, 19 nt, Homo sapiens
cacaauggcaugcucagua

SEQ ID NO: 1041367 - RNA, 19 nt, Homo sapiens
cugcagaccuugaugauac

SEQ ID NO: 1041368 - RNA, 19 nt, Homo sapiens
aaggauaccugaaugucuu

SEQ ID NO: 1041369 - RNA, 19 nt, Homo sapiens
gcuaagggaugaggaacug

SEQ ID NO: 1041370 - RNA, 19 nt, Homo sapiens
caccagacaccaccuauga

SEQ ID NO: 1041371 - RNA, 19 nt, Homo sapiens
gagagucaagaaacaaauu

SEQ ID NO: 1041372 - RNA, 19 nt, Homo sapiens
gagaggaagcgaugaucaa

SEQ ID NO: 1041373 - RNA, 19 nt, Homo sapiens
ccagacaccaccuaugauu

SEQ ID NO: 1041374 - RNA, 19 nt, Homo sapiens
gcagguaggaaacagcaaa

SEQ ID NO: 1041375 - RNA, 19 nt, Homo sapiens
gauacaugaucucugaaag

SEQ ID NO: 1041376 - RNA, 19 nt, Homo sapiens
agaccuugaugauacauga

SEQ ID NO: 1041377 - RNA, 19 nt, Homo sapiens
uugaauggcuucuggacuu

SEQ ID NO: 1041378 - RNA, 19 nt, Homo sapiens
uuccaucucuuucauaguu

SEQ ID NO: 1041379 - RNA, 19 nt, Homo sapiens
agaauaggacucaguuuau

SEQ ID NO: 1041380 - RNA, 19 nt, Homo sapiens
agagaacuguuagauaaug

SEQ ID NO: 1041381 - RNA, 19 nt, Homo sapiens
gcgaugaucaauuacgaaa

SEQ ID NO: 1041382 - RNA, 19 nt, Homo sapiens
uucaagaugucaaggauga

SEQ ID NO: 1041383 - RNA, 19 nt, Homo sapiens
gaggaagcgaugaucaauu

SEQ ID NO: 1041384 - RNA, 19 nt, Homo sapiens
cccaacaccuguccaaaca

SEQ ID NO: 1041385 - RNA, 19 nt, Homo sapiens
gcugacgccugagcuggua

SEQ ID NO: 1041386 - RNA, 19 nt, Homo sapiens
aaucaacaguaaucaagga

SEQ ID NO: 1041387 - RNA, 19 nt, Homo sapiens
ggaugaaaucuuugacaug

SEQ ID NO: 1041388 - RNA, 19 nt, Homo sapiens
uggacaagauccuguuuca

SEQ ID NO: 1041389 - RNA, 19 nt, Homo sapiens
gccauggacuggaaagaag

SEQ ID NO: 1041390 - RNA, 19 nt, Homo sapiens
uaaccaccauucuaaucga

SEQ ID NO: 1041391 - RNA, 19 nt, Homo sapiens
ggccauacaggaacuaaug

SEQ ID NO: 1041392 - RNA, 19 nt, Homo sapiens
ggagaggaagcgaugauca

SEQ ID NO: 1041393 - RNA, 19 nt, Homo sapiens
gaauggaaaggagguagaa

SEQ ID NO: 1041394 - RNA, 19 nt, Homo sapiens
gaacucucacgcuauggaa

SEQ ID NO: 1041395 - RNA, 19 nt, Homo sapiens
gcaguucuuuaauuauguc

SEQ ID NO: 1041396 - RNA, 19 nt, Homo sapiens
gcuaaacuccuucauacag

SEQ ID NO: 1041397 - RNA, 19 nt, Homo sapiens
gauccuguuucauuucaag

SEQ ID NO: 1041398 - RNA, 19 nt, Homo sapiens
gaaccugcagcucuacaau

SEQ ID NO: 1041399 - RNA, 19 nt, Homo sapiens
uauuggagcuaagggauga

SEQ ID NO: 1041400 - RNA, 19 nt, Homo sapiens
cagcuuccuagaugauuua

SEQ ID NO: 1041401 - RNA, 19 nt, Homo sapiens
cgccaaaggcacacgauaa

SEQ ID NO: 1041402 - RNA, 19 nt, Homo sapiens
uaaucaaggagacacagua

SEQ ID NO: 1041403 - RNA, 19 nt, Homo sapiens
uaaacuccuucauacagau

SEQ ID NO: 1041404 - RNA, 19 nt, Homo sapiens
uugcuaaacuccuucauac

SEQ ID NO: 1041405 - RNA, 19 nt, Homo sapiens
gcaaagugcaagcaauuuu

SEQ ID NO: 1041406 - RNA, 19 nt, Homo sapiens
ugaaaaggcuggagcaaag

SEQ ID NO: 1041407 - RNA, 19 nt, Homo sapiens
caaaggcacacgauaaagg

SEQ ID NO: 1041408 - RNA, 19 nt, Homo sapiens
caagaugucaaggaugaaa

SEQ ID NO: 1041409 - RNA, 19 nt, Homo sapiens
aacaaaggauaccugaaug

SEQ ID NO: 1041410 - RNA, 19 nt, Homo sapiens
augaggaacuguccaagga

SEQ ID NO: 1041411 - RNA, 19 nt, Homo sapiens
ggugaaagcuggaauagaa

SEQ ID NO: 1041412 - RNA, 19 nt, Homo sapiens
aaagagagagcaccauuua

SEQ ID NO: 1041413 - RNA, 19 nt, Homo sapiens
guggaaaugugaaauacua

SEQ ID NO: 1041414 - RNA, 19 nt, Homo sapiens
acacuuaccuugccaucua

SEQ ID NO: 1041415 - RNA, 19 nt, Homo sapiens
gcagauggcaacaugauuu

SEQ ID NO: 1041416 - RNA, 19 nt, Homo sapiens
gcaaguagaagaacucaau

SEQ ID NO: 1041417 - RNA, 19 nt, Homo sapiens
gcaaaugcaaguagaagaa

SEQ ID NO: 1041418 - RNA, 19 nt, Homo sapiens
gcagcaauacaacaaguua

SEQ ID NO: 1041419 - RNA, 19 nt, Homo sapiens
gcacacugcugagauggaa

SEQ ID NO: 1041420 - RNA, 19 nt, Homo sapiens
gaugugcaguguccaaaga

SEQ ID NO: 1041421 - RNA, 19 nt, Homo sapiens
gcuucuaccuugauggaua

SEQ ID NO: 1041422 - RNA, 19 nt, Homo sapiens
guagaagaacucaaugaaa

SEQ ID NO: 1041423 - RNA, 19 nt, Homo sapiens
gaagcuguguggaaaugug

SEQ ID NO: 1041424 - RNA, 19 nt, Homo sapiens
ucauggagccaguuacaua

SEQ ID NO: 1041425 - RNA, 19 nt, Homo sapiens
gaaaagaacguugucaauu

SEQ ID NO: 1041426 - RNA, 19 nt, Homo sapiens
gauaucauggagccaguua

SEQ ID NO: 1041427 - RNA, 19 nt, Homo sapiens
caacaugauuucagcuucu

SEQ ID NO: 1041428 - RNA, 19 nt, Homo sapiens
guaggcaauuucuucaguu

SEQ ID NO: 1041429 - RNA, 19 nt, Homo sapiens
guucacagacuauuuacaa

SEQ ID NO: 1041430 - RNA, 19 nt, Homo sapiens
ggcaauuucuucaguucuu

SEQ ID NO: 1041431 - RNA, 19 nt, Homo sapiens
ugagucccaugguucauuu

SEQ ID NO: 1041432 - RNA, 19 nt, Homo sapiens
gcuaaagaaucccugaaac

SEQ ID NO: 1041433 - RNA, 19 nt, Homo sapiens
uauacuuacucagcuguua

SEQ ID NO: 1041434 - RNA, 19 nt, Homo sapiens
gaaacaggcgcgucauucu

SEQ ID NO: 1041435 - RNA, 19 nt, Homo sapiens
aaaagaacguugucaauuc

SEQ ID NO: 1041436 - RNA, 19 nt, Homo sapiens
uauagucacucgacaggau

SEQ ID NO: 1041437 - RNA, 19 nt, Homo sapiens
ggagccaguuacauacuuc

SEQ ID NO: 1041438 - RNA, 19 nt, Homo sapiens
cagacuauuuacaaucuug

SEQ ID NO: 1041439 - RNA, 19 nt, Homo sapiens
ugagauggaacacaugaaa

SEQ ID NO: 1041440 - RNA, 19 nt, Homo sapiens
gcaauuucuucaguucuuc

SEQ ID NO: 1041441 - RNA, 19 nt, Homo sapiens
gugaagcuguguggaaaug

SEQ ID NO: 1041442 - RNA, 19 nt, Homo sapiens
cacagcagauggcaacaug

SEQ ID NO: 1041443 - RNA, 19 nt, Homo sapiens
gugugaagcuguguggaaa

SEQ ID NO: 1041444 - RNA, 19 nt, Homo sapiens
acuuugaugugcagcaaua

SEQ ID NO: 1041445 - RNA, 19 nt, Homo sapiens
cuaaagaaucccugaaaca

SEQ ID NO: 1041446 - RNA, 19 nt, Homo sapiens
cacagacuauuuacaaucu

SEQ ID NO: 1041447 - RNA, 19 nt, Homo sapiens
gacauggccuucccuuggu

SEQ ID NO: 1041448 - RNA, 19 nt, Homo sapiens
uggaacacaugaaauccuu

SEQ ID NO: 1041449 - RNA, 19 nt, Homo sapiens
agaacguugucaauucgua

SEQ ID NO: 1041450 - RNA, 19 nt, Homo sapiens
aaagaacguugucaauucg

SEQ ID NO: 1041451 - RNA, 19 nt, Homo sapiens
guuaagaguaggcaauuuc

SEQ ID NO: 1041452 - RNA, 19 nt, Homo sapiens
gaaauccuugguucacaga

SEQ ID NO: 1041453 - RNA, 19 nt, Homo sapiens
cauucucucuguuugcaaa

SEQ ID NO: 1041454 - RNA, 19 nt, Homo sapiens
ccacaagaaaucaaagcaa

SEQ ID NO: 1041455 - RNA, 19 nt, Homo sapiens
gaacaggugaaagcuggaa

SEQ ID NO: 1041456 - RNA, 19 nt, Homo sapiens
gcaacagcacuuugaugug

SEQ ID NO: 1041457 - RNA, 19 nt, Homo sapiens
gagagagcaccauuuacug

SEQ ID NO: 1041458 - RNA, 19 nt, Homo sapiens
gcgcgucauucucucuguu

SEQ ID NO: 1041459 - RNA, 19 nt, Homo sapiens
uaaagaaucccugaaacag

SEQ ID NO: 1041460 - RNA, 19 nt, Homo sapiens
ggcuaaagaaucccugaaa

SEQ ID NO: 1041461 - RNA, 19 nt, Homo sapiens
uaaaagaagaccuugcuaa

SEQ ID NO: 1041462 - RNA, 19 nt, Homo sapiens
gauuggcacugcuguccau

SEQ ID NO: 1041463 - RNA, 19 nt, Homo sapiens
gagauggaacacaugaaau

SEQ ID NO: 1041464 - RNA, 19 nt, Homo sapiens
gcugagauggaacacauga

SEQ ID NO: 1041465 - RNA, 19 nt, Homo sapiens
gucgucagauuuuccauua

SEQ ID NO: 1041466 - RNA, 19 nt, Homo sapiens
gugcagcaauacaacaagu

SEQ ID NO: 1041467 - RNA, 19 nt, Homo sapiens
gaaaugugaaauacuacca

SEQ ID NO: 1041468 - RNA, 19 nt, Homo sapiens
aaucaaagcaacagcacuu

SEQ ID NO: 1041469 - RNA, 19 nt, Homo sapiens
uggcacugcuguccauuca

SEQ ID NO: 1041470 - RNA, 19 nt, Homo sapiens
ucacagacuauuuacaauc

SEQ ID NO: 1041471 - RNA, 19 nt, Homo sapiens
cagcaauacaacaaguuaa

SEQ ID NO: 1041472 - RNA, 19 nt, Homo sapiens
cgacaggauuauacuuacu

SEQ ID NO: 1041473 - RNA, 19 nt, Homo sapiens
ugaaacaggcgcgucauuc

SEQ ID NO: 1041474 - RNA, 19 nt, Homo sapiens
uggguguacuccugggaua

SEQ ID NO: 1041475 - RNA, 19 nt, Homo sapiens
aaauugaccaccugaagga

SEQ ID NO: 1041476 - RNA, 19 nt, Homo sapiens
acacaugaaauccuugguu

SEQ ID NO: 1041477 - RNA, 19 nt, Homo sapiens
cugcugagauggaacacau

SEQ ID NO: 1041478 - RNA, 19 nt, Homo sapiens
guagucaaaccaauguugu

SEQ ID NO: 1041479 - RNA, 19 nt, Homo sapiens
uaggcaauuucuucaguuc

SEQ ID NO: 1041480 - RNA, 19 nt, Homo sapiens
ugaaauacuaccagucaca

SEQ ID NO: 1041481 - RNA, 19 nt, Homo sapiens
cucgacaggauuauacuua

SEQ ID NO: 1041482 - RNA, 19 nt, Homo sapiens
ggacuccugugggcuggau

SEQ ID NO: 1041483 - RNA, 19 nt, Homo sapiens
gaaaauugaccaccugaag

SEQ ID NO: 1041484 - RNA, 19 nt, Homo sapiens
agagagagcaccauuuacu

SEQ ID NO: 1041485 - RNA, 19 nt, Homo sapiens
uuuagaagagucucagaaa

SEQ ID NO: 1041486 - RNA, 19 nt, Homo sapiens
ugugaaauacuaccaguca

SEQ ID NO: 1041487 - RNA, 19 nt, Homo sapiens
uguguggaaaugugaaaua

SEQ ID NO: 1041488 - RNA, 19 nt, Homo sapiens
acaggugaaagcuggaaua

SEQ ID NO: 1041489 - RNA, 19 nt, Homo sapiens
uugguucacagacuauuua

SEQ ID NO: 1041490 - RNA, 19 nt, Homo sapiens
cuucuaccuugauggauau

SEQ ID NO: 1041491 - RNA, 19 nt, Homo sapiens
ugcaaauucuauggucuuu

SEQ ID NO: 1041492 - RNA, 19 nt, Homo sapiens
cagcagauggcaacaugau

SEQ ID NO: 1041493 - RNA, 19 nt, Homo sapiens
aguagaagaacucaaugaa

SEQ ID NO: 1041494 - RNA, 19 nt, Homo sapiens
caaguagaagaacucaaug

SEQ ID NO: 1041495 - RNA, 19 nt, Homo sapiens
uguuaagaguaggcaauuu

SEQ ID NO: 1041496 - RNA, 19 nt, Homo sapiens
gaagaacucaaugaaaaga

SEQ ID NO: 1041497 - RNA, 19 nt, Homo sapiens
gcgucauucucucuguuug

SEQ ID NO: 1041498 - RNA, 19 nt, Homo sapiens
acauggccuucccuuggua

SEQ ID NO: 1041499 - RNA, 19 nt, Homo sapiens
uuagaagagucucagaaaa

SEQ ID NO: 1041500 - RNA, 19 nt, Homo sapiens
cuaccagucacaccauuau

SEQ ID NO: 1041501 - RNA, 19 nt, Homo sapiens
uggagccaguuacauacuu

SEQ ID NO: 1041502 - RNA, 19 nt, Homo sapiens
uaucauggagccaguuaca

SEQ ID NO: 1041503 - RNA, 19 nt, Homo sapiens
guacuccugggauaucaug

SEQ ID NO: 1041504 - RNA, 19 nt, Homo sapiens
agauggaacacaugaaauc

SEQ ID NO: 1041505 - RNA, 19 nt, Homo sapiens
cagucacaccauuauagua

SEQ ID NO: 1041506 - RNA, 19 nt, Homo sapiens
cuaccuugauggauauuuu

SEQ ID NO: 1041507 - RNA, 19 nt, Homo sapiens
cgucagauuuuccauuaug

SEQ ID NO: 1041508 - RNA, 19 nt, Homo sapiens
caagaaaucaaagcaacag

SEQ ID NO: 1041509 - RNA, 19 nt, Homo sapiens
aacaugauuucagcuucua

SEQ ID NO: 1041510 - RNA, 19 nt, Homo sapiens
guguggaaaugugaaauac

SEQ ID NO: 1041511 - RNA, 19 nt, Homo sapiens
gaacacaaguauaucaaga

SEQ ID NO: 1041512 - RNA, 19 nt, Homo sapiens
gacaagaaaugcaguuaaa

SEQ ID NO: 1041513 - RNA, 19 nt, Homo sapiens
ggaauucucucauaaccuu

SEQ ID NO: 1041514 - RNA, 19 nt, Homo sapiens
gaaagcaccagauaaauau

SEQ ID NO: 1041515 - RNA, 19 nt, Homo sapiens
gaagugugauaaauggaua

SEQ ID NO: 1041516 - RNA, 19 nt, Homo sapiens
gauaaggacuugagaugug

SEQ ID NO: 1041517 - RNA, 19 nt, Homo sapiens
gauagauccuguuaaagaa

SEQ ID NO: 1041518 - RNA, 19 nt, Homo sapiens
ucaaugaaauccagugaaa

SEQ ID NO: 1041519 - RNA, 19 nt, Homo sapiens
gcugagaacucgcuugcua

SEQ ID NO: 1041520 - RNA, 19 nt, Homo sapiens
gaacucuacccauguauaa

SEQ ID NO: 1041521 - RNA, 19 nt, Homo sapiens
gaaccuauaacucugauaa

SEQ ID NO: 1041522 - RNA, 19 nt, Homo sapiens
gaagcuaguucucagaguu

SEQ ID NO: 1041523 - RNA, 19 nt, Homo sapiens
uaagaaagcaccagauaaa

SEQ ID NO: 1041524 - RNA, 19 nt, Homo sapiens
gauaguggcuacugauguu

SEQ ID NO: 1041525 - RNA, 19 nt, Homo sapiens
gaaauuacgccgucuugaa

SEQ ID NO: 1041526 - RNA, 19 nt, Homo sapiens
ccgaaaggaugaccuagua

SEQ ID NO: 1041527 - RNA, 19 nt, Homo sapiens
gggauuggaugguuuauca

SEQ ID NO: 1041528 - RNA, 19 nt, Homo sapiens
uagaagaacuuaagaagca

SEQ ID NO: 1041529 - RNA, 19 nt, Homo sapiens
gcacaggucgacuacauaa

SEQ ID NO: 1041530 - RNA, 19 nt, Homo sapiens
cagccaaacugacaagaaa

SEQ ID NO: 1041531 - RNA, 19 nt, Homo sapiens
uaucaaaggugcagaaucu

SEQ ID NO: 1041532 - RNA, 19 nt, Homo sapiens
gaggguauauaauguaugu

SEQ ID NO: 1041533 - RNA, 19 nt, Homo sapiens
ggagaagauugacagcauu

SEQ ID NO: 1041534 - RNA, 19 nt, Homo sapiens
agaaagcaccagauaaaua

SEQ ID NO: 1041535 - RNA, 19 nt, Homo sapiens
ggugaacucuacccaugua

SEQ ID NO: 1041536 - RNA, 19 nt, Homo sapiens
gagcacaggucgacuacau

SEQ ID NO: 1041537 - RNA, 19 nt, Homo sapiens
gaugguuuaucacuucuuu

SEQ ID NO: 1041538 - RNA, 19 nt, Homo sapiens
cagcaacuccgauccaaua

SEQ ID NO: 1041539 - RNA, 19 nt, Homo sapiens
agacaaugauggacaaaga

SEQ ID NO: 1041540 - RNA, 19 nt, Homo sapiens
ggaaugguguggugcuaau

SEQ ID NO: 1041541 - RNA, 19 nt, Homo sapiens
ggauugaagugugauaaau

SEQ ID NO: 1041542 - RNA, 19 nt, Homo sapiens
ugacuucucucuccuagug

SEQ ID NO: 1041543 - RNA, 19 nt, Homo sapiens
gaagaagcaucagcagcaa

SEQ ID NO: 1041544 - RNA, 19 nt, Homo sapiens
ugaaccagcuauccagaaa

SEQ ID NO: 1041545 - RNA, 19 nt, Homo sapiens
guagaaacguuggguuaug

SEQ ID NO: 1041546 - RNA, 19 nt, Homo sapiens
gaagcggacuuaauugaac

SEQ ID NO: 1041547 - RNA, 19 nt, Homo sapiens
ugaaauuccucaagaucaa

SEQ ID NO: 1041548 - RNA, 19 nt, Homo sapiens
gguggagcauuucauacua

SEQ ID NO: 1041549 - RNA, 19 nt, Homo sapiens
ucagaagccuuuguuauca

SEQ ID NO: 1041550 - RNA, 19 nt, Homo sapiens
agacuaguuucuuccauaa

SEQ ID NO: 1041551 - RNA, 19 nt, Homo sapiens
ucauggagauguuaagaga

SEQ ID NO: 1041552 - RNA, 19 nt, Homo sapiens
ugauagauccuguuaaaga

SEQ ID NO: 1041553 - RNA, 19 nt, Homo sapiens
uaggaugucugaagaugaa

SEQ ID NO: 1041554 - RNA, 19 nt, Homo sapiens
ccagggaggucauacaaca

SEQ ID NO: 1041555 - RNA, 19 nt, Homo sapiens
guuaagaaagcaccagaua

SEQ ID NO: 1041556 - RNA, 19 nt, Homo sapiens
uaacacagaauuucaagug

SEQ ID NO: 1041557 - RNA, 19 nt, Homo sapiens
uuggagaccuuaaugcuaa

SEQ ID NO: 1041558 - RNA, 19 nt, Homo sapiens
ccagauaaauauugagaag

SEQ ID NO: 1041559 - RNA, 19 nt, Homo sapiens
cacagaauuucaaguggua

SEQ ID NO: 1041560 - RNA, 19 nt, Homo sapiens
ggacuuaauugaacuuagc

SEQ ID NO: 1041561 - RNA, 19 nt, Homo sapiens
gagcauuucauacuacuga

SEQ ID NO: 1041562 - RNA, 19 nt, Homo sapiens
gggacaaguugcaugaaga

SEQ ID NO: 1041563 - RNA, 19 nt, Homo sapiens
cgucuuaaaucucaucaau

SEQ ID NO: 1041564 - RNA, 19 nt, Homo sapiens
ggacuugagauguguagaa

SEQ ID NO: 1041565 - RNA, 19 nt, Homo sapiens
ucaugucccugucuaaaga

SEQ ID NO: 1041566 - RNA, 19 nt, Homo sapiens
gacuugagauguguagaaa

SEQ ID NO: 1041567 - RNA, 19 nt, Homo sapiens
gggcugaggguauauaaug

SEQ ID NO: 1041568 - RNA, 19 nt, Homo sapiens
ggcgaacccuauugcaauu

SEQ ID NO: 1041569 - RNA, 19 nt, Homo sapiens
aaacugaaccuauaacucu

SEQ ID NO: 1041570 - RNA, 19 nt, Homo sapiens
gaccuuugcugcuguugga

SEQ ID NO: 1041571 - RNA, 19 nt, Homo sapiens
gauauaugccuuaccugaa

SEQ ID NO: 1041572 - RNA, 19 nt, Homo sapiens
aaccagcuauccagaaauu

SEQ ID NO: 1041573 - RNA, 19 nt, Homo sapiens
auauaugccuuaccugaaa

SEQ ID NO: 1041574 - RNA, 19 nt, Homo sapiens
uuuggaaucuguagaagaa

SEQ ID NO: 1041575 - RNA, 19 nt, Homo sapiens
gaauuucuccaacuccauu

SEQ ID NO: 1041576 - RNA, 19 nt, Homo sapiens
agaaugauagauccuguua

SEQ ID NO: 1041577 - RNA, 19 nt, Homo sapiens
gauccaauauccgagaaau

SEQ ID NO: 1041578 - RNA, 19 nt, Homo sapiens
acagcaccauuucuuagua

SEQ ID NO: 1041579 - RNA, 19 nt, Homo sapiens
ucauacgucuuaaaucuca

SEQ ID NO: 1041580 - RNA, 19 nt, Homo sapiens
ucaagauaguggcuacuga

SEQ ID NO: 1041581 - RNA, 19 nt, Homo sapiens
cuuagaagcggacuuaauu

SEQ ID NO: 1041582 - RNA, 19 nt, Homo sapiens
gggaggucauacaacauuu

SEQ ID NO: 1041583 - RNA, 19 nt, Homo sapiens
gcaugaagagcauaucaau

SEQ ID NO: 1041584 - RNA, 19 nt, Homo sapiens
uaugucagguaaaguuuga

SEQ ID NO: 1041585 - RNA, 19 nt, Homo sapiens
uaccugaaauuccucaaga

SEQ ID NO: 1041586 - RNA, 19 nt, Homo sapiens
caggagcuaagguucauua

SEQ ID NO: 1041587 - RNA, 19 nt, Homo sapiens
cgaacccuauugcaauuug

SEQ ID NO: 1041588 - RNA, 19 nt, Homo sapiens
ugagauguguagaaacguu

SEQ ID NO: 1041589 - RNA, 19 nt, Homo sapiens
ugacaagaaaugcaguuaa

SEQ ID NO: 1041590 - RNA, 19 nt, Homo sapiens
ugaagaaacuuugcuacag

SEQ ID NO: 1041591 - RNA, 19 nt, Homo sapiens
cagcaccauuucuuaguau

SEQ ID NO: 1041592 - RNA, 19 nt, Homo sapiens
gacaaagacgcaugcaaga

SEQ ID NO: 1041593 - RNA, 19 nt, Homo sapiens
ucuaacaccucaaagaucu

SEQ ID NO: 1041594 - RNA, 19 nt, Homo sapiens
agugguaggagacuuauua

SEQ ID NO: 1041595 - RNA, 19 nt, Homo sapiens
guguagaaacguuggguua

SEQ ID NO: 1041596 - RNA, 19 nt, Homo sapiens
caacuccgauccaauaucc

SEQ ID NO: 1041597 - RNA, 19 nt, Homo sapiens
cgagauauuuucaacauug

SEQ ID NO: 1041598 - RNA, 19 nt, Homo sapiens
guucagaagccuuuguuau

SEQ ID NO: 1041599 - RNA, 19 nt, Homo sapiens
gguuauggaagacuaguuu

SEQ ID NO: 1041600 - RNA, 19 nt, Homo sapiens
gugcugcugugaauguuga

SEQ ID NO: 1041601 - RNA, 19 nt, Homo sapiens
gagaagauugacagcauug

SEQ ID NO: 1041602 - RNA, 19 nt, Homo sapiens
gaaauuccucaagaucaaa

SEQ ID NO: 1041603 - RNA, 19 nt, Homo sapiens
gacuguugguggagcauuu

SEQ ID NO: 1041604 - RNA, 19 nt, Homo sapiens
gaggagcacaggucgacua

SEQ ID NO: 1041605 - RNA, 19 nt, Homo sapiens
cgaaaucagggccuaguga

SEQ ID NO: 1041606 - RNA, 19 nt, Homo sapiens
caaguugcaugaagagcau

SEQ ID NO: 1041607 - RNA, 19 nt, Homo sapiens
uuaagaaagcaccagauaa

SEQ ID NO: 1041608 - RNA, 19 nt, Homo sapiens
cgagaaauugagaaacuuu

SEQ ID NO: 1041609 - RNA, 19 nt, Homo sapiens
uaagaguucagaagccuuu

SEQ ID NO: 1041610 - RNA, 19 nt, Homo sapiens
ugugaaaacugaaccuaua

SEQ ID NO: 1041611 - RNA, 19 nt, Homo sapiens
ggaauuagcuucuguaaau

SEQ ID NO: 1041612 - RNA, 19 nt, Homo sapiens
ggaagaagcugaacauuug

SEQ ID NO: 1041613 - RNA, 19 nt, Homo sapiens
cagcagagcuuguacuaua

SEQ ID NO: 1041614 - RNA, 19 nt, Homo sapiens
gaacagcaggguaauauua

SEQ ID NO: 1041615 - RNA, 19 nt, Homo sapiens
gaugauugauggugauuua

SEQ ID NO: 1041616 - RNA, 19 nt, Homo sapiens
ugacaaagcugacaugguu

SEQ ID NO: 1041617 - RNA, 19 nt, Homo sapiens
ugaaagaugugucauauca

SEQ ID NO: 1041618 - RNA, 19 nt, Homo sapiens
gaaggcauuugacagauuu

SEQ ID NO: 1041619 - RNA, 19 nt, Homo sapiens
uaaccugucuuccuuguuu

SEQ ID NO: 1041620 - RNA, 19 nt, Homo sapiens
gagagaaguuacagcuaua

SEQ ID NO: 1041621 - RNA, 19 nt, Homo sapiens
caauauaguugguuugcua

SEQ ID NO: 1041622 - RNA, 19 nt, Homo sapiens
gcagaaaggauacauuauu

SEQ ID NO: 1041623 - RNA, 19 nt, Homo sapiens
gaaugcaucuacagaagaa

SEQ ID NO: 1041624 - RNA, 19 nt, Homo sapiens
aagcugacaugguucauua

SEQ ID NO: 1041625 - RNA, 19 nt, Homo sapiens
ucacauggaugauuacaga

SEQ ID NO: 1041626 - RNA, 19 nt, Homo sapiens
caaguggcauccaucauaa

SEQ ID NO: 1041627 - RNA, 19 nt, Homo sapiens
gaaagcacauacagaagau

SEQ ID NO: 1041628 - RNA, 19 nt, Homo sapiens
ggaaggcauuugacagauu

SEQ ID NO: 1041629 - RNA, 19 nt, Homo sapiens
ucaggagacuuuguauuua

SEQ ID NO: 1041630 - RNA, 19 nt, Homo sapiens
caaagagaacacaaaguua

SEQ ID NO: 1041631 - RNA, 19 nt, Homo sapiens
guacugagauuaugaacgu

SEQ ID NO: 1041632 - RNA, 19 nt, Homo sapiens
gggaaaaugucaauuagua

SEQ ID NO: 1041633 - RNA, 19 nt, Homo sapiens
uuaauaagcuucugaaugc

SEQ ID NO: 1041634 - RNA, 19 nt, Homo sapiens
ugacaugguucauuaccua

SEQ ID NO: 1041635 - RNA, 19 nt, Homo sapiens
gcaaagcuaauuacagaaa

SEQ ID NO: 1041636 - RNA, 19 nt, Homo sapiens
caaauuucccuccagaaua

SEQ ID NO: 1041637 - RNA, 19 nt, Homo sapiens
guauuacacugcagcuuaa

SEQ ID NO: 1041638 - RNA, 19 nt, Homo sapiens
caugguucauuaccuauua

SEQ ID NO: 1041639 - RNA, 19 nt, Homo sapiens
gaacaagcuuucauuuuga

SEQ ID NO: 1041640 - RNA, 19 nt, Homo sapiens
caaaccaagcuguauauaa

SEQ ID NO: 1041641 - RNA, 19 nt, Homo sapiens
gauacaacuucaucaucua

SEQ ID NO: 1041642 - RNA, 19 nt, Homo sapiens
aaagaaagcacauacagaa

SEQ ID NO: 1041643 - RNA, 19 nt, Homo sapiens
cugcaaagcuaauuacaga

SEQ ID NO: 1041644 - RNA, 19 nt, Homo sapiens
gaaguuacagcuauauaug

SEQ ID NO: 1041645 - RNA, 19 nt, Homo sapiens
ugagagaaguuacagcuau

SEQ ID NO: 1041646 - RNA, 19 nt, Homo sapiens
aaauuucccuccagaauau

SEQ ID NO: 1041647 - RNA, 19 nt, Homo sapiens
ucaaguggcauccaucaua

SEQ ID NO: 1041648 - RNA, 19 nt, Homo sapiens
uagaacauccuacugauuu

SEQ ID NO: 1041649 - RNA, 19 nt, Homo sapiens
aaagaugugucauaucaug

SEQ ID NO: 1041650 - RNA, 19 nt, Homo sapiens
ggaaaaggcacaacuaaaa

SEQ ID NO: 1041651 - RNA, 19 nt, Homo sapiens
gaucuaccaucgggaauug

SEQ ID NO: 1041652 - RNA, 19 nt, Homo sapiens
gcauggaaaucuggaagaa

SEQ ID NO: 1041653 - RNA, 19 nt, Homo sapiens
cuauacaucucccaaagaa

SEQ ID NO: 1041654 - RNA, 19 nt, Homo sapiens
ggauuaaguaugccaagua

SEQ ID NO: 1041655 - RNA, 19 nt, Homo sapiens
cacugcagcuuaacaagua

SEQ ID NO: 1041656 - RNA, 19 nt, Homo sapiens
gcaaauuucccuccagaau

SEQ ID NO: 1041657 - RNA, 19 nt, Homo sapiens
ggaagacucauccaguaaa

SEQ ID NO: 1041658 - RNA, 19 nt, Homo sapiens
uaagaucguuaacugaaga

SEQ ID NO: 1041659 - RNA, 19 nt, Homo sapiens
acaaagagaacacaaaguu

SEQ ID NO: 1041660 - RNA, 19 nt, Homo sapiens
gaacguuacagaaauggaa

SEQ ID NO: 1041661 - RNA, 19 nt, Homo sapiens
ggucagacgcugucauuga

SEQ ID NO: 1041662 - RNA, 19 nt, Homo sapiens
ucacauuugcuacgucuua

SEQ ID NO: 1041663 - RNA, 19 nt, Homo sapiens
agaauaauuugccuagaga

SEQ ID NO: 1041664 - RNA, 19 nt, Homo sapiens
ggaaaccugagagaaguua

SEQ ID NO: 1041665 - RNA, 19 nt, Homo sapiens
gaauuagcuucuguaaaug

SEQ ID NO: 1041666 - RNA, 19 nt, Homo sapiens
gagaaguuacagcuauaua

SEQ ID NO: 1041667 - RNA, 19 nt, Homo sapiens
gaacaggagaaucacuuga

SEQ ID NO: 1041668 - RNA, 19 nt, Homo sapiens
guucagagguagugguaga

SEQ ID NO: 1041669 - RNA, 19 nt, Homo sapiens
gauaaccugucuuccuugu

SEQ ID NO: 1041670 - RNA, 19 nt, Homo sapiens
cauaucaugugcccucuau

SEQ ID NO: 1041671 - RNA, 19 nt, Homo sapiens
ugagauucaucaagaaaug

SEQ ID NO: 1041672 - RNA, 19 nt, Homo sapiens
agacauagaaucauugaga

SEQ ID NO: 1041673 - RNA, 19 nt, Homo sapiens
uaaguggucuagaauucuu

SEQ ID NO: 1041674 - RNA, 19 nt, Homo sapiens
auuaguagcuuaccacaga

SEQ ID NO: 1041675 - RNA, 19 nt, Homo sapiens
cauaagaucguuaacugaa

SEQ ID NO: 1041676 - RNA, 19 nt, Homo sapiens
cagaauaauuugccuagag

SEQ ID NO: 1041677 - RNA, 19 nt, Homo sapiens
uauccaaccuccacccaaa

SEQ ID NO: 1041678 - RNA, 19 nt, Homo sapiens
agugcaagccucuguauua

SEQ ID NO: 1041679 - RNA, 19 nt, Homo sapiens
gaauguuugcgucccuuua

SEQ ID NO: 1041680 - RNA, 19 nt, Homo sapiens
ugagggauguaaacaguau

SEQ ID NO: 1041681 - RNA, 19 nt, Homo sapiens
cagaauccuuggaauuaug

SEQ ID NO: 1041682 - RNA, 19 nt, Homo sapiens
gcaaaccaagcuguauaua

SEQ ID NO: 1041683 - RNA, 19 nt, Homo sapiens
guuaauaagcuucugaaug

SEQ ID NO: 1041684 - RNA, 19 nt, Homo sapiens
gcaggguaauauuaaugaa

SEQ ID NO: 1041685 - RNA, 19 nt, Homo sapiens
gacauagaaucauugagau

SEQ ID NO: 1041686 - RNA, 19 nt, Homo sapiens
cgacaacauuaaaccauca

SEQ ID NO: 1041687 - RNA, 19 nt, Homo sapiens
caggagacuuuguauuuag

SEQ ID NO: 1041688 - RNA, 19 nt, Homo sapiens
caguuauacuugugaauug

SEQ ID NO: 1041689 - RNA, 19 nt, Homo sapiens
uggaagaagcugaacauuu

SEQ ID NO: 1041690 - RNA, 19 nt, Homo sapiens
gauccugcaaagcuaauua

SEQ ID NO: 1041691 - RNA, 19 nt, Homo sapiens
cugcagaaaggauacauua

SEQ ID NO: 1041692 - RNA, 19 nt, Homo sapiens
gauacuguuuccuaccauu

SEQ ID NO: 1041693 - RNA, 19 nt, Homo sapiens
ucugaaugcuuaugaugaa

SEQ ID NO: 1041694 - RNA, 19 nt, Homo sapiens
acggaagacucauccagua

SEQ ID NO: 1041695 - RNA, 19 nt, Homo sapiens
ccuccaaccugaugggaaa

SEQ ID NO: 1041696 - RNA, 19 nt, Homo sapiens
acacaaaguuauaccucaa

SEQ ID NO: 1041697 - RNA, 19 nt, Homo sapiens
agaaacccauggugcauau

SEQ ID NO: 1041698 - RNA, 19 nt, Homo sapiens
gauuaaguaugccaaguac

SEQ ID NO: 1041699 - RNA, 19 nt, Homo sapiens
auucucacauggaugauua

SEQ ID NO: 1041700 - RNA, 19 nt, Homo sapiens
gaagacucauccaguaaaa

SEQ ID NO: 1041701 - RNA, 19 nt, Homo sapiens
aaacacuccugaaagaaca

SEQ ID NO: 1041702 - RNA, 19 nt, Homo sapiens
gagacaaagagaacacaaa

SEQ ID NO: 1041703 - RNA, 19 nt, Homo sapiens
aagaguaaguuuagaacga

SEQ ID NO: 1041704 - RNA, 19 nt, Homo sapiens
agaccuuacuuucauguga

SEQ ID NO: 1041705 - RNA, 19 nt, Homo sapiens
gauccugagacaaacaaua

SEQ ID NO: 1041706 - RNA, 19 nt, Homo sapiens
gacagaaacagaagcaaau

SEQ ID NO: 1041707 - RNA, 19 nt, Homo sapiens
ccugaugacucucccaaug

SEQ ID NO: 1041708 - RNA, 19 nt, Homo sapiens
ucagaauccuuggaauuau

SEQ ID NO: 1041709 - RNA, 19 nt, Homo sapiens
gaagccaggauaucuugaa

SEQ ID NO: 1041710 - RNA, 19 nt, Homo sapiens
ggaaaaccauagcauugaa

SEQ ID NO: 1041711 - RNA, 19 nt, Homo sapiens
ggaagaagcugaacauuug

SEQ ID NO: 1041712 - RNA, 19 nt, Homo sapiens
cagcagagcuuguacuaua

SEQ ID NO: 1041713 - RNA, 19 nt, Homo sapiens
gaacagcaggguaauauua

SEQ ID NO: 1041714 - RNA, 19 nt, Homo sapiens
gaugauugauggugauuua

SEQ ID NO: 1041715 - RNA, 19 nt, Homo sapiens
guacaugguucauuaccua

SEQ ID NO: 1041716 - RNA, 19 nt, Homo sapiens
uaaccugucuuccuuguuu

SEQ ID NO: 1041717 - RNA, 19 nt, Homo sapiens
gcagaaaggauacauuauu

SEQ ID NO: 1041718 - RNA, 19 nt, Homo sapiens
ugacaaagcuguacauggu

SEQ ID NO: 1041719 - RNA, 19 nt, Homo sapiens
caauaaaggugcugaaugg

SEQ ID NO: 1041720 - RNA, 19 nt, Homo sapiens
guacuucuguugaauguug

SEQ ID NO: 1041721 - RNA, 19 nt, Homo sapiens
gaaagcacauacagaagau

SEQ ID NO: 1041722 - RNA, 19 nt, Homo sapiens
ucaggagacuuuguauuua

SEQ ID NO: 1041723 - RNA, 19 nt, Homo sapiens
caaagagaacacaaaguua

SEQ ID NO: 1041724 - RNA, 19 nt, Homo sapiens
gggaaaaugucaauuagua

SEQ ID NO: 1041725 - RNA, 19 nt, Homo sapiens
uuaauaagcuucugaaugc

SEQ ID NO: 1041726 - RNA, 19 nt, Homo sapiens
aagugagucugcauaauua

SEQ ID NO: 1041727 - RNA, 19 nt, Homo sapiens
caagugagucugcauaauu

SEQ ID NO: 1041728 - RNA, 19 nt, Homo sapiens
caugguucauuaccuauua

SEQ ID NO: 1041729 - RNA, 19 nt, Homo sapiens
gaacaagcuuucauuuuga

SEQ ID NO: 1041730 - RNA, 19 nt, Homo sapiens
caaaccaagcuguauauaa

SEQ ID NO: 1041731 - RNA, 19 nt, Homo sapiens
gauacaacuucaucaucua

SEQ ID NO: 1041732 - RNA, 19 nt, Homo sapiens
ccacaguucuaauaugcua

SEQ ID NO: 1041733 - RNA, 19 nt, Homo sapiens
aaagaaagcacauacagaa

SEQ ID NO: 1041734 - RNA, 19 nt, Homo sapiens
caaauuuaauggcuuguuc

SEQ ID NO: 1041735 - RNA, 19 nt, Homo sapiens
aaagaugugucauaucaug

SEQ ID NO: 1041736 - RNA, 19 nt, Homo sapiens
gcauggaaaucuggaagaa

SEQ ID NO: 1041737 - RNA, 19 nt, Homo sapiens
cuauacaucucccaaagaa

SEQ ID NO: 1041738 - RNA, 19 nt, Homo sapiens
acaaagagaacacaaaguu

SEQ ID NO: 1041739 - RNA, 19 nt, Homo sapiens
caugugcucuuaaacuuga

SEQ ID NO: 1041740 - RNA, 19 nt, Homo sapiens
guucauagauguuauuagc

SEQ ID NO: 1041741 - RNA, 19 nt, Homo sapiens
gauaaccugucuuccuugu

SEQ ID NO: 1041742 - RNA, 19 nt, Homo sapiens
cauaucaugugcccucuau

SEQ ID NO: 1041743 - RNA, 19 nt, Homo sapiens
uaaguggucuagaauucuu

SEQ ID NO: 1041744 - RNA, 19 nt, Homo sapiens
auuaguagcuuaccacaga

SEQ ID NO: 1041745 - RNA, 19 nt, Homo sapiens
ugagggauguaaacaguau

SEQ ID NO: 1041746 - RNA, 19 nt, Homo sapiens
cagaauccuuggaauuaug

SEQ ID NO: 1041747 - RNA, 19 nt, Homo sapiens
gcaaaccaagcuguauaua

SEQ ID NO: 1041748 - RNA, 19 nt, Homo sapiens
guuaauaagcuucugaaug

SEQ ID NO: 1041749 - RNA, 19 nt, Homo sapiens
gcaggguaauauuaaugaa

SEQ ID NO: 1041750 - RNA, 19 nt, Homo sapiens
caggagacuuuguauuuag

SEQ ID NO: 1041751 - RNA, 19 nt, Homo sapiens
caguuauacuugugaauug

SEQ ID NO: 1041752 - RNA, 19 nt, Homo sapiens
gugguuaaguacuagaauu

SEQ ID NO: 1041753 - RNA, 19 nt, Homo sapiens
uggaagaagcugaacauuu

SEQ ID NO: 1041754 - RNA, 19 nt, Homo sapiens
cugcagaaaggauacauua

SEQ ID NO: 1041755 - RNA, 19 nt, Homo sapiens
gauacuguuuccuaccauu

SEQ ID NO: 1041756 - RNA, 19 nt, Homo sapiens
ucugaaugcuuaugaugaa

SEQ ID NO: 1041757 - RNA, 19 nt, Homo sapiens
ccuccaaccugaugggaaa

SEQ ID NO: 1041758 - RNA, 19 nt, Homo sapiens
acacaaaguuauaccucaa

SEQ ID NO: 1041759 - RNA, 19 nt, Homo sapiens
agaaacccauggugcauau

SEQ ID NO: 1041760 - RNA, 19 nt, Homo sapiens
guauguaguaugccaagua

SEQ ID NO: 1041761 - RNA, 19 nt, Homo sapiens
aaacauugaucuagugacu

SEQ ID NO: 1041762 - RNA, 19 nt, Homo sapiens
aaacacuccugaaagaaca

SEQ ID NO: 1041763 - RNA, 19 nt, Homo sapiens
gagacaaagagaacacaaa

SEQ ID NO: 1041764 - RNA, 19 nt, Homo sapiens
aagaguaaguuuagaacga

SEQ ID NO: 1041765 - RNA, 19 nt, Homo sapiens
ucagaauccuuggaauuau

SEQ ID NO: 1041766 - RNA, 19 nt, Homo sapiens
agauuugacugcugcauau

SEQ ID NO: 1041767 - RNA, 19 nt, Homo sapiens
ggaaaaccauagcauugaa

SEQ ID NO: 1041768 - RNA, 19 nt, Homo sapiens
gccuuggaauagauuauaa

SEQ ID NO: 1041769 - RNA, 19 nt, Homo sapiens
ugcauuaaguggucuagaa

SEQ ID NO: 1041770 - RNA, 19 nt, Homo sapiens
uaucagaauccuuggaauu

SEQ ID NO: 1041771 - RNA, 19 nt, Homo sapiens
gcacauacagaagauacaa

SEQ ID NO: 1041772 - RNA, 19 nt, Homo sapiens
gaauguuugcaucccuuua

SEQ ID NO: 1041773 - RNA, 19 nt, Homo sapiens
gcaaaucaugucaguguag

SEQ ID NO: 1041774 - RNA, 19 nt, Homo sapiens
ggagauggucugcuugcaa

SEQ ID NO: 1041775 - RNA, 19 nt, Homo sapiens
ucaaaugcagugugugaaa

SEQ ID NO: 1041776 - RNA, 19 nt, Homo sapiens
uggaagcaaucgaaagaga

SEQ ID NO: 1041777 - RNA, 19 nt, Homo sapiens
uaugaggaguuuuggauua

SEQ ID NO: 1041778 - RNA, 19 nt, Homo sapiens
aaaguggaauuucuugaag

SEQ ID NO: 1041779 - RNA, 19 nt, Homo sapiens
ggaacagcaggguaauauu

SEQ ID NO: 1041780 - RNA, 19 nt, Homo sapiens
agaaagcacauacagaaga

SEQ ID NO: 1041781 - RNA, 19 nt, Homo sapiens
gaaaauggaucagaagaac

SEQ ID NO: 1041782 - RNA, 19 nt, Homo sapiens
gaacgacggcauggaaauc

SEQ ID NO: 1041783 - RNA, 19 nt, Homo sapiens
gaggaacagcaggguaaua

SEQ ID NO: 1041784 - RNA, 19 nt, Homo sapiens
aaaccugacugcaaaucau

SEQ ID NO: 1041785 - RNA, 19 nt, Homo sapiens
uugauaaccugucuuccuu

SEQ ID NO: 1041786 - RNA, 19 nt, Homo sapiens
cgaaagagacaaagagaac

SEQ ID NO: 1041787 - RNA, 19 nt, Homo sapiens
gaagcaaucgaaagagaca

SEQ ID NO: 1041788 - RNA, 19 nt, Homo sapiens
uaaaauacuuugccuugga

SEQ ID NO: 1041789 - RNA, 19 nt, Homo sapiens
caaaucaugucaguguagu

SEQ ID NO: 1041790 - RNA, 19 nt, Homo sapiens
guaaacaguauaagcuugu

SEQ ID NO: 1041791 - RNA, 19 nt, Homo sapiens
uucaggagacuuuguauuu

SEQ ID NO: 1041792 - RNA, 19 nt, Homo sapiens
gcauuaaguggucuagaau

SEQ ID NO: 1041793 - RNA, 19 nt, Homo sapiens
ucaauaaaggugcugaaug

SEQ ID NO: 1041794 - RNA, 19 nt, Homo sapiens
aaugagggauguaaacagu

SEQ ID NO: 1041795 - RNA, 19 nt, Homo sapiens
cagauuugacugcugcaua

SEQ ID NO: 1041796 - RNA, 19 nt, Homo sapiens
gugagucugcauaauuaua

SEQ ID NO: 1041797 - RNA, 19 nt, Homo sapiens
caucaaacacuccugaaag

SEQ ID NO: 1041798 - RNA, 19 nt, Homo sapiens
guacuauacaucucccaaa

SEQ ID NO: 1041799 - RNA, 19 nt, Homo sapiens
uuuaauggcuuguucaacu

SEQ ID NO: 1041800 - RNA, 19 nt, Homo sapiens
ucuuaaacauagcugcuuu

SEQ ID NO: 1041801 - RNA, 19 nt, Homo sapiens
acacuugcuuguuuucuua

SEQ ID NO: 1041802 - RNA, 19 nt, Homo sapiens
auucuuuggugguuaagua

SEQ ID NO: 1041803 - RNA, 19 nt, Homo sapiens
gaaaaucaugugcucuuaa

SEQ ID NO: 1041804 - RNA, 19 nt, Homo sapiens
gaaugcuuaugaugaacau

SEQ ID NO: 1041805 - RNA, 19 nt, Homo sapiens
agcuguacaugguucauua

SEQ ID NO: 1041806 - RNA, 19 nt, Homo sapiens
gauguaaacaguauaagcu

SEQ ID NO: 1041807 - RNA, 19 nt, Homo sapiens
uacauucuuuggugguuaa

SEQ ID NO: 1041808 - RNA, 19 nt, Homo sapiens
ucaagugagucugcauaau

SEQ ID NO: 1041809 - RNA, 19 nt, Homo sapiens
uaucaagugagucugcaua

SEQ ID NO: 1041810 - RNA, 19 nt, Homo sapiens
aucaaacacuccugaaaga

SEQ ID NO: 1041811 - RNA, 19 nt, Homo sapiens
uaaccaagaugccaaauua

SEQ ID NO: 1041812 - RNA, 19 nt, Homo sapiens
cagaagugaucuugaauua

SEQ ID NO: 1041813 - RNA, 19 nt, Homo sapiens
gaacuguuaucaggucuua

SEQ ID NO: 1041814 - RNA, 19 nt, Homo sapiens
gaacuucucauguaaugua

SEQ ID NO: 1041815 - RNA, 19 nt, Homo sapiens
gaaguaauagcguaaagua

SEQ ID NO: 1041816 - RNA, 19 nt, Homo sapiens
gaaauugucugcauuaucc

SEQ ID NO: 1041817 - RNA, 19 nt, Homo sapiens
cauaugaggugucaacuug

SEQ ID NO: 1041818 - RNA, 19 nt, Homo sapiens
ccaagacaauuaagaacua

SEQ ID NO: 1041819 - RNA, 19 nt, Homo sapiens
gcaaucaccugugugguuu

SEQ ID NO: 1041820 - RNA, 19 nt, Homo sapiens
gcugugagcucugcaagua

SEQ ID NO: 1041821 - RNA, 19 nt, Homo sapiens
gacagaugaugaguaauua

SEQ ID NO: 1041822 - RNA, 19 nt, Homo sapiens
ugacagaagugaucuugaa

SEQ ID NO: 1041823 - RNA, 19 nt, Homo sapiens
uaaagucuauguucaguug

SEQ ID NO: 1041824 - RNA, 19 nt, Homo sapiens
uagcagaguugugaaauaa

SEQ ID NO: 1041825 - RNA, 19 nt, Homo sapiens
ucacaucucuaaaggguaa

SEQ ID NO: 1041826 - RNA, 19 nt, Homo sapiens
gcaagagaaugauuuccaa

SEQ ID NO: 1041827 - RNA, 19 nt, Homo sapiens
gcagaguugugaaauaaau

SEQ ID NO: 1041828 - RNA, 19 nt, Homo sapiens
gauuaacggugauuauaga

SEQ ID NO: 1041829 - RNA, 19 nt, Homo sapiens
gaacuuggaggaugcauau

SEQ ID NO: 1041830 - RNA, 19 nt, Homo sapiens
gauaugcuuugacagcuaa

SEQ ID NO: 1041831 - RNA, 19 nt, Homo sapiens
gcagugagcuagauuaacg

SEQ ID NO: 1041832 - RNA, 19 nt, Homo sapiens
ggauuucccuugcucaguu

SEQ ID NO: 1041833 - RNA, 19 nt, Homo sapiens
acaaacaggugcaaauuca

SEQ ID NO: 1041834 - RNA, 19 nt, Homo sapiens
uguauuaccuuaaccaaga

SEQ ID NO: 1041835 - RNA, 19 nt, Homo sapiens
ggccacagauacaaauauu

SEQ ID NO: 1041836 - RNA, 19 nt, Homo sapiens
gaaguuugcaagagaauga

SEQ ID NO: 1041837 - RNA, 19 nt, Homo sapiens
ugacagaugaugaguaauu

SEQ ID NO: 1041838 - RNA, 19 nt, Homo sapiens
ugaauugcgauguguauua

SEQ ID NO: 1041839 - RNA, 19 nt, Homo sapiens
caagauaucaaccauguau

SEQ ID NO: 1041840 - RNA, 19 nt, Homo sapiens
gagaaugauuuccaagaca

SEQ ID NO: 1041841 - RNA, 19 nt, Homo sapiens
caaagaugcugugguagug

SEQ ID NO: 1041842 - RNA, 19 nt, Homo sapiens
cuugacagaugaugaguaa

SEQ ID NO: 1041843 - RNA, 19 nt, Homo sapiens
gaaguucacaucucuaaag

SEQ ID NO: 1041844 - RNA, 19 nt, Homo sapiens
ggggaaaaguucaagaaua

SEQ ID NO: 1041845 - RNA, 19 nt, Homo sapiens
ucaaccauguauuaccuua

SEQ ID NO: 1041846 - RNA, 19 nt, Homo sapiens
cuagggccuuguaauguua

SEQ ID NO: 1041847 - RNA, 19 nt, Homo sapiens
guaauagcguaaaguaaag

SEQ ID NO: 1041848 - RNA, 19 nt, Homo sapiens
cuacaaccgugugaucuuu

SEQ ID NO: 1041849 - RNA, 19 nt, Homo sapiens
uagcacagccguaaaauua

SEQ ID NO: 1041850 - RNA, 19 nt, Homo sapiens
caaaugcaggccacagaua

SEQ ID NO: 1041851 - RNA, 19 nt, Homo sapiens
ggauauaauuagcucuguu

SEQ ID NO: 1041852 - RNA, 19 nt, Homo sapiens
gcaaggcaaugacaauggu

SEQ ID NO: 1041853 - RNA, 19 nt, Homo sapiens
uaacggugauuauagauac

SEQ ID NO: 1041854 - RNA, 19 nt, Homo sapiens
guuuacaucuguuucuuga

SEQ ID NO: 1041855 - RNA, 19 nt, Homo sapiens
gcagccacguuuguuguaa

SEQ ID NO: 1041856 - RNA, 19 nt, Homo sapiens
uuugacagcuaacagauuu

SEQ ID NO: 1041857 - RNA, 19 nt, Homo sapiens
cacaggaggucuugucuuc

SEQ ID NO: 1041858 - RNA, 19 nt, Homo sapiens
gauuucccuugcucaguua

SEQ ID NO: 1041859 - RNA, 19 nt, Homo sapiens
gaauugcgauguguauuac

SEQ ID NO: 1041860 - RNA, 19 nt, Homo sapiens
caggacaucugcagaaucu

SEQ ID NO: 1041861 - RNA, 19 nt, Homo sapiens
gacaguugauuauuguguu

SEQ ID NO: 1041862 - RNA, 19 nt, Homo sapiens
caaagucucacaaaaguua

SEQ ID NO: 1041863 - RNA, 19 nt, Homo sapiens
gaaacacaacagccacaaa

SEQ ID NO: 1041864 - RNA, 19 nt, Homo sapiens
ucaucugguuccucuaaua

SEQ ID NO: 1041865 - RNA, 19 nt, Homo sapiens
cccaggagcccaugaagua

SEQ ID NO: 1041866 - RNA, 19 nt, Homo sapiens
ggacagcggaggaaaucaa

SEQ ID NO: 1041867 - RNA, 19 nt, Homo sapiens
gcaagcagcccaacaacag

SEQ ID NO: 1041868 - RNA, 19 nt, Homo sapiens
cagaugaccacaagugaaa

SEQ ID NO: 1041869 - RNA, 19 nt, Homo sapiens
gauauggaaaugugaaguu

SEQ ID NO: 1041870 - RNA, 19 nt, Homo sapiens
ccacaaacaggugcaaauu

SEQ ID NO: 1041871 - RNA, 19 nt, Homo sapiens
cauguaauguaaacacaga

SEQ ID NO: 1041872 - RNA, 19 nt, Homo sapiens
gguuuggucuuuguaugua

SEQ ID NO: 1041873 - RNA, 19 nt, Homo sapiens
gaggaugcauauuuugaua

SEQ ID NO: 1041874 - RNA, 19 nt, Homo sapiens
agaaugauuuccaagacaa

SEQ ID NO: 1041875 - RNA, 19 nt, Homo sapiens
gauaaagagcucagauaca

SEQ ID NO: 1041876 - RNA, 19 nt, Homo sapiens
guuugacaguugauuauug

SEQ ID NO: 1041877 - RNA, 19 nt, Homo sapiens
auagcagaguugugaaaua

SEQ ID NO: 1041878 - RNA, 19 nt, Homo sapiens
ugucucaucuggaaauaau

SEQ ID NO: 1041879 - RNA, 19 nt, Homo sapiens
uuaacugucucaucuggaa

SEQ ID NO: 1041880 - RNA, 19 nt, Homo sapiens
acaaugguguccuugaaug

SEQ ID NO: 1041881 - RNA, 19 nt, Homo sapiens
ggauaaagagcucagauac

SEQ ID NO: 1041882 - RNA, 19 nt, Homo sapiens
cagaaaauguucggauaua

SEQ ID NO: 1041883 - RNA, 19 nt, Homo sapiens
gcuaacagauuuguauggu

SEQ ID NO: 1041884 - RNA, 19 nt, Homo sapiens
ggaaaucaagcaaggcaau

SEQ ID NO: 1041885 - RNA, 19 nt, Homo sapiens
gaaucuagcccuuacuuuu

SEQ ID NO: 1041886 - RNA, 19 nt, Homo sapiens
aaacacaacagccacaaau

SEQ ID NO: 1041887 - RNA, 19 nt, Homo sapiens
ucuagggccuuguaauguu

SEQ ID NO: 1041888 - RNA, 19 nt, Homo sapiens
aaacacagacaucaaagau

SEQ ID NO: 1041889 - RNA, 19 nt, Homo sapiens
gaggucuugucuucaugua

SEQ ID NO: 1041890 - RNA, 19 nt, Homo sapiens
aauguuaacugucucaucu

SEQ ID NO: 1041891 - RNA, 19 nt, Homo sapiens
gggaaaaguucaagaauac

SEQ ID NO: 1041892 - RNA, 19 nt, Homo sapiens
ggaccaugauacucuucuu

SEQ ID NO: 1041893 - RNA, 19 nt, Homo sapiens
gcacagccguaaaauuaga

SEQ ID NO: 1041894 - RNA, 19 nt, Homo sapiens
ccugaaauugucugcauua

SEQ ID NO: 1041895 - RNA, 19 nt, Homo sapiens
auauuuaacuucccaguag

SEQ ID NO: 1041896 - RNA, 19 nt, Homo sapiens
cgauguguauuacuucuag

SEQ ID NO: 1041897 - RNA, 19 nt, Homo sapiens
ggaaaugugaaguuugcaa

SEQ ID NO: 1041898 - RNA, 19 nt, Homo sapiens
aggagcccaugaaguaaua

SEQ ID NO: 1041899 - RNA, 19 nt, Homo sapiens
ccucagccacuacaaauga

SEQ ID NO: 1041900 - RNA, 19 nt, Homo sapiens
ugauaugcuuugacagcua

SEQ ID NO: 1041901 - RNA, 19 nt, Homo sapiens
gggagaaacuacagaugac

SEQ ID NO: 1041902 - RNA, 19 nt, Homo sapiens
ugaagacauugauauuugg

SEQ ID NO: 1041903 - RNA, 19 nt, Homo sapiens
agacuugaauugcgaugug

SEQ ID NO: 1041904 - RNA, 19 nt, Homo sapiens
gaugccaaauuaucuaacu

SEQ ID NO: 1041905 - RNA, 19 nt, Homo sapiens
caggaggucuugucuucau

SEQ ID NO: 1041906 - RNA, 19 nt, Homo sapiens
gaaaucaagcaaggcaaug

SEQ ID NO: 1041907 - RNA, 19 nt, Homo sapiens
uuacaucuguuucuugaac

SEQ ID NO: 1041908 - RNA, 19 nt, Homo sapiens
gccaaauuaucuaacuugu

SEQ ID NO: 1041909 - RNA, 19 nt, Homo sapiens
auaaagagcucagauacac

SEQ ID NO: 1041910 - RNA, 19 nt, Homo sapiens
uguaaacacagacaucaaa

SEQ ID NO: 1041911 - RNA, 19 nt, Homo sapiens
aaacauggguugucacuua

SEQ ID NO: 1041912 - RNA, 19 nt, Homo sapiens
caucauaccucccuuauuc

SEQ ID NO: 1041913 - RNA, 19 nt, Homo sapiens
ggaauaaugccuagccuua

SEQ ID NO: 1041914 - RNA, 19 nt, Homo sapiens
gaaagaggcauuccaaaga

SEQ ID NO: 1041915 - RNA, 19 nt, Homo sapiens
gaauggaucuuuagaacug

SEQ ID NO: 1041916 - RNA, 19 nt, Homo sapiens
gaaauaagacaggacaaua

SEQ ID NO: 1041917 - RNA, 19 nt, Homo sapiens
gcauuaagcuaaacaggaa

SEQ ID NO: 1041918 - RNA, 19 nt, Homo sapiens
ggacuaagaucccuauguc

SEQ ID NO: 1041919 - RNA, 19 nt, Homo sapiens
caacuggacuccuauuugu

SEQ ID NO: 1041920 - RNA, 19 nt, Homo sapiens
gagggacuaucgaaccuua

SEQ ID NO: 1041921 - RNA, 19 nt, Homo sapiens
gaucuuggcucaccguaau

SEQ ID NO: 1041922 - RNA, 19 nt, Homo sapiens
gcucaucagucuacuaguu

SEQ ID NO: 1041923 - RNA, 19 nt, Homo sapiens
guacaggcaugguuauuuc

SEQ ID NO: 1041924 - RNA, 19 nt, Homo sapiens
uaacagugcuuaagaaagg

SEQ ID NO: 1041925 - RNA, 19 nt, Homo sapiens
gguaauauuuggcauggaa

SEQ ID NO: 1041926 - RNA, 19 nt, Homo sapiens
gugagugagugcuuaauaa

SEQ ID NO: 1041927 - RNA, 19 nt, Homo sapiens
uagaggaccugguagcuaa

SEQ ID NO: 1041928 - RNA, 19 nt, Homo sapiens
gaaacugucucuaucaaaa

SEQ ID NO: 1041929 - RNA, 19 nt, Homo sapiens
guaguguaauugugugaua

SEQ ID NO: 1041930 - RNA, 19 nt, Homo sapiens
caaggaaccuacacauugu

SEQ ID NO: 1041931 - RNA, 19 nt, Homo sapiens
aaagaggcauuccaaagaa

SEQ ID NO: 1041932 - RNA, 19 nt, Homo sapiens
gucaaguccucaagaauuu

SEQ ID NO: 1041933 - RNA, 19 nt, Homo sapiens
uaucgaaccuuaaaguaga

SEQ ID NO: 1041934 - RNA, 19 nt, Homo sapiens
gaugucaaguccucaagaa

SEQ ID NO: 1041935 - RNA, 19 nt, Homo sapiens
caugaaauguguaaaguag

SEQ ID NO: 1041936 - RNA, 19 nt, Homo sapiens
gguagcagguguuccuauu

SEQ ID NO: 1041937 - RNA, 19 nt, Homo sapiens
caggagagggagauaauua

SEQ ID NO: 1041938 - RNA, 19 nt, Homo sapiens
gggaauguguuauuguaug

SEQ ID NO: 1041939 - RNA, 19 nt, Homo sapiens
caaauucuaggcugaagua

SEQ ID NO: 1041940 - RNA, 19 nt, Homo sapiens
gaagauaaccauagcugau

SEQ ID NO: 1041941 - RNA, 19 nt, Homo sapiens
ucaaauguguugccuaaag

SEQ ID NO: 1041942 - RNA, 19 nt, Homo sapiens
ucccagugaugauuuaaua

SEQ ID NO: 1041943 - RNA, 19 nt, Homo sapiens
gcuaaacaggaaaucauua

SEQ ID NO: 1041944 - RNA, 19 nt, Homo sapiens
agagggagauaauuaguug

SEQ ID NO: 1041945 - RNA, 19 nt, Homo sapiens
ccuaucagauuguagugua

SEQ ID NO: 1041946 - RNA, 19 nt, Homo sapiens
ggaagagucagucuauguu

SEQ ID NO: 1041947 - RNA, 19 nt, Homo sapiens
ggauuauggucugaaguaa

SEQ ID NO: 1041948 - RNA, 19 nt, Homo sapiens
gggauuauggucugaagua

SEQ ID NO: 1041949 - RNA, 19 nt, Homo sapiens
gagcucuggugaaugguaa

SEQ ID NO: 1041950 - RNA, 19 nt, Homo sapiens
caacaucauaccucccuua

SEQ ID NO: 1041951 - RNA, 19 nt, Homo sapiens
gcaugguuauuucaacauu

SEQ ID NO: 1041952 - RNA, 19 nt, Homo sapiens
ggagucauccucuucaaug

SEQ ID NO: 1041953 - RNA, 19 nt, Homo sapiens
acaaggaaccuacacauug

SEQ ID NO: 1041954 - RNA, 19 nt, Homo sapiens
caaagaagauaaccauagc

SEQ ID NO: 1041955 - RNA, 19 nt, Homo sapiens
cauagaagguaauauuugg

SEQ ID NO: 1041956 - RNA, 19 nt, Homo sapiens
caagggaaguggcuuaagg

SEQ ID NO: 1041957 - RNA, 19 nt, Homo sapiens
gaacccuccuucccgagaa

SEQ ID NO: 1041958 - RNA, 19 nt, Homo sapiens
ucuacuaguuugcuucuuu

SEQ ID NO: 1041959 - RNA, 19 nt, Homo sapiens
caugucaacuggacuccua

SEQ ID NO: 1041960 - RNA, 19 nt, Homo sapiens
gcaggagcgcaaugaauuu

SEQ ID NO: 1041961 - RNA, 19 nt, Homo sapiens
ggaauguguuauuguaugg

SEQ ID NO: 1041962 - RNA, 19 nt, Homo sapiens
uuagguagcuagacacaau

SEQ ID NO: 1041963 - RNA, 19 nt, Homo sapiens
cauccaagcauuaagcuaa

SEQ ID NO: 1041964 - RNA, 19 nt, Homo sapiens
ccagcaaccuaggaacaua

SEQ ID NO: 1041965 - RNA, 19 nt, Homo sapiens
ccgaccaccuucuaucuuu

SEQ ID NO: 1041966 - RNA, 19 nt, Homo sapiens
cuaggaacauagaagguaa

SEQ ID NO: 1041967 - RNA, 19 nt, Homo sapiens
cccaggagaugaaguguau

SEQ ID NO: 1041968 - RNA, 19 nt, Homo sapiens
ggagugcaguggugugauc

SEQ ID NO: 1041969 - RNA, 19 nt, Homo sapiens
gcagauggucucacaggaa

SEQ ID NO: 1041970 - RNA, 19 nt, Homo sapiens
ggagugcaguggcaugauc

SEQ ID NO: 1041971 - RNA, 19 nt, Homo sapiens
ggacuggaugaucguguua

SEQ ID NO: 1041972 - RNA, 19 nt, Homo sapiens
gugaaacugucucuaucaa

SEQ ID NO: 1041973 - RNA, 19 nt, Homo sapiens
ccaaagugcugggauuaca

SEQ ID NO: 1041974 - RNA, 19 nt, Homo sapiens
auucaaauguguugccuaa

SEQ ID NO: 1041975 - RNA, 19 nt, Homo sapiens
ccaaagaagauaaccauag

SEQ ID NO: 1041976 - RNA, 19 nt, Homo sapiens
ugaaguaaccagcaaccua

SEQ ID NO: 1041977 - RNA, 19 nt, Homo sapiens
uuacaggcaugaaccauca

SEQ ID NO: 1041978 - RNA, 19 nt, Homo sapiens
gcagaccgaccaccuucua

SEQ ID NO: 1041979 - RNA, 19 nt, Homo sapiens
acacgugagugagugcuua

SEQ ID NO: 1041980 - RNA, 19 nt, Homo sapiens
ggucugaaguaaccagcaa

SEQ ID NO: 1041981 - RNA, 19 nt, Homo sapiens
acugugaccucaaauucua

SEQ ID NO: 1041982 - RNA, 19 nt, Homo sapiens
gcauucagaccaaagaaga

SEQ ID NO: 1041983 - RNA, 19 nt, Homo sapiens
gggaagagucagucuaugu

SEQ ID NO: 1041984 - RNA, 19 nt, Homo sapiens
gagagggagauaauuaguu

SEQ ID NO: 1041985 - RNA, 19 nt, Homo sapiens
ccacuccuaucagauugua

SEQ ID NO: 1041986 - RNA, 19 nt, Homo sapiens
gaaacgcaacccugucuag

SEQ ID NO: 1041987 - RNA, 19 nt, Homo sapiens
ggaucuuuguucucugaaa

SEQ ID NO: 1041988 - RNA, 19 nt, Homo sapiens
ccgaauagcugggacuaca

SEQ ID NO: 1041989 - RNA, 19 nt, Homo sapiens
guggagcucuggugaaugg

SEQ ID NO: 1041990 - RNA, 19 nt, Homo sapiens
caauccagcucaucagucu

SEQ ID NO: 1041991 - RNA, 19 nt, Homo sapiens
gaagagucagucuauguuc

SEQ ID NO: 1041992 - RNA, 19 nt, Homo sapiens
gcaauucuccugccucaac

SEQ ID NO: 1041993 - RNA, 19 nt, Homo sapiens
ugucaaguccucaagaauu

SEQ ID NO: 1041994 - RNA, 19 nt, Homo sapiens
gagcaggagcgcaaugaau

SEQ ID NO: 1041995 - RNA, 19 nt, Homo sapiens
gggacuggaugaucguguu

SEQ ID NO: 1041996 - RNA, 19 nt, Homo sapiens
ggagaugaaguguauucuu

SEQ ID NO: 1041997 - RNA, 19 nt, Homo sapiens
gauauucuuggaacuggua

SEQ ID NO: 1041998 - RNA, 19 nt, Homo sapiens
ucacacuguuugaaucgaa

SEQ ID NO: 1041999 - RNA, 19 nt, Homo sapiens
gauaggcauucagaccaaa

SEQ ID NO: 1042000 - RNA, 19 nt, Homo sapiens
gauagucuggagcagcuua

SEQ ID NO: 1042001 - RNA, 19 nt, Homo sapiens
ucagacagcuggaguucag

SEQ ID NO: 1042002 - RNA, 19 nt, Homo sapiens
gaucuaagucuucuagcau

SEQ ID NO: 1042003 - RNA, 19 nt, Homo sapiens
ggauuccauuggcugguuu

SEQ ID NO: 1042004 - RNA, 19 nt, Homo sapiens
uuacaaccacugcuggaua

SEQ ID NO: 1042005 - RNA, 19 nt, Homo sapiens
ccaaccagcugaccgaacu

SEQ ID NO: 1042006 - RNA, 19 nt, Homo sapiens
cagcaagggaaguggcuua

SEQ ID NO: 1042007 - RNA, 19 nt, Homo sapiens
guccacugcuggcucauga

SEQ ID NO: 1042008 - RNA, 19 nt, Homo sapiens
ugagugagugcuuaauaaa

SEQ ID NO: 1042009 - RNA, 19 nt, Homo sapiens
gagucagucuauguucuuu

SEQ ID NO: 1042010 - RNA, 19 nt, Homo sapiens
gaaguggcuuaagggaaga

SEQ ID NO: 1042011 - RNA, 19 nt, Homo sapiens
gaaaggcccugcuaugaua

SEQ ID NO: 1042012 - RNA, 19 nt, Homo sapiens
gcaaagcacucuaaauauu

SEQ ID NO: 1042013 - RNA, 19 nt, Homo sapiens
cuagagaacugaagacaua

SEQ ID NO: 1042014 - RNA, 19 nt, Homo sapiens
caacugugauuucccauuu

SEQ ID NO: 1042015 - RNA, 19 nt, Homo sapiens
gaugucagcucaaauaauc

SEQ ID NO: 1042016 - RNA, 19 nt, Homo sapiens
guugggagcuugugcauaa

SEQ ID NO: 1042017 - RNA, 19 nt, Homo sapiens
gaaacccagucucuacuaa

SEQ ID NO: 1042018 - RNA, 19 nt, Homo sapiens
gagcuaagcacagagauua

SEQ ID NO: 1042019 - RNA, 19 nt, Homo sapiens
caaacacacugcucagaaa

SEQ ID NO: 1042020 - RNA, 19 nt, Homo sapiens
ggacaaagacauucgaaga

SEQ ID NO: 1042021 - RNA, 19 nt, Homo sapiens
gaaaaucucugacagguau

SEQ ID NO: 1042022 - RNA, 19 nt, Homo sapiens
gaaaagaacccucagcuaa

SEQ ID NO: 1042023 - RNA, 19 nt, Homo sapiens
gcccaagggugauguguuu

SEQ ID NO: 1042024 - RNA, 19 nt, Homo sapiens
cacaauagcuucuuuaagg

SEQ ID NO: 1042025 - RNA, 19 nt, Homo sapiens
ccugaaagaugguagaauu

SEQ ID NO: 1042026 - RNA, 19 nt, Homo sapiens
gaggaggaguccauucaaa

SEQ ID NO: 1042027 - RNA, 19 nt, Homo sapiens
gaaagaugguagaauuauc

SEQ ID NO: 1042028 - RNA, 19 nt, Homo sapiens
gagcuuguguuuaaaguca

SEQ ID NO: 1042029 - RNA, 19 nt, Homo sapiens
aaagcuccaugucuacuua

SEQ ID NO: 1042030 - RNA, 19 nt, Homo sapiens
ggacaguuaaguuggaaua

SEQ ID NO: 1042031 - RNA, 19 nt, Homo sapiens
ucucaacucuuuccugauu

SEQ ID NO: 1042032 - RNA, 19 nt, Homo sapiens
gaauaugugccaucucuga

SEQ ID NO: 1042033 - RNA, 19 nt, Homo sapiens
ucagaugucagcucaaaua

SEQ ID NO: 1042034 - RNA, 19 nt, Homo sapiens
gcgcacaccuguaguaguc

SEQ ID NO: 1042035 - RNA, 19 nt, Homo sapiens
agggugauguguuuaaaua

SEQ ID NO: 1042036 - RNA, 19 nt, Homo sapiens
ugauuuggguggugauuaa

SEQ ID NO: 1042037 - RNA, 19 nt, Homo sapiens
gaacugaagacauaaagca

SEQ ID NO: 1042038 - RNA, 19 nt, Homo sapiens
agagacaucuuugggauuu

SEQ ID NO: 1042039 - RNA, 19 nt, Homo sapiens
caacaacggacccaaguga

SEQ ID NO: 1042040 - RNA, 19 nt, Homo sapiens
aaagaacccucagcuaaug

SEQ ID NO: 1042041 - RNA, 19 nt, Homo sapiens
cccugaagcuuuccagaua

SEQ ID NO: 1042042 - RNA, 19 nt, Homo sapiens
gaccaucugcuuuccauuu

SEQ ID NO: 1042043 - RNA, 19 nt, Homo sapiens
caacggacccaagugauaa

SEQ ID NO: 1042044 - RNA, 19 nt, Homo sapiens
augcaaagcacucuaaaua

SEQ ID NO: 1042045 - RNA, 19 nt, Homo sapiens
caaauaaucaaccuucaug

SEQ ID NO: 1042046 - RNA, 19 nt, Homo sapiens
cagaauaugugccaucucu

SEQ ID NO: 1042047 - RNA, 19 nt, Homo sapiens
aaauugaacugaagagaca

SEQ ID NO: 1042048 - RNA, 19 nt, Homo sapiens
gcuccagauugacagaaua

SEQ ID NO: 1042049 - RNA, 19 nt, Homo sapiens
gaagagacaagaacugagu

SEQ ID NO: 1042050 - RNA, 19 nt, Homo sapiens
ggugauguguuuaaauauc

SEQ ID NO: 1042051 - RNA, 19 nt, Homo sapiens
caaugccacuguccugaaa

SEQ ID NO: 1042052 - RNA, 19 nt, Homo sapiens
ccagauuacgcaccauuua

SEQ ID NO: 1042053 - RNA, 19 nt, Homo sapiens
caguggauauuguaagaaa

SEQ ID NO: 1042054 - RNA, 19 nt, Homo sapiens
gaguaaagacagugaaaug

SEQ ID NO: 1042055 - RNA, 19 nt, Homo sapiens
cagaaaggcccugcuauga

SEQ ID NO: 1042056 - RNA, 19 nt, Homo sapiens
uaucuucucaggacaguua

SEQ ID NO: 1042057 - RNA, 19 nt, Homo sapiens
gcuaagcacagagauuaua

SEQ ID NO: 1042058 - RNA, 19 nt, Homo sapiens
ggaaguggaacucauuuua

SEQ ID NO: 1042059 - RNA, 19 nt, Homo sapiens
gcugcaagcuuucugucuu

SEQ ID NO: 1042060 - RNA, 19 nt, Homo sapiens
caagggugauguguuuaaa

SEQ ID NO: 1042061 - RNA, 19 nt, Homo sapiens
ccagauaagcaacaaggua

SEQ ID NO: 1042062 - RNA, 19 nt, Homo sapiens
ggacccaagugauaacaag

SEQ ID NO: 1042063 - RNA, 19 nt, Homo sapiens
caaagcacucuaaauauuc

SEQ ID NO: 1042064 - RNA, 19 nt, Homo sapiens
gaugguagaauuauccuau

SEQ ID NO: 1042065 - RNA, 19 nt, Homo sapiens
ucaaaguacuguguauuuc

SEQ ID NO: 1042066 - RNA, 19 nt, Homo sapiens
ucagaaagcuaccaaacac

SEQ ID NO: 1042067 - RNA, 19 nt, Homo sapiens
aaacgugaguugcugugaa

SEQ ID NO: 1042068 - RNA, 19 nt, Homo sapiens
gaacugaagagacaagaac

SEQ ID NO: 1042069 - RNA, 19 nt, Homo sapiens
caguuaaguuggaauacaa

SEQ ID NO: 1042070 - RNA, 19 nt, Homo sapiens
cugcacaucugacggacua

SEQ ID NO: 1042071 - RNA, 19 nt, Homo sapiens
cagaaaggacaaagacauu

SEQ ID NO: 1042072 - RNA, 19 nt, Homo sapiens
ccaaacacacugcucagaa

SEQ ID NO: 1042073 - RNA, 19 nt, Homo sapiens
gauaagcaacaagguauga

SEQ ID NO: 1042074 - RNA, 19 nt, Homo sapiens
ccugaagcuuuccagauaa

SEQ ID NO: 1042075 - RNA, 19 nt, Homo sapiens
caaacugaccaucugcuuu

SEQ ID NO: 1042076 - RNA, 19 nt, Homo sapiens
cagauuacgcaccauuuaa

SEQ ID NO: 1042077 - RNA, 19 nt, Homo sapiens
gaucaucaccaaggucauu

SEQ ID NO: 1042078 - RNA, 19 nt, Homo sapiens
ucacugggcuggcaagaac

SEQ ID NO: 1042079 - RNA, 19 nt, Homo sapiens
gaagacugcgggacuuuca

SEQ ID NO: 1042080 - RNA, 19 nt, Homo sapiens
ugauuuagagcuuguguuu

SEQ ID NO: 1042081 - RNA, 19 nt, Homo sapiens
ucccagagcuugcccaaca

SEQ ID NO: 1042082 - RNA, 19 nt, Homo sapiens
gggcauccuuguccuuugu

SEQ ID NO: 1042083 - RNA, 19 nt, Homo sapiens
caaaguacuguguauuuca

SEQ ID NO: 1042084 - RNA, 19 nt, Homo sapiens
gaaguggaacucauuuuaa

SEQ ID NO: 1042085 - RNA, 19 nt, Homo sapiens
gaguggagaagaucagaaa

SEQ ID NO: 1042086 - RNA, 19 nt, Homo sapiens
ccaagggugauguguuuaa

SEQ ID NO: 1042087 - RNA, 19 nt, Homo sapiens
acaauagcuucuuuaagga

SEQ ID NO: 1042088 - RNA, 19 nt, Homo sapiens
acagccaacuggucaggua

SEQ ID NO: 1042089 - RNA, 19 nt, Homo sapiens
uauaaagacacccuccuaa

SEQ ID NO: 1042090 - RNA, 19 nt, Homo sapiens
gcacaauagcuucuuuaag

SEQ ID NO: 1042091 - RNA, 19 nt, Homo sapiens
uaaacaagaaggcacaaau

SEQ ID NO: 1042092 - RNA, 19 nt, Homo sapiens
caacauguucaguggauau

SEQ ID NO: 1042093 - RNA, 19 nt, Homo sapiens
gaaagcuccaugucuacuu

SEQ ID NO: 1042094 - RNA, 19 nt, Homo sapiens
acaacggacccaagugaua

SEQ ID NO: 1042095 - RNA, 19 nt, Homo sapiens
ugacagaaaggcccugcua

SEQ ID NO: 1042096 - RNA, 19 nt, Homo sapiens
ggaaggggcugggaguaaa

SEQ ID NO: 1042097 - RNA, 19 nt, Homo sapiens
gaacgaguggagaagauca

SEQ ID NO: 1042098 - RNA, 19 nt, Homo sapiens
cagauaagcaacaagguau

SEQ ID NO: 1042099 - RNA, 19 nt, Homo sapiens
gagcacagagacaucuuug

SEQ ID NO: 1042100 - RNA, 19 nt, Homo sapiens
cuucagaugucagcucaaa

SEQ ID NO: 1042101 - RNA, 19 nt, Homo sapiens
ggacuagaggugacucaug

SEQ ID NO: 1042102 - RNA, 19 nt, Homo sapiens
cagaugugcugaggcugua

SEQ ID NO: 1042103 - RNA, 19 nt, Homo sapiens
aaaugacccugcucuaucu

SEQ ID NO: 1042104 - RNA, 19 nt, Homo sapiens
ggagaagaucagaaagcua

SEQ ID NO: 1042105 - RNA, 19 nt, Homo sapiens
cagaacgaguggagaagau

SEQ ID NO: 1042106 - RNA, 19 nt, Homo sapiens
ggcuauacauuucccugaa

SEQ ID NO: 1042107 - RNA, 19 nt, Homo sapiens
aaacugaccaucugcuuuc

SEQ ID NO: 1042108 - RNA, 19 nt, Homo sapiens
aggcacaaauccacacuug

SEQ ID NO: 1042109 - RNA, 19 nt, Homo sapiens
caaaaggccuggcauaugc

SEQ ID NO: 1042110 - RNA, 19 nt, Homo sapiens
cauguucaguggauauugu

SEQ ID NO: 1042111 - RNA, 19 nt, Homo sapiens
ggaagugggucacggguua

SEQ ID NO: 1042112 - RNA, 19 nt, Homo sapiens
gaaggacucugauauguug

SEQ ID NO: 1042113 - RNA, 19 nt, Homo sapiens
ggccagagccuguuuguua

SEQ ID NO: 1042114 - RNA, 19 nt, Homo sapiens
gcacugggcuuuauaucug

SEQ ID NO: 1042115 - RNA, 19 nt, Homo sapiens
gaaagccugugaacuaugg

SEQ ID NO: 1042116 - RNA, 19 nt, Homo sapiens
gcacgugucugcaguagag

SEQ ID NO: 1042117 - RNA, 19 nt, Homo sapiens
gaucaaggauggguuggaa

SEQ ID NO: 1042118 - RNA, 19 nt, Homo sapiens
guacugaaauuagggauuc

SEQ ID NO: 1042119 - RNA, 19 nt, Homo sapiens
ccaccugccuugcaaauuc

SEQ ID NO: 1042120 - RNA, 19 nt, Homo sapiens
gaugagagauucuguugcu

SEQ ID NO: 1042121 - RNA, 19 nt, Homo sapiens
ccaaagugcugugaugugu

SEQ ID NO: 1042122 - RNA, 19 nt, Homo sapiens
ccaccacccuucuuacaga

SEQ ID NO: 1042123 - RNA, 19 nt, Homo sapiens
ggaaggacucugauauguu

SEQ ID NO: 1042124 - RNA, 19 nt, Homo sapiens
gcgcugaccaucuacgaua

SEQ ID NO: 1042125 - RNA, 19 nt, Homo sapiens
ccgugaagcuggacaaaga

SEQ ID NO: 1042126 - RNA, 19 nt, Homo sapiens
aggcaaauuucugugauua

SEQ ID NO: 1042127 - RNA, 19 nt, Homo sapiens
ggaccuggcugugaagaca

SEQ ID NO: 1042128 - RNA, 19 nt, Homo sapiens
gcagauccaaccuuuguga

SEQ ID NO: 1042129 - RNA, 19 nt, Homo sapiens
ucaaguuccucaguuugua

SEQ ID NO: 1042130 - RNA, 19 nt, Homo sapiens
agacaaugguggagauuuc

SEQ ID NO: 1042131 - RNA, 19 nt, Homo sapiens
agagggugaucuucaguuu

SEQ ID NO: 1042132 - RNA, 19 nt, Homo sapiens
gcauccaccacccuucuua

SEQ ID NO: 1042133 - RNA, 19 nt, Homo sapiens
cauguuggcccugaaauuu

SEQ ID NO: 1042134 - RNA, 19 nt, Homo sapiens
cuucugaggugcaaggauu

SEQ ID NO: 1042135 - RNA, 19 nt, Homo sapiens
aaucauaaaugcacuucug

SEQ ID NO: 1042136 - RNA, 19 nt, Homo sapiens
ccgaaagccugugaacuau

SEQ ID NO: 1042137 - RNA, 19 nt, Homo sapiens
gaaagcagagaucaaggau

SEQ ID NO: 1042138 - RNA, 19 nt, Homo sapiens
gaaauuagggauucaucag

SEQ ID NO: 1042139 - RNA, 19 nt, Homo sapiens
gcaccuccagcguccauaa

SEQ ID NO: 1042140 - RNA, 19 nt, Homo sapiens
uggaaggacucugauaugu

SEQ ID NO: 1042141 - RNA, 19 nt, Homo sapiens
gaugaaagcagagaucaag

SEQ ID NO: 1042142 - RNA, 19 nt, Homo sapiens
gaacuaugggaacagauuc

SEQ ID NO: 1042143 - RNA, 19 nt, Homo sapiens
uccgaaagccugugaacua

SEQ ID NO: 1042144 - RNA, 19 nt, Homo sapiens
ugaagacaaugguggagau

SEQ ID NO: 1042145 - RNA, 19 nt, Homo sapiens
cagcagauccaaccuuugu

SEQ ID NO: 1042146 - RNA, 19 nt, Homo sapiens
caggcaaauuucugugauu

SEQ ID NO: 1042147 - RNA, 19 nt, Homo sapiens
gccagagccuguuuguuag

SEQ ID NO: 1042148 - RNA, 19 nt, Homo sapiens
gagaccacauccugcuguu

SEQ ID NO: 1042149 - RNA, 19 nt, Homo sapiens
ucaaggauggguuggaauu

SEQ ID NO: 1042150 - RNA, 19 nt, Homo sapiens
gagaagggccaaugagcau

SEQ ID NO: 1042151 - RNA, 19 nt, Homo sapiens
gaccacauccugcuguuca

SEQ ID NO: 1042152 - RNA, 19 nt, Homo sapiens
ggagcaaugcccagagaga

SEQ ID NO: 1042153 - RNA, 19 nt, Homo sapiens
gcucaagcccaggcaaauu

SEQ ID NO: 1042154 - RNA, 19 nt, Homo sapiens
gcuuucagcccuccuguga

SEQ ID NO: 1042155 - RNA, 19 nt, Homo sapiens
agagagacgucuucaacca

SEQ ID NO: 1042156 - RNA, 19 nt, Homo sapiens
caucuacgauacccacauc

SEQ ID NO: 1042157 - RNA, 19 nt, Homo sapiens
gauggaaaccaacuucuac

SEQ ID NO: 1042158 - RNA, 19 nt, Homo sapiens
gaagacaaugguggagauu

SEQ ID NO: 1042159 - RNA, 19 nt, Homo sapiens
gagcuggaccuggcuguga

SEQ ID NO: 1042160 - RNA, 19 nt, Homo sapiens
gcucaaagcagcagaucca

SEQ ID NO: 1042161 - RNA, 19 nt, Homo sapiens
gugggucacggguuaauuu

SEQ ID NO: 1042162 - RNA, 19 nt, Homo sapiens
agggugaucuucaguuuua

SEQ ID NO: 1042163 - RNA, 19 nt, Homo sapiens
cagcugcuccaccggguua

SEQ ID NO: 1042164 - RNA, 19 nt, Homo sapiens
gcagauggaaggagugucu

SEQ ID NO: 1042165 - RNA, 19 nt, Homo sapiens
ccuaagcagcuaugugaaa

SEQ ID NO: 1042166 - RNA, 19 nt, Homo sapiens
cugaacgccugcugaaugu

SEQ ID NO: 1042167 - RNA, 19 nt, Homo sapiens
ccagagagacgucuucaac

SEQ ID NO: 1042168 - RNA, 19 nt, Homo sapiens
cuacuggccuugugcugau

SEQ ID NO: 1042169 - RNA, 19 nt, Homo sapiens
gcacagccgagaccacauc

SEQ ID NO: 1042170 - RNA, 19 nt, Homo sapiens
ccaggcaaauuucugugau

SEQ ID NO: 1042171 - RNA, 19 nt, Homo sapiens
ugaaugugccgcugacuca

SEQ ID NO: 1042172 - RNA, 19 nt, Homo sapiens
ucacugaacgccugcugaa

SEQ ID NO: 1042173 - RNA, 19 nt, Homo sapiens
ccacccuucuuacagauca

SEQ ID NO: 1042174 - RNA, 19 nt, Homo sapiens
ggauggaccuuuucauucu

SEQ ID NO: 1042175 - RNA, 19 nt, Homo sapiens
ggagcgugaugccuugaag

SEQ ID NO: 1042176 - RNA, 19 nt, Homo sapiens
gcacaccgucgcucacauc

SEQ ID NO: 1042177 - RNA, 19 nt, Homo sapiens
cuaagcagcuaugugaaag

SEQ ID NO: 1042178 - RNA, 19 nt, Homo sapiens
ugaacuaugggaacagauu

SEQ ID NO: 1042179 - RNA, 19 nt, Homo sapiens
ggcaaauuucugugauuaa

SEQ ID NO: 1042180 - RNA, 19 nt, Homo sapiens
gcugcucuguuguggcaaa

SEQ ID NO: 1042181 - RNA, 19 nt, Homo sapiens
ucuguugucucauuguguu

SEQ ID NO: 1042182 - RNA, 19 nt, Homo sapiens
cagcguccauaagaacgua

SEQ ID NO: 1042183 - RNA, 19 nt, Homo sapiens
uggcuugucauaacuauug

SEQ ID NO: 1042184 - RNA, 19 nt, Homo sapiens
ugaaagcagagaucaagga

SEQ ID NO: 1042185 - RNA, 19 nt, Homo sapiens
gcacuggaagcuccgugaa

SEQ ID NO: 1042186 - RNA, 19 nt, Homo sapiens
gaagugggucacggguuaa

SEQ ID NO: 1042187 - RNA, 19 nt, Homo sapiens
ccuccagcguccauaagaa

SEQ ID NO: 1042188 - RNA, 19 nt, Homo sapiens
gagaugaaagcagagauca

SEQ ID NO: 1042189 - RNA, 19 nt, Homo sapiens
ggaccaaugacaagagucu

SEQ ID NO: 1042190 - RNA, 19 nt, Homo sapiens
acgcugacccaguauguaa

SEQ ID NO: 1042191 - RNA, 19 nt, Homo sapiens
ugauggaaaccaacuucua

SEQ ID NO: 1042192 - RNA, 19 nt, Homo sapiens
gugaaaggcaucuacucuu

SEQ ID NO: 1042193 - RNA, 19 nt, Homo sapiens
agcagcagauccaaccuuu

SEQ ID NO: 1042194 - RNA, 19 nt, Homo sapiens
aggaacagaugagagauuc

SEQ ID NO: 1042195 - RNA, 19 nt, Homo sapiens
gcccagggucacacuauga

SEQ ID NO: 1042196 - RNA, 19 nt, Homo sapiens
acauccugcuguucaauga

SEQ ID NO: 1042197 - RNA, 19 nt, Homo sapiens
gcuguuagagggugaucuu

SEQ ID NO: 1042198 - RNA, 19 nt, Homo sapiens
uugagaagggcgaauauga

SEQ ID NO: 1042199 - RNA, 19 nt, Homo sapiens
augccacgcugacccagua

SEQ ID NO: 1042200 - RNA, 19 nt, Homo sapiens
aaggauggguuggaauuca

SEQ ID NO: 1042201 - RNA, 19 nt, Homo sapiens
guucaaugacgcacacuuc

SEQ ID NO: 1042202 - RNA, 19 nt, Homo sapiens
gcaggccaacgaugcaaug

SEQ ID NO: 1042203 - RNA, 19 nt, Homo sapiens
gauugagaagggcgaauau

SEQ ID NO: 1042204 - RNA, 19 nt, Homo sapiens
ugauugagaagggcgaaua

SEQ ID NO: 1042205 - RNA, 19 nt, Homo sapiens
uaaaauggaccaaugacaa

SEQ ID NO: 1042206 - RNA, 19 nt, Homo sapiens
cucaagcccaggcaaauuu

SEQ ID NO: 1042207 - RNA, 19 nt, Homo sapiens
gcucuguuggugcugauuu

SEQ ID NO: 1042208 - RNA, 19 nt, Homo sapiens
cagucucuguugucucauu

SEQ ID NO: 1042209 - RNA, 19 nt, Homo sapiens
guuagagggugaucuucag

SEQ ID NO: 1042210 - RNA, 19 nt, Homo sapiens
ugacgcacacuuccugaug

SEQ ID NO: 1042211 - RNA, 19 nt, Homo sapiens
gaaacccugucucuacuaa

SEQ ID NO: 1042212 - RNA, 19 nt, Homo sapiens
gaaacccugucucuacaaa

SEQ ID NO: 1042213 - RNA, 19 nt, Homo sapiens
guaguugguugguugguuu

SEQ ID NO: 1042214 - RNA, 19 nt, Homo sapiens
agaaguagcuuuaguugag

SEQ ID NO: 1042215 - RNA, 19 nt, Homo sapiens
caucacaccauauuuauug

SEQ ID NO: 1042216 - RNA, 19 nt, Homo sapiens
gcacaguccuugccuucug

SEQ ID NO: 1042217 - RNA, 19 nt, Homo sapiens
gaugagaaguagcuuuagu

SEQ ID NO: 1042218 - RNA, 19 nt, Homo sapiens
gagacggguuucaccauau

SEQ ID NO: 1042219 - RNA, 19 nt, Homo sapiens
agagacggguuucaccaua

SEQ ID NO: 1042220 - RNA, 19 nt, Homo sapiens
ggaaggauaggucagaaau

SEQ ID NO: 1042221 - RNA, 19 nt, Homo sapiens
gaguagaugagcagaauga

SEQ ID NO: 1042222 - RNA, 19 nt, Homo sapiens
aagaugagaaguagcuuua

SEQ ID NO: 1042223 - RNA, 19 nt, Homo sapiens
ggaaaggaaauuaaacaag

SEQ ID NO: 1042224 - RNA, 19 nt, Homo sapiens
uauagaggccugucuuuga

SEQ ID NO: 1042225 - RNA, 19 nt, Homo sapiens
gaaugaaacccugucucua

SEQ ID NO: 1042226 - RNA, 19 nt, Homo sapiens
ccaaagugcugggauuaca

SEQ ID NO: 1042227 - RNA, 19 nt, Homo sapiens
gaggaaaggaaauuaaaca

SEQ ID NO: 1042228 - RNA, 19 nt, Homo sapiens
uaaacaagcccuguacaga

SEQ ID NO: 1042229 - RNA, 19 nt, Homo sapiens
ugaaucaucacaccauauu

SEQ ID NO: 1042230 - RNA, 19 nt, Homo sapiens
gagaaguagcuuuaguuga

SEQ ID NO: 1042231 - RNA, 19 nt, Homo sapiens
aaacaagcccuguacagau

SEQ ID NO: 1042232 - RNA, 19 nt, Homo sapiens
gcaggagaauggcaugaac

SEQ ID NO: 1042233 - RNA, 19 nt, Homo sapiens
ggugaaacccugucucuac

SEQ ID NO: 1042234 - RNA, 19 nt, Homo sapiens
agacggguuucaccauauu

SEQ ID NO: 1042235 - RNA, 19 nt, Homo sapiens
cuagauggaacguguguuu

SEQ ID NO: 1042236 - RNA, 19 nt, Homo sapiens
gaucagacuggccaacaga

SEQ ID NO: 1042237 - RNA, 19 nt, Homo sapiens
gauggaacguguguuuaag

SEQ ID NO: 1042238 - RNA, 19 nt, Homo sapiens
ggacaccuacagcuugcua

SEQ ID NO: 1042239 - RNA, 19 nt, Homo sapiens
ggaggaugcagucucuuug

SEQ ID NO: 1042240 - RNA, 19 nt, Homo sapiens
gagcucaugguccagaauu

SEQ ID NO: 1042241 - RNA, 19 nt, Homo sapiens
ccugaaaucccagcacuuu

SEQ ID NO: 1042242 - RNA, 19 nt, Homo sapiens
guguuuaagaugcagauua

SEQ ID NO: 1042243 - RNA, 19 nt, Homo sapiens
caagaugagaaguagcuuu

SEQ ID NO: 1042244 - RNA, 19 nt, Homo sapiens
ccaacagcgggaaguauuu

SEQ ID NO: 1042245 - RNA, 19 nt, Homo sapiens
ucacaguaauccucagagu

SEQ ID NO: 1042246 - RNA, 19 nt, Homo sapiens
agauggaacguguguuuaa

SEQ ID NO: 1042247 - RNA, 19 nt, Homo sapiens
cauauuuauuggacaccua

SEQ ID NO: 1042248 - RNA, 19 nt, Homo sapiens
gaaucaucacaccauauuu

SEQ ID NO: 1042249 - RNA, 19 nt, Homo sapiens
agguuucccugguuucaua

SEQ ID NO: 1042250 - RNA, 19 nt, Homo sapiens
ucgagaccauccuggcuaa

SEQ ID NO: 1042251 - RNA, 19 nt, Homo sapiens
gguaguugguugguugguu

SEQ ID NO: 1042252 - RNA, 19 nt, Homo sapiens
ggucaaguucucuuugguu

SEQ ID NO: 1042253 - RNA, 19 nt, Homo sapiens
gugaaacccugucucuacu

SEQ ID NO: 1042254 - RNA, 19 nt, Homo sapiens
guagaugagcagaaugaga

SEQ ID NO: 1042255 - RNA, 19 nt, Homo sapiens
uagcuucucuggcccaucu

SEQ ID NO: 1042256 - RNA, 19 nt, Homo sapiens
ugagaaguagcuuuaguug

SEQ ID NO: 1042257 - RNA, 19 nt, Homo sapiens
aacaagcccuguacagauc

SEQ ID NO: 1042258 - RNA, 19 nt, Homo sapiens
gcucaugguccagaauuga

SEQ ID NO: 1042259 - RNA, 19 nt, Homo sapiens
gaaggauaggucagaaauc

SEQ ID NO: 1042260 - RNA, 19 nt, Homo sapiens
gaaaccccauucuaccaaa

SEQ ID NO: 1042261 - RNA, 19 nt, Homo sapiens
ugccucagccucccaagua

SEQ ID NO: 1042262 - RNA, 19 nt, Homo sapiens
caacuacuaaugccaccaa

SEQ ID NO: 1042263 - RNA, 19 nt, Homo sapiens
gcaccuguagucccagcua

SEQ ID NO: 1042264 - RNA, 19 nt, Homo sapiens
ggguuuaagugauucuucu

SEQ ID NO: 1042265 - RNA, 19 nt, Homo sapiens
cucauuaccuccuggugaa

SEQ ID NO: 1042266 - RNA, 19 nt, Homo sapiens
agaccauccuggcuaacuu

SEQ ID NO: 1042267 - RNA, 19 nt, Homo sapiens
ccuguaaucccagcacuuu

SEQ ID NO: 1042268 - RNA, 19 nt, Homo sapiens
ccuguaaccucagcacugu

SEQ ID NO: 1042269 - RNA, 19 nt, Homo sapiens
gaagccaguaggugaaaca

SEQ ID NO: 1042270 - RNA, 19 nt, Homo sapiens
uggaacguguguuuaagau

SEQ ID NO: 1042271 - RNA, 19 nt, Homo sapiens
uauauagaggccugucuuu

SEQ ID NO: 1042272 - RNA, 19 nt, Homo sapiens
agacuggccaacagaauga

SEQ ID NO: 1042273 - RNA, 19 nt, Homo sapiens
gaggucaggaugucaagau

SEQ ID NO: 1042274 - RNA, 19 nt, Homo sapiens
ugaaaucccagcacuuugg

SEQ ID NO: 1042275 - RNA, 19 nt, Homo sapiens
gaacuccugaccucaugau

SEQ ID NO: 1042276 - RNA, 19 nt, Homo sapiens
gaggaugcagucucuuugu

SEQ ID NO: 1042277 - RNA, 19 nt, Homo sapiens
uguuuaagaugcagauuac

SEQ ID NO: 1042278 - RNA, 19 nt, Homo sapiens
ggaccaggaacagggauga

SEQ ID NO: 1042279 - RNA, 19 nt, Homo sapiens
gacugagguuucccugguu

SEQ ID NO: 1042280 - RNA, 19 nt, Homo sapiens
gggcgacacagcgagauuu

SEQ ID NO: 1042281 - RNA, 19 nt, Homo sapiens
ccacuugcaucgccuuuug

SEQ ID NO: 1042282 - RNA, 19 nt, Homo sapiens
uagauggaacguguguuua

SEQ ID NO: 1042283 - RNA, 19 nt, Homo sapiens
aaauuaaacaagcccugua

SEQ ID NO: 1042284 - RNA, 19 nt, Homo sapiens
aaugaaacccugucucuac

SEQ ID NO: 1042285 - RNA, 19 nt, Homo sapiens
agccuuagcgcaacuacua

SEQ ID NO: 1042286 - RNA, 19 nt, Homo sapiens
caggucaaguucucuuugg

SEQ ID NO: 1042287 - RNA, 19 nt, Homo sapiens
gaccauccuggcuaacuug

SEQ ID NO: 1042288 - RNA, 19 nt, Homo sapiens
uugaguagaugagcagaau

SEQ ID NO: 1042289 - RNA, 19 nt, Homo sapiens
uaacagccuuagcgcaacu

SEQ ID NO: 1042290 - RNA, 19 nt, Homo sapiens
ccacugcugcucuuagcuu

SEQ ID NO: 1042291 - RNA, 19 nt, Homo sapiens
cuccuggguuuaagugauu

SEQ ID NO: 1042292 - RNA, 19 nt, Homo sapiens
cuacuaaugccaccaagag

SEQ ID NO: 1042293 - RNA, 19 nt, Homo sapiens
gggagcucaugguccagaa

SEQ ID NO: 1042294 - RNA, 19 nt, Homo sapiens
auagaggccugucuuugag

SEQ ID NO: 1042295 - RNA, 19 nt, Homo sapiens
uggaggaugcagucucuuu

SEQ ID NO: 1042296 - RNA, 19 nt, Homo sapiens
agaaugaaacccugucucu

SEQ ID NO: 1042297 - RNA, 19 nt, Homo sapiens
cccaacagcgggaaguauu

SEQ ID NO: 1042298 - RNA, 19 nt, Homo sapiens
ucgaacuccugaccucaug

SEQ ID NO: 1042299 - RNA, 19 nt, Homo sapiens
ggaacguguguuuaagaug

SEQ ID NO: 1042300 - RNA, 19 nt, Homo sapiens
ugaaacccugucucuacua

SEQ ID NO: 1042301 - RNA, 19 nt, Homo sapiens
cagacuggccaacagaaug

SEQ ID NO: 1042302 - RNA, 19 nt, Homo sapiens
ggucaggaugucaagauca

SEQ ID NO: 1042303 - RNA, 19 nt, Homo sapiens
uuaagugauucuucuucug

SEQ ID NO: 1042304 - RNA, 19 nt, Homo sapiens
gcgaagccaguaggugaaa

SEQ ID NO: 1042305 - RNA, 19 nt, Homo sapiens
ucuaggagacugagguuuc

SEQ ID NO: 1042306 - RNA, 19 nt, Homo sapiens
acugagguuucccugguuu

SEQ ID NO: 1042307 - RNA, 19 nt, Homo sapiens
cugaggguauuuuacuuua

SEQ ID NO: 1042308 - RNA, 19 nt, Homo sapiens
cugugccucuccuuuguuu

SEQ ID NO: 1042309 - RNA, 19 nt, Homo sapiens
ugaggccacugcugcucuu

SEQ ID NO: 1042310 - RNA, 19 nt, Homo sapiens
augaaacccugucucuaca

SEQ ID NO: 1042311 - RNA, 19 nt, Homo sapiens
gcacuuagauacagaauga

SEQ ID NO: 1042312 - RNA, 19 nt, Homo sapiens
gaauaagcauggagucaua

SEQ ID NO: 1042313 - RNA, 19 nt, Homo sapiens
guucuaggcucucuucuua

SEQ ID NO: 1042314 - RNA, 19 nt, Homo sapiens
gaagagcaauucuaaaucu

SEQ ID NO: 1042315 - RNA, 19 nt, Homo sapiens
cagcugagauuuaugguaa

SEQ ID NO: 1042316 - RNA, 19 nt, Homo sapiens
gggaugaaaucucagcaua

SEQ ID NO: 1042317 - RNA, 19 nt, Homo sapiens
gaggaggacucacuucuug

SEQ ID NO: 1042318 - RNA, 19 nt, Homo sapiens
caacauauguaagcuauuc

SEQ ID NO: 1042319 - RNA, 19 nt, Homo sapiens
gaugaaaucucagcauaug

SEQ ID NO: 1042320 - RNA, 19 nt, Homo sapiens
caaauacucugcagcuguu

SEQ ID NO: 1042321 - RNA, 19 nt, Homo sapiens
cacaguggcugcaagguua

SEQ ID NO: 1042322 - RNA, 19 nt, Homo sapiens
aaugagagcuaauccaauu

SEQ ID NO: 1042323 - RNA, 19 nt, Homo sapiens
guaagcaacguuucaaauu

SEQ ID NO: 1042324 - RNA, 19 nt, Homo sapiens
gaugauggcugaaugaacu

SEQ ID NO: 1042325 - RNA, 19 nt, Homo sapiens
aaacuuggcuugucuagag

SEQ ID NO: 1042326 - RNA, 19 nt, Homo sapiens
caacagaagccuuggcaaa

SEQ ID NO: 1042327 - RNA, 19 nt, Homo sapiens
aagagcagaugacuacuuu

SEQ ID NO: 1042328 - RNA, 19 nt, Homo sapiens
gggaauagaugaguaagca

SEQ ID NO: 1042329 - RNA, 19 nt, Homo sapiens
agagacccaugucaucuua

SEQ ID NO: 1042330 - RNA, 19 nt, Homo sapiens
ccaaugcccuccuggaaau

SEQ ID NO: 1042331 - RNA, 19 nt, Homo sapiens
gcugaagucuaaauugaau

SEQ ID NO: 1042332 - RNA, 19 nt, Homo sapiens
gcugaagucuaaauugaau

SEQ ID NO: 1042333 - RNA, 19 nt, Homo sapiens
gaaaucuuauugcguuauc

SEQ ID NO: 1042334 - RNA, 19 nt, Homo sapiens
caugucaucuuaaccuaaa

SEQ ID NO: 1042335 - RNA, 19 nt, Homo sapiens
aagauaugcuuguugcuuu

SEQ ID NO: 1042336 - RNA, 19 nt, Homo sapiens
uuucaggcauguagaauaa

SEQ ID NO: 1042337 - RNA, 19 nt, Homo sapiens
cgaucugccuuaugaaauu

SEQ ID NO: 1042338 - RNA, 19 nt, Homo sapiens
ucauugagcucuggaagaa

SEQ ID NO: 1042339 - RNA, 19 nt, Homo sapiens
aagcaacguuucaaauuug

SEQ ID NO: 1042340 - RNA, 19 nt, Homo sapiens
ucaagggaauagaugagua

SEQ ID NO: 1042341 - RNA, 19 nt, Homo sapiens
uugaaugucuuaacacuga

SEQ ID NO: 1042342 - RNA, 19 nt, Homo sapiens
uugaaugucuuaacacuga

SEQ ID NO: 1042343 - RNA, 19 nt, Homo sapiens
gcccgcaccuugaucauga

SEQ ID NO: 1042344 - RNA, 19 nt, Homo sapiens
gaagauaugcuuguugcuu

SEQ ID NO: 1042345 - RNA, 19 nt, Homo sapiens
gagcgauggugucagcauu

SEQ ID NO: 1042346 - RNA, 19 nt, Homo sapiens
ggacaagagcagaugacua

SEQ ID NO: 1042347 - RNA, 19 nt, Homo sapiens
gggaaaucuuauugcguua

SEQ ID NO: 1042348 - RNA, 19 nt, Homo sapiens
ucacucagcauugcacuua

SEQ ID NO: 1042349 - RNA, 19 nt, Homo sapiens
ugaaaagacugccaaacua

SEQ ID NO: 1042350 - RNA, 19 nt, Homo sapiens
ugagagcuaauccaauuua

SEQ ID NO: 1042351 - RNA, 19 nt, Homo sapiens
ucuaggcucucuucuuauu

SEQ ID NO: 1042352 - RNA, 19 nt, Homo sapiens
gaacgcacuuucagaccau

SEQ ID NO: 1042353 - RNA, 19 nt, Homo sapiens
uaaaugagagcuaauccaa

SEQ ID NO: 1042354 - RNA, 19 nt, Homo sapiens
gcacugcggcaccuaagaa

SEQ ID NO: 1042355 - RNA, 19 nt, Homo sapiens
uuagagggaugaaaucuca

SEQ ID NO: 1042356 - RNA, 19 nt, Homo sapiens
gacaagagcagaugacuac

SEQ ID NO: 1042357 - RNA, 19 nt, Homo sapiens
ccacaccgcugaugaagac

SEQ ID NO: 1042358 - RNA, 19 nt, Homo sapiens
ccacaccgcugaugaagac

SEQ ID NO: 1042359 - RNA, 19 nt, Homo sapiens
agauaugcuuguugcuuua

SEQ ID NO: 1042360 - RNA, 19 nt, Homo sapiens
uaucuuagggucagaauug

SEQ ID NO: 1042361 - RNA, 19 nt, Homo sapiens
gaauuggaauccgaugaug

SEQ ID NO: 1042362 - RNA, 19 nt, Homo sapiens
gcaaagaggaauaagugau

SEQ ID NO: 1042363 - RNA, 19 nt, Homo sapiens
caagggaauagaugaguaa

SEQ ID NO: 1042364 - RNA, 19 nt, Homo sapiens
ucacggaguucaagggaau

SEQ ID NO: 1042365 - RNA, 19 nt, Homo sapiens
uaaugcugcuccuuccuaa

SEQ ID NO: 1042366 - RNA, 19 nt, Homo sapiens
ugaaaucucagcauauguu

SEQ ID NO: 1042367 - RNA, 19 nt, Homo sapiens
cagcauuggucacggaguu

SEQ ID NO: 1042368 - RNA, 19 nt, Homo sapiens
caacagcuccuccgaagag

SEQ ID NO: 1042369 - RNA, 19 nt, Homo sapiens
ccugagauuucuuaauuuc

SEQ ID NO: 1042370 - RNA, 19 nt, Homo sapiens
acagaagccuuggcaaaga

SEQ ID NO: 1042371 - RNA, 19 nt, Homo sapiens
cuuaugaaauuccacaaga

SEQ ID NO: 1042372 - RNA, 19 nt, Homo sapiens
cagcauuccuuccuuccaa

SEQ ID NO: 1042373 - RNA, 19 nt, Homo sapiens
ggaggacucacuucuugaa

SEQ ID NO: 1042374 - RNA, 19 nt, Homo sapiens
cuaaagggaaaucuuauug

SEQ ID NO: 1042375 - RNA, 19 nt, Homo sapiens
guaaugcugcuccuuccua

SEQ ID NO: 1042376 - RNA, 19 nt, Homo sapiens
acacagagucaacauagaa

SEQ ID NO: 1042377 - RNA, 19 nt, Homo sapiens
uaaacacagagucaacaua

SEQ ID NO: 1042378 - RNA, 19 nt, Homo sapiens
gaacacacucuaugucaac

SEQ ID NO: 1042379 - RNA, 19 nt, Homo sapiens
gcaagcacuuucagaccau

SEQ ID NO: 1042380 - RNA, 19 nt, Homo sapiens
aaacacagagucaacauag

SEQ ID NO: 1042381 - RNA, 19 nt, Homo sapiens
uaugucaacucuccuuuua

SEQ ID NO: 1042382 - RNA, 19 nt, Homo sapiens
caaagaggaauaagugauc

SEQ ID NO: 1042383 - RNA, 19 nt, Homo sapiens
ggaugaaaucucagcauau

SEQ ID NO: 1042384 - RNA, 19 nt, Homo sapiens
ggaauuggaauccgaugau

SEQ ID NO: 1042385 - RNA, 19 nt, Homo sapiens
ugaacacacucuaugucaa

SEQ ID NO: 1042386 - RNA, 19 nt, Homo sapiens
aggaauaagugaucagcaa

SEQ ID NO: 1042387 - RNA, 19 nt, Homo sapiens
gaaaucucagcauauguug

SEQ ID NO: 1042388 - RNA, 19 nt, Homo sapiens
gauacagaaugaguuagau

SEQ ID NO: 1042389 - RNA, 19 nt, Homo sapiens
uaagugaucagcaagugaa

SEQ ID NO: 1042390 - RNA, 19 nt, Homo sapiens
auuccgaucugccuuauga

SEQ ID NO: 1042391 - RNA, 19 nt, Homo sapiens
uggcaagcuucaaaucuga

SEQ ID NO: 1042392 - RNA, 19 nt, Homo sapiens
gcauuucggucugcauauc

SEQ ID NO: 1042393 - RNA, 19 nt, Homo sapiens
gaucugccuuaugaaauuc

SEQ ID NO: 1042394 - RNA, 19 nt, Homo sapiens
gaaaagacugccaaacuau

SEQ ID NO: 1042395 - RNA, 19 nt, Homo sapiens
augcugaagucuaaauuga

SEQ ID NO: 1042396 - RNA, 19 nt, Homo sapiens
augcugaagucuaaauuga

SEQ ID NO: 1042397 - RNA, 19 nt, Homo sapiens
augggaagcucucacuaaa

SEQ ID NO: 1042398 - RNA, 19 nt, Homo sapiens
aaccuaaagggaaaucuua

SEQ ID NO: 1042399 - RNA, 19 nt, Homo sapiens
aaagacugccaaacuauug

SEQ ID NO: 1042400 - RNA, 19 nt, Homo sapiens
ucacaagacaaucaaacaa

SEQ ID NO: 1042401 - RNA, 19 nt, Homo sapiens
caagagcagaugacuacuu

SEQ ID NO: 1042402 - RNA, 19 nt, Homo sapiens
gaaugggaagcucucacua

SEQ ID NO: 1042403 - RNA, 19 nt, Homo sapiens
uagauaaacuuggcuuguc

SEQ ID NO: 1042404 - RNA, 19 nt, Homo sapiens
cagaaugaguuagauaaac

SEQ ID NO: 1042405 - RNA, 19 nt, Homo sapiens
ucaccacgcucaggcaaau

SEQ ID NO: 1042406 - RNA, 19 nt, Homo sapiens
ucaaugaugaccuguccua

SEQ ID NO: 1042407 - RNA, 19 nt, Homo sapiens
gccaaugcccuccuggaaa

SEQ ID NO: 1042408 - RNA, 19 nt, Homo sapiens
cagcauuucggucugcaua

SEQ ID NO: 1042409 - RNA, 19 nt, Homo sapiens
gaauaagugaucagcaagu

SEQ ID NO: 1042410 - RNA, 19 nt, Homo sapiens
aagcauggagucauauuga

SEQ ID NO: 1042411 - RNA, 19 nt, Homo sapiens
ggacagcuuucuauaauga

SEQ ID NO: 1042412 - RNA, 19 nt, Homo sapiens
gaaacagugugaagaauug

SEQ ID NO: 1042413 - RNA, 19 nt, Homo sapiens
uaaaggaucagacuuguua

SEQ ID NO: 1042414 - RNA, 19 nt, Homo sapiens
acacaaugcugcucagaua

SEQ ID NO: 1042415 - RNA, 19 nt, Homo sapiens
gaaggacagcuuucuauaa

SEQ ID NO: 1042416 - RNA, 19 nt, Homo sapiens
gcgcuugucugcauucuuu

SEQ ID NO: 1042417 - RNA, 19 nt, Homo sapiens
ggaauaaaccaguugauga

SEQ ID NO: 1042418 - RNA, 19 nt, Homo sapiens
ggaagaagaguuugaagaa

SEQ ID NO: 1042419 - RNA, 19 nt, Homo sapiens
gcaaggagauuguaagaac

SEQ ID NO: 1042420 - RNA, 19 nt, Homo sapiens
gaagaaacagugugaagaa

SEQ ID NO: 1042421 - RNA, 19 nt, Homo sapiens
gaaggaaaccuaaaguaga

SEQ ID NO: 1042422 - RNA, 19 nt, Homo sapiens
ugauaugccugacguuaua

SEQ ID NO: 1042423 - RNA, 19 nt, Homo sapiens
guaaagaugucagacuuau

SEQ ID NO: 1042424 - RNA, 19 nt, Homo sapiens
cgguagaucuccuugaaua

SEQ ID NO: 1042425 - RNA, 19 nt, Homo sapiens
gaugaugccuggugguuug

SEQ ID NO: 1042426 - RNA, 19 nt, Homo sapiens
guaauagagcccagucuua

SEQ ID NO: 1042427 - RNA, 19 nt, Homo sapiens
gaucaaggauuuacagcau

SEQ ID NO: 1042428 - RNA, 19 nt, Homo sapiens
ugugaaaucugcuaaauuc

SEQ ID NO: 1042429 - RNA, 19 nt, Homo sapiens
gauauugccucagcauuug

SEQ ID NO: 1042430 - RNA, 19 nt, Homo sapiens
gugggaaguucgauauaua

SEQ ID NO: 1042431 - RNA, 19 nt, Homo sapiens
gcaagccuaucccauguau

SEQ ID NO: 1042432 - RNA, 19 nt, Homo sapiens
caacggaucuaaguacaau

SEQ ID NO: 1042433 - RNA, 19 nt, Homo sapiens
gaugaagaaugugaaagaa

SEQ ID NO: 1042434 - RNA, 19 nt, Homo sapiens
ggaaggaaaccuaaaguag

SEQ ID NO: 1042435 - RNA, 19 nt, Homo sapiens
cagguacaguuaaggaaua

SEQ ID NO: 1042436 - RNA, 19 nt, Homo sapiens
ugacugaucuucuucuaca

SEQ ID NO: 1042437 - RNA, 19 nt, Homo sapiens
auauggagcuuauaccuaa

SEQ ID NO: 1042438 - RNA, 19 nt, Homo sapiens
caaccugaguacccugaua

SEQ ID NO: 1042439 - RNA, 19 nt, Homo sapiens
aaaggaagaugaagacaca

SEQ ID NO: 1042440 - RNA, 19 nt, Homo sapiens
aaggaaaccuaaaguagaa

SEQ ID NO: 1042441 - RNA, 19 nt, Homo sapiens
caugagaacuagaaaucaa

SEQ ID NO: 1042442 - RNA, 19 nt, Homo sapiens
gccagaagauuuagagcaa

SEQ ID NO: 1042443 - RNA, 19 nt, Homo sapiens
uagaugauccuauagauga

SEQ ID NO: 1042444 - RNA, 19 nt, Homo sapiens
ccaggaaccauucaaguaa

SEQ ID NO: 1042445 - RNA, 19 nt, Homo sapiens
ccaauggaguuauguaaag

SEQ ID NO: 1042446 - RNA, 19 nt, Homo sapiens
agagaaagaugcugaugug

SEQ ID NO: 1042447 - RNA, 19 nt, Homo sapiens
aaggacagcuuucuauaau

SEQ ID NO: 1042448 - RNA, 19 nt, Homo sapiens
uaaacugacuggcggauca

SEQ ID NO: 1042449 - RNA, 19 nt, Homo sapiens
ggaugaagaaugugaaaga

SEQ ID NO: 1042450 - RNA, 19 nt, Homo sapiens
uagggaauguuaugauuug

SEQ ID NO: 1042451 - RNA, 19 nt, Homo sapiens
ggacagccaucaaaacuug

SEQ ID NO: 1042452 - RNA, 19 nt, Homo sapiens
ucaaguaaauggccaugga

SEQ ID NO: 1042453 - RNA, 19 nt, Homo sapiens
cuauaaaccucuugaugga

SEQ ID NO: 1042454 - RNA, 19 nt, Homo sapiens
ggauuuacagcaugaguuu

SEQ ID NO: 1042455 - RNA, 19 nt, Homo sapiens
ggaguuauguaaagauguc

SEQ ID NO: 1042456 - RNA, 19 nt, Homo sapiens
uuaauugguugguaacuug

SEQ ID NO: 1042457 - RNA, 19 nt, Homo sapiens
gaagaagaguuugaagaac

SEQ ID NO: 1042458 - RNA, 19 nt, Homo sapiens
ucaaggauuuacagcauga

SEQ ID NO: 1042459 - RNA, 19 nt, Homo sapiens
ggaagaaacagugugaaga

SEQ ID NO: 1042460 - RNA, 19 nt, Homo sapiens
gcauaauacacgaacauuu

SEQ ID NO: 1042461 - RNA, 19 nt, Homo sapiens
aaauacaggcgauggaaua

SEQ ID NO: 1042462 - RNA, 19 nt, Homo sapiens
uauaaagcagguacaguua

SEQ ID NO: 1042463 - RNA, 19 nt, Homo sapiens
gaaguuaauaccaauagug

SEQ ID NO: 1042464 - RNA, 19 nt, Homo sapiens
gaagcccuauugugaaauc

SEQ ID NO: 1042465 - RNA, 19 nt, Homo sapiens
guccgaaaguugacugaaa

SEQ ID NO: 1042466 - RNA, 19 nt, Homo sapiens
cgaaggacagcuuucuaua

SEQ ID NO: 1042467 - RNA, 19 nt, Homo sapiens
caggaaccauucaaguaaa

SEQ ID NO: 1042468 - RNA, 19 nt, Homo sapiens
gaagaaugugaaagaauug

SEQ ID NO: 1042469 - RNA, 19 nt, Homo sapiens
gauauggagcuuauaccua

SEQ ID NO: 1042470 - RNA, 19 nt, Homo sapiens
ggacaauggagauacagaa

SEQ ID NO: 1042471 - RNA, 19 nt, Homo sapiens
uaaagcagguacaguuaag

SEQ ID NO: 1042472 - RNA, 19 nt, Homo sapiens
gagcaaggagauuguaaga

SEQ ID NO: 1042473 - RNA, 19 nt, Homo sapiens
gccgguagaucuccuugaa

SEQ ID NO: 1042474 - RNA, 19 nt, Homo sapiens
aaaggcagcuguuguucga

SEQ ID NO: 1042475 - RNA, 19 nt, Homo sapiens
ccaggaacuucuacucgaa

SEQ ID NO: 1042476 - RNA, 19 nt, Homo sapiens
uggaagcccuauugugaaa

SEQ ID NO: 1042477 - RNA, 19 nt, Homo sapiens
ugccugacguuauagauuu

SEQ ID NO: 1042478 - RNA, 19 nt, Homo sapiens
ggaauaaguagaacuaagg

SEQ ID NO: 1042479 - RNA, 19 nt, Homo sapiens
ggaaaacaauacuagagaa

SEQ ID NO: 1042480 - RNA, 19 nt, Homo sapiens
ggaauuaugagucaccaau

SEQ ID NO: 1042481 - RNA, 19 nt, Homo sapiens
uguauuuccugaagaacua

SEQ ID NO: 1042482 - RNA, 19 nt, Homo sapiens
guagggaauguuaugauuu

SEQ ID NO: 1042483 - RNA, 19 nt, Homo sapiens
uaaugaggaugacucugaa

SEQ ID NO: 1042484 - RNA, 19 nt, Homo sapiens
gauaaacgguaaaacagaa

SEQ ID NO: 1042485 - RNA, 19 nt, Homo sapiens
caauggaguuauguaaaga

SEQ ID NO: 1042486 - RNA, 19 nt, Homo sapiens
gaaggaccaucagccuaga

SEQ ID NO: 1042487 - RNA, 19 nt, Homo sapiens
gucaaaguguuaaggagaa

SEQ ID NO: 1042488 - RNA, 19 nt, Homo sapiens
guggugaaauuauacacaa

SEQ ID NO: 1042489 - RNA, 19 nt, Homo sapiens
caucaagcccugaaaggaa

SEQ ID NO: 1042490 - RNA, 19 nt, Homo sapiens
gcagcucuguuuccaguag

SEQ ID NO: 1042491 - RNA, 19 nt, Homo sapiens
gaccaucagccuagaagaa

SEQ ID NO: 1042492 - RNA, 19 nt, Homo sapiens
gcggguuucuucccuaaug

SEQ ID NO: 1042493 - RNA, 19 nt, Homo sapiens
gagcaaaggcagcuguugu

SEQ ID NO: 1042494 - RNA, 19 nt, Homo sapiens
cguuauagauuuccuaguc

SEQ ID NO: 1042495 - RNA, 19 nt, Homo sapiens
guacuuccuucuucaacau

SEQ ID NO: 1042496 - RNA, 19 nt, Homo sapiens
ccuagaagaagauuacgua

SEQ ID NO: 1042497 - RNA, 19 nt, Homo sapiens
ccuggaagcccuauuguga

SEQ ID NO: 1042498 - RNA, 19 nt, Homo sapiens
agacaacaauuugaugaug

SEQ ID NO: 1042499 - RNA, 19 nt, Homo sapiens
caaggagauuguaagaaca

SEQ ID NO: 1042500 - RNA, 19 nt, Homo sapiens
agucauggcacuaggaaua

SEQ ID NO: 1042501 - RNA, 19 nt, Homo sapiens
ugaaacauuccaaagcuuu

SEQ ID NO: 1042502 - RNA, 19 nt, Homo sapiens
cuucaggucugucauagau

SEQ ID NO: 1042503 - RNA, 19 nt, Homo sapiens
gcacaguaguggcauaucc

SEQ ID NO: 1042504 - RNA, 19 nt, Homo sapiens
gaugaguccuugggauaug

SEQ ID NO: 1042505 - RNA, 19 nt, Homo sapiens
uacaggcgauggaauauag

SEQ ID NO: 1042506 - RNA, 19 nt, Homo sapiens
aggaagauuuguuacagaa

SEQ ID NO: 1042507 - RNA, 19 nt, Homo sapiens
gaaaagccagucaaacgua

SEQ ID NO: 1042508 - RNA, 19 nt, Homo sapiens
gaaauaccauaaccaaaag

SEQ ID NO: 1042509 - RNA, 19 nt, Homo sapiens
gaauaaaccaguugaugac

SEQ ID NO: 1042510 - RNA, 19 nt, Homo sapiens
caugauaugccugacguua

SEQ ID NO: 1042511 - RNA, 19 nt, Homo sapiens
gcagaaaccuugucuuauu

SEQ ID NO: 1042512 - RNA, 19 nt, Homo sapiens
gcacuaaccucaacagauu

SEQ ID NO: 1042513 - RNA, 19 nt, Homo sapiens
uuacauagcucaaguguuu

SEQ ID NO: 1042514 - RNA, 19 nt, Homo sapiens
caugaaagcuuuagaguuu

SEQ ID NO: 1042515 - RNA, 19 nt, Homo sapiens
uuaaguagcugguucauuu

SEQ ID NO: 1042516 - RNA, 19 nt, Homo sapiens
gaacuuaacgucuuacaaa

SEQ ID NO: 1042517 - RNA, 19 nt, Homo sapiens
guacaaaugccacaaauaa

SEQ ID NO: 1042518 - RNA, 19 nt, Homo sapiens
gaaccuggcuauucauuug

SEQ ID NO: 1042519 - RNA, 19 nt, Homo sapiens
gggagucggucuuucauua

SEQ ID NO: 1042520 - RNA, 19 nt, Homo sapiens
gcaauguuaucgucauaua

SEQ ID NO: 1042521 - RNA, 19 nt, Homo sapiens
uaaagaaccuggcuauuca

SEQ ID NO: 1042522 - RNA, 19 nt, Homo sapiens
gaaauucagccuauucuuu

SEQ ID NO: 1042523 - RNA, 19 nt, Homo sapiens
ggaaugggcucuguacuug

SEQ ID NO: 1042524 - RNA, 19 nt, Homo sapiens
gaugggagaucucaacuga

SEQ ID NO: 1042525 - RNA, 19 nt, Homo sapiens
gaaaggaaauugaagaacu

SEQ ID NO: 1042526 - RNA, 19 nt, Homo sapiens
caaauagccugcuuagaga

SEQ ID NO: 1042527 - RNA, 19 nt, Homo sapiens
cagaucagcucuaugaauu

SEQ ID NO: 1042528 - RNA, 19 nt, Homo sapiens
ugagaauccuggugaaaua

SEQ ID NO: 1042529 - RNA, 19 nt, Homo sapiens
ccacugaaauuccauguga

SEQ ID NO: 1042530 - RNA, 19 nt, Homo sapiens
gggaagccauccuguuaua

SEQ ID NO: 1042531 - RNA, 19 nt, Homo sapiens
ggaugaagcucuggagaaa

SEQ ID NO: 1042532 - RNA, 19 nt, Homo sapiens
gaagaagacccauauacuu

SEQ ID NO: 1042533 - RNA, 19 nt, Homo sapiens
gaucucaacugaacaggaa

SEQ ID NO: 1042534 - RNA, 19 nt, Homo sapiens
cuaaauaucucucaaagca

SEQ ID NO: 1042535 - RNA, 19 nt, Homo sapiens
cagaaaccuugucuuauuu

SEQ ID NO: 1042536 - RNA, 19 nt, Homo sapiens
cuacgagacugcauuauug

SEQ ID NO: 1042537 - RNA, 19 nt, Homo sapiens
ucaaagaacuuccaacucu

SEQ ID NO: 1042538 - RNA, 19 nt, Homo sapiens
ugaagaagaugcugaggaa

SEQ ID NO: 1042539 - RNA, 19 nt, Homo sapiens
ggaaauaagugagagaaag

SEQ ID NO: 1042540 - RNA, 19 nt, Homo sapiens
caacagaccuacgagcaaa

SEQ ID NO: 1042541 - RNA, 19 nt, Homo sapiens
cauuauaccugcuucauau

SEQ ID NO: 1042542 - RNA, 19 nt, Homo sapiens
uaaggaaacugcccacaau

SEQ ID NO: 1042543 - RNA, 19 nt, Homo sapiens
gagaguuugugccagaaua

SEQ ID NO: 1042544 - RNA, 19 nt, Homo sapiens
gauagagaguccagccuuu

SEQ ID NO: 1042545 - RNA, 19 nt, Homo sapiens
gaauagcauugaagaacuu

SEQ ID NO: 1042546 - RNA, 19 nt, Homo sapiens
gaaguuaaaugcgguguag

SEQ ID NO: 1042547 - RNA, 19 nt, Homo sapiens
ugaaaggcauggucacaaa

SEQ ID NO: 1042548 - RNA, 19 nt, Homo sapiens
agaccuaacuccaaagaaa

SEQ ID NO: 1042549 - RNA, 19 nt, Homo sapiens
gagucggucuuucauuaua

SEQ ID NO: 1042550 - RNA, 19 nt, Homo sapiens
ccaaugaaacagcuaauuu

SEQ ID NO: 1042551 - RNA, 19 nt, Homo sapiens
gaagacaaucugaugauga

SEQ ID NO: 1042552 - RNA, 19 nt, Homo sapiens
ggccagcccuuuggaauaa

SEQ ID NO: 1042553 - RNA, 19 nt, Homo sapiens
gaguagaaauucagccuau

SEQ ID NO: 1042554 - RNA, 19 nt, Homo sapiens
cagugaauaugacaugaua

SEQ ID NO: 1042555 - RNA, 19 nt, Homo sapiens
ucacaaagaacucaagaaa

SEQ ID NO: 1042556 - RNA, 19 nt, Homo sapiens
gaagaacuaucagaagcuu

SEQ ID NO: 1042557 - RNA, 19 nt, Homo sapiens
gcacagagaaguuaaaugc

SEQ ID NO: 1042558 - RNA, 19 nt, Homo sapiens
uaaugaaacucacgaaucu

SEQ ID NO: 1042559 - RNA, 19 nt, Homo sapiens
caacuacgagacugcauua

SEQ ID NO: 1042560 - RNA, 19 nt, Homo sapiens
gaaacuacaccuuacauag

SEQ ID NO: 1042561 - RNA, 19 nt, Homo sapiens
ggaaacuacaccuuacaua

SEQ ID NO: 1042562 - RNA, 19 nt, Homo sapiens
aagaaagucuggugcauga

SEQ ID NO: 1042563 - RNA, 19 nt, Homo sapiens
gaagcaagccugaauuugg

SEQ ID NO: 1042564 - RNA, 19 nt, Homo sapiens
aauguacacuucagcaaua

SEQ ID NO: 1042565 - RNA, 19 nt, Homo sapiens
gaaaguaaagaaugggaaa

SEQ ID NO: 1042566 - RNA, 19 nt, Homo sapiens
gaaagucuggugcaugaaa

SEQ ID NO: 1042567 - RNA, 19 nt, Homo sapiens
ggaaauugaagaacuauca

SEQ ID NO: 1042568 - RNA, 19 nt, Homo sapiens
gaaacugcccacaaugaaa

SEQ ID NO: 1042569 - RNA, 19 nt, Homo sapiens
gaaauuacgacaacuacga

SEQ ID NO: 1042570 - RNA, 19 nt, Homo sapiens
caacugaacaggaacuuga

SEQ ID NO: 1042571 - RNA, 19 nt, Homo sapiens
ucaaauagccugcuuagag

SEQ ID NO: 1042572 - RNA, 19 nt, Homo sapiens
ggagaaauuacgacaacua

SEQ ID NO: 1042573 - RNA, 19 nt, Homo sapiens
gaucaggcauggagaccaa

SEQ ID NO: 1042574 - RNA, 19 nt, Homo sapiens
guucagaucagcucuauga

SEQ ID NO: 1042575 - RNA, 19 nt, Homo sapiens
uaaaugcgguguagcaaag

SEQ ID NO: 1042576 - RNA, 19 nt, Homo sapiens
gaacacggccagcccuuug

SEQ ID NO: 1042577 - RNA, 19 nt, Homo sapiens
caaagauucugaagacuac

SEQ ID NO: 1042578 - RNA, 19 nt, Homo sapiens
aaacagcacagagaaguua

SEQ ID NO: 1042579 - RNA, 19 nt, Homo sapiens
gcaagaaagaucauuaaag

SEQ ID NO: 1042580 - RNA, 19 nt, Homo sapiens
ggaaacugcccacaaugaa

SEQ ID NO: 1042581 - RNA, 19 nt, Homo sapiens
ccacaaguauaccuccaaa

SEQ ID NO: 1042582 - RNA, 19 nt, Homo sapiens
acaaugcacuucaccaaug

SEQ ID NO: 1042583 - RNA, 19 nt, Homo sapiens
ggaggaagaagacccauau

SEQ ID NO: 1042584 - RNA, 19 nt, Homo sapiens
ggagcaaccugggcaucua

SEQ ID NO: 1042585 - RNA, 19 nt, Homo sapiens
gauggaaucguuaaagcua

SEQ ID NO: 1042586 - RNA, 19 nt, Homo sapiens
uaugaugacuuguaugugu

SEQ ID NO: 1042587 - RNA, 19 nt, Homo sapiens
gcagugagaguucugaaga

SEQ ID NO: 1042588 - RNA, 19 nt, Homo sapiens
gagaaaggaaauugaagaa

SEQ ID NO: 1042589 - RNA, 19 nt, Homo sapiens
uggauugccugcucucuuu

SEQ ID NO: 1042590 - RNA, 19 nt, Homo sapiens
ucacgaaucuacggacauu

SEQ ID NO: 1042591 - RNA, 19 nt, Homo sapiens
aagaagacccauauacuuu

SEQ ID NO: 1042592 - RNA, 19 nt, Homo sapiens
cguuaaagcuacaaccaaa

SEQ ID NO: 1042593 - RNA, 19 nt, Homo sapiens
caaugcacuucaccaauga

SEQ ID NO: 1042594 - RNA, 19 nt, Homo sapiens
agacagagcucggauagag

SEQ ID NO: 1042595 - RNA, 19 nt, Homo sapiens
ggaagaagacccauauacu

SEQ ID NO: 1042596 - RNA, 19 nt, Homo sapiens
ccaguaugaugacuuguau

SEQ ID NO: 1042597 - RNA, 19 nt, Homo sapiens
uaucagaagcuucaagaaa

SEQ ID NO: 1042598 - RNA, 19 nt, Homo sapiens
aacaggaacuugaagacua

SEQ ID NO: 1042599 - RNA, 19 nt, Homo sapiens
gaagcucuggagaaauuua

SEQ ID NO: 1042600 - RNA, 19 nt, Homo sapiens
gaaaaugucuauggaugaa

SEQ ID NO: 1042601 - RNA, 19 nt, Homo sapiens
gaaaccuugucuuauuuag

SEQ ID NO: 1042602 - RNA, 19 nt, Homo sapiens
gaauuugguuucuguugca

SEQ ID NO: 1042603 - RNA, 19 nt, Homo sapiens
caaauggaaagaagucaaa

SEQ ID NO: 1042604 - RNA, 19 nt, Homo sapiens
ucaaagauucugaagacua

SEQ ID NO: 1042605 - RNA, 19 nt, Homo sapiens
guaguuacuuugcuuugug

SEQ ID NO: 1042606 - RNA, 19 nt, Homo sapiens
augaagcucuggagaaauu

SEQ ID NO: 1042607 - RNA, 19 nt, Homo sapiens
gaucagcucuaugaauuac

SEQ ID NO: 1042608 - RNA, 19 nt, Homo sapiens
aagggaagccauccuguua

SEQ ID NO: 1042609 - RNA, 19 nt, Homo sapiens
aaaggaauuugguuucugu

SEQ ID NO: 1042610 - RNA, 19 nt, Homo sapiens
gaaaaggccagaagaagaa

SEQ ID NO: 1042611 - RNA, 19 nt, Homo sapiens
gcacauagauggcuaauca

SEQ ID NO: 1042612 - RNA, 19 nt, Homo sapiens
gcaaacagcuccugaaacu

SEQ ID NO: 1042613 - RNA, 19 nt, Homo sapiens
gaaagggcaugaacuuagu

SEQ ID NO: 1042614 - RNA, 19 nt, Homo sapiens
uuugaaaggugacaugaua

SEQ ID NO: 1042615 - RNA, 19 nt, Homo sapiens
uagagauggugaagaauaa

SEQ ID NO: 1042616 - RNA, 19 nt, Homo sapiens
ggaaagggcaugaacuuag

SEQ ID NO: 1042617 - RNA, 19 nt, Homo sapiens
ggacaucgcggcucugugu

SEQ ID NO: 1042618 - RNA, 19 nt, Homo sapiens
uaaugaacaucucugaguu

SEQ ID NO: 1042619 - RNA, 19 nt, Homo sapiens
gaagucagaucucauugcu

SEQ ID NO: 1042620 - RNA, 19 nt, Homo sapiens
gauguuguguguucuggaa

SEQ ID NO: 1042621 - RNA, 19 nt, Homo sapiens
aaucuuggcuggaauuuca

SEQ ID NO: 1042622 - RNA, 19 nt, Homo sapiens
gugaucaacuggaagauuc

SEQ ID NO: 1042623 - RNA, 19 nt, Homo sapiens
gcaaauuaaugaacaucuc

SEQ ID NO: 1042624 - RNA, 19 nt, Homo sapiens
cauagauggcuaaucaaua

SEQ ID NO: 1042625 - RNA, 19 nt, Homo sapiens
aaagacauuucggaaguuu

SEQ ID NO: 1042626 - RNA, 19 nt, Homo sapiens
ccagauagccuuucuuagg

SEQ ID NO: 1042627 - RNA, 19 nt, Homo sapiens
auucuaggguccucaauuu

SEQ ID NO: 1042628 - RNA, 19 nt, Homo sapiens
gggcaaacagcuccugaaa

SEQ ID NO: 1042629 - RNA, 19 nt, Homo sapiens
agagagugaucaacuggaa

SEQ ID NO: 1042630 - RNA, 19 nt, Homo sapiens
ggaauuucaccaucaggaa

SEQ ID NO: 1042631 - RNA, 19 nt, Homo sapiens
ugaaacggcagaaucagaa

SEQ ID NO: 1042632 - RNA, 19 nt, Homo sapiens
gcugugaccugucuuucuc

SEQ ID NO: 1042633 - RNA, 19 nt, Homo sapiens
gaaguucuugcuccuguug

SEQ ID NO: 1042634 - RNA, 19 nt, Homo sapiens
gcacauggagagagugauc

SEQ ID NO: 1042635 - RNA, 19 nt, Homo sapiens
auagagauggugaagaaua

SEQ ID NO: 1042636 - RNA, 19 nt, Homo sapiens
ucauugcugugguuucuau

SEQ ID NO: 1042637 - RNA, 19 nt, Homo sapiens
guuucggucuccugucuaa

SEQ ID NO: 1042638 - RNA, 19 nt, Homo sapiens
gaauuucaccaucaggaau

SEQ ID NO: 1042639 - RNA, 19 nt, Homo sapiens
uaaaagagugccccagaua

SEQ ID NO: 1042640 - RNA, 19 nt, Homo sapiens
gaguuucggucuccugucu

SEQ ID NO: 1042641 - RNA, 19 nt, Homo sapiens
ggccacggcaaauuaauga

SEQ ID NO: 1042642 - RNA, 19 nt, Homo sapiens
gaauaagggagguagugau

SEQ ID NO: 1042643 - RNA, 19 nt, Homo sapiens
ggcagaaucagaagagguu

SEQ ID NO: 1042644 - RNA, 19 nt, Homo sapiens
cagaaaaucuuggcuggaa

SEQ ID NO: 1042645 - RNA, 19 nt, Homo sapiens
gugauaauagcuucuugaa

SEQ ID NO: 1042646 - RNA, 19 nt, Homo sapiens
gauucuaggguccucaauu

SEQ ID NO: 1042647 - RNA, 19 nt, Homo sapiens
uaagggagguagugaucgu

SEQ ID NO: 1042648 - RNA, 19 nt, Homo sapiens
ggugauaauagcuucuuga

SEQ ID NO: 1042649 - RNA, 19 nt, Homo sapiens
gaaaaucuuggcuggaauu

SEQ ID NO: 1042650 - RNA, 19 nt, Homo sapiens
guguggccacggcaaauua

SEQ ID NO: 1042651 - RNA, 19 nt, Homo sapiens
uggaaagggcaugaacuua

SEQ ID NO: 1042652 - RNA, 19 nt, Homo sapiens
gacaugauacccuggaaag

SEQ ID NO: 1042653 - RNA, 19 nt, Homo sapiens
gaaagaggcuggggcacau

SEQ ID NO: 1042654 - RNA, 19 nt, Homo sapiens
uggaaugccuggccucucu

SEQ ID NO: 1042655 - RNA, 19 nt, Homo sapiens
gugaaacggcagaaucaga

SEQ ID NO: 1042656 - RNA, 19 nt, Homo sapiens
gguagggguuccuuccaua

SEQ ID NO: 1042657 - RNA, 19 nt, Homo sapiens
acaggucgcaggaaucuug

SEQ ID NO: 1042658 - RNA, 19 nt, Homo sapiens
ggucuccugucuaaaauga

SEQ ID NO: 1042659 - RNA, 19 nt, Homo sapiens
uuaaugaacaucucugagu

SEQ ID NO: 1042660 - RNA, 19 nt, Homo sapiens
ucaguucguccuugccuuu

SEQ ID NO: 1042661 - RNA, 19 nt, Homo sapiens
ccuggggccuugcaaauaa

SEQ ID NO: 1042662 - RNA, 19 nt, Homo sapiens
agacucaguuucccaugca

SEQ ID NO: 1042663 - RNA, 19 nt, Homo sapiens
cauggguggugcagacuca

SEQ ID NO: 1042664 - RNA, 19 nt, Homo sapiens
cgaaguucuugcuccuguu

SEQ ID NO: 1042665 - RNA, 19 nt, Homo sapiens
ggucgcaggaaucuuguug

SEQ ID NO: 1042666 - RNA, 19 nt, Homo sapiens
aaugaacaucucugaguuu

SEQ ID NO: 1042667 - RNA, 19 nt, Homo sapiens
ugugacaggucgcaggaau

SEQ ID NO: 1042668 - RNA, 19 nt, Homo sapiens
gaucaacuggaagauucua

SEQ ID NO: 1042669 - RNA, 19 nt, Homo sapiens
cagugaaacggcagaauca

SEQ ID NO: 1042670 - RNA, 19 nt, Homo sapiens
cacggcaaauuaaugaaca

SEQ ID NO: 1042671 - RNA, 19 nt, Homo sapiens
gggcacauggagagaguga

SEQ ID NO: 1042672 - RNA, 19 nt, Homo sapiens
gaagaauaagggagguagu

SEQ ID NO: 1042673 - RNA, 19 nt, Homo sapiens
ucagugaaacggcagaauc

SEQ ID NO: 1042674 - RNA, 19 nt, Homo sapiens
aaaaugaggugauaauagc

SEQ ID NO: 1042675 - RNA, 19 nt, Homo sapiens
auccagauguuguguguuc

SEQ ID NO: 1042676 - RNA, 19 nt, Homo sapiens
ggcuggaauuucaccauca

SEQ ID NO: 1042677 - RNA, 19 nt, Homo sapiens
caucaggaauaaaacagaa

SEQ ID NO: 1042678 - RNA, 19 nt, Homo sapiens
aauuucaccaucaggaaua

SEQ ID NO: 1042679 - RNA, 19 nt, Homo sapiens
ugacaugauacccuggaaa

SEQ ID NO: 1042680 - RNA, 19 nt, Homo sapiens
uggagagagugaucaacug

SEQ ID NO: 1042681 - RNA, 19 nt, Homo sapiens
ggaguugcuaccugucuuc

SEQ ID NO: 1042682 - RNA, 19 nt, Homo sapiens
ugucuaaaaugaggugaua

SEQ ID NO: 1042683 - RNA, 19 nt, Homo sapiens
ucucauugcugugguuucu

SEQ ID NO: 1042684 - RNA, 19 nt, Homo sapiens
ucgcaggaaucuuguuggu

SEQ ID NO: 1042685 - RNA, 19 nt, Homo sapiens
gaaacggcagaaucagaag

SEQ ID NO: 1042686 - RNA, 19 nt, Homo sapiens
agagugaucaacuggaaga

SEQ ID NO: 1042687 - RNA, 19 nt, Homo sapiens
gcuggaauuucaccaucag

SEQ ID NO: 1042688 - RNA, 19 nt, Homo sapiens
agaauaagggagguaguga

SEQ ID NO: 1042689 - RNA, 19 nt, Homo sapiens
acauagauggcuaaucaau

SEQ ID NO: 1042690 - RNA, 19 nt, Homo sapiens
ggagguagugaucgucucu

SEQ ID NO: 1042691 - RNA, 19 nt, Homo sapiens
gaucucauugcugugguuu

SEQ ID NO: 1042692 - RNA, 19 nt, Homo sapiens
gaaucuuguuggugaucca

SEQ ID NO: 1042693 - RNA, 19 nt, Homo sapiens
gugacaugauacccuggaa

SEQ ID NO: 1042694 - RNA, 19 nt, Homo sapiens
ggacgaagcuuauucauua

SEQ ID NO: 1042695 - RNA, 19 nt, Homo sapiens
gaagugcacucucucauua

SEQ ID NO: 1042696 - RNA, 19 nt, Homo sapiens
uaaagugcauguuaccuua

SEQ ID NO: 1042697 - RNA, 19 nt, Homo sapiens
guagccaacuugacaaaua

SEQ ID NO: 1042698 - RNA, 19 nt, Homo sapiens
gaacugggcaugaaacauu

SEQ ID NO: 1042699 - RNA, 19 nt, Homo sapiens
caaguggcauccuacaaua

SEQ ID NO: 1042700 - RNA, 19 nt, Homo sapiens
acacauagcuuuaaaccau

SEQ ID NO: 1042701 - RNA, 19 nt, Homo sapiens
uaaacuggauguugcuuaa

SEQ ID NO: 1042702 - RNA, 19 nt, Homo sapiens
aaacgaaacuccaucuaug

SEQ ID NO: 1042703 - RNA, 19 nt, Homo sapiens
ugaaaccacucuacgcuaa

SEQ ID NO: 1042704 - RNA, 19 nt, Homo sapiens
gaaacgaaacuccaucuau

SEQ ID NO: 1042705 - RNA, 19 nt, Homo sapiens
uacaauaccuacuaccaua

SEQ ID NO: 1042706 - RNA, 19 nt, Homo sapiens
guacugaacugggcaugaa

SEQ ID NO: 1042707 - RNA, 19 nt, Homo sapiens
acaggaggguaccuaauua

SEQ ID NO: 1042708 - RNA, 19 nt, Homo sapiens
gucgugauaugaauuguua

SEQ ID NO: 1042709 - RNA, 19 nt, Homo sapiens
ugaagcaccugguuuauag

SEQ ID NO: 1042710 - RNA, 19 nt, Homo sapiens
gaaauacacagcaacaugu

SEQ ID NO: 1042711 - RNA, 19 nt, Homo sapiens
ucuacuacauguugcauua

SEQ ID NO: 1042712 - RNA, 19 nt, Homo sapiens
ggacuugcauuacccuaug

SEQ ID NO: 1042713 - RNA, 19 nt, Homo sapiens
ccacgaggguuaugaggaa

SEQ ID NO: 1042714 - RNA, 19 nt, Homo sapiens
uaaagucagucccuaagga

SEQ ID NO: 1042715 - RNA, 19 nt, Homo sapiens
gaagugugguugccaucuu

SEQ ID NO: 1042716 - RNA, 19 nt, Homo sapiens
gcuuaugacuuucagcauu

SEQ ID NO: 1042717 - RNA, 19 nt, Homo sapiens
gauuagagguagcgcaaau

SEQ ID NO: 1042718 - RNA, 19 nt, Homo sapiens
gaggguaccuaauuagaca

SEQ ID NO: 1042719 - RNA, 19 nt, Homo sapiens
guagguauuuguacaguuc

SEQ ID NO: 1042720 - RNA, 19 nt, Homo sapiens
ugacagcauucaagauuau

SEQ ID NO: 1042721 - RNA, 19 nt, Homo sapiens
gaaacuguauaaacuggau

SEQ ID NO: 1042722 - RNA, 19 nt, Homo sapiens
ccucuggacuuucugauga

SEQ ID NO: 1042723 - RNA, 19 nt, Homo sapiens
gcugugaccucuacaacug

SEQ ID NO: 1042724 - RNA, 19 nt, Homo sapiens
gcuaaccggugccauuaug

SEQ ID NO: 1042725 - RNA, 19 nt, Homo sapiens
aagauucuauggcucauuu

SEQ ID NO: 1042726 - RNA, 19 nt, Homo sapiens
caucaugaauguucuuauc

SEQ ID NO: 1042727 - RNA, 19 nt, Homo sapiens
uauguuaaccugagaauug

SEQ ID NO: 1042728 - RNA, 19 nt, Homo sapiens
ggagacagugguucuacua

SEQ ID NO: 1042729 - RNA, 19 nt, Homo sapiens
gguugaagcaccugguuua

SEQ ID NO: 1042730 - RNA, 19 nt, Homo sapiens
cugaugaguuuaaagcuuu

SEQ ID NO: 1042731 - RNA, 19 nt, Homo sapiens
guagaucacuuaggagaca

SEQ ID NO: 1042732 - RNA, 19 nt, Homo sapiens
ccaggcagcuagagagguu

SEQ ID NO: 1042733 - RNA, 19 nt, Homo sapiens
ccaacugacuaacuaaaca

SEQ ID NO: 1042734 - RNA, 19 nt, Homo sapiens
agacugcccguaucucuua

SEQ ID NO: 1042735 - RNA, 19 nt, Homo sapiens
caugacagcauucaagauu

SEQ ID NO: 1042736 - RNA, 19 nt, Homo sapiens
guucuugggucgugauaug

SEQ ID NO: 1042737 - RNA, 19 nt, Homo sapiens
auacccaacugacuaacua

SEQ ID NO: 1042738 - RNA, 19 nt, Homo sapiens
ugccuucacuucagaauga

SEQ ID NO: 1042739 - RNA, 19 nt, Homo sapiens
cagaagggcagcucacauu

SEQ ID NO: 1042740 - RNA, 19 nt, Homo sapiens
gucagcaguugccaagaua

SEQ ID NO: 1042741 - RNA, 19 nt, Homo sapiens
uagccaacuugacaaauau

SEQ ID NO: 1042742 - RNA, 19 nt, Homo sapiens
gguuguaauucagaguuua

SEQ ID NO: 1042743 - RNA, 19 nt, Homo sapiens
ugaauguucuuauccagau

SEQ ID NO: 1042744 - RNA, 19 nt, Homo sapiens
guaccuaauuagacaguuc

SEQ ID NO: 1042745 - RNA, 19 nt, Homo sapiens
aaacguagccaacuugaca

SEQ ID NO: 1042746 - RNA, 19 nt, Homo sapiens
gaccagucaugacagcauu

SEQ ID NO: 1042747 - RNA, 19 nt, Homo sapiens
ggaaacgaaacuccaucua

SEQ ID NO: 1042748 - RNA, 19 nt, Homo sapiens
gcuugugucuggauguuga

SEQ ID NO: 1042749 - RNA, 19 nt, Homo sapiens
cacaguuuauccuacauuu

SEQ ID NO: 1042750 - RNA, 19 nt, Homo sapiens
acacuuagccaucaagaau

SEQ ID NO: 1042751 - RNA, 19 nt, Homo sapiens
cugaggaggucauaaguuc

SEQ ID NO: 1042752 - RNA, 19 nt, Homo sapiens
caacuuguaauacucaaug

SEQ ID NO: 1042753 - RNA, 19 nt, Homo sapiens
uuacaguucugagcauauu

SEQ ID NO: 1042754 - RNA, 19 nt, Homo sapiens
gaauguucuuauccagauu

SEQ ID NO: 1042755 - RNA, 19 nt, Homo sapiens
agacaguucuccaaacaca

SEQ ID NO: 1042756 - RNA, 19 nt, Homo sapiens
ccucaaacguagccaacuu

SEQ ID NO: 1042757 - RNA, 19 nt, Homo sapiens
gagaggcaaccgcggagua

SEQ ID NO: 1042758 - RNA, 19 nt, Homo sapiens
ccugagaauugauuuaaag

SEQ ID NO: 1042759 - RNA, 19 nt, Homo sapiens
ugaaauacacagcaacaug

SEQ ID NO: 1042760 - RNA, 19 nt, Homo sapiens
ccaaguggcauccuacaau

SEQ ID NO: 1042761 - RNA, 19 nt, Homo sapiens
ccugaaacaguauagauuu

SEQ ID NO: 1042762 - RNA, 19 nt, Homo sapiens
caaaauaaccugaaacagu

SEQ ID NO: 1042763 - RNA, 19 nt, Homo sapiens
caccuucauugugaucuua

SEQ ID NO: 1042764 - RNA, 19 nt, Homo sapiens
ccaaaagagucaucuguau

SEQ ID NO: 1042765 - RNA, 19 nt, Homo sapiens
gacagugguucuacuacau

SEQ ID NO: 1042766 - RNA, 19 nt, Homo sapiens
acacugaaauacacagcaa

SEQ ID NO: 1042767 - RNA, 19 nt, Homo sapiens
gaaaagugcaauauucuug

SEQ ID NO: 1042768 - RNA, 19 nt, Homo sapiens
gacgaagcuuauucauuau

SEQ ID NO: 1042769 - RNA, 19 nt, Homo sapiens
gggacgaagcuuauucauu

SEQ ID NO: 1042770 - RNA, 19 nt, Homo sapiens
cacaagaagugcacucucu

SEQ ID NO: 1042771 - RNA, 19 nt, Homo sapiens
gaacacacacuggaaaauu

SEQ ID NO: 1042772 - RNA, 19 nt, Homo sapiens
uuagacaguucuccaaaca

SEQ ID NO: 1042773 - RNA, 19 nt, Homo sapiens
caccgugacuuugcuuauu

SEQ ID NO: 1042774 - RNA, 19 nt, Homo sapiens
agagaguucuggcuaagau

SEQ ID NO: 1042775 - RNA, 19 nt, Homo sapiens
uccaacaguuucuuacuau

SEQ ID NO: 1042776 - RNA, 19 nt, Homo sapiens
ccaccauccucaacauugu

SEQ ID NO: 1042777 - RNA, 19 nt, Homo sapiens
cauaaguuccucaaccaaa

SEQ ID NO: 1042778 - RNA, 19 nt, Homo sapiens
caaaccuuauugagaacaa

SEQ ID NO: 1042779 - RNA, 19 nt, Homo sapiens
uuacacaguuuauccuaca

SEQ ID NO: 1042780 - RNA, 19 nt, Homo sapiens
uuuaucagcuuugguguga

SEQ ID NO: 1042781 - RNA, 19 nt, Homo sapiens
aucauuggaucaaaccuua

SEQ ID NO: 1042782 - RNA, 19 nt, Homo sapiens
ccucccaacuugauggauu

SEQ ID NO: 1042783 - RNA, 19 nt, Homo sapiens
uggcuucuaucguguuuau

SEQ ID NO: 1042784 - RNA, 19 nt, Homo sapiens
uccagaaacuguauaaacu

SEQ ID NO: 1042785 - RNA, 19 nt, Homo sapiens
cuaauacccaacugacuaa

SEQ ID NO: 1042786 - RNA, 19 nt, Homo sapiens
gguagguauuuguacaguu

SEQ ID NO: 1042787 - RNA, 19 nt, Homo sapiens
gcacaccgugguagguauu

SEQ ID NO: 1042788 - RNA, 19 nt, Homo sapiens
ggagccagcccagcaagaa

SEQ ID NO: 1042789 - RNA, 19 nt, Homo sapiens
gggcagcucacauucucua

SEQ ID NO: 1042790 - RNA, 19 nt, Homo sapiens
aggaaugccugcuggcuau

SEQ ID NO: 1042791 - RNA, 19 nt, Homo sapiens
caguaaauguuugcaagau

SEQ ID NO: 1042792 - RNA, 19 nt, Homo sapiens
guagacacuuagccaucaa

SEQ ID NO: 1042793 - RNA, 19 nt, Homo sapiens
ccugaugaguuuaaagcuu

SEQ ID NO: 1042794 - RNA, 19 nt, Homo sapiens
gaaagagccucgauucaaa

SEQ ID NO: 1042795 - RNA, 19 nt, Homo sapiens
ucagguagcucuuaacuaa

SEQ ID NO: 1042796 - RNA, 19 nt, Homo sapiens
ggaaggaauuucucauaaa

SEQ ID NO: 1042797 - RNA, 19 nt, Homo sapiens
caaagaagaugguacacuu

SEQ ID NO: 1042798 - RNA, 19 nt, Homo sapiens
gagccucgauucaaauuaa

SEQ ID NO: 1042799 - RNA, 19 nt, Homo sapiens
cauggaaucucuucuauug

SEQ ID NO: 1042800 - RNA, 19 nt, Homo sapiens
gauugaagaugaugaaaug

SEQ ID NO: 1042801 - RNA, 19 nt, Homo sapiens
gaagggagagguaacuaua

SEQ ID NO: 1042802 - RNA, 19 nt, Homo sapiens
ggaaaccuuugauuagaaa

SEQ ID NO: 1042803 - RNA, 19 nt, Homo sapiens
gagagagacuauagcauug

SEQ ID NO: 1042804 - RNA, 19 nt, Homo sapiens
gaacauagccaaugagacu

SEQ ID NO: 1042805 - RNA, 19 nt, Homo sapiens
ccaaaguauucaaugcuua

SEQ ID NO: 1042806 - RNA, 19 nt, Homo sapiens
gugaugacauggugacuaa

SEQ ID NO: 1042807 - RNA, 19 nt, Homo sapiens
ccaacuaccucaucccaaa

SEQ ID NO: 1042808 - RNA, 19 nt, Homo sapiens
ggaaauuauugucaacaug

SEQ ID NO: 1042809 - RNA, 19 nt, Homo sapiens
gaacugagagagacuauag

SEQ ID NO: 1042810 - RNA, 19 nt, Homo sapiens
gaucuuaucugaaguuuug

SEQ ID NO: 1042811 - RNA, 19 nt, Homo sapiens
ggacuggauucaaaugaga

SEQ ID NO: 1042812 - RNA, 19 nt, Homo sapiens
gcuguaacaucacuucuug

SEQ ID NO: 1042813 - RNA, 19 nt, Homo sapiens
uaucugcucugaaagaauu

SEQ ID NO: 1042814 - RNA, 19 nt, Homo sapiens
gaagaugguacacuugaaa

SEQ ID NO: 1042815 - RNA, 19 nt, Homo sapiens
gaaagugacgcauuuaugg

SEQ ID NO: 1042816 - RNA, 19 nt, Homo sapiens
ugaccuggcuauuucagua

SEQ ID NO: 1042817 - RNA, 19 nt, Homo sapiens
gaucagcuguguguucuug

SEQ ID NO: 1042818 - RNA, 19 nt, Homo sapiens
agacugcucuggaaauuau

SEQ ID NO: 1042819 - RNA, 19 nt, Homo sapiens
uggaaggaauuucucauaa

SEQ ID NO: 1042820 - RNA, 19 nt, Homo sapiens
gcaguugaccuauguucua

SEQ ID NO: 1042821 - RNA, 19 nt, Homo sapiens
acacggcucucaccaacua

SEQ ID NO: 1042822 - RNA, 19 nt, Homo sapiens
gagaauuccuucagugagu

SEQ ID NO: 1042823 - RNA, 19 nt, Homo sapiens
gcaaugaagaucccucuga

SEQ ID NO: 1042824 - RNA, 19 nt, Homo sapiens
gggaugauuugauugaaga

SEQ ID NO: 1042825 - RNA, 19 nt, Homo sapiens
gggaauggaugcuggugaa

SEQ ID NO: 1042826 - RNA, 19 nt, Homo sapiens
gaaguuaccaccaaagauc

SEQ ID NO: 1042827 - RNA, 19 nt, Homo sapiens
ugaugaaagugacgcauuu

SEQ ID NO: 1042828 - RNA, 19 nt, Homo sapiens
gugcuggacuggauucaaa

SEQ ID NO: 1042829 - RNA, 19 nt, Homo sapiens
gugaagaaguaaaugaguu

SEQ ID NO: 1042830 - RNA, 19 nt, Homo sapiens
uggaaucucuucuauugaa

SEQ ID NO: 1042831 - RNA, 19 nt, Homo sapiens
gaagacaagcuuuauaaac

SEQ ID NO: 1042832 - RNA, 19 nt, Homo sapiens
caaacagcauugcaguuga

SEQ ID NO: 1042833 - RNA, 19 nt, Homo sapiens
gaggaaauauuagagaaca

SEQ ID NO: 1042834 - RNA, 19 nt, Homo sapiens
gagucaagcagaaaucaua

SEQ ID NO: 1042835 - RNA, 19 nt, Homo sapiens
guuuggagauuguguuaaa

SEQ ID NO: 1042836 - RNA, 19 nt, Homo sapiens
gcgaagauuuauugcuuau

SEQ ID NO: 1042837 - RNA, 19 nt, Homo sapiens
cagagcugcugaagucuuu

SEQ ID NO: 1042838 - RNA, 19 nt, Homo sapiens
caaagauccuucccuugug

SEQ ID NO: 1042839 - RNA, 19 nt, Homo sapiens
ccaaagauccuucccuugu

SEQ ID NO: 1042840 - RNA, 19 nt, Homo sapiens
caacaugugcugcaaugaa

SEQ ID NO: 1042841 - RNA, 19 nt, Homo sapiens
ugaagaugaugaaauggaa

SEQ ID NO: 1042842 - RNA, 19 nt, Homo sapiens
ugagagagacuauagcauu

SEQ ID NO: 1042843 - RNA, 19 nt, Homo sapiens
ugacuuugaugaguuauug

SEQ ID NO: 1042844 - RNA, 19 nt, Homo sapiens
cgaaagagccucgauucaa

SEQ ID NO: 1042845 - RNA, 19 nt, Homo sapiens
ggcacaauuuggaaucuaa

SEQ ID NO: 1042846 - RNA, 19 nt, Homo sapiens
agacugacuucuuaaacaa

SEQ ID NO: 1042847 - RNA, 19 nt, Homo sapiens
gcagcguccuugccaaaga

SEQ ID NO: 1042848 - RNA, 19 nt, Homo sapiens
gaaggguguuuggagauug

SEQ ID NO: 1042849 - RNA, 19 nt, Homo sapiens
gaaagaaaauccaaagcau

SEQ ID NO: 1042850 - RNA, 19 nt, Homo sapiens
ugagaucuguguggcauuu

SEQ ID NO: 1042851 - RNA, 19 nt, Homo sapiens
caaugaagaucccucugau

SEQ ID NO: 1042852 - RNA, 19 nt, Homo sapiens
gaaauaugaagacaagcuu

SEQ ID NO: 1042853 - RNA, 19 nt, Homo sapiens
ugcagaggcugaggaaaua

SEQ ID NO: 1042854 - RNA, 19 nt, Homo sapiens
aagcagaaaucauaaaugc

SEQ ID NO: 1042855 - RNA, 19 nt, Homo sapiens
gcaaagcaggcauucauag

SEQ ID NO: 1042856 - RNA, 19 nt, Homo sapiens
cuaaacauguugacuuucu

SEQ ID NO: 1042857 - RNA, 19 nt, Homo sapiens
ccaaacagcauugcaguug

SEQ ID NO: 1042858 - RNA, 19 nt, Homo sapiens
gaugaaagugacgcauuua

SEQ ID NO: 1042859 - RNA, 19 nt, Homo sapiens
guaaagaagggagagguaa

SEQ ID NO: 1042860 - RNA, 19 nt, Homo sapiens
aaagcaggcauucauagua

SEQ ID NO: 1042861 - RNA, 19 nt, Homo sapiens
cauaaaugccuuacuaaag

SEQ ID NO: 1042862 - RNA, 19 nt, Homo sapiens
gaacgugcuguggaauaua

SEQ ID NO: 1042863 - RNA, 19 nt, Homo sapiens
agguagcucuuaacuaauu

SEQ ID NO: 1042864 - RNA, 19 nt, Homo sapiens
uuuaaucacuggaaacuca

SEQ ID NO: 1042865 - RNA, 19 nt, Homo sapiens
gcagcaacggaccuuguua

SEQ ID NO: 1042866 - RNA, 19 nt, Homo sapiens
uaagaacauugggugcuuu

SEQ ID NO: 1042867 - RNA, 19 nt, Homo sapiens
aaacaauggccuccaagaa

SEQ ID NO: 1042868 - RNA, 19 nt, Homo sapiens
gacaagcuuuauaaacuag

SEQ ID NO: 1042869 - RNA, 19 nt, Homo sapiens
cuagcgcucucuaaauuau

SEQ ID NO: 1042870 - RNA, 19 nt, Homo sapiens
gaugcccucuuugauguuu

SEQ ID NO: 1042871 - RNA, 19 nt, Homo sapiens
acaauggccuccaagaaca

SEQ ID NO: 1042872 - RNA, 19 nt, Homo sapiens
uggaaaccuuugauuagaa

SEQ ID NO: 1042873 - RNA, 19 nt, Homo sapiens
gcauugcaguugaccuaug

SEQ ID NO: 1042874 - RNA, 19 nt, Homo sapiens
gagaacauagccaaugaga

SEQ ID NO: 1042875 - RNA, 19 nt, Homo sapiens
aaucucagguagcucuuaa

SEQ ID NO: 1042876 - RNA, 19 nt, Homo sapiens
caccgugccuggccagaaa

SEQ ID NO: 1042877 - RNA, 19 nt, Homo sapiens
gcaggcauucauaguagua

SEQ ID NO: 1042878 - RNA, 19 nt, Homo sapiens
cauguugacuuucuagaag

SEQ ID NO: 1042879 - RNA, 19 nt, Homo sapiens
uggagauuguguuaaagua

SEQ ID NO: 1042880 - RNA, 19 nt, Homo sapiens
ugaacgugcuguggaauau

SEQ ID NO: 1042881 - RNA, 19 nt, Homo sapiens
gaauugggagaagguauuu

SEQ ID NO: 1042882 - RNA, 19 nt, Homo sapiens
aaagaagagucagaaggaa

SEQ ID NO: 1042883 - RNA, 19 nt, Homo sapiens
gcugaaacgcaaagguuaa

SEQ ID NO: 1042884 - RNA, 19 nt, Homo sapiens
ggagauuguguuaaaguau

SEQ ID NO: 1042885 - RNA, 19 nt, Homo sapiens
gauauggaaucagaauugg

SEQ ID NO: 1042886 - RNA, 19 nt, Homo sapiens
gaacauugggugcuuucug

SEQ ID NO: 1042887 - RNA, 19 nt, Homo sapiens
gcugaugacauuaugcaaa

SEQ ID NO: 1042888 - RNA, 19 nt, Homo sapiens
ugcuaaacauguugacuuu

SEQ ID NO: 1042889 - RNA, 19 nt, Homo sapiens
ugaaguuugugaugacaug

SEQ ID NO: 1042890 - RNA, 19 nt, Homo sapiens
gcaagagucaagcagaaau

SEQ ID NO: 1042891 - RNA, 19 nt, Homo sapiens
ggaaucagaauugggagaa

SEQ ID NO: 1042892 - RNA, 19 nt, Homo sapiens
aauggaugcuggugaaaug

SEQ ID NO: 1042893 - RNA, 19 nt, Homo sapiens
cagcaacggaccuuguuaa

SEQ ID NO: 1042894 - RNA, 19 nt, Homo sapiens
gaacgaagcucaacucaua

SEQ ID NO: 1042895 - RNA, 19 nt, Homo sapiens
gaaagacucucacaaguuu

SEQ ID NO: 1042896 - RNA, 19 nt, Homo sapiens
caaaggaaaugcagagaaa

SEQ ID NO: 1042897 - RNA, 19 nt, Homo sapiens
gaaagucgauguaauccuu

SEQ ID NO: 1042898 - RNA, 19 nt, Homo sapiens
ggaauaggaugagugauaa

SEQ ID NO: 1042899 - RNA, 19 nt, Homo sapiens
ggagacgacuuaccaguuu

SEQ ID NO: 1042900 - RNA, 19 nt, Homo sapiens
aaagagaacuugccaaaga

SEQ ID NO: 1042901 - RNA, 19 nt, Homo sapiens
ggaaagaguuagagacaga

SEQ ID NO: 1042902 - RNA, 19 nt, Homo sapiens
gacaggaacuucuaguaaa

SEQ ID NO: 1042903 - RNA, 19 nt, Homo sapiens
gaauggaaguguguccuua

SEQ ID NO: 1042904 - RNA, 19 nt, Homo sapiens
gaacacagaaucccucauu

SEQ ID NO: 1042905 - RNA, 19 nt, Homo sapiens
gaagccauuuaaacgauua

SEQ ID NO: 1042906 - RNA, 19 nt, Homo sapiens
ggaaagaccacauuuaagu

SEQ ID NO: 1042907 - RNA, 19 nt, Homo sapiens
ggaaugcaaugacccagaa

SEQ ID NO: 1042908 - RNA, 19 nt, Homo sapiens
gggaauaggaugagugaua

SEQ ID NO: 1042909 - RNA, 19 nt, Homo sapiens
ccacugaauugcccuguaa

SEQ ID NO: 1042910 - RNA, 19 nt, Homo sapiens
gaaaaccucuccuaaaaga

SEQ ID NO: 1042911 - RNA, 19 nt, Homo sapiens
ggaaagacucucacaaguu

SEQ ID NO: 1042912 - RNA, 19 nt, Homo sapiens
gcagaagcccagaaucaua

SEQ ID NO: 1042913 - RNA, 19 nt, Homo sapiens
ggaaguguguccuuacugu

SEQ ID NO: 1042914 - RNA, 19 nt, Homo sapiens
ggaaagagcagcuacuaca

SEQ ID NO: 1042915 - RNA, 19 nt, Homo sapiens
gaugauaggaccaaccaua

SEQ ID NO: 1042916 - RNA, 19 nt, Homo sapiens
gaagcacguuuaaguagga

SEQ ID NO: 1042917 - RNA, 19 nt, Homo sapiens
gaaagaccacauuuaaguu

SEQ ID NO: 1042918 - RNA, 19 nt, Homo sapiens
cuaaaccaaugacuacuuu

SEQ ID NO: 1042919 - RNA, 19 nt, Homo sapiens
gaugaaaggaccaaucaaa

SEQ ID NO: 1042920 - RNA, 19 nt, Homo sapiens
ccucaacucuaccuaauga

SEQ ID NO: 1042921 - RNA, 19 nt, Homo sapiens
ggagaaagucgauguaauc

SEQ ID NO: 1042922 - RNA, 19 nt, Homo sapiens
ggacaaaccagaacagaca

SEQ ID NO: 1042923 - RNA, 19 nt, Homo sapiens
gacagagaaugaagaaaga

SEQ ID NO: 1042924 - RNA, 19 nt, Homo sapiens
gaaaggaccaaucaaagau

SEQ ID NO: 1042925 - RNA, 19 nt, Homo sapiens
gggaaagacucucacaagu

SEQ ID NO: 1042926 - RNA, 19 nt, Homo sapiens
ccagagcccuuuauguuca

SEQ ID NO: 1042927 - RNA, 19 nt, Homo sapiens
cacaguaccuccaugcauu

SEQ ID NO: 1042928 - RNA, 19 nt, Homo sapiens
gaccaaccauaccuacuga

SEQ ID NO: 1042929 - RNA, 19 nt, Homo sapiens
gcauuuguaucacugcuau

SEQ ID NO: 1042930 - RNA, 19 nt, Homo sapiens
gaaagcagaagcccagaau

SEQ ID NO: 1042931 - RNA, 19 nt, Homo sapiens
ugucauauuucuccaaaga

SEQ ID NO: 1042932 - RNA, 19 nt, Homo sapiens
cuacaaaggcagauaaaga

SEQ ID NO: 1042933 - RNA, 19 nt, Homo sapiens
gcaaaggaaaugcagagaa

SEQ ID NO: 1042934 - RNA, 19 nt, Homo sapiens
gaaagagcagcuacuacaa

SEQ ID NO: 1042935 - RNA, 19 nt, Homo sapiens
ggauuaggaagcacguuua

SEQ ID NO: 1042936 - RNA, 19 nt, Homo sapiens
cagaagcccagaaucauaa

SEQ ID NO: 1042937 - RNA, 19 nt, Homo sapiens
gggauucagucacaggaaa

SEQ ID NO: 1042938 - RNA, 19 nt, Homo sapiens
caaacuaccucuggugauc

SEQ ID NO: 1042939 - RNA, 19 nt, Homo sapiens
caucaagaauccaauccaa

SEQ ID NO: 1042940 - RNA, 19 nt, Homo sapiens
gauaaagacaucaagaauc

SEQ ID NO: 1042941 - RNA, 19 nt, Homo sapiens
ccaaagacaggaacuucua

SEQ ID NO: 1042942 - RNA, 19 nt, Homo sapiens
gcagucaaguagucaaagu

SEQ ID NO: 1042943 - RNA, 19 nt, Homo sapiens
cgacuuaccaguuucauuc

SEQ ID NO: 1042944 - RNA, 19 nt, Homo sapiens
agacaggaacuucuaguaa

SEQ ID NO: 1042945 - RNA, 19 nt, Homo sapiens
caaaauugauccccaaaga

SEQ ID NO: 1042946 - RNA, 19 nt, Homo sapiens
ugaaaggaccaaucaaaga

SEQ ID NO: 1042947 - RNA, 19 nt, Homo sapiens
gcagauaaagacaucaaga

SEQ ID NO: 1042948 - RNA, 19 nt, Homo sapiens
cagggaagccucaguguug

SEQ ID NO: 1042949 - RNA, 19 nt, Homo sapiens
ggacuuacccugggaguag

SEQ ID NO: 1042950 - RNA, 19 nt, Homo sapiens
gaaacaagagaaaggacuu

SEQ ID NO: 1042951 - RNA, 19 nt, Homo sapiens
gcaaugagagagauuccaa

SEQ ID NO: 1042952 - RNA, 19 nt, Homo sapiens
gcuacaacauuucuucaag

SEQ ID NO: 1042953 - RNA, 19 nt, Homo sapiens
gugguagcauuaagggaua

SEQ ID NO: 1042954 - RNA, 19 nt, Homo sapiens
guaagaagccauuuaaacg

SEQ ID NO: 1042955 - RNA, 19 nt, Homo sapiens
gauagucaguuccaagcau

SEQ ID NO: 1042956 - RNA, 19 nt, Homo sapiens
gauaauccacccagaaugg

SEQ ID NO: 1042957 - RNA, 19 nt, Homo sapiens
gagaacuugccaaagauuu

SEQ ID NO: 1042958 - RNA, 19 nt, Homo sapiens
ugacuacuuuccaagaaga

SEQ ID NO: 1042959 - RNA, 19 nt, Homo sapiens
gaaguguguccuuacugua

SEQ ID NO: 1042960 - RNA, 19 nt, Homo sapiens
gauacuucguccuguguug

SEQ ID NO: 1042961 - RNA, 19 nt, Homo sapiens
gguaagaacauuauuaagc

SEQ ID NO: 1042962 - RNA, 19 nt, Homo sapiens
gcucuauccugguuaccuu

SEQ ID NO: 1042963 - RNA, 19 nt, Homo sapiens
aaagagcagcuacuacaaa

SEQ ID NO: 1042964 - RNA, 19 nt, Homo sapiens
uggaggagcucgggaauag

SEQ ID NO: 1042965 - RNA, 19 nt, Homo sapiens
uguuguagcuggaguuuca

SEQ ID NO: 1042966 - RNA, 19 nt, Homo sapiens
cuaaugauguacaaacuac

SEQ ID NO: 1042967 - RNA, 19 nt, Homo sapiens
cagauaaagacaucaagaa

SEQ ID NO: 1042968 - RNA, 19 nt, Homo sapiens
ggaccaaccauaccuacug

SEQ ID NO: 1042969 - RNA, 19 nt, Homo sapiens
uaaguguagugguagcauu

SEQ ID NO: 1042970 - RNA, 19 nt, Homo sapiens
uaggaagcacguuuaagua

SEQ ID NO: 1042971 - RNA, 19 nt, Homo sapiens
gauuaggaagcacguuuaa

SEQ ID NO: 1042972 - RNA, 19 nt, Homo sapiens
uaagaagccauuuaaacga

SEQ ID NO: 1042973 - RNA, 19 nt, Homo sapiens
gcaacaccaccauaaggaa

SEQ ID NO: 1042974 - RNA, 19 nt, Homo sapiens
ggagaaacaagagaaagga

SEQ ID NO: 1042975 - RNA, 19 nt, Homo sapiens
caccagggauucagucaca

SEQ ID NO: 1042976 - RNA, 19 nt, Homo sapiens
gccauacuguaagaugaua

SEQ ID NO: 1042977 - RNA, 19 nt, Homo sapiens
ccaaagaaugucagugaug

SEQ ID NO: 1042978 - RNA, 19 nt, Homo sapiens
aaaggcagauaaagacauc

SEQ ID NO: 1042979 - RNA, 19 nt, Homo sapiens
aaccauaccuacugaucaa

SEQ ID NO: 1042980 - RNA, 19 nt, Homo sapiens
aagcucaacucauauaagg

SEQ ID NO: 1042981 - RNA, 19 nt, Homo sapiens
agucuugccucucuagcua

SEQ ID NO: 1042982 - RNA, 19 nt, Homo sapiens
gggagacgacuuaccaguu

SEQ ID NO: 1042983 - RNA, 19 nt, Homo sapiens
aaacaagagaaaggacuua

SEQ ID NO: 1042984 - RNA, 19 nt, Homo sapiens
aagaagccauuuaaacgau

SEQ ID NO: 1042985 - RNA, 19 nt, Homo sapiens
gaggagcucgggaauagga

SEQ ID NO: 1042986 - RNA, 19 nt, Homo sapiens
auaaagacaucaagaaucc

SEQ ID NO: 1042987 - RNA, 19 nt, Homo sapiens
guuaucaggagcauuugua

SEQ ID NO: 1042988 - RNA, 19 nt, Homo sapiens
gcacaguaccuccaugcau

SEQ ID NO: 1042989 - RNA, 19 nt, Homo sapiens
ugccagagcccuuuauguu

SEQ ID NO: 1042990 - RNA, 19 nt, Homo sapiens
gauguaaaggcauuaaugg

SEQ ID NO: 1042991 - RNA, 19 nt, Homo sapiens
gucaaagucuugccucucu

SEQ ID NO: 1042992 - RNA, 19 nt, Homo sapiens
ggggaaagaccacauuuaa

SEQ ID NO: 1042993 - RNA, 19 nt, Homo sapiens
aaauauuccucaacucuac

SEQ ID NO: 1042994 - RNA, 19 nt, Homo sapiens
gcucaaaggauaccaaaua

SEQ ID NO: 1042995 - RNA, 19 nt, Homo sapiens
agaagaagcucuaaauagu

SEQ ID NO: 1042996 - RNA, 19 nt, Homo sapiens
gagcuugugucccuuacua

SEQ ID NO: 1042997 - RNA, 19 nt, Homo sapiens
caaaggauaccaaauaaug

SEQ ID NO: 1042998 - RNA, 19 nt, Homo sapiens
gagaagaagcucuaaauag

SEQ ID NO: 1042999 - RNA, 19 nt, Homo sapiens
gaagaggaauacuaaaguc

SEQ ID NO: 1043000 - RNA, 19 nt, Homo sapiens
gaagaagcucuaaauaguu

SEQ ID NO: 1043001 - RNA, 19 nt, Homo sapiens
aaacaugcaucuuaaaugg

SEQ ID NO: 1043002 - RNA, 19 nt, Homo sapiens
gaaucuuugugcauuagua

SEQ ID NO: 1043003 - RNA, 19 nt, Homo sapiens
gacugaagcugaagaggaa

SEQ ID NO: 1043004 - RNA, 19 nt, Homo sapiens
ggcaacauauuugagauaa

SEQ ID NO: 1043005 - RNA, 19 nt, Homo sapiens
aaauguaccugcugcuauu

SEQ ID NO: 1043006 - RNA, 19 nt, Homo sapiens
aagaagcucuaaauaguug

SEQ ID NO: 1043007 - RNA, 19 nt, Homo sapiens
gcuaugaaagugcacguua

SEQ ID NO: 1043008 - RNA, 19 nt, Homo sapiens
agucaucacucuagaagaa

SEQ ID NO: 1043009 - RNA, 19 nt, Homo sapiens
agaagcaggugucgcauga

SEQ ID NO: 1043010 - RNA, 19 nt, Homo sapiens
gaaauccugaucaaagaaa

SEQ ID NO: 1043011 - RNA, 19 nt, Homo sapiens
ccacaaugcagcuaggaua

SEQ ID NO: 1043012 - RNA, 19 nt, Homo sapiens
cagaugcuguugauuguau

SEQ ID NO: 1043013 - RNA, 19 nt, Homo sapiens
gaugaagacucaccaccau

SEQ ID NO: 1043014 - RNA, 19 nt, Homo sapiens
agaagaaucuguacaucau

SEQ ID NO: 1043015 - RNA, 19 nt, Homo sapiens
ccgaaauccugaucaaaga

SEQ ID NO: 1043016 - RNA, 19 nt, Homo sapiens
ugagaagaagcucuaaaua

SEQ ID NO: 1043017 - RNA, 19 nt, Homo sapiens
uauccugucugguuacaaa

SEQ ID NO: 1043018 - RNA, 19 nt, Homo sapiens
cucaaaggauaccaaauaa

SEQ ID NO: 1043019 - RNA, 19 nt, Homo sapiens
ugaauauuguccugugaaa

SEQ ID NO: 1043020 - RNA, 19 nt, Homo sapiens
gcacuggcaacauauuuga

SEQ ID NO: 1043021 - RNA, 19 nt, Homo sapiens
gugaauaacugccuguuuu

SEQ ID NO: 1043022 - RNA, 19 nt, Homo sapiens
ccugugagauugauguuug

SEQ ID NO: 1043023 - RNA, 19 nt, Homo sapiens
uagagaggauccuugcaaa

SEQ ID NO: 1043024 - RNA, 19 nt, Homo sapiens
ggaaaugacagaugaacuc

SEQ ID NO: 1043025 - RNA, 19 nt, Homo sapiens
uuugagcacuggcaacaua

SEQ ID NO: 1043026 - RNA, 19 nt, Homo sapiens
caaaaggaccgguuucuaa

SEQ ID NO: 1043027 - RNA, 19 nt, Homo sapiens
cuaugaaagugcacguuaa

SEQ ID NO: 1043028 - RNA, 19 nt, Homo sapiens
ggucagcacuugucagacu

SEQ ID NO: 1043029 - RNA, 19 nt, Homo sapiens
cuaugaauguuuccuguau

SEQ ID NO: 1043030 - RNA, 19 nt, Homo sapiens
gagcacuggcaacauauuu

SEQ ID NO: 1043031 - RNA, 19 nt, Homo sapiens
aaugacagaugaacucguu

SEQ ID NO: 1043032 - RNA, 19 nt, Homo sapiens
ugaaugaaagcacaacaaa

SEQ ID NO: 1043033 - RNA, 19 nt, Homo sapiens
cuaaccugcucaaaggaua

SEQ ID NO: 1043034 - RNA, 19 nt, Homo sapiens
gagaggauccuugcaaaca

SEQ ID NO: 1043035 - RNA, 19 nt, Homo sapiens
gcugcuauuucaaguuuau

SEQ ID NO: 1043036 - RNA, 19 nt, Homo sapiens
aaucaaacccauccucaaa

SEQ ID NO: 1043037 - RNA, 19 nt, Homo sapiens
cugcugcuauuucaaguuu

SEQ ID NO: 1043038 - RNA, 19 nt, Homo sapiens
cugagcgccuuuaccuuua

SEQ ID NO: 1043039 - RNA, 19 nt, Homo sapiens
aagaauagcaggacuuuua

SEQ ID NO: 1043040 - RNA, 19 nt, Homo sapiens
gugaauagcacgauuaaaa

SEQ ID NO: 1043041 - RNA, 19 nt, Homo sapiens
ccacaagauugagaaaaua

SEQ ID NO: 1043042 - RNA, 19 nt, Homo sapiens
ccugagcgccuuuaccuuu

SEQ ID NO: 1043043 - RNA, 19 nt, Homo sapiens
auaguggcaucucauguuu

SEQ ID NO: 1043044 - RNA, 19 nt, Homo sapiens
uagauacaccguucaaaug

SEQ ID NO: 1043045 - RNA, 19 nt, Homo sapiens
caaugcagcuaggauagug

SEQ ID NO: 1043046 - RNA, 19 nt, Homo sapiens
ccuuagaccucguaugcuu

SEQ ID NO: 1043047 - RNA, 19 nt, Homo sapiens
uagcaggacuuuuagauga

SEQ ID NO: 1043048 - RNA, 19 nt, Homo sapiens
cugcauugcucaggcauuu

SEQ ID NO: 1043049 - RNA, 19 nt, Homo sapiens
gaggauccuugcaaacagu

SEQ ID NO: 1043050 - RNA, 19 nt, Homo sapiens
guacauuaccagugcuuga

SEQ ID NO: 1043051 - RNA, 19 nt, Homo sapiens
cagcuaacggaacaauaua

SEQ ID NO: 1043052 - RNA, 19 nt, Homo sapiens
guauauaauggacagcuaa

SEQ ID NO: 1043053 - RNA, 19 nt, Homo sapiens
gcaggugucgcaugacuuc

SEQ ID NO: 1043054 - RNA, 19 nt, Homo sapiens
ccaaauaaugguuuaacug

SEQ ID NO: 1043055 - RNA, 19 nt, Homo sapiens
uaaauguaccugcugcuau

SEQ ID NO: 1043056 - RNA, 19 nt, Homo sapiens
aagaaucuguacaucauca

SEQ ID NO: 1043057 - RNA, 19 nt, Homo sapiens
gaggaauacuaaaguccau

SEQ ID NO: 1043058 - RNA, 19 nt, Homo sapiens
gccagccucuucuguggaa

SEQ ID NO: 1043059 - RNA, 19 nt, Homo sapiens
gucagacuauucccaguug

SEQ ID NO: 1043060 - RNA, 19 nt, Homo sapiens
gaaaggcuaaccugcucaa

SEQ ID NO: 1043061 - RNA, 19 nt, Homo sapiens
gcaacauauuugagauaag

SEQ ID NO: 1043062 - RNA, 19 nt, Homo sapiens
aguggcaucucauguuuga

SEQ ID NO: 1043063 - RNA, 19 nt, Homo sapiens
cuagauacaccguucaaau

SEQ ID NO: 1043064 - RNA, 19 nt, Homo sapiens
ccaccggucucagaaagga

SEQ ID NO: 1043065 - RNA, 19 nt, Homo sapiens
gguucgagauccacgcuau

SEQ ID NO: 1043066 - RNA, 19 nt, Homo sapiens
uuaguggcccuuaaaugua

SEQ ID NO: 1043067 - RNA, 19 nt, Homo sapiens
gacagugcaucugaggaaa

SEQ ID NO: 1043068 - RNA, 19 nt, Homo sapiens
ugacagugcaucugaggaa

SEQ ID NO: 1043069 - RNA, 19 nt, Homo sapiens
gaaagugcacguuaaaccu

SEQ ID NO: 1043070 - RNA, 19 nt, Homo sapiens
uaugaaagugcacguuaaa

SEQ ID NO: 1043071 - RNA, 19 nt, Homo sapiens
ucaaacccauccucaaagg

SEQ ID NO: 1043072 - RNA, 19 nt, Homo sapiens
uagaagaaucuguacauca

SEQ ID NO: 1043073 - RNA, 19 nt, Homo sapiens
gauacaccguucaaaugag

SEQ ID NO: 1043074 - RNA, 19 nt, Homo sapiens
agauacaccguucaaauga

SEQ ID NO: 1043075 - RNA, 19 nt, Homo sapiens
gcuaacggaacaauauaau

SEQ ID NO: 1043076 - RNA, 19 nt, Homo sapiens
gaagaguucacugcagaug

SEQ ID NO: 1043077 - RNA, 19 nt, Homo sapiens
cucaaaggaugaagacuca

SEQ ID NO: 1043078 - RNA, 19 nt, Homo sapiens
uauaguggcaucucauguu

SEQ ID NO: 1043079 - RNA, 19 nt, Homo sapiens
ggaauacuaaaguccaugu

SEQ ID NO: 1043080 - RNA, 19 nt, Homo sapiens
gagauccacgcuauagaga

SEQ ID NO: 1043081 - RNA, 19 nt, Homo sapiens
uuagugauccacaagauug

SEQ ID NO: 1043082 - RNA, 19 nt, Homo sapiens
uagccgaaauccugaucaa

SEQ ID NO: 1043083 - RNA, 19 nt, Homo sapiens
caauauaaucaccacaaug

SEQ ID NO: 1043084 - RNA, 19 nt, Homo sapiens
ugaagaggaauacuaaagu

SEQ ID NO: 1043085 - RNA, 19 nt, Homo sapiens
gccgaaauccugaucaaag

SEQ ID NO: 1043086 - RNA, 19 nt, Homo sapiens
acagcuaacggaacaauau

SEQ ID NO: 1043087 - RNA, 19 nt, Homo sapiens
ucagguuacuucccaccaa

SEQ ID NO: 1043088 - RNA, 19 nt, Homo sapiens
aggcuaaccugcucaaagg

SEQ ID NO: 1043089 - RNA, 19 nt, Homo sapiens
ggacagcuaacggaacaau

SEQ ID NO: 1043090 - RNA, 19 nt, Homo sapiens
aaaauggguuccagaaaug

SEQ ID NO: 1043091 - RNA, 19 nt, Homo sapiens
gggccaggguauuggaugu

SEQ ID NO: 1043092 - RNA, 19 nt, Homo sapiens
agaguuuaguggcccuuaa

SEQ ID NO: 1043093 - RNA, 19 nt, Homo sapiens
gaagcucuaaauaguugaa

SEQ ID NO: 1043094 - RNA, 19 nt, Homo sapiens
gaaggaaucugucuugaaa

SEQ ID NO: 1043095 - RNA, 19 nt, Homo sapiens
gaacagaaauggaagcaaa

SEQ ID NO: 1043096 - RNA, 19 nt, Homo sapiens
gcaaagaaaugaacugaug

SEQ ID NO: 1043097 - RNA, 19 nt, Homo sapiens
ggacuugacucucacagua

SEQ ID NO: 1043098 - RNA, 19 nt, Homo sapiens
gaaagcaaaugaagggaaa

SEQ ID NO: 1043099 - RNA, 19 nt, Homo sapiens
gaacugauagugaauauga

SEQ ID NO: 1043100 - RNA, 19 nt, Homo sapiens
ccugaaagcugaaggauuu

SEQ ID NO: 1043101 - RNA, 19 nt, Homo sapiens
gaauuacucuggcagcuuu

SEQ ID NO: 1043102 - RNA, 19 nt, Homo sapiens
caaauguacuguaaaguga

SEQ ID NO: 1043103 - RNA, 19 nt, Homo sapiens
agaaauggcuuauaagaug

SEQ ID NO: 1043104 - RNA, 19 nt, Homo sapiens
gagagaagcuuagugaaau

SEQ ID NO: 1043105 - RNA, 19 nt, Homo sapiens
gcaacgauuucuccaauga

SEQ ID NO: 1043106 - RNA, 19 nt, Homo sapiens
ggaaucauguugugcacua

SEQ ID NO: 1043107 - RNA, 19 nt, Homo sapiens
gaaaugcaguacauguauu

SEQ ID NO: 1043108 - RNA, 19 nt, Homo sapiens
gaaauggcuuauaagauga

SEQ ID NO: 1043109 - RNA, 19 nt, Homo sapiens
gaacgcugcuacaaugauu

SEQ ID NO: 1043110 - RNA, 19 nt, Homo sapiens
caguagaaauggcuuauaa

SEQ ID NO: 1043111 - RNA, 19 nt, Homo sapiens
agaacaggcugaucuuaua

SEQ ID NO: 1043112 - RNA, 19 nt, Homo sapiens
gcugucgccuuguuaaaua

SEQ ID NO: 1043113 - RNA, 19 nt, Homo sapiens
caacaugucagcaggauaa

SEQ ID NO: 1043114 - RNA, 19 nt, Homo sapiens
gaagauccagugacaagua

SEQ ID NO: 1043115 - RNA, 19 nt, Homo sapiens
auaaagaucugacucaaga

SEQ ID NO: 1043116 - RNA, 19 nt, Homo sapiens
gagcaacgauuucuccaau

SEQ ID NO: 1043117 - RNA, 19 nt, Homo sapiens
gaagaacgaaagcaaauga

SEQ ID NO: 1043118 - RNA, 19 nt, Homo sapiens
gcaguaguguggacgaauu

SEQ ID NO: 1043119 - RNA, 19 nt, Homo sapiens
gaagaagacucuggaacug

SEQ ID NO: 1043120 - RNA, 19 nt, Homo sapiens
aggcugaucuuauaaauga

SEQ ID NO: 1043121 - RNA, 19 nt, Homo sapiens
auucuuagcuccagucaua

SEQ ID NO: 1043122 - RNA, 19 nt, Homo sapiens
gcuccgagacuuuggauua

SEQ ID NO: 1043123 - RNA, 19 nt, Homo sapiens
gaacaggcugaucuuauaa

SEQ ID NO: 1043124 - RNA, 19 nt, Homo sapiens
aaaggagaauacagaguua

SEQ ID NO: 1043125 - RNA, 19 nt, Homo sapiens
acucagaugugaauaauga

SEQ ID NO: 1043126 - RNA, 19 nt, Homo sapiens
gaugauggauuuagaagag

SEQ ID NO: 1043127 - RNA, 19 nt, Homo sapiens
cgcaauacaugcaagauaa

SEQ ID NO: 1043128 - RNA, 19 nt, Homo sapiens
caagaacuaugcagaguca

SEQ ID NO: 1043129 - RNA, 19 nt, Homo sapiens
ggaaugaguaaacuucuuu

SEQ ID NO: 1043130 - RNA, 19 nt, Homo sapiens
gauggugcauguugauaaa

SEQ ID NO: 1043131 - RNA, 19 nt, Homo sapiens
gagaaaugcaguacaugua

SEQ ID NO: 1043132 - RNA, 19 nt, Homo sapiens
gaaaguucauguuguugau

SEQ ID NO: 1043133 - RNA, 19 nt, Homo sapiens
gagaagugauggugaaagu

SEQ ID NO: 1043134 - RNA, 19 nt, Homo sapiens
acaggaugcucauagcuua

SEQ ID NO: 1043135 - RNA, 19 nt, Homo sapiens
ggauggagcaccaaauaaa

SEQ ID NO: 1043136 - RNA, 19 nt, Homo sapiens
caaguucaguggacaguga

SEQ ID NO: 1043137 - RNA, 19 nt, Homo sapiens
ggaagcagaggauauuauu

SEQ ID NO: 1043138 - RNA, 19 nt, Homo sapiens
guaacauacucaccucgua

SEQ ID NO: 1043139 - RNA, 19 nt, Homo sapiens
ugaagaagauccagugaca

SEQ ID NO: 1043140 - RNA, 19 nt, Homo sapiens
gaacauuucccugugauau

SEQ ID NO: 1043141 - RNA, 19 nt, Homo sapiens
ugagacacuuucaucauuu

SEQ ID NO: 1043142 - RNA, 19 nt, Homo sapiens
gaacuugaacagcauauuc

SEQ ID NO: 1043143 - RNA, 19 nt, Homo sapiens
ggauuuagaagagguaaua

SEQ ID NO: 1043144 - RNA, 19 nt, Homo sapiens
gaaucugucuugaaaccaa

SEQ ID NO: 1043145 - RNA, 19 nt, Homo sapiens
guuuagagcucaguauuga

SEQ ID NO: 1043146 - RNA, 19 nt, Homo sapiens
ggaaugcauuauauaagug

SEQ ID NO: 1043147 - RNA, 19 nt, Homo sapiens
agauaaagauggugaacaa

SEQ ID NO: 1043148 - RNA, 19 nt, Homo sapiens
cagcaucaguggauaauag

SEQ ID NO: 1043149 - RNA, 19 nt, Homo sapiens
gagggacucuucagcauca

SEQ ID NO: 1043150 - RNA, 19 nt, Homo sapiens
uaaagucuguggaagcuau

SEQ ID NO: 1043151 - RNA, 19 nt, Homo sapiens
ccauuuaccugcugaaaca

SEQ ID NO: 1043152 - RNA, 19 nt, Homo sapiens
gaaaagagacaacgagaaa

SEQ ID NO: 1043153 - RNA, 19 nt, Homo sapiens
gcagaaagagagagaguug

SEQ ID NO: 1043154 - RNA, 19 nt, Homo sapiens
gcagcaugauguacaagaa

SEQ ID NO: 1043155 - RNA, 19 nt, Homo sapiens
ggacugcccuacaccaauc

SEQ ID NO: 1043156 - RNA, 19 nt, Homo sapiens
cugaaugucuggccucuuu

SEQ ID NO: 1043157 - RNA, 19 nt, Homo sapiens
guagaaauggcuuauaaga

SEQ ID NO: 1043158 - RNA, 19 nt, Homo sapiens
uaacacaagaggacauuaa

SEQ ID NO: 1043159 - RNA, 19 nt, Homo sapiens
gaaauggaagcaaacagaa

SEQ ID NO: 1043160 - RNA, 19 nt, Homo sapiens
ugaacaaccucaaauacug

SEQ ID NO: 1043161 - RNA, 19 nt, Homo sapiens
guaaagagaaagcacuaaa

SEQ ID NO: 1043162 - RNA, 19 nt, Homo sapiens
gaacaagagccaugcaagu

SEQ ID NO: 1043163 - RNA, 19 nt, Homo sapiens
guacauguauuucaaagcu

SEQ ID NO: 1043164 - RNA, 19 nt, Homo sapiens
cuaauggacuugacucuca

SEQ ID NO: 1043165 - RNA, 19 nt, Homo sapiens
agaagaagauacaccaaug

SEQ ID NO: 1043166 - RNA, 19 nt, Homo sapiens
gccauucucucuugagcua

SEQ ID NO: 1043167 - RNA, 19 nt, Homo sapiens
gaaagaggcaccacuggau

SEQ ID NO: 1043168 - RNA, 19 nt, Homo sapiens
uaauggaauugacagauga

SEQ ID NO: 1043169 - RNA, 19 nt, Homo sapiens
cgagagaagcuuagugaaa

SEQ ID NO: 1043170 - RNA, 19 nt, Homo sapiens
caagagccaugcaaguuuc

SEQ ID NO: 1043171 - RNA, 19 nt, Homo sapiens
gaagugauggugaaaguuc

SEQ ID NO: 1043172 - RNA, 19 nt, Homo sapiens
aaaggaagcaguagaaaug

SEQ ID NO: 1043173 - RNA, 19 nt, Homo sapiens
agaauuccuugaucuauga

SEQ ID NO: 1043174 - RNA, 19 nt, Homo sapiens
uguggaagcuauucuagaa

SEQ ID NO: 1043175 - RNA, 19 nt, Homo sapiens
cccaguaucuuauuccaaa

SEQ ID NO: 1043176 - RNA, 19 nt, Homo sapiens
uaaacugaaugaucgaaug

SEQ ID NO: 1043177 - RNA, 19 nt, Homo sapiens
gcacuauagucaaauguac

SEQ ID NO: 1043178 - RNA, 19 nt, Homo sapiens
agacuggaauccuaaaguu

SEQ ID NO: 1043179 - RNA, 19 nt, Homo sapiens
gaugagaguggcaagagua

SEQ ID NO: 1043180 - RNA, 19 nt, Homo sapiens
uuauaaaccuggagaagug

SEQ ID NO: 1043181 - RNA, 19 nt, Homo sapiens
gaaaagaauuccuugaucu

SEQ ID NO: 1043182 - RNA, 19 nt, Homo sapiens
caaauaaagaucugacuca

SEQ ID NO: 1043183 - RNA, 19 nt, Homo sapiens
gaauugcgagagaagcuua

SEQ ID NO: 1043184 - RNA, 19 nt, Homo sapiens
gaagaugaaguccauguca

SEQ ID NO: 1043185 - RNA, 19 nt, Homo sapiens
gcugaggccuccgcuauug

SEQ ID NO: 1043186 - RNA, 19 nt, Homo sapiens
ggcgucaagucaacauaua

SEQ ID NO: 1043187 - RNA, 19 nt, Homo sapiens
ggauaagacauuaaaggaa

SEQ ID NO: 1043188 - RNA, 19 nt, Homo sapiens
aaagagacaacgagaaauu

SEQ ID NO: 1043189 - RNA, 19 nt, Homo sapiens
gaucagaugagcaacgauu

SEQ ID NO: 1043190 - RNA, 19 nt, Homo sapiens
ggaagaauccuggcacugu

SEQ ID NO: 1043191 - RNA, 19 nt, Homo sapiens
ggagcaaugugguuuagag

SEQ ID NO: 1043192 - RNA, 19 nt, Homo sapiens
uagaugcuguguuugcuaa

SEQ ID NO: 1043193 - RNA, 19 nt, Homo sapiens
caaggucuuucgaguguau

SEQ ID NO: 1043194 - RNA, 19 nt, Homo sapiens
gaaagcaucuucauacaga

SEQ ID NO: 1043195 - RNA, 19 nt, Homo sapiens
gaagucaggugauagauga

SEQ ID NO: 1043196 - RNA, 19 nt, Homo sapiens
ggaaggaauucucugauuu

SEQ ID NO: 1043197 - RNA, 19 nt, Homo sapiens
ggaauucucugauuucaug

SEQ ID NO: 1043198 - RNA, 19 nt, Homo sapiens
gcuguuaucuucucaaauu

SEQ ID NO: 1043199 - RNA, 19 nt, Homo sapiens
gcagcucucuugaaccuua

SEQ ID NO: 1043200 - RNA, 19 nt, Homo sapiens
gcagaugaauauaagguaa

SEQ ID NO: 1043201 - RNA, 19 nt, Homo sapiens
ugucauuacuccugaauua

SEQ ID NO: 1043202 - RNA, 19 nt, Homo sapiens
gaaguauucugccaaugaa

SEQ ID NO: 1043203 - RNA, 19 nt, Homo sapiens
gaagaacuagaaagacuua

SEQ ID NO: 1043204 - RNA, 19 nt, Homo sapiens
guccuucucucuauauuua

SEQ ID NO: 1043205 - RNA, 19 nt, Homo sapiens
gggcuucccuccugacuuu

SEQ ID NO: 1043206 - RNA, 19 nt, Homo sapiens
uagguugucucuugaauuu

SEQ ID NO: 1043207 - RNA, 19 nt, Homo sapiens
gaaagaucaucaaaguaga

SEQ ID NO: 1043208 - RNA, 19 nt, Homo sapiens
ccaguuaacucucguagau

SEQ ID NO: 1043209 - RNA, 19 nt, Homo sapiens
ggaaccagcucacugaaag

SEQ ID NO: 1043210 - RNA, 19 nt, Homo sapiens
uggcaggccuguauguuua

SEQ ID NO: 1043211 - RNA, 19 nt, Homo sapiens
gagaagaacuagaaagacu

SEQ ID NO: 1043212 - RNA, 19 nt, Homo sapiens
gaacagcaaacucuauuuc

SEQ ID NO: 1043213 - RNA, 19 nt, Homo sapiens
uaauaugacuggcaagaau

SEQ ID NO: 1043214 - RNA, 19 nt, Homo sapiens
gacacaacaucucagaauu

SEQ ID NO: 1043215 - RNA, 19 nt, Homo sapiens
gaucuaaguggcaaucuuu

SEQ ID NO: 1043216 - RNA, 19 nt, Homo sapiens
aacaacagcucuucuauuc

SEQ ID NO: 1043217 - RNA, 19 nt, Homo sapiens
gcaacgggacccuuucuaa

SEQ ID NO: 1043218 - RNA, 19 nt, Homo sapiens
aaagcuagguugucucuug

SEQ ID NO: 1043219 - RNA, 19 nt, Homo sapiens
caacagcucuucuauucag

SEQ ID NO: 1043220 - RNA, 19 nt, Homo sapiens
ggaguaacaauaugaagaa

SEQ ID NO: 1043221 - RNA, 19 nt, Homo sapiens
gaagugagugucccagaaa

SEQ ID NO: 1043222 - RNA, 19 nt, Homo sapiens
guaauaugcuccuugucaa

SEQ ID NO: 1043223 - RNA, 19 nt, Homo sapiens
gaguaaccgugaucagauu

SEQ ID NO: 1043224 - RNA, 19 nt, Homo sapiens
gcucagaacuggugaagcu

SEQ ID NO: 1043225 - RNA, 19 nt, Homo sapiens
aagcucaagucgcaucuua

SEQ ID NO: 1043226 - RNA, 19 nt, Homo sapiens
gauagaagagugggcuuua

SEQ ID NO: 1043227 - RNA, 19 nt, Homo sapiens
gcagcugggugaugauaga

SEQ ID NO: 1043228 - RNA, 19 nt, Homo sapiens
caucaguccuucucucuau

SEQ ID NO: 1043229 - RNA, 19 nt, Homo sapiens
gauguagucugugcuaaau

SEQ ID NO: 1043230 - RNA, 19 nt, Homo sapiens
cagcaaacucuauuucuuu

SEQ ID NO: 1043231 - RNA, 19 nt, Homo sapiens
gaaggaauucucugauuuc

SEQ ID NO: 1043232 - RNA, 19 nt, Homo sapiens
ucacaaucauguaguucua

SEQ ID NO: 1043233 - RNA, 19 nt, Homo sapiens
gaacaccacagccagaguu

SEQ ID NO: 1043234 - RNA, 19 nt, Homo sapiens
gaugugcguucuuccacua

SEQ ID NO: 1043235 - RNA, 19 nt, Homo sapiens
cauaccagauugucaguga

SEQ ID NO: 1043236 - RNA, 19 nt, Homo sapiens
uaccauagauuugggauga

SEQ ID NO: 1043237 - RNA, 19 nt, Homo sapiens
caacgggacccuuucuaaa

SEQ ID NO: 1043238 - RNA, 19 nt, Homo sapiens
ggauggagaagaacuagaa

SEQ ID NO: 1043239 - RNA, 19 nt, Homo sapiens
gauuaagaacuguggauuu

SEQ ID NO: 1043240 - RNA, 19 nt, Homo sapiens
uaacaacagcucuucuauu

SEQ ID NO: 1043241 - RNA, 19 nt, Homo sapiens
gcugaugccuaggaacuuu

SEQ ID NO: 1043242 - RNA, 19 nt, Homo sapiens
ugccaaauauucacaauca

SEQ ID NO: 1043243 - RNA, 19 nt, Homo sapiens
gggccauguucuuauuaua

SEQ ID NO: 1043244 - RNA, 19 nt, Homo sapiens
aaacauugguucccuaguc

SEQ ID NO: 1043245 - RNA, 19 nt, Homo sapiens
ggcaagaauugguggaaau

SEQ ID NO: 1043246 - RNA, 19 nt, Homo sapiens
auagagaagucaggugaua

SEQ ID NO: 1043247 - RNA, 19 nt, Homo sapiens
gaaaugcuggcuucagaau

SEQ ID NO: 1043248 - RNA, 19 nt, Homo sapiens
acacaacaucucagaauuu

SEQ ID NO: 1043249 - RNA, 19 nt, Homo sapiens
gauacaggaguaacaauau

SEQ ID NO: 1043250 - RNA, 19 nt, Homo sapiens
uggaaggaauucucugauu

SEQ ID NO: 1043251 - RNA, 19 nt, Homo sapiens
ugaaguauucugccaauga

SEQ ID NO: 1043252 - RNA, 19 nt, Homo sapiens
ugaagauacuuucuaacug

SEQ ID NO: 1043253 - RNA, 19 nt, Homo sapiens
gugaucagauuaagaacug

SEQ ID NO: 1043254 - RNA, 19 nt, Homo sapiens
agaaagaucaucaaaguag

SEQ ID NO: 1043255 - RNA, 19 nt, Homo sapiens
uguagucugugcuaaauau

SEQ ID NO: 1043256 - RNA, 19 nt, Homo sapiens
guagucauccuguaauaug

SEQ ID NO: 1043257 - RNA, 19 nt, Homo sapiens
gauuugggaugauguaguc

SEQ ID NO: 1043258 - RNA, 19 nt, Homo sapiens
acacauagagaucaauuug

SEQ ID NO: 1043259 - RNA, 19 nt, Homo sapiens
ugucucagcucuaggaugu

SEQ ID NO: 1043260 - RNA, 19 nt, Homo sapiens
ggaguaaccgugaucagau

SEQ ID NO: 1043261 - RNA, 19 nt, Homo sapiens
acagcaaacucuauuucuu

SEQ ID NO: 1043262 - RNA, 19 nt, Homo sapiens
agucgcaucuuacuaguga

SEQ ID NO: 1043263 - RNA, 19 nt, Homo sapiens
ucucaguacuugauaaauc

SEQ ID NO: 1043264 - RNA, 19 nt, Homo sapiens
ugauacaggaguaacaaua

SEQ ID NO: 1043265 - RNA, 19 nt, Homo sapiens
ucacuuugauaaaccagaa

SEQ ID NO: 1043266 - RNA, 19 nt, Homo sapiens
cuacggggcuagacaguua

SEQ ID NO: 1043267 - RNA, 19 nt, Homo sapiens
ccaaauauucacaaucaug

SEQ ID NO: 1043268 - RNA, 19 nt, Homo sapiens
aaagacaauuguacagcaa

SEQ ID NO: 1043269 - RNA, 19 nt, Homo sapiens
agacuaccauacuguaaau

SEQ ID NO: 1043270 - RNA, 19 nt, Homo sapiens
ucacuuagcaaacacaugu

SEQ ID NO: 1043271 - RNA, 19 nt, Homo sapiens
cagguuaccacugucauua

SEQ ID NO: 1043272 - RNA, 19 nt, Homo sapiens
agaagugagugucccagaa

SEQ ID NO: 1043273 - RNA, 19 nt, Homo sapiens
uccaauuccugccuucuuu

SEQ ID NO: 1043274 - RNA, 19 nt, Homo sapiens
gcugggugaugauagaaga

SEQ ID NO: 1043275 - RNA, 19 nt, Homo sapiens
aaugcuggcuucagaauca

SEQ ID NO: 1043276 - RNA, 19 nt, Homo sapiens
ugaaguuccuggauaacau

SEQ ID NO: 1043277 - RNA, 19 nt, Homo sapiens
gaagagugggcuuuaacug

SEQ ID NO: 1043278 - RNA, 19 nt, Homo sapiens
ccugcuaggugccauauuc

SEQ ID NO: 1043279 - RNA, 19 nt, Homo sapiens
uagaguacccaaaggcuaa

SEQ ID NO: 1043280 - RNA, 19 nt, Homo sapiens
gaacuagaaagacuuacca

SEQ ID NO: 1043281 - RNA, 19 nt, Homo sapiens
uauaacaacagcucuucua

SEQ ID NO: 1043282 - RNA, 19 nt, Homo sapiens
cuggauaacuugauugucu

SEQ ID NO: 1043283 - RNA, 19 nt, Homo sapiens
gcuaggugccauauucauu

SEQ ID NO: 1043284 - RNA, 19 nt, Homo sapiens
gaugauguagucugugcua

SEQ ID NO: 1043285 - RNA, 19 nt, Homo sapiens
cuaaauaccuggccauacc

SEQ ID NO: 1043286 - RNA, 19 nt, Homo sapiens
cccaaaggcuaagaaauuc

SEQ ID NO: 1043287 - RNA, 19 nt, Homo sapiens
acccaaaggcuaagaaauu

SEQ ID NO: 1043288 - RNA, 19 nt, Homo sapiens
uuaccaaacccaagaguga

SEQ ID NO: 1043289 - RNA, 19 nt, Homo sapiens
auucugaaguuccuggaua

SEQ ID NO: 1043290 - RNA, 19 nt, Homo sapiens
cagaacagcaaacucuauu

SEQ ID NO: 1043291 - RNA, 19 nt, Homo sapiens
ucaagucgcaucuuacuag

SEQ ID NO: 1043292 - RNA, 19 nt, Homo sapiens
gcuagguugucucuugaau

SEQ ID NO: 1043293 - RNA, 19 nt, Homo sapiens
cagaugaagauacuuucua

SEQ ID NO: 1043294 - RNA, 19 nt, Homo sapiens
gcuaauuggucuuugaaua

SEQ ID NO: 1043295 - RNA, 19 nt, Homo sapiens
guuaauggcuacugcuuua

SEQ ID NO: 1043296 - RNA, 19 nt, Homo sapiens
uagaugagguagaaaguua

SEQ ID NO: 1043297 - RNA, 19 nt, Homo sapiens
agacaaagauggguuuaua

SEQ ID NO: 1043298 - RNA, 19 nt, Homo sapiens
caaauuagcacccuauauu

SEQ ID NO: 1043299 - RNA, 19 nt, Homo sapiens
gaaacccuaucucuacuaa

SEQ ID NO: 1043300 - RNA, 19 nt, Homo sapiens
gaaguuagaaacaagguua

SEQ ID NO: 1043301 - RNA, 19 nt, Homo sapiens
gaccagggcuugaaaggaa

SEQ ID NO: 1043302 - RNA, 19 nt, Homo sapiens
ggaccaagaucccaugaau

SEQ ID NO: 1043303 - RNA, 19 nt, Homo sapiens
gaagagaaagcucaucauu

SEQ ID NO: 1043304 - RNA, 19 nt, Homo sapiens
ucacagauaugaagcuuug

SEQ ID NO: 1043305 - RNA, 19 nt, Homo sapiens
aagaugagguuaaagcaua

SEQ ID NO: 1043306 - RNA, 19 nt, Homo sapiens
ggaccugacuuguuaaugg

SEQ ID NO: 1043307 - RNA, 19 nt, Homo sapiens
gccagagaauuuacauaua

SEQ ID NO: 1043308 - RNA, 19 nt, Homo sapiens
gaaaccuugucucuacuaa

SEQ ID NO: 1043309 - RNA, 19 nt, Homo sapiens
uaugaaggcuacuuagaaa

SEQ ID NO: 1043310 - RNA, 19 nt, Homo sapiens
guucgucacuucuuugauu

SEQ ID NO: 1043311 - RNA, 19 nt, Homo sapiens
ggugaaaccuugucucuac

SEQ ID NO: 1043312 - RNA, 19 nt, Homo sapiens
gaugugcaaugcugaaguu

SEQ ID NO: 1043313 - RNA, 19 nt, Homo sapiens
gugcaaugcugaaguuaga

SEQ ID NO: 1043314 - RNA, 19 nt, Homo sapiens
uguuggaccugacuuguua

SEQ ID NO: 1043315 - RNA, 19 nt, Homo sapiens
ggucagcccauuugguuua

SEQ ID NO: 1043316 - RNA, 19 nt, Homo sapiens
gaggguggaucacuugaga

SEQ ID NO: 1043317 - RNA, 19 nt, Homo sapiens
caaguuagaggucaacauu

SEQ ID NO: 1043318 - RNA, 19 nt, Homo sapiens
cagguuauagcacaaauua

SEQ ID NO: 1043319 - RNA, 19 nt, Homo sapiens
gaaauggaucuuaaugaug

SEQ ID NO: 1043320 - RNA, 19 nt, Homo sapiens
gacaggagauuugcuugaa

SEQ ID NO: 1043321 - RNA, 19 nt, Homo sapiens
gaaacucucuaaagaugag

SEQ ID NO: 1043322 - RNA, 19 nt, Homo sapiens
gaaaggaauguguguagga

SEQ ID NO: 1043323 - RNA, 19 nt, Homo sapiens
ugugugaguuucuuuguaa

SEQ ID NO: 1043324 - RNA, 19 nt, Homo sapiens
gacaugagaccagguuaua

SEQ ID NO: 1043325 - RNA, 19 nt, Homo sapiens
uggaaacucucuaaagaug

SEQ ID NO: 1043326 - RNA, 19 nt, Homo sapiens
caaggaggguggaucacuu

SEQ ID NO: 1043327 - RNA, 19 nt, Homo sapiens
agugauugguggccuauua

SEQ ID NO: 1043328 - RNA, 19 nt, Homo sapiens
uaaacacgaugaguuauag

SEQ ID NO: 1043329 - RNA, 19 nt, Homo sapiens
gcacaaauuagcacccuau

SEQ ID NO: 1043330 - RNA, 19 nt, Homo sapiens
gggaauauaccacgacaug

SEQ ID NO: 1043331 - RNA, 19 nt, Homo sapiens
gagaagagaaagcucauca

SEQ ID NO: 1043332 - RNA, 19 nt, Homo sapiens
ccacuaugaaggcuacuua

SEQ ID NO: 1043333 - RNA, 19 nt, Homo sapiens
ggaacgcggucuugacucu

SEQ ID NO: 1043334 - RNA, 19 nt, Homo sapiens
ccauuucugucucaucaaa

SEQ ID NO: 1043335 - RNA, 19 nt, Homo sapiens
uauccuuccugguucuuua

SEQ ID NO: 1043336 - RNA, 19 nt, Homo sapiens
ucuuaaggcuagcggaaua

SEQ ID NO: 1043337 - RNA, 19 nt, Homo sapiens
ugaugaagcuuggcuccua

SEQ ID NO: 1043338 - RNA, 19 nt, Homo sapiens
cugaagcccuuguccguaa

SEQ ID NO: 1043339 - RNA, 19 nt, Homo sapiens
agagggcagucaucuuuaa

SEQ ID NO: 1043340 - RNA, 19 nt, Homo sapiens
gagagggcagucaucuuua

SEQ ID NO: 1043341 - RNA, 19 nt, Homo sapiens
acgaugaguuauagagaua

SEQ ID NO: 1043342 - RNA, 19 nt, Homo sapiens
gaagacaaagauggguuua

SEQ ID NO: 1043343 - RNA, 19 nt, Homo sapiens
acuggaaacucucuaaaga

SEQ ID NO: 1043344 - RNA, 19 nt, Homo sapiens
agagaaagcucaucauucc

SEQ ID NO: 1043345 - RNA, 19 nt, Homo sapiens
guaaaccagucuacauuuu

SEQ ID NO: 1043346 - RNA, 19 nt, Homo sapiens
gaugagguagaaaguuaua

SEQ ID NO: 1043347 - RNA, 19 nt, Homo sapiens
ucacaaacauaacaauggu

SEQ ID NO: 1043348 - RNA, 19 nt, Homo sapiens
gaauauaccacgacaugag

SEQ ID NO: 1043349 - RNA, 19 nt, Homo sapiens
agagagggcagucaucuuu

SEQ ID NO: 1043350 - RNA, 19 nt, Homo sapiens
cauauaaacacgaugaguu

SEQ ID NO: 1043351 - RNA, 19 nt, Homo sapiens
gaagaugaagacaaagaug

SEQ ID NO: 1043352 - RNA, 19 nt, Homo sapiens
cccagaaaguacacugaua

SEQ ID NO: 1043353 - RNA, 19 nt, Homo sapiens
gauucgaaauggaccaaga

SEQ ID NO: 1043354 - RNA, 19 nt, Homo sapiens
ccagaaaguacacugauau

SEQ ID NO: 1043355 - RNA, 19 nt, Homo sapiens
gaaaagaaggaaaagguaa

SEQ ID NO: 1043356 - RNA, 19 nt, Homo sapiens
gcaaugcugaaguuagaaa

SEQ ID NO: 1043357 - RNA, 19 nt, Homo sapiens
aguuagaggucaacauuug

SEQ ID NO: 1043358 - RNA, 19 nt, Homo sapiens
acccauuucuuucugauaa

SEQ ID NO: 1043359 - RNA, 19 nt, Homo sapiens
ugauguugguccacuauga

SEQ ID NO: 1043360 - RNA, 19 nt, Homo sapiens
gaauauccuuccugguucu

SEQ ID NO: 1043361 - RNA, 19 nt, Homo sapiens
gaagcuuggcuccuaguga

SEQ ID NO: 1043362 - RNA, 19 nt, Homo sapiens
acaauguucuuucuugcuu

SEQ ID NO: 1043363 - RNA, 19 nt, Homo sapiens
guucuuucuugcuuuguuu

SEQ ID NO: 1043364 - RNA, 19 nt, Homo sapiens
ggaaacucucuaaagauga

SEQ ID NO: 1043365 - RNA, 19 nt, Homo sapiens
guccugaacuugucugaag

SEQ ID NO: 1043366 - RNA, 19 nt, Homo sapiens
uguuauagaugagguagaa

SEQ ID NO: 1043367 - RNA, 19 nt, Homo sapiens
gcucugagucucugcuuga

SEQ ID NO: 1043368 - RNA, 19 nt, Homo sapiens
ucacuccacucacaaacau

SEQ ID NO: 1043369 - RNA, 19 nt, Homo sapiens
ucuaaguacccauuucuuu

SEQ ID NO: 1043370 - RNA, 19 nt, Homo sapiens
caauguucuuucuugcuuu

SEQ ID NO: 1043371 - RNA, 19 nt, Homo sapiens
gacaaagauggguuuauau

SEQ ID NO: 1043372 - RNA, 19 nt, Homo sapiens
gaauguguguaggagagaa

SEQ ID NO: 1043373 - RNA, 19 nt, Homo sapiens
gcagugagccaagauugug

SEQ ID NO: 1043374 - RNA, 19 nt, Homo sapiens
cuaaggagaugugcaaugc

SEQ ID NO: 1043375 - RNA, 19 nt, Homo sapiens
auauagcacucaucuuuca

SEQ ID NO: 1043376 - RNA, 19 nt, Homo sapiens
cuaugaaggcuacuuagaa

SEQ ID NO: 1043377 - RNA, 19 nt, Homo sapiens
uuuaauggguagucuauag

SEQ ID NO: 1043378 - RNA, 19 nt, Homo sapiens
ggugaugcgugccuguaau

SEQ ID NO: 1043379 - RNA, 19 nt, Homo sapiens
gaugaguuauagagauaca

SEQ ID NO: 1043380 - RNA, 19 nt, Homo sapiens
cagaaaguacacugauauu

SEQ ID NO: 1043381 - RNA, 19 nt, Homo sapiens
gaaggaaaagguaaaauuc

SEQ ID NO: 1043382 - RNA, 19 nt, Homo sapiens
ggaaaagaaggaaaaggua

SEQ ID NO: 1043383 - RNA, 19 nt, Homo sapiens
uaauggguagucuauagua

SEQ ID NO: 1043384 - RNA, 19 nt, Homo sapiens
uguagggacuucuuuccuu

SEQ ID NO: 1043385 - RNA, 19 nt, Homo sapiens
gauugguggccuauuauga

SEQ ID NO: 1043386 - RNA, 19 nt, Homo sapiens
gagaccagccugaccaaca

SEQ ID NO: 1043387 - RNA, 19 nt, Homo sapiens
gcuacugcuuuacuaagga

SEQ ID NO: 1043388 - RNA, 19 nt, Homo sapiens
ggaauauaccacgacauga

SEQ ID NO: 1043389 - RNA, 19 nt, Homo sapiens
cuaauuggucuuugaauag

SEQ ID NO: 1043390 - RNA, 19 nt, Homo sapiens
aaugaugacuggaaacucu

SEQ ID NO: 1043391 - RNA, 19 nt, Homo sapiens
uaguaaaccagucuacauu

SEQ ID NO: 1043392 - RNA, 19 nt, Homo sapiens
cagauaugaagcuuuguuu

SEQ ID NO: 1043393 - RNA, 19 nt, Homo sapiens
gauguugguccacuaugaa

SEQ ID NO: 1043394 - RNA, 19 nt, Homo sapiens
gaacuucaccggcaacuaa

SEQ ID NO: 1043395 - RNA, 19 nt, Homo sapiens
gcagcaagcucacccauga

SEQ ID NO: 1043396 - RNA, 19 nt, Homo sapiens
gcagaagacuacacuguga

SEQ ID NO: 1043397 - RNA, 19 nt, Homo sapiens
gaagagaaaugggaugaga

SEQ ID NO: 1043398 - RNA, 19 nt, Homo sapiens
gcaacgagauggucaggaa

SEQ ID NO: 1043399 - RNA, 19 nt, Homo sapiens
ucacuaaccuuuaucucua

SEQ ID NO: 1043400 - RNA, 19 nt, Homo sapiens
uguggaaggucaugauuua

SEQ ID NO: 1043401 - RNA, 19 nt, Homo sapiens
ccaaagggauggagccuau

SEQ ID NO: 1043402 - RNA, 19 nt, Homo sapiens
cgaacuggcugcuucugua

SEQ ID NO: 1043403 - RNA, 19 nt, Homo sapiens
gaauggaaaggaggaauua

SEQ ID NO: 1043404 - RNA, 19 nt, Homo sapiens
gcucagagguuugaagaug

SEQ ID NO: 1043405 - RNA, 19 nt, Homo sapiens
gggaugagauuucaauugg

SEQ ID NO: 1043406 - RNA, 19 nt, Homo sapiens
ggccacauguugucacuaa

SEQ ID NO: 1043407 - RNA, 19 nt, Homo sapiens
gaagaaacauggaaaagau

SEQ ID NO: 1043408 - RNA, 19 nt, Homo sapiens
caacuaaacaccagugaug

SEQ ID NO: 1043409 - RNA, 19 nt, Homo sapiens
aagggaacaucauugguua

SEQ ID NO: 1043410 - RNA, 19 nt, Homo sapiens
gcgcucugcugguccauaa

SEQ ID NO: 1043411 - RNA, 19 nt, Homo sapiens
gaaagagaauguggaaggu

SEQ ID NO: 1043412 - RNA, 19 nt, Homo sapiens
gcaaagaagaaacauggaa

SEQ ID NO: 1043413 - RNA, 19 nt, Homo sapiens
uuacagcgauucugaguuc

SEQ ID NO: 1043414 - RNA, 19 nt, Homo sapiens
gaccauggcuauaaauguc

SEQ ID NO: 1043415 - RNA, 19 nt, Homo sapiens
ggaaaacacuuaugguaau

SEQ ID NO: 1043416 - RNA, 19 nt, Homo sapiens
gaucaacacauccaguauu

SEQ ID NO: 1043417 - RNA, 19 nt, Homo sapiens
accaagggcugcuauauga

SEQ ID NO: 1043418 - RNA, 19 nt, Homo sapiens
gaacuggcugcuucuguaa

SEQ ID NO: 1043419 - RNA, 19 nt, Homo sapiens
gaacgugaccauggcuaua

SEQ ID NO: 1043420 - RNA, 19 nt, Homo sapiens
ugucacagaugccagauga

SEQ ID NO: 1043421 - RNA, 19 nt, Homo sapiens
ggcaggaacugucuaucuu

SEQ ID NO: 1043422 - RNA, 19 nt, Homo sapiens
caaagaagaaacauggaaa

SEQ ID NO: 1043423 - RNA, 19 nt, Homo sapiens
caacucgucuacugugaau

SEQ ID NO: 1043424 - RNA, 19 nt, Homo sapiens
cacaguaucugcugaucaa

SEQ ID NO: 1043425 - RNA, 19 nt, Homo sapiens
ucaaaggaaugcaaagaag

SEQ ID NO: 1043426 - RNA, 19 nt, Homo sapiens
ggacucagauucgccaaag

SEQ ID NO: 1043427 - RNA, 19 nt, Homo sapiens
ggagcuggaugguugugaa

SEQ ID NO: 1043428 - RNA, 19 nt, Homo sapiens
gaauggagaauauaaagca

SEQ ID NO: 1043429 - RNA, 19 nt, Homo sapiens
uauaagaucuucggguuuc

SEQ ID NO: 1043430 - RNA, 19 nt, Homo sapiens
gaaaccaagggcugcuaua

SEQ ID NO: 1043431 - RNA, 19 nt, Homo sapiens
gcaugcaucauuggauuua

SEQ ID NO: 1043432 - RNA, 19 nt, Homo sapiens
aaacaccagugaugagaau

SEQ ID NO: 1043433 - RNA, 19 nt, Homo sapiens
ugacaaagggaacaucauu

SEQ ID NO: 1043434 - RNA, 19 nt, Homo sapiens
gaucucagcuugcguuuuc

SEQ ID NO: 1043435 - RNA, 19 nt, Homo sapiens
caggaacugucuaucuuga

SEQ ID NO: 1043436 - RNA, 19 nt, Homo sapiens
cagguggaauggagaauau

SEQ ID NO: 1043437 - RNA, 19 nt, Homo sapiens
aaagaucaacuuccuggua

SEQ ID NO: 1043438 - RNA, 19 nt, Homo sapiens
ucaggaagaugcccucaca

SEQ ID NO: 1043439 - RNA, 19 nt, Homo sapiens
cucgaaagcuucacuagug

SEQ ID NO: 1043440 - RNA, 19 nt, Homo sapiens
ggaaugcaaagaagaaaca

SEQ ID NO: 1043441 - RNA, 19 nt, Homo sapiens
gcuggaugguugugaauca

SEQ ID NO: 1043442 - RNA, 19 nt, Homo sapiens
ggauuuacagcgauucuga

SEQ ID NO: 1043443 - RNA, 19 nt, Homo sapiens
gaggaagaccuacuuugga

SEQ ID NO: 1043444 - RNA, 19 nt, Homo sapiens
uuaaugugcuggaugacaa

SEQ ID NO: 1043445 - RNA, 19 nt, Homo sapiens
caaaggaaugcaaagaaga

SEQ ID NO: 1043446 - RNA, 19 nt, Homo sapiens
caaaggaucauggucauca

SEQ ID NO: 1043447 - RNA, 19 nt, Homo sapiens
gagcaggugcgcuacagaa

SEQ ID NO: 1043448 - RNA, 19 nt, Homo sapiens
uguuauaccugcugucaug

SEQ ID NO: 1043449 - RNA, 19 nt, Homo sapiens
uuucuuagguucaucauag

SEQ ID NO: 1043450 - RNA, 19 nt, Homo sapiens
ugucgacgcuggaugaugu

SEQ ID NO: 1043451 - RNA, 19 nt, Homo sapiens
gcaggaacugucuaucuug

SEQ ID NO: 1043452 - RNA, 19 nt, Homo sapiens
gagauggucaggaagcauu

SEQ ID NO: 1043453 - RNA, 19 nt, Homo sapiens
gguggaauggagaauauaa

SEQ ID NO: 1043454 - RNA, 19 nt, Homo sapiens
gucgguagcucagagguuu

SEQ ID NO: 1043455 - RNA, 19 nt, Homo sapiens
gauagaagaggucaagucu

SEQ ID NO: 1043456 - RNA, 19 nt, Homo sapiens
ucacagaugccagaugauu

SEQ ID NO: 1043457 - RNA, 19 nt, Homo sapiens
uggaacaacucgucuacug

SEQ ID NO: 1043458 - RNA, 19 nt, Homo sapiens
gauuucauuuggauacaug

SEQ ID NO: 1043459 - RNA, 19 nt, Homo sapiens
gaucugugaggauuucauu

SEQ ID NO: 1043460 - RNA, 19 nt, Homo sapiens
ucucauuccuugauguuau

SEQ ID NO: 1043461 - RNA, 19 nt, Homo sapiens
agacuacacugugaucuuc

SEQ ID NO: 1043462 - RNA, 19 nt, Homo sapiens
aaagggaacaucauugguu

SEQ ID NO: 1043463 - RNA, 19 nt, Homo sapiens
ucaacuuccugguacaaug

SEQ ID NO: 1043464 - RNA, 19 nt, Homo sapiens
ggccguccuuguaauuuga

SEQ ID NO: 1043465 - RNA, 19 nt, Homo sapiens
cuagugaucucauggaaaa

SEQ ID NO: 1043466 - RNA, 19 nt, Homo sapiens
gauuucaauuggcucuuug

SEQ ID NO: 1043467 - RNA, 19 nt, Homo sapiens
aucaacacauccaguauuu

SEQ ID NO: 1043468 - RNA, 19 nt, Homo sapiens
aaaggaaugcaaagaagaa

SEQ ID NO: 1043469 - RNA, 19 nt, Homo sapiens
ggaacaacucgucuacugu

SEQ ID NO: 1043470 - RNA, 19 nt, Homo sapiens
gauguccaggccuuucuua

SEQ ID NO: 1043471 - RNA, 19 nt, Homo sapiens
gacaaagggaacaucauug

SEQ ID NO: 1043472 - RNA, 19 nt, Homo sapiens
guucaaacucucaaaggaa

SEQ ID NO: 1043473 - RNA, 19 nt, Homo sapiens
gugaggauuucauuuggau

SEQ ID NO: 1043474 - RNA, 19 nt, Homo sapiens
gggcauaagcaacgagaug

SEQ ID NO: 1043475 - RNA, 19 nt, Homo sapiens
gugggagucgcuucuguua

SEQ ID NO: 1043476 - RNA, 19 nt, Homo sapiens
ggucaugauuuaccugcau

SEQ ID NO: 1043477 - RNA, 19 nt, Homo sapiens
agagaaaugggaugagauu

SEQ ID NO: 1043478 - RNA, 19 nt, Homo sapiens
gcacaguaucugcugauca

SEQ ID NO: 1043479 - RNA, 19 nt, Homo sapiens
guccaggccuuucuuaggu

SEQ ID NO: 1043480 - RNA, 19 nt, Homo sapiens
gcaacgaaaccagcauguu

SEQ ID NO: 1043481 - RNA, 19 nt, Homo sapiens
gaaucacaaugguguuugc

SEQ ID NO: 1043482 - RNA, 19 nt, Homo sapiens
caacacauccaguauuuug

SEQ ID NO: 1043483 - RNA, 19 nt, Homo sapiens
ugaaugaggcacaguaucu

SEQ ID NO: 1043484 - RNA, 19 nt, Homo sapiens
guacaauggccacccuuuc

SEQ ID NO: 1043485 - RNA, 19 nt, Homo sapiens
ggcaaaggaucauggucau

SEQ ID NO: 1043486 - RNA, 19 nt, Homo sapiens
ggaaaccaagggcugcuau

SEQ ID NO: 1043487 - RNA, 19 nt, Homo sapiens
gccgacuccuucagagaaa

SEQ ID NO: 1043488 - RNA, 19 nt, Homo sapiens
gacagccucugcguaccua

SEQ ID NO: 1043489 - RNA, 19 nt, Homo sapiens
ggauagaagaggucaaguc

SEQ ID NO: 1043490 - RNA, 19 nt, Homo sapiens
ccuguggucugcagaggaa

SEQ ID NO: 1043491 - RNA, 19 nt, Homo sapiens
acagaugccagaugauuug

SEQ ID NO: 1043492 - RNA, 19 nt, Homo sapiens
cccuuucucuggugaauga

SEQ ID NO: 1043493 - RNA, 19 nt, Homo sapiens
gaauguggaaggucaugau

SEQ ID NO: 1043494 - RNA, 19 nt, Homo sapiens
gaagaugaauugagaauga

SEQ ID NO: 1043495 - RNA, 19 nt, Homo sapiens
gaagagaccuacagaguug

SEQ ID NO: 1043496 - RNA, 19 nt, Homo sapiens
gacagaagcucauggauuu

SEQ ID NO: 1043497 - RNA, 19 nt, Homo sapiens
gaacaaggcucaccuaagg

SEQ ID NO: 1043498 - RNA, 19 nt, Homo sapiens
gaaaugaucgugaguauga

SEQ ID NO: 1043499 - RNA, 19 nt, Homo sapiens
aaagacagcugccauagua

SEQ ID NO: 1043500 - RNA, 19 nt, Homo sapiens
agaagaagcuggugcauaa

SEQ ID NO: 1043501 - RNA, 19 nt, Homo sapiens
ggaggaagcugagaaacua

SEQ ID NO: 1043502 - RNA, 19 nt, Homo sapiens
gauuguggcuucccuguua

SEQ ID NO: 1043503 - RNA, 19 nt, Homo sapiens
ggaagacccucguuuacaa

SEQ ID NO: 1043504 - RNA, 19 nt, Homo sapiens
gacagaagcuucacaggaa

SEQ ID NO: 1043505 - RNA, 19 nt, Homo sapiens
ggaguaggcugucuauaug

SEQ ID NO: 1043506 - RNA, 19 nt, Homo sapiens
ggagaagcaucauuacuug

SEQ ID NO: 1043507 - RNA, 19 nt, Homo sapiens
gaaagagaccacuagauuu

SEQ ID NO: 1043508 - RNA, 19 nt, Homo sapiens
gcaggaagacccucguuua

SEQ ID NO: 1043509 - RNA, 19 nt, Homo sapiens
gaacuccucugcauuucuu

SEQ ID NO: 1043510 - RNA, 19 nt, Homo sapiens
aagaagagcuugcugaaga

SEQ ID NO: 1043511 - RNA, 19 nt, Homo sapiens
gagaaaugaucgugaguau

SEQ ID NO: 1043512 - RNA, 19 nt, Homo sapiens
uaaggaaacugacccagaa

SEQ ID NO: 1043513 - RNA, 19 nt, Homo sapiens
gaaguaauaugagcaggaa

SEQ ID NO: 1043514 - RNA, 19 nt, Homo sapiens
acacaacccucaauaaaug

SEQ ID NO: 1043515 - RNA, 19 nt, Homo sapiens
ucacaucucucaagaaauc

SEQ ID NO: 1043516 - RNA, 19 nt, Homo sapiens
gaaaaggagucaaugaaaa

SEQ ID NO: 1043517 - RNA, 19 nt, Homo sapiens
agaauuagcugacucugaa

SEQ ID NO: 1043518 - RNA, 19 nt, Homo sapiens
gggcagagcuggacagaag

SEQ ID NO: 1043519 - RNA, 19 nt, Homo sapiens
gaaagagucuauggguaaa

SEQ ID NO: 1043520 - RNA, 19 nt, Homo sapiens
gcgaauggcccaaacuaua

SEQ ID NO: 1043521 - RNA, 19 nt, Homo sapiens
auaaugcucuggcaaauuu

SEQ ID NO: 1043522 - RNA, 19 nt, Homo sapiens
gaaugaugauugcgaaaga

SEQ ID NO: 1043523 - RNA, 19 nt, Homo sapiens
ggacagaagcucauggauu

SEQ ID NO: 1043524 - RNA, 19 nt, Homo sapiens
gaaguaagaauccuauuuc

SEQ ID NO: 1043525 - RNA, 19 nt, Homo sapiens
caucauuacuugagaaaga

SEQ ID NO: 1043526 - RNA, 19 nt, Homo sapiens
ggagauacagaugaaauua

SEQ ID NO: 1043527 - RNA, 19 nt, Homo sapiens
ggacugugguaaagagaaa

SEQ ID NO: 1043528 - RNA, 19 nt, Homo sapiens
gaauugagaaugaugauug

SEQ ID NO: 1043529 - RNA, 19 nt, Homo sapiens
ccucacaucucucaagaaa

SEQ ID NO: 1043530 - RNA, 19 nt, Homo sapiens
gaagagcggucugauucaa

SEQ ID NO: 1043531 - RNA, 19 nt, Homo sapiens
cagggaagcuguuugauag

SEQ ID NO: 1043532 - RNA, 19 nt, Homo sapiens
caaaagaagugcagaagaa

SEQ ID NO: 1043533 - RNA, 19 nt, Homo sapiens
ggaguaggaaguaauauga

SEQ ID NO: 1043534 - RNA, 19 nt, Homo sapiens
caaaucaggcguucacaaa

SEQ ID NO: 1043535 - RNA, 19 nt, Homo sapiens
uguaagggaugauuucaaa

SEQ ID NO: 1043536 - RNA, 19 nt, Homo sapiens
agucaaagcacuuguauuu

SEQ ID NO: 1043537 - RNA, 19 nt, Homo sapiens
aaaucuggcugacggaaua

SEQ ID NO: 1043538 - RNA, 19 nt, Homo sapiens
agaaagagaccacuagauu

SEQ ID NO: 1043539 - RNA, 19 nt, Homo sapiens
ggaagagaccuacagaguu

SEQ ID NO: 1043540 - RNA, 19 nt, Homo sapiens
cuaaagacauaaaggaaga

SEQ ID NO: 1043541 - RNA, 19 nt, Homo sapiens
ugcaaagacucacaacaua

SEQ ID NO: 1043542 - RNA, 19 nt, Homo sapiens
ggaagauguuacugaagaa

SEQ ID NO: 1043543 - RNA, 19 nt, Homo sapiens
ugaaagagucuauggguaa

SEQ ID NO: 1043544 - RNA, 19 nt, Homo sapiens
gggaguaggcugucuauau

SEQ ID NO: 1043545 - RNA, 19 nt, Homo sapiens
agaagaaauuucagaguga

SEQ ID NO: 1043546 - RNA, 19 nt, Homo sapiens
ggagaggaguaggaaguaa

SEQ ID NO: 1043547 - RNA, 19 nt, Homo sapiens
ggagaacaccuguggcaaa

SEQ ID NO: 1043548 - RNA, 19 nt, Homo sapiens
ucaagguucugacuuauuc

SEQ ID NO: 1043549 - RNA, 19 nt, Homo sapiens
aaacagaaaccaaaggaaa

SEQ ID NO: 1043550 - RNA, 19 nt, Homo sapiens
gaagaaacagaucacagaa

SEQ ID NO: 1043551 - RNA, 19 nt, Homo sapiens
gcaaaucaacuuaagcaau

SEQ ID NO: 1043552 - RNA, 19 nt, Homo sapiens
gaggaaaacuuacagagaa

SEQ ID NO: 1043553 - RNA, 19 nt, Homo sapiens
gaucagaauuccaugaaac

SEQ ID NO: 1043554 - RNA, 19 nt, Homo sapiens
agugaaaccuggaaagauu

SEQ ID NO: 1043555 - RNA, 19 nt, Homo sapiens
gaagaugacaguaauaggu

SEQ ID NO: 1043556 - RNA, 19 nt, Homo sapiens
uaagagugauggaccagaa

SEQ ID NO: 1043557 - RNA, 19 nt, Homo sapiens
cugcauuucuuccuaagua

SEQ ID NO: 1043558 - RNA, 19 nt, Homo sapiens
cuacacaacccucaauaaa

SEQ ID NO: 1043559 - RNA, 19 nt, Homo sapiens
ggaagaagagcuugcugaa

SEQ ID NO: 1043560 - RNA, 19 nt, Homo sapiens
caccaaaggucucauccaa

SEQ ID NO: 1043561 - RNA, 19 nt, Homo sapiens
ugaaggaggugaggaguau

SEQ ID NO: 1043562 - RNA, 19 nt, Homo sapiens
ucacaaacugcauucuuua

SEQ ID NO: 1043563 - RNA, 19 nt, Homo sapiens
gaacaaccaaccugcguau

SEQ ID NO: 1043564 - RNA, 19 nt, Homo sapiens
uaagaaugaugaacgacuu

SEQ ID NO: 1043565 - RNA, 19 nt, Homo sapiens
gaagcaucauuacuugaga

SEQ ID NO: 1043566 - RNA, 19 nt, Homo sapiens
ggaaugaggacugugguaa

SEQ ID NO: 1043567 - RNA, 19 nt, Homo sapiens
uaauggacaucuucucaug

SEQ ID NO: 1043568 - RNA, 19 nt, Homo sapiens
agaaagcccugaauguugu

SEQ ID NO: 1043569 - RNA, 19 nt, Homo sapiens
cauggacucucgauuucua

SEQ ID NO: 1043570 - RNA, 19 nt, Homo sapiens
uagcugauuuggaacaauu

SEQ ID NO: 1043571 - RNA, 19 nt, Homo sapiens
cacuuuagcugauuuggaa

SEQ ID NO: 1043572 - RNA, 19 nt, Homo sapiens
agaggaagauguuacugaa

SEQ ID NO: 1043573 - RNA, 19 nt, Homo sapiens
gaaugaggacugugguaaa

SEQ ID NO: 1043574 - RNA, 19 nt, Homo sapiens
ugaggugucuaaagaaaug

SEQ ID NO: 1043575 - RNA, 19 nt, Homo sapiens
aaacugauuucucacuuuc

SEQ ID NO: 1043576 - RNA, 19 nt, Homo sapiens
gcaaacagaaaccaaagga

SEQ ID NO: 1043577 - RNA, 19 nt, Homo sapiens
ggaguauaaugccaugaug

SEQ ID NO: 1043578 - RNA, 19 nt, Homo sapiens
cuauggaucugaaagaaau

SEQ ID NO: 1043579 - RNA, 19 nt, Homo sapiens
aaagaaagcccugaauguu

SEQ ID NO: 1043580 - RNA, 19 nt, Homo sapiens
gacaaagacagcugccaua

SEQ ID NO: 1043581 - RNA, 19 nt, Homo sapiens
gaucugaagguuccaaaug

SEQ ID NO: 1043582 - RNA, 19 nt, Homo sapiens
uaauaaaugucagcugguu

SEQ ID NO: 1043583 - RNA, 19 nt, Homo sapiens
caaccaaccugcguaugga

SEQ ID NO: 1043584 - RNA, 19 nt, Homo sapiens
agagaaaccugaggaaauc

SEQ ID NO: 1043585 - RNA, 19 nt, Homo sapiens
ucagggaagcuguuugaua

SEQ ID NO: 1043586 - RNA, 19 nt, Homo sapiens
gcaagaccaugccacuuac

SEQ ID NO: 1043587 - RNA, 19 nt, Homo sapiens
gaaaacugcugaggaagaa

SEQ ID NO: 1043588 - RNA, 19 nt, Homo sapiens
gaacuacacaacccucaau

SEQ ID NO: 1043589 - RNA, 19 nt, Homo sapiens
gcaaagacucacaacauag

SEQ ID NO: 1043590 - RNA, 19 nt, Homo sapiens
gaaucucacuuuagcugau

SEQ ID NO: 1043591 - RNA, 19 nt, Homo sapiens
aggaagauguuacugaaga

SEQ ID NO: 1043592 - RNA, 19 nt, Homo sapiens
gaaaagagaaguaagaauc

SEQ ID NO: 1043593 - RNA, 19 nt, Homo sapiens
cgaauggcccaaacuauau

SEQ ID NO: 1043594 - RNA, 19 nt, Homo sapiens
gggcagaaaucgagaagaa

SEQ ID NO: 1043595 - RNA, 19 nt, Homo sapiens
gaaggaugauggccagaaa

SEQ ID NO: 1043596 - RNA, 19 nt, Homo sapiens
ugacacaagugguaaagaa

SEQ ID NO: 1043597 - RNA, 19 nt, Homo sapiens
gcaaaucagugcugcagau

SEQ ID NO: 1043598 - RNA, 19 nt, Homo sapiens
ggacaugcgugacgacauc

SEQ ID NO: 1043599 - RNA, 19 nt, Homo sapiens
agacugagauggagaacuu

SEQ ID NO: 1043600 - RNA, 19 nt, Homo sapiens
gaacaucgaccaggacaug

SEQ ID NO: 1043601 - RNA, 19 nt, Homo sapiens
gaaggaagggaauaaugaa

SEQ ID NO: 1043602 - RNA, 19 nt, Homo sapiens
gcgaagaggaauauuacua

SEQ ID NO: 1043603 - RNA, 19 nt, Homo sapiens
ccagaaaggugaagaagcu

SEQ ID NO: 1043604 - RNA, 19 nt, Homo sapiens
uaaguaggauugugacagu

SEQ ID NO: 1043605 - RNA, 19 nt, Homo sapiens
ucaccaggaugcuauauag

SEQ ID NO: 1043606 - RNA, 19 nt, Homo sapiens
gaaggagaccugccagugu

SEQ ID NO: 1043607 - RNA, 19 nt, Homo sapiens
aaagcgaagaggaauauua

SEQ ID NO: 1043608 - RNA, 19 nt, Homo sapiens
ccaccagaauccagagaaa

SEQ ID NO: 1043609 - RNA, 19 nt, Homo sapiens
cuagagcgcuucccaaguc

SEQ ID NO: 1043610 - RNA, 19 nt, Homo sapiens
ggagaggaggcauacgaua

SEQ ID NO: 1043611 - RNA, 19 nt, Homo sapiens
gcaacuggaagaagacauu

SEQ ID NO: 1043612 - RNA, 19 nt, Homo sapiens
gagagaaggaagggaauaa

SEQ ID NO: 1043613 - RNA, 19 nt, Homo sapiens
gagaaggaagggaauaaug

SEQ ID NO: 1043614 - RNA, 19 nt, Homo sapiens
agaagacauugcccuguuu

SEQ ID NO: 1043615 - RNA, 19 nt, Homo sapiens
gagaggauccgggcagaaa

SEQ ID NO: 1043616 - RNA, 19 nt, Homo sapiens
cgaagaggaauauuacuau

SEQ ID NO: 1043617 - RNA, 19 nt, Homo sapiens
cgaggaagcagaagacgaa

SEQ ID NO: 1043618 - RNA, 19 nt, Homo sapiens
ggaagggaauaaugaaagc

SEQ ID NO: 1043619 - RNA, 19 nt, Homo sapiens
aagaagacauugcccuguu

SEQ ID NO: 1043620 - RNA, 19 nt, Homo sapiens
ggagagaaggaagggaaua

SEQ ID NO: 1043621 - RNA, 19 nt, Homo sapiens
agaaggaagggaauaauga

SEQ ID NO: 1043622 - RNA, 19 nt, Homo sapiens
gcauuccgcugggauacuu

SEQ ID NO: 1043623 - RNA, 19 nt, Homo sapiens
gagaggaggcauacgauag

SEQ ID NO: 1043624 - RNA, 19 nt, Homo sapiens
aaggagaccugccaguguu

SEQ ID NO: 1043625 - RNA, 19 nt, Homo sapiens
gcagcgguguuucaaaguc

SEQ ID NO: 1043626 - RNA, 19 nt, Homo sapiens
gcugaggacacccggauuu

SEQ ID NO: 1043627 - RNA, 19 nt, Homo sapiens
gaagacauugcccuguuug

SEQ ID NO: 1043628 - RNA, 19 nt, Homo sapiens
aggcugcccugaagaacua

SEQ ID NO: 1043629 - RNA, 19 nt, Homo sapiens
caaaucagugcugcagaua

SEQ ID NO: 1043630 - RNA, 19 nt, Homo sapiens
uaaggaaagcagugaguga

SEQ ID NO: 1043631 - RNA, 19 nt, Homo sapiens
uggcggcucugcagacuga

SEQ ID NO: 1043632 - RNA, 19 nt, Homo sapiens
gcgguacugcuguagauaa

SEQ ID NO: 1043633 - RNA, 19 nt, Homo sapiens
cggcagcgguguuucaaag

SEQ ID NO: 1043634 - RNA, 19 nt, Homo sapiens
gaacuuggcccugcaucuc

SEQ ID NO: 1043635 - RNA, 19 nt, Homo sapiens
ugaaagcgaagaggaauau

SEQ ID NO: 1043636 - RNA, 19 nt, Homo sapiens
ggagaagaggcgcaucaug

SEQ ID NO: 1043637 - RNA, 19 nt, Homo sapiens
gcagaaaucgagaagaaaa

SEQ ID NO: 1043638 - RNA, 19 nt, Homo sapiens
gugcugcagauacgacuua

SEQ ID NO: 1043639 - RNA, 19 nt, Homo sapiens
agcggaagcugcaauugaa

SEQ ID NO: 1043640 - RNA, 19 nt, Homo sapiens
ggaggcauacgauaguguu

SEQ ID NO: 1043641 - RNA, 19 nt, Homo sapiens
gaggacacccggauuuuaa

SEQ ID NO: 1043642 - RNA, 19 nt, Homo sapiens
gagcgcuucccaagucaaa

SEQ ID NO: 1043643 - RNA, 19 nt, Homo sapiens
gcagugggcagauuaacag

SEQ ID NO: 1043644 - RNA, 19 nt, Homo sapiens
gccagcagugggcagauua

SEQ ID NO: 1043645 - RNA, 19 nt, Homo sapiens
ggccagcagugggcagauu

SEQ ID NO: 1043646 - RNA, 19 nt, Homo sapiens
gaggaggcauacgauagug

SEQ ID NO: 1043647 - RNA, 19 nt, Homo sapiens
gaauaaugaaagccacaug

SEQ ID NO: 1043648 - RNA, 19 nt, Homo sapiens
ggucccagcuggugguuuu

SEQ ID NO: 1043649 - RNA, 19 nt, Homo sapiens
gugggcagauuaacaggau

SEQ ID NO: 1043650 - RNA, 19 nt, Homo sapiens
cgugaugacacaaguggua

SEQ ID NO: 1043651 - RNA, 19 nt, Homo sapiens
gccaucccacggagucuua

SEQ ID NO: 1043652 - RNA, 19 nt, Homo sapiens
gaggcauacgauaguguua

SEQ ID NO: 1043653 - RNA, 19 nt, Homo sapiens
aagcggaagcugcaauuga

SEQ ID NO: 1043654 - RNA, 19 nt, Homo sapiens
ugacagcucagcauguugu

SEQ ID NO: 1043655 - RNA, 19 nt, Homo sapiens
gcucguucccgccuuucua

SEQ ID NO: 1043656 - RNA, 19 nt, Homo sapiens
ccaagcggaagcugcaauu

SEQ ID NO: 1043657 - RNA, 19 nt, Homo sapiens
gaaagcgaagaggaauauu

SEQ ID NO: 1043658 - RNA, 19 nt, Homo sapiens
cuauggagaugcugaaagc

SEQ ID NO: 1043659 - RNA, 19 nt, Homo sapiens
agaagcugcuggagaagag

SEQ ID NO: 1043660 - RNA, 19 nt, Homo sapiens
guauugcuaaguaggauug

SEQ ID NO: 1043661 - RNA, 19 nt, Homo sapiens
uaucaagcccggaaugucu

SEQ ID NO: 1043662 - RNA, 19 nt, Homo sapiens
gauaaccggauccgcgaau

SEQ ID NO: 1043663 - RNA, 19 nt, Homo sapiens
gaggauccgggcagaaauc

SEQ ID NO: 1043664 - RNA, 19 nt, Homo sapiens
uggcgguacugcuguagau

SEQ ID NO: 1043665 - RNA, 19 nt, Homo sapiens
uuauggcgguacugcugua

SEQ ID NO: 1043666 - RNA, 19 nt, Homo sapiens
caacuggaagaagacauug

SEQ ID NO: 1043667 - RNA, 19 nt, Homo sapiens
gagugacgaggaagcagaa

SEQ ID NO: 1043668 - RNA, 19 nt, Homo sapiens
aaucagugcugcagauacg

SEQ ID NO: 1043669 - RNA, 19 nt, Homo sapiens
cuucaggacugugccaauc

SEQ ID NO: 1043670 - RNA, 19 nt, Homo sapiens
gaggaauauuacuauacag

SEQ ID NO: 1043671 - RNA, 19 nt, Homo sapiens
cgacagaucgaaaaguuga

SEQ ID NO: 1043672 - RNA, 19 nt, Homo sapiens
gcugaaagcgaagaggaau

SEQ ID NO: 1043673 - RNA, 19 nt, Homo sapiens
ccggauccgcgaaugcuaa

SEQ ID NO: 1043674 - RNA, 19 nt, Homo sapiens
ggcagaaaucgagaagaaa

SEQ ID NO: 1043675 - RNA, 19 nt, Homo sapiens
ggagaggauccgggcagaa

SEQ ID NO: 1043676 - RNA, 19 nt, Homo sapiens
ggaagcugcaauugaagag

SEQ ID NO: 1043677 - RNA, 19 nt, Homo sapiens
ucacgaccgccacgcaaug

SEQ ID NO: 1043678 - RNA, 19 nt, Homo sapiens
ccagcagugggcagauuaa

SEQ ID NO: 1043679 - RNA, 19 nt, Homo sapiens
aagcgaagaggaauauuac

SEQ ID NO: 1043680 - RNA, 19 nt, Homo sapiens
aaggaagggaauaaugaaa

SEQ ID NO: 1043681 - RNA, 19 nt, Homo sapiens
ggguauugcuaaguaggau

SEQ ID NO: 1043682 - RNA, 19 nt, Homo sapiens
gugaugacacaagugguaa

SEQ ID NO: 1043683 - RNA, 19 nt, Homo sapiens
gaacugagauauaccaaua

SEQ ID NO: 1043684 - RNA, 19 nt, Homo sapiens
gaagugaguugcugaauga

SEQ ID NO: 1043685 - RNA, 19 nt, Homo sapiens
guacacagcugacuuaugu

SEQ ID NO: 1043686 - RNA, 19 nt, Homo sapiens
gaucauccuucaucauuua

SEQ ID NO: 1043687 - RNA, 19 nt, Homo sapiens
ggacauagcugaaccucau

SEQ ID NO: 1043688 - RNA, 19 nt, Homo sapiens
gcacuugcauccacaguaa

SEQ ID NO: 1043689 - RNA, 19 nt, Homo sapiens
ggagacaacuggaaauuca

SEQ ID NO: 1043690 - RNA, 19 nt, Homo sapiens
gaaagcuggucaucaguuu

SEQ ID NO: 1043691 - RNA, 19 nt, Homo sapiens
gauuuaagcugcuaauaug

SEQ ID NO: 1043692 - RNA, 19 nt, Homo sapiens
gucaauaguuucccaauuu

SEQ ID NO: 1043693 - RNA, 19 nt, Homo sapiens
gaacauuccuauugcacaa

SEQ ID NO: 1043694 - RNA, 19 nt, Homo sapiens
uaacgcaucuuaggaauga

SEQ ID NO: 1043695 - RNA, 19 nt, Homo sapiens
aaccaaaucuucagacuuu

SEQ ID NO: 1043696 - RNA, 19 nt, Homo sapiens
ggucaucaguuuggaguua

SEQ ID NO: 1043697 - RNA, 19 nt, Homo sapiens
ugaaggaacugauguaaca

SEQ ID NO: 1043698 - RNA, 19 nt, Homo sapiens
ggauaagccugcacaccua

SEQ ID NO: 1043699 - RNA, 19 nt, Homo sapiens
gaaagccauuggaauagaa

SEQ ID NO: 1043700 - RNA, 19 nt, Homo sapiens
uaauauagccgcugccaua

SEQ ID NO: 1043701 - RNA, 19 nt, Homo sapiens
caaaggacccggaugauga

SEQ ID NO: 1043702 - RNA, 19 nt, Homo sapiens
gcacgcagcugcagauuuu

SEQ ID NO: 1043703 - RNA, 19 nt, Homo sapiens
gaaccacugugucucuuga

SEQ ID NO: 1043704 - RNA, 19 nt, Homo sapiens
uaacagggauugaagaagu

SEQ ID NO: 1043705 - RNA, 19 nt, Homo sapiens
gcauuuaaguagcaacauu

SEQ ID NO: 1043706 - RNA, 19 nt, Homo sapiens
gcagugaccugagagaaga

SEQ ID NO: 1043707 - RNA, 19 nt, Homo sapiens
gaaauaacgcaucuuagga

SEQ ID NO: 1043708 - RNA, 19 nt, Homo sapiens
gccuucagcuuaccuauuu

SEQ ID NO: 1043709 - RNA, 19 nt, Homo sapiens
uuaaagagaucauccuuca

SEQ ID NO: 1043710 - RNA, 19 nt, Homo sapiens
ccgaagauuucauguguuu

SEQ ID NO: 1043711 - RNA, 19 nt, Homo sapiens
ugaaaugucuccgaagauu

SEQ ID NO: 1043712 - RNA, 19 nt, Homo sapiens
ggacauguuugaucagcuu

SEQ ID NO: 1043713 - RNA, 19 nt, Homo sapiens
gggagaauguggccaaguu

SEQ ID NO: 1043714 - RNA, 19 nt, Homo sapiens
gagaucauccuucaucauu

SEQ ID NO: 1043715 - RNA, 19 nt, Homo sapiens
ucagaaauaacgcaucuua

SEQ ID NO: 1043716 - RNA, 19 nt, Homo sapiens
caccauagcugcuggaauc

SEQ ID NO: 1043717 - RNA, 19 nt, Homo sapiens
gcaacaguaugugcgauaa

SEQ ID NO: 1043718 - RNA, 19 nt, Homo sapiens
ggaguuacauggcgagcaa

SEQ ID NO: 1043719 - RNA, 19 nt, Homo sapiens
gaggaaagcuggucaucag

SEQ ID NO: 1043720 - RNA, 19 nt, Homo sapiens
gcugacuuauguagauuua

SEQ ID NO: 1043721 - RNA, 19 nt, Homo sapiens
uaucaaaucugcguaugaa

SEQ ID NO: 1043722 - RNA, 19 nt, Homo sapiens
guggccaaguuuauuauua

SEQ ID NO: 1043723 - RNA, 19 nt, Homo sapiens
gcaagugccuucagcuuac

SEQ ID NO: 1043724 - RNA, 19 nt, Homo sapiens
gagaagagauccugaugcu

SEQ ID NO: 1043725 - RNA, 19 nt, Homo sapiens
ccaaguacauggccuuuua

SEQ ID NO: 1043726 - RNA, 19 nt, Homo sapiens
gagcaggcauuaaacuugu

SEQ ID NO: 1043727 - RNA, 19 nt, Homo sapiens
gaucaaagacauaagugaa

SEQ ID NO: 1043728 - RNA, 19 nt, Homo sapiens
gagaauguggccaaguuua

SEQ ID NO: 1043729 - RNA, 19 nt, Homo sapiens
ggucaauaguuucccaauu

SEQ ID NO: 1043730 - RNA, 19 nt, Homo sapiens
aaacaacgcugagagaauc

SEQ ID NO: 1043731 - RNA, 19 nt, Homo sapiens
ggaaugacuaaacaagaua

SEQ ID NO: 1043732 - RNA, 19 nt, Homo sapiens
ccaccucucucaacuguau

SEQ ID NO: 1043733 - RNA, 19 nt, Homo sapiens
caggagcccucaacugauu

SEQ ID NO: 1043734 - RNA, 19 nt, Homo sapiens
caagaugauccuuaccuua

SEQ ID NO: 1043735 - RNA, 19 nt, Homo sapiens
guaauuaguguacacguuu

SEQ ID NO: 1043736 - RNA, 19 nt, Homo sapiens
gaaauucauuggaccugau

SEQ ID NO: 1043737 - RNA, 19 nt, Homo sapiens
cacagaaggugaaaccaaa

SEQ ID NO: 1043738 - RNA, 19 nt, Homo sapiens
cauuaaaggcuuagcauuu

SEQ ID NO: 1043739 - RNA, 19 nt, Homo sapiens
acaagauaauggcaguuua

SEQ ID NO: 1043740 - RNA, 19 nt, Homo sapiens
cuguauagcuauccucuuu

SEQ ID NO: 1043741 - RNA, 19 nt, Homo sapiens
gaaaccaaaucuucagacu

SEQ ID NO: 1043742 - RNA, 19 nt, Homo sapiens
gcacagaaggugaaaccaa

SEQ ID NO: 1043743 - RNA, 19 nt, Homo sapiens
ccucauauaccguguuuaa

SEQ ID NO: 1043744 - RNA, 19 nt, Homo sapiens
uauagccgcugccauaguu

SEQ ID NO: 1043745 - RNA, 19 nt, Homo sapiens
gaagaaguaguaauuccaa

SEQ ID NO: 1043746 - RNA, 19 nt, Homo sapiens
caacaaauagucucuugga

SEQ ID NO: 1043747 - RNA, 19 nt, Homo sapiens
uuuggaaucucguucauuu

SEQ ID NO: 1043748 - RNA, 19 nt, Homo sapiens
ggcuagaagugauuccuaa

SEQ ID NO: 1043749 - RNA, 19 nt, Homo sapiens
cauuaaacuuguacacuga

SEQ ID NO: 1043750 - RNA, 19 nt, Homo sapiens
caucuuagguguucaugca

SEQ ID NO: 1043751 - RNA, 19 nt, Homo sapiens
gcucuugucaucaggauaa

SEQ ID NO: 1043752 - RNA, 19 nt, Homo sapiens
cugcuaauaugcuacuuaa

SEQ ID NO: 1043753 - RNA, 19 nt, Homo sapiens
ucucucaacuguauagcua

SEQ ID NO: 1043754 - RNA, 19 nt, Homo sapiens
acacugaguuacuaaacaa

SEQ ID NO: 1043755 - RNA, 19 nt, Homo sapiens
gcacaaugauccgaggaau

SEQ ID NO: 1043756 - RNA, 19 nt, Homo sapiens
ggaaagcuggucaucaguu

SEQ ID NO: 1043757 - RNA, 19 nt, Homo sapiens
gcuacuuaaccaucuauua

SEQ ID NO: 1043758 - RNA, 19 nt, Homo sapiens
cagauuuggugaauuuguu

SEQ ID NO: 1043759 - RNA, 19 nt, Homo sapiens
caggaagcauaauaagauu

SEQ ID NO: 1043760 - RNA, 19 nt, Homo sapiens
acaaauagucucuuggauu

SEQ ID NO: 1043761 - RNA, 19 nt, Homo sapiens
gagcugaccucacgaugcu

SEQ ID NO: 1043762 - RNA, 19 nt, Homo sapiens
guccauggcucuugucauc

SEQ ID NO: 1043763 - RNA, 19 nt, Homo sapiens
gauuugauuugucuaaugg

SEQ ID NO: 1043764 - RNA, 19 nt, Homo sapiens
aacccucgcuugcaacaua

SEQ ID NO: 1043765 - RNA, 19 nt, Homo sapiens
aaucacaccugagaacuga

SEQ ID NO: 1043766 - RNA, 19 nt, Homo sapiens
gcaaaugaaaguggagauu

SEQ ID NO: 1043767 - RNA, 19 nt, Homo sapiens
aaaggaagcccuaaguaau

SEQ ID NO: 1043768 - RNA, 19 nt, Homo sapiens
gcaaucaaccaggaacaaa

SEQ ID NO: 1043769 - RNA, 19 nt, Homo sapiens
ugacugugcugcugauauc

SEQ ID NO: 1043770 - RNA, 19 nt, Homo sapiens
ugaaagccauuggaauaga

SEQ ID NO: 1043771 - RNA, 19 nt, Homo sapiens
gaauugagcucagaaaagu

SEQ ID NO: 1043772 - RNA, 19 nt, Homo sapiens
ggaacgaauugagcucaga

SEQ ID NO: 1043773 - RNA, 19 nt, Homo sapiens
gaauguggccaaguuuauu

SEQ ID NO: 1043774 - RNA, 19 nt, Homo sapiens
ucaauaguuucccaauuuc

SEQ ID NO: 1043775 - RNA, 19 nt, Homo sapiens
ugacaccagugaaggcaaa

SEQ ID NO: 1043776 - RNA, 19 nt, Homo sapiens
gcagugacagcgacaguga

SEQ ID NO: 1043777 - RNA, 19 nt, Homo sapiens
gugcaacccucucaaaggu

SEQ ID NO: 1043778 - RNA, 19 nt, Homo sapiens
ucaggaagcauaauaagau

SEQ ID NO: 1043779 - RNA, 19 nt, Homo sapiens
caaagccucuguggacaug

SEQ ID NO: 1043780 - RNA, 19 nt, Homo sapiens
ucauauaccguguuuaaug

SEQ ID NO: 1043781 - RNA, 19 nt, Homo sapiens
uaaaguagccguucuucag

SEQ ID NO: 1043782 - RNA, 19 nt, Homo sapiens
gaacgaauugagcucagaa

SEQ ID NO: 1043783 - RNA, 19 nt, Homo sapiens
gcauauagccauucuuaaa

SEQ ID NO: 1043784 - RNA, 19 nt, Homo sapiens
gaagacaaaggucaaauau

SEQ ID NO: 1043785 - RNA, 19 nt, Homo sapiens
uggaagagcuguucucaga

SEQ ID NO: 1043786 - RNA, 19 nt, Homo sapiens
gagcaucacuacagucuca

SEQ ID NO: 1043787 - RNA, 19 nt, Homo sapiens
uugaaacgcuggagacuaa

SEQ ID NO: 1043788 - RNA, 19 nt, Homo sapiens
gugcauauagccauucuua

SEQ ID NO: 1043789 - RNA, 19 nt, Homo sapiens
cgccugcgcugcucuguua

SEQ ID NO: 1043790 - RNA, 19 nt, Homo sapiens
ggacaugucucuggugaag

SEQ ID NO: 1043791 - RNA, 19 nt, Homo sapiens
guugaagucuagaaugaaa

SEQ ID NO: 1043792 - RNA, 19 nt, Homo sapiens
agaggaagcuuucacaagu

SEQ ID NO: 1043793 - RNA, 19 nt, Homo sapiens
gugugauacuucuucauua

SEQ ID NO: 1043794 - RNA, 19 nt, Homo sapiens
gaaagaaaucugaauccau

SEQ ID NO: 1043795 - RNA, 19 nt, Homo sapiens
ugaagacaaaggucaaaua

SEQ ID NO: 1043796 - RNA, 19 nt, Homo sapiens
gaccuaagaguaaauuaug

SEQ ID NO: 1043797 - RNA, 19 nt, Homo sapiens
gcugcuacauuagaacuuu

SEQ ID NO: 1043798 - RNA, 19 nt, Homo sapiens
caguugguguguuucauuu

SEQ ID NO: 1043799 - RNA, 19 nt, Homo sapiens
gugugaauguaucauguuu

SEQ ID NO: 1043800 - RNA, 19 nt, Homo sapiens
ggacugaagaggaaaugug

SEQ ID NO: 1043801 - RNA, 19 nt, Homo sapiens
gcaguugguguguuucauu

SEQ ID NO: 1043802 - RNA, 19 nt, Homo sapiens
gaggaagcuuucacaaguc

SEQ ID NO: 1043803 - RNA, 19 nt, Homo sapiens
acaugucucuggugaaguu

SEQ ID NO: 1043804 - RNA, 19 nt, Homo sapiens
cacgaggacugaagaggaa

SEQ ID NO: 1043805 - RNA, 19 nt, Homo sapiens
ggucaggacacaauguuug

SEQ ID NO: 1043806 - RNA, 19 nt, Homo sapiens
gaaaucugaauccauguca

SEQ ID NO: 1043807 - RNA, 19 nt, Homo sapiens
auccuuugcugcuacauua

SEQ ID NO: 1043808 - RNA, 19 nt, Homo sapiens
uaaacauccuuugcugcua

SEQ ID NO: 1043809 - RNA, 19 nt, Homo sapiens
ugaaagaaaucugaaucca

SEQ ID NO: 1043810 - RNA, 19 nt, Homo sapiens
ccacaucuuccuagaccua

SEQ ID NO: 1043811 - RNA, 19 nt, Homo sapiens
ucacuacagucucagucaa

SEQ ID NO: 1043812 - RNA, 19 nt, Homo sapiens
caaccuccuuuuaccuuua

SEQ ID NO: 1043813 - RNA, 19 nt, Homo sapiens
agguugaagucuagaauga

SEQ ID NO: 1043814 - RNA, 19 nt, Homo sapiens
ggcagucgcuccuggacau

SEQ ID NO: 1043815 - RNA, 19 nt, Homo sapiens
gcagugagaccugggugaa

SEQ ID NO: 1043816 - RNA, 19 nt, Homo sapiens
cuggugaaguugcagcuuu

SEQ ID NO: 1043817 - RNA, 19 nt, Homo sapiens
agucaacagugugaaugua

SEQ ID NO: 1043818 - RNA, 19 nt, Homo sapiens
aaggcuagguugaagucua

SEQ ID NO: 1043819 - RNA, 19 nt, Homo sapiens
agacuggugcugaaacaaa

SEQ ID NO: 1043820 - RNA, 19 nt, Homo sapiens
caacagugugaauguauca

SEQ ID NO: 1043821 - RNA, 19 nt, Homo sapiens
aauugcaguugguguguuu

SEQ ID NO: 1043822 - RNA, 19 nt, Homo sapiens
cuaaacaauugcaguuggu

SEQ ID NO: 1043823 - RNA, 19 nt, Homo sapiens
gucacuugaucagauauuu

SEQ ID NO: 1043824 - RNA, 19 nt, Homo sapiens
cauaaccccuugaucugua

SEQ ID NO: 1043825 - RNA, 19 nt, Homo sapiens
cuuccuagaccuaagagua

SEQ ID NO: 1043826 - RNA, 19 nt, Homo sapiens
uuaaaugugugugugauac

SEQ ID NO: 1043827 - RNA, 19 nt, Homo sapiens
cagugugaauguaucaugu

SEQ ID NO: 1043828 - RNA, 19 nt, Homo sapiens
ucaacagugugaauguauc

SEQ ID NO: 1043829 - RNA, 19 nt, Homo sapiens
ccacacacaggguccaguu

SEQ ID NO: 1043830 - RNA, 19 nt, Homo sapiens
cccuugaucuguaguguca

SEQ ID NO: 1043831 - RNA, 19 nt, Homo sapiens
aaucugaauccaugucauu

SEQ ID NO: 1043832 - RNA, 19 nt, Homo sapiens
gguuaaggcuagguugaag

SEQ ID NO: 1043833 - RNA, 19 nt, Homo sapiens
ugugugauacuucuucauu

SEQ ID NO: 1043834 - RNA, 19 nt, Homo sapiens
ugaagucuagaaugaaaga

SEQ ID NO: 1043835 - RNA, 19 nt, Homo sapiens
caauugcaguugguguguu

SEQ ID NO: 1043836 - RNA, 19 nt, Homo sapiens
gcaguauuuugucuuaaga

SEQ ID NO: 1043837 - RNA, 19 nt, Homo sapiens
cauugcugcuggaugagaa

SEQ ID NO: 1043838 - RNA, 19 nt, Homo sapiens
aaaugugugugugauacuu

SEQ ID NO: 1043839 - RNA, 19 nt, Homo sapiens
cacuugaucagauauuuga

SEQ ID NO: 1043840 - RNA, 19 nt, Homo sapiens
cagaggaagcuuucacaag

SEQ ID NO: 1043841 - RNA, 19 nt, Homo sapiens
uuagacuggugcugaaaca

SEQ ID NO: 1043842 - RNA, 19 nt, Homo sapiens
acacagccacaucuuccua

SEQ ID NO: 1043843 - RNA, 19 nt, Homo sapiens
cugaagaggaaauguguug

SEQ ID NO: 1043844 - RNA, 19 nt, Homo sapiens
ucacuugaucagauauuug

SEQ ID NO: 1043845 - RNA, 19 nt, Homo sapiens
aggaagcuuucacaaguca

SEQ ID NO: 1043846 - RNA, 19 nt, Homo sapiens
gauggauggcccucgagaa

SEQ ID NO: 1043847 - RNA, 19 nt, Homo sapiens
gcagauccaagaggagaug

SEQ ID NO: 1043848 - RNA, 19 nt, Homo sapiens
gacugaagaggaaaugugu

SEQ ID NO: 1043849 - RNA, 19 nt, Homo sapiens
ccucgguggugccuucuca

SEQ ID NO: 1043850 - RNA, 19 nt, Homo sapiens
gauacuucuucauuauguc

SEQ ID NO: 1043851 - RNA, 19 nt, Homo sapiens
gaccuggacacaguacuga

SEQ ID NO: 1043852 - RNA, 19 nt, Homo sapiens
ccucaccccuuaaccaaaa

SEQ ID NO: 1043853 - RNA, 19 nt, Homo sapiens
uuucucaugcuuucucuaa

SEQ ID NO: 1043854 - RNA, 19 nt, Homo sapiens
ucucaugcuuucucuaacu

SEQ ID NO: 1043855 - RNA, 19 nt, Homo sapiens
acacacaggguccaguuuc

SEQ ID NO: 1043856 - RNA, 19 nt, Homo sapiens
uggugaaguugcagcuuug

SEQ ID NO: 1043857 - RNA, 19 nt, Homo sapiens
acuacgaccuggacacagu

SEQ ID NO: 1043858 - RNA, 19 nt, Homo sapiens
cacaggguccaguuucuga

SEQ ID NO: 1043859 - RNA, 19 nt, Homo sapiens
cuaacuuccucaccccuua

SEQ ID NO: 1043860 - RNA, 19 nt, Homo sapiens
uuccuagaccuaagaguaa

SEQ ID NO: 1043861 - RNA, 19 nt, Homo sapiens
gugauacuucuucauuaug

SEQ ID NO: 1043862 - RNA, 19 nt, Homo sapiens
gucaacagugugaauguau

SEQ ID NO: 1043863 - RNA, 19 nt, Homo sapiens
ccaacacgguccggcagau

SEQ ID NO: 1043864 - RNA, 19 nt, Homo sapiens
gacuggugcugaaacaaaa

SEQ ID NO: 1043865 - RNA, 19 nt, Homo sapiens
ccuaagaguaaauuaugga

SEQ ID NO: 1043866 - RNA, 19 nt, Homo sapiens
ccacaugcucccuguuucu

SEQ ID NO: 1043867 - RNA, 19 nt, Homo sapiens
cuugaucuguagugucaug

SEQ ID NO: 1043868 - RNA, 19 nt, Homo sapiens
gggugaggaaguagcauug

SEQ ID NO: 1043869 - RNA, 19 nt, Homo sapiens
gcauauagccauucuuaaa

SEQ ID NO: 1043870 - RNA, 19 nt, Homo sapiens
gaagacaaaggucaaauau

SEQ ID NO: 1043871 - RNA, 19 nt, Homo sapiens
uggaagagcuguucucaga

SEQ ID NO: 1043872 - RNA, 19 nt, Homo sapiens
gagcaucacuacagucuca

SEQ ID NO: 1043873 - RNA, 19 nt, Homo sapiens
uugaaacgcuggagacuaa

SEQ ID NO: 1043874 - RNA, 19 nt, Homo sapiens
gugcauauagccauucuua

SEQ ID NO: 1043875 - RNA, 19 nt, Homo sapiens
cgccugcgcugcucuguua

SEQ ID NO: 1043876 - RNA, 19 nt, Homo sapiens
ggacaugucucuggugaag

SEQ ID NO: 1043877 - RNA, 19 nt, Homo sapiens
guugaagucuagaaugaaa

SEQ ID NO: 1043878 - RNA, 19 nt, Homo sapiens
agaggaagcuuucacaagu

SEQ ID NO: 1043879 - RNA, 19 nt, Homo sapiens
gugugauacuucuucauua

SEQ ID NO: 1043880 - RNA, 19 nt, Homo sapiens
gaaagaaaucugaauccau

SEQ ID NO: 1043881 - RNA, 19 nt, Homo sapiens
ugaagacaaaggucaaaua

SEQ ID NO: 1043882 - RNA, 19 nt, Homo sapiens
gaccuaagaguaaauuaug

SEQ ID NO: 1043883 - RNA, 19 nt, Homo sapiens
gugugaauguaucauguuu

SEQ ID NO: 1043884 - RNA, 19 nt, Homo sapiens
ggacugaagaggaaaugug

SEQ ID NO: 1043885 - RNA, 19 nt, Homo sapiens
gaggaagcuuucacaaguc

SEQ ID NO: 1043886 - RNA, 19 nt, Homo sapiens
acaugucucuggugaaguu

SEQ ID NO: 1043887 - RNA, 19 nt, Homo sapiens
cacgaggacugaagaggaa

SEQ ID NO: 1043888 - RNA, 19 nt, Homo sapiens
ggucaggacacaauguuug

SEQ ID NO: 1043889 - RNA, 19 nt, Homo sapiens
gaaaucugaauccauguca

SEQ ID NO: 1043890 - RNA, 19 nt, Homo sapiens
gcauugacacugagcauca

SEQ ID NO: 1043891 - RNA, 19 nt, Homo sapiens
ugaaagaaaucugaaucca

SEQ ID NO: 1043892 - RNA, 19 nt, Homo sapiens
ccacaucuuccuagaccua

SEQ ID NO: 1043893 - RNA, 19 nt, Homo sapiens
ucacuacagucucagucaa

SEQ ID NO: 1043894 - RNA, 19 nt, Homo sapiens
agguugaagucuagaauga

SEQ ID NO: 1043895 - RNA, 19 nt, Homo sapiens
gcagugagaccugggugaa

SEQ ID NO: 1043896 - RNA, 19 nt, Homo sapiens
ggcagucgcuccuggacau

SEQ ID NO: 1043897 - RNA, 19 nt, Homo sapiens
cuggugaaguugcagcuuu

SEQ ID NO: 1043898 - RNA, 19 nt, Homo sapiens
agucaacagugugaaugua

SEQ ID NO: 1043899 - RNA, 19 nt, Homo sapiens
aaggcuagguugaagucua

SEQ ID NO: 1043900 - RNA, 19 nt, Homo sapiens
agacuggugcugaaacaaa

SEQ ID NO: 1043901 - RNA, 19 nt, Homo sapiens
caacagugugaauguauca

SEQ ID NO: 1043902 - RNA, 19 nt, Homo sapiens
gucacuugaucagauauuu

SEQ ID NO: 1043903 - RNA, 19 nt, Homo sapiens
cauaaccccuugaucugua

SEQ ID NO: 1043904 - RNA, 19 nt, Homo sapiens
cuuccuagaccuaagagua

SEQ ID NO: 1043905 - RNA, 19 nt, Homo sapiens
uuaaaugugugugugauac

SEQ ID NO: 1043906 - RNA, 19 nt, Homo sapiens
cagugugaauguaucaugu

SEQ ID NO: 1043907 - RNA, 19 nt, Homo sapiens
ucaacagugugaauguauc

SEQ ID NO: 1043908 - RNA, 19 nt, Homo sapiens
ccacacacaggguccaguu

SEQ ID NO: 1043909 - RNA, 19 nt, Homo sapiens
cccuugaucuguaguguca

SEQ ID NO: 1043910 - RNA, 19 nt, Homo sapiens
aaucugaauccaugucauu

SEQ ID NO: 1043911 - RNA, 19 nt, Homo sapiens
gguuaaggcuagguugaag

SEQ ID NO: 1043912 - RNA, 19 nt, Homo sapiens
ugugugauacuucuucauu

SEQ ID NO: 1043913 - RNA, 19 nt, Homo sapiens
ucugacgcauugacacuga

SEQ ID NO: 1043914 - RNA, 19 nt, Homo sapiens
ugaagucuagaaugaaaga

SEQ ID NO: 1043915 - RNA, 19 nt, Homo sapiens
acacugagcaucacuacag

SEQ ID NO: 1043916 - RNA, 19 nt, Homo sapiens
cauugcugcuggaugagaa

SEQ ID NO: 1043917 - RNA, 19 nt, Homo sapiens
aaaugugugugugauacuu

SEQ ID NO: 1043918 - RNA, 19 nt, Homo sapiens
cacuugaucagauauuuga

SEQ ID NO: 1043919 - RNA, 19 nt, Homo sapiens
cagaggaagcuuucacaag

SEQ ID NO: 1043920 - RNA, 19 nt, Homo sapiens
cugaagaggaaauguguug

SEQ ID NO: 1043921 - RNA, 19 nt, Homo sapiens
uuagacuggugcugaaaca

SEQ ID NO: 1043922 - RNA, 19 nt, Homo sapiens
acacagccacaucuuccua

SEQ ID NO: 1043923 - RNA, 19 nt, Homo sapiens
ucacuugaucagauauuug

SEQ ID NO: 1043924 - RNA, 19 nt, Homo sapiens
aggaagcuuucacaaguca

SEQ ID NO: 1043925 - RNA, 19 nt, Homo sapiens
gauggauggcccucgagaa

SEQ ID NO: 1043926 - RNA, 19 nt, Homo sapiens
gcagauccaagaggagaug

SEQ ID NO: 1043927 - RNA, 19 nt, Homo sapiens
ccucgguggugccuucuca

SEQ ID NO: 1043928 - RNA, 19 nt, Homo sapiens
gacugaagaggaaaugugu

SEQ ID NO: 1043929 - RNA, 19 nt, Homo sapiens
gauacuucuucauuauguc

SEQ ID NO: 1043930 - RNA, 19 nt, Homo sapiens
gaccuggacacaguacuga

SEQ ID NO: 1043931 - RNA, 19 nt, Homo sapiens
ccucaccccuuaaccaaaa

SEQ ID NO: 1043932 - RNA, 19 nt, Homo sapiens
uuucucaugcuuucucuaa

SEQ ID NO: 1043933 - RNA, 19 nt, Homo sapiens
ucucaugcuuucucuaacu

SEQ ID NO: 1043934 - RNA, 19 nt, Homo sapiens
uggugaaguugcagcuuug

SEQ ID NO: 1043935 - RNA, 19 nt, Homo sapiens
acuacgaccuggacacagu

SEQ ID NO: 1043936 - RNA, 19 nt, Homo sapiens
cacaggguccaguuucuga

SEQ ID NO: 1043937 - RNA, 19 nt, Homo sapiens
acacacaggguccaguuuc

SEQ ID NO: 1043938 - RNA, 19 nt, Homo sapiens
cuaacuuccucaccccuua

SEQ ID NO: 1043939 - RNA, 19 nt, Homo sapiens
ccaacacgguccggcagau

SEQ ID NO: 1043940 - RNA, 19 nt, Homo sapiens
uuccuagaccuaagaguaa

SEQ ID NO: 1043941 - RNA, 19 nt, Homo sapiens
gugauacuucuucauuaug

SEQ ID NO: 1043942 - RNA, 19 nt, Homo sapiens
gucaacagugugaauguau

SEQ ID NO: 1043943 - RNA, 19 nt, Homo sapiens
gacuggugcugaaacaaaa

SEQ ID NO: 1043944 - RNA, 19 nt, Homo sapiens
ccuaagaguaaauuaugga

SEQ ID NO: 1043945 - RNA, 19 nt, Homo sapiens
ccacaugcucccuguuucu

SEQ ID NO: 1043946 - RNA, 19 nt, Homo sapiens
cuugaucuguagugucaug

SEQ ID NO: 1043947 - RNA, 19 nt, Homo sapiens
gggugaggaaguagcauug

SEQ ID NO: 1043948 - RNA, 19 nt, Homo sapiens
gaagaaggcuggcccauug

SEQ ID NO: 1043949 - RNA, 19 nt, Homo sapiens
ggagguagauugauaugau

SEQ ID NO: 1043950 - RNA, 19 nt, Homo sapiens
aaacugaagcucucaaaua

SEQ ID NO: 1043951 - RNA, 19 nt, Homo sapiens
gcagaucggugccaaauac

SEQ ID NO: 1043952 - RNA, 19 nt, Homo sapiens
gaaagagcauuggcuguau

SEQ ID NO: 1043953 - RNA, 19 nt, Homo sapiens
gagguagauugauaugaua

SEQ ID NO: 1043954 - RNA, 19 nt, Homo sapiens
cugaagcucucaaauauug

SEQ ID NO: 1043955 - RNA, 19 nt, Homo sapiens
ggacaucgguuauuuuaga

SEQ ID NO: 1043956 - RNA, 19 nt, Homo sapiens
gagagaaugugguuguuag

SEQ ID NO: 1043957 - RNA, 19 nt, Homo sapiens
gcucaucugugcaauuaug

SEQ ID NO: 1043958 - RNA, 19 nt, Homo sapiens
gagaagugcugguggaucu

SEQ ID NO: 1043959 - RNA, 19 nt, Homo sapiens
gggccaagauggaaacaga

SEQ ID NO: 1043960 - RNA, 19 nt, Homo sapiens
gaguggcccuuaaauguau

SEQ ID NO: 1043961 - RNA, 19 nt, Homo sapiens
gcccuuaaauguaucaguu

SEQ ID NO: 1043962 - RNA, 19 nt, Homo sapiens
ggguagagcauguggauaa

SEQ ID NO: 1043963 - RNA, 19 nt, Homo sapiens
ugaggaggcuucugugguu

SEQ ID NO: 1043964 - RNA, 19 nt, Homo sapiens
gcacauccaaccagugaaa

SEQ ID NO: 1043965 - RNA, 19 nt, Homo sapiens
aaugggagguagauugaua

SEQ ID NO: 1043966 - RNA, 19 nt, Homo sapiens
ggcagaaacucuuugauac

SEQ ID NO: 1043967 - RNA, 19 nt, Homo sapiens
ggacucggauggugguaau

SEQ ID NO: 1043968 - RNA, 19 nt, Homo sapiens
aggcucaucugugcaauua

SEQ ID NO: 1043969 - RNA, 19 nt, Homo sapiens
ucucaaauauugcagauag

SEQ ID NO: 1043970 - RNA, 19 nt, Homo sapiens
aaacaucacugagaagcuu

SEQ ID NO: 1043971 - RNA, 19 nt, Homo sapiens
cacaggacaucgguuauuu

SEQ ID NO: 1043972 - RNA, 19 nt, Homo sapiens
gcgaguggcccuuaaaugu

SEQ ID NO: 1043973 - RNA, 19 nt, Homo sapiens
gaguaucgcugaggugaug

SEQ ID NO: 1043974 - RNA, 19 nt, Homo sapiens
caaauuaccaccaaccaau

SEQ ID NO: 1043975 - RNA, 19 nt, Homo sapiens
aacugaagcucucaaauau

SEQ ID NO: 1043976 - RNA, 19 nt, Homo sapiens
guaguugcucugagaaaua

SEQ ID NO: 1043977 - RNA, 19 nt, Homo sapiens
guaaugggagguagauuga

SEQ ID NO: 1043978 - RNA, 19 nt, Homo sapiens
uacauugccuuuccuaguu

SEQ ID NO: 1043979 - RNA, 19 nt, Homo sapiens
gcaugguaaucucuuguug

SEQ ID NO: 1043980 - RNA, 19 nt, Homo sapiens
ucacgugacuauuaagcaa

SEQ ID NO: 1043981 - RNA, 19 nt, Homo sapiens
ugucucacgugacuauuaa

SEQ ID NO: 1043982 - RNA, 19 nt, Homo sapiens
gaccucaguucuggaauug

SEQ ID NO: 1043983 - RNA, 19 nt, Homo sapiens
cgaguggcccuuaaaugua

SEQ ID NO: 1043984 - RNA, 19 nt, Homo sapiens
gcagaaacucuuugauaca

SEQ ID NO: 1043985 - RNA, 19 nt, Homo sapiens
gagagagaaugugguuguu

SEQ ID NO: 1043986 - RNA, 19 nt, Homo sapiens
gguaaugggagguagauug

SEQ ID NO: 1043987 - RNA, 19 nt, Homo sapiens
gaaacagagagaccaguga

SEQ ID NO: 1043988 - RNA, 19 nt, Homo sapiens
gaaggagggccaagaugga

SEQ ID NO: 1043989 - RNA, 19 nt, Homo sapiens
ccucaguucuggaauugaa

SEQ ID NO: 1043990 - RNA, 19 nt, Homo sapiens
ugaccucaguucuggaauu

SEQ ID NO: 1043991 - RNA, 19 nt, Homo sapiens
ucgcugaggugaugagaga

SEQ ID NO: 1043992 - RNA, 19 nt, Homo sapiens
ggagauaacagaaaacuga

SEQ ID NO: 1043993 - RNA, 19 nt, Homo sapiens
agaaauaaccuugagauca

SEQ ID NO: 1043994 - RNA, 19 nt, Homo sapiens
uaguugcucugagaaauaa

SEQ ID NO: 1043995 - RNA, 19 nt, Homo sapiens
gaagagggcccaggguugu

SEQ ID NO: 1043996 - RNA, 19 nt, Homo sapiens
aggcagaaacucuuugaua

SEQ ID NO: 1043997 - RNA, 19 nt, Homo sapiens
gcaaauuaccaccaaccaa

SEQ ID NO: 1043998 - RNA, 19 nt, Homo sapiens
agaaagagcauuggcugua

SEQ ID NO: 1043999 - RNA, 19 nt, Homo sapiens
gaugagagagaaugugguu

SEQ ID NO: 1044000 - RNA, 19 nt, Homo sapiens
gagcauguggauaauggua

SEQ ID NO: 1044001 - RNA, 19 nt, Homo sapiens
gagcugaggaaucguguug

SEQ ID NO: 1044002 - RNA, 19 nt, Homo sapiens
ggucugaggugaugguaac

SEQ ID NO: 1044003 - RNA, 19 nt, Homo sapiens
ggccucggguuucguuauu

SEQ ID NO: 1044004 - RNA, 19 nt, Homo sapiens
ggcucuagaucgauucaaa

SEQ ID NO: 1044005 - RNA, 19 nt, Homo sapiens
ucagcaaaguagagaaaga

SEQ ID NO: 1044006 - RNA, 19 nt, Homo sapiens
ugagaucaauggaguagca

SEQ ID NO: 1044007 - RNA, 19 nt, Homo sapiens
caacauggagagagaaagu

SEQ ID NO: 1044008 - RNA, 19 nt, Homo sapiens
gcaaaggugggcagaaucu

SEQ ID NO: 1044009 - RNA, 19 nt, Homo sapiens
ggaucucuaugcagggauu

SEQ ID NO: 1044010 - RNA, 19 nt, Homo sapiens
ugguauccguuauaaguuu

SEQ ID NO: 1044011 - RNA, 19 nt, Homo sapiens
auacacaggacaucgguua

SEQ ID NO: 1044012 - RNA, 19 nt, Homo sapiens
augcagggauugguuauuu

SEQ ID NO: 1044013 - RNA, 19 nt, Homo sapiens
guucuggaauugaaguuuc

SEQ ID NO: 1044014 - RNA, 19 nt, Homo sapiens
caguguauguucuccuuug

SEQ ID NO: 1044015 - RNA, 19 nt, Homo sapiens
agaaugugguuguuagcaa

SEQ ID NO: 1044016 - RNA, 19 nt, Homo sapiens
ucauuugucuuccauugau

SEQ ID NO: 1044017 - RNA, 19 nt, Homo sapiens
aaagcaggcucuagaucga

SEQ ID NO: 1044018 - RNA, 19 nt, Homo sapiens
agacacaaauucugcacau

SEQ ID NO: 1044019 - RNA, 19 nt, Homo sapiens
gagugaagacuguuuccaa

SEQ ID NO: 1044020 - RNA, 19 nt, Homo sapiens
caaguggucagccgaguug

SEQ ID NO: 1044021 - RNA, 19 nt, Homo sapiens
caagauggaaacagagaga

SEQ ID NO: 1044022 - RNA, 19 nt, Homo sapiens
gcucucaaauauugcagau

SEQ ID NO: 1044023 - RNA, 19 nt, Homo sapiens
gguauccguuauaaguuug

SEQ ID NO: 1044024 - RNA, 19 nt, Homo sapiens
uagagcauguggauaaugg

SEQ ID NO: 1044025 - RNA, 19 nt, Homo sapiens
uggcaaaggugggcagaau

SEQ ID NO: 1044026 - RNA, 19 nt, Homo sapiens
gagaaauaaccuugagauc

SEQ ID NO: 1044027 - RNA, 19 nt, Homo sapiens
uuggaaacaucacugagaa

SEQ ID NO: 1044028 - RNA, 19 nt, Homo sapiens
uguauguucuccuuuggaa

SEQ ID NO: 1044029 - RNA, 19 nt, Homo sapiens
gguagagcauguggauaau

SEQ ID NO: 1044030 - RNA, 19 nt, Homo sapiens
gcaacggcaugguaaucuc

SEQ ID NO: 1044031 - RNA, 19 nt, Homo sapiens
gcagggauugguuauuuua

SEQ ID NO: 1044032 - RNA, 19 nt, Homo sapiens
gcugguggaucucuaugca

SEQ ID NO: 1044033 - RNA, 19 nt, Homo sapiens
uauuuaagaccgggaauuu

SEQ ID NO: 1044034 - RNA, 19 nt, Homo sapiens
aaugagaguuucuuugaac

SEQ ID NO: 1044035 - RNA, 19 nt, Homo sapiens
ccucggguuucguuauuug

SEQ ID NO: 1044036 - RNA, 19 nt, Homo sapiens
caaaguagagaaagagcau

SEQ ID NO: 1044037 - RNA, 19 nt, Homo sapiens
gacgugacccaguguaugu

SEQ ID NO: 1044038 - RNA, 19 nt, Homo sapiens
uuagcaacauggagagaga

SEQ ID NO: 1044039 - RNA, 19 nt, Homo sapiens
guccugugcuggagaagug

SEQ ID NO: 1044040 - RNA, 19 nt, Homo sapiens
cagaaacucuuugauacac

SEQ ID NO: 1044041 - RNA, 19 nt, Homo sapiens
cauuugucuuccauugaua

SEQ ID NO: 1044042 - RNA, 19 nt, Homo sapiens
ugagagagaaugugguugu

SEQ ID NO: 1044043 - RNA, 19 nt, Homo sapiens
agagagaaugugguuguua

SEQ ID NO: 1044044 - RNA, 19 nt, Homo sapiens
cgaguuggaggcugauuug

SEQ ID NO: 1044045 - RNA, 19 nt, Homo sapiens
ggguuucguuauuugcaaa

SEQ ID NO: 1044046 - RNA, 19 nt, Homo sapiens
uuucauuugucuuccauug

SEQ ID NO: 1044047 - RNA, 19 nt, Homo sapiens
ggagcuaccagggauucua

SEQ ID NO: 1044048 - RNA, 19 nt, Homo sapiens
guacaaggcucuaacauug

SEQ ID NO: 1044049 - RNA, 19 nt, Homo sapiens
ggacuuggcugacaucuuc

SEQ ID NO: 1044050 - RNA, 19 nt, Homo sapiens
ucaauucggucauuucauu

SEQ ID NO: 1044051 - RNA, 19 nt, Homo sapiens
ggacagagagccugagaga

SEQ ID NO: 1044052 - RNA, 19 nt, Homo sapiens
gaagagcugcuacccauuc

SEQ ID NO: 1044053 - RNA, 19 nt, Homo sapiens
ugaagaacaucgugcacaa

SEQ ID NO: 1044054 - RNA, 19 nt, Homo sapiens
cuaagcagaucaguuuauu

SEQ ID NO: 1044055 - RNA, 19 nt, Homo sapiens
gcgagaaccucuacaccau

SEQ ID NO: 1044056 - RNA, 19 nt, Homo sapiens
acagagagccugagagaga

SEQ ID NO: 1044057 - RNA, 19 nt, Homo sapiens
gcaacgacucucugaggua

SEQ ID NO: 1044058 - RNA, 19 nt, Homo sapiens
uaacauugcuggacuaccu

SEQ ID NO: 1044059 - RNA, 19 nt, Homo sapiens
gaacaucgugcacaacuac

SEQ ID NO: 1044060 - RNA, 19 nt, Homo sapiens
gcacuaacccagccaagca

SEQ ID NO: 1044061 - RNA, 19 nt, Homo sapiens
guggaucaccggcuguuua

SEQ ID NO: 1044062 - RNA, 19 nt, Homo sapiens
gaaaggaggaggagaagcu

SEQ ID NO: 1044063 - RNA, 19 nt, Homo sapiens
gaucaccggcuguuuagga

SEQ ID NO: 1044064 - RNA, 19 nt, Homo sapiens
ucucagcucucaccaagug

SEQ ID NO: 1044065 - RNA, 19 nt, Homo sapiens
gguggugccucgaccuuug

SEQ ID NO: 1044066 - RNA, 19 nt, Homo sapiens
gccaggcugucacucaauu

SEQ ID NO: 1044067 - RNA, 19 nt, Homo sapiens
gaucccggcuacauaaucu

SEQ ID NO: 1044068 - RNA, 19 nt, Homo sapiens
ucacucaauucggucauuu

SEQ ID NO: 1044069 - RNA, 19 nt, Homo sapiens
ggguacugcuuacgugcua

SEQ ID NO: 1044070 - RNA, 19 nt, Homo sapiens
caagagacaauaggccuuu

SEQ ID NO: 1044071 - RNA, 19 nt, Homo sapiens
gcuaacagcaagagacaau

SEQ ID NO: 1044072 - RNA, 19 nt, Homo sapiens
cccgggagcuagaaacuga

SEQ ID NO: 1044073 - RNA, 19 nt, Homo sapiens
ucaaggacuuccaguacau

SEQ ID NO: 1044074 - RNA, 19 nt, Homo sapiens
ucgcugaccugaccuucaa

SEQ ID NO: 1044075 - RNA, 19 nt, Homo sapiens
caggaucccggcuacauaa

SEQ ID NO: 1044076 - RNA, 19 nt, Homo sapiens
gcuaagcagaucaguuuau

SEQ ID NO: 1044077 - RNA, 19 nt, Homo sapiens
caacuacuccgaggcagaa

SEQ ID NO: 1044078 - RNA, 19 nt, Homo sapiens
ggccuuuguuccuauuuau

SEQ ID NO: 1044079 - RNA, 19 nt, Homo sapiens
uaacagcaagagacaauag

SEQ ID NO: 1044080 - RNA, 19 nt, Homo sapiens
ggccgacgcuaaaccagau

SEQ ID NO: 1044081 - RNA, 19 nt, Homo sapiens
ggcaggagcacgagaagga

SEQ ID NO: 1044082 - RNA, 19 nt, Homo sapiens
ugauggcccugcucaagga

SEQ ID NO: 1044083 - RNA, 19 nt, Homo sapiens
ucggucauuucauucauuu

SEQ ID NO: 1044084 - RNA, 19 nt, Homo sapiens
ucaggaucccggcuacaua

SEQ ID NO: 1044085 - RNA, 19 nt, Homo sapiens
agagaaaggaggaggagaa

SEQ ID NO: 1044086 - RNA, 19 nt, Homo sapiens
agaacaucgugcacaacua

SEQ ID NO: 1044087 - RNA, 19 nt, Homo sapiens
gcccauccuucgagacugu

SEQ ID NO: 1044088 - RNA, 19 nt, Homo sapiens
uguacaaggcucuaacauu

SEQ ID NO: 1044089 - RNA, 19 nt, Homo sapiens
gaacuggcggcacguguac

SEQ ID NO: 1044090 - RNA, 19 nt, Homo sapiens
aggccuuuguuccuauuua

SEQ ID NO: 1044091 - RNA, 19 nt, Homo sapiens
ggaagagcugcuacccauu

SEQ ID NO: 1044092 - RNA, 19 nt, Homo sapiens
uaacccagccaagcaaaga

SEQ ID NO: 1044093 - RNA, 19 nt, Homo sapiens
ucucaacccucaccuccau

SEQ ID NO: 1044094 - RNA, 19 nt, Homo sapiens
ucucugagguagaaaauau

SEQ ID NO: 1044095 - RNA, 19 nt, Homo sapiens
ugccaaaccuccagaaucc

SEQ ID NO: 1044096 - RNA, 19 nt, Homo sapiens
gcaaggaccagggcgucaa

SEQ ID NO: 1044097 - RNA, 19 nt, Homo sapiens
gaaggucaagcaggugaug

SEQ ID NO: 1044098 - RNA, 19 nt, Homo sapiens
cuguggagcuggaccuguu

SEQ ID NO: 1044099 - RNA, 19 nt, Homo sapiens
ccuccagaauccacagaga

SEQ ID NO: 1044100 - RNA, 19 nt, Homo sapiens
ccucgaccuuugacccauu

SEQ ID NO: 1044101 - RNA, 19 nt, Homo sapiens
gaacucuccccacuacaaa

SEQ ID NO: 1044102 - RNA, 19 nt, Homo sapiens
gggcuaacagcaagagaca

SEQ ID NO: 1044103 - RNA, 19 nt, Homo sapiens
uccagacacucaaggacuu

SEQ ID NO: 1044104 - RNA, 19 nt, Homo sapiens
gcgaggccaccagcaauga

SEQ ID NO: 1044105 - RNA, 19 nt, Homo sapiens
ucaaugacagcggcaagaa

SEQ ID NO: 1044106 - RNA, 19 nt, Homo sapiens
gcaccuucgcuuccagaug

SEQ ID NO: 1044107 - RNA, 19 nt, Homo sapiens
gagaaaggaggaggagaag

SEQ ID NO: 1044108 - RNA, 19 nt, Homo sapiens
gaacccacgcccucaagac

SEQ ID NO: 1044109 - RNA, 19 nt, Homo sapiens
agaacuggcggcacgugua

SEQ ID NO: 1044110 - RNA, 19 nt, Homo sapiens
cuuuacagcucuucucaac

SEQ ID NO: 1044111 - RNA, 19 nt, Homo sapiens
ugaccugaccuucaacaca

SEQ ID NO: 1044112 - RNA, 19 nt, Homo sapiens
ccuuuguuccuauuuauug

SEQ ID NO: 1044113 - RNA, 19 nt, Homo sapiens
uggacuaccugcucaagac

SEQ ID NO: 1044114 - RNA, 19 nt, Homo sapiens
gcacguguacaaggcucua

SEQ ID NO: 1044115 - RNA, 19 nt, Homo sapiens
ggggcucaauacaaaauaa

SEQ ID NO: 1044116 - RNA, 19 nt, Homo sapiens
agagagaggagagaaagga

SEQ ID NO: 1044117 - RNA, 19 nt, Homo sapiens
uggcccugcucaaggauga

SEQ ID NO: 1044118 - RNA, 19 nt, Homo sapiens
ggugauggcccugcucaag

SEQ ID NO: 1044119 - RNA, 19 nt, Homo sapiens
cucaaggacuuccaguaca

SEQ ID NO: 1044120 - RNA, 19 nt, Homo sapiens
acaaggcucuaacauugcu

SEQ ID NO: 1044121 - RNA, 19 nt, Homo sapiens
gaagaacaucgugcacaac

SEQ ID NO: 1044122 - RNA, 19 nt, Homo sapiens
gagaacauaucccacauua

SEQ ID NO: 1044123 - RNA, 19 nt, Homo sapiens
gaacaaucaugcuucagaa

SEQ ID NO: 1044124 - RNA, 19 nt, Homo sapiens
gaacauaucccacauuagg

SEQ ID NO: 1044125 - RNA, 19 nt, Homo sapiens
gauuuaagccugagaguuu

SEQ ID NO: 1044126 - RNA, 19 nt, Homo sapiens
gagcauaccuguuuugaaa

SEQ ID NO: 1044127 - RNA, 19 nt, Homo sapiens
ugaaaguagugaugucaua

SEQ ID NO: 1044128 - RNA, 19 nt, Homo sapiens
gaagagauggcguuuguga

SEQ ID NO: 1044129 - RNA, 19 nt, Homo sapiens
cagaacugguugcauguua

SEQ ID NO: 1044130 - RNA, 19 nt, Homo sapiens
gcagaaagcacagaugauu

SEQ ID NO: 1044131 - RNA, 19 nt, Homo sapiens
ccaguaauauaguguugua

SEQ ID NO: 1044132 - RNA, 19 nt, Homo sapiens
gguuugaacugugcuauuu

SEQ ID NO: 1044133 - RNA, 19 nt, Homo sapiens
guagugaugucauaauugu

SEQ ID NO: 1044134 - RNA, 19 nt, Homo sapiens
gggcaggaaugucgggaua

SEQ ID NO: 1044135 - RNA, 19 nt, Homo sapiens
gugcauagcuucugauaac

SEQ ID NO: 1044136 - RNA, 19 nt, Homo sapiens
gugaagagauggcguuugu

SEQ ID NO: 1044137 - RNA, 19 nt, Homo sapiens
ggacaaacacagcguaugu

SEQ ID NO: 1044138 - RNA, 19 nt, Homo sapiens
guguagugcuuaaggguua

SEQ ID NO: 1044139 - RNA, 19 nt, Homo sapiens
gaaaguagugaugucauaa

SEQ ID NO: 1044140 - RNA, 19 nt, Homo sapiens
aagaagaacugguuugauc

SEQ ID NO: 1044141 - RNA, 19 nt, Homo sapiens
ccaauggacugcaucaaca

SEQ ID NO: 1044142 - RNA, 19 nt, Homo sapiens
gcauguuacuuuaggaguu

SEQ ID NO: 1044143 - RNA, 19 nt, Homo sapiens
ggaagaagaacugguuuga

SEQ ID NO: 1044144 - RNA, 19 nt, Homo sapiens
gcugcucacuuuauucuug

SEQ ID NO: 1044145 - RNA, 19 nt, Homo sapiens
gaaauuuacacuccaagau

SEQ ID NO: 1044146 - RNA, 19 nt, Homo sapiens
gaccagacucggcagaaua

SEQ ID NO: 1044147 - RNA, 19 nt, Homo sapiens
ggccuuagggucucuauuu

SEQ ID NO: 1044148 - RNA, 19 nt, Homo sapiens
caccugaucuauuaugaug

SEQ ID NO: 1044149 - RNA, 19 nt, Homo sapiens
auggucaccugaucuauua

SEQ ID NO: 1044150 - RNA, 19 nt, Homo sapiens
cgagagcgcuaucgagaca

SEQ ID NO: 1044151 - RNA, 19 nt, Homo sapiens
agaguuagguguagugcuu

SEQ ID NO: 1044152 - RNA, 19 nt, Homo sapiens
gcagggcauuucuguuugu

SEQ ID NO: 1044153 - RNA, 19 nt, Homo sapiens
caaucaugcuucagaaauc

SEQ ID NO: 1044154 - RNA, 19 nt, Homo sapiens
uugaagcgcuggaagaaga

SEQ ID NO: 1044155 - RNA, 19 nt, Homo sapiens
gagauggcguuugugaaga

SEQ ID NO: 1044156 - RNA, 19 nt, Homo sapiens
guucgcaggugaagagaug

SEQ ID NO: 1044157 - RNA, 19 nt, Homo sapiens
gcagugagccaagauagug

SEQ ID NO: 1044158 - RNA, 19 nt, Homo sapiens
guaauauaguguuguaugc

SEQ ID NO: 1044159 - RNA, 19 nt, Homo sapiens
gauggucaccugaucuauu

SEQ ID NO: 1044160 - RNA, 19 nt, Homo sapiens
gaaaccccaucucuacuaa

SEQ ID NO: 1044161 - RNA, 19 nt, Homo sapiens
ugagggcuuuaauccuuua

SEQ ID NO: 1044162 - RNA, 19 nt, Homo sapiens
uauuugagcauaccuguuu

SEQ ID NO: 1044163 - RNA, 19 nt, Homo sapiens
ggaaauuuacacuccaaga

SEQ ID NO: 1044164 - RNA, 19 nt, Homo sapiens
guaugccuauugagugauu

SEQ ID NO: 1044165 - RNA, 19 nt, Homo sapiens
ggaaaacaauuagucuuug

SEQ ID NO: 1044166 - RNA, 19 nt, Homo sapiens
ggagaacauaucccacauu

SEQ ID NO: 1044167 - RNA, 19 nt, Homo sapiens
gauaacccugugugcaaua

SEQ ID NO: 1044168 - RNA, 19 nt, Homo sapiens
guacccauaugcaggacuu

SEQ ID NO: 1044169 - RNA, 19 nt, Homo sapiens
cugguugcauguuacuuua

SEQ ID NO: 1044170 - RNA, 19 nt, Homo sapiens
aacccugugugcaauaaua

SEQ ID NO: 1044171 - RNA, 19 nt, Homo sapiens
gagugauuguggcaagaaa

SEQ ID NO: 1044172 - RNA, 19 nt, Homo sapiens
ccacagagaaggguuugaa

SEQ ID NO: 1044173 - RNA, 19 nt, Homo sapiens
gaagaacugguuugaucug

SEQ ID NO: 1044174 - RNA, 19 nt, Homo sapiens
gaagaagaacugguuugau

SEQ ID NO: 1044175 - RNA, 19 nt, Homo sapiens
gcaacucucagaauaccuu

SEQ ID NO: 1044176 - RNA, 19 nt, Homo sapiens
ugcuuggccuggaaauuua

SEQ ID NO: 1044177 - RNA, 19 nt, Homo sapiens
cagauuguuugucgagaug

SEQ ID NO: 1044178 - RNA, 19 nt, Homo sapiens
uuugagggcuuuaauccuu

SEQ ID NO: 1044179 - RNA, 19 nt, Homo sapiens
cauguuacuuuaggaguug

SEQ ID NO: 1044180 - RNA, 19 nt, Homo sapiens
agagaaggguuugaacugu

SEQ ID NO: 1044181 - RNA, 19 nt, Homo sapiens
ccacauuaggaauugauuu

SEQ ID NO: 1044182 - RNA, 19 nt, Homo sapiens
ccagauuguuugucgagau

SEQ ID NO: 1044183 - RNA, 19 nt, Homo sapiens
gcaggagaauagugugaac

SEQ ID NO: 1044184 - RNA, 19 nt, Homo sapiens
uugugcaacucucagaaua

SEQ ID NO: 1044185 - RNA, 19 nt, Homo sapiens
uugcagggcauuucuguuu

SEQ ID NO: 1044186 - RNA, 19 nt, Homo sapiens
gcuggaagaagaacugguu

SEQ ID NO: 1044187 - RNA, 19 nt, Homo sapiens
gcaggaaugucgggauacu

SEQ ID NO: 1044188 - RNA, 19 nt, Homo sapiens
gguaagcucccagguacuu

SEQ ID NO: 1044189 - RNA, 19 nt, Homo sapiens
cuacagcuucuuugcguuu

SEQ ID NO: 1044190 - RNA, 19 nt, Homo sapiens
aauuuacacuccaagauuc

SEQ ID NO: 1044191 - RNA, 19 nt, Homo sapiens
cagaaagcacagaugauug

SEQ ID NO: 1044192 - RNA, 19 nt, Homo sapiens
gggaaaacaauuagucuuu

SEQ ID NO: 1044193 - RNA, 19 nt, Homo sapiens
uaucccacauuaggaauug

SEQ ID NO: 1044194 - RNA, 19 nt, Homo sapiens
ucacuuuauucuuguaugg

SEQ ID NO: 1044195 - RNA, 19 nt, Homo sapiens
ccgaggcuauggugugaga

SEQ ID NO: 1044196 - RNA, 19 nt, Homo sapiens
guugguaagcucccaggua

SEQ ID NO: 1044197 - RNA, 19 nt, Homo sapiens
cauguuaugccaguaauau

SEQ ID NO: 1044198 - RNA, 19 nt, Homo sapiens
uaugugggcucugcaguca

SEQ ID NO: 1044199 - RNA, 19 nt, Homo sapiens
cgagaugggaaaacaauua

SEQ ID NO: 1044200 - RNA, 19 nt, Homo sapiens
uguaaucccagcacuuuga

SEQ ID NO: 1044201 - RNA, 19 nt, Homo sapiens
gccgauggcucaggaugau

SEQ ID NO: 1044202 - RNA, 19 nt, Homo sapiens
ugaugugcauagcuucuga

SEQ ID NO: 1044203 - RNA, 19 nt, Homo sapiens
ccuguaaucccagcacuuu

SEQ ID NO: 1044204 - RNA, 19 nt, Homo sapiens
gcacuggcucauuccaaga

SEQ ID NO: 1044205 - RNA, 19 nt, Homo sapiens
cagagaaggguuugaacug

SEQ ID NO: 1044206 - RNA, 19 nt, Homo sapiens
cuucuuugcguuuaacuuu

SEQ ID NO: 1044207 - RNA, 19 nt, Homo sapiens
aguguuguaugccuauuga

SEQ ID NO: 1044208 - RNA, 19 nt, Homo sapiens
acaaucaugcuucagaaau

SEQ ID NO: 1044209 - RNA, 19 nt, Homo sapiens
ugaccagacucggcagaau

SEQ ID NO: 1044210 - RNA, 19 nt, Homo sapiens
gucaccugaucuauuauga

SEQ ID NO: 1044211 - RNA, 19 nt, Homo sapiens
cgacagaguacuauuuuga

SEQ ID NO: 1044212 - RNA, 19 nt, Homo sapiens
caacucucagaauaccuua

SEQ ID NO: 1044213 - RNA, 19 nt, Homo sapiens
guaccacagagaaggguuu

SEQ ID NO: 1044214 - RNA, 19 nt, Homo sapiens
ugauaacccugugugcaau

SEQ ID NO: 1044215 - RNA, 19 nt, Homo sapiens
cgaaugggcaggcguaugc

SEQ ID NO: 1044216 - RNA, 19 nt, Homo sapiens
uugcuuggccuggaaauuu

SEQ ID NO: 1044217 - RNA, 19 nt, Homo sapiens
ugugggcucugcagucaug

SEQ ID NO: 1044218 - RNA, 19 nt, Homo sapiens
uacagcuucuuugcguuua

SEQ ID NO: 1044219 - RNA, 19 nt, Homo sapiens
gcuaaccaagucaucauuc

SEQ ID NO: 1044220 - RNA, 19 nt, Homo sapiens
aggcauacuuggagaacau

SEQ ID NO: 1044221 - RNA, 19 nt, Homo sapiens
gaacugguugcauguuacu

SEQ ID NO: 1044222 - RNA, 19 nt, Homo sapiens
ggcaauggcuguccucaua

SEQ ID NO: 1044223 - RNA, 19 nt, Homo sapiens
gaagcuagcuauucaaucu

SEQ ID NO: 1044224 - RNA, 19 nt, Homo sapiens
ugaaagagcugggcaaugu

SEQ ID NO: 1044225 - RNA, 19 nt, Homo sapiens
gaucagggcuggcuauugg

SEQ ID NO: 1044226 - RNA, 19 nt, Homo sapiens
gauagacacuucccugaga

SEQ ID NO: 1044227 - RNA, 19 nt, Homo sapiens
gagagaacaucacaaaguc

SEQ ID NO: 1044228 - RNA, 19 nt, Homo sapiens
cuacugaauugcuauguga

SEQ ID NO: 1044229 - RNA, 19 nt, Homo sapiens
aaagagagaacaucacaaa

SEQ ID NO: 1044230 - RNA, 19 nt, Homo sapiens
cccaaaguccauuauauua

SEQ ID NO: 1044231 - RNA, 19 nt, Homo sapiens
auacucaccuggauuaaug

SEQ ID NO: 1044232 - RNA, 19 nt, Homo sapiens
gagauuagaagcuagcuau

SEQ ID NO: 1044233 - RNA, 19 nt, Homo sapiens
ugaaagagcugggcaccau

SEQ ID NO: 1044234 - RNA, 19 nt, Homo sapiens
ggcauacucaccuggauua

SEQ ID NO: 1044235 - RNA, 19 nt, Homo sapiens
cauacugucucgcucaaga

SEQ ID NO: 1044236 - RNA, 19 nt, Homo sapiens
gggcucaguuugucuaucu

SEQ ID NO: 1044237 - RNA, 19 nt, Homo sapiens
gcaggagaauugcuugaac

SEQ ID NO: 1044238 - RNA, 19 nt, Homo sapiens
guggugaguucugagauuu

SEQ ID NO: 1044239 - RNA, 19 nt, Homo sapiens
gaauugcuaugugacuguu

SEQ ID NO: 1044240 - RNA, 19 nt, Homo sapiens
gaagaguaaauccaaguca

SEQ ID NO: 1044241 - RNA, 19 nt, Homo sapiens
gauccuggcucugcuacug

SEQ ID NO: 1044242 - RNA, 19 nt, Homo sapiens
gaaaccccgucucuacuaa

SEQ ID NO: 1044243 - RNA, 19 nt, Homo sapiens
uuacacggauaaguucuuu

SEQ ID NO: 1044244 - RNA, 19 nt, Homo sapiens
agaguaaauccaagucaua

SEQ ID NO: 1044245 - RNA, 19 nt, Homo sapiens
acacuucccugagauuaga

SEQ ID NO: 1044246 - RNA, 19 nt, Homo sapiens
cccaguauguagccucuaa

SEQ ID NO: 1044247 - RNA, 19 nt, Homo sapiens
gaaagagcugggcaauguu

SEQ ID NO: 1044248 - RNA, 19 nt, Homo sapiens
acggauaaguucuuuagug

SEQ ID NO: 1044249 - RNA, 19 nt, Homo sapiens
gugaggagccaaugccaaa

SEQ ID NO: 1044250 - RNA, 19 nt, Homo sapiens
auuagaagcuagcuauuca

SEQ ID NO: 1044251 - RNA, 19 nt, Homo sapiens
ugguacaccugucaacuga

SEQ ID NO: 1044252 - RNA, 19 nt, Homo sapiens
gaaagagcugggcaccauu

SEQ ID NO: 1044253 - RNA, 19 nt, Homo sapiens
gauuagaagcuagcuauuc

SEQ ID NO: 1044254 - RNA, 19 nt, Homo sapiens
cugcauuacugagucauuu

SEQ ID NO: 1044255 - RNA, 19 nt, Homo sapiens
gaaggcagauguggcucau

SEQ ID NO: 1044256 - RNA, 19 nt, Homo sapiens
gcuacugaauugcuaugug

SEQ ID NO: 1044257 - RNA, 19 nt, Homo sapiens
agagagaacaucacaaagu

SEQ ID NO: 1044258 - RNA, 19 nt, Homo sapiens
gcauuacugagucauuuga

SEQ ID NO: 1044259 - RNA, 19 nt, Homo sapiens
caagaucagcuucaaaugc

SEQ ID NO: 1044260 - RNA, 19 nt, Homo sapiens
gaacugugucagcagauca

SEQ ID NO: 1044261 - RNA, 19 nt, Homo sapiens
ggaacugugucagcagauc

SEQ ID NO: 1044262 - RNA, 19 nt, Homo sapiens
ggcuaaggcaggagaauug

SEQ ID NO: 1044263 - RNA, 19 nt, Homo sapiens
gcagaucagggcuggcuau

SEQ ID NO: 1044264 - RNA, 19 nt, Homo sapiens
gcugccuucuccuccauuu

SEQ ID NO: 1044265 - RNA, 19 nt, Homo sapiens
ccuacugggugcaacaaug

SEQ ID NO: 1044266 - RNA, 19 nt, Homo sapiens
agacacuucccugagauua

SEQ ID NO: 1044267 - RNA, 19 nt, Homo sapiens
guucuuuaguggugaguuc

SEQ ID NO: 1044268 - RNA, 19 nt, Homo sapiens
aagaucagcuucaaaugcu

SEQ ID NO: 1044269 - RNA, 19 nt, Homo sapiens
gcucaagaucagcuucaaa

SEQ ID NO: 1044270 - RNA, 19 nt, Homo sapiens
ucccugagauuagaagcua

SEQ ID NO: 1044271 - RNA, 19 nt, Homo sapiens
gcaccuguagucccagcua

SEQ ID NO: 1044272 - RNA, 19 nt, Homo sapiens
gaguaaauccaagucauag

SEQ ID NO: 1044273 - RNA, 19 nt, Homo sapiens
uggcucugcuacugaauug

SEQ ID NO: 1044274 - RNA, 19 nt, Homo sapiens
cagaaagacaggauagaca

SEQ ID NO: 1044275 - RNA, 19 nt, Homo sapiens
caaagucaggaguucaaga

SEQ ID NO: 1044276 - RNA, 19 nt, Homo sapiens
caucacaaagucaggaguu

SEQ ID NO: 1044277 - RNA, 19 nt, Homo sapiens
gaauugcuugaaccuggua

SEQ ID NO: 1044278 - RNA, 19 nt, Homo sapiens
ggaagaguaaauccaaguc

SEQ ID NO: 1044279 - RNA, 19 nt, Homo sapiens
uuagauuucucaggucaug

SEQ ID NO: 1044280 - RNA, 19 nt, Homo sapiens
aagaguaaauccaagucau

SEQ ID NO: 1044281 - RNA, 19 nt, Homo sapiens
gauucuuucucaucuuucu

SEQ ID NO: 1044282 - RNA, 19 nt, Homo sapiens
acacggauaaguucuuuag

SEQ ID NO: 1044283 - RNA, 19 nt, Homo sapiens
guaaauccaagucauagcu

SEQ ID NO: 1044284 - RNA, 19 nt, Homo sapiens
uaaggcaggagaauugcuu

SEQ ID NO: 1044285 - RNA, 19 nt, Homo sapiens
aguggugaguucugagauu

SEQ ID NO: 1044286 - RNA, 19 nt, Homo sapiens
caauggcuguccucauacu

SEQ ID NO: 1044287 - RNA, 19 nt, Homo sapiens
gaaagacaggauagacacu

SEQ ID NO: 1044288 - RNA, 19 nt, Homo sapiens
uuugcauccucauagcuua

SEQ ID NO: 1044289 - RNA, 19 nt, Homo sapiens
ccagggcucaguuugucua

SEQ ID NO: 1044290 - RNA, 19 nt, Homo sapiens
uagaagcuagcuauucaau

SEQ ID NO: 1044291 - RNA, 19 nt, Homo sapiens
aagacaggauagacacuuc

SEQ ID NO: 1044292 - RNA, 19 nt, Homo sapiens
caccuggauuaaugagcua

SEQ ID NO: 1044293 - RNA, 19 nt, Homo sapiens
uagucuggcugcauuacug

SEQ ID NO: 1044294 - RNA, 19 nt, Homo sapiens
gugaagaggcaaggccaaa

SEQ ID NO: 1044295 - RNA, 19 nt, Homo sapiens
aaagagcugggcaauguuc

SEQ ID NO: 1044296 - RNA, 19 nt, Homo sapiens
cacaaagucaggaguucaa

SEQ ID NO: 1044297 - RNA, 19 nt, Homo sapiens
cagaaucuccccagaaaga

SEQ ID NO: 1044298 - RNA, 19 nt, Homo sapiens
cccagaaucuccccagaaa

SEQ ID NO: 1044299 - RNA, 19 nt, Homo sapiens
ucacccugccugugccaua

SEQ ID NO: 1044300 - RNA, 19 nt, Homo sapiens
gcaauggcuguccucauac

SEQ ID NO: 1044301 - RNA, 19 nt, Homo sapiens
guucugagauuuugguaca

SEQ ID NO: 1044302 - RNA, 19 nt, Homo sapiens
uaaauccaagucauagcuu

SEQ ID NO: 1044303 - RNA, 19 nt, Homo sapiens
gcauacucaccuggauuaa

SEQ ID NO: 1044304 - RNA, 19 nt, Homo sapiens
ccauagucuggcugcauua

SEQ ID NO: 1044305 - RNA, 19 nt, Homo sapiens
ucaagaucagcuucaaaug

SEQ ID NO: 1044306 - RNA, 19 nt, Homo sapiens
gcuuagcucccacuuaaaa

SEQ ID NO: 1044307 - RNA, 19 nt, Homo sapiens
ggaccaguuccgccucuag

SEQ ID NO: 1044308 - RNA, 19 nt, Homo sapiens
aaagagcugggcaccauuc

SEQ ID NO: 1044309 - RNA, 19 nt, Homo sapiens
ggcaggagaauugcuugaa

SEQ ID NO: 1044310 - RNA, 19 nt, Homo sapiens
cucaagaucagcuucaaau

SEQ ID NO: 1044311 - RNA, 19 nt, Homo sapiens
ggaccaaggcuaggcuuuu

SEQ ID NO: 1044312 - RNA, 19 nt, Homo sapiens
ccaguuccgccucuagugu

SEQ ID NO: 1044313 - RNA, 19 nt, Homo sapiens
ggacugguguauauuaaua

SEQ ID NO: 1044314 - RNA, 19 nt, Homo sapiens
gguuaggacuucaguauaa

SEQ ID NO: 1044315 - RNA, 19 nt, Homo sapiens
uaaagagccuagugaauga

SEQ ID NO: 1044316 - RNA, 19 nt, Homo sapiens
gagaggagacgauguuaaa

SEQ ID NO: 1044317 - RNA, 19 nt, Homo sapiens
ggacacaauuuagaacuau

SEQ ID NO: 1044318 - RNA, 19 nt, Homo sapiens
caaaguagacaguccaauu

SEQ ID NO: 1044319 - RNA, 19 nt, Homo sapiens
gaaagaaaaugggagaaaa

SEQ ID NO: 1044320 - RNA, 19 nt, Homo sapiens
gaacuaugcacaucauuag

SEQ ID NO: 1044321 - RNA, 19 nt, Homo sapiens
gggacacaauuuagaacua

SEQ ID NO: 1044322 - RNA, 19 nt, Homo sapiens
guuaaugcagugauacuua

SEQ ID NO: 1044323 - RNA, 19 nt, Homo sapiens
ugacucccauacaccauua

SEQ ID NO: 1044324 - RNA, 19 nt, Homo sapiens
caagggagccuguaagagu

SEQ ID NO: 1044325 - RNA, 19 nt, Homo sapiens
aaaguagacaguccaauuu

SEQ ID NO: 1044326 - RNA, 19 nt, Homo sapiens
gaccucaucuugacuacau

SEQ ID NO: 1044327 - RNA, 19 nt, Homo sapiens
gaggagacgauguuaaaga

SEQ ID NO: 1044328 - RNA, 19 nt, Homo sapiens
ggacugaggguuaggacuu

SEQ ID NO: 1044329 - RNA, 19 nt, Homo sapiens
ugagguuaaugcagugaua

SEQ ID NO: 1044330 - RNA, 19 nt, Homo sapiens
caggacugguguauauuaa

SEQ ID NO: 1044331 - RNA, 19 nt, Homo sapiens
ugccagaaaugcuacauga

SEQ ID NO: 1044332 - RNA, 19 nt, Homo sapiens
uuaaagagccuagugaaug

SEQ ID NO: 1044333 - RNA, 19 nt, Homo sapiens
caucuugacuacaucugaa

SEQ ID NO: 1044334 - RNA, 19 nt, Homo sapiens
agaacuaugcacaucauua

SEQ ID NO: 1044335 - RNA, 19 nt, Homo sapiens
caaguaaggucacauucac

SEQ ID NO: 1044336 - RNA, 19 nt, Homo sapiens
gacaagggagccuguaaga

SEQ ID NO: 1044337 - RNA, 19 nt, Homo sapiens
cacaggagauuuuccauuu

SEQ ID NO: 1044338 - RNA, 19 nt, Homo sapiens
guaagagucagcccuccua

SEQ ID NO: 1044339 - RNA, 19 nt, Homo sapiens
gaaaccccgucucuacuaa

SEQ ID NO: 1044340 - RNA, 19 nt, Homo sapiens
agucagcccuccuacaaga

SEQ ID NO: 1044341 - RNA, 19 nt, Homo sapiens
ucacaggacugaggguuag

SEQ ID NO: 1044342 - RNA, 19 nt, Homo sapiens
cuacaagacugagcagagu

SEQ ID NO: 1044343 - RNA, 19 nt, Homo sapiens
ggguuaggacuucaguaua

SEQ ID NO: 1044344 - RNA, 19 nt, Homo sapiens
cuacaugagcagaaagaaa

SEQ ID NO: 1044345 - RNA, 19 nt, Homo sapiens
uggagaccauccuggcuaa

SEQ ID NO: 1044346 - RNA, 19 nt, Homo sapiens
gaaaagcaagcaauggauu

SEQ ID NO: 1044347 - RNA, 19 nt, Homo sapiens
ucaaguaaggucacauuca

SEQ ID NO: 1044348 - RNA, 19 nt, Homo sapiens
gacacaauuuagaacuaug

SEQ ID NO: 1044349 - RNA, 19 nt, Homo sapiens
agagucagcccuccuacaa

SEQ ID NO: 1044350 - RNA, 19 nt, Homo sapiens
gacaguccaauuucucuug

SEQ ID NO: 1044351 - RNA, 19 nt, Homo sapiens
guuaaagagccuagugaau

SEQ ID NO: 1044352 - RNA, 19 nt, Homo sapiens
gagaugccacaggagauuu

SEQ ID NO: 1044353 - RNA, 19 nt, Homo sapiens
ugagaggagacgauguuaa

SEQ ID NO: 1044354 - RNA, 19 nt, Homo sapiens
ggugaccucaucuugacua

SEQ ID NO: 1044355 - RNA, 19 nt, Homo sapiens
ccacucuggugaccucauc

SEQ ID NO: 1044356 - RNA, 19 nt, Homo sapiens
cccauaaucccagcacuuu

SEQ ID NO: 1044357 - RNA, 19 nt, Homo sapiens
gauguuaaagagccuagug

SEQ ID NO: 1044358 - RNA, 19 nt, Homo sapiens
uuagaacuaugcacaucau

SEQ ID NO: 1044359 - RNA, 19 nt, Homo sapiens
gagaaaagcaagcaaugga

SEQ ID NO: 1044360 - RNA, 19 nt, Homo sapiens
ccauggaaaggcuuacuug

SEQ ID NO: 1044361 - RNA, 19 nt, Homo sapiens
gaucacgagcucaggagau

SEQ ID NO: 1044362 - RNA, 19 nt, Homo sapiens
cauaaucccagcacuuugg

SEQ ID NO: 1044363 - RNA, 19 nt, Homo sapiens
aggagacgauguuaaagag

SEQ ID NO: 1044364 - RNA, 19 nt, Homo sapiens
aaugagaggagacgauguu

SEQ ID NO: 1044365 - RNA, 19 nt, Homo sapiens
gacugaggguuaggacuuc

SEQ ID NO: 1044366 - RNA, 19 nt, Homo sapiens
gagaccauccuggcuaaca

SEQ ID NO: 1044367 - RNA, 19 nt, Homo sapiens
cuuacuugcugccagaaau

SEQ ID NO: 1044368 - RNA, 19 nt, Homo sapiens
cggaagcugguccauggua

SEQ ID NO: 1044369 - RNA, 19 nt, Homo sapiens
gaggcugacucccauacac

SEQ ID NO: 1044370 - RNA, 19 nt, Homo sapiens
aaagcaagcaauggauuug

SEQ ID NO: 1044371 - RNA, 19 nt, Homo sapiens
guagacaguccaauuucuc

SEQ ID NO: 1044372 - RNA, 19 nt, Homo sapiens
caccuugcccuacgccaaa

SEQ ID NO: 1044373 - RNA, 19 nt, Homo sapiens
caguggcucacacccauaa

SEQ ID NO: 1044374 - RNA, 19 nt, Homo sapiens
gacaaugagaggagacgau

SEQ ID NO: 1044375 - RNA, 19 nt, Homo sapiens
gcacauacaugaaauagug

SEQ ID NO: 1044376 - RNA, 19 nt, Homo sapiens
gaagacaguuucaagcaaa

SEQ ID NO: 1044377 - RNA, 19 nt, Homo sapiens
cauaggaguuucaaugaua

SEQ ID NO: 1044378 - RNA, 19 nt, Homo sapiens
ggaaaugucccaaucagaa

SEQ ID NO: 1044379 - RNA, 19 nt, Homo sapiens
gcauggcacuugagaaaug

SEQ ID NO: 1044380 - RNA, 19 nt, Homo sapiens
caacauaggaguuucaaug

SEQ ID NO: 1044381 - RNA, 19 nt, Homo sapiens
gccaugagcuccaauuauc

SEQ ID NO: 1044382 - RNA, 19 nt, Homo sapiens
ccauugagauuuauguguu

SEQ ID NO: 1044383 - RNA, 19 nt, Homo sapiens
gaaacugucauugcacuuu

SEQ ID NO: 1044384 - RNA, 19 nt, Homo sapiens
ccacacacacugaagagua

SEQ ID NO: 1044385 - RNA, 19 nt, Homo sapiens
ucacaguucucacauaugg

SEQ ID NO: 1044386 - RNA, 19 nt, Homo sapiens
ugaagaacaugaagacagu

SEQ ID NO: 1044387 - RNA, 19 nt, Homo sapiens
gagcuccaauuaucucaga

SEQ ID NO: 1044388 - RNA, 19 nt, Homo sapiens
cuaaaggcauggcacuuga

SEQ ID NO: 1044389 - RNA, 19 nt, Homo sapiens
gcacauacaggcacauaca

SEQ ID NO: 1044390 - RNA, 19 nt, Homo sapiens
aaacauggaaccucacaaa

SEQ ID NO: 1044391 - RNA, 19 nt, Homo sapiens
cgucauucauccacauuaa

SEQ ID NO: 1044392 - RNA, 19 nt, Homo sapiens
ccucacaguucucacauau

SEQ ID NO: 1044393 - RNA, 19 nt, Homo sapiens
cauggaaccucacaaaguc

SEQ ID NO: 1044394 - RNA, 19 nt, Homo sapiens
uagaaucuguuuccucuca

SEQ ID NO: 1044395 - RNA, 19 nt, Homo sapiens
cccuagaaauccuaugaua

SEQ ID NO: 1044396 - RNA, 19 nt, Homo sapiens
cugaguagcugggccuaua

SEQ ID NO: 1044397 - RNA, 19 nt, Homo sapiens
gaagugaagaacaugaaga

SEQ ID NO: 1044398 - RNA, 19 nt, Homo sapiens
gcaaaaguuucaguacuaa

SEQ ID NO: 1044399 - RNA, 19 nt, Homo sapiens
gaguuucaaugauaucuag

SEQ ID NO: 1044400 - RNA, 19 nt, Homo sapiens
ccugagggcugccuagaau

SEQ ID NO: 1044401 - RNA, 19 nt, Homo sapiens
ucaaacuccugaccucaug

SEQ ID NO: 1044402 - RNA, 19 nt, Homo sapiens
caaauuaugaccacacaca

SEQ ID NO: 1044403 - RNA, 19 nt, Homo sapiens
cuaaaugucaccuuguauu

SEQ ID NO: 1044404 - RNA, 19 nt, Homo sapiens
gaugggcuuucacuacguu

SEQ ID NO: 1044405 - RNA, 19 nt, Homo sapiens
cacacacacugaagaguau

SEQ ID NO: 1044406 - RNA, 19 nt, Homo sapiens
agucucuugucuugaauua

SEQ ID NO: 1044407 - RNA, 19 nt, Homo sapiens
guuugucucuuguggugua

SEQ ID NO: 1044408 - RNA, 19 nt, Homo sapiens
gaaaugucccaaucagaag

SEQ ID NO: 1044409 - RNA, 19 nt, Homo sapiens
uaaaagggcucguucaaac

SEQ ID NO: 1044410 - RNA, 19 nt, Homo sapiens
cccuaaaugucaccuugua

SEQ ID NO: 1044411 - RNA, 19 nt, Homo sapiens
aagguacagucagauguua

SEQ ID NO: 1044412 - RNA, 19 nt, Homo sapiens
caagguacagucagauguu

SEQ ID NO: 1044413 - RNA, 19 nt, Homo sapiens
cuaaagugcugggauuaca

SEQ ID NO: 1044414 - RNA, 19 nt, Homo sapiens
acagucagauguuaacagu

SEQ ID NO: 1044415 - RNA, 19 nt, Homo sapiens
ugagauuuauguguucuga

SEQ ID NO: 1044416 - RNA, 19 nt, Homo sapiens
cauacaggcacauacauga

SEQ ID NO: 1044417 - RNA, 19 nt, Homo sapiens
gcaagguacagucagaugu

SEQ ID NO: 1044418 - RNA, 19 nt, Homo sapiens
cggcuuaucccuagaaauc

SEQ ID NO: 1044419 - RNA, 19 nt, Homo sapiens
ccaccacgcccagcuaauu

SEQ ID NO: 1044420 - RNA, 19 nt, Homo sapiens
gaguauguuugucucuugu

SEQ ID NO: 1044421 - RNA, 19 nt, Homo sapiens
caugaaauagugauacuuc

SEQ ID NO: 1044422 - RNA, 19 nt, Homo sapiens
ggauagccaugagcuccaa

SEQ ID NO: 1044423 - RNA, 19 nt, Homo sapiens
aaugugaauuuggcaagua

SEQ ID NO: 1044424 - RNA, 19 nt, Homo sapiens
ucagcaaggugagauuaug

SEQ ID NO: 1044425 - RNA, 19 nt, Homo sapiens
aaauggcaguuucuucuca

SEQ ID NO: 1044426 - RNA, 19 nt, Homo sapiens
aaacugucauugcacuuuc

SEQ ID NO: 1044427 - RNA, 19 nt, Homo sapiens
agucagauguuaacagucu

SEQ ID NO: 1044428 - RNA, 19 nt, Homo sapiens
acagggagaugggacauuc

SEQ ID NO: 1044429 - RNA, 19 nt, Homo sapiens
uaacgucauucauccacau

SEQ ID NO: 1044430 - RNA, 19 nt, Homo sapiens
ggcaguuucuucucagcaa

SEQ ID NO: 1044431 - RNA, 19 nt, Homo sapiens
cugcuuguaugugaauuaa

SEQ ID NO: 1044432 - RNA, 19 nt, Homo sapiens
ugcagucucuugucuugaa

SEQ ID NO: 1044433 - RNA, 19 nt, Homo sapiens
gaaaauggagguugcaauc

SEQ ID NO: 1044434 - RNA, 19 nt, Homo sapiens
ggaguuucaaugauaucua

SEQ ID NO: 1044435 - RNA, 19 nt, Homo sapiens
ucucacauauggaaaggau

SEQ ID NO: 1044436 - RNA, 19 nt, Homo sapiens
gcacuugagaaaugugaau

SEQ ID NO: 1044437 - RNA, 19 nt, Homo sapiens
uaguagagaugggcuuuca

SEQ ID NO: 1044438 - RNA, 19 nt, Homo sapiens
gcaaggugagauuauggaa

SEQ ID NO: 1044439 - RNA, 19 nt, Homo sapiens
ucuagcuacuuacuucauu

SEQ ID NO: 1044440 - RNA, 19 nt, Homo sapiens
cucacaaaguccacuguaa

SEQ ID NO: 1044441 - RNA, 19 nt, Homo sapiens
uagccaugagcuccaauua

SEQ ID NO: 1044442 - RNA, 19 nt, Homo sapiens
ucucuugugguguaaauuu

SEQ ID NO: 1044443 - RNA, 19 nt, Homo sapiens
aggcauggcacuugagaaa

SEQ ID NO: 1044444 - RNA, 19 nt, Homo sapiens
caccacgcccagcuaauuu

SEQ ID NO: 1044445 - RNA, 19 nt, Homo sapiens
gcagucucuugucuugaau

SEQ ID NO: 1044446 - RNA, 19 nt, Homo sapiens
ucugcagucucuugucuug

SEQ ID NO: 1044447 - RNA, 19 nt, Homo sapiens
aaauggagguugcaaucag

SEQ ID NO: 1044448 - RNA, 19 nt, Homo sapiens
acacugaagaguauguuug

SEQ ID NO: 1044449 - RNA, 19 nt, Homo sapiens
acauaggaguuucaaugau

SEQ ID NO: 1044450 - RNA, 19 nt, Homo sapiens
aaagggcucguucaaacaa

SEQ ID NO: 1044451 - RNA, 19 nt, Homo sapiens
cuccauggguaacgucauu

SEQ ID NO: 1044452 - RNA, 19 nt, Homo sapiens
ucuucuagcuacuuacuuc

SEQ ID NO: 1044453 - RNA, 19 nt, Homo sapiens
guaauaucuucauccuucu

SEQ ID NO: 1044454 - RNA, 19 nt, Homo sapiens
guagcugggccuauagguu

SEQ ID NO: 1044455 - RNA, 19 nt, Homo sapiens
aacauaggaguuucaauga

SEQ ID NO: 1044456 - RNA, 19 nt, Homo sapiens
uagugauacuucauucuca

SEQ ID NO: 1044457 - RNA, 19 nt, Homo sapiens
ccuaaaggcauggcacuug

SEQ ID NO: 1044458 - RNA, 19 nt, Homo sapiens
cauugagauuuauguguuc

SEQ ID NO: 1044459 - RNA, 19 nt, Homo sapiens
acaguuucaagcaaaguua

SEQ ID NO: 1044460 - RNA, 19 nt, Homo sapiens
uaaucuuccugcuuguaug

SEQ ID NO: 1044461 - RNA, 19 nt, Homo sapiens
ucaguaauaucuucauccu

SEQ ID NO: 1044462 - RNA, 19 nt, Homo sapiens
acaggcacauacaugaaau

SEQ ID NO: 1044463 - RNA, 19 nt, Homo sapiens
auagcaagguacagucaga

SEQ ID NO: 1044464 - RNA, 19 nt, Homo sapiens
cuccuaaagugcugggauu

SEQ ID NO: 1044465 - RNA, 19 nt, Homo sapiens
cacaaaguccacuguaaca

SEQ ID NO: 1044466 - RNA, 19 nt, Homo sapiens
ucacaaaguccacuguaac

SEQ ID NO: 1044467 - RNA, 19 nt, Homo sapiens
ucacauauggaaaggauac

SEQ ID NO: 1044468 - RNA, 19 nt, Homo sapiens
augauagcaugauguauag

SEQ ID NO: 1044469 - RNA, 19 nt, Homo sapiens
ccaccgcacucggcuuauc

SEQ ID NO: 1044470 - RNA, 19 nt, Homo sapiens
acauggaaccucacaaagu

SEQ ID NO: 1044471 - RNA, 19 nt, Homo sapiens
gaaucuguuuccucucacu

SEQ ID NO: 1044472 - RNA, 19 nt, Homo sapiens
acaguucucacauauggaa

SEQ ID NO: 1044473 - RNA, 19 nt, Homo sapiens
uacaggcacauacaugaaa

SEQ ID NO: 1044474 - RNA, 19 nt, Homo sapiens
acaaauagcaagguacagu

SEQ ID NO: 1044475 - RNA, 19 nt, Homo sapiens
gaaauagggucuuugcaaa

SEQ ID NO: 1044476 - RNA, 19 nt, Homo sapiens
guuaagggcugaaaugugu

SEQ ID NO: 1044477 - RNA, 19 nt, Homo sapiens
ggaaauagggucuuugcaa

SEQ ID NO: 1044478 - RNA, 19 nt, Homo sapiens
gggcauaggugcagugagu

SEQ ID NO: 1044479 - RNA, 19 nt, Homo sapiens
gggcauaggugcagugagu

SEQ ID NO: 1044480 - RNA, 19 nt, Homo sapiens
gggcauaggugcagugagu

SEQ ID NO: 1044481 - RNA, 19 nt, Homo sapiens
aauagggucuuugcaaaua

SEQ ID NO: 1044482 - RNA, 19 nt, Homo sapiens
gcucacaucacccaagaua

SEQ ID NO: 1044483 - RNA, 19 nt, Homo sapiens
gagcgaaacucagucucaa

SEQ ID NO: 1044484 - RNA, 19 nt, Homo sapiens
cugcaaacgugaccuuauu

SEQ ID NO: 1044485 - RNA, 19 nt, Homo sapiens
gcaacaagagcgaaacuca

SEQ ID NO: 1044486 - RNA, 19 nt, Homo sapiens
ccaccucugcuguaaauaa

SEQ ID NO: 1044487 - RNA, 19 nt, Homo sapiens
gagaaggaggcuacaguga

SEQ ID NO: 1044488 - RNA, 19 nt, Homo sapiens
uagggucuuugcaaauaua

SEQ ID NO: 1044489 - RNA, 19 nt, Homo sapiens
gaaaccccaucucuacuaa

SEQ ID NO: 1044490 - RNA, 19 nt, Homo sapiens
cacacuggcugaaugcauu

SEQ ID NO: 1044491 - RNA, 19 nt, Homo sapiens
gagacccugucccuacaaa

SEQ ID NO: 1044492 - RNA, 19 nt, Homo sapiens
gcgccagggugcaaguuga

SEQ ID NO: 1044493 - RNA, 19 nt, Homo sapiens
gcaggagaaucgcuugaac

SEQ ID NO: 1044494 - RNA, 19 nt, Homo sapiens
aacgugaccuuauuuggaa

SEQ ID NO: 1044495 - RNA, 19 nt, Homo sapiens
aaacgugaccuuauuugga

SEQ ID NO: 1044496 - RNA, 19 nt, Homo sapiens
aagccuccauagagaaaua

SEQ ID NO: 1044497 - RNA, 19 nt, Homo sapiens
gagaagccuccauagagaa

SEQ ID NO: 1044498 - RNA, 19 nt, Homo sapiens
gaaaugugucugcugaagu

SEQ ID NO: 1044499 - RNA, 19 nt, Homo sapiens
aaaugugucugcugaaguc

SEQ ID NO: 1044500 - RNA, 19 nt, Homo sapiens
ccuguaaucccaacucuug

SEQ ID NO: 1044501 - RNA, 19 nt, Homo sapiens
gagaccagccugaccaaca

SEQ ID NO: 1044502 - RNA, 19 nt, Homo sapiens
gcauaacccagcaaagcaa

SEQ ID NO: 1044503 - RNA, 19 nt, Homo sapiens
uggugacgcugguuacuug

SEQ ID NO: 1044504 - RNA, 19 nt, Homo sapiens
gauggugcaugcuuguagu

SEQ ID NO: 1044505 - RNA, 19 nt, Homo sapiens
ugaaaugugucugcugaag

SEQ ID NO: 1044506 - RNA, 19 nt, Homo sapiens
uaacagcagcgucaaggau

SEQ ID NO: 1044507 - RNA, 19 nt, Homo sapiens
guacaggugggcacaagug

SEQ ID NO: 1044508 - RNA, 19 nt, Homo sapiens
uggcugaaugcauuaguua

SEQ ID NO: 1044509 - RNA, 19 nt, Homo sapiens
caaagcaaggacuccauga

SEQ ID NO: 1044510 - RNA, 19 nt, Homo sapiens
aaucccagcuacucaggaa

SEQ ID NO: 1044511 - RNA, 19 nt, Homo sapiens
gcuguuaagggcugaaaug

SEQ ID NO: 1044512 - RNA, 19 nt, Homo sapiens
ugccaccucugcuguaaau

SEQ ID NO: 1044513 - RNA, 19 nt, Homo sapiens
ucacaucacccaagauacu

SEQ ID NO: 1044514 - RNA, 19 nt, Homo sapiens
ggucuuugcaaauauaauc

SEQ ID NO: 1044515 - RNA, 19 nt, Homo sapiens
agaccagccugaccaacau

SEQ ID NO: 1044516 - RNA, 19 nt, Homo sapiens
gguaugauggugcaugcuu

SEQ ID NO: 1044517 - RNA, 19 nt, Homo sapiens
aggcagagguugcguugag

SEQ ID NO: 1044518 - RNA, 19 nt, Homo sapiens
uccaugaccugcuguguac

SEQ ID NO: 1044519 - RNA, 19 nt, Homo sapiens
gggagaaggaggcuacagu

SEQ ID NO: 1044520 - RNA, 19 nt, Homo sapiens
caagcugugaugcuguuaa

SEQ ID NO: 1044521 - RNA, 19 nt, Homo sapiens
aaauagggucuuugcaaau

SEQ ID NO: 1044522 - RNA, 19 nt, Homo sapiens
gaaguccuaaaccugcaaa

SEQ ID NO: 1044523 - RNA, 19 nt, Homo sapiens
aacagcagcgucaaggaua

SEQ ID NO: 1044524 - RNA, 19 nt, Homo sapiens
gcacacuggcugaaugcau

SEQ ID NO: 1044525 - RNA, 19 nt, Homo sapiens
gggcacaggauccaauugg

SEQ ID NO: 1044526 - RNA, 19 nt, Homo sapiens
gaaggcugaggcaggagaa

SEQ ID NO: 1044527 - RNA, 19 nt, Homo sapiens
cccaagcugugaugcuguu

SEQ ID NO: 1044528 - RNA, 19 nt, Homo sapiens
ugugucugcugaaguccua

SEQ ID NO: 1044529 - RNA, 19 nt, Homo sapiens
agaagccuccauagagaaa

SEQ ID NO: 1044530 - RNA, 19 nt, Homo sapiens
cgugcacacuggcugaaug

SEQ ID NO: 1044531 - RNA, 19 nt, Homo sapiens
gcgaaacucagucucaaaa

SEQ ID NO: 1044532 - RNA, 19 nt, Homo sapiens
acacuggcugaaugcauua

SEQ ID NO: 1044533 - RNA, 19 nt, Homo sapiens
aggcucacaucacccaaga

SEQ ID NO: 1044534 - RNA, 19 nt, Homo sapiens
caagagcgaaacucagucu

SEQ ID NO: 1044535 - RNA, 19 nt, Homo sapiens
ugaccaacauggagaaacc

SEQ ID NO: 1044536 - RNA, 19 nt, Homo sapiens
acaguggccacgagaggua

SEQ ID NO: 1044537 - RNA, 19 nt, Homo sapiens
aaauuagccagguaugaug

SEQ ID NO: 1044538 - RNA, 19 nt, Homo sapiens
aagcugugaugcuguuaag

SEQ ID NO: 1044539 - RNA, 19 nt, Homo sapiens
auagggucuuugcaaauau

SEQ ID NO: 1044540 - RNA, 19 nt, Homo sapiens
ccagcuuccuuaaaagaaa

SEQ ID NO: 1044541 - RNA, 19 nt, Homo sapiens
gggauuaugucucuguuua

SEQ ID NO: 1044542 - RNA, 19 nt, Homo sapiens
uaacuuuacuucccaaaug

SEQ ID NO: 1044543 - RNA, 19 nt, Homo sapiens
aaagagaaaucacuaaugg

SEQ ID NO: 1044544 - RNA, 19 nt, Homo sapiens
gagcugcuauugcuuagga

SEQ ID NO: 1044545 - RNA, 19 nt, Homo sapiens
cuaauggacucuacugguu

SEQ ID NO: 1044546 - RNA, 19 nt, Homo sapiens
ggagggaccuugaccuucu

SEQ ID NO: 1044547 - RNA, 19 nt, Homo sapiens
guacgugccuugaaauguc

SEQ ID NO: 1044548 - RNA, 19 nt, Homo sapiens
ugaacccagugcagaguua

SEQ ID NO: 1044549 - RNA, 19 nt, Homo sapiens
gcuugcuucuccuaaguua

SEQ ID NO: 1044550 - RNA, 19 nt, Homo sapiens
uaauuuaacuccaguagcu

SEQ ID NO: 1044551 - RNA, 19 nt, Homo sapiens
gcacucagggccauuugaa

SEQ ID NO: 1044552 - RNA, 19 nt, Homo sapiens
caacagguuugaguccuau

SEQ ID NO: 1044553 - RNA, 19 nt, Homo sapiens
gccaagggaugcagcuguu

SEQ ID NO: 1044554 - RNA, 19 nt, Homo sapiens
gaugaguguuaacuugguu

SEQ ID NO: 1044555 - RNA, 19 nt, Homo sapiens
ugugaugaguguuaacuug

SEQ ID NO: 1044556 - RNA, 19 nt, Homo sapiens
ggauuaugucucuguuuaa

SEQ ID NO: 1044557 - RNA, 19 nt, Homo sapiens
aaacaccaucacuacauua

SEQ ID NO: 1044558 - RNA, 19 nt, Homo sapiens
uguccuauguccuauuuga

SEQ ID NO: 1044559 - RNA, 19 nt, Homo sapiens
acaccucccugucuucaga

SEQ ID NO: 1044560 - RNA, 19 nt, Homo sapiens
gcauccauccacuccuuua

SEQ ID NO: 1044561 - RNA, 19 nt, Homo sapiens
ggagggagagaacagaguu

SEQ ID NO: 1044562 - RNA, 19 nt, Homo sapiens
gcgcauuuaugagcaucua

SEQ ID NO: 1044563 - RNA, 19 nt, Homo sapiens
acaacagguuugaguccua

SEQ ID NO: 1044564 - RNA, 19 nt, Homo sapiens
ccuguauguuuguguaauu

SEQ ID NO: 1044565 - RNA, 19 nt, Homo sapiens
gaaguuguacgugccuuga

SEQ ID NO: 1044566 - RNA, 19 nt, Homo sapiens
gaccuugcuugcagugguu

SEQ ID NO: 1044567 - RNA, 19 nt, Homo sapiens
gaugaccgaccgccuguau

SEQ ID NO: 1044568 - RNA, 19 nt, Homo sapiens
ugaauacaauagacaaagg

SEQ ID NO: 1044569 - RNA, 19 nt, Homo sapiens
ugaguccuauaaagccaua

SEQ ID NO: 1044570 - RNA, 19 nt, Homo sapiens
uaacuccaguagcugaugu

SEQ ID NO: 1044571 - RNA, 19 nt, Homo sapiens
cagcgcugccgguucuuua

SEQ ID NO: 1044572 - RNA, 19 nt, Homo sapiens
uuuagugccuugaaucuca

SEQ ID NO: 1044573 - RNA, 19 nt, Homo sapiens
uaauggacucuacugguuu

SEQ ID NO: 1044574 - RNA, 19 nt, Homo sapiens
cuuguccuauguccuauuu

SEQ ID NO: 1044575 - RNA, 19 nt, Homo sapiens
ccgccuguauguuugugua

SEQ ID NO: 1044576 - RNA, 19 nt, Homo sapiens
ucacucuguugauguaauc

SEQ ID NO: 1044577 - RNA, 19 nt, Homo sapiens
gcucuagcccuggagauug

SEQ ID NO: 1044578 - RNA, 19 nt, Homo sapiens
aagcuuguccuauguccua

SEQ ID NO: 1044579 - RNA, 19 nt, Homo sapiens
ugaccgaccgccuguaugu

SEQ ID NO: 1044580 - RNA, 19 nt, Homo sapiens
gcuauugcuuaggaaguug

SEQ ID NO: 1044581 - RNA, 19 nt, Homo sapiens
aguguuaacuugguuguuc

SEQ ID NO: 1044582 - RNA, 19 nt, Homo sapiens
gcauguucaguaauaagaa

SEQ ID NO: 1044583 - RNA, 19 nt, Homo sapiens
aauggacucuacugguuug

SEQ ID NO: 1044584 - RNA, 19 nt, Homo sapiens
gugcuugcuucuccuaagu

SEQ ID NO: 1044585 - RNA, 19 nt, Homo sapiens
aguuguacgugccuugaaa

SEQ ID NO: 1044586 - RNA, 19 nt, Homo sapiens
gaagagccuggagcugcua

SEQ ID NO: 1044587 - RNA, 19 nt, Homo sapiens
ggcauguucaguaauaaga

SEQ ID NO: 1044588 - RNA, 19 nt, Homo sapiens
uugcuucuccuaaguuauu

SEQ ID NO: 1044589 - RNA, 19 nt, Homo sapiens
cuggagcugcuauugcuua

SEQ ID NO: 1044590 - RNA, 19 nt, Homo sapiens
gagccuggagcugcuauug

SEQ ID NO: 1044591 - RNA, 19 nt, Homo sapiens
aaccaggucucagggaaga

SEQ ID NO: 1044592 - RNA, 19 nt, Homo sapiens
aaaacaccaucacuacauu

SEQ ID NO: 1044593 - RNA, 19 nt, Homo sapiens
cagccacccucccuucucu

SEQ ID NO: 1044594 - RNA, 19 nt, Homo sapiens
gccuugaaauguccacuac

SEQ ID NO: 1044595 - RNA, 19 nt, Homo sapiens
uuucacaccucccugucuu

SEQ ID NO: 1044596 - RNA, 19 nt, Homo sapiens
gccauaauaaacuuugaug

SEQ ID NO: 1044597 - RNA, 19 nt, Homo sapiens
gagggaccuugaccuucug

SEQ ID NO: 1044598 - RNA, 19 nt, Homo sapiens
gaacccagugcagaguuau

SEQ ID NO: 1044599 - RNA, 19 nt, Homo sapiens
ccgaccgccuguauguuug

SEQ ID NO: 1044600 - RNA, 19 nt, Homo sapiens
gccuggagcugcuauugcu

SEQ ID NO: 1044601 - RNA, 19 nt, Homo sapiens
acgcauccauccacuccuu

SEQ ID NO: 1044602 - RNA, 19 nt, Homo sapiens
ggguuuggcauauuugaca

SEQ ID NO: 1044603 - RNA, 19 nt, Homo sapiens
cucccugucuucagaaugu

SEQ ID NO: 1044604 - RNA, 19 nt, Homo sapiens
acagguuugaguccuauaa

SEQ ID NO: 1044605 - RNA, 19 nt, Homo sapiens
gccgguucuuuaccaaaug

SEQ ID NO: 1044606 - RNA, 19 nt, Homo sapiens
ugaugaguguuaacuuggu

SEQ ID NO: 1044607 - RNA, 19 nt, Homo sapiens
uaagacaggcaucaaaaga

SEQ ID NO: 1044608 - RNA, 19 nt, Homo sapiens
cauaauuuaacuccaguag

SEQ ID NO: 1044609 - RNA, 19 nt, Homo sapiens
cagguuugaguccuauaaa

SEQ ID NO: 1044610 - RNA, 19 nt, Homo sapiens
ugcggaaucugccgaguga

SEQ ID NO: 1044611 - RNA, 19 nt, Homo sapiens
gagcuccuccucuguaaaa

SEQ ID NO: 1044612 - RNA, 19 nt, Homo sapiens
cggaaucugccgagugaug

SEQ ID NO: 1044613 - RNA, 19 nt, Homo sapiens
gagcaucacuguuguuauu

SEQ ID NO: 1044614 - RNA, 19 nt, Homo sapiens
gcagagaacguguguguua

SEQ ID NO: 1044615 - RNA, 19 nt, Homo sapiens
gaaagacucugaccucugu

SEQ ID NO: 1044616 - RNA, 19 nt, Homo sapiens
gagaacagcaucuuugaua

SEQ ID NO: 1044617 - RNA, 19 nt, Homo sapiens
gcaucacuguuguuauuua

SEQ ID NO: 1044618 - RNA, 19 nt, Homo sapiens
ggaauucuuugaacccuuu

SEQ ID NO: 1044619 - RNA, 19 nt, Homo sapiens
ggacuucaccuucuucaaa

SEQ ID NO: 1044620 - RNA, 19 nt, Homo sapiens
acaaagcacuucagaguug

SEQ ID NO: 1044621 - RNA, 19 nt, Homo sapiens
uagaauugcuguauacuug

SEQ ID NO: 1044622 - RNA, 19 nt, Homo sapiens
gguguuggcuguucacauu

SEQ ID NO: 1044623 - RNA, 19 nt, Homo sapiens
gaauugcuguauacuugua

SEQ ID NO: 1044624 - RNA, 19 nt, Homo sapiens
gaggauguauuugaacuuu

SEQ ID NO: 1044625 - RNA, 19 nt, Homo sapiens
guacauagccagagaguca

SEQ ID NO: 1044626 - RNA, 19 nt, Homo sapiens
gaacucggcuuuugaaaug

SEQ ID NO: 1044627 - RNA, 19 nt, Homo sapiens
gaaagaagcaaagguguau

SEQ ID NO: 1044628 - RNA, 19 nt, Homo sapiens
gaacagcaucuuugauaau

SEQ ID NO: 1044629 - RNA, 19 nt, Homo sapiens
ggaugacgaugaaccagaa

SEQ ID NO: 1044630 - RNA, 19 nt, Homo sapiens
ggaagagacugguggaaac

SEQ ID NO: 1044631 - RNA, 19 nt, Homo sapiens
agagacagguguuguuuga

SEQ ID NO: 1044632 - RNA, 19 nt, Homo sapiens
uuaaaccgaugaugauuga

SEQ ID NO: 1044633 - RNA, 19 nt, Homo sapiens
gauaagaccaagaagcaaa

SEQ ID NO: 1044634 - RNA, 19 nt, Homo sapiens
acacgagccugcugagauu

SEQ ID NO: 1044635 - RNA, 19 nt, Homo sapiens
uaaagcggcugcucgaaca

SEQ ID NO: 1044636 - RNA, 19 nt, Homo sapiens
aagcaaagguguauucuac

SEQ ID NO: 1044637 - RNA, 19 nt, Homo sapiens
gcaggaagcagagaacuga

SEQ ID NO: 1044638 - RNA, 19 nt, Homo sapiens
agaacagcaucuuugauaa

SEQ ID NO: 1044639 - RNA, 19 nt, Homo sapiens
caacgcugcuuacacuaug

SEQ ID NO: 1044640 - RNA, 19 nt, Homo sapiens
gaacuuucugguuuccuua

SEQ ID NO: 1044641 - RNA, 19 nt, Homo sapiens
ggccauguuugcacucuuu

SEQ ID NO: 1044642 - RNA, 19 nt, Homo sapiens
gagcagagaacgugugugu

SEQ ID NO: 1044643 - RNA, 19 nt, Homo sapiens
cugcugagauuccacauga

SEQ ID NO: 1044644 - RNA, 19 nt, Homo sapiens
agacagguguuguuugaug

SEQ ID NO: 1044645 - RNA, 19 nt, Homo sapiens
guuccuggcugcccacaaa

SEQ ID NO: 1044646 - RNA, 19 nt, Homo sapiens
agaaacaacccucaacuug

SEQ ID NO: 1044647 - RNA, 19 nt, Homo sapiens
gaagcaaagguguauucua

SEQ ID NO: 1044648 - RNA, 19 nt, Homo sapiens
ggaaauaaagaaagaagca

SEQ ID NO: 1044649 - RNA, 19 nt, Homo sapiens
agaagaggaugaccaggaa

SEQ ID NO: 1044650 - RNA, 19 nt, Homo sapiens
ccaaaggacagguggaauu

SEQ ID NO: 1044651 - RNA, 19 nt, Homo sapiens
gagguccuauguacagauu

SEQ ID NO: 1044652 - RNA, 19 nt, Homo sapiens
gaggaugaccaggaaauaa

SEQ ID NO: 1044653 - RNA, 19 nt, Homo sapiens
ugacucaugucucuucuca

SEQ ID NO: 1044654 - RNA, 19 nt, Homo sapiens
gaaaagccaguguauaauu

SEQ ID NO: 1044655 - RNA, 19 nt, Homo sapiens
uaacuggcuugaacuguca

SEQ ID NO: 1044656 - RNA, 19 nt, Homo sapiens
gcaguuaacgcuugguguu

SEQ ID NO: 1044657 - RNA, 19 nt, Homo sapiens
ggauguauuugaacuuucu

SEQ ID NO: 1044658 - RNA, 19 nt, Homo sapiens
gguguuguuugaugauauu

SEQ ID NO: 1044659 - RNA, 19 nt, Homo sapiens
gacagguguuguuugauga

SEQ ID NO: 1044660 - RNA, 19 nt, Homo sapiens
gcacuuugucugcuguuaa

SEQ ID NO: 1044661 - RNA, 19 nt, Homo sapiens
gucaagagcaucacuguug

SEQ ID NO: 1044662 - RNA, 19 nt, Homo sapiens
cuacaaagcacuucagagu

SEQ ID NO: 1044663 - RNA, 19 nt, Homo sapiens
gauccaagcccuguuugaa

SEQ ID NO: 1044664 - RNA, 19 nt, Homo sapiens
uagaaaagccaguguauaa

SEQ ID NO: 1044665 - RNA, 19 nt, Homo sapiens
gaacagaaugaaaugucaa

SEQ ID NO: 1044666 - RNA, 19 nt, Homo sapiens
ugaacagaaugaaauguca

SEQ ID NO: 1044667 - RNA, 19 nt, Homo sapiens
acaugaaagugaguguuua

SEQ ID NO: 1044668 - RNA, 19 nt, Homo sapiens
gaagcaguaugcacaucug

SEQ ID NO: 1044669 - RNA, 19 nt, Homo sapiens
gggugugccuucuggcuuu

SEQ ID NO: 1044670 - RNA, 19 nt, Homo sapiens
ugccagagccaguuuagua

SEQ ID NO: 1044671 - RNA, 19 nt, Homo sapiens
acauauggcuggaaggaau

SEQ ID NO: 1044672 - RNA, 19 nt, Homo sapiens
gcagcguccuugcucauuc

SEQ ID NO: 1044673 - RNA, 19 nt, Homo sapiens
ucucacaucuugcacacuu

SEQ ID NO: 1044674 - RNA, 19 nt, Homo sapiens
gcacggaagaggccauguu

SEQ ID NO: 1044675 - RNA, 19 nt, Homo sapiens
gagaacguguguguuagga

SEQ ID NO: 1044676 - RNA, 19 nt, Homo sapiens
ccuccagccuccugucuuu

SEQ ID NO: 1044677 - RNA, 19 nt, Homo sapiens
ggaaggaaugguuuucuua

SEQ ID NO: 1044678 - RNA, 19 nt, Homo sapiens
gcaacgcugcuuacacuau

SEQ ID NO: 1044679 - RNA, 19 nt, Homo sapiens
ugagauaaaggucugguuu

SEQ ID NO: 1044680 - RNA, 19 nt, Homo sapiens
gccagccucucacaucuug

SEQ ID NO: 1044681 - RNA, 19 nt, Homo sapiens
gcugagaaacugaggaaga

SEQ ID NO: 1044682 - RNA, 19 nt, Homo sapiens
gcugagauuccacaugaaa

SEQ ID NO: 1044683 - RNA, 19 nt, Homo sapiens
ucgagcuguucacauauua

SEQ ID NO: 1044684 - RNA, 19 nt, Homo sapiens
cagcaucuuugauaaugga

SEQ ID NO: 1044685 - RNA, 19 nt, Homo sapiens
gcaaaccgaggaagacugu

SEQ ID NO: 1044686 - RNA, 19 nt, Homo sapiens
cagaugaggaugacgauga

SEQ ID NO: 1044687 - RNA, 19 nt, Homo sapiens
agaaggccaucucauuguu

SEQ ID NO: 1044688 - RNA, 19 nt, Homo sapiens
gaacagauugcgagcacau

SEQ ID NO: 1044689 - RNA, 19 nt, Homo sapiens
ccgaugagaugcaggagau

SEQ ID NO: 1044690 - RNA, 19 nt, Homo sapiens
gguccuauguacagauuca

SEQ ID NO: 1044691 - RNA, 19 nt, Homo sapiens
ucacaggcuuuaaaguugu

SEQ ID NO: 1044692 - RNA, 19 nt, Homo sapiens
gcuucaugcucuuccagua

SEQ ID NO: 1044693 - RNA, 19 nt, Homo sapiens
uccuguagccgccuaauua

SEQ ID NO: 1044694 - RNA, 19 nt, Homo sapiens
gcacuuggcauggcaggaa

SEQ ID NO: 1044695 - RNA, 19 nt, Homo sapiens
uuuccucucuuuagaauug

SEQ ID NO: 1044696 - RNA, 19 nt, Homo sapiens
ucaagagcaucacuguugu

SEQ ID NO: 1044697 - RNA, 19 nt, Homo sapiens
agaagggcguggccucuga

SEQ ID NO: 1044698 - RNA, 19 nt, Homo sapiens
agaaagaagcaaaggugua

SEQ ID NO: 1044699 - RNA, 19 nt, Homo sapiens
ggaaacuguccagagguua

SEQ ID NO: 1044700 - RNA, 19 nt, Homo sapiens
gagccuugguuguuugcaa

SEQ ID NO: 1044701 - RNA, 19 nt, Homo sapiens
gagccaguuuaguaccuuu

SEQ ID NO: 1044702 - RNA, 19 nt, Homo sapiens
gccaugaucuucaguucca

SEQ ID NO: 1044703 - RNA, 19 nt, Homo sapiens
ggacagguggaauucuuug

SEQ ID NO: 1044704 - RNA, 19 nt, Homo sapiens
acagauugcgagcacauua

SEQ ID NO: 1044705 - RNA, 19 nt, Homo sapiens
uaucuccucagcacauuua

SEQ ID NO: 1044706 - RNA, 19 nt, Homo sapiens
caugccacguggucauuaa

SEQ ID NO: 1044707 - RNA, 19 nt, Homo sapiens
gaaacuguccagagguuag

SEQ ID NO: 1044708 - RNA, 19 nt, Homo sapiens
ucucacaggcuuuaaaguu

SEQ ID NO: 1044709 - RNA, 19 nt, Homo sapiens
gcaggagaauggcgugaac

SEQ ID NO: 1044710 - RNA, 19 nt, Homo sapiens
guggcaaccugucccuuga

SEQ ID NO: 1044711 - RNA, 19 nt, Homo sapiens
acucaugucucuucucauc

SEQ ID NO: 1044712 - RNA, 19 nt, Homo sapiens
gcaaguucccugaguuuac

SEQ ID NO: 1044713 - RNA, 19 nt, Homo sapiens
gaaggaaccugaaggcauu

SEQ ID NO: 1044714 - RNA, 19 nt, Homo sapiens
ggacagagccucacagaug

SEQ ID NO: 1044715 - RNA, 19 nt, Homo sapiens
gaaaagagacagaguaauu

SEQ ID NO: 1044716 - RNA, 19 nt, Homo sapiens
gacagagccucacagauga

SEQ ID NO: 1044717 - RNA, 19 nt, Homo sapiens
gaacauggacugaaguauc

SEQ ID NO: 1044718 - RNA, 19 nt, Homo sapiens
uagcggaucuggccaucua

SEQ ID NO: 1044719 - RNA, 19 nt, Homo sapiens
gauucgagccuuugugaaa

SEQ ID NO: 1044720 - RNA, 19 nt, Homo sapiens
cagaguaauuugcaguuug

SEQ ID NO: 1044721 - RNA, 19 nt, Homo sapiens
gacuguugcuguauugauu

SEQ ID NO: 1044722 - RNA, 19 nt, Homo sapiens
ggaaaguccuagcggaucu

SEQ ID NO: 1044723 - RNA, 19 nt, Homo sapiens
gaggacuguugcuguauug

SEQ ID NO: 1044724 - RNA, 19 nt, Homo sapiens
guaauuugcaguuuguuug

SEQ ID NO: 1044725 - RNA, 19 nt, Homo sapiens
ccaggaacauggacugaag

SEQ ID NO: 1044726 - RNA, 19 nt, Homo sapiens
gaggcgacacgaaggauuu

SEQ ID NO: 1044727 - RNA, 19 nt, Homo sapiens
ugaggacuguugcuguauu

SEQ ID NO: 1044728 - RNA, 19 nt, Homo sapiens
agaguaauuugcaguuugu

SEQ ID NO: 1044729 - RNA, 19 nt, Homo sapiens
acugaggacuguugcugua

SEQ ID NO: 1044730 - RNA, 19 nt, Homo sapiens
ucacagaugauguccaugu

SEQ ID NO: 1044731 - RNA, 19 nt, Homo sapiens
acagaguaauuugcaguuu

SEQ ID NO: 1044732 - RNA, 19 nt, Homo sapiens
aaagagacagaguaauuug

SEQ ID NO: 1044733 - RNA, 19 nt, Homo sapiens
cagaugauguccauguuuu

SEQ ID NO: 1044734 - RNA, 19 nt, Homo sapiens
ccucacagaugauguccau

SEQ ID NO: 1044735 - RNA, 19 nt, Homo sapiens
cacagaugauguccauguu

SEQ ID NO: 1044736 - RNA, 19 nt, Homo sapiens
agguggagcucaacaggaa

SEQ ID NO: 1044737 - RNA, 19 nt, Homo sapiens
gaaguauccagcgcucauu

SEQ ID NO: 1044738 - RNA, 19 nt, Homo sapiens
ggucagaaccgugauucga

SEQ ID NO: 1044739 - RNA, 19 nt, Homo sapiens
cgucaccgaccgcuacuuu

SEQ ID NO: 1044740 - RNA, 19 nt, Homo sapiens
gcucauugggaauuuaguu

SEQ ID NO: 1044741 - RNA, 19 nt, Homo sapiens
ggacuguugcuguauugau

SEQ ID NO: 1044742 - RNA, 19 nt, Homo sapiens
gugauucgagccuuuguga

SEQ ID NO: 1044743 - RNA, 19 nt, Homo sapiens
gugaaugaaacucaaacaa

SEQ ID NO: 1044744 - RNA, 19 nt, Homo sapiens
guugcuguauugauuagga

SEQ ID NO: 1044745 - RNA, 19 nt, Homo sapiens
ccucuggauuaaucgaauu

SEQ ID NO: 1044746 - RNA, 19 nt, Homo sapiens
ggaggcgacacgaaggauu

SEQ ID NO: 1044747 - RNA, 19 nt, Homo sapiens
guuuaucuacaacccaaua

SEQ ID NO: 1044748 - RNA, 19 nt, Homo sapiens
gacagaguaauuugcaguu

SEQ ID NO: 1044749 - RNA, 19 nt, Homo sapiens
cagcgcucauugggaauuu

SEQ ID NO: 1044750 - RNA, 19 nt, Homo sapiens
ccaaagcccgauaccugaa

SEQ ID NO: 1044751 - RNA, 19 nt, Homo sapiens
uaucuacaacccaauaaca

SEQ ID NO: 1044752 - RNA, 19 nt, Homo sapiens
acagaugauguccauguuu

SEQ ID NO: 1044753 - RNA, 19 nt, Homo sapiens
guaccacugaggacuguug

SEQ ID NO: 1044754 - RNA, 19 nt, Homo sapiens
cauugggaauuuaguuaag

SEQ ID NO: 1044755 - RNA, 19 nt, Homo sapiens
gggauggcccugucucucu

SEQ ID NO: 1044756 - RNA, 19 nt, Homo sapiens
aaagcccgauaccugaaga

SEQ ID NO: 1044757 - RNA, 19 nt, Homo sapiens
ggaacauggacugaaguau

SEQ ID NO: 1044758 - RNA, 19 nt, Homo sapiens
uuuccagaguggugcagua

SEQ ID NO: 1044759 - RNA, 19 nt, Homo sapiens
aaccgugauucgagccuuu

SEQ ID NO: 1044760 - RNA, 19 nt, Homo sapiens
cucauugggaauuuaguua

SEQ ID NO: 1044761 - RNA, 19 nt, Homo sapiens
ucuacaacccaauaacaga

SEQ ID NO: 1044762 - RNA, 19 nt, Homo sapiens
gaggaaagcugcauuugaa

SEQ ID NO: 1044763 - RNA, 19 nt, Homo sapiens
ggaauacucuucauaagga

SEQ ID NO: 1044764 - RNA, 19 nt, Homo sapiens
gggcgaagcauguaacuua

SEQ ID NO: 1044765 - RNA, 19 nt, Homo sapiens
gaggaugaauuuggcauua

SEQ ID NO: 1044766 - RNA, 19 nt, Homo sapiens
gaacuuagcaacagcaugu

SEQ ID NO: 1044767 - RNA, 19 nt, Homo sapiens
gcacagaacuuagcaacag

SEQ ID NO: 1044768 - RNA, 19 nt, Homo sapiens
gcauguaacuuaauuugca

SEQ ID NO: 1044769 - RNA, 19 nt, Homo sapiens
aaagugggauauagaagua

SEQ ID NO: 1044770 - RNA, 19 nt, Homo sapiens
gcacauggaaugacaauca

SEQ ID NO: 1044771 - RNA, 19 nt, Homo sapiens
cgaagcauguaacuuaauu

SEQ ID NO: 1044772 - RNA, 19 nt, Homo sapiens
gaggugagcuccgggauug

SEQ ID NO: 1044773 - RNA, 19 nt, Homo sapiens
ggauauagaaguacaaaug

SEQ ID NO: 1044774 - RNA, 19 nt, Homo sapiens
acaaauggauguaucauag

SEQ ID NO: 1044775 - RNA, 19 nt, Homo sapiens
aagaggaacugacugaauu

SEQ ID NO: 1044776 - RNA, 19 nt, Homo sapiens
gagaucauccugcaguaua

SEQ ID NO: 1044777 - RNA, 19 nt, Homo sapiens
gagaaaugauuggauguug

SEQ ID NO: 1044778 - RNA, 19 nt, Homo sapiens
gaagugaggguaccagcua

SEQ ID NO: 1044779 - RNA, 19 nt, Homo sapiens
cgaacaggaugaugacauu

SEQ ID NO: 1044780 - RNA, 19 nt, Homo sapiens
gcagaaagagcuugcagaa

SEQ ID NO: 1044781 - RNA, 19 nt, Homo sapiens
gguaagacccaguuaagaa

SEQ ID NO: 1044782 - RNA, 19 nt, Homo sapiens
acagggagaugcagaaaga

SEQ ID NO: 1044783 - RNA, 19 nt, Homo sapiens
gaaggaaucaucacauaag

SEQ ID NO: 1044784 - RNA, 19 nt, Homo sapiens
acuggcaggugcuuaauua

SEQ ID NO: 1044785 - RNA, 19 nt, Homo sapiens
uaagaaaguuagugcaauc

SEQ ID NO: 1044786 - RNA, 19 nt, Homo sapiens
aaagucagaucuucauuca

SEQ ID NO: 1044787 - RNA, 19 nt, Homo sapiens
cugaaggaaucaucacaua

SEQ ID NO: 1044788 - RNA, 19 nt, Homo sapiens
caaacuucaugugguguua

SEQ ID NO: 1044789 - RNA, 19 nt, Homo sapiens
ggaauuacaagcauugaau

SEQ ID NO: 1044790 - RNA, 19 nt, Homo sapiens
acaaucagcuacaagaaau

SEQ ID NO: 1044791 - RNA, 19 nt, Homo sapiens
guaagacccaguuaagaaa

SEQ ID NO: 1044792 - RNA, 19 nt, Homo sapiens
ugacugaauuacacaagaa

SEQ ID NO: 1044793 - RNA, 19 nt, Homo sapiens
caagaaauggcccaacuga

SEQ ID NO: 1044794 - RNA, 19 nt, Homo sapiens
caagaaacguggggaguua

SEQ ID NO: 1044795 - RNA, 19 nt, Homo sapiens
ggaaucaucacauaagcuu

SEQ ID NO: 1044796 - RNA, 19 nt, Homo sapiens
ggcgaagcauguaacuuaa

SEQ ID NO: 1044797 - RNA, 19 nt, Homo sapiens
caaacuggcaggugcuuaa

SEQ ID NO: 1044798 - RNA, 19 nt, Homo sapiens
uguggaugauuaucgauua

SEQ ID NO: 1044799 - RNA, 19 nt, Homo sapiens
gacaaucagcuacaagaaa

SEQ ID NO: 1044800 - RNA, 19 nt, Homo sapiens
gaaugacaaucagcuacaa

SEQ ID NO: 1044801 - RNA, 19 nt, Homo sapiens
agaaaugauuggauguuga

SEQ ID NO: 1044802 - RNA, 19 nt, Homo sapiens
ugcuggaucuuaccucuua

SEQ ID NO: 1044803 - RNA, 19 nt, Homo sapiens
ggaacugacugaauuacac

SEQ ID NO: 1044804 - RNA, 19 nt, Homo sapiens
ccauaagccugaaggaauc

SEQ ID NO: 1044805 - RNA, 19 nt, Homo sapiens
ggauaagacaauucugaaa

SEQ ID NO: 1044806 - RNA, 19 nt, Homo sapiens
ucuggacuguggaugauua

SEQ ID NO: 1044807 - RNA, 19 nt, Homo sapiens
agucagaucuucauucagu

SEQ ID NO: 1044808 - RNA, 19 nt, Homo sapiens
ggaugaauuuggcauuagu

SEQ ID NO: 1044809 - RNA, 19 nt, Homo sapiens
gaaucuggacuguggauga

SEQ ID NO: 1044810 - RNA, 19 nt, Homo sapiens
uggauucugucacuaauau

SEQ ID NO: 1044811 - RNA, 19 nt, Homo sapiens
gagcagggagaaaugauug

SEQ ID NO: 1044812 - RNA, 19 nt, Homo sapiens
aaucuguguuuccacuuua

SEQ ID NO: 1044813 - RNA, 19 nt, Homo sapiens
gauuggauguugaggaaag

SEQ ID NO: 1044814 - RNA, 19 nt, Homo sapiens
gcaacagcaugugaauugu

SEQ ID NO: 1044815 - RNA, 19 nt, Homo sapiens
gcaggaauuacaagcauug

SEQ ID NO: 1044816 - RNA, 19 nt, Homo sapiens
gaugaaacuucugaucaca

SEQ ID NO: 1044817 - RNA, 19 nt, Homo sapiens
ggaugaaacuucugaucac

SEQ ID NO: 1044818 - RNA, 19 nt, Homo sapiens
aaaucuguguuuccacuuu

SEQ ID NO: 1044819 - RNA, 19 nt, Homo sapiens
gauggcacauggaaugaca

SEQ ID NO: 1044820 - RNA, 19 nt, Homo sapiens
ugaaggaaucaucacauaa

SEQ ID NO: 1044821 - RNA, 19 nt, Homo sapiens
ggagaaaugauuggauguu

SEQ ID NO: 1044822 - RNA, 19 nt, Homo sapiens
ggcauggaccgcaggguua

SEQ ID NO: 1044823 - RNA, 19 nt, Homo sapiens
ugaaacuucugaucacaca

SEQ ID NO: 1044824 - RNA, 19 nt, Homo sapiens
caagaggaacugacugaau

SEQ ID NO: 1044825 - RNA, 19 nt, Homo sapiens
ccaaacaggcacgagauaa

SEQ ID NO: 1044826 - RNA, 19 nt, Homo sapiens
gauaagacaauucugaaac

SEQ ID NO: 1044827 - RNA, 19 nt, Homo sapiens
gggauaagacaauucugaa

SEQ ID NO: 1044828 - RNA, 19 nt, Homo sapiens
cuuaauggcacagaacuua

SEQ ID NO: 1044829 - RNA, 19 nt, Homo sapiens
ugauugaccugaauaacca

SEQ ID NO: 1044830 - RNA, 19 nt, Homo sapiens
ugaggaaagcugcauuuga

SEQ ID NO: 1044831 - RNA, 19 nt, Homo sapiens
gaaaugauuggauguugag

SEQ ID NO: 1044832 - RNA, 19 nt, Homo sapiens
cuuagcagcuucaaaugau

SEQ ID NO: 1044833 - RNA, 19 nt, Homo sapiens
gaauucucuuggcaucuga

SEQ ID NO: 1044834 - RNA, 19 nt, Homo sapiens
ggguuaagcuuugggaagu

SEQ ID NO: 1044835 - RNA, 19 nt, Homo sapiens
ggacagggagaugcagaaa

SEQ ID NO: 1044836 - RNA, 19 nt, Homo sapiens
ugaccugaauaaccaaaug

SEQ ID NO: 1044837 - RNA, 19 nt, Homo sapiens
gaacugacugaauuacaca

SEQ ID NO: 1044838 - RNA, 19 nt, Homo sapiens
ggaaugacaaucagcuaca

SEQ ID NO: 1044839 - RNA, 19 nt, Homo sapiens
gauauagaaguacaaaugg

SEQ ID NO: 1044840 - RNA, 19 nt, Homo sapiens
agaucauccugcaguauaa

SEQ ID NO: 1044841 - RNA, 19 nt, Homo sapiens
gguuaagcuuugggaagua

SEQ ID NO: 1044842 - RNA, 19 nt, Homo sapiens
gcuggaggccuucuggauu

SEQ ID NO: 1044843 - RNA, 19 nt, Homo sapiens
gaugaauuuggcauuagua

SEQ ID NO: 1044844 - RNA, 19 nt, Homo sapiens
ucauagggauaagacaauu

SEQ ID NO: 1044845 - RNA, 19 nt, Homo sapiens
ccucuuagcagcuucaaau

SEQ ID NO: 1044846 - RNA, 19 nt, Homo sapiens
caguccagguucccgguua

SEQ ID NO: 1044847 - RNA, 19 nt, Homo sapiens
gcuacugccuugugugucu

SEQ ID NO: 1044848 - RNA, 19 nt, Homo sapiens
aagauauaauggaggauga

SEQ ID NO: 1044849 - RNA, 19 nt, Homo sapiens
gaaucaucacauaagcuua

SEQ ID NO: 1044850 - RNA, 19 nt, Homo sapiens
gaaagcugcauuugaacca

SEQ ID NO: 1044851 - RNA, 19 nt, Homo sapiens
uaaagugggauauagaagu

SEQ ID NO: 1044852 - RNA, 19 nt, Homo sapiens
aacagcaugugaauuguga

SEQ ID NO: 1044853 - RNA, 19 nt, Homo sapiens
gcaugaaaaccuuggaaua

SEQ ID NO: 1044854 - RNA, 19 nt, Homo sapiens
gaccgcaggguuaagcuuu

SEQ ID NO: 1044855 - RNA, 19 nt, Homo sapiens
gaacaggaugaugacauug

SEQ ID NO: 1044856 - RNA, 19 nt, Homo sapiens
guuaagaaaguuagugcaa

SEQ ID NO: 1044857 - RNA, 19 nt, Homo sapiens
uggcaguaaugcaggaauu

SEQ ID NO: 1044858 - RNA, 19 nt, Homo sapiens
guuaagcuuugggaaguau

SEQ ID NO: 1044859 - RNA, 19 nt, Homo sapiens
agucaacgcugugcaguuc

SEQ ID NO: 1044860 - RNA, 19 nt, Homo sapiens
gauuaagcaccaagaggaa

SEQ ID NO: 1044861 - RNA, 19 nt, Homo sapiens
ggaggaugaauuuggcauu

SEQ ID NO: 1044862 - RNA, 19 nt, Homo sapiens
caacagaacuugauuguaa

SEQ ID NO: 1044863 - RNA, 19 nt, Homo sapiens
gaucaccgcuuuccaauuu

SEQ ID NO: 1044864 - RNA, 19 nt, Homo sapiens
ggaaagugcugucugcuaa

SEQ ID NO: 1044865 - RNA, 19 nt, Homo sapiens
gaacucacuuuaagcauug

SEQ ID NO: 1044866 - RNA, 19 nt, Homo sapiens
gcugagggcucucuguaua

SEQ ID NO: 1044867 - RNA, 19 nt, Homo sapiens
gagcauaguucgagagaug

SEQ ID NO: 1044868 - RNA, 19 nt, Homo sapiens
cagcacagcucauccauca

SEQ ID NO: 1044869 - RNA, 19 nt, Homo sapiens
gcauggaccucccagagaa

SEQ ID NO: 1044870 - RNA, 19 nt, Homo sapiens
gcacagcagcgccaucuuu

SEQ ID NO: 1044871 - RNA, 19 nt, Homo sapiens
ucagagaacuuaagucaag

SEQ ID NO: 1044872 - RNA, 19 nt, Homo sapiens
ugaaugggauuucugaaga

SEQ ID NO: 1044873 - RNA, 19 nt, Homo sapiens
gaagugaggguaccagcua

SEQ ID NO: 1044874 - RNA, 19 nt, Homo sapiens
ggauccaguugcaaugaua

SEQ ID NO: 1044875 - RNA, 19 nt, Homo sapiens
caagcuauguggcacugua

SEQ ID NO: 1044876 - RNA, 19 nt, Homo sapiens
ugaacucacuuuaagcauu

SEQ ID NO: 1044877 - RNA, 19 nt, Homo sapiens
gcacagcucauccaucaau

SEQ ID NO: 1044878 - RNA, 19 nt, Homo sapiens
uuacugcccuggacuuaaa

SEQ ID NO: 1044879 - RNA, 19 nt, Homo sapiens
ggaauuacaagcauugaau

SEQ ID NO: 1044880 - RNA, 19 nt, Homo sapiens
agauggagcuguugggaaa

SEQ ID NO: 1044881 - RNA, 19 nt, Homo sapiens
gaaugggauuucugaagau

SEQ ID NO: 1044882 - RNA, 19 nt, Homo sapiens
gggcacaucuuuuauuuau

SEQ ID NO: 1044883 - RNA, 19 nt, Homo sapiens
uguggaugauuaucgauua

SEQ ID NO: 1044884 - RNA, 19 nt, Homo sapiens
uguuagagcuggugagaga

SEQ ID NO: 1044885 - RNA, 19 nt, Homo sapiens
ggacuuaaacccagaaagg

SEQ ID NO: 1044886 - RNA, 19 nt, Homo sapiens
gcgaugcccuuggugcuuu

SEQ ID NO: 1044887 - RNA, 19 nt, Homo sapiens
ggacaaaggaugcaaagcu

SEQ ID NO: 1044888 - RNA, 19 nt, Homo sapiens
ucuggacuguggaugauua

SEQ ID NO: 1044889 - RNA, 19 nt, Homo sapiens
gagcuguugggaaagauua

SEQ ID NO: 1044890 - RNA, 19 nt, Homo sapiens
acagagcaauguguaauga

SEQ ID NO: 1044891 - RNA, 19 nt, Homo sapiens
gaaucuggacuguggauga

SEQ ID NO: 1044892 - RNA, 19 nt, Homo sapiens
uggguucgcugcagaggua

SEQ ID NO: 1044893 - RNA, 19 nt, Homo sapiens
gaaacacuacuagcucuga

SEQ ID NO: 1044894 - RNA, 19 nt, Homo sapiens
agcaaagucugcauaaaga

SEQ ID NO: 1044895 - RNA, 19 nt, Homo sapiens
ccaauuugcccuucagaga

SEQ ID NO: 1044896 - RNA, 19 nt, Homo sapiens
aacggaaacucccgaacua

SEQ ID NO: 1044897 - RNA, 19 nt, Homo sapiens
gcaggaauuacaagcauug

SEQ ID NO: 1044898 - RNA, 19 nt, Homo sapiens
gcucugaccuuccauaccu

SEQ ID NO: 1044899 - RNA, 19 nt, Homo sapiens
uggcagcaaugcaggaauu

SEQ ID NO: 1044900 - RNA, 19 nt, Homo sapiens
gaaacucccgaacuacaga

SEQ ID NO: 1044901 - RNA, 19 nt, Homo sapiens
gcucgcacguugucagugu

SEQ ID NO: 1044902 - RNA, 19 nt, Homo sapiens
cagcaaagucugcauaaag

SEQ ID NO: 1044903 - RNA, 19 nt, Homo sapiens
ggcauggaccgcaggguua

SEQ ID NO: 1044904 - RNA, 19 nt, Homo sapiens
ucaaggugguguucucugu

SEQ ID NO: 1044905 - RNA, 19 nt, Homo sapiens
uuauugaucuccgaacaaa

SEQ ID NO: 1044906 - RNA, 19 nt, Homo sapiens
gggaaagugcugucugcua

SEQ ID NO: 1044907 - RNA, 19 nt, Homo sapiens
caauuugcccuucagagaa

SEQ ID NO: 1044908 - RNA, 19 nt, Homo sapiens
caacaccuuggguucauuu

SEQ ID NO: 1044909 - RNA, 19 nt, Homo sapiens
ugggauuucugaagauuug

SEQ ID NO: 1044910 - RNA, 19 nt, Homo sapiens
caggugaugugcuggguau

SEQ ID NO: 1044911 - RNA, 19 nt, Homo sapiens
gaucuacgcagcaaagucu

SEQ ID NO: 1044912 - RNA, 19 nt, Homo sapiens
ggguuaagcuuugggaagu

SEQ ID NO: 1044913 - RNA, 19 nt, Homo sapiens
ccagugcccuccucagaag

SEQ ID NO: 1044914 - RNA, 19 nt, Homo sapiens
gcuggaggccuucuggauu

SEQ ID NO: 1044915 - RNA, 19 nt, Homo sapiens
gauuacugcccuggacuua

SEQ ID NO: 1044916 - RNA, 19 nt, Homo sapiens
gguuaagcuuugggaagua

SEQ ID NO: 1044917 - RNA, 19 nt, Homo sapiens
cuuguucucuggacauuug

SEQ ID NO: 1044918 - RNA, 19 nt, Homo sapiens
ggugggagaggauguguga

SEQ ID NO: 1044919 - RNA, 19 nt, Homo sapiens
ggaagaauaacacugaaaa

SEQ ID NO: 1044920 - RNA, 19 nt, Homo sapiens
ccgaacaaaugcuaucaag

SEQ ID NO: 1044921 - RNA, 19 nt, Homo sapiens
gaucuccgaacaaaugcua

SEQ ID NO: 1044922 - RNA, 19 nt, Homo sapiens
gcuacugccuugugugucu

SEQ ID NO: 1044923 - RNA, 19 nt, Homo sapiens
caguccagguucccgguua

SEQ ID NO: 1044924 - RNA, 19 nt, Homo sapiens
ucucuucccugccugauca

SEQ ID NO: 1044925 - RNA, 19 nt, Homo sapiens
ccaacauacuugucugaag

SEQ ID NO: 1044926 - RNA, 19 nt, Homo sapiens
cuaaguuccugcuggacaa

SEQ ID NO: 1044927 - RNA, 19 nt, Homo sapiens
guucuggccuaacgcaugu

SEQ ID NO: 1044928 - RNA, 19 nt, Homo sapiens
guucuugccuugggaaaca

SEQ ID NO: 1044929 - RNA, 19 nt, Homo sapiens
gcauaaagacaguguuugc

SEQ ID NO: 1044930 - RNA, 19 nt, Homo sapiens
cgaccggacucucaaacuc

SEQ ID NO: 1044931 - RNA, 19 nt, Homo sapiens
gaccgcaggguuaagcuuu

SEQ ID NO: 1044932 - RNA, 19 nt, Homo sapiens
gcagagguaaggauguguu

SEQ ID NO: 1044933 - RNA, 19 nt, Homo sapiens
agucaacgcugugcaguuc

SEQ ID NO: 1044934 - RNA, 19 nt, Homo sapiens
guuaagcuuugggaaguau

SEQ ID NO: 1044935 - RNA, 19 nt, Homo sapiens
gaggccuucuggauucuau

SEQ ID NO: 1044936 - RNA, 19 nt, Homo sapiens
gagagcauaguucgagaga

SEQ ID NO: 1044937 - RNA, 19 nt, Homo sapiens
gcauggaccgcaggguuaa

SEQ ID NO: 1044938 - RNA, 19 nt, Homo sapiens
gaccuuccauaccucacuu

SEQ ID NO: 1044939 - RNA, 19 nt, Homo sapiens
ggaccagaguugucuucag

SEQ ID NO: 1044940 - RNA, 19 nt, Homo sapiens
cagggcacaucuuuuauuu

SEQ ID NO: 1044941 - RNA, 19 nt, Homo sapiens
ggccagggcacaucuuuua

SEQ ID NO: 1044942 - RNA, 19 nt, Homo sapiens
cgaugcccuuggugcuuua

SEQ ID NO: 1044943 - RNA, 19 nt, Homo sapiens
cagcagagcagccacuaag

SEQ ID NO: 1044944 - RNA, 19 nt, Homo sapiens
ugauagugcuggaucuuac

SEQ ID NO: 1044945 - RNA, 19 nt, Homo sapiens
ccugguggguugcaugaau

SEQ ID NO: 1044946 - RNA, 19 nt, Homo sapiens
cacuuuaagcauuggauua

SEQ ID NO: 1044947 - RNA, 19 nt, Homo sapiens
ccuggaagaauaacacuga

SEQ ID NO: 1044948 - RNA, 19 nt, Homo sapiens
cuggaggccuucuggauuc

SEQ ID NO: 1044949 - RNA, 19 nt, Homo sapiens
ugucuucgaugcacaugau

SEQ ID NO: 1044950 - RNA, 19 nt, Homo sapiens
gacuguggaugauuaucga

SEQ ID NO: 1044951 - RNA, 19 nt, Homo sapiens
gccaacagaacuugauugu

SEQ ID NO: 1044952 - RNA, 19 nt, Homo sapiens
cuucagagaacuuaaguca

SEQ ID NO: 1044953 - RNA, 19 nt, Homo sapiens
agcauuggauuaacggaaa

SEQ ID NO: 1044954 - RNA, 19 nt, Homo sapiens
gcucacagggaaaguggaa

SEQ ID NO: 1044955 - RNA, 19 nt, Homo sapiens
agagcaauguguaaugagu

SEQ ID NO: 1044956 - RNA, 19 nt, Homo sapiens
gcaggauccaguugcaaug

SEQ ID NO: 1044957 - RNA, 19 nt, Homo sapiens
cuuggcagcuucaaaugau

SEQ ID NO: 1044958 - RNA, 19 nt, Homo sapiens
ugcuggaucuuaccucuug

SEQ ID NO: 1044959 - RNA, 19 nt, Homo sapiens
ugggaaguauuuggagaaa

SEQ ID NO: 1044960 - RNA, 19 nt, Homo sapiens
ugagggcucucuguauauc

SEQ ID NO: 1044961 - RNA, 19 nt, Homo sapiens
ccaacagaacuugauugua

SEQ ID NO: 1044962 - RNA, 19 nt, Homo sapiens
gaacugaaauuucuucuug

SEQ ID NO: 1044963 - RNA, 19 nt, Homo sapiens
uaaauaagcuggauggauu

SEQ ID NO: 1044964 - RNA, 19 nt, Homo sapiens
uaaguaagcucauucauca

SEQ ID NO: 1044965 - RNA, 19 nt, Homo sapiens
gcaguagugugauuucaua

SEQ ID NO: 1044966 - RNA, 19 nt, Homo sapiens
gaagaaacaagucauauug

SEQ ID NO: 1044967 - RNA, 19 nt, Homo sapiens
gaacuugcaucuuugaauc

SEQ ID NO: 1044968 - RNA, 19 nt, Homo sapiens
ggaaauauauaguggucaa

SEQ ID NO: 1044969 - RNA, 19 nt, Homo sapiens
uaacacagaucugcauaaa

SEQ ID NO: 1044970 - RNA, 19 nt, Homo sapiens
acacagaucugcauaaagu

SEQ ID NO: 1044971 - RNA, 19 nt, Homo sapiens
gaagugugcugaugaaguc

SEQ ID NO: 1044972 - RNA, 19 nt, Homo sapiens
gaacuccucuuuucuuuaa

SEQ ID NO: 1044973 - RNA, 19 nt, Homo sapiens
ugaagaaacugccauaucu

SEQ ID NO: 1044974 - RNA, 19 nt, Homo sapiens
gucaggaacuugcaucuuu

SEQ ID NO: 1044975 - RNA, 19 nt, Homo sapiens
ggacacaguuucucucagu

SEQ ID NO: 1044976 - RNA, 19 nt, Homo sapiens
ggaagaaacaagucauauu

SEQ ID NO: 1044977 - RNA, 19 nt, Homo sapiens
ggacuggugucacugaaug

SEQ ID NO: 1044978 - RNA, 19 nt, Homo sapiens
gaaauggagaguggaaaua

SEQ ID NO: 1044979 - RNA, 19 nt, Homo sapiens
gguaagaugugacaguuca

SEQ ID NO: 1044980 - RNA, 19 nt, Homo sapiens
caacagcauuacaggaauu

SEQ ID NO: 1044981 - RNA, 19 nt, Homo sapiens
caacugcaaucugaauauu

SEQ ID NO: 1044982 - RNA, 19 nt, Homo sapiens
gaaacugccauaucugauu

SEQ ID NO: 1044983 - RNA, 19 nt, Homo sapiens
cugaugaaguccucuauaa

SEQ ID NO: 1044984 - RNA, 19 nt, Homo sapiens
gcccagagguccuuugaau

SEQ ID NO: 1044985 - RNA, 19 nt, Homo sapiens
aaacugccauaucugauuu

SEQ ID NO: 1044986 - RNA, 19 nt, Homo sapiens
aagacuaggugaaguguuu

SEQ ID NO: 1044987 - RNA, 19 nt, Homo sapiens
caacugcuguaaagaacuu

SEQ ID NO: 1044988 - RNA, 19 nt, Homo sapiens
gcaguuaauuggacuuuac

SEQ ID NO: 1044989 - RNA, 19 nt, Homo sapiens
cuacagagaacugaaauuu

SEQ ID NO: 1044990 - RNA, 19 nt, Homo sapiens
gagcuuaucacaacaaaca

SEQ ID NO: 1044991 - RNA, 19 nt, Homo sapiens
cuucauugcuccaucagua

SEQ ID NO: 1044992 - RNA, 19 nt, Homo sapiens
ccaggugcauuucaaguga

SEQ ID NO: 1044993 - RNA, 19 nt, Homo sapiens
ucaaaucccuccacucucu

SEQ ID NO: 1044994 - RNA, 19 nt, Homo sapiens
uggaugagauucuucaaau

SEQ ID NO: 1044995 - RNA, 19 nt, Homo sapiens
uugcaugccuuucauuaaa

SEQ ID NO: 1044996 - RNA, 19 nt, Homo sapiens
aaacugcgaucgcuuugga

SEQ ID NO: 1044997 - RNA, 19 nt, Homo sapiens
aguaugagcucuuuaaguc

SEQ ID NO: 1044998 - RNA, 19 nt, Homo sapiens
ucacuugucuacuguaaca

SEQ ID NO: 1044999 - RNA, 19 nt, Homo sapiens
ccacuugcuuuaccaguug

SEQ ID NO: 1045000 - RNA, 19 nt, Homo sapiens
ucuacaacguggugauaua

SEQ ID NO: 1045001 - RNA, 19 nt, Homo sapiens
ccagagguccuuugaauca

SEQ ID NO: 1045002 - RNA, 19 nt, Homo sapiens
gcucacaauccuaauauga

SEQ ID NO: 1045003 - RNA, 19 nt, Homo sapiens
caagugaagugugcugaug

SEQ ID NO: 1045004 - RNA, 19 nt, Homo sapiens
gcagccaggugcauuucaa

SEQ ID NO: 1045005 - RNA, 19 nt, Homo sapiens
caucacuugucuacuguaa

SEQ ID NO: 1045006 - RNA, 19 nt, Homo sapiens
ugacccauuugaagauuaa

SEQ ID NO: 1045007 - RNA, 19 nt, Homo sapiens
ccauaggccaucugaauuu

SEQ ID NO: 1045008 - RNA, 19 nt, Homo sapiens
aauggagaguggaaauaua

SEQ ID NO: 1045009 - RNA, 19 nt, Homo sapiens
gaccaacugcuguaaagaa

SEQ ID NO: 1045010 - RNA, 19 nt, Homo sapiens
gugagaagccacagaaaug

SEQ ID NO: 1045011 - RNA, 19 nt, Homo sapiens
acaacaaacaacagcauua

SEQ ID NO: 1045012 - RNA, 19 nt, Homo sapiens
gaaacaagucauauugaag

SEQ ID NO: 1045013 - RNA, 19 nt, Homo sapiens
uggacaaacuaaagaaaga

SEQ ID NO: 1045014 - RNA, 19 nt, Homo sapiens
caacuguggugcaaaauga

SEQ ID NO: 1045015 - RNA, 19 nt, Homo sapiens
ugacauaguauucauagug

SEQ ID NO: 1045016 - RNA, 19 nt, Homo sapiens
uaguggaaguaacaguuua

SEQ ID NO: 1045017 - RNA, 19 nt, Homo sapiens
caagucauauugaagaacu

SEQ ID NO: 1045018 - RNA, 19 nt, Homo sapiens
gagcaacuguggugcaaaa

SEQ ID NO: 1045019 - RNA, 19 nt, Homo sapiens
ggaauuucugaaugacuua

SEQ ID NO: 1045020 - RNA, 19 nt, Homo sapiens
caggaauugucuuauaugu

SEQ ID NO: 1045021 - RNA, 19 nt, Homo sapiens
ucaggaacuugcaucuuug

SEQ ID NO: 1045022 - RNA, 19 nt, Homo sapiens
gaaggcaaggcaguuaauu

SEQ ID NO: 1045023 - RNA, 19 nt, Homo sapiens
uauauguggucaguuguaa

SEQ ID NO: 1045024 - RNA, 19 nt, Homo sapiens
gagcaguagugugauuuca

SEQ ID NO: 1045025 - RNA, 19 nt, Homo sapiens
ggauggauuuggugauucu

SEQ ID NO: 1045026 - RNA, 19 nt, Homo sapiens
ucuuauauguggucaguug

SEQ ID NO: 1045027 - RNA, 19 nt, Homo sapiens
ugccauaucugauuucucu

SEQ ID NO: 1045028 - RNA, 19 nt, Homo sapiens
cagaccaacugcuguaaag

SEQ ID NO: 1045029 - RNA, 19 nt, Homo sapiens
ggaacuugcaucuuugaau

SEQ ID NO: 1045030 - RNA, 19 nt, Homo sapiens
ggacuauuccaguucaaau

SEQ ID NO: 1045031 - RNA, 19 nt, Homo sapiens
gcgaucgcuuuggauauuu

SEQ ID NO: 1045032 - RNA, 19 nt, Homo sapiens
uaauuggacuuuacaccau

SEQ ID NO: 1045033 - RNA, 19 nt, Homo sapiens
gaagaaacugccauaucug

SEQ ID NO: 1045034 - RNA, 19 nt, Homo sapiens
ccuaauaugacccauuuga

SEQ ID NO: 1045035 - RNA, 19 nt, Homo sapiens
gcgguagccuggaagaaag

SEQ ID NO: 1045036 - RNA, 19 nt, Homo sapiens
gauauacaagaacagguuu

SEQ ID NO: 1045037 - RNA, 19 nt, Homo sapiens
guagugugauuucauacca

SEQ ID NO: 1045038 - RNA, 19 nt, Homo sapiens
ggagugaucuugauuuugc

SEQ ID NO: 1045039 - RNA, 19 nt, Homo sapiens
ggcaguuaauuggacuuua

SEQ ID NO: 1045040 - RNA, 19 nt, Homo sapiens
ggaguccuguggaugagau

SEQ ID NO: 1045041 - RNA, 19 nt, Homo sapiens
uaaguccucugccuuggau

SEQ ID NO: 1045042 - RNA, 19 nt, Homo sapiens
cauuacaggaauugucuua

SEQ ID NO: 1045043 - RNA, 19 nt, Homo sapiens
gaugaaguccucuauaagc

SEQ ID NO: 1045044 - RNA, 19 nt, Homo sapiens
gcugaugaaguccucuaua

SEQ ID NO: 1045045 - RNA, 19 nt, Homo sapiens
ggagaguggaaauauauag

SEQ ID NO: 1045046 - RNA, 19 nt, Homo sapiens
gcaugccuuucauuaaauc

SEQ ID NO: 1045047 - RNA, 19 nt, Homo sapiens
gaggacuggugucacugaa

SEQ ID NO: 1045048 - RNA, 19 nt, Homo sapiens
ggaaggcaaggcaguuaau

SEQ ID NO: 1045049 - RNA, 19 nt, Homo sapiens
uaauaugacccauuugaag

SEQ ID NO: 1045050 - RNA, 19 nt, Homo sapiens
aaagugagaagccacagaa

SEQ ID NO: 1045051 - RNA, 19 nt, Homo sapiens
uuucauaggucaggaacuu

SEQ ID NO: 1045052 - RNA, 19 nt, Homo sapiens
caguagauauacaagaaca

SEQ ID NO: 1045053 - RNA, 19 nt, Homo sapiens
ggaaccauggacacaguuu

SEQ ID NO: 1045054 - RNA, 19 nt, Homo sapiens
gcucauucaucagucuuau

SEQ ID NO: 1045055 - RNA, 19 nt, Homo sapiens
aaaaugagcaguaguguga

SEQ ID NO: 1045056 - RNA, 19 nt, Homo sapiens
gggaaggcaaggcaguuaa

SEQ ID NO: 1045057 - RNA, 19 nt, Homo sapiens
auccuaauaugacccauuu

SEQ ID NO: 1045058 - RNA, 19 nt, Homo sapiens
aagaaacugccauaucuga

SEQ ID NO: 1045059 - RNA, 19 nt, Homo sapiens
aauaugacccauuugaaga

SEQ ID NO: 1045060 - RNA, 19 nt, Homo sapiens
caacaugaacuccucuuuu

SEQ ID NO: 1045061 - RNA, 19 nt, Homo sapiens
cuaaguaagcucauucauc

SEQ ID NO: 1045062 - RNA, 19 nt, Homo sapiens
gauccacucucauuuauua

SEQ ID NO: 1045063 - RNA, 19 nt, Homo sapiens
gggaagaaguugagaauuu

SEQ ID NO: 1045064 - RNA, 19 nt, Homo sapiens
gcucagacuuugaauuuaa

SEQ ID NO: 1045065 - RNA, 19 nt, Homo sapiens
guacaaauacucuugcuuu

SEQ ID NO: 1045066 - RNA, 19 nt, Homo sapiens
guucaucacuguguguuua

SEQ ID NO: 1045067 - RNA, 19 nt, Homo sapiens
agagugacaucuugcauuu

SEQ ID NO: 1045068 - RNA, 19 nt, Homo sapiens
aaagauccacucucauuua

SEQ ID NO: 1045069 - RNA, 19 nt, Homo sapiens
gagcggacaucuguucaaa

SEQ ID NO: 1045070 - RNA, 19 nt, Homo sapiens
ccacccagcuugguuuaaa

SEQ ID NO: 1045071 - RNA, 19 nt, Homo sapiens
aaaugguccuuguaaagua

SEQ ID NO: 1045072 - RNA, 19 nt, Homo sapiens
ggaagaaguugagaauuuu

SEQ ID NO: 1045073 - RNA, 19 nt, Homo sapiens
gguuugauguagucuguaa

SEQ ID NO: 1045074 - RNA, 19 nt, Homo sapiens
gauguagucuguaaauggu

SEQ ID NO: 1045075 - RNA, 19 nt, Homo sapiens
gaaguuaguggucauucuu

SEQ ID NO: 1045076 - RNA, 19 nt, Homo sapiens
uaaaguacauugccaucuc

SEQ ID NO: 1045077 - RNA, 19 nt, Homo sapiens
guacauugccaucucagaa

SEQ ID NO: 1045078 - RNA, 19 nt, Homo sapiens
guaaaugguccuuguaaag

SEQ ID NO: 1045079 - RNA, 19 nt, Homo sapiens
gcggacaucuguucaaagg

SEQ ID NO: 1045080 - RNA, 19 nt, Homo sapiens
guaaagacccacccagcuu

SEQ ID NO: 1045081 - RNA, 19 nt, Homo sapiens
guauaaccaucagcuuuga

SEQ ID NO: 1045082 - RNA, 19 nt, Homo sapiens
gugugugucuucccacuuu

SEQ ID NO: 1045083 - RNA, 19 nt, Homo sapiens
auacaggccugcuuugugu

SEQ ID NO: 1045084 - RNA, 19 nt, Homo sapiens
uaaggaaacuaaagaugac

SEQ ID NO: 1045085 - RNA, 19 nt, Homo sapiens
aagauccacucucauuuau

SEQ ID NO: 1045086 - RNA, 19 nt, Homo sapiens
uguaaaugguccuuguaaa

SEQ ID NO: 1045087 - RNA, 19 nt, Homo sapiens
agacaggguuaauggaaga

SEQ ID NO: 1045088 - RNA, 19 nt, Homo sapiens
ugaaaccaaaggaaugaua

SEQ ID NO: 1045089 - RNA, 19 nt, Homo sapiens
cggugaagcucuccaagug

SEQ ID NO: 1045090 - RNA, 19 nt, Homo sapiens
acacuccacuguacacuca

SEQ ID NO: 1045091 - RNA, 19 nt, Homo sapiens
uaaaagauccacucucauu

SEQ ID NO: 1045092 - RNA, 19 nt, Homo sapiens
gauacaggccugcuuugug

SEQ ID NO: 1045093 - RNA, 19 nt, Homo sapiens
ggcucagacuuugaauuua

SEQ ID NO: 1045094 - RNA, 19 nt, Homo sapiens
aaacugaaaccaaaggaau

SEQ ID NO: 1045095 - RNA, 19 nt, Homo sapiens
aggcucagacuuugaauuu

SEQ ID NO: 1045096 - RNA, 19 nt, Homo sapiens
uaaaugguccuuguaaagu

SEQ ID NO: 1045097 - RNA, 19 nt, Homo sapiens
ucucaauucaggcaaguua

SEQ ID NO: 1045098 - RNA, 19 nt, Homo sapiens
gaucuacgucagacuguug

SEQ ID NO: 1045099 - RNA, 19 nt, Homo sapiens
ccagacaggguuaauggaa

SEQ ID NO: 1045100 - RNA, 19 nt, Homo sapiens
cagcuuugauacuuccauu

SEQ ID NO: 1045101 - RNA, 19 nt, Homo sapiens
aaaguacauugccaucuca

SEQ ID NO: 1045102 - RNA, 19 nt, Homo sapiens
gaaaccaaaggaaugauac

SEQ ID NO: 1045103 - RNA, 19 nt, Homo sapiens
ggucauucuuuccuguaga

SEQ ID NO: 1045104 - RNA, 19 nt, Homo sapiens
acauugccaucucagaauu

SEQ ID NO: 1045105 - RNA, 19 nt, Homo sapiens
gaccagacaggguuaaugg

SEQ ID NO: 1045106 - RNA, 19 nt, Homo sapiens
cgugaaaacugaaaccaaa

SEQ ID NO: 1045107 - RNA, 19 nt, Homo sapiens
cguauaaccaucagcuuug

SEQ ID NO: 1045108 - RNA, 19 nt, Homo sapiens
ggaccagacaggguuaaug

SEQ ID NO: 1045109 - RNA, 19 nt, Homo sapiens
cuccaaguguguugaauca

SEQ ID NO: 1045110 - RNA, 19 nt, Homo sapiens
ccauguaaccucuggaaca

SEQ ID NO: 1045111 - RNA, 19 nt, Homo sapiens
acauagaugauaagaguga

SEQ ID NO: 1045112 - RNA, 19 nt, Homo sapiens
gagaccacaguacuucuga

SEQ ID NO: 1045113 - RNA, 19 nt, Homo sapiens
ccacucucauuuauuaugc

SEQ ID NO: 1045114 - RNA, 19 nt, Homo sapiens
ccacuguacacucauacuu

SEQ ID NO: 1045115 - RNA, 19 nt, Homo sapiens
gcagaaguuaguggucauu

SEQ ID NO: 1045116 - RNA, 19 nt, Homo sapiens
cacuguacacucauacuuu

SEQ ID NO: 1045117 - RNA, 19 nt, Homo sapiens
cagggaagaaguugagaau

SEQ ID NO: 1045118 - RNA, 19 nt, Homo sapiens
cagcgugccuagccucaag

SEQ ID NO: 1045119 - RNA, 19 nt, Homo sapiens
ucaagggugcaucgugaaa

SEQ ID NO: 1045120 - RNA, 19 nt, Homo sapiens
ccagcuugguuuaaauuuu

SEQ ID NO: 1045121 - RNA, 19 nt, Homo sapiens
cauugccaucucagaauua

SEQ ID NO: 1045122 - RNA, 19 nt, Homo sapiens
aaugauacaggccugcuuu

SEQ ID NO: 1045123 - RNA, 19 nt, Homo sapiens
acuccacuguacacucaua

SEQ ID NO: 1045124 - RNA, 19 nt, Homo sapiens
gacccacccagcuugguuu

SEQ ID NO: 1045125 - RNA, 19 nt, Homo sapiens
gucauucuuuccuguagau

SEQ ID NO: 1045126 - RNA, 19 nt, Homo sapiens
ugauguagucuguaaaugg

SEQ ID NO: 1045127 - RNA, 19 nt, Homo sapiens
aagguuugauguagucugu

SEQ ID NO: 1045128 - RNA, 19 nt, Homo sapiens
gaaugauacaggccugcuu

SEQ ID NO: 1045129 - RNA, 19 nt, Homo sapiens
cgucagacuguugugguua

SEQ ID NO: 1045130 - RNA, 19 nt, Homo sapiens
gaagccugccguucugaag

SEQ ID NO: 1045131 - RNA, 19 nt, Homo sapiens
gucagacuguugugguuag

SEQ ID NO: 1045132 - RNA, 19 nt, Homo sapiens
cacccagcuugguuuaaau

SEQ ID NO: 1045133 - RNA, 19 nt, Homo sapiens
ugugugucuucccacuuua

SEQ ID NO: 1045134 - RNA, 19 nt, Homo sapiens
gaagcucuccaaguguguu

SEQ ID NO: 1045135 - RNA, 19 nt, Homo sapiens
cauguaaccucuggaacac

SEQ ID NO: 1045136 - RNA, 19 nt, Homo sapiens
uuuaguguguuucggugaa

SEQ ID NO: 1045137 - RNA, 19 nt, Homo sapiens
acguauaaccaucagcuuu

SEQ ID NO: 1045138 - RNA, 19 nt, Homo sapiens
gcacugccucagggaagaa

SEQ ID NO: 1045139 - RNA, 19 nt, Homo sapiens
cuguaaaugguccuuguaa

SEQ ID NO: 1045140 - RNA, 19 nt, Homo sapiens
agaccacaguacuucugaa

SEQ ID NO: 1045141 - RNA, 19 nt, Homo sapiens
ggaauaaguuuguucagaa

SEQ ID NO: 1045142 - RNA, 19 nt, Homo sapiens
agaaggagauguuugaguu

SEQ ID NO: 1045143 - RNA, 19 nt, Homo sapiens
gaagagaucaaacaugguu

SEQ ID NO: 1045144 - RNA, 19 nt, Homo sapiens
ccacgugcuuugaaacuuu

SEQ ID NO: 1045145 - RNA, 19 nt, Homo sapiens
aagaagagacugugaauug

SEQ ID NO: 1045146 - RNA, 19 nt, Homo sapiens
ggacagcagagcuuaaaga

SEQ ID NO: 1045147 - RNA, 19 nt, Homo sapiens
gagaggaaguggaagucaa

SEQ ID NO: 1045148 - RNA, 19 nt, Homo sapiens
gugcucaccugccuaagaa

SEQ ID NO: 1045149 - RNA, 19 nt, Homo sapiens
ggaagucaauggcuuugca

SEQ ID NO: 1045150 - RNA, 19 nt, Homo sapiens
ggacagggcaucccagauc

SEQ ID NO: 1045151 - RNA, 19 nt, Homo sapiens
ggaagaagagacugugaau

SEQ ID NO: 1045152 - RNA, 19 nt, Homo sapiens
gaagaagagacugugaauu

SEQ ID NO: 1045153 - RNA, 19 nt, Homo sapiens
ccgugaaagugcuaaguaa

SEQ ID NO: 1045154 - RNA, 19 nt, Homo sapiens
guucagccgucgagaggaa

SEQ ID NO: 1045155 - RNA, 19 nt, Homo sapiens
uaacucacccugcaaagca

SEQ ID NO: 1045156 - RNA, 19 nt, Homo sapiens
ggacuauccacgugcuuug

SEQ ID NO: 1045157 - RNA, 19 nt, Homo sapiens
aggaauaaguuuguucaga

SEQ ID NO: 1045158 - RNA, 19 nt, Homo sapiens
caaggaauaaguuuguuca

SEQ ID NO: 1045159 - RNA, 19 nt, Homo sapiens
ggagcgagcaugugacagu

SEQ ID NO: 1045160 - RNA, 19 nt, Homo sapiens
cccggagccucgaggaaua

SEQ ID NO: 1045161 - RNA, 19 nt, Homo sapiens
gaaggagauguuugaguuc

SEQ ID NO: 1045162 - RNA, 19 nt, Homo sapiens
gugaggagcgagcauguga

SEQ ID NO: 1045163 - RNA, 19 nt, Homo sapiens
ccacgcagacugugaguag

SEQ ID NO: 1045164 - RNA, 19 nt, Homo sapiens
cgccagacguggagcauca

SEQ ID NO: 1045165 - RNA, 19 nt, Homo sapiens
gccgugaaagugcuaagua

SEQ ID NO: 1045166 - RNA, 19 nt, Homo sapiens
ucaauggcuuugcaacaca

SEQ ID NO: 1045167 - RNA, 19 nt, Homo sapiens
gacagggcaucccagaucu

SEQ ID NO: 1045168 - RNA, 19 nt, Homo sapiens
ccagugcucaccugccuaa

SEQ ID NO: 1045169 - RNA, 19 nt, Homo sapiens
gguaagugccacauugaca

SEQ ID NO: 1045170 - RNA, 19 nt, Homo sapiens
gaagucaauggcuuugcaa

SEQ ID NO: 1045171 - RNA, 19 nt, Homo sapiens
agacguggagcaucaguga

SEQ ID NO: 1045172 - RNA, 19 nt, Homo sapiens
gcagccaggccgugaaagu

SEQ ID NO: 1045173 - RNA, 19 nt, Homo sapiens
guaagugccacauugacau

SEQ ID NO: 1045174 - RNA, 19 nt, Homo sapiens
gaggagcgagcaugugaca

SEQ ID NO: 1045175 - RNA, 19 nt, Homo sapiens
cgaggaauaccgagugaca

SEQ ID NO: 1045176 - RNA, 19 nt, Homo sapiens
gccaagcucccaggacuga

SEQ ID NO: 1045177 - RNA, 19 nt, Homo sapiens
cuauccacgugcuuugaaa

SEQ ID NO: 1045178 - RNA, 19 nt, Homo sapiens
gagcuauggccaggacuga

SEQ ID NO: 1045179 - RNA, 19 nt, Homo sapiens
caaggugucccugguguca

SEQ ID NO: 1045180 - RNA, 19 nt, Homo sapiens
aaggagauguuugaguuca

SEQ ID NO: 1045181 - RNA, 19 nt, Homo sapiens
cuacaagaaggaaggaugu

SEQ ID NO: 1045182 - RNA, 19 nt, Homo sapiens
cgcagaaggagauguuuga

SEQ ID NO: 1045183 - RNA, 19 nt, Homo sapiens
agaagagacugugaauugc

SEQ ID NO: 1045184 - RNA, 19 nt, Homo sapiens
ccaaggaauaaguuuguuc

SEQ ID NO: 1045185 - RNA, 19 nt, Homo sapiens
gauguucgaaggccagauc

SEQ ID NO: 1045186 - RNA, 19 nt, Homo sapiens
acaaggacaccuccagaca

SEQ ID NO: 1045187 - RNA, 19 nt, Homo sapiens
uaagugccacauugacaug

SEQ ID NO: 1045188 - RNA, 19 nt, Homo sapiens
acagcuggcuccaagaacu

SEQ ID NO: 1045189 - RNA, 19 nt, Homo sapiens
gcucaccugccuaagaauc

SEQ ID NO: 1045190 - RNA, 19 nt, Homo sapiens
ccaggaagagaucaaacau

SEQ ID NO: 1045191 - RNA, 19 nt, Homo sapiens
gucaauggcuuugcaacac

SEQ ID NO: 1045192 - RNA, 19 nt, Homo sapiens
gcuccauccacuacaagaa

SEQ ID NO: 1045193 - RNA, 19 nt, Homo sapiens
ugaaagugcuaaguaaccu

SEQ ID NO: 1045194 - RNA, 19 nt, Homo sapiens
gcuguggaccagagugaug

SEQ ID NO: 1045195 - RNA, 19 nt, Homo sapiens
gccaaggcccaagugguaa

SEQ ID NO: 1045196 - RNA, 19 nt, Homo sapiens
caggaagagaucaaacaug

SEQ ID NO: 1045197 - RNA, 19 nt, Homo sapiens
auacagcuggcuccaagaa

SEQ ID NO: 1045198 - RNA, 19 nt, Homo sapiens
gcaaugagcuguucaaaug

SEQ ID NO: 1045199 - RNA, 19 nt, Homo sapiens
agacacaucugccuucuuu

SEQ ID NO: 1045200 - RNA, 19 nt, Homo sapiens
gaaacccugucucuacuaa

SEQ ID NO: 1045201 - RNA, 19 nt, Homo sapiens
gaacuuagguagguuaugg

SEQ ID NO: 1045202 - RNA, 19 nt, Homo sapiens
gcuggaagauuacgacaaa

SEQ ID NO: 1045203 - RNA, 19 nt, Homo sapiens
gcacgagacuugcuugaac

SEQ ID NO: 1045204 - RNA, 19 nt, Homo sapiens
guucagcucuugcaacguu

SEQ ID NO: 1045205 - RNA, 19 nt, Homo sapiens
gaagagaagggcacugaga

SEQ ID NO: 1045206 - RNA, 19 nt, Homo sapiens
gggagagacugaccucaug

SEQ ID NO: 1045207 - RNA, 19 nt, Homo sapiens
acagaggcauccaaaggua

SEQ ID NO: 1045208 - RNA, 19 nt, Homo sapiens
guucaaauguggagacuac

SEQ ID NO: 1045209 - RNA, 19 nt, Homo sapiens
gcucuugccuggagacagu

SEQ ID NO: 1045210 - RNA, 19 nt, Homo sapiens
ggaguggagaggcugguua

SEQ ID NO: 1045211 - RNA, 19 nt, Homo sapiens
gagaaggugcgauacaugu

SEQ ID NO: 1045212 - RNA, 19 nt, Homo sapiens
gagccaagcccuagagaag

SEQ ID NO: 1045213 - RNA, 19 nt, Homo sapiens
acaucugccuucuuucuuu

SEQ ID NO: 1045214 - RNA, 19 nt, Homo sapiens
ugacagagcgagacuaucu

SEQ ID NO: 1045215 - RNA, 19 nt, Homo sapiens
accucaagcuggaagauua

SEQ ID NO: 1045216 - RNA, 19 nt, Homo sapiens
gcgaaacccugucucuacu

SEQ ID NO: 1045217 - RNA, 19 nt, Homo sapiens
ggagggcaaugagcuguuc

SEQ ID NO: 1045218 - RNA, 19 nt, Homo sapiens
aaagaacuuagguagguua

SEQ ID NO: 1045219 - RNA, 19 nt, Homo sapiens
ggagaaggugcgauacaug

SEQ ID NO: 1045220 - RNA, 19 nt, Homo sapiens
ugaggcagguggaucacuu

SEQ ID NO: 1045221 - RNA, 19 nt, Homo sapiens
caggaggccuugcggaaca

SEQ ID NO: 1045222 - RNA, 19 nt, Homo sapiens
aaacagaggcauccaaagg

SEQ ID NO: 1045223 - RNA, 19 nt, Homo sapiens
gcccugguguggagcugua

SEQ ID NO: 1045224 - RNA, 19 nt, Homo sapiens
agaaacagaggcauccaaa

SEQ ID NO: 1045225 - RNA, 19 nt, Homo sapiens
guacgcugguuggcauuug

SEQ ID NO: 1045226 - RNA, 19 nt, Homo sapiens
cagaagagaagggcacuga

SEQ ID NO: 1045227 - RNA, 19 nt, Homo sapiens
ggugacagagcgagacuau

SEQ ID NO: 1045228 - RNA, 19 nt, Homo sapiens
ggaagauuacgacaaagca

SEQ ID NO: 1045229 - RNA, 19 nt, Homo sapiens
acaaggagauacauguaac

SEQ ID NO: 1045230 - RNA, 19 nt, Homo sapiens
caucugccuucuuucuuuc

SEQ ID NO: 1045231 - RNA, 19 nt, Homo sapiens
guagugcacgccuguaauc

SEQ ID NO: 1045232 - RNA, 19 nt, Homo sapiens
gcucagccauugaaaagga

SEQ ID NO: 1045233 - RNA, 19 nt, Homo sapiens
aaugagcuguucaaaugug

SEQ ID NO: 1045234 - RNA, 19 nt, Homo sapiens
gaaacagaggcauccaaag

SEQ ID NO: 1045235 - RNA, 19 nt, Homo sapiens
ccuguaaucccagcacuuu

SEQ ID NO: 1045236 - RNA, 19 nt, Homo sapiens
ggcaaugagcuguucaaau

SEQ ID NO: 1045237 - RNA, 19 nt, Homo sapiens
ggccuuuccucgagaucuu

SEQ ID NO: 1045238 - RNA, 19 nt, Homo sapiens
agagaagggcacugagaaa

SEQ ID NO: 1045239 - RNA, 19 nt, Homo sapiens
uggagcagcugcggaagga

SEQ ID NO: 1045240 - RNA, 19 nt, Homo sapiens
ggcgaaacccugucucuac

SEQ ID NO: 1045241 - RNA, 19 nt, Homo sapiens
cagcuucagucccuuuguc

SEQ ID NO: 1045242 - RNA, 19 nt, Homo sapiens
gagcccaagaacaaaguuu

SEQ ID NO: 1045243 - RNA, 19 nt, Homo sapiens
ggagccaagcccuagagaa

SEQ ID NO: 1045244 - RNA, 19 nt, Homo sapiens
cccaggagguggagguugu

SEQ ID NO: 1045245 - RNA, 19 nt, Homo sapiens
cgaaacccugucucuacua

SEQ ID NO: 1045246 - RNA, 19 nt, Homo sapiens
gaccugcagagauguguga

SEQ ID NO: 1045247 - RNA, 19 nt, Homo sapiens
gcagcuacccucaccuuuu

SEQ ID NO: 1045248 - RNA, 19 nt, Homo sapiens
gccaagcccuagagaagcu

SEQ ID NO: 1045249 - RNA, 19 nt, Homo sapiens
aagagaagggcacugagaa

SEQ ID NO: 1045250 - RNA, 19 nt, Homo sapiens
ccccuuaccuuauucuaaa

SEQ ID NO: 1045251 - RNA, 19 nt, Homo sapiens
guaaugggguucagcucuu

SEQ ID NO: 1045252 - RNA, 19 nt, Homo sapiens
uggagacaguggccucaug

SEQ ID NO: 1045253 - RNA, 19 nt, Homo sapiens
cgucacauucuccuccuuu

SEQ ID NO: 1045254 - RNA, 19 nt, Homo sapiens
gagaagggcacugagaaaa

SEQ ID NO: 1045255 - RNA, 19 nt, Homo sapiens
gggcaaugagcuguucaaa

SEQ ID NO: 1045256 - RNA, 19 nt, Homo sapiens
caaggagauacauguaaca

SEQ ID NO: 1045257 - RNA, 19 nt, Homo sapiens
agagaugugugagcuugga

SEQ ID NO: 1045258 - RNA, 19 nt, Homo sapiens
cagcuacccucaccuuuuc

SEQ ID NO: 1045259 - RNA, 19 nt, Homo sapiens
cagaguacaaggagauaca

SEQ ID NO: 1045260 - RNA, 19 nt, Homo sapiens
ucacuugaggucaggaguu

SEQ ID NO: 1045261 - RNA, 19 nt, Homo sapiens
acacaucugccuucuuucu

SEQ ID NO: 1045262 - RNA, 19 nt, Homo sapiens
uccuugaccugcagagaug

SEQ ID NO: 1045263 - RNA, 19 nt, Homo sapiens
ccgcugcaccgucacauuc

SEQ ID NO: 1045264 - RNA, 19 nt, Homo sapiens
gucacauucuccuccuuug

SEQ ID NO: 1045265 - RNA, 19 nt, Homo sapiens
cagaaacagaggcauccaa

SEQ ID NO: 1045266 - RNA, 19 nt, Homo sapiens
gguagugcacgccuguaau

SEQ ID NO: 1045267 - RNA, 19 nt, Homo sapiens
cacuugaggucaggaguuc

SEQ ID NO: 1045268 - RNA, 19 nt, Homo sapiens
gacggaugccaaaguggaa

SEQ ID NO: 1045269 - RNA, 19 nt, Homo sapiens
ggaagaagaucccuaauau

SEQ ID NO: 1045270 - RNA, 19 nt, Homo sapiens
ggacaacccugacauaauu

SEQ ID NO: 1045271 - RNA, 19 nt, Homo sapiens
ggaaauuucuucacaaagu

SEQ ID NO: 1045272 - RNA, 19 nt, Homo sapiens
gaagggcgcuacaaagaga

SEQ ID NO: 1045273 - RNA, 19 nt, Homo sapiens
ggaauaaucugcccaucug

SEQ ID NO: 1045274 - RNA, 19 nt, Homo sapiens
agacuccacuuaacauuua

SEQ ID NO: 1045275 - RNA, 19 nt, Homo sapiens
gucagaauguguucaaaua

SEQ ID NO: 1045276 - RNA, 19 nt, Homo sapiens
caauggagauggauuucua

SEQ ID NO: 1045277 - RNA, 19 nt, Homo sapiens
gaaaguuuguguugagaug

SEQ ID NO: 1045278 - RNA, 19 nt, Homo sapiens
ggaaugaacccgagcaaug

SEQ ID NO: 1045279 - RNA, 19 nt, Homo sapiens
ccagacaacucuacucgaa

SEQ ID NO: 1045280 - RNA, 19 nt, Homo sapiens
gcagaaaguuuguguugag

SEQ ID NO: 1045281 - RNA, 19 nt, Homo sapiens
ugaaagauguaucauggaa

SEQ ID NO: 1045282 - RNA, 19 nt, Homo sapiens
ggaccacaguucacauuau

SEQ ID NO: 1045283 - RNA, 19 nt, Homo sapiens
gauggaacguggaauaauc

SEQ ID NO: 1045284 - RNA, 19 nt, Homo sapiens
gguaacauaucaucagugu

SEQ ID NO: 1045285 - RNA, 19 nt, Homo sapiens
ggagagaagcuaaucauca

SEQ ID NO: 1045286 - RNA, 19 nt, Homo sapiens
gaugauggaacguggaaua

SEQ ID NO: 1045287 - RNA, 19 nt, Homo sapiens
gaccacaguucacauuaug

SEQ ID NO: 1045288 - RNA, 19 nt, Homo sapiens
aaacauauccgaccuucaa

SEQ ID NO: 1045289 - RNA, 19 nt, Homo sapiens
cagaugagauuccucuaau

SEQ ID NO: 1045290 - RNA, 19 nt, Homo sapiens
gcagaugagauuccucuaa

SEQ ID NO: 1045291 - RNA, 19 nt, Homo sapiens
aaagauguaucauggaaug

SEQ ID NO: 1045292 - RNA, 19 nt, Homo sapiens
gaagugugagguuggauuu

SEQ ID NO: 1045293 - RNA, 19 nt, Homo sapiens
ccacuuaacauuuaucuca

SEQ ID NO: 1045294 - RNA, 19 nt, Homo sapiens
uaucauuccugcauuccua

SEQ ID NO: 1045295 - RNA, 19 nt, Homo sapiens
gaagaagaucccuaauaug

SEQ ID NO: 1045296 - RNA, 19 nt, Homo sapiens
gaagaugcugagauucaua

SEQ ID NO: 1045297 - RNA, 19 nt, Homo sapiens
cagaauguguucaaauaca

SEQ ID NO: 1045298 - RNA, 19 nt, Homo sapiens
gcugucuucugguaacaua

SEQ ID NO: 1045299 - RNA, 19 nt, Homo sapiens
caagacauauagacaugga

SEQ ID NO: 1045300 - RNA, 19 nt, Homo sapiens
cuacaaagagacuguguuu

SEQ ID NO: 1045301 - RNA, 19 nt, Homo sapiens
gagcaauggagauggauuu

SEQ ID NO: 1045302 - RNA, 19 nt, Homo sapiens
cgacauugcagaugagauu

SEQ ID NO: 1045303 - RNA, 19 nt, Homo sapiens
gagagaagcuaaucaucac

SEQ ID NO: 1045304 - RNA, 19 nt, Homo sapiens
ccuaagaaacugauugauu

SEQ ID NO: 1045305 - RNA, 19 nt, Homo sapiens
uggaagaagaucccuaaua

SEQ ID NO: 1045306 - RNA, 19 nt, Homo sapiens
gaccagcucccaaaggaaa

SEQ ID NO: 1045307 - RNA, 19 nt, Homo sapiens
ccaaauugaaccauacauu

SEQ ID NO: 1045308 - RNA, 19 nt, Homo sapiens
guucaaauacaucucauga

SEQ ID NO: 1045309 - RNA, 19 nt, Homo sapiens
uggagaaucuuccuucauc

SEQ ID NO: 1045310 - RNA, 19 nt, Homo sapiens
caagcuggaugcccucugu

SEQ ID NO: 1045311 - RNA, 19 nt, Homo sapiens
gaugagggguguuaaaugu

SEQ ID NO: 1045312 - RNA, 19 nt, Homo sapiens
aagaagaucccuaauaugg

SEQ ID NO: 1045313 - RNA, 19 nt, Homo sapiens
uaacaucugcuucaaacug

SEQ ID NO: 1045314 - RNA, 19 nt, Homo sapiens
ggagacaguaaccaaggua

SEQ ID NO: 1045315 - RNA, 19 nt, Homo sapiens
cuggaaauuucuucacaaa

SEQ ID NO: 1045316 - RNA, 19 nt, Homo sapiens
guguugagaugcuggaaga

SEQ ID NO: 1045317 - RNA, 19 nt, Homo sapiens
ggguaaaucuggugguuuu

SEQ ID NO: 1045318 - RNA, 19 nt, Homo sapiens
gaaugaacccgagcaaugg

SEQ ID NO: 1045319 - RNA, 19 nt, Homo sapiens
gaugagauuccucuaaugg

SEQ ID NO: 1045320 - RNA, 19 nt, Homo sapiens
gacuguguuugaagcauuu

SEQ ID NO: 1045321 - RNA, 19 nt, Homo sapiens
aaguagagcucaugaacuc

SEQ ID NO: 1045322 - RNA, 19 nt, Homo sapiens
caaaguagagcucaugaac

SEQ ID NO: 1045323 - RNA, 19 nt, Homo sapiens
augcugagauucauaacaa

SEQ ID NO: 1045324 - RNA, 19 nt, Homo sapiens
uaaccaagguaauguuuug

SEQ ID NO: 1045325 - RNA, 19 nt, Homo sapiens
ggcuggaucccaagugaua

SEQ ID NO: 1045326 - RNA, 19 nt, Homo sapiens
gggaccacaguucacauua

SEQ ID NO: 1045327 - RNA, 19 nt, Homo sapiens
caaaaugucuaacuugucu

SEQ ID NO: 1045328 - RNA, 19 nt, Homo sapiens
uaauaugggucaagaucca

SEQ ID NO: 1045329 - RNA, 19 nt, Homo sapiens
gcuccaaagucuguauuca

SEQ ID NO: 1045330 - RNA, 19 nt, Homo sapiens
gagaagcuaaucaucacuu

SEQ ID NO: 1045331 - RNA, 19 nt, Homo sapiens
aacaagacauauagacaug

SEQ ID NO: 1045332 - RNA, 19 nt, Homo sapiens
ccguaucccucaaaucgaa

SEQ ID NO: 1045333 - RNA, 19 nt, Homo sapiens
ugaacucugugcugucuuc

SEQ ID NO: 1045334 - RNA, 19 nt, Homo sapiens
ucuaacaucugcuucaaac

SEQ ID NO: 1045335 - RNA, 19 nt, Homo sapiens
gaaagauguaucauggaau

SEQ ID NO: 1045336 - RNA, 19 nt, Homo sapiens
gacaguaaccaagguaaug

SEQ ID NO: 1045337 - RNA, 19 nt, Homo sapiens
cagaaaguuuguguugaga

SEQ ID NO: 1045338 - RNA, 19 nt, Homo sapiens
ccacagugaggcugacaaa

SEQ ID NO: 1045339 - RNA, 19 nt, Homo sapiens
ugucuaacuugucuacaug

SEQ ID NO: 1045340 - RNA, 19 nt, Homo sapiens
ucacuugucaugaaggauu

SEQ ID NO: 1045341 - RNA, 19 nt, Homo sapiens
ccaccucaccugccuauca

SEQ ID NO: 1045342 - RNA, 19 nt, Homo sapiens
ggucagaauguguucaaau

SEQ ID NO: 1045343 - RNA, 19 nt, Homo sapiens
uggcagugcuuuuaaauga

SEQ ID NO: 1045344 - RNA, 19 nt, Homo sapiens
gaccuacacaauaugguuu

SEQ ID NO: 1045345 - RNA, 19 nt, Homo sapiens
agacuguguuugaagcauu

SEQ ID NO: 1045346 - RNA, 19 nt, Homo sapiens
ccaagguaauguuuuguuu

SEQ ID NO: 1045347 - RNA, 19 nt, Homo sapiens
gcggagggguuuucuuuga

SEQ ID NO: 1045348 - RNA, 19 nt, Homo sapiens
caucacuugucaugaagga

SEQ ID NO: 1045349 - RNA, 19 nt, Homo sapiens
caagaagauugccguaucc

SEQ ID NO: 1045350 - RNA, 19 nt, Homo sapiens
gagccucucucuaguugac

SEQ ID NO: 1045351 - RNA, 19 nt, Homo sapiens
cgaagaugcugagauucau

SEQ ID NO: 1045352 - RNA, 19 nt, Homo sapiens
uaggcuggaucccaaguga

SEQ ID NO: 1045353 - RNA, 19 nt, Homo sapiens
aaagaagugugagguugga

SEQ ID NO: 1045354 - RNA, 19 nt, Homo sapiens
gagacaguaaccaagguaa

SEQ ID NO: 1045355 - RNA, 19 nt, Homo sapiens
cauaucaucaguguuugua

SEQ ID NO: 1045356 - RNA, 19 nt, Homo sapiens
ucugugcugucuucuggua

SEQ ID NO: 1045357 - RNA, 19 nt, Homo sapiens
ggaaaggugggcagacucu

SEQ ID NO: 1045358 - RNA, 19 nt, Homo sapiens
cuaaucaucacuugucaug

SEQ ID NO: 1045359 - RNA, 19 nt, Homo sapiens
agaagcuaaucaucacuug

SEQ ID NO: 1045360 - RNA, 19 nt, Homo sapiens
agacauggagagaagcuaa

SEQ ID NO: 1045361 - RNA, 19 nt, Homo sapiens
ggguguuguuccuaagaaa

SEQ ID NO: 1045362 - RNA, 19 nt, Homo sapiens
uauccgaccuucaaaagaa

SEQ ID NO: 1045363 - RNA, 19 nt, Homo sapiens
caucaguguuuguauucau

SEQ ID NO: 1045364 - RNA, 19 nt, Homo sapiens
cugaagggcgcuacaaaga

SEQ ID NO: 1045365 - RNA, 19 nt, Homo sapiens
gcugagauucauaacaaga

SEQ ID NO: 1045366 - RNA, 19 nt, Homo sapiens
caugaacucugugcugucu

SEQ ID NO: 1045367 - RNA, 19 nt, Homo sapiens
gcagugagaaaggaaagga

SEQ ID NO: 1045368 - RNA, 19 nt, Homo sapiens
gcagugcuuuuaaaugaga

SEQ ID NO: 1045369 - RNA, 19 nt, Homo sapiens
gaacaucucuuugaauugu

SEQ ID NO: 1045370 - RNA, 19 nt, Homo sapiens
gaacuaaagccggguauaa

SEQ ID NO: 1045371 - RNA, 19 nt, Homo sapiens
gaacaacagaagagaauaa

SEQ ID NO: 1045372 - RNA, 19 nt, Homo sapiens
gagaaugaguuuccuccua

SEQ ID NO: 1045373 - RNA, 19 nt, Homo sapiens
gaacaucuguacccucuca

SEQ ID NO: 1045374 - RNA, 19 nt, Homo sapiens
gaacguguaucacuucaag

SEQ ID NO: 1045375 - RNA, 19 nt, Homo sapiens
caacagaagagaauaaaga

SEQ ID NO: 1045376 - RNA, 19 nt, Homo sapiens
cuagaagaguccauuuaua

SEQ ID NO: 1045377 - RNA, 19 nt, Homo sapiens
guggacaccuuuauaugua

SEQ ID NO: 1045378 - RNA, 19 nt, Homo sapiens
gaaugaguuuccuccuaua

SEQ ID NO: 1045379 - RNA, 19 nt, Homo sapiens
gcaauugugugagcagaaa

SEQ ID NO: 1045380 - RNA, 19 nt, Homo sapiens
gcacaucccuagcaauugg

SEQ ID NO: 1045381 - RNA, 19 nt, Homo sapiens
gaagaguccauuuauauuc

SEQ ID NO: 1045382 - RNA, 19 nt, Homo sapiens
acaaucagcucucuagugu

SEQ ID NO: 1045383 - RNA, 19 nt, Homo sapiens
ugaagacccuccuggauau

SEQ ID NO: 1045384 - RNA, 19 nt, Homo sapiens
ggagagggaugaaaaggua

SEQ ID NO: 1045385 - RNA, 19 nt, Homo sapiens
gagagugugucuuaaucaa

SEQ ID NO: 1045386 - RNA, 19 nt, Homo sapiens
aggaacaucucuuugaauu

SEQ ID NO: 1045387 - RNA, 19 nt, Homo sapiens
gagaagcacaccucagaaa

SEQ ID NO: 1045388 - RNA, 19 nt, Homo sapiens
guauacacaucaugcuauu

SEQ ID NO: 1045389 - RNA, 19 nt, Homo sapiens
ggaccagugugucuugaug

SEQ ID NO: 1045390 - RNA, 19 nt, Homo sapiens
gggagauugugcuuuauga

SEQ ID NO: 1045391 - RNA, 19 nt, Homo sapiens
uuaaagacaugaagcuguu

SEQ ID NO: 1045392 - RNA, 19 nt, Homo sapiens
ucucaacgauccagaaguu

SEQ ID NO: 1045393 - RNA, 19 nt, Homo sapiens
caguauggauucacaauuc

SEQ ID NO: 1045394 - RNA, 19 nt, Homo sapiens
aaacgaagcagucaugaug

SEQ ID NO: 1045395 - RNA, 19 nt, Homo sapiens
agaaugaguuuccuccuau

SEQ ID NO: 1045396 - RNA, 19 nt, Homo sapiens
ggaggagagugugucuuaa

SEQ ID NO: 1045397 - RNA, 19 nt, Homo sapiens
gagaaguuauuccugaaca

SEQ ID NO: 1045398 - RNA, 19 nt, Homo sapiens
aaucagcucucuaguguuc

SEQ ID NO: 1045399 - RNA, 19 nt, Homo sapiens
ggcaaaagcucuaugaguu

SEQ ID NO: 1045400 - RNA, 19 nt, Homo sapiens
gauggaaacucccugaaaa

SEQ ID NO: 1045401 - RNA, 19 nt, Homo sapiens
agcaacaucuuguccauaa

SEQ ID NO: 1045402 - RNA, 19 nt, Homo sapiens
ggaagaauggagugcaauu

SEQ ID NO: 1045403 - RNA, 19 nt, Homo sapiens
caaggaaggcggaagaaug

SEQ ID NO: 1045404 - RNA, 19 nt, Homo sapiens
gcgcucagcugcuucucuu

SEQ ID NO: 1045405 - RNA, 19 nt, Homo sapiens
gaagcacaccucagaaauc

SEQ ID NO: 1045406 - RNA, 19 nt, Homo sapiens
gaagaauggagugcaauug

SEQ ID NO: 1045407 - RNA, 19 nt, Homo sapiens
cagugugucuugaugauga

SEQ ID NO: 1045408 - RNA, 19 nt, Homo sapiens
uauaggaacaucucuuuga

SEQ ID NO: 1045409 - RNA, 19 nt, Homo sapiens
gagauugugcuuuaugaug

SEQ ID NO: 1045410 - RNA, 19 nt, Homo sapiens
ggcuguggcuggaauaaau

SEQ ID NO: 1045411 - RNA, 19 nt, Homo sapiens
uuacauacuuagagagaga

SEQ ID NO: 1045412 - RNA, 19 nt, Homo sapiens
gguauaagcuguuuucucu

SEQ ID NO: 1045413 - RNA, 19 nt, Homo sapiens
uaaagaaaaugaccucaga

SEQ ID NO: 1045414 - RNA, 19 nt, Homo sapiens
uggaggagagugugucuua

SEQ ID NO: 1045415 - RNA, 19 nt, Homo sapiens
ucacaacauuaaagacaug

SEQ ID NO: 1045416 - RNA, 19 nt, Homo sapiens
cggcaaaggcugcugguuu

SEQ ID NO: 1045417 - RNA, 19 nt, Homo sapiens
caagaaaggcacagagauc

SEQ ID NO: 1045418 - RNA, 19 nt, Homo sapiens
aagcacaccucagaaauca

SEQ ID NO: 1045419 - RNA, 19 nt, Homo sapiens
ccuccacggugccagguua

SEQ ID NO: 1045420 - RNA, 19 nt, Homo sapiens
gacaugaagcuguugaaga

SEQ ID NO: 1045421 - RNA, 19 nt, Homo sapiens
ugaguuuccuccuauaauc

SEQ ID NO: 1045422 - RNA, 19 nt, Homo sapiens
gaaguuauuccugaacaug

SEQ ID NO: 1045423 - RNA, 19 nt, Homo sapiens
gaaaaugaccucagaccuu

SEQ ID NO: 1045424 - RNA, 19 nt, Homo sapiens
gaccuggaguggcuacaug

SEQ ID NO: 1045425 - RNA, 19 nt, Homo sapiens
gcacuauugcugcccauga

SEQ ID NO: 1045426 - RNA, 19 nt, Homo sapiens
cguucaaacuauaguguaa

SEQ ID NO: 1045427 - RNA, 19 nt, Homo sapiens
gaauggagugcaauugugu

SEQ ID NO: 1045428 - RNA, 19 nt, Homo sapiens
gcggaagaauggagugcaa

SEQ ID NO: 1045429 - RNA, 19 nt, Homo sapiens
caggggagauugugcuuua

SEQ ID NO: 1045430 - RNA, 19 nt, Homo sapiens
ucaaccauuccaauucuua

SEQ ID NO: 1045431 - RNA, 19 nt, Homo sapiens
auaggaacaucucuuugaa

SEQ ID NO: 1045432 - RNA, 19 nt, Homo sapiens
ggaacaacagaagagaaua

SEQ ID NO: 1045433 - RNA, 19 nt, Homo sapiens
ccaguggacaccuuuauau

SEQ ID NO: 1045434 - RNA, 19 nt, Homo sapiens
gaaaacagucugcacuauu

SEQ ID NO: 1045435 - RNA, 19 nt, Homo sapiens
gaaacucccugaaaacagu

SEQ ID NO: 1045436 - RNA, 19 nt, Homo sapiens
uaucaaccauuccaauucu

SEQ ID NO: 1045437 - RNA, 19 nt, Homo sapiens
gaggagagugugucuuaau

SEQ ID NO: 1045438 - RNA, 19 nt, Homo sapiens
caccaacagucgaccagaa

SEQ ID NO: 1045439 - RNA, 19 nt, Homo sapiens
gaaaagguaugugacaauc

SEQ ID NO: 1045440 - RNA, 19 nt, Homo sapiens
aaacaaggaaggcggaaga

SEQ ID NO: 1045441 - RNA, 19 nt, Homo sapiens
ggacaccuuuauauguaca

SEQ ID NO: 1045442 - RNA, 19 nt, Homo sapiens
aaaacagucugcacuauug

SEQ ID NO: 1045443 - RNA, 19 nt, Homo sapiens
uaugugcucucucuaucaa

SEQ ID NO: 1045444 - RNA, 19 nt, Homo sapiens
uugaagacccuccuggaua

SEQ ID NO: 1045445 - RNA, 19 nt, Homo sapiens
acaugaagcuguugaagac

SEQ ID NO: 1045446 - RNA, 19 nt, Homo sapiens
gccuagaagaguccauuua

SEQ ID NO: 1045447 - RNA, 19 nt, Homo sapiens
ggaacaucucuuugaauug

SEQ ID NO: 1045448 - RNA, 19 nt, Homo sapiens
gagugugucuuaaucaaaa

SEQ ID NO: 1045449 - RNA, 19 nt, Homo sapiens
ggagagugugucuuaauca

SEQ ID NO: 1045450 - RNA, 19 nt, Homo sapiens
ggaacuaaagccggguaua

SEQ ID NO: 1045451 - RNA, 19 nt, Homo sapiens
gacaaucagcucucuagug

SEQ ID NO: 1045452 - RNA, 19 nt, Homo sapiens
gcacagucauccggguguu

SEQ ID NO: 1045453 - RNA, 19 nt, Homo sapiens
ggacugcacaucccuagca

SEQ ID NO: 1045454 - RNA, 19 nt, Homo sapiens
gggagacauuguauacaca

SEQ ID NO: 1045455 - RNA, 19 nt, Homo sapiens
agaauggagugcaauugug

SEQ ID NO: 1045456 - RNA, 19 nt, Homo sapiens
gcgcugcgaggagaaguua

SEQ ID NO: 1045457 - RNA, 19 nt, Homo sapiens
gcugcugguuugccuagaa

SEQ ID NO: 1045458 - RNA, 19 nt, Homo sapiens
guguaucacuucaagaaag

SEQ ID NO: 1045459 - RNA, 19 nt, Homo sapiens
uggagcagcuggaucaagu

SEQ ID NO: 1045460 - RNA, 19 nt, Homo sapiens
ccucagaccuuccuuaccu

SEQ ID NO: 1045461 - RNA, 19 nt, Homo sapiens
gaaguugccacggcugcua

SEQ ID NO: 1045462 - RNA, 19 nt, Homo sapiens
ccuagaagaguccauuuau

SEQ ID NO: 1045463 - RNA, 19 nt, Homo sapiens
gcucucuaguguucaguau

SEQ ID NO: 1045464 - RNA, 19 nt, Homo sapiens
gaugaacguguaucacuuc

SEQ ID NO: 1045465 - RNA, 19 nt, Homo sapiens
caaacuauaguguaaaugc

SEQ ID NO: 1045466 - RNA, 19 nt, Homo sapiens
gaccguagccagaccaagu

SEQ ID NO: 1045467 - RNA, 19 nt, Homo sapiens
ccacugcacgcuugaacuu

SEQ ID NO: 1045468 - RNA, 19 nt, Homo sapiens
gguguucucugucccugau

SEQ ID NO: 1045469 - RNA, 19 nt, Homo sapiens
ggacagggcuugagaguga

SEQ ID NO: 1045470 - RNA, 19 nt, Homo sapiens
gaaggaagcucaugagaag

SEQ ID NO: 1045471 - RNA, 19 nt, Homo sapiens
gauaaggacaucuaaguua

SEQ ID NO: 1045472 - RNA, 19 nt, Homo sapiens
ugacaacguugcagaauaa

SEQ ID NO: 1045473 - RNA, 19 nt, Homo sapiens
gaaagaaggaagcucauga

SEQ ID NO: 1045474 - RNA, 19 nt, Homo sapiens
ggagaaagaggaagaguug

SEQ ID NO: 1045475 - RNA, 19 nt, Homo sapiens
caacggaucuaacaguaau

SEQ ID NO: 1045476 - RNA, 19 nt, Homo sapiens
ggaaagggaccaaagagaa

SEQ ID NO: 1045477 - RNA, 19 nt, Homo sapiens
gaaagaaggccaagggaau

SEQ ID NO: 1045478 - RNA, 19 nt, Homo sapiens
gcuaugagguucaaaugug

SEQ ID NO: 1045479 - RNA, 19 nt, Homo sapiens
uauaaucgcugugauauuc

SEQ ID NO: 1045480 - RNA, 19 nt, Homo sapiens
ggaacggguuaacuuguuu

SEQ ID NO: 1045481 - RNA, 19 nt, Homo sapiens
uuucuaagcugaaugauga

SEQ ID NO: 1045482 - RNA, 19 nt, Homo sapiens
gauaauugguccugugauc

SEQ ID NO: 1045483 - RNA, 19 nt, Homo sapiens
agaaucugauccugacuua

SEQ ID NO: 1045484 - RNA, 19 nt, Homo sapiens
gaugggaucuggccuugau

SEQ ID NO: 1045485 - RNA, 19 nt, Homo sapiens
gaaagggaccaaagagaau

SEQ ID NO: 1045486 - RNA, 19 nt, Homo sapiens
ccucaguucucccagauaa

SEQ ID NO: 1045487 - RNA, 19 nt, Homo sapiens
ccaauagacucaccuuaag

SEQ ID NO: 1045488 - RNA, 19 nt, Homo sapiens
ggaagauaaugaagagauc

SEQ ID NO: 1045489 - RNA, 19 nt, Homo sapiens
ggagaggagguaccacaua

SEQ ID NO: 1045490 - RNA, 19 nt, Homo sapiens
gaaaggcacaaaucaacaa

SEQ ID NO: 1045491 - RNA, 19 nt, Homo sapiens
gagaggagguaccacauac

SEQ ID NO: 1045492 - RNA, 19 nt, Homo sapiens
ccaaaggccaguuuaaaga

SEQ ID NO: 1045493 - RNA, 19 nt, Homo sapiens
caacguugcagaauaaaga

SEQ ID NO: 1045494 - RNA, 19 nt, Homo sapiens
ggagcuaucagucaugaaa

SEQ ID NO: 1045495 - RNA, 19 nt, Homo sapiens
gacaaggagccaggaauua

SEQ ID NO: 1045496 - RNA, 19 nt, Homo sapiens
caaagaaccugggccuauc

SEQ ID NO: 1045497 - RNA, 19 nt, Homo sapiens
cggguuaacuuguuugguu

SEQ ID NO: 1045498 - RNA, 19 nt, Homo sapiens
cacaaagcguaguuucuaa

SEQ ID NO: 1045499 - RNA, 19 nt, Homo sapiens
uuacagcucucugguuuga

SEQ ID NO: 1045500 - RNA, 19 nt, Homo sapiens
ggaagaccgacuaaagaaa

SEQ ID NO: 1045501 - RNA, 19 nt, Homo sapiens
gcugaaugaugacaacguu

SEQ ID NO: 1045502 - RNA, 19 nt, Homo sapiens
gaaaagaaguuagaacagu

SEQ ID NO: 1045503 - RNA, 19 nt, Homo sapiens
ggaauuacugcuucugcua

SEQ ID NO: 1045504 - RNA, 19 nt, Homo sapiens
uuagaacagugccaaagaa

SEQ ID NO: 1045505 - RNA, 19 nt, Homo sapiens
gaaagaggaagaguuggaa

SEQ ID NO: 1045506 - RNA, 19 nt, Homo sapiens
cagaacagaucagcauuca

SEQ ID NO: 1045507 - RNA, 19 nt, Homo sapiens
gggccaagcaauacgguua

SEQ ID NO: 1045508 - RNA, 19 nt, Homo sapiens
aagcaaccaugaagaaugu

SEQ ID NO: 1045509 - RNA, 19 nt, Homo sapiens
caaaggccaguuuaaagaa

SEQ ID NO: 1045510 - RNA, 19 nt, Homo sapiens
ggguuaacuuguuugguuu

SEQ ID NO: 1045511 - RNA, 19 nt, Homo sapiens
acacaaagcguaguuucua

SEQ ID NO: 1045512 - RNA, 19 nt, Homo sapiens
uaauaaagcagguuacagu

SEQ ID NO: 1045513 - RNA, 19 nt, Homo sapiens
uaaguaccaugugacguuu

SEQ ID NO: 1045514 - RNA, 19 nt, Homo sapiens
aaucaagucuuaccaaugc

SEQ ID NO: 1045515 - RNA, 19 nt, Homo sapiens
uaaagaagaauguggaaag

SEQ ID NO: 1045516 - RNA, 19 nt, Homo sapiens
ccaaagaaccugggccuau

SEQ ID NO: 1045517 - RNA, 19 nt, Homo sapiens
gagauuguccagauuguuc

SEQ ID NO: 1045518 - RNA, 19 nt, Homo sapiens
gcuaagugcugggucuguu

SEQ ID NO: 1045519 - RNA, 19 nt, Homo sapiens
acuuacagcucucugguuu

SEQ ID NO: 1045520 - RNA, 19 nt, Homo sapiens
ucaacaugcuaaagaacuu

SEQ ID NO: 1045521 - RNA, 19 nt, Homo sapiens
uugauucccugccgucuaa

SEQ ID NO: 1045522 - RNA, 19 nt, Homo sapiens
caggaagaccgacuaaaga

SEQ ID NO: 1045523 - RNA, 19 nt, Homo sapiens
gcacacaaagcguaguuuc

SEQ ID NO: 1045524 - RNA, 19 nt, Homo sapiens
gcaguuucuguguuaauaa

SEQ ID NO: 1045525 - RNA, 19 nt, Homo sapiens
ggccuucccuucuuuacug

SEQ ID NO: 1045526 - RNA, 19 nt, Homo sapiens
caagcaagcagagaagaaa

SEQ ID NO: 1045527 - RNA, 19 nt, Homo sapiens
uggagcaacucauggaaga

SEQ ID NO: 1045528 - RNA, 19 nt, Homo sapiens
gcagaacagaucagcauuc

SEQ ID NO: 1045529 - RNA, 19 nt, Homo sapiens
gugcauggaucccagucaa

SEQ ID NO: 1045530 - RNA, 19 nt, Homo sapiens
aagaagaaauccaauagac

SEQ ID NO: 1045531 - RNA, 19 nt, Homo sapiens
ggagguaccacauacucaa

SEQ ID NO: 1045532 - RNA, 19 nt, Homo sapiens
aaagaaaggcacaaaucaa

SEQ ID NO: 1045533 - RNA, 19 nt, Homo sapiens
gcagaauaaagaagaaugu

SEQ ID NO: 1045534 - RNA, 19 nt, Homo sapiens
auccuaagcuuucaguauu

SEQ ID NO: 1045535 - RNA, 19 nt, Homo sapiens
gaagaccgacuaaagaaaa

SEQ ID NO: 1045536 - RNA, 19 nt, Homo sapiens
uccaauagacucaccuuaa

SEQ ID NO: 1045537 - RNA, 19 nt, Homo sapiens
gaggagauuguccagauug

SEQ ID NO: 1045538 - RNA, 19 nt, Homo sapiens
cagucaacaugcuaaagaa

SEQ ID NO: 1045539 - RNA, 19 nt, Homo sapiens
ccagucaacaugcuaaaga

SEQ ID NO: 1045540 - RNA, 19 nt, Homo sapiens
cuaaguaccaugugacguu

SEQ ID NO: 1045541 - RNA, 19 nt, Homo sapiens
ggccaggcaugauagaauc

SEQ ID NO: 1045542 - RNA, 19 nt, Homo sapiens
caguauaaucgcugugaua

SEQ ID NO: 1045543 - RNA, 19 nt, Homo sapiens
aaggagagauaagugguuu

SEQ ID NO: 1045544 - RNA, 19 nt, Homo sapiens
ccacauacucaagagauuu

SEQ ID NO: 1045545 - RNA, 19 nt, Homo sapiens
ugaggagauuguccagauu

SEQ ID NO: 1045546 - RNA, 19 nt, Homo sapiens
uggugcaguuucuguguua

SEQ ID NO: 1045547 - RNA, 19 nt, Homo sapiens
gaacagugccaaagaaccu

SEQ ID NO: 1045548 - RNA, 19 nt, Homo sapiens
agaggaagauaaugaagag

SEQ ID NO: 1045549 - RNA, 19 nt, Homo sapiens
gaaaugacugcagccagaa

SEQ ID NO: 1045550 - RNA, 19 nt, Homo sapiens
agacaaggagccaggaauu

SEQ ID NO: 1045551 - RNA, 19 nt, Homo sapiens
gaucagaggcacacaaagc

SEQ ID NO: 1045552 - RNA, 19 nt, Homo sapiens
ucuuaccaaugcagaauuu

SEQ ID NO: 1045553 - RNA, 19 nt, Homo sapiens
gcaagcagagaagaaagaa

SEQ ID NO: 1045554 - RNA, 19 nt, Homo sapiens
ugcaguuucuguguuaaua

SEQ ID NO: 1045555 - RNA, 19 nt, Homo sapiens
gagcaacucauggaagaug

SEQ ID NO: 1045556 - RNA, 19 nt, Homo sapiens
agaaggaagcucaugagaa

SEQ ID NO: 1045557 - RNA, 19 nt, Homo sapiens
cuaagaagaaauccaauag

SEQ ID NO: 1045558 - RNA, 19 nt, Homo sapiens
gccaaaggccaguuuaaag

SEQ ID NO: 1045559 - RNA, 19 nt, Homo sapiens
ggaccuggagcaacucaug

SEQ ID NO: 1045560 - RNA, 19 nt, Homo sapiens
aaagaaggccaagggaauu

SEQ ID NO: 1045561 - RNA, 19 nt, Homo sapiens
gagaaaacagacccaauuu

SEQ ID NO: 1045562 - RNA, 19 nt, Homo sapiens
augacaacguugcagaaua

SEQ ID NO: 1045563 - RNA, 19 nt, Homo sapiens
gcaguauaaucgcugugau

SEQ ID NO: 1045564 - RNA, 19 nt, Homo sapiens
ucaguucucccagauaauu

SEQ ID NO: 1045565 - RNA, 19 nt, Homo sapiens
agacucaccuuaagcaaaa

SEQ ID NO: 1045566 - RNA, 19 nt, Homo sapiens
aaauguguguggugcaguu

SEQ ID NO: 1045567 - RNA, 19 nt, Homo sapiens
uggaagauguugggagaga

SEQ ID NO: 1045568 - RNA, 19 nt, Homo sapiens
aaacaguucaggaucauuc

SEQ ID NO: 1045569 - RNA, 19 nt, Homo sapiens
gaaccaauauuucccuuaa

SEQ ID NO: 1045570 - RNA, 19 nt, Homo sapiens
aaaggaagguugaguuaua

SEQ ID NO: 1045571 - RNA, 19 nt, Homo sapiens
ggaaguuaaugaaagcuua

SEQ ID NO: 1045572 - RNA, 19 nt, Homo sapiens
cauaggagaugcucaguaa

SEQ ID NO: 1045573 - RNA, 19 nt, Homo sapiens
gaacacagaagcuuaaaga

SEQ ID NO: 1045574 - RNA, 19 nt, Homo sapiens
agaagaaacugaacagaaa

SEQ ID NO: 1045575 - RNA, 19 nt, Homo sapiens
gaauguguguuucugcaua

SEQ ID NO: 1045576 - RNA, 19 nt, Homo sapiens
aaugaaagcuuaaggagaa

SEQ ID NO: 1045577 - RNA, 19 nt, Homo sapiens
cacagaagcuuaaagaaga

SEQ ID NO: 1045578 - RNA, 19 nt, Homo sapiens
gcaagaacacagaagcuua

SEQ ID NO: 1045579 - RNA, 19 nt, Homo sapiens
gcaaagaggagcaugcaaa

SEQ ID NO: 1045580 - RNA, 19 nt, Homo sapiens
gcuacccucugaagaaaua

SEQ ID NO: 1045581 - RNA, 19 nt, Homo sapiens
gggaugaguuggccuacua

SEQ ID NO: 1045582 - RNA, 19 nt, Homo sapiens
gaagcaagccuccauuugu

SEQ ID NO: 1045583 - RNA, 19 nt, Homo sapiens
guagggaggugcucaugaa

SEQ ID NO: 1045584 - RNA, 19 nt, Homo sapiens
gaagcauccuuaaagaaau

SEQ ID NO: 1045585 - RNA, 19 nt, Homo sapiens
gugcaugcaucaccuauga

SEQ ID NO: 1045586 - RNA, 19 nt, Homo sapiens
uaaacaugcugauugaaug

SEQ ID NO: 1045587 - RNA, 19 nt, Homo sapiens
caucagagaauguguguuu

SEQ ID NO: 1045588 - RNA, 19 nt, Homo sapiens
gagcacagcugcaccaaaa

SEQ ID NO: 1045589 - RNA, 19 nt, Homo sapiens
ggacagccaucagagaaug

SEQ ID NO: 1045590 - RNA, 19 nt, Homo sapiens
gauucuaccucugaaguaa

SEQ ID NO: 1045591 - RNA, 19 nt, Homo sapiens
caagaacacagaagcuuaa

SEQ ID NO: 1045592 - RNA, 19 nt, Homo sapiens
caguaaacaugcugauuga

SEQ ID NO: 1045593 - RNA, 19 nt, Homo sapiens
gaagaaauacucacugcau

SEQ ID NO: 1045594 - RNA, 19 nt, Homo sapiens
ggaaaugugggaugaguug

SEQ ID NO: 1045595 - RNA, 19 nt, Homo sapiens
agaccaagcuacccucuga

SEQ ID NO: 1045596 - RNA, 19 nt, Homo sapiens
gagaggguaugcagucuuc

SEQ ID NO: 1045597 - RNA, 19 nt, Homo sapiens
aaacaugcaucaagaagca

SEQ ID NO: 1045598 - RNA, 19 nt, Homo sapiens
ugaagcauccuuaaagaaa

SEQ ID NO: 1045599 - RNA, 19 nt, Homo sapiens
ggaagauucuaccucugaa

SEQ ID NO: 1045600 - RNA, 19 nt, Homo sapiens
gguguaaccucaucucuac

SEQ ID NO: 1045601 - RNA, 19 nt, Homo sapiens
caagcuacccucugaagaa

SEQ ID NO: 1045602 - RNA, 19 nt, Homo sapiens
ggaagcaagccuccauuug

SEQ ID NO: 1045603 - RNA, 19 nt, Homo sapiens
uacaucacaugaaccaaua

SEQ ID NO: 1045604 - RNA, 19 nt, Homo sapiens
ggaagaaagacaugaguca

SEQ ID NO: 1045605 - RNA, 19 nt, Homo sapiens
gguaauaucaccacucuag

SEQ ID NO: 1045606 - RNA, 19 nt, Homo sapiens
guaaacaugcugauugaau

SEQ ID NO: 1045607 - RNA, 19 nt, Homo sapiens
gaaauacucacugcaugaa

SEQ ID NO: 1045608 - RNA, 19 nt, Homo sapiens
agaaaggaagguugaguua

SEQ ID NO: 1045609 - RNA, 19 nt, Homo sapiens
aagcaagccuccauuuguu

SEQ ID NO: 1045610 - RNA, 19 nt, Homo sapiens
agaauaaucucaacagacu

SEQ ID NO: 1045611 - RNA, 19 nt, Homo sapiens
gaagaaaacacacgagauu

SEQ ID NO: 1045612 - RNA, 19 nt, Homo sapiens
caggagagcaugagauuug

SEQ ID NO: 1045613 - RNA, 19 nt, Homo sapiens
aaaauaaacugguccuuga

SEQ ID NO: 1045614 - RNA, 19 nt, Homo sapiens
gaucuuacuuuguuaaucc

SEQ ID NO: 1045615 - RNA, 19 nt, Homo sapiens
gggcugcuaugaggauuaa

SEQ ID NO: 1045616 - RNA, 19 nt, Homo sapiens
gacaauugaagcauccuua

SEQ ID NO: 1045617 - RNA, 19 nt, Homo sapiens
ucacggaggccuuuaucua

SEQ ID NO: 1045618 - RNA, 19 nt, Homo sapiens
ggaaacaaagggaagaugu

SEQ ID NO: 1045619 - RNA, 19 nt, Homo sapiens
gaaaagguauuugaaagug

SEQ ID NO: 1045620 - RNA, 19 nt, Homo sapiens
gaaaggaagaggcaaagag

SEQ ID NO: 1045621 - RNA, 19 nt, Homo sapiens
gggucuaccucaugaauca

SEQ ID NO: 1045622 - RNA, 19 nt, Homo sapiens
uugagucacugaugucuaa

SEQ ID NO: 1045623 - RNA, 19 nt, Homo sapiens
ggaugcuucuucaggaauu

SEQ ID NO: 1045624 - RNA, 19 nt, Homo sapiens
caggauaugaucuuacuuu

SEQ ID NO: 1045625 - RNA, 19 nt, Homo sapiens
gaagguugaguuauaacaa

SEQ ID NO: 1045626 - RNA, 19 nt, Homo sapiens
gaaaggaagguugaguuau

SEQ ID NO: 1045627 - RNA, 19 nt, Homo sapiens
ggucccaccuacuugauga

SEQ ID NO: 1045628 - RNA, 19 nt, Homo sapiens
ccuguuuccuuaucucuaa

SEQ ID NO: 1045629 - RNA, 19 nt, Homo sapiens
ucaaccuccuguuuccuua

SEQ ID NO: 1045630 - RNA, 19 nt, Homo sapiens
gaggaggucuggaagaaaa

SEQ ID NO: 1045631 - RNA, 19 nt, Homo sapiens
ggaugaggguggaagaaag

SEQ ID NO: 1045632 - RNA, 19 nt, Homo sapiens
gauguugguucagcaagaa

SEQ ID NO: 1045633 - RNA, 19 nt, Homo sapiens
guaaccucaucucuacuaa

SEQ ID NO: 1045634 - RNA, 19 nt, Homo sapiens
ucaccacucuaggcuauuu

SEQ ID NO: 1045635 - RNA, 19 nt, Homo sapiens
uaucaccacucuaggcuau

SEQ ID NO: 1045636 - RNA, 19 nt, Homo sapiens
aaggaagguugaguuauaa

SEQ ID NO: 1045637 - RNA, 19 nt, Homo sapiens
gaagaaacugaacagaaau

SEQ ID NO: 1045638 - RNA, 19 nt, Homo sapiens
gaagacggcucuggguuuu

SEQ ID NO: 1045639 - RNA, 19 nt, Homo sapiens
ccaccuacuugaugacuuc

SEQ ID NO: 1045640 - RNA, 19 nt, Homo sapiens
gaaugacuaacagguauuu

SEQ ID NO: 1045641 - RNA, 19 nt, Homo sapiens
gagaugcucaguaaacaug

SEQ ID NO: 1045642 - RNA, 19 nt, Homo sapiens
aaacaaggcaggauaugau

SEQ ID NO: 1045643 - RNA, 19 nt, Homo sapiens
gagagcaugagauuugaaa

SEQ ID NO: 1045644 - RNA, 19 nt, Homo sapiens
agaugaaacuaaaggagaa

SEQ ID NO: 1045645 - RNA, 19 nt, Homo sapiens
ucacaugaaccaauauuuc

SEQ ID NO: 1045646 - RNA, 19 nt, Homo sapiens
ucacgaauguauacucagu

SEQ ID NO: 1045647 - RNA, 19 nt, Homo sapiens
guucacgaauguauacuca

SEQ ID NO: 1045648 - RNA, 19 nt, Homo sapiens
uaaggagaaucaugaagag

SEQ ID NO: 1045649 - RNA, 19 nt, Homo sapiens
gguaugcagucuucugaca

SEQ ID NO: 1045650 - RNA, 19 nt, Homo sapiens
caguugaaccuuggaaaua

SEQ ID NO: 1045651 - RNA, 19 nt, Homo sapiens
ggaauucgaaggaagaaag

SEQ ID NO: 1045652 - RNA, 19 nt, Homo sapiens
ucugcagccuugauuagua

SEQ ID NO: 1045653 - RNA, 19 nt, Homo sapiens
gcaggagaaucgcuugaac

SEQ ID NO: 1045654 - RNA, 19 nt, Homo sapiens
cuagcuaucugcuuguuca

SEQ ID NO: 1045655 - RNA, 19 nt, Homo sapiens
aguugaaccuuggaaauaa

SEQ ID NO: 1045656 - RNA, 19 nt, Homo sapiens
ugaagacggcucuggguuu

SEQ ID NO: 1045657 - RNA, 19 nt, Homo sapiens
ugaguuggccuacuacgaa

SEQ ID NO: 1045658 - RNA, 19 nt, Homo sapiens
caauugaagcauccuuaaa

SEQ ID NO: 1045659 - RNA, 19 nt, Homo sapiens
ggaccagccagcucaguug

SEQ ID NO: 1045660 - RNA, 19 nt, Homo sapiens
aagaagaaacugaacagaa

SEQ ID NO: 1045661 - RNA, 19 nt, Homo sapiens
uuagagacaugaagaacuc

SEQ ID NO: 1045662 - RNA, 19 nt, Homo sapiens
caggagaccuagcuaucug

SEQ ID NO: 1045663 - RNA, 19 nt, Homo sapiens
gaaagcuuaaggagaauca

SEQ ID NO: 1045664 - RNA, 19 nt, Homo sapiens
aagcuacccucugaagaaa

SEQ ID NO: 1045665 - RNA, 19 nt, Homo sapiens
gcaauagugaggauaugga

SEQ ID NO: 1045666 - RNA, 19 nt, Homo sapiens
acagaagcuuaaagaagaa

SEQ ID NO: 1045667 - RNA, 19 nt, Homo sapiens
gaagauguugguucagcaa

SEQ ID NO: 1045668 - RNA, 19 nt, Homo sapiens
caugaaggcaggagaccua

SEQ ID NO: 1045669 - RNA, 19 nt, Homo sapiens
ggaccugccugugaccuuu

SEQ ID NO: 1045670 - RNA, 19 nt, Homo sapiens
gagcagaggaggaagagaa

SEQ ID NO: 1045671 - RNA, 19 nt, Homo sapiens
agaagaggcuuugccauug

SEQ ID NO: 1045672 - RNA, 19 nt, Homo sapiens
gaaaaucagcucccucuuu

SEQ ID NO: 1045673 - RNA, 19 nt, Homo sapiens
gcaauggccuguuguaccu

SEQ ID NO: 1045674 - RNA, 19 nt, Homo sapiens
ccugccaccuccuuucuua

SEQ ID NO: 1045675 - RNA, 19 nt, Homo sapiens
ggagcugccugugguggua

SEQ ID NO: 1045676 - RNA, 19 nt, Homo sapiens
gggaaggaccugccuguga

SEQ ID NO: 1045677 - RNA, 19 nt, Homo sapiens
agaagacguuggcauguga

SEQ ID NO: 1045678 - RNA, 19 nt, Homo sapiens
cacagugccugacuacuug

SEQ ID NO: 1045679 - RNA, 19 nt, Homo sapiens
gaagaggcuuugccauugc

SEQ ID NO: 1045680 - RNA, 19 nt, Homo sapiens
ccacagugccugacuacuu

SEQ ID NO: 1045681 - RNA, 19 nt, Homo sapiens
cagcaucuaccacguguuu

SEQ ID NO: 1045682 - RNA, 19 nt, Homo sapiens
cagggcagcuccacucugu

SEQ ID NO: 1045683 - RNA, 19 nt, Homo sapiens
aaaaucagcucccucuuug

SEQ ID NO: 1045684 - RNA, 19 nt, Homo sapiens
aagaagaggcuuugccauu

SEQ ID NO: 1045685 - RNA, 19 nt, Homo sapiens
gugcagagcuuuuccuguu

SEQ ID NO: 1045686 - RNA, 19 nt, Homo sapiens
gcagaaaggacuguguaga

SEQ ID NO: 1045687 - RNA, 19 nt, Homo sapiens
guaccucuaaugucacuuu

SEQ ID NO: 1045688 - RNA, 19 nt, Homo sapiens
cagaagacguuggcaugug

SEQ ID NO: 1045689 - RNA, 19 nt, Homo sapiens
gcacugcugggucgcugua

SEQ ID NO: 1045690 - RNA, 19 nt, Homo sapiens
uguuguaccucuaauguca

SEQ ID NO: 1045691 - RNA, 19 nt, Homo sapiens
ggaggaagaagaggcuuug

SEQ ID NO: 1045692 - RNA, 19 nt, Homo sapiens
ggaagagaaggaggaagaa

SEQ ID NO: 1045693 - RNA, 19 nt, Homo sapiens
cagaagaaccaaagcaucu

SEQ ID NO: 1045694 - RNA, 19 nt, Homo sapiens
ugugggauuugugcaauaa

SEQ ID NO: 1045695 - RNA, 19 nt, Homo sapiens
uguguguucucauauguga

SEQ ID NO: 1045696 - RNA, 19 nt, Homo sapiens
ccagugccgugaccaaugg

SEQ ID NO: 1045697 - RNA, 19 nt, Homo sapiens
gcaucuaccacguguuuca

SEQ ID NO: 1045698 - RNA, 19 nt, Homo sapiens
gucuguguguguucucaua

SEQ ID NO: 1045699 - RNA, 19 nt, Homo sapiens
ugagaccuuugugggauuu

SEQ ID NO: 1045700 - RNA, 19 nt, Homo sapiens
gcagagcuuuuccuguuug

SEQ ID NO: 1045701 - RNA, 19 nt, Homo sapiens
aagcagaaaggacugugua

SEQ ID NO: 1045702 - RNA, 19 nt, Homo sapiens
ucacuacccucuguaacca

SEQ ID NO: 1045703 - RNA, 19 nt, Homo sapiens
ggauuugugcaauaaagug

SEQ ID NO: 1045704 - RNA, 19 nt, Homo sapiens
ccaagugggcucccugcuu

SEQ ID NO: 1045705 - RNA, 19 nt, Homo sapiens
gcagggcugguuggucuuu

SEQ ID NO: 1045706 - RNA, 19 nt, Homo sapiens
ggaggaagagaaggaggaa

SEQ ID NO: 1045707 - RNA, 19 nt, Homo sapiens
aagagaaggaggaagaaga

SEQ ID NO: 1045708 - RNA, 19 nt, Homo sapiens
gaagagaaggaggaagaag

SEQ ID NO: 1045709 - RNA, 19 nt, Homo sapiens
cagaaaggacuguguagac

SEQ ID NO: 1045710 - RNA, 19 nt, Homo sapiens
caacacaggaacgcucaug

SEQ ID NO: 1045711 - RNA, 19 nt, Homo sapiens
cgacuucccugagcguuuu

SEQ ID NO: 1045712 - RNA, 19 nt, Homo sapiens
aggaagagaaggaggaaga

SEQ ID NO: 1045713 - RNA, 19 nt, Homo sapiens
cagaggaggaagagaagga

SEQ ID NO: 1045714 - RNA, 19 nt, Homo sapiens
ugccaucacuacccucugu

SEQ ID NO: 1045715 - RNA, 19 nt, Homo sapiens
ugguacaggugcugagugu

SEQ ID NO: 1045716 - RNA, 19 nt, Homo sapiens
acacaggaacgcucaugga

SEQ ID NO: 1045717 - RNA, 19 nt, Homo sapiens
ccaucacuacccucuguaa

SEQ ID NO: 1045718 - RNA, 19 nt, Homo sapiens
uaccacguguuucaaagca

SEQ ID NO: 1045719 - RNA, 19 nt, Homo sapiens
ugucgugggugcugugucu

SEQ ID NO: 1045720 - RNA, 19 nt, Homo sapiens
ugggauuugugcaauaaag

SEQ ID NO: 1045721 - RNA, 19 nt, Homo sapiens
uguguguguucucauaugu

SEQ ID NO: 1045722 - RNA, 19 nt, Homo sapiens
gagcuguuuugacaacuug

SEQ ID NO: 1045723 - RNA, 19 nt, Homo sapiens
gaaaguaccuugccgaaug

SEQ ID NO: 1045724 - RNA, 19 nt, Homo sapiens
gaacuugaccuacuuuaaa

SEQ ID NO: 1045725 - RNA, 19 nt, Homo sapiens
gagcaagacuuucuauaag

SEQ ID NO: 1045726 - RNA, 19 nt, Homo sapiens
caaguaagccacaguguuu

SEQ ID NO: 1045727 - RNA, 19 nt, Homo sapiens
gaacucugcuggccuuuca

SEQ ID NO: 1045728 - RNA, 19 nt, Homo sapiens
gaaaaugacugcagcauag

SEQ ID NO: 1045729 - RNA, 19 nt, Homo sapiens
gaagcagaauggaguguau

SEQ ID NO: 1045730 - RNA, 19 nt, Homo sapiens
ggagaaacauggauuugag

SEQ ID NO: 1045731 - RNA, 19 nt, Homo sapiens
ccauagaagucaugccuuu

SEQ ID NO: 1045732 - RNA, 19 nt, Homo sapiens
gagaagaacccgaaaccaa

SEQ ID NO: 1045733 - RNA, 19 nt, Homo sapiens
ucaucuaccucacugauaa

SEQ ID NO: 1045734 - RNA, 19 nt, Homo sapiens
gaagaacccgaaaccaauu

SEQ ID NO: 1045735 - RNA, 19 nt, Homo sapiens
gcuaaucucuauaauaagg

SEQ ID NO: 1045736 - RNA, 19 nt, Homo sapiens
agaaacacaugccgaaaga

SEQ ID NO: 1045737 - RNA, 19 nt, Homo sapiens
gaagucaagugcuguaagg

SEQ ID NO: 1045738 - RNA, 19 nt, Homo sapiens
gagacaagcaguuaaccua

SEQ ID NO: 1045739 - RNA, 19 nt, Homo sapiens
ucauugacauguccucuuu

SEQ ID NO: 1045740 - RNA, 19 nt, Homo sapiens
gcugauggaagaauuuaua

SEQ ID NO: 1045741 - RNA, 19 nt, Homo sapiens
gggccuggcuuaagaaaca

SEQ ID NO: 1045742 - RNA, 19 nt, Homo sapiens
gaacaagcgcaguuucuuc

SEQ ID NO: 1045743 - RNA, 19 nt, Homo sapiens
gaucaggcauuagaaguuc

SEQ ID NO: 1045744 - RNA, 19 nt, Homo sapiens
ggaagacugggaucacuuu

SEQ ID NO: 1045745 - RNA, 19 nt, Homo sapiens
gaauuggaccugaaacguu

SEQ ID NO: 1045746 - RNA, 19 nt, Homo sapiens
ugaggaggaugccagaauu

SEQ ID NO: 1045747 - RNA, 19 nt, Homo sapiens
gaggaggaugccagaauua

SEQ ID NO: 1045748 - RNA, 19 nt, Homo sapiens
gaagcugugugugucauug

SEQ ID NO: 1045749 - RNA, 19 nt, Homo sapiens
agagcaagacuuucuauaa

SEQ ID NO: 1045750 - RNA, 19 nt, Homo sapiens
gggcauggauuucauuggu

SEQ ID NO: 1045751 - RNA, 19 nt, Homo sapiens
guacacagcccucaaucug

SEQ ID NO: 1045752 - RNA, 19 nt, Homo sapiens
ccagguggauggagaaaca

SEQ ID NO: 1045753 - RNA, 19 nt, Homo sapiens
gaagucaugccuuugaugu

SEQ ID NO: 1045754 - RNA, 19 nt, Homo sapiens
agaaccagcuggagauuca

SEQ ID NO: 1045755 - RNA, 19 nt, Homo sapiens
gcaagaaccagcuggagau

SEQ ID NO: 1045756 - RNA, 19 nt, Homo sapiens
gaaguacacagcccucaau

SEQ ID NO: 1045757 - RNA, 19 nt, Homo sapiens
ggaugcugauggaagaauu

SEQ ID NO: 1045758 - RNA, 19 nt, Homo sapiens
ccagaccgguaggcaguua

SEQ ID NO: 1045759 - RNA, 19 nt, Homo sapiens
aauuggaccugaaacguuu

SEQ ID NO: 1045760 - RNA, 19 nt, Homo sapiens
gacguucucuggucuguag

SEQ ID NO: 1045761 - RNA, 19 nt, Homo sapiens
uauaaacgccucaccaugu

SEQ ID NO: 1045762 - RNA, 19 nt, Homo sapiens
guaaggaagcugugugugu

SEQ ID NO: 1045763 - RNA, 19 nt, Homo sapiens
gagcagagcaagacuuucu

SEQ ID NO: 1045764 - RNA, 19 nt, Homo sapiens
cgaccaugauucagaccua

SEQ ID NO: 1045765 - RNA, 19 nt, Homo sapiens
gacauguccucuuucacaa

SEQ ID NO: 1045766 - RNA, 19 nt, Homo sapiens
gaauggaugguacaugguu

SEQ ID NO: 1045767 - RNA, 19 nt, Homo sapiens
cuucaucucuugcuaaucu

SEQ ID NO: 1045768 - RNA, 19 nt, Homo sapiens
agauugacaucgcgggaua

SEQ ID NO: 1045769 - RNA, 19 nt, Homo sapiens
gacagcagauuucaucaac

SEQ ID NO: 1045770 - RNA, 19 nt, Homo sapiens
caagcgcaguuucuucaug

SEQ ID NO: 1045771 - RNA, 19 nt, Homo sapiens
acacagcccucaaucugau

SEQ ID NO: 1045772 - RNA, 19 nt, Homo sapiens
ggcagccucccuauaauuu

SEQ ID NO: 1045773 - RNA, 19 nt, Homo sapiens
aagcgcaguuucuucauga

SEQ ID NO: 1045774 - RNA, 19 nt, Homo sapiens
ggaucaggcauuagaaguu

SEQ ID NO: 1045775 - RNA, 19 nt, Homo sapiens
ugacauguccucuuucaca

SEQ ID NO: 1045776 - RNA, 19 nt, Homo sapiens
gauggagaaacauggauuu

SEQ ID NO: 1045777 - RNA, 19 nt, Homo sapiens
ggagcugagugacuuccuu

SEQ ID NO: 1045778 - RNA, 19 nt, Homo sapiens
auaaacgccucaccauguu

SEQ ID NO: 1045779 - RNA, 19 nt, Homo sapiens
gggcagccucccuauaauu

SEQ ID NO: 1045780 - RNA, 19 nt, Homo sapiens
gauguaugaucugaagguu

SEQ ID NO: 1045781 - RNA, 19 nt, Homo sapiens
ggaggaugccagaauuaga

SEQ ID NO: 1045782 - RNA, 19 nt, Homo sapiens
gcaccucuccucucuacga

SEQ ID NO: 1045783 - RNA, 19 nt, Homo sapiens
gaagcaagcuccccaucau

SEQ ID NO: 1045784 - RNA, 19 nt, Homo sapiens
gcagagcaagacuuucuau

SEQ ID NO: 1045785 - RNA, 19 nt, Homo sapiens
gagaaacauggauuugaga

SEQ ID NO: 1045786 - RNA, 19 nt, Homo sapiens
ugaacuugaccuacuuuaa

SEQ ID NO: 1045787 - RNA, 19 nt, Homo sapiens
ccacuucccaagccucuuu

SEQ ID NO: 1045788 - RNA, 19 nt, Homo sapiens
uggaugugcugucugaguu

SEQ ID NO: 1045789 - RNA, 19 nt, Homo sapiens
gaggguggaggguaugaaa

SEQ ID NO: 1045790 - RNA, 19 nt, Homo sapiens
agucaugccuuugauguau

SEQ ID NO: 1045791 - RNA, 19 nt, Homo sapiens
ccaccuccuccuccuaaua

SEQ ID NO: 1045792 - RNA, 19 nt, Homo sapiens
ggugacagcagauuucauc

SEQ ID NO: 1045793 - RNA, 19 nt, Homo sapiens
gcagaauggaguguauaaa

SEQ ID NO: 1045794 - RNA, 19 nt, Homo sapiens
ucuauaagccagauugguu

SEQ ID NO: 1045795 - RNA, 19 nt, Homo sapiens
agaagaacccgaaaccaau

SEQ ID NO: 1045796 - RNA, 19 nt, Homo sapiens
gagaugagcgugggcuaug

SEQ ID NO: 1045797 - RNA, 19 nt, Homo sapiens
ggauggagaaacauggauu

SEQ ID NO: 1045798 - RNA, 19 nt, Homo sapiens
ucccaucucuuaucuccuu

SEQ ID NO: 1045799 - RNA, 19 nt, Homo sapiens
auucagaccuagaccuuug

SEQ ID NO: 1045800 - RNA, 19 nt, Homo sapiens
ggaaguacacagcccucaa

SEQ ID NO: 1045801 - RNA, 19 nt, Homo sapiens
gacgucaccuggaaguaca

SEQ ID NO: 1045802 - RNA, 19 nt, Homo sapiens
uggaggacgucaccuggaa

SEQ ID NO: 1045803 - RNA, 19 nt, Homo sapiens
cagcauagcacgacugaac

SEQ ID NO: 1045804 - RNA, 19 nt, Homo sapiens
aauggaugguacaugguua

SEQ ID NO: 1045805 - RNA, 19 nt, Homo sapiens
ccacugaaaggcuaaaugg

SEQ ID NO: 1045806 - RNA, 19 nt, Homo sapiens
gagcgugggcuaugcaaag

SEQ ID NO: 1045807 - RNA, 19 nt, Homo sapiens
aaacacaugccgaaagaca

SEQ ID NO: 1045808 - RNA, 19 nt, Homo sapiens
gcauagcacgacugaacaa

SEQ ID NO: 1045809 - RNA, 19 nt, Homo sapiens
agacugggaucacuuugag

SEQ ID NO: 1045810 - RNA, 19 nt, Homo sapiens
ccagagcagccgcaccuuu

SEQ ID NO: 1045811 - RNA, 19 nt, Homo sapiens
ggaaaguaccuugccgaau

SEQ ID NO: 1045812 - RNA, 19 nt, Homo sapiens
gcaguuaaccuagcaccau

SEQ ID NO: 1045813 - RNA, 19 nt, Homo sapiens
acauggagcugagugacuu

SEQ ID NO: 1045814 - RNA, 19 nt, Homo sapiens
gaggaugccagaauuagag

SEQ ID NO: 1045815 - RNA, 19 nt, Homo sapiens
cagagcaagacuuucuaua

SEQ ID NO: 1045816 - RNA, 19 nt, Homo sapiens
uuacgcaccucuccucucu

SEQ ID NO: 1045817 - RNA, 19 nt, Homo sapiens
cccaucaucuuguccuaga

SEQ ID NO: 1045818 - RNA, 19 nt, Homo sapiens
ggacgucaccuggaaguac

SEQ ID NO: 1045819 - RNA, 19 nt, Homo sapiens
gccauuagcagaccuuugg

SEQ ID NO: 1045820 - RNA, 19 nt, Homo sapiens
gagaguaugagauugacau

SEQ ID NO: 1045821 - RNA, 19 nt, Homo sapiens
gaugcugauggaagaauuu

SEQ ID NO: 1045822 - RNA, 19 nt, Homo sapiens
uguggaugcugauggaaga

SEQ ID NO: 1045823 - RNA, 19 nt, Homo sapiens
gaaagaagcucugcuaaua

SEQ ID NO: 1045824 - RNA, 19 nt, Homo sapiens
aaacaaagcuucauacugu

SEQ ID NO: 1045825 - RNA, 19 nt, Homo sapiens
caagauaucugcaaaugaa

SEQ ID NO: 1045826 - RNA, 19 nt, Homo sapiens
gaacacauuugucuucuga

SEQ ID NO: 1045827 - RNA, 19 nt, Homo sapiens
gagaauagcucaccaagca

SEQ ID NO: 1045828 - RNA, 19 nt, Homo sapiens
gaacagugcggugauauua

SEQ ID NO: 1045829 - RNA, 19 nt, Homo sapiens
gcuaauagguaucauauca

SEQ ID NO: 1045830 - RNA, 19 nt, Homo sapiens
gcaagaacauagacauuug

SEQ ID NO: 1045831 - RNA, 19 nt, Homo sapiens
ccauuuaccuuucugguua

SEQ ID NO: 1045832 - RNA, 19 nt, Homo sapiens
ggaaaugucugaugaugag

SEQ ID NO: 1045833 - RNA, 19 nt, Homo sapiens
gaaguugugugccuuugaa

SEQ ID NO: 1045834 - RNA, 19 nt, Homo sapiens
agaaguggcuguugucaaa

SEQ ID NO: 1045835 - RNA, 19 nt, Homo sapiens
gagcaaagcaucucuggaa

SEQ ID NO: 1045836 - RNA, 19 nt, Homo sapiens
gugaagagcauccauuuaa

SEQ ID NO: 1045837 - RNA, 19 nt, Homo sapiens
caaagcaucucuggaaaug

SEQ ID NO: 1045838 - RNA, 19 nt, Homo sapiens
gauccaagccucaacauga

SEQ ID NO: 1045839 - RNA, 19 nt, Homo sapiens
ugacagcccuacaaagaaa

SEQ ID NO: 1045840 - RNA, 19 nt, Homo sapiens
uaacugggauucucacuca

SEQ ID NO: 1045841 - RNA, 19 nt, Homo sapiens
ugaagagcauccauuuaaa

SEQ ID NO: 1045842 - RNA, 19 nt, Homo sapiens
caacauagaauaucuuugg

SEQ ID NO: 1045843 - RNA, 19 nt, Homo sapiens
gaaauguaauuguguacca

SEQ ID NO: 1045844 - RNA, 19 nt, Homo sapiens
gaugaagccucugguaugu

SEQ ID NO: 1045845 - RNA, 19 nt, Homo sapiens
gaauaucuuuggucauaca

SEQ ID NO: 1045846 - RNA, 19 nt, Homo sapiens
aaauggaaaugucugauga

SEQ ID NO: 1045847 - RNA, 19 nt, Homo sapiens
gaaccaugcugucuuccau

SEQ ID NO: 1045848 - RNA, 19 nt, Homo sapiens
gaaagaugauagcaagucu

SEQ ID NO: 1045849 - RNA, 19 nt, Homo sapiens
ggccagggaugacuucuau

SEQ ID NO: 1045850 - RNA, 19 nt, Homo sapiens
ggaaauuauucaagaaguc

SEQ ID NO: 1045851 - RNA, 19 nt, Homo sapiens
gaaaugaaaccaugugaac

SEQ ID NO: 1045852 - RNA, 19 nt, Homo sapiens
aagcaucucuggaaaugaa

SEQ ID NO: 1045853 - RNA, 19 nt, Homo sapiens
caugagacuuccuuuguga

SEQ ID NO: 1045854 - RNA, 19 nt, Homo sapiens
gaaauggaaaugucugaug

SEQ ID NO: 1045855 - RNA, 19 nt, Homo sapiens
gaaauaauccacugcaaaa

SEQ ID NO: 1045856 - RNA, 19 nt, Homo sapiens
gaauagcucaccaagcaaa

SEQ ID NO: 1045857 - RNA, 19 nt, Homo sapiens
aagccugccuuuaguuaua

SEQ ID NO: 1045858 - RNA, 19 nt, Homo sapiens
gaagcucugcuaauaggua

SEQ ID NO: 1045859 - RNA, 19 nt, Homo sapiens
gaauacaugguuucaauca

SEQ ID NO: 1045860 - RNA, 19 nt, Homo sapiens
guggaaauguaauugugua

SEQ ID NO: 1045861 - RNA, 19 nt, Homo sapiens
ggaugaagccucugguaug

SEQ ID NO: 1045862 - RNA, 19 nt, Homo sapiens
gcucgugucugacucaauc

SEQ ID NO: 1045863 - RNA, 19 nt, Homo sapiens
gagaaagaagcucugcuaa

SEQ ID NO: 1045864 - RNA, 19 nt, Homo sapiens
gagagaacaauauugagaa

SEQ ID NO: 1045865 - RNA, 19 nt, Homo sapiens
ggacacucauaauucaaug

SEQ ID NO: 1045866 - RNA, 19 nt, Homo sapiens
gguaucauaucaacguuuc

SEQ ID NO: 1045867 - RNA, 19 nt, Homo sapiens
gaagagcagucccauacac

SEQ ID NO: 1045868 - RNA, 19 nt, Homo sapiens
cgaagccugccuuuaguua

SEQ ID NO: 1045869 - RNA, 19 nt, Homo sapiens
ggaaaugaaaccaugugaa

SEQ ID NO: 1045870 - RNA, 19 nt, Homo sapiens
gagccaacauagaauaucu

SEQ ID NO: 1045871 - RNA, 19 nt, Homo sapiens
gccaugaggauucaaauga

SEQ ID NO: 1045872 - RNA, 19 nt, Homo sapiens
cagaggaauucaugguuga

SEQ ID NO: 1045873 - RNA, 19 nt, Homo sapiens
caucgaagccugccuuuag

SEQ ID NO: 1045874 - RNA, 19 nt, Homo sapiens
gcaaagcaucucuggaaau

SEQ ID NO: 1045875 - RNA, 19 nt, Homo sapiens
gcaaaccaguucuauucca

SEQ ID NO: 1045876 - RNA, 19 nt, Homo sapiens
ggaauucaugguugauaaa

SEQ ID NO: 1045877 - RNA, 19 nt, Homo sapiens
guaauuguguaccaguuuc

SEQ ID NO: 1045878 - RNA, 19 nt, Homo sapiens
gaagaagaaauggaaaugu

SEQ ID NO: 1045879 - RNA, 19 nt, Homo sapiens
ugaagccucugguauguca

SEQ ID NO: 1045880 - RNA, 19 nt, Homo sapiens
cugaaaagcugaaagauga

SEQ ID NO: 1045881 - RNA, 19 nt, Homo sapiens
ggaaaagcaagaagaauuu

SEQ ID NO: 1045882 - RNA, 19 nt, Homo sapiens
ucagaaccaugcugucuuc

SEQ ID NO: 1045883 - RNA, 19 nt, Homo sapiens
gcggugauauuacagcaau

SEQ ID NO: 1045884 - RNA, 19 nt, Homo sapiens
cugaggaaauuauucaaga

SEQ ID NO: 1045885 - RNA, 19 nt, Homo sapiens
cgagagaacaauauugaga

SEQ ID NO: 1045886 - RNA, 19 nt, Homo sapiens
caagaccgagagaacaaua

SEQ ID NO: 1045887 - RNA, 19 nt, Homo sapiens
aagaagaaauggaaauguc

SEQ ID NO: 1045888 - RNA, 19 nt, Homo sapiens
cgacccagcucaacauguc

SEQ ID NO: 1045889 - RNA, 19 nt, Homo sapiens
ccacagccaugaggauuca

SEQ ID NO: 1045890 - RNA, 19 nt, Homo sapiens
gggauucucacucaauuug

SEQ ID NO: 1045891 - RNA, 19 nt, Homo sapiens
ggcaaaaucuuaaaaugug

SEQ ID NO: 1045892 - RNA, 19 nt, Homo sapiens
agagagagcucaccaugcu

SEQ ID NO: 1045893 - RNA, 19 nt, Homo sapiens
gaaagaggagaaugacagu

SEQ ID NO: 1045894 - RNA, 19 nt, Homo sapiens
ccagggaugacuucuauga

SEQ ID NO: 1045895 - RNA, 19 nt, Homo sapiens
aggaauucaugguugauaa

SEQ ID NO: 1045896 - RNA, 19 nt, Homo sapiens
gaagagcauccauuuaaaa

SEQ ID NO: 1045897 - RNA, 19 nt, Homo sapiens
ggaggaagccaaggagaau

SEQ ID NO: 1045898 - RNA, 19 nt, Homo sapiens
caaaccaguucuauuccau

SEQ ID NO: 1045899 - RNA, 19 nt, Homo sapiens
agaaauaauccacugcaaa

SEQ ID NO: 1045900 - RNA, 19 nt, Homo sapiens
uaaugaugguguagcaaug

SEQ ID NO: 1045901 - RNA, 19 nt, Homo sapiens
gugcuacauuugagaauag

SEQ ID NO: 1045902 - RNA, 19 nt, Homo sapiens
ucuuguaaguggaaaugua

SEQ ID NO: 1045903 - RNA, 19 nt, Homo sapiens
ccaugagacuuccuuugug

SEQ ID NO: 1045904 - RNA, 19 nt, Homo sapiens
caggaggaguuaaacaaca

SEQ ID NO: 1045905 - RNA, 19 nt, Homo sapiens
gcgcaagaacauagacauu

SEQ ID NO: 1045906 - RNA, 19 nt, Homo sapiens
gaggaauucaugguugaua

SEQ ID NO: 1045907 - RNA, 19 nt, Homo sapiens
gguguaagaccguguuugu

SEQ ID NO: 1045908 - RNA, 19 nt, Homo sapiens
uaaacaaagcuucauacug

SEQ ID NO: 1045909 - RNA, 19 nt, Homo sapiens
ccagagaacacauuugucu

SEQ ID NO: 1045910 - RNA, 19 nt, Homo sapiens
gucggaggauuaccagaaa

SEQ ID NO: 1045911 - RNA, 19 nt, Homo sapiens
guaaguggaaauguaauug

SEQ ID NO: 1045912 - RNA, 19 nt, Homo sapiens
gaagccugccuuuaguuau

SEQ ID NO: 1045913 - RNA, 19 nt, Homo sapiens
auacaugguuucaaucaag

SEQ ID NO: 1045914 - RNA, 19 nt, Homo sapiens
ggaaguugugugccuuuga

SEQ ID NO: 1045915 - RNA, 19 nt, Homo sapiens
ugugacagcccuacaaaga

SEQ ID NO: 1045916 - RNA, 19 nt, Homo sapiens
ugaauaaccugggcauggu

SEQ ID NO: 1045917 - RNA, 19 nt, Homo sapiens
ucuggacacucauaauuca

SEQ ID NO: 1045918 - RNA, 19 nt, Homo sapiens
aagaagcucugcuaauagg

SEQ ID NO: 1045919 - RNA, 19 nt, Homo sapiens
guugacaguugcauuaguc

SEQ ID NO: 1045920 - RNA, 19 nt, Homo sapiens
gggaugaagccucugguau

SEQ ID NO: 1045921 - RNA, 19 nt, Homo sapiens
acagugcggugauauuaca

SEQ ID NO: 1045922 - RNA, 19 nt, Homo sapiens
uugcuaggcuacagaguug

SEQ ID NO: 1045923 - RNA, 19 nt, Homo sapiens
gggcagaccuagcaaauug

SEQ ID NO: 1045924 - RNA, 19 nt, Homo sapiens
gaaacagucugcaccuuug

SEQ ID NO: 1045925 - RNA, 19 nt, Homo sapiens
gaagguggcuuuggcugaa

SEQ ID NO: 1045926 - RNA, 19 nt, Homo sapiens
gcagaggauuggaauacuu

SEQ ID NO: 1045927 - RNA, 19 nt, Homo sapiens
caaaauacgcccaagauua

SEQ ID NO: 1045928 - RNA, 19 nt, Homo sapiens
gauuuggacuuguguguau

SEQ ID NO: 1045929 - RNA, 19 nt, Homo sapiens
gagcugaucagaauaaugu

SEQ ID NO: 1045930 - RNA, 19 nt, Homo sapiens
agaauaauguucagcauca

SEQ ID NO: 1045931 - RNA, 19 nt, Homo sapiens
guagagaacauuugaaaca

SEQ ID NO: 1045932 - RNA, 19 nt, Homo sapiens
ggguggagcugaucagaau

SEQ ID NO: 1045933 - RNA, 19 nt, Homo sapiens
uacaagaucuucacaacug

SEQ ID NO: 1045934 - RNA, 19 nt, Homo sapiens
ucaagcaucucacaaacga

SEQ ID NO: 1045935 - RNA, 19 nt, Homo sapiens
gaugcucugugaauacauu

SEQ ID NO: 1045936 - RNA, 19 nt, Homo sapiens
ccagagaugccaacacaaa

SEQ ID NO: 1045937 - RNA, 19 nt, Homo sapiens
caaagccaccaauccauuu

SEQ ID NO: 1045938 - RNA, 19 nt, Homo sapiens
gaaguuugguuugguucuu

SEQ ID NO: 1045939 - RNA, 19 nt, Homo sapiens
gagauaaacaucaccuuca

SEQ ID NO: 1045940 - RNA, 19 nt, Homo sapiens
gggccuggaugcucuguga

SEQ ID NO: 1045941 - RNA, 19 nt, Homo sapiens
gaauaucucagucucaauc

SEQ ID NO: 1045942 - RNA, 19 nt, Homo sapiens
gugaauaucucagucucaa

SEQ ID NO: 1045943 - RNA, 19 nt, Homo sapiens
ggaaaagucuaucaugcuu

SEQ ID NO: 1045944 - RNA, 19 nt, Homo sapiens
gaaugaaacccucaagcau

SEQ ID NO: 1045945 - RNA, 19 nt, Homo sapiens
ucaaugauuuggacuugug

SEQ ID NO: 1045946 - RNA, 19 nt, Homo sapiens
caggaaacauaccuuaagu

SEQ ID NO: 1045947 - RNA, 19 nt, Homo sapiens
gcaggaaacauaccuuaag

SEQ ID NO: 1045948 - RNA, 19 nt, Homo sapiens
ugaaacagucugcaccuuu

SEQ ID NO: 1045949 - RNA, 19 nt, Homo sapiens
ccaguuacuuccucuuugu

SEQ ID NO: 1045950 - RNA, 19 nt, Homo sapiens
gguacaagaucuucacaac

SEQ ID NO: 1045951 - RNA, 19 nt, Homo sapiens
aauccuuucugguguuaua

SEQ ID NO: 1045952 - RNA, 19 nt, Homo sapiens
ucaagugccuguaacugau

SEQ ID NO: 1045953 - RNA, 19 nt, Homo sapiens
guucaaugauuuggacuug

SEQ ID NO: 1045954 - RNA, 19 nt, Homo sapiens
gucuguggcuuaauaauca

SEQ ID NO: 1045955 - RNA, 19 nt, Homo sapiens
ccaaagccaccaauccauu

SEQ ID NO: 1045956 - RNA, 19 nt, Homo sapiens
gaauaauguucagcaucaa

SEQ ID NO: 1045957 - RNA, 19 nt, Homo sapiens
cugcuacgguucaaugauu

SEQ ID NO: 1045958 - RNA, 19 nt, Homo sapiens
gcaacgccacgcucuggua

SEQ ID NO: 1045959 - RNA, 19 nt, Homo sapiens
caaggucacaggagcauug

SEQ ID NO: 1045960 - RNA, 19 nt, Homo sapiens
caacgucacccaucuguac

SEQ ID NO: 1045961 - RNA, 19 nt, Homo sapiens
ccacaacuccggaaaguac

SEQ ID NO: 1045962 - RNA, 19 nt, Homo sapiens
ccuggaugcucugugaaua

SEQ ID NO: 1045963 - RNA, 19 nt, Homo sapiens
ugagagaaccauaauccuu

SEQ ID NO: 1045964 - RNA, 19 nt, Homo sapiens
gagacugagagaaccauaa

SEQ ID NO: 1045965 - RNA, 19 nt, Homo sapiens
gagcaauccugaauuuugu

SEQ ID NO: 1045966 - RNA, 19 nt, Homo sapiens
acaauccuuucugguguua

SEQ ID NO: 1045967 - RNA, 19 nt, Homo sapiens
gguauugcauuuccaaagc

SEQ ID NO: 1045968 - RNA, 19 nt, Homo sapiens
guugaaguuugguuugguu

SEQ ID NO: 1045969 - RNA, 19 nt, Homo sapiens
gccuguaacugauuuguac

SEQ ID NO: 1045970 - RNA, 19 nt, Homo sapiens
gccacgcucugguacaaga

SEQ ID NO: 1045971 - RNA, 19 nt, Homo sapiens
ggaagcccacgaggagaua

SEQ ID NO: 1045972 - RNA, 19 nt, Homo sapiens
cagaggauuggaauacuuu

SEQ ID NO: 1045973 - RNA, 19 nt, Homo sapiens
caauaaugcacgugcuuug

SEQ ID NO: 1045974 - RNA, 19 nt, Homo sapiens
gccaaagacauuucaagug

SEQ ID NO: 1045975 - RNA, 19 nt, Homo sapiens
ugccagagaugccaacaca

SEQ ID NO: 1045976 - RNA, 19 nt, Homo sapiens
guggagcugaucagaauaa

SEQ ID NO: 1045977 - RNA, 19 nt, Homo sapiens
cuucacaacugccagagau

SEQ ID NO: 1045978 - RNA, 19 nt, Homo sapiens
caucuguacucaaccaucu

SEQ ID NO: 1045979 - RNA, 19 nt, Homo sapiens
gcaucagauuggacuuuca

SEQ ID NO: 1045980 - RNA, 19 nt, Homo sapiens
caccacaacuccggaaagu

SEQ ID NO: 1045981 - RNA, 19 nt, Homo sapiens
agagaacauuugaaacagu

SEQ ID NO: 1045982 - RNA, 19 nt, Homo sapiens
ccaauaaugcacgugcuuu

SEQ ID NO: 1045983 - RNA, 19 nt, Homo sapiens
ucacccaucuguacucaac

SEQ ID NO: 1045984 - RNA, 19 nt, Homo sapiens
ugagagagacugagagaac

SEQ ID NO: 1045985 - RNA, 19 nt, Homo sapiens
gagaugccaacacaaaaua

SEQ ID NO: 1045986 - RNA, 19 nt, Homo sapiens
gggcaucagauuggacuuu

SEQ ID NO: 1045987 - RNA, 19 nt, Homo sapiens
ggcaucagauuggacuuuc

SEQ ID NO: 1045988 - RNA, 19 nt, Homo sapiens
gcaacgucacccaucugua

SEQ ID NO: 1045989 - RNA, 19 nt, Homo sapiens
gaaacccucaagcaucuca

SEQ ID NO: 1045990 - RNA, 19 nt, Homo sapiens
uuaugugucuguggcuuaa

SEQ ID NO: 1045991 - RNA, 19 nt, Homo sapiens
uguuucagcccaauaugua

SEQ ID NO: 1045992 - RNA, 19 nt, Homo sapiens
gagcauugcgucgcugaug

SEQ ID NO: 1045993 - RNA, 19 nt, Homo sapiens
cagcguggagcucagauga

SEQ ID NO: 1045994 - RNA, 19 nt, Homo sapiens
cugguggucuucaugauca

SEQ ID NO: 1045995 - RNA, 19 nt, Homo sapiens
ucagaauaauguucagcau

SEQ ID NO: 1045996 - RNA, 19 nt, Homo sapiens
cagaaauggcagaggauug

SEQ ID NO: 1045997 - RNA, 19 nt, Homo sapiens
caagugccuguaacugauu

SEQ ID NO: 1045998 - RNA, 19 nt, Homo sapiens
caccaguuacuuccucuuu

SEQ ID NO: 1045999 - RNA, 19 nt, Homo sapiens
ccucaagcaucucacaaac

SEQ ID NO: 1046000 - RNA, 19 nt, Homo sapiens
agaaugaaacccucaagca

SEQ ID NO: 1046001 - RNA, 19 nt, Homo sapiens
cguaagcgccauggccaua

SEQ ID NO: 1046002 - RNA, 19 nt, Homo sapiens
uagagaacauuugaaacag

SEQ ID NO: 1046003 - RNA, 19 nt, Homo sapiens
cagugauuguuccagauga

SEQ ID NO: 1046004 - RNA, 19 nt, Homo sapiens
uacaauccuuucugguguu

SEQ ID NO: 1046005 - RNA, 19 nt, Homo sapiens
guacaagaucuucacaacu

SEQ ID NO: 1046006 - RNA, 19 nt, Homo sapiens
agacugagagaaccauaau

SEQ ID NO: 1046007 - RNA, 19 nt, Homo sapiens
caagggcagaccuagcaaa

SEQ ID NO: 1046008 - RNA, 19 nt, Homo sapiens
gcguggagcucagaugacu

SEQ ID NO: 1046009 - RNA, 19 nt, Homo sapiens
ucuguacucaaccaucuua

SEQ ID NO: 1046010 - RNA, 19 nt, Homo sapiens
augugucuguggcuuaaua

SEQ ID NO: 1046011 - RNA, 19 nt, Homo sapiens
gacccugggcuacuucuuc

SEQ ID NO: 1046012 - RNA, 19 nt, Homo sapiens
acagucugcaccuuugaua

SEQ ID NO: 1046013 - RNA, 19 nt, Homo sapiens
ccagaaauggcagaggauu

SEQ ID NO: 1046014 - RNA, 19 nt, Homo sapiens
gggaagcccacgaggagau

SEQ ID NO: 1046015 - RNA, 19 nt, Homo sapiens
uugcaggaaacauaccuua

SEQ ID NO: 1046016 - RNA, 19 nt, Homo sapiens
ggagcugaucagaauaaug

SEQ ID NO: 1046017 - RNA, 19 nt, Homo sapiens
uugcuaugcuguuaucaag

SEQ ID NO: 1046018 - RNA, 19 nt, Homo sapiens
augaaacccucaagcaucu

SEQ ID NO: 1046019 - RNA, 19 nt, Homo sapiens
gugauggugauaacaaugu

SEQ ID NO: 1046020 - RNA, 19 nt, Homo sapiens
guauucacagccugcauga

SEQ ID NO: 1046021 - RNA, 19 nt, Homo sapiens
uggaugcucugugaauaca

SEQ ID NO: 1046022 - RNA, 19 nt, Homo sapiens
gaaauggcagaggauugga

SEQ ID NO: 1046023 - RNA, 19 nt, Homo sapiens
ugaaagcaguuaaaucuug

SEQ ID NO: 1046024 - RNA, 19 nt, Homo sapiens
gaaagcaguuaaaucuugu

SEQ ID NO: 1046025 - RNA, 19 nt, Homo sapiens
ggacuaaugcugaguaugu

SEQ ID NO: 1046026 - RNA, 19 nt, Homo sapiens
cauacauccuuuccauuua

SEQ ID NO: 1046027 - RNA, 19 nt, Homo sapiens
gaaggcacuuucauugaug

SEQ ID NO: 1046028 - RNA, 19 nt, Homo sapiens
aaaugcagcuucuggauga

SEQ ID NO: 1046029 - RNA, 19 nt, Homo sapiens
gaagacuauucccuccaua

SEQ ID NO: 1046030 - RNA, 19 nt, Homo sapiens
ucacaggcaucuuucuuug

SEQ ID NO: 1046031 - RNA, 19 nt, Homo sapiens
agaaugacauacauccuuu

SEQ ID NO: 1046032 - RNA, 19 nt, Homo sapiens
gaggguggcucaaccuaau

SEQ ID NO: 1046033 - RNA, 19 nt, Homo sapiens
ggauuugucucucuucagu

SEQ ID NO: 1046034 - RNA, 19 nt, Homo sapiens
ugacauacauccuuuccau

SEQ ID NO: 1046035 - RNA, 19 nt, Homo sapiens
aaacaccgguugcugguau

SEQ ID NO: 1046036 - RNA, 19 nt, Homo sapiens
cauaagcacggcuaucuuu

SEQ ID NO: 1046037 - RNA, 19 nt, Homo sapiens
gagaaugacauacauccuu

SEQ ID NO: 1046038 - RNA, 19 nt, Homo sapiens
cauuaugguuugcaucuga

SEQ ID NO: 1046039 - RNA, 19 nt, Homo sapiens
caaguacacuagugaggau

SEQ ID NO: 1046040 - RNA, 19 nt, Homo sapiens
agacuuugccacucacuua

SEQ ID NO: 1046041 - RNA, 19 nt, Homo sapiens
acauacauccuuuccauuu

SEQ ID NO: 1046042 - RNA, 19 nt, Homo sapiens
auaauauccucuugcguuu

SEQ ID NO: 1046043 - RNA, 19 nt, Homo sapiens
auacugcuacugauuguua

SEQ ID NO: 1046044 - RNA, 19 nt, Homo sapiens
gaggacuaaugcugaguau

SEQ ID NO: 1046045 - RNA, 19 nt, Homo sapiens
gaacaggaugguagugcaa

SEQ ID NO: 1046046 - RNA, 19 nt, Homo sapiens
caaaagcucccgacuacua

SEQ ID NO: 1046047 - RNA, 19 nt, Homo sapiens
cagcuucuagcaacaauuu

SEQ ID NO: 1046048 - RNA, 19 nt, Homo sapiens
acaauauggugacgacaga

SEQ ID NO: 1046049 - RNA, 19 nt, Homo sapiens
uuucaucaauucccucaaa

SEQ ID NO: 1046050 - RNA, 19 nt, Homo sapiens
gagaucacccaaucagguu

SEQ ID NO: 1046051 - RNA, 19 nt, Homo sapiens
gggauccuuucaucaauuc

SEQ ID NO: 1046052 - RNA, 19 nt, Homo sapiens
agaggugauugcuguguuu

SEQ ID NO: 1046053 - RNA, 19 nt, Homo sapiens
acaggcaucuuucuuugug

SEQ ID NO: 1046054 - RNA, 19 nt, Homo sapiens
guaguaacacugcgaguca

SEQ ID NO: 1046055 - RNA, 19 nt, Homo sapiens
ugucacuucuucggcauua

SEQ ID NO: 1046056 - RNA, 19 nt, Homo sapiens
gaagaugaaagcauuagac

SEQ ID NO: 1046057 - RNA, 19 nt, Homo sapiens
gacuaaugcugaguauguu

SEQ ID NO: 1046058 - RNA, 19 nt, Homo sapiens
auuugucucucuucaguua

SEQ ID NO: 1046059 - RNA, 19 nt, Homo sapiens
aggaugaccugcucacugu

SEQ ID NO: 1046060 - RNA, 19 nt, Homo sapiens
guagugcaauggccaagag

SEQ ID NO: 1046061 - RNA, 19 nt, Homo sapiens
ugauugcuguguuugagaa

SEQ ID NO: 1046062 - RNA, 19 nt, Homo sapiens
ugauugcugugaagaugaa

SEQ ID NO: 1046063 - RNA, 19 nt, Homo sapiens
gcauuugauugcugugaag

SEQ ID NO: 1046064 - RNA, 19 nt, Homo sapiens
uauacaauacugcuacuga

SEQ ID NO: 1046065 - RNA, 19 nt, Homo sapiens
accgguugcugguauauuu

SEQ ID NO: 1046066 - RNA, 19 nt, Homo sapiens
auacauccuuuccauuuag

SEQ ID NO: 1046067 - RNA, 19 nt, Homo sapiens
ucugaaagcaguuaaaucu

SEQ ID NO: 1046068 - RNA, 19 nt, Homo sapiens
acucgggccugcucaaguu

SEQ ID NO: 1046069 - RNA, 19 nt, Homo sapiens
cagaggugauugcuguguu

SEQ ID NO: 1046070 - RNA, 19 nt, Homo sapiens
ggcucaaccuaauggaauu

SEQ ID NO: 1046071 - RNA, 19 nt, Homo sapiens
caucuuucuuuguggugua

SEQ ID NO: 1046072 - RNA, 19 nt, Homo sapiens
cugugaagaugaaagcauu

SEQ ID NO: 1046073 - RNA, 19 nt, Homo sapiens
cagcauuaauuaaguccau

SEQ ID NO: 1046074 - RNA, 19 nt, Homo sapiens
gccacucacuuaucucagu

SEQ ID NO: 1046075 - RNA, 19 nt, Homo sapiens
uagugaggauguaguaaca

SEQ ID NO: 1046076 - RNA, 19 nt, Homo sapiens
gauacacgcacguucaagu

SEQ ID NO: 1046077 - RNA, 19 nt, Homo sapiens
gaugacaaguggguaucug

SEQ ID NO: 1046078 - RNA, 19 nt, Homo sapiens
ccaucagugcucagucuua

SEQ ID NO: 1046079 - RNA, 19 nt, Homo sapiens
gcgagucacagauccauca

SEQ ID NO: 1046080 - RNA, 19 nt, Homo sapiens
uagggauccuuucaucaau

SEQ ID NO: 1046081 - RNA, 19 nt, Homo sapiens
auacaauacugcuacugau

SEQ ID NO: 1046082 - RNA, 19 nt, Homo sapiens
caucagugcucagucuuac

SEQ ID NO: 1046083 - RNA, 19 nt, Homo sapiens
uuagggauccuuucaucaa

SEQ ID NO: 1046084 - RNA, 19 nt, Homo sapiens
gaugggagagagccagaga

SEQ ID NO: 1046085 - RNA, 19 nt, Homo sapiens
augcuacccugcacaguga

SEQ ID NO: 1046086 - RNA, 19 nt, Homo sapiens
ggagcucuuugagaacuuc

SEQ ID NO: 1046087 - RNA, 19 nt, Homo sapiens
ggugauugcuguguuugag

SEQ ID NO: 1046088 - RNA, 19 nt, Homo sapiens
aaacauccuggccaucuug

SEQ ID NO: 1046089 - RNA, 19 nt, Homo sapiens
ggcauggccaaucccuuua

SEQ ID NO: 1046090 - RNA, 19 nt, Homo sapiens
agaagacuauucccuccau

SEQ ID NO: 1046091 - RNA, 19 nt, Homo sapiens
gacauacauccuuuccauu

SEQ ID NO: 1046092 - RNA, 19 nt, Homo sapiens
ugaugagaaugacauacau

SEQ ID NO: 1046093 - RNA, 19 nt, Homo sapiens
gacuauucccuccauauca

SEQ ID NO: 1046094 - RNA, 19 nt, Homo sapiens
uccaagacuuugccacuca

SEQ ID NO: 1046095 - RNA, 19 nt, Homo sapiens
ccucaccagagccagauua

SEQ ID NO: 1046096 - RNA, 19 nt, Homo sapiens
ucaguuaugaugacaagug

SEQ ID NO: 1046097 - RNA, 19 nt, Homo sapiens
caguuucccugcucagcuu

SEQ ID NO: 1046098 - RNA, 19 nt, Homo sapiens
caucacaggcaucuuucuu

SEQ ID NO: 1046099 - RNA, 19 nt, Homo sapiens
aagguggucuugucacaca

SEQ ID NO: 1046100 - RNA, 19 nt, Homo sapiens
gcccagcauuaauuaaguc

SEQ ID NO: 1046101 - RNA, 19 nt, Homo sapiens
caaguggguaucugucaug

SEQ ID NO: 1046102 - RNA, 19 nt, Homo sapiens
agggauccuuucaucaauu

SEQ ID NO: 1046103 - RNA, 19 nt, Homo sapiens
aggcauggccaaucccuuu

SEQ ID NO: 1046104 - RNA, 19 nt, Homo sapiens
gcaucugaaagcaguuaaa

SEQ ID NO: 1046105 - RNA, 19 nt, Homo sapiens
uaacacugcgagucacaga

SEQ ID NO: 1046106 - RNA, 19 nt, Homo sapiens
caucugaaagcaguuaaau

SEQ ID NO: 1046107 - RNA, 19 nt, Homo sapiens
gaugaccugcucacugugu

SEQ ID NO: 1046108 - RNA, 19 nt, Homo sapiens
uacaauacugcuacugauu

SEQ ID NO: 1046109 - RNA, 19 nt, Homo sapiens
acagugcgacgccuuguug

SEQ ID NO: 1046110 - RNA, 19 nt, Homo sapiens
gugaggauguaguaacacu

SEQ ID NO: 1046111 - RNA, 19 nt, Homo sapiens
agacaggcauggccaaucc

SEQ ID NO: 1046112 - RNA, 19 nt, Homo sapiens
gcauuaugguuugcaucug

SEQ ID NO: 1046113 - RNA, 19 nt, Homo sapiens
gcucaaccuaauggaauuu

SEQ ID NO: 1046114 - RNA, 19 nt, Homo sapiens
ccgacuacuagcucuguua

SEQ ID NO: 1046115 - RNA, 19 nt, Homo sapiens
uuauaaaugccaaguaugg

SEQ ID NO: 1046116 - RNA, 19 nt, Homo sapiens
acuauucccuccauaucau

SEQ ID NO: 1046117 - RNA, 19 nt, Homo sapiens
gcuuuacuuugcauuugau

SEQ ID NO: 1046118 - RNA, 19 nt, Homo sapiens
uaucuggauuugucucucu

SEQ ID NO: 1046119 - RNA, 19 nt, Homo sapiens
agaggcgcuucuuccagua

SEQ ID NO: 1046120 - RNA, 19 nt, Homo sapiens
gaaugacauacauccuuuc

SEQ ID NO: 1046121 - RNA, 19 nt, Homo sapiens
cuuguuuacugaugagaau

SEQ ID NO: 1046122 - RNA, 19 nt, Homo sapiens
ucacuucuucggcauuaug

SEQ ID NO: 1046123 - RNA, 19 nt, Homo sapiens
gaacaucuaugcaaacuua

SEQ ID NO: 1046124 - RNA, 19 nt, Homo sapiens
gaaagauuguucugacauu

SEQ ID NO: 1046125 - RNA, 19 nt, Homo sapiens
cuacugaaccucuuaauaa

SEQ ID NO: 1046126 - RNA, 19 nt, Homo sapiens
ugaagguacugaucuuaua

SEQ ID NO: 1046127 - RNA, 19 nt, Homo sapiens
uugcaaagcuuccaauauu

SEQ ID NO: 1046128 - RNA, 19 nt, Homo sapiens
acaaauagcugacuugaac

SEQ ID NO: 1046129 - RNA, 19 nt, Homo sapiens
auaaucagcuucuugguuu

SEQ ID NO: 1046130 - RNA, 19 nt, Homo sapiens
uggcagacauugaagauuu

SEQ ID NO: 1046131 - RNA, 19 nt, Homo sapiens
gaagguacugaucuuauaa

SEQ ID NO: 1046132 - RNA, 19 nt, Homo sapiens
gaaguuauauuuccaaacc

SEQ ID NO: 1046133 - RNA, 19 nt, Homo sapiens
gaacaaauagcugacuuga

SEQ ID NO: 1046134 - RNA, 19 nt, Homo sapiens
ggcagacauugaagauuua

SEQ ID NO: 1046135 - RNA, 19 nt, Homo sapiens
ccagcacaaugaagaauuu

SEQ ID NO: 1046136 - RNA, 19 nt, Homo sapiens
caauuuggguagcguguuu

SEQ ID NO: 1046137 - RNA, 19 nt, Homo sapiens
ccugagaaaugaagaaaga

SEQ ID NO: 1046138 - RNA, 19 nt, Homo sapiens
gcagugggauuggcugauu

SEQ ID NO: 1046139 - RNA, 19 nt, Homo sapiens
ggucuuggauauaacuauu

SEQ ID NO: 1046140 - RNA, 19 nt, Homo sapiens
gggcugagguugacaugga

SEQ ID NO: 1046141 - RNA, 19 nt, Homo sapiens
gagaaccaguagacuaaug

SEQ ID NO: 1046142 - RNA, 19 nt, Homo sapiens
gaagacacccugacagaag

SEQ ID NO: 1046143 - RNA, 19 nt, Homo sapiens
gagaaaugaagaaagauug

SEQ ID NO: 1046144 - RNA, 19 nt, Homo sapiens
ugaggugggucuuggauau

SEQ ID NO: 1046145 - RNA, 19 nt, Homo sapiens
cuaagugaauucucguauu

SEQ ID NO: 1046146 - RNA, 19 nt, Homo sapiens
aauuugagcugaagcaaug

SEQ ID NO: 1046147 - RNA, 19 nt, Homo sapiens
caacacugacagcacuuua

SEQ ID NO: 1046148 - RNA, 19 nt, Homo sapiens
gacauuaaauaccuacagu

SEQ ID NO: 1046149 - RNA, 19 nt, Homo sapiens
uagcugacuugaacaucua

SEQ ID NO: 1046150 - RNA, 19 nt, Homo sapiens
acucaaauauuccuccuau

SEQ ID NO: 1046151 - RNA, 19 nt, Homo sapiens
ggaauccuuugccuccuau

SEQ ID NO: 1046152 - RNA, 19 nt, Homo sapiens
ugcaaagcuuccaauauuu

SEQ ID NO: 1046153 - RNA, 19 nt, Homo sapiens
gaagaauuuuggcaguaua

SEQ ID NO: 1046154 - RNA, 19 nt, Homo sapiens
uuccaaaccugagaaauga

SEQ ID NO: 1046155 - RNA, 19 nt, Homo sapiens
uaacuaauuugagcugaag

SEQ ID NO: 1046156 - RNA, 19 nt, Homo sapiens
ugguuaagcucuacuaugg

SEQ ID NO: 1046157 - RNA, 19 nt, Homo sapiens
ucuauugacucuguuaguu

SEQ ID NO: 1046158 - RNA, 19 nt, Homo sapiens
uauugacucuguuaguuga

SEQ ID NO: 1046159 - RNA, 19 nt, Homo sapiens
ucaaauauuccuccuaucu

SEQ ID NO: 1046160 - RNA, 19 nt, Homo sapiens
aauaaggauuugucaagga

SEQ ID NO: 1046161 - RNA, 19 nt, Homo sapiens
guugagaaccaguagacua

SEQ ID NO: 1046162 - RNA, 19 nt, Homo sapiens
ggaaguauuuuauguaugc

SEQ ID NO: 1046163 - RNA, 19 nt, Homo sapiens
aacugaagauggauaaaga

SEQ ID NO: 1046164 - RNA, 19 nt, Homo sapiens
gugaagacacccugacaga

SEQ ID NO: 1046165 - RNA, 19 nt, Homo sapiens
acacugacagcacuuuaaa

SEQ ID NO: 1046166 - RNA, 19 nt, Homo sapiens
gaauugaagguacugaucu

SEQ ID NO: 1046167 - RNA, 19 nt, Homo sapiens
uauaaucagcuucuugguu

SEQ ID NO: 1046168 - RNA, 19 nt, Homo sapiens
gaggugggucuuggauaua

SEQ ID NO: 1046169 - RNA, 19 nt, Homo sapiens
caaauauuccuccuaucug

SEQ ID NO: 1046170 - RNA, 19 nt, Homo sapiens
uacauucuauugacucugu

SEQ ID NO: 1046171 - RNA, 19 nt, Homo sapiens
ggggaaguauuuuauguau

SEQ ID NO: 1046172 - RNA, 19 nt, Homo sapiens
guucugacauuaaauaccu

SEQ ID NO: 1046173 - RNA, 19 nt, Homo sapiens
caacugaagauggauaaag

SEQ ID NO: 1046174 - RNA, 19 nt, Homo sapiens
gggcaacugaagauggaua

SEQ ID NO: 1046175 - RNA, 19 nt, Homo sapiens
uugagaaccaguagacuaa

SEQ ID NO: 1046176 - RNA, 19 nt, Homo sapiens
gcagacauugaagauuuaa

SEQ ID NO: 1046177 - RNA, 19 nt, Homo sapiens
gauguaaggagccgaagca

SEQ ID NO: 1046178 - RNA, 19 nt, Homo sapiens
caucuaugcaaacuuaaga

SEQ ID NO: 1046179 - RNA, 19 nt, Homo sapiens
auaaggauuugucaaggau

SEQ ID NO: 1046180 - RNA, 19 nt, Homo sapiens
cagugggauuggcugauuu

SEQ ID NO: 1046181 - RNA, 19 nt, Homo sapiens
gugcagacaggguugagaa

SEQ ID NO: 1046182 - RNA, 19 nt, Homo sapiens
ugauguugguuaagcucua

SEQ ID NO: 1046183 - RNA, 19 nt, Homo sapiens
gcucuacuaugggcaacug

SEQ ID NO: 1046184 - RNA, 19 nt, Homo sapiens
cuuccaauauuugauguug

SEQ ID NO: 1046185 - RNA, 19 nt, Homo sapiens
gccugggccucacucuuga

SEQ ID NO: 1046186 - RNA, 19 nt, Homo sapiens
ggcaugguuuuauuccuua

SEQ ID NO: 1046187 - RNA, 19 nt, Homo sapiens
gcuccugcuuugcgacuuc

SEQ ID NO: 1046188 - RNA, 19 nt, Homo sapiens
ugaagacacccugacagaa

SEQ ID NO: 1046189 - RNA, 19 nt, Homo sapiens
ucaaggauagaguacaguu

SEQ ID NO: 1046190 - RNA, 19 nt, Homo sapiens
acuacugaaccucuuaaua

SEQ ID NO: 1046191 - RNA, 19 nt, Homo sapiens
aggugggucuuggauauaa

SEQ ID NO: 1046192 - RNA, 19 nt, Homo sapiens
ggcaacugaagauggauaa

SEQ ID NO: 1046193 - RNA, 19 nt, Homo sapiens
acuugaacaucuaugcaaa

SEQ ID NO: 1046194 - RNA, 19 nt, Homo sapiens
gcuucgcgguugcuucuca

SEQ ID NO: 1046195 - RNA, 19 nt, Homo sapiens
agaugucucuaagugaauu

SEQ ID NO: 1046196 - RNA, 19 nt, Homo sapiens
gaagauuuaagugaagaca

SEQ ID NO: 1046197 - RNA, 19 nt, Homo sapiens
uagcguguuugcaaagcuu

SEQ ID NO: 1046198 - RNA, 19 nt, Homo sapiens
gacuugaacaucuaugcaa

SEQ ID NO: 1046199 - RNA, 19 nt, Homo sapiens
ccuccuaucugcaccaaaa

SEQ ID NO: 1046200 - RNA, 19 nt, Homo sapiens
ucccagagcagcaccgaaa

SEQ ID NO: 1046201 - RNA, 19 nt, Homo sapiens
caaggauagaguacaguug

SEQ ID NO: 1046202 - RNA, 19 nt, Homo sapiens
guuacuacugaaccucuua

SEQ ID NO: 1046203 - RNA, 19 nt, Homo sapiens
gagccgaagcagugggauu

SEQ ID NO: 1046204 - RNA, 19 nt, Homo sapiens
caaugcuucuuaauuagcu

SEQ ID NO: 1046205 - RNA, 19 nt, Homo sapiens
gcaaugcuucuuaauuagc

SEQ ID NO: 1046206 - RNA, 19 nt, Homo sapiens
auaauaccuuccaauacug

SEQ ID NO: 1046207 - RNA, 19 nt, Homo sapiens
ugaacaaauagcugacuug

SEQ ID NO: 1046208 - RNA, 19 nt, Homo sapiens
aauugaagguacugaucuu

SEQ ID NO: 1046209 - RNA, 19 nt, Homo sapiens
gccagcacaaugaagaauu

SEQ ID NO: 1046210 - RNA, 19 nt, Homo sapiens
cugaagauggauaaagaaa

SEQ ID NO: 1046211 - RNA, 19 nt, Homo sapiens
uggguagcguguuugcaaa

SEQ ID NO: 1046212 - RNA, 19 nt, Homo sapiens
ugucaaggauagaguacag

SEQ ID NO: 1046213 - RNA, 19 nt, Homo sapiens
aaggauuugucaaggauag

SEQ ID NO: 1046214 - RNA, 19 nt, Homo sapiens
ucuguugguggcuuuguua

SEQ ID NO: 1046215 - RNA, 19 nt, Homo sapiens
gacauugaagauuuaagug

SEQ ID NO: 1046216 - RNA, 19 nt, Homo sapiens
gcaacugaagauggauaaa

SEQ ID NO: 1046217 - RNA, 19 nt, Homo sapiens
gauguugguuaagcucuac

SEQ ID NO: 1046218 - RNA, 19 nt, Homo sapiens
cuauugacucuguuaguug

SEQ ID NO: 1046219 - RNA, 19 nt, Homo sapiens
aaggauagaguacaguugu

SEQ ID NO: 1046220 - RNA, 19 nt, Homo sapiens
uaaggauuugucaaggaua

SEQ ID NO: 1046221 - RNA, 19 nt, Homo sapiens
guagacuaauggucguuuu

SEQ ID NO: 1046222 - RNA, 19 nt, Homo sapiens
ugccugggccucacucuug

SEQ ID NO: 1046223 - RNA, 19 nt, Homo sapiens
gacaauaacgucauguuua

SEQ ID NO: 1046224 - RNA, 19 nt, Homo sapiens
ggacaauaacgucauguuu

SEQ ID NO: 1046225 - RNA, 19 nt, Homo sapiens
gaagcugacagaagagaua

SEQ ID NO: 1046226 - RNA, 19 nt, Homo sapiens
uacagaagcugacagaaga

SEQ ID NO: 1046227 - RNA, 19 nt, Homo sapiens
gagauacccuugggacaga

SEQ ID NO: 1046228 - RNA, 19 nt, Homo sapiens
agaaggagguucccaaugg

SEQ ID NO: 1046229 - RNA, 19 nt, Homo sapiens
acacacaguugcucagcua

SEQ ID NO: 1046230 - RNA, 19 nt, Homo sapiens
caauguaucuucaggaaaa

SEQ ID NO: 1046231 - RNA, 19 nt, Homo sapiens
gcaugaacgacccagaaua

SEQ ID NO: 1046232 - RNA, 19 nt, Homo sapiens
ggacugcucuccggcuuca

SEQ ID NO: 1046233 - RNA, 19 nt, Homo sapiens
ccaaaugcaaguucucgua

SEQ ID NO: 1046234 - RNA, 19 nt, Homo sapiens
ggacccagccaccuuguau

SEQ ID NO: 1046235 - RNA, 19 nt, Homo sapiens
gagaagcacaucacagaca

SEQ ID NO: 1046236 - RNA, 19 nt, Homo sapiens
gggaggacuuccagaacug

SEQ ID NO: 1046237 - RNA, 19 nt, Homo sapiens
gcagaaggagguucccaau

SEQ ID NO: 1046238 - RNA, 19 nt, Homo sapiens
gugcuccuuuggcuucaua

SEQ ID NO: 1046239 - RNA, 19 nt, Homo sapiens
ugcaugcacuuucacugua

SEQ ID NO: 1046240 - RNA, 19 nt, Homo sapiens
ggagacacccaggaacuau

SEQ ID NO: 1046241 - RNA, 19 nt, Homo sapiens
gaggcugcaugcacuuuca

SEQ ID NO: 1046242 - RNA, 19 nt, Homo sapiens
gcaauguaucuucaggaaa

SEQ ID NO: 1046243 - RNA, 19 nt, Homo sapiens
gaccgagggugugcugaug

SEQ ID NO: 1046244 - RNA, 19 nt, Homo sapiens
auaaauguccagagccuaa

SEQ ID NO: 1046245 - RNA, 19 nt, Homo sapiens
gaaggagaagcacaucaca

SEQ ID NO: 1046246 - RNA, 19 nt, Homo sapiens
ccaggagugugccgugugu

SEQ ID NO: 1046247 - RNA, 19 nt, Homo sapiens
gcucagggacgaagcuugu

SEQ ID NO: 1046248 - RNA, 19 nt, Homo sapiens
ggaaacuccagcuggcuau

SEQ ID NO: 1046249 - RNA, 19 nt, Homo sapiens
gcaugcacuuucacuguac

SEQ ID NO: 1046250 - RNA, 19 nt, Homo sapiens
gaacuggaaacgcaugaac

SEQ ID NO: 1046251 - RNA, 19 nt, Homo sapiens
gagacugccucuucuaccu

SEQ ID NO: 1046252 - RNA, 19 nt, Homo sapiens
cccagggccuagcaaugua

SEQ ID NO: 1046253 - RNA, 19 nt, Homo sapiens
caugaacgacccagaauac

SEQ ID NO: 1046254 - RNA, 19 nt, Homo sapiens
gcuccagcaccaauaaaga

SEQ ID NO: 1046255 - RNA, 19 nt, Homo sapiens
uuacagaagcugacagaag

SEQ ID NO: 1046256 - RNA, 19 nt, Homo sapiens
gccaggcacacuacaaaga

SEQ ID NO: 1046257 - RNA, 19 nt, Homo sapiens
agcaauguaucuucaggaa

SEQ ID NO: 1046258 - RNA, 19 nt, Homo sapiens
ccagaugccuaugcguugu

SEQ ID NO: 1046259 - RNA, 19 nt, Homo sapiens
uugcucagcuacuucucua

SEQ ID NO: 1046260 - RNA, 19 nt, Homo sapiens
gccuuuggcuggagaggau

SEQ ID NO: 1046261 - RNA, 19 nt, Homo sapiens
cacaguugcucagcuacuu

SEQ ID NO: 1046262 - RNA, 19 nt, Homo sapiens
agaagcacaucacagacau

SEQ ID NO: 1046263 - RNA, 19 nt, Homo sapiens
gccgagugauagagcagaa

SEQ ID NO: 1046264 - RNA, 19 nt, Homo sapiens
acaggacaauaacgucaug

SEQ ID NO: 1046265 - RNA, 19 nt, Homo sapiens
gccuagcaauguaucuuca

SEQ ID NO: 1046266 - RNA, 19 nt, Homo sapiens
agacacccaggaacuauga

SEQ ID NO: 1046267 - RNA, 19 nt, Homo sapiens
uccuuuggcuucauauaug

SEQ ID NO: 1046268 - RNA, 19 nt, Homo sapiens
gcccugacuuccugugagu

SEQ ID NO: 1046269 - RNA, 19 nt, Homo sapiens
aggagaagcacaucacaga

SEQ ID NO: 1046270 - RNA, 19 nt, Homo sapiens
gggaugggccagacaagca

SEQ ID NO: 1046271 - RNA, 19 nt, Homo sapiens
agaagcugcuacaggacaa

SEQ ID NO: 1046272 - RNA, 19 nt, Homo sapiens
cagaaggagguucccaaug

SEQ ID NO: 1046273 - RNA, 19 nt, Homo sapiens
ccucgagacugccucuucu

SEQ ID NO: 1046274 - RNA, 19 nt, Homo sapiens
gagacacccaggaacuaug

SEQ ID NO: 1046275 - RNA, 19 nt, Homo sapiens
cgaccucaccgaugacaca

SEQ ID NO: 1046276 - RNA, 19 nt, Homo sapiens
gcuccuuuggcuucauaua

SEQ ID NO: 1046277 - RNA, 19 nt, Homo sapiens
gaagcacaucacagacaug

SEQ ID NO: 1046278 - RNA, 19 nt, Homo sapiens
caacuuguccccaguguca

SEQ ID NO: 1046279 - RNA, 19 nt, Homo sapiens
cuacuucucuacccuugac

SEQ ID NO: 1046280 - RNA, 19 nt, Homo sapiens
ucaccgaugacacacaguu

SEQ ID NO: 1046281 - RNA, 19 nt, Homo sapiens
ggaggcugcaugcacuuuc

SEQ ID NO: 1046282 - RNA, 19 nt, Homo sapiens
ugggaggacuuccagaacu

SEQ ID NO: 1046283 - RNA, 19 nt, Homo sapiens
ucucuacccuugacaucca

SEQ ID NO: 1046284 - RNA, 19 nt, Homo sapiens
gcacugagcugacuguuga

SEQ ID NO: 1046285 - RNA, 19 nt, Homo sapiens
ggagaacgcugccgaagaa

SEQ ID NO: 1046286 - RNA, 19 nt, Homo sapiens
gaauggcacucaaauguuu

SEQ ID NO: 1046287 - RNA, 19 nt, Homo sapiens
gcgaagagccucauaaauu

SEQ ID NO: 1046288 - RNA, 19 nt, Homo sapiens
gaaacagccuggcaaagau

SEQ ID NO: 1046289 - RNA, 19 nt, Homo sapiens
cgaagagccucauaaauuc

SEQ ID NO: 1046290 - RNA, 19 nt, Homo sapiens
ggaaacagccuggcaaaga

SEQ ID NO: 1046291 - RNA, 19 nt, Homo sapiens
aaacucaucuuggcauuaa

SEQ ID NO: 1046292 - RNA, 19 nt, Homo sapiens
caaaagaaguuccaggaua

SEQ ID NO: 1046293 - RNA, 19 nt, Homo sapiens
guacagcuauggacugaug

SEQ ID NO: 1046294 - RNA, 19 nt, Homo sapiens
gaagucaccaucucugaaa

SEQ ID NO: 1046295 - RNA, 19 nt, Homo sapiens
agacacaacugcaagaaau

SEQ ID NO: 1046296 - RNA, 19 nt, Homo sapiens
gaaacgccaucuacaccaa

SEQ ID NO: 1046297 - RNA, 19 nt, Homo sapiens
uggcaaagauucaaacugu

SEQ ID NO: 1046298 - RNA, 19 nt, Homo sapiens
agaaaugccuuggaagaaa

SEQ ID NO: 1046299 - RNA, 19 nt, Homo sapiens
gaaagacaacacacacuau

SEQ ID NO: 1046300 - RNA, 19 nt, Homo sapiens
gaaguaaaggcaucugaga

SEQ ID NO: 1046301 - RNA, 19 nt, Homo sapiens
gcucauuucucauguuauc

SEQ ID NO: 1046302 - RNA, 19 nt, Homo sapiens
aaaccuagauguggaauca

SEQ ID NO: 1046303 - RNA, 19 nt, Homo sapiens
agaagaaccuguagggaau

SEQ ID NO: 1046304 - RNA, 19 nt, Homo sapiens
gcaaagauucaaacuguag

SEQ ID NO: 1046305 - RNA, 19 nt, Homo sapiens
uacaagcccggaagaauua

SEQ ID NO: 1046306 - RNA, 19 nt, Homo sapiens
ggugagagacagauugaaa

SEQ ID NO: 1046307 - RNA, 19 nt, Homo sapiens
gagcauucaugaagguguu

SEQ ID NO: 1046308 - RNA, 19 nt, Homo sapiens
uuugacagcugaagaagaa

SEQ ID NO: 1046309 - RNA, 19 nt, Homo sapiens
ggauacggcuauacugaca

SEQ ID NO: 1046310 - RNA, 19 nt, Homo sapiens
gaaaugccuuggaagaaaa

SEQ ID NO: 1046311 - RNA, 19 nt, Homo sapiens
cuaaaccaauuucacauuc

SEQ ID NO: 1046312 - RNA, 19 nt, Homo sapiens
ggcaaagauucaaacugua

SEQ ID NO: 1046313 - RNA, 19 nt, Homo sapiens
ccauauuucucagcaguaa

SEQ ID NO: 1046314 - RNA, 19 nt, Homo sapiens
agagacagauugaaagaca

SEQ ID NO: 1046315 - RNA, 19 nt, Homo sapiens
guccaaaguucagaaagaa

SEQ ID NO: 1046316 - RNA, 19 nt, Homo sapiens
ugaaagacaacacacacua

SEQ ID NO: 1046317 - RNA, 19 nt, Homo sapiens
gaaggcucauuucucaugu

SEQ ID NO: 1046318 - RNA, 19 nt, Homo sapiens
caacuuagggccaacuguu

SEQ ID NO: 1046319 - RNA, 19 nt, Homo sapiens
guagacugaugcucgcaaa

SEQ ID NO: 1046320 - RNA, 19 nt, Homo sapiens
uuacaagcccggaagaauu

SEQ ID NO: 1046321 - RNA, 19 nt, Homo sapiens
gcaguggcaucaacuuguc

SEQ ID NO: 1046322 - RNA, 19 nt, Homo sapiens
gcagcgaagagccucauaa

SEQ ID NO: 1046323 - RNA, 19 nt, Homo sapiens
ccagaaggagcauucauga

SEQ ID NO: 1046324 - RNA, 19 nt, Homo sapiens
agaaagagaagucgcuuga

SEQ ID NO: 1046325 - RNA, 19 nt, Homo sapiens
aggcucauuucucauguua

SEQ ID NO: 1046326 - RNA, 19 nt, Homo sapiens
acacuaacaugccagaagu

SEQ ID NO: 1046327 - RNA, 19 nt, Homo sapiens
ggacugcauucaacuuagg

SEQ ID NO: 1046328 - RNA, 19 nt, Homo sapiens
gcaaacaggccuccguucu

SEQ ID NO: 1046329 - RNA, 19 nt, Homo sapiens
cagcgaagagccucauaaa

SEQ ID NO: 1046330 - RNA, 19 nt, Homo sapiens
aggcuagaguuacaaauau

SEQ ID NO: 1046331 - RNA, 19 nt, Homo sapiens
gugagcagcuagacaccaa

SEQ ID NO: 1046332 - RNA, 19 nt, Homo sapiens
gcauuaauugugacugaaa

SEQ ID NO: 1046333 - RNA, 19 nt, Homo sapiens
caacacacacuauuuccau

SEQ ID NO: 1046334 - RNA, 19 nt, Homo sapiens
aaagacaacacacacuauu

SEQ ID NO: 1046335 - RNA, 19 nt, Homo sapiens
gagacagauugaaagacaa

SEQ ID NO: 1046336 - RNA, 19 nt, Homo sapiens
gauguggaaucaauguuac

SEQ ID NO: 1046337 - RNA, 19 nt, Homo sapiens
caucaucuuucacgagcaa

SEQ ID NO: 1046338 - RNA, 19 nt, Homo sapiens
caaacucaucuuggcauua

SEQ ID NO: 1046339 - RNA, 19 nt, Homo sapiens
guuacuaccguucauuaaa

SEQ ID NO: 1046340 - RNA, 19 nt, Homo sapiens
ucauugugguuuaggauug

SEQ ID NO: 1046341 - RNA, 19 nt, Homo sapiens
uggcauuaauugugacuga

SEQ ID NO: 1046342 - RNA, 19 nt, Homo sapiens
cauguuauccggaccuuga

SEQ ID NO: 1046343 - RNA, 19 nt, Homo sapiens
aaacaggccuccguucucu

SEQ ID NO: 1046344 - RNA, 19 nt, Homo sapiens
caaaggcuagaguuacaaa

SEQ ID NO: 1046345 - RNA, 19 nt, Homo sapiens
aaaguuaucugaguagacu

SEQ ID NO: 1046346 - RNA, 19 nt, Homo sapiens
gugugugucuccucucuga

SEQ ID NO: 1046347 - RNA, 19 nt, Homo sapiens
gagaacuacauuaaugaga

SEQ ID NO: 1046348 - RNA, 19 nt, Homo sapiens
cagcagcuacagucccuua

SEQ ID NO: 1046349 - RNA, 19 nt, Homo sapiens
gcuagaguuacaaauauga

SEQ ID NO: 1046350 - RNA, 19 nt, Homo sapiens
aaggcuagaguuacaaaua

SEQ ID NO: 1046351 - RNA, 19 nt, Homo sapiens
agacaacacacacuauuuc

SEQ ID NO: 1046352 - RNA, 19 nt, Homo sapiens
agauguggaaucaauguua

SEQ ID NO: 1046353 - RNA, 19 nt, Homo sapiens
ggcuagaguuacaaauaug

SEQ ID NO: 1046354 - RNA, 19 nt, Homo sapiens
gcauaaggcagcagucucu

SEQ ID NO: 1046355 - RNA, 19 nt, Homo sapiens
aguccaaaguucagaaaga

SEQ ID NO: 1046356 - RNA, 19 nt, Homo sapiens
agaaggagcauucaugaag

SEQ ID NO: 1046357 - RNA, 19 nt, Homo sapiens
aaauaccgcuuucacaaaa

SEQ ID NO: 1046358 - RNA, 19 nt, Homo sapiens
caucuuggcauuaauugug

SEQ ID NO: 1046359 - RNA, 19 nt, Homo sapiens
caggauacggcuauacuga

SEQ ID NO: 1046360 - RNA, 19 nt, Homo sapiens
acacacacuauuuccauuu

SEQ ID NO: 1046361 - RNA, 19 nt, Homo sapiens
uuacuaccguucauuaaac

SEQ ID NO: 1046362 - RNA, 19 nt, Homo sapiens
cuaaguuacauuugccaua

SEQ ID NO: 1046363 - RNA, 19 nt, Homo sapiens
guguacagcuauggacuga

SEQ ID NO: 1046364 - RNA, 19 nt, Homo sapiens
ugagagacagauugaaaga

SEQ ID NO: 1046365 - RNA, 19 nt, Homo sapiens
ugaauggcacucaaauguu

SEQ ID NO: 1046366 - RNA, 19 nt, Homo sapiens
acaaacucaucuuggcauu

SEQ ID NO: 1046367 - RNA, 19 nt, Homo sapiens
auacggcuauacugacaaa

SEQ ID NO: 1046368 - RNA, 19 nt, Homo sapiens
agagugaacagaaagagaa

SEQ ID NO: 1046369 - RNA, 19 nt, Homo sapiens
gaaaaguuaucugaguaga

SEQ ID NO: 1046370 - RNA, 19 nt, Homo sapiens
gauacggaccaauggaaga

SEQ ID NO: 1046371 - RNA, 19 nt, Homo sapiens
acaacaacgugggcacuga

SEQ ID NO: 1046372 - RNA, 19 nt, Homo sapiens
ugcaaaggcuagaguuaca

SEQ ID NO: 1046373 - RNA, 19 nt, Homo sapiens
cugaauggcacucaaaugu

SEQ ID NO: 1046374 - RNA, 19 nt, Homo sapiens
gggacugcauucaacuuag

SEQ ID NO: 1046375 - RNA, 19 nt, Homo sapiens
aagacaacacacacuauuu

SEQ ID NO: 1046376 - RNA, 19 nt, Homo sapiens
aaacagccuggcaaagauu

SEQ ID NO: 1046377 - RNA, 19 nt, Homo sapiens
cggaagaauuacacaagca

SEQ ID NO: 1046378 - RNA, 19 nt, Homo sapiens
uguagggaauccagaagga

SEQ ID NO: 1046379 - RNA, 19 nt, Homo sapiens
gggauacggaccaauggaa

SEQ ID NO: 1046380 - RNA, 19 nt, Homo sapiens
gcaaaggcuagaguuacaa

SEQ ID NO: 1046381 - RNA, 19 nt, Homo sapiens
gaaaaggcacuucaaagag

SEQ ID NO: 1046382 - RNA, 19 nt, Homo sapiens
agacaccaaugacgagagu

SEQ ID NO: 1046383 - RNA, 19 nt, Homo sapiens
agacagcaguggcaucaac

SEQ ID NO: 1046384 - RNA, 19 nt, Homo sapiens
gacaggagaugauauguuu

SEQ ID NO: 1046385 - RNA, 19 nt, Homo sapiens
cagagaaccuggauuuaua

SEQ ID NO: 1046386 - RNA, 19 nt, Homo sapiens
gcauaugcuuucaucauua

SEQ ID NO: 1046387 - RNA, 19 nt, Homo sapiens
gaaccuggauuuauaguag

SEQ ID NO: 1046388 - RNA, 19 nt, Homo sapiens
gggaagacauaaauucaaa

SEQ ID NO: 1046389 - RNA, 19 nt, Homo sapiens
ggagaucucuaccauggaa

SEQ ID NO: 1046390 - RNA, 19 nt, Homo sapiens
cauaugaucugcagguuug

SEQ ID NO: 1046391 - RNA, 19 nt, Homo sapiens
ccagaguucuuuagguuaa

SEQ ID NO: 1046392 - RNA, 19 nt, Homo sapiens
gcagguugcuacagugaaa

SEQ ID NO: 1046393 - RNA, 19 nt, Homo sapiens
ggagaauucugguuguaau

SEQ ID NO: 1046394 - RNA, 19 nt, Homo sapiens
gaaaguucaagaagcaaua

SEQ ID NO: 1046395 - RNA, 19 nt, Homo sapiens
ugaggagucugaaacaauu

SEQ ID NO: 1046396 - RNA, 19 nt, Homo sapiens
ggcauaugcuuucaucauu

SEQ ID NO: 1046397 - RNA, 19 nt, Homo sapiens
aaaggagaaugagaacuua

SEQ ID NO: 1046398 - RNA, 19 nt, Homo sapiens
gaggagaauuugcgcuuug

SEQ ID NO: 1046399 - RNA, 19 nt, Homo sapiens
gcaacaguaugcacagaga

SEQ ID NO: 1046400 - RNA, 19 nt, Homo sapiens
ggacagaucacuuguaugc

SEQ ID NO: 1046401 - RNA, 19 nt, Homo sapiens
gaggagaauucugguugua

SEQ ID NO: 1046402 - RNA, 19 nt, Homo sapiens
guuacucaguucccuaaua

SEQ ID NO: 1046403 - RNA, 19 nt, Homo sapiens
gaagauacuggcgaauaua

SEQ ID NO: 1046404 - RNA, 19 nt, Homo sapiens
caacauacugugucaggua

SEQ ID NO: 1046405 - RNA, 19 nt, Homo sapiens
caaaggagaaugagaacuu

SEQ ID NO: 1046406 - RNA, 19 nt, Homo sapiens
caauugaggauucuaguaa

SEQ ID NO: 1046407 - RNA, 19 nt, Homo sapiens
acaugucacuugugcuuua

SEQ ID NO: 1046408 - RNA, 19 nt, Homo sapiens
gaauucugguuguaauaga

SEQ ID NO: 1046409 - RNA, 19 nt, Homo sapiens
agaagauacuggcgaauau

SEQ ID NO: 1046410 - RNA, 19 nt, Homo sapiens
uugcagguauucucaauuu

SEQ ID NO: 1046411 - RNA, 19 nt, Homo sapiens
gugcuacaaugcaacagua

SEQ ID NO: 1046412 - RNA, 19 nt, Homo sapiens
ggaggagaauuugcgcuuu

SEQ ID NO: 1046413 - RNA, 19 nt, Homo sapiens
ucacaaaggagaaugagaa

SEQ ID NO: 1046414 - RNA, 19 nt, Homo sapiens
uauaacagcuuggguuugu

SEQ ID NO: 1046415 - RNA, 19 nt, Homo sapiens
aaacauggcacaagcuuga

SEQ ID NO: 1046416 - RNA, 19 nt, Homo sapiens
gagaaugagaacuuaauga

SEQ ID NO: 1046417 - RNA, 19 nt, Homo sapiens
gagaauucugguuguaaua

SEQ ID NO: 1046418 - RNA, 19 nt, Homo sapiens
ggacauguucaucuuauuc

SEQ ID NO: 1046419 - RNA, 19 nt, Homo sapiens
ggacaggagaugauauguu

SEQ ID NO: 1046420 - RNA, 19 nt, Homo sapiens
gccagagaaugggagauua

SEQ ID NO: 1046421 - RNA, 19 nt, Homo sapiens
aaucugggcuuuugaauaa

SEQ ID NO: 1046422 - RNA, 19 nt, Homo sapiens
ggaaucguacacuuucuaa

SEQ ID NO: 1046423 - RNA, 19 nt, Homo sapiens
ucacuuguaugccuucuuc

SEQ ID NO: 1046424 - RNA, 19 nt, Homo sapiens
cagcuuggguuuguuagaa

SEQ ID NO: 1046425 - RNA, 19 nt, Homo sapiens
aaggacagaucacuuguau

SEQ ID NO: 1046426 - RNA, 19 nt, Homo sapiens
cagaagauacuggcgaaua

SEQ ID NO: 1046427 - RNA, 19 nt, Homo sapiens
uaacgauguugcagguauu

SEQ ID NO: 1046428 - RNA, 19 nt, Homo sapiens
acaauuggcuauccaugga

SEQ ID NO: 1046429 - RNA, 19 nt, Homo sapiens
caagggaagacauaaauuc

SEQ ID NO: 1046430 - RNA, 19 nt, Homo sapiens
acauauguguagcuuagua

SEQ ID NO: 1046431 - RNA, 19 nt, Homo sapiens
uguugaaccuguauugauu

SEQ ID NO: 1046432 - RNA, 19 nt, Homo sapiens
cauggacucuuguuuaugg

SEQ ID NO: 1046433 - RNA, 19 nt, Homo sapiens
agacagugauggacagguu

SEQ ID NO: 1046434 - RNA, 19 nt, Homo sapiens
gcacagagagauaagaaac

SEQ ID NO: 1046435 - RNA, 19 nt, Homo sapiens
gaaguuggcacagguaaca

SEQ ID NO: 1046436 - RNA, 19 nt, Homo sapiens
uuacucaguucccuaauag

SEQ ID NO: 1046437 - RNA, 19 nt, Homo sapiens
uaacaugucacuugugcuu

SEQ ID NO: 1046438 - RNA, 19 nt, Homo sapiens
gaacaaugacagguuuaga

SEQ ID NO: 1046439 - RNA, 19 nt, Homo sapiens
guaaggcauuaacauaagu

SEQ ID NO: 1046440 - RNA, 19 nt, Homo sapiens
ggcauuaacauaaguacaa

SEQ ID NO: 1046441 - RNA, 19 nt, Homo sapiens
cugauaaaguuacaaguca

SEQ ID NO: 1046442 - RNA, 19 nt, Homo sapiens
uagaugacaguacauauga

SEQ ID NO: 1046443 - RNA, 19 nt, Homo sapiens
gaaaggacagaucacuugu

SEQ ID NO: 1046444 - RNA, 19 nt, Homo sapiens
cugcguccauguacuagua

SEQ ID NO: 1046445 - RNA, 19 nt, Homo sapiens
ucaagaagcaauacagugu

SEQ ID NO: 1046446 - RNA, 19 nt, Homo sapiens
agacauggauucacuagcu

SEQ ID NO: 1046447 - RNA, 19 nt, Homo sapiens
agaaaggacagaucacuug

SEQ ID NO: 1046448 - RNA, 19 nt, Homo sapiens
ggagaaugagaacuuaaug

SEQ ID NO: 1046449 - RNA, 19 nt, Homo sapiens
cuaauaggauggugcucuu

SEQ ID NO: 1046450 - RNA, 19 nt, Homo sapiens
uagucuguaucaccauuua

SEQ ID NO: 1046451 - RNA, 19 nt, Homo sapiens
caucugagccacugaaagu

SEQ ID NO: 1046452 - RNA, 19 nt, Homo sapiens
gagaaugggagauuacuac

SEQ ID NO: 1046453 - RNA, 19 nt, Homo sapiens
agagagauaagaaacauga

SEQ ID NO: 1046454 - RNA, 19 nt, Homo sapiens
gguauucucaauuuccuuu

SEQ ID NO: 1046455 - RNA, 19 nt, Homo sapiens
ucccagaguucuuuagguu

SEQ ID NO: 1046456 - RNA, 19 nt, Homo sapiens
ugugucagguauacuguuu

SEQ ID NO: 1046457 - RNA, 19 nt, Homo sapiens
guuuguaucucaagcaagu

SEQ ID NO: 1046458 - RNA, 19 nt, Homo sapiens
ugaaaugugaggagaauuc

SEQ ID NO: 1046459 - RNA, 19 nt, Homo sapiens
uuaacgauguugcagguau

SEQ ID NO: 1046460 - RNA, 19 nt, Homo sapiens
caaaggagacauggauuca

SEQ ID NO: 1046461 - RNA, 19 nt, Homo sapiens
gauuaaagacagugaugga

SEQ ID NO: 1046462 - RNA, 19 nt, Homo sapiens
cgaccaaaccuaagugauc

SEQ ID NO: 1046463 - RNA, 19 nt, Homo sapiens
cugaaacaauugaggauuc

SEQ ID NO: 1046464 - RNA, 19 nt, Homo sapiens
gcaggagaauggcccaaac

SEQ ID NO: 1046465 - RNA, 19 nt, Homo sapiens
uaaaaugcucucugucuua

SEQ ID NO: 1046466 - RNA, 19 nt, Homo sapiens
aaucguacacuuucuaaga

SEQ ID NO: 1046467 - RNA, 19 nt, Homo sapiens
uccauggacucuuguuuau

SEQ ID NO: 1046468 - RNA, 19 nt, Homo sapiens
aaugggagauuacuacaag

SEQ ID NO: 1046469 - RNA, 19 nt, Homo sapiens
gggaaucguacacuuucua

SEQ ID NO: 1046470 - RNA, 19 nt, Homo sapiens
gaaugggagauuacuacaa

SEQ ID NO: 1046471 - RNA, 19 nt, Homo sapiens
ucaagcagcagccagagaa

SEQ ID NO: 1046472 - RNA, 19 nt, Homo sapiens
cuucauagaccacugaguu

SEQ ID NO: 1046473 - RNA, 19 nt, Homo sapiens
ggauggugcucuuuuguug

SEQ ID NO: 1046474 - RNA, 19 nt, Homo sapiens
gcuuggguuuguuagaauu

SEQ ID NO: 1046475 - RNA, 19 nt, Homo sapiens
gacauggauucacuagcuu

SEQ ID NO: 1046476 - RNA, 19 nt, Homo sapiens
ccagaaauauaugcagaag

SEQ ID NO: 1046477 - RNA, 19 nt, Homo sapiens
gcauauuuccucaacauac

SEQ ID NO: 1046478 - RNA, 19 nt, Homo sapiens
gggcauaugcuuucaucau

SEQ ID NO: 1046479 - RNA, 19 nt, Homo sapiens
cagguaacauuuggacaug

SEQ ID NO: 1046480 - RNA, 19 nt, Homo sapiens
uuucacauguuacucaguu

SEQ ID NO: 1046481 - RNA, 19 nt, Homo sapiens
ggcuauccauggacucuug

SEQ ID NO: 1046482 - RNA, 19 nt, Homo sapiens
ccuaagugaucccagugaa

SEQ ID NO: 1046483 - RNA, 19 nt, Homo sapiens
acagagagauaagaaacau

SEQ ID NO: 1046484 - RNA, 19 nt, Homo sapiens
gcacauaacuuaacaauug

SEQ ID NO: 1046485 - RNA, 19 nt, Homo sapiens
gaagaaagcuuaaggacua

SEQ ID NO: 1046486 - RNA, 19 nt, Homo sapiens
gaaagaaguuggaaucaua

SEQ ID NO: 1046487 - RNA, 19 nt, Homo sapiens
uaacugaacugcuuaauga

SEQ ID NO: 1046488 - RNA, 19 nt, Homo sapiens
gcaagagaaugacaaguua

SEQ ID NO: 1046489 - RNA, 19 nt, Homo sapiens
gcaauuagaagaugcauua

SEQ ID NO: 1046490 - RNA, 19 nt, Homo sapiens
ggaagaagaucacugaguu

SEQ ID NO: 1046491 - RNA, 19 nt, Homo sapiens
ugaagaagaugaugaguaa

SEQ ID NO: 1046492 - RNA, 19 nt, Homo sapiens
gaagaaaggucacagagau

SEQ ID NO: 1046493 - RNA, 19 nt, Homo sapiens
gcagagcauuugcagauua

SEQ ID NO: 1046494 - RNA, 19 nt, Homo sapiens
gcaaagguguuacgagaaa

SEQ ID NO: 1046495 - RNA, 19 nt, Homo sapiens
caaagcagaucuauguuaa

SEQ ID NO: 1046496 - RNA, 19 nt, Homo sapiens
gcauacagcugcuuuguga

SEQ ID NO: 1046497 - RNA, 19 nt, Homo sapiens
ggagagaacuuuggaagaa

SEQ ID NO: 1046498 - RNA, 19 nt, Homo sapiens
gaaagagcauuaagcagaa

SEQ ID NO: 1046499 - RNA, 19 nt, Homo sapiens
caaaugaagugaaugagaa

SEQ ID NO: 1046500 - RNA, 19 nt, Homo sapiens
gcucugaaauccaauauug

SEQ ID NO: 1046501 - RNA, 19 nt, Homo sapiens
ggagcaagcacauaacuua

SEQ ID NO: 1046502 - RNA, 19 nt, Homo sapiens
gcaaagcagaucuauguua

SEQ ID NO: 1046503 - RNA, 19 nt, Homo sapiens
uaagauaacugaacugcuu

SEQ ID NO: 1046504 - RNA, 19 nt, Homo sapiens
gaagaucacugaguuaaca

SEQ ID NO: 1046505 - RNA, 19 nt, Homo sapiens
aaacagaacugcccucaug

SEQ ID NO: 1046506 - RNA, 19 nt, Homo sapiens
gaacuuaguaugugugaaa

SEQ ID NO: 1046507 - RNA, 19 nt, Homo sapiens
ggaaguaugugaggaaguu

SEQ ID NO: 1046508 - RNA, 19 nt, Homo sapiens
gaaaggugcaggauaguaa

SEQ ID NO: 1046509 - RNA, 19 nt, Homo sapiens
gagaaggaauuacugcauu

SEQ ID NO: 1046510 - RNA, 19 nt, Homo sapiens
aaacagcugucugaacuua

SEQ ID NO: 1046511 - RNA, 19 nt, Homo sapiens
gcaguagaagucuuaauua

SEQ ID NO: 1046512 - RNA, 19 nt, Homo sapiens
uaacaacaaucacagaguu

SEQ ID NO: 1046513 - RNA, 19 nt, Homo sapiens
guaguugacuugucuaaau

SEQ ID NO: 1046514 - RNA, 19 nt, Homo sapiens
acaagaaucugcuaaacaa

SEQ ID NO: 1046515 - RNA, 19 nt, Homo sapiens
agagagaacuugagaaugu

SEQ ID NO: 1046516 - RNA, 19 nt, Homo sapiens
ugaccaaacugcaucaauu

SEQ ID NO: 1046517 - RNA, 19 nt, Homo sapiens
gauaauagcucugaaaucc

SEQ ID NO: 1046518 - RNA, 19 nt, Homo sapiens
gaaguuggcccuuuccauu

SEQ ID NO: 1046519 - RNA, 19 nt, Homo sapiens
gaauaugguugcagagaug

SEQ ID NO: 1046520 - RNA, 19 nt, Homo sapiens
cagaaagauuugagagaua

SEQ ID NO: 1046521 - RNA, 19 nt, Homo sapiens
gauguaagccgccuagaaa

SEQ ID NO: 1046522 - RNA, 19 nt, Homo sapiens
gaagaagaucacugaguua

SEQ ID NO: 1046523 - RNA, 19 nt, Homo sapiens
uaaauaugaugaccgauug

SEQ ID NO: 1046524 - RNA, 19 nt, Homo sapiens
guuaagaccucuggaacua

SEQ ID NO: 1046525 - RNA, 19 nt, Homo sapiens
agaaggagcucgacacaau

SEQ ID NO: 1046526 - RNA, 19 nt, Homo sapiens
gaaauuaaagcccagaaga

SEQ ID NO: 1046527 - RNA, 19 nt, Homo sapiens
gcaaagaugagcucgcuaa

SEQ ID NO: 1046528 - RNA, 19 nt, Homo sapiens
gaacagaaaucaggagaac

SEQ ID NO: 1046529 - RNA, 19 nt, Homo sapiens
acacagauuucuagcuuaa

SEQ ID NO: 1046530 - RNA, 19 nt, Homo sapiens
gaacugaagaguaugcaaa

SEQ ID NO: 1046531 - RNA, 19 nt, Homo sapiens
ugacacacaugcaagauga

SEQ ID NO: 1046532 - RNA, 19 nt, Homo sapiens
gcagaucugucuuccaugu

SEQ ID NO: 1046533 - RNA, 19 nt, Homo sapiens
uuacugugcugguauaauu

SEQ ID NO: 1046534 - RNA, 19 nt, Homo sapiens
gcauugagcaagaaauuaa

SEQ ID NO: 1046535 - RNA, 19 nt, Homo sapiens
caaacugcaucaauuguug

SEQ ID NO: 1046536 - RNA, 19 nt, Homo sapiens
gaagagcucauuaucaaau

SEQ ID NO: 1046537 - RNA, 19 nt, Homo sapiens
gaagaaagccaaaacaaaa

SEQ ID NO: 1046538 - RNA, 19 nt, Homo sapiens
gaaaaugacagcuuaagua

SEQ ID NO: 1046539 - RNA, 19 nt, Homo sapiens
gcaaagcuuuagcauuaga

SEQ ID NO: 1046540 - RNA, 19 nt, Homo sapiens
caacucaccuacacaagug

SEQ ID NO: 1046541 - RNA, 19 nt, Homo sapiens
gaaagagaagcuaguagaa

SEQ ID NO: 1046542 - RNA, 19 nt, Homo sapiens
gaaauacacggaaguaaag

SEQ ID NO: 1046543 - RNA, 19 nt, Homo sapiens
gauaagacaguucucauug

SEQ ID NO: 1046544 - RNA, 19 nt, Homo sapiens
ugagaaaggugcaggauag

SEQ ID NO: 1046545 - RNA, 19 nt, Homo sapiens
gcaagcacauaacuuaaca

SEQ ID NO: 1046546 - RNA, 19 nt, Homo sapiens
gaaggaacuuaguaugugu

SEQ ID NO: 1046547 - RNA, 19 nt, Homo sapiens
gaugauaguagaagaguuu

SEQ ID NO: 1046548 - RNA, 19 nt, Homo sapiens
gaacagauaaagcaauuag

SEQ ID NO: 1046549 - RNA, 19 nt, Homo sapiens
uaaacaaggucagauguau

SEQ ID NO: 1046550 - RNA, 19 nt, Homo sapiens
ugaaaucucuggagcaaca

SEQ ID NO: 1046551 - RNA, 19 nt, Homo sapiens
aggaagaacugaagaguau

SEQ ID NO: 1046552 - RNA, 19 nt, Homo sapiens
agucaaugguuuacaguua

SEQ ID NO: 1046553 - RNA, 19 nt, Homo sapiens
gaauagaaaguaugaggaa

SEQ ID NO: 1046554 - RNA, 19 nt, Homo sapiens
caacagagaaagaacuaaa

SEQ ID NO: 1046555 - RNA, 19 nt, Homo sapiens
gacacugaaugacacguua

SEQ ID NO: 1046556 - RNA, 19 nt, Homo sapiens
ugaaagagagguugagaaa

SEQ ID NO: 1046557 - RNA, 19 nt, Homo sapiens
ucaccuggcugcuaaguau

SEQ ID NO: 1046558 - RNA, 19 nt, Homo sapiens
caagaaugcauuaagguaa

SEQ ID NO: 1046559 - RNA, 19 nt, Homo sapiens
uaauagcucugaaauccaa

SEQ ID NO: 1046560 - RNA, 19 nt, Homo sapiens
ggaaauggagaaauugcua

SEQ ID NO: 1046561 - RNA, 19 nt, Homo sapiens
gagagaacuuuggaagaaa

SEQ ID NO: 1046562 - RNA, 19 nt, Homo sapiens
gaaaguaugaggaaguaug

SEQ ID NO: 1046563 - RNA, 19 nt, Homo sapiens
aagagaagcuaguagaaga

SEQ ID NO: 1046564 - RNA, 19 nt, Homo sapiens
ggaaguaaagaaugugaaa

SEQ ID NO: 1046565 - RNA, 19 nt, Homo sapiens
gagcuaaacaaacaguuaa

SEQ ID NO: 1046566 - RNA, 19 nt, Homo sapiens
gaaggagcucgacacaaua

SEQ ID NO: 1046567 - RNA, 19 nt, Homo sapiens
caggagaacuugggaagaa

SEQ ID NO: 1046568 - RNA, 19 nt, Homo sapiens
cagcagauuggaauaaaua

SEQ ID NO: 1046569 - RNA, 19 nt, Homo sapiens
caaaguggcagaaugcaaa

SEQ ID NO: 1046570 - RNA, 19 nt, Homo sapiens
uagaaaguaugaggaagua

SEQ ID NO: 1046571 - RNA, 19 nt, Homo sapiens
agacacagauuucuagcuu

SEQ ID NO: 1046572 - RNA, 19 nt, Homo sapiens
caugcuagguugcgaauau

SEQ ID NO: 1046573 - RNA, 19 nt, Homo sapiens
gagaaugacaaguuaaaga

SEQ ID NO: 1046574 - RNA, 19 nt, Homo sapiens
aaagucacaugaugcaauu

SEQ ID NO: 1046575 - RNA, 19 nt, Homo sapiens
ucaaggagcaagcacauaa

SEQ ID NO: 1046576 - RNA, 19 nt, Homo sapiens
ucacugaguuaacauugaa

SEQ ID NO: 1046577 - RNA, 19 nt, Homo sapiens
gaaaauaagcgauuacaga

SEQ ID NO: 1046578 - RNA, 19 nt, Homo sapiens
gaagaugcauuaaaagaug

SEQ ID NO: 1046579 - RNA, 19 nt, Homo sapiens
caugcaagaugaaguaaau

SEQ ID NO: 1046580 - RNA, 19 nt, Homo sapiens
cagacgagcuaaacaaaca

SEQ ID NO: 1046581 - RNA, 19 nt, Homo sapiens
gaacaugaacagguuaaga

SEQ ID NO: 1046582 - RNA, 19 nt, Homo sapiens
uggauaaagucaaugguuu

SEQ ID NO: 1046583 - RNA, 19 nt, Homo sapiens
agaaggaauuacugcauuu

SEQ ID NO: 1046584 - RNA, 19 nt, Homo sapiens
gcagauaucuuauguuuca

SEQ ID NO: 1046585 - RNA, 19 nt, Homo sapiens
caaagaguauucugaagua

SEQ ID NO: 1046586 - RNA, 19 nt, Homo sapiens
gagaacagcuggcuaagga

SEQ ID NO: 1046587 - RNA, 19 nt, Homo sapiens
gaagaaaugugacuuugau

SEQ ID NO: 1046588 - RNA, 19 nt, Homo sapiens
gaagaagaaaugugacuuu

SEQ ID NO: 1046589 - RNA, 19 nt, Homo sapiens
uggcagauaucuuauguuu

SEQ ID NO: 1046590 - RNA, 19 nt, Homo sapiens
gaacaagaaucagaagaag

SEQ ID NO: 1046591 - RNA, 19 nt, Homo sapiens
caccauguauuucuucuuu

SEQ ID NO: 1046592 - RNA, 19 nt, Homo sapiens
ggagggaauuacaauaguu

SEQ ID NO: 1046593 - RNA, 19 nt, Homo sapiens
uuacugggcuugcuacuau

SEQ ID NO: 1046594 - RNA, 19 nt, Homo sapiens
ucucgccacuuauuauuua

SEQ ID NO: 1046595 - RNA, 19 nt, Homo sapiens
guacaaagaguauucugaa

SEQ ID NO: 1046596 - RNA, 19 nt, Homo sapiens
uaaacaaggucacuggaau

SEQ ID NO: 1046597 - RNA, 19 nt, Homo sapiens
gggaaaugcuggacaucuu

SEQ ID NO: 1046598 - RNA, 19 nt, Homo sapiens
aagcgaaccugcuaucuug

SEQ ID NO: 1046599 - RNA, 19 nt, Homo sapiens
ccaaguuaauguugucaaa

SEQ ID NO: 1046600 - RNA, 19 nt, Homo sapiens
ggaaaugcuggacaucuuu

SEQ ID NO: 1046601 - RNA, 19 nt, Homo sapiens
uaaguguacuguuugcauu

SEQ ID NO: 1046602 - RNA, 19 nt, Homo sapiens
uucauuaccugguugguua

SEQ ID NO: 1046603 - RNA, 19 nt, Homo sapiens
ccaacacacgguuuaauuu

SEQ ID NO: 1046604 - RNA, 19 nt, Homo sapiens
aaggaugacucuaagugua

SEQ ID NO: 1046605 - RNA, 19 nt, Homo sapiens
gaacagaaacagcaacaac

SEQ ID NO: 1046606 - RNA, 19 nt, Homo sapiens
gaccauggaauuauacuug

SEQ ID NO: 1046607 - RNA, 19 nt, Homo sapiens
gauuggauuuguccuguau

SEQ ID NO: 1046608 - RNA, 19 nt, Homo sapiens
gacucuaaguguacuguuu

SEQ ID NO: 1046609 - RNA, 19 nt, Homo sapiens
acaagaaucagaagaagaa

SEQ ID NO: 1046610 - RNA, 19 nt, Homo sapiens
ggguguggcagauaucuua

SEQ ID NO: 1046611 - RNA, 19 nt, Homo sapiens
auagauaugcucaagguua

SEQ ID NO: 1046612 - RNA, 19 nt, Homo sapiens
caaggucacuggaaucaac

SEQ ID NO: 1046613 - RNA, 19 nt, Homo sapiens
ggucuuuggugguguacaa

SEQ ID NO: 1046614 - RNA, 19 nt, Homo sapiens
gacuagggacccaaguuua

SEQ ID NO: 1046615 - RNA, 19 nt, Homo sapiens
cgacuagggacccaaguuu

SEQ ID NO: 1046616 - RNA, 19 nt, Homo sapiens
ggcaucauuucaccaugua

SEQ ID NO: 1046617 - RNA, 19 nt, Homo sapiens
gaaaugugacuuugaugag

SEQ ID NO: 1046618 - RNA, 19 nt, Homo sapiens
aagaagaaaugugacuuug

SEQ ID NO: 1046619 - RNA, 19 nt, Homo sapiens
ugaguaaacagaccaaguu

SEQ ID NO: 1046620 - RNA, 19 nt, Homo sapiens
gaauuaugcuuucauuacc

SEQ ID NO: 1046621 - RNA, 19 nt, Homo sapiens
gaaaugcuggacaucuuug

SEQ ID NO: 1046622 - RNA, 19 nt, Homo sapiens
ggucaugcccucccuggaa

SEQ ID NO: 1046623 - RNA, 19 nt, Homo sapiens
ggagcugguucuuucagau

SEQ ID NO: 1046624 - RNA, 19 nt, Homo sapiens
ccuugaccauggaauuaua

SEQ ID NO: 1046625 - RNA, 19 nt, Homo sapiens
gagcugguucuuucagauu

SEQ ID NO: 1046626 - RNA, 19 nt, Homo sapiens
ugaacgagaacaagaauca

SEQ ID NO: 1046627 - RNA, 19 nt, Homo sapiens
uggaaugaauuaugcuuuc

SEQ ID NO: 1046628 - RNA, 19 nt, Homo sapiens
agaaaugugacuuugauga

SEQ ID NO: 1046629 - RNA, 19 nt, Homo sapiens
agaacaagaaucagaagaa

SEQ ID NO: 1046630 - RNA, 19 nt, Homo sapiens
caauguacuucuggagcua

SEQ ID NO: 1046631 - RNA, 19 nt, Homo sapiens
uggcuaaggaugacucuaa

SEQ ID NO: 1046632 - RNA, 19 nt, Homo sapiens
agaaucagaagaagaaaug

SEQ ID NO: 1046633 - RNA, 19 nt, Homo sapiens
ggccagaucccauccaaca

SEQ ID NO: 1046634 - RNA, 19 nt, Homo sapiens
gagggaauuacaauaguug

SEQ ID NO: 1046635 - RNA, 19 nt, Homo sapiens
gagaacaagaaucagaaga

SEQ ID NO: 1046636 - RNA, 19 nt, Homo sapiens
gggagcugguucuuucaga

SEQ ID NO: 1046637 - RNA, 19 nt, Homo sapiens
cagaaacagcaacaacaaa

SEQ ID NO: 1046638 - RNA, 19 nt, Homo sapiens
ccauggaauuauacuuguu

SEQ ID NO: 1046639 - RNA, 19 nt, Homo sapiens
uuauagauaugcucaaggu

SEQ ID NO: 1046640 - RNA, 19 nt, Homo sapiens
cuguuugcauuuccaauuu

SEQ ID NO: 1046641 - RNA, 19 nt, Homo sapiens
cuccugggcuggcaucauu

SEQ ID NO: 1046642 - RNA, 19 nt, Homo sapiens
uagauaugcucaagguuac

SEQ ID NO: 1046643 - RNA, 19 nt, Homo sapiens
caacacacgguuuaauuuu

SEQ ID NO: 1046644 - RNA, 19 nt, Homo sapiens
guaacuccuugaccaugga

SEQ ID NO: 1046645 - RNA, 19 nt, Homo sapiens
cuauugcggucaagucuca

SEQ ID NO: 1046646 - RNA, 19 nt, Homo sapiens
ccauguauuucuucuuugg

SEQ ID NO: 1046647 - RNA, 19 nt, Homo sapiens
guggaggccuuuaucuucu

SEQ ID NO: 1046648 - RNA, 19 nt, Homo sapiens
gaguaaacagaccaaguug

SEQ ID NO: 1046649 - RNA, 19 nt, Homo sapiens
agaagaaaugugacuuuga

SEQ ID NO: 1046650 - RNA, 19 nt, Homo sapiens
acuagggacccaaguuuaa

SEQ ID NO: 1046651 - RNA, 19 nt, Homo sapiens
uuaccugguugguuaaauc

SEQ ID NO: 1046652 - RNA, 19 nt, Homo sapiens
caucauuucaccauguauu

SEQ ID NO: 1046653 - RNA, 19 nt, Homo sapiens
uugaugagcuuccaguuuu

SEQ ID NO: 1046654 - RNA, 19 nt, Homo sapiens
acagaaacagcaacaacaa

SEQ ID NO: 1046655 - RNA, 19 nt, Homo sapiens
acaaagaguauucugaagu

SEQ ID NO: 1046656 - RNA, 19 nt, Homo sapiens
gguccugcaugggaucuga

SEQ ID NO: 1046657 - RNA, 19 nt, Homo sapiens
uguggcagauaucuuaugu

SEQ ID NO: 1046658 - RNA, 19 nt, Homo sapiens
ucugaaguauaucugcaaa

SEQ ID NO: 1046659 - RNA, 19 nt, Homo sapiens
uaaggaugacucuaagugu

SEQ ID NO: 1046660 - RNA, 19 nt, Homo sapiens
cuaaggaugacucuaagug

SEQ ID NO: 1046661 - RNA, 19 nt, Homo sapiens
uggcaucauuucaccaugu

SEQ ID NO: 1046662 - RNA, 19 nt, Homo sapiens
aaagcgaaccugcuaucuu

SEQ ID NO: 1046663 - RNA, 19 nt, Homo sapiens
gggcuugcuacuauuugua

SEQ ID NO: 1046664 - RNA, 19 nt, Homo sapiens
caagucucauucugcuuca

SEQ ID NO: 1046665 - RNA, 19 nt, Homo sapiens
cgccacuuauuauuuauuc

SEQ ID NO: 1046666 - RNA, 19 nt, Homo sapiens
gcugcaaugagaaauaaau

SEQ ID NO: 1046667 - RNA, 19 nt, Homo sapiens
ccacacuaugaaagaaaua

SEQ ID NO: 1046668 - RNA, 19 nt, Homo sapiens
ccagaucccauccaacaca

SEQ ID NO: 1046669 - RNA, 19 nt, Homo sapiens
ccauccaacacacgguuua

SEQ ID NO: 1046670 - RNA, 19 nt, Homo sapiens
uccaacacacgguuuaauu

SEQ ID NO: 1046671 - RNA, 19 nt, Homo sapiens
gcggucaagucucauucug

SEQ ID NO: 1046672 - RNA, 19 nt, Homo sapiens
uggaggccuuuaucuucua

SEQ ID NO: 1046673 - RNA, 19 nt, Homo sapiens
ccugguugguuaaaucuag

SEQ ID NO: 1046674 - RNA, 19 nt, Homo sapiens
ggcuugcuacuauuuguaa

SEQ ID NO: 1046675 - RNA, 19 nt, Homo sapiens
agauuggauuuguccugua

SEQ ID NO: 1046676 - RNA, 19 nt, Homo sapiens
aaacaaggucacuggaauc

SEQ ID NO: 1046677 - RNA, 19 nt, Homo sapiens
uggagggaauuacaauagu

SEQ ID NO: 1046678 - RNA, 19 nt, Homo sapiens
uacaaagaguauucugaag

SEQ ID NO: 1046679 - RNA, 19 nt, Homo sapiens
gcgacuagggacccaaguu

SEQ ID NO: 1046680 - RNA, 19 nt, Homo sapiens
ggcuaaggaugacucuaag

SEQ ID NO: 1046681 - RNA, 19 nt, Homo sapiens
caggggagcugguucuuuc

SEQ ID NO: 1046682 - RNA, 19 nt, Homo sapiens
aauguugucaaaugccuua

SEQ ID NO: 1046683 - RNA, 19 nt, Homo sapiens
caauaguuggcauggcuuu

SEQ ID NO: 1046684 - RNA, 19 nt, Homo sapiens
acacugagauaacagcuua

SEQ ID NO: 1046685 - RNA, 19 nt, Homo sapiens
gaagugaccuugcuagcau

SEQ ID NO: 1046686 - RNA, 19 nt, Homo sapiens
gaaacgugcucuccagguu

SEQ ID NO: 1046687 - RNA, 19 nt, Homo sapiens
gaagguagaggaagauauu

SEQ ID NO: 1046688 - RNA, 19 nt, Homo sapiens
ucacuuagcgaacaaauaa

SEQ ID NO: 1046689 - RNA, 19 nt, Homo sapiens
aaagaugagucugaaguua

SEQ ID NO: 1046690 - RNA, 19 nt, Homo sapiens
gcucacaccuauaauccua

SEQ ID NO: 1046691 - RNA, 19 nt, Homo sapiens
guacauaauugacuagagu

SEQ ID NO: 1046692 - RNA, 19 nt, Homo sapiens
cagcuuaaguuaguacaua

SEQ ID NO: 1046693 - RNA, 19 nt, Homo sapiens
ugacuuugaugaacuguuu

SEQ ID NO: 1046694 - RNA, 19 nt, Homo sapiens
gcgaacaaauaacuuagaa

SEQ ID NO: 1046695 - RNA, 19 nt, Homo sapiens
gaaguuauaucgcaaaaug

SEQ ID NO: 1046696 - RNA, 19 nt, Homo sapiens
aaacaucucuccuuccaau

SEQ ID NO: 1046697 - RNA, 19 nt, Homo sapiens
cagagaaaguugagaauag

SEQ ID NO: 1046698 - RNA, 19 nt, Homo sapiens
ccaaugaaauccuguucuu

SEQ ID NO: 1046699 - RNA, 19 nt, Homo sapiens
gcagagaaaguugagaaua

SEQ ID NO: 1046700 - RNA, 19 nt, Homo sapiens
gaacuuacuugcuuuucua

SEQ ID NO: 1046701 - RNA, 19 nt, Homo sapiens
agaugagucugaaguuaua

SEQ ID NO: 1046702 - RNA, 19 nt, Homo sapiens
gaaauugaccaaggugaaa

SEQ ID NO: 1046703 - RNA, 19 nt, Homo sapiens
cagccugggugacaaagua

SEQ ID NO: 1046704 - RNA, 19 nt, Homo sapiens
guaccuaucucucccaucu

SEQ ID NO: 1046705 - RNA, 19 nt, Homo sapiens
aaauagagaugaaguagag

SEQ ID NO: 1046706 - RNA, 19 nt, Homo sapiens
ugagauaacagcuuaaguu

SEQ ID NO: 1046707 - RNA, 19 nt, Homo sapiens
ggaugaacuuacuugcuuu

SEQ ID NO: 1046708 - RNA, 19 nt, Homo sapiens
gaucuuguagaaacgauua

SEQ ID NO: 1046709 - RNA, 19 nt, Homo sapiens
ugaaugagcucccuguaac

SEQ ID NO: 1046710 - RNA, 19 nt, Homo sapiens
gaagggagauaaaauaagu

SEQ ID NO: 1046711 - RNA, 19 nt, Homo sapiens
guaacccaauucucuuauu

SEQ ID NO: 1046712 - RNA, 19 nt, Homo sapiens
gacuagaguuguagcaguu

SEQ ID NO: 1046713 - RNA, 19 nt, Homo sapiens
gaaauagagaugaaguaga

SEQ ID NO: 1046714 - RNA, 19 nt, Homo sapiens
ggaaauugaccaaggugaa

SEQ ID NO: 1046715 - RNA, 19 nt, Homo sapiens
ugacagcaccauuguugua

SEQ ID NO: 1046716 - RNA, 19 nt, Homo sapiens
ucuauuugcuucaagugua

SEQ ID NO: 1046717 - RNA, 19 nt, Homo sapiens
agugaugacucuauagaaa

SEQ ID NO: 1046718 - RNA, 19 nt, Homo sapiens
ggaaauagagaugaaguag

SEQ ID NO: 1046719 - RNA, 19 nt, Homo sapiens
caauauaucauaccagcuu

SEQ ID NO: 1046720 - RNA, 19 nt, Homo sapiens
ugaugacucuauagaaaga

SEQ ID NO: 1046721 - RNA, 19 nt, Homo sapiens
ccauaacacugagauaaca

SEQ ID NO: 1046722 - RNA, 19 nt, Homo sapiens
cuuauagucuggaaauaga

SEQ ID NO: 1046723 - RNA, 19 nt, Homo sapiens
gaaaauaugcccuuauagu

SEQ ID NO: 1046724 - RNA, 19 nt, Homo sapiens
ccuuaaagcuugauuaucc

SEQ ID NO: 1046725 - RNA, 19 nt, Homo sapiens
aggaugaacuuacuugcuu

SEQ ID NO: 1046726 - RNA, 19 nt, Homo sapiens
gaugaaacuucugcagauc

SEQ ID NO: 1046727 - RNA, 19 nt, Homo sapiens
ugaaacuucugcagaucuu

SEQ ID NO: 1046728 - RNA, 19 nt, Homo sapiens
gcaguucuuucuugcuauc

SEQ ID NO: 1046729 - RNA, 19 nt, Homo sapiens
caccauaacacugagauaa

SEQ ID NO: 1046730 - RNA, 19 nt, Homo sapiens
gaaguagagcaccauaaca

SEQ ID NO: 1046731 - RNA, 19 nt, Homo sapiens
gauauuguccgucuauguc

SEQ ID NO: 1046732 - RNA, 19 nt, Homo sapiens
cagaaaccuuaaagcuuga

SEQ ID NO: 1046733 - RNA, 19 nt, Homo sapiens
agaugaaacuucugcagau

SEQ ID NO: 1046734 - RNA, 19 nt, Homo sapiens
cugcagaucuuguagaaac

SEQ ID NO: 1046735 - RNA, 19 nt, Homo sapiens
gaagauaacaaaagugaga

SEQ ID NO: 1046736 - RNA, 19 nt, Homo sapiens
gccagaaaccuuaaagcuu

SEQ ID NO: 1046737 - RNA, 19 nt, Homo sapiens
cuauuugcuucaaguguaa

SEQ ID NO: 1046738 - RNA, 19 nt, Homo sapiens
gaauuaguguguguacucu

SEQ ID NO: 1046739 - RNA, 19 nt, Homo sapiens
aaacgugcucuccagguua

SEQ ID NO: 1046740 - RNA, 19 nt, Homo sapiens
aaacaagaaaguagugaga

SEQ ID NO: 1046741 - RNA, 19 nt, Homo sapiens
cuagcaguauggaaauuga

SEQ ID NO: 1046742 - RNA, 19 nt, Homo sapiens
gcaccauaacacugagaua

SEQ ID NO: 1046743 - RNA, 19 nt, Homo sapiens
cccauuauaucacauucuu

SEQ ID NO: 1046744 - RNA, 19 nt, Homo sapiens
ugucuuagaucucuguuac

SEQ ID NO: 1046745 - RNA, 19 nt, Homo sapiens
acaagaaaguagugagagu

SEQ ID NO: 1046746 - RNA, 19 nt, Homo sapiens
gagagaagugaccuugcua

SEQ ID NO: 1046747 - RNA, 19 nt, Homo sapiens
acccaauucucuuauuuga

SEQ ID NO: 1046748 - RNA, 19 nt, Homo sapiens
gaugaaguagagcaccaua

SEQ ID NO: 1046749 - RNA, 19 nt, Homo sapiens
gaaaguagugagaguuugc

SEQ ID NO: 1046750 - RNA, 19 nt, Homo sapiens
caagaaaguagugagaguu

SEQ ID NO: 1046751 - RNA, 19 nt, Homo sapiens
cagacucuauggagacaga

SEQ ID NO: 1046752 - RNA, 19 nt, Homo sapiens
cuuuaugguuuguucagua

SEQ ID NO: 1046753 - RNA, 19 nt, Homo sapiens
gacagcaccauuguuguaa

SEQ ID NO: 1046754 - RNA, 19 nt, Homo sapiens
aaaagaagguagaggaaga

SEQ ID NO: 1046755 - RNA, 19 nt, Homo sapiens
agagaaaguugagaauagu

SEQ ID NO: 1046756 - RNA, 19 nt, Homo sapiens
uauuuuagcugcagagaaa

SEQ ID NO: 1046757 - RNA, 19 nt, Homo sapiens
ucuccagguuagcauauaa

SEQ ID NO: 1046758 - RNA, 19 nt, Homo sapiens
gauuucaaacuccuuaugu

SEQ ID NO: 1046759 - RNA, 19 nt, Homo sapiens
ucuuagaucucuguuacuu

SEQ ID NO: 1046760 - RNA, 19 nt, Homo sapiens
caaugaaauccuguucuuu

SEQ ID NO: 1046761 - RNA, 19 nt, Homo sapiens
aagaaaguagugagaguuu

SEQ ID NO: 1046762 - RNA, 19 nt, Homo sapiens
uaagagacagagacaacuu

SEQ ID NO: 1046763 - RNA, 19 nt, Homo sapiens
uuucuaagccuguggaaga

SEQ ID NO: 1046764 - RNA, 19 nt, Homo sapiens
ccuauucucuuccccauuu

SEQ ID NO: 1046765 - RNA, 19 nt, Homo sapiens
caucuaaacaagaaaguag

SEQ ID NO: 1046766 - RNA, 19 nt, Homo sapiens
aauauucuuuguccaggaa

SEQ ID NO: 1046767 - RNA, 19 nt, Homo sapiens
ugagagaagugaccuugcu

SEQ ID NO: 1046768 - RNA, 19 nt, Homo sapiens
gaaaauacagacucuaugg

SEQ ID NO: 1046769 - RNA, 19 nt, Homo sapiens
gcuugcaccuucugaggau

SEQ ID NO: 1046770 - RNA, 19 nt, Homo sapiens
uagagcaccauaacacuga

SEQ ID NO: 1046771 - RNA, 19 nt, Homo sapiens
aagcaugaauaccuuucuu

SEQ ID NO: 1046772 - RNA, 19 nt, Homo sapiens
auacuaagaagggagauaa

SEQ ID NO: 1046773 - RNA, 19 nt, Homo sapiens
gaagagaaaauggaaaguu

SEQ ID NO: 1046774 - RNA, 19 nt, Homo sapiens
gauucuacccagccuauuc

SEQ ID NO: 1046775 - RNA, 19 nt, Homo sapiens
guuguaagccagaaaccuu

SEQ ID NO: 1046776 - RNA, 19 nt, Homo sapiens
gagaauagugaugacucua

SEQ ID NO: 1046777 - RNA, 19 nt, Homo sapiens
ugagaauagugaugacucu

SEQ ID NO: 1046778 - RNA, 19 nt, Homo sapiens
gaaaguugagaauagugau

SEQ ID NO: 1046779 - RNA, 19 nt, Homo sapiens
agaaaguagugagaguuug

SEQ ID NO: 1046780 - RNA, 19 nt, Homo sapiens
ucucccaucucuuuuauuu

SEQ ID NO: 1046781 - RNA, 19 nt, Homo sapiens
cugaaugagcucccuguaa

SEQ ID NO: 1046782 - RNA, 19 nt, Homo sapiens
aaauaugcccuuauagucu

SEQ ID NO: 1046783 - RNA, 19 nt, Homo sapiens
ugaccaaggugaaaagaau

SEQ ID NO: 1046784 - RNA, 19 nt, Homo sapiens
gcagaaacuuugacuuaaa

SEQ ID NO: 1046785 - RNA, 19 nt, Homo sapiens
gaaaacagaucacacauau

SEQ ID NO: 1046786 - RNA, 19 nt, Homo sapiens
gcaaaggaccugacuagga

SEQ ID NO: 1046787 - RNA, 19 nt, Homo sapiens
gcaagaaacugcucaaccu

SEQ ID NO: 1046788 - RNA, 19 nt, Homo sapiens
gcuacgaggugccgucaaa

SEQ ID NO: 1046789 - RNA, 19 nt, Homo sapiens
gcgagaagcaguacaaaug

SEQ ID NO: 1046790 - RNA, 19 nt, Homo sapiens
uaucgaaaccagcauauuu

SEQ ID NO: 1046791 - RNA, 19 nt, Homo sapiens
cuaaauguuuccucgauga

SEQ ID NO: 1046792 - RNA, 19 nt, Homo sapiens
caaccuaaccuuccauaug

SEQ ID NO: 1046793 - RNA, 19 nt, Homo sapiens
gaacacggaauauauacau

SEQ ID NO: 1046794 - RNA, 19 nt, Homo sapiens
guuuaacgcucacuauaau

SEQ ID NO: 1046795 - RNA, 19 nt, Homo sapiens
ccauguaaauccuccugua

SEQ ID NO: 1046796 - RNA, 19 nt, Homo sapiens
gccgaaacguauuuaauuc

SEQ ID NO: 1046797 - RNA, 19 nt, Homo sapiens
aaagaaacaugugcgcaaa

SEQ ID NO: 1046798 - RNA, 19 nt, Homo sapiens
uugcagaaacuuugacuua

SEQ ID NO: 1046799 - RNA, 19 nt, Homo sapiens
gagcagguacugaaggaaa

SEQ ID NO: 1046800 - RNA, 19 nt, Homo sapiens
gcggcucgcucuacuacuu

SEQ ID NO: 1046801 - RNA, 19 nt, Homo sapiens
gcagagaggcuaaaaucua

SEQ ID NO: 1046802 - RNA, 19 nt, Homo sapiens
caagcgaacacggaauaua

SEQ ID NO: 1046803 - RNA, 19 nt, Homo sapiens
ugcagaaacuuugacuuaa

SEQ ID NO: 1046804 - RNA, 19 nt, Homo sapiens
cgaaacguauuuaauucca

SEQ ID NO: 1046805 - RNA, 19 nt, Homo sapiens
cgccgaaacguauuuaauu

SEQ ID NO: 1046806 - RNA, 19 nt, Homo sapiens
ccagugcgccgaaacguau

SEQ ID NO: 1046807 - RNA, 19 nt, Homo sapiens
ggacagugcagagcugaga

SEQ ID NO: 1046808 - RNA, 19 nt, Homo sapiens
ggaacuacaagaaccacaa

SEQ ID NO: 1046809 - RNA, 19 nt, Homo sapiens
aagcgaacacggaauauau

SEQ ID NO: 1046810 - RNA, 19 nt, Homo sapiens
gugcaaagucugcggcaaa

SEQ ID NO: 1046811 - RNA, 19 nt, Homo sapiens
uacaagcgaacacggaaua

SEQ ID NO: 1046812 - RNA, 19 nt, Homo sapiens
aaccuaaccuuccauaugc

SEQ ID NO: 1046813 - RNA, 19 nt, Homo sapiens
cagagaggcuaaaaucuau

SEQ ID NO: 1046814 - RNA, 19 nt, Homo sapiens
cgagaagcaguacaaaugu

SEQ ID NO: 1046815 - RNA, 19 nt, Homo sapiens
gaacuacaagaaccacaag

SEQ ID NO: 1046816 - RNA, 19 nt, Homo sapiens
uaaauccagugcgccgaaa

SEQ ID NO: 1046817 - RNA, 19 nt, Homo sapiens
gcucggaacgcaucuccuu

SEQ ID NO: 1046818 - RNA, 19 nt, Homo sapiens
ccagaccguucgugugcaa

SEQ ID NO: 1046819 - RNA, 19 nt, Homo sapiens
guguuuaacgcucacuaua

SEQ ID NO: 1046820 - RNA, 19 nt, Homo sapiens
ccaagacacuggccuuuuc

SEQ ID NO: 1046821 - RNA, 19 nt, Homo sapiens
uguuuaacgcucacuauaa

SEQ ID NO: 1046822 - RNA, 19 nt, Homo sapiens
gcgccgaaacguauuuaau

SEQ ID NO: 1046823 - RNA, 19 nt, Homo sapiens
acaaauguaccaucugcaa

SEQ ID NO: 1046824 - RNA, 19 nt, Homo sapiens
cgucuggccuccucaaugc

SEQ ID NO: 1046825 - RNA, 19 nt, Homo sapiens
ccgcaaaggaccugacuag

SEQ ID NO: 1046826 - RNA, 19 nt, Homo sapiens
uggagcagguacugaagga

SEQ ID NO: 1046827 - RNA, 19 nt, Homo sapiens
agaaacaugugcgcaaacu

SEQ ID NO: 1046828 - RNA, 19 nt, Homo sapiens
gcagauggcaagcccaaaa

SEQ ID NO: 1046829 - RNA, 19 nt, Homo sapiens
gcucuacuacuucaacuac

SEQ ID NO: 1046830 - RNA, 19 nt, Homo sapiens
cucgaugacuggcagcaaa

SEQ ID NO: 1046831 - RNA, 19 nt, Homo sapiens
gagcgcaucauggccaaga

SEQ ID NO: 1046832 - RNA, 19 nt, Homo sapiens
ugaaaacagaucacacaua

SEQ ID NO: 1046833 - RNA, 19 nt, Homo sapiens
acaacgacaagaagccuuu

SEQ ID NO: 1046834 - RNA, 19 nt, Homo sapiens
ggaaaagccacauaaaugc

SEQ ID NO: 1046835 - RNA, 19 nt, Homo sapiens
acagaucacacauauaaac

SEQ ID NO: 1046836 - RNA, 19 nt, Homo sapiens
gccagcggcuugugcaaaa

SEQ ID NO: 1046837 - RNA, 19 nt, Homo sapiens
ugacuuaaagaaacaugug

SEQ ID NO: 1046838 - RNA, 19 nt, Homo sapiens
gcacacccacaacgacaag

SEQ ID NO: 1046839 - RNA, 19 nt, Homo sapiens
aaauguaccaucugcaaca

SEQ ID NO: 1046840 - RNA, 19 nt, Homo sapiens
gcgaacacggaauauauac

SEQ ID NO: 1046841 - RNA, 19 nt, Homo sapiens
cggcuucccuggagaccau

SEQ ID NO: 1046842 - RNA, 19 nt, Homo sapiens
agcgaacacggaauauaua

SEQ ID NO: 1046843 - RNA, 19 nt, Homo sapiens
ucaagccgcaggucaucaa

SEQ ID NO: 1046844 - RNA, 19 nt, Homo sapiens
guacaagcgaacacggaau

SEQ ID NO: 1046845 - RNA, 19 nt, Homo sapiens
gccccuagccaucuuuaua

SEQ ID NO: 1046846 - RNA, 19 nt, Homo sapiens
ggcgagaagcaguacaaau

SEQ ID NO: 1046847 - RNA, 19 nt, Homo sapiens
gcggcgagaagcaguacaa

SEQ ID NO: 1046848 - RNA, 19 nt, Homo sapiens
gguguuuaacgcucacuau

SEQ ID NO: 1046849 - RNA, 19 nt, Homo sapiens
caagaugacccaccuauua

SEQ ID NO: 1046850 - RNA, 19 nt, Homo sapiens
gaacagggaagaaaccuaa

SEQ ID NO: 1046851 - RNA, 19 nt, Homo sapiens
caaccaagccaguuuaaug

SEQ ID NO: 1046852 - RNA, 19 nt, Homo sapiens
caacaaccaagccaguuua

SEQ ID NO: 1046853 - RNA, 19 nt, Homo sapiens
gacaugagacuacuagaaa

SEQ ID NO: 1046854 - RNA, 19 nt, Homo sapiens
gcaagcaccuacaggacuu

SEQ ID NO: 1046855 - RNA, 19 nt, Homo sapiens
cgacauugcuggcuauuac

SEQ ID NO: 1046856 - RNA, 19 nt, Homo sapiens
ccaagccaguuuaauggua

SEQ ID NO: 1046857 - RNA, 19 nt, Homo sapiens
ugacccaccuauuaucuuu

SEQ ID NO: 1046858 - RNA, 19 nt, Homo sapiens
gaauacaugacauugguaa

SEQ ID NO: 1046859 - RNA, 19 nt, Homo sapiens
ggacuucaccgauuuccaa

SEQ ID NO: 1046860 - RNA, 19 nt, Homo sapiens
gacagcagcuugguucaug

SEQ ID NO: 1046861 - RNA, 19 nt, Homo sapiens
ugagaucucccgcuacuuu

SEQ ID NO: 1046862 - RNA, 19 nt, Homo sapiens
cagaauacaugacauuggu

SEQ ID NO: 1046863 - RNA, 19 nt, Homo sapiens
guaccgagcucagcagauc

SEQ ID NO: 1046864 - RNA, 19 nt, Homo sapiens
gcucccaucuccaugaaga

SEQ ID NO: 1046865 - RNA, 19 nt, Homo sapiens
gcuauuacccucuggaugu

SEQ ID NO: 1046866 - RNA, 19 nt, Homo sapiens
acgcugaacuugccacuga

SEQ ID NO: 1046867 - RNA, 19 nt, Homo sapiens
gcuuggaccucaucagugu

SEQ ID NO: 1046868 - RNA, 19 nt, Homo sapiens
gcacacuggcccaagauga

SEQ ID NO: 1046869 - RNA, 19 nt, Homo sapiens
gagcucccaucuccaugaa

SEQ ID NO: 1046870 - RNA, 19 nt, Homo sapiens
cgacugagcuuggcaaacg

SEQ ID NO: 1046871 - RNA, 19 nt, Homo sapiens
ggaccuacauuugccagau

SEQ ID NO: 1046872 - RNA, 19 nt, Homo sapiens
cgacaugagacuacuagaa

SEQ ID NO: 1046873 - RNA, 19 nt, Homo sapiens
gcaggcaccuacagcaucu

SEQ ID NO: 1046874 - RNA, 19 nt, Homo sapiens
uggaggacuucaccgauuu

SEQ ID NO: 1046875 - RNA, 19 nt, Homo sapiens
ugagacuacuagaaagaaa

SEQ ID NO: 1046876 - RNA, 19 nt, Homo sapiens
gcucugcaggugccacuua

SEQ ID NO: 1046877 - RNA, 19 nt, Homo sapiens
gaccuaaagcgacaugaga

SEQ ID NO: 1046878 - RNA, 19 nt, Homo sapiens
gcaagcagcguaggacugu

SEQ ID NO: 1046879 - RNA, 19 nt, Homo sapiens
agagaccacuguuaagaca

SEQ ID NO: 1046880 - RNA, 19 nt, Homo sapiens
gggccucccuugugcugaa

SEQ ID NO: 1046881 - RNA, 19 nt, Homo sapiens
guucagaauacaugacauu

SEQ ID NO: 1046882 - RNA, 19 nt, Homo sapiens
gaucaccaccucucuguac

SEQ ID NO: 1046883 - RNA, 19 nt, Homo sapiens
gaacagccuugggagucau

SEQ ID NO: 1046884 - RNA, 19 nt, Homo sapiens
ggaacagggaagaaaccua

SEQ ID NO: 1046885 - RNA, 19 nt, Homo sapiens
cauccaagcuuccccuaaa

SEQ ID NO: 1046886 - RNA, 19 nt, Homo sapiens
gaucauccagcucaacauc

SEQ ID NO: 1046887 - RNA, 19 nt, Homo sapiens
gaccuacauuugccagauc

SEQ ID NO: 1046888 - RNA, 19 nt, Homo sapiens
cuggaggacuucaccgauu

SEQ ID NO: 1046889 - RNA, 19 nt, Homo sapiens
agcagucucuuccuucuug

SEQ ID NO: 1046890 - RNA, 19 nt, Homo sapiens
gcagagggaacagggaaga

SEQ ID NO: 1046891 - RNA, 19 nt, Homo sapiens
aagaugacccaccuauuau

SEQ ID NO: 1046892 - RNA, 19 nt, Homo sapiens
ccaagaugacccaccuauu

SEQ ID NO: 1046893 - RNA, 19 nt, Homo sapiens
ccaguuuaaugguaggaau

SEQ ID NO: 1046894 - RNA, 19 nt, Homo sapiens
acaacaaccaagccaguuu

SEQ ID NO: 1046895 - RNA, 19 nt, Homo sapiens
caugagacuacuagaaaga

SEQ ID NO: 1046896 - RNA, 19 nt, Homo sapiens
gcacccaacgcugaacuug

SEQ ID NO: 1046897 - RNA, 19 nt, Homo sapiens
gaccuagcaucuccuuggu

SEQ ID NO: 1046898 - RNA, 19 nt, Homo sapiens
gaccgcacagcgcguguaa

SEQ ID NO: 1046899 - RNA, 19 nt, Homo sapiens
gaugacccaccuauuaucu

SEQ ID NO: 1046900 - RNA, 19 nt, Homo sapiens
gcgacauugcuggcuauua

SEQ ID NO: 1046901 - RNA, 19 nt, Homo sapiens
gagcucagcagaucaucca

SEQ ID NO: 1046902 - RNA, 19 nt, Homo sapiens
ccagcagucucuuccuucu

SEQ ID NO: 1046903 - RNA, 19 nt, Homo sapiens
gggcuuggaccucaucagu

SEQ ID NO: 1046904 - RNA, 19 nt, Homo sapiens
cuaaagcgacaugagacua

SEQ ID NO: 1046905 - RNA, 19 nt, Homo sapiens
agaacagccuugggaguca

SEQ ID NO: 1046906 - RNA, 19 nt, Homo sapiens
ccgcuacuuucuccagaug

SEQ ID NO: 1046907 - RNA, 19 nt, Homo sapiens
acccaccuauuaucuuuga

SEQ ID NO: 1046908 - RNA, 19 nt, Homo sapiens
ccuggagccugcacaacug

SEQ ID NO: 1046909 - RNA, 19 nt, Homo sapiens
ccagggucgccaagaauga

SEQ ID NO: 1046910 - RNA, 19 nt, Homo sapiens
gcguaggacuguggagaag

SEQ ID NO: 1046911 - RNA, 19 nt, Homo sapiens
ccggugaaagugaaagaaa

SEQ ID NO: 1046912 - RNA, 19 nt, Homo sapiens
uaaagcgacaugagacuac

SEQ ID NO: 1046913 - RNA, 19 nt, Homo sapiens
ugugagaucucccgcuacu

SEQ ID NO: 1046914 - RNA, 19 nt, Homo sapiens
caacccaaacaacaaccaa

SEQ ID NO: 1046915 - RNA, 19 nt, Homo sapiens
acaugagacuacuagaaag

SEQ ID NO: 1046916 - RNA, 19 nt, Homo sapiens
ggaggacuucaccgauuuc

SEQ ID NO: 1046917 - RNA, 19 nt, Homo sapiens
agagggaacagggaagaaa

SEQ ID NO: 1046918 - RNA, 19 nt, Homo sapiens
gagaucucccgcuacuuuc

SEQ ID NO: 1046919 - RNA, 19 nt, Homo sapiens
guuuaaugguaggaauuug

SEQ ID NO: 1046920 - RNA, 19 nt, Homo sapiens
cagaucauccagcucaaca

SEQ ID NO: 1046921 - RNA, 19 nt, Homo sapiens
gcaagaaacuguagagaug

SEQ ID NO: 1046922 - RNA, 19 nt, Homo sapiens
ugacaaauaugccaguuua

SEQ ID NO: 1046923 - RNA, 19 nt, Homo sapiens
gcacagaaguggaauugaa

SEQ ID NO: 1046924 - RNA, 19 nt, Homo sapiens
gaucuaagccacuaaauaa

SEQ ID NO: 1046925 - RNA, 19 nt, Homo sapiens
acaaucagcuugagaauuu

SEQ ID NO: 1046926 - RNA, 19 nt, Homo sapiens
gaacgagacugccaaacaa

SEQ ID NO: 1046927 - RNA, 19 nt, Homo sapiens
gaaaggaugacaaucaaua

SEQ ID NO: 1046928 - RNA, 19 nt, Homo sapiens
gaacaugcaugccacaguu

SEQ ID NO: 1046929 - RNA, 19 nt, Homo sapiens
caaaguacacccauuauuu

SEQ ID NO: 1046930 - RNA, 19 nt, Homo sapiens
gaaguugguuucuuaugaa

SEQ ID NO: 1046931 - RNA, 19 nt, Homo sapiens
agaagaugaugcagaauua

SEQ ID NO: 1046932 - RNA, 19 nt, Homo sapiens
gaaaguguauguaaacuac

SEQ ID NO: 1046933 - RNA, 19 nt, Homo sapiens
aaucaaagcugaaggagaa

SEQ ID NO: 1046934 - RNA, 19 nt, Homo sapiens
aaucagaacucuccuuaaa

SEQ ID NO: 1046935 - RNA, 19 nt, Homo sapiens
ggaauugaaucugcucuaa

SEQ ID NO: 1046936 - RNA, 19 nt, Homo sapiens
caacugaaagucacgauua

SEQ ID NO: 1046937 - RNA, 19 nt, Homo sapiens
gugcauaccuugaauaaag

SEQ ID NO: 1046938 - RNA, 19 nt, Homo sapiens
gcauaugcaugucucaauu

SEQ ID NO: 1046939 - RNA, 19 nt, Homo sapiens
cuaagaagcuuucacuaau

SEQ ID NO: 1046940 - RNA, 19 nt, Homo sapiens
gagcuucggucauuuggaa

SEQ ID NO: 1046941 - RNA, 19 nt, Homo sapiens
gcaacaauaucuaacauac

SEQ ID NO: 1046942 - RNA, 19 nt, Homo sapiens
ugaaguugguuucuuauga

SEQ ID NO: 1046943 - RNA, 19 nt, Homo sapiens
acacagaucuuucccuuuc

SEQ ID NO: 1046944 - RNA, 19 nt, Homo sapiens
ggacaaacuccauaaugaa

SEQ ID NO: 1046945 - RNA, 19 nt, Homo sapiens
agaccucucuuuaguuuaa

SEQ ID NO: 1046946 - RNA, 19 nt, Homo sapiens
uaacaaaacugaagcaaga

SEQ ID NO: 1046947 - RNA, 19 nt, Homo sapiens
gagaauccauguugaccaa

SEQ ID NO: 1046948 - RNA, 19 nt, Homo sapiens
uaaaucagaacucuccuua

SEQ ID NO: 1046949 - RNA, 19 nt, Homo sapiens
cuagaccucucuuuaguuu

SEQ ID NO: 1046950 - RNA, 19 nt, Homo sapiens
gggaaucuaucuucuagga

SEQ ID NO: 1046951 - RNA, 19 nt, Homo sapiens
gaagcaaaguacacccauu

SEQ ID NO: 1046952 - RNA, 19 nt, Homo sapiens
ggagacagccugcguuaau

SEQ ID NO: 1046953 - RNA, 19 nt, Homo sapiens
ggaucuaagccacuaaaua

SEQ ID NO: 1046954 - RNA, 19 nt, Homo sapiens
gagauggacauuagaauug

SEQ ID NO: 1046955 - RNA, 19 nt, Homo sapiens
caacagaugcugcagaaug

SEQ ID NO: 1046956 - RNA, 19 nt, Homo sapiens
gcauuagagugccagaauu

SEQ ID NO: 1046957 - RNA, 19 nt, Homo sapiens
ugccucagcuuuaugguua

SEQ ID NO: 1046958 - RNA, 19 nt, Homo sapiens
gcaaaguacacccauuauu

SEQ ID NO: 1046959 - RNA, 19 nt, Homo sapiens
ugucauggcugaguaguuu

SEQ ID NO: 1046960 - RNA, 19 nt, Homo sapiens
gaacacacacuacuccaau

SEQ ID NO: 1046961 - RNA, 19 nt, Homo sapiens
gcugcuugguugauuaaua

SEQ ID NO: 1046962 - RNA, 19 nt, Homo sapiens
gagacagccugcguuaauu

SEQ ID NO: 1046963 - RNA, 19 nt, Homo sapiens
uaaaggagaccaagggauu

SEQ ID NO: 1046964 - RNA, 19 nt, Homo sapiens
gagccacgcuggacucugu

SEQ ID NO: 1046965 - RNA, 19 nt, Homo sapiens
aaagucagguuauggagaa

SEQ ID NO: 1046966 - RNA, 19 nt, Homo sapiens
ggaugacaaucaauacaau

SEQ ID NO: 1046967 - RNA, 19 nt, Homo sapiens
agagacagauaaugaagaa

SEQ ID NO: 1046968 - RNA, 19 nt, Homo sapiens
gaagaaagcguugcagaag

SEQ ID NO: 1046969 - RNA, 19 nt, Homo sapiens
gaucuuuacuuaugcaucu

SEQ ID NO: 1046970 - RNA, 19 nt, Homo sapiens
gaugacaggucgcaugaag

SEQ ID NO: 1046971 - RNA, 19 nt, Homo sapiens
aaacagagcuuaacaaaac

SEQ ID NO: 1046972 - RNA, 19 nt, Homo sapiens
gacaaacuccauaaugaaa

SEQ ID NO: 1046973 - RNA, 19 nt, Homo sapiens
gauuaggacugacaauaag

SEQ ID NO: 1046974 - RNA, 19 nt, Homo sapiens
agagaacgcuuuuagauaa

SEQ ID NO: 1046975 - RNA, 19 nt, Homo sapiens
cugcuugguugauuaauaa

SEQ ID NO: 1046976 - RNA, 19 nt, Homo sapiens
cugaugaucuuuacuuaug

SEQ ID NO: 1046977 - RNA, 19 nt, Homo sapiens
aaacuucaguauccucauu

SEQ ID NO: 1046978 - RNA, 19 nt, Homo sapiens
uaagaagcuuucacuaauc

SEQ ID NO: 1046979 - RNA, 19 nt, Homo sapiens
gaauuggcauuguggaaca

SEQ ID NO: 1046980 - RNA, 19 nt, Homo sapiens
caaaagcagugguagaaaa

SEQ ID NO: 1046981 - RNA, 19 nt, Homo sapiens
cauuagagugccagaauua

SEQ ID NO: 1046982 - RNA, 19 nt, Homo sapiens
gcaugaagaucagccucua

SEQ ID NO: 1046983 - RNA, 19 nt, Homo sapiens
guacacccauuauuuaugc

SEQ ID NO: 1046984 - RNA, 19 nt, Homo sapiens
aaggagaaguccaacauga

SEQ ID NO: 1046985 - RNA, 19 nt, Homo sapiens
gaaaagggcagcagcauga

SEQ ID NO: 1046986 - RNA, 19 nt, Homo sapiens
ucucugagguuauggaaga

SEQ ID NO: 1046987 - RNA, 19 nt, Homo sapiens
cgauuaggacugacaauaa

SEQ ID NO: 1046988 - RNA, 19 nt, Homo sapiens
cacaacagaugcugcagaa

SEQ ID NO: 1046989 - RNA, 19 nt, Homo sapiens
aagaagagacagauaauga

SEQ ID NO: 1046990 - RNA, 19 nt, Homo sapiens
ggaagaagagacagauaau

SEQ ID NO: 1046991 - RNA, 19 nt, Homo sapiens
aagcaaaguacacccauua

SEQ ID NO: 1046992 - RNA, 19 nt, Homo sapiens
gucagucacucauguuuga

SEQ ID NO: 1046993 - RNA, 19 nt, Homo sapiens
ucuaagaagcuuucacuaa

SEQ ID NO: 1046994 - RNA, 19 nt, Homo sapiens
acacacuacuccaaucaaa

SEQ ID NO: 1046995 - RNA, 19 nt, Homo sapiens
gaauccauguugaccaaau

SEQ ID NO: 1046996 - RNA, 19 nt, Homo sapiens
caauauacccaguagaaga

SEQ ID NO: 1046997 - RNA, 19 nt, Homo sapiens
gaagagaaggugcauaugc

SEQ ID NO: 1046998 - RNA, 19 nt, Homo sapiens
gcagugaucauaagugcuu

SEQ ID NO: 1046999 - RNA, 19 nt, Homo sapiens
gaagauuaaacagagcuua

SEQ ID NO: 1047000 - RNA, 19 nt, Homo sapiens
gaauugaaucugcucuaaa

SEQ ID NO: 1047001 - RNA, 19 nt, Homo sapiens
ugaagaauuuguggaagaa

SEQ ID NO: 1047002 - RNA, 19 nt, Homo sapiens
gccaauauacccaguagaa

SEQ ID NO: 1047003 - RNA, 19 nt, Homo sapiens
gaagaugguaggcaggauu

SEQ ID NO: 1047004 - RNA, 19 nt, Homo sapiens
ggaugaagaauuuguggaa

SEQ ID NO: 1047005 - RNA, 19 nt, Homo sapiens
gaagaugaugcagaauuaa

SEQ ID NO: 1047006 - RNA, 19 nt, Homo sapiens
gcuauguucuugauugcuu

SEQ ID NO: 1047007 - RNA, 19 nt, Homo sapiens
gacaaucaauacaaugaca

SEQ ID NO: 1047008 - RNA, 19 nt, Homo sapiens
guacugaugaucuuuacuu

SEQ ID NO: 1047009 - RNA, 19 nt, Homo sapiens
gaagaucagccucuaguac

SEQ ID NO: 1047010 - RNA, 19 nt, Homo sapiens
agaaagcguugcagaagau

SEQ ID NO: 1047011 - RNA, 19 nt, Homo sapiens
uaacucagcuuggguucug

SEQ ID NO: 1047012 - RNA, 19 nt, Homo sapiens
guauguaaacuaccugaaa

SEQ ID NO: 1047013 - RNA, 19 nt, Homo sapiens
ggagaaaguguauguaaac

SEQ ID NO: 1047014 - RNA, 19 nt, Homo sapiens
caggagaaaguguauguaa

SEQ ID NO: 1047015 - RNA, 19 nt, Homo sapiens
ccagacauaucacuuggau

SEQ ID NO: 1047016 - RNA, 19 nt, Homo sapiens
gaagaagagacagauaaug

SEQ ID NO: 1047017 - RNA, 19 nt, Homo sapiens
uaguauaagccaccuauuu

SEQ ID NO: 1047018 - RNA, 19 nt, Homo sapiens
uggaagaacugcagauuuu

SEQ ID NO: 1047019 - RNA, 19 nt, Homo sapiens
gaaauuacuaggacuuugg

SEQ ID NO: 1047020 - RNA, 19 nt, Homo sapiens
uaaaggcccagacauauca

SEQ ID NO: 1047021 - RNA, 19 nt, Homo sapiens
gaagaacaguugagaauug

SEQ ID NO: 1047022 - RNA, 19 nt, Homo sapiens
ggaccuaugugguguauug

SEQ ID NO: 1047023 - RNA, 19 nt, Homo sapiens
gaacaaagaaagauucaug

SEQ ID NO: 1047024 - RNA, 19 nt, Homo sapiens
aaacuguccuucucauuaa

SEQ ID NO: 1047025 - RNA, 19 nt, Homo sapiens
ggaugaaacuagaacaaga

SEQ ID NO: 1047026 - RNA, 19 nt, Homo sapiens
gagcagaucacauuguaaa

SEQ ID NO: 1047027 - RNA, 19 nt, Homo sapiens
uaugguagcuucauguuga

SEQ ID NO: 1047028 - RNA, 19 nt, Homo sapiens
ccuaugugguguauuguua

SEQ ID NO: 1047029 - RNA, 19 nt, Homo sapiens
ggaagaaacagcacgaaga

SEQ ID NO: 1047030 - RNA, 19 nt, Homo sapiens
ccaaaucucgggaaaguaa

SEQ ID NO: 1047031 - RNA, 19 nt, Homo sapiens
ucuaaggagugacguauuu

SEQ ID NO: 1047032 - RNA, 19 nt, Homo sapiens
gcagcaagcacaacaagaa

SEQ ID NO: 1047033 - RNA, 19 nt, Homo sapiens
gaacgacaacgucaacaga

SEQ ID NO: 1047034 - RNA, 19 nt, Homo sapiens
ggaugaaauugaacgagaa

SEQ ID NO: 1047035 - RNA, 19 nt, Homo sapiens
gaaacuagaacaagaacga

SEQ ID NO: 1047036 - RNA, 19 nt, Homo sapiens
gaagaacaaagaaagauuc

SEQ ID NO: 1047037 - RNA, 19 nt, Homo sapiens
guugagaauuguugaagaa

SEQ ID NO: 1047038 - RNA, 19 nt, Homo sapiens
aagagcagaucacauugua

SEQ ID NO: 1047039 - RNA, 19 nt, Homo sapiens
uagaagaauugguagcaaa

SEQ ID NO: 1047040 - RNA, 19 nt, Homo sapiens
agaaacagcacgaagagua

SEQ ID NO: 1047041 - RNA, 19 nt, Homo sapiens
gagaggaggaggagaagaa

SEQ ID NO: 1047042 - RNA, 19 nt, Homo sapiens
gcagcagccuggacgagaa

SEQ ID NO: 1047043 - RNA, 19 nt, Homo sapiens
ucagaucauuguuguauuc

SEQ ID NO: 1047044 - RNA, 19 nt, Homo sapiens
agccgcagcugccaucuua

SEQ ID NO: 1047045 - RNA, 19 nt, Homo sapiens
gaggaaaggaugaaacuag

SEQ ID NO: 1047046 - RNA, 19 nt, Homo sapiens
gaagaaacagcacgaagag

SEQ ID NO: 1047047 - RNA, 19 nt, Homo sapiens
ggauuaaauugcaaacucu

SEQ ID NO: 1047048 - RNA, 19 nt, Homo sapiens
gaagaacucgagcgacaga

SEQ ID NO: 1047049 - RNA, 19 nt, Homo sapiens
aaggaaggaugaaauugaa

SEQ ID NO: 1047050 - RNA, 19 nt, Homo sapiens
gaaaaggaaggaugaaauu

SEQ ID NO: 1047051 - RNA, 19 nt, Homo sapiens
gaagagcagaucacauugu

SEQ ID NO: 1047052 - RNA, 19 nt, Homo sapiens
gggcuaugcucugcaauuc

SEQ ID NO: 1047053 - RNA, 19 nt, Homo sapiens
gaugaaacuagaacaagaa

SEQ ID NO: 1047054 - RNA, 19 nt, Homo sapiens
aaaggaaggaugaaauuga

SEQ ID NO: 1047055 - RNA, 19 nt, Homo sapiens
ggaaaguuagcuuguucua

SEQ ID NO: 1047056 - RNA, 19 nt, Homo sapiens
gugaggagcuagagcgaau

SEQ ID NO: 1047057 - RNA, 19 nt, Homo sapiens
gcacgaagaguagaagaau

SEQ ID NO: 1047058 - RNA, 19 nt, Homo sapiens
caacagaaagaagaacaaa

SEQ ID NO: 1047059 - RNA, 19 nt, Homo sapiens
gaauacuggaagagaauaa

SEQ ID NO: 1047060 - RNA, 19 nt, Homo sapiens
ggaggaagaacuggagaaa

SEQ ID NO: 1047061 - RNA, 19 nt, Homo sapiens
gaaacagcacgaagaguag

SEQ ID NO: 1047062 - RNA, 19 nt, Homo sapiens
gugauugcauugggaaauu

SEQ ID NO: 1047063 - RNA, 19 nt, Homo sapiens
ucaaauccuuaucagauca

SEQ ID NO: 1047064 - RNA, 19 nt, Homo sapiens
ggaaaggaugaaacuagaa

SEQ ID NO: 1047065 - RNA, 19 nt, Homo sapiens
gaaagauucaugaggaaag

SEQ ID NO: 1047066 - RNA, 19 nt, Homo sapiens
guagaagaauugguagcaa

SEQ ID NO: 1047067 - RNA, 19 nt, Homo sapiens
aacuauggauggucugaua

SEQ ID NO: 1047068 - RNA, 19 nt, Homo sapiens
aggaagagcagaucacauu

SEQ ID NO: 1047069 - RNA, 19 nt, Homo sapiens
ggaagagaauaaccgaaaa

SEQ ID NO: 1047070 - RNA, 19 nt, Homo sapiens
gccaaacgcaucauggaaa

SEQ ID NO: 1047071 - RNA, 19 nt, Homo sapiens
aagaguagaagaauuggua

SEQ ID NO: 1047072 - RNA, 19 nt, Homo sapiens
gugauacugucgcucuuga

SEQ ID NO: 1047073 - RNA, 19 nt, Homo sapiens
aggaaaggaugaaacuaga

SEQ ID NO: 1047074 - RNA, 19 nt, Homo sapiens
aagaaagauucaugaggaa

SEQ ID NO: 1047075 - RNA, 19 nt, Homo sapiens
ggaagagcagaucacauug

SEQ ID NO: 1047076 - RNA, 19 nt, Homo sapiens
ugaaauugaacgagaaguu

SEQ ID NO: 1047077 - RNA, 19 nt, Homo sapiens
gaaauucccaggguauuac

SEQ ID NO: 1047078 - RNA, 19 nt, Homo sapiens
gaaaggaugaaacuagaac

SEQ ID NO: 1047079 - RNA, 19 nt, Homo sapiens
ucaccuguuuggauucuau

SEQ ID NO: 1047080 - RNA, 19 nt, Homo sapiens
gagcgaauacuggaagaga

SEQ ID NO: 1047081 - RNA, 19 nt, Homo sapiens
gucaaauccuuaucagauc

SEQ ID NO: 1047082 - RNA, 19 nt, Homo sapiens
ccgaagaacaguugagaau

SEQ ID NO: 1047083 - RNA, 19 nt, Homo sapiens
cacgaagaguagaagaauu

SEQ ID NO: 1047084 - RNA, 19 nt, Homo sapiens
aguauugucucuguucauu

SEQ ID NO: 1047085 - RNA, 19 nt, Homo sapiens
gcucuugauguuccugaua

SEQ ID NO: 1047086 - RNA, 19 nt, Homo sapiens
cgaagaacaguugagaauu

SEQ ID NO: 1047087 - RNA, 19 nt, Homo sapiens
uggaagagaauaaccgaaa

SEQ ID NO: 1047088 - RNA, 19 nt, Homo sapiens
aaaacuguccuucucauua

SEQ ID NO: 1047089 - RNA, 19 nt, Homo sapiens
uaaggaaacaguuggucaa

SEQ ID NO: 1047090 - RNA, 19 nt, Homo sapiens
gauacugucgcucuugaug

SEQ ID NO: 1047091 - RNA, 19 nt, Homo sapiens
ggguauuacuggaccuaug

SEQ ID NO: 1047092 - RNA, 19 nt, Homo sapiens
gauggucugauaaggcuuu

SEQ ID NO: 1047093 - RNA, 19 nt, Homo sapiens
cuuaucagaucauuguugu

SEQ ID NO: 1047094 - RNA, 19 nt, Homo sapiens
acgacaacgucaacagaaa

SEQ ID NO: 1047095 - RNA, 19 nt, Homo sapiens
caaacuggccgaagaacag

SEQ ID NO: 1047096 - RNA, 19 nt, Homo sapiens
ggagcuagagcgaauacug

SEQ ID NO: 1047097 - RNA, 19 nt, Homo sapiens
agucaaauccuuaucagau

SEQ ID NO: 1047098 - RNA, 19 nt, Homo sapiens
gcgaauacuggaagagaau

SEQ ID NO: 1047099 - RNA, 19 nt, Homo sapiens
ccaaacgcaucauggaaaa

SEQ ID NO: 1047100 - RNA, 19 nt, Homo sapiens
acgaagaguagaagaauug

SEQ ID NO: 1047101 - RNA, 19 nt, Homo sapiens
uacugucgcucuugauguu

SEQ ID NO: 1047102 - RNA, 19 nt, Homo sapiens
gguauuacuggaccuaugu

SEQ ID NO: 1047103 - RNA, 19 nt, Homo sapiens
uuaaaccaguguccuugug

SEQ ID NO: 1047104 - RNA, 19 nt, Homo sapiens
gacaacgucaacagaaaga

SEQ ID NO: 1047105 - RNA, 19 nt, Homo sapiens
aagaacaguugagaauugu

SEQ ID NO: 1047106 - RNA, 19 nt, Homo sapiens
uaaaccaguguccuuguga

SEQ ID NO: 1047107 - RNA, 19 nt, Homo sapiens
ucugcuugcuacaucauaa

SEQ ID NO: 1047108 - RNA, 19 nt, Homo sapiens
ggaggaagaacgugcaaaa

SEQ ID NO: 1047109 - RNA, 19 nt, Homo sapiens
cuggaaaguuagcuuguuc

SEQ ID NO: 1047110 - RNA, 19 nt, Homo sapiens
aggauuaaauugcaaacuc

SEQ ID NO: 1047111 - RNA, 19 nt, Homo sapiens
ggaagccaaacgcaucaug

SEQ ID NO: 1047112 - RNA, 19 nt, Homo sapiens
gaggaagccaaacgcauca

SEQ ID NO: 1047113 - RNA, 19 nt, Homo sapiens
gaaggaugaaauugaacga

SEQ ID NO: 1047114 - RNA, 19 nt, Homo sapiens
gcgcuacggguuucucguu

SEQ ID NO: 1047115 - RNA, 19 nt, Homo sapiens
gcuccaagcacaccaagag

SEQ ID NO: 1047116 - RNA, 19 nt, Homo sapiens
guugaagaacaaagaaaga

SEQ ID NO: 1047117 - RNA, 19 nt, Homo sapiens
gagcagcaagcacaacaag

SEQ ID NO: 1047118 - RNA, 19 nt, Homo sapiens
guucaguauugucucuguu

SEQ ID NO: 1047119 - RNA, 19 nt, Homo sapiens
ugauacagguaaggaaaca

SEQ ID NO: 1047120 - RNA, 19 nt, Homo sapiens
cagcaagaaauagaagaaa

SEQ ID NO: 1047121 - RNA, 19 nt, Homo sapiens
cauaagaacugcuagcaaa

SEQ ID NO: 1047122 - RNA, 19 nt, Homo sapiens
cagaaugacugauuaagug

SEQ ID NO: 1047123 - RNA, 19 nt, Homo sapiens
caucaaagacaaugaauga

SEQ ID NO: 1047124 - RNA, 19 nt, Homo sapiens
uuaaagaccuuguuuguac

SEQ ID NO: 1047125 - RNA, 19 nt, Homo sapiens
cggacagccucuccuauua

SEQ ID NO: 1047126 - RNA, 19 nt, Homo sapiens
ggagagccgugucaacuuc

SEQ ID NO: 1047127 - RNA, 19 nt, Homo sapiens
guucauacuuucuugugua

SEQ ID NO: 1047128 - RNA, 19 nt, Homo sapiens
gggcguggauguaggauug

SEQ ID NO: 1047129 - RNA, 19 nt, Homo sapiens
gaaaggugcaaacgucaaa

SEQ ID NO: 1047130 - RNA, 19 nt, Homo sapiens
acaaguggcucagugaauu

SEQ ID NO: 1047131 - RNA, 19 nt, Homo sapiens
gcaaggaggccaugugcuu

SEQ ID NO: 1047132 - RNA, 19 nt, Homo sapiens
gggaacccuuugagauuaa

SEQ ID NO: 1047133 - RNA, 19 nt, Homo sapiens
ggaagacggcccuguucua

SEQ ID NO: 1047134 - RNA, 19 nt, Homo sapiens
gaagguugguggcaagucu

SEQ ID NO: 1047135 - RNA, 19 nt, Homo sapiens
agaccucacucuucucuug

SEQ ID NO: 1047136 - RNA, 19 nt, Homo sapiens
gcacuuugaggaaccuuaa

SEQ ID NO: 1047137 - RNA, 19 nt, Homo sapiens
gacaaugaaugaggaugaa

SEQ ID NO: 1047138 - RNA, 19 nt, Homo sapiens
guacagauggugcuaguca

SEQ ID NO: 1047139 - RNA, 19 nt, Homo sapiens
gaagaaacgcuccaaucca

SEQ ID NO: 1047140 - RNA, 19 nt, Homo sapiens
uuaagugccuugcgaaucu

SEQ ID NO: 1047141 - RNA, 19 nt, Homo sapiens
gaccaaacaguaucugaug

SEQ ID NO: 1047142 - RNA, 19 nt, Homo sapiens
augcaaagcugaagauucu

SEQ ID NO: 1047143 - RNA, 19 nt, Homo sapiens
gccaugugcuucaaugcaa

SEQ ID NO: 1047144 - RNA, 19 nt, Homo sapiens
caacccagaaugacugauu

SEQ ID NO: 1047145 - RNA, 19 nt, Homo sapiens
agaccuuguuuguacauaa

SEQ ID NO: 1047146 - RNA, 19 nt, Homo sapiens
ggggaacccuuugagauua

SEQ ID NO: 1047147 - RNA, 19 nt, Homo sapiens
aacccagaaugacugauua

SEQ ID NO: 1047148 - RNA, 19 nt, Homo sapiens
acgaguggcugaugaagga

SEQ ID NO: 1047149 - RNA, 19 nt, Homo sapiens
gccuugcgaaucuuuauua

SEQ ID NO: 1047150 - RNA, 19 nt, Homo sapiens
uaaagaccuuguuuguaca

SEQ ID NO: 1047151 - RNA, 19 nt, Homo sapiens
ucagugaauuugacuugga

SEQ ID NO: 1047152 - RNA, 19 nt, Homo sapiens
gagccagacccuuguccua

SEQ ID NO: 1047153 - RNA, 19 nt, Homo sapiens
gaaggcgaguuuucuuuug

SEQ ID NO: 1047154 - RNA, 19 nt, Homo sapiens
gcaaggcccaucucaugau

SEQ ID NO: 1047155 - RNA, 19 nt, Homo sapiens
gcucagugaauuugacuug

SEQ ID NO: 1047156 - RNA, 19 nt, Homo sapiens
caaguggcucagugaauuu

SEQ ID NO: 1047157 - RNA, 19 nt, Homo sapiens
gaggccaugugcuucaaug

SEQ ID NO: 1047158 - RNA, 19 nt, Homo sapiens
ggaacccuuugagauuaaa

SEQ ID NO: 1047159 - RNA, 19 nt, Homo sapiens
gaagacggcccuguucuac

SEQ ID NO: 1047160 - RNA, 19 nt, Homo sapiens
caacaaguggcucagugaa

SEQ ID NO: 1047161 - RNA, 19 nt, Homo sapiens
gaugcuggaucccaacaag

SEQ ID NO: 1047162 - RNA, 19 nt, Homo sapiens
gaggaaccuuaaagaccuu

SEQ ID NO: 1047163 - RNA, 19 nt, Homo sapiens
gaccuuguuuguacauaag

SEQ ID NO: 1047164 - RNA, 19 nt, Homo sapiens
ggacagccucuccuauuac

SEQ ID NO: 1047165 - RNA, 19 nt, Homo sapiens
ggaaaggugcaaacgucaa

SEQ ID NO: 1047166 - RNA, 19 nt, Homo sapiens
ccagaaugacugauuaagu

SEQ ID NO: 1047167 - RNA, 19 nt, Homo sapiens
gggcaucaaagacaaugaa

SEQ ID NO: 1047168 - RNA, 19 nt, Homo sapiens
gaaguacgaguggcugaug

SEQ ID NO: 1047169 - RNA, 19 nt, Homo sapiens
ggaggcgaccaaacaguau

SEQ ID NO: 1047170 - RNA, 19 nt, Homo sapiens
ucacucuucucuugcuuuc

SEQ ID NO: 1047171 - RNA, 19 nt, Homo sapiens
gaaccuuaaagaccuuguu

SEQ ID NO: 1047172 - RNA, 19 nt, Homo sapiens
agacaaugaaugaggauga

SEQ ID NO: 1047173 - RNA, 19 nt, Homo sapiens
ccaacaaguggcucaguga

SEQ ID NO: 1047174 - RNA, 19 nt, Homo sapiens
ccaugugcuucaaugcaaa

SEQ ID NO: 1047175 - RNA, 19 nt, Homo sapiens
agacggcccuguucuacca

SEQ ID NO: 1047176 - RNA, 19 nt, Homo sapiens
cuuaaagaccuuguuugua

SEQ ID NO: 1047177 - RNA, 19 nt, Homo sapiens
ggaaggcgaguuuucuuuu

SEQ ID NO: 1047178 - RNA, 19 nt, Homo sapiens
ccggacagccucuccuauu

SEQ ID NO: 1047179 - RNA, 19 nt, Homo sapiens
gacagccucuccuauuacu

SEQ ID NO: 1047180 - RNA, 19 nt, Homo sapiens
ggaaagcgaacacaaaaca

SEQ ID NO: 1047181 - RNA, 19 nt, Homo sapiens
gcaucaaagacaaugaaug

SEQ ID NO: 1047182 - RNA, 19 nt, Homo sapiens
ccagacccuuguccuagug

SEQ ID NO: 1047183 - RNA, 19 nt, Homo sapiens
gccagacccuuguccuagu

SEQ ID NO: 1047184 - RNA, 19 nt, Homo sapiens
ccuuaaagaccuuguuugu

SEQ ID NO: 1047185 - RNA, 19 nt, Homo sapiens
gaucaccugcuucgacauc

SEQ ID NO: 1047186 - RNA, 19 nt, Homo sapiens
cugcaaggcccaucucaug

SEQ ID NO: 1047187 - RNA, 19 nt, Homo sapiens
uggaggcgaccaaacagua

SEQ ID NO: 1047188 - RNA, 19 nt, Homo sapiens
ggacuucagagauguugca

SEQ ID NO: 1047189 - RNA, 19 nt, Homo sapiens
cgaagaaacgcuccaaucc

SEQ ID NO: 1047190 - RNA, 19 nt, Homo sapiens
ccgaagaaacgcuccaauc

SEQ ID NO: 1047191 - RNA, 19 nt, Homo sapiens
gaacugcuagcaaaagaga

SEQ ID NO: 1047192 - RNA, 19 nt, Homo sapiens
ggucagccacuacgaaugc

SEQ ID NO: 1047193 - RNA, 19 nt, Homo sapiens
gauuaagugccuugcgaau

SEQ ID NO: 1047194 - RNA, 19 nt, Homo sapiens
cgaguuuucuuuuguuuuc

SEQ ID NO: 1047195 - RNA, 19 nt, Homo sapiens
cgaccaaacaguaucugau

SEQ ID NO: 1047196 - RNA, 19 nt, Homo sapiens
guguacagauggugcuagu

SEQ ID NO: 1047197 - RNA, 19 nt, Homo sapiens
cauacuuucuuguguacag

SEQ ID NO: 1047198 - RNA, 19 nt, Homo sapiens
aaacaccguggaaggagaa

SEQ ID NO: 1047199 - RNA, 19 nt, Homo sapiens
ucaaugcaaagcugaagau

SEQ ID NO: 1047200 - RNA, 19 nt, Homo sapiens
agauggugcuagucaagau

SEQ ID NO: 1047201 - RNA, 19 nt, Homo sapiens
acaaaacaacccagaauga

SEQ ID NO: 1047202 - RNA, 19 nt, Homo sapiens
gcgaccaaacaguaucuga

SEQ ID NO: 1047203 - RNA, 19 nt, Homo sapiens
ccuugcgaaucuuuauuau

SEQ ID NO: 1047204 - RNA, 19 nt, Homo sapiens
uaagugccuugcgaaucuu

SEQ ID NO: 1047205 - RNA, 19 nt, Homo sapiens
aaguacgaguggcugauga

SEQ ID NO: 1047206 - RNA, 19 nt, Homo sapiens
gcagagcccuuucauguua

SEQ ID NO: 1047207 - RNA, 19 nt, Homo sapiens
gcaauucgauccucaauca

SEQ ID NO: 1047208 - RNA, 19 nt, Homo sapiens
guaagaagcagcaugaaua

SEQ ID NO: 1047209 - RNA, 19 nt, Homo sapiens
caagagaacucgguaaaug

SEQ ID NO: 1047210 - RNA, 19 nt, Homo sapiens
gaagcagcaugaauaguuu

SEQ ID NO: 1047211 - RNA, 19 nt, Homo sapiens
ugagaaagaucacccauga

SEQ ID NO: 1047212 - RNA, 19 nt, Homo sapiens
gcacugaguuggugagaca

SEQ ID NO: 1047213 - RNA, 19 nt, Homo sapiens
cuucucagcuuucucuuua

SEQ ID NO: 1047214 - RNA, 19 nt, Homo sapiens
gggaugcacuuuaaaugaa

SEQ ID NO: 1047215 - RNA, 19 nt, Homo sapiens
uaagagaaaugugcaauuc

SEQ ID NO: 1047216 - RNA, 19 nt, Homo sapiens
gcaagaguguugaacugaa

SEQ ID NO: 1047217 - RNA, 19 nt, Homo sapiens
ucacuugugugcacuugua

SEQ ID NO: 1047218 - RNA, 19 nt, Homo sapiens
gagcaagaguguugaacug

SEQ ID NO: 1047219 - RNA, 19 nt, Homo sapiens
gacaaucucucuauaugca

SEQ ID NO: 1047220 - RNA, 19 nt, Homo sapiens
aggaaagacucaaaugaaa

SEQ ID NO: 1047221 - RNA, 19 nt, Homo sapiens
gaaguccucuagagcaugu

SEQ ID NO: 1047222 - RNA, 19 nt, Homo sapiens
gacugaggcuggaagauga

SEQ ID NO: 1047223 - RNA, 19 nt, Homo sapiens
gcuggaagaugauauggau

SEQ ID NO: 1047224 - RNA, 19 nt, Homo sapiens
gagaauaacugugcuucca

SEQ ID NO: 1047225 - RNA, 19 nt, Homo sapiens
ggaaagacucaaaugaaau

SEQ ID NO: 1047226 - RNA, 19 nt, Homo sapiens
gauguaagaagcagcauga

SEQ ID NO: 1047227 - RNA, 19 nt, Homo sapiens
gcccaaugcuucagaguca

SEQ ID NO: 1047228 - RNA, 19 nt, Homo sapiens
gugagacaguuguggagua

SEQ ID NO: 1047229 - RNA, 19 nt, Homo sapiens
aagaugauauggauuggaa

SEQ ID NO: 1047230 - RNA, 19 nt, Homo sapiens
caggaaagacucaaaugaa

SEQ ID NO: 1047231 - RNA, 19 nt, Homo sapiens
gagacugaaugccaagaga

SEQ ID NO: 1047232 - RNA, 19 nt, Homo sapiens
gauauggauuggaacacaa

SEQ ID NO: 1047233 - RNA, 19 nt, Homo sapiens
ggacgaggaccaugccuau

SEQ ID NO: 1047234 - RNA, 19 nt, Homo sapiens
caggguagauucacuugug

SEQ ID NO: 1047235 - RNA, 19 nt, Homo sapiens
ggaagucagugagacaauc

SEQ ID NO: 1047236 - RNA, 19 nt, Homo sapiens
gaggauaacaggguagauu

SEQ ID NO: 1047237 - RNA, 19 nt, Homo sapiens
cagcaugaauaguuuauac

SEQ ID NO: 1047238 - RNA, 19 nt, Homo sapiens
gaauugugauuugcauugu

SEQ ID NO: 1047239 - RNA, 19 nt, Homo sapiens
uagagucggucaaggagaa

SEQ ID NO: 1047240 - RNA, 19 nt, Homo sapiens
gagggaaagugagaaagau

SEQ ID NO: 1047241 - RNA, 19 nt, Homo sapiens
aaaggaacguucacucaca

SEQ ID NO: 1047242 - RNA, 19 nt, Homo sapiens
agaagcagcaugaauaguu

SEQ ID NO: 1047243 - RNA, 19 nt, Homo sapiens
gauuugcauuguacgguuu

SEQ ID NO: 1047244 - RNA, 19 nt, Homo sapiens
agagaaaugugcaauucga

SEQ ID NO: 1047245 - RNA, 19 nt, Homo sapiens
gaguaucccauucugauga

SEQ ID NO: 1047246 - RNA, 19 nt, Homo sapiens
caagagggaaagugagaaa

SEQ ID NO: 1047247 - RNA, 19 nt, Homo sapiens
caagaguguugaacugaag

SEQ ID NO: 1047248 - RNA, 19 nt, Homo sapiens
ucucagcuuucucuuuaaa

SEQ ID NO: 1047249 - RNA, 19 nt, Homo sapiens
gguauggacaaaccaauga

SEQ ID NO: 1047250 - RNA, 19 nt, Homo sapiens
ucaggaaagacucaaauga

SEQ ID NO: 1047251 - RNA, 19 nt, Homo sapiens
guguugaacugaagaccaa

SEQ ID NO: 1047252 - RNA, 19 nt, Homo sapiens
gccaagagaacucgguaaa

SEQ ID NO: 1047253 - RNA, 19 nt, Homo sapiens
gcugcuacacuaagaauug

SEQ ID NO: 1047254 - RNA, 19 nt, Homo sapiens
agucagacccgaaccuuaa

SEQ ID NO: 1047255 - RNA, 19 nt, Homo sapiens
ugagacaguuguggaguau

SEQ ID NO: 1047256 - RNA, 19 nt, Homo sapiens
cacuaagaauugugauuug

SEQ ID NO: 1047257 - RNA, 19 nt, Homo sapiens
gcacuuuaaaugaagaguu

SEQ ID NO: 1047258 - RNA, 19 nt, Homo sapiens
ggaugcacuuuaaaugaag

SEQ ID NO: 1047259 - RNA, 19 nt, Homo sapiens
aaaaugcccucaaggugua

SEQ ID NO: 1047260 - RNA, 19 nt, Homo sapiens
gagaacucgguaaauguuu

SEQ ID NO: 1047261 - RNA, 19 nt, Homo sapiens
uaagaagcagcaugaauag

SEQ ID NO: 1047262 - RNA, 19 nt, Homo sapiens
gcaugaauaguuuauacug

SEQ ID NO: 1047263 - RNA, 19 nt, Homo sapiens
guccagaaguccucuagag

SEQ ID NO: 1047264 - RNA, 19 nt, Homo sapiens
ugugugcacuuguacaguu

SEQ ID NO: 1047265 - RNA, 19 nt, Homo sapiens
cagagcccuuucauguuaa

SEQ ID NO: 1047266 - RNA, 19 nt, Homo sapiens
gggaacagagcaagagugu

SEQ ID NO: 1047267 - RNA, 19 nt, Homo sapiens
ggaagaugauauggauugg

SEQ ID NO: 1047268 - RNA, 19 nt, Homo sapiens
ggaccaauguagguauucu

SEQ ID NO: 1047269 - RNA, 19 nt, Homo sapiens
cagaaguccucuagagcau

SEQ ID NO: 1047270 - RNA, 19 nt, Homo sapiens
uaacaggguagauucacuu

SEQ ID NO: 1047271 - RNA, 19 nt, Homo sapiens
cgggaugcacuuuaaauga

SEQ ID NO: 1047272 - RNA, 19 nt, Homo sapiens
gaccuauauuguucacguu

SEQ ID NO: 1047273 - RNA, 19 nt, Homo sapiens
cgacugaggcuggaagaug

SEQ ID NO: 1047274 - RNA, 19 nt, Homo sapiens
gagagagggcgcagagcaa

SEQ ID NO: 1047275 - RNA, 19 nt, Homo sapiens
ggauaacaggguagauuca

SEQ ID NO: 1047276 - RNA, 19 nt, Homo sapiens
gggaaagugagaaagauca

SEQ ID NO: 1047277 - RNA, 19 nt, Homo sapiens
cgauuugacagauguaaga

SEQ ID NO: 1047278 - RNA, 19 nt, Homo sapiens
gaugcacuuuaaaugaaga

SEQ ID NO: 1047279 - RNA, 19 nt, Homo sapiens
uggaagaugauauggauug

SEQ ID NO: 1047280 - RNA, 19 nt, Homo sapiens
gaagcagcccucccucgau

SEQ ID NO: 1047281 - RNA, 19 nt, Homo sapiens
ggaguaucccauucugaug

SEQ ID NO: 1047282 - RNA, 19 nt, Homo sapiens
cuguuucacuguuugcuuu

SEQ ID NO: 1047283 - RNA, 19 nt, Homo sapiens
gcccuuucauguuaauuag

SEQ ID NO: 1047284 - RNA, 19 nt, Homo sapiens
ggucaaggagaauaacugu

SEQ ID NO: 1047285 - RNA, 19 nt, Homo sapiens
gcagcaugaauaguuuaua

SEQ ID NO: 1047286 - RNA, 19 nt, Homo sapiens
ugccauauuuucaguguua

SEQ ID NO: 1047287 - RNA, 19 nt, Homo sapiens
gcgcagagcaaaccauguc

SEQ ID NO: 1047288 - RNA, 19 nt, Homo sapiens
agagaacucgguaaauguu

SEQ ID NO: 1047289 - RNA, 19 nt, Homo sapiens
ugauauggauuggaacaca

SEQ ID NO: 1047290 - RNA, 19 nt, Homo sapiens
gaugauauggauuggaaca

SEQ ID NO: 1047291 - RNA, 19 nt, Homo sapiens
ugauucuguuucacuguuu

SEQ ID NO: 1047292 - RNA, 19 nt, Homo sapiens
gaagucagugagacaaucu

SEQ ID NO: 1047293 - RNA, 19 nt, Homo sapiens
agaauugugauuugcauug

SEQ ID NO: 1047294 - RNA, 19 nt, Homo sapiens
gauucuguuucacuguuug

SEQ ID NO: 1047295 - RNA, 19 nt, Homo sapiens
augcagagcccuuucaugu

SEQ ID NO: 1047296 - RNA, 19 nt, Homo sapiens
cagacccgaaccuuaauaa

SEQ ID NO: 1047297 - RNA, 19 nt, Homo sapiens
gcuacacuaagaauuguga

SEQ ID NO: 1047298 - RNA, 19 nt, Homo sapiens
caagaccggcugcgugauc

SEQ ID NO: 1047299 - RNA, 19 nt, Homo sapiens
agagggaaagugagaaaga

SEQ ID NO: 1047300 - RNA, 19 nt, Homo sapiens
ccaagagaacucgguaaau

SEQ ID NO: 1047301 - RNA, 19 nt, Homo sapiens
gaagaugauauggauugga

SEQ ID NO: 1047302 - RNA, 19 nt, Homo sapiens
aaggaccaauguagguauu

SEQ ID NO: 1047303 - RNA, 19 nt, Homo sapiens
caaggaccaauguagguau

SEQ ID NO: 1047304 - RNA, 19 nt, Homo sapiens
aucaguggguggaggauaa

SEQ ID NO: 1047305 - RNA, 19 nt, Homo sapiens
uuagaaugguauggacaaa

SEQ ID NO: 1047306 - RNA, 19 nt, Homo sapiens
gaacacaacuuuagcgaua

SEQ ID NO: 1047307 - RNA, 19 nt, Homo sapiens
gaaaugaccuggacuaaca

SEQ ID NO: 1047308 - RNA, 19 nt, Homo sapiens
uacaugagcucuaaaguua

SEQ ID NO: 1047309 - RNA, 19 nt, Homo sapiens
ggucagaacuggaugauau

SEQ ID NO: 1047310 - RNA, 19 nt, Homo sapiens
gaagaucccuauggagaua

SEQ ID NO: 1047311 - RNA, 19 nt, Homo sapiens
caagguaguuuguaucauu

SEQ ID NO: 1047312 - RNA, 19 nt, Homo sapiens
gcuauaaacuugugggauu

SEQ ID NO: 1047313 - RNA, 19 nt, Homo sapiens
gagaguggaguguuuauua

SEQ ID NO: 1047314 - RNA, 19 nt, Homo sapiens
caacugaacuggauagagu

SEQ ID NO: 1047315 - RNA, 19 nt, Homo sapiens
ggagauaucugguuaacag

SEQ ID NO: 1047316 - RNA, 19 nt, Homo sapiens
ccacagaucaaacuaauuu

SEQ ID NO: 1047317 - RNA, 19 nt, Homo sapiens
gugaggaucuuacauaaau

SEQ ID NO: 1047318 - RNA, 19 nt, Homo sapiens
uaacgaagaucccuaugga

SEQ ID NO: 1047319 - RNA, 19 nt, Homo sapiens
gcuauacgcuuuaaaugug

SEQ ID NO: 1047320 - RNA, 19 nt, Homo sapiens
caaccaagguaguuuguau

SEQ ID NO: 1047321 - RNA, 19 nt, Homo sapiens
ccacggaaauuuauguuug

SEQ ID NO: 1047322 - RNA, 19 nt, Homo sapiens
ggaaguugcugacaguuca

SEQ ID NO: 1047323 - RNA, 19 nt, Homo sapiens
ucaagcagcuagaguagaa

SEQ ID NO: 1047324 - RNA, 19 nt, Homo sapiens
cuucaagacuauucuguua

SEQ ID NO: 1047325 - RNA, 19 nt, Homo sapiens
gguugcaggugauauuaua

SEQ ID NO: 1047326 - RNA, 19 nt, Homo sapiens
ggacacaacuggaaaugac

SEQ ID NO: 1047327 - RNA, 19 nt, Homo sapiens
guggauuccucucguguua

SEQ ID NO: 1047328 - RNA, 19 nt, Homo sapiens
caagggaaagccagaaaua

SEQ ID NO: 1047329 - RNA, 19 nt, Homo sapiens
guacaaacaaagggaauua

SEQ ID NO: 1047330 - RNA, 19 nt, Homo sapiens
gcucuaaaguuauuaagca

SEQ ID NO: 1047331 - RNA, 19 nt, Homo sapiens
ccagaaauacuauaaguga

SEQ ID NO: 1047332 - RNA, 19 nt, Homo sapiens
gagcuucuguacaaacaaa

SEQ ID NO: 1047333 - RNA, 19 nt, Homo sapiens
guacacaguugaaaguugu

SEQ ID NO: 1047334 - RNA, 19 nt, Homo sapiens
gcaguuuguucauaaaugu

SEQ ID NO: 1047335 - RNA, 19 nt, Homo sapiens
gaauuuaccuugcuuaccu

SEQ ID NO: 1047336 - RNA, 19 nt, Homo sapiens
caugagcucuaaaguuauu

SEQ ID NO: 1047337 - RNA, 19 nt, Homo sapiens
cagcaagaauauuacauga

SEQ ID NO: 1047338 - RNA, 19 nt, Homo sapiens
gaaaucugccugaaucuuc

SEQ ID NO: 1047339 - RNA, 19 nt, Homo sapiens
cuauggagauaucugguua

SEQ ID NO: 1047340 - RNA, 19 nt, Homo sapiens
ucaaauagacacacuguug

SEQ ID NO: 1047341 - RNA, 19 nt, Homo sapiens
gaguagaaauucaagaaag

SEQ ID NO: 1047342 - RNA, 19 nt, Homo sapiens
caacaucgcagccagaaau

SEQ ID NO: 1047343 - RNA, 19 nt, Homo sapiens
cuaaagacauacugcaguu

SEQ ID NO: 1047344 - RNA, 19 nt, Homo sapiens
gauauucgaacaucucaaa

SEQ ID NO: 1047345 - RNA, 19 nt, Homo sapiens
ggacuaacagaagaaauuu

SEQ ID NO: 1047346 - RNA, 19 nt, Homo sapiens
gggaaagccagaaauacua

SEQ ID NO: 1047347 - RNA, 19 nt, Homo sapiens
guugaaaguugucagaaau

SEQ ID NO: 1047348 - RNA, 19 nt, Homo sapiens
aaacugcgauacuauggaa

SEQ ID NO: 1047349 - RNA, 19 nt, Homo sapiens
gaagacuguucuccuaaag

SEQ ID NO: 1047350 - RNA, 19 nt, Homo sapiens
guguacugcuuuaaagaua

SEQ ID NO: 1047351 - RNA, 19 nt, Homo sapiens
ugaagacuguucuccuaaa

SEQ ID NO: 1047352 - RNA, 19 nt, Homo sapiens
aagaguaacuuuccaugga

SEQ ID NO: 1047353 - RNA, 19 nt, Homo sapiens
caaauagacacacuguuga

SEQ ID NO: 1047354 - RNA, 19 nt, Homo sapiens
ugaaaguugucagaaauga

SEQ ID NO: 1047355 - RNA, 19 nt, Homo sapiens
gaaaauauuuacccaaugg

SEQ ID NO: 1047356 - RNA, 19 nt, Homo sapiens
ucauaucgcuggauucaca

SEQ ID NO: 1047357 - RNA, 19 nt, Homo sapiens
caguaugucuauauucuug

SEQ ID NO: 1047358 - RNA, 19 nt, Homo sapiens
gaccuggacuaacagaaga

SEQ ID NO: 1047359 - RNA, 19 nt, Homo sapiens
cauccuaacuuacaagagu

SEQ ID NO: 1047360 - RNA, 19 nt, Homo sapiens
uugcuuaccuuacuaguau

SEQ ID NO: 1047361 - RNA, 19 nt, Homo sapiens
uaaaguggaagucuauuug

SEQ ID NO: 1047362 - RNA, 19 nt, Homo sapiens
uaauagaucaccuacacua

SEQ ID NO: 1047363 - RNA, 19 nt, Homo sapiens
uaaccaguguguugauguu

SEQ ID NO: 1047364 - RNA, 19 nt, Homo sapiens
aaaugagaguggaguguuu

SEQ ID NO: 1047365 - RNA, 19 nt, Homo sapiens
guucgaauuucucaguauu

SEQ ID NO: 1047366 - RNA, 19 nt, Homo sapiens
gaauuacagcugugcauau

SEQ ID NO: 1047367 - RNA, 19 nt, Homo sapiens
ggaaagccagaaauacuau

SEQ ID NO: 1047368 - RNA, 19 nt, Homo sapiens
ugacgguacuucagaacaa

SEQ ID NO: 1047369 - RNA, 19 nt, Homo sapiens
ggaagucuauuugcacaag

SEQ ID NO: 1047370 - RNA, 19 nt, Homo sapiens
gaaagccagaaauacuaua

SEQ ID NO: 1047371 - RNA, 19 nt, Homo sapiens
guugacaucugugugguuu

SEQ ID NO: 1047372 - RNA, 19 nt, Homo sapiens
gcauaucgucgguaucuug

SEQ ID NO: 1047373 - RNA, 19 nt, Homo sapiens
cagaagauauucgaacauc

SEQ ID NO: 1047374 - RNA, 19 nt, Homo sapiens
gaggccagccguauacgua

SEQ ID NO: 1047375 - RNA, 19 nt, Homo sapiens
aaagaguuauccauucaga

SEQ ID NO: 1047376 - RNA, 19 nt, Homo sapiens
ccaguguguugauguuaaa

SEQ ID NO: 1047377 - RNA, 19 nt, Homo sapiens
cuugacuucugguaauuua

SEQ ID NO: 1047378 - RNA, 19 nt, Homo sapiens
uaucuugacuucugguaau

SEQ ID NO: 1047379 - RNA, 19 nt, Homo sapiens
cagaaaugacaaucaagua

SEQ ID NO: 1047380 - RNA, 19 nt, Homo sapiens
guauaaggcauccuaacuu

SEQ ID NO: 1047381 - RNA, 19 nt, Homo sapiens
gaagucuauuugcacaaga

SEQ ID NO: 1047382 - RNA, 19 nt, Homo sapiens
uaauuucccuuucucaucu

SEQ ID NO: 1047383 - RNA, 19 nt, Homo sapiens
ugacuauuaucuugacuuc

SEQ ID NO: 1047384 - RNA, 19 nt, Homo sapiens
gaauauuacaugagcucua

SEQ ID NO: 1047385 - RNA, 19 nt, Homo sapiens
cgaguguacugcuuuaaag

SEQ ID NO: 1047386 - RNA, 19 nt, Homo sapiens
ugagauagcaaucgauguu

SEQ ID NO: 1047387 - RNA, 19 nt, Homo sapiens
ccccaaaacuugaugauuu

SEQ ID NO: 1047388 - RNA, 19 nt, Homo sapiens
gaaauauguaccaccagaa

SEQ ID NO: 1047389 - RNA, 19 nt, Homo sapiens
ggauuccucucguguuaca

SEQ ID NO: 1047390 - RNA, 19 nt, Homo sapiens
acaucugugugguuuguua

SEQ ID NO: 1047391 - RNA, 19 nt, Homo sapiens
agacuguucuccuaaagug

SEQ ID NO: 1047392 - RNA, 19 nt, Homo sapiens
auacgaguguacugcuuua

SEQ ID NO: 1047393 - RNA, 19 nt, Homo sapiens
ccacaggacacaacuggaa

SEQ ID NO: 1047394 - RNA, 19 nt, Homo sapiens
cacggaaauuuauguuuga

SEQ ID NO: 1047395 - RNA, 19 nt, Homo sapiens
accaggagcuucuguacaa

SEQ ID NO: 1047396 - RNA, 19 nt, Homo sapiens
auacugcaguuuguucaua

SEQ ID NO: 1047397 - RNA, 19 nt, Homo sapiens
cuauaaacuugugggauuu

SEQ ID NO: 1047398 - RNA, 19 nt, Homo sapiens
cauagaggccagccguaua

SEQ ID NO: 1047399 - RNA, 19 nt, Homo sapiens
gguaguuucaguauaugua

SEQ ID NO: 1047400 - RNA, 19 nt, Homo sapiens
ugucagugauuauguggaa

SEQ ID NO: 1047401 - RNA, 19 nt, Homo sapiens
gcacagugucagugauuau

SEQ ID NO: 1047402 - RNA, 19 nt, Homo sapiens
ggcacagugucagugauua

SEQ ID NO: 1047403 - RNA, 19 nt, Homo sapiens
guuaagcuauaaacuugug

SEQ ID NO: 1047404 - RNA, 19 nt, Homo sapiens
ugacaucugugugguuugu

SEQ ID NO: 1047405 - RNA, 19 nt, Homo sapiens
guaaauggccacucugcau

SEQ ID NO: 1047406 - RNA, 19 nt, Homo sapiens
gaaaguagguuguugaaag

SEQ ID NO: 1047407 - RNA, 19 nt, Homo sapiens
ccacugaccucuauuguug

SEQ ID NO: 1047408 - RNA, 19 nt, Homo sapiens
aaacaugccucuaguauca

SEQ ID NO: 1047409 - RNA, 19 nt, Homo sapiens
gaaguuaaagcauugagua

SEQ ID NO: 1047410 - RNA, 19 nt, Homo sapiens
ucaaacaacugguggaaga

SEQ ID NO: 1047411 - RNA, 19 nt, Homo sapiens
ucaaggaucucaccaaaca

SEQ ID NO: 1047412 - RNA, 19 nt, Homo sapiens
ggaaaucaaccgaaaauua

SEQ ID NO: 1047413 - RNA, 19 nt, Homo sapiens
caucauggcaucuuuauau

SEQ ID NO: 1047414 - RNA, 19 nt, Homo sapiens
uaucaaggaucucaccaaa

SEQ ID NO: 1047415 - RNA, 19 nt, Homo sapiens
gauaaggccauguugauug

SEQ ID NO: 1047416 - RNA, 19 nt, Homo sapiens
gaacagaggacaaagaaaa

SEQ ID NO: 1047417 - RNA, 19 nt, Homo sapiens
aaaguagguuguugaaaga

SEQ ID NO: 1047418 - RNA, 19 nt, Homo sapiens
ugaaugcauugcuguauau

SEQ ID NO: 1047419 - RNA, 19 nt, Homo sapiens
gaaggaaaaucuacaaaca

SEQ ID NO: 1047420 - RNA, 19 nt, Homo sapiens
guaaacaugccucuaguau

SEQ ID NO: 1047421 - RNA, 19 nt, Homo sapiens
acugaaagcuuugaugaaa

SEQ ID NO: 1047422 - RNA, 19 nt, Homo sapiens
gaagaaucaggcacacuuu

SEQ ID NO: 1047423 - RNA, 19 nt, Homo sapiens
ggaagucguucuaguucau

SEQ ID NO: 1047424 - RNA, 19 nt, Homo sapiens
uaacauuggagcucucuuu

SEQ ID NO: 1047425 - RNA, 19 nt, Homo sapiens
ggacaaagaaaaccuaaaa

SEQ ID NO: 1047426 - RNA, 19 nt, Homo sapiens
cauuggagcucucuuugga

SEQ ID NO: 1047427 - RNA, 19 nt, Homo sapiens
gagaauaguuaggcugcaa

SEQ ID NO: 1047428 - RNA, 19 nt, Homo sapiens
uggaagcuaugacaaagaa

SEQ ID NO: 1047429 - RNA, 19 nt, Homo sapiens
ggacaaaugaaacagacaa

SEQ ID NO: 1047430 - RNA, 19 nt, Homo sapiens
acagaaauagaacgucuua

SEQ ID NO: 1047431 - RNA, 19 nt, Homo sapiens
acaaacacuuggaacagaa

SEQ ID NO: 1047432 - RNA, 19 nt, Homo sapiens
ggagcucucuuuggaaauc

SEQ ID NO: 1047433 - RNA, 19 nt, Homo sapiens
cauggcaucuuuauauaca

SEQ ID NO: 1047434 - RNA, 19 nt, Homo sapiens
caacugguggaagaaauua

SEQ ID NO: 1047435 - RNA, 19 nt, Homo sapiens
caaagccaguguggacaaa

SEQ ID NO: 1047436 - RNA, 19 nt, Homo sapiens
gaacuagaacagaggacaa

SEQ ID NO: 1047437 - RNA, 19 nt, Homo sapiens
guagauaaggccauguuga

SEQ ID NO: 1047438 - RNA, 19 nt, Homo sapiens
guagacaaacagaaguuaa

SEQ ID NO: 1047439 - RNA, 19 nt, Homo sapiens
gcauugcuguauauacugu

SEQ ID NO: 1047440 - RNA, 19 nt, Homo sapiens
auaaggccauguugauuga

SEQ ID NO: 1047441 - RNA, 19 nt, Homo sapiens
gaaaaucuacaaacacuug

SEQ ID NO: 1047442 - RNA, 19 nt, Homo sapiens
gaguggaagcuaugacaaa

SEQ ID NO: 1047443 - RNA, 19 nt, Homo sapiens
acaccagcaugaacuagaa

SEQ ID NO: 1047444 - RNA, 19 nt, Homo sapiens
uagaacagaggacaaagaa

SEQ ID NO: 1047445 - RNA, 19 nt, Homo sapiens
cuguaagacugaaagcuuu

SEQ ID NO: 1047446 - RNA, 19 nt, Homo sapiens
guauauacuguaagacuga

SEQ ID NO: 1047447 - RNA, 19 nt, Homo sapiens
augaaugcauugcuguaua

SEQ ID NO: 1047448 - RNA, 19 nt, Homo sapiens
uacaaacacuuggaacaga

SEQ ID NO: 1047449 - RNA, 19 nt, Homo sapiens
cauguugauugagagaaua

SEQ ID NO: 1047450 - RNA, 19 nt, Homo sapiens
gggaagucguucuaguuca

SEQ ID NO: 1047451 - RNA, 19 nt, Homo sapiens
agacugaaagcuuugauga

SEQ ID NO: 1047452 - RNA, 19 nt, Homo sapiens
caggcacacuuucuucaga

SEQ ID NO: 1047453 - RNA, 19 nt, Homo sapiens
uaaaguuuccuguagugaa

SEQ ID NO: 1047454 - RNA, 19 nt, Homo sapiens
ggaaaguagguuguugaaa

SEQ ID NO: 1047455 - RNA, 19 nt, Homo sapiens
gaaaucaaccgaaaauuac

SEQ ID NO: 1047456 - RNA, 19 nt, Homo sapiens
gaagcuaugacaaagaagu

SEQ ID NO: 1047457 - RNA, 19 nt, Homo sapiens
gcaagcacgaagaaaauua

SEQ ID NO: 1047458 - RNA, 19 nt, Homo sapiens
aacagaaguuaaagcauug

SEQ ID NO: 1047459 - RNA, 19 nt, Homo sapiens
gaaucaggcacacuuucuu

SEQ ID NO: 1047460 - RNA, 19 nt, Homo sapiens
caguagcuguggauaacuu

SEQ ID NO: 1047461 - RNA, 19 nt, Homo sapiens
ccauguugauugagagaau

SEQ ID NO: 1047462 - RNA, 19 nt, Homo sapiens
gaucucaccaaacaacuuc

SEQ ID NO: 1047463 - RNA, 19 nt, Homo sapiens
gaaugcauugcuguauaua

SEQ ID NO: 1047464 - RNA, 19 nt, Homo sapiens
uaaacaccagcaugaacua

SEQ ID NO: 1047465 - RNA, 19 nt, Homo sapiens
caaacaacuucagcaagca

SEQ ID NO: 1047466 - RNA, 19 nt, Homo sapiens
acucagagacguaaacaug

SEQ ID NO: 1047467 - RNA, 19 nt, Homo sapiens
uuggagcucucuuuggaaa

SEQ ID NO: 1047468 - RNA, 19 nt, Homo sapiens
ucgaagcagugcagaagau

SEQ ID NO: 1047469 - RNA, 19 nt, Homo sapiens
gacaaaugaaacagacaaa

SEQ ID NO: 1047470 - RNA, 19 nt, Homo sapiens
ggaggaccacaucaaacaa

SEQ ID NO: 1047471 - RNA, 19 nt, Homo sapiens
uagauaaggccauguugau

SEQ ID NO: 1047472 - RNA, 19 nt, Homo sapiens
gagaguggaagcuaugaca

SEQ ID NO: 1047473 - RNA, 19 nt, Homo sapiens
gcaucauggcaucuuuaua

SEQ ID NO: 1047474 - RNA, 19 nt, Homo sapiens
gguggaagaaauuaggaaa

SEQ ID NO: 1047475 - RNA, 19 nt, Homo sapiens
acaaagaagucagcagcau

SEQ ID NO: 1047476 - RNA, 19 nt, Homo sapiens
acaaacagaaguuaaagca

SEQ ID NO: 1047477 - RNA, 19 nt, Homo sapiens
gacguaaacaugccucuag

SEQ ID NO: 1047478 - RNA, 19 nt, Homo sapiens
uuuguauggugcaauauga

SEQ ID NO: 1047479 - RNA, 19 nt, Homo sapiens
agaagaaucaggcacacuu

SEQ ID NO: 1047480 - RNA, 19 nt, Homo sapiens
gguugagaguggaagcuau

SEQ ID NO: 1047481 - RNA, 19 nt, Homo sapiens
guagugaaagucaguuaca

SEQ ID NO: 1047482 - RNA, 19 nt, Homo sapiens
cugaaagcuuugaugaaau

SEQ ID NO: 1047483 - RNA, 19 nt, Homo sapiens
ccagguagaagaauuaaaa

SEQ ID NO: 1047484 - RNA, 19 nt, Homo sapiens
caaacacuuggaacagaaa

SEQ ID NO: 1047485 - RNA, 19 nt, Homo sapiens
aaacaacugguggaagaaa

SEQ ID NO: 1047486 - RNA, 19 nt, Homo sapiens
uauggaggaccacaucaaa

SEQ ID NO: 1047487 - RNA, 19 nt, Homo sapiens
caugggaagucguucuagu

SEQ ID NO: 1047488 - RNA, 19 nt, Homo sapiens
guauucauaagaaguguug

SEQ ID NO: 1047489 - RNA, 19 nt, Homo sapiens
gacugaaagcuuugaugaa

SEQ ID NO: 1047490 - RNA, 19 nt, Homo sapiens
guugaaagaggaagaacug

SEQ ID NO: 1047491 - RNA, 19 nt, Homo sapiens
uuauuaaacaccagcauga

SEQ ID NO: 1047492 - RNA, 19 nt, Homo sapiens
cguaaacaugccucuagua

SEQ ID NO: 1047493 - RNA, 19 nt, Homo sapiens
ggagacuuuguuccacuuu

SEQ ID NO: 1047494 - RNA, 19 nt, Homo sapiens
ccucaguagcuguggauaa

SEQ ID NO: 1047495 - RNA, 19 nt, Homo sapiens
gugaaagucaguuacaaag

SEQ ID NO: 1047496 - RNA, 19 nt, Homo sapiens
aagccaguguggacaaaug

SEQ ID NO: 1047497 - RNA, 19 nt, Homo sapiens
ccucuaguaucaaggaucu

SEQ ID NO: 1047498 - RNA, 19 nt, Homo sapiens
uggaggauacguuacuaaa

SEQ ID NO: 1047499 - RNA, 19 nt, Homo sapiens
uaaacaugccucuaguauc

SEQ ID NO: 1047500 - RNA, 19 nt, Homo sapiens
ugcuucaucuguacacaaa

SEQ ID NO: 1047501 - RNA, 19 nt, Homo sapiens
cuagaacagaggacaaaga

SEQ ID NO: 1047502 - RNA, 19 nt, Homo sapiens
ggaaguccaaacucugcaa

SEQ ID NO: 1047503 - RNA, 19 nt, Homo sapiens
ccaguguggacaaaugaaa

SEQ ID NO: 1047504 - RNA, 19 nt, Homo sapiens
gaaaauuagaucagguuga

SEQ ID NO: 1047505 - RNA, 19 nt, Homo sapiens
ggaucucaccaaacaacuu

SEQ ID NO: 1047506 - RNA, 19 nt, Homo sapiens
gcacaggacuggauaaaua

SEQ ID NO: 1047507 - RNA, 19 nt, Homo sapiens
gcaaagcuaucaccauuua

SEQ ID NO: 1047508 - RNA, 19 nt, Homo sapiens
gcaaugcucuucuucaaua

SEQ ID NO: 1047509 - RNA, 19 nt, Homo sapiens
gaaggagggucuuugauuu

SEQ ID NO: 1047510 - RNA, 19 nt, Homo sapiens
gcaacuaccucaucauauu

SEQ ID NO: 1047511 - RNA, 19 nt, Homo sapiens
caaagucucuggucuguuu

SEQ ID NO: 1047512 - RNA, 19 nt, Homo sapiens
ggaagaaccuuaagcugaa

SEQ ID NO: 1047513 - RNA, 19 nt, Homo sapiens
ccaaagacguuuaccagua

SEQ ID NO: 1047514 - RNA, 19 nt, Homo sapiens
ggaauauucuucaugauug

SEQ ID NO: 1047515 - RNA, 19 nt, Homo sapiens
uaagauggcucaauguauu

SEQ ID NO: 1047516 - RNA, 19 nt, Homo sapiens
caaacggugucaaauauuu

SEQ ID NO: 1047517 - RNA, 19 nt, Homo sapiens
gcaaugagcagucaauuug

SEQ ID NO: 1047518 - RNA, 19 nt, Homo sapiens
aaaagaagcuggcagauua

SEQ ID NO: 1047519 - RNA, 19 nt, Homo sapiens
ggaaauaacaggaagauuc

SEQ ID NO: 1047520 - RNA, 19 nt, Homo sapiens
ggaaaucugucauucaaca

SEQ ID NO: 1047521 - RNA, 19 nt, Homo sapiens
aaagguaucuucugaaugu

SEQ ID NO: 1047522 - RNA, 19 nt, Homo sapiens
ggaaaugguuacaaguuau

SEQ ID NO: 1047523 - RNA, 19 nt, Homo sapiens
gcagucaauuugcuaauga

SEQ ID NO: 1047524 - RNA, 19 nt, Homo sapiens
ccaaauagcaucuuuagga

SEQ ID NO: 1047525 - RNA, 19 nt, Homo sapiens
ggagauacacuacccagua

SEQ ID NO: 1047526 - RNA, 19 nt, Homo sapiens
gauacgacauuuccugauu

SEQ ID NO: 1047527 - RNA, 19 nt, Homo sapiens
guacaugaauggucaaaca

SEQ ID NO: 1047528 - RNA, 19 nt, Homo sapiens
gacauucauuggccauuua

SEQ ID NO: 1047529 - RNA, 19 nt, Homo sapiens
uaaacugccuguucuagaa

SEQ ID NO: 1047530 - RNA, 19 nt, Homo sapiens
cagcaaaguguauacauua

SEQ ID NO: 1047531 - RNA, 19 nt, Homo sapiens
uggaaaugguuacaaguua

SEQ ID NO: 1047532 - RNA, 19 nt, Homo sapiens
ggaaggagggucuuugauu

SEQ ID NO: 1047533 - RNA, 19 nt, Homo sapiens
ccuaaauccucuugucaua

SEQ ID NO: 1047534 - RNA, 19 nt, Homo sapiens
gcacauuucuacccagguu

SEQ ID NO: 1047535 - RNA, 19 nt, Homo sapiens
ggaagcauggcacucauua

SEQ ID NO: 1047536 - RNA, 19 nt, Homo sapiens
acacagagcugacgcaagu

SEQ ID NO: 1047537 - RNA, 19 nt, Homo sapiens
ccacuggucuuuaaaucaa

SEQ ID NO: 1047538 - RNA, 19 nt, Homo sapiens
gcauggcacucauuauaau

SEQ ID NO: 1047539 - RNA, 19 nt, Homo sapiens
gccaagggcucucuucaug

SEQ ID NO: 1047540 - RNA, 19 nt, Homo sapiens
ugaacuaccugaaguaauc

SEQ ID NO: 1047541 - RNA, 19 nt, Homo sapiens
cagaaaguguauauuggua

SEQ ID NO: 1047542 - RNA, 19 nt, Homo sapiens
gagggucuuugauuuauga

SEQ ID NO: 1047543 - RNA, 19 nt, Homo sapiens
caaauagcaucuuuaggau

SEQ ID NO: 1047544 - RNA, 19 nt, Homo sapiens
gaagaaaugcacacgauca

SEQ ID NO: 1047545 - RNA, 19 nt, Homo sapiens
ucucuggucuguuuacuaa

SEQ ID NO: 1047546 - RNA, 19 nt, Homo sapiens
uggcaaagcuaucaccauu

SEQ ID NO: 1047547 - RNA, 19 nt, Homo sapiens
agacaucccucuucucaug

SEQ ID NO: 1047548 - RNA, 19 nt, Homo sapiens
caaauacccugcccucuac

SEQ ID NO: 1047549 - RNA, 19 nt, Homo sapiens
gagcagcaguggagaaagu

SEQ ID NO: 1047550 - RNA, 19 nt, Homo sapiens
guuggaauauucuucauga

SEQ ID NO: 1047551 - RNA, 19 nt, Homo sapiens
caucuacagugaacuuaaa

SEQ ID NO: 1047552 - RNA, 19 nt, Homo sapiens
ugacaagugugaacccaaa

SEQ ID NO: 1047553 - RNA, 19 nt, Homo sapiens
gaaacugugauuugcuaua

SEQ ID NO: 1047554 - RNA, 19 nt, Homo sapiens
ccaaauacccugcccucua

SEQ ID NO: 1047555 - RNA, 19 nt, Homo sapiens
caaggaugguuguguaugu

SEQ ID NO: 1047556 - RNA, 19 nt, Homo sapiens
gauagcuugugcugauuaa

SEQ ID NO: 1047557 - RNA, 19 nt, Homo sapiens
uaugauagcuugugcugau

SEQ ID NO: 1047558 - RNA, 19 nt, Homo sapiens
gggcuuuauuucaaucaua

SEQ ID NO: 1047559 - RNA, 19 nt, Homo sapiens
aaagaucggucccggagaa

SEQ ID NO: 1047560 - RNA, 19 nt, Homo sapiens
ggagaaugguaccucaaug

SEQ ID NO: 1047561 - RNA, 19 nt, Homo sapiens
caaaguggaagaaccuuaa

SEQ ID NO: 1047562 - RNA, 19 nt, Homo sapiens
gauugcagcugugcuuauu

SEQ ID NO: 1047563 - RNA, 19 nt, Homo sapiens
caacaacacgcuuccaaug

SEQ ID NO: 1047564 - RNA, 19 nt, Homo sapiens
ugucaaggaugguugugua

SEQ ID NO: 1047565 - RNA, 19 nt, Homo sapiens
aagcauggcacucauuaua

SEQ ID NO: 1047566 - RNA, 19 nt, Homo sapiens
caagcuaccucuuuaucau

SEQ ID NO: 1047567 - RNA, 19 nt, Homo sapiens
gacauugaguugugacuuc

SEQ ID NO: 1047568 - RNA, 19 nt, Homo sapiens
caacuaccucaucauauuu

SEQ ID NO: 1047569 - RNA, 19 nt, Homo sapiens
gaaguaaucagagcauuca

SEQ ID NO: 1047570 - RNA, 19 nt, Homo sapiens
gcaggaaacugugauuugc

SEQ ID NO: 1047571 - RNA, 19 nt, Homo sapiens
ggucugccauuccaaacaa

SEQ ID NO: 1047572 - RNA, 19 nt, Homo sapiens
gcaaacggugucaaauauu

SEQ ID NO: 1047573 - RNA, 19 nt, Homo sapiens
ugcaaacggugucaaauau

SEQ ID NO: 1047574 - RNA, 19 nt, Homo sapiens
agaaauuccugacaaaugg

SEQ ID NO: 1047575 - RNA, 19 nt, Homo sapiens
ucaagagcauccuauagug

SEQ ID NO: 1047576 - RNA, 19 nt, Homo sapiens
gaaaaucccauucauaugu

SEQ ID NO: 1047577 - RNA, 19 nt, Homo sapiens
ccuauagugccaaauaaua

SEQ ID NO: 1047578 - RNA, 19 nt, Homo sapiens
gaucauucuugcucacuuc

SEQ ID NO: 1047579 - RNA, 19 nt, Homo sapiens
guagucaucagaauguuaa

SEQ ID NO: 1047580 - RNA, 19 nt, Homo sapiens
caaugcaugugguaauguu

SEQ ID NO: 1047581 - RNA, 19 nt, Homo sapiens
ccauggaacugagaaaugu

SEQ ID NO: 1047582 - RNA, 19 nt, Homo sapiens
ugacauucauuggccauuu

SEQ ID NO: 1047583 - RNA, 19 nt, Homo sapiens
acagcaaaguguauacauu

SEQ ID NO: 1047584 - RNA, 19 nt, Homo sapiens
cugcagggcuggaugagaa

SEQ ID NO: 1047585 - RNA, 19 nt, Homo sapiens
uauaagauggcucaaugua

SEQ ID NO: 1047586 - RNA, 19 nt, Homo sapiens
auaguaagaucacuugugu

SEQ ID NO: 1047587 - RNA, 19 nt, Homo sapiens
ggaauuaguucaguuuagc

SEQ ID NO: 1047588 - RNA, 19 nt, Homo sapiens
guaacugcauguaacaauc

SEQ ID NO: 1047589 - RNA, 19 nt, Homo sapiens
uuuauaagauggcucaaug

SEQ ID NO: 1047590 - RNA, 19 nt, Homo sapiens
cauccuauagugccaaaua

SEQ ID NO: 1047591 - RNA, 19 nt, Homo sapiens
ucucagaacaucaaacaaa

SEQ ID NO: 1047592 - RNA, 19 nt, Homo sapiens
gcaaaguguauacauuaga

SEQ ID NO: 1047593 - RNA, 19 nt, Homo sapiens
guugagugguucuccguaa

SEQ ID NO: 1047594 - RNA, 19 nt, Homo sapiens
uaaauccucuugucauacu

SEQ ID NO: 1047595 - RNA, 19 nt, Homo sapiens
gagaggggcuuuauuucaa

SEQ ID NO: 1047596 - RNA, 19 nt, Homo sapiens
cuuaggaacuguuucuguu

SEQ ID NO: 1047597 - RNA, 19 nt, Homo sapiens
gaauauucuucaugauugg

SEQ ID NO: 1047598 - RNA, 19 nt, Homo sapiens
uggagaaguugaagaugaa

SEQ ID NO: 1047599 - RNA, 19 nt, Homo sapiens
gagaaagugcuccagauag

SEQ ID NO: 1047600 - RNA, 19 nt, Homo sapiens
uagagcaucuuauugucaa

SEQ ID NO: 1047601 - RNA, 19 nt, Homo sapiens
caaaaggcaugucuuagga

SEQ ID NO: 1047602 - RNA, 19 nt, Homo sapiens
gugagaugaugaaggugua

SEQ ID NO: 1047603 - RNA, 19 nt, Homo sapiens
caaauuccaagcaucacua

SEQ ID NO: 1047604 - RNA, 19 nt, Homo sapiens
caaaguguauacauuagac

SEQ ID NO: 1047605 - RNA, 19 nt, Homo sapiens
caacacagggaucauacuu

SEQ ID NO: 1047606 - RNA, 19 nt, Homo sapiens
gaagguggguggcauauug

SEQ ID NO: 1047607 - RNA, 19 nt, Homo sapiens
aaagaaggcucuggauuua

SEQ ID NO: 1047608 - RNA, 19 nt, Homo sapiens
gaagagaacuacuccuuuu

SEQ ID NO: 1047609 - RNA, 19 nt, Homo sapiens
gcgaaguccuggaguauug

SEQ ID NO: 1047610 - RNA, 19 nt, Homo sapiens
uagcagagcuuccauuagu

SEQ ID NO: 1047611 - RNA, 19 nt, Homo sapiens
gaaggaggagaucaaauuu

SEQ ID NO: 1047612 - RNA, 19 nt, Homo sapiens
gcagaaggguucaguaugc

SEQ ID NO: 1047613 - RNA, 19 nt, Homo sapiens
guacacauuguuccuguua

SEQ ID NO: 1047614 - RNA, 19 nt, Homo sapiens
ggaagagaacuacuccuuu

SEQ ID NO: 1047615 - RNA, 19 nt, Homo sapiens
gaggcugacuuccuuagaa

SEQ ID NO: 1047616 - RNA, 19 nt, Homo sapiens
ucaaaugcauggacaagga

SEQ ID NO: 1047617 - RNA, 19 nt, Homo sapiens
uaacagcagcuucuugaaa

SEQ ID NO: 1047618 - RNA, 19 nt, Homo sapiens
ugaaggaggagaucaaauu

SEQ ID NO: 1047619 - RNA, 19 nt, Homo sapiens
cagcuucccugauuucuuc

SEQ ID NO: 1047620 - RNA, 19 nt, Homo sapiens
ccaaaccgcuucacaucug

SEQ ID NO: 1047621 - RNA, 19 nt, Homo sapiens
aauuaagccugcacucaua

SEQ ID NO: 1047622 - RNA, 19 nt, Homo sapiens
uaagcuaggucugaaaguu

SEQ ID NO: 1047623 - RNA, 19 nt, Homo sapiens
gaagggaacuacgcuuugg

SEQ ID NO: 1047624 - RNA, 19 nt, Homo sapiens
gcauagaauugugagagaa

SEQ ID NO: 1047625 - RNA, 19 nt, Homo sapiens
aaccugcgcugaccaguuu

SEQ ID NO: 1047626 - RNA, 19 nt, Homo sapiens
gagugaggcugacuuccuu

SEQ ID NO: 1047627 - RNA, 19 nt, Homo sapiens
gaauuaagccugcacucau

SEQ ID NO: 1047628 - RNA, 19 nt, Homo sapiens
gcagcuucuugaaacauuu

SEQ ID NO: 1047629 - RNA, 19 nt, Homo sapiens
ccuugggacuguuauuuaa

SEQ ID NO: 1047630 - RNA, 19 nt, Homo sapiens
ggugcgaaguccuggagua

SEQ ID NO: 1047631 - RNA, 19 nt, Homo sapiens
gagcaagucaggaccaaga

SEQ ID NO: 1047632 - RNA, 19 nt, Homo sapiens
ugacagauaccacgaaaca

SEQ ID NO: 1047633 - RNA, 19 nt, Homo sapiens
aggaggagaucaaauuuca

SEQ ID NO: 1047634 - RNA, 19 nt, Homo sapiens
ggcauagaauugugagaga

SEQ ID NO: 1047635 - RNA, 19 nt, Homo sapiens
agaaggcucuggauuuaag

SEQ ID NO: 1047636 - RNA, 19 nt, Homo sapiens
guuaacagcagcuucuuga

SEQ ID NO: 1047637 - RNA, 19 nt, Homo sapiens
gagcuuccauuaguguaga

SEQ ID NO: 1047638 - RNA, 19 nt, Homo sapiens
aagcuaggucugaaaguua

SEQ ID NO: 1047639 - RNA, 19 nt, Homo sapiens
gaaaagaaggcucuggauu

SEQ ID NO: 1047640 - RNA, 19 nt, Homo sapiens
gaauugugagagaauguuu

SEQ ID NO: 1047641 - RNA, 19 nt, Homo sapiens
ggaccugaacgcccucaaa

SEQ ID NO: 1047642 - RNA, 19 nt, Homo sapiens
aaaagaaggcucuggauuu

SEQ ID NO: 1047643 - RNA, 19 nt, Homo sapiens
gaggagaucaaauuucagu

SEQ ID NO: 1047644 - RNA, 19 nt, Homo sapiens
gcagagcuuccauuagugu

SEQ ID NO: 1047645 - RNA, 19 nt, Homo sapiens
gaucugaagagcacaguag

SEQ ID NO: 1047646 - RNA, 19 nt, Homo sapiens
acagauaccacgaaacaug

SEQ ID NO: 1047647 - RNA, 19 nt, Homo sapiens
cuucacaucugcagugcuu

SEQ ID NO: 1047648 - RNA, 19 nt, Homo sapiens
cagauaccacgaaacauga

SEQ ID NO: 1047649 - RNA, 19 nt, Homo sapiens
gugaagggaacuacgcuuu

SEQ ID NO: 1047650 - RNA, 19 nt, Homo sapiens
guucacaacaucaucaaau

SEQ ID NO: 1047651 - RNA, 19 nt, Homo sapiens
cuuaugcucugcugucuca

SEQ ID NO: 1047652 - RNA, 19 nt, Homo sapiens
caccuuguguugagagaga

SEQ ID NO: 1047653 - RNA, 19 nt, Homo sapiens
gagagaauguuuugaaagg

SEQ ID NO: 1047654 - RNA, 19 nt, Homo sapiens
caagucaggaccaagaaug

SEQ ID NO: 1047655 - RNA, 19 nt, Homo sapiens
aaacaugaagcacguggaa

SEQ ID NO: 1047656 - RNA, 19 nt, Homo sapiens
aaaguuacacagccaaguu

SEQ ID NO: 1047657 - RNA, 19 nt, Homo sapiens
guaugcaccuuguguugag

SEQ ID NO: 1047658 - RNA, 19 nt, Homo sapiens
cgagggaggaagagaacua

SEQ ID NO: 1047659 - RNA, 19 nt, Homo sapiens
aggcugacuuccuuagaaa

SEQ ID NO: 1047660 - RNA, 19 nt, Homo sapiens
aaagcaaguuccaggagau

SEQ ID NO: 1047661 - RNA, 19 nt, Homo sapiens
ccauuaguguagaccugua

SEQ ID NO: 1047662 - RNA, 19 nt, Homo sapiens
gaugggacguuuuauuugu

SEQ ID NO: 1047663 - RNA, 19 nt, Homo sapiens
gaagcacguggaacuacaa

SEQ ID NO: 1047664 - RNA, 19 nt, Homo sapiens
ugaagcacguggaacuaca

SEQ ID NO: 1047665 - RNA, 19 nt, Homo sapiens
aaauuucaguggcuuugga

SEQ ID NO: 1047666 - RNA, 19 nt, Homo sapiens
gcugacuuccuuagaaaga

SEQ ID NO: 1047667 - RNA, 19 nt, Homo sapiens
gcacguggaacuacaagac

SEQ ID NO: 1047668 - RNA, 19 nt, Homo sapiens
guagugggugggccuguuu

SEQ ID NO: 1047669 - RNA, 19 nt, Homo sapiens
uuuagcagagcuuccauua

SEQ ID NO: 1047670 - RNA, 19 nt, Homo sapiens
cagccaaguuugagcucuu

SEQ ID NO: 1047671 - RNA, 19 nt, Homo sapiens
ggccaaaccgcuucacauc

SEQ ID NO: 1047672 - RNA, 19 nt, Homo sapiens
cgaauuaagccugcacuca

SEQ ID NO: 1047673 - RNA, 19 nt, Homo sapiens
cuugaaacauuugcauaga

SEQ ID NO: 1047674 - RNA, 19 nt, Homo sapiens
ccugccagcugaccucguu

SEQ ID NO: 1047675 - RNA, 19 nt, Homo sapiens
cagaugggacguuuuauuu

SEQ ID NO: 1047676 - RNA, 19 nt, Homo sapiens
ucagaagguggguggcaua

SEQ ID NO: 1047677 - RNA, 19 nt, Homo sapiens
gcaagucaggaccaagaau

SEQ ID NO: 1047678 - RNA, 19 nt, Homo sapiens
ugaagggaacuacgcuuug

SEQ ID NO: 1047679 - RNA, 19 nt, Homo sapiens
gguacacauuguuccuguu

SEQ ID NO: 1047680 - RNA, 19 nt, Homo sapiens
ccacugacagaucugaaga

SEQ ID NO: 1047681 - RNA, 19 nt, Homo sapiens
gaaaguuacacagccaagu

SEQ ID NO: 1047682 - RNA, 19 nt, Homo sapiens
aacagcagcuucuugaaac

SEQ ID NO: 1047683 - RNA, 19 nt, Homo sapiens
ccaaguuugagcucuuaaa

SEQ ID NO: 1047684 - RNA, 19 nt, Homo sapiens
gugagagaauguuuugaaa

SEQ ID NO: 1047685 - RNA, 19 nt, Homo sapiens
gacaggcggaggauguauu

SEQ ID NO: 1047686 - RNA, 19 nt, Homo sapiens
gcaaggcugaaauggacaa

SEQ ID NO: 1047687 - RNA, 19 nt, Homo sapiens
agccaaguuugagcucuua

SEQ ID NO: 1047688 - RNA, 19 nt, Homo sapiens
cgacccgaccucuggcuaa

SEQ ID NO: 1047689 - RNA, 19 nt, Homo sapiens
acacauuguuccuguuaac

SEQ ID NO: 1047690 - RNA, 19 nt, Homo sapiens
cccauaggaucagugugua

SEQ ID NO: 1047691 - RNA, 19 nt, Homo sapiens
gggagcaagucaggaccaa

SEQ ID NO: 1047692 - RNA, 19 nt, Homo sapiens
guagagugaggcugacuuc

SEQ ID NO: 1047693 - RNA, 19 nt, Homo sapiens
caguggcuuuggacagaaa

SEQ ID NO: 1047694 - RNA, 19 nt, Homo sapiens
gaaguccuggaguauuguu

SEQ ID NO: 1047695 - RNA, 19 nt, Homo sapiens
ccucguggccuuugcacuu

SEQ ID NO: 1047696 - RNA, 19 nt, Homo sapiens
gcgcgagggaggaagagaa

SEQ ID NO: 1047697 - RNA, 19 nt, Homo sapiens
uaaccugcgcugaccaguu

SEQ ID NO: 1047698 - RNA, 19 nt, Homo sapiens
cagaaggguucaguaugca

SEQ ID NO: 1047699 - RNA, 19 nt, Homo sapiens
gggccguccuuuccacaca

SEQ ID NO: 1047700 - RNA, 19 nt, Homo sapiens
uucacaacaucaucaaaug

SEQ ID NO: 1047701 - RNA, 19 nt, Homo sapiens
cauagaauugugagagaau

SEQ ID NO: 1047702 - RNA, 19 nt, Homo sapiens
gaaucaguuauuuccuuga

SEQ ID NO: 1047703 - RNA, 19 nt, Homo sapiens
caguaugcaccuuguguug

SEQ ID NO: 1047704 - RNA, 19 nt, Homo sapiens
cugaagagcacaguaggaa

SEQ ID NO: 1047705 - RNA, 19 nt, Homo sapiens
gagccugccuuguguuccu

SEQ ID NO: 1047706 - RNA, 19 nt, Homo sapiens
guaauagucuucaauggua

SEQ ID NO: 1047707 - RNA, 19 nt, Homo sapiens
gaacacaaacuacucagaa

SEQ ID NO: 1047708 - RNA, 19 nt, Homo sapiens
uaacuagucucuucugugu

SEQ ID NO: 1047709 - RNA, 19 nt, Homo sapiens
gcugaaaguucgaaggauu

SEQ ID NO: 1047710 - RNA, 19 nt, Homo sapiens
acacuuaacuagucucuuc

SEQ ID NO: 1047711 - RNA, 19 nt, Homo sapiens
cgaccuggcuuuguagaaa

SEQ ID NO: 1047712 - RNA, 19 nt, Homo sapiens
guaggcacgugaugcguaa

SEQ ID NO: 1047713 - RNA, 19 nt, Homo sapiens
gguacuauguucccagcua

SEQ ID NO: 1047714 - RNA, 19 nt, Homo sapiens
acuagucucuucuguguaa

SEQ ID NO: 1047715 - RNA, 19 nt, Homo sapiens
ggaucaaccucccagacaa

SEQ ID NO: 1047716 - RNA, 19 nt, Homo sapiens
gcaucucucucccguccua

SEQ ID NO: 1047717 - RNA, 19 nt, Homo sapiens
gaucaaccucccagacaaa

SEQ ID NO: 1047718 - RNA, 19 nt, Homo sapiens
gcucagggcagcaacaaga

SEQ ID NO: 1047719 - RNA, 19 nt, Homo sapiens
aacacgaccuggcuuugua

SEQ ID NO: 1047720 - RNA, 19 nt, Homo sapiens
agauugugguuguuuguuu

SEQ ID NO: 1047721 - RNA, 19 nt, Homo sapiens
ccacaugagccacaguuga

SEQ ID NO: 1047722 - RNA, 19 nt, Homo sapiens
aggaagugaugaacacaaa

SEQ ID NO: 1047723 - RNA, 19 nt, Homo sapiens
gaaccaucccgcaggaguu

SEQ ID NO: 1047724 - RNA, 19 nt, Homo sapiens
ugacugcugccuuguauau

SEQ ID NO: 1047725 - RNA, 19 nt, Homo sapiens
ccuuggagcuggugaaucu

SEQ ID NO: 1047726 - RNA, 19 nt, Homo sapiens
ucaaugguacacuuaacua

SEQ ID NO: 1047727 - RNA, 19 nt, Homo sapiens
gaugaacacaaacuacuca

SEQ ID NO: 1047728 - RNA, 19 nt, Homo sapiens
ccucgcggcugguuuagau

SEQ ID NO: 1047729 - RNA, 19 nt, Homo sapiens
gaguucagcugauauuuuc

SEQ ID NO: 1047730 - RNA, 19 nt, Homo sapiens
cgcaggaguucagcugaua

SEQ ID NO: 1047731 - RNA, 19 nt, Homo sapiens
cugaaaguucgaaggauua

SEQ ID NO: 1047732 - RNA, 19 nt, Homo sapiens
gaaaacacgaccuggcuuu

SEQ ID NO: 1047733 - RNA, 19 nt, Homo sapiens
guuccucgcggcugguuua

SEQ ID NO: 1047734 - RNA, 19 nt, Homo sapiens
aaagagaugcugccuugga

SEQ ID NO: 1047735 - RNA, 19 nt, Homo sapiens
gaagugaugaacacaaacu

SEQ ID NO: 1047736 - RNA, 19 nt, Homo sapiens
gcugccuuguauauauuua

SEQ ID NO: 1047737 - RNA, 19 nt, Homo sapiens
cgacugaaaccgcugaaag

SEQ ID NO: 1047738 - RNA, 19 nt, Homo sapiens
cuuucuaucugccugagua

SEQ ID NO: 1047739 - RNA, 19 nt, Homo sapiens
gggcuuaaggccugaugaa

SEQ ID NO: 1047740 - RNA, 19 nt, Homo sapiens
ggcgacacauucuccuuuc

SEQ ID NO: 1047741 - RNA, 19 nt, Homo sapiens
ggaagacagccaggaggaa

SEQ ID NO: 1047742 - RNA, 19 nt, Homo sapiens
acugcugccuuguauauau

SEQ ID NO: 1047743 - RNA, 19 nt, Homo sapiens
guuguucuuugagggcuua

SEQ ID NO: 1047744 - RNA, 19 nt, Homo sapiens
cagcugauauuuucuagug

SEQ ID NO: 1047745 - RNA, 19 nt, Homo sapiens
ggaguucagcugauauuuu

SEQ ID NO: 1047746 - RNA, 19 nt, Homo sapiens
ugugacugcugccuuguau

SEQ ID NO: 1047747 - RNA, 19 nt, Homo sapiens
gcguaauagucuucaaugg

SEQ ID NO: 1047748 - RNA, 19 nt, Homo sapiens
ccugaacuguggguagaaa

SEQ ID NO: 1047749 - RNA, 19 nt, Homo sapiens
gacugaaaccgcugaaagu

SEQ ID NO: 1047750 - RNA, 19 nt, Homo sapiens
cugaugcuguuguucuuug

SEQ ID NO: 1047751 - RNA, 19 nt, Homo sapiens
guccugaacuguggguaga

SEQ ID NO: 1047752 - RNA, 19 nt, Homo sapiens
gaaaguucgaaggauuaaa

SEQ ID NO: 1047753 - RNA, 19 nt, Homo sapiens
gaggaagugaugaacacaa

SEQ ID NO: 1047754 - RNA, 19 nt, Homo sapiens
cuuaaggccugaugaacgu

SEQ ID NO: 1047755 - RNA, 19 nt, Homo sapiens
ggaagaagaggaggaugag

SEQ ID NO: 1047756 - RNA, 19 nt, Homo sapiens
caacagcucagggcagcaa

SEQ ID NO: 1047757 - RNA, 19 nt, Homo sapiens
cugcugccuuguauauauu

SEQ ID NO: 1047758 - RNA, 19 nt, Homo sapiens
gauugugguuguuuguuuu

SEQ ID NO: 1047759 - RNA, 19 nt, Homo sapiens
ugguuuagauugugguugu

SEQ ID NO: 1047760 - RNA, 19 nt, Homo sapiens
augaugaaguccaggagaa

SEQ ID NO: 1047761 - RNA, 19 nt, Homo sapiens
gcaggaguucagcugauau

SEQ ID NO: 1047762 - RNA, 19 nt, Homo sapiens
ugaaaguucgaaggauuaa

SEQ ID NO: 1047763 - RNA, 19 nt, Homo sapiens
ggaggaagaagaggaggau

SEQ ID NO: 1047764 - RNA, 19 nt, Homo sapiens
gugaugcugcugcugcuuu

SEQ ID NO: 1047765 - RNA, 19 nt, Homo sapiens
cguaauagucuucaauggu

SEQ ID NO: 1047766 - RNA, 19 nt, Homo sapiens
ugacuccuccaccgcagua

SEQ ID NO: 1047767 - RNA, 19 nt, Homo sapiens
acaaacuacucagaagcaa

SEQ ID NO: 1047768 - RNA, 19 nt, Homo sapiens
caggaguucagcugauauu

SEQ ID NO: 1047769 - RNA, 19 nt, Homo sapiens
cagcuacgaggaagugaug

SEQ ID NO: 1047770 - RNA, 19 nt, Homo sapiens
agucuucaaugguacacuu

SEQ ID NO: 1047771 - RNA, 19 nt, Homo sapiens
gcacgugaugcguaauagu

SEQ ID NO: 1047772 - RNA, 19 nt, Homo sapiens
gcuacgaggaagugaugaa

SEQ ID NO: 1047773 - RNA, 19 nt, Homo sapiens
gccucaagguacuauguuc

SEQ ID NO: 1047774 - RNA, 19 nt, Homo sapiens
aaacacgaccuggcuuugu

SEQ ID NO: 1047775 - RNA, 19 nt, Homo sapiens
cuacuaagacuguuuuguu

SEQ ID NO: 1047776 - RNA, 19 nt, Homo sapiens
cugacaggcagaacucuaa

SEQ ID NO: 1047777 - RNA, 19 nt, Homo sapiens
ccgcaggaguucagcugau

SEQ ID NO: 1047778 - RNA, 19 nt, Homo sapiens
aggaagaagaggaggauga

SEQ ID NO: 1047779 - RNA, 19 nt, Homo sapiens
ugaugcuguuguucuuuga

SEQ ID NO: 1047780 - RNA, 19 nt, Homo sapiens
cuaagacuguuuuguuuca

SEQ ID NO: 1047781 - RNA, 19 nt, Homo sapiens
gcggcauccucaagagcaa

SEQ ID NO: 1047782 - RNA, 19 nt, Homo sapiens
acauucuccuuuccagcua

SEQ ID NO: 1047783 - RNA, 19 nt, Homo sapiens
uggcgacacauucuccuuu

SEQ ID NO: 1047784 - RNA, 19 nt, Homo sapiens
uccugucucucacaccuuu

SEQ ID NO: 1047785 - RNA, 19 nt, Homo sapiens
caaugguacacuuaacuag

SEQ ID NO: 1047786 - RNA, 19 nt, Homo sapiens
gaugcguaauagucuucaa

SEQ ID NO: 1047787 - RNA, 19 nt, Homo sapiens
cacaaacuacucagaagca

SEQ ID NO: 1047788 - RNA, 19 nt, Homo sapiens
aacacaaacuacucagaag

SEQ ID NO: 1047789 - RNA, 19 nt, Homo sapiens
ggacagaacuucauuuaug

SEQ ID NO: 1047790 - RNA, 19 nt, Homo sapiens
ggaauuaugucuuucucuu

SEQ ID NO: 1047791 - RNA, 19 nt, Homo sapiens
ggacuaugguauuguuaaa

SEQ ID NO: 1047792 - RNA, 19 nt, Homo sapiens
gaucugggauuaccauguu

SEQ ID NO: 1047793 - RNA, 19 nt, Homo sapiens
gaggacagaacuucauuua

SEQ ID NO: 1047794 - RNA, 19 nt, Homo sapiens
ugaccgaucucacaugaaa

SEQ ID NO: 1047795 - RNA, 19 nt, Homo sapiens
gauacugucuugccauuuc

SEQ ID NO: 1047796 - RNA, 19 nt, Homo sapiens
gugcguacuugcuaagaua

SEQ ID NO: 1047797 - RNA, 19 nt, Homo sapiens
gacauucacccacaguuua

SEQ ID NO: 1047798 - RNA, 19 nt, Homo sapiens
ccaguauccuuuagaagaa

SEQ ID NO: 1047799 - RNA, 19 nt, Homo sapiens
ccauaucccugcauugaga

SEQ ID NO: 1047800 - RNA, 19 nt, Homo sapiens
gaccugugaucugggauua

SEQ ID NO: 1047801 - RNA, 19 nt, Homo sapiens
guggaacuguggagaaauu

SEQ ID NO: 1047802 - RNA, 19 nt, Homo sapiens
acacaucgguuuggcagua

SEQ ID NO: 1047803 - RNA, 19 nt, Homo sapiens
agaggaagaugauaccuau

SEQ ID NO: 1047804 - RNA, 19 nt, Homo sapiens
gaagcucugugaauacauc

SEQ ID NO: 1047805 - RNA, 19 nt, Homo sapiens
caguauggaucccaaggua

SEQ ID NO: 1047806 - RNA, 19 nt, Homo sapiens
cauaaaaggugcccauaaa

SEQ ID NO: 1047807 - RNA, 19 nt, Homo sapiens
cagcaaacauuaugguaca

SEQ ID NO: 1047808 - RNA, 19 nt, Homo sapiens
ugaccaguauccuuuagaa

SEQ ID NO: 1047809 - RNA, 19 nt, Homo sapiens
caaacauuaugguacaguu

SEQ ID NO: 1047810 - RNA, 19 nt, Homo sapiens
gaaagacuccagugggaau

SEQ ID NO: 1047811 - RNA, 19 nt, Homo sapiens
gaggaaauuuagagugauc

SEQ ID NO: 1047812 - RNA, 19 nt, Homo sapiens
caguuuaggaggaaauuua

SEQ ID NO: 1047813 - RNA, 19 nt, Homo sapiens
uaagucugaugaugacauu

SEQ ID NO: 1047814 - RNA, 19 nt, Homo sapiens
uuuggaagcucugugaaua

SEQ ID NO: 1047815 - RNA, 19 nt, Homo sapiens
gagaggaagaugauaccua

SEQ ID NO: 1047816 - RNA, 19 nt, Homo sapiens
agauagagguguggaggua

SEQ ID NO: 1047817 - RNA, 19 nt, Homo sapiens
acaguuggcuuggaauuau

SEQ ID NO: 1047818 - RNA, 19 nt, Homo sapiens
aggaggaaauuuagaguga

SEQ ID NO: 1047819 - RNA, 19 nt, Homo sapiens
ggcgagaccuggagaugga

SEQ ID NO: 1047820 - RNA, 19 nt, Homo sapiens
aaucucaaaugcccauaaa

SEQ ID NO: 1047821 - RNA, 19 nt, Homo sapiens
gaauuuacacaucgguuug

SEQ ID NO: 1047822 - RNA, 19 nt, Homo sapiens
uuuaugaucucgauacugu

SEQ ID NO: 1047823 - RNA, 19 nt, Homo sapiens
gagcguuaauuggcuuauu

SEQ ID NO: 1047824 - RNA, 19 nt, Homo sapiens
ccauuucccugccucuuug

SEQ ID NO: 1047825 - RNA, 19 nt, Homo sapiens
gaggacagcaaacauuaug

SEQ ID NO: 1047826 - RNA, 19 nt, Homo sapiens
uguagaagaugccuuuaag

SEQ ID NO: 1047827 - RNA, 19 nt, Homo sapiens
ggaaagggguaauauugug

SEQ ID NO: 1047828 - RNA, 19 nt, Homo sapiens
ggcuuggaauuaugucuuu

SEQ ID NO: 1047829 - RNA, 19 nt, Homo sapiens
gaaucucaaaugcccauaa

SEQ ID NO: 1047830 - RNA, 19 nt, Homo sapiens
ugacauucacccacaguuu

SEQ ID NO: 1047831 - RNA, 19 nt, Homo sapiens
gcguuaauuggcuuauuua

SEQ ID NO: 1047832 - RNA, 19 nt, Homo sapiens
ucgaggacagcaaacauua

SEQ ID NO: 1047833 - RNA, 19 nt, Homo sapiens
gaaauucuaggacaugaac

SEQ ID NO: 1047834 - RNA, 19 nt, Homo sapiens
cuacacacuauccgaauuu

SEQ ID NO: 1047835 - RNA, 19 nt, Homo sapiens
ggaggacagaacuucauuu

SEQ ID NO: 1047836 - RNA, 19 nt, Homo sapiens
cgaauuuacacaucgguuu

SEQ ID NO: 1047837 - RNA, 19 nt, Homo sapiens
ugacacuuauguagaagau

SEQ ID NO: 1047838 - RNA, 19 nt, Homo sapiens
guaauauugugagcugaau

SEQ ID NO: 1047839 - RNA, 19 nt, Homo sapiens
gacagcaaacauuauggua

SEQ ID NO: 1047840 - RNA, 19 nt, Homo sapiens
gcauugagacuggagauuc

SEQ ID NO: 1047841 - RNA, 19 nt, Homo sapiens
ggaggaaauuuagagugau

SEQ ID NO: 1047842 - RNA, 19 nt, Homo sapiens
uccuguggcucaugcguua

SEQ ID NO: 1047843 - RNA, 19 nt, Homo sapiens
guacaguuggcuuggaauu

SEQ ID NO: 1047844 - RNA, 19 nt, Homo sapiens
caagcuauccuuucaucga

SEQ ID NO: 1047845 - RNA, 19 nt, Homo sapiens
gaacaagcuauccuuucau

SEQ ID NO: 1047846 - RNA, 19 nt, Homo sapiens
ucugaccgaucucacauga

SEQ ID NO: 1047847 - RNA, 19 nt, Homo sapiens
ccgugcagauucauauuug

SEQ ID NO: 1047848 - RNA, 19 nt, Homo sapiens
aagaugccuuuaagucuga

SEQ ID NO: 1047849 - RNA, 19 nt, Homo sapiens
gaagaauguuaugcugucu

SEQ ID NO: 1047850 - RNA, 19 nt, Homo sapiens
ggacagcaaacauuauggu

SEQ ID NO: 1047851 - RNA, 19 nt, Homo sapiens
uacacacuauccgaauuua

SEQ ID NO: 1047852 - RNA, 19 nt, Homo sapiens
gauccgugcagauucauau

SEQ ID NO: 1047853 - RNA, 19 nt, Homo sapiens
agaauguuaugcugucuuc

SEQ ID NO: 1047854 - RNA, 19 nt, Homo sapiens
uagaagaugccuuuaaguc

SEQ ID NO: 1047855 - RNA, 19 nt, Homo sapiens
agcguuaauuggcuuauuu

SEQ ID NO: 1047856 - RNA, 19 nt, Homo sapiens
ggacuuaagccaguaaucg

SEQ ID NO: 1047857 - RNA, 19 nt, Homo sapiens
guuacaacacgaggacuua

SEQ ID NO: 1047858 - RNA, 19 nt, Homo sapiens
cuuugacacuuauguagaa

SEQ ID NO: 1047859 - RNA, 19 nt, Homo sapiens
gcagcccucucagacuuga

SEQ ID NO: 1047860 - RNA, 19 nt, Homo sapiens
gguaauauugugagcugaa

SEQ ID NO: 1047861 - RNA, 19 nt, Homo sapiens
gcccauugcucugugaauc

SEQ ID NO: 1047862 - RNA, 19 nt, Homo sapiens
gauguggaacuguggagaa

SEQ ID NO: 1047863 - RNA, 19 nt, Homo sapiens
gcucugugaauacaucaaa

SEQ ID NO: 1047864 - RNA, 19 nt, Homo sapiens
ggauuaccauguuguuuug

SEQ ID NO: 1047865 - RNA, 19 nt, Homo sapiens
ucuacacacuauccgaauu

SEQ ID NO: 1047866 - RNA, 19 nt, Homo sapiens
ucgauacugucuugccauu

SEQ ID NO: 1047867 - RNA, 19 nt, Homo sapiens
cagcugcuacugugaagaa

SEQ ID NO: 1047868 - RNA, 19 nt, Homo sapiens
cugcagcccucucagacuu

SEQ ID NO: 1047869 - RNA, 19 nt, Homo sapiens
gccauuucccugccucuuu

SEQ ID NO: 1047870 - RNA, 19 nt, Homo sapiens
cuaaugagaggaagaugau

SEQ ID NO: 1047871 - RNA, 19 nt, Homo sapiens
auaccuaucuggaaacaac

SEQ ID NO: 1047872 - RNA, 19 nt, Homo sapiens
caugaacaagcuauccuuu

SEQ ID NO: 1047873 - RNA, 19 nt, Homo sapiens
aaaaugaaccugaacgauu

SEQ ID NO: 1047874 - RNA, 19 nt, Homo sapiens
gcucugugaaucucaaaug

SEQ ID NO: 1047875 - RNA, 19 nt, Homo sapiens
ccaugaccaguauccuuua

SEQ ID NO: 1047876 - RNA, 19 nt, Homo sapiens
uggaagcucugugaauaca

SEQ ID NO: 1047877 - RNA, 19 nt, Homo sapiens
aacaagcuauccuuucauc

SEQ ID NO: 1047878 - RNA, 19 nt, Homo sapiens
ggaccugugaucugggauu

SEQ ID NO: 1047879 - RNA, 19 nt, Homo sapiens
ugaucucgauacugucuug

SEQ ID NO: 1047880 - RNA, 19 nt, Homo sapiens
aaugugcuguugucuggaa

SEQ ID NO: 1047881 - RNA, 19 nt, Homo sapiens
uacaguuggcuuggaauua

SEQ ID NO: 1047882 - RNA, 19 nt, Homo sapiens
agagugauccgugcagauu

SEQ ID NO: 1047883 - RNA, 19 nt, Homo sapiens
gggauuaccauguuguuuu

SEQ ID NO: 1047884 - RNA, 19 nt, Homo sapiens
gaacgauuucaucaguaug

SEQ ID NO: 1047885 - RNA, 19 nt, Homo sapiens
cgccauaucccugcauuga

SEQ ID NO: 1047886 - RNA, 19 nt, Homo sapiens
uaaaaggugcccauaaaau

SEQ ID NO: 1047887 - RNA, 19 nt, Homo sapiens
aaacauuaugguacaguug

SEQ ID NO: 1047888 - RNA, 19 nt, Homo sapiens
uuauguagaagaugccuuu

SEQ ID NO: 1047889 - RNA, 19 nt, Homo sapiens
gcagauagaugaaagagaa

SEQ ID NO: 1047890 - RNA, 19 nt, Homo sapiens
gaaagaagauuccauuagu

SEQ ID NO: 1047891 - RNA, 19 nt, Homo sapiens
gaacagagcagacaaaucu

SEQ ID NO: 1047892 - RNA, 19 nt, Homo sapiens
gcaccgaggucccgacaaa

SEQ ID NO: 1047893 - RNA, 19 nt, Homo sapiens
cagaaacucuauccaagua

SEQ ID NO: 1047894 - RNA, 19 nt, Homo sapiens
gaaauuggacugaauaaag

SEQ ID NO: 1047895 - RNA, 19 nt, Homo sapiens
gaaagaaggacaaggaguu

SEQ ID NO: 1047896 - RNA, 19 nt, Homo sapiens
gaugacuacuugccugaua

SEQ ID NO: 1047897 - RNA, 19 nt, Homo sapiens
ggaagagcaugcaccagaa

SEQ ID NO: 1047898 - RNA, 19 nt, Homo sapiens
ggaaggaucugagggugaa

SEQ ID NO: 1047899 - RNA, 19 nt, Homo sapiens
aagaagaucuggucagcua

SEQ ID NO: 1047900 - RNA, 19 nt, Homo sapiens
gaaacucuauccaaguaug

SEQ ID NO: 1047901 - RNA, 19 nt, Homo sapiens
ggagaaauuggacugaaua

SEQ ID NO: 1047902 - RNA, 19 nt, Homo sapiens
ugagagagcuggcgaucuu

SEQ ID NO: 1047903 - RNA, 19 nt, Homo sapiens
cugacaagcuucuauguaa

SEQ ID NO: 1047904 - RNA, 19 nt, Homo sapiens
gaacuucgggagaacauuu

SEQ ID NO: 1047905 - RNA, 19 nt, Homo sapiens
gcacugcucuuggaacaug

SEQ ID NO: 1047906 - RNA, 19 nt, Homo sapiens
gauagcaccuaaagcgauu

SEQ ID NO: 1047907 - RNA, 19 nt, Homo sapiens
gagccacccuccuugauga

SEQ ID NO: 1047908 - RNA, 19 nt, Homo sapiens
gagugaagcgugacaagua

SEQ ID NO: 1047909 - RNA, 19 nt, Homo sapiens
gaaacagggucagaaagau

SEQ ID NO: 1047910 - RNA, 19 nt, Homo sapiens
agacaaaucuguucuuggu

SEQ ID NO: 1047911 - RNA, 19 nt, Homo sapiens
guacucagucuucaacuuu

SEQ ID NO: 1047912 - RNA, 19 nt, Homo sapiens
gauaagcagucggcuguga

SEQ ID NO: 1047913 - RNA, 19 nt, Homo sapiens
cuacuucaguguuagaauu

SEQ ID NO: 1047914 - RNA, 19 nt, Homo sapiens
ccagaaagaaucagagaaa

SEQ ID NO: 1047915 - RNA, 19 nt, Homo sapiens
guaaauuccugcuguaaaa

SEQ ID NO: 1047916 - RNA, 19 nt, Homo sapiens
ggaggaggaugacucagau

SEQ ID NO: 1047917 - RNA, 19 nt, Homo sapiens
ggacagcacccaggcagua

SEQ ID NO: 1047918 - RNA, 19 nt, Homo sapiens
ugaagaugaugacuacuug

SEQ ID NO: 1047919 - RNA, 19 nt, Homo sapiens
uaagaaggcaguaauugaa

SEQ ID NO: 1047920 - RNA, 19 nt, Homo sapiens
caaaucagaccgucaacaa

SEQ ID NO: 1047921 - RNA, 19 nt, Homo sapiens
gaacaaagacaagcacaag

SEQ ID NO: 1047922 - RNA, 19 nt, Homo sapiens
ggauaccucuaaacacgaa

SEQ ID NO: 1047923 - RNA, 19 nt, Homo sapiens
gaaagaccuucgguacguu

SEQ ID NO: 1047924 - RNA, 19 nt, Homo sapiens
ggaguugguccucgaguaa

SEQ ID NO: 1047925 - RNA, 19 nt, Homo sapiens
gauggaagcccagugauug

SEQ ID NO: 1047926 - RNA, 19 nt, Homo sapiens
gcagucggcugugaagaug

SEQ ID NO: 1047927 - RNA, 19 nt, Homo sapiens
gcgauacgacgaguucuua

SEQ ID NO: 1047928 - RNA, 19 nt, Homo sapiens
gagagaaucaaagaaauga

SEQ ID NO: 1047929 - RNA, 19 nt, Homo sapiens
gaaggugaaagaccaaaga

SEQ ID NO: 1047930 - RNA, 19 nt, Homo sapiens
ccacagaaacucuauccaa

SEQ ID NO: 1047931 - RNA, 19 nt, Homo sapiens
agaggaagaugaugauauc

SEQ ID NO: 1047932 - RNA, 19 nt, Homo sapiens
cuacuugccugauaaugug

SEQ ID NO: 1047933 - RNA, 19 nt, Homo sapiens
ggacagugacagcgaagaa

SEQ ID NO: 1047934 - RNA, 19 nt, Homo sapiens
aaagaagauuccauuagug

SEQ ID NO: 1047935 - RNA, 19 nt, Homo sapiens
ccagaugggauaccucuaa

SEQ ID NO: 1047936 - RNA, 19 nt, Homo sapiens
ugaagucccucgagaccaa

SEQ ID NO: 1047937 - RNA, 19 nt, Homo sapiens
gaagaggaagaugaugaua

SEQ ID NO: 1047938 - RNA, 19 nt, Homo sapiens
aaaggaagguauaaacgau

SEQ ID NO: 1047939 - RNA, 19 nt, Homo sapiens
caaacgggcugaguugcuu

SEQ ID NO: 1047940 - RNA, 19 nt, Homo sapiens
cuccagagcugccaagaga

SEQ ID NO: 1047941 - RNA, 19 nt, Homo sapiens
gauuucacaccuaaagaua

SEQ ID NO: 1047942 - RNA, 19 nt, Homo sapiens
uaaugucccugacccuuau

SEQ ID NO: 1047943 - RNA, 19 nt, Homo sapiens
guacgcaucuucccauucg

SEQ ID NO: 1047944 - RNA, 19 nt, Homo sapiens
ugaaacagggucagaaaga

SEQ ID NO: 1047945 - RNA, 19 nt, Homo sapiens
acaaagagagaaucaaaga

SEQ ID NO: 1047946 - RNA, 19 nt, Homo sapiens
agacaaagagagaaucaaa

SEQ ID NO: 1047947 - RNA, 19 nt, Homo sapiens
ggagagacgccuauucaag

SEQ ID NO: 1047948 - RNA, 19 nt, Homo sapiens
gagaaauuggacugaauaa

SEQ ID NO: 1047949 - RNA, 19 nt, Homo sapiens
gaaaggucgcagaaauuga

SEQ ID NO: 1047950 - RNA, 19 nt, Homo sapiens
gcccagugauuguucaguu

SEQ ID NO: 1047951 - RNA, 19 nt, Homo sapiens
cuaagaaggcaguaauuga

SEQ ID NO: 1047952 - RNA, 19 nt, Homo sapiens
cagaugggauaccucuaaa

SEQ ID NO: 1047953 - RNA, 19 nt, Homo sapiens
aaagacagaauacgagaaa

SEQ ID NO: 1047954 - RNA, 19 nt, Homo sapiens
ucaauacuguuggcucaaa

SEQ ID NO: 1047955 - RNA, 19 nt, Homo sapiens
ugacucagaucagguugaa

SEQ ID NO: 1047956 - RNA, 19 nt, Homo sapiens
cuucaagccuuucgccaaa

SEQ ID NO: 1047957 - RNA, 19 nt, Homo sapiens
ccaacugaaugccuccaaa

SEQ ID NO: 1047958 - RNA, 19 nt, Homo sapiens
gaaagaaucagagaaagac

SEQ ID NO: 1047959 - RNA, 19 nt, Homo sapiens
uuggguggcuuccagcuua

SEQ ID NO: 1047960 - RNA, 19 nt, Homo sapiens
cccagugauuguucaguua

SEQ ID NO: 1047961 - RNA, 19 nt, Homo sapiens
acucaagcaucaagugaaa

SEQ ID NO: 1047962 - RNA, 19 nt, Homo sapiens
ccagcaacuucaagccuuu

SEQ ID NO: 1047963 - RNA, 19 nt, Homo sapiens
aaaugaagcaggcaacuga

SEQ ID NO: 1047964 - RNA, 19 nt, Homo sapiens
guaugacacuguucugaag

SEQ ID NO: 1047965 - RNA, 19 nt, Homo sapiens
ugauaucuaugccacagaa

SEQ ID NO: 1047966 - RNA, 19 nt, Homo sapiens
cuugaaaggucgcagaaau

SEQ ID NO: 1047967 - RNA, 19 nt, Homo sapiens
uauguaaauuccugcugua

SEQ ID NO: 1047968 - RNA, 19 nt, Homo sapiens
gaugggauaccucuaaaca

SEQ ID NO: 1047969 - RNA, 19 nt, Homo sapiens
gcccaccacucaagcauca

SEQ ID NO: 1047970 - RNA, 19 nt, Homo sapiens
gaagaucuggucagcuaug

SEQ ID NO: 1047971 - RNA, 19 nt, Homo sapiens
gggcacugcucuuggaaca

SEQ ID NO: 1047972 - RNA, 19 nt, Homo sapiens
ugagcaaggugacagugaa

SEQ ID NO: 1047973 - RNA, 19 nt, Homo sapiens
gacaagcuucuauguaaga

SEQ ID NO: 1047974 - RNA, 19 nt, Homo sapiens
ggaagaggaagaugaugau

SEQ ID NO: 1047975 - RNA, 19 nt, Homo sapiens
gggugaagaugaugacuac

SEQ ID NO: 1047976 - RNA, 19 nt, Homo sapiens
ggaucagacugucagagau

SEQ ID NO: 1047977 - RNA, 19 nt, Homo sapiens
ugaaaggucgcagaaauug

SEQ ID NO: 1047978 - RNA, 19 nt, Homo sapiens
gaucagacugucagagaug

SEQ ID NO: 1047979 - RNA, 19 nt, Homo sapiens
gaagcccagugauuguuca

SEQ ID NO: 1047980 - RNA, 19 nt, Homo sapiens
gagcacaggcggaagaaag

SEQ ID NO: 1047981 - RNA, 19 nt, Homo sapiens
gcacaaggccaagaaagag

SEQ ID NO: 1047982 - RNA, 19 nt, Homo sapiens
gcuggagccucuggaagaa

SEQ ID NO: 1047983 - RNA, 19 nt, Homo sapiens
aaauuggacugaauaaagg

SEQ ID NO: 1047984 - RNA, 19 nt, Homo sapiens
gcaccuaaagcgauuguca

SEQ ID NO: 1047985 - RNA, 19 nt, Homo sapiens
caaagagagaaucaaagaa

SEQ ID NO: 1047986 - RNA, 19 nt, Homo sapiens
aguaguagcuccgagaguu

SEQ ID NO: 1047987 - RNA, 19 nt, Homo sapiens
gagcaugcaccagaauuau

SEQ ID NO: 1047988 - RNA, 19 nt, Homo sapiens
ugacaaguacucagucuuc

SEQ ID NO: 1047989 - RNA, 19 nt, Homo sapiens
gcuagcagauucaaagaua

SEQ ID NO: 1047990 - RNA, 19 nt, Homo sapiens
gaauuaauguucacacuuc

SEQ ID NO: 1047991 - RNA, 19 nt, Homo sapiens
caaguuaguugccaagaaa

SEQ ID NO: 1047992 - RNA, 19 nt, Homo sapiens
ucaaagauaugccuaacuu

SEQ ID NO: 1047993 - RNA, 19 nt, Homo sapiens
uaaagcuccugauguuaua

SEQ ID NO: 1047994 - RNA, 19 nt, Homo sapiens
cacaaugucucaucuaaga

SEQ ID NO: 1047995 - RNA, 19 nt, Homo sapiens
caaggaagauuugagcuau

SEQ ID NO: 1047996 - RNA, 19 nt, Homo sapiens
gcacagaugacaaccuauu

SEQ ID NO: 1047997 - RNA, 19 nt, Homo sapiens
ugagagugcugaucugcua

SEQ ID NO: 1047998 - RNA, 19 nt, Homo sapiens
gaccauggguuggagaauu

SEQ ID NO: 1047999 - RNA, 19 nt, Homo sapiens
aagcacagaugacaaccua

SEQ ID NO: 1048000 - RNA, 19 nt, Homo sapiens
gaccuaugauucuuaacaa

SEQ ID NO: 1048001 - RNA, 19 nt, Homo sapiens
ggggaaauauuuugaguuu

SEQ ID NO: 1048002 - RNA, 19 nt, Homo sapiens
ccacgaauguucccaaacu

SEQ ID NO: 1048003 - RNA, 19 nt, Homo sapiens
gcaaacuacugggccaaga

SEQ ID NO: 1048004 - RNA, 19 nt, Homo sapiens
ggaaugagaacgaggaaag

SEQ ID NO: 1048005 - RNA, 19 nt, Homo sapiens
gcaagaggucuaauacugu

SEQ ID NO: 1048006 - RNA, 19 nt, Homo sapiens
ucaaguuaguugccaagaa

SEQ ID NO: 1048007 - RNA, 19 nt, Homo sapiens
caccagcagucuucaaguu

SEQ ID NO: 1048008 - RNA, 19 nt, Homo sapiens
ggaaauauuuugaguuugg

SEQ ID NO: 1048009 - RNA, 19 nt, Homo sapiens
gaugacaaccuauuaaugc

SEQ ID NO: 1048010 - RNA, 19 nt, Homo sapiens
cuccuaacaugaacuaauu

SEQ ID NO: 1048011 - RNA, 19 nt, Homo sapiens
gaauuaagucggaaccaau

SEQ ID NO: 1048012 - RNA, 19 nt, Homo sapiens
accauggguuggagaauua

SEQ ID NO: 1048013 - RNA, 19 nt, Homo sapiens
caagaaagcacagaugaca

SEQ ID NO: 1048014 - RNA, 19 nt, Homo sapiens
gagaauuaauguucacacu

SEQ ID NO: 1048015 - RNA, 19 nt, Homo sapiens
gaaccaauuuuccacaaug

SEQ ID NO: 1048016 - RNA, 19 nt, Homo sapiens
gcacuccuaacaugaacua

SEQ ID NO: 1048017 - RNA, 19 nt, Homo sapiens
aguguuggguggaaucaua

SEQ ID NO: 1048018 - RNA, 19 nt, Homo sapiens
caaugucucaucuaagaaa

SEQ ID NO: 1048019 - RNA, 19 nt, Homo sapiens
uuaaagcuccugauguuau

SEQ ID NO: 1048020 - RNA, 19 nt, Homo sapiens
auuuaaagcuccugauguu

SEQ ID NO: 1048021 - RNA, 19 nt, Homo sapiens
caacagcggcaaacuacug

SEQ ID NO: 1048022 - RNA, 19 nt, Homo sapiens
gccaagaaagcacagauga

SEQ ID NO: 1048023 - RNA, 19 nt, Homo sapiens
gcuagacccagcacauaaa

SEQ ID NO: 1048024 - RNA, 19 nt, Homo sapiens
uccacaaugucucaucuaa

SEQ ID NO: 1048025 - RNA, 19 nt, Homo sapiens
guucacacuucuauuugga

SEQ ID NO: 1048026 - RNA, 19 nt, Homo sapiens
caaugcagaaucagccaua

SEQ ID NO: 1048027 - RNA, 19 nt, Homo sapiens
ccagcagucuucaaguuca

SEQ ID NO: 1048028 - RNA, 19 nt, Homo sapiens
cccaggagaugacgcaaug

SEQ ID NO: 1048029 - RNA, 19 nt, Homo sapiens
cacagaugacaaccuauua

SEQ ID NO: 1048030 - RNA, 19 nt, Homo sapiens
cuugagaagucaucaguuc

SEQ ID NO: 1048031 - RNA, 19 nt, Homo sapiens
gugagcaagaggucuaaua

SEQ ID NO: 1048032 - RNA, 19 nt, Homo sapiens
auagauccaugcacuccua

SEQ ID NO: 1048033 - RNA, 19 nt, Homo sapiens
ggauuuaaagcuccugaug

SEQ ID NO: 1048034 - RNA, 19 nt, Homo sapiens
agaauuaagucggaaccaa

SEQ ID NO: 1048035 - RNA, 19 nt, Homo sapiens
uagcaacagcggcaaacua

SEQ ID NO: 1048036 - RNA, 19 nt, Homo sapiens
acagaugacaaccuauuaa

SEQ ID NO: 1048037 - RNA, 19 nt, Homo sapiens
agcaagaggucuaauacug

SEQ ID NO: 1048038 - RNA, 19 nt, Homo sapiens
gauuuaaagcuccugaugu

SEQ ID NO: 1048039 - RNA, 19 nt, Homo sapiens
cuacgcaagucaaguuagu

SEQ ID NO: 1048040 - RNA, 19 nt, Homo sapiens
ugucugagaucccagucuu

SEQ ID NO: 1048041 - RNA, 19 nt, Homo sapiens
gcaucuauuggaagacuuu

SEQ ID NO: 1048042 - RNA, 19 nt, Homo sapiens
gauaugccuaacuuuauug

SEQ ID NO: 1048043 - RNA, 19 nt, Homo sapiens
acgaauguucccaaacuua

SEQ ID NO: 1048044 - RNA, 19 nt, Homo sapiens
caccacgaauguucccaaa

SEQ ID NO: 1048045 - RNA, 19 nt, Homo sapiens
guuggagaauuaauguuca

SEQ ID NO: 1048046 - RNA, 19 nt, Homo sapiens
uggaucagcucaagaccau

SEQ ID NO: 1048047 - RNA, 19 nt, Homo sapiens
auaccaggaucaaccauca

SEQ ID NO: 1048048 - RNA, 19 nt, Homo sapiens
guacuuugccaccccauua

SEQ ID NO: 1048049 - RNA, 19 nt, Homo sapiens
uuaaugcugugagaauguu

SEQ ID NO: 1048050 - RNA, 19 nt, Homo sapiens
uauuaaugcugugagaaug

SEQ ID NO: 1048051 - RNA, 19 nt, Homo sapiens
cagaugacaaccuauuaau

SEQ ID NO: 1048052 - RNA, 19 nt, Homo sapiens
gguuggagaauuaauguuc

SEQ ID NO: 1048053 - RNA, 19 nt, Homo sapiens
gcagaaucagccauagguu

SEQ ID NO: 1048054 - RNA, 19 nt, Homo sapiens
gauucaaagauaugccuaa

SEQ ID NO: 1048055 - RNA, 19 nt, Homo sapiens
auacugugguugggaauga

SEQ ID NO: 1048056 - RNA, 19 nt, Homo sapiens
ggugugagcaagaggucua

SEQ ID NO: 1048057 - RNA, 19 nt, Homo sapiens
gagcugucaccacgaaugu

SEQ ID NO: 1048058 - RNA, 19 nt, Homo sapiens
ggagcugucaccacgaaug

SEQ ID NO: 1048059 - RNA, 19 nt, Homo sapiens
cuagcagauucaaagauau

SEQ ID NO: 1048060 - RNA, 19 nt, Homo sapiens
gauccaugcacuccuaaca

SEQ ID NO: 1048061 - RNA, 19 nt, Homo sapiens
gauguuauaccaggaucaa

SEQ ID NO: 1048062 - RNA, 19 nt, Homo sapiens
cgaauguucccaaacuuag

SEQ ID NO: 1048063 - RNA, 19 nt, Homo sapiens
caaguucagagacgauuca

SEQ ID NO: 1048064 - RNA, 19 nt, Homo sapiens
ccacugcugugaccuuuug

SEQ ID NO: 1048065 - RNA, 19 nt, Homo sapiens
aaaaggcauuggggaaaua

SEQ ID NO: 1048066 - RNA, 19 nt, Homo sapiens
uuauuggccuugagaaguc

SEQ ID NO: 1048067 - RNA, 19 nt, Homo sapiens
uagcagauucaaagauaug

SEQ ID NO: 1048068 - RNA, 19 nt, Homo sapiens
ugugacagaucuuacaaaa

SEQ ID NO: 1048069 - RNA, 19 nt, Homo sapiens
cacgaauguucccaaacuu

SEQ ID NO: 1048070 - RNA, 19 nt, Homo sapiens
uacgggccauugugucuga

SEQ ID NO: 1048071 - RNA, 19 nt, Homo sapiens
gcucuacgggccauugugu

SEQ ID NO: 1048072 - RNA, 19 nt, Homo sapiens
uggaagacuuucacauggu

SEQ ID NO: 1048073 - RNA, 19 nt, Homo sapiens
gaugagcaaccccacauuu

SEQ ID NO: 1048074 - RNA, 19 nt, Homo sapiens
gcugucaccacgaauguuc

SEQ ID NO: 1048075 - RNA, 19 nt, Homo sapiens
ugucucaucuaagaaagga

SEQ ID NO: 1048076 - RNA, 19 nt, Homo sapiens
cauugcggcuggaucaagu

SEQ ID NO: 1048077 - RNA, 19 nt, Homo sapiens
uaacuuuauuggccuugag

SEQ ID NO: 1048078 - RNA, 19 nt, Homo sapiens
gagcaagaggucuaauacu

SEQ ID NO: 1048079 - RNA, 19 nt, Homo sapiens
aaacuacugggccaagaug

SEQ ID NO: 1048080 - RNA, 19 nt, Homo sapiens
caaacuacugggccaagau

SEQ ID NO: 1048081 - RNA, 19 nt, Homo sapiens
uggguuacaccaggcauua

SEQ ID NO: 1048082 - RNA, 19 nt, Homo sapiens
aagcuacgcaagucaaguu

SEQ ID NO: 1048083 - RNA, 19 nt, Homo sapiens
cuacacaagcuacgcaagu

SEQ ID NO: 1048084 - RNA, 19 nt, Homo sapiens
gaggucuaauacugugguu

SEQ ID NO: 1048085 - RNA, 19 nt, Homo sapiens
cuauuaaugcugugagaau

SEQ ID NO: 1048086 - RNA, 19 nt, Homo sapiens
gagagugcugaucugcuaa

SEQ ID NO: 1048087 - RNA, 19 nt, Homo sapiens
ggaaucauagauccaugca

SEQ ID NO: 1048088 - RNA, 19 nt, Homo sapiens
agaccuaugauucuuaaca

SEQ ID NO: 1048089 - RNA, 19 nt, Homo sapiens
gaagaucagucucaagguu

SEQ ID NO: 1048090 - RNA, 19 nt, Homo sapiens
caccacaucuggcuaauuu

SEQ ID NO: 1048091 - RNA, 19 nt, Homo sapiens
gcagcaggauucagaccua

SEQ ID NO: 1048092 - RNA, 19 nt, Homo sapiens
aggcagauguugucgauuu

SEQ ID NO: 1048093 - RNA, 19 nt, Homo sapiens
ggcagauguugucgauuua

SEQ ID NO: 1048094 - RNA, 19 nt, Homo sapiens
gugauggacuuaagugaug

SEQ ID NO: 1048095 - RNA, 19 nt, Homo sapiens
caaggcagauguugucgau

SEQ ID NO: 1048096 - RNA, 19 nt, Homo sapiens
acaaguagcugggauuaca

SEQ ID NO: 1048097 - RNA, 19 nt, Homo sapiens
cagauguugucgauuuaaa

SEQ ID NO: 1048098 - RNA, 19 nt, Homo sapiens
ccagguggcugcucugagu

SEQ ID NO: 1048099 - RNA, 19 nt, Homo sapiens
gcuguauucucuucucuuc

SEQ ID NO: 1048100 - RNA, 19 nt, Homo sapiens
gaggugggguuucauguuu

SEQ ID NO: 1048101 - RNA, 19 nt, Homo sapiens
ggguuucccuugaagauca

SEQ ID NO: 1048102 - RNA, 19 nt, Homo sapiens
gcaccaccaugcccagcuu

SEQ ID NO: 1048103 - RNA, 19 nt, Homo sapiens
ccagcucccugcaucagaa

SEQ ID NO: 1048104 - RNA, 19 nt, Homo sapiens
ucacaaguagcugggauua

SEQ ID NO: 1048105 - RNA, 19 nt, Homo sapiens
ucugagugcuccaguguug

SEQ ID NO: 1048106 - RNA, 19 nt, Homo sapiens
caccuaacccugacgcuuu

SEQ ID NO: 1048107 - RNA, 19 nt, Homo sapiens
ucacugggaaucuucguuu

SEQ ID NO: 1048108 - RNA, 19 nt, Homo sapiens
gcagauguugucgauuuaa

SEQ ID NO: 1048109 - RNA, 19 nt, Homo sapiens
ccaggcggcuguauucucu

SEQ ID NO: 1048110 - RNA, 19 nt, Homo sapiens
gaaucuucguuugucauga

SEQ ID NO: 1048111 - RNA, 19 nt, Homo sapiens
gagcgcuacugucucuuag

SEQ ID NO: 1048112 - RNA, 19 nt, Homo sapiens
ggaccagcacugucaggaa

SEQ ID NO: 1048113 - RNA, 19 nt, Homo sapiens
ggaagcacaaggcagaugu

SEQ ID NO: 1048114 - RNA, 19 nt, Homo sapiens
ugccucagccucacaagua

SEQ ID NO: 1048115 - RNA, 19 nt, Homo sapiens
ggaaucuucguuugucaug

SEQ ID NO: 1048116 - RNA, 19 nt, Homo sapiens
ggauucagaccuagaugug

SEQ ID NO: 1048117 - RNA, 19 nt, Homo sapiens
ugaggcaggaggaucauuu

SEQ ID NO: 1048118 - RNA, 19 nt, Homo sapiens
uugaguagcugagauuaca

SEQ ID NO: 1048119 - RNA, 19 nt, Homo sapiens
gagaugggguuuugcuaug

SEQ ID NO: 1048120 - RNA, 19 nt, Homo sapiens
gaagcacaaggcagauguu

SEQ ID NO: 1048121 - RNA, 19 nt, Homo sapiens
gugagcagcaggauucaga

SEQ ID NO: 1048122 - RNA, 19 nt, Homo sapiens
uggcuuggcuuccagaaac

SEQ ID NO: 1048123 - RNA, 19 nt, Homo sapiens
gaucauuugagcccaggaa

SEQ ID NO: 1048124 - RNA, 19 nt, Homo sapiens
gucaugagccaguggaaug

SEQ ID NO: 1048125 - RNA, 19 nt, Homo sapiens
gcaggauucagaccuagau

SEQ ID NO: 1048126 - RNA, 19 nt, Homo sapiens
ucugggauccuuucaccua

SEQ ID NO: 1048127 - RNA, 19 nt, Homo sapiens
gaggcaggaggaucauuug

SEQ ID NO: 1048128 - RNA, 19 nt, Homo sapiens
guagcugagauuacaggua

SEQ ID NO: 1048129 - RNA, 19 nt, Homo sapiens
gucccagucucuugaguag

SEQ ID NO: 1048130 - RNA, 19 nt, Homo sapiens
gaagggcucacugggaauc

SEQ ID NO: 1048131 - RNA, 19 nt, Homo sapiens
ugucagagcgcuacugucu

SEQ ID NO: 1048132 - RNA, 19 nt, Homo sapiens
gcucugagugcuccagugu

SEQ ID NO: 1048133 - RNA, 19 nt, Homo sapiens
ccaggccacugcuaauagg

SEQ ID NO: 1048134 - RNA, 19 nt, Homo sapiens
cugggauccuuucaccuaa

SEQ ID NO: 1048135 - RNA, 19 nt, Homo sapiens
cagaguggcuuggcuucca

SEQ ID NO: 1048136 - RNA, 19 nt, Homo sapiens
uuugagcccaggaaacaua

SEQ ID NO: 1048137 - RNA, 19 nt, Homo sapiens
cauuugagcccaggaaaca

SEQ ID NO: 1048138 - RNA, 19 nt, Homo sapiens
ccggugagcagcaggauuc

SEQ ID NO: 1048139 - RNA, 19 nt, Homo sapiens
aaucuucguuugucaugag

SEQ ID NO: 1048140 - RNA, 19 nt, Homo sapiens
ggccugggcuggguuucau

SEQ ID NO: 1048141 - RNA, 19 nt, Homo sapiens
ggagguccuggccaugcua

SEQ ID NO: 1048142 - RNA, 19 nt, Homo sapiens
gccgggaacucugauugca

SEQ ID NO: 1048143 - RNA, 19 nt, Homo sapiens
uucuuugggucacuuauga

SEQ ID NO: 1048144 - RNA, 19 nt, Homo sapiens
caucuuggaguuucugaag

SEQ ID NO: 1048145 - RNA, 19 nt, Homo sapiens
augagccaguggaauguuu

SEQ ID NO: 1048146 - RNA, 19 nt, Homo sapiens
ggagaugggguuuugcuau

SEQ ID NO: 1048147 - RNA, 19 nt, Homo sapiens
gaacagagagaaagaauua

SEQ ID NO: 1048148 - RNA, 19 nt, Homo sapiens
ggaaacagcuggagaagga

SEQ ID NO: 1048149 - RNA, 19 nt, Homo sapiens
gaucaaauguggucagaga

SEQ ID NO: 1048150 - RNA, 19 nt, Homo sapiens
ggauaugacuaugauguua

SEQ ID NO: 1048151 - RNA, 19 nt, Homo sapiens
ggucagagauugcuccaaa

SEQ ID NO: 1048152 - RNA, 19 nt, Homo sapiens
gaacauugcuuuggacaag

SEQ ID NO: 1048153 - RNA, 19 nt, Homo sapiens
ggaaauggauuggcuaaag

SEQ ID NO: 1048154 - RNA, 19 nt, Homo sapiens
gaaauggauuggcuaaagu

SEQ ID NO: 1048155 - RNA, 19 nt, Homo sapiens
ccaaaggguguaugaaaua

SEQ ID NO: 1048156 - RNA, 19 nt, Homo sapiens
ggacagcuguggaaagaag

SEQ ID NO: 1048157 - RNA, 19 nt, Homo sapiens
gaucaagucauuacaguau

SEQ ID NO: 1048158 - RNA, 19 nt, Homo sapiens
gagcagcagugaaagugaa

SEQ ID NO: 1048159 - RNA, 19 nt, Homo sapiens
cauccuaaguuccacuaua

SEQ ID NO: 1048160 - RNA, 19 nt, Homo sapiens
agacaugauucuuguugua

SEQ ID NO: 1048161 - RNA, 19 nt, Homo sapiens
gccaucagaucaagucauu

SEQ ID NO: 1048162 - RNA, 19 nt, Homo sapiens
gagaaagaauuaagaagac

SEQ ID NO: 1048163 - RNA, 19 nt, Homo sapiens
gaagauauccucgguccuu

SEQ ID NO: 1048164 - RNA, 19 nt, Homo sapiens
gauacgagcagcagugaaa

SEQ ID NO: 1048165 - RNA, 19 nt, Homo sapiens
ggaaagaagucgcaaaaca

SEQ ID NO: 1048166 - RNA, 19 nt, Homo sapiens
gcagaagacagcccauauu

SEQ ID NO: 1048167 - RNA, 19 nt, Homo sapiens
ugaagaacauugcuuugga

SEQ ID NO: 1048168 - RNA, 19 nt, Homo sapiens
ggacaagaccgaugacagu

SEQ ID NO: 1048169 - RNA, 19 nt, Homo sapiens
uaacacaggagacaugauu

SEQ ID NO: 1048170 - RNA, 19 nt, Homo sapiens
gaagaaaugaacagagaga

SEQ ID NO: 1048171 - RNA, 19 nt, Homo sapiens
ccucaugccuugccuaugu

SEQ ID NO: 1048172 - RNA, 19 nt, Homo sapiens
gaucugggaccgaaauuug

SEQ ID NO: 1048173 - RNA, 19 nt, Homo sapiens
caaauguggucagagauug

SEQ ID NO: 1048174 - RNA, 19 nt, Homo sapiens
gagccaacauccucaagau

SEQ ID NO: 1048175 - RNA, 19 nt, Homo sapiens
caagaccgaugacaguaau

SEQ ID NO: 1048176 - RNA, 19 nt, Homo sapiens
gaccgaaauuugacuguuc

SEQ ID NO: 1048177 - RNA, 19 nt, Homo sapiens
ggcacucucucuuccuaua

SEQ ID NO: 1048178 - RNA, 19 nt, Homo sapiens
ccaaggugauugacagaga

SEQ ID NO: 1048179 - RNA, 19 nt, Homo sapiens
gaaaugaacagagagaaag

SEQ ID NO: 1048180 - RNA, 19 nt, Homo sapiens
gagcguaggacuuuccaaa

SEQ ID NO: 1048181 - RNA, 19 nt, Homo sapiens
gacauccgacaauuuaaua

SEQ ID NO: 1048182 - RNA, 19 nt, Homo sapiens
ggaggugacgauucauuaa

SEQ ID NO: 1048183 - RNA, 19 nt, Homo sapiens
ggaccgaaauuugacuguu

SEQ ID NO: 1048184 - RNA, 19 nt, Homo sapiens
ggagacaugauucuuguug

SEQ ID NO: 1048185 - RNA, 19 nt, Homo sapiens
gcugaagcauggcacuaaa

SEQ ID NO: 1048186 - RNA, 19 nt, Homo sapiens
ggacauccgacaauuuaau

SEQ ID NO: 1048187 - RNA, 19 nt, Homo sapiens
ugacagagaugguuuugaa

SEQ ID NO: 1048188 - RNA, 19 nt, Homo sapiens
ggaagaggaggaagaggaa

SEQ ID NO: 1048189 - RNA, 19 nt, Homo sapiens
cagaagacagcccauauug

SEQ ID NO: 1048190 - RNA, 19 nt, Homo sapiens
caaggaaacagcuggagaa

SEQ ID NO: 1048191 - RNA, 19 nt, Homo sapiens
gcaaaauuaugugugguua

SEQ ID NO: 1048192 - RNA, 19 nt, Homo sapiens
uggauuggcuaaagucuau

SEQ ID NO: 1048193 - RNA, 19 nt, Homo sapiens
gguuggaacuggaaaugga

SEQ ID NO: 1048194 - RNA, 19 nt, Homo sapiens
aggaagaaaugaacagaga

SEQ ID NO: 1048195 - RNA, 19 nt, Homo sapiens
caaagaaugagccagaaug

SEQ ID NO: 1048196 - RNA, 19 nt, Homo sapiens
caaaggguguaugaaauag

SEQ ID NO: 1048197 - RNA, 19 nt, Homo sapiens
ugggacauccgacaauuua

SEQ ID NO: 1048198 - RNA, 19 nt, Homo sapiens
caggagacaugauucuugu

SEQ ID NO: 1048199 - RNA, 19 nt, Homo sapiens
ugacuuggaagcaauguuu

SEQ ID NO: 1048200 - RNA, 19 nt, Homo sapiens
gaaugagccagaauggaaa

SEQ ID NO: 1048201 - RNA, 19 nt, Homo sapiens
agaaugagccagaauggaa

SEQ ID NO: 1048202 - RNA, 19 nt, Homo sapiens
caaguugaaucugaugaug

SEQ ID NO: 1048203 - RNA, 19 nt, Homo sapiens
gaagucgcauaaaccugaa

SEQ ID NO: 1048204 - RNA, 19 nt, Homo sapiens
cauagucacugguacaucu

SEQ ID NO: 1048205 - RNA, 19 nt, Homo sapiens
gacaggaggauaugacuau

SEQ ID NO: 1048206 - RNA, 19 nt, Homo sapiens
guuaauuggcccuccuuua

SEQ ID NO: 1048207 - RNA, 19 nt, Homo sapiens
gaggugacgauucauuaaa

SEQ ID NO: 1048208 - RNA, 19 nt, Homo sapiens
aaggacagcuguggaaaga

SEQ ID NO: 1048209 - RNA, 19 nt, Homo sapiens
ugaaauagacaucacagau

SEQ ID NO: 1048210 - RNA, 19 nt, Homo sapiens
gaggauaugacuaugaugu

SEQ ID NO: 1048211 - RNA, 19 nt, Homo sapiens
gauuggcuaaagucuauua

SEQ ID NO: 1048212 - RNA, 19 nt, Homo sapiens
cccacuacgugcacauaua

SEQ ID NO: 1048213 - RNA, 19 nt, Homo sapiens
aaaggagaccaguauauug

SEQ ID NO: 1048214 - RNA, 19 nt, Homo sapiens
gagacaugauucuuguugu

SEQ ID NO: 1048215 - RNA, 19 nt, Homo sapiens
gaauggaugcuucuuuuaa

SEQ ID NO: 1048216 - RNA, 19 nt, Homo sapiens
ugaaucugaugaugaggaa

SEQ ID NO: 1048217 - RNA, 19 nt, Homo sapiens
acugguacaucuauucaaa

SEQ ID NO: 1048218 - RNA, 19 nt, Homo sapiens
auccuaaguuccacuauaa

SEQ ID NO: 1048219 - RNA, 19 nt, Homo sapiens
gcaaagaaugagccagaau

SEQ ID NO: 1048220 - RNA, 19 nt, Homo sapiens
ucaagucauuacaguauag

SEQ ID NO: 1048221 - RNA, 19 nt, Homo sapiens
cagaucaagucauuacagu

SEQ ID NO: 1048222 - RNA, 19 nt, Homo sapiens
gccaacauccucaagauca

SEQ ID NO: 1048223 - RNA, 19 nt, Homo sapiens
gauguuaaguuuugggauu

SEQ ID NO: 1048224 - RNA, 19 nt, Homo sapiens
ucaaauguggucagagauu

SEQ ID NO: 1048225 - RNA, 19 nt, Homo sapiens
uggcuaaagucuauuacga

SEQ ID NO: 1048226 - RNA, 19 nt, Homo sapiens
ccaacauccucaagaucaa

SEQ ID NO: 1048227 - RNA, 19 nt, Homo sapiens
ggaaaauccuguucacaag

SEQ ID NO: 1048228 - RNA, 19 nt, Homo sapiens
agaagaagcagaggaagaa

SEQ ID NO: 1048229 - RNA, 19 nt, Homo sapiens
gacaagaccgaugacagua

SEQ ID NO: 1048230 - RNA, 19 nt, Homo sapiens
uccaaaggguguaugaaau

SEQ ID NO: 1048231 - RNA, 19 nt, Homo sapiens
gcucaaaugaugcgacugu

SEQ ID NO: 1048232 - RNA, 19 nt, Homo sapiens
caaggugauugacagagau

SEQ ID NO: 1048233 - RNA, 19 nt, Homo sapiens
gaaggacagcuguggaaag

SEQ ID NO: 1048234 - RNA, 19 nt, Homo sapiens
cagaauggaagcauacaga

SEQ ID NO: 1048235 - RNA, 19 nt, Homo sapiens
gugaggacgugggaaguug

SEQ ID NO: 1048236 - RNA, 19 nt, Homo sapiens
gaauuuaugacuugcucaa

SEQ ID NO: 1048237 - RNA, 19 nt, Homo sapiens
agggagaauuuaugacuug

SEQ ID NO: 1048238 - RNA, 19 nt, Homo sapiens
gaagauauugagccaacau

SEQ ID NO: 1048239 - RNA, 19 nt, Homo sapiens
cagcauauuccaagacuca

SEQ ID NO: 1048240 - RNA, 19 nt, Homo sapiens
ggagaaggacagacuggau

SEQ ID NO: 1048241 - RNA, 19 nt, Homo sapiens
ugguacaucuauucaaaga

SEQ ID NO: 1048242 - RNA, 19 nt, Homo sapiens
agaaaugaacagagagaaa

SEQ ID NO: 1048243 - RNA, 19 nt, Homo sapiens
gaauggaagcauacagauc

SEQ ID NO: 1048244 - RNA, 19 nt, Homo sapiens
ggaagaagaagaggaagag

SEQ ID NO: 1048245 - RNA, 19 nt, Homo sapiens
agaagaagaagcagaggaa

SEQ ID NO: 1048246 - RNA, 19 nt, Homo sapiens
ugaagaagaagaagaagca

SEQ ID NO: 1048247 - RNA, 19 nt, Homo sapiens
gggauaagcuuugucagua

SEQ ID NO: 1048248 - RNA, 19 nt, Homo sapiens
gcaccaaacaggcauuaua

SEQ ID NO: 1048249 - RNA, 19 nt, Homo sapiens
gcacccagcuccugaagca

SEQ ID NO: 1048250 - RNA, 19 nt, Homo sapiens
gagcgugaguucccaguau

SEQ ID NO: 1048251 - RNA, 19 nt, Homo sapiens
gauaagcuuugucaguaga

SEQ ID NO: 1048252 - RNA, 19 nt, Homo sapiens
gccaguaauucucuauauu

SEQ ID NO: 1048253 - RNA, 19 nt, Homo sapiens
gacuuuauguuccaaauuc

SEQ ID NO: 1048254 - RNA, 19 nt, Homo sapiens
gaucaggccagauaaguau
